United States Patent 8,461,315 (MICRORNAS AND USES THEREOF) - sequence listing, part 16

SEQ ID NO: 437432 - RNA, 64 nt, Homo Sapiens
acauguauuuaaaucauugccaacuguuuucucuuuuuuacaguaaaaauuaagaguguguuua

SEQ ID NO: 437433 - RNA, 64 nt, Homo Sapiens
aucucauuugaucucaaaaccaguuugccaaguguuuuuacauccauuaauuuuugcauugcuu

SEQ ID NO: 437434 - RNA, 64 nt, Homo Sapiens
ggggcccgagagaaggaacagcuguggaacaggcuuuuuacaccccaagugcaugggguugcuc

SEQ ID NO: 437435 - RNA, 64 nt, Homo Sapiens
gagcccauaaaugacuuaaaucagcuuuacaucauuuuuacauaucaagugguuucauguuaaa

SEQ ID NO: 437436 - RNA, 64 nt, Homo Sapiens
agaaaugcaguggucacuucccagucaaaugaccuuuuuacaaaguggcaguugugaggaaaag

SEQ ID NO: 437437 - RNA, 64 nt, Homo Sapiens
auuggagucauacuguaaacuguauuguauacuuuuuuuacauacccccauguaugccuauaug

SEQ ID NO: 437438 - RNA, 64 nt, Homo Sapiens
gauuuugauagugccauuuauuguuaaagauuuauuuuuacaaaguaaauucaggguuuuagau

SEQ ID NO: 437439 - RNA, 64 nt, Homo Sapiens
aauuuaaaaagcuagaaaauucauguaguuacuuuuuuuacauauauaaucuguuaaugaauua

SEQ ID NO: 437440 - RNA, 64 nt, Homo Sapiens
guuuaagauagacacuuaagcuaucuuguuggauuuuuuacaguaauuuuagagccaaauuuuu

SEQ ID NO: 437441 - RNA, 64 nt, Homo Sapiens
ccagcauaucgggugaguuugauaaaaauguuuauuuuuacacuucaagacaacuaaaacaaau

SEQ ID NO: 437442 - RNA, 64 nt, Homo Sapiens
caaagaaauagagauaaucaugauuauaccuuuauuuuuacaggaagagaugauguaacuagag

SEQ ID NO: 437443 - RNA, 64 nt, Homo Sapiens
auaaaccaauuuuauaaucuuuaaauuuaucaacuuuuuacauuuguguuauuuucagucaggg

SEQ ID NO: 437444 - RNA, 64 nt, Homo Sapiens
cuggccagaggcauuuuuuauuguuacuuucacuuuuuuacaacuccaacuucuauguuuaucu

SEQ ID NO: 437445 - RNA, 64 nt, Homo Sapiens
uccaacuucuauguuuaucuaauuccaacucacuuuuuuacaacaaguagaucauggcagcaug

SEQ ID NO: 437446 - RNA, 64 nt, Homo Sapiens
ucuuaaccuguugaucuauuuuuuucguuguuguuuuuuacacuuucuccaugauuugggguuu

SEQ ID NO: 437447 - RNA, 64 nt, Homo Sapiens
auauacucuucuuaccaguaauuuuucaucuuaauuuuuacagcauguucuuuuguauuugggu

SEQ ID NO: 437448 - RNA, 64 nt, Homo Sapiens
guaauugcauguacuuaggaacuucauggucuuguuuuuacauguuuugucauuuuuuacauca

SEQ ID NO: 437449 - RNA, 64 nt, Homo Sapiens
aacuucauggucuuguuuuuagugauuuugucauuuuuuacaucuuuucuaguuuuggugacuu

SEQ ID NO: 437450 - RNA, 64 nt, Homo Sapiens
uuagaucucuucaguguuuauugguuaguuuuuuuuuuuacaauuauauaugaugcuauuguuu

SEQ ID NO: 437451 - RNA, 64 nt, Homo Sapiens
auucugaaaagcaaacaugaaaaacugaacacaguuuuuacagauauacaauauggagugacuu

SEQ ID NO: 437452 - RNA, 64 nt, Homo Sapiens
guuguuuuuucuuaauguaagaaaaauuguauuuuuuuuacaaguaucuucaaacugaaucuuu

SEQ ID NO: 437453 - RNA, 64 nt, Homo Sapiens
uuucacuuuacuacagugauauaaaaaccagcaguuuuuacacuaaauuuuuuaaagaaauauu

SEQ ID NO: 437454 - RNA, 64 nt, Homo Sapiens
uuggaacagcuuugguguguguaauaacuacaguuuuuuacaaauaaagagauuucauugcaau

SEQ ID NO: 437455 - RNA, 64 nt, Homo Sapiens
uuagacuuuguacuuacugcauauuuucaaacgguuuuuacagcuguauuccaaaaacgaguuu

SEQ ID NO: 437456 - RNA, 64 nt, Homo Sapiens
guguagaguggccagcaguggucuuugccucugauuuuuacacacuauaaacacagacccccuu

SEQ ID NO: 437457 - RNA, 64 nt, Homo Sapiens
gacuucacugcuccuuuacgauauuccaaauaguuuuuuacauuggaaaaacuaauucuuggga

SEQ ID NO: 437458 - RNA, 64 nt, Homo Sapiens
uguaguuuaaaaauaggaccauguaugagacacuuuuuuacaaaaagugccguauauacauaug

SEQ ID NO: 437459 - RNA, 64 nt, Homo Sapiens
gugcuaaccauggcaagcaaacauuuacauuuguuuuuuacaauaaauuucuuuuaaaauauac

SEQ ID NO: 437460 - RNA, 64 nt, Homo Sapiens
cugauaccuuuuccuucuccuaccauguacugaauuuuuacaucaaauuuuagauuauuuuuau

SEQ ID NO: 437461 - RNA, 64 nt, Homo Sapiens
uagcacuucaacauagcucuugaaagcacuuaauuuuuuacagugaauuaagaaagccucgucg

SEQ ID NO: 437462 - RNA, 64 nt, Homo Sapiens
ucccuaaugaucuugcuaaugaaaggguguugcauuuuuacauuuuucagauguuaaugugaaa

SEQ ID NO: 437463 - RNA, 64 nt, Homo Sapiens
aauucgggaccuccgcuugcaguuuguucagcaguuuuuacaagcuucuuaagagaaacugaag

SEQ ID NO: 437464 - RNA, 64 nt, Homo Sapiens
ugaaaugauaggcaucuaugaauagaauuaaccuuuuuuacaaauguaaguauuuuaaugagua

SEQ ID NO: 437465 - RNA, 64 nt, Homo Sapiens
uuaaauugucuuuauuguguuuuuuaagcccaguuuuuuacauuaaacaggugguuggcugcau

SEQ ID NO: 437466 - RNA, 64 nt, Homo Sapiens
ccuuaaaacaguuuuuaaguuuuuuaccgguuccuuuuuacacuucauauuuuacgcucgaggg

SEQ ID NO: 437467 - RNA, 64 nt, Homo Sapiens
ccuugcaauacugauggugauuauuaaaagcgcuuuuuuacauuaugccuacaccuagguuuau

SEQ ID NO: 437468 - RNA, 64 nt, Homo Sapiens
aaagaccuuuguagauucaacaauuaugauaggauuuuuacagacaccuauuuugggcucaguu

SEQ ID NO: 437469 - RNA, 64 nt, Homo Sapiens
uaugucuguauugaagagaaagccaguuuugaguuuuuuacacuugcacaucauuaucugugcc

SEQ ID NO: 437470 - RNA, 64 nt, Homo Sapiens
ccgcccuuuggcccggccucugcucugucuccuuuuuuuacauaagaaccaauccguguuucac

SEQ ID NO: 437471 - RNA, 64 nt, Homo Sapiens
cugguaagggcaauuagccucgcuuaaguugccuuuuuuacacaccaaaacuuuuuacaugaag

SEQ ID NO: 437472 - RNA, 64 nt, Homo Sapiens
ccucgcuuaaguugccuuuuuuacacaccaaaacuuuuuacaugaagggcugguuucacaugaa

SEQ ID NO: 437473 - RNA, 64 nt, Homo Sapiens
uggguggccuuuuuuuaccgauccccuuuuuuauuuuuuacaaccggaccuccacccccaacuu

SEQ ID NO: 437474 - RNA, 64 nt, Homo Sapiens
uauaauuuuaguggaauuguuauugagaauaaaauuuuuacaaucauaacuggcuuuuuccaag

SEQ ID NO: 437475 - RNA, 64 nt, Homo Sapiens
uuugaggucuucguguucaauucuuuuuuuuuuuuuuuuacaauuuuguuuuucuuuuuuuucu

SEQ ID NO: 437476 - RNA, 64 nt, Homo Sapiens
auuacgaugucauuugggucgaaugagugagaaauuuuuacaaaccacagggagagacaugggc

SEQ ID NO: 437477 - RNA, 64 nt, Homo Sapiens
uuucaagaacggauuuccuggucuaagugggucuuuuuuacauugcauuauauguuucaaccua

SEQ ID NO: 437478 - RNA, 64 nt, Homo Sapiens
uuaggacacugugaggggaaccuuuuuuuuuuuuuuuuuacauugaaaacacuccccccccccc

SEQ ID NO: 437479 - RNA, 64 nt, Homo Sapiens
caaacuuaaauguuggugcgugcuuuuuuuuuuuuuuuuacacugaauacuugcugugugcaau

SEQ ID NO: 437480 - RNA, 64 nt, Homo Sapiens
uuacugaaucuuuaaaacuguguauuugaccuuuuuuuuacaacacuggugacagucauauggu

SEQ ID NO: 437481 - RNA, 64 nt, Homo Sapiens
gaaacuguguucucccugcucgggggcccauguuuuuuuacacgccugccuccuguccccuuau

SEQ ID NO: 437482 - RNA, 64 nt, Homo Sapiens
ccaggucuggaucgauucacuugccgggagagacuuuuuacaacucaucugcagcuccgggugc

SEQ ID NO: 437483 - RNA, 64 nt, Homo Sapiens
auauauauauggagaugcuccuuauuauuauuauuuuuuacaaaaacaaauucauuuaaacaaa

SEQ ID NO: 437484 - RNA, 64 nt, Homo Sapiens
uuguauagaaacaaauucauuauuuuucuuuuuuuuuuuacauugaaugaauuauuauuauuuu

SEQ ID NO: 437485 - RNA, 64 nt, Homo Sapiens
uccaaggaagugcuuugcacacuuucuuugcuccuuuuuacagucuuugucuuugcagcaagca

SEQ ID NO: 437486 - RNA, 64 nt, Homo Sapiens
guuaacuguucuauucugauacuacgcguguuguuuuuuacaacagguauguuuuuguuucaga

SEQ ID NO: 437487 - RNA, 64 nt, Homo Sapiens
caccaaaaaucaaggacaaaaauaaguguguuuguuuuuacaggugugaaagucacagcuugua

SEQ ID NO: 437488 - RNA, 64 nt, Homo Sapiens
gcagguuuguauauaaaaugaaaagcuauacuacuuuuuacaaaagggcaaacugggcugaugu

SEQ ID NO: 437489 - RNA, 64 nt, Homo Sapiens
auguaguauuuugauaucauagaaguacacagaauuuuuacagacgcuuuuauuaauuuuuuga

SEQ ID NO: 437490 - RNA, 64 nt, Homo Sapiens
ucauacuuuaauuucuaggcuauacauuuacauauuuuuacaauuacaaacacauguacuucug

SEQ ID NO: 437491 - RNA, 64 nt, Homo Sapiens
auaaauaaaguguuuuacauuucauauuuaaacauuuuuacaaauuuggguuacaguauuuuua

SEQ ID NO: 437492 - RNA, 64 nt, Homo Sapiens
uuucauuuuuaaaaguaggcugggcucccucuuauuuuuacaagcuaagacuuucuaugugguu

SEQ ID NO: 437493 - RNA, 64 nt, Homo Sapiens
gaaaugacaaugggaaaauuauugucaaggggaguuuuuacauguguggcuuggacuuacguuu

SEQ ID NO: 437494 - RNA, 64 nt, Homo Sapiens
uaagaagaugaaauuacucuggauguuugguauuuuuuuacauuaaaacaaacuaaagcaaaau

SEQ ID NO: 437495 - RNA, 64 nt, Homo Sapiens
aaaaauguaguuacacguuaaaaucugcaaaugguuuuuacaccucugauuuuaacaugaacuu

SEQ ID NO: 437496 - RNA, 64 nt, Homo Sapiens
uguggccagaaugcggugaucaaaacgcuccaucuuuuuacaguggcauaggaagacggcaaaa

SEQ ID NO: 437497 - RNA, 64 nt, Homo Sapiens
cuagguuuaggcccuuguacauuuugcccauaacuuuuuacaaaguacuucuuuuauugcacau

SEQ ID NO: 437498 - RNA, 64 nt, Homo Sapiens
ugucuugcaguuuuugaaaauguuucaagucuaguuuuuacaagcacauuacaguaauugcagg

SEQ ID NO: 437499 - RNA, 64 nt, Homo Sapiens
aaauaucauucgucagggaaauauaguuguaauauuuuuacaggauauuccuagguaaaugaag

SEQ ID NO: 437500 - RNA, 64 nt, Homo Sapiens
agacuucuagaaaaccugagaggaaaaagaauucuuuuuacaggaggcagcagaaaacugucug

SEQ ID NO: 437501 - RNA, 64 nt, Homo Sapiens
acagugaaucuccuaauuuuagcaucuuuuuuuuuuuuuacaaucauucagauugugaauucag

SEQ ID NO: 437502 - RNA, 64 nt, Homo Sapiens; identical to SEQ ID NO: 189516

SEQ ID NO: 437503 - RNA, 64 nt, Homo Sapiens; identical to SEQ ID NO: 189517

SEQ ID NO: 437504 - RNA, 63 nt, Homo Sapiens
guggucuucaagacgacagcucuguaucugccaugugaagagaauuaacaauaaaagugugaa

SEQ ID NO: 437505 - RNA, 63 nt, Homo Sapiens
uaucugccaugugaagagaauuaacaauaaaagugugaagagcgauugugaggaacaagccug

SEQ ID NO: 437506 - RNA, 63 nt, Homo Sapiens
aguauuccagagcugcuauuagaagcugcuuccugugaagaucaaaucuuccugaguaauuaa

SEQ ID NO: 437507 - RNA, 63 nt, Homo Sapiens
uuauaauauaaugguaauucauuuuugauguuuugugaagaauuuaaauuuaaacgaauguuc

SEQ ID NO: 437508 - RNA, 63 nt, Homo Sapiens
aauguaaacccuggcgacagauguaacuccuggugugaagauggccgaugugaagaugaauga

SEQ ID NO: 437509 - RNA, 63 nt, Homo Sapiens
aaugaauguaacuccuggugagagcagcgccgaugugaagauguuucucgguaaccacggcag

SEQ ID NO: 437510 - RNA, 63 nt, Homo Sapiens
guggaguucacaagacuacgcagcugcugaguuugugaagacaguucuucagagagcuuccac

SEQ ID NO: 437511 - RNA, 63 nt, Homo Sapiens
aucuuccuacagagucuaggggucaucuugucaugugaagacccugaagcaguggguucagcu

SEQ ID NO: 437512 - RNA, 63 nt, Homo Sapiens
gccaguguuguuuaagauucucuugcaaacgauugugaagaauuucuaugguauaucccaguc

SEQ ID NO: 437513 - RNA, 63 nt, Homo Sapiens
aggcccuuccuguuuggggauuuucuuuaucuuugugaagaacggccagcaaaaugcuggcag

SEQ ID NO: 437514 - RNA, 63 nt, Homo Sapiens
gagaaaauuuauacuguagagaaacccuggaaaugugaagaacguggcaaaguucuuuaccuc

SEQ ID NO: 437515 - RNA, 63 nt, Homo Sapiens
aagagaauucauaccggagagaaacuguacaaaugugaagaauauggcaaagccugugaaugg

SEQ ID NO: 437516 - RNA, 63 nt, Homo Sapiens
augagaacucauacuggaggaaagucuuacaaaugugaagaauguggcagucuuuaaaucuuc

SEQ ID NO: 437517 - RNA, 63 nt, Homo Sapiens
cugaaauuccguaaguacauagucaaaacacaaugugaagaauuuguuuaaaaacauccugua

SEQ ID NO: 437518 - RNA, 63 nt, Homo Sapiens
aacaaaguuuacuucaacuaaaauguuucuuccugugaagacauaugguaucauuuuaauuua

SEQ ID NO: 437519 - RNA, 63 nt, Homo Sapiens
uucuguacuuugcccucaugaguuccaauguugugugaagacaggcagaugcugcacagugaa

SEQ ID NO: 437520 - RNA, 63 nt, Homo Sapiens
aggccuuguuuuucagcuucaucugcaguucuaugugaagauugauaaaucaguuuuuacuug

SEQ ID NO: 437521 - RNA, 63 nt, Homo Sapiens
auaggaaaauucauacuggagagaaacuacaaaugugaagaauguguuaaagccuuuaacaag

SEQ ID NO: 437522 - RNA, 63 nt, Homo Sapiens
aagauaauuuauacuggagaggaacucuauaguugugaagaauguggcaaagcuuuuaaccaa

SEQ ID NO: 437523 - RNA, 63 nt, Homo Sapiens
acagaaauucauacuggagagaaagccuacaauugugaagaauguggcaaagcuuuuaaccuu

SEQ ID NO: 437524 - RNA, 63 nt, Homo Sapiens
aagaaaauuuacacuagagagaaagccuacaaaugugaagaauguggcaaagccuuuaaccag

SEQ ID NO: 437525 - RNA, 63 nt, Homo Sapiens
aagauaauucauagcggagagaaaccccacaaaugugaagaauguggcagagcuuuuaaccag

SEQ ID NO: 437526 - RNA, 63 nt, Homo Sapiens
aagauaauucacaguggagaaaaacccuacaaaugugaagaauguggcaaagcuuuuaaccag

SEQ ID NO: 437527 - RNA, 63 nt, Homo Sapiens
aagaagauucauacuagagagaaacccuacaaaugugaagaauguggcauaucuuuuaaccag

SEQ ID NO: 437528 - RNA, 63 nt, Homo Sapiens
aagaaaauucaaacuggagagaaacucuacaaaugugaagaauguggcaaagcuuuuaaccaa

SEQ ID NO: 437529 - RNA, 63 nt, Homo Sapiens
guggcaaaacuucuaaccaugaaaccuuacaagugugaagaauaagaaaauucauacuggaga

SEQ ID NO: 437530 - RNA, 63 nt, Homo Sapiens
guggcaaagcuuuuaaccaagaaacccuacaaaugugaagaauaagagaauucauacuggaga

SEQ ID NO: 437531 - RNA, 63 nt, Homo Sapiens
aagaccugcauuuggcaggaagauuaguaaauaugugaagaaaaaagcggcuuucuaauagag

SEQ ID NO: 437532 - RNA, 63 nt, Homo Sapiens
uauucagugaauuuguccaucgaacauaucauuugugaagaauuucuccauccucccaggaac

SEQ ID NO: 437533 - RNA, 63 nt, Homo Sapiens
gaaucuacagaacaaagaacggcaugugaauucugugaagaaugaaguggaggaaguaacuuu

SEQ ID NO: 437534 - RNA, 63 nt, Homo Sapiens
uuuaacaaaacaagaaagaaacguacuuaacugugugaagaaauggaaucagcuuuuaauaaa

SEQ ID NO: 437535 - RNA, 63 nt, Homo Sapiens
gaacaccaacuuaagaauuugggggauuaaagaugugaagaccacagucuuggguuuucauau

SEQ ID NO: 437536 - RNA, 63 nt, Homo Sapiens
uuuuugagacagaguuucgaucuauuuuaaguaugugaagaaaaucuacuuguaaaaggcuca

SEQ ID NO: 437537 - RNA, 63 nt, Homo Sapiens
aaugacacuaaacuccaugauauuuaaggauagugugaagaucuuuggcaugauuuaaagguu

SEQ ID NO: 437538 - RNA, 63 nt, Homo Sapiens
ugaagaucuuuggcaugauuuaaagguugaguaugugaagauauaaguaagugaacuaccaug

SEQ ID NO: 437539 - RNA, 63 nt, Homo Sapiens
aacaaauuaucuaaaaaaaaucuauccuguacaugugaagaucuaggcucgccuccauguuac

SEQ ID NO: 437540 - RNA, 63 nt, Homo Sapiens
agaaucaagcugguguggggcuuuuauugauagugugaagauuguacacuauauuacaugauc

SEQ ID NO: 437541 - RNA, 63 nt, Homo Sapiens
guacacuacauuacaugauccuuuuauugacagugugaagauuagaaucaagcuggcaugggg

SEQ ID NO: 437542 - RNA, 63 nt, Homo Sapiens
uaggccugccuccauguuacucuauccuguacgugugaagaucacagauuaucugaaaaaaaa

SEQ ID NO: 437543 - RNA, 63 nt, Homo Sapiens
gcaaugggcagagaccuaccucaacucuaaaagugugaagaauaguagcucuacagccuggcc

SEQ ID NO: 437544 - RNA, 63 nt, Homo Sapiens
guaauuugcugcuaauagaggacacguggugauugugaagauguucccuuuacugaauaagau

SEQ ID NO: 437545 - RNA, 63 nt, Homo Sapiens
ggcaugguggcuuauggaaaagaggugagccuuugugaagaacauaauggaaaagugcaugua

SEQ ID NO: 437546 - RNA, 63 nt, Homo Sapiens
ccaaucuccauuacauagggacuguacagagccugugaagauguaugaaugguaucuuuuaua

SEQ ID NO: 437547 - RNA, 63 nt, Homo Sapiens
uugcugcccucuuaagagcugagcccucugacuugugaagaauuugucuuuuuguggguucaa

SEQ ID NO: 437548 - RNA, 63 nt, Homo Sapiens
cacugcuuuaaggaagcaggggucauuuggagaugugaagauaggaauuucacuuaaaaggaa

SEQ ID NO: 437549 - RNA, 63 nt, Homo Sapiens
uuucuuuaaagaacugcucaauauucaaucuguugugaagaaccugauuugcacucuguagug

SEQ ID NO: 437550 - RNA, 63 nt, Homo Sapiens
ggcaugaaaggaagaggaaugaggauugagacaugugaagacauugugcauuauaucaaugug

SEQ ID NO: 437551 - RNA, 63 nt, Homo Sapiens
accacuucuuuuuauggccaugaacuucauaaaugugaagauuauauauauauauauauaacu

SEQ ID NO: 437552 - RNA, 63 nt, Homo Sapiens
acuaccaacaucgcuuuuguaagggaauguguaugugaagagcacuuucaaaacuacauuuua

SEQ ID NO: 437553 - RNA, 63 nt, Homo Sapiens
gugagccacacgccacagucagcgucugcugcuugugaagaaauagccuaccagguacaggau

SEQ ID NO: 437554 - RNA, 63 nt, Homo Sapiens
uacaccuuuaagaauguuucugaaguuacguuuugugaagagcaaagcacuuggaaucuccgu

SEQ ID NO: 437555 - RNA, 63 nt, Homo Sapiens
guaauauugacggugauaugaaaacuuuuguuaugugaagauauuuaagucagaaaauuguua

SEQ ID NO: 437556 - RNA, 63 nt, Homo Sapiens
ucaauaacuucauuugcgaagaacgauuuccaaugugaagacguugauuuaugcugggcagug

SEQ ID NO: 437557 - RNA, 63 nt, Homo Sapiens
agucuucacaucuuguuuucugcaaagcuuuucugugaagacagagaaagaaauuuuugagga

SEQ ID NO: 437558 - RNA, 63 nt, Homo Sapiens
gauccagacacagaagaacauuauuucugucauugugaagacggcuucuuguuguugcuucug

SEQ ID NO: 437559 - RNA, 63 nt, Homo Sapiens
aagauaauuaaugcuggagagaaacccuacaaaugugaagaauguggcaaagauuucuauuga

SEQ ID NO: 437560 - RNA, 63 nt, Homo Sapiens
aagauaauucauauuggagagaaauucuacagaugugaagaauguggcaaaggcuuuaauuag

SEQ ID NO: 437561 - RNA, 63 nt, Homo Sapiens
aaaauaauucauaaaggagauaaauuauacaaaugugaagaauguggcaaagcuuuuaacaaa

SEQ ID NO: 437562 - RNA, 63 nt, Homo Sapiens
aagauaacucauacuggagaaaaaucuuacaaaugugaagaauguggcaaagccuuuauccag

SEQ ID NO: 437563 - RNA, 63 nt, Homo Sapiens
aacauaauuaaugauggagagaaaccauacaacugugaagaauguggcaaagcuuuuaaccag

SEQ ID NO: 437564 - RNA, 63 nt, Homo Sapiens
aaaauaauucauacaggagagaaacccuacaaaugugaagaaugugacaaagccuuuaaccag

SEQ ID NO: 437565 - RNA, 63 nt, Homo Sapiens
aacauaauucauaauggagaaaaacccuacaaaugugaagaaugugucaaagcuuuuaacugu

SEQ ID NO: 437566 - RNA, 63 nt, Homo Sapiens
auaagggaauucauaauagagaaacccuacaaaugugaagaacguggccuggcuuuuaacaaa

SEQ ID NO: 437567 - RNA, 63 nt, Homo Sapiens
acacauaauuuauacuggacagaaauccuaaagugugaagaaugucacaaagcccuuaauaag

SEQ ID NO: 437568 - RNA, 63 nt, Homo Sapiens
gugauaaaguuuuaaauggugaaauccuagaaaugugaagaauaacauaaaucauaguguuga

SEQ ID NO: 437569 - RNA, 63 nt, Homo Sapiens
auggcaaagccuuuaauaaagaacuccugugacugugaagaauaaaaaaauucauacuggagg

SEQ ID NO: 437570 - RNA, 63 nt, Homo Sapiens
gugacaaagccuuuaaaugggaaauccuagaaaugugaagaauaaaagaaaucauaugaauga

SEQ ID NO: 437571 - RNA, 63 nt, Homo Sapiens
gugggaaagccucuaacagagaaaccaugcaugugugaagaauaagacaacucauacuggaga

SEQ ID NO: 437572 - RNA, 63 nt, Homo Sapiens
guggcaagccuuuuagcugugaaacccuacaaaugugaagaauaagggaauuuauacaggagg

SEQ ID NO: 437573 - RNA, 53 nt, Homo Sapiens
gugguaaauccuucagcugaaaaugugaagaauauacuggagagaaucccuaa

SEQ ID NO: 437574 - RNA, 63 nt, Homo Sapiens
augaguuuuagccagucucaagaggcagaguucugugaagaggaacagugugguuugggaaag

SEQ ID NO: 437575 - RNA, 63 nt, Homo Sapiens
aaauggaaaaaaacauaaaaagcagaauuuuaaugugaagacauuuuuugcuauaaucauuag

SEQ ID NO: 437576 - RNA, 63 nt, Homo Sapiens
ucauggacacugaucacuucucuaaacacaaauugugaagauuugccugucuuuaccgcaauc

SEQ ID NO: 437577 - RNA, 63 nt, Homo Sapiens
ucauggacauuuauuaguucgaagaacguggauugugaagauugacuggcugaagccauggca

SEQ ID NO: 437578 - RNA, 63 nt, Homo Sapiens
guauggcuuuuguguaguuagggguuuuuuaagugugaagaaagguaugugggcuuuaaaagu

SEQ ID NO: 437579 - RNA, 63 nt, Homo Sapiens
gccgucuugaagcaggguacacacguuagguauugugaagaacaucaauccgaacuuuucuuc

SEQ ID NO: 437580 - RNA, 63 nt, Homo Sapiens
auaagaugguguguauguaagaaauuuguaaaaugugaagagcuaucuacacuaaguucguaa

SEQ ID NO: 437581 - RNA, 63 nt, Homo Sapiens
ggggacuaugagaucaaaauauuuuuauuauaaugugaagacauugucuuuucacucuaucuc

SEQ ID NO: 437582 - RNA, 63 nt, Homo Sapiens
aauguugucucuuaacuuggagagccaugacucugugaagaugaaaacggugguucagcuugu

SEQ ID NO: 437583 - RNA, 63 nt, Homo Sapiens
aagaaauauagcuuauuuuauuuuauaauuuuaugugaagaggggucauucugaauaucagcc

SEQ ID NO: 437584 - RNA, 64 nt, Homo Sapiens
uauggugacuuuagcuacagcauuuccuauacccagagcuaaacacuggaauaauacugacauc

SEQ ID NO: 437585 - RNA, 64 nt, Homo Sapiens
ugcuuauuguaacugacaacuguuuucaacuccaagagcuaaacuauuggcaguucauguuaag

SEQ ID NO: 437586 - RNA, 64 nt, Homo Sapiens
guacucucuucucugcguaccaaugagaaauauuagagcuaaccaaggcacauaccaccaaguu

SEQ ID NO: 437587 - RNA, 64 nt, Homo Sapiens
gaauugggcauuaguauuucgcuuuuggcaggauagagcuaagaauagaaaacaguggguacuu

SEQ ID NO: 437588 - RNA, 64 nt, Homo Sapiens
acuggccagugugggguuagagauauuuuacugaagagcuaaaaaccuggcuuuccuuuuuaaa

SEQ ID NO: 437589 - RNA, 64 nt, Homo Sapiens
aagucuaacccaggaaagcuuuugccuauuccaaagagcuaaaaaaacaaaagucucuauauuc

SEQ ID NO: 437590 - RNA, 64 nt, Homo Sapiens
ccaauaucuguuucuugguggacuuuuauacuauauugcagaaacuaagacuggauugauugug

SEQ ID NO: 437591 - RNA, 64 nt, Homo Sapiens
gguggucagaugaccaguguaauaccuucuuagcauugcagaaaggacugcuguuuggucaaag

SEQ ID NO: 437592 - RNA, 64 nt, Homo Sapiens
gauuuacagaccaaggugugguggaggagguagaauugcagaucagauaaaaagugagcuuaca

SEQ ID NO: 437593 - RNA, 64 nt, Homo Sapiens
ucuguggcccauugucauuguuuccucaugaaacauugcagaguuugaauccucaguaacucuc

SEQ ID NO: 437594 - RNA, 64 nt, Homo Sapiens
uauuuucauugcaaacuuuaaggcauaaaucuuuauugcagauuaaaaaaaaagaaaagaaaaa

SEQ ID NO: 437595 - RNA, 64 nt, Homo Sapiens
guagaaugguacugauuugccaguauaaugcagaauugcagaguauauuacugaacucaguguc

SEQ ID NO: 437596 - RNA, 64 nt, Homo Sapiens
acaguguguugccuuacccacucugacugucuuuauugcagaagcauacacacacacacacaca

SEQ ID NO: 437597 - RNA, 64 nt, Homo Sapiens
acaguguguugccuuaccagcacacacagucuuuauugcagaagcacacacacacacacacaca

SEQ ID NO: 437598 - RNA, 64 nt, Homo Sapiens
acaguguguugccuuauaggcacacagagucuuuauugcagaagcacauacacacacauacaca

SEQ ID NO: 437599 - RNA, 64 nt, Homo Sapiens
uauuuauuuaaacuaauguucucuuaauuugaccauugcagauuugggugacuuuuuuuuaacc

SEQ ID NO: 437600 - RNA, 64 nt, Homo Sapiens
cuagccccacucccccauguguauacacaaggaaauugcagaccaauuaguugucuuggccuga

SEQ ID NO: 437601 - RNA, 64 nt, Homo Sapiens
cgcaucaaucuguguucagguccaggguuacauaauugcagaagcacaagccauacaucgcagg

SEQ ID NO: 437602 - RNA, 64 nt, Homo Sapiens
acaguauauuuuguaaauauaaguacuaguccuaauugcagaaagagcgucaguuucaccuccc

SEQ ID NO: 437603 - RNA, 64 nt, Homo Sapiens
ucauggauuaggaguaaagaucuggcugguuugagucucucaaagccagaucccugagagucuu

SEQ ID NO: 437604 - RNA, 64 nt, Homo Sapiens
acaccuucugggccucauuaucccacaccaccaugucucucaccaccccaaacacaacucaacu

SEQ ID NO: 437605 - RNA, 64 nt, Homo Sapiens
gguagccuaagcugauuuucugcugguuacacgugucucucacaccacauuuccucaaagcuaa

SEQ ID NO: 437606 - RNA, 64 nt, Homo Sapiens
agaauguaucuggcuucauauuuucaagucacaugucucucagaccccuggauucagaacccaa

SEQ ID NO: 437607 - RNA, 64 nt, Homo Sapiens
uucaggcaaggacaagccagcuucagagaauagugaggagaagcugaucaguaaguuugacaag

SEQ ID NO: 437608 - RNA, 64 nt, Homo Sapiens
cuguaguuuuuaaaaauguuuuuaguuaaacguugaggagaaaaaaaaaaaaggcuuuuccccc

SEQ ID NO: 437609 - RNA, 64 nt, Homo Sapiens
caggcuaagucaggaacaucggaugccagggagggaggagaaagccgaagcgaaaggggucagg

SEQ ID NO: 437610 - RNA, 64 nt, Homo Sapiens
aagggaauuuuagugacaccuuaugccauuucaagaggagaaaugcaggcuggcagagcaauuu

SEQ ID NO: 437611 - RNA, 64 nt, Homo Sapiens
agcugcugccuugccuuccggccuguccaguucggaggagaacugacaacagaagccccaugcc

SEQ ID NO: 437612 - RNA, 64 nt, Homo Sapiens
ugagcacgugugacauugccugaaccgaggggaggaggagaagcgugcgaguuccuccugcaua

SEQ ID NO: 437613 - RNA, 64 nt, Homo Sapiens
agcuggguuuugggucuaaucaugucaucuaagagaggagaaauuggaugcuguuuuuauuggg

SEQ ID NO: 437614 - RNA, 64 nt, Homo Sapiens
caauuguuuuuaaaucacacgauuuuggugggaggaggagaaaaugaaacuuaucucaaaugga

SEQ ID NO: 437615 - RNA, 64 nt, Homo Sapiens
uuuaaaccagcaggauacaaguugcaaaugaaaugaggagaaacaguuucaacucugaaaguga

SEQ ID NO: 437616 - RNA, 64 nt, Homo Sapiens
cagcaagcauuuaucagaaauagaaucacaauaggaggagaauuugacugucugauauuaugau

SEQ ID NO: 437617 - RNA, 64 nt, Homo Sapiens
aaaggaguauuaucaguaaucaugcaaacgucaugaggagaauuaaccuugcuuggaaacccca

SEQ ID NO: 437618 - RNA, 64 nt, Homo Sapiens
auaaccuaccauccgcaagcgcuuugaauuauaggaggagaacacagucaacugaccaaacacu

SEQ ID NO: 437619 - RNA, 64 nt, Homo Sapiens
gcgcaggcagggagaagggccgggggggguaggagaggagaaaaaaaaagugaaaaaaagaaac

SEQ ID NO: 437620 - RNA, 64 nt, Homo Sapiens
uguccacccuccggcccccgucuuguaaaaaggggaggagaauuagccaaacacuguaagcuuu

SEQ ID NO: 437621 - RNA, 64 nt, Homo Sapiens
gaaacucaagucucaccauuaggaggagaagagugaggagaaagccggcacagcagcucccuca

SEQ ID NO: 437622 - RNA, 64 nt, Homo Sapiens
gugaggagaaaggaaacucagcagcucccucaaggaggagaagagggcaggucuguccggcaca

SEQ ID NO: 437623 - RNA, 64 nt, Homo Sapiens
gggaaucucccaaaauuuaauaugcuuccagguggaggagaaagaaucaaggccccagagugug

SEQ ID NO: 437624 - RNA, 64 nt, Homo Sapiens
augaagagaaaaccuguuugcugcccacaggcaggaggagaagcacaccauucuggaaguuugg

SEQ ID NO: 437625 - RNA, 63 nt, Homo Sapiens
aggacuuccugggcccauaggugaagccuucuggaggagaaggugacguggcccagcguccaa

SEQ ID NO: 437626 - RNA, 64 nt, Homo Sapiens
gacucagcuccaggcugcuuggcagcccagccuggaggagaaggcuaaugacggaggggccccu

SEQ ID NO: 437627 - RNA, 64 nt, Homo Sapiens
gggccccaccggggucuaaucuugggcuccugaugaggagaaagggaugaaagaggagccaggc

SEQ ID NO: 437628 - RNA, 64 nt, Homo Sapiens
ggaaguauguuuuggggggcuucuguuucugugggaggagaaggagaauucugaacuuuaucug

SEQ ID NO: 437629 - RNA, 64 nt, Homo Sapiens
aguuauuuauuaccguucccgauaccagaggugggaggagaaaacauagguuugaacaguggga

SEQ ID NO: 437630 - RNA, 64 nt, Homo Sapiens
ugaagaggcaugaagaaguagagucccagaaggagaggagaaaaguguaauauauguuuaacug

SEQ ID NO: 437631 - RNA, 64 nt, Homo Sapiens
ggcggcaccagcaccuucgcuuugcaucucgguagaggagaaacggcagcacagcccaaggacc

SEQ ID NO: 437632 - RNA, 64 nt, Homo Sapiens
ucaugccucgagcuuggcaaccgaaaacccgagggaggagaagggaccugccuugugacaucuc

SEQ ID NO: 437633 - RNA, 64 nt, Homo Sapiens
ucucaugcugcccuugggugggcaucuguuaacagaggagaacgucuggguggcggcagcagcu

SEQ ID NO: 437634 - RNA, 64 nt, Homo Sapiens
aaccugccucugaccuggcuugcaaugcauaggugaggagaagcagagagcuugucauaugcaa

SEQ ID NO: 437635 - RNA, 64 nt, Homo Sapiens
agaccucccuucagccugagccaagcugcauugggaggagaaggcagggugagggaucugggag

SEQ ID NO: 437636 - RNA, 64 nt, Homo Sapiens
guagccacuugguucuuagggggccccaagaggagaggagaagugcugagguugauguuacgac

SEQ ID NO: 437637 - RNA, 64 nt, Homo Sapiens
ccagagaaagaugaagaggaccaaauuacucauagaggagaaaacucaagcuggacuguggguu

SEQ ID NO: 437638 - RNA, 64 nt, Homo Sapiens
auugguguaaucugcuuuccaggcuuggacuagagaggagaaaggcuucaggguaggugggcac

SEQ ID NO: 437639 - RNA, 64 nt, Homo Sapiens
caaacugaugggcucuuugcgccgugcagggugggaggagaagaccaaacgaaguaacgucugu

SEQ ID NO: 437640 - RNA, 64 nt, Homo Sapiens
acagaaaaugaugcaauguaugaaaaacugcuuugaggagaaaaacaacacaguguguuuuugg

SEQ ID NO: 437641 - RNA, 64 nt, Homo Sapiens
aaugaguuacaaugucagguguguuuagauucuggaggagaaaacuggggagaagacaaaauug

SEQ ID NO: 437642 - RNA, 64 nt, Homo Sapiens
accucacugcaguuucaacauuccagauagagcagaggagaaacaauucuaaauuaccauuuac

SEQ ID NO: 437643 - RNA, 64 nt, Homo Sapiens
uccagcuauguaucgggaaccaugaucuauuuaugaggagaaggaaagccgauucuuuggaagu

SEQ ID NO: 437644 - RNA, 64 nt, Homo Sapiens
uuuggaaguucagcagaugaaagcccaggccagggaggagaaggcuagaaagcaggugagcaca

SEQ ID NO: 437645 - RNA, 64 nt, Homo Sapiens
gcagcgcaucaaggccacagcgauucgcacggaggaggagaagcgccugauggagcagaaggug

SEQ ID NO: 437646 - RNA, 64 nt, Homo Sapiens
gcagaaucuuaaaugguaccauuggugucacugggaggagaaauugggguguguuacuguuuac

SEQ ID NO: 437647 - RNA, 64 nt, Homo Sapiens
guuuccagaugcuacuaucauucacgauggccaugaggagaagauggaaaauggucagaucaca

SEQ ID NO: 437648 - RNA, 64 nt, Homo Sapiens
ggaggaaaaggaggaagaggaggacaaaaagggggaggagaagguucuucguccaaaggaggaa

SEQ ID NO: 437649 - RNA, 64 nt, Homo Sapiens
uaauuggagcauuugcacugagaccccugccagagaggagaaaacccuuucaagggaaauuuua

SEQ ID NO: 437650 - RNA, 64 nt, Homo Sapiens
agagguuggccucuggcucuucaugugcugcugcuucaucuagccuuaucagauagaaauggag

SEQ ID NO: 437651 - RNA, 64 nt, Homo Sapiens
uagaaauuguuuuauuuuuaacaucgugauuauauucaucuacuuaugcuuuauagcuguauaa

SEQ ID NO: 437652 - RNA, 64 nt, Homo Sapiens
aucucugccucauuucuggaacagguugaaacauuucaucuauuuuuuuuuuuuuuuuuuuaac

SEQ ID NO: 437653 - RNA, 59 nt, Homo Sapiens
gacucucaugucaauguggaaaaacaagcuucaucuaaaagaagaaaggagcaaguuag

SEQ ID NO: 437654 - RNA, 64 nt, Homo Sapiens
aucacuugaacucaggagauuacacaggaggcugaggcacgagacaggagccuguaaucccagc

SEQ ID NO: 437655 - RNA, 64 nt, Homo Sapiens
cuugcuuaauaccugggagguacuugggaggcugaggcacgagacucaugccuauaauccuagc

SEQ ID NO: 437656 - RNA, 64 nt, Homo Sapiens
uuuauucacugauagagaaugcucaugugcugcccgcccccauaacagccgccuaaggcccgcg

SEQ ID NO: 437657 - RNA, 64 nt, Homo Sapiens
gcgucugcccaggaacagcagucuccuccuccugcgcccccacuccuugggcgcacucuucagc

SEQ ID NO: 437658 - RNA, 64 nt, Homo Sapiens
gguccgugugagcaggcccaccuggcuccagacccgcccccaaccugagacagaaccaggcuga

SEQ ID NO: 437659 - RNA, 64 nt, Homo Sapiens
acccccacccccguuugcugggggcuccuccagccgcccccaugggaagaggccugguaccgcc

SEQ ID NO: 437660 - RNA, 64 nt, Homo Sapiens
ugcagguaccucccuuggucgaauggacagcaggcgcccccagagccccugccacagggcacug

SEQ ID NO: 437661 - RNA, 64 nt, Homo Sapiens
gagcuggggacacccccaugagcgccggagcggacgcccccaggaggaccagggcgagcccugg

SEQ ID NO: 437662 - RNA, 64 nt, Homo Sapiens
acugcacgagugucugugaggcgcugcgcggacucgcccccaggaacgcucuccucgagcccuc

SEQ ID NO: 437663 - RNA, 64 nt, Homo Sapiens
guauuuccuuccacuguagcuauuagcggcuccucgcccccaccaguguagcaucuuccucugc

SEQ ID NO: 437664 - RNA, 64 nt, Homo Sapiens
gacccuggggccagcggggcccccuguaaggucccgcccccaaaucccugccggggccugcugg

SEQ ID NO: 437665 - RNA, 64 nt, Homo Sapiens
auugaacguggggagccccacccagcucuggcagcgcccccaggccccaggugggccuuguacc

SEQ ID NO: 437666 - RNA, 64 nt, Homo Sapiens
uggguccuguggaggccagcagcgguguggcccccgcccccaggcugccugugucuucaccugu

SEQ ID NO: 437667 - RNA, 64 nt, Homo Sapiens
agggcaggggaagcggagaccagggugcaggcuccgcccccacccaaggccgggcccagccaga

SEQ ID NO: 437668 - RNA, 64 nt, Homo Sapiens
gagaggcagccccggccugaccggccccccgccccgcccccaccccgcccccaggccuaaaugu

SEQ ID NO: 437669 - RNA, 64 nt, Homo Sapiens
ccggccugaccggccccccgccccgcccccaccccgcccccaggccuaaaugugcacagcaugc

SEQ ID NO: 437670 - RNA, 64 nt, Homo Sapiens
cacgagggaggggagucgggccccaggucgcccccgcccccagcccugcaugcaggugcccucg

SEQ ID NO: 437671 - RNA, 64 nt, Homo Sapiens
gguaguuuccuccccccuuucccggcgccccucccgcccccauucaacaucucucauccuaucc

SEQ ID NO: 437672 - RNA, 64 nt, Homo Sapiens
ggcgcgccccugcggcucccgaggguccaggccccgcccccaaaggaccaggacucgccccaaa

SEQ ID NO: 437673 - RNA, 64 nt, Homo Sapiens
ccagggucgacccugcccccuugggcucaggccccgcccccaggauccuacggauugagguccu

SEQ ID NO: 437674 - RNA, 64 nt, Homo Sapiens
ccagcugggacgguacagagaccuggugccuugacgcccccaccuguccccccaaccuaaccag

SEQ ID NO: 437675 - RNA, 64 nt, Homo Sapiens
gcccagguguccccccaaccguccagugcaaagccgcccccagauggggcuggacaucacugca

SEQ ID NO: 437676 - RNA, 64 nt, Homo Sapiens
gcugccugucucuuagaugcacuuucuuuuuccaccagcacauccuucaacacacagaauuuca

SEQ ID NO: 437677 - RNA, 64 nt, Homo Sapiens
aacagaagggccuguaggcccuggugaacugaauccagcacaggccuccccuguaacacaacag

SEQ ID NO: 437678 - RNA, 64 nt, Homo Sapiens
uccaggauuagcucccaagugcgcugagacccagccagcacacuucuggcccuucucccugccu

SEQ ID NO: 437679 - RNA, 64 nt, Homo Sapiens
uccugccucuguucccuuuucucuccuugaaaguccagcacaccauucuuguccuuccccaguu

SEQ ID NO: 437680 - RNA, 64 nt, Homo Sapiens
gcaucucgggcuuggcuggugacugugaugacugccagcacaggacggaaggacaugcugucca

SEQ ID NO: 437681 - RNA, 64 nt, Homo Sapiens
uuucugggucuuggaggucagagccacuuuccugccagcacaugcccucccugcaguugaggaa

SEQ ID NO: 437682 - RNA, 64 nt, Homo Sapiens
gaggauguaguuggugaaugucuugucucccaucccagcacauuuugaauugggaacuuuggag

SEQ ID NO: 437683 - RNA, 64 nt, Homo Sapiens
auaaucuccccguccaaggacucggaucugaagcccagcacaaaagaaucuacagaccuggcuc

SEQ ID NO: 437684 - RNA, 64 nt, Homo Sapiens
gugggaaugcaguggguggggcuguacacacccuccagcacagacuguucccuccaagguccuc

SEQ ID NO: 437685 - RNA, 64 nt, Homo Sapiens
uccuuagcagcucaggcgcagcccuagugggagcccagcacacugcuucucggaggccaggccc

SEQ ID NO: 437686 - RNA, 64 nt, Homo Sapiens
gcccccagccaguucucagaaacguggcuggggcccagcacagcagccugcaagggccccuguu

SEQ ID NO: 437687 - RNA, 64 nt, Homo Sapiens
agaguauggaggcugagccaggccuuggguuuccccagcacagccuccugucgcugcaugcgac

SEQ ID NO: 437688 - RNA, 64 nt, Homo Sapiens
gcuguaaaugcagauauugcuccugugugugcugccagcacaggggugacugaagucgugcuuu

SEQ ID NO: 437689 - RNA, 64 nt, Homo Sapiens
agcuuucucuggcagaauugaagggguucagagcccagcacagguaaccugcaccccucccugc

SEQ ID NO: 437690 - RNA, 64 nt, Homo Sapiens
cagcaaggacacgcucucccacacagcccucaccccagcacagcaugcaggggcucccuccagc

SEQ ID NO: 437691 - RNA, 64 nt, Homo Sapiens
gcccucaccccagcacagccugcaggggcucccuccagcacacaaggaagcccaccgugcccca

SEQ ID NO: 437692 - RNA, 64 nt, Homo Sapiens
ugcauuccccccuccacaccauccuagcgaggcaccagcacaccuaaucacagcaaagcccaga

SEQ ID NO: 437693 - RNA, 64 nt, Homo Sapiens
acaugagacaaagcugacuguucacacugauugcccagcacauaccgucuugccaguuucuucu

SEQ ID NO: 437694 - RNA, 64 nt, Homo Sapiens
cuccccauguauuccccaccuguguuccguuugaccagcacagaaauauuaaacguccucuauu

SEQ ID NO: 437695 - RNA, 64 nt, Homo Sapiens
aagccaaagauggccccugacaccucccccagccccagcacaccagccugcaccucuuaucccg

SEQ ID NO: 437696 - RNA, 64 nt, Homo Sapiens
uccccaguggcagccucgcccaggcuggcuggauccagcacaucugacccccgccaggggagac

SEQ ID NO: 437697 - RNA, 64 nt, Homo Sapiens
ugagccugguguggaaaccaccucccgcucgugcccagcacaaguccccccuccaccuucgcca

SEQ ID NO: 437698 - RNA, 64 nt, Homo Sapiens
gucuugggccugggcagucucccuuugaagggacccagcacaggauuucccuccucagugugca

SEQ ID NO: 437699 - RNA, 64 nt, Homo Sapiens
guguguucccgggcguguguggcccacuuccuccccagcacaguuggaccugcaggcccuccua

SEQ ID NO: 437700 - RNA, 64 nt, Homo Sapiens
gaaggaggcuggcuggcucaggucugaagucugaccagcacaaggcugaucaacagaaggaaau

SEQ ID NO: 437701 - RNA, 64 nt, Homo Sapiens
cgaccugugucaaauccguccauugaucugcccuccagcacacauuuacugagcuucuguuacg

SEQ ID NO: 437702 - RNA, 64 nt, Homo Sapiens
uuagugagugaauguuuguaaaacaggauagugcccagcacauacuaguaacaaauguaaaaua

SEQ ID NO: 437703 - RNA, 64 nt, Homo Sapiens
acgaaaccauaucgcaaaccagagcugcuggaaaccagcacacgcaaaagaugacgcccagcac

SEQ ID NO: 437704 - RNA, 64 nt, Homo Sapiens
gcugcuggaaaccagcacacgcaaaagaugacgcccagcacagcagcaggacacaccaugugcc

SEQ ID NO: 437705 - RNA, 64 nt, Homo Sapiens
agccaccaacuucagugccuuucuguaccccaagccagcacaagauuggaccaauccuuuuugc

SEQ ID NO: 437706 - RNA, 64 nt, Homo Sapiens
uccucuaaaggggaggcauuaaaauucacugugcccagcacaugggugguacacuaauuaugac

SEQ ID NO: 437707 - RNA, 64 nt, Homo Sapiens
gaucugaaugaugcaccccauaugcacguaggcaccagcacaaauguguguguguguguacuug

SEQ ID NO: 437708 - RNA, 64 nt, Homo Sapiens
agagcucuggccuuguguguagcuugccccuccuccagcacacuuaauacccucuuggaaaaag

SEQ ID NO: 437709 - RNA, 64 nt, Homo Sapiens
cuuugcccaaggacuaagcucucgccacucucgaccagcacaaggccugggucucugucccaga

SEQ ID NO: 437710 - RNA, 64 nt, Homo Sapiens
uucaccaggggcuuuucaggcucaacagacaccuccagcacagcgggaccccagcgccuaccac

SEQ ID NO: 437711 - RNA, 64 nt, Homo Sapiens
uccagccggccggggaugugagucaucccuugguccagcacauccacgcuguauacgccaccca

SEQ ID NO: 437712 - RNA, 64 nt, Homo Sapiens
acugggccaaaggcucacuaccccugugcguuguccagcacacagacacuaugugcauuauuug

SEQ ID NO: 437713 - RNA, 64 nt, Homo Sapiens
caagcuaagauccacuggcuuggaauucucccugccagcacagcagucugaagucaaccuggga

SEQ ID NO: 437714 - RNA, 64 nt, Homo Sapiens
cugccugccagcucugaagagagcagcaguucuuccagcacagcgcuugagcucugcuaaggga

SEQ ID NO: 437715 - RNA, 64 nt, Homo Sapiens
cuguccuccugagcucgcguggguuuaggcuggcccagcacaucccugcgcuagucucccccga

SEQ ID NO: 437716 - RNA, 64 nt, Homo Sapiens
ugacauuuuagauacacucuuucaaaaacagaggccagcacagacauuuuugguuuuuagcuug

SEQ ID NO: 437717 - RNA, 64 nt, Homo Sapiens
aggugcuggagaggaaagcagggagccacugcauccagcacauggggugccugggccucagaug

SEQ ID NO: 437718 - RNA, 64 nt, Homo Sapiens
uguucuucucugagcagcuccuccccggagucccccagcacagucccaggagaugacaggaagg

SEQ ID NO: 437719 - RNA, 64 nt, Homo Sapiens; identical to SEQ ID NO: 150696

SEQ ID NO: 437720 - RNA, 64 nt, Homo Sapiens; identical to SEQ ID NO: 150697

SEQ ID NO: 437721 - RNA, 64 nt, Homo Sapiens; identical to SEQ ID NO: 150698

SEQ ID NO: 437722 - RNA, 64 nt, Homo Sapiens; identical to SEQ ID NO: 150699

SEQ ID NO: 437723 - RNA, 64 nt, Homo Sapiens; identical to SEQ ID NO: 318262

SEQ ID NO: 437724 - RNA, 64 nt, Homo Sapiens; identical to SEQ ID NO: 318263

SEQ ID NO: 437725 - RNA, 60 nt, Homo Sapiens; identical to SEQ ID NO: 318264

SEQ ID NO: 437726 - RNA, 64 nt, Homo Sapiens; identical to SEQ ID NO: 318265

SEQ ID NO: 437727 - RNA, 64 nt, Homo Sapiens; identical to SEQ ID NO: 318266

SEQ ID NO: 437728 - RNA, 64 nt, Homo Sapiens; identical to SEQ ID NO: 318267

SEQ ID NO: 437729 - RNA, 64 nt, Homo Sapiens; identical to SEQ ID NO: 318268

SEQ ID NO: 437730 - RNA, 64 nt, Homo Sapiens; identical to SEQ ID NO: 318269

SEQ ID NO: 437731 - RNA, 64 nt, Homo Sapiens; identical to SEQ ID NO: 318270

SEQ ID NO: 437732 - RNA, 64 nt, Homo Sapiens; identical to SEQ ID NO: 318271

SEQ ID NO: 437733 - RNA, 64 nt, Homo Sapiens; identical to SEQ ID NO: 318272

SEQ ID NO: 437734 - RNA, 64 nt, Homo Sapiens; identical to SEQ ID NO: 318273

SEQ ID NO: 437735 - RNA, 64 nt, Homo Sapiens; identical to SEQ ID NO: 318274

SEQ ID NO: 437736 - RNA, 64 nt, Homo Sapiens; identical to SEQ ID NO: 318275

SEQ ID NO: 437737 - RNA, 64 nt, Homo Sapiens; identical to SEQ ID NO: 318276

SEQ ID NO: 437738 - RNA, 64 nt, Homo Sapiens; identical to SEQ ID NO: 318277

SEQ ID NO: 437739 - RNA, 64 nt, Homo Sapiens; identical to SEQ ID NO: 318278

SEQ ID NO: 437740 - RNA, 64 nt, Homo Sapiens; identical to SEQ ID NO: 318279

SEQ ID NO: 437741 - RNA, 64 nt, Homo Sapiens
caucuuaguugauuauuaaaaaagaugaggcuuucuuacauauaaucuuguauauuaaaaauca

SEQ ID NO: 437742 - RNA, 64 nt, Homo Sapiens
uuugaguuagacucuuaaaacagguacaccagagcuuacauauguuuuuuuugguauauauaac

SEQ ID NO: 437743 - RNA, 64 nt, Homo Sapiens
cuggaacuugcuucacagcccugaggaagguggacuuacauaagcagcuguauuccauuagaug

SEQ ID NO: 437744 - RNA, 64 nt, Homo Sapiens
ugcccucaaacagaacagcuccccuuguagcugucuuacauauugggguucaggguaagauuuu

SEQ ID NO: 437745 - RNA, 64 nt, Homo Sapiens
uaaagacaggcuccugagaaaugcaacaaguggucuuacauauacaugagaacuuagacacaag

SEQ ID NO: 437746 - RNA, 64 nt, Homo Sapiens
uuguaguucuaguuucagugacuuguuauaucuacuuacauacaacagggaggcaagaggauuc

SEQ ID NO: 437747 - RNA, 64 nt, Homo Sapiens
uuauauuuggcuuuagaugguucuaaauuauauauucaguuauagaaaaugcacuuaaaccugu

SEQ ID NO: 437748 - RNA, 64 nt, Homo Sapiens
uuuuaaauguuuacauaauguuuucaauuggcaauucaguuaauauacguauguaagcucuuau

SEQ ID NO: 437749 - RNA, 64 nt, Homo Sapiens
gcuaaugggaaaugucuaguuguuugauaucuguuucaguuagggcacugaagagaaucuaggg

SEQ ID NO: 437750 - RNA, 64 nt, Homo Sapiens
ugacuuguuuuuuccaccugcugugauuuugguuuucaguuaugaauauaaaauaguuauguaa

SEQ ID NO: 437751 - RNA, 64 nt, Homo Sapiens
guugacaggaugguuuaaaauaagacgugaagguuucaguuaccugcucuagacuuugccugag

SEQ ID NO: 437752 - RNA, 64 nt, Homo Sapiens
agucccuaugucaccacauugcuugagaugaucauucaguuacuugucaggauuucuccucuuc

SEQ ID NO: 437753 - RNA, 64 nt, Homo Sapiens
uacaguauguaauacugauaaaaaguacagcacauucaguuauguacuacacugccaguuguau

SEQ ID NO: 437754 - RNA, 64 nt, Homo Sapiens
acuauaaugugugauucuguauaugaaaaacaacuucaguuaaacucauauuuaugauuguccu

SEQ ID NO: 437755 - RNA, 64 nt, Homo Sapiens
uauauguaguuguuuuguuuuuuaguuguucauuuucaguuauuuuacuuuauuuucaaaguua

SEQ ID NO: 437756 - RNA, 64 nt, Homo Sapiens
gguuuauaguuacuuuauuuuuuaauuuuauaguuucaguuacuucuuuguagcuuucugguua

SEQ ID NO: 437757 - RNA, 64 nt, Homo Sapiens
uaauuuauucuggaugauauucuccaaaauucaauucaguuauuauauucauuuagcauuaagu

SEQ ID NO: 437758 - RNA, 64 nt, Homo Sapiens
uuauagaaaucaguaucaauuccucccauuucaauucaguuaagacuucugugauagauguuua

SEQ ID NO: 437759 - RNA, 64 nt, Homo Sapiens
uguuuauuuacuacauaguuuucaugguaguucauucaguuaugacucauuguaugaauucuuu

SEQ ID NO: 437760 - RNA, 64 nt, Homo Sapiens
uagaauacacaccauccuggaaaagaacucagcauucaguuagauuuuucagaaaaauuauuuu

SEQ ID NO: 437761 - RNA, 64 nt, Homo Sapiens
acucagguuaagaaauguguuuaaagucuauguuuucaguuauggaauuuucaacaaaauguaa

SEQ ID NO: 437762 - RNA, 64 nt, Homo Sapiens
aagugguugauaaaguuuccaaucuaacuuuuuguucaguuaauuuaaaagagcauuugguagu

SEQ ID NO: 437763 - RNA, 64 nt, Homo Sapiens
aagaacaaagaaguauccauauuaaguuuagauuuucaguuaauuuuugagacugaguaguauu

SEQ ID NO: 437764 - RNA, 64 nt, Homo Sapiens
ucuucuaguaaugcaguucaugggcuuuagguacuucaguuaugaaguaggcuuuucaugggga

SEQ ID NO: 437765 - RNA, 64 nt, Homo Sapiens
ucauuucuccuccaugauggaagcccagugauuguucaguuaacgcauuguacagaguguauuu

SEQ ID NO: 437766 - RNA, 64 nt, Homo Sapiens
ugaaaggucgcagaaauugauuucuauuuuuaauuucaguuaguaucgggggaaaaaaauccag

SEQ ID NO: 437767 - RNA, 64 nt, Homo Sapiens
acuguacugcucaaaaacauaaugugggaaagccuucaguuaccgaaacccuacaaaugcaagg

SEQ ID NO: 437768 - RNA, 64 nt, Homo Sapiens
ugcagucuuuuaaaaaacauaaugugggaaacccuucaguuaucgaagccauauaaauguaaga

SEQ ID NO: 437769 - RNA, 64 nt, Homo Sapiens
uauuccuuuaaaaagaaaaucauuucaguuacuuuucaguuaauuguaggccauuuucuuauaa

SEQ ID NO: 437770 - RNA, 64 nt, Homo Sapiens
uuucaguuaauuauuccuuuuuuucuuauaacauuucaguuacuaguagugaaauuguaggcca

SEQ ID NO: 437771 - RNA, 64 nt, Homo Sapiens
uuucauugcagauacgaagaacaacagcauuguuuucaguuauuuuuuccucguuaccaauauu

SEQ ID NO: 437772 - RNA, 64 nt, Homo Sapiens
uauauuuguuuuccuuguuuugcagucauggucuuucaguuaugauucuguuucuuuaagaaga

SEQ ID NO: 437773 - RNA, 64 nt, Homo Sapiens; identical to SEQ ID NO: 225321

SEQ ID NO: 437774 - RNA, 64 nt, Homo Sapiens; identical to SEQ ID NO: 225322

SEQ ID NO: 437775 - RNA, 64 nt, Homo Sapiens; identical to SEQ ID NO: 225323

SEQ ID NO: 437776 - RNA, 64 nt, Homo Sapiens; identical to SEQ ID NO: 225324

SEQ ID NO: 437777 - RNA, 64 nt, Homo Sapiens; identical to SEQ ID NO: 225325

SEQ ID NO: 437778 - RNA, 64 nt, Homo Sapiens; identical to SEQ ID NO: 225326

SEQ ID NO: 437779 - RNA, 64 nt, Homo Sapiens; identical to SEQ ID NO: 225327

SEQ ID NO: 437780 - RNA, 64 nt, Homo Sapiens; identical to SEQ ID NO: 225328

SEQ ID NO: 437781 - RNA, 64 nt, Homo Sapiens; identical to SEQ ID NO: 225329

SEQ ID NO: 437782 - RNA, 64 nt, Homo Sapiens; identical to SEQ ID NO: 225330

SEQ ID NO: 437783 - RNA, 64 nt, Homo Sapiens; identical to SEQ ID NO: 225331

SEQ ID NO: 437784 - RNA, 64 nt, Homo Sapiens; identical to SEQ ID NO: 225332

SEQ ID NO: 437785 - RNA, 64 nt, Homo Sapiens; identical to SEQ ID NO: 225333

SEQ ID NO: 437786 - RNA, 64 nt, Homo Sapiens; identical to SEQ ID NO: 225334

SEQ ID NO: 437787 - RNA, 64 nt, Homo Sapiens; identical to SEQ ID NO: 225335

SEQ ID NO: 437788 - RNA, 64 nt, Homo Sapiens; identical to SEQ ID NO: 225336

SEQ ID NO: 437789 - RNA, 64 nt, Homo Sapiens; identical to SEQ ID NO: 225337

SEQ ID NO: 437790 - RNA, 64 nt, Homo Sapiens; identical to SEQ ID NO: 225338

SEQ ID NO: 437791 - RNA, 64 nt, Homo Sapiens; identical to SEQ ID NO: 225339

SEQ ID NO: 437792 - RNA, 64 nt, Homo Sapiens; identical to SEQ ID NO: 225340

SEQ ID NO: 437793 - RNA, 64 nt, Homo Sapiens; identical to SEQ ID NO: 225341

SEQ ID NO: 437794 - RNA, 64 nt, Homo Sapiens; identical to SEQ ID NO: 225342

SEQ ID NO: 437795 - RNA, 64 nt, Homo Sapiens; identical to SEQ ID NO: 225343

SEQ ID NO: 437796 - RNA, 64 nt, Homo Sapiens; identical to SEQ ID NO: 225344

SEQ ID NO: 437797 - RNA, 64 nt, Homo Sapiens; identical to SEQ ID NO: 225345

SEQ ID NO: 437798 - RNA, 64 nt, Homo Sapiens; identical to SEQ ID NO: 225346

SEQ ID NO: 437799 - RNA, 64 nt, Homo Sapiens; identical to SEQ ID NO: 225347

SEQ ID NO: 437800 - RNA, 64 nt, Homo Sapiens; identical to SEQ ID NO: 225348

SEQ ID NO: 437801 - RNA, 64 nt, Homo Sapiens; identical to SEQ ID NO: 225349

SEQ ID NO: 437802 - RNA, 64 nt, Homo Sapiens; identical to SEQ ID NO: 225350

SEQ ID NO: 437803 - RNA, 64 nt, Homo Sapiens; identical to SEQ ID NO: 225351

SEQ ID NO: 437804 - RNA, 64 nt, Homo Sapiens; identical to SEQ ID NO: 225352

SEQ ID NO: 437805 - RNA, 64 nt, Homo Sapiens; identical to SEQ ID NO: 225353

SEQ ID NO: 437806 - RNA, 64 nt, Homo Sapiens; identical to SEQ ID NO: 225354

SEQ ID NO: 437807 - RNA, 64 nt, Homo Sapiens; identical to SEQ ID NO: 225355

SEQ ID NO: 437808 - RNA, 64 nt, Homo Sapiens; identical to SEQ ID NO: 225356

SEQ ID NO: 437809 - RNA, 64 nt, Homo Sapiens; identical to SEQ ID NO: 225357

SEQ ID NO: 437810 - RNA, 64 nt, Homo Sapiens; identical to SEQ ID NO: 225358

SEQ ID NO: 437811 - RNA, 64 nt, Homo Sapiens; identical to SEQ ID NO: 225359

SEQ ID NO: 437812 - RNA, 64 nt, Homo Sapiens; identical to SEQ ID NO: 225360

SEQ ID NO: 437813 - RNA, 64 nt, Homo Sapiens; identical to SEQ ID NO: 225361

SEQ ID NO: 437814 - RNA, 64 nt, Homo Sapiens; identical to SEQ ID NO: 225362

SEQ ID NO: 437815 - RNA, 64 nt, Homo Sapiens; identical to SEQ ID NO: 225363

SEQ ID NO: 437816 - RNA, 64 nt, Homo Sapiens; identical to SEQ ID NO: 225364

SEQ ID NO: 437817 - RNA, 64 nt, Homo Sapiens; identical to SEQ ID NO: 225365

SEQ ID NO: 437818 - RNA, 64 nt, Homo Sapiens; identical to SEQ ID NO: 225366

SEQ ID NO: 437819 - RNA, 64 nt, Homo Sapiens; identical to SEQ ID NO: 225367

SEQ ID NO: 437820 - RNA, 64 nt, Homo Sapiens; identical to SEQ ID NO: 225368

SEQ ID NO: 437821 - RNA, 64 nt, Homo Sapiens; identical to SEQ ID NO: 225369

SEQ ID NO: 437822 - RNA, 64 nt, Homo Sapiens; identical to SEQ ID NO: 225370

SEQ ID NO: 437823 - RNA, 64 nt, Homo Sapiens; identical to SEQ ID NO: 225371

SEQ ID NO: 437824 - RNA, 64 nt, Homo Sapiens; identical to SEQ ID NO: 225372

SEQ ID NO: 437825 - RNA, 64 nt, Homo Sapiens; identical to SEQ ID NO: 225373

SEQ ID NO: 437826 - RNA, 64 nt, Homo Sapiens; identical to SEQ ID NO: 225374

SEQ ID NO: 437827 - RNA, 64 nt, Homo Sapiens; identical to SEQ ID NO: 225375

SEQ ID NO: 437828 - RNA, 64 nt, Homo Sapiens; identical to SEQ ID NO: 225376

SEQ ID NO: 437829 - RNA, 64 nt, Homo Sapiens; identical to SEQ ID NO: 225377

SEQ ID NO: 437830 - RNA, 64 nt, Homo Sapiens; identical to SEQ ID NO: 225378

SEQ ID NO: 437831 - RNA, 64 nt, Homo Sapiens; identical to SEQ ID NO: 225379

SEQ ID NO: 437832 - RNA, 64 nt, Homo Sapiens; identical to SEQ ID NO: 225380

SEQ ID NO: 437833 - RNA, 64 nt, Homo Sapiens; identical to SEQ ID NO: 225381

SEQ ID NO: 437834 - RNA, 64 nt, Homo Sapiens; identical to SEQ ID NO: 225382

SEQ ID NO: 437835 - RNA, 64 nt, Homo Sapiens; identical to SEQ ID NO: 225383

SEQ ID NO: 437836 - RNA, 64 nt, Homo Sapiens; identical to SEQ ID NO: 225384

SEQ ID NO: 437837 - RNA, 64 nt, Homo Sapiens; identical to SEQ ID NO: 225385

SEQ ID NO: 437838 - RNA, 64 nt, Homo Sapiens; identical to SEQ ID NO: 225386

SEQ ID NO: 437839 - RNA, 64 nt, Homo Sapiens; identical to SEQ ID NO: 225387

SEQ ID NO: 437840 - RNA, 64 nt, Homo Sapiens; identical to SEQ ID NO: 225388

SEQ ID NO: 437841 - RNA, 64 nt, Homo Sapiens; identical to SEQ ID NO: 225389

SEQ ID NO: 437842 - RNA, 64 nt, Homo Sapiens; identical to SEQ ID NO: 225390

SEQ ID NO: 437843 - RNA, 64 nt, Homo Sapiens; identical to SEQ ID NO: 225391

SEQ ID NO: 437844 - RNA, 64 nt, Homo Sapiens; identical to SEQ ID NO: 225392

SEQ ID NO: 437845 - RNA, 64 nt, Homo Sapiens; identical to SEQ ID NO: 225393

SEQ ID NO: 437846 - RNA, 64 nt, Homo Sapiens; identical to SEQ ID NO: 225394

SEQ ID NO: 437847 - RNA, 64 nt, Homo Sapiens; identical to SEQ ID NO: 225395

SEQ ID NO: 437848 - RNA, 64 nt, Homo Sapiens; identical to SEQ ID NO: 225396

SEQ ID NO: 437849 - RNA, 64 nt, Homo Sapiens; identical to SEQ ID NO: 225397

SEQ ID NO: 437850 - RNA, 64 nt, Homo Sapiens; identical to SEQ ID NO: 225398

SEQ ID NO: 437851 - RNA, 64 nt, Homo Sapiens; identical to SEQ ID NO: 225399

SEQ ID NO: 437852 - RNA, 64 nt, Homo Sapiens; identical to SEQ ID NO: 225400

SEQ ID NO: 437853 - RNA, 64 nt, Homo Sapiens; identical to SEQ ID NO: 225401

SEQ ID NO: 437854 - RNA, 64 nt, Homo Sapiens; identical to SEQ ID NO: 225402

SEQ ID NO: 437855 - RNA, 64 nt, Homo Sapiens; identical to SEQ ID NO: 225403

SEQ ID NO: 437856 - RNA, 64 nt, Homo Sapiens; identical to SEQ ID NO: 225404

SEQ ID NO: 437857 - RNA, 64 nt, Homo Sapiens; identical to SEQ ID NO: 225405

SEQ ID NO: 437858 - RNA, 64 nt, Homo Sapiens; identical to SEQ ID NO: 225406

SEQ ID NO: 437859 - RNA, 64 nt, Homo Sapiens; identical to SEQ ID NO: 225407

SEQ ID NO: 437860 - RNA, 64 nt, Homo Sapiens; identical to SEQ ID NO: 225408

SEQ ID NO: 437861 - RNA, 64 nt, Homo Sapiens; identical to SEQ ID NO: 225409

SEQ ID NO: 437862 - RNA, 64 nt, Homo Sapiens; identical to SEQ ID NO: 225410

SEQ ID NO: 437863 - RNA, 64 nt, Homo Sapiens
uucugacccacagcacccgcgccucagaagcuacggucacaacuaaaggaguccagggacuugc

SEQ ID NO: 437864 - RNA, 64 nt, Homo Sapiens
acaauuuuuuauuguuaaauuugugguaauacauggucacaaccguggaucaaacaaggucagu

SEQ ID NO: 437865 - RNA, 64 nt, Homo Sapiens; identical to SEQ ID NO: 73420

SEQ ID NO: 437866 - RNA, 64 nt, Homo Sapiens; identical to SEQ ID NO: 73421

SEQ ID NO: 437867 - RNA, 64 nt, Homo Sapiens
uguaaucccagcacuuuggggagccagccgugguggcucacaccuuuuaagauuuuuggguccu

SEQ ID NO: 437868 - RNA, 64 nt, Homo Sapiens
agugccaguuagugccuucguuucacauguugcuggcucacauucugcaucuccuggauuagcc

SEQ ID NO: 437869 - RNA, 64 nt, Homo Sapiens
ugucacccaggcuggaauacagugguacagucacggcucacaaaagccuugaccuccugggcuc

SEQ ID NO: 437870 - RNA, 64 nt, Homo Sapiens
acauagaaaauguuuugaauaggccaggcgcaguggcucacaccuguaaucccagcacguuggg

SEQ ID NO: 437871 - RNA, 64 nt, Homo Sapiens
uauaaucccagcacuauggguggccgggcacgguggcucacaccuaagcuuaaacaaauaacuu

SEQ ID NO: 437872 - RNA, 64 nt, Homo Sapiens
uguaaucccagcacuuuggggggccgggugugguggcucacaccucaggaaucaaaagauaaag

SEQ ID NO: 437873 - RNA, 64 nt, Homo Sapiens
acugcaaaaugggagcacaguacugggaaaugggggcucacagcacugggaaaugggagcacag

SEQ ID NO: 437874 - RNA, 64 nt, Homo Sapiens
ugugagcacaguacugggaagggccgggcauguuggcucacacccuugcugcuuaagagcugau

SEQ ID NO: 437875 - RNA, 64 nt, Homo Sapiens
uguaauuccaacacuuugggaggcccugugcaauggcucacaccaagugcuuagaacaggaccu

SEQ ID NO: 437876 - RNA, 64 nt, Homo Sapiens
uguaauccuagcgcuuugggggguugggcgccguggcucacaccuggaaagaauugugaaaauu

SEQ ID NO: 437877 - RNA, 64 nt, Homo Sapiens
uguaaucccagcacuuugggagcccaggagcgguggcucacacucucaaaaaaaaaagaguucu

SEQ ID NO: 437878 - RNA, 64 nt, Homo Sapiens
uguaaucccagcacuuugggaggcggggcgugguggcucacacuucauucucuauaagaguucu

SEQ ID NO: 437879 - RNA, 64 nt, Homo Sapiens
uguaauccgacuguaagcucuggccaggcacaguggcucacaccugucucaaaaaaaugcagac

SEQ ID NO: 437880 - RNA, 64 nt, Homo Sapiens
uguaaucccagcgcuuugggaggccaggugcgguggcucacaccgggcugcuuguuaaaaaugc

SEQ ID NO: 437881 - RNA, 64 nt, Homo Sapiens
gcuauaaaguuaagugucccucaggcagggagagggcucacagagucuccucuguacguggcca

SEQ ID NO: 437882 - RNA, 64 nt, Homo Sapiens
gguuuugccauccacaaucccuccuacagggccuggcucacaaaaagagugcaacaaaugcuuc

SEQ ID NO: 437883 - RNA, 64 nt, Homo Sapiens
accaaugaggaaagagagaggcaggucugggccaggcucacagggacuccggcauagcagaccc

SEQ ID NO: 437884 - RNA, 64 nt, Homo Sapiens
cucaccaagccuagccacucucgcggcucugaguggcucacaggcuugugagggccccgucgcu

SEQ ID NO: 437885 - RNA, 64 nt, Homo Sapiens
cucuaaaaugcaauaauaaugggccaggugaaguggcucacaccuguaaucccagcacugugga

SEQ ID NO: 437886 - RNA, 64 nt, Homo Sapiens
uaaauaaauaaauaaaaugcgggccaggcacaguggcucacaccuguaaucccagcacuauggg

SEQ ID NO: 437887 - RNA, 64 nt, Homo Sapiens
cuucagagcugagcuugaacagagugggaaucggggcucacagcaagacacagaaauauagugc

SEQ ID NO: 437888 - RNA, 64 nt, Homo Sapiens
uuggccuuagaugcaucccguuggagguuguaauggcucacagaagauuaguccuaaaugccuu

SEQ ID NO: 437889 - RNA, 64 nt, Homo Sapiens
uguaaucccaguacuuugggaggccaggcacgguggcucacaccgaaugcgagaaauauaaauc

SEQ ID NO: 437890 - RNA, 64 nt, Homo Sapiens
uguaaucccagcacuuugggaggccaggcgcgguggcucacaccuguuuugaaauugaagagag

SEQ ID NO: 437891 - RNA, 64 nt, Homo Sapiens
accgaguggcaaggccccugggagggcuuuagcaggcucacauaccugcaagcacacauggcaa

SEQ ID NO: 437892 - RNA, 64 nt, Homo Sapiens
agcaccuuugguucugcaggagcacugggcuacuggcucacagaccccgccccugcccccaagc

SEQ ID NO: 437893 - RNA, 64 nt, Homo Sapiens; identical to SEQ ID NO: 128854

SEQ ID NO: 437894 - RNA, 64 nt, Homo Sapiens; identical to SEQ ID NO: 128855

SEQ ID NO: 437895 - RNA, 64 nt, Homo Sapiens; identical to SEQ ID NO: 128856

SEQ ID NO: 437896 - RNA, 64 nt, Homo Sapiens; identical to SEQ ID NO: 128857

SEQ ID NO: 437897 - RNA, 64 nt, Homo Sapiens; identical to SEQ ID NO: 128858

SEQ ID NO: 437898 - RNA, 64 nt, Homo Sapiens; identical to SEQ ID NO: 128859

SEQ ID NO: 437899 - RNA, 64 nt, Homo Sapiens; identical to SEQ ID NO: 128860

SEQ ID NO: 437900 - RNA, 64 nt, Homo Sapiens; identical to SEQ ID NO: 128861

SEQ ID NO: 437901 - RNA, 64 nt, Homo Sapiens; identical to SEQ ID NO: 128862

SEQ ID NO: 437902 - RNA, 64 nt, Homo Sapiens; identical to SEQ ID NO: 128863

SEQ ID NO: 437903 - RNA, 64 nt, Homo Sapiens; identical to SEQ ID NO: 128864

SEQ ID NO: 437904 - RNA, 64 nt, Homo Sapiens; identical to SEQ ID NO: 128865

SEQ ID NO: 437905 - RNA, 64 nt, Homo Sapiens; identical to SEQ ID NO: 128866

SEQ ID NO: 437906 - RNA, 64 nt, Homo Sapiens; identical to SEQ ID NO: 128867

SEQ ID NO: 437907 - RNA, 64 nt, Homo Sapiens; identical to SEQ ID NO: 128868

SEQ ID NO: 437908 - RNA, 64 nt, Homo Sapiens; identical to SEQ ID NO: 128869

SEQ ID NO: 437909 - RNA, 64 nt, Homo Sapiens; identical to SEQ ID NO: 128870

SEQ ID NO: 437910 - RNA, 64 nt, Homo Sapiens; identical to SEQ ID NO: 128871

SEQ ID NO: 437911 - RNA, 64 nt, Homo Sapiens; identical to SEQ ID NO: 128872

SEQ ID NO: 437912 - RNA, 64 nt, Homo Sapiens; identical to SEQ ID NO: 128873

SEQ ID NO: 437913 - RNA, 64 nt, Homo Sapiens; identical to SEQ ID NO: 128874

SEQ ID NO: 437914 - RNA, 64 nt, Homo Sapiens; identical to SEQ ID NO: 128875

SEQ ID NO: 437915 - RNA, 64 nt, Homo Sapiens; identical to SEQ ID NO: 128876

SEQ ID NO: 437916 - RNA, 64 nt, Homo Sapiens; identical to SEQ ID NO: 128877

SEQ ID NO: 437917 - RNA, 64 nt, Homo Sapiens; identical to SEQ ID NO: 128878

SEQ ID NO: 437918 - RNA, 64 nt, Homo Sapiens; identical to SEQ ID NO: 128879

SEQ ID NO: 437919 - RNA, 64 nt, Homo Sapiens; identical to SEQ ID NO: 128880

SEQ ID NO: 437920 - RNA, 64 nt, Homo Sapiens; identical to SEQ ID NO: 128881

SEQ ID NO: 437921 - RNA, 64 nt, Homo Sapiens; identical to SEQ ID NO: 128882

SEQ ID NO: 437922 - RNA, 64 nt, Homo Sapiens; identical to SEQ ID NO: 128883

SEQ ID NO: 437923 - RNA, 64 nt, Homo Sapiens; identical to SEQ ID NO: 128884

SEQ ID NO: 437924 - RNA, 64 nt, Homo Sapiens; identical to SEQ ID NO: 128885

SEQ ID NO: 437925 - RNA, 64 nt, Homo Sapiens; identical to SEQ ID NO: 128886

SEQ ID NO: 437926 - RNA, 64 nt, Homo Sapiens
uugugacugaaaacuugaaaaaacgaugagaguaaguugcaaccuucaacuugauuaucuugug

SEQ ID NO: 437927 - RNA, 64 nt, Homo Sapiens
agcaccaggaauuagauuucuuuuaaauauauguaguugcaaauuggguauuuaucuccuugua

SEQ ID NO: 437928 - RNA, 64 nt, Homo Sapiens
aguaggaggggguaugugucucaggcuuuucugaaguugcaagacuuaaagaaauaauccaucu

SEQ ID NO: 437929 - RNA, 64 nt, Homo Sapiens
augggugccuugaggaaaagcaguuacacaguugaguugcaagcugaauuggcuguguucaagg

SEQ ID NO: 437930 - RNA, 64 nt, Homo Sapiens
aauuuuuauccaguacuuuauagauucaacucuaaguugcaagcgaagucaaaacugaugaaaa

SEQ ID NO: 437931 - RNA, 64 nt, Homo Sapiens
ccacaacaugugggaauuccagaagauaaauucaaguugcaauuucaguggggacauagccaaa

SEQ ID NO: 437932 - RNA, 64 nt, Homo Sapiens
cugcacucucauugucaagguuagauauauccccaguugcaaaacagccagacuugagcugugc

SEQ ID NO: 437933 - RNA, 64 nt, Homo Sapiens
aaaugaaaagaccaaaaucuucaggcaaaaagcaaguugcaaaauuagaaaccauuggcuaaaa

SEQ ID NO: 437934 - RNA, 60 nt, Homo Sapiens; identical to SEQ ID NO: 37632

SEQ ID NO: 437935 - RNA, 60 nt, Homo Sapiens; identical to SEQ ID NO: 37633

SEQ ID NO: 437936 - RNA, 60 nt, Homo Sapiens; identical to SEQ ID NO: 37634

SEQ ID NO: 437937 - RNA, 60 nt, Homo Sapiens; identical to SEQ ID NO: 37635

SEQ ID NO: 437938 - RNA, 60 nt, Homo Sapiens; identical to SEQ ID NO: 37636

SEQ ID NO: 437939 - RNA, 60 nt, Homo Sapiens; identical to SEQ ID NO: 37637

SEQ ID NO: 437940 - RNA, 60 nt, Homo Sapiens; identical to SEQ ID NO: 37638

SEQ ID NO: 437941 - RNA, 60 nt, Homo Sapiens; identical to SEQ ID NO: 37639

SEQ ID NO: 437942 - RNA, 60 nt, Homo Sapiens; identical to SEQ ID NO: 37640

SEQ ID NO: 437943 - RNA, 60 nt, Homo Sapiens; identical to SEQ ID NO: 37641

SEQ ID NO: 437944 - RNA, 60 nt, Homo Sapiens; identical to SEQ ID NO: 37642

SEQ ID NO: 437945 - RNA, 60 nt, Homo Sapiens; identical to SEQ ID NO: 37643

SEQ ID NO: 437946 - RNA, 60 nt, Homo Sapiens; identical to SEQ ID NO: 37644

SEQ ID NO: 437947 - RNA, 60 nt, Homo Sapiens; identical to SEQ ID NO: 37645

SEQ ID NO: 437948 - RNA, 60 nt, Homo Sapiens; identical to SEQ ID NO: 37646

SEQ ID NO: 437949 - RNA, 60 nt, Homo Sapiens; identical to SEQ ID NO: 37647

SEQ ID NO: 437950 - RNA, 60 nt, Homo Sapiens; identical to SEQ ID NO: 37648

SEQ ID NO: 437951 - RNA, 60 nt, Homo Sapiens; identical to SEQ ID NO: 37649

SEQ ID NO: 437952 - RNA, 60 nt, Homo Sapiens; identical to SEQ ID NO: 37650

SEQ ID NO: 437953 - RNA, 60 nt, Homo Sapiens; identical to SEQ ID NO: 37651

SEQ ID NO: 437954 - RNA, 60 nt, Homo Sapiens; identical to SEQ ID NO: 37652

SEQ ID NO: 437955 - RNA, 60 nt, Homo Sapiens; identical to SEQ ID NO: 37653

SEQ ID NO: 437956 - RNA, 60 nt, Homo Sapiens; identical to SEQ ID NO: 37654

SEQ ID NO: 437957 - RNA, 60 nt, Homo Sapiens; identical to SEQ ID NO: 37655

SEQ ID NO: 437958 - RNA, 60 nt, Homo Sapiens; identical to SEQ ID NO: 37656

SEQ ID NO: 437959 - RNA, 60 nt, Homo Sapiens; identical to SEQ ID NO: 37657

SEQ ID NO: 437960 - RNA, 60 nt, Homo Sapiens; identical to SEQ ID NO: 37658

SEQ ID NO: 437961 - RNA, 60 nt, Homo Sapiens; identical to SEQ ID NO: 37659

SEQ ID NO: 437962 - RNA, 60 nt, Homo Sapiens; identical to SEQ ID NO: 37660

SEQ ID NO: 437963 - RNA, 60 nt, Homo Sapiens; identical to SEQ ID NO: 37661

SEQ ID NO: 437964 - RNA, 60 nt, Homo Sapiens; identical to SEQ ID NO: 37662

SEQ ID NO: 437965 - RNA, 60 nt, Homo Sapiens; identical to SEQ ID NO: 37663

SEQ ID NO: 437966 - RNA, 60 nt, Homo Sapiens; identical to SEQ ID NO: 37664

SEQ ID NO: 437967 - RNA, 60 nt, Homo Sapiens; identical to SEQ ID NO: 37665

SEQ ID NO: 437968 - RNA, 60 nt, Homo Sapiens; identical to SEQ ID NO: 37666

SEQ ID NO: 437969 - RNA, 60 nt, Homo Sapiens; identical to SEQ ID NO: 37667

SEQ ID NO: 437970 - RNA, 60 nt, Homo Sapiens; identical to SEQ ID NO: 37668

SEQ ID NO: 437971 - RNA, 60 nt, Homo Sapiens; identical to SEQ ID NO: 37669

SEQ ID NO: 437972 - RNA, 60 nt, Homo Sapiens; identical to SEQ ID NO: 37670

SEQ ID NO: 437973 - RNA, 60 nt, Homo Sapiens; identical to SEQ ID NO: 37671

SEQ ID NO: 437974 - RNA, 60 nt, Homo Sapiens; identical to SEQ ID NO: 37672

SEQ ID NO: 437975 - RNA, 50 nt, Homo Sapiens; identical to SEQ ID NO: 37673

SEQ ID NO: 437976 - RNA, 60 nt, Homo Sapiens; identical to SEQ ID NO: 37674

SEQ ID NO: 437977 - RNA, 60 nt, Homo Sapiens; identical to SEQ ID NO: 37675

SEQ ID NO: 437978 - RNA, 60 nt, Homo Sapiens; identical to SEQ ID NO: 37676

SEQ ID NO: 437979 - RNA, 60 nt, Homo Sapiens; identical to SEQ ID NO: 37677

SEQ ID NO: 437980 - RNA, 60 nt, Homo Sapiens; identical to SEQ ID NO: 37678

SEQ ID NO: 437981 - RNA, 60 nt, Homo Sapiens; identical to SEQ ID NO: 37679

SEQ ID NO: 437982 - RNA, 60 nt, Homo Sapiens; identical to SEQ ID NO: 37680

SEQ ID NO: 437983 - RNA, 60 nt, Homo Sapiens; identical to SEQ ID NO: 37681

SEQ ID NO: 437984 - RNA, 60 nt, Homo Sapiens; identical to SEQ ID NO: 37682

SEQ ID NO: 437985 - RNA, 60 nt, Homo Sapiens; identical to SEQ ID NO: 37683

SEQ ID NO: 437986 - RNA, 60 nt, Homo Sapiens; identical to SEQ ID NO: 37684

SEQ ID NO: 437987 - RNA, 60 nt, Homo Sapiens; identical to SEQ ID NO: 37685

SEQ ID NO: 437988 - RNA, 60 nt, Homo Sapiens; identical to SEQ ID NO: 37686

SEQ ID NO: 437989 - RNA, 60 nt, Homo Sapiens; identical to SEQ ID NO: 37687

SEQ ID NO: 437990 - RNA, 60 nt, Homo Sapiens; identical to SEQ ID NO: 37688

SEQ ID NO: 437991 - RNA, 60 nt, Homo Sapiens; identical to SEQ ID NO: 37689

SEQ ID NO: 437992 - RNA, 60 nt, Homo Sapiens; identical to SEQ ID NO: 37690

SEQ ID NO: 437993 - RNA, 60 nt, Homo Sapiens; identical to SEQ ID NO: 37691

SEQ ID NO: 437994 - RNA, 60 nt, Homo Sapiens; identical to SEQ ID NO: 37692

SEQ ID NO: 437995 - RNA, 60 nt, Homo Sapiens; identical to SEQ ID NO: 37693

SEQ ID NO: 437996 - RNA, 60 nt, Homo Sapiens; identical to SEQ ID NO: 37694

SEQ ID NO: 437997 - RNA, 60 nt, Homo Sapiens; identical to SEQ ID NO: 37695

SEQ ID NO: 437998 - RNA, 60 nt, Homo Sapiens; identical to SEQ ID NO: 37696

SEQ ID NO: 437999 - RNA, 60 nt, Homo Sapiens; identical to SEQ ID NO: 37697

SEQ ID NO: 438000 - RNA, 60 nt, Homo Sapiens; identical to SEQ ID NO: 37698

SEQ ID NO: 438001 - RNA, 60 nt, Homo Sapiens; identical to SEQ ID NO: 37699

SEQ ID NO: 438002 - RNA, 60 nt, Homo Sapiens; identical to SEQ ID NO: 37700

SEQ ID NO: 438003 - RNA, 60 nt, Homo Sapiens; identical to SEQ ID NO: 37701

SEQ ID NO: 438004 - RNA, 60 nt, Homo Sapiens; identical to SEQ ID NO: 37702

SEQ ID NO: 438005 - RNA, 60 nt, Homo Sapiens; identical to SEQ ID NO: 37703

SEQ ID NO: 438006 - RNA, 60 nt, Homo Sapiens; identical to SEQ ID NO: 37704

SEQ ID NO: 438007 - RNA, 60 nt, Homo Sapiens; identical to SEQ ID NO: 37705

SEQ ID NO: 438008 - RNA, 60 nt, Homo Sapiens; identical to SEQ ID NO: 37706

SEQ ID NO: 438009 - RNA, 60 nt, Homo Sapiens; identical to SEQ ID NO: 37707

SEQ ID NO: 438010 - RNA, 60 nt, Homo Sapiens; identical to SEQ ID NO: 37708

SEQ ID NO: 438011 - RNA, 60 nt, Homo Sapiens; identical to SEQ ID NO: 37709

SEQ ID NO: 438012 - RNA, 60 nt, Homo Sapiens; identical to SEQ ID NO: 37710

SEQ ID NO: 438013 - RNA, 60 nt, Homo Sapiens; identical to SEQ ID NO: 37711

SEQ ID NO: 438014 - RNA, 60 nt, Homo Sapiens; identical to SEQ ID NO: 37712

SEQ ID NO: 438015 - RNA, 60 nt, Homo Sapiens; identical to SEQ ID NO: 37713

SEQ ID NO: 438016 - RNA, 60 nt, Homo Sapiens; identical to SEQ ID NO: 37714

SEQ ID NO: 438017 - RNA, 60 nt, Homo Sapiens; identical to SEQ ID NO: 37715

SEQ ID NO: 438018 - RNA, 60 nt, Homo Sapiens; identical to SEQ ID NO: 37716

SEQ ID NO: 438019 - RNA, 60 nt, Homo Sapiens; identical to SEQ ID NO: 37717

SEQ ID NO: 438020 - RNA, 60 nt, Homo Sapiens; identical to SEQ ID NO: 37718

SEQ ID NO: 438021 - RNA, 60 nt, Homo Sapiens; identical to SEQ ID NO: 37719

SEQ ID NO: 438022 - RNA, 60 nt, Homo Sapiens; identical to SEQ ID NO: 37720

SEQ ID NO: 438023 - RNA, 60 nt, Homo Sapiens; identical to SEQ ID NO: 37721

SEQ ID NO: 438024 - RNA, 60 nt, Homo Sapiens; identical to SEQ ID NO: 37722

SEQ ID NO: 438025 - RNA, 60 nt, Homo Sapiens; identical to SEQ ID NO: 37723

SEQ ID NO: 438026 - RNA, 60 nt, Homo Sapiens; identical to SEQ ID NO: 37724

SEQ ID NO: 438027 - RNA, 60 nt, Homo Sapiens; identical to SEQ ID NO: 37725

SEQ ID NO: 438028 - RNA, 60 nt, Homo Sapiens; identical to SEQ ID NO: 37726

SEQ ID NO: 438029 - RNA, 60 nt, Homo Sapiens; identical to SEQ ID NO: 37727

SEQ ID NO: 438030 - RNA, 60 nt, Homo Sapiens; identical to SEQ ID NO: 37728

SEQ ID NO: 438031 - RNA, 60 nt, Homo Sapiens; identical to SEQ ID NO: 37729

SEQ ID NO: 438032 - RNA, 60 nt, Homo Sapiens; identical to SEQ ID NO: 37730

SEQ ID NO: 438033 - RNA, 60 nt, Homo Sapiens; identical to SEQ ID NO: 37731

SEQ ID NO: 438034 - RNA, 60 nt, Homo Sapiens; identical to SEQ ID NO: 37732

SEQ ID NO: 438035 - RNA, 60 nt, Homo Sapiens; identical to SEQ ID NO: 37733

SEQ ID NO: 438036 - RNA, 60 nt, Homo Sapiens; identical to SEQ ID NO: 37734

SEQ ID NO: 438037 - RNA, 60 nt, Homo Sapiens; identical to SEQ ID NO: 37735

SEQ ID NO: 438038 - RNA, 60 nt, Homo Sapiens; identical to SEQ ID NO: 37736

SEQ ID NO: 438039 - RNA, 60 nt, Homo Sapiens; identical to SEQ ID NO: 37737

SEQ ID NO: 438040 - RNA, 60 nt, Homo Sapiens; identical to SEQ ID NO: 37738

SEQ ID NO: 438041 - RNA, 60 nt, Homo Sapiens; identical to SEQ ID NO: 37739

SEQ ID NO: 438042 - RNA, 60 nt, Homo Sapiens; identical to SEQ ID NO: 37740

SEQ ID NO: 438043 - RNA, 60 nt, Homo Sapiens; identical to SEQ ID NO: 37741

SEQ ID NO: 438044 - RNA, 60 nt, Homo Sapiens; identical to SEQ ID NO: 37742

SEQ ID NO: 438045 - RNA, 60 nt, Homo Sapiens; identical to SEQ ID NO: 37743

SEQ ID NO: 438046 - RNA, 60 nt, Homo Sapiens; identical to SEQ ID NO: 37744

SEQ ID NO: 438047 - RNA, 60 nt, Homo Sapiens; identical to SEQ ID NO: 37745

SEQ ID NO: 438048 - RNA, 60 nt, Homo Sapiens; identical to SEQ ID NO: 37746

SEQ ID NO: 438049 - RNA, 60 nt, Homo Sapiens; identical to SEQ ID NO: 37747

SEQ ID NO: 438050 - RNA, 60 nt, Homo Sapiens; identical to SEQ ID NO: 37748

SEQ ID NO: 438051 - RNA, 60 nt, Homo Sapiens; identical to SEQ ID NO: 37749

SEQ ID NO: 438052 - RNA, 60 nt, Homo Sapiens; identical to SEQ ID NO: 37750

SEQ ID NO: 438053 - RNA, 60 nt, Homo Sapiens; identical to SEQ ID NO: 37751

SEQ ID NO: 438054 - RNA, 60 nt, Homo Sapiens; identical to SEQ ID NO: 37752

SEQ ID NO: 438055 - RNA, 51 nt, Homo Sapiens; identical to SEQ ID NO: 37753

SEQ ID NO: 438056 - RNA, 60 nt, Homo Sapiens; identical to SEQ ID NO: 37754

SEQ ID NO: 438057 - RNA, 60 nt, Homo Sapiens; identical to SEQ ID NO: 37755

SEQ ID NO: 438058 - RNA, 60 nt, Homo Sapiens; identical to SEQ ID NO: 37756

SEQ ID NO: 438059 - RNA, 60 nt, Homo Sapiens; identical to SEQ ID NO: 37757

SEQ ID NO: 438060 - RNA, 60 nt, Homo Sapiens; identical to SEQ ID NO: 37758

SEQ ID NO: 438061 - RNA, 60 nt, Homo Sapiens; identical to SEQ ID NO: 37759

SEQ ID NO: 438062 - RNA, 60 nt, Homo Sapiens; identical to SEQ ID NO: 37760

SEQ ID NO: 438063 - RNA, 60 nt, Homo Sapiens; identical to SEQ ID NO: 37761

SEQ ID NO: 438064 - RNA, 60 nt, Homo Sapiens; identical to SEQ ID NO: 37762

SEQ ID NO: 438065 - RNA, 60 nt, Homo Sapiens; identical to SEQ ID NO: 37763

SEQ ID NO: 438066 - RNA, 60 nt, Homo Sapiens; identical to SEQ ID NO: 37764

SEQ ID NO: 438067 - RNA, 60 nt, Homo Sapiens; identical to SEQ ID NO: 37765

SEQ ID NO: 438068 - RNA, 54 nt, Homo Sapiens; identical to SEQ ID NO: 37766

SEQ ID NO: 438069 - RNA, 60 nt, Homo Sapiens; identical to SEQ ID NO: 37767

SEQ ID NO: 438070 - RNA, 60 nt, Homo Sapiens; identical to SEQ ID NO: 37768

SEQ ID NO: 438071 - RNA, 60 nt, Homo Sapiens; identical to SEQ ID NO: 37769

SEQ ID NO: 438072 - RNA, 60 nt, Homo Sapiens; identical to SEQ ID NO: 37770

SEQ ID NO: 438073 - RNA, 60 nt, Homo Sapiens; identical to SEQ ID NO: 37771

SEQ ID NO: 438074 - RNA, 60 nt, Homo Sapiens; identical to SEQ ID NO: 37772

SEQ ID NO: 438075 - RNA, 60 nt, Homo Sapiens; identical to SEQ ID NO: 37773

SEQ ID NO: 438076 - RNA, 60 nt, Homo Sapiens; identical to SEQ ID NO: 37774

SEQ ID NO: 438077 - RNA, 60 nt, Homo Sapiens; identical to SEQ ID NO: 37775

SEQ ID NO: 438078 - RNA, 60 nt, Homo Sapiens; identical to SEQ ID NO: 37776

SEQ ID NO: 438079 - RNA, 60 nt, Homo Sapiens; identical to SEQ ID NO: 37777

SEQ ID NO: 438080 - RNA, 60 nt, Homo Sapiens; identical to SEQ ID NO: 37778

SEQ ID NO: 438081 - RNA, 60 nt, Homo Sapiens; identical to SEQ ID NO: 37779

SEQ ID NO: 438082 - RNA, 60 nt, Homo Sapiens; identical to SEQ ID NO: 37780

SEQ ID NO: 438083 - RNA, 60 nt, Homo Sapiens; identical to SEQ ID NO: 37781

SEQ ID NO: 438084 - RNA, 60 nt, Homo Sapiens; identical to SEQ ID NO: 37782

SEQ ID NO: 438085 - RNA, 60 nt, Homo Sapiens; identical to SEQ ID NO: 37783

SEQ ID NO: 438086 - RNA, 60 nt, Homo Sapiens; identical to SEQ ID NO: 37784

SEQ ID NO: 438087 - RNA, 60 nt, Homo Sapiens; identical to SEQ ID NO: 37785

SEQ ID NO: 438088 - RNA, 60 nt, Homo Sapiens; identical to SEQ ID NO: 37786

SEQ ID NO: 438089 - RNA, 60 nt, Homo Sapiens; identical to SEQ ID NO: 37787

SEQ ID NO: 438090 - RNA, 60 nt, Homo Sapiens; identical to SEQ ID NO: 37788

SEQ ID NO: 438091 - RNA, 60 nt, Homo Sapiens; identical to SEQ ID NO: 37789

SEQ ID NO: 438092 - RNA, 60 nt, Homo Sapiens; identical to SEQ ID NO: 37790

SEQ ID NO: 438093 - RNA, 60 nt, Homo Sapiens; identical to SEQ ID NO: 37791

SEQ ID NO: 438094 - RNA, 60 nt, Homo Sapiens; identical to SEQ ID NO: 37792

SEQ ID NO: 438095 - RNA, 60 nt, Homo Sapiens; identical to SEQ ID NO: 37793

SEQ ID NO: 438096 - RNA, 60 nt, Homo Sapiens; identical to SEQ ID NO: 37794

SEQ ID NO: 438097 - RNA, 60 nt, Homo Sapiens; identical to SEQ ID NO: 37795

SEQ ID NO: 438098 - RNA, 60 nt, Homo Sapiens; identical to SEQ ID NO: 37796

SEQ ID NO: 438099 - RNA, 60 nt, Homo Sapiens; identical to SEQ ID NO: 37797

SEQ ID NO: 438100 - RNA, 60 nt, Homo Sapiens; identical to SEQ ID NO: 37798

SEQ ID NO: 438101 - RNA, 60 nt, Homo Sapiens; identical to SEQ ID NO: 37799

SEQ ID NO: 438102 - RNA, 60 nt, Homo Sapiens; identical to SEQ ID NO: 37800

SEQ ID NO: 438103 - RNA, 60 nt, Homo Sapiens; identical to SEQ ID NO: 37801

SEQ ID NO: 438104 - RNA, 60 nt, Homo Sapiens; identical to SEQ ID NO: 37802

SEQ ID NO: 438105 - RNA, 60 nt, Homo Sapiens; identical to SEQ ID NO: 37803

SEQ ID NO: 438106 - RNA, 60 nt, Homo Sapiens; identical to SEQ ID NO: 37804

SEQ ID NO: 438107 - RNA, 60 nt, Homo Sapiens; identical to SEQ ID NO: 37805

SEQ ID NO: 438108 - RNA, 60 nt, Homo Sapiens; identical to SEQ ID NO: 37806

SEQ ID NO: 438109 - RNA, 60 nt, Homo Sapiens; identical to SEQ ID NO: 37807

SEQ ID NO: 438110 - RNA, 60 nt, Homo Sapiens; identical to SEQ ID NO: 37808

SEQ ID NO: 438111 - RNA, 60 nt, Homo Sapiens; identical to SEQ ID NO: 37809

SEQ ID NO: 438112 - RNA, 60 nt, Homo Sapiens; identical to SEQ ID NO: 37810

SEQ ID NO: 438113 - RNA, 60 nt, Homo Sapiens; identical to SEQ ID NO: 37811

SEQ ID NO: 438114 - RNA, 60 nt, Homo Sapiens; identical to SEQ ID NO: 37812

SEQ ID NO: 438115 - RNA, 60 nt, Homo Sapiens; identical to SEQ ID NO: 37813

SEQ ID NO: 438116 - RNA, 60 nt, Homo Sapiens; identical to SEQ ID NO: 37814

SEQ ID NO: 438117 - RNA, 60 nt, Homo Sapiens; identical to SEQ ID NO: 37815

SEQ ID NO: 438118 - RNA, 60 nt, Homo Sapiens; identical to SEQ ID NO: 37816

SEQ ID NO: 438119 - RNA, 60 nt, Homo Sapiens; identical to SEQ ID NO: 37817

SEQ ID NO: 438120 - RNA, 60 nt, Homo Sapiens; identical to SEQ ID NO: 37818

SEQ ID NO: 438121 - RNA, 60 nt, Homo Sapiens; identical to SEQ ID NO: 37819

SEQ ID NO: 438122 - RNA, 60 nt, Homo Sapiens; identical to SEQ ID NO: 37820

SEQ ID NO: 438123 - RNA, 60 nt, Homo Sapiens; identical to SEQ ID NO: 37821

SEQ ID NO: 438124 - RNA, 60 nt, Homo Sapiens; identical to SEQ ID NO: 37822

SEQ ID NO: 438125 - RNA, 60 nt, Homo Sapiens; identical to SEQ ID NO: 37823

SEQ ID NO: 438126 - RNA, 60 nt, Homo Sapiens; identical to SEQ ID NO: 37824

SEQ ID NO: 438127 - RNA, 60 nt, Homo Sapiens; identical to SEQ ID NO: 37825

SEQ ID NO: 438128 - RNA, 60 nt, Homo Sapiens; identical to SEQ ID NO: 37826

SEQ ID NO: 438129 - RNA, 60 nt, Homo Sapiens; identical to SEQ ID NO: 37827

SEQ ID NO: 438130 - RNA, 60 nt, Homo Sapiens; identical to SEQ ID NO: 37828

SEQ ID NO: 438131 - RNA, 60 nt, Homo Sapiens; identical to SEQ ID NO: 37829

SEQ ID NO: 438132 - RNA, 60 nt, Homo Sapiens; identical to SEQ ID NO: 37830

SEQ ID NO: 438133 - RNA, 60 nt, Homo Sapiens; identical to SEQ ID NO: 37831

SEQ ID NO: 438134 - RNA, 60 nt, Homo Sapiens; identical to SEQ ID NO: 37832

SEQ ID NO: 438135 - RNA, 60 nt, Homo Sapiens; identical to SEQ ID NO: 37833

SEQ ID NO: 438136 - RNA, 60 nt, Homo Sapiens; identical to SEQ ID NO: 37834

SEQ ID NO: 438137 - RNA, 60 nt, Homo Sapiens; identical to SEQ ID NO: 37835

SEQ ID NO: 438138 - RNA, 60 nt, Homo Sapiens; identical to SEQ ID NO: 37836

SEQ ID NO: 438139 - RNA, 60 nt, Homo Sapiens; identical to SEQ ID NO: 37837

SEQ ID NO: 438140 - RNA, 60 nt, Homo Sapiens; identical to SEQ ID NO: 37838

SEQ ID NO: 438141 - RNA, 60 nt, Homo Sapiens; identical to SEQ ID NO: 37839

SEQ ID NO: 438142 - RNA, 60 nt, Homo Sapiens; identical to SEQ ID NO: 37840

SEQ ID NO: 438143 - RNA, 60 nt, Homo Sapiens; identical to SEQ ID NO: 37841

SEQ ID NO: 438144 - RNA, 60 nt, Homo Sapiens; identical to SEQ ID NO: 37842

SEQ ID NO: 438145 - RNA, 60 nt, Homo Sapiens; identical to SEQ ID NO: 37843

SEQ ID NO: 438146 - RNA, 60 nt, Homo Sapiens; identical to SEQ ID NO: 37844

SEQ ID NO: 438147 - RNA, 60 nt, Homo Sapiens; identical to SEQ ID NO: 37845

SEQ ID NO: 438148 - RNA, 60 nt, Homo Sapiens; identical to SEQ ID NO: 37846

SEQ ID NO: 438149 - RNA, 60 nt, Homo Sapiens; identical to SEQ ID NO: 37847

SEQ ID NO: 438150 - RNA, 60 nt, Homo Sapiens; identical to SEQ ID NO: 37848

SEQ ID NO: 438151 - RNA, 60 nt, Homo Sapiens; identical to SEQ ID NO: 37849

SEQ ID NO: 438152 - RNA, 60 nt, Homo Sapiens; identical to SEQ ID NO: 37850

SEQ ID NO: 438153 - RNA, 60 nt, Homo Sapiens; identical to SEQ ID NO: 37851

SEQ ID NO: 438154 - RNA, 60 nt, Homo Sapiens; identical to SEQ ID NO: 37852

SEQ ID NO: 438155 - RNA, 60 nt, Homo Sapiens; identical to SEQ ID NO: 37853

SEQ ID NO: 438156 - RNA, 60 nt, Homo Sapiens; identical to SEQ ID NO: 37854

SEQ ID NO: 438157 - RNA, 60 nt, Homo Sapiens; identical to SEQ ID NO: 37855

SEQ ID NO: 438158 - RNA, 60 nt, Homo Sapiens; identical to SEQ ID NO: 37856

SEQ ID NO: 438159 - RNA, 60 nt, Homo Sapiens; identical to SEQ ID NO: 37857

SEQ ID NO: 438160 - RNA, 60 nt, Homo Sapiens; identical to SEQ ID NO: 37858

SEQ ID NO: 438161 - RNA, 60 nt, Homo Sapiens; identical to SEQ ID NO: 37859

SEQ ID NO: 438162 - RNA, 60 nt, Homo Sapiens; identical to SEQ ID NO: 37860

SEQ ID NO: 438163 - RNA, 60 nt, Homo Sapiens; identical to SEQ ID NO: 37861

SEQ ID NO: 438164 - RNA, 60 nt, Homo Sapiens; identical to SEQ ID NO: 37862

SEQ ID NO: 438165 - RNA, 60 nt, Homo Sapiens; identical to SEQ ID NO: 37863

SEQ ID NO: 438166 - RNA, 60 nt, Homo Sapiens; identical to SEQ ID NO: 37864

SEQ ID NO: 438167 - RNA, 60 nt, Homo Sapiens; identical to SEQ ID NO: 37865

SEQ ID NO: 438168 - RNA, 60 nt, Homo Sapiens; identical to SEQ ID NO: 37866

SEQ ID NO: 438169 - RNA, 60 nt, Homo Sapiens; identical to SEQ ID NO: 37867

SEQ ID NO: 438170 - RNA, 60 nt, Homo Sapiens; identical to SEQ ID NO: 37868

SEQ ID NO: 438171 - RNA, 60 nt, Homo Sapiens; identical to SEQ ID NO: 37869

SEQ ID NO: 438172 - RNA, 60 nt, Homo Sapiens; identical to SEQ ID NO: 37870

SEQ ID NO: 438173 - RNA, 60 nt, Homo Sapiens; identical to SEQ ID NO: 37871

SEQ ID NO: 438174 - RNA, 60 nt, Homo Sapiens; identical to SEQ ID NO: 37872

SEQ ID NO: 438175 - RNA, 60 nt, Homo Sapiens; identical to SEQ ID NO: 37873

SEQ ID NO: 438176 - RNA, 60 nt, Homo Sapiens; identical to SEQ ID NO: 37874

SEQ ID NO: 438177 - RNA, 60 nt, Homo Sapiens; identical to SEQ ID NO: 37875

SEQ ID NO: 438178 - RNA, 60 nt, Homo Sapiens; identical to SEQ ID NO: 37876

SEQ ID NO: 438179 - RNA, 60 nt, Homo Sapiens; identical to SEQ ID NO: 37877

SEQ ID NO: 438180 - RNA, 60 nt, Homo Sapiens; identical to SEQ ID NO: 37878

SEQ ID NO: 438181 - RNA, 60 nt, Homo Sapiens; identical to SEQ ID NO: 37879

SEQ ID NO: 438182 - RNA, 60 nt, Homo Sapiens; identical to SEQ ID NO: 37880

SEQ ID NO: 438183 - RNA, 60 nt, Homo Sapiens; identical to SEQ ID NO: 37881

SEQ ID NO: 438184 - RNA, 60 nt, Homo Sapiens; identical to SEQ ID NO: 37882

SEQ ID NO: 438185 - RNA, 60 nt, Homo Sapiens; identical to SEQ ID NO: 37883

SEQ ID NO: 438186 - RNA, 60 nt, Homo Sapiens; identical to SEQ ID NO: 37884

SEQ ID NO: 438187 - RNA, 60 nt, Homo Sapiens; identical to SEQ ID NO: 37885

SEQ ID NO: 438188 - RNA, 60 nt, Homo Sapiens; identical to SEQ ID NO: 37886

SEQ ID NO: 438189 - RNA, 60 nt, Homo Sapiens; identical to SEQ ID NO: 37887

SEQ ID NO: 438190 - RNA, 60 nt, Homo Sapiens; identical to SEQ ID NO: 37888

SEQ ID NO: 438191 - RNA, 60 nt, Homo Sapiens; identical to SEQ ID NO: 37889

SEQ ID NO: 438192 - RNA, 60 nt, Homo Sapiens; identical to SEQ ID NO: 37890

SEQ ID NO: 438193 - RNA, 60 nt, Homo Sapiens; identical to SEQ ID NO: 37891

SEQ ID NO: 438194 - RNA, 60 nt, Homo Sapiens; identical to SEQ ID NO: 37892

SEQ ID NO: 438195 - RNA, 60 nt, Homo Sapiens; identical to SEQ ID NO: 37893

SEQ ID NO: 438196 - RNA, 60 nt, Homo Sapiens; identical to SEQ ID NO: 37894

SEQ ID NO: 438197 - RNA, 60 nt, Homo Sapiens; identical to SEQ ID NO: 37895

SEQ ID NO: 438198 - RNA, 60 nt, Homo Sapiens; identical to SEQ ID NO: 37896

SEQ ID NO: 438199 - RNA, 60 nt, Homo Sapiens; identical to SEQ ID NO: 37897

SEQ ID NO: 438200 - RNA, 60 nt, Homo Sapiens; identical to SEQ ID NO: 37898

SEQ ID NO: 438201 - RNA, 60 nt, Homo Sapiens; identical to SEQ ID NO: 37899

SEQ ID NO: 438202 - RNA, 60 nt, Homo Sapiens; identical to SEQ ID NO: 37900

SEQ ID NO: 438203 - RNA, 60 nt, Homo Sapiens; identical to SEQ ID NO: 37901

SEQ ID NO: 438204 - RNA, 60 nt, Homo Sapiens; identical to SEQ ID NO: 37902

SEQ ID NO: 438205 - RNA, 60 nt, Homo Sapiens; identical to SEQ ID NO: 37903

SEQ ID NO: 438206 - RNA, 60 nt, Homo Sapiens; identical to SEQ ID NO: 37904

SEQ ID NO: 438207 - RNA, 60 nt, Homo Sapiens; identical to SEQ ID NO: 37905

SEQ ID NO: 438208 - RNA, 60 nt, Homo Sapiens; identical to SEQ ID NO: 37906

SEQ ID NO: 438209 - RNA, 60 nt, Homo Sapiens; identical to SEQ ID NO: 37907

SEQ ID NO: 438210 - RNA, 60 nt, Homo Sapiens; identical to SEQ ID NO: 37908

SEQ ID NO: 438211 - RNA, 60 nt, Homo Sapiens; identical to SEQ ID NO: 37909

SEQ ID NO: 438212 - RNA, 60 nt, Homo Sapiens; identical to SEQ ID NO: 37910

SEQ ID NO: 438213 - RNA, 60 nt, Homo Sapiens; identical to SEQ ID NO: 37911

SEQ ID NO: 438214 - RNA, 60 nt, Homo Sapiens; identical to SEQ ID NO: 37912

SEQ ID NO: 438215 - RNA, 60 nt, Homo Sapiens; identical to SEQ ID NO: 37913

SEQ ID NO: 438216 - RNA, 60 nt, Homo Sapiens; identical to SEQ ID NO: 37914

SEQ ID NO: 438217 - RNA, 60 nt, Homo Sapiens; identical to SEQ ID NO: 37915

SEQ ID NO: 438218 - RNA, 60 nt, Homo Sapiens; identical to SEQ ID NO: 37916

SEQ ID NO: 438219 - RNA, 60 nt, Homo Sapiens; identical to SEQ ID NO: 37917

SEQ ID NO: 438220 - RNA, 60 nt, Homo Sapiens; identical to SEQ ID NO: 37918

SEQ ID NO: 438221 - RNA, 60 nt, Homo Sapiens; identical to SEQ ID NO: 37919

SEQ ID NO: 438222 - RNA, 60 nt, Homo Sapiens; identical to SEQ ID NO: 37920

SEQ ID NO: 438223 - RNA, 60 nt, Homo Sapiens; identical to SEQ ID NO: 37921

SEQ ID NO: 438224 - RNA, 60 nt, Homo Sapiens; identical to SEQ ID NO: 37922

SEQ ID NO: 438225 - RNA, 60 nt, Homo Sapiens; identical to SEQ ID NO: 37923

SEQ ID NO: 438226 - RNA, 60 nt, Homo Sapiens; identical to SEQ ID NO: 37924

SEQ ID NO: 438227 - RNA, 60 nt, Homo Sapiens; identical to SEQ ID NO: 37925

SEQ ID NO: 438228 - RNA, 60 nt, Homo Sapiens; identical to SEQ ID NO: 37926

SEQ ID NO: 438229 - RNA, 60 nt, Homo Sapiens; identical to SEQ ID NO: 37927

SEQ ID NO: 438230 - RNA, 60 nt, Homo Sapiens; identical to SEQ ID NO: 37928

SEQ ID NO: 438231 - RNA, 60 nt, Homo Sapiens; identical to SEQ ID NO: 37929

SEQ ID NO: 438232 - RNA, 60 nt, Homo Sapiens; identical to SEQ ID NO: 37930

SEQ ID NO: 438233 - RNA, 60 nt, Homo Sapiens; identical to SEQ ID NO: 37931

SEQ ID NO: 438234 - RNA, 60 nt, Homo Sapiens; identical to SEQ ID NO: 37932

SEQ ID NO: 438235 - RNA, 60 nt, Homo Sapiens; identical to SEQ ID NO: 37933

SEQ ID NO: 438236 - RNA, 60 nt, Homo Sapiens; identical to SEQ ID NO: 37934

SEQ ID NO: 438237 - RNA, 60 nt, Homo Sapiens; identical to SEQ ID NO: 37935

SEQ ID NO: 438238 - RNA, 60 nt, Homo Sapiens; identical to SEQ ID NO: 37936

SEQ ID NO: 438239 - RNA, 60 nt, Homo Sapiens; identical to SEQ ID NO: 37937

SEQ ID NO: 438240 - RNA, 60 nt, Homo Sapiens; identical to SEQ ID NO: 37938

SEQ ID NO: 438241 - RNA, 60 nt, Homo Sapiens; identical to SEQ ID NO: 37939

SEQ ID NO: 438242 - RNA, 60 nt, Homo Sapiens; identical to SEQ ID NO: 37940

SEQ ID NO: 438243 - RNA, 60 nt, Homo Sapiens; identical to SEQ ID NO: 37941

SEQ ID NO: 438244 - RNA, 60 nt, Homo Sapiens; identical to SEQ ID NO: 37942

SEQ ID NO: 438245 - RNA, 60 nt, Homo Sapiens; identical to SEQ ID NO: 37943

SEQ ID NO: 438246 - RNA, 60 nt, Homo Sapiens; identical to SEQ ID NO: 37944

SEQ ID NO: 438247 - RNA, 60 nt, Homo Sapiens; identical to SEQ ID NO: 37945

SEQ ID NO: 438248 - RNA, 60 nt, Homo Sapiens; identical to SEQ ID NO: 37946

SEQ ID NO: 438249 - RNA, 60 nt, Homo Sapiens; identical to SEQ ID NO: 37947

SEQ ID NO: 438250 - RNA, 60 nt, Homo Sapiens; identical to SEQ ID NO: 37948

SEQ ID NO: 438251 - RNA, 60 nt, Homo Sapiens; identical to SEQ ID NO: 37949

SEQ ID NO: 438252 - RNA, 60 nt, Homo Sapiens; identical to SEQ ID NO: 37950

SEQ ID NO: 438253 - RNA, 60 nt, Homo Sapiens; identical to SEQ ID NO: 37951

SEQ ID NO: 438254 - RNA, 60 nt, Homo Sapiens; identical to SEQ ID NO: 37952

SEQ ID NO: 438255 - RNA, 60 nt, Homo Sapiens; identical to SEQ ID NO: 37953

SEQ ID NO: 438256 - RNA, 60 nt, Homo Sapiens; identical to SEQ ID NO: 37954

SEQ ID NO: 438257 - RNA, 60 nt, Homo Sapiens; identical to SEQ ID NO: 37955

SEQ ID NO: 438258 - RNA, 60 nt, Homo Sapiens; identical to SEQ ID NO: 37956

SEQ ID NO: 438259 - RNA, 60 nt, Homo Sapiens; identical to SEQ ID NO: 37957

SEQ ID NO: 438260 - RNA, 60 nt, Homo Sapiens; identical to SEQ ID NO: 37958

SEQ ID NO: 438261 - RNA, 60 nt, Homo Sapiens; identical to SEQ ID NO: 37959

SEQ ID NO: 438262 - RNA, 60 nt, Homo Sapiens; identical to SEQ ID NO: 37960

SEQ ID NO: 438263 - RNA, 54 nt, Homo Sapiens; identical to SEQ ID NO: 37961

SEQ ID NO: 438264 - RNA, 60 nt, Homo Sapiens; identical to SEQ ID NO: 37962

SEQ ID NO: 438265 - RNA, 60 nt, Homo Sapiens; identical to SEQ ID NO: 37963

SEQ ID NO: 438266 - RNA, 60 nt, Homo Sapiens; identical to SEQ ID NO: 37964

SEQ ID NO: 438267 - RNA, 60 nt, Homo Sapiens; identical to SEQ ID NO: 37965

SEQ ID NO: 438268 - RNA, 60 nt, Homo Sapiens; identical to SEQ ID NO: 37966

SEQ ID NO: 438269 - RNA, 60 nt, Homo Sapiens; identical to SEQ ID NO: 37967

SEQ ID NO: 438270 - RNA, 60 nt, Homo Sapiens; identical to SEQ ID NO: 37968

SEQ ID NO: 438271 - RNA, 60 nt, Homo Sapiens; identical to SEQ ID NO: 37969

SEQ ID NO: 438272 - RNA, 60 nt, Homo Sapiens; identical to SEQ ID NO: 37970

SEQ ID NO: 438273 - RNA, 60 nt, Homo Sapiens; identical to SEQ ID NO: 37971

SEQ ID NO: 438274 - RNA, 60 nt, Homo Sapiens; identical to SEQ ID NO: 37972

SEQ ID NO: 438275 - RNA, 60 nt, Homo Sapiens; identical to SEQ ID NO: 37973

SEQ ID NO: 438276 - RNA, 60 nt, Homo Sapiens; identical to SEQ ID NO: 37974

SEQ ID NO: 438277 - RNA, 60 nt, Homo Sapiens; identical to SEQ ID NO: 37975

SEQ ID NO: 438278 - RNA, 60 nt, Homo Sapiens; identical to SEQ ID NO: 37976

SEQ ID NO: 438279 - RNA, 60 nt, Homo Sapiens; identical to SEQ ID NO: 37977

SEQ ID NO: 438280 - RNA, 60 nt, Homo Sapiens; identical to SEQ ID NO: 37978

SEQ ID NO: 438281 - RNA, 60 nt, Homo Sapiens; identical to SEQ ID NO: 37979

SEQ ID NO: 438282 - RNA, 60 nt, Homo Sapiens; identical to SEQ ID NO: 37980

SEQ ID NO: 438283 - RNA, 60 nt, Homo Sapiens; identical to SEQ ID NO: 37981

SEQ ID NO: 438284 - RNA, 60 nt, Homo Sapiens; identical to SEQ ID NO: 37982

SEQ ID NO: 438285 - RNA, 60 nt, Homo Sapiens; identical to SEQ ID NO: 37983

SEQ ID NO: 438286 - RNA, 60 nt, Homo Sapiens; identical to SEQ ID NO: 37984

SEQ ID NO: 438287 - RNA, 60 nt, Homo Sapiens; identical to SEQ ID NO: 37985

SEQ ID NO: 438288 - RNA, 60 nt, Homo Sapiens; identical to SEQ ID NO: 37986

SEQ ID NO: 438289 - RNA, 60 nt, Homo Sapiens; identical to SEQ ID NO: 37987

SEQ ID NO: 438290 - RNA, 60 nt, Homo Sapiens; identical to SEQ ID NO: 37988

SEQ ID NO: 438291 - RNA, 60 nt, Homo Sapiens; identical to SEQ ID NO: 37989

SEQ ID NO: 438292 - RNA, 60 nt, Homo Sapiens; identical to SEQ ID NO: 37990

SEQ ID NO: 438293 - RNA, 60 nt, Homo Sapiens; identical to SEQ ID NO: 37991

SEQ ID NO: 438294 - RNA, 60 nt, Homo Sapiens; identical to SEQ ID NO: 37992

SEQ ID NO: 438295 - RNA, 60 nt, Homo Sapiens; identical to SEQ ID NO: 37993

SEQ ID NO: 438296 - RNA, 60 nt, Homo Sapiens; identical to SEQ ID NO: 37994

SEQ ID NO: 438297 - RNA, 52 nt, Homo Sapiens; identical to SEQ ID NO: 37995

SEQ ID NO: 438298 - RNA, 60 nt, Homo Sapiens; identical to SEQ ID NO: 37996

SEQ ID NO: 438299 - RNA, 60 nt, Homo Sapiens; identical to SEQ ID NO: 37997

SEQ ID NO: 438300 - RNA, 60 nt, Homo Sapiens; identical to SEQ ID NO: 37998

SEQ ID NO: 438301 - RNA, 60 nt, Homo Sapiens; identical to SEQ ID NO: 37999

SEQ ID NO: 438302 - RNA, 60 nt, Homo Sapiens; identical to SEQ ID NO: 38000

SEQ ID NO: 438303 - RNA, 60 nt, Homo Sapiens; identical to SEQ ID NO: 38001

SEQ ID NO: 438304 - RNA, 60 nt, Homo Sapiens; identical to SEQ ID NO: 38002

SEQ ID NO: 438305 - RNA, 60 nt, Homo Sapiens; identical to SEQ ID NO: 38003

SEQ ID NO: 438306 - RNA, 60 nt, Homo Sapiens; identical to SEQ ID NO: 38004

SEQ ID NO: 438307 - RNA, 60 nt, Homo Sapiens; identical to SEQ ID NO: 38005

SEQ ID NO: 438308 - RNA, 60 nt, Homo Sapiens; identical to SEQ ID NO: 38006

SEQ ID NO: 438309 - RNA, 60 nt, Homo Sapiens; identical to SEQ ID NO: 38007

SEQ ID NO: 438310 - RNA, 60 nt, Homo Sapiens; identical to SEQ ID NO: 38008

SEQ ID NO: 438311 - RNA, 60 nt, Homo Sapiens; identical to SEQ ID NO: 38009

SEQ ID NO: 438312 - RNA, 60 nt, Homo Sapiens; identical to SEQ ID NO: 38010

SEQ ID NO: 438313 - RNA, 60 nt, Homo Sapiens; identical to SEQ ID NO: 38011

SEQ ID NO: 438314 - RNA, 60 nt, Homo Sapiens; identical to SEQ ID NO: 38012

SEQ ID NO: 438315 - RNA, 60 nt, Homo Sapiens; identical to SEQ ID NO: 38013

SEQ ID NO: 438316 - RNA, 60 nt, Homo Sapiens; identical to SEQ ID NO: 38014

SEQ ID NO: 438317 - RNA, 60 nt, Homo Sapiens; identical to SEQ ID NO: 38015

SEQ ID NO: 438318 - RNA, 60 nt, Homo Sapiens; identical to SEQ ID NO: 38016

SEQ ID NO: 438319 - RNA, 60 nt, Homo Sapiens; identical to SEQ ID NO: 38017

SEQ ID NO: 438320 - RNA, 60 nt, Homo Sapiens; identical to SEQ ID NO: 38018

SEQ ID NO: 438321 - RNA, 60 nt, Homo Sapiens; identical to SEQ ID NO: 38019

SEQ ID NO: 438322 - RNA, 60 nt, Homo Sapiens; identical to SEQ ID NO: 38020

SEQ ID NO: 438323 - RNA, 60 nt, Homo Sapiens; identical to SEQ ID NO: 38021

SEQ ID NO: 438324 - RNA, 60 nt, Homo Sapiens; identical to SEQ ID NO: 38022

SEQ ID NO: 438325 - RNA, 60 nt, Homo Sapiens; identical to SEQ ID NO: 38023

SEQ ID NO: 438326 - RNA, 60 nt, Homo Sapiens; identical to SEQ ID NO: 38024

SEQ ID NO: 438327 - RNA, 60 nt, Homo Sapiens; identical to SEQ ID NO: 38025

SEQ ID NO: 438328 - RNA, 60 nt, Homo Sapiens; identical to SEQ ID NO: 38026

SEQ ID NO: 438329 - RNA, 60 nt, Homo Sapiens; identical to SEQ ID NO: 38027

SEQ ID NO: 438330 - RNA, 60 nt, Homo Sapiens; identical to SEQ ID NO: 38028

SEQ ID NO: 438331 - RNA, 60 nt, Homo Sapiens; identical to SEQ ID NO: 38029

SEQ ID NO: 438332 - RNA, 60 nt, Homo Sapiens; identical to SEQ ID NO: 38030

SEQ ID NO: 438333 - RNA, 60 nt, Homo Sapiens; identical to SEQ ID NO: 38031

SEQ ID NO: 438334 - RNA, 60 nt, Homo Sapiens; identical to SEQ ID NO: 38032

SEQ ID NO: 438335 - RNA, 60 nt, Homo Sapiens; identical to SEQ ID NO: 38033

SEQ ID NO: 438336 - RNA, 60 nt, Homo Sapiens; identical to SEQ ID NO: 38034

SEQ ID NO: 438337 - RNA, 60 nt, Homo Sapiens; identical to SEQ ID NO: 38035

SEQ ID NO: 438338 - RNA, 60 nt, Homo Sapiens; identical to SEQ ID NO: 38036

SEQ ID NO: 438339 - RNA, 60 nt, Homo Sapiens; identical to SEQ ID NO: 38037

SEQ ID NO: 438340 - RNA, 60 nt, Homo Sapiens; identical to SEQ ID NO: 38038

SEQ ID NO: 438341 - RNA, 60 nt, Homo Sapiens; identical to SEQ ID NO: 38039

SEQ ID NO: 438342 - RNA, 60 nt, Homo Sapiens; identical to SEQ ID NO: 38040

SEQ ID NO: 438343 - RNA, 60 nt, Homo Sapiens; identical to SEQ ID NO: 38041

SEQ ID NO: 438344 - RNA, 60 nt, Homo Sapiens; identical to SEQ ID NO: 38042

SEQ ID NO: 438345 - RNA, 60 nt, Homo Sapiens; identical to SEQ ID NO: 38043

SEQ ID NO: 438346 - RNA, 60 nt, Homo Sapiens; identical to SEQ ID NO: 38044

SEQ ID NO: 438347 - RNA, 60 nt, Homo Sapiens; identical to SEQ ID NO: 38045

SEQ ID NO: 438348 - RNA, 60 nt, Homo Sapiens; identical to SEQ ID NO: 38046

SEQ ID NO: 438349 - RNA, 60 nt, Homo Sapiens; identical to SEQ ID NO: 38047

SEQ ID NO: 438350 - RNA, 60 nt, Homo Sapiens; identical to SEQ ID NO: 38048

SEQ ID NO: 438351 - RNA, 60 nt, Homo Sapiens; identical to SEQ ID NO: 38049

SEQ ID NO: 438352 - RNA, 60 nt, Homo Sapiens; identical to SEQ ID NO: 38050

SEQ ID NO: 438353 - RNA, 60 nt, Homo Sapiens; identical to SEQ ID NO: 38051

SEQ ID NO: 438354 - RNA, 60 nt, Homo Sapiens; identical to SEQ ID NO: 38052

SEQ ID NO: 438355 - RNA, 60 nt, Homo Sapiens; identical to SEQ ID NO: 38053

SEQ ID NO: 438356 - RNA, 60 nt, Homo Sapiens; identical to SEQ ID NO: 38054

SEQ ID NO: 438357 - RNA, 60 nt, Homo Sapiens; identical to SEQ ID NO: 38055

SEQ ID NO: 438358 - RNA, 60 nt, Homo Sapiens; identical to SEQ ID NO: 38056

SEQ ID NO: 438359 - RNA, 60 nt, Homo Sapiens; identical to SEQ ID NO: 38057

SEQ ID NO: 438360 - RNA, 60 nt, Homo Sapiens; identical to SEQ ID NO: 38058

SEQ ID NO: 438361 - RNA, 60 nt, Homo Sapiens; identical to SEQ ID NO: 38059

SEQ ID NO: 438362 - RNA, 60 nt, Homo Sapiens; identical to SEQ ID NO: 38060

SEQ ID NO: 438363 - RNA, 60 nt, Homo Sapiens; identical to SEQ ID NO: 38061

SEQ ID NO: 438364 - RNA, 60 nt, Homo Sapiens; identical to SEQ ID NO: 38062

SEQ ID NO: 438365 - RNA, 60 nt, Homo Sapiens; identical to SEQ ID NO: 38063

SEQ ID NO: 438366 - RNA, 60 nt, Homo Sapiens; identical to SEQ ID NO: 38064

SEQ ID NO: 438367 - RNA, 60 nt, Homo Sapiens; identical to SEQ ID NO: 38065

SEQ ID NO: 438368 - RNA, 60 nt, Homo Sapiens; identical to SEQ ID NO: 38066

SEQ ID NO: 438369 - RNA, 60 nt, Homo Sapiens; identical to SEQ ID NO: 38067

SEQ ID NO: 438370 - RNA, 60 nt, Homo Sapiens; identical to SEQ ID NO: 38068

SEQ ID NO: 438371 - RNA, 60 nt, Homo Sapiens; identical to SEQ ID NO: 38069

SEQ ID NO: 438372 - RNA, 60 nt, Homo Sapiens; identical to SEQ ID NO: 38070

SEQ ID NO: 438373 - RNA, 60 nt, Homo Sapiens; identical to SEQ ID NO: 38071

SEQ ID NO: 438374 - RNA, 60 nt, Homo Sapiens; identical to SEQ ID NO: 38072

SEQ ID NO: 438375 - RNA, 60 nt, Homo Sapiens; identical to SEQ ID NO: 38073

SEQ ID NO: 438376 - RNA, 60 nt, Homo Sapiens; identical to SEQ ID NO: 38074

SEQ ID NO: 438377 - RNA, 60 nt, Homo Sapiens; identical to SEQ ID NO: 38075

SEQ ID NO: 438378 - RNA, 60 nt, Homo Sapiens; identical to SEQ ID NO: 38076

SEQ ID NO: 438379 - RNA, 60 nt, Homo Sapiens; identical to SEQ ID NO: 38077

SEQ ID NO: 438380 - RNA, 60 nt, Homo Sapiens; identical to SEQ ID NO: 38078

SEQ ID NO: 438381 - RNA, 60 nt, Homo Sapiens; identical to SEQ ID NO: 38079

SEQ ID NO: 438382 - RNA, 60 nt, Homo Sapiens; identical to SEQ ID NO: 38080

SEQ ID NO: 438383 - RNA, 60 nt, Homo Sapiens; identical to SEQ ID NO: 38081

SEQ ID NO: 438384 - RNA, 60 nt, Homo Sapiens; identical to SEQ ID NO: 38082

SEQ ID NO: 438385 - RNA, 60 nt, Homo Sapiens; identical to SEQ ID NO: 38083

SEQ ID NO: 438386 - RNA, 60 nt, Homo Sapiens; identical to SEQ ID NO: 38084

SEQ ID NO: 438387 - RNA, 60 nt, Homo Sapiens; identical to SEQ ID NO: 38085

SEQ ID NO: 438388 - RNA, 60 nt, Homo Sapiens; identical to SEQ ID NO: 38086

SEQ ID NO: 438389 - RNA, 60 nt, Homo Sapiens; identical to SEQ ID NO: 38087

SEQ ID NO: 438390 - RNA, 60 nt, Homo Sapiens; identical to SEQ ID NO: 38088

SEQ ID NO: 438391 - RNA, 60 nt, Homo Sapiens; identical to SEQ ID NO: 38089

SEQ ID NO: 438392 - RNA, 60 nt, Homo Sapiens; identical to SEQ ID NO: 38090

SEQ ID NO: 438393 - RNA, 60 nt, Homo Sapiens; identical to SEQ ID NO: 38091

SEQ ID NO: 438394 - RNA, 60 nt, Homo Sapiens; identical to SEQ ID NO: 38092

SEQ ID NO: 438395 - RNA, 60 nt, Homo Sapiens; identical to SEQ ID NO: 38093

SEQ ID NO: 438396 - RNA, 60 nt, Homo Sapiens; identical to SEQ ID NO: 38094

SEQ ID NO: 438397 - RNA, 60 nt, Homo Sapiens; identical to SEQ ID NO: 38095

SEQ ID NO: 438398 - RNA, 60 nt, Homo Sapiens; identical to SEQ ID NO: 38096

SEQ ID NO: 438399 - RNA, 60 nt, Homo Sapiens; identical to SEQ ID NO: 38097

SEQ ID NO: 438400 - RNA, 60 nt, Homo Sapiens; identical to SEQ ID NO: 38098

SEQ ID NO: 438401 - RNA, 60 nt, Homo Sapiens; identical to SEQ ID NO: 38099

SEQ ID NO: 438402 - RNA, 60 nt, Homo Sapiens; identical to SEQ ID NO: 38100

SEQ ID NO: 438403 - RNA, 60 nt, Homo Sapiens; identical to SEQ ID NO: 38101

SEQ ID NO: 438404 - RNA, 60 nt, Homo Sapiens; identical to SEQ ID NO: 38102

SEQ ID NO: 438405 - RNA, 60 nt, Homo Sapiens; identical to SEQ ID NO: 38103

SEQ ID NO: 438406 - RNA, 60 nt, Homo Sapiens; identical to SEQ ID NO: 38104

SEQ ID NO: 438407 - RNA, 60 nt, Homo Sapiens; identical to SEQ ID NO: 38105

SEQ ID NO: 438408 - RNA, 60 nt, Homo Sapiens; identical to SEQ ID NO: 38106

SEQ ID NO: 438409 - RNA, 60 nt, Homo Sapiens; identical to SEQ ID NO: 38107

SEQ ID NO: 438410 - RNA, 60 nt, Homo Sapiens; identical to SEQ ID NO: 38108

SEQ ID NO: 438411 - RNA, 60 nt, Homo Sapiens; identical to SEQ ID NO: 38109

SEQ ID NO: 438412 - RNA, 60 nt, Homo Sapiens; identical to SEQ ID NO: 38110

SEQ ID NO: 438413 - RNA, 60 nt, Homo Sapiens; identical to SEQ ID NO: 38111

SEQ ID NO: 438414 - RNA, 60 nt, Homo Sapiens; identical to SEQ ID NO: 38112

SEQ ID NO: 438415 - RNA, 60 nt, Homo Sapiens; identical to SEQ ID NO: 38113

SEQ ID NO: 438416 - RNA, 60 nt, Homo Sapiens; identical to SEQ ID NO: 38114

SEQ ID NO: 438417 - RNA, 60 nt, Homo Sapiens; identical to SEQ ID NO: 38115

SEQ ID NO: 438418 - RNA, 60 nt, Homo Sapiens; identical to SEQ ID NO: 38116

SEQ ID NO: 438419 - RNA, 60 nt, Homo Sapiens; identical to SEQ ID NO: 38117

SEQ ID NO: 438420 - RNA, 60 nt, Homo Sapiens; identical to SEQ ID NO: 38118

SEQ ID NO: 438421 - RNA, 60 nt, Homo Sapiens; identical to SEQ ID NO: 38119

SEQ ID NO: 438422 - RNA, 60 nt, Homo Sapiens; identical to SEQ ID NO: 38120

SEQ ID NO: 438423 - RNA, 60 nt, Homo Sapiens; identical to SEQ ID NO: 38121

SEQ ID NO: 438424 - RNA, 60 nt, Homo Sapiens; identical to SEQ ID NO: 38122

SEQ ID NO: 438425 - RNA, 60 nt, Homo Sapiens; identical to SEQ ID NO: 38123

SEQ ID NO: 438426 - RNA, 60 nt, Homo Sapiens; identical to SEQ ID NO: 38124

SEQ ID NO: 438427 - RNA, 60 nt, Homo Sapiens; identical to SEQ ID NO: 38125

SEQ ID NO: 438428 - RNA, 60 nt, Homo Sapiens; identical to SEQ ID NO: 38126

SEQ ID NO: 438429 - RNA, 60 nt, Homo Sapiens; identical to SEQ ID NO: 38127

SEQ ID NO: 438430 - RNA, 60 nt, Homo Sapiens; identical to SEQ ID NO: 38128

SEQ ID NO: 438431 - RNA, 60 nt, Homo Sapiens; identical to SEQ ID NO: 38129

SEQ ID NO: 438432 - RNA, 60 nt, Homo Sapiens; identical to SEQ ID NO: 38130

SEQ ID NO: 438433 - RNA, 60 nt, Homo Sapiens; identical to SEQ ID NO: 38131

SEQ ID NO: 438434 - RNA, 60 nt, Homo Sapiens; identical to SEQ ID NO: 38132

SEQ ID NO: 438435 - RNA, 60 nt, Homo Sapiens; identical to SEQ ID NO: 38133

SEQ ID NO: 438436 - RNA, 60 nt, Homo Sapiens; identical to SEQ ID NO: 38134

SEQ ID NO: 438437 - RNA, 60 nt, Homo Sapiens; identical to SEQ ID NO: 38135

SEQ ID NO: 438438 - RNA, 60 nt, Homo Sapiens; identical to SEQ ID NO: 38136

SEQ ID NO: 438439 - RNA, 60 nt, Homo Sapiens; identical to SEQ ID NO: 38137

SEQ ID NO: 438440 - RNA, 60 nt, Homo Sapiens; identical to SEQ ID NO: 38138

SEQ ID NO: 438441 - RNA, 60 nt, Homo Sapiens; identical to SEQ ID NO: 38139

SEQ ID NO: 438442 - RNA, 64 nt, Homo Sapiens
acuuggcuucuuuaaccaagaauauuauuggaaaauucucuaaaaguuaauaggguaaauucuc

SEQ ID NO: 438443 - RNA, 64 nt, Homo Sapiens
uuauuggaaaauucucuaaaaguuaauaggguaaauucucuauuuuuuguaauguguucgguga

SEQ ID NO: 438444 - RNA, 64 nt, Homo Sapiens
gaccucagaguuccuguaucagggagauugucugauucucuaauaaaagacacauugcugaccu

SEQ ID NO: 438445 - RNA, 64 nt, Homo Sapiens
uuuaaaaaaacaagaaaugcauguuucaaauaaaauucucuauuguaaauaaaauuuuuucuuu

SEQ ID NO: 438446 - RNA, 64 nt, Homo Sapiens
aaaugaugugaaaggaaaguaucauggguguggcauucucuaacgauuguaauaauguuacaug

SEQ ID NO: 438447 - RNA, 64 nt, Homo Sapiens
guuuugauuuuuggauuuucuugauuuuuaauguauucucuacuaagguuuacaaauuaaaugc

SEQ ID NO: 438448 - RNA, 64 nt, Homo Sapiens
uaucagauucauucauucagugaagcagccucugauucucuaagagucacgaaugucuuagugu

SEQ ID NO: 438449 - RNA, 64 nt, Homo Sapiens
uuguucucuuguucauaacauuucucugcaaagaauucucuauggagugaagcgaaugaaguga

SEQ ID NO: 438450 - RNA, 64 nt, Homo Sapiens; identical to SEQ ID NO: 204913

SEQ ID NO: 438451 - RNA, 64 nt, Homo Sapiens; identical to SEQ ID NO: 204914

SEQ ID NO: 438452 - RNA, 64 nt, Homo Sapiens; identical to SEQ ID NO: 204915

SEQ ID NO: 438453 - RNA, 64 nt, Homo Sapiens; identical to SEQ ID NO: 204916

SEQ ID NO: 438454 - RNA, 64 nt, Homo Sapiens; identical to SEQ ID NO: 204917

SEQ ID NO: 438455 - RNA, 64 nt, Homo Sapiens; identical to SEQ ID NO: 204918

SEQ ID NO: 438456 - RNA, 64 nt, Homo Sapiens; identical to SEQ ID NO: 204919

SEQ ID NO: 438457 - RNA, 64 nt, Homo Sapiens; identical to SEQ ID NO: 204920

SEQ ID NO: 438458 - RNA, 64 nt, Homo Sapiens; identical to SEQ ID NO: 204921

SEQ ID NO: 438459 - RNA, 64 nt, Homo Sapiens; identical to SEQ ID NO: 204922

SEQ ID NO: 438460 - RNA, 64 nt, Homo Sapiens; identical to SEQ ID NO: 204923

SEQ ID NO: 438461 - RNA, 64 nt, Homo Sapiens; identical to SEQ ID NO: 204924

SEQ ID NO: 438462 - RNA, 64 nt, Homo Sapiens; identical to SEQ ID NO: 204925

SEQ ID NO: 438463 - RNA, 64 nt, Homo Sapiens; identical to SEQ ID NO: 204926

SEQ ID NO: 438464 - RNA, 64 nt, Homo Sapiens; identical to SEQ ID NO: 204927

SEQ ID NO: 438465 - RNA, 64 nt, Homo Sapiens; identical to SEQ ID NO: 204928

SEQ ID NO: 438466 - RNA, 64 nt, Homo Sapiens; identical to SEQ ID NO: 204929

SEQ ID NO: 438467 - RNA, 64 nt, Homo Sapiens; identical to SEQ ID NO: 204930

SEQ ID NO: 438468 - RNA, 64 nt, Homo Sapiens; identical to SEQ ID NO: 204931

SEQ ID NO: 438469 - RNA, 64 nt, Homo Sapiens; identical to SEQ ID NO: 204932

SEQ ID NO: 438470 - RNA, 64 nt, Homo Sapiens; identical to SEQ ID NO: 204933

SEQ ID NO: 438471 - RNA, 64 nt, Homo Sapiens; identical to SEQ ID NO: 204934

SEQ ID NO: 438472 - RNA, 64 nt, Homo Sapiens; identical to SEQ ID NO: 204935

SEQ ID NO: 438473 - RNA, 64 nt, Homo Sapiens; identical to SEQ ID NO: 204936

SEQ ID NO: 438474 - RNA, 64 nt, Homo Sapiens; identical to SEQ ID NO: 204937

SEQ ID NO: 438475 - RNA, 64 nt, Homo Sapiens; identical to SEQ ID NO: 204938

SEQ ID NO: 438476 - RNA, 64 nt, Homo Sapiens; identical to SEQ ID NO: 204939

SEQ ID NO: 438477 - RNA, 64 nt, Homo Sapiens; identical to SEQ ID NO: 204940

SEQ ID NO: 438478 - RNA, 64 nt, Homo Sapiens; identical to SEQ ID NO: 204941

SEQ ID NO: 438479 - RNA, 64 nt, Homo Sapiens
ccugaggaggauugagggugaaagucucccacgaguacacuaaaccuaggucuggucaccaaua

SEQ ID NO: 438480 - RNA, 64 nt, Homo Sapiens
caacuuucuccuuguauuucaaaggccaggccauguacacuaacguccuugaaauuugcaguuc

SEQ ID NO: 438481 - RNA, 64 nt, Homo Sapiens
aaugugcaccugagggugcuuuguguaauauauuguacacuacagcaucuuauauuuuuugagu

SEQ ID NO: 438482 - RNA, 64 nt, Homo Sapiens
aauaugucaagggagucaauuucugaccaaucaaguacacuaaauuagaauauuuuuaaaguau

SEQ ID NO: 438483 - RNA, 64 nt, Homo Sapiens
acuauuuugaaugaaucagaaugucaacuuguauguacacuauaucuacacuuacucauuauuu

SEQ ID NO: 438484 - RNA, 64 nt, Homo Sapiens
ccuuaugagaaaaccuguguggacaucccuugguguacacuaagacagagcagagcccagcgcu

SEQ ID NO: 438485 - RNA, 64 nt, Homo Sapiens
uaucuaguagagcuuguuuaggaaacugagaaacguacacuaucauugcuaaacuaacaguccu

SEQ ID NO: 438486 - RNA, 64 nt, Homo Sapiens
cauuuaccauuauuuauaccuuaaugacucaaagguacacuauacuguuaucuuuuaagacauu

SEQ ID NO: 438487 - RNA, 64 nt, Homo Sapiens
aaucuccuuaauucuauaaacuaugaacuuugauguacacuauacaaaauugcaaauaaauaag

SEQ ID NO: 438488 - RNA, 64 nt, Homo Sapiens
acuaaguuuuuggcugacugguuuaaagcaguuuguacacuaaaacucugaagauguauaugua

SEQ ID NO: 438489 - RNA, 64 nt, Homo Sapiens
aauuuucuaucaaccuuaaaaggucaugaaauagguacacuaauacuuccuuuuaggcgauggc

SEQ ID NO: 438490 - RNA, 64 nt, Homo Sapiens
uaaaaagcaccuuauccuuucucccauaaccuuuguacacuaaaaaaugaaagaauuuagaaug

SEQ ID NO: 438491 - RNA, 64 nt, Homo Sapiens
uuuuuguacugcugguccuguuauccagguacucguacacuauuacuauugcaaaacgggugua

SEQ ID NO: 438492 - RNA, 64 nt, Homo Sapiens
aaugugcugaguuagaauuaagaucuuggcaaugguacacuacauuuuccugcuuccuaccuca

SEQ ID NO: 438493 - RNA, 64 nt, Homo Sapiens
auauuaucuauuaaaauauuauguauauucagauguacacuaaucuaauggaacauuuuggcaa

SEQ ID NO: 438494 - RNA, 64 nt, Homo Sapiens
uuuuuauuaauccauguacaugaguauaucaucaguacacuagcguuugacaauuaguaagcaa

SEQ ID NO: 438495 - RNA, 64 nt, Homo Sapiens
acaaaccaaauuaaaagaaauuguuuuucuuucaguacacuaagguguguguuuucaaaaccaa

SEQ ID NO: 438496 - RNA, 64 nt, Homo Sapiens
ucuugggccauggacauccccacuuccagcccauguacacuaguggcccacgaccaaggggucu

SEQ ID NO: 438497 - RNA, 64 nt, Homo Sapiens
ugcaagcuuguucagggggcugagaagauccugaguacacuaggugcaaaccagaacucuuggu

SEQ ID NO: 438498 - RNA, 64 nt, Homo Sapiens
uuuuuucuuuuucauuuuuuuaaaagauugagugguacacuaauaaaugagaguuugaaauuag

SEQ ID NO: 438499 - RNA, 64 nt, Homo Sapiens
cauucugauuuuaguauauguguuguggaagugaguacacuaucauccacuuuuaaugacagaa

SEQ ID NO: 438500 - RNA, 64 nt, Homo Sapiens
caagagguauaucgaugauggaaauuagccacauguacacuacauuuuuucuaauaaagccauu

SEQ ID NO: 438501 - RNA, 64 nt, Homo Sapiens
ucuaaugcccaaaugccagcugcaauggcuguguguacacuacaaacccacuguacuuggggcc

SEQ ID NO: 438502 - RNA, 64 nt, Homo Sapiens
guuuacuuuucaucuguaaaccuucauuaucacgguacacuauuuaguaauaugacaaagugau

SEQ ID NO: 438503 - RNA, 64 nt, Homo Sapiens
gcuaauccuaauaaauccgacuaaaggaaucaguguacacuacaacauauguauccauuuagag

SEQ ID NO: 438504 - RNA, 64 nt, Homo Sapiens
uaucugccuuuaccuacauauacuaacacgcauuguacacuaucccaaacuauucuauggccau

SEQ ID NO: 438505 - RNA, 64 nt, Homo Sapiens
agauguguuuuguucaaaauuuaaauuuguugugguacacuaucuuauguaaccugucugguga

SEQ ID NO: 438506 - RNA, 64 nt, Homo Sapiens
ugugggagguaaggaaaaggauuuagagguaaaaguacacuaaguuugcaacauuuauugagau

SEQ ID NO: 438507 - RNA, 64 nt, Homo Sapiens
gguauguccuaacauggaguuaacuggaauagcaguacacuagcaaguaucugugaauccuuag

SEQ ID NO: 438508 - RNA, 64 nt, Homo Sapiens
auauuuagaagcugaacuuagugaaacaauuauuguacacuaacuauucaaauguaauuaugag

SEQ ID NO: 438509 - RNA, 64 nt, Homo Sapiens
gaugcuguuuguuguacugacuuuuuaucaaaguguacacuacuuucuacuaagcuaaaaauuc

SEQ ID NO: 438510 - RNA, 64 nt, Homo Sapiens
auuaucugucccugaaauaauagacagaucuuaaguacacuagauuacaggaauguuaaauacu

SEQ ID NO: 438511 - RNA, 64 nt, Homo Sapiens
auuuucugaaagcagaaaaccuaagcuguacaugguacacuagauuuaacugaaaaagaaauau

SEQ ID NO: 438512 - RNA, 64 nt, Homo Sapiens
accauuaacuuauaucccaaguccauuuuuuccuguacacuacaaacaaaagauauauuagaga

SEQ ID NO: 438513 - RNA, 64 nt, Homo Sapiens
cccguucuacucaccuaagugccgccugacccuuguacacuaggagcuggccucccaccucugc

SEQ ID NO: 438514 - RNA, 64 nt, Homo Sapiens
gagaaaugggagcacaguacacugagaaaugggaguacacuacucugagaagugggagcacagu

SEQ ID NO: 438515 - RNA, 64 nt, Homo Sapiens
auuucccccgagcucuuggcuucugaucagagguguacacuaacucguguggaucuugccacau

SEQ ID NO: 438516 - RNA, 64 nt, Homo Sapiens
cagugguuguggacaaccauauuuuaguucauauguacacuagcguuucuccccaaaucuagaa

SEQ ID NO: 438517 - RNA, 64 nt, Homo Sapiens
uauuauuuuccaguaaauaugcuucaaaccaugaguacacuauuaggcccuacaacuuuguuuu

SEQ ID NO: 438518 - RNA, 64 nt, Homo Sapiens
uguguuuucucuuggcucuuugggucuuucccggguacacuagauggcuccaucccaaggcauc

SEQ ID NO: 438519 - RNA, 63 nt, Homo Sapiens
gcaaaaccaacggcccuuuugcuuaccucuacaguacacuaccuuuauggcuucggcggcuga

SEQ ID NO: 438520 - RNA, 64 nt, Homo Sapiens
auauaauacagaauugucuuaauaagaacauauuguacacuauuuccuuuauuucuacaucuaa

SEQ ID NO: 438521 - RNA, 64 nt, Homo Sapiens
uuugaagccaauauuucuguauauacuguguuuaguacacuaauacaaugguauucaacauucu

SEQ ID NO: 438522 - RNA, 64 nt, Homo Sapiens
ccauacuuccuuagcuuauaaacuauugugaacaguacacuauaggaacuggugaauaauaauu

SEQ ID NO: 438523 - RNA, 64 nt, Homo Sapiens
uuuaguaggggacaagaagucuguucuucagugaguacacuagagauuuacucuggugacugcc

SEQ ID NO: 438524 - RNA, 64 nt, Homo Sapiens
guucuaugucaaaaucaaaaauuuugugaaaguuguacacuaauacuguuuuuaucacugauuu

SEQ ID NO: 438525 - RNA, 64 nt, Homo Sapiens
aaacccaaaauguaguucucuauuaaccugaaauguacacuagcccagaacaguuuaaugguac

SEQ ID NO: 438526 - RNA, 64 nt, Homo Sapiens
uagcaaguugauacucauguugggucauuuacauguacacuacaggaugcuagaggugaauauu

SEQ ID NO: 438527 - RNA, 64 nt, Homo Sapiens
uucuaggucagucuaacagugagacugaaauuuaguacacuaugaugagcauuuagcacaauuu

SEQ ID NO: 438528 - RNA, 64 nt, Homo Sapiens
aucguugaagagcaauagaauuuuauauuucaaaguacacuaagguuccaaugauaauuauuac

SEQ ID NO: 438529 - RNA, 64 nt, Homo Sapiens
uuugcauaaaauaagagcuguaaacuuuuauauuguacacuauuucaaaacagcaggaaauuuu

SEQ ID NO: 438530 - RNA, 64 nt, Homo Sapiens
cugguguggggcuuuuauugauagugugaagauuguacacuauauuacaugaucagaucauaca

SEQ ID NO: 438531 - RNA, 64 nt, Homo Sapiens
agaagucuggcuuugcucuauuaagauuggaaauguacacuaccaaacacucaguccacuguug

SEQ ID NO: 438532 - RNA, 64 nt, Homo Sapiens
agagcguccugcggucucgcuggcacagcgccccguacacuaggggguccuacagcuacguggc

SEQ ID NO: 438533 - RNA, 64 nt, Homo Sapiens
uuacaugaucagaucauacaacagugugaagauuguacacuacacuggcauggggcuuuuauug

SEQ ID NO: 438534 - RNA, 64 nt, Homo Sapiens
uuaauuauuguacauuuauagcuugugucaaacaguacacuaucauucuagucuauuuguugau

SEQ ID NO: 438535 - RNA, 64 nt, Homo Sapiens
uuauagaguuuauuuuugcuuuaaauaaugcacaguacacuagaaaauaaaauauaugugcuua

SEQ ID NO: 438536 - RNA, 64 nt, Homo Sapiens
cucuucuugcuuuugcauuacagcuguacaguucguacacuaaaccaagauagagcuacaaacu

SEQ ID NO: 438537 - RNA, 64 nt, Homo Sapiens
augucccugcuauuucuggauuuaugaggcaaugguacacuaaagaauggaaucaguucaguga

SEQ ID NO: 438538 - RNA, 64 nt, Homo Sapiens
accuucaauccagaguuacacaaaaaggagauauguacacuagagacaucaaaccaggggacau

SEQ ID NO: 438539 - RNA, 64 nt, Homo Sapiens
acuugcuuuccagucugauucacguuagcaguguguacacuacuguaucaucaucagcuucauc

SEQ ID NO: 438540 - RNA, 64 nt, Homo Sapiens
uaaugguuauacauggcauacaaugcauacaguaguacacuauuaaugaaauaugcaaaugauc

SEQ ID NO: 438541 - RNA, 64 nt, Homo Sapiens
cauaguuuaacuuuuuuuaacagcuuuauaaauaguacacuaaauaguucagaaauaauucucc

SEQ ID NO: 438542 - RNA, 64 nt, Homo Sapiens
uuuaugacagugcauaauuugcaaaauaaaaaauguacacuagcauaauauuuguggcauaucc

SEQ ID NO: 438543 - RNA, 64 nt, Homo Sapiens
uggcacauaugcgcucaauauugaguauguauuuguacacuaucguucugaggauugauacguu

SEQ ID NO: 438544 - RNA, 64 nt, Homo Sapiens
guguuucacugaccauacauuaaggcauuuaaggguacacuacuacuggauggauggucuuuua

SEQ ID NO: 438545 - RNA, 64 nt, Homo Sapiens
agacuuugauaaaaagaaacauagcgcugguacaguacacuaaauuuaaaaaaauaacuacagu

SEQ ID NO: 438546 - RNA, 64 nt, Homo Sapiens
uucauuuaaaggggaaaguuagguugggaggauuguacacuacuucacagcaccuggcccgcca

SEQ ID NO: 438547 - RNA, 64 nt, Homo Sapiens
gaauugacguuuaugauuuaacacaauuugcacuguacacuaguauuugauguauuuacucaaa

SEQ ID NO: 438548 - RNA, 64 nt, Homo Sapiens
gguuguuuuaguugggccuuuucuagaggcuuguguacacuacuaucauauuaaaagugaauuc

SEQ ID NO: 438549 - RNA, 64 nt, Homo Sapiens
gggacccugagaacuccucucagaaaauagacagguacacuaaaccuacacauuucccaucaau

SEQ ID NO: 438550 - RNA, 64 nt, Homo Sapiens
uuauucuuuagucagaucuaaauauaccgcuucuguacacuaauguuuauagguauuuauagca

SEQ ID NO: 438551 - RNA, 64 nt, Homo Sapiens
gaauaaguguaggaguuuuaguuuuccauugaguguacacuacugcuguuauuaaugccuuuuu

SEQ ID NO: 438552 - RNA, 64 nt, Homo Sapiens
uggaacaccuaucagggagcagaaaaggggugcaguacacuaagugaacccagauucuggauuc

SEQ ID NO: 438553 - RNA, 64 nt, Homo Sapiens
aauaaaaccgaggguuguugauuuugcugugacaguacacuaaaucaauacuauaucuuauaca

SEQ ID NO: 438554 - RNA, 64 nt, Homo Sapiens
uuguuuuuaacuuauuuuuuuuuuaacaacuguaguacacuacccugagacacugcaucucgau

SEQ ID NO: 438555 - RNA, 64 nt, Homo Sapiens
uugaacuggacuggucucagaacacccucguggaguacacuaauugaccuugcugggcacagaa

SEQ ID NO: 438556 - RNA, 64 nt, Homo Sapiens
gauguaguaagaaccugggaaaugccaggagcugguacacuacauagagucagaccagaaugaa

SEQ ID NO: 438557 - RNA, 64 nt, Homo Sapiens
ggcauuaaaauucacugugcccagcacaugggugguacacuaauuaugacuucccccagcucug

SEQ ID NO: 438558 - RNA, 64 nt, Homo Sapiens
aaguuccaggggagcccaggaccccuggggaccuguacacuagcaggaugggucuugggaguug

SEQ ID NO: 438559 - RNA, 64 nt, Homo Sapiens
cuccggucauuugugccuuucucuugucaucucuguacacuacuuauauucacuguggguuggg

SEQ ID NO: 438560 - RNA, 64 nt, Homo Sapiens
ccuuucccaccacaaauuaucaacugguugauguguacacuaauuacauuucaggaggacuuaa

SEQ ID NO: 438561 - RNA, 64 nt, Homo Sapiens
cacuggacagcaucagaaaugaauaugcaaggcgguacacuacguuauguuuauuucauguggu

SEQ ID NO: 438562 - RNA, 64 nt, Homo Sapiens
augcauauauguuguauuuuauacguauuuuacaguacacuaauuaaaacuuauuuugcaauua

SEQ ID NO: 438563 - RNA, 64 nt, Homo Sapiens
acgagggucagauuucccaugucuauaaaaucugguacacuauggacaccgccuucucaagccu

SEQ ID NO: 438564 - RNA, 64 nt, Homo Sapiens
caggugaaugcugacuuuuucuaguguccuuuuuguacacuaaacugauauuuucuuaaaagau

SEQ ID NO: 438565 - RNA, 64 nt, Homo Sapiens
gaaauaugucuucuuuccagucagaggaguuguaguacacuacagcagguaagcuuuacagcuu

SEQ ID NO: 438566 - RNA, 64 nt, Homo Sapiens
gaccuuuuuuccuguucacauguaucaggaaaguguacacuauuggcauugcaaugaagugcuu

SEQ ID NO: 438567 - RNA, 64 nt, Homo Sapiens
acccaggcacagccccgccaccauggaucuccguguacacuaucaauaaaaguggguuuguuac

SEQ ID NO: 438568 - RNA, 64 nt, Homo Sapiens; identical to SEQ ID NO: 392709

SEQ ID NO: 438569 - RNA, 64 nt, Homo Sapiens; identical to SEQ ID NO: 392710

SEQ ID NO: 438570 - RNA, 64 nt, Homo Sapiens; identical to SEQ ID NO: 392711

SEQ ID NO: 438571 - RNA, 64 nt, Homo Sapiens; identical to SEQ ID NO: 392712

SEQ ID NO: 438572 - RNA, 64 nt, Homo Sapiens; identical to SEQ ID NO: 392713

SEQ ID NO: 438573 - RNA, 64 nt, Homo Sapiens; identical to SEQ ID NO: 392714

SEQ ID NO: 438574 - RNA, 64 nt, Homo Sapiens; identical to SEQ ID NO: 392715

SEQ ID NO: 438575 - RNA, 64 nt, Homo Sapiens; identical to SEQ ID NO: 392716

SEQ ID NO: 438576 - RNA, 64 nt, Homo Sapiens; identical to SEQ ID NO: 438479

SEQ ID NO: 438577 - RNA, 64 nt, Homo Sapiens; identical to SEQ ID NO: 438480

SEQ ID NO: 438578 - RNA, 64 nt, Homo Sapiens; identical to SEQ ID NO: 438481

SEQ ID NO: 438579 - RNA, 64 nt, Homo Sapiens; identical to SEQ ID NO: 438482

SEQ ID NO: 438580 - RNA, 64 nt, Homo Sapiens; identical to SEQ ID NO: 438483

SEQ ID NO: 438581 - RNA, 64 nt, Homo Sapiens; identical to SEQ ID NO: 438484

SEQ ID NO: 438582 - RNA, 64 nt, Homo Sapiens; identical to SEQ ID NO: 438485

SEQ ID NO: 438583 - RNA, 64 nt, Homo Sapiens; identical to SEQ ID NO: 438486

SEQ ID NO: 438584 - RNA, 64 nt, Homo Sapiens; identical to SEQ ID NO: 438487

SEQ ID NO: 438585 - RNA, 64 nt, Homo Sapiens; identical to SEQ ID NO: 438488

SEQ ID NO: 438586 - RNA, 64 nt, Homo Sapiens; identical to SEQ ID NO: 438489

SEQ ID NO: 438587 - RNA, 64 nt, Homo Sapiens; identical to SEQ ID NO: 438490

SEQ ID NO: 438588 - RNA, 64 nt, Homo Sapiens; identical to SEQ ID NO: 438491

SEQ ID NO: 438589 - RNA, 64 nt, Homo Sapiens; identical to SEQ ID NO: 438492

SEQ ID NO: 438590 - RNA, 64 nt, Homo Sapiens; identical to SEQ ID NO: 438493

SEQ ID NO: 438591 - RNA, 64 nt, Homo Sapiens; identical to SEQ ID NO: 438494

SEQ ID NO: 438592 - RNA, 64 nt, Homo Sapiens; identical to SEQ ID NO: 438495

SEQ ID NO: 438593 - RNA, 64 nt, Homo Sapiens; identical to SEQ ID NO: 438496

SEQ ID NO: 438594 - RNA, 64 nt, Homo Sapiens; identical to SEQ ID NO: 438497

SEQ ID NO: 438595 - RNA, 64 nt, Homo Sapiens; identical to SEQ ID NO: 438498

SEQ ID NO: 438596 - RNA, 64 nt, Homo Sapiens; identical to SEQ ID NO: 438499

SEQ ID NO: 438597 - RNA, 64 nt, Homo Sapiens; identical to SEQ ID NO: 438500

SEQ ID NO: 438598 - RNA, 64 nt, Homo Sapiens; identical to SEQ ID NO: 438501

SEQ ID NO: 438599 - RNA, 64 nt, Homo Sapiens; identical to SEQ ID NO: 438502

SEQ ID NO: 438600 - RNA, 64 nt, Homo Sapiens; identical to SEQ ID NO: 438503

SEQ ID NO: 438601 - RNA, 64 nt, Homo Sapiens; identical to SEQ ID NO: 438504

SEQ ID NO: 438602 - RNA, 64 nt, Homo Sapiens; identical to SEQ ID NO: 438505

SEQ ID NO: 438603 - RNA, 64 nt, Homo Sapiens; identical to SEQ ID NO: 438506

SEQ ID NO: 438604 - RNA, 64 nt, Homo Sapiens; identical to SEQ ID NO: 438507

SEQ ID NO: 438605 - RNA, 64 nt, Homo Sapiens; identical to SEQ ID NO: 438508

SEQ ID NO: 438606 - RNA, 64 nt, Homo Sapiens; identical to SEQ ID NO: 438509

SEQ ID NO: 438607 - RNA, 64 nt, Homo Sapiens; identical to SEQ ID NO: 438510

SEQ ID NO: 438608 - RNA, 64 nt, Homo Sapiens; identical to SEQ ID NO: 438511

SEQ ID NO: 438609 - RNA, 64 nt, Homo Sapiens; identical to SEQ ID NO: 438512

SEQ ID NO: 438610 - RNA, 64 nt, Homo Sapiens; identical to SEQ ID NO: 438513

SEQ ID NO: 438611 - RNA, 64 nt, Homo Sapiens; identical to SEQ ID NO: 438514

SEQ ID NO: 438612 - RNA, 64 nt, Homo Sapiens; identical to SEQ ID NO: 438515

SEQ ID NO: 438613 - RNA, 64 nt, Homo Sapiens; identical to SEQ ID NO: 438516

SEQ ID NO: 438614 - RNA, 64 nt, Homo Sapiens; identical to SEQ ID NO: 438517

SEQ ID NO: 438615 - RNA, 64 nt, Homo Sapiens; identical to SEQ ID NO: 438518

SEQ ID NO: 438616 - RNA, 63 nt, Homo Sapiens; identical to SEQ ID NO: 438519

SEQ ID NO: 438617 - RNA, 64 nt, Homo Sapiens; identical to SEQ ID NO: 438520

SEQ ID NO: 438618 - RNA, 64 nt, Homo Sapiens; identical to SEQ ID NO: 438521

SEQ ID NO: 438619 - RNA, 64 nt, Homo Sapiens; identical to SEQ ID NO: 438522

SEQ ID NO: 438620 - RNA, 64 nt, Homo Sapiens; identical to SEQ ID NO: 438523

SEQ ID NO: 438621 - RNA, 64 nt, Homo Sapiens; identical to SEQ ID NO: 438524

SEQ ID NO: 438622 - RNA, 64 nt, Homo Sapiens; identical to SEQ ID NO: 438525

SEQ ID NO: 438623 - RNA, 64 nt, Homo Sapiens; identical to SEQ ID NO: 438526

SEQ ID NO: 438624 - RNA, 64 nt, Homo Sapiens; identical to SEQ ID NO: 438527

SEQ ID NO: 438625 - RNA, 64 nt, Homo Sapiens; identical to SEQ ID NO: 438528

SEQ ID NO: 438626 - RNA, 64 nt, Homo Sapiens; identical to SEQ ID NO: 438529

SEQ ID NO: 438627 - RNA, 64 nt, Homo Sapiens; identical to SEQ ID NO: 438530

SEQ ID NO: 438628 - RNA, 64 nt, Homo Sapiens; identical to SEQ ID NO: 438531

SEQ ID NO: 438629 - RNA, 64 nt, Homo Sapiens; identical to SEQ ID NO: 438532

SEQ ID NO: 438630 - RNA, 64 nt, Homo Sapiens; identical to SEQ ID NO: 438533

SEQ ID NO: 438631 - RNA, 64 nt, Homo Sapiens; identical to SEQ ID NO: 438534

SEQ ID NO: 438632 - RNA, 64 nt, Homo Sapiens; identical to SEQ ID NO: 438535

SEQ ID NO: 438633 - RNA, 64 nt, Homo Sapiens; identical to SEQ ID NO: 438536

SEQ ID NO: 438634 - RNA, 64 nt, Homo Sapiens; identical to SEQ ID NO: 438537

SEQ ID NO: 438635 - RNA, 64 nt, Homo Sapiens; identical to SEQ ID NO: 438538

SEQ ID NO: 438636 - RNA, 64 nt, Homo Sapiens; identical to SEQ ID NO: 438539

SEQ ID NO: 438637 - RNA, 64 nt, Homo Sapiens; identical to SEQ ID NO: 438540

SEQ ID NO: 438638 - RNA, 64 nt, Homo Sapiens; identical to SEQ ID NO: 438541

SEQ ID NO: 438639 - RNA, 64 nt, Homo Sapiens; identical to SEQ ID NO: 438542

SEQ ID NO: 438640 - RNA, 64 nt, Homo Sapiens; identical to SEQ ID NO: 438543

SEQ ID NO: 438641 - RNA, 64 nt, Homo Sapiens; identical to SEQ ID NO: 438544

SEQ ID NO: 438642 - RNA, 64 nt, Homo Sapiens; identical to SEQ ID NO: 438545

SEQ ID NO: 438643 - RNA, 64 nt, Homo Sapiens; identical to SEQ ID NO: 438546

SEQ ID NO: 438644 - RNA, 64 nt, Homo Sapiens; identical to SEQ ID NO: 438547

SEQ ID NO: 438645 - RNA, 64 nt, Homo Sapiens; identical to SEQ ID NO: 438548

SEQ ID NO: 438646 - RNA, 64 nt, Homo Sapiens; identical to SEQ ID NO: 438549

SEQ ID NO: 438647 - RNA, 64 nt, Homo Sapiens; identical to SEQ ID NO: 438550

SEQ ID NO: 438648 - RNA, 64 nt, Homo Sapiens; identical to SEQ ID NO: 438551

SEQ ID NO: 438649 - RNA, 64 nt, Homo Sapiens; identical to SEQ ID NO: 438552

SEQ ID NO: 438650 - RNA, 64 nt, Homo Sapiens; identical to SEQ ID NO: 438553

SEQ ID NO: 438651 - RNA, 64 nt, Homo Sapiens; identical to SEQ ID NO: 438554

SEQ ID NO: 438652 - RNA, 64 nt, Homo Sapiens; identical to SEQ ID NO: 438555

SEQ ID NO: 438653 - RNA, 64 nt, Homo Sapiens; identical to SEQ ID NO: 438556

SEQ ID NO: 438654 - RNA, 64 nt, Homo Sapiens; identical to SEQ ID NO: 438557

SEQ ID NO: 438655 - RNA, 64 nt, Homo Sapiens; identical to SEQ ID NO: 438558

SEQ ID NO: 438656 - RNA, 64 nt, Homo Sapiens; identical to SEQ ID NO: 438559

SEQ ID NO: 438657 - RNA, 64 nt, Homo Sapiens; identical to SEQ ID NO: 438560

SEQ ID NO: 438658 - RNA, 64 nt, Homo Sapiens; identical to SEQ ID NO: 438561

SEQ ID NO: 438659 - RNA, 64 nt, Homo Sapiens; identical to SEQ ID NO: 438562

SEQ ID NO: 438660 - RNA, 64 nt, Homo Sapiens; identical to SEQ ID NO: 438563

SEQ ID NO: 438661 - RNA, 64 nt, Homo Sapiens; identical to SEQ ID NO: 438564

SEQ ID NO: 438662 - RNA, 64 nt, Homo Sapiens; identical to SEQ ID NO: 438565

SEQ ID NO: 438663 - RNA, 64 nt, Homo Sapiens; identical to SEQ ID NO: 438566

SEQ ID NO: 438664 - RNA, 64 nt, Homo Sapiens; identical to SEQ ID NO: 438567

SEQ ID NO: 438665 - RNA, 64 nt, Homo Sapiens; identical to SEQ ID NO: 392709

SEQ ID NO: 438666 - RNA, 64 nt, Homo Sapiens; identical to SEQ ID NO: 392710

SEQ ID NO: 438667 - RNA, 64 nt, Homo Sapiens; identical to SEQ ID NO: 392711

SEQ ID NO: 438668 - RNA, 64 nt, Homo Sapiens; identical to SEQ ID NO: 392712

SEQ ID NO: 438669 - RNA, 64 nt, Homo Sapiens; identical to SEQ ID NO: 392713

SEQ ID NO: 438670 - RNA, 64 nt, Homo Sapiens; identical to SEQ ID NO: 392714

SEQ ID NO: 438671 - RNA, 64 nt, Homo Sapiens; identical to SEQ ID NO: 392715

SEQ ID NO: 438672 - RNA, 64 nt, Homo Sapiens; identical to SEQ ID NO: 392716

SEQ ID NO: 438673 - RNA, 64 nt, Homo Sapiens
uuauauauacuuaauaaaaccuuuguaaauauuacccuguaauauuauuuaaaaaaaaacauaa

SEQ ID NO: 438674 - RNA, 64 nt, Homo Sapiens
auacguaauucuuccuguuuacugcucaccaauacccuguaaaaguaauuugccacgcuuuuug

SEQ ID NO: 438675 - RNA, 64 nt, Homo Sapiens
guuuuacuuuuuuaaagcugaguaguuaagaauucccuguaaaaacaaaacccuguaaauugag

SEQ ID NO: 438676 - RNA, 64 nt, Homo Sapiens
gcugaguaguuaagaauucccuguaaaaacaaaacccuguaaauugagccucaugucugguaua

SEQ ID NO: 438677 - RNA, 64 nt, Homo Sapiens
uaauuugaagauucuuuaacuaaaaaccaaacaucccuguaauuccauuuuacuguguuugagu

SEQ ID NO: 438678 - RNA, 64 nt, Homo Sapiens
uuaagacguuuccaaggaaagcccaccuugucuucccuguaaguuuuguagcucugcauauuuu

SEQ ID NO: 438679 - RNA, 64 nt, Homo Sapiens
ugugcagugugagggccuggcccccaccccagggcccuguaagcucuaggcugccagcucacag

SEQ ID NO: 438680 - RNA, 64 nt, Homo Sapiens
cagacaguuuguucaaaaccgugcucucccucaccccuguaagcacaucaccacccauugucag

SEQ ID NO: 438681 - RNA, 64 nt, Homo Sapiens
uaguuaauauuauccccauuaauccucaaaaugacccuguaaaacuuuaugauuguugagcauu

SEQ ID NO: 438682 - RNA, 64 nt, Homo Sapiens
aaggugaaaugccagagacccuuccuuaccacaucccuguaaguaugccuacacgaucucauuu

SEQ ID NO: 438683 - RNA, 62 nt, Homo Sapiens
uuuguauaggaagugcuauuucucauaggcuguuucuugaaauuuuaaguuuauugcuuuaa

SEQ ID NO: 438684 - RNA, 62 nt, Homo Sapiens
uguugaacagaauuggaguauuuucuuuauaauuucuugaacaggcaaaugaaagcuuauua

SEQ ID NO: 438685 - RNA, 62 nt, Homo Sapiens
aauuaaaauauuaaauaacauauuuauggcauuuucuugaagagugugguugaagaaauauu

SEQ ID NO: 438686 - RNA, 62 nt, Homo Sapiens
uuaggagcaaaucuccccagggguguacgguauuucuugacucugggaacagcugcuacccc

SEQ ID NO: 438687 - RNA, 62 nt, Homo Sapiens
uagaauauucucuuauuauuuauauuuuuauauuucuugaaagaugguaaguuucuugaagu

SEQ ID NO: 438688 - RNA, 62 nt, Homo Sapiens
uuauauuuuuauauuucuugaaagaugguaaguuucuugaaguuuuuggggcguuucucuuu

SEQ ID NO: 438689 - RNA, 62 nt, Homo Sapiens
aucaacaaggugcauauaaaccauccuaugccuuucuugaaaugugcauuuuaagaaguuau

SEQ ID NO: 438690 - RNA, 62 nt, Homo Sapiens
agauuuagaaagccuuaugcacucuuuguguuuuucuugaaacuugcuguaguaacuuuuug

SEQ ID NO: 438691 - RNA, 62 nt, Homo Sapiens
gaccauuguuaaauuuaauuauaguguauuucuuucuugaauuucagucugcugcuuuguaa

SEQ ID NO: 438692 - RNA, 62 nt, Homo Sapiens
uauuuauaaaaugacaaacuuggaccacaggcuuucuugaccuuguacaguauaguaaaaau

SEQ ID NO: 438693 - RNA, 62 nt, Homo Sapiens
guaucaauauuuacuuuaaucacaaaggaugguuucuugaaauaauuuguauugauugaggc

SEQ ID NO: 438694 - RNA, 62 nt, Homo Sapiens
uauaauuuuguaggaaaaauaugcaucuauuuuuucuugacuucuuuuauauaguaauaaaa

SEQ ID NO: 438695 - RNA, 62 nt, Homo Sapiens
aacaguucuguuaauauuguuguuuaacacauuuucuugaguuagccugaguuugcuguuaa

SEQ ID NO: 438696 - RNA, 62 nt, Homo Sapiens
guauauauuguuacugaauucuauauacugcuuuucuugacuucuagcuuuucaagugauga

SEQ ID NO: 438697 - RNA, 62 nt, Homo Sapiens
auuggaggaccaaaaaaauaugaauuaucccuuuucuugacugugguaagagaauguuauag

SEQ ID NO: 438698 - RNA, 62 nt, Homo Sapiens
acuggaauuuuuauuaugcaaaauuuuguaauuuucuugaugagaaaucauguuaugauaaa

SEQ ID NO: 438699 - RNA, 62 nt, Homo Sapiens
uuuguuuuaaaauuaaagcuuggagauaaagauuucuugaguaaugcuguauucuucuuugg

SEQ ID NO: 438700 - RNA, 62 nt, Homo Sapiens
agagaauauuagcuuuacugagacaaauucuguuucuugagacauuggcuauuuaaagacaa

SEQ ID NO: 438701 - RNA, 62 nt, Homo Sapiens
cucccugcacugcauucgcacaaacugcuuccuuucuugauucguagauuuaauaacuuacc

SEQ ID NO: 438702 - RNA, 62 nt, Homo Sapiens
auucguagauuuaauaacuuaccugaagggguuuucuugauaauuuuccuuuaauaugaaau

SEQ ID NO: 438703 - RNA, 62 nt, Homo Sapiens
guugaugucaauaacaguauaaaacagcccuauuucuugauaaaaaaugacaaaugacuguc

SEQ ID NO: 438704 - RNA, 62 nt, Homo Sapiens
cuuccaaaugacaucuacagcauacuuaucaauuucuugaugaaaguaauuuuaauucacca

SEQ ID NO: 438705 - RNA, 62 nt, Homo Sapiens
augcugagacccaauuuggaucuguggcuugauuucuugaauuagcaauacaaguacacauu

SEQ ID NO: 438706 - RNA, 62 nt, Homo Sapiens
aaaaccugaauagccaugacaagaguuugcauuuucuugaugauucaucuccaugagugcac

SEQ ID NO: 438707 - RNA, 62 nt, Homo Sapiens
gcaccucaaaugaacagacuugguuuccuugcuuucuugacauuuccaugacuguuucacau

SEQ ID NO: 438708 - RNA, 62 nt, Homo Sapiens
cggagucuuggucuugucacucuuguuuuuguuuucuugagaaauuuauuuuaauauggauu

SEQ ID NO: 438709 - RNA, 62 nt, Homo Sapiens
guuuuaacuaagugagaaauuucuaaauauuuuuucuugaaaauacaagagucuuuaaguca

SEQ ID NO: 438710 - RNA, 62 nt, Homo Sapiens
gucuucagggaacugagcuaauacuuuuuuuuuuucuugauguuuucuugaaaagccuuucu

SEQ ID NO: 438711 - RNA, 62 nt, Homo Sapiens
acugagcuaauacuuuuuuuuuuucuugauguuuucuugaaaagccuuucuguugcaacuau

SEQ ID NO: 438712 - RNA, 62 nt, Homo Sapiens
uuaaaaugaaaauaauuacugcuauuuuaaaauuucuugaucauugaaugugagacccuucu

SEQ ID NO: 438713 - RNA, 62 nt, Homo Sapiens
cuuuggaauuuugcauucgagguauacugucauuucuugaaaucuuuuucucguuuaguugc

SEQ ID NO: 438714 - RNA, 62 nt, Homo Sapiens
uugcuaaauuaccaagcaaagcagacaaucuuuuucuugaaauuaccuccauucuuacuuug

SEQ ID NO: 438715 - RNA, 62 nt, Homo Sapiens
cuuaguguccagauaugucacuauuacucauuuuucuugacaguucaaauggauuuuugugc

SEQ ID NO: 438716 - RNA, 62 nt, Homo Sapiens
aggucuggaacagcucuagauuuuuuccuuuuuuucuugauuaaaacaugguuuuguuuuuu

SEQ ID NO: 438717 - RNA, 62 nt, Homo Sapiens
cccgccccuuucuuuccccgcucuggcaaggcuuucuugagccugggcugccaggucagccu

SEQ ID NO: 438718 - RNA, 62 nt, Homo Sapiens
uguuuauaguuuuuaaauaaaagacugaacauuuucuugaguccuucauuucugaguaugcu

SEQ ID NO: 438719 - RNA, 62 nt, Homo Sapiens
uuggcuaaaagcuuuuauuguuugauguuguguuucuugacuguuuauucagaaucacagug

SEQ ID NO: 438720 - RNA, 62 nt, Homo Sapiens
gugacuuagugcauugauucagauuuuuaaaauuucuugaugugguuuguaauaaucaaaua

SEQ ID NO: 438721 - RNA, 62 nt, Homo Sapiens
ucagauuuuuauuuuuaaaauauuuucauuuuuuucuugaauuuuauauccguuuguucacu

SEQ ID NO: 438722 - RNA, 62 nt, Homo Sapiens
auaucacaagugauugaagcccccagcccccuuuucuugaccaauagauacaagccuaggag

SEQ ID NO: 438723 - RNA, 62 nt, Homo Sapiens
ccauuuuaaacaacccuuguggguguacggcuuuucuugagcuuuguguaggaacauaacaa

SEQ ID NO: 438724 - RNA, 62 nt, Homo Sapiens
uuugggagguuaauaccaagguuauucuacauuuucuugaaagcuaauuauauacaucugua

SEQ ID NO: 438725 - RNA, 62 nt, Homo Sapiens
uuugggagguuaauaccaagguuauucuacauuuucuugaaacuaauuaauauacaucugua

SEQ ID NO: 438726 - RNA, 62 nt, Homo Sapiens
uauucaggccuaaagacauugaaaaagcaucuuuucuugagaucauggucauaugagguccu

SEQ ID NO: 438727 - RNA, 62 nt, Homo Sapiens
cggcaguacgguauuaugaaaccaagaaaggguuucuugaaaagcuugucgguucaaagagg

SEQ ID NO: 438728 - RNA, 62 nt, Homo Sapiens
uuuuaacauuccacuuaugccuugaaacaucauuucuugauaacuuuuugauacuucuuucu

SEQ ID NO: 438729 - RNA, 62 nt, Homo Sapiens
aacaucauuucuugauaacuuuuugauacuucuuucuugauaaggcacuuuuaccaggugug

SEQ ID NO: 438730 - RNA, 62 nt, Homo Sapiens
uguucuuguggacuuuuccuguuucuuacuaguuucuugaaucccacagcuuucugcccauu

SEQ ID NO: 438731 - RNA, 62 nt, Homo Sapiens
gaaggugagauguuauuuguuuccuuugcguuuuucuugacuaguucaaaugagccaucuuu

SEQ ID NO: 438732 - RNA, 62 nt, Homo Sapiens
agaauuugucuuaacauuccaauguugguggauuucuugaauaaacaugauaggauuaacau

SEQ ID NO: 438733 - RNA, 62 nt, Homo Sapiens
cuggcuuggaccuuggcauuccucccuuuuuauuucuugagcaucuuaucuauuacuccaaa

SEQ ID NO: 438734 - RNA, 62 nt, Homo Sapiens
uaaaaagaaaaaaaaaaggucaauaaaagcccuuucuugagucccaggaagugaguuaaaaa

SEQ ID NO: 438735 - RNA, 62 nt, Homo Sapiens
aucuggucuggggggaccacgauccccaaguguuucuugagccaaguuaagagccaaucacu

SEQ ID NO: 438736 - RNA, 62 nt, Homo Sapiens
guaucuuuucaauuaauguauucaaaauuauauuucuugaugaauuggcaagaaagggagau

SEQ ID NO: 438737 - RNA, 62 nt, Homo Sapiens
auucaucuugaguuaucuuuuagcuuuuuuucuuucuugagagauauagucccuuauguaua

SEQ ID NO: 438738 - RNA, 62 nt, Homo Sapiens
caagcuuccaagggcuagaaauauggugucuuuuucuugaaaacugauaucugauguuuaug

SEQ ID NO: 438739 - RNA, 62 nt, Homo Sapiens
acauucccuuuuuuaggaaccucuauuuuauuuuucuugaaauuuuauaauugaaaaggccc

SEQ ID NO: 438740 - RNA, 62 nt, Homo Sapiens
aggaauguuauauaggcuugucaguucccauuuuucuugacaacaauaaauaccacuuuuaa

SEQ ID NO: 438741 - RNA, 62 nt, Homo Sapiens
ucuccugaccauguauuuuaaaauauagucuauuucuugacuuugaacuuaaagcuuuaauc

SEQ ID NO: 438742 - RNA, 64 nt, Homo Sapiens
gguuuuaaaaauagacaguauuuuuuaaaaaucaaaaaaugacuugcaaauuguuuuuuaaaag

SEQ ID NO: 438743 - RNA, 64 nt, Homo Sapiens
aguguucuauuuauuucuuguauuguuuggaagaaaaaaugaugauagagucccaaaaagaaga

SEQ ID NO: 438744 - RNA, 64 nt, Homo Sapiens
gaaaucagaaaauauaauaaaauugcacaaaaaaaaaaaugaaaaagaugcagacuggucuuuu

SEQ ID NO: 438745 - RNA, 64 nt, Homo Sapiens
uucugaaugcuuuauauucuuucugcuguaaauuaaaaaugaagaaaauuuccccauacuacgu

SEQ ID NO: 438746 - RNA, 64 nt, Homo Sapiens
aaauguguauuaccaauguggguguaaauuuuuaaaaaaugauuauugauagaaguuuggcagg

SEQ ID NO: 438747 - RNA, 64 nt, Homo Sapiens
ugauauuuggaaauaccuggauauuugcuagaggaaaaaugaaagcaaaacuucguacacagug

SEQ ID NO: 438748 - RNA, 64 nt, Homo Sapiens
cuuaaucagaaaaggacuagauuuguuuaagaagaaaaaugaaaccagacccagaucaauauuu

SEQ ID NO: 438749 - RNA, 64 nt, Homo Sapiens
gggaauuuugcugcucccuauugcuucuguuuacaaaaaugaauuuuuccugguuucccacuag

SEQ ID NO: 438750 - RNA, 64 nt, Homo Sapiens
ccugaggaauugcgagauauugcugaggggaaaaaaaaaugaccuuuucuugaaauguaacuug

SEQ ID NO: 438751 - RNA, 64 nt, Homo Sapiens
gcugccaugguggucaaauggcauguguuugcacaaaaaugaccgauguguuuaaccaaagcuu

SEQ ID NO: 438752 - RNA, 64 nt, Homo Sapiens
ucaagaaccauacuucgacauuuccucugccacaaaaaaugaacgcauuuuaaguuaggaguca

SEQ ID NO: 438753 - RNA, 64 nt, Homo Sapiens
aggcagaucugaaaaagaaccaaauagagcuccuaaaaaugagaaauauuuauugaaauaagaa

SEQ ID NO: 438754 - RNA, 64 nt, Homo Sapiens
uuucuuugcuuaaccuucugagaauuuuuauauuaaaaaugauuuaaggaauaucucuugauau

SEQ ID NO: 438755 - RNA, 64 nt, Homo Sapiens
uuuuucaaugcauuuuuuucguucuuucauguuuaaaaaugaugauuuggaauucuucugguuu

SEQ ID NO: 438756 - RNA, 64 nt, Homo Sapiens
acuuacaauuguaugucuccucuuaaaauugacaaaaaaugagcccuucuuacacauaauggug

SEQ ID NO: 438757 - RNA, 64 nt, Homo Sapiens
uaaaugccguauaugaucaacuggcaagguuuuuaaaaaugagggagcagcuuagauuucccua

SEQ ID NO: 438758 - RNA, 64 nt, Homo Sapiens
cauaaaaaugcaauaaacugaguacguaacauugaaaaaugaggaacuuaaaacuccaaacuag

SEQ ID NO: 438759 - RNA, 64 nt, Homo Sapiens
aaaaguaauuagaauauuuuagagagaagaaaagaaaaaugaagagagagggaggaagaaaggg

SEQ ID NO: 438760 - RNA, 64 nt, Homo Sapiens
uaaaaagaagagagggaggacaaauaaaugggaaaaaaaugaaaaaaucaccuggcuucuauaa

SEQ ID NO: 438761 - RNA, 64 nt, Homo Sapiens
gauguugaaugcccacaggcauauuauaacuuaaaaaaaugacagaggaaaaaaaugacuaaaa

SEQ ID NO: 438762 - RNA, 64 nt, Homo Sapiens
aaaaauauuauaacuuaaaaagaguuuagaggaaaaaaaugacuagaaugaauaauaauuaucc

SEQ ID NO: 438763 - RNA, 64 nt, Homo Sapiens
aaacuucagaaaauaaaauguuguuuuguuuuguaaaaaugauauaccugcuuuuuguuucauu

SEQ ID NO: 438764 - RNA, 64 nt, Homo Sapiens
ggugcuuauaaaaaguuauacaaaucaguucucaaaaaaugaccguuuacuuuguuggacaaac

SEQ ID NO: 438765 - RNA, 64 nt, Homo Sapiens
ucucaugagaaaauaaauuuuuucuuuguguaauaaaaaugaaaauuacauuauucauuauaau

SEQ ID NO: 438766 - RNA, 64 nt, Homo Sapiens
gaugcaacaaucgaguuauuuaugcuaacuugacaaaaaugacuacacagaguaugggcacggc

SEQ ID NO: 438767 - RNA, 64 nt, Homo Sapiens
caacauggcaaaaccccaucucuacuaaaaauacaaaaaugagcuaggcaugguggcacacgcc

SEQ ID NO: 438768 - RNA, 64 nt, Homo Sapiens
aggcaaacauuucuuaaaauguuucauuuucauuaaaaaugaaagccaaauuuauaugccaccg

SEQ ID NO: 438769 - RNA, 64 nt, Homo Sapiens
aguauauuucuuuuuaaagaaucuuuuuaagauuaaaaaugaauaccuuaaaucucccaaaaga

SEQ ID NO: 438770 - RNA, 64 nt, Homo Sapiens
ccuuuauuguuucuagguguugauauacuuuaauaaaaaugauauguuuaauauuuucccauua

SEQ ID NO: 438771 - RNA, 64 nt, Homo Sapiens
uucccuuaaauaauugacuauuuugcuguguuuuaaaaaugauugaaauuuaucuugccauauc

SEQ ID NO: 438772 - RNA, 64 nt, Homo Sapiens
uauaguuuuguauaauagcauagauuuuccuucaaaaaaugaacauuuauauaucuacaaaaau

SEQ ID NO: 438773 - RNA, 64 nt, Homo Sapiens
gaugaauaauuuaaagaaaaacaccuaaaauuugaaaaaugauuguaggaucaaaaaaggcaga

SEQ ID NO: 438774 - RNA, 64 nt, Homo Sapiens
cuuuuguuaaaaauaaaguuaaaaguuaaaguuaaaaaaugaaguuaaaaguuucaucagaaac

SEQ ID NO: 438775 - RNA, 64 nt, Homo Sapiens
cuguuuuggaaaugcacaguugacauguugaaauaaaaaugaauaccauuuuuaaauguuucuu

SEQ ID NO: 438776 - RNA, 64 nt, Homo Sapiens
cagugucuucuuuauauauuuauuuuuuauuagaaaaaaugaaguuugguuggugaugcaugaa

SEQ ID NO: 438777 - RNA, 64 nt, Homo Sapiens
accuuauccuuucucccauaaccuuuguacacuaaaaaaugaaagaauuuagaauguauuugau

SEQ ID NO: 438778 - RNA, 64 nt, Homo Sapiens
uagaguauaccaaaugcauaugcuuuuccaaauuaaaaaugaaguuaaaauuauuuuuaacaug

SEQ ID NO: 438779 - RNA, 64 nt, Homo Sapiens
uuuaugaacuuuuuauuuuaauauaguuauuguaaaaaaugauagugcugcuuagaaugaccaa

SEQ ID NO: 438780 - RNA, 64 nt, Homo Sapiens
acuuuaauuuuuaccauccauaugcuuuuccuuaaaaaaugaaaaaauguuugacaaaaaugaa

SEQ ID NO: 438781 - RNA, 64 nt, Homo Sapiens
augcuuuuccuuaaaaaauguguaaauguuugacaaaaaugaauagcuuuuuaacccggauuac

SEQ ID NO: 438782 - RNA, 64 nt, Homo Sapiens
uuaaaaauaaaauuaccuagaaaaguaaaaauuaaaaaaugaaaagcaaaaucucaucucuaca

SEQ ID NO: 438783 - RNA, 64 nt, Homo Sapiens
aauagcaaaauuccuguguuuuucuuauggcacaaaaaaugaggguuuguaaaaccaucagaua

SEQ ID NO: 438784 - RNA, 64 nt, Homo Sapiens
caacauuucuuagcaugagcugaacuuucauaggaaaaaugaccgaauuagaccauuuggccuu

SEQ ID NO: 438785 - RNA, 64 nt, Homo Sapiens
uuaaaauguuuaacuugugacaagauugucaauuaaaaaugaguccuuuugugaccucucauuc

SEQ ID NO: 438786 - RNA, 64 nt, Homo Sapiens
uaaacuucauauuuguugauuggaauuuuaagggaaaaaugaacuacaaccuuuugaucuuugu

SEQ ID NO: 438787 - RNA, 64 nt, Homo Sapiens
ccaucauuauauucuuucguagaguuaaauauagaaaaaugaaaagauaucauuaggaucacac

SEQ ID NO: 438788 - RNA, 64 nt, Homo Sapiens
acaauuuuaaaaauguaaaaaagugcaaauaagcaaaaaugaaacucaugauagaaaauuugga

SEQ ID NO: 438789 - RNA, 64 nt, Homo Sapiens
gaggcgcuggcuuuccacagugguuccuugccugaaaaaugaaacaguccaccuuucuaggccu

SEQ ID NO: 438790 - RNA, 64 nt, Homo Sapiens
augggucccucucacuaauguuucaacaauagggaaaaaugagaacuauguggacacuuguuuc

SEQ ID NO: 438791 - RNA, 64 nt, Homo Sapiens
ucaguguuccuuucaaacaugugaguucuuuaacaaaaaugaaauaaaccaggugucugugauu

SEQ ID NO: 438792 - RNA, 64 nt, Homo Sapiens
aaaugcaguucuuugccuucucuguuccugcaccaaaaaugaucaggagaaagcauauuaccag

SEQ ID NO: 438793 - RNA, 64 nt, Homo Sapiens
gcuaagcugggaugccacauaggcagaagccaggaaaaaugaccaaccacagaaccaagugguu

SEQ ID NO: 438794 - RNA, 64 nt, Homo Sapiens
gaagauuugagaacuuuuuaacuauucauugacuaaaaaugaacauuaauguuaaagacuuaag

SEQ ID NO: 438795 - RNA, 64 nt, Homo Sapiens
gccuauacauucauuugcuuuguacuauaaaaauaaaaaugauuucuuaaguuaaugacauccc

SEQ ID NO: 438796 - RNA, 64 nt, Homo Sapiens
auuuaaauuacaacccuagaacuguguauguaaaaaaaaugaauuauuuugcuuuuacgucuca

SEQ ID NO: 438797 - RNA, 64 nt, Homo Sapiens
cccuugugucguuguuaaccuuccccuaaaaccaaaaaaugaacuuaacuuuugaugcuuucug

SEQ ID NO: 438798 - RNA, 64 nt, Homo Sapiens
ugaaaaaaguuucaccguuugcauugacuucugaaaaaaugaucuugcgcuuugcaucagcaag

SEQ ID NO: 438799 - RNA, 64 nt, Homo Sapiens
cacaaaacaaaauaucuggaaaaauauccaucagaaaaaugacaaaaauauuuuacaguuguaa

SEQ ID NO: 438800 - RNA, 64 nt, Homo Sapiens
gucucaucucugaauuuauauuuuuuuaacugcaaaaaaugauguugcaccagaaucagcauuu

SEQ ID NO: 438801 - RNA, 55 nt, Homo Sapiens
uuuuuccgacuucuaaacaaaaagaaaaaaugauccagagcuuaguaauuucuaa

SEQ ID NO: 438802 - RNA, 64 nt, Homo Sapiens
uagcacaagcuaaaucucaagagcuacaauuuuaaaaaaugauuuuuuauaauaaaaugccuca

SEQ ID NO: 438803 - RNA, 64 nt, Homo Sapiens
uaaauguaugaugaauuuuaagaaggucaagcuaaaaaaugaagaaugaagcuaaagauuuacu

SEQ ID NO: 438804 - RNA, 64 nt, Homo Sapiens
gugcucaauagaauuuuuaaccuguuuuauucugaaaaaugaaaguugugaguuauuugcuuau

SEQ ID NO: 438805 - RNA, 64 nt, Homo Sapiens
ugcguaugaagugaggaggcucuucaaguuagcuaaaaaugagauaauauucuuguuuuuauuu

SEQ ID NO: 438806 - RNA, 50 nt, Homo Sapiens
agagucagaaagcuaaauaaaaaaaugaaacuuuuuugaguaauaaaaau

SEQ ID NO: 438807 - RNA, 64 nt, Homo Sapiens
agcuaaauaaaaaaaugaaacuuuuuugaguaauaaaaaugaaaagacgcuguauguaugacuu

SEQ ID NO: 438808 - RNA, 64 nt, Homo Sapiens
uuccaagguuauuucugaauguaacaauuuccuuaaaaaugacuuauccaauuucuguauuuca

SEQ ID NO: 438809 - RNA, 64 nt, Homo Sapiens
uaauaauuuaaaaacaagacaucuccagguaggaaaaaaugaaagcuauuucaugcaaacauua

SEQ ID NO: 438810 - RNA, 64 nt, Homo Sapiens
cgggugcaauggcaggcacccuacuaaaaauacaaaaaaugagcaacauggugaaacccugccu

SEQ ID NO: 438811 - RNA, 64 nt, Homo Sapiens
aaaugcuauaaguauaaacugaaaaaaaaacacuaaaaaugaagcagaucuguuuaacccacuu

SEQ ID NO: 438812 - RNA, 64 nt, Homo Sapiens
caugaaaugcaguagcaaccguauaugaucuaacaaaaaugaaaauguaucauucuuuucuaau

SEQ ID NO: 438813 - RNA, 64 nt, Homo Sapiens
guuuucauaaugcaauguaacaagagacagcuacaaaaaugaaggugugacauguugggcagau

SEQ ID NO: 438814 - RNA, 64 nt, Homo Sapiens
gaaaguaacugauugacacuaaacugcuguauggaaaaaugacauguaaacauaucccagauga

SEQ ID NO: 438815 - RNA, 64 nt, Homo Sapiens
aaaacaaaugauuuucaaggaucuugauagucuaaaaaaugaucggaccaaaggcuagguugua

SEQ ID NO: 438816 - RNA, 64 nt, Homo Sapiens
augacaugagaaugaagaaauuauuuuggaaaaaaaaaaugaccuaauuuaccuaucagugaaa

SEQ ID NO: 438817 - RNA, 64 nt, Homo Sapiens
ugguaguauuuuguuggaagagaauguuuauacaaaaaaugaaauucuuccaacagcagagaaa

SEQ ID NO: 438818 - RNA, 64 nt, Homo Sapiens
auucagaaauucuuuuuuucuacuuucauucaugaaaaaugaaaaaaauuuucucucugauuuu

SEQ ID NO: 438819 - RNA, 64 nt, Homo Sapiens
uugugguggacugcuaaaaauuuauuuuuauuauaaaaaugauaucuaucaucaaugaguauau

SEQ ID NO: 438820 - RNA, 64 nt, Homo Sapiens
gaaauuaaaauucagcuuuaccugucucaaaaaaaaaaaugauuccuaggugacagaaugagac

SEQ ID NO: 438821 - RNA, 64 nt, Homo Sapiens
gaccagccugggaaacauaauaaaagggcuagaaaaaaaugauuaucuuuggaugccugaauuu

SEQ ID NO: 438822 - RNA, 64 nt, Homo Sapiens
auaauaaaacaaauaauuuccucaaauaacaaagaaaaaugauaccuauaaauauauuuauaaa

SEQ ID NO: 438823 - RNA, 64 nt, Homo Sapiens
uuggaugaauaaauaaaugcaauugaauucccagaaaaaugauuguuucaaggaagugacaguu

SEQ ID NO: 438824 - RNA, 64 nt, Homo Sapiens
aaaaaaaaaaaaaaaaaaaaaaaaguuaauguccaaaaaugacagauuuacaaguguaagcuau

SEQ ID NO: 438825 - RNA, 64 nt, Homo Sapiens
caacauggcaaaacuccgucucugcaaaaaauacaaaaaugagcccgguauguuggcauaugcc

SEQ ID NO: 438826 - RNA, 64 nt, Homo Sapiens
cauuaauuuuauaucaggauucauguaagagacuaaaaaugauccauagugguuaguacuguaa

SEQ ID NO: 438827 - RNA, 64 nt, Homo Sapiens
augaggaaaucaaauguaaaugcaaacuauaugcaaaaaugaguuuacuauacauugaaaugcc

SEQ ID NO: 438828 - RNA, 64 nt, Homo Sapiens
gaauuagggaaacaccaaaauccuaaaaaaaaaaaaaaaugagaaguuaagcuacuccucuuuc

SEQ ID NO: 438829 - RNA, 64 nt, Homo Sapiens
gcugugacagcuuuuuggcugcuuuaaccauaagaaaaaugauugguggaugauuuuauuagcc

SEQ ID NO: 438830 - RNA, 64 nt, Homo Sapiens
aucuuaauaaagcugcucuuuacuguuucuagucaaaaaugagacuucgaucaaaccauaagau

SEQ ID NO: 438831 - RNA, 64 nt, Homo Sapiens
acaaaagauugguccuuggugaaauaaacuuuucaaaaaugaauguucuuuucaaaaaauaaag

SEQ ID NO: 438832 - RNA, 64 nt, Homo Sapiens
aaaguagaaaaaugcacuuacuaagaacaugaaaaaaaaugaaguaggaaaauaagaugaagac

SEQ ID NO: 438833 - RNA, 64 nt, Homo Sapiens
guauuauccugaauacacuauuuugaaaauuuuuaaaaaugacuucuuuauuuugcuuuaccgu

SEQ ID NO: 438834 - RNA, 64 nt, Homo Sapiens
uuuuacaauauaugcugagauuaaaaaccaagguaaaaaugaucaaacauauaugaaauugagu

SEQ ID NO: 438835 - RNA, 64 nt, Homo Sapiens
aagacgacauggcagaaguucccaacuaaaaaguaaaaaugaaaaauaaucaauuuaguuaccu

SEQ ID NO: 438836 - RNA, 64 nt, Homo Sapiens
uguaugaaaagcaccugauggcauguggaaacacaaaaaugaugggaagccaaucugaaaacag

SEQ ID NO: 438837 - RNA, 64 nt, Homo Sapiens
cccaaaacucucugcauguaaauaagucagcgaaaaaaaugaaauuauguaaacauguaaagaa

SEQ ID NO: 438838 - RNA, 64 nt, Homo Sapiens
acacugucccuuuauguaaauauaguaucuuaauaaaaaugagauaaugaaugacuauacaaau

SEQ ID NO: 438839 - RNA, 64 nt, Homo Sapiens
cugcaagccuucuaaaugagcacaucuuaaagcuaaaaaugaacccuuggauuaaaacgggaau

SEQ ID NO: 438840 - RNA, 64 nt, Homo Sapiens
augaagagcuauuuaaugacauugugacucuucuaaaaaugaagagacaaaaucaaauuguccu

SEQ ID NO: 438841 - RNA, 64 nt, Homo Sapiens
ugaccuggccgggcgcggugcagcuguuguccuuaaaaaugaauguuaagcaugaaacaaacag

SEQ ID NO: 438842 - RNA, 64 nt, Homo Sapiens
auuuugcagcacugaaaaucuuaucucacaagucaaaaaugaagaaguauuguuuauagauaau

SEQ ID NO: 438843 - RNA, 64 nt, Homo Sapiens
aaaaacaaaguaaggugcacaauucagcuaaaggaaaaaugaucaagugcuauuggcauuccaa

SEQ ID NO: 438844 - RNA, 64 nt, Homo Sapiens
aaaagaaggaaaaaagaauauaacauugcaaugaaaaaaugaaaaucacauaacucuggugugu

SEQ ID NO: 438845 - RNA, 64 nt, Homo Sapiens
agccaccaugccuggccuucauuaucucuuuuuuaaaaaugaaaaaguuuauaauuuacauuca

SEQ ID NO: 438846 - RNA, 64 nt, Homo Sapiens
auaauguaaauacuugcuagcuuaugugccauuaaaaaaugacuugauuuggcuuacagaccag

SEQ ID NO: 438847 - RNA, 64 nt, Homo Sapiens
aacagccauuugauuuauguaaugaauaacagccaaaaaugaauaauauuaacugguauucaaa

SEQ ID NO: 438848 - RNA, 64 nt, Homo Sapiens
aacagccaaaaaugaauaacauuaacugguauucaaaaaugaauacaacuuugaaagcaguaau

SEQ ID NO: 438849 - RNA, 64 nt, Homo Sapiens
uccuauuuuuucugggagagcuccccacccugaaaaaaaugaguucccaugauccccucucuuc

SEQ ID NO: 438850 - RNA, 64 nt, Homo Sapiens
ugcuugguauucauuacuucaguaaagaugcaggaaaaaugaauaaccuaagaacaaauguaaa

SEQ ID NO: 438851 - RNA, 64 nt, Homo Sapiens
agucgaugguuaaacuucucguuuaguuuuuaugaaaaaugacacuccagaccuauaaggaaau

SEQ ID NO: 438852 - RNA, 64 nt, Homo Sapiens
cacauucuagcccuggucugccacuuugauuguuaaaaaugaacugaucaccaaacagaucuug

SEQ ID NO: 438853 - RNA, 64 nt, Homo Sapiens
aguguuugaguucagccucuuucugauaugacagaaaaaugaaauauucacauuuaguuuaugu

SEQ ID NO: 438854 - RNA, 64 nt, Homo Sapiens
aauucuaccuuuaccagggaggcaugaagcugugaaaaaugagagccaguaaaauuauaccauu

SEQ ID NO: 438855 - RNA, 64 nt, Homo Sapiens
cuuuuugagaccucuuaagaaaaaauaaaaaguaaaaaaugaaaggaaucuuuuuuagaaauag

SEQ ID NO: 438856 - RNA, 64 nt, Homo Sapiens
ucugcuguauuaaugacaauuauucaugaaaauaaaaaaugaaauauuuuguauacuacuaccu

SEQ ID NO: 438857 - RNA, 64 nt, Homo Sapiens
uguuuauuaaguagcuagaaauaauuauguggaaaaaaaugaauaauggaaaauagugagucuc

SEQ ID NO: 438858 - RNA, 64 nt, Homo Sapiens
auuucaaaaaaaaauuacaaaaguaugugaauuuaaaaaugagagcaguccucucacccuacca

SEQ ID NO: 438859 - RNA, 64 nt, Homo Sapiens
gguggcuggaacaucuauuuuucuacaaaacuggaaaaaugaaccugguucuagaagaauguac

SEQ ID NO: 438860 - RNA, 64 nt, Homo Sapiens
gcuuagcugacuacagaauaggugaggguuucuuaaaaaugagauuuaagggcugggcacggug

SEQ ID NO: 438861 - RNA, 64 nt, Homo Sapiens
caacaagagugaaacucuugucucaaaaaaaaaaaaaaaugagguuuaagacaguuuugucauu

SEQ ID NO: 438862 - RNA, 64 nt, Homo Sapiens
ggauuauucauuuugucccauaagaagauaauuaaaaaaugacaaaaaugaacugaacaaaaaa

SEQ ID NO: 438863 - RNA, 64 nt, Homo Sapiens
auuuugucccauaagaagauaauuaaaaaaugacaaaaaugaacugaacaaaaaaguucuaaca

SEQ ID NO: 438864 - RNA, 64 nt, Homo Sapiens
cugcaacuuuaaaauuuaaaguccucagccaaggaaaaaugauaaaggcaacagacuuaaaguu

SEQ ID NO: 438865 - RNA, 64 nt, Homo Sapiens
caagagaacuuucuuauuuucuauccaaauaugcaaaaaugaccuccaaaagcaugagauuuuu

SEQ ID NO: 438866 - RNA, 64 nt, Homo Sapiens
aaaagugucccauuuuuaaugaauacaagauaccaaaaaugaaagugaagaggauggaaaaacu

SEQ ID NO: 438867 - RNA, 64 nt, Homo Sapiens
uaauaguuuaaaacaaguagauaauuuggucaccaaaaaugaaauucuuuaauuauggucaaau

SEQ ID NO: 438868 - RNA, 64 nt, Homo Sapiens
gggacuucccgaacuaauuuuuuuaaggauacugaaaaaugagagagaguggucgaaugccuga

SEQ ID NO: 438869 - RNA, 64 nt, Homo Sapiens
ugaucacuuaaaguaguuuccuucuuuauucugaaaaaaugaggaaaaaauaacaacaguggca

SEQ ID NO: 438870 - RNA, 64 nt, Homo Sapiens
gaagaaggccuggcaggaccuggccuguuuguuuaaaaaugaaguauggguugggggauuacgc

SEQ ID NO: 438871 - RNA, 64 nt, Homo Sapiens
ucucuaucuccucacuuuuucucccaaaguagaaaaaaaugauaucugaacugcgucugccuac

SEQ ID NO: 438872 - RNA, 64 nt, Homo Sapiens
accagccuggcaacagagcaagacuccgucucacaaaaaugaauaaauaaaauaaaaauaaaaa

SEQ ID NO: 438873 - RNA, 64 nt, Homo Sapiens
uuuugucaauuucauguaauuuacccuuugcaauaaaaaugauucauuaaauauauaacuaaau

SEQ ID NO: 438874 - RNA, 64 nt, Homo Sapiens
uuuuuuuuuaaauauggcuggaaagcuuguuuugaaaaaugaagcuuauauuaauuguugcuuc

SEQ ID NO: 438875 - RNA, 64 nt, Homo Sapiens
uaaguaauuuaacaacagauuugcuaauuuaaaaaaaaaugaaaaaaaaaaucuuaccagcagu

SEQ ID NO: 438876 - RNA, 64 nt, Homo Sapiens
cuuacugggugaggaaaucccaaguauaugugaaaaaaaugagacuuaaggaccuuugggucua

SEQ ID NO: 438877 - RNA, 64 nt, Homo Sapiens
gugacuuuaaaagaaaauaguggcuucaaguuguaaaaaugaaaauaaaaaccaugcugguaua

SEQ ID NO: 438878 - RNA, 64 nt, Homo Sapiens
uggcuuuugguauugauaauuuuucuaaauuaaaaaaaaugacuaaauuauucuuagugaauua

SEQ ID NO: 438879 - RNA, 64 nt, Homo Sapiens
uacacuguaucuuauaugaaccucuagagagaguaaaaaugaauuacuguuuagaugggagaaa

SEQ ID NO: 438880 - RNA, 64 nt, Homo Sapiens
gaguaucuggagaauaaaacccaaauucaaaaaaaaaaaugauaauuuauuuuuaagguaaaaa

SEQ ID NO: 438881 - RNA, 64 nt, Homo Sapiens
uuacaauguugguuuuaaagauaagcacauggguaaaaaugagggugauccuuauucaaaaaua

SEQ ID NO: 438882 - RNA, 64 nt, Homo Sapiens
cacacuguuguauaaagcagcagaacugaaggggaaaaaugauuguuguauacacugaauugcu

SEQ ID NO: 438883 - RNA, 64 nt, Homo Sapiens
uuuuuuauauuuggaaacaucaaauaaaaauggaaaaaaugaucauggcuuuaaaaaaaaaaca

SEQ ID NO: 438884 - RNA, 64 nt, Homo Sapiens
accaucaaugaauucagauaugggaaaagucaguaaaaaugauacugaagaggaaaguaauaaa

SEQ ID NO: 438885 - RNA, 64 nt, Homo Sapiens
uggugaggaggaagaacaaauaauagaagaaaauaaaaaugagauagaagaaaaguaagaacca

SEQ ID NO: 438886 - RNA, 64 nt, Homo Sapiens
gugcauuuuggugguaauuuaaacuaaauaaaaaaaaaaugauauacuuacagauucuuccugu

SEQ ID NO: 438887 - RNA, 64 nt, Homo Sapiens
uugcaggcugacauuacauuaguuuagccuuuauaaaaaugaagaacaauauuccauauaaaua

SEQ ID NO: 438888 - RNA, 64 nt, Homo Sapiens
aaucaaauugaaucuuuuacuuaccucuugcaaaaaaaaugaaaaaugaaaaaacaaauucaaa

SEQ ID NO: 438889 - RNA, 64 nt, Homo Sapiens
uugaaucuuuuacuuaccucuugcaaaaaaaaugaaaaaugaaaaaacaaauucaaaaccuauu

SEQ ID NO: 438890 - RNA, 64 nt, Homo Sapiens
aauuaauuuaaaaaaaugcauuauuuuauuuuaaaaaaaugaaaguaacuuuacacuuuuuugg

SEQ ID NO: 438891 - RNA, 64 nt, Homo Sapiens
gaaaagcuaaaaaaaaaaaaaauaacaacaaaaaaaaaaugagaugugacaucuuuuuaaaaaa

SEQ ID NO: 438892 - RNA, 64 nt, Homo Sapiens
uucuaugccaaaauaacuucaggagcugguaguaaaaaaugagacauauugugagaaaaacguu

SEQ ID NO: 438893 - RNA, 64 nt, Homo Sapiens
uauaggucaguacucacaugguuuuagauuugcaaaaaaugacagaacauuuugaaauauuuuu

SEQ ID NO: 438894 - RNA, 64 nt, Homo Sapiens
ugaaccauuucaacuauuuuuauuuucucccgguaaaaaugaauacuguuuaccucuugcuaug

SEQ ID NO: 438895 - RNA, 64 nt, Homo Sapiens
auuuuucuaugcauaguuaugcauuuauauucucaaaaaugaaaucauaauguacauugcuuug

SEQ ID NO: 438896 - RNA, 64 nt, Homo Sapiens
uagaaaaugacuuauuuccagaagauaccgcucuaaaaaugaaauuguuaggugaaaguguuuu

SEQ ID NO: 438897 - RNA, 64 nt, Homo Sapiens
guaucuucacaccuugaauaagcauaauaccauaaaaaaugacacuugacaugucaauguauuu

SEQ ID NO: 438898 - RNA, 64 nt, Homo Sapiens
uuuuaaacucguauuugugguuuuuuucccagauaaaaaugaaauuaaaccauuucuuuuuaag

SEQ ID NO: 438899 - RNA, 64 nt, Homo Sapiens
acaaccaaagaaggccugcucuuugcugcuuuuaaaaaaugacaauuaaaugugcagauucccc

SEQ ID NO: 438900 - RNA, 64 nt, Homo Sapiens
cagcccgcaguuuaugugugugcuuuuuucuaugaaaaaugauguauuuugcuacuuccugugu

SEQ ID NO: 438901 - RNA, 64 nt, Homo Sapiens
uugaacguaugugcucuuauaaaguggacuucugaaaaaugaauguaaaagacacugguguauc

SEQ ID NO: 438902 - RNA, 64 nt, Homo Sapiens
aauuguuagauggcaauagucauuaaaaacauagaaaaaugaugucuuuaaguggagaauugug

SEQ ID NO: 438903 - RNA, 64 nt, Homo Sapiens
ccagcugcaauaccugucuguaauaugagaaaaaaaaaaugaaucuauuuaaucauuucuacuu

SEQ ID NO: 438904 - RNA, 64 nt, Homo Sapiens
aaauccuaugacaguaagcaaaaacagaaccaugaaaaaugauuggacauacaccuuuucaauu

SEQ ID NO: 438905 - RNA, 64 nt, Homo Sapiens
ucuuucaauugagauuaagugcucugugguaagaaaaaaugaacagcacuuuucuaacuaauga

SEQ ID NO: 438906 - RNA, 64 nt, Homo Sapiens
uuuugcuuucaggauuuggcgaccagguuacugcaaaaaugagguguaucugagagggucucca

SEQ ID NO: 438907 - RNA, 64 nt, Homo Sapiens
uaauacugagcaagccuguggaauuuucuuuaugaaaaaugauuuuagccuuugcaaauguuaa

SEQ ID NO: 438908 - RNA, 64 nt, Homo Sapiens
uuauguucugagugugugguauguucccuuaaaaaaaaaugacacuuggaagaaaaauguauga

SEQ ID NO: 438909 - RNA, 64 nt, Homo Sapiens
uaugacacuugcuguuuuucacauuuuuagcagcaaaaaugaagcuccaauucuuuccuaaaga

SEQ ID NO: 438910 - RNA, 64 nt, Homo Sapiens
aaacaugagacuguaagaaaauucacugcuuuguaaaaaugaacuauaaaaacagguuccaaau

SEQ ID NO: 438911 - RNA, 64 nt, Homo Sapiens
acagugaggaaauuaugacagaaaccaccuaugcaaaaaugauagaacauggaaauacaguggu

SEQ ID NO: 438912 - RNA, 64 nt, Homo Sapiens
ugauguaauguauuuauaaaauuugaagguauauaaaaaugagauaucaguguugucuauaaau

SEQ ID NO: 438913 - RNA, 64 nt, Homo Sapiens
uguaaauugagggucauaguuuuuuauucuuuugaaaaaugauucaaaaauauguuuaaacuuu

SEQ ID NO: 438914 - RNA, 64 nt, Homo Sapiens
ccgugaacacagauguguuugauuuuguuauuagaaaaaugauugggaauucccucccaaauuu

SEQ ID NO: 438915 - RNA, 64 nt, Homo Sapiens
agguauaaaaagagaauaugaaaaaugaaaaaauaaaaaugaaccugucucugauaaaaagaaa

SEQ ID NO: 438916 - RNA, 64 nt, Homo Sapiens
aaauaaaaaugaacagguaucugauaaaaagaaaaaaaaugaaacaacaaagaggccccugucu

SEQ ID NO: 438917 - RNA, 64 nt, Homo Sapiens
aggcugggagugguggcucacacauuagggauacaaaaaugaacugguagacauuucaaacugu

SEQ ID NO: 438918 - RNA, 64 nt, Homo Sapiens
cgauuaaaagauucuguggcacaauuccuaauacaaaaaugacccaaaauauguuaaauuucug

SEQ ID NO: 438919 - RNA, 64 nt, Homo Sapiens
auagaaaagcugcuucuugcaaucuaugcuaaaaaaaaaugaaucuguuuccuaagcaucagau

SEQ ID NO: 438920 - RNA, 64 nt, Homo Sapiens
uauucacagaaucagaucugugacccuacccauaaaaaaugaaagacaaaaauauauauguaug

SEQ ID NO: 438921 - RNA, 64 nt, Homo Sapiens
cuuagacagaauugucaguaauuacaaaccuauuaaaaaugauacacggccagcccacaaugau

SEQ ID NO: 438922 - RNA, 64 nt, Homo Sapiens
guuuguagaggggucaaacacaaauacuuguuguaaaaaugaugaauaugugagcaaaaugaaa

SEQ ID NO: 438923 - RNA, 64 nt, Homo Sapiens
accuaggaaaguagcaaauauuuugagauccaaaaaaaaugaaaaaagugaucccagauuagau

SEQ ID NO: 438924 - RNA, 64 nt, Homo Sapiens
gugcaaccugaaacccaggacagugcaagauugcaaaaaugacugcagcccucacuuuucaugg

SEQ ID NO: 438925 - RNA, 64 nt, Homo Sapiens
cucuuuccucuuuguccaagaccaauuuuaagaaaaaaaugauugaauacacaugaaccccuau

SEQ ID NO: 438926 - RNA, 64 nt, Homo Sapiens
agucugcuuaacuccaauuucagggucaugaucaaaaaaugaaaugucaaauauauuucucuuu

SEQ ID NO: 438927 - RNA, 64 nt, Homo Sapiens
uagaauacagcauggaaaaucaaccagcauuuuaaaaaaugaaagaaaccaguuuaaugggaua

SEQ ID NO: 438928 - RNA, 64 nt, Homo Sapiens
uacaaugucagguguuuuuagauucuggaggagaaaaaaugagugaagacaaaauugguguuua

SEQ ID NO: 438929 - RNA, 64 nt, Homo Sapiens
gguguuuugucuucacauuuaucuguuagauuuuaaaaaugacuucuaaacauagguucugcau

SEQ ID NO: 438930 - RNA, 64 nt, Homo Sapiens
ggccccuccuagggagccucuucgacuuuuuuagaaaaaugaucuccauuucuuuccagccaug

SEQ ID NO: 438931 - RNA, 64 nt, Homo Sapiens
auuuugcuuaaauuucuacaguauguaaaagugaaaaaaugaugaagacgggugcaccugucug

SEQ ID NO: 438932 - RNA, 64 nt, Homo Sapiens
cgugauaauauaaucucuauuuuuuuaggaaaacaaaaaugaaaaacuacuccauuugaggauu

SEQ ID NO: 438933 - RNA, 64 nt, Homo Sapiens
guaggcuguaauauguguacauuguguuuaagagaaaaaugaaacccacaugccgccauuuucc

SEQ ID NO: 438934 - RNA, 64 nt, Homo Sapiens
caacguggugaaacacugucucuacuaaaaauacaaaaaugagcugggugugaugauacaugcc

SEQ ID NO: 438935 - RNA, 64 nt, Homo Sapiens
augaugacuucaaaaauuaauaaaaagaaaagaaaaaaaugauuucuggccgggcgugguggcu

SEQ ID NO: 438936 - RNA, 64 nt, Homo Sapiens
aggggagcagauaucuuguuaugggaaaaaucacaaaaaugagauacguugaguuugcaaccag

SEQ ID NO: 438937 - RNA, 64 nt, Homo Sapiens
guuugugaguguuuauugguauugcugaaaaccuaaaaaugaaauggacuaaugugaaaaaaac

SEQ ID NO: 438938 - RNA, 64 nt, Homo Sapiens
uuucuccuagaaucucaaguggaauuggaaucauaaaaaugaaugagauuugaaaacuuucaca

SEQ ID NO: 438939 - RNA, 64 nt, Homo Sapiens
auaaauguaguuaguuugauacuccuuagaauaaaaaaaugaaacaguaacaacuuuuauguaa

SEQ ID NO: 438940 - RNA, 64 nt, Homo Sapiens
aucuuuagcuuuauaaucuaaggaaccaaauuuaaaaaaugauggauuaugcucugugaaauga

SEQ ID NO: 438941 - RNA, 64 nt, Homo Sapiens
uauaauuuuucaguuugcuuacuuccuggccuuuaaaaaugaccgcauggcuuugauauucucu

SEQ ID NO: 438942 - RNA, 64 nt, Homo Sapiens
acugcauagaaaucaaauguugcccaagugacacaaaaaugauugaaaucuauaacauuucuuu

SEQ ID NO: 438943 - RNA, 64 nt, Homo Sapiens
auuuaaaauguugcuuguaaaguugcaauggauuaaaaaugauguuguuuuagauguuuuaaau

SEQ ID NO: 438944 - RNA, 64 nt, Homo Sapiens
aagacaagauuuaugagaaaguauuuacuuuagaaaaaaugaaauaauuggguggggcaggugu

SEQ ID NO: 438945 - RNA, 64 nt, Homo Sapiens
uauaaauuuauucauguacauaauccaguucugcaaaaaugaccuauuacauuuuauuuuuucu

SEQ ID NO: 438946 - RNA, 64 nt, Homo Sapiens
cugauaauucaagggagcucaaagucacaagaagaaaaaugaaaggaaaaaacagcagcccuau

SEQ ID NO: 438947 - RNA, 64 nt, Homo Sapiens
gaacauuuugacaaauauuuauuuuuguaagccuaaaaaugauucuuugaaaguuuaaagaaac

SEQ ID NO: 438948 - RNA, 62 nt, Homo Sapiens
auuguagcaagugcuggaaugucccuuuuuuccuaugcaacuuuuuuuaacccuuuaaugaa

SEQ ID NO: 438949 - RNA, 62 nt, Homo Sapiens
agaaugaaccagauuugguggugguuuuguuucuaugcaaacuggacacaaauuacaacagu

SEQ ID NO: 438950 - RNA, 62 nt, Homo Sapiens
uucuucauaucaucacaacauucaugugguuucuaugcaaaguucgaauuuugucuuuaaaa

SEQ ID NO: 438951 - RNA, 62 nt, Homo Sapiens
cuacuaacaaauuauacuguaagguguuauaucuaugcaaacagauguauuauaccagugaa

SEQ ID NO: 438952 - RNA, 62 nt, Homo Sapiens
uagggauccuccucacugugggcgcugcguaccuaugcaagugccuagcuaugaagucccag

SEQ ID NO: 438953 - RNA, 62 nt, Homo Sapiens
agaccagccuggacaacauagugagaccccgucuaugcaaaaaauacacaaauuagccuggu

SEQ ID NO: 438954 - RNA, 62 nt, Homo Sapiens
ccuaaacucaggagucaacguguuuaccucuucuaugcaagccuugcuagacagccagguua

SEQ ID NO: 438955 - RNA, 62 nt, Homo Sapiens
ucuuuauguccgcccaccuagugcuuccacuucuaugcaaaugccuccaagccauucacuuc

SEQ ID NO: 438956 - RNA, 64 nt, Homo Sapiens
cauaacacccaucacauugucugagaauaggauuaaugagcaaaaguuaugauaauagaguuau

SEQ ID NO: 438957 - RNA, 64 nt, Homo Sapiens
cuaaugccgugaaugaaacacagucuguguagggaaugagcaaaaaaguugaauuccaauugcu

SEQ ID NO: 438958 - RNA, 64 nt, Homo Sapiens
gguauauguaauauauaugugggaaauacaggggaaugagcaaaucucaaagagcuggcgucuu

SEQ ID NO: 438959 - RNA, 64 nt, Homo Sapiens
acccaauacauuauuagacugaacugugaccugaaaugagcaauaaacucuguauuaauucacu

SEQ ID NO: 438960 - RNA, 64 nt, Homo Sapiens
cacacacuuaccuuacuaagucuuugcuuuaauaaaugagcaacccuggguauagucuuaaaau

SEQ ID NO: 438961 - RNA, 64 nt, Homo Sapiens
aaauuauuccuaaacucucuaaguguggacggagaaugagcaagccccagaaguauuuuacaac

SEQ ID NO: 438962 - RNA, 64 nt, Homo Sapiens
gcugcgucuccccugacacacacuuucuuuuuugaaugagcaagucuccauuuugauuucagca

SEQ ID NO: 438963 - RNA, 64 nt, Homo Sapiens
uaaauugucucuugcaucacuaaaauuuuuuuaaaaugagcauaacaacgaaaggcauccagcu

SEQ ID NO: 438964 - RNA, 64 nt, Homo Sapiens
gcuaggccugauuagaguaguagugaggcuccaaaaugagcaaauauacugaaaucuguuauuu

SEQ ID NO: 438965 - RNA, 64 nt, Homo Sapiens
gguguacgcgaaauuguguuaaguguaauuccauaaugagcagaacccucuugagauucguuuu

SEQ ID NO: 438966 - RNA, 64 nt, Homo Sapiens
ucuauauuuuucuuauuuaauuacaaauacuauaaaugagcaaggaaaaggaauagacuuucuu

SEQ ID NO: 438967 - RNA, 64 nt, Homo Sapiens
ugccaaaggaacuugauuacauggugucuaaccaaaugagcaggcuuaggaauuuagaugagau

SEQ ID NO: 438968 - RNA, 64 nt, Homo Sapiens
cucuacccccuagccugggcguuggaucuacuggaaugagcagcagccgcuuccucggcagccu

SEQ ID NO: 438969 - RNA, 64 nt, Homo Sapiens
gugggauaaaaguuaucuuccccuuggaaagacuaaugagcacaaugauauuaaucacuuuuau

SEQ ID NO: 438970 - RNA, 64 nt, Homo Sapiens
uguauuguguagcuaggccuaaugaagcauucaaaaugagcaaugcuaauggguuguuuagcuu

SEQ ID NO: 438971 - RNA, 64 nt, Homo Sapiens
aucuucucaccuugauuuugagcuggaauguuucaaugagcaaaauaaauuagacaaaaguuua

SEQ ID NO: 438972 - RNA, 64 nt, Homo Sapiens
gaucugccagacauucuaauuugaaccagauaucucuggguagcuacaaaguuccucagggguu

SEQ ID NO: 438973 - RNA, 64 nt, Homo Sapiens
acuuuauuccuccacaggaacccagcauuccugaucuggguaccaauauuucugcaaucaguuu

SEQ ID NO: 438974 - RNA, 64 nt, Homo Sapiens
aguaauagcuuuggcuguuuauuugauagcuguuucuggguauuuaauaggaauccuuucucaa

SEQ ID NO: 438975 - RNA, 64 nt, Homo Sapiens
cuggacacuucuuuauacucucuucccuuuuuuuucuggguagaagccacccuucccugccucc

SEQ ID NO: 438976 - RNA, 64 nt, Homo Sapiens
aagggguuaauaaaugggccauccuuuccugagcucuggguauacuaccagucacagaacguca

SEQ ID NO: 438977 - RNA, 64 nt, Homo Sapiens
ugcugccaaggccacaucacugagguaaaggcuuucuggguauucccguggagaaucagguuaa

SEQ ID NO: 438978 - RNA, 64 nt, Homo Sapiens
gucacuccuggugaugauauuaucuguucauuugucuggguauaguguguacgugaccacguuc

SEQ ID NO: 438979 - RNA, 64 nt, Homo Sapiens
uuuuuuucucucauaugcaccuugcaguuucuguucuggguagaugcauuuuccaaugagauau

SEQ ID NO: 438980 - RNA, 64 nt, Homo Sapiens
cuaaaaccugcucauaaccugaucauauuaaaaaucuggguaaaauccuuaugagggagauucu

SEQ ID NO: 438981 - RNA, 64 nt, Homo Sapiens
uaaaaacagaaaauuauaguaaacaggcuuggaaucuggguaauuccucagguauaaguucuau

SEQ ID NO: 438982 - RNA, 64 nt, Homo Sapiens
gaggccguuuaucuuuguaauugagguuuugaucucuggguaaauuuaucuucccccuugucgu

SEQ ID NO: 438983 - RNA, 64 nt, Homo Sapiens
uacaaaauuccucagggauuuugaaccacguaucucuggguagcgaucagucggacauuuuaau

SEQ ID NO: 438984 - RNA, 64 nt, Homo Sapiens
gacaggggugggaaggguccccugccuccugcucucuggguauaauccaguggagcuaaucagu

SEQ ID NO: 438985 - RNA, 64 nt, Homo Sapiens
uuucguuucccauugcuguacaggaauacgagcuucuggguaugucccaucuaaagaaaccugu

SEQ ID NO: 438986 - RNA, 64 nt, Homo Sapiens
ucuccuaugggcaaagccauccucuguuugccacucuggguaucaacagcauuuuuuuccuuag

SEQ ID NO: 438987 - RNA, 64 nt, Homo Sapiens
uaucuccuuguauuuuaaauuaggcuuaauguguucuggguauuaaauguucuguuuaaaucag

SEQ ID NO: 438988 - RNA, 64 nt, Homo Sapiens
ggaugcugaacugacucagcuuguguuuacuuuuucuggguagacccucacucuugcugcacag

SEQ ID NO: 438989 - RNA, 64 nt, Homo Sapiens
ggacagauaucauugcaucacauuuauuuaucuuucuggguauuuuuauagcccuuaauaaaaa

SEQ ID NO: 438990 - RNA, 64 nt, Homo Sapiens
aaaucauacaaaugguggcuguucugagaaucagucuggguauugauuuccuuuuccagugacu

SEQ ID NO: 438991 - RNA, 64 nt, Homo Sapiens
ugucaccugccuggcuccugcucucugauguaccucuggguagugagauggaaauggugccugc

SEQ ID NO: 438992 - RNA, 64 nt, Homo Sapiens
gacaauuagauaccuauccuguaguuacugaaaaucuggguaguaaaucuacccaauuaaaaug

SEQ ID NO: 438993 - RNA, 64 nt, Homo Sapiens
gaggaggcugugcugaguuuguguggcuggaaucucuggguaaggaacuuaaagaacaaaaauc

SEQ ID NO: 438994 - RNA, 64 nt, Homo Sapiens
acccuccuguuuuguugaaggaucaaccccaaauucuggguauuugaguacaugugaaucaugg

SEQ ID NO: 438995 - RNA, 64 nt, Homo Sapiens
caucaucuccacagccugguaaauuccaugugccucuggguacaaaagugccucaacgacaugc

SEQ ID NO: 438996 - RNA, 64 nt, Homo Sapiens
guuuuuacacuucucuuuaauucccaccuaagccucuggguaauauuguaaauauuguuuuaaa

SEQ ID NO: 438997 - RNA, 64 nt, Homo Sapiens
uguaguuuauaugcuuaguuguugccuauagugaucuggguaagauucaaacauuuaucuuuug

SEQ ID NO: 438998 - RNA, 64 nt, Homo Sapiens
ugcgcuggauggacaccgccuugcacuguuggauucuggguaugacauacucgcagcaguguua

SEQ ID NO: 438999 - RNA, 64 nt, Homo Sapiens
uguuaucaaaaugauuuuaaagacuauuucuuuuucuggguaacuauugaaguuuguaauuaaa

SEQ ID NO: 439000 - RNA, 64 nt, Homo Sapiens
ccaggucaccagauccaaggagcgcuugaggagcucuggguacagggcagcaacccagagccca

SEQ ID NO: 439001 - RNA, 64 nt, Homo Sapiens
agcccauaccagcuggcaucucccccccgugccuucuggguacaauaagcacccaauucucaac

SEQ ID NO: 439002 - RNA, 64 nt, Homo Sapiens
ugagacaagggcucggccuuaaggagcugaagagucuggguagcuuguuuaggguacaagaagc

SEQ ID NO: 439003 - RNA, 64 nt, Homo Sapiens
augaccugagucccuuaugacuuacccuuguagcucuggguaagagggacuuugaaaauuccau

SEQ ID NO: 439004 - RNA, 64 nt, Homo Sapiens
ucccuugaccccgagaucacgcaaaccugccccuucuggguacugaugguacuugcugucuucu

SEQ ID NO: 439005 - RNA, 64 nt, Homo Sapiens
cucccuuucuguaacagccuagagagguuugaguucuggguaucaaauauuuauaaauaaaagg

SEQ ID NO: 439006 - RNA, 64 nt, Homo Sapiens
gagcgggaguccguguucucggguguccuuuuauucuggguaggucccugagugaguuucuucu

SEQ ID NO: 439007 - RNA, 64 nt, Homo Sapiens
cacaaagaccaugaagacuugaaaacuucaauuuucuggguaugaaagaaaaaaaaaaagaaaa

SEQ ID NO: 439008 - RNA, 64 nt, Homo Sapiens
ggacuguuuuggauccaagggcugaaaugaaggcucuggguaggucccuaaugaacacgcaugg

SEQ ID NO: 439009 - RNA, 64 nt, Homo Sapiens
acuuuggugguuuaaaaaugaaaguucagaguuuucuggguagggaauuaugauggaagacagg

SEQ ID NO: 439010 - RNA, 64 nt, Homo Sapiens
cucacaugcacauauauggacccggcugugccccucuggguaugcccccccagcacccagcaug

SEQ ID NO: 439011 - RNA, 64 nt, Homo Sapiens
cguguuuuauguuaagucacaaacccacuugacuucuggguacuggaauuaauaccagugggug

SEQ ID NO: 439012 - RNA, 64 nt, Homo Sapiens
cccucccccaccccggguaguggagaugcuggugucuggguagucauggauuucugcuggacau

SEQ ID NO: 439013 - RNA, 64 nt, Homo Sapiens
auauacauuuaaagaccguguuuacauaaucucuucuggguagaaaauggaaauacuuaaccuu

SEQ ID NO: 439014 - RNA, 64 nt, Homo Sapiens
gaucauuuagaugagaguucuuuggggcuuauuuucuggguaaggcucaucuuuaaaaacuggc

SEQ ID NO: 439015 - RNA, 64 nt, Homo Sapiens
aagauugaacuacaggugcauagcaagcacucuuucuggguaacuaggcugcugguuuuaauua

SEQ ID NO: 439016 - RNA, 64 nt, Homo Sapiens
uauuguauuagaagucugcccuagcuguuaaauuucuggguauuuauccuaaggaauuaauuaa

SEQ ID NO: 439017 - RNA, 64 nt, Homo Sapiens
cuguaggagcaacuucucugaucaaaauuacuuuucuggguaugugcugauuaaggggguggac

SEQ ID NO: 439018 - RNA, 64 nt, Homo Sapiens
agcucuugggcugguuuuuccuaaagauuguucuucuggguaagaguuucagugaccuugaggg

SEQ ID NO: 439019 - RNA, 64 nt, Homo Sapiens
auuugcacuuuugagacuggcccuugaccuggguucuggguauagcugggacuggaaaggacag

SEQ ID NO: 439020 - RNA, 64 nt, Homo Sapiens
ccaugaagaaaaugaagcugugguuccacaucugucuggguaaagaaauaugcacuuagcacuu

SEQ ID NO: 439021 - RNA, 64 nt, Homo Sapiens
accugccucuggcccugguccugccccagcaggcucuggguaugggugaagacaggcuugaggg

SEQ ID NO: 439022 - RNA, 64 nt, Homo Sapiens
acagcgauucaaaggguggcauuggguuggacguucuggguacaagccaaccuagucccacguu

SEQ ID NO: 439023 - RNA, 64 nt, Homo Sapiens
gagggccgggaagccaggaaagcuugguguuuucucuggguacaccccaagcagcgucuccuuu

SEQ ID NO: 439024 - RNA, 64 nt, Homo Sapiens
aagagcggauuagucacagauauuggcuuugcuaucuggguagaaauuaauacaauucccugug

SEQ ID NO: 439025 - RNA, 64 nt, Homo Sapiens
uucuuaauuccacaugacugaggcauauaugaucucuggguaggugaguuguugugacaaccac

SEQ ID NO: 439026 - RNA, 64 nt, Homo Sapiens
gcuuuaagaaugaacacaaucggcaccauuggucucuggguaguucaggcgggcaccaaggcaa

SEQ ID NO: 439027 - RNA, 64 nt, Homo Sapiens
ccggaaaacaaaaggagggacacgcagucauggaucuggguagucaccgauuucauuacggugc

SEQ ID NO: 439028 - RNA, 64 nt, Homo Sapiens
auauccuacuguguaacaggucagaauuucaagcucuggguaauaacugcugauauuuuuucua

SEQ ID NO: 439029 - RNA, 64 nt, Homo Sapiens
gaguggucugaaaaaacaucaagcauaguaauugucuggguagacagauuucagaauuuuuaaa

SEQ ID NO: 439030 - RNA, 64 nt, Homo Sapiens
uccagugagccgagauggcgcuauugcacuccagucuggguaacagggagacugcaucucaaaa

SEQ ID NO: 439031 - RNA, 64 nt, Homo Sapiens
cuaacucaaaaaauuugaaguguuuuaaguuguuucuggguaagggagauguuaggagaaagga

SEQ ID NO: 439032 - RNA, 64 nt, Homo Sapiens
auguaccccuccgauuugugaagccuacaggaaaucuggguauauggauuuguaacugcagaag

SEQ ID NO: 439033 - RNA, 64 nt, Homo Sapiens
auuucauuuucuuauaaaccaguaaucuugcuuuucuggguaaauuuucagcuauuauuacuaa

SEQ ID NO: 439034 - RNA, 64 nt, Homo Sapiens
gagguccagguagccugcaacacuggaaaugaguucuggguaagugaguuauaagaguacaugc

SEQ ID NO: 439035 - RNA, 64 nt, Homo Sapiens
cagcuauggacaugcgggauaucucccccugcucucuggguauuugaaaugucaauuuuagcac

SEQ ID NO: 439036 - RNA, 64 nt, Homo Sapiens
cuuggcccaggauguugaaagggugcaaauuccuucuggguagauaagaaaugacucugggaga

SEQ ID NO: 439037 - RNA, 64 nt, Homo Sapiens; identical to SEQ ID NO: 235043

SEQ ID NO: 439038 - RNA, 64 nt, Homo Sapiens; identical to SEQ ID NO: 235044

SEQ ID NO: 439039 - RNA, 64 nt, Homo Sapiens
guauggggaaaaaaauguccaagaaaaugcaauaucuggguacuuacauuuccuaaaaugccau

SEQ ID NO: 439040 - RNA, 64 nt, Homo Sapiens
aaaagauguauguugcuaucaaauguauuuugccucuggguagggcaguguccacguuuuugga

SEQ ID NO: 439041 - RNA, 64 nt, Homo Sapiens
guccuuuaagaaaagugaauuugccuuccauuuuucuggguaauuugaaaaaaaucaaaauuuu

SEQ ID NO: 439042 - RNA, 64 nt, Homo Sapiens
aagaaagcaaaagcaagggauauguccgaugguaucuggguaagccuucaagugccaaacagag

SEQ ID NO: 439043 - RNA, 64 nt, Homo Sapiens
gcuggcaaugguugccuuaacguggcccugcauuucuggguagguagccugaggggccuggagu

SEQ ID NO: 439044 - RNA, 64 nt, Homo Sapiens
gggggacauccucuguuacuacagcaugcaccauucuggguacaucuacuugcaggguaucucc

SEQ ID NO: 439045 - RNA, 64 nt, Homo Sapiens
ugggcuucuggaaggguggccuuguucuccagcuucuggguagccagccucagccccuugucua

SEQ ID NO: 439046 - RNA, 64 nt, Homo Sapiens
cuguaggauuuucuuuucuuuaaaaaauguauauucuggguaguuuuaauugguaaaaaaaugu

SEQ ID NO: 439047 - RNA, 64 nt, Homo Sapiens
acugugcucaaccagacagauagugaaacagcuuucuggguaauucaccaauuuccuuuaaaac

SEQ ID NO: 439048 - RNA, 64 nt, Homo Sapiens
uagaacauauccuccagagacuuggcuuaauuggucuggguaaauauggcugagcguuguuauc

SEQ ID NO: 439049 - RNA, 64 nt, Homo Sapiens
guucaaaaacauucauccucuuacugcaaguuuaucuggguacuuuuaccuguguguucaaagg

SEQ ID NO: 439050 - RNA, 64 nt, Homo Sapiens
cacauacaaacaguggcaaaauaacauucaagcuucuggguaaaacauugaagugacuugggaa

SEQ ID NO: 439051 - RNA, 64 nt, Homo Sapiens
uucacuauugugagucaauauccagcucaacaagucuggguauauaggaaaaugaucagaauau

SEQ ID NO: 439052 - RNA, 64 nt, Homo Sapiens
ugauaggcgccuuucuggccacugagagucacucucuggguagaacugcaugaaaccaugacug

SEQ ID NO: 439053 - RNA, 64 nt, Homo Sapiens
auuuuuuagaggugccaguugaguuugagugcaaucuggguaacaggaggauuguugagcccag

SEQ ID NO: 439054 - RNA, 64 nt, Homo Sapiens
ucccauaugcacauagcacuuuguacaauuauuuucuggguacuuuauuuucaaacaagcacac

SEQ ID NO: 439055 - RNA, 64 nt, Homo Sapiens
gauuugcuguacauuuuuaaaagacucuuuuacuucuggguauuaagaaugaacuagaacauuc

SEQ ID NO: 439056 - RNA, 64 nt, Homo Sapiens
acuuucuuuggucacauaaugaggaaauugagguucuggguauaaacugccccauuuugaaggu

SEQ ID NO: 439057 - RNA, 64 nt, Homo Sapiens
cuccuggcugguuuaccugcugcugcccauuuucucuggguacugcuggccagaggacuuuagc

SEQ ID NO: 439058 - RNA, 64 nt, Homo Sapiens
agggaggaaggcagcuagaaaugggagggaagcuucuggguaggcaccauaguaggggaauguc

SEQ ID NO: 439059 - RNA, 64 nt, Homo Sapiens
gcagugaacgaaaugaauuuuaaugccuauuauuucuggguacuuuaacaauauuucaaauauc

SEQ ID NO: 439060 - RNA, 64 nt, Homo Sapiens
uuagaaauucucuacauucauugagcucucauugucuggguagaguauuacacguugcauacua

SEQ ID NO: 439061 - RNA, 64 nt, Homo Sapiens
gcaagauauuuaacuuaauaucuuagacaagaguucuggguacaauuuugggaucuaguucccc

SEQ ID NO: 439062 - RNA, 64 nt, Homo Sapiens
caaaggcaacauaugacaacaaguaauuuaugaaucuggguaguagcguugguaaucugaguuc

SEQ ID NO: 439063 - RNA, 64 nt, Homo Sapiens
gggugauaugugagagagaaaucuggaaccuucuucuggguagauacaggauaagauagauaca

SEQ ID NO: 439064 - RNA, 64 nt, Homo Sapiens
cuauuaaaggaaacuuugaagauuuccuauguauucuggguauuuucuaugucuagcacauguu

SEQ ID NO: 439065 - RNA, 64 nt, Homo Sapiens; identical to SEQ ID NO: 235045

SEQ ID NO: 439066 - RNA, 64 nt, Homo Sapiens; identical to SEQ ID NO: 235046

SEQ ID NO: 439067 - RNA, 64 nt, Homo Sapiens
uaaaaauuacucccucuuuuuugugcaucuucuuucuggguagucuacguaggaaaagauguau

SEQ ID NO: 439068 - RNA, 64 nt, Homo Sapiens
acugccuuuuccacacaaaggcugggaauaaaauucuggguauucucguauucucauuuaaagg

SEQ ID NO: 439069 - RNA, 64 nt, Homo Sapiens
uuuuuugucucaagauuauauuauaauaauguucucuggguagguguugaaaaugagccuguaa

SEQ ID NO: 439070 - RNA, 64 nt, Homo Sapiens
uguguauauaaugauaucuauauuuuugcccaggucuggguauugcuccugcccagacccugac

SEQ ID NO: 439071 - RNA, 64 nt, Homo Sapiens
uauuucuuacuguaauugccagaggcagaaauggucuggguauaagcuauuucauaaaagcagc

SEQ ID NO: 439072 - RNA, 64 nt, Homo Sapiens
aaaggaaauacaguauaacuaccagcccugugguucuggguagcuucuucaauauguguugaca

SEQ ID NO: 439073 - RNA, 64 nt, Homo Sapiens
uguuuuuuggaaaagauuuguccuuuuuuuguauucuggguaaaggaaucugaccacuauacug

SEQ ID NO: 439074 - RNA, 64 nt, Homo Sapiens
cuguuuuacccaggaauucuuggauauuuaguuuucuggguacugaaguggaugggagggggaa

SEQ ID NO: 439075 - RNA, 64 nt, Homo Sapiens
agacuucucaguguuggugcaacagaccuuaucaucuggguaacgcggagcaagugccaagcag

SEQ ID NO: 439076 - RNA, 64 nt, Homo Sapiens
uuuguuacuacuguugcuuuucaggcccuugucuucuggguaguacucaggagggggauggagc

SEQ ID NO: 439077 - RNA, 64 nt, Homo Sapiens
ggcugaggccagaggcccaugcugcgagccaggcucuggguagugaggagggggcaccgacagc

SEQ ID NO: 439078 - RNA, 64 nt, Homo Sapiens
auuguaagaaauacuguacaaugacuuuauugcaucuggguagcuguaaggcaugaaggaugcc

SEQ ID NO: 439079 - RNA, 64 nt, Homo Sapiens
ucaggaggaccugugaagcauguaguuaucuagaucuggguaauuucauguuuauuaaacucga

SEQ ID NO: 439080 - RNA, 64 nt, Homo Sapiens
guguuauugauuagugaggagccaguaagaaacaucuggguauuuggaaacaaguggucauugu

SEQ ID NO: 439081 - RNA, 64 nt, Homo Sapiens
agacuucaauccugauuagugucuccagucaagcucuggguacugaauugccuguucauaaaac

SEQ ID NO: 439082 - RNA, 64 nt, Homo Sapiens
guagguggcuugagcuagagauaaaacagaaucuucuggguaguccccuguugauuaucuucag

SEQ ID NO: 439083 - RNA, 64 nt, Homo Sapiens
guacauggguaucggugcucaaacacuuuuuuuuucuggguacaugugugcaagcaugaaguag

SEQ ID NO: 439084 - RNA, 64 nt, Homo Sapiens
cgggcagaguccuugggacauuuugaugguggccucuggguacucccugccccucccugcuccc

SEQ ID NO: 439085 - RNA, 64 nt, Homo Sapiens
cuggggcugaggaggugcccgggugaucggcuguucuggguagccacuggguugcugugcugua

SEQ ID NO: 439086 - RNA, 64 nt, Homo Sapiens
aggagacuuccugaauuuccgagggggugagcuuucuggguagagggaaaagguuauggaacug

SEQ ID NO: 439087 - RNA, 64 nt, Homo Sapiens
aaauuuaagcaagauauugaauacugcauuucacucuggguaccauagucaaaauaccccuaac

SEQ ID NO: 439088 - RNA, 64 nt, Homo Sapiens
gcauaaaaggcuucaucuuauugaaaaaguuaucucuggguauucugguauaaguguuucauau

SEQ ID NO: 439089 - RNA, 64 nt, Homo Sapiens
aaagucccuguuuuguccugaaauuuuagucuauucuggguaaauaggauuuucugacacagau

SEQ ID NO: 439090 - RNA, 64 nt, Homo Sapiens
aaccauguccaugcugagaaggcagcuuucccgcucuggguaccuuacguccugcccagcucug

SEQ ID NO: 439091 - RNA, 64 nt, Homo Sapiens
gcguggagcaugaguugugaauggcagggaucauucuggguaaaaaaaaccuagaaucauuucu

SEQ ID NO: 439092 - RNA, 64 nt, Homo Sapiens; identical to SEQ ID NO: 235047

SEQ ID NO: 439093 - RNA, 64 nt, Homo Sapiens; identical to SEQ ID NO: 235048

SEQ ID NO: 439094 - RNA, 64 nt, Homo Sapiens
cucugaguaggccuauaauuuaaaacuuucugugucuggguaccuuguaguuuacuauuuaccc

SEQ ID NO: 439095 - RNA, 64 nt, Homo Sapiens
aagcccuaacuucuguaauuauuguuuucuccuuucuggguaacguguccuggaugcccauuau

SEQ ID NO: 439096 - RNA, 64 nt, Homo Sapiens
aacugguucuauaaauuaagaauuaauuuacauuucuggguaaaacuucauuucaaaugaaguu

SEQ ID NO: 439097 - RNA, 64 nt, Homo Sapiens
gggcacagucaccccaggccuugcugagcccaggucuggguacugaguguccagagcugccucc

SEQ ID NO: 439098 - RNA, 64 nt, Homo Sapiens
auucuuugaguucuuaaaaguccuucauacaccuucuggguagggaaacaaccaacuaauugac

SEQ ID NO: 439099 - RNA, 64 nt, Homo Sapiens
gcuggggggguggggggcaguggauggugcccuaucuggguagagguagugugaguguggugug

SEQ ID NO: 439100 - RNA, 64 nt, Homo Sapiens
caacucaggugcaugauacaaggagagguugucaucuggguagggcagagaggagggcuugcuc

SEQ ID NO: 439101 - RNA, 64 nt, Homo Sapiens
uagguaguaguaaguaugugccacaggcugauuaucuggguaaucuuuuacgggugggagguga

SEQ ID NO: 439102 - RNA, 64 nt, Homo Sapiens
gagaagcagcagcagaaugaagaacccaaggacuucuggguacucugucggaguggucucuggu

SEQ ID NO: 439103 - RNA, 64 nt, Homo Sapiens
aauaaacaggugccugaacuaauuaauaguuuuaucuggguacaguaauuaaaauauacuuaaa

SEQ ID NO: 439104 - RNA, 64 nt, Homo Sapiens
ccagaaauuuguuugccugauuuaagaaaaugguucuggguacaauaaaaacccauggaaaugg

SEQ ID NO: 439105 - RNA, 64 nt, Homo Sapiens
gccucccuugggcaucuucaguggaggccugguuucuggguaauccuucugacaccagcucccu

SEQ ID NO: 439106 - RNA, 64 nt, Homo Sapiens
ucuugaaggugcugacggcccugaaaaggaggggucuggguacuguccccccacccucauucua

SEQ ID NO: 439107 - RNA, 64 nt, Homo Sapiens
uggaucauggcuccacuggguagcuugcugcaggucuggguagucucagaauuuuauuccaggc

SEQ ID NO: 439108 - RNA, 64 nt, Homo Sapiens
ggugagcaucccuggucuuccaaucaucugguccucuggguacuaugcucgugguagaacccau

SEQ ID NO: 439109 - RNA, 64 nt, Homo Sapiens
aacagcaucuuccacaguuuguugaacagaacaaucuggguagccucaggcuucaggcccacuu

SEQ ID NO: 439110 - RNA, 64 nt, Homo Sapiens
uucgcuucucccuggacugggcccugauucucccucuggguaaccagucccaggugaaccacac

SEQ ID NO: 439111 - RNA, 64 nt, Homo Sapiens
uauaccucucccaagcccccaucuuccuccugagucuggguaauaguagcucuuaggaaaauau

SEQ ID NO: 439112 - RNA, 64 nt, Homo Sapiens
gacaguaaagcccuuugauuaauaacaaugagcaucuggguacaaugaagaauaugagucauuc

SEQ ID NO: 439113 - RNA, 64 nt, Homo Sapiens
uggaguauaaacauuugaauucugcuguaauuguucuggguagacuuuggaggugccuauuuuu

SEQ ID NO: 439114 - RNA, 64 nt, Homo Sapiens
aaagcuaguuguucugucugcgagaaguugaaguucuggguaucaaaaacgaaaaccaaacgag

SEQ ID NO: 439115 - RNA, 64 nt, Homo Sapiens
ucaaucauagccaagaucccaucccuccauguacucuggguaucagcaacuguccucaucaguc

SEQ ID NO: 439116 - RNA, 64 nt, Homo Sapiens
cuucuauaaauucuuagguuuagagaugauaccaucuggguaccuuugcuugaaccgugcaacc

SEQ ID NO: 439117 - RNA, 64 nt, Homo Sapiens
cauuaacugaggguaauuacaguaguagacauggucuggguacuauacuaccauguuuauuugc

SEQ ID NO: 439118 - RNA, 64 nt, Homo Sapiens
acuuaaaaguuuacuauuucgaauacuucugcuuucuggguaaauagacauuaggaguggaucg

SEQ ID NO: 439119 - RNA, 64 nt, Homo Sapiens
ggacagcuaagacugagcauagcaguucacauggucuggguaaacaagucacuggcacagggga

SEQ ID NO: 439120 - RNA, 64 nt, Homo Sapiens
gcccagguuucuggucucuaggcuggggaaguccucuggguaggaaucagcaagaagauccuaa

SEQ ID NO: 439121 - RNA, 64 nt, Homo Sapiens
agagcgagacuuucuagaaaccacugcacuccagucuggguaacugcagugagccgaggucgca

SEQ ID NO: 439122 - RNA, 64 nt, Homo Sapiens
uuggaaguguuagguuuguguauaugauuugggcucuggguaaugccauuucucacuagcacua

SEQ ID NO: 439123 - RNA, 64 nt, Homo Sapiens
acugguuugcauuaguuuaucacguguuggugcuucuggguagcgauugguggaauggagaaca

SEQ ID NO: 439124 - RNA, 64 nt, Homo Sapiens
cacgauuggguaucacucacaguuugccuuuuuuucuggguaauguuuuuuggauuuuagccaa

SEQ ID NO: 439125 - RNA, 64 nt, Homo Sapiens
ggucuucccuugagcuccagccaguuagucccuaucuggguaagccuuguucccuuccaccccu

SEQ ID NO: 439126 - RNA, 64 nt, Homo Sapiens
aaggugcgcgccagcuguggguucucuaacuguaucuggguaaacgacuugaaacuuccuacau

SEQ ID NO: 439127 - RNA, 64 nt, Homo Sapiens
uuuccaggcuucccugacuuaacauguuaucaaaucuggguauccuuagccuggauuuccuucu

SEQ ID NO: 439128 - RNA, 64 nt, Homo Sapiens
cacaccucuuggcaaugaaagucaaauguaucuuucuggguaucguaacuuugauagaugguuu

SEQ ID NO: 439129 - RNA, 64 nt, Homo Sapiens
gggcaacgccugcagccccuaggaccuggauuccucuggguagagccugagccuuccuggagcc

SEQ ID NO: 439130 - RNA, 64 nt, Homo Sapiens
gacaggaaguauuguuucagucacagaaagcuuuucuggguaccucugguuagcacuuucuacu

SEQ ID NO: 439131 - RNA, 64 nt, Homo Sapiens
aggaggcggaggcgcuccucccugccucaguggcucuggguaccugcaagcagaacuuccaaag

SEQ ID NO: 439132 - RNA, 64 nt, Homo Sapiens
ugugcuccacagcucaccugcuugccaagguacgucuggguaguaguuucuggaaaugacugca

SEQ ID NO: 439133 - RNA, 64 nt, Homo Sapiens
gagccacagccuagggguuggaggaagacuccacucuggguacacccuuaggggcuggcuuuau

SEQ ID NO: 439134 - RNA, 64 nt, Homo Sapiens
aucucaacugcugguagcauucuuuaguaaugcaucuggguagcagucuccucaccuugagggg

SEQ ID NO: 439135 - RNA, 64 nt, Homo Sapiens
aucuucccuuuguugacuggagcguuugagcuccucuggguaaaacuucagagucuuucaugcc

SEQ ID NO: 439136 - RNA, 64 nt, Homo Sapiens
acggucacuguccucucuccgcaugggcagggguucuggguaggauggcccuggccagagcuca

SEQ ID NO: 439137 - RNA, 64 nt, Homo Sapiens
ccuggcaugccaacaucagcucucaacggugaccucuggguaguucaccaauggccaaaacucc

SEQ ID NO: 439138 - RNA, 64 nt, Homo Sapiens
gagcugucuaauccaaguccugggucuuugccuuucuggguaggguauggaagcaaguguggga

SEQ ID NO: 439139 - RNA, 64 nt, Homo Sapiens
gggaugggaaggaagggaccuuuggagggugucuucuggguagacucuggggcuucugcugucc

SEQ ID NO: 439140 - RNA, 64 nt, Homo Sapiens
uuuguauauauguguauauagcauuaugcacgugucuggguaucaccacuguguacuggagccu

SEQ ID NO: 439141 - RNA, 64 nt, Homo Sapiens
ugaguggcucugaaguugcaaauagcaucccaccucuggguaucccaaggaugucagauuagaa

SEQ ID NO: 439142 - RNA, 64 nt, Homo Sapiens
auuaugccaugguugcuuuugagauagauuguagucuggguagcaucuuuaaaauguauguggg

SEQ ID NO: 439143 - RNA, 64 nt, Homo Sapiens
aggaaauuauuuugauuaaauauauuuuauuugaucuggguauuuuuggaccacauuauuaaau

SEQ ID NO: 439144 - RNA, 64 nt, Homo Sapiens
agaaguagacagacagguuacaaguucuuuuauuucuggguaacccuccagccaagcagcccuu

SEQ ID NO: 439145 - RNA, 64 nt, Homo Sapiens
cuucaaugguuuguuaguugccauuacaacuuugucuggguagaguuuuugaguuuuugcaguu

SEQ ID NO: 439146 - RNA, 64 nt, Homo Sapiens
cuaagcaacguggcuuaguccaucagcaucuuauucuggguaauaaaaaauaaaaauaaacgga

SEQ ID NO: 439147 - RNA, 64 nt, Homo Sapiens
gggacgaggagcgaacacuggaucugaaucauguucuggguaaguguuuuuguguuuauguuag

SEQ ID NO: 439148 - RNA, 64 nt, Homo Sapiens
agggcacaccccucuaguuuaguccccugcaguuucuggguaacauucucccccucucccugag

SEQ ID NO: 439149 - RNA, 64 nt, Homo Sapiens
gugugugucucacauuuuuaguucucuuggcagaucuggguaaucugagaagaccaggaacaaa

SEQ ID NO: 439150 - RNA, 64 nt, Homo Sapiens
ucuuaaaucuuagccucaguggggaaaauuuagcucuggguagcagagcagggaggcuugggga

SEQ ID NO: 439151 - RNA, 64 nt, Homo Sapiens
guguugaaucuacaucacauguuauagaaauuucucuggguauuuuuuguuucuuuaacaaaaa

SEQ ID NO: 439152 - RNA, 64 nt, Homo Sapiens
cagagagcacugcacuucccccccugcuccagcuucuggguaucguccagacaagagucacugg

SEQ ID NO: 439153 - RNA, 64 nt, Homo Sapiens
uuuuggcuugcaaaauauuuuuguaauaaagauuucuggguaauaaugaguccuuccgguguuc

SEQ ID NO: 439154 - RNA, 64 nt, Homo Sapiens
cacaucaugacccuuucuggcagccucuuggugcucuggguagugagggaugaccagucuuguc

SEQ ID NO: 439155 - RNA, 64 nt, Homo Sapiens
gugugcuguuugaauugacuauuugcacucaaagucuggguauucauugguuauuggccugaaa

SEQ ID NO: 439156 - RNA, 64 nt, Homo Sapiens
cuugucaccugcuugcaaaggguauagacaucauucuggguaguucuagaggauaucgcaacaa

SEQ ID NO: 439157 - RNA, 64 nt, Homo Sapiens
agggcauuccuccccacucugucuccaggcugccucuggguagccucuagucugcuguucuuca

SEQ ID NO: 439158 - RNA, 64 nt, Homo Sapiens
aggaauacacugguuaacagggagccagauuuguucuggguauuaauuauuugaaugccugcca

SEQ ID NO: 439159 - RNA, 52 nt, Homo Sapiens
ugcacggggcacugcccugagcucuggguaaggacgagaagagccaaggucc

SEQ ID NO: 439160 - RNA, 64 nt, Homo Sapiens
agguuggagggggcacuuagcagugaaccuuaagucuggguacauguaacccugcugaggggcu

SEQ ID NO: 439161 - RNA, 64 nt, Homo Sapiens
ggucuguaagaaggggcuggacccaggcucuuccucuggguaaaaggugcagagguucugaggg

SEQ ID NO: 439162 - RNA, 64 nt, Homo Sapiens
cuugagcuauguaugacacaacaucuccugcuguucuggguaaccaaggcccaaaugcuggacc

SEQ ID NO: 439163 - RNA, 64 nt, Homo Sapiens
cauuuagaucaucuaaaucagguaugagugaaacucuggguauggucuuuccugaggccaaauu

SEQ ID NO: 439164 - RNA, 64 nt, Homo Sapiens
guuaguuacuuauauuuuuauuagaacucauuauucuggguacccuccaaugagaauuagagag

SEQ ID NO: 439165 - RNA, 64 nt, Homo Sapiens
auaaagaaaaaaacaauauuggauuuggauuuaaucuggguaaaaucagccuucugagaagggc

SEQ ID NO: 439166 - RNA, 64 nt, Homo Sapiens
ugcaaagccacagucaugaagagaccauggugugucuggguaacugugagcaguuuauguaacu

SEQ ID NO: 439167 - RNA, 64 nt, Homo Sapiens
acaguacuuauguucccaaguagcaucaucaucuucuggguaguaauuacauugugguauuaau

SEQ ID NO: 439168 - RNA, 64 nt, Homo Sapiens
agacauuggacagauauuuuucaugcuucuuuugucuggguaauuuuaauuuuauaaaauuuaa

SEQ ID NO: 439169 - RNA, 64 nt, Homo Sapiens
uccuguguccuagugacugugugaugaaauaauuucuggguagacagguggaauagaagaaauc

SEQ ID NO: 439170 - RNA, 58 nt, Homo Sapiens
uuaggaagaguugggaguuguucuauuuucuggguauucaaggcaaaguguugucuga

SEQ ID NO: 439171 - RNA, 64 nt, Homo Sapiens
aguggcuuguuucguucuuagucagcuugugguuucuggguauaugaagagauuucaaagaauu

SEQ ID NO: 439172 - RNA, 64 nt, Homo Sapiens
ccacagaugcaaaagggagaccccucucucuaacucuggguaucgaagaaaauagcagacguuu

SEQ ID NO: 439173 - RNA, 64 nt, Homo Sapiens; identical to SEQ ID NO: 391125

SEQ ID NO: 439174 - RNA, 64 nt, Homo Sapiens; identical to SEQ ID NO: 391126

SEQ ID NO: 439175 - RNA, 64 nt, Homo Sapiens; identical to SEQ ID NO: 391127

SEQ ID NO: 439176 - RNA, 64 nt, Homo Sapiens; identical to SEQ ID NO: 391128

SEQ ID NO: 439177 - RNA, 64 nt, Homo Sapiens; identical to SEQ ID NO: 391129

SEQ ID NO: 439178 - RNA, 64 nt, Homo Sapiens; identical to SEQ ID NO: 391130

SEQ ID NO: 439179 - RNA, 64 nt, Homo Sapiens; identical to SEQ ID NO: 391131

SEQ ID NO: 439180 - RNA, 64 nt, Homo Sapiens; identical to SEQ ID NO: 391132

SEQ ID NO: 439181 - RNA, 64 nt, Homo Sapiens; identical to SEQ ID NO: 391133

SEQ ID NO: 439182 - RNA, 64 nt, Homo Sapiens; identical to SEQ ID NO: 391134

SEQ ID NO: 439183 - RNA, 64 nt, Homo Sapiens; identical to SEQ ID NO: 391135

SEQ ID NO: 439184 - RNA, 64 nt, Homo Sapiens; identical to SEQ ID NO: 391136

SEQ ID NO: 439185 - RNA, 64 nt, Homo Sapiens; identical to SEQ ID NO: 391137

SEQ ID NO: 439186 - RNA, 64 nt, Homo Sapiens; identical to SEQ ID NO: 391138

SEQ ID NO: 439187 - RNA, 64 nt, Homo Sapiens; identical to SEQ ID NO: 391139

SEQ ID NO: 439188 - RNA, 64 nt, Homo Sapiens; identical to SEQ ID NO: 391140

SEQ ID NO: 439189 - RNA, 64 nt, Homo Sapiens
aucccugagagucucuguuucaucaggacauucugaaauuuacccacagugaggcuguggaugg

SEQ ID NO: 439190 - RNA, 64 nt, Homo Sapiens
gcuuagauuuaaaagcaucaaaacaacaacaauggaaauuuauguuggcgauagccaagaccac

SEQ ID NO: 439191 - RNA, 64 nt, Homo Sapiens
agauaacacuuuuuaagacuggagaaaagaccaugaaauuuaccgaaaaaaccugagaagaaag

SEQ ID NO: 439192 - RNA, 64 nt, Homo Sapiens
ucauacuuauuuuuuuaguaguuuuaagaaaaaugaaauuuauguaggagccacgugagugaaa

SEQ ID NO: 439193 - RNA, 64 nt, Homo Sapiens
gcuuuauguuaccaaaacauacaguaaaaaaguagaaauuuaugaaauacuuuugauaaaaagu

SEQ ID NO: 439194 - RNA, 64 nt, Homo Sapiens
auacuuuuuaaccaaucucuguggcuucacucaugaaauuuacuucaguuaauaugagacuggg

SEQ ID NO: 439195 - RNA, 64 nt, Homo Sapiens
aggauaagcauuuugcucuuuuuaagaacagcaugaaauuuagaauaccaaugauagcuaucuu

SEQ ID NO: 439196 - RNA, 64 nt, Homo Sapiens
ugauagcuaucuuuaagaaucagaauuaguacuagaaauuuaaaaaacccuauaguuuggaguu

SEQ ID NO: 439197 - RNA, 64 nt, Homo Sapiens
uuggaaguacauuuuuauaaguuuuuauauucuagaaauuuauugggcuggaaaaauguagaac

SEQ ID NO: 439198 - RNA, 64 nt, Homo Sapiens
acuugcauuuuuauauaugugguaaauuuuuauugaaauuuaaaacaugaucaucaaguuaauu

SEQ ID NO: 439199 - RNA, 64 nt, Homo Sapiens
uuacauugacauugcauugcaaagaggagagaaagaaauuuauugcauacaucaugauuauggc

SEQ ID NO: 439200 - RNA, 64 nt, Homo Sapiens
uauaacucuauguaguuauagaacuaauuucuaagaaauuuaguucauauauuuuagcauauuc

SEQ ID NO: 439201 - RNA, 64 nt, Homo Sapiens
uucuuccuaguucuggaggcauuuaaaaagaaaagaaauuuauuagaauacgacagacugggua

SEQ ID NO: 439202 - RNA, 64 nt, Homo Sapiens
uuuuaauaaauuaaaaaauccaggcaugguaacagaaauuuaccuuuucuauuuugcauauuuu

SEQ ID NO: 439203 - RNA, 64 nt, Homo Sapiens
gacuuuuaagaaaugcuaacagauuuuucuggaggaaauuuagacaaaacaaugucauuuagua

SEQ ID NO: 439204 - RNA, 64 nt, Homo Sapiens
uaugcauacacagaugcauauguguauauauaaugaaauuuauguugcugguauuuugcauuuu

SEQ ID NO: 439205 - RNA, 64 nt, Homo Sapiens
cuugcuacuauagcgucuuauguaugguuuaaaggaaauuuaucaggugagagagaugagcaac

SEQ ID NO: 439206 - RNA, 64 nt, Homo Sapiens
uugauacuuagucaugggaggauauuacaaaaaagaaauuuaaauuguguucauagucuuucag

SEQ ID NO: 439207 - RNA, 64 nt, Homo Sapiens
cucgaaccaagcaaaaggcucucacacaaagggagaaauuuaaaaggccagaacuauagucaua

SEQ ID NO: 439208 - RNA, 64 nt, Homo Sapiens
aauaaggagaggaguccaagccagauccuaauuggaaauuuagcucucuaagggacaggauuuu

SEQ ID NO: 439209 - RNA, 64 nt, Homo Sapiens
ucuauucccaugccagaaucuuaucaauacauaagaaauuuaggaagauuaggugccaaaauac

SEQ ID NO: 439210 - RNA, 64 nt, Homo Sapiens
gucccucaacuuggcuaaagaaucucaaucucuugaaauuuauuuuuuuaaugucauauucauc

SEQ ID NO: 439211 - RNA, 64 nt, Homo Sapiens
uguagaagucacugccuucuuguuuugauuuuuugaaauuuaaucugaagcuaauaauguuuua

SEQ ID NO: 439212 - RNA, 64 nt, Homo Sapiens
aauuauuuaaaaguuaccauuuaacagauuacaugaaauuuaggaaauguuaacaaaauauauc

SEQ ID NO: 439213 - RNA, 64 nt, Homo Sapiens
ucuggcauacggauaggcuucauuaagaguuccugaaauuuauaaguuucuguaaaagaagaga

SEQ ID NO: 439214 - RNA, 64 nt, Homo Sapiens
uagauaauuauagguugauuuauguauguaaagugaaauuuaaaguuaaccucagcugugaucu

SEQ ID NO: 439215 - RNA, 64 nt, Homo Sapiens
aauauauuuucaucucuucuuguuaaauugggaggaaauuuaugauagcaauuaugaagauugu

SEQ ID NO: 439216 - RNA, 64 nt, Homo Sapiens
uaguucaacaugaacuaaaauggcaugcuauuuggaaauuuaguuugagauaaacuaaagugug

SEQ ID NO: 439217 - RNA, 64 nt, Homo Sapiens
aaaccagcacuuggccaaaaacaaaauuguaaaggaaauuuaaauucuggagaauucuacaggg

SEQ ID NO: 439218 - RNA, 64 nt, Homo Sapiens
gaacugucuucucagcaguugauccagcuguacggaaauuuaggguauuuaaacuuuuaaagga

SEQ ID NO: 439219 - RNA, 64 nt, Homo Sapiens
ugugguuuuaaagucauuccgcaaaaaucucucagaaauuuaugaagguggaugguaccuuaug

SEQ ID NO: 439220 - RNA, 64 nt, Homo Sapiens
gcacuaaaugcccacaaggggcaguguguagagggaaauuuauaaucucugggacacauuuaaa

SEQ ID NO: 439221 - RNA, 64 nt, Homo Sapiens
ucuuuuagacuuuuaaggacaauuuacagcaaaugaaauuuaugaugcugugacaagaaauuua

SEQ ID NO: 439222 - RNA, 64 nt, Homo Sapiens
uuuacagcaaaugaaauuuaugaugcugugacaagaaauuuaaagaaucaaaacgaugguuuga

SEQ ID NO: 439223 - RNA, 64 nt, Homo Sapiens
aguaugauucuuuauuuuuacuuuuucauuucaagaaauuuagaguuuccaaauuuagagcuuc

SEQ ID NO: 439224 - RNA, 64 nt, Homo Sapiens
caaagucauuuagggguaauaaauacuuggcuuggaaauuuaacacaguccuuuugucuccaaa

SEQ ID NO: 439225 - RNA, 64 nt, Homo Sapiens
aaaaucaaaauaauauucugugacaaugacaggugaaauuuauaugugacaagugaaaauuaua

SEQ ID NO: 439226 - RNA, 64 nt, Homo Sapiens
ggugaaauuuauaugugacaagugaaaauuauaugaaauuuaagaguccauaaauaaaauuugu

SEQ ID NO: 439227 - RNA, 64 nt, Homo Sapiens
auguaauacuugaguagauuuuuuuuucuaguuugaaauuuagucugucuuuuugaccuuacua

SEQ ID NO: 439228 - RNA, 64 nt, Homo Sapiens
auuuuugcuuuuacuucaaauguuauuuaaaguagaaauuuaauuuguagauauaaccuuuaaa

SEQ ID NO: 439229 - RNA, 64 nt, Homo Sapiens
gguuucugaaucaagcuuaaaauuaccccacauggaaauuuaggagugaugaucugacauuuac

SEQ ID NO: 439230 - RNA, 64 nt, Homo Sapiens
uguuauggcugaaauuccucccccucaaagccuagaaauuuaauuaauacucaagguuguaaaa

SEQ ID NO: 439231 - RNA, 64 nt, Homo Sapiens
uuagguacagucuggaucauggcauguagaaauagaaauuuagaauuuuacugcagcuuugaug

SEQ ID NO: 439232 - RNA, 64 nt, Homo Sapiens
uauguuuuuauguaaucagucauuacacuagggagaaauuuaucagcuuuaguucuaaauaugc

SEQ ID NO: 439233 - RNA, 64 nt, Homo Sapiens
aaauacagauuauuuauuaacucuguucugccuggaaauuuaggcuucauacggaaaguguuug

SEQ ID NO: 439234 - RNA, 64 nt, Homo Sapiens
uucuuauguacaaggaacaacaauaaaucauauggaaauuuauauuuauacuuacuguauccau

SEQ ID NO: 439235 - RNA, 64 nt, Homo Sapiens
auauacauccuucccuauuauguguaugcaaauagaaauuuauaagcauuuuacuacaaguuaa

SEQ ID NO: 439236 - RNA, 64 nt, Homo Sapiens
uuucugucacuauagauuaauuugcauuuuuaaagaaauuuacauacauggaaccauacaucau

SEQ ID NO: 439237 - RNA, 64 nt, Homo Sapiens
gucuaaaaugcaugaauauauaugucuauauccugaaauuuauugaucucaaauagcaugagug

SEQ ID NO: 439238 - RNA, 64 nt, Homo Sapiens
caagugcaguugucuugauuuucucuguaugacagaaauuuaaccagcuguaauuuuucuauaa

SEQ ID NO: 439239 - RNA, 64 nt, Homo Sapiens
aagaagauaaauaauuguguaauuaaacuuuccagaaauuuaucuuccucaugugcaguuuaac

SEQ ID NO: 439240 - RNA, 64 nt, Homo Sapiens
acuacauauauauuuagaggaagaaagugaaggggaaauuuaaaauguuuacggcgcuuaauug

SEQ ID NO: 439241 - RNA, 64 nt, Homo Sapiens
uucuucaugugaugucaugaugccauuuuuauuagaaauuuaauaucugcucaguaauauaauu

SEQ ID NO: 439242 - RNA, 64 nt, Homo Sapiens
ucagggaaaagaccaagggcuuuuacaagagagugaaauuuagguggguagggggaaaugaccu

SEQ ID NO: 439243 - RNA, 64 nt, Homo Sapiens
gcugaucacaaggacagacaucaaaaagaaaaaagaaauuuauucaacagagcgagacucaguc

SEQ ID NO: 439244 - RNA, 64 nt, Homo Sapiens
gcugauuggccaggugcgguggguaaauagaaaagaaauuuauugugugaauuaauaagaaaug

SEQ ID NO: 439245 - RNA, 64 nt, Homo Sapiens
cuuaguaaauguaauaaauuauuuuuuagaucuugaaauuuauaauaaaaauacuuuaccuacc

SEQ ID NO: 439246 - RNA, 64 nt, Homo Sapiens
ccaaaaccugauguuuuaaaugugcuuucuuuuugaaauuuauguuuucaaauaaaaucucccu

SEQ ID NO: 439247 - RNA, 64 nt, Homo Sapiens
agccgugcgccagggcagggggagcugccuucccagggagaagggucaguggccuuucaccagu

SEQ ID NO: 439248 - RNA, 64 nt, Homo Sapiens
caggcccugccucuccaggggaugcaagcucuaaagggagaaguucucuccugagccuccucuu

SEQ ID NO: 439249 - RNA, 64 nt, Homo Sapiens
aauuuauugugcaaaugcugugguaccagggaagagggagaauuuucaggggugguaaggacuc

SEQ ID NO: 439250 - RNA, 64 nt, Homo Sapiens
uugaugcaauaggacaauuuuuauugauaaaguuagggagaagaaagugagggaaaucaggucu

SEQ ID NO: 439251 - RNA, 64 nt, Homo Sapiens
uaaugaccauuguuaaagugaggcaugaguccuuagggagaaguaaucuuauguaaauaaccuu

SEQ ID NO: 439252 - RNA, 64 nt, Homo Sapiens
gaaagguuuaauauacuccuccaugaguguucagagggagaaaaugaaaguauaaaugaauggg

SEQ ID NO: 439253 - RNA, 64 nt, Homo Sapiens
agggcucgggaagccacgccggggggguucugugagggagaaucaggcucucccaggggcugau

SEQ ID NO: 439254 - RNA, 64 nt, Homo Sapiens
cacaucucuucugggcggccguuccucuggugggagggagaacgcggcauggagggugguguga

SEQ ID NO: 439255 - RNA, 64 nt, Homo Sapiens
cuguuuucugugucuagugccaauuagcuaaaucagggagaaagaaaugaucacaugacuuuua

SEQ ID NO: 439256 - RNA, 64 nt, Homo Sapiens
cacugucuaaguuuauguugcauuuuuagucaaaagggagaaaucuuauuccuucuugaaaauu

SEQ ID NO: 439257 - RNA, 64 nt, Homo Sapiens
agggcaccaccuucaaggcacagcccuuguugggagggagaacccucuccagaaacccugccac

SEQ ID NO: 439258 - RNA, 64 nt, Homo Sapiens
uugguuuccucucugcucugccccugcucagcacagggagaauguugacuuagaagcaauaggg

SEQ ID NO: 439259 - RNA, 64 nt, Homo Sapiens
auggacaauaaaguaguauaugauccucagauacagggagaaggacaaggcauacagcuuauug

SEQ ID NO: 439260 - RNA, 64 nt, Homo Sapiens
acuuugaagauaggaauaucuaaauuauaucucuagggagaaaauguuguaaaaaauuaaaagu

SEQ ID NO: 439261 - RNA, 64 nt, Homo Sapiens
caaucggccuauuggcucaaugggaagagaggagagggagaaaaauaaaaugaaaggaaaaaaa

SEQ ID NO: 439262 - RNA, 64 nt, Homo Sapiens
cacaucacuggaaucugcaauucaagaagugacaagggagaauucuugcuuuaccuauggacug

SEQ ID NO: 439263 - RNA, 64 nt, Homo Sapiens
gcagugggaaaagaggugagcugugagcuggaaaagggagaaagaaaggcccggcccaggacca

SEQ ID NO: 439264 - RNA, 64 nt, Homo Sapiens
aaagcaagccagaagcagagucaacucuaggacaagggagaacaccccauucccucuuuaucua

SEQ ID NO: 439265 - RNA, 64 nt, Homo Sapiens
cucaagacuguuagccuggcagagccaggggugaagggagaagcucuuggagcaggcaggaugc

SEQ ID NO: 439266 - RNA, 64 nt, Homo Sapiens
ucccaugguguucugacuucaagggcuggcagccagggagaaugggcccaggggaagcaaagac

SEQ ID NO: 439267 - RNA, 64 nt, Homo Sapiens
uugacaccugacucugagcuggaacaguaggggcagggagaagacaggucucaagaaaagguuu

SEQ ID NO: 439268 - RNA, 64 nt, Homo Sapiens
aaaagaaagucuucugggauuuauagaucaauuuagggagaaaugacauuuuaacaauucugag

SEQ ID NO: 439269 - RNA, 64 nt, Homo Sapiens
uggucuugugucuuaagacagcugcugugaccaaagggagaauggagauaacagggguggcagg

SEQ ID NO: 439270 - RNA, 64 nt, Homo Sapiens
gacucaaaccaggaauuuccaaagauuucaagccagggagaaggguucuuggugaugcagggca

SEQ ID NO: 439271 - RNA, 64 nt, Homo Sapiens
cuuugagccuccugccccugcuuucugcccagggagggagaaggaagagggggagcugguuuuu

SEQ ID NO: 439272 - RNA, 64 nt, Homo Sapiens
gcaagugcucuggggaugaggcauggguauaggaagggagaaaggaguuggagacaagauccuc

SEQ ID NO: 439273 - RNA, 64 nt, Homo Sapiens
ccucuuagcaaagcccugugagcagaaaagaaaaagggagaaaacaaccgccaaauuguuucag

SEQ ID NO: 439274 - RNA, 64 nt, Homo Sapiens
uggcauaacuuuuuggaacaaggggugagaaggaagggagaagggcugguggcugggacccucc

SEQ ID NO: 439275 - RNA, 64 nt, Homo Sapiens
cugagcugcugugaaagccccugcacaaucagccagggagaacugggcggguuuaguggcccca

SEQ ID NO: 439276 - RNA, 64 nt, Homo Sapiens
gucuuaggccuacgaugccacacaaagguuguucagggagaagggggugcaggaggcagagggu

SEQ ID NO: 439277 - RNA, 64 nt, Homo Sapiens
ggggucgccaacacuuguguuggacagagggagaagggagaacacuuuuaucauugcaggccag

SEQ ID NO: 439278 - RNA, 64 nt, Homo Sapiens
gagaacaggggucgccaacaaggccaguggacagagggagaaggugcaugucuuuuaucauugc

SEQ ID NO: 439279 - RNA, 64 nt, Homo Sapiens
cauuuaacaaaacuaaucuaaaaaagaacuaaaaagggagaacggggcaagggaccucaggcug

SEQ ID NO: 439280 - RNA, 64 nt, Homo Sapiens
cccauuaaagaccgggcugguuagcguccagcucagggagaagggcgcuagugccuaaccucac

SEQ ID NO: 439281 - RNA, 64 nt, Homo Sapiens
cgggcuccugggcccuguucuuaggaucaguggcagggagaaacggguaucucuuuucucucuu

SEQ ID NO: 439282 - RNA, 64 nt, Homo Sapiens
cacucugagguuuccccaagagaaccagauuggcagggagaagcauuguggggcaauuguuccu

SEQ ID NO: 439283 - RNA, 64 nt, Homo Sapiens
agacauagucauuuaugauuuaggaagggugggaagggagaagcgguggggagggaggaaaggg

SEQ ID NO: 439284 - RNA, 64 nt, Homo Sapiens
gacgcugccgccuaagagugcaguuacuggcaagagggagaaaguccacugguugacauggcag

SEQ ID NO: 439285 - RNA, 64 nt, Homo Sapiens
aguguccucagccgacacucacgagggcagugcaagggagaaccugccagcccagccccaccac

SEQ ID NO: 439286 - RNA, 64 nt, Homo Sapiens
auggucaugaaagcgugguucuguaagaaaucagagggagaaagggagagaagggggagggaga

SEQ ID NO: 439287 - RNA, 64 nt, Homo Sapiens
uccaggucaugcaguuccugucgugggucacuacagggagaaaaguccucuacaucaauuaaca

SEQ ID NO: 439288 - RNA, 64 nt, Homo Sapiens
aagggcagagaauggcuggguugggcuacccuaaagggagaaggauguuguguggcaaugggau

SEQ ID NO: 439289 - RNA, 64 nt, Homo Sapiens
uauuguguaacaaguacugcucccagcagcaauuagggagaaaacuagucuaaauuauuucaac

SEQ ID NO: 439290 - RNA, 64 nt, Homo Sapiens
gguuacaccacuccuucguccuuacaggagauguagggagaagaaucugcaggcugcuuguagg

SEQ ID NO: 439291 - RNA, 64 nt, Homo Sapiens
gacauguuuucuauuuucuuagaaaggucacuaaagggagaaauuaaaccagguaauugaauga

SEQ ID NO: 439292 - RNA, 64 nt, Homo Sapiens
aacaaucacuggucuugucuucaggggcuccaacagggagaaaaugccaucuuaaucacagacc

SEQ ID NO: 439293 - RNA, 64 nt, Homo Sapiens
aagccugauacuuuagccaucauaacucacuaacagggagaaguagcuaguagcaaugugccuu

SEQ ID NO: 439294 - RNA, 64 nt, Homo Sapiens
cagagugacagucauaaauacugucaaacaauaaagggagaauggugcuguuuaaagucacauc

SEQ ID NO: 439295 - RNA, 64 nt, Homo Sapiens
ccucugugggcagggcuuguaggaggacacacucagggagaagauaaaccucaucuuguacuaa

SEQ ID NO: 439296 - RNA, 64 nt, Homo Sapiens
ugcauguggggacacuguggugaucacacaccacagggagaaucauguaugggcaaagcuuuug

SEQ ID NO: 439297 - RNA, 64 nt, Homo Sapiens
ucugccuggccgugcugaaccucugcuggucccaagggagaagggagugagcgugggucaccug

SEQ ID NO: 439298 - RNA, 64 nt, Homo Sapiens
auaugcacugaugaggaaagacauacugugugauagggagaaaaagcagcuuauaaaauaaugu

SEQ ID NO: 439299 - RNA, 64 nt, Homo Sapiens; identical to SEQ ID NO: 295046

SEQ ID NO: 439300 - RNA, 64 nt, Homo Sapiens; identical to SEQ ID NO: 295047

SEQ ID NO: 439301 - RNA, 64 nt, Homo Sapiens; identical to SEQ ID NO: 295048

SEQ ID NO: 439302 - RNA, 64 nt, Homo Sapiens; identical to SEQ ID NO: 295049

SEQ ID NO: 439303 - RNA, 64 nt, Homo Sapiens; identical to SEQ ID NO: 295050

SEQ ID NO: 439304 - RNA, 64 nt, Homo Sapiens; identical to SEQ ID NO: 295051

SEQ ID NO: 439305 - RNA, 64 nt, Homo Sapiens; identical to SEQ ID NO: 295052

SEQ ID NO: 439306 - RNA, 64 nt, Homo Sapiens; identical to SEQ ID NO: 295053

SEQ ID NO: 439307 - RNA, 64 nt, Homo Sapiens; identical to SEQ ID NO: 295054

SEQ ID NO: 439308 - RNA, 64 nt, Homo Sapiens; identical to SEQ ID NO: 295055

SEQ ID NO: 439309 - RNA, 64 nt, Homo Sapiens; identical to SEQ ID NO: 295056

SEQ ID NO: 439310 - RNA, 64 nt, Homo Sapiens; identical to SEQ ID NO: 295057

SEQ ID NO: 439311 - RNA, 64 nt, Homo Sapiens; identical to SEQ ID NO: 295058

SEQ ID NO: 439312 - RNA, 64 nt, Homo Sapiens; identical to SEQ ID NO: 295059

SEQ ID NO: 439313 - RNA, 64 nt, Homo Sapiens; identical to SEQ ID NO: 295060

SEQ ID NO: 439314 - RNA, 64 nt, Homo Sapiens; identical to SEQ ID NO: 295061

SEQ ID NO: 439315 - RNA, 64 nt, Homo Sapiens; identical to SEQ ID NO: 295062

SEQ ID NO: 439316 - RNA, 64 nt, Homo Sapiens; identical to SEQ ID NO: 295063

SEQ ID NO: 439317 - RNA, 64 nt, Homo Sapiens; identical to SEQ ID NO: 295064

SEQ ID NO: 439318 - RNA, 64 nt, Homo Sapiens; identical to SEQ ID NO: 295065

SEQ ID NO: 439319 - RNA, 64 nt, Homo Sapiens; identical to SEQ ID NO: 295066

SEQ ID NO: 439320 - RNA, 64 nt, Homo Sapiens; identical to SEQ ID NO: 295067

SEQ ID NO: 439321 - RNA, 64 nt, Homo Sapiens; identical to SEQ ID NO: 295068

SEQ ID NO: 439322 - RNA, 64 nt, Homo Sapiens; identical to SEQ ID NO: 295069

SEQ ID NO: 439323 - RNA, 64 nt, Homo Sapiens; identical to SEQ ID NO: 295070

SEQ ID NO: 439324 - RNA, 64 nt, Homo Sapiens; identical to SEQ ID NO: 295071

SEQ ID NO: 439325 - RNA, 64 nt, Homo Sapiens; identical to SEQ ID NO: 295072

SEQ ID NO: 439326 - RNA, 64 nt, Homo Sapiens; identical to SEQ ID NO: 295073

SEQ ID NO: 439327 - RNA, 64 nt, Homo Sapiens; identical to SEQ ID NO: 295074

SEQ ID NO: 439328 - RNA, 64 nt, Homo Sapiens; identical to SEQ ID NO: 295075

SEQ ID NO: 439329 - RNA, 64 nt, Homo Sapiens; identical to SEQ ID NO: 295076

SEQ ID NO: 439330 - RNA, 64 nt, Homo Sapiens; identical to SEQ ID NO: 295077

SEQ ID NO: 439331 - RNA, 64 nt, Homo Sapiens; identical to SEQ ID NO: 295078

SEQ ID NO: 439332 - RNA, 64 nt, Homo Sapiens; identical to SEQ ID NO: 295079

SEQ ID NO: 439333 - RNA, 64 nt, Homo Sapiens; identical to SEQ ID NO: 295080

SEQ ID NO: 439334 - RNA, 64 nt, Homo Sapiens; identical to SEQ ID NO: 295081

SEQ ID NO: 439335 - RNA, 64 nt, Homo Sapiens; identical to SEQ ID NO: 295082

SEQ ID NO: 439336 - RNA, 64 nt, Homo Sapiens; identical to SEQ ID NO: 295083

SEQ ID NO: 439337 - RNA, 64 nt, Homo Sapiens; identical to SEQ ID NO: 295084

SEQ ID NO: 439338 - RNA, 64 nt, Homo Sapiens; identical to SEQ ID NO: 295085

SEQ ID NO: 439339 - RNA, 64 nt, Homo Sapiens; identical to SEQ ID NO: 84084

SEQ ID NO: 439340 - RNA, 64 nt, Homo Sapiens; identical to SEQ ID NO: 84085

SEQ ID NO: 439341 - RNA, 64 nt, Homo Sapiens
gcacuacauguaaccuucaucuaguuaaccaaucgcaaagcaagggggaaguaaguacaaaugg

SEQ ID NO: 439342 - RNA, 64 nt, Homo Sapiens
agauuuauuuuuaauauguugacuuuauuucugagcaaagcaucggucauguguguauuuuuuc

SEQ ID NO: 439343 - RNA, 64 nt, Homo Sapiens
gcuaaucaggguucuccauggagaccgacuuugugcaaagcaauaucaacaaauauauuuauug

SEQ ID NO: 439344 - RNA, 64 nt, Homo Sapiens
ugaugaagcagaguggaugucagaagagaugucagcaaagcaaguauuccgaggaguagagagg

SEQ ID NO: 439345 - RNA, 64 nt, Homo Sapiens
ucuagauuggagugcugcacaaacaaacauaagagcaaagcaaaacuguaucacauaggguuuu

SEQ ID NO: 439346 - RNA, 64 nt, Homo Sapiens
aacuuuuauguuuacagggcacgucuguuguaaugcaaagcauauuuggcaagcaguucaucac

SEQ ID NO: 439347 - RNA, 64 nt, Homo Sapiens
ugccuggagcacugcagagaugacuuuggagaaagcaaagcagugacccagugaccaggcacau

SEQ ID NO: 439348 - RNA, 64 nt, Homo Sapiens
auccaagccuuacccagcugugcuacugucauuugcaaagcaaggaaauacuacuacugguaau

SEQ ID NO: 439349 - RNA, 64 nt, Homo Sapiens
gaagaagccucaacuuacccaggaggagcuagaagcaaagcaagguuuguugauagcuuuuaaa

SEQ ID NO: 439350 - RNA, 64 nt, Homo Sapiens
ucaacuuacccaggaggagcuagaagcaaagcaagcaaagcaaaagcuggaagaucgccucgca

SEQ ID NO: 439351 - RNA, 64 nt, Homo Sapiens
gucauccaaguccaggucuagaucacacucaaaagcaaagcauucucuucccagugccuaucgg

SEQ ID NO: 439352 - RNA, 64 nt, Homo Sapiens
aagaagaaucagaauguaccauaagaaaucagaugcaaagcacguuaaugucauugguaaguuu

SEQ ID NO: 439353 - RNA, 64 nt, Homo Sapiens
acuauuuugucuuuuaguuuuaaacuuuuuuaaggcaaagcaagcuccccaaucccuguucucc

SEQ ID NO: 439354 - RNA, 64 nt, Homo Sapiens
ggaucagaacucuccuaucugaaccuacugaggagcaaagcagcaauuacaugggauccugugg

SEQ ID NO: 439355 - RNA, 64 nt, Homo Sapiens
ugauugcaccaacagguccagaguaugagugcaagcaaagcagaacucucaugcgugaccugag

SEQ ID NO: 439356 - RNA, 64 nt, Homo Sapiens
agcugcugaagcacgggguggccucuccggcaaagcaaagcagacccucaggauggcgccuuca

SEQ ID NO: 439357 - RNA, 64 nt, Homo Sapiens
gcagaagcugcugaagcacgcuucagccucuccggcaaagcaaaccaaacccucaggauggcgc

SEQ ID NO: 439358 - RNA, 64 nt, Homo Sapiens
uguaaagugacuaccuuaauuuugaaguuaagugauagcucacuaauuuggugcccauuaugaa

SEQ ID NO: 439359 - RNA, 64 nt, Homo Sapiens
auugucccugauuuuauuuuaaccaguuaauuuaauagcucaaagccauugggagguuuugaaa

SEQ ID NO: 439360 - RNA, 64 nt, Homo Sapiens
cuuuuuuguuuguuuuuuucgcagguuagcuauuauagcucaaggcaugacaauuuuuagagcu

SEQ ID NO: 439361 - RNA, 64 nt, Homo Sapiens
uaugaauguaaugaguaugagggcaguuucagucauagcucagaucuuauccugcaacaagaag

SEQ ID NO: 439362 - RNA, 64 nt, Homo Sapiens
cauguauguacugcaugugguaaagccuucagucauagcucagccauugcucagcaucagauaa

SEQ ID NO: 439363 - RNA, 64 nt, Homo Sapiens
cagacacuaauaauuaagaagaacacaaucagaaauagcucagguucaauucucuaaaauccca

SEQ ID NO: 439364 - RNA, 64 nt, Homo Sapiens
gacugcuaacagagaacuacacaccgaaauucagauagcucagggcaagaggcuuaagagagaa

SEQ ID NO: 439365 - RNA, 64 nt, Homo Sapiens
gugcccuugaauccauacaguauaaugacuuguuauagcucagugcacuguuacccagugugua

SEQ ID NO: 439366 - RNA, 64 nt, Homo Sapiens
agaugacauucacgcaugcuuccucagccuacaaauagcucauucugcauuucaacucuucacu

SEQ ID NO: 439367 - RNA, 64 nt, Homo Sapiens
uaucgaguacccugucauacagaguaccuguucaauagcucauaugauaauaaggcuaaguggg

SEQ ID NO: 439368 - RNA, 64 nt, Homo Sapiens
ucaauuucagugccuuuaucaggaugacuuuucaauagcucaaaugagguaguguuccacuggc

SEQ ID NO: 439369 - RNA, 64 nt, Homo Sapiens
ugggaacugaauccaccuaauaacacuaccgcugauagcucaccagaauaguaguuagguuccc

SEQ ID NO: 439370 - RNA, 64 nt, Homo Sapiens
aacacaauauucguuaauguuacuuuuagcucuaauagcucaagucauauaacuuuaaaaauaa

SEQ ID NO: 439371 - RNA, 64 nt, Homo Sapiens
gucuacauuucauucaacuuaacauaauuacuugauagcucaggauucucuauuuuuauauuga

SEQ ID NO: 439372 - RNA, 64 nt, Homo Sapiens
aaacucugauaauguaacaaguccuuaccaaaugauagcucauacuugggaaucccuuccuugu

SEQ ID NO: 439373 - RNA, 64 nt, Homo Sapiens; identical to SEQ ID NO: 99128

SEQ ID NO: 439374 - RNA, 64 nt, Homo Sapiens; identical to SEQ ID NO: 99129

SEQ ID NO: 439375 - RNA, 64 nt, Homo Sapiens; identical to SEQ ID NO: 99130

SEQ ID NO: 439376 - RNA, 64 nt, Homo Sapiens; identical to SEQ ID NO: 99131

SEQ ID NO: 439377 - RNA, 64 nt, Homo Sapiens; identical to SEQ ID NO: 99132

SEQ ID NO: 439378 - RNA, 64 nt, Homo Sapiens; identical to SEQ ID NO: 99133

SEQ ID NO: 439379 - RNA, 64 nt, Homo Sapiens; identical to SEQ ID NO: 99134

SEQ ID NO: 439380 - RNA, 64 nt, Homo Sapiens; identical to SEQ ID NO: 99135

SEQ ID NO: 439381 - RNA, 64 nt, Homo Sapiens; identical to SEQ ID NO: 99136

SEQ ID NO: 439382 - RNA, 64 nt, Homo Sapiens; identical to SEQ ID NO: 99137

SEQ ID NO: 439383 - RNA, 64 nt, Homo Sapiens; identical to SEQ ID NO: 99138

SEQ ID NO: 439384 - RNA, 64 nt, Homo Sapiens; identical to SEQ ID NO: 99139

SEQ ID NO: 439385 - RNA, 64 nt, Homo Sapiens; identical to SEQ ID NO: 99140

SEQ ID NO: 439386 - RNA, 64 nt, Homo Sapiens; identical to SEQ ID NO: 99141

SEQ ID NO: 439387 - RNA, 64 nt, Homo Sapiens; identical to SEQ ID NO: 99142

SEQ ID NO: 439388 - RNA, 64 nt, Homo Sapiens; identical to SEQ ID NO: 99143

SEQ ID NO: 439389 - RNA, 64 nt, Homo Sapiens; identical to SEQ ID NO: 99144

SEQ ID NO: 439390 - RNA, 64 nt, Homo Sapiens; identical to SEQ ID NO: 99145

SEQ ID NO: 439391 - RNA, 64 nt, Homo Sapiens; identical to SEQ ID NO: 99146

SEQ ID NO: 439392 - RNA, 64 nt, Homo Sapiens; identical to SEQ ID NO: 99147

SEQ ID NO: 439393 - RNA, 64 nt, Homo Sapiens; identical to SEQ ID NO: 99148

SEQ ID NO: 439394 - RNA, 64 nt, Homo Sapiens; identical to SEQ ID NO: 99149

SEQ ID NO: 439395 - RNA, 64 nt, Homo Sapiens
cuauaacaaaagacagauugacaagagaaaaacaaacauaaauuuauuagcggguauauguaau

SEQ ID NO: 439396 - RNA, 64 nt, Homo Sapiens
cuuguuauaguagucgguccaucaugaccaguaaaacauaaaucaaaaguuaauguaauuguua

SEQ ID NO: 439397 - RNA, 64 nt, Homo Sapiens
caaaauuacuggggccccaucccugucuccacuaaacauaaaaagucugggaaacaaagcgaga

SEQ ID NO: 439398 - RNA, 64 nt, Homo Sapiens
uaccauaggauucagcaguuuucucaaaggauuaaacauaaaauuuggaaaacaguuuggcagu

SEQ ID NO: 439399 - RNA, 64 nt, Homo Sapiens
aaagacgaauauuuaaggugauuagaauauuuucaacauaaagaaagaaaaaugaagaaaagua

SEQ ID NO: 439400 - RNA, 64 nt, Homo Sapiens
gagaaaaaguucuauagggcauugcaaccagcaaaacauaaacuuguuuaaauaacauuauggg

SEQ ID NO: 439401 - RNA, 64 nt, Homo Sapiens
uucuguuacccucauucuauucuuucaaacagauaacauaaaaggauuacagugcuccuuucau

SEQ ID NO: 439402 - RNA, 64 nt, Homo Sapiens
ccacauauucuaaugacaacgcuuauuuauguguaacauaaaucguuaguccucuuagaugacu

SEQ ID NO: 439403 - RNA, 64 nt, Homo Sapiens
aagacaacaugcuuuggaaacauauguccuagaaaacauaaaauuaaaaaaaaacacuauagug

SEQ ID NO: 439404 - RNA, 64 nt, Homo Sapiens
ugucagucaagcagcacuuuuucagaauauacagaacauaaauaauaugaugugguugaguguu

SEQ ID NO: 439405 - RNA, 64 nt, Homo Sapiens
aaaauaauaguuuuagugaggauggugcugaguaaacauaaaaacugauuugcucucagcugau

SEQ ID NO: 439406 - RNA, 64 nt, Homo Sapiens
uuuugguaaacgguuuuuauuaaagaugcuauggaacauaaaguuguauugcaugcaauuugaa

SEQ ID NO: 439407 - RNA, 64 nt, Homo Sapiens
cauaggaggcacuucuuuucauaaagagaagcuaaacauaaaaaggaauuuuaaauuuaacucu

SEQ ID NO: 439408 - RNA, 64 nt, Homo Sapiens
cauacauauauacacauaugcauguguguguguaaacauaaaaguccuuuauuauuaaaaaaug

SEQ ID NO: 439409 - RNA, 64 nt, Homo Sapiens
ucagaauucacuguaauggaauuuugccucuaauaacauaaagggggaagaaacauaaaguggu

SEQ ID NO: 439410 - RNA, 64 nt, Homo Sapiens
ggaauuuugccucuaauaacauaaagggggaagaaacauaaagugguucucuuaauaaaacuag

SEQ ID NO: 439411 - RNA, 64 nt, Homo Sapiens
gaagcaggugaaaauguuaauagcaacuuuuaaaaacauaaaaaggucacuuuaaauguucuag

SEQ ID NO: 439412 - RNA, 64 nt, Homo Sapiens
uuuauucaguguaauuuaagcuucacuauucuggaacauaaaacuuucaugaagguaaagcuuu

SEQ ID NO: 439413 - RNA, 64 nt, Homo Sapiens
uacauauuuuucaacagaagcgucuuuucugagaaacauaaauuauuucuuaaaauucugaauu

SEQ ID NO: 439414 - RNA, 64 nt, Homo Sapiens
guuuaugaucccagcaauacuaauaaaaaugcacaacauaaaaucuaucuuucaaaaguaaaug

SEQ ID NO: 439415 - RNA, 64 nt, Homo Sapiens
ugcauuuuuacaucagauuuaugaagcauccugcaacauaaauuuaaaccacuugaagggacuc

SEQ ID NO: 439416 - RNA, 64 nt, Homo Sapiens
ucuuucauauuuuguuaguaaaacucacaauauuaacauaaacaugcuacauguaaaaagaacc

SEQ ID NO: 439417 - RNA, 64 nt, Homo Sapiens
cuucugaagaaucauaggaagcaaaaucugaggaaacauaaauuuagauuauaacaaacugcua

SEQ ID NO: 439418 - RNA, 64 nt, Homo Sapiens
uguauuuaaaacauuucauguauuucuuuagaacaacauaaaauuaaaauuuaacaucugcagu

SEQ ID NO: 439419 - RNA, 64 nt, Homo Sapiens
uagucuuaugaauagacauaaauuguaauuugggaacauaaaaacuacugaauaaaucaugugg

SEQ ID NO: 439420 - RNA, 64 nt, Homo Sapiens
guuuaauaauauuuaaugucuuuuuaggaucauaaacauaaauagguuuguugauauucaggcc

SEQ ID NO: 439421 - RNA, 64 nt, Homo Sapiens
acuuagcuugaguuaaaggcaaagaaaaucuaaaaacauaaauguuauauuucacaagaaauca

SEQ ID NO: 439422 - RNA, 64 nt, Homo Sapiens
auaugccuucacacuggauucauggucuaauuuuaacauaaauacucuuuauucucauguucca

SEQ ID NO: 439423 - RNA, 64 nt, Homo Sapiens
uugguuauaugucaacuauuauauuucuagauacaacauaaaccuuuuuuuuaaagcauaaaac

SEQ ID NO: 439424 - RNA, 64 nt, Homo Sapiens
uuucagcaguacaaaggcauguuuuaaaaucuauaacauaaagaauaaggaauagcuuuguauu

SEQ ID NO: 439425 - RNA, 64 nt, Homo Sapiens
cagacacauuuuuggauuucugugaaguugaauaaacauaaaagcuaauacaguuguauuauuu

SEQ ID NO: 439426 - RNA, 64 nt, Homo Sapiens
ccccaaaacuaucacuuggaaaaacaagaaacaaaacauaaaaaacauaucuuuaaauuaccaa

SEQ ID NO: 439427 - RNA, 64 nt, Homo Sapiens
cugggaaagauuucauuuuguguuuaacaaaagcaacauaaacuagauucuaguacaaaguuac

SEQ ID NO: 439428 - RNA, 64 nt, Homo Sapiens
accuuccuuaaguacaauuuuguuaauucagccaaacauaaauagaauugacguuuaugauuua

SEQ ID NO: 439429 - RNA, 64 nt, Homo Sapiens
acaauaaaaaugcaaauaaaaacauaaagcaaacaacauaaagcggaaguaagcccaagagaac

SEQ ID NO: 439430 - RNA, 64 nt, Homo Sapiens
aaacaacauaaagcacaauaaagcccaagagaacaacauaaagccccaucuccaacucggaagu

SEQ ID NO: 439431 - RNA, 64 nt, Homo Sapiens
uguuagauguuagcacaucuacuucaaguuguugaacauaaaggaaauaauuucuucagagaua

SEQ ID NO: 439432 - RNA, 64 nt, Homo Sapiens
guacauauuuuuaaaguuaaugaaaagguuaagaaacauaaauguacuuuuacuccaugggcau

SEQ ID NO: 439433 - RNA, 64 nt, Homo Sapiens
uuuuucauccuuacaauccugucccaugguauuuaacauaaaaaaaaauaaaacuguuaacaga

SEQ ID NO: 439434 - RNA, 64 nt, Homo Sapiens
aauugucuuaguuugagagauggcugaaauaaugaacauaaaaugcuauuuauaauaacaagua

SEQ ID NO: 439435 - RNA, 64 nt, Homo Sapiens
uacuaaacugcuuuguauucacauuaucugaaauaacauaaagcaauuuuucauuaaaaaaauu

SEQ ID NO: 439436 - RNA, 64 nt, Homo Sapiens
agggaugucacuuugagggggaggucgguaauuuaacauaaaacuacaugccuuugauuccuua

SEQ ID NO: 439437 - RNA, 64 nt, Homo Sapiens
aaaucauacuggugaggaaccucaaacuuuucuaaacauaaaaucacaguaauucugacaacac

SEQ ID NO: 439438 - RNA, 64 nt, Homo Sapiens
aacuuaaacuggagagaaacccuaaaucuuacuaaacauaaaaaggcaaagcauuuaacugguc

SEQ ID NO: 439439 - RNA, 64 nt, Homo Sapiens
uugcaagaaaauguagaaaucuuaaaguguggcaaacauaaaauguuaaaaaaaaaauuagauu

SEQ ID NO: 439440 - RNA, 64 nt, Homo Sapiens
auaguguugagaaauccuagcucaaacuuuucaaaacauaaaucugacagugcuuugaaaacac

SEQ ID NO: 439441 - RNA, 64 nt, Homo Sapiens
aauucauacuggagggaacucucaacucuuacuaaacauaaaaaggcaaagccuuuuaccaguc

SEQ ID NO: 439442 - RNA, 64 nt, Homo Sapiens
aguauuuuuaggauucaugaaaauaacauaaaauaacauaaaacccagauuuaacauaaguagu

SEQ ID NO: 439443 - RNA, 64 nt, Homo Sapiens
aacauaaaacaguauuuuuacauaaguaguaaauaacauaaaauauguguuguuccagauuuaa

SEQ ID NO: 439444 - RNA, 64 nt, Homo Sapiens
cuuuuauuuucuucugauuuagcaacuaaaaugaaacauaaaacgagaauaaguauaaacauaa

SEQ ID NO: 439445 - RNA, 64 nt, Homo Sapiens
aacuaaaaugaaacauaaaaugagaauaaguauaaacauaaagcucaaauauuuuuuccagggg

SEQ ID NO: 439446 - RNA, 64 nt, Homo Sapiens
gugaccauuuaacuuauggcggagacaaagugaaaacauaaaaugaaguucuuaaauuaguuau

SEQ ID NO: 439447 - RNA, 64 nt, Homo Sapiens
aauccaguuuccauggcccugguuucccaaugcacucagaaagauuccugcuuaaaacccugca

SEQ ID NO: 439448 - RNA, 64 nt, Homo Sapiens
uuucuuggaccuuccacuucccuuuggacucuaccucagaaauacagugucuuugucaccaggc

SEQ ID NO: 439449 - RNA, 64 nt, Homo Sapiens
gaaagagaacauggucacccaaaagcaacuguaacucagaaauuaaguuacucagaaauuaagu

SEQ ID NO: 439450 - RNA, 64 nt, Homo Sapiens
acccaaaagcaacuguaacucagaaauuaaguuacucagaaauuaaguagcucagaaauuaaga

SEQ ID NO: 439451 - RNA, 64 nt, Homo Sapiens
aacucagaaauuaaguuacucagaaauuaaguagcucagaaauuaagaaagaaugguauaauga

SEQ ID NO: 439452 - RNA, 64 nt, Homo Sapiens
aggaaggauucaccaccuccaggaaaagugucuucucagaaacaaccagcugagaagguaauua

SEQ ID NO: 439453 - RNA, 64 nt, Homo Sapiens
auaaaggagggaccaauaucugggacagugucuucucagaaacaaccagcugagaagguaauua

SEQ ID NO: 439454 - RNA, 64 nt, Homo Sapiens
auaaagaagggacaacaaucugggacagugucuccucagaaacaaucggccuggaagguaguua

SEQ ID NO: 439455 - RNA, 64 nt, Homo Sapiens
auaauggguggugggaaaucuggaacagugucuucucagaaacaaccagccucaaagguaauua

SEQ ID NO: 439456 - RNA, 64 nt, Homo Sapiens
auaaaggauggacuacagugugggacagugucuucucagaaacaaccagccuugaagguaauua

SEQ ID NO: 439457 - RNA, 64 nt, Homo Sapiens
auaaaggauggagaaaaaucugggacagugucuucucagaaacaaccagccuugaagguaauua

SEQ ID NO: 439458 - RNA, 64 nt, Homo Sapiens
auaaaggauggagaaaaaucugggacagugucuucucagaaaccaccagccuugacgguaauga

SEQ ID NO: 439459 - RNA, 64 nt, Homo Sapiens
aaaaaggauggagaaauaucuaggaaagugucuucucagaaaccaccaaccuugaagguaauga

SEQ ID NO: 439460 - RNA, 64 nt, Homo Sapiens
aaaaaggauggagaaauaucuaggaaagugucuucucagaaaccaccagccuugaagguaauga

SEQ ID NO: 439461 - RNA, 64 nt, Homo Sapiens
uaauucauguuucuuaaauguagauguagauaaacucagaaauuucaaaaguugaaauuaacca

SEQ ID NO: 439462 - RNA, 64 nt, Homo Sapiens
ucaguuacucugaagggcaugaauuuuucucuaacucagaaacagcaaccuguugauagcaagu

SEQ ID NO: 439463 - RNA, 64 nt, Homo Sapiens
uuuuuauauuaugcagagaucaauucuagaaauccucagaaauggauccuuugacauguuaauu

SEQ ID NO: 439464 - RNA, 64 nt, Homo Sapiens
aauguuuugaugaauacaauaaucuaaugagaaacucagaaaaaaaacaaaacacagcuuaucu

SEQ ID NO: 439465 - RNA, 64 nt, Homo Sapiens
uagauuuuuaaaaaagaauuaaaaugugggaguucucagaaagaaauaaacacaugagaauaag

SEQ ID NO: 439466 - RNA, 64 nt, Homo Sapiens
aauaacgccugauguauagauuaguuagcaaauucucagaaaucccccacauaaaagccuuacu

SEQ ID NO: 439467 - RNA, 64 nt, Homo Sapiens
gcacuccagccugggcgacagagugaaacuacaucucagaaaaaaaaaaaaaaaaaaaaaaaaa

SEQ ID NO: 439468 - RNA, 64 nt, Homo Sapiens
auacacagaaugaucuacagugaucuuuaacauacucagaaauaugaaaaauguuugaauauga

SEQ ID NO: 439469 - RNA, 64 nt, Homo Sapiens
aaaaacauccaguuuguggaaaaaucucuaauggcucagaaaauuaaaaaucaaagugauuuug

SEQ ID NO: 439470 - RNA, 64 nt, Homo Sapiens
acuuuuuucacaacggaaagugggguuucaauuccucagaaacauuuuuguuguaguuaucuuc

SEQ ID NO: 439471 - RNA, 64 nt, Homo Sapiens
aaaguccguuuuacugugaaacauagacugaucacucagaaauuaguuucaucagaaacuuaaa

SEQ ID NO: 439472 - RNA, 64 nt, Homo Sapiens
cacacaagaacaauaacacauucauuacccaagccucagaaaaacaauggaguggggaaguacu

SEQ ID NO: 439473 - RNA, 64 nt, Homo Sapiens
gaaucaguguccuagagacuaaccugacacaaugcucagaaacagugugaggugggaguacugc

SEQ ID NO: 439474 - RNA, 64 nt, Homo Sapiens
uacccaaaugcguacgucuucagcacaguaggaccucagaaaagggucaucuaugacaccacac

SEQ ID NO: 439475 - RNA, 64 nt, Homo Sapiens
augucaaaucagaugaaguugaaagauaucaaaucucagaaagaaaaacuaagguaacuucuca

SEQ ID NO: 439476 - RNA, 64 nt, Homo Sapiens
uaucaaaucucagaaagaauaacuaagguaacuucucagaaagaucacucacuguggaaauaaa

SEQ ID NO: 439477 - RNA, 64 nt, Homo Sapiens
aauuuuguaauuucagagaggacuuuuaaauuggcucagaaagcuagcuuggauucaaucaugu

SEQ ID NO: 439478 - RNA, 64 nt, Homo Sapiens
cuuuguuuucuuuuacgauguauugaaaggacgccucagaaaugugacgccgccuuccuccggu

SEQ ID NO: 439479 - RNA, 64 nt, Homo Sapiens
gauacauuauuuuuucuuucuuucauagcugugucucagaaaggacccauuuguggcucuuuuu

SEQ ID NO: 439480 - RNA, 64 nt, Homo Sapiens
ucuagccaucuaaauugacucuuccaauauaggucucagaaauccaauauuuggaguacaauuu

SEQ ID NO: 439481 - RNA, 64 nt, Homo Sapiens
aaaaaaaaaaagagagagaggagcaagacucugucucagaaaaacacuccagccugggcgacaa

SEQ ID NO: 439482 - RNA, 64 nt, Homo Sapiens
ccaaucaggucaagguuugcgugggucucuucaucucagaaaugaggaaaaucuauuggcucuc

SEQ ID NO: 439483 - RNA, 64 nt, Homo Sapiens
uuuuauugcaucugccaucccuuguuuuugcuuccucagaaacuuuaugaagccuuaacuaauu

SEQ ID NO: 439484 - RNA, 64 nt, Homo Sapiens
aaaaaaaagcauauauauauugaguaagguugcucucagaaaaaacuaagauaaaugugaaguc

SEQ ID NO: 439485 - RNA, 64 nt, Homo Sapiens
gaaccagagagaaguuaaacgaaauguauuuauucucagaaacaugucaggucaacauuuuuca

SEQ ID NO: 439486 - RNA, 64 nt, Homo Sapiens
uuaggaugugauuuugguugaugaaaagaaagggcucagaaaaauuuauaauauguaauuuuuc

SEQ ID NO: 439487 - RNA, 64 nt, Homo Sapiens
accuuagcuucacucagcugaucaucuuuguuggcucagaaaaucucgagccauagagccugaa

SEQ ID NO: 439488 - RNA, 64 nt, Homo Sapiens
uugaggggcuccccagagguugaggaauuugaagcucagaaagguaggagucuuauaucccagg

SEQ ID NO: 439489 - RNA, 64 nt, Homo Sapiens
cuggcuguuaaagaauguuguuauuauuuccugucucagaaaguaugcuaaauauauggagcca

SEQ ID NO: 439490 - RNA, 64 nt, Homo Sapiens
uuuaguuccuuuuuccaccacacccuggcaggcucucagaaauuagggaaaggggugcagcuuc

SEQ ID NO: 439491 - RNA, 64 nt, Homo Sapiens
gcaaaacaaaacaaacaaacgagcgagacuccaacucagaaaaagcacuccagccugggcaaca

SEQ ID NO: 439492 - RNA, 64 nt, Homo Sapiens
aagauacacaagugaggaauaccgacacugaguacucagaaaucaaccucaggaaccaaagguc

SEQ ID NO: 439493 - RNA, 64 nt, Homo Sapiens; identical to SEQ ID NO: 229068

SEQ ID NO: 439494 - RNA, 64 nt, Homo Sapiens; identical to SEQ ID NO: 229069

SEQ ID NO: 439495 - RNA, 64 nt, Homo Sapiens
uacacauucuauacaggagagauguauuauuuccccccuucagccccuacuaaacucuuaagcc

SEQ ID NO: 439496 - RNA, 64 nt, Homo Sapiens
aaaccacuaagaguuccucccgcgcagacugcugccccuucagcugcccucgauuuugcuccac

SEQ ID NO: 439497 - RNA, 64 nt, Homo Sapiens
cuucuucccauuuugucuucccuucugccuguuuccccuucaggcuuggcucuaggaaccaaag

SEQ ID NO: 439498 - RNA, 64 nt, Homo Sapiens
uuugguuagugccacuaccuucuucccuccuuucccccuucaauuuggaaauaaauuucuguau

SEQ ID NO: 439499 - RNA, 64 nt, Homo Sapiens
guggggacgagacccccucaugcccaaccucccaccccuucaauggccuaugaaaagguccuga

SEQ ID NO: 439500 - RNA, 64 nt, Homo Sapiens
ccuggguuuggcaucagcacagacuggcuguaacccccuucacagagccacugggagacugggg

SEQ ID NO: 439501 - RNA, 64 nt, Homo Sapiens
cccuugccccaggacaccgccuaccccguacagaccccuucacuccggggugcuauccccaucc

SEQ ID NO: 439502 - RNA, 64 nt, Homo Sapiens
ucuucccugacugcuguccccuacccagccuugcccccuucauccuuuugcguuugguauugag

SEQ ID NO: 439503 - RNA, 64 nt, Homo Sapiens
agacucuacuccucuuucuuuuguauggacaguuccccuucagucccaucccccuacacauaca

SEQ ID NO: 439504 - RNA, 64 nt, Homo Sapiens
cuacaggggacaggagaccaaagaaaaaaagaagccccuucacucugucuuaaaaaaaacuaaa

SEQ ID NO: 439505 - RNA, 64 nt, Homo Sapiens
ccagucgugguggcucaugcccaagaugaagaagccccuucaggagacaggguccaccaacucc

SEQ ID NO: 439506 - RNA, 64 nt, Homo Sapiens
auuuccacuggaccuugcccaccccacgagacagccccuucaggggagcucccuaucuacccuc

SEQ ID NO: 439507 - RNA, 64 nt, Homo Sapiens
auccacccuuucaggcuaagcacucccaagaagcccccuucacguccacugacuguccaagggc

SEQ ID NO: 439508 - RNA, 64 nt, Homo Sapiens
uguuucuguuccucuucccaucuacuccccuacgccccuucaaccuuuuuucucugucugcuuc

SEQ ID NO: 439509 - RNA, 64 nt, Homo Sapiens
ccuaaaggaaaccuuucuuaaagacaggcugaaaccccuucaaaggcagaugaggagguacaga

SEQ ID NO: 439510 - RNA, 64 nt, Homo Sapiens
uaaaaugucuuuuuuaccuuuuguuuaccaagggccccuucauaaauagcaggcaaaugccuag

SEQ ID NO: 439511 - RNA, 64 nt, Homo Sapiens
cuuucaaagccuuuuagcuuuuccagcaccucagccccuucacacauuuacacauaccaauuuu

SEQ ID NO: 439512 - RNA, 64 nt, Homo Sapiens
ggggucguaugaguaaggggaaccccuucacaccccccuucacacucauaugcacaagcccacc

SEQ ID NO: 439513 - RNA, 64 nt, Homo Sapiens
ccccccuucacaggggucgucacaagcccaccaaccccuucacacguucacauucccucauaug

SEQ ID NO: 439514 - RNA, 64 nt, Homo Sapiens
augccauuuggaggguaggguucgugccgcuuucccccuucaaguuuugcuuaucauguuccau

SEQ ID NO: 439515 - RNA, 64 nt, Homo Sapiens
uccucaguggauuacuuaacgguaaguccauuuuccccuucaggcaggccaaguauaugagaaa

SEQ ID NO: 439516 - RNA, 64 nt, Homo Sapiens
guagaugcccggcaggcuggggucugaguugugaccccuucagaguuggugagaugccaaguuu

SEQ ID NO: 439517 - RNA, 64 nt, Homo Sapiens
gaggagaggccacaggagcucccucccagggaggccccuucagaccggagcucauuacugccuu

SEQ ID NO: 439518 - RNA, 64 nt, Homo Sapiens
ucuucaccgcgguuccucguuucaccucccugauccccuucauuuccccuucuaguugauccuu

SEQ ID NO: 439519 - RNA, 64 nt, Homo Sapiens
ccuccuugcccgccuacccuacuccccucagcucccccuucaccccucuucaggaaauguccug

SEQ ID NO: 439520 - RNA, 64 nt, Homo Sapiens
cagcaccucucaaucuccuaugcagguaccugccccccuucacagggcugggacugaggccucc

SEQ ID NO: 439521 - RNA, 64 nt, Homo Sapiens
gggaaccguagugucagugcuagacaccucugauccccuucagugacuuugcauaucauuugca

SEQ ID NO: 439522 - RNA, 64 nt, Homo Sapiens
ugcucuggcaggacucacguuacagaccccucuaccccuucagccugcccuacagcgacuuccc

SEQ ID NO: 439523 - RNA, 64 nt, Homo Sapiens
ccacgcccacccuucgaggaaggugucaccuggaccccuucauuccacggaggaagcugaggcc

SEQ ID NO: 439524 - RNA, 56 nt, Homo Sapiens
uccuggaggaacgacccugacccggcccccuucaccccuucagccgagcccagacc

SEQ ID NO: 439525 - RNA, 64 nt, Homo Sapiens
uccuggaggaacgacccugacccggcccccuucaccccuucagccgagcccagaccuccccucu

SEQ ID NO: 439526 - RNA, 64 nt, Homo Sapiens
aaccccaacaccccugacuuagagacccccccaaccccuucacacccauucagucccagggagc

SEQ ID NO: 439527 - RNA, 64 nt, Homo Sapiens
gcaccucuggugguggagugagccugccacccucccccuucaaugggagccgcguugucccaag

SEQ ID NO: 439528 - RNA, 64 nt, Homo Sapiens
cugguuaccuggagaaguaguauuugccuauuucccccuucauccauccugagccaaauuucuu

SEQ ID NO: 439529 - RNA, 64 nt, Homo Sapiens
uccacccacaaacuccaggcuggaaguacuuggcccccuucaggagccuggccaggcagggaga

SEQ ID NO: 439530 - RNA, 64 nt, Homo Sapiens
ucuccucuuucauuauucuguucuguauuccuuuccccuucauucucacccugucugcuuuuac

SEQ ID NO: 439531 - RNA, 64 nt, Homo Sapiens
cucuuaaaaaguacagagagccugugcugugaacccccuucaaugggaaaaagcugcaguggug

SEQ ID NO: 439532 - RNA, 64 nt, Homo Sapiens; identical to SEQ ID NO: 179925

SEQ ID NO: 439533 - RNA, 64 nt, Homo Sapiens; identical to SEQ ID NO: 179926

SEQ ID NO: 439534 - RNA, 64 nt, Homo Sapiens; identical to SEQ ID NO: 179927

SEQ ID NO: 439535 - RNA, 64 nt, Homo Sapiens; identical to SEQ ID NO: 179928

SEQ ID NO: 439536 - RNA, 64 nt, Homo Sapiens; identical to SEQ ID NO: 179929

SEQ ID NO: 439537 - RNA, 64 nt, Homo Sapiens; identical to SEQ ID NO: 179930

SEQ ID NO: 439538 - RNA, 64 nt, Homo Sapiens; identical to SEQ ID NO: 179931

SEQ ID NO: 439539 - RNA, 64 nt, Homo Sapiens; identical to SEQ ID NO: 179932

SEQ ID NO: 439540 - RNA, 64 nt, Homo Sapiens; identical to SEQ ID NO: 179933

SEQ ID NO: 439541 - RNA, 64 nt, Homo Sapiens; identical to SEQ ID NO: 179934

SEQ ID NO: 439542 - RNA, 64 nt, Homo Sapiens; identical to SEQ ID NO: 179935

SEQ ID NO: 439543 - RNA, 64 nt, Homo Sapiens; identical to SEQ ID NO: 179936

SEQ ID NO: 439544 - RNA, 64 nt, Homo Sapiens; identical to SEQ ID NO: 179937

SEQ ID NO: 439545 - RNA, 64 nt, Homo Sapiens; identical to SEQ ID NO: 179938

SEQ ID NO: 439546 - RNA, 64 nt, Homo Sapiens; identical to SEQ ID NO: 179939

SEQ ID NO: 439547 - RNA, 64 nt, Homo Sapiens; identical to SEQ ID NO: 179940

SEQ ID NO: 439548 - RNA, 64 nt, Homo Sapiens; identical to SEQ ID NO: 179941

SEQ ID NO: 439549 - RNA, 64 nt, Homo Sapiens; identical to SEQ ID NO: 179942

SEQ ID NO: 439550 - RNA, 64 nt, Homo Sapiens; identical to SEQ ID NO: 179943

SEQ ID NO: 439551 - RNA, 64 nt, Homo Sapiens
augaauuuggguaugaacagauugccugcuuucccuuaaauaacacuuagauuuauuggaccag

SEQ ID NO: 439552 - RNA, 64 nt, Homo Sapiens
cugaauucugguuacauguguuuuucucucccuccuuaaauaaagagagggguuaaacaugccc

SEQ ID NO: 439553 - RNA, 64 nt, Homo Sapiens
auauguauaaauauguauuuugucaaauuuguuacuuaaauauauagagaccaguuuucucugg

SEQ ID NO: 439554 - RNA, 64 nt, Homo Sapiens
acugcacuugauuucacucauauucuuuccaguucuuaaauaaauuucuuucacagauacugau

SEQ ID NO: 439555 - RNA, 64 nt, Homo Sapiens
gcaaauagucccaacuaagacucucaaaaauaaucuuaaauacuuacaaauccaagcagauuga

SEQ ID NO: 439556 - RNA, 64 nt, Homo Sapiens
uaauacauuuuuuuccaugggaauguuucaaaugcuuaaauauaugaacugaacugcagcuaua

SEQ ID NO: 439557 - RNA, 64 nt, Homo Sapiens
uugaaaaaacuaaaguaccaaggugagaucauagcuuaaauacaagaacuucuagcuaaugcuc

SEQ ID NO: 439558 - RNA, 64 nt, Homo Sapiens
auguagguuuuauuuuuaaaagucuugagcucuucuuaaauauacauuauaaagagcaagcaua

SEQ ID NO: 439559 - RNA, 64 nt, Homo Sapiens
gcucuuugaagccaaccaaggcaggcagaacccucuuaaauaugagacugauguauagguucuc

SEQ ID NO: 439560 - RNA, 64 nt, Homo Sapiens
ucuaaauacaaaugcaaaugaagcauuaguaauacuuaaauaauuuuacugugcuacauaaagu

SEQ ID NO: 439561 - RNA, 64 nt, Homo Sapiens
cauuuugaauaauauggcuuaguguuaacggggacuuaaauaugauuuuuuuuucuuacucauu

SEQ ID NO: 439562 - RNA, 64 nt, Homo Sapiens
aaaggaagaaaaaagaucccuauuagauacacuucuuaaauacaaucacauuaacauuuugagc

SEQ ID NO: 439563 - RNA, 64 nt, Homo Sapiens
acaguuuuauacccuuuuucauuuaacuuuauaacuuaaauauugcucuauguuaguauaagcu

SEQ ID NO: 439564 - RNA, 64 nt, Homo Sapiens
uguauguaagcaguaguaguuuaaauaaaguugccuuaaauaaguuuacuacauauauugauuu

SEQ ID NO: 439565 - RNA, 64 nt, Homo Sapiens
auauaaacauuuggaaaaguauuuugauaugaugcuuaaauauugauuuuauuuuaaaauauuu

SEQ ID NO: 439566 - RNA, 64 nt, Homo Sapiens
aauuuauuuauuuaagauacagucuuuuucaguucuuaaauaaauaaaauauuaacuucaaaaa

SEQ ID NO: 439567 - RNA, 64 nt, Homo Sapiens
ucuaaaauauuaacuucaaaguuuaugauaaacgcuuaaauauuagagauaaauguaugugaau

SEQ ID NO: 439568 - RNA, 64 nt, Homo Sapiens
auagagcacugugauucauuugagauauaaguaucuuaaauauccuguagaguuucaaccucuu

SEQ ID NO: 439569 - RNA, 64 nt, Homo Sapiens
ugugugcagcauuucuacuuuuuaaagaauuaaacuuaaauaagaaaacuaaggguaaaagaca

SEQ ID NO: 439570 - RNA, 64 nt, Homo Sapiens
gcaaaccauagcacaggcuaauuuuuuguuguuucuuaaauaagaaacuuuuuuauuuaaaaaa

SEQ ID NO: 439571 - RNA, 64 nt, Homo Sapiens
uuaaaaaagcuuaaaacuuugaaguuagcuuuaacuuaaauaguauuucccauuuaucgcagac

SEQ ID NO: 439572 - RNA, 64 nt, Homo Sapiens
gccauuauuuuuauaucaauaucacuuacuaagccuuaaauaaaguucagggcaacuacaaaua

SEQ ID NO: 439573 - RNA, 64 nt, Homo Sapiens
cuuauacuuugccaaagcugcaagaaagaagccacuuaaauaaguuaaauuguuuucuuucuuc

SEQ ID NO: 439574 - RNA, 64 nt, Homo Sapiens
augaccagaggaaagauggauaagaugauaauuucuuaaauagacauuuuccuuuuuucuuugu

SEQ ID NO: 439575 - RNA, 64 nt, Homo Sapiens
uggugcuugaagauaaaugugcuguuucuaguuucuuaaauagcccacaccccuggaugcaaaa

SEQ ID NO: 439576 - RNA, 64 nt, Homo Sapiens
accaaacauuuugaacuuuauugaugagaaaacucuuaaauaguuccagaauguacuauccauc

SEQ ID NO: 439577 - RNA, 64 nt, Homo Sapiens
gcauguuucuuuucuauagaugagauguuccuaucuuaaauaaaaaugaaagcuuuagaaggca

SEQ ID NO: 439578 - RNA, 64 nt, Homo Sapiens
gggaacuuuuuucgaaaggauacaugaccaccuucuuaaauaguaugacuuuacauagacucuu

SEQ ID NO: 439579 - RNA, 64 nt, Homo Sapiens
uauucaucugucauauacuauugauccuuuggcacuuaaauaaaugugaaauccuccaggaauu

SEQ ID NO: 439580 - RNA, 64 nt, Homo Sapiens
acacucaccccauuucccucauuucuuuccuacacuuaaauaccucguguauggugcaaucaga

SEQ ID NO: 439581 - RNA, 64 nt, Homo Sapiens
cccuagaaaaauuaaacaguuacugaaauuaugacuuaaauacccaaugacuccuuaaauaugu

SEQ ID NO: 439582 - RNA, 64 nt, Homo Sapiens
uuacugaaauuaugacuuaaauacccaaugacuccuuaaauauguaaauuauaguuauaccuug

SEQ ID NO: 439583 - RNA, 64 nt, Homo Sapiens
aauguaauuaccaaaagauuuuauuuugguuaugcuuaaauaugaauguuuucaguuuucuuuu

SEQ ID NO: 439584 - RNA, 64 nt, Homo Sapiens
uuuacuacuuaaugguuuugguccuaauuaguuucuuaaauacacuaaugaaguuaugacaucu

SEQ ID NO: 439585 - RNA, 64 nt, Homo Sapiens
cuauaaauuauaugguccuuaaagaaaguggacacuuaaauaagcacaaagaauaggaugggau

SEQ ID NO: 439586 - RNA, 64 nt, Homo Sapiens
auuaugcuaauuaguuacauaacacagucuaacucuuaaauaaaccaaaaaugucaguauugac

SEQ ID NO: 439587 - RNA, 64 nt, Homo Sapiens
ugauacacaaauuguuuaagguuauacacucgagcuuaaauagauauuuuuaaccagguguuug

SEQ ID NO: 439588 - RNA, 64 nt, Homo Sapiens
guuauaugugaucuuucuauaaccaugccauucacuuaaauaauucaugaagggaaugguuuaa

SEQ ID NO: 439589 - RNA, 64 nt, Homo Sapiens
ucauuuuugucuguggcauuauauacucgcacaacuuaaauagguauaaugccugcaauguguc

SEQ ID NO: 439590 - RNA, 64 nt, Homo Sapiens
ucaguucuucuuuucuuuugguaggcacucuucacuuaaauaccaaguuucuuuaauuagacuu

SEQ ID NO: 439591 - RNA, 64 nt, Homo Sapiens
ugaaacauaauuucacaauuauuccuuuuuccaccuuaaauaauaagaguagaauacuuucugu

SEQ ID NO: 439592 - RNA, 64 nt, Homo Sapiens
gaauuuuguaauuuuuuucugagaaaaaaaaguucuuaaauacaauaaaauugaaauguugaaa

SEQ ID NO: 439593 - RNA, 64 nt, Homo Sapiens
uauauauacacacccugugaauguuacgaaucuucuuaaauauauuaggaauaauuguaaauau

SEQ ID NO: 439594 - RNA, 64 nt, Homo Sapiens
gaauuuuguccuuaacauuuuaaguccuguaugacuuaaauaguagaguucacacaauaggaua

SEQ ID NO: 439595 - RNA, 64 nt, Homo Sapiens
cuuucauauuuuuuaagugucucauuuugcuuuacuuaaauaauuaaacugucuucuucuguuc

SEQ ID NO: 439596 - RNA, 64 nt, Homo Sapiens
augauguuuaauaaguauuagcagcaauucaaaacuuaaauacuugaaugugggaaguccuuca

SEQ ID NO: 439597 - RNA, 64 nt, Homo Sapiens
guaauagaaauauuauucaaugccaaaauauuuucuuaaauagucauagaacuaacaagaaaaa

SEQ ID NO: 439598 - RNA, 64 nt, Homo Sapiens
cauauuucaaaaauguugucauucauuaaggccucuuaaauagaccacuauuuuuugugucugg

SEQ ID NO: 439599 - RNA, 64 nt, Homo Sapiens
ggucccagcaugaaauaaagccuuggccugggggccgcuucauucucccucacugugcugcgcu

SEQ ID NO: 439600 - RNA, 64 nt, Homo Sapiens
cugacucucaggcguuaggcagcuggaugacuucccgcuucacgcagcaaaggccaggggcuug

SEQ ID NO: 439601 - RNA, 64 nt, Homo Sapiens
uguggcccuucuguccaccagacccaccuggagcccgcuucaagcucucuguugcgcucccgca

SEQ ID NO: 439602 - RNA, 64 nt, Homo Sapiens
gacuuuacaccuaccccucaccggaaagcuagacccgcuucagggccaggaguggcguuuccgc

SEQ ID NO: 439603 - RNA, 64 nt, Homo Sapiens
ccccgcacccggcacacucccccuuccuccagccccgcuucagccacaugcuccagcugcugcc

SEQ ID NO: 439604 - RNA, 64 nt, Homo Sapiens
ccugcacuucagacaccguucugaggacuggagaccgcuucaccaggagcugauuuccaggccc

SEQ ID NO: 439605 - RNA, 64 nt, Homo Sapiens
acaaauaggcagcuuaaggcggucguucugcagcccgcuucagcugcucaggguggauaacacg

SEQ ID NO: 439606 - RNA, 64 nt, Homo Sapiens
uccacauuguccaagucacaccauguucucucacccgcuucaaccccugagaagggcgggccuu

SEQ ID NO: 439607 - RNA, 64 nt, Homo Sapiens
uaccaaaggggaagacagaaggaacccaccaaguccgcuucagagaccuuuccuuccccagugg

SEQ ID NO: 439608 - RNA, 64 nt, Homo Sapiens
augagauauagcugucccaugguuuuagcugccaccgcuucagugacacuggcagcaguugcca

SEQ ID NO: 439609 - RNA, 64 nt, Homo Sapiens
uguuaaauaggcuugagggguuguugcgcaauggccgcuucagaugacagauguuguaagagaa

SEQ ID NO: 439610 - RNA, 64 nt, Homo Sapiens
gaagcuugaguauguucuccuucaccuuaucgugccgcuucaugcuuuauuuuugugccaauua

SEQ ID NO: 439611 - RNA, 64 nt, Homo Sapiens
ggcggcacacuucacuacagcgcgcggggagcggccgcuucaaauuaggcucgccauggaaaua

SEQ ID NO: 439612 - RNA, 64 nt, Homo Sapiens
accacggcggccgcgguagccacuccggagcuguccgcuucagcgugccgccgccgccgccagg

SEQ ID NO: 439613 - RNA, 64 nt, Homo Sapiens
aauuuccccucuguccuccauccagcggcuucuuccgcuucauucucuaccauaccacuugugc

SEQ ID NO: 439614 - RNA, 64 nt, Homo Sapiens
aguuacuaccucauuguuacuuucuaaaccaggcccgcuucacgaguuagaguugagcuccccu

SEQ ID NO: 439615 - RNA, 64 nt, Homo Sapiens
cuccugaguagcuggugcgccucaagcaauccucccgcuucagccacugaaguuucgaccuggg

SEQ ID NO: 439616 - RNA, 64 nt, Homo Sapiens
auagauaaaccucaagcaacgauucauguuguaaccgcuucauaugguuuaguuuucaaaaaac

SEQ ID NO: 439617 - RNA, 64 nt, Homo Sapiens
uucccaaagugcuggcauuacucaggugauccacccgcuucagcgcugcucucgaacuccugac

SEQ ID NO: 439618 - RNA, 64 nt, Homo Sapiens
cccagcucuguggccucaggacucucugccucacccgcuucagcccagggccccuggagacuga

SEQ ID NO: 439619 - RNA, 64 nt, Homo Sapiens
uugcccauuccuuacaccccuuccccauccugcuccgcuucauguccccuccugaguagucaug

SEQ ID NO: 439620 - RNA, 64 nt, Homo Sapiens
uguuggguaagaaacauaacggugcaucacacauccgcuucauaggcaugucaggagaguuaga

SEQ ID NO: 439621 - RNA, 64 nt, Homo Sapiens
ugcacccccgggcgaguuacgcggccucucugugccgcuucauuuguagagggcuguaacagug

SEQ ID NO: 439622 - RNA, 64 nt, Homo Sapiens
cuguuucagauauuuuuauucaaacccauuucucccgcuucacucucaggaacuaguuaaagag

SEQ ID NO: 439623 - RNA, 64 nt, Homo Sapiens
gucucuuacagagggggcccaaggaaucaccaccccgcuucaguguaaacaacgugccuugucc

SEQ ID NO: 439624 - RNA, 64 nt, Homo Sapiens
cugggcaucacugcaggcccugaaccccuccagcccgcuucagcgagcgcucaauccagcuccu

SEQ ID NO: 439625 - RNA, 64 nt, Homo Sapiens
uuuauaauuuuuuauugguaaacauaugcuaaauccgcuucaguauuuuauuauguuuuuuaaa

SEQ ID NO: 439626 - RNA, 64 nt, Homo Sapiens
acugcaaccucaauccugggcucaagugauccucccgcuucagccucucaagcagcgggaacua

SEQ ID NO: 439627 - RNA, 64 nt, Homo Sapiens
ggccuccugccaggugacugcuaucccguccacaccgcuucauugaugaggacaggagacucca

SEQ ID NO: 439628 - RNA, 64 nt, Homo Sapiens
uugcugaggacugucuccaacacgcauagcauugccgcuucagcuaaacaagagcccuuaagcc

SEQ ID NO: 439629 - RNA, 64 nt, Homo Sapiens
gaggaacuggacucucugggcagccuccauccacccgcuucagggacugagcaucuaaaauggg

SEQ ID NO: 439630 - RNA, 64 nt, Homo Sapiens
gggccuugcccuuuguacagggccuggcuuucccccgcuucaguaccugggccgggggcagcac

SEQ ID NO: 439631 - RNA, 64 nt, Homo Sapiens
agcagucagaggaggacgugagccaguuugauacccgcuucacacggcagacgccgguggacag

SEQ ID NO: 439632 - RNA, 64 nt, Homo Sapiens
acauagcccuuucuuugccaugaggccaugaggcccgcuucauccuuuucuauuucccuagaac

SEQ ID NO: 439633 - RNA, 58 nt, Homo Sapiens
gacggagacaggaccgggcggcgccgcaccgcuucaggacgacaccucgcucaccuga

SEQ ID NO: 439634 - RNA, 64 nt, Homo Sapiens
cugcggggcaagcgggccgcuggaaagagcugagccgcuucagaaagggccaccaccgcccuca

SEQ ID NO: 439635 - RNA, 64 nt, Homo Sapiens
ccagacucucuucuagggcuagacagggaggaggccgcuucaucagacucaauuuuggagggca

SEQ ID NO: 439636 - RNA, 64 nt, Homo Sapiens
aggaggcaggcuuuuagaaucauguuuuguuaauccgcuucacuaaauuggaccuucacauauc

SEQ ID NO: 439637 - RNA, 64 nt, Homo Sapiens
cugugugcugaucgcauccucaguuucuuguccaccgcuucacuggcaagagucccaggcucca

SEQ ID NO: 439638 - RNA, 64 nt, Homo Sapiens
acuaaaucacagguggcagaugacuauguuucacccgcuucauguccuuuuccucauaccaacu

SEQ ID NO: 439639 - RNA, 64 nt, Homo Sapiens
cuccugggcucaaaugauccaucaccacacacugccgcuucaauggcuagagcgcaggggcaca

SEQ ID NO: 439640 - RNA, 64 nt, Homo Sapiens
auaaguguaauccacgguagacugucccuucuccccgcuucaaaaguacuuuggugucuccacc

SEQ ID NO: 439641 - RNA, 64 nt, Homo Sapiens
gccagcuuugacaugcccgugaggacaggagccgccgcuucaguugucacugcagagccaucgu

SEQ ID NO: 439642 - RNA, 64 nt, Homo Sapiens
ggcugaguccaggccuguguuuucugaguacccgccgcuucacaauuuaaaauacuagugucac

SEQ ID NO: 439643 - RNA, 64 nt, Homo Sapiens
ggucugggugcggguguucccugugagcccgaguccgcuucaggaggggagccugcaggugccg

SEQ ID NO: 439644 - RNA, 50 nt, Homo Sapiens
cuguaccacggaaauugugaccgcuucagaggcaaggcuugccacuuggg

SEQ ID NO: 439645 - RNA, 64 nt, Homo Sapiens
gcuggucuugaacuccggggcucaagcgauccucccgcuucagccucccuaagugcugggauug

SEQ ID NO: 439646 - RNA, 64 nt, Homo Sapiens
uagaucauuguuagauauuucugcuuugcuccacccgcuucagaaacgacaaacgcucauggcg

SEQ ID NO: 439647 - RNA, 64 nt, Homo Sapiens
agccaguacgucugagcugacgggggaggacugaccgcuucauaaaagguuaguguuugggggc

SEQ ID NO: 439648 - RNA, 64 nt, Homo Sapiens
caucacccucagucagugcccaagaguggccaaaccgcuucacaucugcagugcuuccccaggg

SEQ ID NO: 439649 - RNA, 64 nt, Homo Sapiens
ucuugccccacuuggggcagccgaaaggaaggaaccgcuucacuuccaaugcacaauagccccu

SEQ ID NO: 439650 - RNA, 64 nt, Homo Sapiens
auuccgauuccuguccccuuauguaagacccuucccgcuucaccccuugccccagacaaccagc

SEQ ID NO: 439651 - RNA, 64 nt, Homo Sapiens
accucaaaugaaagacugucgguucgaggugaggccgcuucagacucuuggaagaucccgcaug

SEQ ID NO: 439652 - RNA, 64 nt, Homo Sapiens
gcaccccuccuccuugcugauuugcacacauuggccgcuucagacacgcacuucuggggccagc

SEQ ID NO: 439653 - RNA, 64 nt, Homo Sapiens
gcuuugugccuggacccagagagugugggacuccccgcuucauccccaccgucccacuccacag

SEQ ID NO: 439654 - RNA, 64 nt, Homo Sapiens
ccuucugacucuggaaaccgucccaggaggagccccgcuucaccagcucuuccaaccuugacau

SEQ ID NO: 439655 - RNA, 64 nt, Homo Sapiens
auuguaagcgauguaugcuugugcguuuucucaaccgcuucaacauguuagacagaugcugagu

SEQ ID NO: 439656 - RNA, 64 nt, Homo Sapiens
ugaucaguuggguggccugaggcaacuccuuuccccgcuucagcccucaacugccucgaguccu

SEQ ID NO: 439657 - RNA, 64 nt, Homo Sapiens
gcggcucugucccugcugccucucgcacgcucacccgcuucaguagccugcucggcuguauguu

SEQ ID NO: 439658 - RNA, 64 nt, Homo Sapiens
aauagauuuaagugucacuuucccucccugccccccgcuucagucucuaccauaucugguccca

SEQ ID NO: 439659 - RNA, 64 nt, Homo Sapiens
auggcagguggucccugcugaaacccccacgccuccgcuucagcaucuccacgcucugaagcug

SEQ ID NO: 439660 - RNA, 64 nt, Homo Sapiens
cugggcugggagcagcccuaggacaggacuuggaccgcuucagcucgcucucccuccaugccaa

SEQ ID NO: 439661 - RNA, 57 nt, Homo Sapiens
gaacaaaaggcucucccuaaaagaccaccgcuucaaaaaaaccugaggaauggagug

SEQ ID NO: 439662 - RNA, 57 nt, Homo Sapiens
gaacaaaaggcucucccuaaaagaccgccgcuucaaaaaaaccugaggaauggagug

SEQ ID NO: 439663 - RNA, 64 nt, Homo Sapiens
caugccuacacaauuuuuuuacuguuuugcuaagccgcuucauugaugaugucuugucaguauu

SEQ ID NO: 439664 - RNA, 64 nt, Homo Sapiens; identical to SEQ ID NO: 332833

SEQ ID NO: 439665 - RNA, 64 nt, Homo Sapiens; identical to SEQ ID NO: 332834

SEQ ID NO: 439666 - RNA, 64 nt, Homo Sapiens; identical to SEQ ID NO: 332835

SEQ ID NO: 439667 - RNA, 64 nt, Homo Sapiens; identical to SEQ ID NO: 332836

SEQ ID NO: 439668 - RNA, 64 nt, Homo Sapiens; identical to SEQ ID NO: 332837

SEQ ID NO: 439669 - RNA, 64 nt, Homo Sapiens; identical to SEQ ID NO: 332838

SEQ ID NO: 439670 - RNA, 64 nt, Homo Sapiens; identical to SEQ ID NO: 332839

SEQ ID NO: 439671 - RNA, 64 nt, Homo Sapiens; identical to SEQ ID NO: 332840

SEQ ID NO: 439672 - RNA, 64 nt, Homo Sapiens; identical to SEQ ID NO: 332841

SEQ ID NO: 439673 - RNA, 64 nt, Homo Sapiens; identical to SEQ ID NO: 332842

SEQ ID NO: 439674 - RNA, 64 nt, Homo Sapiens; identical to SEQ ID NO: 332843

SEQ ID NO: 439675 - RNA, 64 nt, Homo Sapiens; identical to SEQ ID NO: 332844

SEQ ID NO: 439676 - RNA, 64 nt, Homo Sapiens; identical to SEQ ID NO: 332845

SEQ ID NO: 439677 - RNA, 64 nt, Homo Sapiens; identical to SEQ ID NO: 332846

SEQ ID NO: 439678 - RNA, 64 nt, Homo Sapiens; identical to SEQ ID NO: 332847

SEQ ID NO: 439679 - RNA, 64 nt, Homo Sapiens; identical to SEQ ID NO: 332848

SEQ ID NO: 439680 - RNA, 64 nt, Homo Sapiens; identical to SEQ ID NO: 332849

SEQ ID NO: 439681 - RNA, 64 nt, Homo Sapiens; identical to SEQ ID NO: 332850

SEQ ID NO: 439682 - RNA, 64 nt, Homo Sapiens; identical to SEQ ID NO: 332851

SEQ ID NO: 439683 - RNA, 64 nt, Homo Sapiens; identical to SEQ ID NO: 332852

SEQ ID NO: 439684 - RNA, 64 nt, Homo Sapiens; identical to SEQ ID NO: 332853

SEQ ID NO: 439685 - RNA, 64 nt, Homo Sapiens; identical to SEQ ID NO: 332854

SEQ ID NO: 439686 - RNA, 64 nt, Homo Sapiens; identical to SEQ ID NO: 332855

SEQ ID NO: 439687 - RNA, 64 nt, Homo Sapiens; identical to SEQ ID NO: 332856

SEQ ID NO: 439688 - RNA, 64 nt, Homo Sapiens; identical to SEQ ID NO: 332857

SEQ ID NO: 439689 - RNA, 64 nt, Homo Sapiens; identical to SEQ ID NO: 332858

SEQ ID NO: 439690 - RNA, 64 nt, Homo Sapiens; identical to SEQ ID NO: 332859

SEQ ID NO: 439691 - RNA, 64 nt, Homo Sapiens; identical to SEQ ID NO: 332860

SEQ ID NO: 439692 - RNA, 64 nt, Homo Sapiens; identical to SEQ ID NO: 332861

SEQ ID NO: 439693 - RNA, 64 nt, Homo Sapiens; identical to SEQ ID NO: 332862

SEQ ID NO: 439694 - RNA, 64 nt, Homo Sapiens; identical to SEQ ID NO: 332863

SEQ ID NO: 439695 - RNA, 64 nt, Homo Sapiens; identical to SEQ ID NO: 332864

SEQ ID NO: 439696 - RNA, 64 nt, Homo Sapiens; identical to SEQ ID NO: 332865

SEQ ID NO: 439697 - RNA, 64 nt, Homo Sapiens; identical to SEQ ID NO: 332866

SEQ ID NO: 439698 - RNA, 64 nt, Homo Sapiens; identical to SEQ ID NO: 332867

SEQ ID NO: 439699 - RNA, 64 nt, Homo Sapiens; identical to SEQ ID NO: 332868

SEQ ID NO: 439700 - RNA, 64 nt, Homo Sapiens; identical to SEQ ID NO: 145127

SEQ ID NO: 439701 - RNA, 64 nt, Homo Sapiens; identical to SEQ ID NO: 145128

SEQ ID NO: 439702 - RNA, 63 nt, Homo Sapiens; identical to SEQ ID NO: 233068

SEQ ID NO: 439703 - RNA, 63 nt, Homo Sapiens; identical to SEQ ID NO: 233069

SEQ ID NO: 439704 - RNA, 63 nt, Homo Sapiens; identical to SEQ ID NO: 233070

SEQ ID NO: 439705 - RNA, 63 nt, Homo Sapiens; identical to SEQ ID NO: 233071

SEQ ID NO: 439706 - RNA, 63 nt, Homo Sapiens; identical to SEQ ID NO: 233072

SEQ ID NO: 439707 - RNA, 63 nt, Homo Sapiens; identical to SEQ ID NO: 233073

SEQ ID NO: 439708 - RNA, 63 nt, Homo Sapiens; identical to SEQ ID NO: 233074

SEQ ID NO: 439709 - RNA, 63 nt, Homo Sapiens; identical to SEQ ID NO: 233075

SEQ ID NO: 439710 - RNA, 63 nt, Homo Sapiens; identical to SEQ ID NO: 233076

SEQ ID NO: 439711 - RNA, 63 nt, Homo Sapiens; identical to SEQ ID NO: 233077

SEQ ID NO: 439712 - RNA, 63 nt, Homo Sapiens; identical to SEQ ID NO: 233078

SEQ ID NO: 439713 - RNA, 63 nt, Homo Sapiens; identical to SEQ ID NO: 233079

SEQ ID NO: 439714 - RNA, 64 nt, Homo Sapiens; identical to SEQ ID NO: 368571

SEQ ID NO: 439715 - RNA, 64 nt, Homo Sapiens; identical to SEQ ID NO: 368572

SEQ ID NO: 439716 - RNA, 64 nt, Homo Sapiens; identical to SEQ ID NO: 368573

SEQ ID NO: 439717 - RNA, 64 nt, Homo Sapiens; identical to SEQ ID NO: 368574

SEQ ID NO: 439718 - RNA, 64 nt, Homo Sapiens; identical to SEQ ID NO: 368575

SEQ ID NO: 439719 - RNA, 64 nt, Homo Sapiens; identical to SEQ ID NO: 368576

SEQ ID NO: 439720 - RNA, 64 nt, Homo Sapiens; identical to SEQ ID NO: 368577

SEQ ID NO: 439721 - RNA, 64 nt, Homo Sapiens; identical to SEQ ID NO: 368578

SEQ ID NO: 439722 - RNA, 64 nt, Homo Sapiens; identical to SEQ ID NO: 368579

SEQ ID NO: 439723 - RNA, 64 nt, Homo Sapiens; identical to SEQ ID NO: 368580

SEQ ID NO: 439724 - RNA, 64 nt, Homo Sapiens; identical to SEQ ID NO: 368581

SEQ ID NO: 439725 - RNA, 64 nt, Homo Sapiens; identical to SEQ ID NO: 368582

SEQ ID NO: 439726 - RNA, 64 nt, Homo Sapiens; identical to SEQ ID NO: 368583

SEQ ID NO: 439727 - RNA, 64 nt, Homo Sapiens; identical to SEQ ID NO: 368584

SEQ ID NO: 439728 - RNA, 64 nt, Homo Sapiens; identical to SEQ ID NO: 368585

SEQ ID NO: 439729 - RNA, 64 nt, Homo Sapiens; identical to SEQ ID NO: 368586

SEQ ID NO: 439730 - RNA, 64 nt, Homo Sapiens; identical to SEQ ID NO: 368587

SEQ ID NO: 439731 - RNA, 64 nt, Homo Sapiens; identical to SEQ ID NO: 368588

SEQ ID NO: 439732 - RNA, 64 nt, Homo Sapiens; identical to SEQ ID NO: 368589

SEQ ID NO: 439733 - RNA, 64 nt, Homo Sapiens; identical to SEQ ID NO: 368590

SEQ ID NO: 439734 - RNA, 64 nt, Homo Sapiens; identical to SEQ ID NO: 368591

SEQ ID NO: 439735 - RNA, 64 nt, Homo Sapiens; identical to SEQ ID NO: 368592

SEQ ID NO: 439736 - RNA, 64 nt, Homo Sapiens; identical to SEQ ID NO: 368593

SEQ ID NO: 439737 - RNA, 64 nt, Homo Sapiens; identical to SEQ ID NO: 368594

SEQ ID NO: 439738 - RNA, 64 nt, Homo Sapiens; identical to SEQ ID NO: 368595

SEQ ID NO: 439739 - RNA, 64 nt, Homo Sapiens; identical to SEQ ID NO: 368596

SEQ ID NO: 439740 - RNA, 64 nt, Homo Sapiens; identical to SEQ ID NO: 368597

SEQ ID NO: 439741 - RNA, 64 nt, Homo Sapiens; identical to SEQ ID NO: 368598

SEQ ID NO: 439742 - RNA, 64 nt, Homo Sapiens; identical to SEQ ID NO: 368599

SEQ ID NO: 439743 - RNA, 64 nt, Homo Sapiens; identical to SEQ ID NO: 368600

SEQ ID NO: 439744 - RNA, 64 nt, Homo Sapiens; identical to SEQ ID NO: 368601

SEQ ID NO: 439745 - RNA, 64 nt, Homo Sapiens; identical to SEQ ID NO: 368602

SEQ ID NO: 439746 - RNA, 64 nt, Homo Sapiens; identical to SEQ ID NO: 368603

SEQ ID NO: 439747 - RNA, 64 nt, Homo Sapiens; identical to SEQ ID NO: 368604

SEQ ID NO: 439748 - RNA, 64 nt, Homo Sapiens; identical to SEQ ID NO: 368605

SEQ ID NO: 439749 - RNA, 64 nt, Homo Sapiens; identical to SEQ ID NO: 368606

SEQ ID NO: 439750 - RNA, 64 nt, Homo Sapiens; identical to SEQ ID NO: 368607

SEQ ID NO: 439751 - RNA, 64 nt, Homo Sapiens; identical to SEQ ID NO: 368608

SEQ ID NO: 439752 - RNA, 64 nt, Homo Sapiens; identical to SEQ ID NO: 368609

SEQ ID NO: 439753 - RNA, 64 nt, Homo Sapiens; identical to SEQ ID NO: 368610

SEQ ID NO: 439754 - RNA, 64 nt, Homo Sapiens; identical to SEQ ID NO: 368611

SEQ ID NO: 439755 - RNA, 64 nt, Homo Sapiens; identical to SEQ ID NO: 368612

SEQ ID NO: 439756 - RNA, 64 nt, Homo Sapiens; identical to SEQ ID NO: 368613

SEQ ID NO: 439757 - RNA, 64 nt, Homo Sapiens
uucagcaccagugaaaggcuuugagaaggacgugggcagcaaaacgacacugcgcaucaccuac

SEQ ID NO: 439758 - RNA, 64 nt, Homo Sapiens
agacccagagaaggacggugccaagggccccaggggcagcaaggccuugguggagcagccagag

SEQ ID NO: 439759 - RNA, 64 nt, Homo Sapiens
ccagcaggcccagcaugcagguggugggacacugggcagcaaggcugcugccggaaucacuucu

SEQ ID NO: 439760 - RNA, 64 nt, Homo Sapiens
gaggggccuaugucaaacugacuacuaugaaguuggcagcaacaaacaaucuuuucugccucca

SEQ ID NO: 439761 - RNA, 64 nt, Homo Sapiens
aggccuccuggugaccggaggcuagagcggugccggcagcaagccggagcuccguggaacugga

SEQ ID NO: 439762 - RNA, 64 nt, Homo Sapiens
cuaaguagccuguguuuuuaaauccagggcugcaggcagcaacgcaagucaggcugaacauuca

SEQ ID NO: 439763 - RNA, 64 nt, Homo Sapiens
ucuucccuaggugaaucugugaaugguccuuucuggcagcaaucccugccuucuuuuugggccc

SEQ ID NO: 439764 - RNA, 64 nt, Homo Sapiens
ggccccaucaucuuggaugcugcccugcguauuuggcagcaauggugggccacccagggccucu

SEQ ID NO: 439765 - RNA, 64 nt, Homo Sapiens
aagcgucuaaccuaaagucccaggauuggcuccaggcagcaauuauaucauaacuuauugaacu

SEQ ID NO: 439766 - RNA, 64 nt, Homo Sapiens
auggagcuucuugcacaaauucaggaguuuguugggcagcaagcgagagagaggcugagaucau

SEQ ID NO: 439767 - RNA, 64 nt, Homo Sapiens
guuccacgugcauuugcaauuccccuguuugcguggcagcaagguagaaaaggauucuggugcu

SEQ ID NO: 439768 - RNA, 64 nt, Homo Sapiens
gcagaggagugacagccgcagacacacgacagccggcagcaacuggaauggcagcaauuaaggg

SEQ ID NO: 439769 - RNA, 64 nt, Homo Sapiens
ccgcagacacacgacagccggcagcaacuggaauggcagcaauuaaggguggggggcggggguu

SEQ ID NO: 439770 - RNA, 64 nt, Homo Sapiens; identical to SEQ ID NO: 215703

SEQ ID NO: 439771 - RNA, 64 nt, Homo Sapiens; identical to SEQ ID NO: 215704

SEQ ID NO: 439772 - RNA, 64 nt, Homo Sapiens; identical to SEQ ID NO: 215705

SEQ ID NO: 439773 - RNA, 64 nt, Homo Sapiens; identical to SEQ ID NO: 215706

SEQ ID NO: 439774 - RNA, 64 nt, Homo Sapiens; identical to SEQ ID NO: 215707

SEQ ID NO: 439775 - RNA, 64 nt, Homo Sapiens; identical to SEQ ID NO: 215708

SEQ ID NO: 439776 - RNA, 64 nt, Homo Sapiens; identical to SEQ ID NO: 215709

SEQ ID NO: 439777 - RNA, 64 nt, Homo Sapiens; identical to SEQ ID NO: 215710

SEQ ID NO: 439778 - RNA, 62 nt, Homo Sapiens; identical to SEQ ID NO: 215711

SEQ ID NO: 439779 - RNA, 64 nt, Homo Sapiens; identical to SEQ ID NO: 215712

SEQ ID NO: 439780 - RNA, 64 nt, Homo Sapiens; identical to SEQ ID NO: 215713

SEQ ID NO: 439781 - RNA, 64 nt, Homo Sapiens; identical to SEQ ID NO: 215714

SEQ ID NO: 439782 - RNA, 64 nt, Homo Sapiens; identical to SEQ ID NO: 215715

SEQ ID NO: 439783 - RNA, 64 nt, Homo Sapiens; identical to SEQ ID NO: 215716

SEQ ID NO: 439784 - RNA, 64 nt, Homo Sapiens; identical to SEQ ID NO: 215717

SEQ ID NO: 439785 - RNA, 64 nt, Homo Sapiens; identical to SEQ ID NO: 215718

SEQ ID NO: 439786 - RNA, 64 nt, Homo Sapiens; identical to SEQ ID NO: 215719

SEQ ID NO: 439787 - RNA, 64 nt, Homo Sapiens; identical to SEQ ID NO: 215720

SEQ ID NO: 439788 - RNA, 64 nt, Homo Sapiens; identical to SEQ ID NO: 215721

SEQ ID NO: 439789 - RNA, 64 nt, Homo Sapiens; identical to SEQ ID NO: 215722

SEQ ID NO: 439790 - RNA, 64 nt, Homo Sapiens; identical to SEQ ID NO: 215723

SEQ ID NO: 439791 - RNA, 64 nt, Homo Sapiens; identical to SEQ ID NO: 215724

SEQ ID NO: 439792 - RNA, 64 nt, Homo Sapiens; identical to SEQ ID NO: 215725

SEQ ID NO: 439793 - RNA, 64 nt, Homo Sapiens; identical to SEQ ID NO: 215726

SEQ ID NO: 439794 - RNA, 64 nt, Homo Sapiens; identical to SEQ ID NO: 215727

SEQ ID NO: 439795 - RNA, 64 nt, Homo Sapiens; identical to SEQ ID NO: 215728

SEQ ID NO: 439796 - RNA, 64 nt, Homo Sapiens; identical to SEQ ID NO: 215729

SEQ ID NO: 439797 - RNA, 64 nt, Homo Sapiens; identical to SEQ ID NO: 215730

SEQ ID NO: 439798 - RNA, 64 nt, Homo Sapiens; identical to SEQ ID NO: 215731

SEQ ID NO: 439799 - RNA, 64 nt, Homo Sapiens; identical to SEQ ID NO: 215732

SEQ ID NO: 439800 - RNA, 64 nt, Homo Sapiens; identical to SEQ ID NO: 215733

SEQ ID NO: 439801 - RNA, 64 nt, Homo Sapiens
caaugcugugaguuuccaacuuuuugacgggaacacugcagagaugauuaaauucagccuaaac

SEQ ID NO: 439802 - RNA, 64 nt, Homo Sapiens
guagaacacugagcaggacaguaaucaccagacaacugcagaauuagccugaguuucauaggag

SEQ ID NO: 439803 - RNA, 64 nt, Homo Sapiens
ccgauuuuuacugagaagagauaugccuguuguuacugcagaaccugaaccguaaguaggauga

SEQ ID NO: 439804 - RNA, 64 nt, Homo Sapiens
guuaagcauaaaaagaaagggaaaaagcagaaacacugcagaagacacaaacaaacaaagaaga

SEQ ID NO: 439805 - RNA, 64 nt, Homo Sapiens
ccagccugguuucauaccgaaaagacauugaaggacugcagaaauguaugggugcaccgggccg

SEQ ID NO: 439806 - RNA, 64 nt, Homo Sapiens
uuucucuucugucccgucaccaggcucuugcuucacugcagauacaguucacucugaaagcugg

SEQ ID NO: 439807 - RNA, 64 nt, Homo Sapiens
ccagaacagaaggccacaggaucaauacacacacacugcagaacuuucuuacccacauucccca

SEQ ID NO: 439808 - RNA, 64 nt, Homo Sapiens
gaacacauuucggcgaggguauccccgcaucagcacugcagagaccacuccucucugguacccc

SEQ ID NO: 439809 - RNA, 64 nt, Homo Sapiens
cuucauguaaauaaaaacuaguuuacauuuuuguacugcagacguucuauuaugagcuaucaaa

SEQ ID NO: 439810 - RNA, 64 nt, Homo Sapiens
cgcucuaggaagaacuggagucccgacccccaccacugcagacuugggcuucaugcauuaugga

SEQ ID NO: 439811 - RNA, 64 nt, Homo Sapiens
cuucuacuguaaugagacaagccuuucuucugucacugcagaauuuagaaggggccgugagcag

SEQ ID NO: 439812 - RNA, 64 nt, Homo Sapiens
acaggcaucaagaagccagggccgugccuggagcacugcagagaugacuuuggagaaagcaaag

SEQ ID NO: 439813 - RNA, 64 nt, Homo Sapiens
uuagaucuaauguauacugcuggugugcuuagaaacugcagauuggaucugaaagaucuaaaca

SEQ ID NO: 439814 - RNA, 64 nt, Homo Sapiens
gaucugaaagaucuaaacauagaaauaaccuaaaacugcagaagucacuuaaagguaccucugu

SEQ ID NO: 439815 - RNA, 64 nt, Homo Sapiens
ggccucucgugguccucagccccucacccccaguacugcagaucucacaguuugccuuccagaa

SEQ ID NO: 439816 - RNA, 64 nt, Homo Sapiens
guggcucugcuggcucagugugggcugcaggaggacugcagacucagcugcaauucugaggggg

SEQ ID NO: 439817 - RNA, 64 nt, Homo Sapiens
caacgcugcuagucuuaaccccagaccagagagaacugcagaucugacugggccuaaauuaagu

SEQ ID NO: 439818 - RNA, 64 nt, Homo Sapiens
uaucuguauuaacagcaauguuacucucaaugaaacugcagaagccaccaugaacauggaagac

SEQ ID NO: 439819 - RNA, 64 nt, Homo Sapiens
augugcagguacuaugcaugggucuguguuacagacugcagaggaagcuacauagaagggacag

SEQ ID NO: 439820 - RNA, 64 nt, Homo Sapiens
aaauucacaggaaaaaucaauuuuuaagcuugaaacugcagaaguucuggaaaagaugccauuc

SEQ ID NO: 439821 - RNA, 64 nt, Homo Sapiens
caaugucguaggugauagaaaacucgccuacuccacugcagaacuugcagaaugcgugguguua

SEQ ID NO: 439822 - RNA, 64 nt, Homo Sapiens
aagucagagauaauugccuauacuaagaaucuauacugcagaauauaguguaucaaaaacuuuu

SEQ ID NO: 439823 - RNA, 64 nt, Homo Sapiens
ggcagcucagaagaaugcagguguuucucagcacacugcagaagggaccgugugaagcuagggg

SEQ ID NO: 439824 - RNA, 64 nt, Homo Sapiens
aagggguguuguuagaugcuuguuucuugauuuuacugcagaucccuuuggauguauacacaca

SEQ ID NO: 439825 - RNA, 64 nt, Homo Sapiens
auagauuuuuuuuuaauauaaaguaugucaaaagacugcagacuaccacauauccacccuugag

SEQ ID NO: 439826 - RNA, 64 nt, Homo Sapiens
uauuaaggauguuaggagaguuggugcugcccacacugcagauaaucccucucugcugcuuuug

SEQ ID NO: 439827 - RNA, 64 nt, Homo Sapiens
uuuucuuaaaaccaaucaauaauagcuagcuauuacugcagacuauaaaaucuggauauagaaa

SEQ ID NO: 439828 - RNA, 64 nt, Homo Sapiens
uuauaaacauuuaaagacaaagacauuucaaauaacugcagaaaaaauauuguaguuugaauau

SEQ ID NO: 439829 - RNA, 64 nt, Homo Sapiens
aucacuggaauccagaucgaggaggcaggugggcacugcagaggggcuucuucagucgcucccu

SEQ ID NO: 439830 - RNA, 64 nt, Homo Sapiens
uuccuuaugaugauuguguggucuugaaaaagcaacugcagaaaguaaaggacuggggaggcgu

SEQ ID NO: 439831 - RNA, 64 nt, Homo Sapiens
cuuuacuuuuuuccccccaaauagguauauauagacugcagaagcuucagucccauauauaaac

SEQ ID NO: 439832 - RNA, 64 nt, Homo Sapiens
aaaguguuuuugagaauuuuuauauauauuacucacugcagagaucauguucauuuacauuccc

SEQ ID NO: 439833 - RNA, 64 nt, Homo Sapiens
ucccauuuuguuuuuccagaguucguggagguggacugcagagcccagagcccuucaucucucu

SEQ ID NO: 439834 - RNA, 64 nt, Homo Sapiens
gcuuggagaguggaucagagagacuaggacaguuacugcagagcuccuaagucaccacucaacc

SEQ ID NO: 439835 - RNA, 64 nt, Homo Sapiens
ugucaucugaugcauuuggaccauaugcugccagacugcagaacgggggagccggggcucaggg

SEQ ID NO: 439836 - RNA, 64 nt, Homo Sapiens
gaggguuguguggacaccccucgcucugaugccaacugcagauaauacacaccuccugcagcgu

SEQ ID NO: 439837 - RNA, 64 nt, Homo Sapiens
ccucaggacuguccuggcuccgaccuuuguguacacugcagacgcugguucugaggaacuguug

SEQ ID NO: 439838 - RNA, 64 nt, Homo Sapiens
ucccuuucaugcugcauauuaacugguuaauuauacugcagaaaccuuuucaccuccacuaguc

SEQ ID NO: 439839 - RNA, 64 nt, Homo Sapiens
aaucuuacaaaugugaagacaucauagucuucauacugcagagaacagucacaccuugcaaguc

SEQ ID NO: 439840 - RNA, 64 nt, Homo Sapiens
aacuuuacaaauaggaagaaaucauagaauucauacugcagagaaaaaacaacccuugcacguc

SEQ ID NO: 439841 - RNA, 64 nt, Homo Sapiens
aaaaauauucauguagcaaaucugagaauugaaaacugcagauaaccggccggguauggugacu

SEQ ID NO: 439842 - RNA, 64 nt, Homo Sapiens
aaaaaaaaaaaaaacagaaagaaagaaaaagaaaacugcagauaacccuauacauuaauacugg

SEQ ID NO: 439843 - RNA, 64 nt, Homo Sapiens
caccggugaggaagggucucuauuccucccaggcacugcagaggggggaagggucuccaggcuu

SEQ ID NO: 439844 - RNA, 64 nt, Homo Sapiens
cccgguggggaagggucucccguugcucccaggcacugcagaggagguucagggagaacagcug

SEQ ID NO: 439845 - RNA, 64 nt, Homo Sapiens; identical to SEQ ID NO: 88665

SEQ ID NO: 439846 - RNA, 64 nt, Homo Sapiens; identical to SEQ ID NO: 88666

SEQ ID NO: 439847 - RNA, 64 nt, Homo Sapiens; identical to SEQ ID NO: 88667

SEQ ID NO: 439848 - RNA, 64 nt, Homo Sapiens; identical to SEQ ID NO: 88668

SEQ ID NO: 439849 - RNA, 64 nt, Homo Sapiens; identical to SEQ ID NO: 88669

SEQ ID NO: 439850 - RNA, 64 nt, Homo Sapiens; identical to SEQ ID NO: 88670

SEQ ID NO: 439851 - RNA, 64 nt, Homo Sapiens; identical to SEQ ID NO: 88671

SEQ ID NO: 439852 - RNA, 64 nt, Homo Sapiens; identical to SEQ ID NO: 88672

SEQ ID NO: 439853 - RNA, 64 nt, Homo Sapiens; identical to SEQ ID NO: 88673

SEQ ID NO: 439854 - RNA, 64 nt, Homo Sapiens; identical to SEQ ID NO: 88674

SEQ ID NO: 439855 - RNA, 64 nt, Homo Sapiens; identical to SEQ ID NO: 88675

SEQ ID NO: 439856 - RNA, 64 nt, Homo Sapiens; identical to SEQ ID NO: 88676

SEQ ID NO: 439857 - RNA, 64 nt, Homo Sapiens; identical to SEQ ID NO: 88677

SEQ ID NO: 439858 - RNA, 64 nt, Homo Sapiens; identical to SEQ ID NO: 88678

SEQ ID NO: 439859 - RNA, 64 nt, Homo Sapiens; identical to SEQ ID NO: 88679

SEQ ID NO: 439860 - RNA, 64 nt, Homo Sapiens; identical to SEQ ID NO: 88680

SEQ ID NO: 439861 - RNA, 64 nt, Homo Sapiens; identical to SEQ ID NO: 88681

SEQ ID NO: 439862 - RNA, 64 nt, Homo Sapiens; identical to SEQ ID NO: 88682

SEQ ID NO: 439863 - RNA, 64 nt, Homo Sapiens; identical to SEQ ID NO: 88683

SEQ ID NO: 439864 - RNA, 64 nt, Homo Sapiens; identical to SEQ ID NO: 88684

SEQ ID NO: 439865 - RNA, 64 nt, Homo Sapiens; identical to SEQ ID NO: 88685

SEQ ID NO: 439866 - RNA, 64 nt, Homo Sapiens; identical to SEQ ID NO: 88686

SEQ ID NO: 439867 - RNA, 64 nt, Homo Sapiens; identical to SEQ ID NO: 88687

SEQ ID NO: 439868 - RNA, 64 nt, Homo Sapiens; identical to SEQ ID NO: 88688

SEQ ID NO: 439869 - RNA, 64 nt, Homo Sapiens; identical to SEQ ID NO: 88689

SEQ ID NO: 439870 - RNA, 64 nt, Homo Sapiens; identical to SEQ ID NO: 88690

SEQ ID NO: 439871 - RNA, 64 nt, Homo Sapiens; identical to SEQ ID NO: 88691

SEQ ID NO: 439872 - RNA, 50 nt, Homo Sapiens; identical to SEQ ID NO: 88692

SEQ ID NO: 439873 - RNA, 64 nt, Homo Sapiens; identical to SEQ ID NO: 88693

SEQ ID NO: 439874 - RNA, 64 nt, Homo Sapiens; identical to SEQ ID NO: 88694

SEQ ID NO: 439875 - RNA, 64 nt, Homo Sapiens; identical to SEQ ID NO: 88695

SEQ ID NO: 439876 - RNA, 64 nt, Homo Sapiens; identical to SEQ ID NO: 88696

SEQ ID NO: 439877 - RNA, 64 nt, Homo Sapiens; identical to SEQ ID NO: 88697

SEQ ID NO: 439878 - RNA, 64 nt, Homo Sapiens; identical to SEQ ID NO: 88698

SEQ ID NO: 439879 - RNA, 64 nt, Homo Sapiens; identical to SEQ ID NO: 88699

SEQ ID NO: 439880 - RNA, 64 nt, Homo Sapiens; identical to SEQ ID NO: 88700

SEQ ID NO: 439881 - RNA, 64 nt, Homo Sapiens; identical to SEQ ID NO: 88701

SEQ ID NO: 439882 - RNA, 64 nt, Homo Sapiens; identical to SEQ ID NO: 88702

SEQ ID NO: 439883 - RNA, 64 nt, Homo Sapiens; identical to SEQ ID NO: 88703

SEQ ID NO: 439884 - RNA, 64 nt, Homo Sapiens; identical to SEQ ID NO: 88704

SEQ ID NO: 439885 - RNA, 64 nt, Homo Sapiens; identical to SEQ ID NO: 88705

SEQ ID NO: 439886 - RNA, 64 nt, Homo Sapiens; identical to SEQ ID NO: 88706

SEQ ID NO: 439887 - RNA, 64 nt, Homo Sapiens; identical to SEQ ID NO: 88707

SEQ ID NO: 439888 - RNA, 64 nt, Homo Sapiens; identical to SEQ ID NO: 88708

SEQ ID NO: 439889 - RNA, 64 nt, Homo Sapiens; identical to SEQ ID NO: 88709

SEQ ID NO: 439890 - RNA, 64 nt, Homo Sapiens; identical to SEQ ID NO: 88710

SEQ ID NO: 439891 - RNA, 64 nt, Homo Sapiens; identical to SEQ ID NO: 88711

SEQ ID NO: 439892 - RNA, 64 nt, Homo Sapiens; identical to SEQ ID NO: 88712

SEQ ID NO: 439893 - RNA, 64 nt, Homo Sapiens; identical to SEQ ID NO: 88713

SEQ ID NO: 439894 - RNA, 64 nt, Homo Sapiens; identical to SEQ ID NO: 88714

SEQ ID NO: 439895 - RNA, 64 nt, Homo Sapiens; identical to SEQ ID NO: 88715

SEQ ID NO: 439896 - RNA, 64 nt, Homo Sapiens; identical to SEQ ID NO: 88716

SEQ ID NO: 439897 - RNA, 64 nt, Homo Sapiens; identical to SEQ ID NO: 88717

SEQ ID NO: 439898 - RNA, 64 nt, Homo Sapiens; identical to SEQ ID NO: 88718

SEQ ID NO: 439899 - RNA, 64 nt, Homo Sapiens; identical to SEQ ID NO: 88719

SEQ ID NO: 439900 - RNA, 64 nt, Homo Sapiens; identical to SEQ ID NO: 88720

SEQ ID NO: 439901 - RNA, 64 nt, Homo Sapiens; identical to SEQ ID NO: 88721

SEQ ID NO: 439902 - RNA, 64 nt, Homo Sapiens; identical to SEQ ID NO: 88722

SEQ ID NO: 439903 - RNA, 64 nt, Homo Sapiens; identical to SEQ ID NO: 88723

SEQ ID NO: 439904 - RNA, 64 nt, Homo Sapiens; identical to SEQ ID NO: 88724

SEQ ID NO: 439905 - RNA, 64 nt, Homo Sapiens; identical to SEQ ID NO: 88725

SEQ ID NO: 439906 - RNA, 64 nt, Homo Sapiens; identical to SEQ ID NO: 88726

SEQ ID NO: 439907 - RNA, 64 nt, Homo Sapiens; identical to SEQ ID NO: 88727

SEQ ID NO: 439908 - RNA, 64 nt, Homo Sapiens; identical to SEQ ID NO: 88728

SEQ ID NO: 439909 - RNA, 64 nt, Homo Sapiens; identical to SEQ ID NO: 88729

SEQ ID NO: 439910 - RNA, 64 nt, Homo Sapiens; identical to SEQ ID NO: 88730

SEQ ID NO: 439911 - RNA, 64 nt, Homo Sapiens; identical to SEQ ID NO: 88731

SEQ ID NO: 439912 - RNA, 64 nt, Homo Sapiens; identical to SEQ ID NO: 88732

SEQ ID NO: 439913 - RNA, 64 nt, Homo Sapiens; identical to SEQ ID NO: 88733

SEQ ID NO: 439914 - RNA, 64 nt, Homo Sapiens; identical to SEQ ID NO: 88734

SEQ ID NO: 439915 - RNA, 64 nt, Homo Sapiens; identical to SEQ ID NO: 88735

SEQ ID NO: 439916 - RNA, 64 nt, Homo Sapiens; identical to SEQ ID NO: 88736

SEQ ID NO: 439917 - RNA, 64 nt, Homo Sapiens; identical to SEQ ID NO: 88737

SEQ ID NO: 439918 - RNA, 64 nt, Homo Sapiens; identical to SEQ ID NO: 88738

SEQ ID NO: 439919 - RNA, 64 nt, Homo Sapiens; identical to SEQ ID NO: 88739

SEQ ID NO: 439920 - RNA, 64 nt, Homo Sapiens; identical to SEQ ID NO: 88740

SEQ ID NO: 439921 - RNA, 64 nt, Homo Sapiens; identical to SEQ ID NO: 88741

SEQ ID NO: 439922 - RNA, 64 nt, Homo Sapiens; identical to SEQ ID NO: 88742

SEQ ID NO: 439923 - RNA, 64 nt, Homo Sapiens; identical to SEQ ID NO: 88743

SEQ ID NO: 439924 - RNA, 64 nt, Homo Sapiens; identical to SEQ ID NO: 88744

SEQ ID NO: 439925 - RNA, 64 nt, Homo Sapiens; identical to SEQ ID NO: 88745

SEQ ID NO: 439926 - RNA, 64 nt, Homo Sapiens; identical to SEQ ID NO: 88746

SEQ ID NO: 439927 - RNA, 64 nt, Homo Sapiens; identical to SEQ ID NO: 88747

SEQ ID NO: 439928 - RNA, 64 nt, Homo Sapiens; identical to SEQ ID NO: 88748

SEQ ID NO: 439929 - RNA, 64 nt, Homo Sapiens; identical to SEQ ID NO: 88749

SEQ ID NO: 439930 - RNA, 64 nt, Homo Sapiens; identical to SEQ ID NO: 88750

SEQ ID NO: 439931 - RNA, 64 nt, Homo Sapiens; identical to SEQ ID NO: 88751

SEQ ID NO: 439932 - RNA, 64 nt, Homo Sapiens; identical to SEQ ID NO: 88752

SEQ ID NO: 439933 - RNA, 64 nt, Homo Sapiens; identical to SEQ ID NO: 88753

SEQ ID NO: 439934 - RNA, 64 nt, Homo Sapiens; identical to SEQ ID NO: 88754

SEQ ID NO: 439935 - RNA, 64 nt, Homo Sapiens; identical to SEQ ID NO: 88755

SEQ ID NO: 439936 - RNA, 64 nt, Homo Sapiens; identical to SEQ ID NO: 88756

SEQ ID NO: 439937 - RNA, 64 nt, Homo Sapiens; identical to SEQ ID NO: 88757

SEQ ID NO: 439938 - RNA, 64 nt, Homo Sapiens; identical to SEQ ID NO: 88758

SEQ ID NO: 439939 - RNA, 64 nt, Homo Sapiens; identical to SEQ ID NO: 88759

SEQ ID NO: 439940 - RNA, 64 nt, Homo Sapiens; identical to SEQ ID NO: 88760

SEQ ID NO: 439941 - RNA, 64 nt, Homo Sapiens; identical to SEQ ID NO: 88761

SEQ ID NO: 439942 - RNA, 64 nt, Homo Sapiens; identical to SEQ ID NO: 88762

SEQ ID NO: 439943 - RNA, 64 nt, Homo Sapiens; identical to SEQ ID NO: 88763

SEQ ID NO: 439944 - RNA, 64 nt, Homo Sapiens; identical to SEQ ID NO: 88764

SEQ ID NO: 439945 - RNA, 64 nt, Homo Sapiens; identical to SEQ ID NO: 88765

SEQ ID NO: 439946 - RNA, 64 nt, Homo Sapiens; identical to SEQ ID NO: 212912

SEQ ID NO: 439947 - RNA, 64 nt, Homo Sapiens; identical to SEQ ID NO: 212913

SEQ ID NO: 439948 - RNA, 64 nt, Homo Sapiens; identical to SEQ ID NO: 212914

SEQ ID NO: 439949 - RNA, 64 nt, Homo Sapiens; identical to SEQ ID NO: 212915

SEQ ID NO: 439950 - RNA, 64 nt, Homo Sapiens; identical to SEQ ID NO: 212916

SEQ ID NO: 439951 - RNA, 64 nt, Homo Sapiens; identical to SEQ ID NO: 212917

SEQ ID NO: 439952 - RNA, 64 nt, Homo Sapiens; identical to SEQ ID NO: 212918

SEQ ID NO: 439953 - RNA, 64 nt, Homo Sapiens
uccagaaggguaaacuaaacuaaagcuacaauuaauaugggaauuuggaagaagugguaggauu

SEQ ID NO: 439954 - RNA, 64 nt, Homo Sapiens
auugaguugaggcuguggagaaauaaggacacauauaugggaauggaaugcaaaaguuaaacuu

SEQ ID NO: 439955 - RNA, 64 nt, Homo Sapiens
auauuguagauugugguuucaucuaucauuagcuauaugggacucagugcuaggaauacugugu

SEQ ID NO: 439956 - RNA, 64 nt, Homo Sapiens
uuaacuuacucaagcaauagucagccauuuauuaauaugggaauuguaccagcuuuaccacuuu

SEQ ID NO: 439957 - RNA, 64 nt, Homo Sapiens
gccaauguuuuuauaaaucacuuguacauaguacauaugggaauaguugcauaugggaauuuaa

SEQ ID NO: 439958 - RNA, 64 nt, Homo Sapiens
aucacuuguacauaguacauaugggaauaguugcauaugggaauuuaaaccaacauguggcuga

SEQ ID NO: 439959 - RNA, 64 nt, Homo Sapiens
aaaaaacaaaaauaauuuccucuguaaucacaucauaugggaauaaaacaaaacaguaagauug

SEQ ID NO: 439960 - RNA, 64 nt, Homo Sapiens
gaugauguguguugggguagcaucuuauucuuuuauaugggacuaaauacauugagaaaguuuc

SEQ ID NO: 439961 - RNA, 64 nt, Homo Sapiens; identical to SEQ ID NO: 183983

SEQ ID NO: 439962 - RNA, 64 nt, Homo Sapiens; identical to SEQ ID NO: 183984

SEQ ID NO: 439963 - RNA, 64 nt, Homo Sapiens; identical to SEQ ID NO: 183985

SEQ ID NO: 439964 - RNA, 64 nt, Homo Sapiens; identical to SEQ ID NO: 183986

SEQ ID NO: 439965 - RNA, 64 nt, Homo Sapiens; identical to SEQ ID NO: 183987

SEQ ID NO: 439966 - RNA, 64 nt, Homo Sapiens; identical to SEQ ID NO: 183988

SEQ ID NO: 439967 - RNA, 64 nt, Homo Sapiens; identical to SEQ ID NO: 183989

SEQ ID NO: 439968 - RNA, 64 nt, Homo Sapiens; identical to SEQ ID NO: 183990

SEQ ID NO: 439969 - RNA, 64 nt, Homo Sapiens; identical to SEQ ID NO: 183991

SEQ ID NO: 439970 - RNA, 64 nt, Homo Sapiens; identical to SEQ ID NO: 183992

SEQ ID NO: 439971 - RNA, 64 nt, Homo Sapiens; identical to SEQ ID NO: 183993

SEQ ID NO: 439972 - RNA, 64 nt, Homo Sapiens; identical to SEQ ID NO: 183994

SEQ ID NO: 439973 - RNA, 64 nt, Homo Sapiens; identical to SEQ ID NO: 183995

SEQ ID NO: 439974 - RNA, 64 nt, Homo Sapiens; identical to SEQ ID NO: 183996

SEQ ID NO: 439975 - RNA, 64 nt, Homo Sapiens; identical to SEQ ID NO: 183997

SEQ ID NO: 439976 - RNA, 64 nt, Homo Sapiens; identical to SEQ ID NO: 183998

SEQ ID NO: 439977 - RNA, 64 nt, Homo Sapiens; identical to SEQ ID NO: 183999

SEQ ID NO: 439978 - RNA, 64 nt, Homo Sapiens; identical to SEQ ID NO: 184000

SEQ ID NO: 439979 - RNA, 64 nt, Homo Sapiens; identical to SEQ ID NO: 184001

SEQ ID NO: 439980 - RNA, 64 nt, Homo Sapiens; identical to SEQ ID NO: 184002

SEQ ID NO: 439981 - RNA, 64 nt, Homo Sapiens; identical to SEQ ID NO: 184003

SEQ ID NO: 439982 - RNA, 64 nt, Homo Sapiens; identical to SEQ ID NO: 184004

SEQ ID NO: 439983 - RNA, 64 nt, Homo Sapiens; identical to SEQ ID NO: 184005

SEQ ID NO: 439984 - RNA, 64 nt, Homo Sapiens; identical to SEQ ID NO: 184006

SEQ ID NO: 439985 - RNA, 64 nt, Homo Sapiens; identical to SEQ ID NO: 184007

SEQ ID NO: 439986 - RNA, 64 nt, Homo Sapiens; identical to SEQ ID NO: 184008

SEQ ID NO: 439987 - RNA, 64 nt, Homo Sapiens; identical to SEQ ID NO: 184009

SEQ ID NO: 439988 - RNA, 64 nt, Homo Sapiens; identical to SEQ ID NO: 184010

SEQ ID NO: 439989 - RNA, 64 nt, Homo Sapiens; identical to SEQ ID NO: 184011

SEQ ID NO: 439990 - RNA, 64 nt, Homo Sapiens; identical to SEQ ID NO: 184012

SEQ ID NO: 439991 - RNA, 64 nt, Homo Sapiens; identical to SEQ ID NO: 184013

SEQ ID NO: 439992 - RNA, 64 nt, Homo Sapiens; identical to SEQ ID NO: 184014

SEQ ID NO: 439993 - RNA, 64 nt, Homo Sapiens; identical to SEQ ID NO: 184015

SEQ ID NO: 439994 - RNA, 64 nt, Homo Sapiens; identical to SEQ ID NO: 184016

SEQ ID NO: 439995 - RNA, 64 nt, Homo Sapiens; identical to SEQ ID NO: 184017

SEQ ID NO: 439996 - RNA, 64 nt, Homo Sapiens; identical to SEQ ID NO: 184018

SEQ ID NO: 439997 - RNA, 64 nt, Homo Sapiens; identical to SEQ ID NO: 184019

SEQ ID NO: 439998 - RNA, 64 nt, Homo Sapiens; identical to SEQ ID NO: 184020

SEQ ID NO: 439999 - RNA, 64 nt, Homo Sapiens; identical to SEQ ID NO: 184021

SEQ ID NO: 440000 - RNA, 64 nt, Homo Sapiens; identical to SEQ ID NO: 184022

SEQ ID NO: 440001 - RNA, 64 nt, Homo Sapiens; identical to SEQ ID NO: 184023

SEQ ID NO: 440002 - RNA, 64 nt, Homo Sapiens; identical to SEQ ID NO: 184024

SEQ ID NO: 440003 - RNA, 64 nt, Homo Sapiens; identical to SEQ ID NO: 184025

SEQ ID NO: 440004 - RNA, 64 nt, Homo Sapiens; identical to SEQ ID NO: 184026

SEQ ID NO: 440005 - RNA, 64 nt, Homo Sapiens; identical to SEQ ID NO: 184027

SEQ ID NO: 440006 - RNA, 64 nt, Homo Sapiens; identical to SEQ ID NO: 184028

SEQ ID NO: 440007 - RNA, 64 nt, Homo Sapiens; identical to SEQ ID NO: 184029

SEQ ID NO: 440008 - RNA, 64 nt, Homo Sapiens; identical to SEQ ID NO: 184030

SEQ ID NO: 440009 - RNA, 64 nt, Homo Sapiens; identical to SEQ ID NO: 184031

SEQ ID NO: 440010 - RNA, 64 nt, Homo Sapiens; identical to SEQ ID NO: 184032

SEQ ID NO: 440011 - RNA, 64 nt, Homo Sapiens; identical to SEQ ID NO: 184033

SEQ ID NO: 440012 - RNA, 64 nt, Homo Sapiens
cacagcaccaggcccacggaaaguggcuaauguuagcuacuaugaauggugccagugaagacac

SEQ ID NO: 440013 - RNA, 64 nt, Homo Sapiens
uuggcuggguguggugucacaugccaguaaccccagcuacuagggaggcugaggcaggagaauc

SEQ ID NO: 440014 - RNA, 64 nt, Homo Sapiens
auauucucagcacaggaaugguggcagcagcaggagcuacuagacugguauucccagcugccau

SEQ ID NO: 440015 - RNA, 64 nt, Homo Sapiens
gaggcugaggcaagagaguuaugccuguaaucccagcuacuagguuagcugggcgugguggugc

SEQ ID NO: 440016 - RNA, 64 nt, Homo Sapiens
ggugauauuuuccuuguuuauaggaugcagggagagcuacuaugagauuugaugagcaaguggu

SEQ ID NO: 440017 - RNA, 64 nt, Homo Sapiens
ucauuagagauacucugaagcuuuauuuuccaugagcuacuaagauagauuuaccuuauauugu

SEQ ID NO: 440018 - RNA, 64 nt, Homo Sapiens; identical to SEQ ID NO: 110071

SEQ ID NO: 440019 - RNA, 64 nt, Homo Sapiens; identical to SEQ ID NO: 110072

SEQ ID NO: 440020 - RNA, 64 nt, Homo Sapiens; identical to SEQ ID NO: 110073

SEQ ID NO: 440021 - RNA, 64 nt, Homo Sapiens; identical to SEQ ID NO: 110074

SEQ ID NO: 440022 - RNA, 64 nt, Homo Sapiens; identical to SEQ ID NO: 110075

SEQ ID NO: 440023 - RNA, 64 nt, Homo Sapiens; identical to SEQ ID NO: 110076

SEQ ID NO: 440024 - RNA, 64 nt, Homo Sapiens; identical to SEQ ID NO: 110077

SEQ ID NO: 440025 - RNA, 64 nt, Homo Sapiens; identical to SEQ ID NO: 110078

SEQ ID NO: 440026 - RNA, 64 nt, Homo Sapiens; identical to SEQ ID NO: 110079

SEQ ID NO: 440027 - RNA, 64 nt, Homo Sapiens; identical to SEQ ID NO: 110080

SEQ ID NO: 440028 - RNA, 64 nt, Homo Sapiens; identical to SEQ ID NO: 110081

SEQ ID NO: 440029 - RNA, 64 nt, Homo Sapiens; identical to SEQ ID NO: 110082

SEQ ID NO: 440030 - RNA, 64 nt, Homo Sapiens; identical to SEQ ID NO: 110083

SEQ ID NO: 440031 - RNA, 64 nt, Homo Sapiens; identical to SEQ ID NO: 110084

SEQ ID NO: 440032 - RNA, 64 nt, Homo Sapiens; identical to SEQ ID NO: 110085

SEQ ID NO: 440033 - RNA, 64 nt, Homo Sapiens; identical to SEQ ID NO: 110086

SEQ ID NO: 440034 - RNA, 64 nt, Homo Sapiens; identical to SEQ ID NO: 110087

SEQ ID NO: 440035 - RNA, 64 nt, Homo Sapiens; identical to SEQ ID NO: 110088

SEQ ID NO: 440036 - RNA, 64 nt, Homo Sapiens; identical to SEQ ID NO: 110089

SEQ ID NO: 440037 - RNA, 64 nt, Homo Sapiens; identical to SEQ ID NO: 110090

SEQ ID NO: 440038 - RNA, 64 nt, Homo Sapiens; identical to SEQ ID NO: 110091

SEQ ID NO: 440039 - RNA, 64 nt, Homo Sapiens; identical to SEQ ID NO: 110092

SEQ ID NO: 440040 - RNA, 64 nt, Homo Sapiens; identical to SEQ ID NO: 110093

SEQ ID NO: 440041 - RNA, 64 nt, Homo Sapiens; identical to SEQ ID NO: 110094

SEQ ID NO: 440042 - RNA, 64 nt, Homo Sapiens; identical to SEQ ID NO: 110095

SEQ ID NO: 440043 - RNA, 64 nt, Homo Sapiens; identical to SEQ ID NO: 110096

SEQ ID NO: 440044 - RNA, 64 nt, Homo Sapiens; identical to SEQ ID NO: 110097

SEQ ID NO: 440045 - RNA, 64 nt, Homo Sapiens; identical to SEQ ID NO: 110098

SEQ ID NO: 440046 - RNA, 64 nt, Homo Sapiens; identical to SEQ ID NO: 110099

SEQ ID NO: 440047 - RNA, 64 nt, Homo Sapiens; identical to SEQ ID NO: 110100

SEQ ID NO: 440048 - RNA, 64 nt, Homo Sapiens; identical to SEQ ID NO: 110101

SEQ ID NO: 440049 - RNA, 64 nt, Homo Sapiens; identical to SEQ ID NO: 110102

SEQ ID NO: 440050 - RNA, 64 nt, Homo Sapiens; identical to SEQ ID NO: 110103

SEQ ID NO: 440051 - RNA, 64 nt, Homo Sapiens; identical to SEQ ID NO: 110104

SEQ ID NO: 440052 - RNA, 64 nt, Homo Sapiens; identical to SEQ ID NO: 110105

SEQ ID NO: 440053 - RNA, 64 nt, Homo Sapiens; identical to SEQ ID NO: 110106

SEQ ID NO: 440054 - RNA, 64 nt, Homo Sapiens
ucuucuuuccuucugacagaccaggucaucuggcuuccgagaucaucagagaagauaagucugu

SEQ ID NO: 440055 - RNA, 64 nt, Homo Sapiens
gagacuuuucaugaaacugaauaaaagaaauccuuuccgagauagaggagauuuguaggugaau

SEQ ID NO: 440056 - RNA, 64 nt, Homo Sapiens
cucaggagaauagcuuuuacucugguaggaaugcuuccgagacaccacaaggcagccugaacac

SEQ ID NO: 440057 - RNA, 64 nt, Homo Sapiens
agcaguacgagaugcucaaguggagaucggccgcuuccgagaccagagaucgaagccguggagg

SEQ ID NO: 440058 - RNA, 64 nt, Homo Sapiens
uaacguuguguuuccuguuucugaaacauuuuauuuccgagacuggcauucuuuuaaaaccagg

SEQ ID NO: 440059 - RNA, 64 nt, Homo Sapiens
aggaccccuggggcccccaucggagcccugcaaauuccgagaaaugugaaacuuggugggguca

SEQ ID NO: 440060 - RNA, 64 nt, Homo Sapiens
cacagagaaguuggguuuaggacagcaggugcuguuccgagacucaguccuaaaggguuuuuuu

SEQ ID NO: 440061 - RNA, 64 nt, Homo Sapiens
ugucacauuacuaagauacgauauuucuuuuuuuuuccgagacggagucuugcucugccacugu

SEQ ID NO: 440062 - RNA, 64 nt, Homo Sapiens
aguaagaagcgugucugggucuggagaagggugcuuccgagagugugcagguggcccuuccccu

SEQ ID NO: 440063 - RNA, 64 nt, Homo Sapiens
uggaguuaugcugcguaugaaaggaugagucuucuuccgagaaauaaagcuuguuuguucuccc

SEQ ID NO: 440064 - RNA, 64 nt, Homo Sapiens
ggauuaugccuaguuugucauuucuacucaacaauuccgagauaaggaguauuaguacauaaau

SEQ ID NO: 440065 - RNA, 64 nt, Homo Sapiens
caucaugauggaaggugcagacuuuuuuggaaguuuccgagaggagggucuauagaccauuugu

SEQ ID NO: 440066 - RNA, 64 nt, Homo Sapiens
cuaguguuaauccagagaaccccccgcaaugugcuuccgagauucagacugcuucauugggaag

SEQ ID NO: 440067 - RNA, 64 nt, Homo Sapiens
acucccuccuuuagugaaggagccguguuagagcuuccgagaauagcuccacuggagagaagug

SEQ ID NO: 440068 - RNA, 64 nt, Homo Sapiens
guauacguccauauagauagaucaacguauacuuuuccgagacuauccauuucuuuguaucuau

SEQ ID NO: 440069 - RNA, 64 nt, Homo Sapiens
aggauguuuuugucugugaauaugcccagaaaacuuccgagaugcccccaggaauacuuuaagu

SEQ ID NO: 440070 - RNA, 64 nt, Homo Sapiens
gccaggagugggcucauccuagaggagcggaguuuuccgagaggaccaucuccugguuuccuga

SEQ ID NO: 440071 - RNA, 64 nt, Homo Sapiens
ucaugccucaggcaaaggcguggguccaucguucuuccgagaggguuuguguggcgacuacacc

SEQ ID NO: 440072 - RNA, 64 nt, Homo Sapiens
gaacugcuuucuguaauugcacuguggauaaauguuccgagagucuccauuguuguacaggauc

SEQ ID NO: 440073 - RNA, 64 nt, Homo Sapiens
cagacauagccaugcugguguggaaccuauucacuuccgagauuagagcugauaauuuguuagc

SEQ ID NO: 440074 - RNA, 64 nt, Homo Sapiens
agccuugccuucccuccucuuaaaucaggguguguuccgagauuacagaacaucacaccuuggc

SEQ ID NO: 440075 - RNA, 64 nt, Homo Sapiens
ugacaagcuuugaggaccucgcuucacucuguccuuccgagaccagaggcucacaccuacaaau

SEQ ID NO: 440076 - RNA, 64 nt, Homo Sapiens
gcuggcucugacaagaugguccauuuguuccugcuuccgagauccccagggcagccuggauccc

SEQ ID NO: 440077 - RNA, 64 nt, Homo Sapiens
cuuccuccucgggcagugcgccccgcaggcccucuuccgagagcgggaggcgccuggcuguauc

SEQ ID NO: 440078 - RNA, 64 nt, Homo Sapiens
gucucaugggucucugcgcccugcacuucguacuuuccgagaguuuaacuggugcuuagagaga

SEQ ID NO: 440079 - RNA, 64 nt, Homo Sapiens
aagcaaguuugagguuucauccuucaaaaggggguuccgagagagcaccguagggcuuuucuca

SEQ ID NO: 440080 - RNA, 64 nt, Homo Sapiens
guaucaaauaauugaaagaaaaguuuaaacacauuuccgagaggcagggcaacuaauaacuggu

SEQ ID NO: 440081 - RNA, 64 nt, Homo Sapiens
cuuuugguacaguguuuucaucucuuggucauaauuccgagauccccagagaccacuguuucug

SEQ ID NO: 440082 - RNA, 64 nt, Homo Sapiens
gugugguggcacugccagccagcacugugcaugauuccgagagggggugagaggugauagaggc

SEQ ID NO: 440083 - RNA, 64 nt, Homo Sapiens
agaugagaucaggcgcguuccgacccugcuuagcuuccgagaucauccaaguacuaaccaggcc

SEQ ID NO: 440084 - RNA, 64 nt, Homo Sapiens
ucucuucuugcacuguccccaaacuugcugucaauuccgagaucuaaucucccccuacgcucug

SEQ ID NO: 440085 - RNA, 64 nt, Homo Sapiens
caccuguaggggaccugucugacugggaagggaguuccgagagggagggggcaaucccuucccc

SEQ ID NO: 440086 - RNA, 64 nt, Homo Sapiens
uccacagugucccauuuuccgacuaggagacaucuuccgagaaacaggcgauaauuuuucagau

SEQ ID NO: 440087 - RNA, 64 nt, Homo Sapiens
uguauuuuaaaaaauagggcaauugauugggccauuccgagagaauuguuugcaaguuuugggu

SEQ ID NO: 440088 - RNA, 64 nt, Homo Sapiens
cugggggaggagaggaagaagcgcggcuaacuuauuccgagaaugccgaggaguugucguuuuu

SEQ ID NO: 440089 - RNA, 64 nt, Homo Sapiens
cuuuucugaucaguuugcgauauuuuuucuagucuuccgagaaagcaugauuaagacaauaaag

SEQ ID NO: 440090 - RNA, 64 nt, Homo Sapiens
cauagaaggaaaaacgaaggucaucugaucaaaguuccgagaggagaugggaugaugcucagac

SEQ ID NO: 440091 - RNA, 64 nt, Homo Sapiens
uggcccuugcacuagcagcuaggguuugguggacuuccgagauguuuuucacaccaggauacca

SEQ ID NO: 440092 - RNA, 64 nt, Homo Sapiens
acccaaucugccuuugaaucggaggagacaugaguuccgagaugauguguuguugcuguguccu

SEQ ID NO: 440093 - RNA, 64 nt, Homo Sapiens
ugguggcaguagcgaugcaagaaugaugggagcuuuccgagagcguucaguguuucacugaaga

SEQ ID NO: 440094 - RNA, 64 nt, Homo Sapiens
agcugcuggcgcacaggccucuucuccccggcacuuccgagauccaccagaucgacuugaucgu

SEQ ID NO: 440095 - RNA, 64 nt, Homo Sapiens
ucuugcagguaagccccaggccguguccaacaaauuccgagacccugccuuucugacuuggccg

SEQ ID NO: 440096 - RNA, 64 nt, Homo Sapiens
ucuucaagugggccaacacccaggugugcucggcuuccgagagucagcuucaccaggggcuuuu

SEQ ID NO: 440097 - RNA, 64 nt, Homo Sapiens
guucugcauauucauuugcacuggagacgccaguuuccgagauugggacaaagugugggugauc

SEQ ID NO: 440098 - RNA, 64 nt, Homo Sapiens
ucuggagggccccgugguucuggaaucccgaucguuccgagaggacggcggcaccggggcucug

SEQ ID NO: 440099 - RNA, 64 nt, Homo Sapiens
cacaugguucuagccuggacguuccccaggccucuuccgagaggcugaaguuacacugccagca

SEQ ID NO: 440100 - RNA, 64 nt, Homo Sapiens
accgcuacuggcgccucgacgcuccaucaucuucuuccgagaugcgcccugccgaggcccgaug

SEQ ID NO: 440101 - RNA, 64 nt, Homo Sapiens
aggggugggucucagacguuuccccucuccuccguuccgagaggaacuaaaggagccaucucuc

SEQ ID NO: 440102 - RNA, 64 nt, Homo Sapiens
agaguggccugaaccgaaagaguuugagcaguauuuccgagacgggcagaauacauugaucagc

SEQ ID NO: 440103 - RNA, 64 nt, Homo Sapiens
aacagauaaucccuguauuugaaggacauccauguuccgagaagaggccagaugcacaucccug

SEQ ID NO: 440104 - RNA, 64 nt, Homo Sapiens
aaguugaagaugacugaagauuauuauucgcccauuccgagagauaaaagcugaagagagcgua

SEQ ID NO: 440105 - RNA, 64 nt, Homo Sapiens
ggggucagggcaggaaggaacuucacucugcugcuuccgagaaccucggccgugacauucgggg

SEQ ID NO: 440106 - RNA, 64 nt, Homo Sapiens
cccccaggaugaagucgucuucuucggugaccacuuccgagacccaacccugcacgcccagcuc

SEQ ID NO: 440107 - RNA, 64 nt, Homo Sapiens
agccccagacccgaaaaaaguguucugcccaagauuccgagagcccugcgcucuagggcagggg

SEQ ID NO: 440108 - RNA, 64 nt, Homo Sapiens
agucacagcagcaagacacgcacagucaaccauuuuccgagaaaaaaagaaaauuccccacuug

SEQ ID NO: 440109 - RNA, 64 nt, Homo Sapiens
cgcccuuggcuucccacccuccucuccaguccuuuuccgagaugaggugagacaaggguccaac

SEQ ID NO: 440110 - RNA, 64 nt, Homo Sapiens
uucuugcccuuucuuuuuuuuuuuuuuuuuuuuuuuccgagauggagucucucucugucaccca

SEQ ID NO: 440111 - RNA, 64 nt, Homo Sapiens
caguauccucuccggaucugucgauuuggagaccuuccgagagagaaccaagggugcagucagc

SEQ ID NO: 440112 - RNA, 64 nt, Homo Sapiens
aguuuguggagaguacagacugcguuggcugggcuuccgagagcuucggccugccuaagucuga

SEQ ID NO: 440113 - RNA, 64 nt, Homo Sapiens; identical to SEQ ID NO: 97841

SEQ ID NO: 440114 - RNA, 64 nt, Homo Sapiens; identical to SEQ ID NO: 97842

SEQ ID NO: 440115 - RNA, 64 nt, Homo Sapiens; identical to SEQ ID NO: 97843

SEQ ID NO: 440116 - RNA, 64 nt, Homo Sapiens; identical to SEQ ID NO: 97844

SEQ ID NO: 440117 - RNA, 64 nt, Homo Sapiens; identical to SEQ ID NO: 97845

SEQ ID NO: 440118 - RNA, 64 nt, Homo Sapiens; identical to SEQ ID NO: 97846

SEQ ID NO: 440119 - RNA, 64 nt, Homo Sapiens; identical to SEQ ID NO: 97847

SEQ ID NO: 440120 - RNA, 64 nt, Homo Sapiens; identical to SEQ ID NO: 97848

SEQ ID NO: 440121 - RNA, 64 nt, Homo Sapiens
gaaauaugaucagagcuugaacacaggcuuauuuuuaaaauaaaaauauuuuuaacauggguuu

SEQ ID NO: 440122 - RNA, 64 nt, Homo Sapiens
aaauaaugcuuugagaagaauguuuaauagaaaauuaaaauaacuuuuucuggccucucuuguu

SEQ ID NO: 440123 - RNA, 64 nt, Homo Sapiens
uuuuucagccaucaguucaagagccaaugccuuuuuaaaauaaagcuucuguggucuuguuuuu

SEQ ID NO: 440124 - RNA, 64 nt, Homo Sapiens
ucccauuccuugucugccauucugaauaugcuuauuaaaauauuuuuuuaaacauauuugccua

SEQ ID NO: 440125 - RNA, 64 nt, Homo Sapiens
guggcucauuuauaccuaauaaaauaaugguauuuuaaaauaaugcuacuuucaaaguagcauu

SEQ ID NO: 440126 - RNA, 64 nt, Homo Sapiens
gaaggcauguuaaacauuauuuccucuaugguaguuaaaauacagaauuagauuuuuaacaggu

SEQ ID NO: 440127 - RNA, 64 nt, Homo Sapiens
caccagagacuugaagaacuugcaaacuggcguuuuaaaauaaccgguuaauuuauuuccacac

SEQ ID NO: 440128 - RNA, 64 nt, Homo Sapiens
agaagaauaaguccuucuguuuucucuuuaacauuuaaaauaucucaaugcacaugauauaauu

SEQ ID NO: 440129 - RNA, 64 nt, Homo Sapiens
uauguaaaauaaaauuaugccauagcaagauugcuuaaaauagcaacacucuauauuuagauug

SEQ ID NO: 440130 - RNA, 64 nt, Homo Sapiens
uugcuuaaaauagcaacacucuauauuuagauuguuaaaauaacuaguguugcuuggacuauua

SEQ ID NO: 440131 - RNA, 64 nt, Homo Sapiens
caaccugaaggaauaaaaugauuuguggaaaugcuuaaaauagaccuaacugaauacagucuca

SEQ ID NO: 440132 - RNA, 64 nt, Homo Sapiens
aaucuaguggguugaccuuuaaaugcaacaguuuuuaaaauauauugcugcauuuuauagaaua

SEQ ID NO: 440133 - RNA, 64 nt, Homo Sapiens
uuaucuuuaguuacuugaagaguuucuaguuuuuuuaaaauacaguuuauguuaaaauaauuuu

SEQ ID NO: 440134 - RNA, 64 nt, Homo Sapiens
aagaguuucuaguuuuuuuaaaauacaguuuauguuaaaauaauuuuuauuaauuuagagaaga

SEQ ID NO: 440135 - RNA, 64 nt, Homo Sapiens
uauuuaguucaguggugcuucugguuugggugcuuuaaaauagaugguuuccagagggucugga

SEQ ID NO: 440136 - RNA, 64 nt, Homo Sapiens
ugcucauaguugauuuaccacccuuaauguugaauuaaaauacuuuuccaaaguccuuuuuuuu

SEQ ID NO: 440137 - RNA, 64 nt, Homo Sapiens
gcacuuaccugaagucagugcuuauaucuguauguuaaaauagauacaucaaaucaaauagaau

SEQ ID NO: 440138 - RNA, 64 nt, Homo Sapiens
cuuuacugauuuaauacagaaguuguccuuucucuuaaaauaccucugaagucucuauuuucca

SEQ ID NO: 440139 - RNA, 64 nt, Homo Sapiens
aacacuacccacugaaaucacaccuaucagauguuuaaaauaacuuuuuuaaucaagggagaua

SEQ ID NO: 440140 - RNA, 64 nt, Homo Sapiens
uguauauuuuaucagauuugauauguauguguuuuuaaaauaugcacuuuugaucuauuuauau

SEQ ID NO: 440141 - RNA, 64 nt, Homo Sapiens
gaguauuuugguagaguauaaaaguuaaaaacaguuaaaauaagucuuugcuucguauguaaau

SEQ ID NO: 440142 - RNA, 64 nt, Homo Sapiens
ucuacauaugagaauguuuaacuuaauacaccaauuaaaauauuaaauuugaucaguuagcaaa

SEQ ID NO: 440143 - RNA, 64 nt, Homo Sapiens
gguaucucuuugcauauauagguagcucucuuuuuuaaaauauagaugggaugcaugacauaca

SEQ ID NO: 440144 - RNA, 64 nt, Homo Sapiens
uuggacaguuuuuaugugacuaaauuugauauacuuaaaauaauuuugcuagugaugaaucaaa

SEQ ID NO: 440145 - RNA, 64 nt, Homo Sapiens
cugucuucauuuuaacauguaaacuagagugcauuuaaaauacuuaauuugaagauggaacagg

SEQ ID NO: 440146 - RNA, 64 nt, Homo Sapiens
acccuuuucagcccucccaucauuuaaccagaaauuaaaauaucugcuucacacacaguucaac

SEQ ID NO: 440147 - RNA, 64 nt, Homo Sapiens
caauaacaaagaagaaaaccaaaagggucuaccuuuaaaauaagcauguaaaaucuauaucagc

SEQ ID NO: 440148 - RNA, 64 nt, Homo Sapiens
aauauuuuguugagauauucacugcaguguuaucuuaaaauaaguuuauuaaggugguggagcc

SEQ ID NO: 440149 - RNA, 64 nt, Homo Sapiens
uuauaagugauguuccuuuuacuacaauugcuuguuaaaauauuguaaaaucaguagaaauuuu

SEQ ID NO: 440150 - RNA, 64 nt, Homo Sapiens
uaauaaaauuauuucuaauguacauugaacugcuuuaaaauaaauguaccauuuugcuaccagu

SEQ ID NO: 440151 - RNA, 64 nt, Homo Sapiens
uauacuugcacaugaaaauagaaauguugccuuuuuaaaauaaugcuuauaaaagacuuuuaau

SEQ ID NO: 440152 - RNA, 64 nt, Homo Sapiens
uauuuuugacuaugaacauuuuguuucauaaauuuuaaaauaauuuccuauauaacuaaaaauu

SEQ ID NO: 440153 - RNA, 64 nt, Homo Sapiens
aaaauuuaaaucugacauuuuuugaaaagcuaaauuaaaauacaaaggaccucaauggaauaaa

SEQ ID NO: 440154 - RNA, 64 nt, Homo Sapiens
uguuacaguuuaucugguacuugauacuucuaaguuaaaauauaagaaucaaaaaauuccuguu

SEQ ID NO: 440155 - RNA, 64 nt, Homo Sapiens
augcauucucccagaagcccaaacacauuuggccuuaaaauagcgggaaggggagaagaaagaa

SEQ ID NO: 440156 - RNA, 64 nt, Homo Sapiens
ccaaaagccugauguucacaugagaauuucacauuuaaaauaaguggaaaagcacuuuuaauuu

SEQ ID NO: 440157 - RNA, 64 nt, Homo Sapiens
aagcuacauccaaagaaauguuagauaauguguuuuaaaauauagaauuauuguggggauuaag

SEQ ID NO: 440158 - RNA, 64 nt, Homo Sapiens
uuccaauaaguaacuuagaccccugcccuggcacuuaaaauagcuucagaaaauuucugcagag

SEQ ID NO: 440159 - RNA, 64 nt, Homo Sapiens
uuauuguauuaacagcugagguagcuaaaguuauuuaaaauaaaauuaaauuuaugauccaagu

SEQ ID NO: 440160 - RNA, 64 nt, Homo Sapiens
agaugcuaacauccucccccaucccaacugcaccuuaaaauaugcaugucaccuucaagguuuu

SEQ ID NO: 440161 - RNA, 64 nt, Homo Sapiens
gaacauuuguuuguuugucuucugauguuuuuucuuaaaauaguaauuucuccuacuuuucuuu

SEQ ID NO: 440162 - RNA, 64 nt, Homo Sapiens
uuaggaaagauuucuuagguuuugaaagaauacauuaaaauaaaaaacuugccccuacuaggua

SEQ ID NO: 440163 - RNA, 64 nt, Homo Sapiens
uaaaucauauuugauuaacauuucauuuaagcuuuuaaaauaucaauuuuuuaaauagcuccca

SEQ ID NO: 440164 - RNA, 64 nt, Homo Sapiens
cccaugggcauuaaggcaaaguaguuccagugauuuaaaauacgguuccaaauacgcuaaaacc

SEQ ID NO: 440165 - RNA, 64 nt, Homo Sapiens
augaaguaaauaugcugcaguuaauuaugcuaaguuaaaauacaguuuaguuauuugcuuuaaa

SEQ ID NO: 440166 - RNA, 64 nt, Homo Sapiens
uaugcuaaguuaaaauacaguuuaguuauuugcuuuaaaauaaacucuucuuuuuuucuuuaaa

SEQ ID NO: 440167 - RNA, 64 nt, Homo Sapiens
gaauuaucauaacuuauggcaucaggaggaaacuuuaaaauaucaaggaaucacucagucaccc

SEQ ID NO: 440168 - RNA, 64 nt, Homo Sapiens
ggaaucgugucuuccaugcuccacuggguucaauuuaaaauaggagaggcuuucucuucugaaa

SEQ ID NO: 440169 - RNA, 64 nt, Homo Sapiens
aucccuuugggccuguacaaagaaauucuggauguuaaaauaauauauacucaucacagaaaaa

SEQ ID NO: 440170 - RNA, 64 nt, Homo Sapiens
cccugauaggggaagugggaguugacaggaugguuuaaaauaagacgugaagguuucaguuacc

SEQ ID NO: 440171 - RNA, 64 nt, Homo Sapiens
uuggugguagcuucuagucccagaaucuguguuuuuaaaauacuacaugacauucugucuauuc

SEQ ID NO: 440172 - RNA, 64 nt, Homo Sapiens
uauuuuaacacacuauuuugcuuuuguauuuuaguuaaaauaaucgauggggauguguagcccc

SEQ ID NO: 440173 - RNA, 64 nt, Homo Sapiens
aauuuguuuuaacguuaaauuguaguuugcuguauuaaaauagaucaaugaauauaauucaguc

SEQ ID NO: 440174 - RNA, 64 nt, Homo Sapiens
uaauaauuuuuaaauuuuuuucuaauuuuaugccuuaaaauagguuucugauuacauaaaauuu

SEQ ID NO: 440175 - RNA, 64 nt, Homo Sapiens
uagauuccaauaaauaucuauuuauuauuaaauauuaaaauaucuauuuauuauuaaaaccauu

SEQ ID NO: 440176 - RNA, 64 nt, Homo Sapiens
gagcauaagauaugagauacaugaaccugaacuauuaaaauaaaauauuauauuuaacccuuag

SEQ ID NO: 440177 - RNA, 64 nt, Homo Sapiens
ugcugaucuacugauuuuuucucuaucucaguaauuaaaauaagcuugcuucugucaaguguga

SEQ ID NO: 440178 - RNA, 64 nt, Homo Sapiens
caccgguggugugaugaugcucucaguuuuaggauuaaaauaccaaauguuuaaguaaacucug

SEQ ID NO: 440179 - RNA, 64 nt, Homo Sapiens
cucuucuuuuuuucuuuaaauuuaguuauuugcuuuaaaauaaaugugcuaaguuaaaauacag

SEQ ID NO: 440180 - RNA, 64 nt, Homo Sapiens
guuuaguuauuugcuuuaaauuaauugugcuaaguuaaaauacaaugaaguaaauaugcugcag

SEQ ID NO: 440181 - RNA, 64 nt, Homo Sapiens
auguuguggaaaagguagcaacuugaaguuuuauuuaaaauaaauuuuguaccuacguaagagu

SEQ ID NO: 440182 - RNA, 64 nt, Homo Sapiens
aaacaaagccaaguuaaacuauacaaggaauguuuuaaaauauaaauugcuuuaaaucuugaaa

SEQ ID NO: 440183 - RNA, 64 nt, Homo Sapiens
ucaaaucgcacugaauacucuagugcaauagcaauuaaaauauauuucaaaggaaaggguguua

SEQ ID NO: 440184 - RNA, 64 nt, Homo Sapiens
uuccuucucuguccucugaauauauuaaagcaaauuaaaauauugugaucuacugaaaagaggu

SEQ ID NO: 440185 - RNA, 64 nt, Homo Sapiens
guugcaauuaaaaugugauugucuggcuuugcccuuaaaauaggugggcauuuaaccauuuacu

SEQ ID NO: 440186 - RNA, 64 nt, Homo Sapiens
aauccauucaggugacaaccaauggugaaguaauuuaaaauauagacagaggcauuuucaccuu

SEQ ID NO: 440187 - RNA, 64 nt, Homo Sapiens
uauauacguaacccaagcccaagggaaaguggauuuaaaauauaacacagggggccuggaaaga

SEQ ID NO: 440188 - RNA, 64 nt, Homo Sapiens
gaucagcccucaaagaauggggucugugggcuaguuaaaauagaaauaaacuuuuaaaauaucc

SEQ ID NO: 440189 - RNA, 64 nt, Homo Sapiens
gggucugugggcuaguuaaaauagaaauaaacuuuuaaaauauccacagaauugauauugugau

SEQ ID NO: 440190 - RNA, 64 nt, Homo Sapiens
uuugcauaaucaaggcacuguaaaucuuauaauuuuaaaauaaauuacuuaagaacaguuguca

SEQ ID NO: 440191 - RNA, 64 nt, Homo Sapiens
guaauaauucuugcauuuuuuccccauaaccugguuaaaauaaauacgccauuggcaauacuuc

SEQ ID NO: 440192 - RNA, 64 nt, Homo Sapiens
cuccuuuacccagcauaaacucuaugguuaauucuuaaaauaaugccuuacagucuccauuaac

SEQ ID NO: 440193 - RNA, 64 nt, Homo Sapiens
gcucauuucauuuuucugugucuuacacagaaacuuaaaauauuucaaacuuuucauuauaugu

SEQ ID NO: 440194 - RNA, 64 nt, Homo Sapiens
gguaaaugagaucaucuguuaccuguacgcuguauuaaaauagaaccaggaaaggcucaggauu

SEQ ID NO: 440195 - RNA, 64 nt, Homo Sapiens
ccaauuaugaggacugacauccuggccacucuccuuaaaauaaacacugacauuuuucuugcuu

SEQ ID NO: 440196 - RNA, 64 nt, Homo Sapiens
uguccuaacugaaagaugaucauuuguaguugccuuaaaauaaugaauacauuuccaaaauggu

SEQ ID NO: 440197 - RNA, 64 nt, Homo Sapiens
gaauacaguuuugaguagaguugaucaaaaucaauuaaaauagucucuuuaaaaggaaagaaaa

SEQ ID NO: 440198 - RNA, 64 nt, Homo Sapiens
caagugaucaaacuacauauuguaaagcccauuuuuaaaauacauuguauauauguguaugcac

SEQ ID NO: 440199 - RNA, 64 nt, Homo Sapiens
guguuaguuuuauuuuuguacugcaauuuuuaguuuaaaauauguuggaugcacucgucaaaua

SEQ ID NO: 440200 - RNA, 64 nt, Homo Sapiens
gauaacaggaaaauaaguuuugauugcauuguuuuuaaaauaagcuaguuuucugagguguuuu

SEQ ID NO: 440201 - RNA, 64 nt, Homo Sapiens
gagccaccgcgccuggccagggacuauacucuuuuuaaaauagacauuuguggggcucacacaa

SEQ ID NO: 440202 - RNA, 64 nt, Homo Sapiens
aaaaaaucauuuuauccgucuuuuaaguauauguuuaaaauaauaauuuaugugucugcauauu

SEQ ID NO: 440203 - RNA, 64 nt, Homo Sapiens
ugugaaugaaaugauacgaugucucagauuugcuuuaaaauaauagggagguuggggaaguggg

SEQ ID NO: 440204 - RNA, 64 nt, Homo Sapiens
ugauaugaacugugauaaugcagaagguuuccuuuuaaaauaaaguucagucaaaaaagugaga

SEQ ID NO: 440205 - RNA, 64 nt, Homo Sapiens
gauuuguguuuuacaguauaucuuaagauaauauuuaaaauaguuccagauaaaaacaauauau

SEQ ID NO: 440206 - RNA, 64 nt, Homo Sapiens
guccuguuaugucauuguguuugugugcuguuguuuaaaauaaaaguaccuauugaacauguga

SEQ ID NO: 440207 - RNA, 64 nt, Homo Sapiens
ugauuauacuuuccuaaagagaaugcuauggucauuaaaauaaugcagcagcauuugaguccau

SEQ ID NO: 440208 - RNA, 64 nt, Homo Sapiens
cagaaaugggagaaaauuaagaugaaagauggguuuaaaauauaucccuauuuuguuuaguagu

SEQ ID NO: 440209 - RNA, 64 nt, Homo Sapiens
auccauuauucuuaauauggauuuccuauuucucuuaaaauaaauuucucuuaaaauaaaaucc

SEQ ID NO: 440210 - RNA, 64 nt, Homo Sapiens
auccauuuccuauuucucuuguuuccuguuucucuuaaaauaaaugugauuaugcuuaacagcu

SEQ ID NO: 440211 - RNA, 64 nt, Homo Sapiens
guucaaauugcaaaauuuggaggacauucaaaguuuaaaauaguaaguaaguuuaaagacuuua

SEQ ID NO: 440212 - RNA, 64 nt, Homo Sapiens
uauuuugauaugaugcuuaaccugugauuuuauuuuaaaauauuuuacauuuaauagcuuguua

SEQ ID NO: 440213 - RNA, 64 nt, Homo Sapiens
uacauuaaaaaaaaaauuauagcagugaauauaguuaaaauacgguuguuacugguccuguugu

SEQ ID NO: 440214 - RNA, 64 nt, Homo Sapiens
uggcauaagagcuuaaaaacugaugucugggcaauuaaaauaaaacuaagaauuuagguggaau

SEQ ID NO: 440215 - RNA, 64 nt, Homo Sapiens
uauuuuuuuuaaaguauuuuuguaagcuauacuuuuaaaauauucuaaaauacuacauugucac

SEQ ID NO: 440216 - RNA, 64 nt, Homo Sapiens
auuucugggcaaauucaaacaacauauagaguguuuaaaauagcccacaaaaaaacagcagacc

SEQ ID NO: 440217 - RNA, 64 nt, Homo Sapiens
uguaaagaaaauagugaaucuugaggaauauuuauuaaaauaccauuggaacagucuucuagaa

SEQ ID NO: 440218 - RNA, 64 nt, Homo Sapiens
ggaguaacaaauuacagaauguuacuucuauuuuuuaaaauaauguagucugauuuagagacua

SEQ ID NO: 440219 - RNA, 64 nt, Homo Sapiens
guuauccuguaacauaaauucaagcccaugcccauuaaaauaaauacauaccuuuguguauaga

SEQ ID NO: 440220 - RNA, 64 nt, Homo Sapiens
aaaaaauuuuaaacugguuuaaaauuucaaacaauuaaaauaagagagcuucuuuggcucuaga

SEQ ID NO: 440221 - RNA, 63 nt, Homo Sapiens
aguuuaaaugcuguucuugaaaaaauaaaauguauuaaaauauaugguuugguucacuuuaug

SEQ ID NO: 440222 - RNA, 64 nt, Homo Sapiens
uguuauuuuaaauauacaaaaaaauuuccuugauuuaaaauauuucaacauauauacuuuuugc

SEQ ID NO: 440223 - RNA, 64 nt, Homo Sapiens
ucaauaaagauagcauguuauuugcaauaaauguuuaaaauauuaauaaaaagcauuuauuguu

SEQ ID NO: 440224 - RNA, 64 nt, Homo Sapiens
aaacauguagauccuuugacaugaauacaauguauuaaaauauaacucagaaaaaaauguuuug

SEQ ID NO: 440225 - RNA, 64 nt, Homo Sapiens
auugcgaauaucagaaaacuugaguaguugucauuuaaaauauaaguuuaaaaguuuagcuuau

SEQ ID NO: 440226 - RNA, 64 nt, Homo Sapiens
caaacaaaacuaaaacaaaaaguaagaacuauuuuuaaaauauuaauacguuucauagaaaaua

SEQ ID NO: 440227 - RNA, 64 nt, Homo Sapiens
aucacaguaucaguggacuaaauuaaaccuugcauuaaaauaauaaaucuguaauaaaaaacua

SEQ ID NO: 440228 - RNA, 64 nt, Homo Sapiens
auguguaaauugaaauuuuuuagaauguacuauuuuaaaauaauuaucuaugucucauaaaaau

SEQ ID NO: 440229 - RNA, 64 nt, Homo Sapiens
cacagaaaaucauuggucucgucaauaugagauauuaaaauaagaauuaaaauaagaauugaau

SEQ ID NO: 440230 - RNA, 64 nt, Homo Sapiens
aauugaaugucaauaugagaauuauguuuccuaauuaaaauaaguguacaccauaguuuacaau

SEQ ID NO: 440231 - RNA, 64 nt, Homo Sapiens
ucuaaaauagguaaauguauugauacuagcauacuuaaaauaucaaauacuauucucauuaugu

SEQ ID NO: 440232 - RNA, 64 nt, Homo Sapiens
cagugcuaaacauggcuuaaaaaaaacccauguguuaaaauacuuacaaaacaaacaaacaaac

SEQ ID NO: 440233 - RNA, 64 nt, Homo Sapiens
caguaaaguuagauuuuaucuugcuaaguauauuuuaaaauaaugugauguuucuagucugagu

SEQ ID NO: 440234 - RNA, 64 nt, Homo Sapiens
uuccugcacuggcuaaaaccuuuauuuuucuguuuuaaaauaucaaccuuacacccauuauuga

SEQ ID NO: 440235 - RNA, 64 nt, Homo Sapiens
uuucuacaaugaacauguuuuauuuuuacuuuuguuaaaauaaauaacauuuaauuugacggaa

SEQ ID NO: 440236 - RNA, 64 nt, Homo Sapiens
acaaaagaaacaagagagaaaaaaaucaaaauaauuaaaauaaauuguuagagaaaaguuacuu

SEQ ID NO: 440237 - RNA, 64 nt, Homo Sapiens
aaacugauuucuucagaauuagauggcuuauuuuuuaaaauauuugaaugaaaacauuuuauuu

SEQ ID NO: 440238 - RNA, 64 nt, Homo Sapiens
uuuuuuaaaauauuugaaugaaaacauuuuauuuuuaaaauauuacacaggaggcuucggaguu

SEQ ID NO: 440239 - RNA, 64 nt, Homo Sapiens
gcacccagccgaguugcuuucuuacuaaauccuauuaaaauaugcaaaaauaagucagauuuua

SEQ ID NO: 440240 - RNA, 64 nt, Homo Sapiens
aggacuuauuuuuuaacuguaauauuuauuaguuuuaaaauauuuguaucucauuuguaacaau

SEQ ID NO: 440241 - RNA, 64 nt, Homo Sapiens
auaccaguugaaugggguuaaagcuuucaauaucuuaaaauauuuauaaaacauuucacuguug

SEQ ID NO: 440242 - RNA, 64 nt, Homo Sapiens
auuuuaacuaugaccuuuaauugaaaauaaauaauuaaaauaucagacauguuuuggaaaaguc

SEQ ID NO: 440243 - RNA, 64 nt, Homo Sapiens
cuuguggcuuuuauuaucuuuaaacuuguugcauuuaaaauauuuuuaaaaccuucuuaacaaa

SEQ ID NO: 440244 - RNA, 64 nt, Homo Sapiens
uggcagucucaauccuacugucauucuuuuuauuuuaaaauaaauaaauaagccuaucuuuuug

SEQ ID NO: 440245 - RNA, 64 nt, Homo Sapiens
uaaaagugcuugauauaaauagcaugacuguauuuuaaaauacugacucuuucaaguguaucug

SEQ ID NO: 440246 - RNA, 64 nt, Homo Sapiens
cacauauuuuuacuuaaauucaaaauccaguagguuaaaauacuuacgugaaacugauuaguug

SEQ ID NO: 440247 - RNA, 64 nt, Homo Sapiens
uaaaaaaauuuucaguuucuaaaguacacauuauuuaaaauauuagagaugaccuauauaaauc

SEQ ID NO: 440248 - RNA, 64 nt, Homo Sapiens
uucuguagauuauuugaaaaacugaaauuuacaauuaaaauauucagacauuguauguuaucau

SEQ ID NO: 440249 - RNA, 64 nt, Homo Sapiens
ucuagaacuccaucuauuuuauguuuuuaggcaguuaaaauacugugguagucaugaagagaua

SEQ ID NO: 440250 - RNA, 64 nt, Homo Sapiens
uucagccuaaggcacaaggauaauguacuaauauuuaaaauaccaucacuuucucuuugcauaa

SEQ ID NO: 440251 - RNA, 64 nt, Homo Sapiens
ggcaaaauaagauuuaguugguuuggucgaaaaauuaaaauaguauuuugguagaaagguauga

SEQ ID NO: 440252 - RNA, 64 nt, Homo Sapiens
caauaauuaaggcacaguugguaaaaaauguaauuuaaaauaaggucagguacuacauagcucu

SEQ ID NO: 440253 - RNA, 64 nt, Homo Sapiens
gaaugagacuaagaagggaaacuauauugacuacuuaaaauagauguucggagaguguuuuugu

SEQ ID NO: 440254 - RNA, 64 nt, Homo Sapiens
uugucuaacaguagaacuguuauaagugccauauuuaaaauaauaauaugaaauauuacauaua

SEQ ID NO: 440255 - RNA, 64 nt, Homo Sapiens
aaauauaaccuuuuaagcuauauguuuuuauacuuuaaaauaagauagguuuagccuuuaagug

SEQ ID NO: 440256 - RNA, 64 nt, Homo Sapiens
caauucagugguuuuaacauauauaaucacacauuuaaaauacaugagauacaauucacauacc

SEQ ID NO: 440257 - RNA, 64 nt, Homo Sapiens
uaauugaugucaauauuaguaguccacuuuaugcuuaaaauaaaaucauaaaaaaucaaguuuu

SEQ ID NO: 440258 - RNA, 64 nt, Homo Sapiens
aaucauaaaaaaucaaguuuuaagguuauauuuuuuaaaauaaugaauuuucuaucucuaggca

SEQ ID NO: 440259 - RNA, 64 nt, Homo Sapiens
cauuaguucuucuuuuccuaaaacuuuuuacuuguuaaaauagucugcugcauguaauaugugc

SEQ ID NO: 440260 - RNA, 64 nt, Homo Sapiens
uuagauccugcuaaauuucaauuaagaggggaccuuaaaauaaggaucaaucucuuauuuaacc

SEQ ID NO: 440261 - RNA, 64 nt, Homo Sapiens
guagucacugugacucgggcauguuucccugaaguuaaaauaguuuuuagaacuuuuuguuuaa

SEQ ID NO: 440262 - RNA, 64 nt, Homo Sapiens
acaguuaucuuacugaaaaugcaugcauggugaauuaaaauaaaagggggaacaaugcacaaau

SEQ ID NO: 440263 - RNA, 64 nt, Homo Sapiens
auuguuaauaauauaacauauaagaauacuuuuauuaaaauaaccaugcaacaauaacacuauc

SEQ ID NO: 440264 - RNA, 64 nt, Homo Sapiens
guuauguguugaacaguaugcuucagggguaaauuuaaaauagucucuugaagcccuagucaug

SEQ ID NO: 440265 - RNA, 64 nt, Homo Sapiens
aaaaaaaauuaaaugcauaagcauaagguagaaauuaaaauaacaaaauugucuacagcuucuu

SEQ ID NO: 440266 - RNA, 64 nt, Homo Sapiens
uucacugaaauaaacuccauauaucauaucuaauuuaaaauaauggggcauaugggagcuuaau

SEQ ID NO: 440267 - RNA, 64 nt, Homo Sapiens
ugauuucucacugagaggaauaaaaauuuugccauuaaaauaaauaacagauuuuacugauaug

SEQ ID NO: 440268 - RNA, 64 nt, Homo Sapiens
cccacgauauucuguacacacacuaauuuuagucuuaaaauauuuauauauucagauacucuag

SEQ ID NO: 440269 - RNA, 64 nt, Homo Sapiens
aaguggccaaaugauaaaaauagacuuugaccacuuaaaauacuauauucuuuggcauacuuug

SEQ ID NO: 440270 - RNA, 64 nt, Homo Sapiens
agauaaaaauuuuaaaaacaagagaaaauaauuuuuaaaauaauuucaaguguuugauuaaaau

SEQ ID NO: 440271 - RNA, 64 nt, Homo Sapiens
gaaaauaauuuuuaaaauaacuucaaguguuugauuaaaauagauagguaucuuuuucuaaaaa

SEQ ID NO: 440272 - RNA, 64 nt, Homo Sapiens
cauuauuuaauuuaaucuuacccaugcuguacauuuaaaauaugaguauaucauuuauugagug

SEQ ID NO: 440273 - RNA, 64 nt, Homo Sapiens
uuagaacuuaaugcagacauaaagguucuuggguuuaaaauacauuaguguauuauuuaaagau

SEQ ID NO: 440274 - RNA, 64 nt, Homo Sapiens
auuuuaacaaaaguuacauucaacacauuuuauuuuaaaauauuuuaaagguaacaguaauuuu

SEQ ID NO: 440275 - RNA, 64 nt, Homo Sapiens
uucuuuuucuuuuguuuaugauguuuuucucaauuuaaaauaauaguaguccaaauuaaagaaa

SEQ ID NO: 440276 - RNA, 64 nt, Homo Sapiens
auauuaaauucugaaugcaaggcuaaaauuaguuuuaaaauacuauugcucauaaugacuuaca

SEQ ID NO: 440277 - RNA, 64 nt, Homo Sapiens
auuauauaccccacaggcugcaggaaauauaaacuuaaaauaaaagauguauguugcuauccug

SEQ ID NO: 440278 - RNA, 64 nt, Homo Sapiens
cagaaacuacuuuuaugcauuuauuuuuuugagguuaaaauauugugguuuuuauuuaaaguac

SEQ ID NO: 440279 - RNA, 64 nt, Homo Sapiens
uuuuaauuugaggaauuacaugacuguguacccuuuaaaauaucaaugauaacuaagaucacaa

SEQ ID NO: 440280 - RNA, 64 nt, Homo Sapiens
uuuuuuccauuuggcauacaauauuuuuaucauuuuaaaauauuuuagucauuucuguuucuaa

SEQ ID NO: 440281 - RNA, 64 nt, Homo Sapiens
uucugggucaguugguaugaaaaauaaacauuucuuaaaauauauuuaaaacaaauaugcacag

SEQ ID NO: 440282 - RNA, 64 nt, Homo Sapiens
auuuauuaucgaggaguuuuaaaguacuguaacuuuaaaauaaauaacuacaaagcuucuuugu

SEQ ID NO: 440283 - RNA, 64 nt, Homo Sapiens
ucaugcugagauaucaauugguuuccccuucuuuuuaaaauacguccaguucuuacccaguuaa

SEQ ID NO: 440284 - RNA, 64 nt, Homo Sapiens
aaaacaaucuaaauauugaagaggaauggccuaauuaaaauaugauguagucauaggauagauu

SEQ ID NO: 440285 - RNA, 64 nt, Homo Sapiens
uuuuaaaaaauaaggucuuaauguuucauuuaauuuaaaauauacugucauguuguguuuugua

SEQ ID NO: 440286 - RNA, 64 nt, Homo Sapiens
cuccuuuugcugucuuucucuaaauaugauuacuuuaaaauaaaaaaguaacaaggugucuuuu

SEQ ID NO: 440287 - RNA, 64 nt, Homo Sapiens
uuaugccguauaggaugucagacaauaccacugguuaaaauaaagccuauuuuucaaauuuagu

SEQ ID NO: 440288 - RNA, 64 nt, Homo Sapiens
ugcuugcacuauaggagucauaaaaggaacuuaguuaaaauauguuggauuguuaaacauuugg

SEQ ID NO: 440289 - RNA, 64 nt, Homo Sapiens
cagcuuauuuaaaaccaaauauaguugaacauauuuaaaauacauuuucacagaauggaugaau

SEQ ID NO: 440290 - RNA, 64 nt, Homo Sapiens
uuagauauauuuugugaacccuugauuagacauauuaaaauauaccaauguuguaguaaaauuu

SEQ ID NO: 440291 - RNA, 64 nt, Homo Sapiens
aacuagcugccuuuagauuuugauaaucacagucuuaaaauacuaggaaagaaguggaugggaa

SEQ ID NO: 440292 - RNA, 64 nt, Homo Sapiens
uuuuaaugccaacaaaauugguuguaaucaaauuuuaaaauaauaauaauuuggcccccccuuu

SEQ ID NO: 440293 - RNA, 64 nt, Homo Sapiens
aaauuuuaaaauaauaauaauuuggcccccccuuuuaaaauagucuugacucuuugugugugac

SEQ ID NO: 440294 - RNA, 64 nt, Homo Sapiens
cuuaaagauaauguacaugcuucaugucaugucuuuaaaauaauuuaaucaacuuuauugucuu

SEQ ID NO: 440295 - RNA, 64 nt, Homo Sapiens
uuuguaaauguuagacuuuuaucauaccuguaaguuaaaauacuuguuaucaauaacuugucau

SEQ ID NO: 440296 - RNA, 64 nt, Homo Sapiens
agauguuaaacuuugaauuuaauauaccagauuauuaaaauauuguccauuaacuaguucauag

SEQ ID NO: 440297 - RNA, 64 nt, Homo Sapiens
ucucauuugucuaauugcaauuaaaagaaaaauguuaaaauauuaaaaugaaaauaaaagcauu

SEQ ID NO: 440298 - RNA, 64 nt, Homo Sapiens
guggggauggauuaugaugaaaucauuuucaaucuuaaaauauaauacaacaaucuugcaaaau

SEQ ID NO: 440299 - RNA, 64 nt, Homo Sapiens
agaaagacacugaaauuuagaaaauuuugucgauuuaaaauauuucuccuaucuaccaaguaaa

SEQ ID NO: 440300 - RNA, 64 nt, Homo Sapiens
cccuuuuuaagccuuaccugagaggaacaaugccuuaaaauaaaaaagcauuaaugagaugaaa

SEQ ID NO: 440301 - RNA, 64 nt, Homo Sapiens
gacccaaagcccuuacguuugaugcaauuuauuuuuaaaauaggccuuguuuuucagcuucauc

SEQ ID NO: 440302 - RNA, 64 nt, Homo Sapiens
uuaauguuuauacuuagauuuucuuuuaaaaaaauuaaaauaaaacaaaaaaaaauuucuagga

SEQ ID NO: 440303 - RNA, 64 nt, Homo Sapiens
auucuuuuuuuugcauccaauugugccugaacuuuuaaaauauguaaaugcugccauguuccaa

SEQ ID NO: 440304 - RNA, 64 nt, Homo Sapiens
auuauuguguguguuuuguaauauuugcgaucacuuaaaauaucagauaaauacagucaugcau

SEQ ID NO: 440305 - RNA, 64 nt, Homo Sapiens
ggcuugugucuguugcacauuucuugaagcauuuuuaaaauaacauguaaccuguaaccuuguu

SEQ ID NO: 440306 - RNA, 64 nt, Homo Sapiens
augcuauuuaugucacaucucacauuaaauuauuuuaaaauaagcagugcccuucaaaacagau

SEQ ID NO: 440307 - RNA, 64 nt, Homo Sapiens
uaaauguguugguucauuugacaguuuccauuauuuaaaauaaaagagcacaguguagccaugu

SEQ ID NO: 440308 - RNA, 64 nt, Homo Sapiens
uauuacaacugggguagauuauuuauggucuccauuaaaauacaucaagcggguuuuuggaaaa

SEQ ID NO: 440309 - RNA, 64 nt, Homo Sapiens
uuuugcaucucagcagaaggcuuuaaaauacauuuuaaaauauacuagaucagauccuguauga

SEQ ID NO: 440310 - RNA, 64 nt, Homo Sapiens
uuuuaaaauauauuuugcaugauccuguaugacuuuaaaauacauugccauucuuacuagauca

SEQ ID NO: 440311 - RNA, 64 nt, Homo Sapiens
ucuacauguuuauugaauuauguaccaaacugacuuaaaauaaaugcaaaaccaaucuguauca

SEQ ID NO: 440312 - RNA, 64 nt, Homo Sapiens
cugcaugaauccuguggcuguucaacaggaauauuuaaaauauuaaaucaauuaaaucauugug

SEQ ID NO: 440313 - RNA, 64 nt, Homo Sapiens
aaauuagcagcccucugcauaccccuuccauuuuuuaaaauaagugauagucuccugcuguuuu

SEQ ID NO: 440314 - RNA, 64 nt, Homo Sapiens
gagcaguguucuccauucguaaauuaaucugcuuuuaaaauaaauuacucaaguagaagccuga

SEQ ID NO: 440315 - RNA, 64 nt, Homo Sapiens
agaguuuuugaaauuuuuuuuaugcuaaauaauuuuaaaauacaaccugguaucuauuuguaua

SEQ ID NO: 440316 - RNA, 64 nt, Homo Sapiens
uagugcuuuguuuaaaaggagguacuuaaaguacuuaaaauaaggaauauuauagucaguucuu

SEQ ID NO: 440317 - RNA, 64 nt, Homo Sapiens
uuuccaaaauaaauuuuauggaagaaauuccuuuuuaaaauauuuuuuuuacuguuuuguuaau

SEQ ID NO: 440318 - RNA, 64 nt, Homo Sapiens
uaaaauuccaaggauauauggacucccguuucucuuaaaauaagaaauggaagugagauggcaa

SEQ ID NO: 440319 - RNA, 64 nt, Homo Sapiens
aaauugaccuagaaucuuugugagguuuuuucuauuaaaauauuuauauuucuaaauccgaggu

SEQ ID NO: 440320 - RNA, 64 nt, Homo Sapiens
uuuucaaucucauaaaaaagggauagugcaucuuuuaaaauacauuuuauuuggggaggaacau

SEQ ID NO: 440321 - RNA, 64 nt, Homo Sapiens
aaaacaauuugcaaaccagcagaauuuuaagcuuuuaaaauaauucaauggauauacauuuuuu

SEQ ID NO: 440322 - RNA, 64 nt, Homo Sapiens
aaauuaaaaagacaaauuaaaccugaaauuauauuuaaaauauauuugagacaugaaauacaua

SEQ ID NO: 440323 - RNA, 64 nt, Homo Sapiens
uacauuccccccaccccaauuugcuauuuccuuauuaaaauagaaaauuauaggcaagauacaa

SEQ ID NO: 440324 - RNA, 64 nt, Homo Sapiens
aaauaugaaaguagauucaugaaaauguauuccuuuaaaauauuguuuuccuacaggccuauuu

SEQ ID NO: 440325 - RNA, 64 nt, Homo Sapiens
uaaaauguuuuaugacauuuuucuggcugugaucuuaaaauaauucauaucuaaauaguauuuu

SEQ ID NO: 440326 - RNA, 64 nt, Homo Sapiens
caguuauaaagaaauugaugagguuuuuaccuuuuuaaaauauugguuagaaguucaaaaacca

SEQ ID NO: 440327 - RNA, 64 nt, Homo Sapiens
uuugaaauuuauuacagugcaauugaaaauacacuuaaaauacugcaggaugcuuagugcucag

SEQ ID NO: 440328 - RNA, 64 nt, Homo Sapiens
uuuagucuuucuuugcuuaaccucugaauguuuauuaaaauaaagaaaauuuggccacccucag

SEQ ID NO: 440329 - RNA, 64 nt, Homo Sapiens
uugcauuccaagcuggucccggcuuucacuguguuuaaaauacauguccagcuaccugccaggu

SEQ ID NO: 440330 - RNA, 64 nt, Homo Sapiens
uaugagauaccaauguagccgaaaucagagguguuuaaaauaccuuaccuuuucauguauauuu

SEQ ID NO: 440331 - RNA, 64 nt, Homo Sapiens
ccucugaugugaaauuaaauuaugcagucgcucauuaaaauauucuuaucuuugacuguuauuu

SEQ ID NO: 440332 - RNA, 64 nt, Homo Sapiens
gaaaaagaaaaguauaguuauuaucaaauuugccuuaaaauaaucuuccucaccacugacuauu

SEQ ID NO: 440333 - RNA, 64 nt, Homo Sapiens
uuaaaaauauuauuaguaaauuuaugauaauuaguuaaaauauauuuggauacaauacucuuga

SEQ ID NO: 440334 - RNA, 64 nt, Homo Sapiens
gaaaauaaauacucuugguuaauguugcaguuuuuuaaaauaauguuccagggauugugaaaua

SEQ ID NO: 440335 - RNA, 64 nt, Homo Sapiens
ucccucaauucuguaaauuaguguauuuugacauuuaaaauacuugcuaaaucacauucagcau

SEQ ID NO: 440336 - RNA, 64 nt, Homo Sapiens
ccuuucuugccuauccuugcuugccuggauaggguuaaaauagauuuccaaaguaaccugcuuu

SEQ ID NO: 440337 - RNA, 64 nt, Homo Sapiens
auguuuuguuuuaauaauaugugguaaggcuguuuuaaaauaaggaagugcagaaguuggaaca

SEQ ID NO: 440338 - RNA, 64 nt, Homo Sapiens
aagauuccuuugacuugccauuuauaucuuacauuuaaaauauuuaaaauauauaagcuuaaau

SEQ ID NO: 440339 - RNA, 64 nt, Homo Sapiens
uaagcuuaaauuuuauaucuagcaguacagcuaauuaaaauauauuccaaauauuuauuucaug

SEQ ID NO: 440340 - RNA, 64 nt, Homo Sapiens
uaaacaguuauuguauuuuuuauuucuuucuaacuuaaaauacgacacccaguauuuucuuuaa

SEQ ID NO: 440341 - RNA, 64 nt, Homo Sapiens
gccucaugucugguauauauuuuaccaaacagccuuaaaauauauuuggaagcaaaaaucagua

SEQ ID NO: 440342 - RNA, 64 nt, Homo Sapiens
auggagcucacgacgugugaccauuucgucauauuuaaaauauaacuucaagaaaagaguaaac

SEQ ID NO: 440343 - RNA, 64 nt, Homo Sapiens
ccagugucuucgccacauaaaauagccauuuucuuuaaaauaguuuuggacuaacgaagcugaa

SEQ ID NO: 440344 - RNA, 64 nt, Homo Sapiens
gagauacguaaaguaggccccacaaauaauauuuuuaaaauacaaaggaucaccacaauccucu

SEQ ID NO: 440345 - RNA, 64 nt, Homo Sapiens
cauuguuuaucuaauauuauuuaugacaguaauuuuaaaauauauuauucauaaguucaaggau

SEQ ID NO: 440346 - RNA, 64 nt, Homo Sapiens
ugcaaagcaaccugucuuacauucuuacauuaucuuaaaauaaauauuucugcccuugaaucaa

SEQ ID NO: 440347 - RNA, 64 nt, Homo Sapiens
aguagaccccaagcauccuuuucuaaaaagugacuuaaaauaagccaacagacucucccagacc

SEQ ID NO: 440348 - RNA, 64 nt, Homo Sapiens
augcuuauaccuaauuuuuaguuuuuaaacuauuuuaaaauauacuaugauuuuauauguauau

SEQ ID NO: 440349 - RNA, 64 nt, Homo Sapiens
gucauuucccaagacuagcauagggaguauccauuuaaaauacauucaucuuccucccauuucc

SEQ ID NO: 440350 - RNA, 64 nt, Homo Sapiens
gugauucauauucaguacuguuuuuaaucacuuuuuaaaauauaaggaccgaaugcaaggaaac

SEQ ID NO: 440351 - RNA, 64 nt, Homo Sapiens
caaagcugaaacugauuagaaaauucuuuauauuuuaaaauagcucuuucucauuuuuagagaa

SEQ ID NO: 440352 - RNA, 64 nt, Homo Sapiens
cuagaacugucaaauaacaaaacggcucauguuuuuaaaauauauguaacucauuuuaaaauau

SEQ ID NO: 440353 - RNA, 64 nt, Homo Sapiens
acggcucauguuuuuaaaauauauguaacucauuuuaaaauauauuaaauuguauuccaaaccu

SEQ ID NO: 440354 - RNA, 64 nt, Homo Sapiens
caaaccuguucuucuguuucuguggcaccuagguuuaaaauauguauuaauguguaaaucacaa

SEQ ID NO: 440355 - RNA, 64 nt, Homo Sapiens
gauuuuuuuauuuguauuaaugaaaagcuuuaguuuaaaauaaggagauccagaauaaaaagaa

SEQ ID NO: 440356 - RNA, 64 nt, Homo Sapiens
aguuucuguuuuucuccauuuagacauaggucaauuaaaauauuuggguuuaaaaugacuaaau

SEQ ID NO: 440357 - RNA, 64 nt, Homo Sapiens
uuguauuaugcugcucacugauccuucugcauauuuaaaauaaaauguccuaaaggguuaguag

SEQ ID NO: 440358 - RNA, 64 nt, Homo Sapiens
auaaacaagacacaacguuuuuauacaacauacuuuaaaauauuaaggaguuuucuuaauuuug

SEQ ID NO: 440359 - RNA, 64 nt, Homo Sapiens
aauaguacuauugcuaguacaauaaaauuuaccuuuaaaauaauuauuacuauuuuuauuuuaa

SEQ ID NO: 440360 - RNA, 64 nt, Homo Sapiens
auuuaccuuuaaaauaauaauuacuauuuuuauuuuaaaauaaauaauaauaguacuauuacua

SEQ ID NO: 440361 - RNA, 64 nt, Homo Sapiens
aauguuauccaacuauuaagccacacauauuguuuuaaaauaaguagauugcaaaaucuccaau

SEQ ID NO: 440362 - RNA, 64 nt, Homo Sapiens
cccacucagcacucagagacuuuuuucuucuuuuuuaaaauauuugaaucaaguguaauauaau

SEQ ID NO: 440363 - RNA, 64 nt, Homo Sapiens
gcuguagauuuagaggaauuggaccuuuuuccaguuaaaauauucugacaaaccagagaaaaau

SEQ ID NO: 440364 - RNA, 64 nt, Homo Sapiens
aaaucuggcaugguuugcgguaacguugaauauauuaaaauaacuuuacucuauguacagaauu

SEQ ID NO: 440365 - RNA, 64 nt, Homo Sapiens
augauccuuuauggaccaaauuaaagaugagccauuaaaauagaacauauuucucuuaggacuu

SEQ ID NO: 440366 - RNA, 64 nt, Homo Sapiens
aacaaaaccagaaucagguaaaacagcuaugugauuaaaauauuuuaauucuucagcaauuacc

SEQ ID NO: 440367 - RNA, 64 nt, Homo Sapiens
acuuaaaaugcauagcauuauuaaaaacaaucuuuuaaaauauaauuuauaacauagauugaag

SEQ ID NO: 440368 - RNA, 64 nt, Homo Sapiens
ugcucccaggagaacuccugauuauugauugugauuaaaauauuuuuucacuauuacuguugua

SEQ ID NO: 440369 - RNA, 64 nt, Homo Sapiens
cuuuccuuuuaaaugugcuguuuucaaauccaauuuaaaauaacauaguauagguaaauuuucu

SEQ ID NO: 440370 - RNA, 64 nt, Homo Sapiens
cugcagggcaaauaauauucuauuuuaacaaagauuaaaauauaaacacaaaacuuuuauaaau

SEQ ID NO: 440371 - RNA, 64 nt, Homo Sapiens
uuuauuuccaugccuuauuaaggguuaauaauccuuaaaauacuauagcagaauuuuuuuauac

SEQ ID NO: 440372 - RNA, 64 nt, Homo Sapiens
agcuacugcaaauuuugucuuucuguaaauguuauuaaaauauccagugagcucuuuagaagga

SEQ ID NO: 440373 - RNA, 64 nt, Homo Sapiens
auuucaagacuauuuuugagguaauucuagccuuuuaaaauauucuacagaccuacggggcuua

SEQ ID NO: 440374 - RNA, 64 nt, Homo Sapiens
aaaaaaagcaauucacaaaaccauuucauauuuuuuaaaauauugugcuuaaagaugguccugg

SEQ ID NO: 440375 - RNA, 64 nt, Homo Sapiens
aagcaguacagaggaaaacaggaaccugauuuuuuuaaaauaaauuuuaaauaaaauagaauua

SEQ ID NO: 440376 - RNA, 64 nt, Homo Sapiens
uccuuugaaauaaacuuaugaaauguuuucucucuuaaaauauuucuccuguguaaaauaaauc

SEQ ID NO: 440377 - RNA, 64 nt, Homo Sapiens
gcaggcucucuaaagaaaaacucauuguaacuuauuaaaauaauaucuggugcaaaguaucugu

SEQ ID NO: 440378 - RNA, 64 nt, Homo Sapiens
uuuucccuaagugaucaacaucaaauuuuuagaauuaaaauacauuuaacucagggaauuugua

SEQ ID NO: 440379 - RNA, 64 nt, Homo Sapiens
aauguuauagugugaacuaccuuuauaacauagguuaaaauacgcuugcuaggguguguuuuca

SEQ ID NO: 440380 - RNA, 64 nt, Homo Sapiens
ccaauggaauuagaugagugcuaugcacuuaauuuuaaaauaaaacuaguuuucaguaaaaugg

SEQ ID NO: 440381 - RNA, 64 nt, Homo Sapiens
gggggcuguagaguuugaaaaagcauauucaauauuaaaauaguuuuauauuugggaaggcaaa

SEQ ID NO: 440382 - RNA, 64 nt, Homo Sapiens
aaauuguguaaauacaauugacauaggaauuacauuaaaauauuaggaagaaacaaggacaaau

SEQ ID NO: 440383 - RNA, 64 nt, Homo Sapiens
acucauguggacuucaaugcaauuuuggauacuguuaaaauauauaaaccauucuccuauauga

SEQ ID NO: 440384 - RNA, 64 nt, Homo Sapiens
auaauugggaaagaaggugggcaacauuagaauuuuaaaauaaauaauccauuaccuggcacua

SEQ ID NO: 440385 - RNA, 64 nt, Homo Sapiens
auauuuacuguguauugccuauucuaugcuauuauuaaaauaaauaacaauuuucuucagaaga

SEQ ID NO: 440386 - RNA, 64 nt, Homo Sapiens
uucauuaagauuuuauuugggcccaauaaaggauuuaaaauauauugguugaagggauuacaga

SEQ ID NO: 440387 - RNA, 64 nt, Homo Sapiens
uggcuguuauuucuacugugauaaaaacugauacuuaaaauaaauaaucaaaaugcacuuuuua

SEQ ID NO: 440388 - RNA, 64 nt, Homo Sapiens
guauuccuugaaaauauaaauuaaauguuuuuauuuaaaauaaauguauggucaguaggcaauc

SEQ ID NO: 440389 - RNA, 64 nt, Homo Sapiens
aaauccuauuuuggaggcaauuuugguaaaccauuuaaaauacaccaaaaguauaagauacauu

SEQ ID NO: 440390 - RNA, 64 nt, Homo Sapiens
ucugaacaugauuauauuaucacuuuaaguuacuuuaaaauaacgaggagggagugcgucuguu

SEQ ID NO: 440391 - RNA, 64 nt, Homo Sapiens
uauuuuggauagauauguguauuguauuaaaaauuuaaaauagguguuuauauuaaaauaaaau

SEQ ID NO: 440392 - RNA, 64 nt, Homo Sapiens
auauuguauuaaaaauuuaagacagauguuuauauuaaaauaaauauuaucuuugucuauaacu

SEQ ID NO: 440393 - RNA, 64 nt, Homo Sapiens
gcugggaaaaauauucaauaaacuugaauuugauuuaaaauagggacagucuuugucauaggca

SEQ ID NO: 440394 - RNA, 64 nt, Homo Sapiens
ucuucuacuuuucuguauauuaagugaccuaauuuuaaaauaaucuuguaguauucaaguaaga

SEQ ID NO: 440395 - RNA, 64 nt, Homo Sapiens
auuuuaaauuacauauuaauaaguuuuuaguuacuuaaaauaugaguuaaugguugaauuuuua

SEQ ID NO: 440396 - RNA, 64 nt, Homo Sapiens
uaaugucaaaaaugacucaccauauuucuucccuuuaaaauauguuuauaaaaaacccuuuguu

SEQ ID NO: 440397 - RNA, 64 nt, Homo Sapiens
uucugugacuucaaauuguaucagaauuagccauuuaaaauauuaauggauucuugucuccucu

SEQ ID NO: 440398 - RNA, 64 nt, Homo Sapiens
uuguuuauucaaugucuaaaaauucuuuuaauauuuaaaauaacaguuaagacuugaaauugaa

SEQ ID NO: 440399 - RNA, 64 nt, Homo Sapiens
uucuugacaaaaaucaacaaaaaaaggagggacuuuaaaauaccgcagaaaucgaauuuaaaac

SEQ ID NO: 440400 - RNA, 64 nt, Homo Sapiens
auuuacuucugauguuuuaacagaggccuaaaguuuaaaauaaacuguguuuacuggaaaaauu

SEQ ID NO: 440401 - RNA, 64 nt, Homo Sapiens
uagaaaaacaaguuuuauucuuuuucagauccacuuaaaauauuuuauacacuugucuugaauu

SEQ ID NO: 440402 - RNA, 64 nt, Homo Sapiens
gacaagauguaaaauaauauguuuuucaugcaguuuaaaauauuacuaacuuaaggguuucuau

SEQ ID NO: 440403 - RNA, 64 nt, Homo Sapiens
aaauauuacuaacuuaaggguuucuaugugcuuuuuaaaauauuccuucuuugauguugacauc

SEQ ID NO: 440404 - RNA, 64 nt, Homo Sapiens
aauagucuauauuuuaaccugcauaaaaaggucuuuaaaauauuguugaacacuugaagccauc

SEQ ID NO: 440405 - RNA, 64 nt, Homo Sapiens
ugccgaauugucuuuggugcuuuucacuuguguuuuaaaauaaggauuuuucucuuauuucucc

SEQ ID NO: 440406 - RNA, 64 nt, Homo Sapiens
gguuaagggaggugggggucacuguucaucacucuuaaaauauguguuuucucuauagaaaagu

SEQ ID NO: 440407 - RNA, 64 nt, Homo Sapiens
uguacuuggacugucauagccucugcguuugaccuuaaaauagcucuucccaguaagauugugc

SEQ ID NO: 440408 - RNA, 64 nt, Homo Sapiens
ugugcugucguuuuguuuguuuuucuaugauaauuuaaaauacauagguagggcuacugaggaa

SEQ ID NO: 440409 - RNA, 64 nt, Homo Sapiens
guuauucacagacagaacuuuguuuccugugauuuuaaaauaccgcgucuguuccuccauggac

SEQ ID NO: 440410 - RNA, 64 nt, Homo Sapiens
ugcauuaaaaguuuacuuuauggaaagugaauuuuuaaaauauaugcacuuuaaaauaguaaaa

SEQ ID NO: 440411 - RNA, 64 nt, Homo Sapiens
aaaauggaaagugaauuuuuauuuuacaugcacuuuaaaauagucuaccaaaaaauggaaaaga

SEQ ID NO: 440412 - RNA, 64 nt, Homo Sapiens
uggcaaaugcuaugcuucuaauugacucgguuuuuuaaaauaacgaacuuugagacuaauuugu

SEQ ID NO: 440413 - RNA, 64 nt, Homo Sapiens
gguagcucaaaggagccaagccuauuuauaauucuuaaaauaagguucuuuguguggguugaca

SEQ ID NO: 440414 - RNA, 64 nt, Homo Sapiens
ucugaacauuuaagaaugagcaguuaaaauaaaauuaaaauagcgaucugaauagagaaaucag

SEQ ID NO: 440415 - RNA, 64 nt, Homo Sapiens
auuaaaauagcucugaacauagagaaaucagcaguuaaaauaaacugagucgagagaucugaau

SEQ ID NO: 440416 - RNA, 64 nt, Homo Sapiens
ugcacaaggauagagagaaauuuugaauaaggauuuaaaauaccuagaaauggagagggaacug

SEQ ID NO: 440417 - RNA, 64 nt, Homo Sapiens
uuauacuuacaaaaaucuaggacauaccuuuguuuuaaaauauuaguucucuagcuaaggaaug

SEQ ID NO: 440418 - RNA, 64 nt, Homo Sapiens
uuuuggaagagcugcuaauuucuuuuguuguauuuuaaaauauuccucaaaggguuauuugaaa

SEQ ID NO: 440419 - RNA, 64 nt, Homo Sapiens
aguguccuucguauuaauaucacaacuaacagacuuaaaauaacgcauuaacgcacaucucuuc

SEQ ID NO: 440420 - RNA, 64 nt, Homo Sapiens
guuuuaaaaauaacugcauuagaugcucauauuuuuaaaauaaaauuaucaaaacuuuuaaaau

SEQ ID NO: 440421 - RNA, 64 nt, Homo Sapiens
ugcucauauuuuuaaaauaaaauuaucaaaacuuuuaaaauagacacaagaaaauaauggcaau

SEQ ID NO: 440422 - RNA, 64 nt, Homo Sapiens
caguguuuuuccacucacuacccaaaucaaacaauuaaaauauaccauuuuuccuuaaccaaca

SEQ ID NO: 440423 - RNA, 64 nt, Homo Sapiens
ucaauccuggauucacagugguauccaaagaauauuaaaauacuuuaugauacuaaucuuuuaa

SEQ ID NO: 440424 - RNA, 64 nt, Homo Sapiens
uauuguuuucaucacugacuuuaauagaguauguuuaaaauaaauguuaauuuaaggauauaua

SEQ ID NO: 440425 - RNA, 64 nt, Homo Sapiens
aaauauauuuuaccaaaaaucaguuuccaaaaacuuaaaauacaguacaccauauaugaauaaa

SEQ ID NO: 440426 - RNA, 64 nt, Homo Sapiens
caugcacugagguccacagaccuacugcacugaguuaaaauagcgguacaaguucuggcaagag

SEQ ID NO: 440427 - RNA, 64 nt, Homo Sapiens
aaauaaaaauauaggugaugggcagaucuuuucuuuaaaauaaaaaagcaaaaacucuuguggu

SEQ ID NO: 440428 - RNA, 64 nt, Homo Sapiens
uaugguauaacaacaagugaauuugaagacucauuuaaaauauuguguuauuuauaaagucauu

SEQ ID NO: 440429 - RNA, 64 nt, Homo Sapiens
uugauguauggauuacuuuuuuuuguaaacaugguuaaaauaaaacuuuugugguucuucugaa

SEQ ID NO: 440430 - RNA, 64 nt, Homo Sapiens
uuuuagcaguggcuuauuauuuguuuuucauaaauuaaaauaacuuuugauaauguuuacuuua

SEQ ID NO: 440431 - RNA, 64 nt, Homo Sapiens
agaguacccaaauucuaggacaaugcuuaaaguguuaaaauacccuagauacuguguuaugugc

SEQ ID NO: 440432 - RNA, 64 nt, Homo Sapiens
guuuugaauuacccauaucacugccaguuuuauuuuaaaauauuuuguguuugaaguaucugug

SEQ ID NO: 440433 - RNA, 64 nt, Homo Sapiens
uuuuuccaauuuauuucucagcaaauuaaacauuuuaaaauauuauuccaguauuauguauauu

SEQ ID NO: 440434 - RNA, 64 nt, Homo Sapiens
aagucuauauuauugcauaaucauuuucuagcacuuaaaauacaccaaacugauaacauuuauc

SEQ ID NO: 440435 - RNA, 64 nt, Homo Sapiens
cuuaaaaauuaauaguuuuacucugcauaaguaauuaaaauauaauguguaauauuccaguuuu

SEQ ID NO: 440436 - RNA, 64 nt, Homo Sapiens
ugaagugagauggcauggugaaauguuacuuauuuuaaaauaaacaauccuuuugauaaauuua

SEQ ID NO: 440437 - RNA, 64 nt, Homo Sapiens
aauaaaaacaauccuuuugauauuuaauaaugcuuuaaaauaaacacuuuucaagucugaucca

SEQ ID NO: 440438 - RNA, 64 nt, Homo Sapiens
uuuuggggaggauuugcugaaaugauauuuugaguuaaaauaucguagggagaaaauaugugcu

SEQ ID NO: 440439 - RNA, 64 nt, Homo Sapiens
cuuaaggucuuuaagggaggagcagagugagaaguuaaaauaccaauacccuuaaggagguuca

SEQ ID NO: 440440 - RNA, 64 nt, Homo Sapiens
cuuaaggagguucaagcagaagcagagugagaaguuaaaauaccucccgaaggacggagguuca

SEQ ID NO: 440441 - RNA, 64 nt, Homo Sapiens
uuaaucaggcagaguuuuauguaaaaaguacacuuuaaaauauuaaugcuauuaacaguaucag

SEQ ID NO: 440442 - RNA, 64 nt, Homo Sapiens
uugagauuaauacaugaaaaccauauguaugcuauuaaaauauacaggaaaggguuuuuugaga

SEQ ID NO: 440443 - RNA, 64 nt, Homo Sapiens
auuuagaguauuugggguuuggguugacagauuuuuaaaauagaaagcauauuagaauaauugu

SEQ ID NO: 440444 - RNA, 64 nt, Homo Sapiens
cauauuacuuaaugaauauggggacagaaagaccuuaaaauauuuaaacuuacuacuuucuugu

SEQ ID NO: 440445 - RNA, 64 nt, Homo Sapiens
guucuaaaaauaaguuucuuaugugagaaauuuauuaaaauauaaauaaaaauuaaauauuaga

SEQ ID NO: 440446 - RNA, 64 nt, Homo Sapiens
aguacaccuaauuguuauuguuuucugaaauguuuuaaaauagauauugcuauaacauauauuu

SEQ ID NO: 440447 - RNA, 64 nt, Homo Sapiens
cuugacuagaguuuccaguuuuuuuaaaaguuuguuaaaauauguucuuagcuguauauacauu

SEQ ID NO: 440448 - RNA, 64 nt, Homo Sapiens
aucuaauaaaaagucacaaacaaaauuugaaauauuaaaauaaugcaauauaaggaaagugauc

SEQ ID NO: 440449 - RNA, 64 nt, Homo Sapiens
gacgucugaaaaauaaaauauaaaacuauuacauuuaaaauaugguugccaaccuuuucuuuua

SEQ ID NO: 440450 - RNA, 63 nt, Homo Sapiens
cccuguauagaaauguggaauauaacucuacccuuaaaauauuaacucaaucaccauagcuga

SEQ ID NO: 440451 - RNA, 64 nt, Homo Sapiens
agagaaucugugggaaauaggcagauauagcuuuuuaaaauauaaaguacuugggauuuugcau

SEQ ID NO: 440452 - RNA, 64 nt, Homo Sapiens
gagagcuuuuccuuauacaucucaaugcugagaguuaaaauauucccagguuaaaauuuuuuua

SEQ ID NO: 440453 - RNA, 64 nt, Homo Sapiens
cuugugugauuaacuuauuuagagaugcuguaacuuaaaauaggggauauuuaagguagcuuca

SEQ ID NO: 440454 - RNA, 64 nt, Homo Sapiens
guuacuauuuucuacaauuaauaguuugucuauuuuaaaauaaauuaguuguuaagagucuuaa

SEQ ID NO: 440455 - RNA, 64 nt, Homo Sapiens
aaugaacuuuaaaaaagcaaauuucaugcacugauuaaaauaggauuauuuuaaauacaaaagg

SEQ ID NO: 440456 - RNA, 64 nt, Homo Sapiens
gggucuuaauugaaaugaaaauuuaauuuuguuuuuaaaauauuguuuaucuuuauuuauuuug

SEQ ID NO: 440457 - RNA, 64 nt, Homo Sapiens
agugguuauucucugacuugauguuuuaaucuuuuuaaaauauaguugauuugaggauauaaua

SEQ ID NO: 440458 - RNA, 64 nt, Homo Sapiens
uuuuaaaacaaaaacauuauuauuaaaacuguuguuaaaauauuaagucaguugauuuuuuuuc

SEQ ID NO: 440459 - RNA, 64 nt, Homo Sapiens
cagucuacaaguuugguucuauauaauuuuaagguuaaaauauuccauagguguauauauaggu

SEQ ID NO: 440460 - RNA, 64 nt, Homo Sapiens
aauguuaaauuauccagaaaaauuuauauaaaauuuaaaauacauuuuaaacuuguuaaaaaga

SEQ ID NO: 440461 - RNA, 64 nt, Homo Sapiens
auuccucauauccaaggcuaggacugccuggugguuaaaauacgcccuuuaaaaauaauuccuu

SEQ ID NO: 440462 - RNA, 64 nt, Homo Sapiens
gauuggcgcguaguauacagccuaacuacaggacuuaaaauauaaauaaaagacuuauaaaaua

SEQ ID NO: 440463 - RNA, 64 nt, Homo Sapiens
guucuuguaauuuuacacgcaaagugccaguauuuuaaaauagcuucgagauuaucguuuucuu

SEQ ID NO: 440464 - RNA, 64 nt, Homo Sapiens
agacugccauauuaaauuuuccaaaagcgugagcuuaaaauacagaagaccugagaauguaucc

SEQ ID NO: 440465 - RNA, 64 nt, Homo Sapiens
cccaaauuuuuacuuuguuugcuuuaacucggucuuaaaauauggaaauaaauugggcccaaga

SEQ ID NO: 440466 - RNA, 64 nt, Homo Sapiens
auuuuucaaaaucauacagaguauaaugcuauaguuaaaauacuuaaaaugguuucuagcauau

SEQ ID NO: 440467 - RNA, 64 nt, Homo Sapiens
auacuuuuaaaaagaaaauuugugccagcugaauuuaaaauauagcauguaacagacuggcaca

SEQ ID NO: 440468 - RNA, 64 nt, Homo Sapiens
aaguguaauuauuuuaacacugcacagcacacuauuaaaauauuaaaacaaaaaacuauguauu

SEQ ID NO: 440469 - RNA, 64 nt, Homo Sapiens
uuaauugauuuuacagucuguaaugcuugauguuuuaaaauaauaacauuuuuauauuuuuuaa

SEQ ID NO: 440470 - RNA, 64 nt, Homo Sapiens
uacaaguuuucuuuaaagcccucuccuuuagaauuuaaaauauuguaccauugaagaguuugga

SEQ ID NO: 440471 - RNA, 64 nt, Homo Sapiens
guuaacaugaaaauggcauuuuuccauaauagcuuuaaaauaauuuuuuaguaauuauuacaaa

SEQ ID NO: 440472 - RNA, 64 nt, Homo Sapiens
gcccggccaagaucuaacucacgcuuacuuuucauuaaaauauuucuugucgcuuuuagcuauu

SEQ ID NO: 440473 - RNA, 64 nt, Homo Sapiens
uacucaucuugcacggccagaacuguuugguugauuaaaauacaucagcucuuaaaaacucauu

SEQ ID NO: 440474 - RNA, 64 nt, Homo Sapiens
ucugugcgaccaaugagacgacuucagcaucuuuuuaaaauaaucuaagcaucauugaagcagu

SEQ ID NO: 440475 - RNA, 64 nt, Homo Sapiens
aaauuaauaacuuuuaguaauuacuuuuauuaauuuaaaauagaacgcuugagaggcacuuugu

SEQ ID NO: 440476 - RNA, 64 nt, Homo Sapiens
uuuuuuaaaauuaauauuaauaacuuuuauuaauuuaaaauagaaugcuuaaaauaaaauagaa

SEQ ID NO: 440477 - RNA, 64 nt, Homo Sapiens
uauuaauaacuuuuauuaauuuaaaauagaaugcuuaaaauaaaauagaaugcuugagaggcac

SEQ ID NO: 440478 - RNA, 64 nt, Homo Sapiens
augaaaagacagcuuaaggaagagcuaaauucuguuaaaauauuuggggcauguuugugcacug

SEQ ID NO: 440479 - RNA, 64 nt, Homo Sapiens
ugaaaacagcauuggccaaagguacugaggcugcuuaaaauauucaauucugcuuuuuaauuuu

SEQ ID NO: 440480 - RNA, 64 nt, Homo Sapiens
uauaguuagauuccaacuucgccaaaagucagaguuaaaauauauuuuuucccuaaaugguaug

SEQ ID NO: 440481 - RNA, 64 nt, Homo Sapiens
cacuauaguuuuacccauaaauauuuuuuucuuuuuaaaauagauuaaaaaauauauauauaaa

SEQ ID NO: 440482 - RNA, 64 nt, Homo Sapiens
acaucacuauuuggcuuuugagcugcagccuggguuaaaauauagcuuucagaucaacacaaau

SEQ ID NO: 440483 - RNA, 64 nt, Homo Sapiens
aguaucauccauaugguccauguuuuauuuggaguuaaaauaagcccucaaauauuuuacuauu

SEQ ID NO: 440484 - RNA, 64 nt, Homo Sapiens
ggaucuugcucuguuaggguaaggccccguugauuuaaaauauuaucgagcgcaguucaugcac

SEQ ID NO: 440485 - RNA, 64 nt, Homo Sapiens
gauauuuuuauuuguuaauaccuguaauugucuuuuaaaauacuuuagaaugaccucuaacacu

SEQ ID NO: 440486 - RNA, 64 nt, Homo Sapiens
uaguuucucuaaaacuuuaucugaaagagucauuuuaaaauaacuauuaaacaauguaacugcu

SEQ ID NO: 440487 - RNA, 64 nt, Homo Sapiens
gcuaucuuaauguucugaaauaaguuaaaacauuuuaaaauaugaauacuguaaaggaaauaaa

SEQ ID NO: 440488 - RNA, 64 nt, Homo Sapiens
aaauagaaguacagugaggucuauagccauuuuauuaaaauagcuuaaaaguuuguaaaaaaau

SEQ ID NO: 440489 - RNA, 64 nt, Homo Sapiens
cuacaaugaauagguauggugguuucacagaauuuuaaaauagaguuaaagggaagugauguac

SEQ ID NO: 440490 - RNA, 64 nt, Homo Sapiens
gauauaaucuuggcuucuuaaaaacuguguaucauuaaaauauauguucugcaagaauuaaaac

SEQ ID NO: 440491 - RNA, 64 nt, Homo Sapiens
uuauauuccaaggaaaauugaaaguauucagaaauuaaaauauuauuugauaucugaaaccugg

SEQ ID NO: 440492 - RNA, 64 nt, Homo Sapiens
cuguuccuugauaaaaggcuaaacauuuuauguauuaaaauaaaaagguuuacugcucguaagg

SEQ ID NO: 440493 - RNA, 64 nt, Homo Sapiens
cagcauucaaauuguaugcuaaucacuuuucauguuaaaauaauacacaguuuguuuuucuugu

SEQ ID NO: 440494 - RNA, 64 nt, Homo Sapiens
aauacuguaaaggaaauaaauaaguuaaaacauuuuaaaauauggcuaucuuaauguucugaaa

SEQ ID NO: 440495 - RNA, 64 nt, Homo Sapiens
uauuaaacaauguaacugcucugaaagagucauuuuaaaauaacuaguuucucuaaaacuuuau

SEQ ID NO: 440496 - RNA, 64 nt, Homo Sapiens
aauccuguaguuuaaaaggaugaaauaaaacauuuuaaaauauauaacugcuaucuuaauguuc

SEQ ID NO: 440497 - RNA, 64 nt, Homo Sapiens
auaaauauuaaaaaauguaacuuaaagagucauuuuaaaauaauccauggguuuaaaacuguau

SEQ ID NO: 440498 - RNA, 64 nt, Homo Sapiens
guuuacuaugaagacaauguauuucuuaugccuuuuaaaauacuuuuguauuaaauuuauuacu

SEQ ID NO: 440499 - RNA, 64 nt, Homo Sapiens
caaagaguuguuauaaugcaaccaaauaauuuguuuaaaauaacaguaucacucuaguaaaaaa

SEQ ID NO: 440500 - RNA, 64 nt, Homo Sapiens
uuuauuuucauaaaugguuuaacuuuuaugccuuuuaaaauaaauuuuuucuuuuuacacuaau

SEQ ID NO: 440501 - RNA, 64 nt, Homo Sapiens
auauauuuuguucuauuggucugugcugguauaauuaaaauaaacauggucuuucugggccuua

SEQ ID NO: 440502 - RNA, 64 nt, Homo Sapiens
uaguuuucuagcucucgggucccuuuauugcuuuuuaaaauaggguuugaaacaugccacagga

SEQ ID NO: 440503 - RNA, 64 nt, Homo Sapiens
gccuuagagacgugguaaagcacuuuggcaggguuuaaaauauuugugagaagcccacauuuca

SEQ ID NO: 440504 - RNA, 64 nt, Homo Sapiens
ggagugggaauugcuaucauguaaaauaucaaaguuaaaauacuaaggugcauuuucccugaag

SEQ ID NO: 440505 - RNA, 64 nt, Homo Sapiens
aagugccaaacuguuauuuuacuauauauaaauauuaaaauauuguguugaaguauagggaugu

SEQ ID NO: 440506 - RNA, 64 nt, Homo Sapiens
uuuccaaucuucuucccccuacuuggguaauugauuaaaauaccuccauuuacggccucuuucu

SEQ ID NO: 440507 - RNA, 64 nt, Homo Sapiens
aaugaagaagaggggaaaauggggagaaagaugguuaaaauacauaauaauccacguuuaaaag

SEQ ID NO: 440508 - RNA, 64 nt, Homo Sapiens
cagcuuuucccaccaguggugcuguugagauauuuuaaaauauugccuccguuuuaucgaggag

SEQ ID NO: 440509 - RNA, 64 nt, Homo Sapiens
uaucuauauuuauuuguaaaaauccaagcauaguuuaaaauaugaugucgauauuacuagucuu

SEQ ID NO: 440510 - RNA, 64 nt, Homo Sapiens
gauauuuuuuuauuuuauacaugcuguuuuuuaauuaaaauauaaucacugaaguuuacuaauu

SEQ ID NO: 440511 - RNA, 64 nt, Homo Sapiens
aaucuauuagauuuuagaaaaacauuuaaacuuuuuaaaauacuuauuaaaaaauuuguauaag

SEQ ID NO: 440512 - RNA, 64 nt, Homo Sapiens
guguugagccaugcuacaguuagucuugucccaauuaaaauacuaugcaguaucucuuacauca

SEQ ID NO: 440513 - RNA, 64 nt, Homo Sapiens
ggucuuaaaguaguuacucccuucucguguuugcuuaaaauaugugaaguuuuccuugcuauuu

SEQ ID NO: 440514 - RNA, 64 nt, Homo Sapiens
aaaauaaaucuugcucuguucaccuuuuugaucauuaaaauaaauuucauagugcuuucaaaua

SEQ ID NO: 440515 - RNA, 64 nt, Homo Sapiens
aggcccugauaaaauugauacucucucucuuuuuuuaaaauacaaaaaucuugagguuaaacau

SEQ ID NO: 440516 - RNA, 64 nt, Homo Sapiens
uuuuucauucagacuaccuuauuacuugagguguuuaaaauaaagauuuuguagaaauguaaag

SEQ ID NO: 440517 - RNA, 64 nt, Homo Sapiens
agaaauaaaggagcucuuacgccuaucccuuuccuuaaaauauauaaugaguacacaaguuuuu

SEQ ID NO: 440518 - RNA, 64 nt, Homo Sapiens
uucacggaauuaaaaguagcuaagugguguaguauuaaaauauuacgucaggccacccucauag

SEQ ID NO: 440519 - RNA, 64 nt, Homo Sapiens
gaauauguuugagacucccucuuugucuuaaauuuuaaaauagugggguuuuuuuucuaagcuu

SEQ ID NO: 440520 - RNA, 64 nt, Homo Sapiens
ucagcuuauuugaagauuaauuuucuuuguuaacuuaaaauaacuauuuuaacccuugaguggc

SEQ ID NO: 440521 - RNA, 64 nt, Homo Sapiens
uuccauugcuuuguuugcuuuaaaaauuccacaauuaaaauaucugucauugaaagcuuagaca

SEQ ID NO: 440522 - RNA, 64 nt, Homo Sapiens
cacaauaauuauugccuguaugucaauuauuauuuuaaaauauuguuguauuuacuuaaugucu

SEQ ID NO: 440523 - RNA, 64 nt, Homo Sapiens
uuucuuagaaacuuuaaaccuuuaacuucaaacauuaaaauacaagucuuuuaaguacaugagu

SEQ ID NO: 440524 - RNA, 64 nt, Homo Sapiens
gaauuuuacuguuacacauaguuuuugacuugaauuaaaauacuagacaaagcagaaauguaca

SEQ ID NO: 440525 - RNA, 64 nt, Homo Sapiens
cuaaccaaacuuccucagauugugcacuguuuguuuaaaauaaucacguauuuuagucugaugc

SEQ ID NO: 440526 - RNA, 64 nt, Homo Sapiens
uucuaccauuuuaaauugguuauauaucauuauauuaaaauaaaaaauaguauauguggacaca

SEQ ID NO: 440527 - RNA, 64 nt, Homo Sapiens
auauguggacacauauauauuuacaugcuuauuuuuaaaauaguuguuuuauaaugauuauaau

SEQ ID NO: 440528 - RNA, 64 nt, Homo Sapiens
caaaaauuggaugcguaaagagaaacuuggcugcuuaaaauaagagaaguuacuuugcuuuuaa

SEQ ID NO: 440529 - RNA, 64 nt, Homo Sapiens
agaagaaauagaaauuuugaucuccagagaaauuuuaaaauaauaauuuuuaaucaguuugcuu

SEQ ID NO: 440530 - RNA, 64 nt, Homo Sapiens
gggaucuugaaggcucccuguuuugaaauaagcuuuaaaauauaaaaugugaaguagugauggu

SEQ ID NO: 440531 - RNA, 64 nt, Homo Sapiens
uucagaauguauuuuuacuagugaaauuuaaguuuuaaaauacuucuguuaccuacuuuugcca

SEQ ID NO: 440532 - RNA, 64 nt, Homo Sapiens
uugauauuuucacaaauuuuauuauaaagauuguuuaaaauaucuucuuuuuugaaaauuagca

SEQ ID NO: 440533 - RNA, 64 nt, Homo Sapiens
ugaugaguuauuuggugcacuuaauagcauugucuuaaaauacgguaguaucuaaaagcauaau

SEQ ID NO: 440534 - RNA, 64 nt, Homo Sapiens
ugaucaguauucagugcgcuuuaauagaauuaucuuaaaauacauuucuuucuaaaaguauaau

SEQ ID NO: 440535 - RNA, 64 nt, Homo Sapiens
uccuguuaaacuuucugacauauuuuaacaggaguuaaaauaacuucuuuuuacugucaucuau

SEQ ID NO: 440536 - RNA, 64 nt, Homo Sapiens
uaguuuuuaauuguaggcucacauaggaaaacauuuaaaauaaagcuugguauuucugucuuau

SEQ ID NO: 440537 - RNA, 64 nt, Homo Sapiens
aagccuuuaaugcucuggguucaugucagauacauuaaaauacucacugaagagaagcccuaug

SEQ ID NO: 440538 - RNA, 64 nt, Homo Sapiens
cuauauguauauuuuguuaauuaguggcucauauuuaaaauaguucucugacuauggauuucaa

SEQ ID NO: 440539 - RNA, 64 nt, Homo Sapiens
gauuaugcaauucuaacuguagaagagauagcuauuaaaauaaucaguagccugggcauagugg

SEQ ID NO: 440540 - RNA, 64 nt, Homo Sapiens
uaaagacuacaguuaauucugacacuguaucuuauuaaaauaggaugauuugcauuuuguaaaa

SEQ ID NO: 440541 - RNA, 64 nt, Homo Sapiens
aaagaaggccucuuaaauucaacccauguuuuacuuaaaauaucuuggcauaagcucaaaaaag

SEQ ID NO: 440542 - RNA, 64 nt, Homo Sapiens
uguuucuauuauugaaaauuguauguaaaacuauuuaaaauagaauagaaggauacacacccaa

SEQ ID NO: 440543 - RNA, 64 nt, Homo Sapiens
uacuuauauaauaaaaguauguaacauacuuuuauuaaaauauauuaaauuuauuuuuuauuau

SEQ ID NO: 440544 - RNA, 64 nt, Homo Sapiens
agauguaugaugaaaaucuacuaugaaaaagacauuaaaauaugagcauuauuuauaaacuuug

SEQ ID NO: 440545 - RNA, 64 nt, Homo Sapiens
ucaugugucacaagaguaaacaacuuaaauucaauuaaaauaacauaauuuuuaauuggggugg

SEQ ID NO: 440546 - RNA, 64 nt, Homo Sapiens
aaauaauuuuuaauuggggucuaaaaucuuaucuuuaaaauaugauauucuguagaagauauuu

SEQ ID NO: 440547 - RNA, 64 nt, Homo Sapiens
aaauguuaauauuccaguuuaauuuaaaacauuuuuaaaauagcugcagaaggcggaguuuuua

SEQ ID NO: 440548 - RNA, 64 nt, Homo Sapiens
aacaucaaaucccccaucaggcagguuagcaguauuaaaauagacacaaaugcuauuucacccu

SEQ ID NO: 440549 - RNA, 64 nt, Homo Sapiens
uauagcaguugcagguaaacugucaggauugguuuuaaaauauuuuuguaacuuuaaaauauuc

SEQ ID NO: 440550 - RNA, 64 nt, Homo Sapiens
cugucaggauugguuuuaaaauauuuuuguaacuuuaaaauauucuauaauuaugcaugugauu

SEQ ID NO: 440551 - RNA, 64 nt, Homo Sapiens
auguagaaaaagagauagaaggaaccaccuaugcuuaaaauacuguaaauaugcagugagguuu

SEQ ID NO: 440552 - RNA, 64 nt, Homo Sapiens
agaauguuguaauaaguaaaugccuuaagaguauuuaaaauaugcuuccacauuucaaaauaua

SEQ ID NO: 440553 - RNA, 64 nt, Homo Sapiens
aauacaguaccgugucugaauuaauuauuaauauuuaaaauacuucauuccuuaacucucccuc

SEQ ID NO: 440554 - RNA, 64 nt, Homo Sapiens
uuuaaaugugaauuuuuauuucuuuuuaauuauuuuaaaauauuuaaaccuuuuucuugaucuu

SEQ ID NO: 440555 - RNA, 64 nt, Homo Sapiens
aucaugaauucccuuuuaaucaacuguagguuauuuaaaauaaauuccuacaacuuaauggaaa

SEQ ID NO: 440556 - RNA, 64 nt, Homo Sapiens
uuuuuaacaaucuucaauaauguaaagauuacuuuuaaaauauuuaaguuaaaacuacuugaau

SEQ ID NO: 440557 - RNA, 64 nt, Homo Sapiens
acucuuguguuucuguuuuucccaguaugcauguuuaaaauagaagugacaagaaucacauccg

SEQ ID NO: 440558 - RNA, 64 nt, Homo Sapiens
aaugcuauaaaaauuccuguuuugcccuaaauccuuaaaauacacaaguagaaaaaaaaaugua

SEQ ID NO: 440559 - RNA, 64 nt, Homo Sapiens
ucccuauuuuaucaugauuaugcauauuuuugaguuaaaauauuacagaaaaaggaagugcugg

SEQ ID NO: 440560 - RNA, 64 nt, Homo Sapiens
acaguuguauuuaacagaaauuguauauuguaauuuaaaauaauuauauaacuguauuugaaau

SEQ ID NO: 440561 - RNA, 64 nt, Homo Sapiens
auuuccuuccugugcuccacguucuucugugugauuaaaauaagaauauuauuuuuggaaauau

SEQ ID NO: 440562 - RNA, 64 nt, Homo Sapiens
agaauucagugcucuuucauuuuacuguaaaucuuuaaaauaacucuuuugggaaccaaaguau

SEQ ID NO: 440563 - RNA, 64 nt, Homo Sapiens
gugguucuggaccuuacaaguagaaauacagcuuuuaaaauauucuuaguaauguccuuaacuu

SEQ ID NO: 440564 - RNA, 64 nt, Homo Sapiens
gaaagugacugauuuuaauaaugagauaggucacuuaaaauaacagugccuuugaccuuaaaac

SEQ ID NO: 440565 - RNA, 64 nt, Homo Sapiens
auuagucauuauagcucagaccuaagcuaauuauuuaaaauaaauacauguaaaggccacugcc

SEQ ID NO: 440566 - RNA, 64 nt, Homo Sapiens
auucuauauauauauaaauauauauaaauauauauuaaaauaccaguuuuuuuucucugggugc

SEQ ID NO: 440567 - RNA, 64 nt, Homo Sapiens
cuauucuguaagucugagcguaaaacuucaaguauuaaaauaauuuguacauguagagagaaaa

SEQ ID NO: 440568 - RNA, 64 nt, Homo Sapiens
aaaucuugaggucauauacugaaauaugaauaaauuaaaauaaugaauucagaucuaaucauuu

SEQ ID NO: 440569 - RNA, 64 nt, Homo Sapiens
auuauugacauuaaguaaugguaccauauauuuuuuaaaauacauauugacuugaauugugagg

SEQ ID NO: 440570 - RNA, 64 nt, Homo Sapiens
auuuaucucuuuguuguauuuuccaugauguuucuuaaaauagaaaguuuauuuagauucagaa

SEQ ID NO: 440571 - RNA, 64 nt, Homo Sapiens
aacacggcaugggaguaagguuauccuuagaaauuuaaaauaacuccacaguaaaauagguaga

SEQ ID NO: 440572 - RNA, 64 nt, Homo Sapiens
ucuaaguuuaugaauggcaugaaucacucauuuauuaaaauauaucagguuggagagugagaau

SEQ ID NO: 440573 - RNA, 64 nt, Homo Sapiens
acuugcugcaugacccuccaaguagaccuguggcuuaaaauaaagaaaaugcagcaaaaagaau

SEQ ID NO: 440574 - RNA, 64 nt, Homo Sapiens
acugaauguuugaauagaaaccucuacuaaauuauuaaaauagacauuuaguguucucacagcu

SEQ ID NO: 440575 - RNA, 64 nt, Homo Sapiens
aauuguacacauugauauuuaaugacaaauuuacuuaaaauaaauugaccccuuguucuuacuu

SEQ ID NO: 440576 - RNA, 64 nt, Homo Sapiens
ugaagcugcaaacuucuuuuuacucuaaucauuuuuaaaauacuaauggaagaacuuucuagca

SEQ ID NO: 440577 - RNA, 64 nt, Homo Sapiens
cucccacagaauuuucaagcccuuaagaguuuaguuaaaauaaaauuuuugaaauuauugucuu

SEQ ID NO: 440578 - RNA, 64 nt, Homo Sapiens
cuuuuaguguuucagauaaccucucaaaaagacuuuaaaauaaugcuauuacacaaagcugcau

SEQ ID NO: 440579 - RNA, 64 nt, Homo Sapiens
uaaaaaguauucuuuauucauauguauagaaugcuuaaaauagcacuguagacaagauguuucc

SEQ ID NO: 440580 - RNA, 64 nt, Homo Sapiens
aaaaaguagaaguaucaaauaaaaagggcaacuuuuaaaauauuaagccugaagacuucuaaaa

SEQ ID NO: 440581 - RNA, 64 nt, Homo Sapiens
uuuguuucaugagauucaaacuugaugcuaugcuuuaaaauaaacucaguacuuuuagaaacau

SEQ ID NO: 440582 - RNA, 64 nt, Homo Sapiens
aaaaggagguggaugcauccaaagcacgagucacuuaaaauaucgacgguaaacuacuauuuug

SEQ ID NO: 440583 - RNA, 64 nt, Homo Sapiens
aauuaccacaccagaucaauuuuaugcagaggccuuaaaauauucuuucacaguagcuuucuua

SEQ ID NO: 440584 - RNA, 64 nt, Homo Sapiens
guaaaaguuauacuuaacuugucugucuauuauuuuaaaauaugcauugaaauaaugugguaua

SEQ ID NO: 440585 - RNA, 64 nt, Homo Sapiens
uuucuucagaauauuuuuaaaagguacagaauccuuaaaauauuaacaacuaauugcauccauc

SEQ ID NO: 440586 - RNA, 64 nt, Homo Sapiens
uucacacaaagugaaauuaguauuuugagccuuauuaaaauauuuucuuaauuaugguaccucu

SEQ ID NO: 440587 - RNA, 64 nt, Homo Sapiens
cacugcaguuauuuaccagaaguuuaaaucuuuguuaaaauauaguguuguguuacaauaagug

SEQ ID NO: 440588 - RNA, 64 nt, Homo Sapiens
ccugccuugccuguuaggucuguugaagugcauguuaaaauaauuauaugaagcagaaugagau

SEQ ID NO: 440589 - RNA, 64 nt, Homo Sapiens
aacauagauauuuucuuucuccugaccauguauuuuaaaauauagucuauuucuugacuuugaa

SEQ ID NO: 440590 - RNA, 64 nt, Homo Sapiens
uuaaaaaugccauaacaaucuugcgagacuaacuuuaaaauauacuuuaaaugauuauuaugau

SEQ ID NO: 440591 - RNA, 64 nt, Homo Sapiens
uaccuugcacacaucaucuguaagcuguuugguuuuaaaauacuguagauaauuaaccaaggua

SEQ ID NO: 440592 - RNA, 64 nt, Homo Sapiens
acucaaccaaaugguacaaaaccacaguguaccauuaaaauaugcacuaagucucuuuuuuaca

SEQ ID NO: 440593 - RNA, 64 nt, Homo Sapiens
cucaugugugggcacacacgcaguuuucugugaauuaaaauaugcuuuuaaaggagggcauguu

SEQ ID NO: 440594 - RNA, 64 nt, Homo Sapiens
gauccuaggacagcaccucggaaaaucuuuugaguuaaaauaagaauuugucaguucauuccug

SEQ ID NO: 440595 - RNA, 64 nt, Homo Sapiens
uaguagaucacuaugguauuguacaauuguguuuuuaaaauaguuuagaguaaaacuauuuugu

SEQ ID NO: 440596 - RNA, 64 nt, Homo Sapiens
uuuucuugacucugagcuugcuggguauuuggguuuaaaauagagccacaaacuggacaagaag

SEQ ID NO: 440597 - RNA, 64 nt, Homo Sapiens; identical to SEQ ID NO: 440582

SEQ ID NO: 440598 - RNA, 64 nt, Homo Sapiens; identical to SEQ ID NO: 440583

SEQ ID NO: 440599 - RNA, 64 nt, Homo Sapiens
ucucuauauauuuuaauguauugcacauguauauuuaaaauauauacgaaagaacucuaaaucc

SEQ ID NO: 440600 - RNA, 64 nt, Homo Sapiens
uuucccuaacucugguccaccugcaaccuaggaguuaaaauaaguaucuugcuauguuaagagu

SEQ ID NO: 440601 - RNA, 64 nt, Homo Sapiens
uuucuucuuuguauacaguaacagaucucuuccuacaucuuauuauaugucauauguuauuaua

SEQ ID NO: 440602 - RNA, 64 nt, Homo Sapiens
aaaaauuacauaguuuuguuaguaagucauuuauacaucuuagaaagaaauauuuauuauuaaa

SEQ ID NO: 440603 - RNA, 64 nt, Homo Sapiens
augccuuaagucaaugcacucagcaaggagaagcacaucuuauuuaucuuguuaccuauaguuu

SEQ ID NO: 440604 - RNA, 64 nt, Homo Sapiens
ggugauuggaggggaaugacuuaguuaugacuggacaucuuaaaagcugauagacaagccaaau

SEQ ID NO: 440605 - RNA, 64 nt, Homo Sapiens
cuacucuuguauucucauggcuggagggcggauaacaucuuauagccucuaguuuuguaagcuc

SEQ ID NO: 440606 - RNA, 64 nt, Homo Sapiens
ucugccucuaguuuuguaagccugagucacauguacaucuuauuuuugugugugucacaugcug

SEQ ID NO: 440607 - RNA, 64 nt, Homo Sapiens
uuuguuauaaaaucucacaaacgauauuguacuaacaucuuaauaccgcgcccggcggcgaaac

SEQ ID NO: 440608 - RNA, 64 nt, Homo Sapiens
gcauucaccuucuuggagcuuuuuuaaaaaacacacaucuuaugcaccaggcccgagaaaugcu

SEQ ID NO: 440609 - RNA, 64 nt, Homo Sapiens
acagauccaagguaacuggguaggaaaucuuuugacaucuuaacucauguugaguuugugcugu

SEQ ID NO: 440610 - RNA, 64 nt, Homo Sapiens
uaucagguaaacugucacuuaaauggagguguccacaucuuaauuguuucuccuugacacauuu

SEQ ID NO: 440611 - RNA, 64 nt, Homo Sapiens
aaaaaaauauuuuaaaaaacacuuuugauuauuaacaucuuaugaauguagauuuuuauuuucu

SEQ ID NO: 440612 - RNA, 64 nt, Homo Sapiens
cuaaugaaauguagauuuuuugguauccaugauaacaucuuauuggggagaguaucaugggaga

SEQ ID NO: 440613 - RNA, 64 nt, Homo Sapiens
guauuuacaaguuuauuuauaugugauauuuuguacaucuuacuaaucuuggcauccuaucacu

SEQ ID NO: 440614 - RNA, 64 nt, Homo Sapiens
gucaagcucauuaaguuaacaauugguggaaaucacaucuuaauggcuaucuggggcaggcaca

SEQ ID NO: 440615 - RNA, 64 nt, Homo Sapiens
cuuccagagaacacguuggcucaguccugggucaacaucuuagacccgguccugcccuuccuga

SEQ ID NO: 440616 - RNA, 64 nt, Homo Sapiens
ugaccuggcuggugacagaacaugcagcaaggggacaucuuaggcuggccagacuucagcuguu

SEQ ID NO: 440617 - RNA, 64 nt, Homo Sapiens
cuagcaauaugugccacaacaugacagucuugugacaucuuaaggaaaagaagaguuccuguua

SEQ ID NO: 440618 - RNA, 62 nt, Homo Sapiens
uuuuacaggggauuaugauuaaaagugauuuaguacaucuuacaugauaucucauuucuacg

SEQ ID NO: 440619 - RNA, 64 nt, Homo Sapiens; identical to SEQ ID NO: 125388

SEQ ID NO: 440620 - RNA, 64 nt, Homo Sapiens; identical to SEQ ID NO: 125389

SEQ ID NO: 440621 - RNA, 64 nt, Homo Sapiens; identical to SEQ ID NO: 125390

SEQ ID NO: 440622 - RNA, 64 nt, Homo Sapiens; identical to SEQ ID NO: 125391

SEQ ID NO: 440623 - RNA, 64 nt, Homo Sapiens; identical to SEQ ID NO: 125392

SEQ ID NO: 440624 - RNA, 64 nt, Homo Sapiens; identical to SEQ ID NO: 125393

SEQ ID NO: 440625 - RNA, 64 nt, Homo Sapiens; identical to SEQ ID NO: 125394

SEQ ID NO: 440626 - RNA, 64 nt, Homo Sapiens; identical to SEQ ID NO: 125395

SEQ ID NO: 440627 - RNA, 64 nt, Homo Sapiens; identical to SEQ ID NO: 125396

SEQ ID NO: 440628 - RNA, 64 nt, Homo Sapiens; identical to SEQ ID NO: 125397

SEQ ID NO: 440629 - RNA, 64 nt, Homo Sapiens; identical to SEQ ID NO: 125398

SEQ ID NO: 440630 - RNA, 64 nt, Homo Sapiens; identical to SEQ ID NO: 125399

SEQ ID NO: 440631 - RNA, 64 nt, Homo Sapiens; identical to SEQ ID NO: 125400

SEQ ID NO: 440632 - RNA, 64 nt, Homo Sapiens; identical to SEQ ID NO: 125401

SEQ ID NO: 440633 - RNA, 64 nt, Homo Sapiens; identical to SEQ ID NO: 309634

SEQ ID NO: 440634 - RNA, 64 nt, Homo Sapiens; identical to SEQ ID NO: 309635

SEQ ID NO: 440635 - RNA, 64 nt, Homo Sapiens; identical to SEQ ID NO: 309636

SEQ ID NO: 440636 - RNA, 64 nt, Homo Sapiens; identical to SEQ ID NO: 309637

SEQ ID NO: 440637 - RNA, 64 nt, Homo Sapiens; identical to SEQ ID NO: 309638

SEQ ID NO: 440638 - RNA, 64 nt, Homo Sapiens; identical to SEQ ID NO: 309639

SEQ ID NO: 440639 - RNA, 64 nt, Homo Sapiens; identical to SEQ ID NO: 309640

SEQ ID NO: 440640 - RNA, 64 nt, Homo Sapiens; identical to SEQ ID NO: 309641

SEQ ID NO: 440641 - RNA, 64 nt, Homo Sapiens; identical to SEQ ID NO: 309642

SEQ ID NO: 440642 - RNA, 64 nt, Homo Sapiens; identical to SEQ ID NO: 309643

SEQ ID NO: 440643 - RNA, 64 nt, Homo Sapiens; identical to SEQ ID NO: 309644

SEQ ID NO: 440644 - RNA, 64 nt, Homo Sapiens; identical to SEQ ID NO: 309645

SEQ ID NO: 440645 - RNA, 64 nt, Homo Sapiens; identical to SEQ ID NO: 309646

SEQ ID NO: 440646 - RNA, 64 nt, Homo Sapiens; identical to SEQ ID NO: 309647

SEQ ID NO: 440647 - RNA, 64 nt, Homo Sapiens; identical to SEQ ID NO: 309648

SEQ ID NO: 440648 - RNA, 64 nt, Homo Sapiens; identical to SEQ ID NO: 309649

SEQ ID NO: 440649 - RNA, 64 nt, Homo Sapiens; identical to SEQ ID NO: 309650

SEQ ID NO: 440650 - RNA, 64 nt, Homo Sapiens; identical to SEQ ID NO: 309651

SEQ ID NO: 440651 - RNA, 64 nt, Homo Sapiens; identical to SEQ ID NO: 309652

SEQ ID NO: 440652 - RNA, 64 nt, Homo Sapiens; identical to SEQ ID NO: 309653

SEQ ID NO: 440653 - RNA, 64 nt, Homo Sapiens; identical to SEQ ID NO: 309654

SEQ ID NO: 440654 - RNA, 64 nt, Homo Sapiens; identical to SEQ ID NO: 309655

SEQ ID NO: 440655 - RNA, 64 nt, Homo Sapiens; identical to SEQ ID NO: 309656

SEQ ID NO: 440656 - RNA, 64 nt, Homo Sapiens; identical to SEQ ID NO: 309657

SEQ ID NO: 440657 - RNA, 64 nt, Homo Sapiens; identical to SEQ ID NO: 309658

SEQ ID NO: 440658 - RNA, 64 nt, Homo Sapiens; identical to SEQ ID NO: 309659

SEQ ID NO: 440659 - RNA, 64 nt, Homo Sapiens; identical to SEQ ID NO: 309660

SEQ ID NO: 440660 - RNA, 64 nt, Homo Sapiens; identical to SEQ ID NO: 309661

SEQ ID NO: 440661 - RNA, 64 nt, Homo Sapiens; identical to SEQ ID NO: 309662

SEQ ID NO: 440662 - RNA, 64 nt, Homo Sapiens; identical to SEQ ID NO: 309663

SEQ ID NO: 440663 - RNA, 64 nt, Homo Sapiens; identical to SEQ ID NO: 309664

SEQ ID NO: 440664 - RNA, 64 nt, Homo Sapiens; identical to SEQ ID NO: 309665

SEQ ID NO: 440665 - RNA, 64 nt, Homo Sapiens; identical to SEQ ID NO: 309666

SEQ ID NO: 440666 - RNA, 64 nt, Homo Sapiens; identical to SEQ ID NO: 309667

SEQ ID NO: 440667 - RNA, 64 nt, Homo Sapiens; identical to SEQ ID NO: 309668

SEQ ID NO: 440668 - RNA, 64 nt, Homo Sapiens; identical to SEQ ID NO: 309669

SEQ ID NO: 440669 - RNA, 64 nt, Homo Sapiens
accauaaauuugcaugaauucucccuggccuggauacauuaauaaucccgauuugaacaaugua

SEQ ID NO: 440670 - RNA, 64 nt, Homo Sapiens
cuucagggcugucucaggccaccuggccgcacuguacauuaagcauccugcgugcagugccagg

SEQ ID NO: 440671 - RNA, 64 nt, Homo Sapiens
aguauaugugucuuaaugcagaugguuuuuuuuuuacauuaaaggugcauuuaguuccgcauau

SEQ ID NO: 440672 - RNA, 64 nt, Homo Sapiens
cuuauauuuuacauaauguaugaccuugagaauguacauuaauugugcauuuugucacugaauc

SEQ ID NO: 440673 - RNA, 64 nt, Homo Sapiens
acagagaaaaaaaaugcaaaauuuauaauagaguuacauuaaccuuguuguuuaccuuucacug

SEQ ID NO: 440674 - RNA, 64 nt, Homo Sapiens
acauugagugcauuaaauaacaaauuaucuuugauacauuaaacuuuuauucuucaugcaucug

SEQ ID NO: 440675 - RNA, 64 nt, Homo Sapiens
uaaaaaaacaaaaauguacauauauccuguucuguacauuaaauggugaagaaaaauuuuacag

SEQ ID NO: 440676 - RNA, 64 nt, Homo Sapiens
cuuuccuguaggaugucucaauuuguucauuaauuacauuaauuuuuuucucauuuacuucuua

SEQ ID NO: 440677 - RNA, 64 nt, Homo Sapiens
uuuuaugucuagaguagguccugaaguuuggcuuuacauuaaguuuagcacuguaucagaauga

SEQ ID NO: 440678 - RNA, 64 nt, Homo Sapiens
guaguugcauauaaucuaugcacauccuccuguauacauuaagucaucucuagauuauuuauaa

SEQ ID NO: 440679 - RNA, 64 nt, Homo Sapiens
uacugccuaugggcugugauguauauagaaguuguacauuaaacauacccucauuuuuuucuuu

SEQ ID NO: 440680 - RNA, 64 nt, Homo Sapiens
aaucuuuauauguuccacauguuaagaauaaauguacauuaaaucuuguuaagcacugugaugg

SEQ ID NO: 440681 - RNA, 64 nt, Homo Sapiens
gugauaucugugucuguauugacuugucuuguguuacauuaaacaguaggcagaacugaggucu

SEQ ID NO: 440682 - RNA, 64 nt, Homo Sapiens
ccuguccaugucuaauaaguaaaaacugauagaauacauuaaaaagucacugguuuaucauaga

SEQ ID NO: 440683 - RNA, 64 nt, Homo Sapiens
ucuucacaucugccuuaaaagugcuauguagagauacauuaacagaguuauaauaaaacagugu

SEQ ID NO: 440684 - RNA, 64 nt, Homo Sapiens
guacaauaugcauuuucagucuggugugucauuauacauuaauuaccuauggagguuucucaca

SEQ ID NO: 440685 - RNA, 64 nt, Homo Sapiens
ucauuugauagguauaaaguauucuaaacagcacuacauuaauaguaauucauauaguaagagu

SEQ ID NO: 440686 - RNA, 64 nt, Homo Sapiens
cuuugcccagucaauucagugauugauagcaauuuacauuaauugcaguaaagcucuuuggauu

SEQ ID NO: 440687 - RNA, 64 nt, Homo Sapiens
cucaaccucaucauacgcugauuuaauauuguuuuacauuaaaauaguccuuuucccuguugug

SEQ ID NO: 440688 - RNA, 64 nt, Homo Sapiens
uccaaggcuccuuagauugggucguuacuaaaaguacauuaaaacacucuuguuuaucgaagua

SEQ ID NO: 440689 - RNA, 64 nt, Homo Sapiens
aaacacacuguauuuuacaagucaaaauauaauuuacauuaaucacuauguuaaugaguaugua

SEQ ID NO: 440690 - RNA, 64 nt, Homo Sapiens
aaaauauauuggcuuuuguuuucaaugugaaagauacauuaaauggacacauaucuugcaaaau

SEQ ID NO: 440691 - RNA, 64 nt, Homo Sapiens
cuaaaguuaugcaaacacacaguuccccauuuacuacauuaaugcccuugacagggaguagcug

SEQ ID NO: 440692 - RNA, 64 nt, Homo Sapiens
cuacaguuuaauacaaaaugaauugcgguuuuauuacauuaauaaccuuucaccucaggguuuu

SEQ ID NO: 440693 - RNA, 64 nt, Homo Sapiens
ucaggaaguuaaaauaucucuacacguauauuuuuacauuaaaaauacaguguuagcauaaauc

SEQ ID NO: 440694 - RNA, 64 nt, Homo Sapiens
uugauucauacuuaaaccugaaagcaggaaugccuacauuaauuccuacauuaaaaacagccau

SEQ ID NO: 440695 - RNA, 64 nt, Homo Sapiens
uaaaccugaaagcaggaaugccuacauuaauuccuacauuaaaaacagccaucuacccuugauu

SEQ ID NO: 440696 - RNA, 64 nt, Homo Sapiens
uuuugccuugucuggcauguuuguuuuaaaugaauacauuaaugggguuuuuauccuuuugaau

SEQ ID NO: 440697 - RNA, 64 nt, Homo Sapiens
uuuuuauaaaguaccaguguuuagcugcuuuuuauacauuaaauuagcaauuugaaaaacucaa

SEQ ID NO: 440698 - RNA, 64 nt, Homo Sapiens
gguugauuuggggaggaaaauuucccuuuuagaauacauuaaaucuauguaaugguggucauuu

SEQ ID NO: 440699 - RNA, 64 nt, Homo Sapiens
uucauguucauggaacugaaaaaguauaaugcaguacauuaauagaccacagaaguggaauuug

SEQ ID NO: 440700 - RNA, 64 nt, Homo Sapiens
ugcaagagagagagaagccuuuagcacuguucacuacauuaacaaauugcacaaucucuggcua

SEQ ID NO: 440701 - RNA, 64 nt, Homo Sapiens
gcuggggaggagggaaaagcggcugugugucuccuacauuaacacauugagacuguccugguua

SEQ ID NO: 440702 - RNA, 64 nt, Homo Sapiens
gcggcgccaccgagcccggcaaaugcgcacgaccuacauuaauuuaugcagagacagcuguuug

SEQ ID NO: 440703 - RNA, 64 nt, Homo Sapiens
uuuugugucugugaacauaggugugcuucccaaauacauuaacaagcucuuacuucccccuaac

SEQ ID NO: 440704 - RNA, 64 nt, Homo Sapiens
uuccuuuuauauaaagaguuuacccauuaagacuuacauuaacaguuucaguuacaaucaucuu

SEQ ID NO: 440705 - RNA, 64 nt, Homo Sapiens
auuagcaacccgaaaggaugcuacagggccagucuacauuaaaagcuuuaaggacaguuuugau

SEQ ID NO: 440706 - RNA, 62 nt, Homo Sapiens
aguaguaaggaagucaaauuuguuuuuuuaucauugauuauaagugguauauuuguuuuuug

SEQ ID NO: 440707 - RNA, 62 nt, Homo Sapiens
auugauuauaagugguauauuuguuuuuugucauugauuaaaagugauuuuagcccuaggcc

SEQ ID NO: 440708 - RNA, 62 nt, Homo Sapiens
uuaccccaauucuaaauagguaccaaaagaguauugauuaugaccuggagccugagcuuugg

SEQ ID NO: 440709 - RNA, 62 nt, Homo Sapiens
aggaagcuuaaguaaauuucugauuuuccuuuauugauuauguaacccacgugauuugcaua

SEQ ID NO: 440710 - RNA, 62 nt, Homo Sapiens
guuaaagugucaugccuugaccaaucuaaugaauugauuaauuaacugggccuuuauacuua

SEQ ID NO: 440711 - RNA, 62 nt, Homo Sapiens
uaggaaguuagucuaauaauucacugcagaaaauugauuaaguggcuguccuuuuaauuaag

SEQ ID NO: 440712 - RNA, 62 nt, Homo Sapiens
cuuuccuaaagaaaagccaugucauuaaaauaauugauuauauugaguccaugaaugcuaug

SEQ ID NO: 440713 - RNA, 62 nt, Homo Sapiens
uauaaaauucaguuuaaaaaaagacugaagacauugauuagaaacaaugcaaauucuucuuc

SEQ ID NO: 440714 - RNA, 62 nt, Homo Sapiens
uuaauaaucuuuugggaggguagaauaaaauaauugauuacuauugcugcauacccggggug

SEQ ID NO: 440715 - RNA, 62 nt, Homo Sapiens
gaacauuguguggguuuuguuuuguuuaauuuauugauuagucuuuaaaguaggcuuuuuuu

SEQ ID NO: 440716 - RNA, 62 nt, Homo Sapiens
aaguauuuuauauauaaccacuaaauuugauaauugauuaggaguauguuucauuauucuuu

SEQ ID NO: 440717 - RNA, 62 nt, Homo Sapiens
agcaaauaccugucuuaggggcuugcacauggauugauuaaacccuuaaaaugucuaguaaa

SEQ ID NO: 440718 - RNA, 62 nt, Homo Sapiens
ggacaaaaagucuggaaacuuucauaucaauaauugauuauguauuaacugaaacaaaagac

SEQ ID NO: 440719 - RNA, 62 nt, Homo Sapiens
gaaacaaaagacuagagaaagacacagugggaauugauuauguauuaacugaggaauaaaag

SEQ ID NO: 440720 - RNA, 62 nt, Homo Sapiens
ugacugugagauuccaaguguuuaguaaaaugauugauuaugugaaugaaaauaugcuugua

SEQ ID NO: 440721 - RNA, 62 nt, Homo Sapiens
acucagcuauaauccugagguauguuuuccuuauugauuacaauguucucuacauguuagga

SEQ ID NO: 440722 - RNA, 64 nt, Homo Sapiens
cgaucuccugaccucacgauuugcccgccucggcuucccagagugcugggauuacaggcgugag

SEQ ID NO: 440723 - RNA, 64 nt, Homo Sapiens
aacuccuggggucaaaugauccgccugcgucggcuucccagagugcugggauuacaggugucag

SEQ ID NO: 440724 - RNA, 64 nt, Homo Sapiens
gaaugagcucuuccugaacgugggcaccaaggacuucccagacggagagcuucgggggcacgug

SEQ ID NO: 440725 - RNA, 64 nt, Homo Sapiens
ugggccccggggcugccguuuugcugggcagugguucccagagagucagagcuggcaccccuca

SEQ ID NO: 440726 - RNA, 64 nt, Homo Sapiens
uggugaugcccaaagaggagagaggaagcucucuuucccagaugccccagcaaguguaaccuug

SEQ ID NO: 440727 - RNA, 64 nt, Homo Sapiens
aaacucuuaaugcuguguuugagcuuucaugaguuucccagagagacauagcuggaaaauuccu

SEQ ID NO: 440728 - RNA, 64 nt, Homo Sapiens
gguugcauggcggcugggcaaaggugcuccccacuucccagauggugcggcggcuggccagagg

SEQ ID NO: 440729 - RNA, 64 nt, Homo Sapiens
gauggugcggcggcuggccagaggcacucuucacuucccagacagaggggcggccgggcagagg

SEQ ID NO: 440730 - RNA, 64 nt, Homo Sapiens
gacagaggggcggccgggcagaggugcuccucacuucccagagggugcaggagccagcucugac

SEQ ID NO: 440731 - RNA, 64 nt, Homo Sapiens
uggacuauucucucuaaagcaagagagacuagcauucccagacaucauucuagggucuuuaagc

SEQ ID NO: 440732 - RNA, 64 nt, Homo Sapiens
guguuuuucaaaauaaguuuaugucaaauccagcuucccagaaacacuaauaauuaaguacauc

SEQ ID NO: 440733 - RNA, 64 nt, Homo Sapiens
cuagagauuugccucuaucuuccuuuccucagucuucccagacugcuaucaagcuguguaaaaa

SEQ ID NO: 440734 - RNA, 64 nt, Homo Sapiens
uuguucuuuauuuuacaggcaguuacugaggcucuucccagaucucaguaaacagccacucagc

SEQ ID NO: 440735 - RNA, 64 nt, Homo Sapiens
ccuugcacagggaaggcuugaggugagaagccgcuucccagacugucagggccaggccuggguc

SEQ ID NO: 440736 - RNA, 64 nt, Homo Sapiens
cagaggcccugggccaccacauuucuggcagcguuucccagacaccccucugcuaggccauccc

SEQ ID NO: 440737 - RNA, 64 nt, Homo Sapiens
cacagcugcaggggccaaguaugaccaagaccucuucccagaccaacauuucugcccaucccug

SEQ ID NO: 440738 - RNA, 64 nt, Homo Sapiens
gccccuucccucccaagcaguccacccugaaaaguucccagaaacagcuuuguccuauacucuc

SEQ ID NO: 440739 - RNA, 64 nt, Homo Sapiens
gggaaacugaggcagagaguuuguccagaaaaucuucccagauaaaaaaauauaguauuuucug

SEQ ID NO: 440740 - RNA, 64 nt, Homo Sapiens
uuuuuuccuuguggucauccagccuuugucauaguucccagaccucuuuuacuuggagcucucc

SEQ ID NO: 440741 - RNA, 64 nt, Homo Sapiens
cuuuuuucaguccagguguucuccuccuauucaguucccagaaucaaagcaaugcauuuuggaa

SEQ ID NO: 440742 - RNA, 64 nt, Homo Sapiens
agagagacuuucagcccuaaaucuagacucaagguucccagagaugacaaauggagaagaaagg

SEQ ID NO: 440743 - RNA, 64 nt, Homo Sapiens
acuagacagaaugaucauucuucccagaaaauguuucccagaaaaugaucauucccagaaacau

SEQ ID NO: 440744 - RNA, 64 nt, Homo Sapiens
auguuucccagaaaacuagaauucccagaaacauuucccagaaagaaaacaaggcagaaugauc

SEQ ID NO: 440745 - RNA, 64 nt, Homo Sapiens
cauuucccagaaaauguuucaggcagaaugaucauucccagaaagucugaauuuccagaaaaca

SEQ ID NO: 440746 - RNA, 64 nt, Homo Sapiens
gagacaagaaauccuagugguuagugucaggcaguucccagaaaacuuuuuuaaauacuacaaa

SEQ ID NO: 440747 - RNA, 64 nt, Homo Sapiens
uugcugcauuuagauuuugacaaugaaagaggcauucccagaauugauuaaaggggcugucucc

SEQ ID NO: 440748 - RNA, 64 nt, Homo Sapiens
uuucaaugcauugcauauuuuuaaaugugaauucuucccagaaauccagauuuuuuaaacuguu

SEQ ID NO: 440749 - RNA, 64 nt, Homo Sapiens
gcuggccuuagcaugugauccugaacaauaauauuucccagauacaaaguuauugcuguuggaa

SEQ ID NO: 440750 - RNA, 64 nt, Homo Sapiens
caccucccagagacggccacccagcgggucuggcuucccagaaaguuaacugaugauugugggg

SEQ ID NO: 440751 - RNA, 64 nt, Homo Sapiens
guaaaaugcacuuuuuguguguguugauccugguuucccagaucuguauuucaguguuuacaag

SEQ ID NO: 440752 - RNA, 64 nt, Homo Sapiens
gcccacccuucccaaagauugggagguuccgccguucccagaggcuccuccugcggugcuccca

SEQ ID NO: 440753 - RNA, 64 nt, Homo Sapiens
ccuucaugagacagugcucaugaagccagugcguuucccagaacgaacacuaggcggcaccguu

SEQ ID NO: 440754 - RNA, 64 nt, Homo Sapiens
guggguugcagguugggugcugcuguugugguccuucccagaaacugccaguagagggcagccu

SEQ ID NO: 440755 - RNA, 64 nt, Homo Sapiens
caaugcacugugaccucuggcuuccccagcagcuuucccagagaggcagaggggccuuccacag

SEQ ID NO: 440756 - RNA, 64 nt, Homo Sapiens
cgcuucucaccuaacugccuccuggauugucaucuucccagaugugucccauaguguccaggug

SEQ ID NO: 440757 - RNA, 64 nt, Homo Sapiens
uccucugucacuugcucuuucacucucucucucauucccagagagccacgggggagggaucacc

SEQ ID NO: 440758 - RNA, 64 nt, Homo Sapiens
gaggcagggcagguuugcaguaggcaguugcauauucccagacuuguguaagccagacccuucu

SEQ ID NO: 440759 - RNA, 64 nt, Homo Sapiens
cccuugcagcuagcaagguuaauagcagcugcauuucccagacucugaggacauggccucugag

SEQ ID NO: 440760 - RNA, 64 nt, Homo Sapiens
acacauuucugguuuauaaucacuugaaacuugguucccagaaauuaauaaaacuuaucugagu

SEQ ID NO: 440761 - RNA, 64 nt, Homo Sapiens
auauuuaaaugcaaaguuaccugugcccagcaguuucccagaaugagauuacaggugugagcca

SEQ ID NO: 440762 - RNA, 64 nt, Homo Sapiens
gccggcuggaacaguacaucagcuguacggagucuucccagaggggagcggucgcuggggcccc

SEQ ID NO: 440763 - RNA, 64 nt, Homo Sapiens
uuugggaggcugaggcgagaagccugggccuguauucccagagcguaacaccucauuacaccga

SEQ ID NO: 440764 - RNA, 64 nt, Homo Sapiens
aaccaguacccuugagccuuucaccagagacuguuucccagaaauucuauuagcuacugucaac

SEQ ID NO: 440765 - RNA, 64 nt, Homo Sapiens
uaccaacgaccauaccauauuuuucacaugaggcuucccagacccaagaaugugugagcaaaga

SEQ ID NO: 440766 - RNA, 64 nt, Homo Sapiens
ggaguggcuuuucugaaacaucugugcuuuuauuuucccagacuaaaccagucauuagaaaugg

SEQ ID NO: 440767 - RNA, 64 nt, Homo Sapiens
uucacgcuuaaacaaccaacgcuucagagcugcuuucccagaaacuuugaugauucuaugucca

SEQ ID NO: 440768 - RNA, 64 nt, Homo Sapiens; identical to SEQ ID NO: 104346

SEQ ID NO: 440769 - RNA, 64 nt, Homo Sapiens; identical to SEQ ID NO: 104347

SEQ ID NO: 440770 - RNA, 64 nt, Homo Sapiens; identical to SEQ ID NO: 104348

SEQ ID NO: 440771 - RNA, 64 nt, Homo Sapiens; identical to SEQ ID NO: 104349

SEQ ID NO: 440772 - RNA, 64 nt, Homo Sapiens; identical to SEQ ID NO: 104350

SEQ ID NO: 440773 - RNA, 64 nt, Homo Sapiens; identical to SEQ ID NO: 104351

SEQ ID NO: 440774 - RNA, 64 nt, Homo Sapiens; identical to SEQ ID NO: 104352

SEQ ID NO: 440775 - RNA, 64 nt, Homo Sapiens; identical to SEQ ID NO: 104353

SEQ ID NO: 440776 - RNA, 64 nt, Homo Sapiens; identical to SEQ ID NO: 104354

SEQ ID NO: 440777 - RNA, 64 nt, Homo Sapiens; identical to SEQ ID NO: 104355

SEQ ID NO: 440778 - RNA, 64 nt, Homo Sapiens; identical to SEQ ID NO: 104356

SEQ ID NO: 440779 - RNA, 64 nt, Homo Sapiens; identical to SEQ ID NO: 104357

SEQ ID NO: 440780 - RNA, 64 nt, Homo Sapiens; identical to SEQ ID NO: 104358

SEQ ID NO: 440781 - RNA, 64 nt, Homo Sapiens; identical to SEQ ID NO: 104359

SEQ ID NO: 440782 - RNA, 64 nt, Homo Sapiens; identical to SEQ ID NO: 104360

SEQ ID NO: 440783 - RNA, 64 nt, Homo Sapiens; identical to SEQ ID NO: 104361

SEQ ID NO: 440784 - RNA, 64 nt, Homo Sapiens; identical to SEQ ID NO: 104362

SEQ ID NO: 440785 - RNA, 64 nt, Homo Sapiens; identical to SEQ ID NO: 104363

SEQ ID NO: 440786 - RNA, 64 nt, Homo Sapiens; identical to SEQ ID NO: 104364

SEQ ID NO: 440787 - RNA, 64 nt, Homo Sapiens; identical to SEQ ID NO: 104365

SEQ ID NO: 440788 - RNA, 64 nt, Homo Sapiens; identical to SEQ ID NO: 104366

SEQ ID NO: 440789 - RNA, 64 nt, Homo Sapiens; identical to SEQ ID NO: 104367

SEQ ID NO: 440790 - RNA, 64 nt, Homo Sapiens; identical to SEQ ID NO: 104368

SEQ ID NO: 440791 - RNA, 64 nt, Homo Sapiens; identical to SEQ ID NO: 104369

SEQ ID NO: 440792 - RNA, 64 nt, Homo Sapiens; identical to SEQ ID NO: 104370

SEQ ID NO: 440793 - RNA, 64 nt, Homo Sapiens; identical to SEQ ID NO: 104371

SEQ ID NO: 440794 - RNA, 64 nt, Homo Sapiens; identical to SEQ ID NO: 104372

SEQ ID NO: 440795 - RNA, 64 nt, Homo Sapiens; identical to SEQ ID NO: 104373

SEQ ID NO: 440796 - RNA, 64 nt, Homo Sapiens; identical to SEQ ID NO: 104374

SEQ ID NO: 440797 - RNA, 64 nt, Homo Sapiens; identical to SEQ ID NO: 104375

SEQ ID NO: 440798 - RNA, 64 nt, Homo Sapiens; identical to SEQ ID NO: 104376

SEQ ID NO: 440799 - RNA, 64 nt, Homo Sapiens; identical to SEQ ID NO: 104377

SEQ ID NO: 440800 - RNA, 64 nt, Homo Sapiens; identical to SEQ ID NO: 104378

SEQ ID NO: 440801 - RNA, 64 nt, Homo Sapiens; identical to SEQ ID NO: 104379

SEQ ID NO: 440802 - RNA, 64 nt, Homo Sapiens; identical to SEQ ID NO: 104380

SEQ ID NO: 440803 - RNA, 64 nt, Homo Sapiens; identical to SEQ ID NO: 104381

SEQ ID NO: 440804 - RNA, 64 nt, Homo Sapiens; identical to SEQ ID NO: 104382

SEQ ID NO: 440805 - RNA, 64 nt, Homo Sapiens; identical to SEQ ID NO: 104383

SEQ ID NO: 440806 - RNA, 64 nt, Homo Sapiens; identical to SEQ ID NO: 104384

SEQ ID NO: 440807 - RNA, 64 nt, Homo Sapiens; identical to SEQ ID NO: 104385

SEQ ID NO: 440808 - RNA, 64 nt, Homo Sapiens; identical to SEQ ID NO: 104386

SEQ ID NO: 440809 - RNA, 64 nt, Homo Sapiens; identical to SEQ ID NO: 104387

SEQ ID NO: 440810 - RNA, 64 nt, Homo Sapiens; identical to SEQ ID NO: 104388

SEQ ID NO: 440811 - RNA, 64 nt, Homo Sapiens; identical to SEQ ID NO: 104389

SEQ ID NO: 440812 - RNA, 64 nt, Homo Sapiens; identical to SEQ ID NO: 104390

SEQ ID NO: 440813 - RNA, 64 nt, Homo Sapiens; identical to SEQ ID NO: 104391

SEQ ID NO: 440814 - RNA, 64 nt, Homo Sapiens; identical to SEQ ID NO: 104392

SEQ ID NO: 440815 - RNA, 64 nt, Homo Sapiens; identical to SEQ ID NO: 104393

SEQ ID NO: 440816 - RNA, 64 nt, Homo Sapiens; identical to SEQ ID NO: 104394

SEQ ID NO: 440817 - RNA, 64 nt, Homo Sapiens; identical to SEQ ID NO: 104395

SEQ ID NO: 440818 - RNA, 64 nt, Homo Sapiens; identical to SEQ ID NO: 104396

SEQ ID NO: 440819 - RNA, 64 nt, Homo Sapiens; identical to SEQ ID NO: 104397

SEQ ID NO: 440820 - RNA, 64 nt, Homo Sapiens; identical to SEQ ID NO: 104398

SEQ ID NO: 440821 - RNA, 64 nt, Homo Sapiens; identical to SEQ ID NO: 104399

SEQ ID NO: 440822 - RNA, 64 nt, Homo Sapiens; identical to SEQ ID NO: 104400

SEQ ID NO: 440823 - RNA, 64 nt, Homo Sapiens; identical to SEQ ID NO: 104401

SEQ ID NO: 440824 - RNA, 64 nt, Homo Sapiens; identical to SEQ ID NO: 104402

SEQ ID NO: 440825 - RNA, 64 nt, Homo Sapiens; identical to SEQ ID NO: 104403

SEQ ID NO: 440826 - RNA, 64 nt, Homo Sapiens; identical to SEQ ID NO: 104404

SEQ ID NO: 440827 - RNA, 64 nt, Homo Sapiens; identical to SEQ ID NO: 104405

SEQ ID NO: 440828 - RNA, 64 nt, Homo Sapiens; identical to SEQ ID NO: 104406

SEQ ID NO: 440829 - RNA, 64 nt, Homo Sapiens; identical to SEQ ID NO: 104407

SEQ ID NO: 440830 - RNA, 64 nt, Homo Sapiens; identical to SEQ ID NO: 104408

SEQ ID NO: 440831 - RNA, 64 nt, Homo Sapiens; identical to SEQ ID NO: 104409

SEQ ID NO: 440832 - RNA, 64 nt, Homo Sapiens; identical to SEQ ID NO: 104410

SEQ ID NO: 440833 - RNA, 64 nt, Homo Sapiens; identical to SEQ ID NO: 104411

SEQ ID NO: 440834 - RNA, 64 nt, Homo Sapiens; identical to SEQ ID NO: 104412

SEQ ID NO: 440835 - RNA, 64 nt, Homo Sapiens; identical to SEQ ID NO: 104413

SEQ ID NO: 440836 - RNA, 64 nt, Homo Sapiens; identical to SEQ ID NO: 104414

SEQ ID NO: 440837 - RNA, 64 nt, Homo Sapiens; identical to SEQ ID NO: 104415

SEQ ID NO: 440838 - RNA, 64 nt, Homo Sapiens; identical to SEQ ID NO: 104416

SEQ ID NO: 440839 - RNA, 64 nt, Homo Sapiens; identical to SEQ ID NO: 104417

SEQ ID NO: 440840 - RNA, 64 nt, Homo Sapiens; identical to SEQ ID NO: 104418

SEQ ID NO: 440841 - RNA, 64 nt, Homo Sapiens; identical to SEQ ID NO: 104419

SEQ ID NO: 440842 - RNA, 64 nt, Homo Sapiens; identical to SEQ ID NO: 104420

SEQ ID NO: 440843 - RNA, 64 nt, Homo Sapiens; identical to SEQ ID NO: 104421

SEQ ID NO: 440844 - RNA, 64 nt, Homo Sapiens; identical to SEQ ID NO: 104422

SEQ ID NO: 440845 - RNA, 64 nt, Homo Sapiens; identical to SEQ ID NO: 104423

SEQ ID NO: 440846 - RNA, 64 nt, Homo Sapiens; identical to SEQ ID NO: 104424

SEQ ID NO: 440847 - RNA, 64 nt, Homo Sapiens; identical to SEQ ID NO: 104425

SEQ ID NO: 440848 - RNA, 64 nt, Homo Sapiens
acuuagaguuccacgguuuguucuaaauacuaugcaauaauauauuuccuucucauauugauua

SEQ ID NO: 440849 - RNA, 64 nt, Homo Sapiens
aagguccuugacuauguguauucuuauaaagcaacaauaauauugcacuuuauugcacuuucaa

SEQ ID NO: 440850 - RNA, 64 nt, Homo Sapiens
auuauuuccuacucgccacucuauaaaaucauggcaauaauagaagauuaugaaggauuucuau

SEQ ID NO: 440851 - RNA, 64 nt, Homo Sapiens
aauccaggauaagaacccauuauacagaaguguucaauaauaucaauuuugcaacucacucagc

SEQ ID NO: 440852 - RNA, 64 nt, Homo Sapiens
aaagauagguuaaaguauuugacaaaagugaauacaauaauaacacuugugucaaaaugauaua

SEQ ID NO: 440853 - RNA, 64 nt, Homo Sapiens
agcuuuccuucagaaaacucugaaguuauauuugcaauaauaaugaaaccagcauuuaguacca

SEQ ID NO: 440854 - RNA, 64 nt, Homo Sapiens
cccuauuuauuuucuuguucacaguaaugcaugucaauaauaaauguuuccccuuacugauaag

SEQ ID NO: 440855 - RNA, 64 nt, Homo Sapiens
guguagcaaauauagauugagcuauguuaguuugcaauaauauauguuaacuuuaguaauuaaa

SEQ ID NO: 440856 - RNA, 64 nt, Homo Sapiens
cauaaaauaacuucccauagagaacaggauauagcaauaauagcuccuuagauacucaguggcu

SEQ ID NO: 440857 - RNA, 64 nt, Homo Sapiens
aaaauauucccagguuaaaauuuuuuuaaaguaccaauaauagagcuaaauacaaugacauuug

SEQ ID NO: 440858 - RNA, 64 nt, Homo Sapiens
uuagucaaguaauggcuuuugaaaaaguaaaguucaauaauaacuaaggcugugauuuuuuuca

SEQ ID NO: 440859 - RNA, 64 nt, Homo Sapiens
uacaagggcugugcuaugcuaccauauucuuguucaauaauaauagguuuguuguuuuuuuuac

SEQ ID NO: 440860 - RNA, 64 nt, Homo Sapiens
ucccuaagccuguggcccaacaaagaaaacgacuuuccuucauuacuuuggccaggauuuccuu

SEQ ID NO: 440861 - RNA, 64 nt, Homo Sapiens
gaaaacgacuuuccuucauuacuuuggccaggauuuccuucaaauaauggugcccacuuucucg

SEQ ID NO: 440862 - RNA, 64 nt, Homo Sapiens
uuccauuucgccccucauuuuaccugaccaacaguuccuucagcagugcaucugggaagauuuc

SEQ ID NO: 440863 - RNA, 64 nt, Homo Sapiens
gcaucugggaagauuucuacaacaugaaguguguuuccuucaguugguggcaccuccuacguca

SEQ ID NO: 440864 - RNA, 64 nt, Homo Sapiens
auucccgaaagaagggaauuucuuuuucugggguuuccuucaaacucuuggcuccaccuagcgg

SEQ ID NO: 440865 - RNA, 64 nt, Homo Sapiens
ucuucuucucuuagcuaagccccaaaaugaagauuuccuucagaagucuuguuagcagaauuau

SEQ ID NO: 440866 - RNA, 64 nt, Homo Sapiens
ugagggcucaaaacuccuggaccacguggccauuuuccuucaacucacuguugccugcaaggac

SEQ ID NO: 440867 - RNA, 64 nt, Homo Sapiens
aaauaaauguacuucauuguucugcggcaaaaacuuccuucaaaacagucccaaguucaauauu

SEQ ID NO: 440868 - RNA, 64 nt, Homo Sapiens
auccuggaagagccuuuugccucuccaucuaaaguuccuucaucccaggaagauccaggauaau

SEQ ID NO: 440869 - RNA, 64 nt, Homo Sapiens
cuguuuaucuuuaaaacaaaaagauuuauuaaauuuccuucaaacuccuuugcagagccaaaac

SEQ ID NO: 440870 - RNA, 64 nt, Homo Sapiens
aucugaccugaaaagcacucguaacuauugugucuuccuucacucuuacagcuuauugauuuag

SEQ ID NO: 440871 - RNA, 64 nt, Homo Sapiens
uucuacggaaugacaguauacaagacaaaaacaguuccuucagaguaauuaauaagaacugaua

SEQ ID NO: 440872 - RNA, 64 nt, Homo Sapiens
uugcugauugcuuauacaaagcuggaggagagguuuccuucagauuuccaagaguuuagguugu

SEQ ID NO: 440873 - RNA, 64 nt, Homo Sapiens
ugccuaaaauuacuaaugcaccacgucagucugcuuccuucaggcaucauucucaauucaucag

SEQ ID NO: 440874 - RNA, 64 nt, Homo Sapiens
cacccaaauagcugagugcaguccuugcucauauuuccuucaucuuaaccccgcaaacaagaau

SEQ ID NO: 440875 - RNA, 64 nt, Homo Sapiens
uguuuaccuuguuucaggggugggagaaacuccuuuccuucagcuggcauuugaauguuuccaa

SEQ ID NO: 440876 - RNA, 64 nt, Homo Sapiens
ccaauuuccagagccacuaucucugcuguccacuuuccuucaggcucugugaauacuucaaccu

SEQ ID NO: 440877 - RNA, 64 nt, Homo Sapiens
caaugucaccaaauuuucagaguucuaaacuccuuuccuucaagccggaauuuuccuuuuuuca

SEQ ID NO: 440878 - RNA, 64 nt, Homo Sapiens
gucacgaacccguuacauuucaggacgauccuuuuuccuucagcagcauuucuuacuggcugug

SEQ ID NO: 440879 - RNA, 64 nt, Homo Sapiens
gggaaauuguuacggaagcuuuucacuggaacauuuccuucauauucccuuuugauauguuuac

SEQ ID NO: 440880 - RNA, 64 nt, Homo Sapiens
cacucccuaucaccaacauauuuugguuaguauauuccuucauauuaaaaugacuuuuugucag

SEQ ID NO: 440881 - RNA, 64 nt, Homo Sapiens
cuugcuucuggaucuguucuuuuuuuaaaaaaacuuccuucaccgcgccuauaauccuagcacu

SEQ ID NO: 440882 - RNA, 64 nt, Homo Sapiens
agcaagacucugucucaaaaacaagcaaacagacuuccuucaacaaauauuuauuaaauaucca

SEQ ID NO: 440883 - RNA, 64 nt, Homo Sapiens
accaguacagcuugacagcucccggcaccaucccuuccuucaucugacuuauugaacuuuuaca

SEQ ID NO: 440884 - RNA, 64 nt, Homo Sapiens
aggccuuggacucuucccugaggguugccugagauuccuucaugcuuucuauucaggacuaagu

SEQ ID NO: 440885 - RNA, 64 nt, Homo Sapiens
cucucuuccuucccuccuuccuuuccuuccuacuuuccuucauuucagaguaaaugguucccuu

SEQ ID NO: 440886 - RNA, 64 nt, Homo Sapiens
acaugcccugcauuuuuuaucuacugugcccaguuuccuucacuacuguuuguuucuaaaaauc

SEQ ID NO: 440887 - RNA, 64 nt, Homo Sapiens
uaauucuauccacagucaaaugucuaugacuuauuuccuucacuagaugugauaauucuaagag

SEQ ID NO: 440888 - RNA, 64 nt, Homo Sapiens
ugaugaguuaaugugcaaccucaacucaaaagaguuccuucaaauuuaaacauagaaaguuucu

SEQ ID NO: 440889 - RNA, 64 nt, Homo Sapiens
aaaaaaaaucucuuaaaguugccauuuugauuuguuccuucauuacuccaucugauuuuucuga

SEQ ID NO: 440890 - RNA, 64 nt, Homo Sapiens
ugugaaaagugucuuuuuggacagaacuuucaaguuccuucaacaaccauuaggacucacuggg

SEQ ID NO: 440891 - RNA, 64 nt, Homo Sapiens
aggagccaaguucuaguaguuucaguucuaggcuuuccuucaagaacagucagaucacaaagug

SEQ ID NO: 440892 - RNA, 64 nt, Homo Sapiens
cuaugacgcauaagcuagcaugccuaugauuuauuuccuucaugaauuugucacuggaucagca

SEQ ID NO: 440893 - RNA, 64 nt, Homo Sapiens
augaauagucaguauuuuaaaguugguugcuauuuuccuucauuauguuuauugugucuaaaag

SEQ ID NO: 440894 - RNA, 64 nt, Homo Sapiens
guugugauuuuugggaaaauucagcaacuaagucuuccuucaaaguuccaggauauaauugaag

SEQ ID NO: 440895 - RNA, 64 nt, Homo Sapiens
ucuuuuguagaacuuaacacuacaagcggaagccuuccuucaacaacaccgaugucuccaucgg

SEQ ID NO: 440896 - RNA, 64 nt, Homo Sapiens
caaaaacgcuaacauugaaaaaguaugucagauuuuccuucauguuucugguuauaagaagcau

SEQ ID NO: 440897 - RNA, 64 nt, Homo Sapiens
auaaugacucgagcaggaaagcaguagaagaggauuccuucaccacaguuucaccuuuacgcug

SEQ ID NO: 440898 - RNA, 64 nt, Homo Sapiens
uaccuccccccccaaaaaaaaaauucaguaggaauuccuucauagaauaacauguuauuuauug

SEQ ID NO: 440899 - RNA, 64 nt, Homo Sapiens
auuuaucauuucauagucauuucacuauuuuuuuuuccuucaccgaaccuuucuccagucuucc

SEQ ID NO: 440900 - RNA, 64 nt, Homo Sapiens
auuuuuuuuuccuucaccauaccuuucuccagucuuccuucacuacuguuaugaagccagauga

SEQ ID NO: 440901 - RNA, 64 nt, Homo Sapiens
auacuacacuuuacaaacaauguuaacacugugauuccuucauuguuuuaagaaguuaaccuag

SEQ ID NO: 440902 - RNA, 64 nt, Homo Sapiens
caaauauuacagggagucaaaugcuuuuauaaaguuccuucagugguugccucacuugcguuuu

SEQ ID NO: 440903 - RNA, 62 nt, Homo Sapiens
aauguacuacugaugaguaaacuugcauucacuuccuucaaaccaucuaauuuucuccugaa

SEQ ID NO: 440904 - RNA, 64 nt, Homo Sapiens
aaugacaggauuaugaguauacaguguaugccuuuuccuucaugcagaauuuugaaauguuuuc

SEQ ID NO: 440905 - RNA, 64 nt, Homo Sapiens
uucuuaaaaaagaaaaaaaauuccucaaguuacuuuccuucauuaaaaguauucaguaugccuu

SEQ ID NO: 440906 - RNA, 64 nt, Homo Sapiens
guugaaggaaaaaaaguuugacuuuuuaguuuuguuccuucaaaagucuacucuaggauuuuca

SEQ ID NO: 440907 - RNA, 64 nt, Homo Sapiens
cuugcuuugcuuuaucaguucauuccagcucccuguuagugaaggacacugcuguuagugaagg

SEQ ID NO: 440908 - RNA, 64 nt, Homo Sapiens
ucauuccagcucccuguuagugaaggacacugcuguuagugaaggaacaaagucuaugaguccu

SEQ ID NO: 440909 - RNA, 64 nt, Homo Sapiens
auuuuuguuuguuguuuucaguuuuuuuguuguuguuagugagucucccuucaaaauacgcagu

SEQ ID NO: 440910 - RNA, 64 nt, Homo Sapiens
uaacuuaucaggcaucucaaugguuacuaucuauguuagugaaaaucaaauaggacucaaaguu

SEQ ID NO: 440911 - RNA, 64 nt, Homo Sapiens
auuuuuguuugugguuuucaguuuuuuuguuguuguuagugagucucccuucaaaauacacagu

SEQ ID NO: 440912 - RNA, 64 nt, Homo Sapiens; identical to SEQ ID NO: 440910

SEQ ID NO: 440913 - RNA, 64 nt, Homo Sapiens
agcuuucugcauuuaauagguuagaauguaaauuaaaguguagcaauagcaacaaaauauuuau

SEQ ID NO: 440914 - RNA, 64 nt, Homo Sapiens
ugcaguuguacaauuuuauuuuuuucugcaagaaaaaguguaauguaugaaauaaaccaaaguc

SEQ ID NO: 440915 - RNA, 64 nt, Homo Sapiens
ugaaagaaaacaaaaccuguccucagaauucuauaaaguguauuaagaauguuccuuaaagguu

SEQ ID NO: 440916 - RNA, 64 nt, Homo Sapiens
auuaaagcuuaaugugcuuucuuaaagaaugccaaaaguguaauaaggucauaacugcauuuau

SEQ ID NO: 440917 - RNA, 64 nt, Homo Sapiens
ggcacagguuacucaugaugcaauaacggauuguaaaguguaaaaucauacuuuuaacagcaac

SEQ ID NO: 440918 - RNA, 64 nt, Homo Sapiens
cauacuuaguuuuuuuuucuugugcguguuuggaaaaguguauuauuccauuguaagcugugua

SEQ ID NO: 440919 - RNA, 64 nt, Homo Sapiens
auaacagugugguaguuaaucuuauuguacguuuaaaguguauuaccucaaauuuaaaggcuac

SEQ ID NO: 440920 - RNA, 64 nt, Homo Sapiens
auaugcaaacauaacaaaauuguaaauuaccaguaaaguguaaccagggccuuaaaagccauca

SEQ ID NO: 440921 - RNA, 64 nt, Homo Sapiens
uggaaauaaagucagauggaguuuuuuaaaaaagaaaguguauuuccucaaagaaaguguauug

SEQ ID NO: 440922 - RNA, 64 nt, Homo Sapiens
gguuuuuuaaaaaagaaaguugucauccucaaagaaaguguauuauaauuggauuuccuaauac

SEQ ID NO: 440923 - RNA, 64 nt, Homo Sapiens
auguguuggcguauguauacaacugcacguaucaaaaguguacagguguacuugacacccaaua

SEQ ID NO: 440924 - RNA, 64 nt, Homo Sapiens
uaauauuucaagcugaaaauaaaguauuuuuaccaaaguguagcgacugugaagauaaaguuca

SEQ ID NO: 440925 - RNA, 64 nt, Homo Sapiens
uuuuucaaagauuuucacuugucccucccuuccaaaaguguauuuauucucuuuuuuucuaaga

SEQ ID NO: 440926 - RNA, 64 nt, Homo Sapiens
guagaaauuucuacaaaaugcauuugaaaaagccaaaguguacgaagcaacaauaauuuugaag

SEQ ID NO: 440927 - RNA, 64 nt, Homo Sapiens
auuaauguuuuugcauacuuugcaucuuuauucaaaaguguaaacuuucuuugucaaucuaugg

SEQ ID NO: 440928 - RNA, 64 nt, Homo Sapiens
gcuuuauuguuuauugcugguuuaugaccuuaauaaaguguaauuauguauuaccagcagggug

SEQ ID NO: 440929 - RNA, 64 nt, Homo Sapiens
uguuuuucaugguuucuaucugcuguaacaugggaaaguguaaaaauauuccauugaaauauug

SEQ ID NO: 440930 - RNA, 64 nt, Homo Sapiens
uaccauacagauuaauaugugaacccuauaccauaaaguguaguuggguaauaaaggcuaguca

SEQ ID NO: 440931 - RNA, 64 nt, Homo Sapiens
ggaaaggaaagaugaugcucaguuuuaaacguuaaaaguguacaaguugcuuuguuacaauaaa

SEQ ID NO: 440932 - RNA, 64 nt, Homo Sapiens
aacuugauaaauggaacuauuccaucaauaggcaaaaguguaacaaccuaucuagauggauagu

SEQ ID NO: 440933 - RNA, 64 nt, Homo Sapiens
aguggcaggaccaggcccaauauuaaggaguggaaaaguguaggcugcccuuggugaagcugug

SEQ ID NO: 440934 - RNA, 64 nt, Homo Sapiens
auuguccacacacacacaaccagauaaucuucugaaaguguaacucagaugaugccuccaaccc

SEQ ID NO: 440935 - RNA, 64 nt, Homo Sapiens
ugaucagaaguggccauuugugccuuuucagggcaaaguguauuugccuuuuccacaaaucucu

SEQ ID NO: 440936 - RNA, 64 nt, Homo Sapiens
ccauaugaaaugaacugcaagguuaguagggaauaaaguguagaugccagccagaagccugauu

SEQ ID NO: 440937 - RNA, 64 nt, Homo Sapiens
guaacaaaacucucuuuuguugguuacuauuuggaaaguguaauugaaaauuaguaggaagaug

SEQ ID NO: 440938 - RNA, 64 nt, Homo Sapiens
aaagggaaagagucuuauuucacauaguuugucaaaaguguacauggucccuacacugaaaacg

SEQ ID NO: 440939 - RNA, 64 nt, Homo Sapiens
guagccucuuuuuguucugaaauugaguuuauucaaaguguaaaagcacauacugcauuuucug

SEQ ID NO: 440940 - RNA, 64 nt, Homo Sapiens
gguaaacgcaaaacuuuuguacuuuauuacgaguaaaguguaaugaguacuguggaaaccaaau

SEQ ID NO: 440941 - RNA, 64 nt, Homo Sapiens
ccccuaagcuuugugcaauuuuuucugguuccccaaaguguauuuuucucuaagucgagggcua

SEQ ID NO: 440942 - RNA, 64 nt, Homo Sapiens
gaagauuguuuuuauuugccugauaaaguaauugaaaguguauuuuugguaugaagcugguuuu

SEQ ID NO: 440943 - RNA, 64 nt, Homo Sapiens; identical to SEQ ID NO: 83734

SEQ ID NO: 440944 - RNA, 64 nt, Homo Sapiens; identical to SEQ ID NO: 83735

SEQ ID NO: 440945 - RNA, 64 nt, Homo Sapiens; identical to SEQ ID NO: 83736

SEQ ID NO: 440946 - RNA, 64 nt, Homo Sapiens; identical to SEQ ID NO: 83737

SEQ ID NO: 440947 - RNA, 64 nt, Homo Sapiens; identical to SEQ ID NO: 83738

SEQ ID NO: 440948 - RNA, 64 nt, Homo Sapiens; identical to SEQ ID NO: 83739

SEQ ID NO: 440949 - RNA, 64 nt, Homo Sapiens; identical to SEQ ID NO: 83740

SEQ ID NO: 440950 - RNA, 64 nt, Homo Sapiens; identical to SEQ ID NO: 83741

SEQ ID NO: 440951 - RNA, 64 nt, Homo Sapiens; identical to SEQ ID NO: 83742

SEQ ID NO: 440952 - RNA, 64 nt, Homo Sapiens; identical to SEQ ID NO: 83743

SEQ ID NO: 440953 - RNA, 64 nt, Homo Sapiens; identical to SEQ ID NO: 83744

SEQ ID NO: 440954 - RNA, 64 nt, Homo Sapiens; identical to SEQ ID NO: 83745

SEQ ID NO: 440955 - RNA, 64 nt, Homo Sapiens; identical to SEQ ID NO: 83746

SEQ ID NO: 440956 - RNA, 64 nt, Homo Sapiens; identical to SEQ ID NO: 83747

SEQ ID NO: 440957 - RNA, 64 nt, Homo Sapiens; identical to SEQ ID NO: 83741

SEQ ID NO: 440958 - RNA, 64 nt, Homo Sapiens; identical to SEQ ID NO: 83749

SEQ ID NO: 440959 - RNA, 64 nt, Homo Sapiens; identical to SEQ ID NO: 83750

SEQ ID NO: 440960 - RNA, 64 nt, Homo Sapiens; identical to SEQ ID NO: 83751

SEQ ID NO: 440961 - RNA, 64 nt, Homo Sapiens; identical to SEQ ID NO: 83752

SEQ ID NO: 440962 - RNA, 64 nt, Homo Sapiens; identical to SEQ ID NO: 83753

SEQ ID NO: 440963 - RNA, 64 nt, Homo Sapiens; identical to SEQ ID NO: 83754

SEQ ID NO: 440964 - RNA, 64 nt, Homo Sapiens; identical to SEQ ID NO: 83755

SEQ ID NO: 440965 - RNA, 64 nt, Homo Sapiens; identical to SEQ ID NO: 83756

SEQ ID NO: 440966 - RNA, 64 nt, Homo Sapiens; identical to SEQ ID NO: 83757

SEQ ID NO: 440967 - RNA, 64 nt, Homo Sapiens; identical to SEQ ID NO: 83742

SEQ ID NO: 440968 - RNA, 64 nt, Homo Sapiens; identical to SEQ ID NO: 83743

SEQ ID NO: 440969 - RNA, 64 nt, Homo Sapiens; identical to SEQ ID NO: 83760

SEQ ID NO: 440970 - RNA, 64 nt, Homo Sapiens; identical to SEQ ID NO: 83761

SEQ ID NO: 440971 - RNA, 64 nt, Homo Sapiens; identical to SEQ ID NO: 83762

SEQ ID NO: 440972 - RNA, 64 nt, Homo Sapiens; identical to SEQ ID NO: 83763

SEQ ID NO: 440973 - RNA, 64 nt, Homo Sapiens; identical to SEQ ID NO: 83764

SEQ ID NO: 440974 - RNA, 64 nt, Homo Sapiens; identical to SEQ ID NO: 83765

SEQ ID NO: 440975 - RNA, 64 nt, Homo Sapiens; identical to SEQ ID NO: 83766

SEQ ID NO: 440976 - RNA, 64 nt, Homo Sapiens; identical to SEQ ID NO: 83767

SEQ ID NO: 440977 - RNA, 64 nt, Homo Sapiens; identical to SEQ ID NO: 83768

SEQ ID NO: 440978 - RNA, 64 nt, Homo Sapiens; identical to SEQ ID NO: 83769

SEQ ID NO: 440979 - RNA, 64 nt, Homo Sapiens; identical to SEQ ID NO: 83770

SEQ ID NO: 440980 - RNA, 64 nt, Homo Sapiens; identical to SEQ ID NO: 83771

SEQ ID NO: 440981 - RNA, 64 nt, Homo Sapiens; identical to SEQ ID NO: 83772

SEQ ID NO: 440982 - RNA, 64 nt, Homo Sapiens; identical to SEQ ID NO: 83773

SEQ ID NO: 440983 - RNA, 64 nt, Homo Sapiens; identical to SEQ ID NO: 83774

SEQ ID NO: 440984 - RNA, 64 nt, Homo Sapiens; identical to SEQ ID NO: 83775

SEQ ID NO: 440985 - RNA, 64 nt, Homo Sapiens; identical to SEQ ID NO: 83776

SEQ ID NO: 440986 - RNA, 64 nt, Homo Sapiens; identical to SEQ ID NO: 83777

SEQ ID NO: 440987 - RNA, 64 nt, Homo Sapiens; identical to SEQ ID NO: 83778

SEQ ID NO: 440988 - RNA, 64 nt, Homo Sapiens; identical to SEQ ID NO: 83779

SEQ ID NO: 440989 - RNA, 64 nt, Homo Sapiens; identical to SEQ ID NO: 83780

SEQ ID NO: 440990 - RNA, 64 nt, Homo Sapiens; identical to SEQ ID NO: 83781

SEQ ID NO: 440991 - RNA, 64 nt, Homo Sapiens
uaccguuuuauguaagguaauuaugaaagacauuggugauaaggugacauuuggucacaguucu

SEQ ID NO: 440992 - RNA, 64 nt, Homo Sapiens
uuaaugguggcuucaacuagguaguagcaauaagggugauaagaaguggucagacucugguugu

SEQ ID NO: 440993 - RNA, 64 nt, Homo Sapiens; identical to SEQ ID NO: 279953

SEQ ID NO: 440994 - RNA, 64 nt, Homo Sapiens; identical to SEQ ID NO: 279954

SEQ ID NO: 440995 - RNA, 64 nt, Homo Sapiens; identical to SEQ ID NO: 279955

SEQ ID NO: 440996 - RNA, 64 nt, Homo Sapiens; identical to SEQ ID NO: 279956

SEQ ID NO: 440997 - RNA, 64 nt, Homo Sapiens; identical to SEQ ID NO: 279957

SEQ ID NO: 440998 - RNA, 64 nt, Homo Sapiens; identical to SEQ ID NO: 279958

SEQ ID NO: 440999 - RNA, 64 nt, Homo Sapiens; identical to SEQ ID NO: 279959

SEQ ID NO: 441000 - RNA, 64 nt, Homo Sapiens; identical to SEQ ID NO: 279960

SEQ ID NO: 441001 - RNA, 64 nt, Homo Sapiens; identical to SEQ ID NO: 279961

SEQ ID NO: 441002 - RNA, 64 nt, Homo Sapiens; identical to SEQ ID NO: 279962

SEQ ID NO: 441003 - RNA, 64 nt, Homo Sapiens; identical to SEQ ID NO: 279963

SEQ ID NO: 441004 - RNA, 64 nt, Homo Sapiens; identical to SEQ ID NO: 279964

SEQ ID NO: 441005 - RNA, 64 nt, Homo Sapiens; identical to SEQ ID NO: 279965

SEQ ID NO: 441006 - RNA, 64 nt, Homo Sapiens; identical to SEQ ID NO: 279966

SEQ ID NO: 441007 - RNA, 64 nt, Homo Sapiens; identical to SEQ ID NO: 279967

SEQ ID NO: 441008 - RNA, 64 nt, Homo Sapiens; identical to SEQ ID NO: 279968

SEQ ID NO: 441009 - RNA, 64 nt, Homo Sapiens
acugucaucacuucuauagauuuccuaacuccaccaugccuauuucugguuauauaauugcucu

SEQ ID NO: 441010 - RNA, 64 nt, Homo Sapiens
uggaggcuggaaacuccaagauuaaggcagauuucaugccuauugagggccugcuuucugauua

SEQ ID NO: 441011 - RNA, 64 nt, Homo Sapiens
ucccuuuggguuccauguuuuccuuguucccucccaugccuagcuggauugcagaguuaaguuu

SEQ ID NO: 441012 - RNA, 64 nt, Homo Sapiens
cucuacaaaaaauaauuagccuggccugguggugcaugccuaguccuagcugaucuggaggcug

SEQ ID NO: 441013 - RNA, 64 nt, Homo Sapiens
acuaaaaauacaaaauuggcagggugugguggcacaugccuauaaucccagcuacuugggaggc

SEQ ID NO: 441014 - RNA, 64 nt, Homo Sapiens
uaaaaaguaaaauaauaggccaggcaugguggcucaugccuauaagcacccugggaggccgagg

SEQ ID NO: 441015 - RNA, 64 nt, Homo Sapiens
aguaaaggagaauaacuggccgggcacgguggcucaugccuauaaaauuccagcacuuugggag

SEQ ID NO: 441016 - RNA, 64 nt, Homo Sapiens
auauguacuuaugcuuuaguuugugauuuagcaguuaugcuaaauaauaaaccuuuuuauuaca

SEQ ID NO: 441017 - RNA, 64 nt, Homo Sapiens
gaacugaaaggaucaacaacuuuguauauuuguuuuaugcuacuuagaggacuauuacauauuu

SEQ ID NO: 441018 - RNA, 64 nt, Homo Sapiens
gauagcccuuacacucauccuaaccgucuuucccuuaugcuaagcuuucaaucuucucagcuua

SEQ ID NO: 441019 - RNA, 64 nt, Homo Sapiens
cucuuuguggcuccauucuuuuccuucuuguuauuuaugcuauuuaagugcuuguucuucaugu

SEQ ID NO: 441020 - RNA, 64 nt, Homo Sapiens
aucacauuauuauguauucacaacaauagcuaaguuaugcuaauaugcuggauaaauauuaguc

SEQ ID NO: 441021 - RNA, 64 nt, Homo Sapiens
caccaauuuauauuuuuaaauucucaauuuugaauuaugcuacuguauguauaugaugauuuuu

SEQ ID NO: 441022 - RNA, 64 nt, Homo Sapiens
uguaucgcuuuugcuucucugauacuggugggcacauauuaauuacacuuugacuccuaaaugu

SEQ ID NO: 441023 - RNA, 64 nt, Homo Sapiens
uggcucccuuuuucuugugguaugggaauauacacauauuaaugauccgcacuuacauuagagu

SEQ ID NO: 441024 - RNA, 64 nt, Homo Sapiens
aguuuaucuuauacuccugguuugauuugauuagcauauuaacgugaaaguaggauagcuacua

SEQ ID NO: 441025 - RNA, 64 nt, Homo Sapiens
uccuucuaaagagacuaauuugagaguacaggugcauauuaauuuucuugguucuuucagcuga

SEQ ID NO: 441026 - RNA, 64 nt, Homo Sapiens
gaggauuguacauauaaauagugggaaauucacucauauuaaugugggaaaauaauuaguuaca

SEQ ID NO: 441027 - RNA, 64 nt, Homo Sapiens
ccaggugauuuguuuuuucaaggggauucuauuucauauuaauuaugaauauaaaauauuuauu

SEQ ID NO: 441028 - RNA, 64 nt, Homo Sapiens
gaauuuucuaaacgcuuacaacuuaucugccacucauauuaauuuacuugaauuugucauaaag

SEQ ID NO: 441029 - RNA, 64 nt, Homo Sapiens
uaaauauuuuauauguuuucaaagauuauuuuuucauauuaauagguuguuuaucuuuuugccu

SEQ ID NO: 441030 - RNA, 64 nt, Homo Sapiens
ccuuuauuccaucucucaagcacuccuuuuuugacauauuaaagaaauuuauuauaacacuaaa

SEQ ID NO: 441031 - RNA, 64 nt, Homo Sapiens
aaagagaaaagagaaagcaacauuuuuuuguuugcauauuaaaauguugucauuuucauuuuug

SEQ ID NO: 441032 - RNA, 64 nt, Homo Sapiens
cagguauuugacauaauaugaaugaauggauucucauauuaacacuaaauuauucaugaauuaa

SEQ ID NO: 441033 - RNA, 64 nt, Homo Sapiens
acaacauacaugaauaucauagcuggcaggcauucauauuaauguaugugacauaacaaaauac

SEQ ID NO: 441034 - RNA, 64 nt, Homo Sapiens
ucaccuaccuauuugauuauauguugauugauaacauauuaaauagagaacaaauaagagaggu

SEQ ID NO: 441035 - RNA, 64 nt, Homo Sapiens
aggcagauucuuagagugaaaaagccucaguuuccauauuaaaaauguuuuaaauauuuugauu

SEQ ID NO: 441036 - RNA, 64 nt, Homo Sapiens
uaagcagagaaaaaaaaaugacuuacacguggugcauauuaaaauuuaccguagcccucaucua

SEQ ID NO: 441037 - RNA, 64 nt, Homo Sapiens
aacacauuuuuucucaacauuguagacauguguucauauuaaugugcaucguguaaaucaucuc

SEQ ID NO: 441038 - RNA, 64 nt, Homo Sapiens
aggaacacugaacuaguuggguguagguagauuccauauuaaugacaccagaaagaguguuggu

SEQ ID NO: 441039 - RNA, 64 nt, Homo Sapiens
ugcagauugggggaaaacaacaaaugucuugaagcauauuaauggaauuaguuucuaauguggc

SEQ ID NO: 441040 - RNA, 64 nt, Homo Sapiens
auuucgggguagugugagcuuuuaauguuuaagucauauuaaacucuuaagucaaauuaagcag

SEQ ID NO: 441041 - RNA, 64 nt, Homo Sapiens
ugguucuacugucuguuuucucucagcugagacacauauuaagcuuaacuauagaaauguugcc

SEQ ID NO: 441042 - RNA, 64 nt, Homo Sapiens
aguacagaguguaggcaagagugaccaauauguucauauuaagcggaauuacuuuacugauuaa

SEQ ID NO: 441043 - RNA, 64 nt, Homo Sapiens; identical to SEQ ID NO: 107827

SEQ ID NO: 441044 - RNA, 64 nt, Homo Sapiens; identical to SEQ ID NO: 107828

SEQ ID NO: 441045 - RNA, 64 nt, Homo Sapiens; identical to SEQ ID NO: 107829

SEQ ID NO: 441046 - RNA, 64 nt, Homo Sapiens; identical to SEQ ID NO: 107830

SEQ ID NO: 441047 - RNA, 64 nt, Homo Sapiens; identical to SEQ ID NO: 107831

SEQ ID NO: 441048 - RNA, 64 nt, Homo Sapiens; identical to SEQ ID NO: 107832

SEQ ID NO: 441049 - RNA, 64 nt, Homo Sapiens; identical to SEQ ID NO: 107833

SEQ ID NO: 441050 - RNA, 64 nt, Homo Sapiens; identical to SEQ ID NO: 107834

SEQ ID NO: 441051 - RNA, 64 nt, Homo Sapiens; identical to SEQ ID NO: 107835

SEQ ID NO: 441052 - RNA, 64 nt, Homo Sapiens; identical to SEQ ID NO: 107836

SEQ ID NO: 441053 - RNA, 64 nt, Homo Sapiens; identical to SEQ ID NO: 107837

SEQ ID NO: 441054 - RNA, 64 nt, Homo Sapiens; identical to SEQ ID NO: 107838

SEQ ID NO: 441055 - RNA, 64 nt, Homo Sapiens; identical to SEQ ID NO: 107839

SEQ ID NO: 441056 - RNA, 64 nt, Homo Sapiens; identical to SEQ ID NO: 107840

SEQ ID NO: 441057 - RNA, 64 nt, Homo Sapiens; identical to SEQ ID NO: 305621

SEQ ID NO: 441058 - RNA, 64 nt, Homo Sapiens; identical to SEQ ID NO: 305622

SEQ ID NO: 441059 - RNA, 64 nt, Homo Sapiens; identical to SEQ ID NO: 305623

SEQ ID NO: 441060 - RNA, 64 nt, Homo Sapiens; identical to SEQ ID NO: 305624

SEQ ID NO: 441061 - RNA, 64 nt, Homo Sapiens; identical to SEQ ID NO: 305625

SEQ ID NO: 441062 - RNA, 64 nt, Homo Sapiens; identical to SEQ ID NO: 305626

SEQ ID NO: 441063 - RNA, 64 nt, Homo Sapiens; identical to SEQ ID NO: 305627

SEQ ID NO: 441064 - RNA, 64 nt, Homo Sapiens; identical to SEQ ID NO: 305628

SEQ ID NO: 441065 - RNA, 64 nt, Homo Sapiens; identical to SEQ ID NO: 305629

SEQ ID NO: 441066 - RNA, 64 nt, Homo Sapiens; identical to SEQ ID NO: 305630

SEQ ID NO: 441067 - RNA, 64 nt, Homo Sapiens; identical to SEQ ID NO: 305631

SEQ ID NO: 441068 - RNA, 64 nt, Homo Sapiens; identical to SEQ ID NO: 305632

SEQ ID NO: 441069 - RNA, 64 nt, Homo Sapiens; identical to SEQ ID NO: 305633

SEQ ID NO: 441070 - RNA, 64 nt, Homo Sapiens; identical to SEQ ID NO: 305634

SEQ ID NO: 441071 - RNA, 64 nt, Homo Sapiens; identical to SEQ ID NO: 305635

SEQ ID NO: 441072 - RNA, 64 nt, Homo Sapiens; identical to SEQ ID NO: 305636

SEQ ID NO: 441073 - RNA, 64 nt, Homo Sapiens; identical to SEQ ID NO: 305637

SEQ ID NO: 441074 - RNA, 64 nt, Homo Sapiens
ucuuucuaagcgguaauggauuuguaaauggagaaacaaucauauuaaauuguccugauucuau

SEQ ID NO: 441075 - RNA, 64 nt, Homo Sapiens
aaguagugguuuaaauacuuccuacauccaagaaaacaaucacauagccuaacccuguaauuuu

SEQ ID NO: 441076 - RNA, 64 nt, Homo Sapiens
gcgcaaaauguggaggaaaaggaugaucaugacaaacaaucacuacggugcagaauguccguau

SEQ ID NO: 441077 - RNA, 64 nt, Homo Sapiens
gugcagaauguccguauggaauggaugaucacgaaacaaucacgucacggugcgaaauguccgc

SEQ ID NO: 441078 - RNA, 64 nt, Homo Sapiens
gugcgaaauguccgcauggaauggacgaucacgaaacaaucacggggcauuccaaaauguccgc

SEQ ID NO: 441079 - RNA, 64 nt, Homo Sapiens; identical to SEQ ID NO: 106415

SEQ ID NO: 441080 - RNA, 64 nt, Homo Sapiens; identical to SEQ ID NO: 106416

SEQ ID NO: 441081 - RNA, 64 nt, Homo Sapiens; identical to SEQ ID NO: 106417

SEQ ID NO: 441082 - RNA, 64 nt, Homo Sapiens; identical to SEQ ID NO: 106418

SEQ ID NO: 441083 - RNA, 64 nt, Homo Sapiens; identical to SEQ ID NO: 106419

SEQ ID NO: 441084 - RNA, 64 nt, Homo Sapiens; identical to SEQ ID NO: 106420

SEQ ID NO: 441085 - RNA, 64 nt, Homo Sapiens; identical to SEQ ID NO: 106421

SEQ ID NO: 441086 - RNA, 64 nt, Homo Sapiens; identical to SEQ ID NO: 106422

SEQ ID NO: 441087 - RNA, 64 nt, Homo Sapiens; identical to SEQ ID NO: 106423

SEQ ID NO: 441088 - RNA, 64 nt, Homo Sapiens; identical to SEQ ID NO: 106424

SEQ ID NO: 441089 - RNA, 64 nt, Homo Sapiens; identical to SEQ ID NO: 106425

SEQ ID NO: 441090 - RNA, 64 nt, Homo Sapiens; identical to SEQ ID NO: 106426

SEQ ID NO: 441091 - RNA, 64 nt, Homo Sapiens; identical to SEQ ID NO: 106427

SEQ ID NO: 441092 - RNA, 64 nt, Homo Sapiens; identical to SEQ ID NO: 106428

SEQ ID NO: 441093 - RNA, 64 nt, Homo Sapiens; identical to SEQ ID NO: 106429

SEQ ID NO: 441094 - RNA, 64 nt, Homo Sapiens; identical to SEQ ID NO: 106430

SEQ ID NO: 441095 - RNA, 64 nt, Homo Sapiens; identical to SEQ ID NO: 106431

SEQ ID NO: 441096 - RNA, 64 nt, Homo Sapiens; identical to SEQ ID NO: 106432

SEQ ID NO: 441097 - RNA, 64 nt, Homo Sapiens; identical to SEQ ID NO: 106433

SEQ ID NO: 441098 - RNA, 64 nt, Homo Sapiens; identical to SEQ ID NO: 106434

SEQ ID NO: 441099 - RNA, 64 nt, Homo Sapiens; identical to SEQ ID NO: 106435

SEQ ID NO: 441100 - RNA, 64 nt, Homo Sapiens; identical to SEQ ID NO: 106436

SEQ ID NO: 441101 - RNA, 64 nt, Homo Sapiens; identical to SEQ ID NO: 106437

SEQ ID NO: 441102 - RNA, 64 nt, Homo Sapiens; identical to SEQ ID NO: 106438

SEQ ID NO: 441103 - RNA, 64 nt, Homo Sapiens; identical to SEQ ID NO: 106439

SEQ ID NO: 441104 - RNA, 64 nt, Homo Sapiens; identical to SEQ ID NO: 106440

SEQ ID NO: 441105 - RNA, 64 nt, Homo Sapiens; identical to SEQ ID NO: 106441

SEQ ID NO: 441106 - RNA, 64 nt, Homo Sapiens; identical to SEQ ID NO: 106442

SEQ ID NO: 441107 - RNA, 64 nt, Homo Sapiens; identical to SEQ ID NO: 106443

SEQ ID NO: 441108 - RNA, 64 nt, Homo Sapiens; identical to SEQ ID NO: 106444

SEQ ID NO: 441109 - RNA, 64 nt, Homo Sapiens; identical to SEQ ID NO: 106445

SEQ ID NO: 441110 - RNA, 64 nt, Homo Sapiens; identical to SEQ ID NO: 106446

SEQ ID NO: 441111 - RNA, 64 nt, Homo Sapiens; identical to SEQ ID NO: 106447

SEQ ID NO: 441112 - RNA, 64 nt, Homo Sapiens; identical to SEQ ID NO: 106448

SEQ ID NO: 441113 - RNA, 64 nt, Homo Sapiens; identical to SEQ ID NO: 110249

SEQ ID NO: 441114 - RNA, 64 nt, Homo Sapiens; identical to SEQ ID NO: 110250

SEQ ID NO: 441115 - RNA, 64 nt, Homo Sapiens; identical to SEQ ID NO: 110251

SEQ ID NO: 441116 - RNA, 64 nt, Homo Sapiens; identical to SEQ ID NO: 110252

SEQ ID NO: 441117 - RNA, 64 nt, Homo Sapiens; identical to SEQ ID NO: 110253

SEQ ID NO: 441118 - RNA, 64 nt, Homo Sapiens; identical to SEQ ID NO: 110254

SEQ ID NO: 441119 - RNA, 64 nt, Homo Sapiens; identical to SEQ ID NO: 110255

SEQ ID NO: 441120 - RNA, 64 nt, Homo Sapiens; identical to SEQ ID NO: 110256

SEQ ID NO: 441121 - RNA, 64 nt, Homo Sapiens; identical to SEQ ID NO: 110257

SEQ ID NO: 441122 - RNA, 64 nt, Homo Sapiens; identical to SEQ ID NO: 110258

SEQ ID NO: 441123 - RNA, 64 nt, Homo Sapiens; identical to SEQ ID NO: 110259

SEQ ID NO: 441124 - RNA, 64 nt, Homo Sapiens; identical to SEQ ID NO: 110260

SEQ ID NO: 441125 - RNA, 64 nt, Homo Sapiens; identical to SEQ ID NO: 110261

SEQ ID NO: 441126 - RNA, 64 nt, Homo Sapiens; identical to SEQ ID NO: 110262

SEQ ID NO: 441127 - RNA, 64 nt, Homo Sapiens; identical to SEQ ID NO: 110263

SEQ ID NO: 441128 - RNA, 64 nt, Homo Sapiens; identical to SEQ ID NO: 110264

SEQ ID NO: 441129 - RNA, 64 nt, Homo Sapiens; identical to SEQ ID NO: 110265

SEQ ID NO: 441130 - RNA, 64 nt, Homo Sapiens; identical to SEQ ID NO: 110266

SEQ ID NO: 441131 - RNA, 64 nt, Homo Sapiens; identical to SEQ ID NO: 110267

SEQ ID NO: 441132 - RNA, 64 nt, Homo Sapiens; identical to SEQ ID NO: 110268

SEQ ID NO: 441133 - RNA, 64 nt, Homo Sapiens; identical to SEQ ID NO: 110269

SEQ ID NO: 441134 - RNA, 64 nt, Homo Sapiens; identical to SEQ ID NO: 110270

SEQ ID NO: 441135 - RNA, 64 nt, Homo Sapiens; identical to SEQ ID NO: 110271

SEQ ID NO: 441136 - RNA, 64 nt, Homo Sapiens; identical to SEQ ID NO: 110272

SEQ ID NO: 441137 - RNA, 64 nt, Homo Sapiens; identical to SEQ ID NO: 110273

SEQ ID NO: 441138 - RNA, 64 nt, Homo Sapiens; identical to SEQ ID NO: 110274

SEQ ID NO: 441139 - RNA, 64 nt, Homo Sapiens; identical to SEQ ID NO: 110275

SEQ ID NO: 441140 - RNA, 64 nt, Homo Sapiens; identical to SEQ ID NO: 110276

SEQ ID NO: 441141 - RNA, 64 nt, Homo Sapiens; identical to SEQ ID NO: 110277

SEQ ID NO: 441142 - RNA, 64 nt, Homo Sapiens; identical to SEQ ID NO: 110278

SEQ ID NO: 441143 - RNA, 64 nt, Homo Sapiens; identical to SEQ ID NO: 110279

SEQ ID NO: 441144 - RNA, 64 nt, Homo Sapiens; identical to SEQ ID NO: 110280

SEQ ID NO: 441145 - RNA, 64 nt, Homo Sapiens; identical to SEQ ID NO: 110281

SEQ ID NO: 441146 - RNA, 64 nt, Homo Sapiens; identical to SEQ ID NO: 110282

SEQ ID NO: 441147 - RNA, 64 nt, Homo Sapiens; identical to SEQ ID NO: 110283

SEQ ID NO: 441148 - RNA, 64 nt, Homo Sapiens; identical to SEQ ID NO: 110284

SEQ ID NO: 441149 - RNA, 64 nt, Homo Sapiens; identical to SEQ ID NO: 110285

SEQ ID NO: 441150 - RNA, 64 nt, Homo Sapiens; identical to SEQ ID NO: 110286

SEQ ID NO: 441151 - RNA, 64 nt, Homo Sapiens; identical to SEQ ID NO: 110287

SEQ ID NO: 441152 - RNA, 64 nt, Homo Sapiens; identical to SEQ ID NO: 110288

SEQ ID NO: 441153 - RNA, 64 nt, Homo Sapiens; identical to SEQ ID NO: 110289

SEQ ID NO: 441154 - RNA, 64 nt, Homo Sapiens; identical to SEQ ID NO: 110290

SEQ ID NO: 441155 - RNA, 64 nt, Homo Sapiens; identical to SEQ ID NO: 110291

SEQ ID NO: 441156 - RNA, 64 nt, Homo Sapiens; identical to SEQ ID NO: 110292

SEQ ID NO: 441157 - RNA, 64 nt, Homo Sapiens; identical to SEQ ID NO: 110293

SEQ ID NO: 441158 - RNA, 64 nt, Homo Sapiens; identical to SEQ ID NO: 110294

SEQ ID NO: 441159 - RNA, 64 nt, Homo Sapiens; identical to SEQ ID NO: 110295

SEQ ID NO: 441160 - RNA, 64 nt, Homo Sapiens; identical to SEQ ID NO: 110296

SEQ ID NO: 441161 - RNA, 64 nt, Homo Sapiens; identical to SEQ ID NO: 110297

SEQ ID NO: 441162 - RNA, 64 nt, Homo Sapiens; identical to SEQ ID NO: 110298

SEQ ID NO: 441163 - RNA, 64 nt, Homo Sapiens; identical to SEQ ID NO: 110299

SEQ ID NO: 441164 - RNA, 64 nt, Homo Sapiens; identical to SEQ ID NO: 110300

SEQ ID NO: 441165 - RNA, 64 nt, Homo Sapiens; identical to SEQ ID NO: 110301

SEQ ID NO: 441166 - RNA, 64 nt, Homo Sapiens; identical to SEQ ID NO: 110302

SEQ ID NO: 441167 - RNA, 64 nt, Homo Sapiens; identical to SEQ ID NO: 110303

SEQ ID NO: 441168 - RNA, 64 nt, Homo Sapiens; identical to SEQ ID NO: 110304

SEQ ID NO: 441169 - RNA, 64 nt, Homo Sapiens; identical to SEQ ID NO: 110305

SEQ ID NO: 441170 - RNA, 64 nt, Homo Sapiens; identical to SEQ ID NO: 110306

SEQ ID NO: 441171 - RNA, 64 nt, Homo Sapiens; identical to SEQ ID NO: 110307

SEQ ID NO: 441172 - RNA, 64 nt, Homo Sapiens; identical to SEQ ID NO: 110308

SEQ ID NO: 441173 - RNA, 64 nt, Homo Sapiens; identical to SEQ ID NO: 110309

SEQ ID NO: 441174 - RNA, 64 nt, Homo Sapiens; identical to SEQ ID NO: 110310

SEQ ID NO: 441175 - RNA, 64 nt, Homo Sapiens; identical to SEQ ID NO: 110311

SEQ ID NO: 441176 - RNA, 64 nt, Homo Sapiens; identical to SEQ ID NO: 110312

SEQ ID NO: 441177 - RNA, 64 nt, Homo Sapiens; identical to SEQ ID NO: 110313

SEQ ID NO: 441178 - RNA, 64 nt, Homo Sapiens; identical to SEQ ID NO: 110314

SEQ ID NO: 441179 - RNA, 64 nt, Homo Sapiens; identical to SEQ ID NO: 110315

SEQ ID NO: 441180 - RNA, 64 nt, Homo Sapiens; identical to SEQ ID NO: 110316

SEQ ID NO: 441181 - RNA, 64 nt, Homo Sapiens; identical to SEQ ID NO: 44425

SEQ ID NO: 441182 - RNA, 64 nt, Homo Sapiens; identical to SEQ ID NO: 44426

SEQ ID NO: 441183 - RNA, 64 nt, Homo Sapiens; identical to SEQ ID NO: 44427

SEQ ID NO: 441184 - RNA, 64 nt, Homo Sapiens; identical to SEQ ID NO: 44428

SEQ ID NO: 441185 - RNA, 64 nt, Homo Sapiens; identical to SEQ ID NO: 44429

SEQ ID NO: 441186 - RNA, 64 nt, Homo Sapiens; identical to SEQ ID NO: 44430

SEQ ID NO: 441187 - RNA, 64 nt, Homo Sapiens; identical to SEQ ID NO: 44431

SEQ ID NO: 441188 - RNA, 64 nt, Homo Sapiens; identical to SEQ ID NO: 44432

SEQ ID NO: 441189 - RNA, 64 nt, Homo Sapiens; identical to SEQ ID NO: 44433

SEQ ID NO: 441190 - RNA, 64 nt, Homo Sapiens; identical to SEQ ID NO: 44434

SEQ ID NO: 441191 - RNA, 64 nt, Homo Sapiens; identical to SEQ ID NO: 44435

SEQ ID NO: 441192 - RNA, 64 nt, Homo Sapiens; identical to SEQ ID NO: 44436

SEQ ID NO: 441193 - RNA, 64 nt, Homo Sapiens; identical to SEQ ID NO: 244748

SEQ ID NO: 441194 - RNA, 64 nt, Homo Sapiens; identical to SEQ ID NO: 244749

SEQ ID NO: 441195 - RNA, 64 nt, Homo Sapiens; identical to SEQ ID NO: 244750

SEQ ID NO: 441196 - RNA, 64 nt, Homo Sapiens; identical to SEQ ID NO: 244751

SEQ ID NO: 441197 - RNA, 64 nt, Homo Sapiens; identical to SEQ ID NO: 244752

SEQ ID NO: 441198 - RNA, 64 nt, Homo Sapiens; identical to SEQ ID NO: 244753

SEQ ID NO: 441199 - RNA, 64 nt, Homo Sapiens; identical to SEQ ID NO: 244754

SEQ ID NO: 441200 - RNA, 64 nt, Homo Sapiens; identical to SEQ ID NO: 244755

SEQ ID NO: 441201 - RNA, 64 nt, Homo Sapiens; identical to SEQ ID NO: 244756

SEQ ID NO: 441202 - RNA, 64 nt, Homo Sapiens; identical to SEQ ID NO: 244757

SEQ ID NO: 441203 - RNA, 64 nt, Homo Sapiens; identical to SEQ ID NO: 244758

SEQ ID NO: 441204 - RNA, 64 nt, Homo Sapiens; identical to SEQ ID NO: 244759

SEQ ID NO: 441205 - RNA, 64 nt, Homo Sapiens; identical to SEQ ID NO: 244760

SEQ ID NO: 441206 - RNA, 64 nt, Homo Sapiens; identical to SEQ ID NO: 244761

SEQ ID NO: 441207 - RNA, 64 nt, Homo Sapiens; identical to SEQ ID NO: 244762

SEQ ID NO: 441208 - RNA, 64 nt, Homo Sapiens; identical to SEQ ID NO: 244763

SEQ ID NO: 441209 - RNA, 64 nt, Homo Sapiens; identical to SEQ ID NO: 244764

SEQ ID NO: 441210 - RNA, 64 nt, Homo Sapiens
acacauauacauuauuucuguauauagaugucuguguauacauauguaugugugaguguaugua

SEQ ID NO: 441211 - RNA, 64 nt, Homo Sapiens
gaugucuguguauacauauguaugugugaguguauguauacacacacacacacacacacacaca

SEQ ID NO: 441212 - RNA, 64 nt, Homo Sapiens
uauaugauaugcagaagucaugugagaaaauauauguauacauauacuuauaacuagacgucua

SEQ ID NO: 441213 - RNA, 64 nt, Homo Sapiens
uaucaaagcuauuuucuuauuauauaugccuuuguguauacacugagggguguuuguguguaua

SEQ ID NO: 441214 - RNA, 64 nt, Homo Sapiens
cauuucuguaaauaccauugacacauccgccuuuuguauacauccuggguaaugagagguggcu

SEQ ID NO: 441215 - RNA, 64 nt, Homo Sapiens
uguaauaauaccucaauguuugaggagcauguuuuguauacaaauauauuguuaaucucuguua

SEQ ID NO: 441216 - RNA, 64 nt, Homo Sapiens
agguauuaaugauauaguuauauauaaacuccuauguauacauaucuuuguuacuuaaaugcau

SEQ ID NO: 441217 - RNA, 64 nt, Homo Sapiens
aaaguuuacaugaauuuuaccuugaucugacauuuguauacauauauaauuaauaaaaccugug

SEQ ID NO: 441218 - RNA, 64 nt, Homo Sapiens
aacuaaauagacuucugcccugcacucuugcaaguguauacaaauuuugcuuuauacugaguaa

SEQ ID NO: 441219 - RNA, 64 nt, Homo Sapiens
cacacagacacacacacacauaucuguguauguguguauacacagaauacauguuguaaauaua

SEQ ID NO: 441220 - RNA, 64 nt, Homo Sapiens
uuccacaaacacauccucacuagagauagacuuguguauacaccuguguguacauaauuauaua

SEQ ID NO: 441221 - RNA, 64 nt, Homo Sapiens
uuuuugccagauaaaaauguaaauuuaaaucauguguauacaauaaacuguuaaaauuuaaaaa

SEQ ID NO: 441222 - RNA, 64 nt, Homo Sapiens
uacaaaugcuuauuuuuauuguugcuauuuucaguguauacauaaacuaaaaauuaggguugau

SEQ ID NO: 441223 - RNA, 64 nt, Homo Sapiens
uuuagaaugugaaaaaaaugcauguuuacuuaccuguauacaccauaugcaugcacuagaauua

SEQ ID NO: 441224 - RNA, 64 nt, Homo Sapiens
cagauuuuuuaaauuauauauauggaaauauauauguauacauuuuaaguucuguauacauaau

SEQ ID NO: 441225 - RNA, 64 nt, Homo Sapiens
uauauggaaauauauauguauacauuuuaaguucuguauacauaauuaccaaacacuaugugac

SEQ ID NO: 441226 - RNA, 64 nt, Homo Sapiens
uguaugugcacauacacacauaaaauguuugccauguauacaccacagugaauguauuagagua

SEQ ID NO: 441227 - RNA, 64 nt, Homo Sapiens
uugccauauacaauauacaaacauuuggguuguguguauacaucacacacaaaaauguguguau

SEQ ID NO: 441228 - RNA, 64 nt, Homo Sapiens
uggguuguguguauacaucucacacaaaaauguguguauacauuuaccaaauagcauacaugua

SEQ ID NO: 441229 - RNA, 64 nt, Homo Sapiens
cacaauaccacaugagaaaauaucugagacaaaauguauacaaauauauuccuuauggcauaau

SEQ ID NO: 441230 - RNA, 64 nt, Homo Sapiens
cauaguaguugcauauaaucuaugcacauccuccuguauacauuaagucaucucuagauuauuu

SEQ ID NO: 441231 - RNA, 64 nt, Homo Sapiens
uaaauaccauaacaguuacucaugacccuuuuauuguauacaaagauucccaacacagaauuuu

SEQ ID NO: 441232 - RNA, 64 nt, Homo Sapiens
uguuuaauuugaacacacuacuaauuauuuuaacuguauacaucaauuguuuauagagacuaca

SEQ ID NO: 441233 - RNA, 64 nt, Homo Sapiens
uacacauauauauguauauauacacauauauguauguauacacauauacacauguauauauaca

SEQ ID NO: 441234 - RNA, 64 nt, Homo Sapiens
uacacauauacacauguauauauacauguguguauguauacauguauauauauauacauacaca

SEQ ID NO: 441235 - RNA, 64 nt, Homo Sapiens
uguauacauguauauauauauacauacacauauauguauacauauauacacauauauguauaca

SEQ ID NO: 441236 - RNA, 64 nt, Homo Sapiens
cauacacauauauguauacauauauacacauauauguauacauauauacacauauguauacaua

SEQ ID NO: 441237 - RNA, 64 nt, Homo Sapiens
uauauacacauauauguauacauauauacacauauguauacauauauauauauucuacaguaaa

SEQ ID NO: 441238 - RNA, 64 nt, Homo Sapiens
cccuuucugcuuaguuguaucucugugaaaaacuuguauacacaagcguccaugucucacacaa

SEQ ID NO: 441239 - RNA, 64 nt, Homo Sapiens
aaaaaguuucuuccucaugaugcuaauaguuuuuuguauacaugggaggauagcacauuugaca

SEQ ID NO: 441240 - RNA, 64 nt, Homo Sapiens
ggcgaauuuguccaaacacauaguguguguguuuuguauacacuguaugaccccaccccaaauc

SEQ ID NO: 441241 - RNA, 64 nt, Homo Sapiens
acuuuaaauguuauuuuggaagacuuacgaugcauguauacaaacgaauagcagauaaugauga

SEQ ID NO: 441242 - RNA, 64 nt, Homo Sapiens
uguauaauuguuguuguugauaacagauacaguauguauacauuguucauucuuggugugucuc

SEQ ID NO: 441243 - RNA, 64 nt, Homo Sapiens
acagcuguuuugcuuuuagaauauuuuaauugcuuguauacacauuauagaagguuuagccuuc

SEQ ID NO: 441244 - RNA, 64 nt, Homo Sapiens
gcagcuuguuaaucguguaaagucaagagaagaauguauacacauauguguguugaauaauuac

SEQ ID NO: 441245 - RNA, 64 nt, Homo Sapiens
uguguguugaauaauuacuauuggcauagguauguguauacacacggugcaccaaucuacagua

SEQ ID NO: 441246 - RNA, 64 nt, Homo Sapiens
gcuguucauagaaaaacaaacaaaauugaguuacuguauacaaagugcacagaacucaagaccu

SEQ ID NO: 441247 - RNA, 64 nt, Homo Sapiens
ccauguauguaugcauauauauauauuccacauauguauacauuuguauacauuccacgugugu

SEQ ID NO: 441248 - RNA, 64 nt, Homo Sapiens
ccacguguguauauauuccaauauaguccccauauguauacauuuguauacauuccacgugugu

SEQ ID NO: 441249 - RNA, 64 nt, Homo Sapiens
ccacguguguauauagucccauauauuccacauauguauacauucguguauguauuccacaugu

SEQ ID NO: 441250 - RNA, 64 nt, Homo Sapiens
uuuaaaaucauaaaaauaagaauauguacaauucuguauacauuauauugcuguccaccccaua

SEQ ID NO: 441251 - RNA, 64 nt, Homo Sapiens
uacugcaauauugcuguccaugaucauagcacguuguauacaugauaugucaauuacccugauu

SEQ ID NO: 441252 - RNA, 64 nt, Homo Sapiens
cauuucuguaaacccaaauuauaugguuucuucugcgaaagaguaaggugugugcuuuuuuuuu

SEQ ID NO: 441253 - RNA, 64 nt, Homo Sapiens
ggaagcgaauaaaguuuuacguuuucuguuaauggcgaaagaauaaacauuuuugcuuucucca

SEQ ID NO: 441254 - RNA, 64 nt, Homo Sapiens
gaacagccuuguccaggcaggcuauugcuggagagcgaaagaugcacagagugcucaggaugau

SEQ ID NO: 441255 - RNA, 64 nt, Homo Sapiens
auugaaaacauagacuuacuauuuguacuuaaaagcgaaagaacagauauaguuuuguuccaca

SEQ ID NO: 441256 - RNA, 64 nt, Homo Sapiens
guagagaagcauacuggagaagcauauccagagggcgaaagauaucucuccauugugcaucugc

SEQ ID NO: 441257 - RNA, 64 nt, Homo Sapiens
aaguuuguuacugguuaaaaaccucaaaugaaaugcgaaagaauuugaauuuuuccugcauaug

SEQ ID NO: 441258 - RNA, 64 nt, Homo Sapiens
uagaauuuuaguuuuuguuguuacaauuaaaagggcgaaagauguuucaguuacaauuuaaucu

SEQ ID NO: 441259 - RNA, 64 nt, Homo Sapiens
gggguggcuguucucugcucucagaauguuuucagcgaaagagugauaacagcuugcacccucc

SEQ ID NO: 441260 - RNA, 64 nt, Homo Sapiens
uuggugugucuuuauguucauuuggagagucagggcgaaagacaggugauguagcacuucuguu

SEQ ID NO: 441261 - RNA, 64 nt, Homo Sapiens
uaugcagcuuggagacaggauucugacagagcaagcgaaagagcaaagucaugucagaaggaga

SEQ ID NO: 441262 - RNA, 64 nt, Homo Sapiens
acaaaccauauuagguaaaagaagauucaaaguugcgaaagagcucuuuuagauuugagcauuu

SEQ ID NO: 441263 - RNA, 64 nt, Homo Sapiens
ugaaaacuaaugaguaaaguggggaauuggcauugcgaaagacugagagacauuguuaauuuug

SEQ ID NO: 441264 - RNA, 64 nt, Homo Sapiens
ucaaacccccaacuucuucgcgaucgaaaccccggcgaaagaaaagcagagugagcuguugacu

SEQ ID NO: 441265 - RNA, 64 nt, Homo Sapiens
aaaccuacuccaaaaaugaacaaaaaaaaaaaaagcgaaagacugcaguugugcuaaaaacaaa

SEQ ID NO: 441266 - RNA, 64 nt, Homo Sapiens
agcccagacaccgggaacccccugccccucaucugcgaaagaagccuaucagcguguaaggggg

SEQ ID NO: 441267 - RNA, 64 nt, Homo Sapiens
cuggagcagccggcggcaggcaccucgccgcaaagcgaaagaaaucccgagagcucacccugcc

SEQ ID NO: 441268 - RNA, 64 nt, Homo Sapiens
gagacuccaucucaaaaaaagcgcuccagccugggcgaaagaguugaguggagaucacgccacu

SEQ ID NO: 441269 - RNA, 64 nt, Homo Sapiens
ugauauaugcaaaguaauucaacauauacuguaugcgaaagaguccugccuuuucccaccugga

SEQ ID NO: 441270 - RNA, 64 nt, Homo Sapiens
gggcucacagaauugaagggggagauuacaugaagcgaaagaggauuuacaacaaaagcaacga

SEQ ID NO: 441271 - RNA, 64 nt, Homo Sapiens
gcgggggcucugguuguaaaacacacuuccugcugcgaaagacccacaugcuacaagacgggca

SEQ ID NO: 441272 - RNA, 64 nt, Homo Sapiens
ucaugucuucucaaaaucuagagaaagcacaaaugcgaaagagguauacuguguucuuauauau

SEQ ID NO: 441273 - RNA, 64 nt, Homo Sapiens
cuggcucuuuuuuuuaauccguaaaagauccuaugcgaaagacacuuucuuccccccaccagcu

SEQ ID NO: 441274 - RNA, 64 nt, Homo Sapiens
gcauugggagaaauuuuagaacuggcaguuagaagcgaaagaugcauugaagcugaaugugcca

SEQ ID NO: 441275 - RNA, 64 nt, Homo Sapiens
cagaaccuagguuuaggguaugacguuaaaauaugcgaaagauuccaaauuccauaaacagaac

SEQ ID NO: 441276 - RNA, 64 nt, Homo Sapiens
cgugagacugacauaugccauuucauugcucgcugcgaaagagaucugccuccacagucaccca

SEQ ID NO: 441277 - RNA, 64 nt, Homo Sapiens
uccacaaacccuucccuauagaaguucaauggcugcgaaagaauuuguaguaaaccaggccucc

SEQ ID NO: 441278 - RNA, 64 nt, Homo Sapiens
ggaauuucauucaaaggcauucuggacaauggaggcgaaagagucaagcugauaugugccuguu

SEQ ID NO: 441279 - RNA, 64 nt, Homo Sapiens
cucucucagcagguuagcgcaauggcugcgauuugcgaaagaaucuuggaaaugggccccacgu

SEQ ID NO: 441280 - RNA, 64 nt, Homo Sapiens
aaggucugcaagggaauucugucuuugcauuucugcgaaagaucgcaaguuguauaacucaggc

SEQ ID NO: 441281 - RNA, 64 nt, Homo Sapiens
gggagugcccaugcccucugugaagugcccaaaugcgaaagaauaacaccuuuucuugcauucu

SEQ ID NO: 441282 - RNA, 64 nt, Homo Sapiens
gcuagagugcauuuuuacugguggaucagugugugcgaaagagaugacccuuuauaaagagauu

SEQ ID NO: 441283 - RNA, 64 nt, Homo Sapiens
augcugcauugcgaggaccccauauaaaccacaggcgaaagagguuggccucacucucuguaag

SEQ ID NO: 441284 - RNA, 64 nt, Homo Sapiens
uccccccgccucgacggcaccacuggccggccccgcgaaagacugcgcgugcguagagcacgcc

SEQ ID NO: 441285 - RNA, 64 nt, Homo Sapiens
ucagcugagauggugccacugcacuccagccugggcgaaagagcgacucugucuccaaaaaaaa

SEQ ID NO: 441286 - RNA, 64 nt, Homo Sapiens
gaaggacagacggaccugucagaggcgaggcugagcgaaagaagcucuggcgucccggcaggcg

SEQ ID NO: 441287 - RNA, 64 nt, Homo Sapiens
gaagugaccauaaaguggucacuuccaccgugaagcgaaagagccaguagugaauccccucauu

SEQ ID NO: 441288 - RNA, 64 nt, Homo Sapiens
acucuauuuagaugcauauuaaaauaauugacaggcgaaagaaauuuuuaaugcuaaucuugug

SEQ ID NO: 441289 - RNA, 64 nt, Homo Sapiens
guaauaaccagacacaaacucugugacagugauggcgaaagaggcucugcccagcuuuucauug

SEQ ID NO: 441290 - RNA, 63 nt, Homo Sapiens
uaauaaauagucugcugauuuagaguagacaaucuggacuauggcuauucauaaccuauauuc

SEQ ID NO: 441291 - RNA, 63 nt, Homo Sapiens
uucuauaggauaauugcuggagaauauaauaaucuggacuauuaguaugaauaaagguguggc

SEQ ID NO: 441292 - RNA, 63 nt, Homo Sapiens
caaugccuauugcugggcaggcuaaguguggagcuggacuacggcggcaguauggaauuccag

SEQ ID NO: 441293 - RNA, 63 nt, Homo Sapiens
cuaccugaugaaccugagcgggugccgaagcuacuggacuaugcugauggguauguccuaccc

SEQ ID NO: 441294 - RNA, 63 nt, Homo Sapiens
cuuacuuuuauuacagucaauuuugaggauauucuggacuaaauauuuaagugcagucauuuc

SEQ ID NO: 441295 - RNA, 63 nt, Homo Sapiens
cauuucuuuuugguuugcaaaaagagcacagcccuggacuacaaguuuggagauuuaaauucu

SEQ ID NO: 441296 - RNA, 63 nt, Homo Sapiens
aguuuggagaucuaaauucuaaagagcacagcccuggacuaugcauuucuuuuugguuugcaa

SEQ ID NO: 441297 - RNA, 63 nt, Homo Sapiens
uauuuaagugcagucauuucuuuugaggauauucuggacuaaacuaacuuuuauuacagucaa

SEQ ID NO: 441298 - RNA, 64 nt, Homo Sapiens
agcucauaaucuauuuuuuucauguaguauauaagucaagaauguuuuauugucauuaugugaa

SEQ ID NO: 441299 - RNA, 64 nt, Homo Sapiens
uugcauuucagguauuaaaauugcuuucuuaacugucaagaaucacaaaauaacaaaucauauu

SEQ ID NO: 441300 - RNA, 64 nt, Homo Sapiens
uaaaauuaauugaaggcagcaaaaggcacaguaggucaagaagcaggucucgaucccggaccag

SEQ ID NO: 441301 - RNA, 64 nt, Homo Sapiens
gaucccguucccguagucgcaaaucuuacagccggucaagaagcaggagcaggagccggagccg

SEQ ID NO: 441302 - RNA, 64 nt, Homo Sapiens
caaagaggccgcuucccuaagggggaagcagagagucaagaaugaaccagccucacagccacac

SEQ ID NO: 441303 - RNA, 64 nt, Homo Sapiens
gacuacaaaacaggaauggaugcagcuggugauggucaagaacugacccacggggcuccuggcu

SEQ ID NO: 441304 - RNA, 64 nt, Homo Sapiens
uccagaagaaagauggaaauucugaaaacugaaugucaagaaaaggagucaagaacaauucaca

SEQ ID NO: 441305 - RNA, 64 nt, Homo Sapiens
uggaaauucugaaaacugaaugucaagaaaaggagucaagaacaauucacaguaugagaagaaa

SEQ ID NO: 441306 - RNA, 64 nt, Homo Sapiens; identical to SEQ ID NO: 336839

SEQ ID NO: 441307 - RNA, 64 nt, Homo Sapiens; identical to SEQ ID NO: 336840

SEQ ID NO: 441308 - RNA, 64 nt, Homo Sapiens; identical to SEQ ID NO: 336841

SEQ ID NO: 441309 - RNA, 64 nt, Homo Sapiens; identical to SEQ ID NO: 336842

SEQ ID NO: 441310 - RNA, 64 nt, Homo Sapiens; identical to SEQ ID NO: 336843

SEQ ID NO: 441311 - RNA, 64 nt, Homo Sapiens; identical to SEQ ID NO: 336844

SEQ ID NO: 441312 - RNA, 64 nt, Homo Sapiens; identical to SEQ ID NO: 336845

SEQ ID NO: 441313 - RNA, 64 nt, Homo Sapiens; identical to SEQ ID NO: 336846

SEQ ID NO: 441314 - RNA, 64 nt, Homo Sapiens; identical to SEQ ID NO: 336847

SEQ ID NO: 441315 - RNA, 64 nt, Homo Sapiens; identical to SEQ ID NO: 336848

SEQ ID NO: 441316 - RNA, 64 nt, Homo Sapiens; identical to SEQ ID NO: 336849

SEQ ID NO: 441317 - RNA, 64 nt, Homo Sapiens; identical to SEQ ID NO: 336850

SEQ ID NO: 441318 - RNA, 64 nt, Homo Sapiens; identical to SEQ ID NO: 336851

SEQ ID NO: 441319 - RNA, 64 nt, Homo Sapiens; identical to SEQ ID NO: 336852

SEQ ID NO: 441320 - RNA, 64 nt, Homo Sapiens; identical to SEQ ID NO: 336853

SEQ ID NO: 441321 - RNA, 64 nt, Homo Sapiens; identical to SEQ ID NO: 336854

SEQ ID NO: 441322 - RNA, 64 nt, Homo Sapiens; identical to SEQ ID NO: 336855

SEQ ID NO: 441323 - RNA, 64 nt, Homo Sapiens; identical to SEQ ID NO: 336856

SEQ ID NO: 441324 - RNA, 64 nt, Homo Sapiens; identical to SEQ ID NO: 336857

SEQ ID NO: 441325 - RNA, 64 nt, Homo Sapiens; identical to SEQ ID NO: 336858

SEQ ID NO: 441326 - RNA, 64 nt, Homo Sapiens; identical to SEQ ID NO: 336859

SEQ ID NO: 441327 - RNA, 64 nt, Homo Sapiens; identical to SEQ ID NO: 336860

SEQ ID NO: 441328 - RNA, 64 nt, Homo Sapiens; identical to SEQ ID NO: 336861

SEQ ID NO: 441329 - RNA, 64 nt, Homo Sapiens; identical to SEQ ID NO: 336862

SEQ ID NO: 441330 - RNA, 64 nt, Homo Sapiens; identical to SEQ ID NO: 336863

SEQ ID NO: 441331 - RNA, 64 nt, Homo Sapiens; identical to SEQ ID NO: 336864

SEQ ID NO: 441332 - RNA, 64 nt, Homo Sapiens; identical to SEQ ID NO: 336865

SEQ ID NO: 441333 - RNA, 64 nt, Homo Sapiens; identical to SEQ ID NO: 336866

SEQ ID NO: 441334 - RNA, 64 nt, Homo Sapiens; identical to SEQ ID NO: 336867

SEQ ID NO: 441335 - RNA, 64 nt, Homo Sapiens; identical to SEQ ID NO: 336868

SEQ ID NO: 441336 - RNA, 64 nt, Homo Sapiens; identical to SEQ ID NO: 336869

SEQ ID NO: 441337 - RNA, 64 nt, Homo Sapiens; identical to SEQ ID NO: 336870

SEQ ID NO: 441338 - RNA, 64 nt, Homo Sapiens; identical to SEQ ID NO: 362171

SEQ ID NO: 441339 - RNA, 64 nt, Homo Sapiens; identical to SEQ ID NO: 362172

SEQ ID NO: 441340 - RNA, 64 nt, Homo Sapiens; identical to SEQ ID NO: 362173

SEQ ID NO: 441341 - RNA, 64 nt, Homo Sapiens; identical to SEQ ID NO: 362174

SEQ ID NO: 441342 - RNA, 64 nt, Homo Sapiens; identical to SEQ ID NO: 362175

SEQ ID NO: 441343 - RNA, 64 nt, Homo Sapiens; identical to SEQ ID NO: 362176

SEQ ID NO: 441344 - RNA, 64 nt, Homo Sapiens; identical to SEQ ID NO: 362177

SEQ ID NO: 441345 - RNA, 64 nt, Homo Sapiens; identical to SEQ ID NO: 362178

SEQ ID NO: 441346 - RNA, 64 nt, Homo Sapiens; identical to SEQ ID NO: 362179

SEQ ID NO: 441347 - RNA, 64 nt, Homo Sapiens; identical to SEQ ID NO: 362180

SEQ ID NO: 441348 - RNA, 64 nt, Homo Sapiens; identical to SEQ ID NO: 362181

SEQ ID NO: 441349 - RNA, 64 nt, Homo Sapiens; identical to SEQ ID NO: 362182

SEQ ID NO: 441350 - RNA, 64 nt, Homo Sapiens; identical to SEQ ID NO: 362183

SEQ ID NO: 441351 - RNA, 64 nt, Homo Sapiens; identical to SEQ ID NO: 362184

SEQ ID NO: 441352 - RNA, 64 nt, Homo Sapiens; identical to SEQ ID NO: 362185

SEQ ID NO: 441353 - RNA, 64 nt, Homo Sapiens; identical to SEQ ID NO: 362186

SEQ ID NO: 441354 - RNA, 64 nt, Homo Sapiens; identical to SEQ ID NO: 362187

SEQ ID NO: 441355 - RNA, 64 nt, Homo Sapiens; identical to SEQ ID NO: 362188

SEQ ID NO: 441356 - RNA, 64 nt, Homo Sapiens; identical to SEQ ID NO: 362189

SEQ ID NO: 441357 - RNA, 64 nt, Homo Sapiens; identical to SEQ ID NO: 362190

SEQ ID NO: 441358 - RNA, 64 nt, Homo Sapiens; identical to SEQ ID NO: 362191

SEQ ID NO: 441359 - RNA, 64 nt, Homo Sapiens; identical to SEQ ID NO: 362192

SEQ ID NO: 441360 - RNA, 64 nt, Homo Sapiens; identical to SEQ ID NO: 362193

SEQ ID NO: 441361 - RNA, 64 nt, Homo Sapiens; identical to SEQ ID NO: 362194

SEQ ID NO: 441362 - RNA, 64 nt, Homo Sapiens; identical to SEQ ID NO: 362195

SEQ ID NO: 441363 - RNA, 64 nt, Homo Sapiens; identical to SEQ ID NO: 362196

SEQ ID NO: 441364 - RNA, 64 nt, Homo Sapiens; identical to SEQ ID NO: 362197

SEQ ID NO: 441365 - RNA, 64 nt, Homo Sapiens; identical to SEQ ID NO: 362198

SEQ ID NO: 441366 - RNA, 64 nt, Homo Sapiens; identical to SEQ ID NO: 362199

SEQ ID NO: 441367 - RNA, 64 nt, Homo Sapiens; identical to SEQ ID NO: 362200

SEQ ID NO: 441368 - RNA, 64 nt, Homo Sapiens; identical to SEQ ID NO: 362201

SEQ ID NO: 441369 - RNA, 64 nt, Homo Sapiens; identical to SEQ ID NO: 362202

SEQ ID NO: 441370 - RNA, 64 nt, Homo Sapiens; identical to SEQ ID NO: 362203

SEQ ID NO: 441371 - RNA, 64 nt, Homo Sapiens; identical to SEQ ID NO: 362204

SEQ ID NO: 441372 - RNA, 64 nt, Homo Sapiens; identical to SEQ ID NO: 362205

SEQ ID NO: 441373 - RNA, 64 nt, Homo Sapiens; identical to SEQ ID NO: 362206

SEQ ID NO: 441374 - RNA, 64 nt, Homo Sapiens; identical to SEQ ID NO: 362207

SEQ ID NO: 441375 - RNA, 64 nt, Homo Sapiens; identical to SEQ ID NO: 362208

SEQ ID NO: 441376 - RNA, 64 nt, Homo Sapiens; identical to SEQ ID NO: 189518

SEQ ID NO: 441377 - RNA, 64 nt, Homo Sapiens; identical to SEQ ID NO: 189519

SEQ ID NO: 441378 - RNA, 64 nt, Homo Sapiens; identical to SEQ ID NO: 189520

SEQ ID NO: 441379 - RNA, 64 nt, Homo Sapiens; identical to SEQ ID NO: 189521

SEQ ID NO: 441380 - RNA, 64 nt, Homo Sapiens; identical to SEQ ID NO: 189522

SEQ ID NO: 441381 - RNA, 64 nt, Homo Sapiens; identical to SEQ ID NO: 189523

SEQ ID NO: 441382 - RNA, 64 nt, Homo Sapiens; identical to SEQ ID NO: 189524

SEQ ID NO: 441383 - RNA, 64 nt, Homo Sapiens; identical to SEQ ID NO: 189525

SEQ ID NO: 441384 - RNA, 64 nt, Homo Sapiens; identical to SEQ ID NO: 189526

SEQ ID NO: 441385 - RNA, 64 nt, Homo Sapiens; identical to SEQ ID NO: 189527

SEQ ID NO: 441386 - RNA, 64 nt, Homo Sapiens; identical to SEQ ID NO: 189528

SEQ ID NO: 441387 - RNA, 64 nt, Homo Sapiens; identical to SEQ ID NO: 189529

SEQ ID NO: 441388 - RNA, 64 nt, Homo Sapiens; identical to SEQ ID NO: 189530

SEQ ID NO: 441389 - RNA, 64 nt, Homo Sapiens
gccauuuuaacauuucuguauuugaagugcuuaucgaaucuaaaagugacuacuguuaauauuu

SEQ ID NO: 441390 - RNA, 64 nt, Homo Sapiens
uucccaguucuaaggccuuaaagugaucagaucccgaaucuagaaagagcaaguuugcucaguc

SEQ ID NO: 441391 - RNA, 64 nt, Homo Sapiens
ugcugcccacucccaugcucacuauccauggcuccgaaucuaagccagagaccuuggacuccgg

SEQ ID NO: 441392 - RNA, 64 nt, Homo Sapiens
uagagugaauauagauuagcaugucuaaaauggacgaaucuauaucugacugcauugaaaugca

SEQ ID NO: 441393 - RNA, 64 nt, Homo Sapiens
uuuucucauuuccagguuauuauaaugaaacucacgaaucuacggacauuuugcuuucagggug

SEQ ID NO: 441394 - RNA, 64 nt, Homo Sapiens
cucaauaagauacuuauaugagaacuacaaucaccgaaucuacuguauucaauauuagcagauc

SEQ ID NO: 441395 - RNA, 64 nt, Homo Sapiens
uuucggaagaacaacaacaaaaaagagguaaagacgaaucuauaaaguaccgagacuuccuggg

SEQ ID NO: 441396 - RNA, 64 nt, Homo Sapiens
ucucaucugucauccgggucgcaguucccagagucgaaucuagaugaggaaaccaaggcaugga

SEQ ID NO: 441397 - RNA, 57 nt, Homo Sapiens
uuccugugcuuuuucucagaaacugggcgaaucuacagaacaaagaacggcauguga

SEQ ID NO: 441398 - RNA, 64 nt, Homo Sapiens
auccauggagcuagaauugugggaaaacuuucuacgaaucuaagcaaugaguuucuucaaagga

SEQ ID NO: 441399 - RNA, 64 nt, Homo Sapiens
uauauaaauuguuuuuuuaauucuucuuuguauacgaaucuauugggguacucuguauaugugu

SEQ ID NO: 441400 - RNA, 64 nt, Homo Sapiens
auucccaucuuacagauaaauacuuuccauacaacgaaucuauuacaugccaaacaauguuagg

SEQ ID NO: 441401 - RNA, 64 nt, Homo Sapiens
uacuugggucuucaggagcugguccaaggagcuucgaaucuaagucaucuagaaugacccugaa

SEQ ID NO: 441402 - RNA, 64 nt, Homo Sapiens
ccugggacaggcuggggccaggucuagagaguugcgaaucuaaauggacacaucucagcagguc

SEQ ID NO: 441403 - RNA, 64 nt, Homo Sapiens
cuucaaaauucucuguauucaaauuugauuguggcgaaucuacuucaaaaaggaaaaauaaucc

SEQ ID NO: 441404 - RNA, 64 nt, Homo Sapiens
uuauuuuaaauuaguagaaaagaggagcuauuuccgaaucuauagaauaaaguaccaccuaaaa

SEQ ID NO: 441405 - RNA, 64 nt, Homo Sapiens
cuccacuuguuagagccucgacaggguuugguuucgaaucuaggaauguuuggguguugaaguc

SEQ ID NO: 441406 - RNA, 64 nt, Homo Sapiens
cguuugcagcacaacaccauugcccggaggcuuccgaaucuagcaaagcagcauauuaaaugac

SEQ ID NO: 441407 - RNA, 64 nt, Homo Sapiens
gaggggcuccuggagucacugcagagggagugugcgaaucuacccugaccaaugggcucaagaa

SEQ ID NO: 441408 - RNA, 55 nt, Homo Sapiens
ggagggggcaggcugaggguggcugcgaaucuagagucucuccugggacaacuag

SEQ ID NO: 441409 - RNA, 64 nt, Homo Sapiens
uucacucaggacacaaaccagacagguuuaauagcgaaucuaauuuugaauucugaccauggau

SEQ ID NO: 441410 - RNA, 64 nt, Homo Sapiens
acaguuggucauauccaaccuuuucuuucucauucgaaucuaccuguaacagacuccugggugu

SEQ ID NO: 441411 - RNA, 64 nt, Homo Sapiens
ucacaauugaguauauaaucuaugaguauuguaccgaaucuaaacaaaaaguuauagagacuuc

SEQ ID NO: 441412 - RNA, 64 nt, Homo Sapiens
gaaacugacccucagcagcugccugauuguuacgcgaaucuagcuuuaacggaagcaaauucau

SEQ ID NO: 441413 - RNA, 64 nt, Homo Sapiens
aauuccacaccuuuuauugaaaacaggucuucaucgaaucuacuaaguccaauguggcaaggaa

SEQ ID NO: 441414 - RNA, 64 nt, Homo Sapiens; identical to SEQ ID NO: 223834

SEQ ID NO: 441415 - RNA, 64 nt, Homo Sapiens; identical to SEQ ID NO: 223835

SEQ ID NO: 441416 - RNA, 64 nt, Homo Sapiens; identical to SEQ ID NO: 223836

SEQ ID NO: 441417 - RNA, 64 nt, Homo Sapiens; identical to SEQ ID NO: 223837

SEQ ID NO: 441418 - RNA, 64 nt, Homo Sapiens; identical to SEQ ID NO: 235935

SEQ ID NO: 441419 - RNA, 64 nt, Homo Sapiens; identical to SEQ ID NO: 235936

SEQ ID NO: 441420 - RNA, 64 nt, Homo Sapiens; identical to SEQ ID NO: 235937

SEQ ID NO: 441421 - RNA, 64 nt, Homo Sapiens; identical to SEQ ID NO: 235938

SEQ ID NO: 441422 - RNA, 64 nt, Homo Sapiens; identical to SEQ ID NO: 235939

SEQ ID NO: 441423 - RNA, 64 nt, Homo Sapiens; identical to SEQ ID NO: 235940

SEQ ID NO: 441424 - RNA, 64 nt, Homo Sapiens; identical to SEQ ID NO: 235941

SEQ ID NO: 441425 - RNA, 64 nt, Homo Sapiens; identical to SEQ ID NO: 235942

SEQ ID NO: 441426 - RNA, 64 nt, Homo Sapiens; identical to SEQ ID NO: 235943

SEQ ID NO: 441427 - RNA, 64 nt, Homo Sapiens; identical to SEQ ID NO: 235944

SEQ ID NO: 441428 - RNA, 64 nt, Homo Sapiens; identical to SEQ ID NO: 235945

SEQ ID NO: 441429 - RNA, 64 nt, Homo Sapiens; identical to SEQ ID NO: 235946

SEQ ID NO: 441430 - RNA, 64 nt, Homo Sapiens; identical to SEQ ID NO: 235947

SEQ ID NO: 441431 - RNA, 64 nt, Homo Sapiens; identical to SEQ ID NO: 235948

SEQ ID NO: 441432 - RNA, 64 nt, Homo Sapiens; identical to SEQ ID NO: 235949

SEQ ID NO: 441433 - RNA, 64 nt, Homo Sapiens; identical to SEQ ID NO: 235950

SEQ ID NO: 441434 - RNA, 64 nt, Homo Sapiens; identical to SEQ ID NO: 235951

SEQ ID NO: 441435 - RNA, 64 nt, Homo Sapiens; identical to SEQ ID NO: 235952

SEQ ID NO: 441436 - RNA, 64 nt, Homo Sapiens; identical to SEQ ID NO: 235953

SEQ ID NO: 441437 - RNA, 64 nt, Homo Sapiens; identical to SEQ ID NO: 235954

SEQ ID NO: 441438 - RNA, 64 nt, Homo Sapiens; identical to SEQ ID NO: 235955

SEQ ID NO: 441439 - RNA, 64 nt, Homo Sapiens; identical to SEQ ID NO: 235956

SEQ ID NO: 441440 - RNA, 64 nt, Homo Sapiens; identical to SEQ ID NO: 235957

SEQ ID NO: 441441 - RNA, 64 nt, Homo Sapiens; identical to SEQ ID NO: 235958

SEQ ID NO: 441442 - RNA, 64 nt, Homo Sapiens; identical to SEQ ID NO: 235959

SEQ ID NO: 441443 - RNA, 64 nt, Homo Sapiens; identical to SEQ ID NO: 235960

SEQ ID NO: 441444 - RNA, 64 nt, Homo Sapiens; identical to SEQ ID NO: 235961

SEQ ID NO: 441445 - RNA, 64 nt, Homo Sapiens; identical to SEQ ID NO: 235962

SEQ ID NO: 441446 - RNA, 64 nt, Homo Sapiens; identical to SEQ ID NO: 235963

SEQ ID NO: 441447 - RNA, 64 nt, Homo Sapiens; identical to SEQ ID NO: 235964

SEQ ID NO: 441448 - RNA, 64 nt, Homo Sapiens; identical to SEQ ID NO: 235965

SEQ ID NO: 441449 - RNA, 64 nt, Homo Sapiens; identical to SEQ ID NO: 235966

SEQ ID NO: 441450 - RNA, 64 nt, Homo Sapiens; identical to SEQ ID NO: 235967

SEQ ID NO: 441451 - RNA, 64 nt, Homo Sapiens; identical to SEQ ID NO: 235968

SEQ ID NO: 441452 - RNA, 64 nt, Homo Sapiens; identical to SEQ ID NO: 235969

SEQ ID NO: 441453 - RNA, 64 nt, Homo Sapiens; identical to SEQ ID NO: 235970

SEQ ID NO: 441454 - RNA, 64 nt, Homo Sapiens; identical to SEQ ID NO: 235971

SEQ ID NO: 441455 - RNA, 64 nt, Homo Sapiens; identical to SEQ ID NO: 235972

SEQ ID NO: 441456 - RNA, 64 nt, Homo Sapiens; identical to SEQ ID NO: 235973

SEQ ID NO: 441457 - RNA, 64 nt, Homo Sapiens; identical to SEQ ID NO: 235974

SEQ ID NO: 441458 - RNA, 58 nt, Homo Sapiens; identical to SEQ ID NO: 235975

SEQ ID NO: 441459 - RNA, 64 nt, Homo Sapiens; identical to SEQ ID NO: 235976

SEQ ID NO: 441460 - RNA, 64 nt, Homo Sapiens; identical to SEQ ID NO: 235977

SEQ ID NO: 441461 - RNA, 64 nt, Homo Sapiens; identical to SEQ ID NO: 235978

SEQ ID NO: 441462 - RNA, 64 nt, Homo Sapiens; identical to SEQ ID NO: 235979

SEQ ID NO: 441463 - RNA, 64 nt, Homo Sapiens; identical to SEQ ID NO: 235980

SEQ ID NO: 441464 - RNA, 64 nt, Homo Sapiens; identical to SEQ ID NO: 235981

SEQ ID NO: 441465 - RNA, 64 nt, Homo Sapiens; identical to SEQ ID NO: 235981

SEQ ID NO: 441466 - RNA, 64 nt, Homo Sapiens; identical to SEQ ID NO: 235983

SEQ ID NO: 441467 - RNA, 64 nt, Homo Sapiens; identical to SEQ ID NO: 235984

SEQ ID NO: 441468 - RNA, 64 nt, Homo Sapiens; identical to SEQ ID NO: 235985

SEQ ID NO: 441469 - RNA, 64 nt, Homo Sapiens; identical to SEQ ID NO: 235986

SEQ ID NO: 441470 - RNA, 64 nt, Homo Sapiens; identical to SEQ ID NO: 235987

SEQ ID NO: 441471 - RNA, 64 nt, Homo Sapiens; identical to SEQ ID NO: 235988

SEQ ID NO: 441472 - RNA, 64 nt, Homo Sapiens; identical to SEQ ID NO: 235989

SEQ ID NO: 441473 - RNA, 64 nt, Homo Sapiens; identical to SEQ ID NO: 235990

SEQ ID NO: 441474 - RNA, 64 nt, Homo Sapiens; identical to SEQ ID NO: 235991

SEQ ID NO: 441475 - RNA, 64 nt, Homo Sapiens; identical to SEQ ID NO: 235992

SEQ ID NO: 441476 - RNA, 64 nt, Homo Sapiens
uauuuucaaaacgaaguucuuacuuuuaaagagaauuaccuauauucuccugauacugauuacc

SEQ ID NO: 441477 - RNA, 64 nt, Homo Sapiens
cugauuugaccaauuuaucaaauaugucauuuuaauuaccuagcuggaaguuagagacaugaaa

SEQ ID NO: 441478 - RNA, 64 nt, Homo Sapiens
acaguuagacaauccaugguuuaaugcacaugaaauuaccuauauuuuauacuguuucaaugua

SEQ ID NO: 441479 - RNA, 64 nt, Homo Sapiens
uucuaagaccauuucauucugaaacuucuuaucaauuaccuaaaucucaacgaaaaacaauuua

SEQ ID NO: 441480 - RNA, 64 nt, Homo Sapiens
gaaaacauuuguucccuguuuguggccacuuauuauuaccuaaaagugaaguuggucagggaca

SEQ ID NO: 441481 - RNA, 64 nt, Homo Sapiens
ucuaguuggccuuugguugauuugaacacuugcaauuaccuagauuagggucaaagacauucua

SEQ ID NO: 441482 - RNA, 64 nt, Homo Sapiens
uagaugcacugcucaccugcuagacauagacaguauuaccuagguaaaauuacauaguauuacc

SEQ ID NO: 441483 - RNA, 64 nt, Homo Sapiens
cauagacaguauuaccuagguaaaauuacauaguauuaccuagacuccacacgcaguaugaaga

SEQ ID NO: 441484 - RNA, 64 nt, Homo Sapiens
aagauuuguaaaaguaaaauacaaacauugaacaauuaccuauauaaaaucucaaauaacaagu

SEQ ID NO: 441485 - RNA, 64 nt, Homo Sapiens
caaugccuuuuaaaagaaaguacucaaacucaguauuaccuacucucgacuuguauuuauuaaa

SEQ ID NO: 441486 - RNA, 64 nt, Homo Sapiens; identical to SEQ ID NO: 274946

SEQ ID NO: 441487 - RNA, 64 nt, Homo Sapiens; identical to SEQ ID NO: 274947

SEQ ID NO: 441488 - RNA, 64 nt, Homo Sapiens; identical to SEQ ID NO: 274948

SEQ ID NO: 441489 - RNA, 64 nt, Homo Sapiens; identical to SEQ ID NO: 274949

SEQ ID NO: 441490 - RNA, 64 nt, Homo Sapiens; identical to SEQ ID NO: 274950

SEQ ID NO: 441491 - RNA, 64 nt, Homo Sapiens; identical to SEQ ID NO: 274951

SEQ ID NO: 441492 - RNA, 64 nt, Homo Sapiens; identical to SEQ ID NO: 274952

SEQ ID NO: 441493 - RNA, 64 nt, Homo Sapiens; identical to SEQ ID NO: 274953

SEQ ID NO: 441494 - RNA, 64 nt, Homo Sapiens; identical to SEQ ID NO: 274954

SEQ ID NO: 441495 - RNA, 64 nt, Homo Sapiens; identical to SEQ ID NO: 274955

SEQ ID NO: 441496 - RNA, 64 nt, Homo Sapiens; identical to SEQ ID NO: 274956

SEQ ID NO: 441497 - RNA, 64 nt, Homo Sapiens; identical to SEQ ID NO: 274957

SEQ ID NO: 441498 - RNA, 64 nt, Homo Sapiens; identical to SEQ ID NO: 274958

SEQ ID NO: 441499 - RNA, 64 nt, Homo Sapiens; identical to SEQ ID NO: 274959

SEQ ID NO: 441500 - RNA, 64 nt, Homo Sapiens; identical to SEQ ID NO: 274960

SEQ ID NO: 441501 - RNA, 64 nt, Homo Sapiens; identical to SEQ ID NO: 274961

SEQ ID NO: 441502 - RNA, 64 nt, Homo Sapiens; identical to SEQ ID NO: 274962

SEQ ID NO: 441503 - RNA, 64 nt, Homo Sapiens; identical to SEQ ID NO: 274963

SEQ ID NO: 441504 - RNA, 64 nt, Homo Sapiens; identical to SEQ ID NO: 274964

SEQ ID NO: 441505 - RNA, 64 nt, Homo Sapiens; identical to SEQ ID NO: 274965

SEQ ID NO: 441506 - RNA, 64 nt, Homo Sapiens; identical to SEQ ID NO: 274966

SEQ ID NO: 441507 - RNA, 64 nt, Homo Sapiens; identical to SEQ ID NO: 274967

SEQ ID NO: 441508 - RNA, 64 nt, Homo Sapiens; identical to SEQ ID NO: 274968

SEQ ID NO: 441509 - RNA, 64 nt, Homo Sapiens; identical to SEQ ID NO: 274969

SEQ ID NO: 441510 - RNA, 64 nt, Homo Sapiens; identical to SEQ ID NO: 274970

SEQ ID NO: 441511 - RNA, 64 nt, Homo Sapiens; identical to SEQ ID NO: 274971

SEQ ID NO: 441512 - RNA, 64 nt, Homo Sapiens; identical to SEQ ID NO: 274972

SEQ ID NO: 441513 - RNA, 64 nt, Homo Sapiens; identical to SEQ ID NO: 274973

SEQ ID NO: 441514 - RNA, 64 nt, Homo Sapiens; identical to SEQ ID NO: 274974

SEQ ID NO: 441515 - RNA, 64 nt, Homo Sapiens; identical to SEQ ID NO: 274975

SEQ ID NO: 441516 - RNA, 64 nt, Homo Sapiens; identical to SEQ ID NO: 274976

SEQ ID NO: 441517 - RNA, 64 nt, Homo Sapiens; identical to SEQ ID NO: 274977

SEQ ID NO: 441518 - RNA, 64 nt, Homo Sapiens; identical to SEQ ID NO: 274978

SEQ ID NO: 441519 - RNA, 64 nt, Homo Sapiens; identical to SEQ ID NO: 274979

SEQ ID NO: 441520 - RNA, 64 nt, Homo Sapiens; identical to SEQ ID NO: 274980

SEQ ID NO: 441521 - RNA, 64 nt, Homo Sapiens; identical to SEQ ID NO: 274981

SEQ ID NO: 441522 - RNA, 59 nt, Homo Sapiens; identical to SEQ ID NO: 274982

SEQ ID NO: 441523 - RNA, 64 nt, Homo Sapiens; identical to SEQ ID NO: 394553

SEQ ID NO: 441524 - RNA, 64 nt, Homo Sapiens; identical to SEQ ID NO: 394554

SEQ ID NO: 441525 - RNA, 64 nt, Homo Sapiens; identical to SEQ ID NO: 394555

SEQ ID NO: 441526 - RNA, 64 nt, Homo Sapiens; identical to SEQ ID NO: 394556

SEQ ID NO: 441527 - RNA, 64 nt, Homo Sapiens; identical to SEQ ID NO: 394557

SEQ ID NO: 441528 - RNA, 64 nt, Homo Sapiens; identical to SEQ ID NO: 394558

SEQ ID NO: 441529 - RNA, 64 nt, Homo Sapiens; identical to SEQ ID NO: 394559

SEQ ID NO: 441530 - RNA, 64 nt, Homo Sapiens; identical to SEQ ID NO: 394560

SEQ ID NO: 441531 - RNA, 64 nt, Homo Sapiens; identical to SEQ ID NO: 394561

SEQ ID NO: 441532 - RNA, 64 nt, Homo Sapiens; identical to SEQ ID NO: 394562

SEQ ID NO: 441533 - RNA, 64 nt, Homo Sapiens; identical to SEQ ID NO: 394563

SEQ ID NO: 441534 - RNA, 64 nt, Homo Sapiens; identical to SEQ ID NO: 394564

SEQ ID NO: 441535 - RNA, 64 nt, Homo Sapiens; identical to SEQ ID NO: 394565

SEQ ID NO: 441536 - RNA, 64 nt, Homo Sapiens; identical to SEQ ID NO: 394566

SEQ ID NO: 441537 - RNA, 64 nt, Homo Sapiens; identical to SEQ ID NO: 394567

SEQ ID NO: 441538 - RNA, 64 nt, Homo Sapiens; identical to SEQ ID NO: 394567

SEQ ID NO: 441539 - RNA, 64 nt, Homo Sapiens; identical to SEQ ID NO: 394569

SEQ ID NO: 441540 - RNA, 64 nt, Homo Sapiens; identical to SEQ ID NO: 394570

SEQ ID NO: 441541 - RNA, 64 nt, Homo Sapiens; identical to SEQ ID NO: 394571

SEQ ID NO: 441542 - RNA, 64 nt, Homo Sapiens; identical to SEQ ID NO: 394572

SEQ ID NO: 441543 - RNA, 64 nt, Homo Sapiens; identical to SEQ ID NO: 394573

SEQ ID NO: 441544 - RNA, 64 nt, Homo Sapiens; identical to SEQ ID NO: 394574

SEQ ID NO: 441545 - RNA, 64 nt, Homo Sapiens; identical to SEQ ID NO: 394575

SEQ ID NO: 441546 - RNA, 64 nt, Homo Sapiens; identical to SEQ ID NO: 394576

SEQ ID NO: 441547 - RNA, 64 nt, Homo Sapiens; identical to SEQ ID NO: 394577

SEQ ID NO: 441548 - RNA, 64 nt, Homo Sapiens; identical to SEQ ID NO: 394578

SEQ ID NO: 441549 - RNA, 64 nt, Homo Sapiens; identical to SEQ ID NO: 394579

SEQ ID NO: 441550 - RNA, 64 nt, Homo Sapiens; identical to SEQ ID NO: 394580

SEQ ID NO: 441551 - RNA, 64 nt, Homo Sapiens; identical to SEQ ID NO: 394581

SEQ ID NO: 441552 - RNA, 64 nt, Homo Sapiens; identical to SEQ ID NO: 394582

SEQ ID NO: 441553 - RNA, 64 nt, Homo Sapiens; identical to SEQ ID NO: 394583

SEQ ID NO: 441554 - RNA, 64 nt, Homo Sapiens; identical to SEQ ID NO: 394584

SEQ ID NO: 441555 - RNA, 64 nt, Homo Sapiens; identical to SEQ ID NO: 394585

SEQ ID NO: 441556 - RNA, 64 nt, Homo Sapiens; identical to SEQ ID NO: 394586

SEQ ID NO: 441557 - RNA, 64 nt, Homo Sapiens; identical to SEQ ID NO: 394587

SEQ ID NO: 441558 - RNA, 64 nt, Homo Sapiens; identical to SEQ ID NO: 394588

SEQ ID NO: 441559 - RNA, 64 nt, Homo Sapiens; identical to SEQ ID NO: 394589

SEQ ID NO: 441560 - RNA, 64 nt, Homo Sapiens; identical to SEQ ID NO: 394590

SEQ ID NO: 441561 - RNA, 63 nt, Homo Sapiens; identical to SEQ ID NO: 66692

SEQ ID NO: 441562 - RNA, 63 nt, Homo Sapiens; identical to SEQ ID NO: 66693

SEQ ID NO: 441563 - RNA, 63 nt, Homo Sapiens; identical to SEQ ID NO: 66694

SEQ ID NO: 441564 - RNA, 63 nt, Homo Sapiens; identical to SEQ ID NO: 66695

SEQ ID NO: 441565 - RNA, 63 nt, Homo Sapiens; identical to SEQ ID NO: 66696

SEQ ID NO: 441566 - RNA, 63 nt, Homo Sapiens; identical to SEQ ID NO: 66697

SEQ ID NO: 441567 - RNA, 63 nt, Homo Sapiens; identical to SEQ ID NO: 66698

SEQ ID NO: 441568 - RNA, 63 nt, Homo Sapiens; identical to SEQ ID NO: 66699

SEQ ID NO: 441569 - RNA, 63 nt, Homo Sapiens; identical to SEQ ID NO: 66700

SEQ ID NO: 441570 - RNA, 63 nt, Homo Sapiens; identical to SEQ ID NO: 66701

SEQ ID NO: 441571 - RNA, 63 nt, Homo Sapiens; identical to SEQ ID NO: 66702

SEQ ID NO: 441572 - RNA, 63 nt, Homo Sapiens; identical to SEQ ID NO: 66703

SEQ ID NO: 441573 - RNA, 63 nt, Homo Sapiens; identical to SEQ ID NO: 66704

SEQ ID NO: 441574 - RNA, 63 nt, Homo Sapiens; identical to SEQ ID NO: 66705

SEQ ID NO: 441575 - RNA, 63 nt, Homo Sapiens; identical to SEQ ID NO: 66706

SEQ ID NO: 441576 - RNA, 63 nt, Homo Sapiens; identical to SEQ ID NO: 66707

SEQ ID NO: 441577 - RNA, 63 nt, Homo Sapiens; identical to SEQ ID NO: 66708

SEQ ID NO: 441578 - RNA, 63 nt, Homo Sapiens; identical to SEQ ID NO: 66709

SEQ ID NO: 441579 - RNA, 63 nt, Homo Sapiens; identical to SEQ ID NO: 66710

SEQ ID NO: 441580 - RNA, 63 nt, Homo Sapiens; identical to SEQ ID NO: 66711

SEQ ID NO: 441581 - RNA, 63 nt, Homo Sapiens; identical to SEQ ID NO: 66712

SEQ ID NO: 441582 - RNA, 63 nt, Homo Sapiens; identical to SEQ ID NO: 66713

SEQ ID NO: 441583 - RNA, 63 nt, Homo Sapiens; identical to SEQ ID NO: 66714

SEQ ID NO: 441584 - RNA, 63 nt, Homo Sapiens; identical to SEQ ID NO: 66715

SEQ ID NO: 441585 - RNA, 63 nt, Homo Sapiens; identical to SEQ ID NO: 66716

SEQ ID NO: 441586 - RNA, 63 nt, Homo Sapiens; identical to SEQ ID NO: 66717

SEQ ID NO: 441587 - RNA, 63 nt, Homo Sapiens; identical to SEQ ID NO: 66718

SEQ ID NO: 441588 - RNA, 63 nt, Homo Sapiens; identical to SEQ ID NO: 66719

SEQ ID NO: 441589 - RNA, 63 nt, Homo Sapiens; identical to SEQ ID NO: 66720

SEQ ID NO: 441590 - RNA, 63 nt, Homo Sapiens; identical to SEQ ID NO: 66721

SEQ ID NO: 441591 - RNA, 63 nt, Homo Sapiens; identical to SEQ ID NO: 66722

SEQ ID NO: 441592 - RNA, 63 nt, Homo Sapiens; identical to SEQ ID NO: 66723

SEQ ID NO: 441593 - RNA, 63 nt, Homo Sapiens; identical to SEQ ID NO: 66724

SEQ ID NO: 441594 - RNA, 63 nt, Homo Sapiens; identical to SEQ ID NO: 66725

SEQ ID NO: 441595 - RNA, 63 nt, Homo Sapiens; identical to SEQ ID NO: 66726

SEQ ID NO: 441596 - RNA, 63 nt, Homo Sapiens; identical to SEQ ID NO: 66727

SEQ ID NO: 441597 - RNA, 63 nt, Homo Sapiens; identical to SEQ ID NO: 66728

SEQ ID NO: 441598 - RNA, 63 nt, Homo Sapiens; identical to SEQ ID NO: 66729

SEQ ID NO: 441599 - RNA, 63 nt, Homo Sapiens; identical to SEQ ID NO: 66730

SEQ ID NO: 441600 - RNA, 63 nt, Homo Sapiens; identical to SEQ ID NO: 66731

SEQ ID NO: 441601 - RNA, 63 nt, Homo Sapiens; identical to SEQ ID NO: 66732

SEQ ID NO: 441602 - RNA, 63 nt, Homo Sapiens; identical to SEQ ID NO: 66733

SEQ ID NO: 441603 - RNA, 63 nt, Homo Sapiens; identical to SEQ ID NO: 66734

SEQ ID NO: 441604 - RNA, 63 nt, Homo Sapiens; identical to SEQ ID NO: 66735

SEQ ID NO: 441605 - RNA, 63 nt, Homo Sapiens; identical to SEQ ID NO: 66736

SEQ ID NO: 441606 - RNA, 63 nt, Homo Sapiens; identical to SEQ ID NO: 66737

SEQ ID NO: 441607 - RNA, 63 nt, Homo Sapiens; identical to SEQ ID NO: 66738

SEQ ID NO: 441608 - RNA, 63 nt, Homo Sapiens; identical to SEQ ID NO: 66739

SEQ ID NO: 441609 - RNA, 63 nt, Homo Sapiens; identical to SEQ ID NO: 66740

SEQ ID NO: 441610 - RNA, 63 nt, Homo Sapiens; identical to SEQ ID NO: 66741

SEQ ID NO: 441611 - RNA, 63 nt, Homo Sapiens; identical to SEQ ID NO: 66742

SEQ ID NO: 441612 - RNA, 63 nt, Homo Sapiens; identical to SEQ ID NO: 66743

SEQ ID NO: 441613 - RNA, 63 nt, Homo Sapiens; identical to SEQ ID NO: 66744

SEQ ID NO: 441614 - RNA, 63 nt, Homo Sapiens; identical to SEQ ID NO: 66745

SEQ ID NO: 441615 - RNA, 63 nt, Homo Sapiens; identical to SEQ ID NO: 66746

SEQ ID NO: 441616 - RNA, 63 nt, Homo Sapiens; identical to SEQ ID NO: 66747

SEQ ID NO: 441617 - RNA, 63 nt, Homo Sapiens; identical to SEQ ID NO: 66748

SEQ ID NO: 441618 - RNA, 63 nt, Homo Sapiens; identical to SEQ ID NO: 66749

SEQ ID NO: 441619 - RNA, 63 nt, Homo Sapiens; identical to SEQ ID NO: 66750

SEQ ID NO: 441620 - RNA, 63 nt, Homo Sapiens; identical to SEQ ID NO: 66751

SEQ ID NO: 441621 - RNA, 63 nt, Homo Sapiens; identical to SEQ ID NO: 66752

SEQ ID NO: 441622 - RNA, 63 nt, Homo Sapiens; identical to SEQ ID NO: 66753

SEQ ID NO: 441623 - RNA, 63 nt, Homo Sapiens; identical to SEQ ID NO: 66754

SEQ ID NO: 441624 - RNA, 63 nt, Homo Sapiens; identical to SEQ ID NO: 66755

SEQ ID NO: 441625 - RNA, 63 nt, Homo Sapiens; identical to SEQ ID NO: 66756

SEQ ID NO: 441626 - RNA, 63 nt, Homo Sapiens; identical to SEQ ID NO: 66757

SEQ ID NO: 441627 - RNA, 63 nt, Homo Sapiens; identical to SEQ ID NO: 66758

SEQ ID NO: 441628 - RNA, 63 nt, Homo Sapiens; identical to SEQ ID NO: 66759

SEQ ID NO: 441629 - RNA, 63 nt, Homo Sapiens; identical to SEQ ID NO: 66760

SEQ ID NO: 441630 - RNA, 63 nt, Homo Sapiens; identical to SEQ ID NO: 66761

SEQ ID NO: 441631 - RNA, 63 nt, Homo Sapiens; identical to SEQ ID NO: 66762

SEQ ID NO: 441632 - RNA, 63 nt, Homo Sapiens; identical to SEQ ID NO: 66763

SEQ ID NO: 441633 - RNA, 63 nt, Homo Sapiens; identical to SEQ ID NO: 66764

SEQ ID NO: 441634 - RNA, 63 nt, Homo Sapiens; identical to SEQ ID NO: 66765

SEQ ID NO: 441635 - RNA, 63 nt, Homo Sapiens; identical to SEQ ID NO: 66766

SEQ ID NO: 441636 - RNA, 63 nt, Homo Sapiens; identical to SEQ ID NO: 66767

SEQ ID NO: 441637 - RNA, 63 nt, Homo Sapiens; identical to SEQ ID NO: 66768

SEQ ID NO: 441638 - RNA, 58 nt, Homo Sapiens; identical to SEQ ID NO: 66050

SEQ ID NO: 441639 - RNA, 63 nt, Homo Sapiens; identical to SEQ ID NO: 66770

SEQ ID NO: 441640 - RNA, 63 nt, Homo Sapiens; identical to SEQ ID NO: 66771

SEQ ID NO: 441641 - RNA, 63 nt, Homo Sapiens; identical to SEQ ID NO: 66772

SEQ ID NO: 441642 - RNA, 63 nt, Homo Sapiens; identical to SEQ ID NO: 66773

SEQ ID NO: 441643 - RNA, 63 nt, Homo Sapiens; identical to SEQ ID NO: 66774

SEQ ID NO: 441644 - RNA, 63 nt, Homo Sapiens; identical to SEQ ID NO: 66775

SEQ ID NO: 441645 - RNA, 63 nt, Homo Sapiens; identical to SEQ ID NO: 66776

SEQ ID NO: 441646 - RNA, 63 nt, Homo Sapiens; identical to SEQ ID NO: 66777

SEQ ID NO: 441647 - RNA, 63 nt, Homo Sapiens; identical to SEQ ID NO: 66778

SEQ ID NO: 441648 - RNA, 63 nt, Homo Sapiens; identical to SEQ ID NO: 66779

SEQ ID NO: 441649 - RNA, 63 nt, Homo Sapiens; identical to SEQ ID NO: 66780

SEQ ID NO: 441650 - RNA, 63 nt, Homo Sapiens; identical to SEQ ID NO: 66781

SEQ ID NO: 441651 - RNA, 63 nt, Homo Sapiens; identical to SEQ ID NO: 66782

SEQ ID NO: 441652 - RNA, 63 nt, Homo Sapiens; identical to SEQ ID NO: 66783

SEQ ID NO: 441653 - RNA, 63 nt, Homo Sapiens; identical to SEQ ID NO: 66784

SEQ ID NO: 441654 - RNA, 63 nt, Homo Sapiens; identical to SEQ ID NO: 66785

SEQ ID NO: 441655 - RNA, 63 nt, Homo Sapiens; identical to SEQ ID NO: 66786

SEQ ID NO: 441656 - RNA, 63 nt, Homo Sapiens; identical to SEQ ID NO: 66787

SEQ ID NO: 441657 - RNA, 63 nt, Homo Sapiens; identical to SEQ ID NO: 66788

SEQ ID NO: 441658 - RNA, 63 nt, Homo Sapiens; identical to SEQ ID NO: 66789

SEQ ID NO: 441659 - RNA, 63 nt, Homo Sapiens; identical to SEQ ID NO: 66790

SEQ ID NO: 441660 - RNA, 63 nt, Homo Sapiens; identical to SEQ ID NO: 66791

SEQ ID NO: 441661 - RNA, 63 nt, Homo Sapiens; identical to SEQ ID NO: 66792

SEQ ID NO: 441662 - RNA, 63 nt, Homo Sapiens; identical to SEQ ID NO: 66793

SEQ ID NO: 441663 - RNA, 63 nt, Homo Sapiens; identical to SEQ ID NO: 66794

SEQ ID NO: 441664 - RNA, 63 nt, Homo Sapiens; identical to SEQ ID NO: 66795

SEQ ID NO: 441665 - RNA, 63 nt, Homo Sapiens; identical to SEQ ID NO: 66796

SEQ ID NO: 441666 - RNA, 63 nt, Homo Sapiens; identical to SEQ ID NO: 66797

SEQ ID NO: 441667 - RNA, 63 nt, Homo Sapiens; identical to SEQ ID NO: 66798

SEQ ID NO: 441668 - RNA, 63 nt, Homo Sapiens; identical to SEQ ID NO: 66799

SEQ ID NO: 441669 - RNA, 63 nt, Homo Sapiens; identical to SEQ ID NO: 66800

SEQ ID NO: 441670 - RNA, 63 nt, Homo Sapiens; identical to SEQ ID NO: 66801

SEQ ID NO: 441671 - RNA, 63 nt, Homo Sapiens; identical to SEQ ID NO: 66802

SEQ ID NO: 441672 - RNA, 63 nt, Homo Sapiens; identical to SEQ ID NO: 66803

SEQ ID NO: 441673 - RNA, 63 nt, Homo Sapiens; identical to SEQ ID NO: 66804

SEQ ID NO: 441674 - RNA, 63 nt, Homo Sapiens; identical to SEQ ID NO: 66805

SEQ ID NO: 441675 - RNA, 63 nt, Homo Sapiens; identical to SEQ ID NO: 66806

SEQ ID NO: 441676 - RNA, 63 nt, Homo Sapiens; identical to SEQ ID NO: 66807

SEQ ID NO: 441677 - RNA, 63 nt, Homo Sapiens; identical to SEQ ID NO: 66808

SEQ ID NO: 441678 - RNA, 63 nt, Homo Sapiens; identical to SEQ ID NO: 66809

SEQ ID NO: 441679 - RNA, 63 nt, Homo Sapiens; identical to SEQ ID NO: 66810

SEQ ID NO: 441680 - RNA, 62 nt, Homo Sapiens; identical to SEQ ID NO: 66092

SEQ ID NO: 441681 - RNA, 63 nt, Homo Sapiens; identical to SEQ ID NO: 66812

SEQ ID NO: 441682 - RNA, 63 nt, Homo Sapiens; identical to SEQ ID NO: 66813

SEQ ID NO: 441683 - RNA, 63 nt, Homo Sapiens; identical to SEQ ID NO: 66814

SEQ ID NO: 441684 - RNA, 63 nt, Homo Sapiens; identical to SEQ ID NO: 66815

SEQ ID NO: 441685 - RNA, 63 nt, Homo Sapiens; identical to SEQ ID NO: 66816

SEQ ID NO: 441686 - RNA, 63 nt, Homo Sapiens; identical to SEQ ID NO: 66817

SEQ ID NO: 441687 - RNA, 63 nt, Homo Sapiens; identical to SEQ ID NO: 66818

SEQ ID NO: 441688 - RNA, 63 nt, Homo Sapiens; identical to SEQ ID NO: 66819

SEQ ID NO: 441689 - RNA, 63 nt, Homo Sapiens; identical to SEQ ID NO: 66820

SEQ ID NO: 441690 - RNA, 63 nt, Homo Sapiens; identical to SEQ ID NO: 66821

SEQ ID NO: 441691 - RNA, 63 nt, Homo Sapiens; identical to SEQ ID NO: 66822

SEQ ID NO: 441692 - RNA, 63 nt, Homo Sapiens; identical to SEQ ID NO: 66823

SEQ ID NO: 441693 - RNA, 63 nt, Homo Sapiens; identical to SEQ ID NO: 66824

SEQ ID NO: 441694 - RNA, 63 nt, Homo Sapiens; identical to SEQ ID NO: 66825

SEQ ID NO: 441695 - RNA, 63 nt, Homo Sapiens; identical to SEQ ID NO: 66826

SEQ ID NO: 441696 - RNA, 63 nt, Homo Sapiens; identical to SEQ ID NO: 66827

SEQ ID NO: 441697 - RNA, 63 nt, Homo Sapiens; identical to SEQ ID NO: 66828

SEQ ID NO: 441698 - RNA, 63 nt, Homo Sapiens; identical to SEQ ID NO: 66829

SEQ ID NO: 441699 - RNA, 63 nt, Homo Sapiens; identical to SEQ ID NO: 66830

SEQ ID NO: 441700 - RNA, 63 nt, Homo Sapiens; identical to SEQ ID NO: 66831

SEQ ID NO: 441701 - RNA, 63 nt, Homo Sapiens; identical to SEQ ID NO: 66832

SEQ ID NO: 441702 - RNA, 63 nt, Homo Sapiens; identical to SEQ ID NO: 66833

SEQ ID NO: 441703 - RNA, 63 nt, Homo Sapiens; identical to SEQ ID NO: 66834

SEQ ID NO: 441704 - RNA, 63 nt, Homo Sapiens; identical to SEQ ID NO: 66835

SEQ ID NO: 441705 - RNA, 63 nt, Homo Sapiens; identical to SEQ ID NO: 66836

SEQ ID NO: 441706 - RNA, 63 nt, Homo Sapiens; identical to SEQ ID NO: 66837

SEQ ID NO: 441707 - RNA, 63 nt, Homo Sapiens; identical to SEQ ID NO: 66838

SEQ ID NO: 441708 - RNA, 63 nt, Homo Sapiens; identical to SEQ ID NO: 66839

SEQ ID NO: 441709 - RNA, 63 nt, Homo Sapiens; identical to SEQ ID NO: 66840

SEQ ID NO: 441710 - RNA, 63 nt, Homo Sapiens; identical to SEQ ID NO: 66841

SEQ ID NO: 441711 - RNA, 63 nt, Homo Sapiens; identical to SEQ ID NO: 66842

SEQ ID NO: 441712 - RNA, 63 nt, Homo Sapiens; identical to SEQ ID NO: 66843

SEQ ID NO: 441713 - RNA, 63 nt, Homo Sapiens; identical to SEQ ID NO: 66844

SEQ ID NO: 441714 - RNA, 63 nt, Homo Sapiens; identical to SEQ ID NO: 66845

SEQ ID NO: 441715 - RNA, 63 nt, Homo Sapiens; identical to SEQ ID NO: 66846

SEQ ID NO: 441716 - RNA, 63 nt, Homo Sapiens; identical to SEQ ID NO: 66847

SEQ ID NO: 441717 - RNA, 63 nt, Homo Sapiens; identical to SEQ ID NO: 66848

SEQ ID NO: 441718 - RNA, 63 nt, Homo Sapiens; identical to SEQ ID NO: 66849

SEQ ID NO: 441719 - RNA, 63 nt, Homo Sapiens; identical to SEQ ID NO: 66850

SEQ ID NO: 441720 - RNA, 63 nt, Homo Sapiens; identical to SEQ ID NO: 66851

SEQ ID NO: 441721 - RNA, 63 nt, Homo Sapiens; identical to SEQ ID NO: 66852

SEQ ID NO: 441722 - RNA, 50 nt, Homo Sapiens; identical to SEQ ID NO: 66134

SEQ ID NO: 441723 - RNA, 63 nt, Homo Sapiens; identical to SEQ ID NO: 66854

SEQ ID NO: 441724 - RNA, 63 nt, Homo Sapiens; identical to SEQ ID NO: 66855

SEQ ID NO: 441725 - RNA, 63 nt, Homo Sapiens; identical to SEQ ID NO: 66856

SEQ ID NO: 441726 - RNA, 63 nt, Homo Sapiens; identical to SEQ ID NO: 66857

SEQ ID NO: 441727 - RNA, 63 nt, Homo Sapiens; identical to SEQ ID NO: 66858

SEQ ID NO: 441728 - RNA, 63 nt, Homo Sapiens; identical to SEQ ID NO: 66859

SEQ ID NO: 441729 - RNA, 63 nt, Homo Sapiens; identical to SEQ ID NO: 66860

SEQ ID NO: 441730 - RNA, 63 nt, Homo Sapiens; identical to SEQ ID NO: 66861

SEQ ID NO: 441731 - RNA, 63 nt, Homo Sapiens; identical to SEQ ID NO: 66862

SEQ ID NO: 441732 - RNA, 63 nt, Homo Sapiens; identical to SEQ ID NO: 66863

SEQ ID NO: 441733 - RNA, 63 nt, Homo Sapiens; identical to SEQ ID NO: 66864

SEQ ID NO: 441734 - RNA, 63 nt, Homo Sapiens; identical to SEQ ID NO: 66865

SEQ ID NO: 441735 - RNA, 63 nt, Homo Sapiens; identical to SEQ ID NO: 66866

SEQ ID NO: 441736 - RNA, 63 nt, Homo Sapiens; identical to SEQ ID NO: 66867

SEQ ID NO: 441737 - RNA, 63 nt, Homo Sapiens; identical to SEQ ID NO: 66868

SEQ ID NO: 441738 - RNA, 63 nt, Homo Sapiens; identical to SEQ ID NO: 66869

SEQ ID NO: 441739 - RNA, 63 nt, Homo Sapiens; identical to SEQ ID NO: 66870

SEQ ID NO: 441740 - RNA, 63 nt, Homo Sapiens; identical to SEQ ID NO: 66871

SEQ ID NO: 441741 - RNA, 63 nt, Homo Sapiens; identical to SEQ ID NO: 66872

SEQ ID NO: 441742 - RNA, 63 nt, Homo Sapiens; identical to SEQ ID NO: 66873

SEQ ID NO: 441743 - RNA, 63 nt, Homo Sapiens; identical to SEQ ID NO: 66874

SEQ ID NO: 441744 - RNA, 63 nt, Homo Sapiens; identical to SEQ ID NO: 66875

SEQ ID NO: 441745 - RNA, 63 nt, Homo Sapiens; identical to SEQ ID NO: 66876

SEQ ID NO: 441746 - RNA, 63 nt, Homo Sapiens; identical to SEQ ID NO: 66877

SEQ ID NO: 441747 - RNA, 63 nt, Homo Sapiens; identical to SEQ ID NO: 66878

SEQ ID NO: 441748 - RNA, 63 nt, Homo Sapiens; identical to SEQ ID NO: 66879

SEQ ID NO: 441749 - RNA, 63 nt, Homo Sapiens; identical to SEQ ID NO: 66880

SEQ ID NO: 441750 - RNA, 61 nt, Homo Sapiens; identical to SEQ ID NO: 66881

SEQ ID NO: 441751 - RNA, 63 nt, Homo Sapiens; identical to SEQ ID NO: 66882

SEQ ID NO: 441752 - RNA, 63 nt, Homo Sapiens; identical to SEQ ID NO: 66883

SEQ ID NO: 441753 - RNA, 63 nt, Homo Sapiens; identical to SEQ ID NO: 66884

SEQ ID NO: 441754 - RNA, 63 nt, Homo Sapiens; identical to SEQ ID NO: 66885

SEQ ID NO: 441755 - RNA, 63 nt, Homo Sapiens; identical to SEQ ID NO: 66886

SEQ ID NO: 441756 - RNA, 63 nt, Homo Sapiens; identical to SEQ ID NO: 66887

SEQ ID NO: 441757 - RNA, 63 nt, Homo Sapiens; identical to SEQ ID NO: 66888

SEQ ID NO: 441758 - RNA, 63 nt, Homo Sapiens; identical to SEQ ID NO: 66889

SEQ ID NO: 441759 - RNA, 63 nt, Homo Sapiens; identical to SEQ ID NO: 66890

SEQ ID NO: 441760 - RNA, 63 nt, Homo Sapiens; identical to SEQ ID NO: 66891

SEQ ID NO: 441761 - RNA, 63 nt, Homo Sapiens; identical to SEQ ID NO: 66892

SEQ ID NO: 441762 - RNA, 63 nt, Homo Sapiens; identical to SEQ ID NO: 66893

SEQ ID NO: 441763 - RNA, 63 nt, Homo Sapiens; identical to SEQ ID NO: 66894

SEQ ID NO: 441764 - RNA, 63 nt, Homo Sapiens; identical to SEQ ID NO: 66895

SEQ ID NO: 441765 - RNA, 63 nt, Homo Sapiens; identical to SEQ ID NO: 66896

SEQ ID NO: 441766 - RNA, 63 nt, Homo Sapiens; identical to SEQ ID NO: 66897

SEQ ID NO: 441767 - RNA, 63 nt, Homo Sapiens; identical to SEQ ID NO: 66898

SEQ ID NO: 441768 - RNA, 63 nt, Homo Sapiens; identical to SEQ ID NO: 66899

SEQ ID NO: 441769 - RNA, 63 nt, Homo Sapiens; identical to SEQ ID NO: 66900

SEQ ID NO: 441770 - RNA, 63 nt, Homo Sapiens; identical to SEQ ID NO: 66901

SEQ ID NO: 441771 - RNA, 63 nt, Homo Sapiens; identical to SEQ ID NO: 66902

SEQ ID NO: 441772 - RNA, 63 nt, Homo Sapiens; identical to SEQ ID NO: 66903

SEQ ID NO: 441773 - RNA, 63 nt, Homo Sapiens; identical to SEQ ID NO: 66904

SEQ ID NO: 441774 - RNA, 63 nt, Homo Sapiens; identical to SEQ ID NO: 66905

SEQ ID NO: 441775 - RNA, 63 nt, Homo Sapiens; identical to SEQ ID NO: 66906

SEQ ID NO: 441776 - RNA, 63 nt, Homo Sapiens; identical to SEQ ID NO: 66907

SEQ ID NO: 441777 - RNA, 63 nt, Homo Sapiens; identical to SEQ ID NO: 66908

SEQ ID NO: 441778 - RNA, 63 nt, Homo Sapiens; identical to SEQ ID NO: 66909

SEQ ID NO: 441779 - RNA, 63 nt, Homo Sapiens; identical to SEQ ID NO: 66910

SEQ ID NO: 441780 - RNA, 63 nt, Homo Sapiens; identical to SEQ ID NO: 66911

SEQ ID NO: 441781 - RNA, 63 nt, Homo Sapiens; identical to SEQ ID NO: 66912

SEQ ID NO: 441782 - RNA, 63 nt, Homo Sapiens; identical to SEQ ID NO: 66913

SEQ ID NO: 441783 - RNA, 51 nt, Homo Sapiens; identical to SEQ ID NO: 66195

SEQ ID NO: 441784 - RNA, 63 nt, Homo Sapiens; identical to SEQ ID NO: 66915

SEQ ID NO: 441785 - RNA, 63 nt, Homo Sapiens; identical to SEQ ID NO: 66916

SEQ ID NO: 441786 - RNA, 63 nt, Homo Sapiens; identical to SEQ ID NO: 66917

SEQ ID NO: 441787 - RNA, 63 nt, Homo Sapiens; identical to SEQ ID NO: 66918

SEQ ID NO: 441788 - RNA, 63 nt, Homo Sapiens; identical to SEQ ID NO: 66919

SEQ ID NO: 441789 - RNA, 63 nt, Homo Sapiens; identical to SEQ ID NO: 66920

SEQ ID NO: 441790 - RNA, 63 nt, Homo Sapiens; identical to SEQ ID NO: 66921

SEQ ID NO: 441791 - RNA, 63 nt, Homo Sapiens; identical to SEQ ID NO: 66922

SEQ ID NO: 441792 - RNA, 63 nt, Homo Sapiens; identical to SEQ ID NO: 66923

SEQ ID NO: 441793 - RNA, 63 nt, Homo Sapiens; identical to SEQ ID NO: 66924

SEQ ID NO: 441794 - RNA, 63 nt, Homo Sapiens; identical to SEQ ID NO: 66925

SEQ ID NO: 441795 - RNA, 63 nt, Homo Sapiens; identical to SEQ ID NO: 66926

SEQ ID NO: 441796 - RNA, 63 nt, Homo Sapiens; identical to SEQ ID NO: 66927

SEQ ID NO: 441797 - RNA, 63 nt, Homo Sapiens; identical to SEQ ID NO: 66928

SEQ ID NO: 441798 - RNA, 63 nt, Homo Sapiens; identical to SEQ ID NO: 66929

SEQ ID NO: 441799 - RNA, 63 nt, Homo Sapiens; identical to SEQ ID NO: 66930

SEQ ID NO: 441800 - RNA, 63 nt, Homo Sapiens; identical to SEQ ID NO: 66931

SEQ ID NO: 441801 - RNA, 63 nt, Homo Sapiens; identical to SEQ ID NO: 66932

SEQ ID NO: 441802 - RNA, 63 nt, Homo Sapiens; identical to SEQ ID NO: 66933

SEQ ID NO: 441803 - RNA, 63 nt, Homo Sapiens; identical to SEQ ID NO: 66934

SEQ ID NO: 441804 - RNA, 63 nt, Homo Sapiens; identical to SEQ ID NO: 66935

SEQ ID NO: 441805 - RNA, 63 nt, Homo Sapiens; identical to SEQ ID NO: 66936

SEQ ID NO: 441806 - RNA, 63 nt, Homo Sapiens; identical to SEQ ID NO: 66937

SEQ ID NO: 441807 - RNA, 63 nt, Homo Sapiens; identical to SEQ ID NO: 66938

SEQ ID NO: 441808 - RNA, 63 nt, Homo Sapiens; identical to SEQ ID NO: 66939

SEQ ID NO: 441809 - RNA, 63 nt, Homo Sapiens; identical to SEQ ID NO: 66940

SEQ ID NO: 441810 - RNA, 63 nt, Homo Sapiens; identical to SEQ ID NO: 66941

SEQ ID NO: 441811 - RNA, 63 nt, Homo Sapiens; identical to SEQ ID NO: 66942

SEQ ID NO: 441812 - RNA, 63 nt, Homo Sapiens; identical to SEQ ID NO: 66943

SEQ ID NO: 441813 - RNA, 63 nt, Homo Sapiens; identical to SEQ ID NO: 66944

SEQ ID NO: 441814 - RNA, 63 nt, Homo Sapiens; identical to SEQ ID NO: 66945

SEQ ID NO: 441815 - RNA, 63 nt, Homo Sapiens; identical to SEQ ID NO: 66946

SEQ ID NO: 441816 - RNA, 63 nt, Homo Sapiens; identical to SEQ ID NO: 66947

SEQ ID NO: 441817 - RNA, 63 nt, Homo Sapiens; identical to SEQ ID NO: 66948

SEQ ID NO: 441818 - RNA, 63 nt, Homo Sapiens; identical to SEQ ID NO: 66949

SEQ ID NO: 441819 - RNA, 63 nt, Homo Sapiens; identical to SEQ ID NO: 66950

SEQ ID NO: 441820 - RNA, 63 nt, Homo Sapiens; identical to SEQ ID NO: 66951

SEQ ID NO: 441821 - RNA, 63 nt, Homo Sapiens; identical to SEQ ID NO: 66952

SEQ ID NO: 441822 - RNA, 63 nt, Homo Sapiens; identical to SEQ ID NO: 66953

SEQ ID NO: 441823 - RNA, 63 nt, Homo Sapiens; identical to SEQ ID NO: 66954

SEQ ID NO: 441824 - RNA, 63 nt, Homo Sapiens; identical to SEQ ID NO: 66955

SEQ ID NO: 441825 - RNA, 63 nt, Homo Sapiens; identical to SEQ ID NO: 66956

SEQ ID NO: 441826 - RNA, 63 nt, Homo Sapiens; identical to SEQ ID NO: 66957

SEQ ID NO: 441827 - RNA, 63 nt, Homo Sapiens; identical to SEQ ID NO: 66958

SEQ ID NO: 441828 - RNA, 63 nt, Homo Sapiens; identical to SEQ ID NO: 66959

SEQ ID NO: 441829 - RNA, 63 nt, Homo Sapiens; identical to SEQ ID NO: 66960

SEQ ID NO: 441830 - RNA, 63 nt, Homo Sapiens; identical to SEQ ID NO: 66961

SEQ ID NO: 441831 - RNA, 63 nt, Homo Sapiens; identical to SEQ ID NO: 66962

SEQ ID NO: 441832 - RNA, 63 nt, Homo Sapiens; identical to SEQ ID NO: 66963

SEQ ID NO: 441833 - RNA, 63 nt, Homo Sapiens; identical to SEQ ID NO: 66964

SEQ ID NO: 441834 - RNA, 63 nt, Homo Sapiens; identical to SEQ ID NO: 66965

SEQ ID NO: 441835 - RNA, 63 nt, Homo Sapiens; identical to SEQ ID NO: 66966

SEQ ID NO: 441836 - RNA, 63 nt, Homo Sapiens; identical to SEQ ID NO: 66967

SEQ ID NO: 441837 - RNA, 63 nt, Homo Sapiens; identical to SEQ ID NO: 66968

SEQ ID NO: 441838 - RNA, 63 nt, Homo Sapiens; identical to SEQ ID NO: 66969

SEQ ID NO: 441839 - RNA, 63 nt, Homo Sapiens; identical to SEQ ID NO: 66970

SEQ ID NO: 441840 - RNA, 63 nt, Homo Sapiens; identical to SEQ ID NO: 66971

SEQ ID NO: 441841 - RNA, 63 nt, Homo Sapiens; identical to SEQ ID NO: 66972

SEQ ID NO: 441842 - RNA, 63 nt, Homo Sapiens; identical to SEQ ID NO: 66973

SEQ ID NO: 441843 - RNA, 63 nt, Homo Sapiens; identical to SEQ ID NO: 66974

SEQ ID NO: 441844 - RNA, 63 nt, Homo Sapiens; identical to SEQ ID NO: 66975

SEQ ID NO: 441845 - RNA, 63 nt, Homo Sapiens; identical to SEQ ID NO: 66976

SEQ ID NO: 441846 - RNA, 63 nt, Homo Sapiens; identical to SEQ ID NO: 66977

SEQ ID NO: 441847 - RNA, 63 nt, Homo Sapiens; identical to SEQ ID NO: 66978

SEQ ID NO: 441848 - RNA, 63 nt, Homo Sapiens; identical to SEQ ID NO: 66979

SEQ ID NO: 441849 - RNA, 63 nt, Homo Sapiens; identical to SEQ ID NO: 66980

SEQ ID NO: 441850 - RNA, 63 nt, Homo Sapiens; identical to SEQ ID NO: 66981

SEQ ID NO: 441851 - RNA, 63 nt, Homo Sapiens; identical to SEQ ID NO: 66982

SEQ ID NO: 441852 - RNA, 63 nt, Homo Sapiens; identical to SEQ ID NO: 66983

SEQ ID NO: 441853 - RNA, 63 nt, Homo Sapiens; identical to SEQ ID NO: 66984

SEQ ID NO: 441854 - RNA, 63 nt, Homo Sapiens; identical to SEQ ID NO: 66985

SEQ ID NO: 441855 - RNA, 63 nt, Homo Sapiens; identical to SEQ ID NO: 66986

SEQ ID NO: 441856 - RNA, 63 nt, Homo Sapiens; identical to SEQ ID NO: 66987

SEQ ID NO: 441857 - RNA, 63 nt, Homo Sapiens; identical to SEQ ID NO: 66988

SEQ ID NO: 441858 - RNA, 63 nt, Homo Sapiens; identical to SEQ ID NO: 66989

SEQ ID NO: 441859 - RNA, 63 nt, Homo Sapiens; identical to SEQ ID NO: 66990

SEQ ID NO: 441860 - RNA, 63 nt, Homo Sapiens; identical to SEQ ID NO: 66991

SEQ ID NO: 441861 - RNA, 63 nt, Homo Sapiens; identical to SEQ ID NO: 66992

SEQ ID NO: 441862 - RNA, 63 nt, Homo Sapiens; identical to SEQ ID NO: 66993

SEQ ID NO: 441863 - RNA, 63 nt, Homo Sapiens; identical to SEQ ID NO: 66994

SEQ ID NO: 441864 - RNA, 63 nt, Homo Sapiens; identical to SEQ ID NO: 66995

SEQ ID NO: 441865 - RNA, 63 nt, Homo Sapiens; identical to SEQ ID NO: 66996

SEQ ID NO: 441866 - RNA, 63 nt, Homo Sapiens; identical to SEQ ID NO: 66997

SEQ ID NO: 441867 - RNA, 63 nt, Homo Sapiens; identical to SEQ ID NO: 66998

SEQ ID NO: 441868 - RNA, 63 nt, Homo Sapiens; identical to SEQ ID NO: 66999

SEQ ID NO: 441869 - RNA, 63 nt, Homo Sapiens; identical to SEQ ID NO: 67000

SEQ ID NO: 441870 - RNA, 63 nt, Homo Sapiens; identical to SEQ ID NO: 67001

SEQ ID NO: 441871 - RNA, 63 nt, Homo Sapiens; identical to SEQ ID NO: 67002

SEQ ID NO: 441872 - RNA, 63 nt, Homo Sapiens; identical to SEQ ID NO: 67003

SEQ ID NO: 441873 - RNA, 63 nt, Homo Sapiens; identical to SEQ ID NO: 67004

SEQ ID NO: 441874 - RNA, 63 nt, Homo Sapiens; identical to SEQ ID NO: 67005

SEQ ID NO: 441875 - RNA, 63 nt, Homo Sapiens; identical to SEQ ID NO: 67006

SEQ ID NO: 441876 - RNA, 63 nt, Homo Sapiens; identical to SEQ ID NO: 67007

SEQ ID NO: 441877 - RNA, 63 nt, Homo Sapiens; identical to SEQ ID NO: 67008

SEQ ID NO: 441878 - RNA, 63 nt, Homo Sapiens; identical to SEQ ID NO: 67009

SEQ ID NO: 441879 - RNA, 63 nt, Homo Sapiens; identical to SEQ ID NO: 67010

SEQ ID NO: 441880 - RNA, 63 nt, Homo Sapiens; identical to SEQ ID NO: 67011

SEQ ID NO: 441881 - RNA, 63 nt, Homo Sapiens; identical to SEQ ID NO: 67012

SEQ ID NO: 441882 - RNA, 63 nt, Homo Sapiens; identical to SEQ ID NO: 67013

SEQ ID NO: 441883 - RNA, 63 nt, Homo Sapiens; identical to SEQ ID NO: 67014

SEQ ID NO: 441884 - RNA, 63 nt, Homo Sapiens; identical to SEQ ID NO: 67015

SEQ ID NO: 441885 - RNA, 63 nt, Homo Sapiens; identical to SEQ ID NO: 67016

SEQ ID NO: 441886 - RNA, 63 nt, Homo Sapiens; identical to SEQ ID NO: 67017

SEQ ID NO: 441887 - RNA, 63 nt, Homo Sapiens; identical to SEQ ID NO: 67018

SEQ ID NO: 441888 - RNA, 63 nt, Homo Sapiens; identical to SEQ ID NO: 67019

SEQ ID NO: 441889 - RNA, 63 nt, Homo Sapiens; identical to SEQ ID NO: 67020

SEQ ID NO: 441890 - RNA, 63 nt, Homo Sapiens; identical to SEQ ID NO: 67021

SEQ ID NO: 441891 - RNA, 63 nt, Homo Sapiens; identical to SEQ ID NO: 67022

SEQ ID NO: 441892 - RNA, 63 nt, Homo Sapiens; identical to SEQ ID NO: 67023

SEQ ID NO: 441893 - RNA, 63 nt, Homo Sapiens; identical to SEQ ID NO: 67024

SEQ ID NO: 441894 - RNA, 63 nt, Homo Sapiens; identical to SEQ ID NO: 67025

SEQ ID NO: 441895 - RNA, 63 nt, Homo Sapiens; identical to SEQ ID NO: 67026

SEQ ID NO: 441896 - RNA, 63 nt, Homo Sapiens; identical to SEQ ID NO: 67027

SEQ ID NO: 441897 - RNA, 63 nt, Homo Sapiens; identical to SEQ ID NO: 67028

SEQ ID NO: 441898 - RNA, 63 nt, Homo Sapiens; identical to SEQ ID NO: 67029

SEQ ID NO: 441899 - RNA, 63 nt, Homo Sapiens; identical to SEQ ID NO: 67030

SEQ ID NO: 441900 - RNA, 63 nt, Homo Sapiens; identical to SEQ ID NO: 67031

SEQ ID NO: 441901 - RNA, 63 nt, Homo Sapiens; identical to SEQ ID NO: 67032

SEQ ID NO: 441902 - RNA, 63 nt, Homo Sapiens; identical to SEQ ID NO: 67033

SEQ ID NO: 441903 - RNA, 63 nt, Homo Sapiens; identical to SEQ ID NO: 67034

SEQ ID NO: 441904 - RNA, 63 nt, Homo Sapiens; identical to SEQ ID NO: 67035

SEQ ID NO: 441905 - RNA, 63 nt, Homo Sapiens; identical to SEQ ID NO: 67036

SEQ ID NO: 441906 - RNA, 63 nt, Homo Sapiens; identical to SEQ ID NO: 67037

SEQ ID NO: 441907 - RNA, 63 nt, Homo Sapiens; identical to SEQ ID NO: 67038

SEQ ID NO: 441908 - RNA, 63 nt, Homo Sapiens; identical to SEQ ID NO: 67039

SEQ ID NO: 441909 - RNA, 63 nt, Homo Sapiens; identical to SEQ ID NO: 67040

SEQ ID NO: 441910 - RNA, 63 nt, Homo Sapiens; identical to SEQ ID NO: 67041

SEQ ID NO: 441911 - RNA, 63 nt, Homo Sapiens; identical to SEQ ID NO: 67042

SEQ ID NO: 441912 - RNA, 63 nt, Homo Sapiens; identical to SEQ ID NO: 67043

SEQ ID NO: 441913 - RNA, 63 nt, Homo Sapiens; identical to SEQ ID NO: 67044

SEQ ID NO: 441914 - RNA, 63 nt, Homo Sapiens; identical to SEQ ID NO: 67045

SEQ ID NO: 441915 - RNA, 63 nt, Homo Sapiens; identical to SEQ ID NO: 67046

SEQ ID NO: 441916 - RNA, 63 nt, Homo Sapiens; identical to SEQ ID NO: 67047

SEQ ID NO: 441917 - RNA, 63 nt, Homo Sapiens; identical to SEQ ID NO: 67048

SEQ ID NO: 441918 - RNA, 63 nt, Homo Sapiens; identical to SEQ ID NO: 67049

SEQ ID NO: 441919 - RNA, 63 nt, Homo Sapiens; identical to SEQ ID NO: 67050

SEQ ID NO: 441920 - RNA, 63 nt, Homo Sapiens; identical to SEQ ID NO: 67051

SEQ ID NO: 441921 - RNA, 63 nt, Homo Sapiens; identical to SEQ ID NO: 67052

SEQ ID NO: 441922 - RNA, 63 nt, Homo Sapiens; identical to SEQ ID NO: 67053

SEQ ID NO: 441923 - RNA, 63 nt, Homo Sapiens; identical to SEQ ID NO: 67054

SEQ ID NO: 441924 - RNA, 63 nt, Homo Sapiens; identical to SEQ ID NO: 67055

SEQ ID NO: 441925 - RNA, 63 nt, Homo Sapiens; identical to SEQ ID NO: 67056

SEQ ID NO: 441926 - RNA, 63 nt, Homo Sapiens; identical to SEQ ID NO: 67057

SEQ ID NO: 441927 - RNA, 63 nt, Homo Sapiens; identical to SEQ ID NO: 67058

SEQ ID NO: 441928 - RNA, 63 nt, Homo Sapiens; identical to SEQ ID NO: 67059

SEQ ID NO: 441929 - RNA, 63 nt, Homo Sapiens; identical to SEQ ID NO: 67060

SEQ ID NO: 441930 - RNA, 63 nt, Homo Sapiens; identical to SEQ ID NO: 67061

SEQ ID NO: 441931 - RNA, 63 nt, Homo Sapiens; identical to SEQ ID NO: 67062

SEQ ID NO: 441932 - RNA, 63 nt, Homo Sapiens; identical to SEQ ID NO: 67063

SEQ ID NO: 441933 - RNA, 63 nt, Homo Sapiens; identical to SEQ ID NO: 67064

SEQ ID NO: 441934 - RNA, 63 nt, Homo Sapiens; identical to SEQ ID NO: 67065

SEQ ID NO: 441935 - RNA, 63 nt, Homo Sapiens; identical to SEQ ID NO: 67066

SEQ ID NO: 441936 - RNA, 63 nt, Homo Sapiens; identical to SEQ ID NO: 67067

SEQ ID NO: 441937 - RNA, 63 nt, Homo Sapiens; identical to SEQ ID NO: 67068

SEQ ID NO: 441938 - RNA, 63 nt, Homo Sapiens; identical to SEQ ID NO: 67069

SEQ ID NO: 441939 - RNA, 63 nt, Homo Sapiens; identical to SEQ ID NO: 67070

SEQ ID NO: 441940 - RNA, 63 nt, Homo Sapiens; identical to SEQ ID NO: 67071

SEQ ID NO: 441941 - RNA, 63 nt, Homo Sapiens; identical to SEQ ID NO: 67072

SEQ ID NO: 441942 - RNA, 63 nt, Homo Sapiens; identical to SEQ ID NO: 67073

SEQ ID NO: 441943 - RNA, 63 nt, Homo Sapiens; identical to SEQ ID NO: 67074

SEQ ID NO: 441944 - RNA, 63 nt, Homo Sapiens; identical to SEQ ID NO: 67075

SEQ ID NO: 441945 - RNA, 63 nt, Homo Sapiens; identical to SEQ ID NO: 67076

SEQ ID NO: 441946 - RNA, 63 nt, Homo Sapiens; identical to SEQ ID NO: 67077

SEQ ID NO: 441947 - RNA, 63 nt, Homo Sapiens; identical to SEQ ID NO: 67078

SEQ ID NO: 441948 - RNA, 63 nt, Homo Sapiens; identical to SEQ ID NO: 67079

SEQ ID NO: 441949 - RNA, 63 nt, Homo Sapiens; identical to SEQ ID NO: 67080

SEQ ID NO: 441950 - RNA, 63 nt, Homo Sapiens; identical to SEQ ID NO: 67081

SEQ ID NO: 441951 - RNA, 63 nt, Homo Sapiens; identical to SEQ ID NO: 67082

SEQ ID NO: 441952 - RNA, 63 nt, Homo Sapiens; identical to SEQ ID NO: 67083

SEQ ID NO: 441953 - RNA, 63 nt, Homo Sapiens; identical to SEQ ID NO: 67084

SEQ ID NO: 441954 - RNA, 63 nt, Homo Sapiens; identical to SEQ ID NO: 67085

SEQ ID NO: 441955 - RNA, 63 nt, Homo Sapiens; identical to SEQ ID NO: 67086

SEQ ID NO: 441956 - RNA, 63 nt, Homo Sapiens; identical to SEQ ID NO: 67087

SEQ ID NO: 441957 - RNA, 63 nt, Homo Sapiens; identical to SEQ ID NO: 67088

SEQ ID NO: 441958 - RNA, 63 nt, Homo Sapiens; identical to SEQ ID NO: 67089

SEQ ID NO: 441959 - RNA, 63 nt, Homo Sapiens; identical to SEQ ID NO: 67090

SEQ ID NO: 441960 - RNA, 63 nt, Homo Sapiens; identical to SEQ ID NO: 67091

SEQ ID NO: 441961 - RNA, 63 nt, Homo Sapiens; identical to SEQ ID NO: 67092

SEQ ID NO: 441962 - RNA, 63 nt, Homo Sapiens; identical to SEQ ID NO: 67093

SEQ ID NO: 441963 - RNA, 63 nt, Homo Sapiens; identical to SEQ ID NO: 67094

SEQ ID NO: 441964 - RNA, 63 nt, Homo Sapiens; identical to SEQ ID NO: 67095

SEQ ID NO: 441965 - RNA, 63 nt, Homo Sapiens; identical to SEQ ID NO: 67096

SEQ ID NO: 441966 - RNA, 63 nt, Homo Sapiens; identical to SEQ ID NO: 67097

SEQ ID NO: 441967 - RNA, 63 nt, Homo Sapiens; identical to SEQ ID NO: 67098

SEQ ID NO: 441968 - RNA, 63 nt, Homo Sapiens; identical to SEQ ID NO: 67099

SEQ ID NO: 441969 - RNA, 63 nt, Homo Sapiens; identical to SEQ ID NO: 67100

SEQ ID NO: 441970 - RNA, 63 nt, Homo Sapiens; identical to SEQ ID NO: 67101

SEQ ID NO: 441971 - RNA, 63 nt, Homo Sapiens; identical to SEQ ID NO: 67102

SEQ ID NO: 441972 - RNA, 63 nt, Homo Sapiens; identical to SEQ ID NO: 67103

SEQ ID NO: 441973 - RNA, 63 nt, Homo Sapiens; identical to SEQ ID NO: 67104

SEQ ID NO: 441974 - RNA, 63 nt, Homo Sapiens; identical to SEQ ID NO: 67105

SEQ ID NO: 441975 - RNA, 63 nt, Homo Sapiens; identical to SEQ ID NO: 67106

SEQ ID NO: 441976 - RNA, 63 nt, Homo Sapiens; identical to SEQ ID NO: 67107

SEQ ID NO: 441977 - RNA, 63 nt, Homo Sapiens; identical to SEQ ID NO: 67108

SEQ ID NO: 441978 - RNA, 63 nt, Homo Sapiens; identical to SEQ ID NO: 67109

SEQ ID NO: 441979 - RNA, 63 nt, Homo Sapiens; identical to SEQ ID NO: 67110

SEQ ID NO: 441980 - RNA, 63 nt, Homo Sapiens; identical to SEQ ID NO: 67111

SEQ ID NO: 441981 - RNA, 63 nt, Homo Sapiens; identical to SEQ ID NO: 67112

SEQ ID NO: 441982 - RNA, 63 nt, Homo Sapiens; identical to SEQ ID NO: 67113

SEQ ID NO: 441983 - RNA, 63 nt, Homo Sapiens; identical to SEQ ID NO: 67114

SEQ ID NO: 441984 - RNA, 63 nt, Homo Sapiens; identical to SEQ ID NO: 67115

SEQ ID NO: 441985 - RNA, 63 nt, Homo Sapiens; identical to SEQ ID NO: 67116

SEQ ID NO: 441986 - RNA, 63 nt, Homo Sapiens; identical to SEQ ID NO: 67117

SEQ ID NO: 441987 - RNA, 63 nt, Homo Sapiens; identical to SEQ ID NO: 67118

SEQ ID NO: 441988 - RNA, 63 nt, Homo Sapiens; identical to SEQ ID NO: 67119

SEQ ID NO: 441989 - RNA, 63 nt, Homo Sapiens; identical to SEQ ID NO: 67120

SEQ ID NO: 441990 - RNA, 63 nt, Homo Sapiens; identical to SEQ ID NO: 67121

SEQ ID NO: 441991 - RNA, 63 nt, Homo Sapiens; identical to SEQ ID NO: 67122

SEQ ID NO: 441992 - RNA, 63 nt, Homo Sapiens; identical to SEQ ID NO: 67123

SEQ ID NO: 441993 - RNA, 63 nt, Homo Sapiens; identical to SEQ ID NO: 67124

SEQ ID NO: 441994 - RNA, 63 nt, Homo Sapiens; identical to SEQ ID NO: 67125

SEQ ID NO: 441995 - RNA, 63 nt, Homo Sapiens; identical to SEQ ID NO: 67126

SEQ ID NO: 441996 - RNA, 63 nt, Homo Sapiens; identical to SEQ ID NO: 67127

SEQ ID NO: 441997 - RNA, 63 nt, Homo Sapiens; identical to SEQ ID NO: 67128

SEQ ID NO: 441998 - RNA, 63 nt, Homo Sapiens; identical to SEQ ID NO: 67129

SEQ ID NO: 441999 - RNA, 63 nt, Homo Sapiens; identical to SEQ ID NO: 67130

SEQ ID NO: 442000 - RNA, 63 nt, Homo Sapiens; identical to SEQ ID NO: 67131

SEQ ID NO: 442001 - RNA, 63 nt, Homo Sapiens; identical to SEQ ID NO: 67132

SEQ ID NO: 442002 - RNA, 63 nt, Homo Sapiens; identical to SEQ ID NO: 67133

SEQ ID NO: 442003 - RNA, 63 nt, Homo Sapiens; identical to SEQ ID NO: 67134

SEQ ID NO: 442004 - RNA, 63 nt, Homo Sapiens; identical to SEQ ID NO: 67135

SEQ ID NO: 442005 - RNA, 63 nt, Homo Sapiens; identical to SEQ ID NO: 67136

SEQ ID NO: 442006 - RNA, 63 nt, Homo Sapiens; identical to SEQ ID NO: 67137

SEQ ID NO: 442007 - RNA, 63 nt, Homo Sapiens; identical to SEQ ID NO: 67138

SEQ ID NO: 442008 - RNA, 63 nt, Homo Sapiens; identical to SEQ ID NO: 67139

SEQ ID NO: 442009 - RNA, 63 nt, Homo Sapiens; identical to SEQ ID NO: 67140

SEQ ID NO: 442010 - RNA, 63 nt, Homo Sapiens; identical to SEQ ID NO: 67141

SEQ ID NO: 442011 - RNA, 63 nt, Homo Sapiens; identical to SEQ ID NO: 67142

SEQ ID NO: 442012 - RNA, 63 nt, Homo Sapiens; identical to SEQ ID NO: 67143

SEQ ID NO: 442013 - RNA, 56 nt, Homo Sapiens; identical to SEQ ID NO: 66425

SEQ ID NO: 442014 - RNA, 63 nt, Homo Sapiens; identical to SEQ ID NO: 67145

SEQ ID NO: 442015 - RNA, 63 nt, Homo Sapiens; identical to SEQ ID NO: 67146

SEQ ID NO: 442016 - RNA, 63 nt, Homo Sapiens; identical to SEQ ID NO: 67147

SEQ ID NO: 442017 - RNA, 63 nt, Homo Sapiens; identical to SEQ ID NO: 67148

SEQ ID NO: 442018 - RNA, 63 nt, Homo Sapiens; identical to SEQ ID NO: 67149

SEQ ID NO: 442019 - RNA, 63 nt, Homo Sapiens; identical to SEQ ID NO: 67150

SEQ ID NO: 442020 - RNA, 63 nt, Homo Sapiens; identical to SEQ ID NO: 67151

SEQ ID NO: 442021 - RNA, 63 nt, Homo Sapiens; identical to SEQ ID NO: 67152

SEQ ID NO: 442022 - RNA, 63 nt, Homo Sapiens; identical to SEQ ID NO: 67153

SEQ ID NO: 442023 - RNA, 63 nt, Homo Sapiens; identical to SEQ ID NO: 67154

SEQ ID NO: 442024 - RNA, 63 nt, Homo Sapiens; identical to SEQ ID NO: 67155

SEQ ID NO: 442025 - RNA, 63 nt, Homo Sapiens; identical to SEQ ID NO: 67156

SEQ ID NO: 442026 - RNA, 63 nt, Homo Sapiens; identical to SEQ ID NO: 67157

SEQ ID NO: 442027 - RNA, 63 nt, Homo Sapiens; identical to SEQ ID NO: 67158

SEQ ID NO: 442028 - RNA, 63 nt, Homo Sapiens; identical to SEQ ID NO: 67159

SEQ ID NO: 442029 - RNA, 63 nt, Homo Sapiens; identical to SEQ ID NO: 67160

SEQ ID NO: 442030 - RNA, 63 nt, Homo Sapiens; identical to SEQ ID NO: 67161

SEQ ID NO: 442031 - RNA, 63 nt, Homo Sapiens; identical to SEQ ID NO: 67162

SEQ ID NO: 442032 - RNA, 63 nt, Homo Sapiens; identical to SEQ ID NO: 67163

SEQ ID NO: 442033 - RNA, 63 nt, Homo Sapiens; identical to SEQ ID NO: 67164

SEQ ID NO: 442034 - RNA, 63 nt, Homo Sapiens; identical to SEQ ID NO: 67165

SEQ ID NO: 442035 - RNA, 63 nt, Homo Sapiens; identical to SEQ ID NO: 67166

SEQ ID NO: 442036 - RNA, 63 nt, Homo Sapiens; identical to SEQ ID NO: 67167

SEQ ID NO: 442037 - RNA, 63 nt, Homo Sapiens; identical to SEQ ID NO: 67168

SEQ ID NO: 442038 - RNA, 63 nt, Homo Sapiens; identical to SEQ ID NO: 67169

SEQ ID NO: 442039 - RNA, 63 nt, Homo Sapiens; identical to SEQ ID NO: 67170

SEQ ID NO: 442040 - RNA, 63 nt, Homo Sapiens; identical to SEQ ID NO: 67171

SEQ ID NO: 442041 - RNA, 63 nt, Homo Sapiens; identical to SEQ ID NO: 67172

SEQ ID NO: 442042 - RNA, 63 nt, Homo Sapiens; identical to SEQ ID NO: 67173

SEQ ID NO: 442043 - RNA, 63 nt, Homo Sapiens; identical to SEQ ID NO: 67174

SEQ ID NO: 442044 - RNA, 63 nt, Homo Sapiens; identical to SEQ ID NO: 67175

SEQ ID NO: 442045 - RNA, 63 nt, Homo Sapiens; identical to SEQ ID NO: 67176

SEQ ID NO: 442046 - RNA, 63 nt, Homo Sapiens; identical to SEQ ID NO: 67177

SEQ ID NO: 442047 - RNA, 63 nt, Homo Sapiens; identical to SEQ ID NO: 67178

SEQ ID NO: 442048 - RNA, 63 nt, Homo Sapiens; identical to SEQ ID NO: 67179

SEQ ID NO: 442049 - RNA, 63 nt, Homo Sapiens; identical to SEQ ID NO: 67180

SEQ ID NO: 442050 - RNA, 63 nt, Homo Sapiens; identical to SEQ ID NO: 67181

SEQ ID NO: 442051 - RNA, 63 nt, Homo Sapiens; identical to SEQ ID NO: 67182

SEQ ID NO: 442052 - RNA, 63 nt, Homo Sapiens; identical to SEQ ID NO: 67183

SEQ ID NO: 442053 - RNA, 63 nt, Homo Sapiens; identical to SEQ ID NO: 67184

SEQ ID NO: 442054 - RNA, 63 nt, Homo Sapiens; identical to SEQ ID NO: 67185

SEQ ID NO: 442055 - RNA, 63 nt, Homo Sapiens; identical to SEQ ID NO: 67186

SEQ ID NO: 442056 - RNA, 63 nt, Homo Sapiens; identical to SEQ ID NO: 67187

SEQ ID NO: 442057 - RNA, 63 nt, Homo Sapiens; identical to SEQ ID NO: 67188

SEQ ID NO: 442058 - RNA, 63 nt, Homo Sapiens; identical to SEQ ID NO: 67189

SEQ ID NO: 442059 - RNA, 63 nt, Homo Sapiens; identical to SEQ ID NO: 67190

SEQ ID NO: 442060 - RNA, 63 nt, Homo Sapiens; identical to SEQ ID NO: 67191

SEQ ID NO: 442061 - RNA, 63 nt, Homo Sapiens; identical to SEQ ID NO: 67192

SEQ ID NO: 442062 - RNA, 63 nt, Homo Sapiens; identical to SEQ ID NO: 67193

SEQ ID NO: 442063 - RNA, 63 nt, Homo Sapiens; identical to SEQ ID NO: 67194

SEQ ID NO: 442064 - RNA, 63 nt, Homo Sapiens; identical to SEQ ID NO: 67195

SEQ ID NO: 442065 - RNA, 63 nt, Homo Sapiens; identical to SEQ ID NO: 67196

SEQ ID NO: 442066 - RNA, 63 nt, Homo Sapiens; identical to SEQ ID NO: 67197

SEQ ID NO: 442067 - RNA, 63 nt, Homo Sapiens; identical to SEQ ID NO: 67198

SEQ ID NO: 442068 - RNA, 63 nt, Homo Sapiens; identical to SEQ ID NO: 67199

SEQ ID NO: 442069 - RNA, 63 nt, Homo Sapiens; identical to SEQ ID NO: 67200

SEQ ID NO: 442070 - RNA, 63 nt, Homo Sapiens; identical to SEQ ID NO: 67201

SEQ ID NO: 442071 - RNA, 63 nt, Homo Sapiens; identical to SEQ ID NO: 67202

SEQ ID NO: 442072 - RNA, 63 nt, Homo Sapiens; identical to SEQ ID NO: 67203

SEQ ID NO: 442073 - RNA, 63 nt, Homo Sapiens; identical to SEQ ID NO: 67204

SEQ ID NO: 442074 - RNA, 63 nt, Homo Sapiens; identical to SEQ ID NO: 67205

SEQ ID NO: 442075 - RNA, 63 nt, Homo Sapiens; identical to SEQ ID NO: 67206

SEQ ID NO: 442076 - RNA, 63 nt, Homo Sapiens; identical to SEQ ID NO: 67207

SEQ ID NO: 442077 - RNA, 63 nt, Homo Sapiens; identical to SEQ ID NO: 67208

SEQ ID NO: 442078 - RNA, 63 nt, Homo Sapiens; identical to SEQ ID NO: 67209

SEQ ID NO: 442079 - RNA, 63 nt, Homo Sapiens; identical to SEQ ID NO: 67210

SEQ ID NO: 442080 - RNA, 63 nt, Homo Sapiens; identical to SEQ ID NO: 67211

SEQ ID NO: 442081 - RNA, 63 nt, Homo Sapiens; identical to SEQ ID NO: 67212

SEQ ID NO: 442082 - RNA, 63 nt, Homo Sapiens; identical to SEQ ID NO: 67213

SEQ ID NO: 442083 - RNA, 63 nt, Homo Sapiens; identical to SEQ ID NO: 67214

SEQ ID NO: 442084 - RNA, 63 nt, Homo Sapiens; identical to SEQ ID NO: 67215

SEQ ID NO: 442085 - RNA, 63 nt, Homo Sapiens; identical to SEQ ID NO: 67216

SEQ ID NO: 442086 - RNA, 63 nt, Homo Sapiens; identical to SEQ ID NO: 67217

SEQ ID NO: 442087 - RNA, 63 nt, Homo Sapiens; identical to SEQ ID NO: 67218

SEQ ID NO: 442088 - RNA, 63 nt, Homo Sapiens; identical to SEQ ID NO: 67219

SEQ ID NO: 442089 - RNA, 63 nt, Homo Sapiens; identical to SEQ ID NO: 67220

SEQ ID NO: 442090 - RNA, 63 nt, Homo Sapiens; identical to SEQ ID NO: 67221

SEQ ID NO: 442091 - RNA, 63 nt, Homo Sapiens; identical to SEQ ID NO: 67222

SEQ ID NO: 442092 - RNA, 63 nt, Homo Sapiens; identical to SEQ ID NO: 67223

SEQ ID NO: 442093 - RNA, 63 nt, Homo Sapiens; identical to SEQ ID NO: 67224

SEQ ID NO: 442094 - RNA, 63 nt, Homo Sapiens; identical to SEQ ID NO: 67225

SEQ ID NO: 442095 - RNA, 63 nt, Homo Sapiens; identical to SEQ ID NO: 67226

SEQ ID NO: 442096 - RNA, 63 nt, Homo Sapiens; identical to SEQ ID NO: 67227

SEQ ID NO: 442097 - RNA, 63 nt, Homo Sapiens; identical to SEQ ID NO: 67228

SEQ ID NO: 442098 - RNA, 63 nt, Homo Sapiens; identical to SEQ ID NO: 67229

SEQ ID NO: 442099 - RNA, 63 nt, Homo Sapiens; identical to SEQ ID NO: 67230

SEQ ID NO: 442100 - RNA, 63 nt, Homo Sapiens; identical to SEQ ID NO: 67231

SEQ ID NO: 442101 - RNA, 63 nt, Homo Sapiens; identical to SEQ ID NO: 67232

SEQ ID NO: 442102 - RNA, 63 nt, Homo Sapiens; identical to SEQ ID NO: 67233

SEQ ID NO: 442103 - RNA, 63 nt, Homo Sapiens; identical to SEQ ID NO: 67234

SEQ ID NO: 442104 - RNA, 63 nt, Homo Sapiens; identical to SEQ ID NO: 67235

SEQ ID NO: 442105 - RNA, 63 nt, Homo Sapiens; identical to SEQ ID NO: 67236

SEQ ID NO: 442106 - RNA, 63 nt, Homo Sapiens; identical to SEQ ID NO: 67237

SEQ ID NO: 442107 - RNA, 63 nt, Homo Sapiens; identical to SEQ ID NO: 67238

SEQ ID NO: 442108 - RNA, 63 nt, Homo Sapiens; identical to SEQ ID NO: 67239

SEQ ID NO: 442109 - RNA, 63 nt, Homo Sapiens; identical to SEQ ID NO: 67240

SEQ ID NO: 442110 - RNA, 63 nt, Homo Sapiens; identical to SEQ ID NO: 67241

SEQ ID NO: 442111 - RNA, 63 nt, Homo Sapiens; identical to SEQ ID NO: 67242

SEQ ID NO: 442112 - RNA, 63 nt, Homo Sapiens; identical to SEQ ID NO: 67243

SEQ ID NO: 442113 - RNA, 63 nt, Homo Sapiens; identical to SEQ ID NO: 67244

SEQ ID NO: 442114 - RNA, 63 nt, Homo Sapiens; identical to SEQ ID NO: 67245

SEQ ID NO: 442115 - RNA, 63 nt, Homo Sapiens; identical to SEQ ID NO: 67246

SEQ ID NO: 442116 - RNA, 63 nt, Homo Sapiens; identical to SEQ ID NO: 67247

SEQ ID NO: 442117 - RNA, 63 nt, Homo Sapiens; identical to SEQ ID NO: 67248

SEQ ID NO: 442118 - RNA, 63 nt, Homo Sapiens; identical to SEQ ID NO: 67249

SEQ ID NO: 442119 - RNA, 63 nt, Homo Sapiens; identical to SEQ ID NO: 67250

SEQ ID NO: 442120 - RNA, 63 nt, Homo Sapiens; identical to SEQ ID NO: 67251

SEQ ID NO: 442121 - RNA, 63 nt, Homo Sapiens; identical to SEQ ID NO: 67252

SEQ ID NO: 442122 - RNA, 63 nt, Homo Sapiens; identical to SEQ ID NO: 67253

SEQ ID NO: 442123 - RNA, 63 nt, Homo Sapiens; identical to SEQ ID NO: 67254

SEQ ID NO: 442124 - RNA, 63 nt, Homo Sapiens; identical to SEQ ID NO: 67255

SEQ ID NO: 442125 - RNA, 63 nt, Homo Sapiens; identical to SEQ ID NO: 67256

SEQ ID NO: 442126 - RNA, 63 nt, Homo Sapiens; identical to SEQ ID NO: 67257

SEQ ID NO: 442127 - RNA, 63 nt, Homo Sapiens; identical to SEQ ID NO: 67258

SEQ ID NO: 442128 - RNA, 63 nt, Homo Sapiens; identical to SEQ ID NO: 67259

SEQ ID NO: 442129 - RNA, 63 nt, Homo Sapiens; identical to SEQ ID NO: 67260

SEQ ID NO: 442130 - RNA, 63 nt, Homo Sapiens; identical to SEQ ID NO: 67261

SEQ ID NO: 442131 - RNA, 63 nt, Homo Sapiens; identical to SEQ ID NO: 67262

SEQ ID NO: 442132 - RNA, 63 nt, Homo Sapiens; identical to SEQ ID NO: 67263

SEQ ID NO: 442133 - RNA, 63 nt, Homo Sapiens; identical to SEQ ID NO: 67264

SEQ ID NO: 442134 - RNA, 63 nt, Homo Sapiens; identical to SEQ ID NO: 67265

SEQ ID NO: 442135 - RNA, 63 nt, Homo Sapiens; identical to SEQ ID NO: 67266

SEQ ID NO: 442136 - RNA, 63 nt, Homo Sapiens; identical to SEQ ID NO: 67267

SEQ ID NO: 442137 - RNA, 63 nt, Homo Sapiens; identical to SEQ ID NO: 67268

SEQ ID NO: 442138 - RNA, 63 nt, Homo Sapiens; identical to SEQ ID NO: 67269

SEQ ID NO: 442139 - RNA, 63 nt, Homo Sapiens; identical to SEQ ID NO: 67270

SEQ ID NO: 442140 - RNA, 63 nt, Homo Sapiens; identical to SEQ ID NO: 67271

SEQ ID NO: 442141 - RNA, 63 nt, Homo Sapiens; identical to SEQ ID NO: 67272

SEQ ID NO: 442142 - RNA, 63 nt, Homo Sapiens; identical to SEQ ID NO: 67273

SEQ ID NO: 442143 - RNA, 63 nt, Homo Sapiens; identical to SEQ ID NO: 67274

SEQ ID NO: 442144 - RNA, 63 nt, Homo Sapiens; identical to SEQ ID NO: 67275

SEQ ID NO: 442145 - RNA, 63 nt, Homo Sapiens; identical to SEQ ID NO: 67276

SEQ ID NO: 442146 - RNA, 63 nt, Homo Sapiens; identical to SEQ ID NO: 67277

SEQ ID NO: 442147 - RNA, 63 nt, Homo Sapiens; identical to SEQ ID NO: 67278

SEQ ID NO: 442148 - RNA, 63 nt, Homo Sapiens; identical to SEQ ID NO: 67279

SEQ ID NO: 442149 - RNA, 63 nt, Homo Sapiens; identical to SEQ ID NO: 67280

SEQ ID NO: 442150 - RNA, 63 nt, Homo Sapiens; identical to SEQ ID NO: 67281

SEQ ID NO: 442151 - RNA, 63 nt, Homo Sapiens; identical to SEQ ID NO: 67282

SEQ ID NO: 442152 - RNA, 63 nt, Homo Sapiens; identical to SEQ ID NO: 67283

SEQ ID NO: 442153 - RNA, 63 nt, Homo Sapiens; identical to SEQ ID NO: 67284

SEQ ID NO: 442154 - RNA, 63 nt, Homo Sapiens; identical to SEQ ID NO: 67285

SEQ ID NO: 442155 - RNA, 63 nt, Homo Sapiens; identical to SEQ ID NO: 67286

SEQ ID NO: 442156 - RNA, 63 nt, Homo Sapiens; identical to SEQ ID NO: 67287

SEQ ID NO: 442157 - RNA, 63 nt, Homo Sapiens; identical to SEQ ID NO: 67288

SEQ ID NO: 442158 - RNA, 63 nt, Homo Sapiens; identical to SEQ ID NO: 67289

SEQ ID NO: 442159 - RNA, 63 nt, Homo Sapiens; identical to SEQ ID NO: 67290

SEQ ID NO: 442160 - RNA, 63 nt, Homo Sapiens; identical to SEQ ID NO: 67291

SEQ ID NO: 442161 - RNA, 63 nt, Homo Sapiens; identical to SEQ ID NO: 67292

SEQ ID NO: 442162 - RNA, 63 nt, Homo Sapiens; identical to SEQ ID NO: 67293

SEQ ID NO: 442163 - RNA, 63 nt, Homo Sapiens; identical to SEQ ID NO: 67294

SEQ ID NO: 442164 - RNA, 63 nt, Homo Sapiens; identical to SEQ ID NO: 67295

SEQ ID NO: 442165 - RNA, 63 nt, Homo Sapiens; identical to SEQ ID NO: 67296

SEQ ID NO: 442166 - RNA, 63 nt, Homo Sapiens; identical to SEQ ID NO: 67297

SEQ ID NO: 442167 - RNA, 63 nt, Homo Sapiens; identical to SEQ ID NO: 67298

SEQ ID NO: 442168 - RNA, 63 nt, Homo Sapiens; identical to SEQ ID NO: 67299

SEQ ID NO: 442169 - RNA, 63 nt, Homo Sapiens; identical to SEQ ID NO: 67300

SEQ ID NO: 442170 - RNA, 63 nt, Homo Sapiens; identical to SEQ ID NO: 67301

SEQ ID NO: 442171 - RNA, 63 nt, Homo Sapiens; identical to SEQ ID NO: 67302

SEQ ID NO: 442172 - RNA, 63 nt, Homo Sapiens; identical to SEQ ID NO: 67303

SEQ ID NO: 442173 - RNA, 63 nt, Homo Sapiens; identical to SEQ ID NO: 67304

SEQ ID NO: 442174 - RNA, 63 nt, Homo Sapiens; identical to SEQ ID NO: 67305

SEQ ID NO: 442175 - RNA, 63 nt, Homo Sapiens; identical to SEQ ID NO: 67306

SEQ ID NO: 442176 - RNA, 63 nt, Homo Sapiens; identical to SEQ ID NO: 67307

SEQ ID NO: 442177 - RNA, 63 nt, Homo Sapiens; identical to SEQ ID NO: 67308

SEQ ID NO: 442178 - RNA, 63 nt, Homo Sapiens; identical to SEQ ID NO: 67309

SEQ ID NO: 442179 - RNA, 63 nt, Homo Sapiens; identical to SEQ ID NO: 67310

SEQ ID NO: 442180 - RNA, 63 nt, Homo Sapiens; identical to SEQ ID NO: 67311

SEQ ID NO: 442181 - RNA, 63 nt, Homo Sapiens; identical to SEQ ID NO: 67312

SEQ ID NO: 442182 - RNA, 63 nt, Homo Sapiens; identical to SEQ ID NO: 67313

SEQ ID NO: 442183 - RNA, 63 nt, Homo Sapiens; identical to SEQ ID NO: 67314

SEQ ID NO: 442184 - RNA, 63 nt, Homo Sapiens; identical to SEQ ID NO: 67315

SEQ ID NO: 442185 - RNA, 63 nt, Homo Sapiens; identical to SEQ ID NO: 67316

SEQ ID NO: 442186 - RNA, 63 nt, Homo Sapiens; identical to SEQ ID NO: 67317

SEQ ID NO: 442187 - RNA, 63 nt, Homo Sapiens; identical to SEQ ID NO: 67318

SEQ ID NO: 442188 - RNA, 62 nt, Homo Sapiens; identical to SEQ ID NO: 67319

SEQ ID NO: 442189 - RNA, 63 nt, Homo Sapiens; identical to SEQ ID NO: 67320

SEQ ID NO: 442190 - RNA, 63 nt, Homo Sapiens; identical to SEQ ID NO: 67321

SEQ ID NO: 442191 - RNA, 63 nt, Homo Sapiens; identical to SEQ ID NO: 67322

SEQ ID NO: 442192 - RNA, 63 nt, Homo Sapiens; identical to SEQ ID NO: 67323

SEQ ID NO: 442193 - RNA, 63 nt, Homo Sapiens; identical to SEQ ID NO: 67324

SEQ ID NO: 442194 - RNA, 63 nt, Homo Sapiens; identical to SEQ ID NO: 67325

SEQ ID NO: 442195 - RNA, 63 nt, Homo Sapiens; identical to SEQ ID NO: 67326

SEQ ID NO: 442196 - RNA, 63 nt, Homo Sapiens; identical to SEQ ID NO: 67327

SEQ ID NO: 442197 - RNA, 63 nt, Homo Sapiens; identical to SEQ ID NO: 67328

SEQ ID NO: 442198 - RNA, 63 nt, Homo Sapiens; identical to SEQ ID NO: 67329

SEQ ID NO: 442199 - RNA, 63 nt, Homo Sapiens; identical to SEQ ID NO: 67330

SEQ ID NO: 442200 - RNA, 63 nt, Homo Sapiens; identical to SEQ ID NO: 67331

SEQ ID NO: 442201 - RNA, 63 nt, Homo Sapiens; identical to SEQ ID NO: 67332

SEQ ID NO: 442202 - RNA, 63 nt, Homo Sapiens; identical to SEQ ID NO: 67333

SEQ ID NO: 442203 - RNA, 63 nt, Homo Sapiens; identical to SEQ ID NO: 67334

SEQ ID NO: 442204 - RNA, 63 nt, Homo Sapiens; identical to SEQ ID NO: 67335

SEQ ID NO: 442205 - RNA, 63 nt, Homo Sapiens; identical to SEQ ID NO: 67336

SEQ ID NO: 442206 - RNA, 63 nt, Homo Sapiens; identical to SEQ ID NO: 67337

SEQ ID NO: 442207 - RNA, 63 nt, Homo Sapiens; identical to SEQ ID NO: 67338

SEQ ID NO: 442208 - RNA, 63 nt, Homo Sapiens; identical to SEQ ID NO: 67339

SEQ ID NO: 442209 - RNA, 63 nt, Homo Sapiens; identical to SEQ ID NO: 67340

SEQ ID NO: 442210 - RNA, 63 nt, Homo Sapiens; identical to SEQ ID NO: 67341

SEQ ID NO: 442211 - RNA, 62 nt, Homo Sapiens; identical to SEQ ID NO: 67342

SEQ ID NO: 442212 - RNA, 63 nt, Homo Sapiens; identical to SEQ ID NO: 67343

SEQ ID NO: 442213 - RNA, 63 nt, Homo Sapiens; identical to SEQ ID NO: 67344

SEQ ID NO: 442214 - RNA, 63 nt, Homo Sapiens; identical to SEQ ID NO: 67345

SEQ ID NO: 442215 - RNA, 61 nt, Homo Sapiens; identical to SEQ ID NO: 67346

SEQ ID NO: 442216 - RNA, 63 nt, Homo Sapiens; identical to SEQ ID NO: 67347

SEQ ID NO: 442217 - RNA, 63 nt, Homo Sapiens; identical to SEQ ID NO: 67348

SEQ ID NO: 442218 - RNA, 63 nt, Homo Sapiens; identical to SEQ ID NO: 67349

SEQ ID NO: 442219 - RNA, 63 nt, Homo Sapiens; identical to SEQ ID NO: 67350

SEQ ID NO: 442220 - RNA, 63 nt, Homo Sapiens; identical to SEQ ID NO: 67351

SEQ ID NO: 442221 - RNA, 63 nt, Homo Sapiens; identical to SEQ ID NO: 67352

SEQ ID NO: 442222 - RNA, 63 nt, Homo Sapiens; identical to SEQ ID NO: 67353

SEQ ID NO: 442223 - RNA, 63 nt, Homo Sapiens; identical to SEQ ID NO: 67354

SEQ ID NO: 442224 - RNA, 63 nt, Homo Sapiens; identical to SEQ ID NO: 67355

SEQ ID NO: 442225 - RNA, 63 nt, Homo Sapiens; identical to SEQ ID NO: 67356

SEQ ID NO: 442226 - RNA, 63 nt, Homo Sapiens; identical to SEQ ID NO: 67357

SEQ ID NO: 442227 - RNA, 63 nt, Homo Sapiens; identical to SEQ ID NO: 67358

SEQ ID NO: 442228 - RNA, 63 nt, Homo Sapiens; identical to SEQ ID NO: 67359

SEQ ID NO: 442229 - RNA, 63 nt, Homo Sapiens; identical to SEQ ID NO: 67360

SEQ ID NO: 442230 - RNA, 63 nt, Homo Sapiens; identical to SEQ ID NO: 67361

SEQ ID NO: 442231 - RNA, 63 nt, Homo Sapiens; identical to SEQ ID NO: 67362

SEQ ID NO: 442232 - RNA, 63 nt, Homo Sapiens; identical to SEQ ID NO: 67363

SEQ ID NO: 442233 - RNA, 63 nt, Homo Sapiens; identical to SEQ ID NO: 67364

SEQ ID NO: 442234 - RNA, 63 nt, Homo Sapiens; identical to SEQ ID NO: 67365

SEQ ID NO: 442235 - RNA, 63 nt, Homo Sapiens; identical to SEQ ID NO: 67366

SEQ ID NO: 442236 - RNA, 63 nt, Homo Sapiens; identical to SEQ ID NO: 67367

SEQ ID NO: 442237 - RNA, 63 nt, Homo Sapiens; identical to SEQ ID NO: 67368

SEQ ID NO: 442238 - RNA, 63 nt, Homo Sapiens; identical to SEQ ID NO: 67369

SEQ ID NO: 442239 - RNA, 63 nt, Homo Sapiens; identical to SEQ ID NO: 67370

SEQ ID NO: 442240 - RNA, 63 nt, Homo Sapiens; identical to SEQ ID NO: 67371

SEQ ID NO: 442241 - RNA, 63 nt, Homo Sapiens; identical to SEQ ID NO: 67372

SEQ ID NO: 442242 - RNA, 63 nt, Homo Sapiens; identical to SEQ ID NO: 67373

SEQ ID NO: 442243 - RNA, 63 nt, Homo Sapiens; identical to SEQ ID NO: 67374

SEQ ID NO: 442244 - RNA, 63 nt, Homo Sapiens; identical to SEQ ID NO: 67375

SEQ ID NO: 442245 - RNA, 63 nt, Homo Sapiens; identical to SEQ ID NO: 67376

SEQ ID NO: 442246 - RNA, 63 nt, Homo Sapiens; identical to SEQ ID NO: 67377

SEQ ID NO: 442247 - RNA, 63 nt, Homo Sapiens; identical to SEQ ID NO: 67378

SEQ ID NO: 442248 - RNA, 63 nt, Homo Sapiens; identical to SEQ ID NO: 67379

SEQ ID NO: 442249 - RNA, 63 nt, Homo Sapiens; identical to SEQ ID NO: 67380

SEQ ID NO: 442250 - RNA, 63 nt, Homo Sapiens; identical to SEQ ID NO: 67381

SEQ ID NO: 442251 - RNA, 63 nt, Homo Sapiens; identical to SEQ ID NO: 67382

SEQ ID NO: 442252 - RNA, 63 nt, Homo Sapiens; identical to SEQ ID NO: 67383

SEQ ID NO: 442253 - RNA, 63 nt, Homo Sapiens; identical to SEQ ID NO: 67384

SEQ ID NO: 442254 - RNA, 63 nt, Homo Sapiens; identical to SEQ ID NO: 67385

SEQ ID NO: 442255 - RNA, 63 nt, Homo Sapiens; identical to SEQ ID NO: 67386

SEQ ID NO: 442256 - RNA, 63 nt, Homo Sapiens; identical to SEQ ID NO: 67387

SEQ ID NO: 442257 - RNA, 63 nt, Homo Sapiens; identical to SEQ ID NO: 67388

SEQ ID NO: 442258 - RNA, 63 nt, Homo Sapiens; identical to SEQ ID NO: 67389

SEQ ID NO: 442259 - RNA, 63 nt, Homo Sapiens; identical to SEQ ID NO: 67390

SEQ ID NO: 442260 - RNA, 63 nt, Homo Sapiens; identical to SEQ ID NO: 67391

SEQ ID NO: 442261 - RNA, 63 nt, Homo Sapiens; identical to SEQ ID NO: 67392

SEQ ID NO: 442262 - RNA, 63 nt, Homo Sapiens; identical to SEQ ID NO: 67393

SEQ ID NO: 442263 - RNA, 63 nt, Homo Sapiens; identical to SEQ ID NO: 67394

SEQ ID NO: 442264 - RNA, 63 nt, Homo Sapiens; identical to SEQ ID NO: 67395

SEQ ID NO: 442265 - RNA, 63 nt, Homo Sapiens; identical to SEQ ID NO: 67396

SEQ ID NO: 442266 - RNA, 63 nt, Homo Sapiens; identical to SEQ ID NO: 67397

SEQ ID NO: 442267 - RNA, 63 nt, Homo Sapiens; identical to SEQ ID NO: 67398

SEQ ID NO: 442268 - RNA, 63 nt, Homo Sapiens; identical to SEQ ID NO: 67399

SEQ ID NO: 442269 - RNA, 63 nt, Homo Sapiens; identical to SEQ ID NO: 67400

SEQ ID NO: 442270 - RNA, 63 nt, Homo Sapiens; identical to SEQ ID NO: 67401

SEQ ID NO: 442271 - RNA, 63 nt, Homo Sapiens; identical to SEQ ID NO: 67402

SEQ ID NO: 442272 - RNA, 63 nt, Homo Sapiens; identical to SEQ ID NO: 67403

SEQ ID NO: 442273 - RNA, 63 nt, Homo Sapiens; identical to SEQ ID NO: 67404

SEQ ID NO: 442274 - RNA, 63 nt, Homo Sapiens; identical to SEQ ID NO: 67405

SEQ ID NO: 442275 - RNA, 63 nt, Homo Sapiens; identical to SEQ ID NO: 67406

SEQ ID NO: 442276 - RNA, 63 nt, Homo Sapiens; identical to SEQ ID NO: 67407

SEQ ID NO: 442277 - RNA, 63 nt, Homo Sapiens; identical to SEQ ID NO: 67408

SEQ ID NO: 442278 - RNA, 63 nt, Homo Sapiens; identical to SEQ ID NO: 67409

SEQ ID NO: 442279 - RNA, 63 nt, Homo Sapiens; identical to SEQ ID NO: 67410

SEQ ID NO: 442280 - RNA, 64 nt, Homo Sapiens
ucauaguuaauacagguauaucuauuuuuauuuacuuuguaagaaacaagcucaaggagcuucc

SEQ ID NO: 442281 - RNA, 64 nt, Homo Sapiens
uaguuaauaauaaaugcuguaaauaagcaucucacuuuguaaaaauaaaauauugugguuuugu

SEQ ID NO: 442282 - RNA, 64 nt, Homo Sapiens
aggcccugccccuggcuccuuaaaugccccgucucuuuguaaacugauauucagccagcaaugc

SEQ ID NO: 442283 - RNA, 64 nt, Homo Sapiens
agccggccgccuucuccccucucccagggaugcucuuuguaaauaucggaugggugugggagug

SEQ ID NO: 442284 - RNA, 64 nt, Homo Sapiens
gggggucccuuuucaucccuucucugacagauugcuuuguaaacuuucuuaggccuucccccca

SEQ ID NO: 442285 - RNA, 64 nt, Homo Sapiens
aaaggucaauuauacuuuuguuguucauuagcaucuuuguaaacuauaagacguaguuuuaauu

SEQ ID NO: 442286 - RNA, 64 nt, Homo Sapiens
agagguuugcaugcugguaaugcaaccuuugaaacuuuguaaaggaaacauauauguauauauu

SEQ ID NO: 442287 - RNA, 64 nt, Homo Sapiens
caaauguauuauuuuggugacaaaaaugaaggagcuuuguaaauuuuuuuuaaaauuaugaauc

SEQ ID NO: 442288 - RNA, 64 nt, Homo Sapiens
cuguggggaggcauaagcugauguuuguaaagcgcuuuguaaauaaacgugcucucugaaugcc

SEQ ID NO: 442289 - RNA, 64 nt, Homo Sapiens
cuuuuugagauacuauuuucauuuuugugagccucuuuguaauaaaaugguacauuucuauauc

SEQ ID NO: 442290 - RNA, 64 nt, Homo Sapiens
ucccacccacaaugcaugagagugccuauuaaaucuuuguaaguguuaucaaauguuuugaucu

SEQ ID NO: 442291 - RNA, 64 nt, Homo Sapiens
guuccucuggcagccaauaaaaucaucauaagcccuuuguaauaaaaagcuaguuuccugagug

SEQ ID NO: 442292 - RNA, 64 nt, Homo Sapiens
cuguauauucuauacaaagguacuuguccuuucccuuuguaaacuacauuugacauggauuaaa

SEQ ID NO: 442293 - RNA, 64 nt, Homo Sapiens
uugcauuauagaggaauguaguaugucauaaguacuuuguaaagauuugacauucaacuguagu

SEQ ID NO: 442294 - RNA, 64 nt, Homo Sapiens
uguaauuucucauauggugcuggaaaugguugggcuuuguaacauuugaaguguuuccauggua

SEQ ID NO: 442295 - RNA, 64 nt, Homo Sapiens
gaguaaagugcaauuucauuggauagcuaaauaucuuuguaagauagagauuguugaaaauucu

SEQ ID NO: 442296 - RNA, 64 nt, Homo Sapiens
uguggcauguugauuucuauggccaacuuucucucuuuguaaaacaaagauugauugauuuucu

SEQ ID NO: 442297 - RNA, 64 nt, Homo Sapiens
auuuaauacagcagagcauggcaugaccaagcaucuuuguaaaguguuagauggaaaaugcugu

SEQ ID NO: 442298 - RNA, 64 nt, Homo Sapiens
acauaaugacauaauuuaguuucauguaaugaaacuuuguaaacagaauacauacauguguaua

SEQ ID NO: 442299 - RNA, 64 nt, Homo Sapiens
uguuuacuguuaugagguagaauaaaaaagaauacuuuguaauagccacaaguucuuguuuaga

SEQ ID NO: 442300 - RNA, 64 nt, Homo Sapiens
uuuguguccaguuauauuauuuaaaaaaguguuacuuuguaaaaauuguauauaaagaacugua

SEQ ID NO: 442301 - RNA, 64 nt, Homo Sapiens
uugaugaacacauuaauccguuaaguaaaauggacuuuguaauuguacagcauaccuaagaaac

SEQ ID NO: 442302 - RNA, 64 nt, Homo Sapiens
aacaucuaaaguguauuaacagugcaugcuuuuacuuuguaaauguggugccaaaucccuguuu

SEQ ID NO: 442303 - RNA, 64 nt, Homo Sapiens
acugacuucugguuuccacuguaucaguauguaccuuuguaauuguuauuuuuaugucuuuuau

SEQ ID NO: 442304 - RNA, 64 nt, Homo Sapiens
agggcucugugucagggaaaaccuucuggguggacuuuguaagaauccaguuuccaagguuaga

SEQ ID NO: 442305 - RNA, 64 nt, Homo Sapiens
uggauucucauagacaacuggguaacuuauauuucuuuguaaucaagacuugagauaucgaagu

SEQ ID NO: 442306 - RNA, 64 nt, Homo Sapiens
aaacaagccuuggaaauaaaucucuauuaaaccgcuuuguaaccaagcucugguacccucuguc

SEQ ID NO: 442307 - RNA, 64 nt, Homo Sapiens
gaacacaucgugaugaugacguccucucaacucucuuuguaaaaauuuuguuauuuuugcuugu

SEQ ID NO: 442308 - RNA, 64 nt, Homo Sapiens
accaauuuugugcuaaugagcauugagacugaugcuuuguaagucacaccacaacaaauauuga

SEQ ID NO: 442309 - RNA, 64 nt, Homo Sapiens
ccuauuuuauuuuucuauaaugaucauauauuaccuuuguaauaaaacauuauaaccaaaacau

SEQ ID NO: 442310 - RNA, 64 nt, Homo Sapiens
uaagccucucgagggugaggccuagccuucuugucuuuguaacccacagcagcugguacugugc

SEQ ID NO: 442311 - RNA, 64 nt, Homo Sapiens
aaaggguuuucaauaggguguagaccuccaguaccuuuguaacuaaagucugucuagucauugu

SEQ ID NO: 442312 - RNA, 64 nt, Homo Sapiens
aaaauuuuaucucuuauucaguaaaaaacaacuucuuuguaaucguuauguguguauauguaug

SEQ ID NO: 442313 - RNA, 64 nt, Homo Sapiens
gcauguguagccucuccuggucauagaccagucucuuuguaaguuauuguggcaguucacacag

SEQ ID NO: 442314 - RNA, 64 nt, Homo Sapiens
uagagaaauauaguucacaaugaaauuauauuuucuuuguaaagaaaguggcuugaaaucuuuu

SEQ ID NO: 442315 - RNA, 64 nt, Homo Sapiens
cagugaucuugaaccauuguuuuauauuuuucaccuuuguaaccucauggaaagaggcuuuaca

SEQ ID NO: 442316 - RNA, 64 nt, Homo Sapiens
aaaaaguugaaggccuuauucuacauuucaccuacuuuguaagugagagagacaagaagcaaau

SEQ ID NO: 442317 - RNA, 64 nt, Homo Sapiens
gaacucagcuacacucucugauuuugugcuacuccuuuguaaagucacugccuuaagggggcug

SEQ ID NO: 442318 - RNA, 64 nt, Homo Sapiens
uuugaauuuuugcugguuaaccuuuaucauuuaucuuuguaaugugaacaugcuucagagugua

SEQ ID NO: 442319 - RNA, 64 nt, Homo Sapiens
aaaaaaaaaaaaucacuuggcgcaggagggagaacuuuguaagaagcugcccucuguuuuuuuu

SEQ ID NO: 442320 - RNA, 64 nt, Homo Sapiens
ucucgccaacagcuagcugcguuagccgaucaggcuuuguaagauuccuaaaccaggaagcugc

SEQ ID NO: 442321 - RNA, 64 nt, Homo Sapiens
ucaguguuuauaugaauaugcccuuuucccuguacuuuguaauguuuuguuuccuucucccuuc

SEQ ID NO: 442322 - RNA, 64 nt, Homo Sapiens
uuaauuuuauuacacauaacacgaguggaaaagccuuuguaaauccaaaaaaggaaucaaaucc

SEQ ID NO: 442323 - RNA, 64 nt, Homo Sapiens
cgaauguucccuggauguugggacauagaacauucuuuguaaccuccgggcucaucuguaccaa

SEQ ID NO: 442324 - RNA, 64 nt, Homo Sapiens
uguuuguaugaguaaagaaacuguuguuugaaaccuuuguaacuuccuuagccuaaagaaugau

SEQ ID NO: 442325 - RNA, 64 nt, Homo Sapiens
acuaaagaagaucuguaauugcaagucuuuaggucuuuguaagaaacaagccugguaggaaagg

SEQ ID NO: 442326 - RNA, 64 nt, Homo Sapiens
agaaacauuucugcauaaaauaacuuuuuucuaccuuuguaaauaaaccacuaucuugcacugc

SEQ ID NO: 442327 - RNA, 64 nt, Homo Sapiens
aaaaggaaaaacuccggguaaauuugguuuacugcuuuguaaaugauauuuauguucacacagg

SEQ ID NO: 442328 - RNA, 64 nt, Homo Sapiens
uauuucuuguuuguuuguuuaaacagcuucaugccuuuguaagugaaagcugauuacugucaau

SEQ ID NO: 442329 - RNA, 64 nt, Homo Sapiens
uuggaacagcagcacuauacagcagacagcuuuacuuuguaagguuaauuuuuggaauuuggga

SEQ ID NO: 442330 - RNA, 64 nt, Homo Sapiens
aggauuuuuagaauuaaaaagcaauguaagcauacuuuguaaauugaugcaugucuuuuaaaau

SEQ ID NO: 442331 - RNA, 64 nt, Homo Sapiens
auuuacacuuuaacuuucucaguugcaugucagucuuuguaauuaugaauaauguaagguaaag

SEQ ID NO: 442332 - RNA, 64 nt, Homo Sapiens
auuuguucugcagaaggcuggcaaauagauuuuucuuuguaacauuauguuuaaucaauugcaa

SEQ ID NO: 442333 - RNA, 64 nt, Homo Sapiens
gacuugcgguuaauuaugcaccacuaacaaaaugcuuuguaacauccuccugcauuuguugaua

SEQ ID NO: 442334 - RNA, 64 nt, Homo Sapiens
aagguaauuagaaugguauguuggcuuuaguuaucuuuguaaauuuuaugaauuggaagugaug

SEQ ID NO: 442335 - RNA, 64 nt, Homo Sapiens
acgaaacauuuuugcuuucuaagaggccguuuaucuuuguaaacgagguuuugaucucugggua

SEQ ID NO: 442336 - RNA, 64 nt, Homo Sapiens
uacucuuuuuaaaucccuuucagggcuucuuauucuuuguaaugguauucucagauagauguua

SEQ ID NO: 442337 - RNA, 64 nt, Homo Sapiens
gaagaauccaagagaaguuuguaugguagagaaacuuuguaaaaggcuuuuaaaacguauguuu

SEQ ID NO: 442338 - RNA, 64 nt, Homo Sapiens
aaaaccuguuuccuauuuugugggcugaaguguucuuuguaaggccgagaugccuuugacauuu

SEQ ID NO: 442339 - RNA, 64 nt, Homo Sapiens
augcuucuugauauuuuacuuagcuauagaacugcuuuguaaagcuuuccccuuuaaaaggaau

SEQ ID NO: 442340 - RNA, 64 nt, Homo Sapiens
uucucccucaccccacccuguuucaucuuguauucuuuguaaaaggccaaccagcccaaaauua

SEQ ID NO: 442341 - RNA, 64 nt, Homo Sapiens
aaauggcguggucuuuguuggcucccacacuggccuuuguaaauuucccucccugccuccccca

SEQ ID NO: 442342 - RNA, 64 nt, Homo Sapiens
gauugaugugaacacuuuuucuacagcacauagucuuuguaagguguauaggaagaagcaaagu

SEQ ID NO: 442343 - RNA, 64 nt, Homo Sapiens
ggaauaaaacaguaccuuagugguugagauggagcuuuguaaugcuuuccaugaaucauugugg

SEQ ID NO: 442344 - RNA, 64 nt, Homo Sapiens
auguauuuacucugccagguauaaacuuaaaacacuuuguaaccccggucacuauauaaagcaa

SEQ ID NO: 442345 - RNA, 64 nt, Homo Sapiens
gggcucuggauuuuugguuuccuaaugagaaacccuuuguaagucuuuagcaaccugucuuggc

SEQ ID NO: 442346 - RNA, 64 nt, Homo Sapiens
augucuguuuucuuuuuuguuuacugccuuugcucuuuguaacuuuauagcuagagaaacaaua

SEQ ID NO: 442347 - RNA, 64 nt, Homo Sapiens
caugaauaaaacacauuuuaccagauaauaaagacuuuguaaaaguggguugugcauccccaau

SEQ ID NO: 442348 - RNA, 64 nt, Homo Sapiens
acuuccguugcugccaucgucccgcagucacuuucuuuguaacaggcggcugagcuccagccac

SEQ ID NO: 442349 - RNA, 64 nt, Homo Sapiens
cuugauuugggagcauuuacuaauuaauuagcagcuuuguaauaaauggcuaauuuucaguugc

SEQ ID NO: 442350 - RNA, 64 nt, Homo Sapiens
cauuuguauauuguggauguauuuaauucuucaccuuuguaagacuguucuguuuggcacuugu

SEQ ID NO: 442351 - RNA, 64 nt, Homo Sapiens
uugucgggagauugaaagauguuuuuguuucuuucuuuguaaaggccuuggauauugaaaaaau

SEQ ID NO: 442352 - RNA, 64 nt, Homo Sapiens
uugggaaagaggucaacugagauuuggaaaucaucuuuguaauauuugcaaauuauacuuguuc

SEQ ID NO: 442353 - RNA, 64 nt, Homo Sapiens
cucagaaaaccacaguguguuuucauauuuggaacuuuguaauagcgggaguagcaguagucca

SEQ ID NO: 442354 - RNA, 64 nt, Homo Sapiens
auaguguauuucuuucuugaauuucagucugcugcuuuguaaaaaauaacuguaauugauauuu

SEQ ID NO: 442355 - RNA, 64 nt, Homo Sapiens
gucagaccagaauuuucuuugucccaugaggugucuuuguaagucagcaugcucuugcuugaac

SEQ ID NO: 442356 - RNA, 64 nt, Homo Sapiens
uauuuuccugaaauacauuugcaaaauaaggcugcuuuguaaucaaggaauauuuuuauugauu

SEQ ID NO: 442357 - RNA, 58 nt, Homo Sapiens; identical to SEQ ID NO: 66050

SEQ ID NO: 442358 - RNA, 64 nt, Homo Sapiens
uauccauuuguacaugguuuacauguuguggaugcuuuguaaacauuuuccuguauguuuaaau

SEQ ID NO: 442359 - RNA, 64 nt, Homo Sapiens
uaucuggguuaaguguuuaucauauauauggguacuuuguaauaucuaaaaacuuagaaacgga

SEQ ID NO: 442360 - RNA, 64 nt, Homo Sapiens
ugacauuguuaccaaccauuaauuggcucaggaccuuuguaauuuuuauuuaacuauaugaguu

SEQ ID NO: 442361 - RNA, 64 nt, Homo Sapiens
guaaacuucagugucccaccuugaccaaaaucagcuuuguaacuguuuucaaggaggugcuuag

SEQ ID NO: 442362 - RNA, 64 nt, Homo Sapiens
ccaaacaagaagaccucaugagagagguaaacaccuuuguaaagaaucuguaaccaauaccaug

SEQ ID NO: 442363 - RNA, 64 nt, Homo Sapiens
cuacacagcuuuugcauacuuacaguuucuguuccuuuguaauaacuuuaacuugcaccuuuga

SEQ ID NO: 442364 - RNA, 64 nt, Homo Sapiens
cccaaaccauaccacacacauuaucauuguuaaacuuuguaaaguauuuaagguacauggaaca

SEQ ID NO: 442365 - RNA, 64 nt, Homo Sapiens
aaucuaaauuucuguaguagagagagccguagcccuuuguaaaggcuuucguucguccaaacaa

SEQ ID NO: 442366 - RNA, 64 nt, Homo Sapiens
uugagcugugagauggauuuauuuuuaaaugcuacuuuguaaaggugaccuuuaaaaaauaaaa

SEQ ID NO: 442367 - RNA, 64 nt, Homo Sapiens
gaaucuuuacaccuccugugugguuacaaguuaacuuuguaaguagcguaccuuccuuccuuaa

SEQ ID NO: 442368 - RNA, 64 nt, Homo Sapiens
uuuagaacaaauaagguauauuuuuuagaaucaacuuuguaagcacuauaaaaucuuuaauaag

SEQ ID NO: 442369 - RNA, 64 nt, Homo Sapiens
uacaagcucgaauuauuccucauuguauagccugcuuuguaaacuaguuuacaauuugcaggcu

SEQ ID NO: 442370 - RNA, 64 nt, Homo Sapiens
uuccucuuccuccuccacuucccacuuauugucacuuuguaauauucagagagcacuuggauua

SEQ ID NO: 442371 - RNA, 64 nt, Homo Sapiens
accuauaauagaaaauagcagacaacauaaacaucuuuguaaauaucaaaccuaauacauuucu

SEQ ID NO: 442372 - RNA, 64 nt, Homo Sapiens
aaauaucaaaaggaagauucuuccauuaaauugccuuuguaauaugagaauguauuaguacaaa

SEQ ID NO: 442373 - RNA, 64 nt, Homo Sapiens
cuaugccuaauacucacacgcaacauuucuuguacuuuguaagucguuugcgagaaugcagacc

SEQ ID NO: 442374 - RNA, 64 nt, Homo Sapiens
uguuaacuuauugcuuuguaucuugggaaaaaaacuuuguaaauaaguuauaaaguuucuuuga

SEQ ID NO: 442375 - RNA, 64 nt, Homo Sapiens
gucacacuagcauagagaauguguugaaauuuaacuuuguaagcuuguaugugguuguugaucu

SEQ ID NO: 442376 - RNA, 64 nt, Homo Sapiens
cuggcgccuccucucuacuuucauggacuuguuccuuuguaauagugcaauuugguuuuguuuu

SEQ ID NO: 442377 - RNA, 64 nt, Homo Sapiens
auucacuagauuucuacguagugaucugcuuuuacuuuguaauuuguaguucucaaaagacuuu

SEQ ID NO: 442378 - RNA, 64 nt, Homo Sapiens
aaucuauguugaauccuuuuauaaaccaguaucacuuuguaauauaaacaccuauuuguacuua

SEQ ID NO: 442379 - RNA, 64 nt, Homo Sapiens
ugaccagccagaccucaggucuucacucuuucuucuuuguaaacuaugucauguggaaagauuu

SEQ ID NO: 442380 - RNA, 64 nt, Homo Sapiens
cagauuuauuccuuuguuacuucucuaauucuuccuuuguaaaaaaaaaaaaaagcaacacuuu

SEQ ID NO: 442381 - RNA, 64 nt, Homo Sapiens
auuuaaauucaggcuacugcuucaaucucaauugcuuuguaagugaaaaacaugacccagagga

SEQ ID NO: 442382 - RNA, 64 nt, Homo Sapiens
aaccauuaaaaguuggggcuccuacucuccuuugcuuuguaaauucaaaaguugggggugggua

SEQ ID NO: 442383 - RNA, 64 nt, Homo Sapiens
uuuuguaccggcacgggauauggaacgaaaacugcuuuguaaugcaguuugugacauuaauagu

SEQ ID NO: 442384 - RNA, 64 nt, Homo Sapiens
cuuuuggaucucauuguugauauaccugaauuuacuuuguaagagauuuuaacuucacuucaug

SEQ ID NO: 442385 - RNA, 64 nt, Homo Sapiens
uuauuugaucagaauauuuucuagauuaucuuuccuuuguaagauuuagaggauagccuugagg

SEQ ID NO: 442386 - RNA, 64 nt, Homo Sapiens
agaagcuucagaacucacuaccagccucuguggucuuuguaauuugagaagcauggcucaccag

SEQ ID NO: 442387 - RNA, 64 nt, Homo Sapiens
auugcauacccauauuuuaaaccauuuacuauggcuuuguaacaaauaaaaguacauuuuauaa

SEQ ID NO: 442388 - RNA, 64 nt, Homo Sapiens
guagggucgccaugaugcaguaguuuugaaaugucuuuguaagaccauguaacuuaauuacugc

SEQ ID NO: 442389 - RNA, 64 nt, Homo Sapiens
aaagcaaaaugagaauuucaacugcuauggcuagcuuuguaacccuggagcuuuguauucugug

SEQ ID NO: 442390 - RNA, 64 nt, Homo Sapiens
uauuguggcaugagauaagaccugucuucaguuacuuuguaauucuguacaaaagcugcaguaa

SEQ ID NO: 442391 - RNA, 64 nt, Homo Sapiens
aaauggaaaaggucaauaaaugaguuuuuaacugcuuuguaagaauagcaugcaaggguaagaa

SEQ ID NO: 442392 - RNA, 64 nt, Homo Sapiens
uguaagaccaaauucauacugguaaauuagaauacuuuguaauuccaaucuaaauauggaauuu

SEQ ID NO: 442393 - RNA, 64 nt, Homo Sapiens
auuuguacuauuuuaaaugauuaagugaaauguucuuuguaaacuuuauaagcagcugugaaau

SEQ ID NO: 442394 - RNA, 64 nt, Homo Sapiens
aggagccauugcauuuauuagcuucauucugcuacuuuguaacuacugcacagggcuuauagcu

SEQ ID NO: 442395 - RNA, 64 nt, Homo Sapiens
cugcauauggaccuguaauccuucuucacuugaacuuuguaaaaauugauggcaucccuacagu

SEQ ID NO: 442396 - RNA, 64 nt, Homo Sapiens
uccacccccugcccacaaaaccauugagaaugugcuuuguaagaauuuuguaauauucucuccg

SEQ ID NO: 442397 - RNA, 64 nt, Homo Sapiens
uucuccccacccaccccacgcccuugagaaggugcuuuguaauagugacaauacaccuucccca

SEQ ID NO: 442398 - RNA, 64 nt, Homo Sapiens
acaauuguuggagagccccugaugacuuuuuauacuuuguaaagaacauguuccugggaucacu

SEQ ID NO: 442399 - RNA, 62 nt, Homo Sapiens; identical to SEQ ID NO: 66092

SEQ ID NO: 442400 - RNA, 64 nt, Homo Sapiens
guggaaccaacacuaacauaugaauguuuacacucuuuguaagacugagccuuguaauucuaaa

SEQ ID NO: 442401 - RNA, 64 nt, Homo Sapiens
guauuauugaauuuucaauucuuuccugaauugucuuuguaaaauaugauaccaugacaaaaau

SEQ ID NO: 442402 - RNA, 64 nt, Homo Sapiens
ugguuuuaaaagccuuauaugaaauaaagaaagccuuuguaaggugaaggaaaaaguaagauga

SEQ ID NO: 442403 - RNA, 64 nt, Homo Sapiens
agcuguucagaagaauaaaaacugauugagauuacuuuguaaguguuacaugauuuauaauuuc

SEQ ID NO: 442404 - RNA, 64 nt, Homo Sapiens
uaggaaagacaaaggucugauuggccauuugagucuuuguaaccagguaacauaauggugaugg

SEQ ID NO: 442405 - RNA, 64 nt, Homo Sapiens
uuuuuucuacaaaugucuaauccgaauccuacagcuuuguaauuuaauggcaagucuagaacuc

SEQ ID NO: 442406 - RNA, 64 nt, Homo Sapiens
gauucuuuucaucaaaaagcuaauggauuuuugacuuuguaauguacugauucaauuauaauug

SEQ ID NO: 442407 - RNA, 64 nt, Homo Sapiens
cccgucuccuuucauucagauauuuccaaagcuccuuuguaaaccucuaguugucuguguauaa

SEQ ID NO: 442408 - RNA, 64 nt, Homo Sapiens
uagccagacaauaaagaaaacuagacaucugcaucuuuguaagugugguaggguagagacuacc

SEQ ID NO: 442409 - RNA, 64 nt, Homo Sapiens
acaaguuuauguuugagcaauugaaucuuauccacuuuguaagaaucuuuauauuugucuuauu

SEQ ID NO: 442410 - RNA, 64 nt, Homo Sapiens
cuucagaauugauuauuuuuuccucaaaauuuuacuuuguaauucuuguuaguagacaguggug

SEQ ID NO: 442411 - RNA, 64 nt, Homo Sapiens
guuugggggcagacucuuaaucuucucucaaccccuuuguaaugucuuuugguuucugcuucuc

SEQ ID NO: 442412 - RNA, 64 nt, Homo Sapiens
cuugcaugcuucuuagaccacuguaucuggaaugcuuuguaauauucacuguuccucugucaua

SEQ ID NO: 442413 - RNA, 64 nt, Homo Sapiens
aauuucuauauaaaaauauucuauguuguaaaaucuuuguaaaacaguaugacauaaugauuug

SEQ ID NO: 442414 - RNA, 64 nt, Homo Sapiens
accagguucuaggaaauguuuuuuauuucuucagcuuuguaaauuucuuugcccaauaaccaca

SEQ ID NO: 442415 - RNA, 64 nt, Homo Sapiens
ucuuaacauuuuuauauugcguuauuuuguacagcuuuguaaaugucuaauuuuuaaauuuuaa

SEQ ID NO: 442416 - RNA, 64 nt, Homo Sapiens
aaaaauaauaauaauuugaauuacagguuuauuucuuuguaaaaaacuguagugcagugauccu

SEQ ID NO: 442417 - RNA, 64 nt, Homo Sapiens
uuaagugccuugagcuggaaccagccacugccuucuuuguaauacuugaggcccaucucuccag

SEQ ID NO: 442418 - RNA, 64 nt, Homo Sapiens
acuaacgaaaaugcaaagcacgguuuaaaaagaccuuuguaauuaugccgucucaaggcauuua

SEQ ID NO: 442419 - RNA, 64 nt, Homo Sapiens
aaaacaggauuuugaaugcauguuugaauuaguucuuuguaaauuagguguguuucugagaauu

SEQ ID NO: 442420 - RNA, 64 nt, Homo Sapiens
caaaacugaaguaucugugucaacucaaccacuucuuuguaagaaacagggaauaaaagcuuuu

SEQ ID NO: 442421 - RNA, 64 nt, Homo Sapiens
cacuagguuuucaucguaaauggaggugaaaucucuuuguaauccaggguuuucuguuuuuuga

SEQ ID NO: 442422 - RNA, 64 nt, Homo Sapiens
ccagacagugaagcaaaauguugucacaagaaagcuuuguaaaagguagacucuuuuauaccug

SEQ ID NO: 442423 - RNA, 64 nt, Homo Sapiens
uaagucaaucauuuaauuuuugggaccucaguuucuuuguaaguaaaauaacaccugcuuguuc

SEQ ID NO: 442424 - RNA, 64 nt, Homo Sapiens
agggacugggucacuauugugguuuuuacuauaacuuuguaaauuaacuuaauuuugcugacuu

SEQ ID NO: 442425 - RNA, 64 nt, Homo Sapiens
aggcuuugaaucaacuuaagggaaaaccuuuugucuuuguaaaaauaaaagccuguagcuaagg

SEQ ID NO: 442426 - RNA, 64 nt, Homo Sapiens
aagaauaugcccgacuccccaugacaagacagaacuuuguaacaaacaguaccaauuuauuuug

SEQ ID NO: 442427 - RNA, 64 nt, Homo Sapiens
auuuguuccugccccacccuaacugaucaauguacuuuguaaucucccccacccuuaagaaggu

SEQ ID NO: 442428 - RNA, 64 nt, Homo Sapiens
guacuuuguaaucucccccacccuuaagaagguacuuuguaaucuuccccacccuuaagaaggu

SEQ ID NO: 442429 - RNA, 64 nt, Homo Sapiens
guacuuuguaaucuuccccacccuuaagaagguucuuuguaauucuccccacccuugagaaugu

SEQ ID NO: 442430 - RNA, 64 nt, Homo Sapiens
caaacguguucuuuuagaccaguuuucuaauaagcuuuguaaaauguacuauccaaauuagaag

SEQ ID NO: 442431 - RNA, 64 nt, Homo Sapiens
auggagaacauuaggacaaaaagucaccaacuuacuuuguaacauuuuaauaaugacuuaaggg

SEQ ID NO: 442432 - RNA, 64 nt, Homo Sapiens
agcccauacaaguauucauuuuuucuacccuuuccuuuguaaguuccugggcaaccuuuuugau

SEQ ID NO: 442433 - RNA, 64 nt, Homo Sapiens
gaggugugugugugucuauguguguguuucagcacuuuguaaauagcaagaagcuguacagauu

SEQ ID NO: 442434 - RNA, 64 nt, Homo Sapiens
ugggugaaggguacccaggaccacucuguaccaucuuuguaacuuccugugaauuuauaauaau

SEQ ID NO: 442435 - RNA, 64 nt, Homo Sapiens
aaaaaauaauugcuuugacauugucuauaugguacuuuguaaagucaugcuuaaguacaaauuc

SEQ ID NO: 442436 - RNA, 64 nt, Homo Sapiens
aauuguuugaaagccuccauauaguuagauugugcuuuguaauuuuguuguuguugcucuaucu

SEQ ID NO: 442437 - RNA, 64 nt, Homo Sapiens
auaaaaguguguuugaaaaauauuaucuuggguucuuuguaaaauuuauuuuuuacaugcugaa

SEQ ID NO: 442438 - RNA, 64 nt, Homo Sapiens
gugggaauaaaaagcugugaaauuguucaaccuacuuuguaaccaaagaagcaaagcuguguaa

SEQ ID NO: 442439 - RNA, 64 nt, Homo Sapiens
uuaaugacuagcuuuuaaaaauacaguacaaagacuuuguaaaugugauucagggcccccagca

SEQ ID NO: 442440 - RNA, 64 nt, Homo Sapiens
caggguccuccaggcaucagcuguuguguccucucuuuguaacaguggacaggacagaccaccc

SEQ ID NO: 442441 - RNA, 50 nt, Homo Sapiens; identical to SEQ ID NO: 66134

SEQ ID NO: 442442 - RNA, 64 nt, Homo Sapiens
ugcuacauuuuaaaagcaauuguauuaguaagaacuuuguaaauaaauaccuaaaacccaagug

SEQ ID NO: 442443 - RNA, 64 nt, Homo Sapiens
ggauccgugcuuugucggccagcguuucugcagucuuuguaaaggccccacgagagcgggccag

SEQ ID NO: 442444 - RNA, 64 nt, Homo Sapiens
aacaguaagauaucucaaugaaccauaaauucaacuuuguaaaaaucuuuugaagcauagauaa

SEQ ID NO: 442445 - RNA, 64 nt, Homo Sapiens
cugcauauacuucuugggauauaguaucuaagaccuuuguaaacugccauuuuguuagguaugg

SEQ ID NO: 442446 - RNA, 64 nt, Homo Sapiens
cugcagugccaccugaguuccaaauuuuaccauucuuuguaaacaguuggauggauuaugauaa

SEQ ID NO: 442447 - RNA, 64 nt, Homo Sapiens
uugaauuaggcagugguuucacauaggcauagaucuuuguaacccuauaaaaucuuagaaagaa

SEQ ID NO: 442448 - RNA, 64 nt, Homo Sapiens
uacuguccagcugaaagcaccgugaucggagaugcuuuguaaucagauugaucaucugccuuaa

SEQ ID NO: 442449 - RNA, 64 nt, Homo Sapiens
gccgcggggcccccauacagucccuaugacaacacuuuguaaaaaagcugcugccaagcacaua

SEQ ID NO: 442450 - RNA, 64 nt, Homo Sapiens
gcagggaccauauaagccuuugcuagacuguaagcuuuguaagguguuacugcuuauugaucac

SEQ ID NO: 442451 - RNA, 64 nt, Homo Sapiens
acaguuuaaguucuccugcaggaucacaggaagacuuuguaaggcuuuuagccucuacaugcua

SEQ ID NO: 442452 - RNA, 64 nt, Homo Sapiens
agagagaugcuuauguuauuuauacguuuuguaccuuuguaaccggggacuggagggagacuuu

SEQ ID NO: 442453 - RNA, 64 nt, Homo Sapiens
uaucgugugugugauuccuuaaaaagucaagaaacuuuguaaaauuggaaaaacaacagcgaca

SEQ ID NO: 442454 - RNA, 64 nt, Homo Sapiens
caggugggggcaucucacaggggcucaggcuucacuuuguaaacccagggaucuggggugguca

SEQ ID NO: 442455 - RNA, 64 nt, Homo Sapiens
caguauguuuuuacauaaugcugagacacauuggcuuuguaaauaggguauauacaaauuaaaa

SEQ ID NO: 442456 - RNA, 64 nt, Homo Sapiens
uucccuugaagacagaauuuccacucuuuuuuaacuuuguaaccgucuuuuuuuauauaaugaa

SEQ ID NO: 442457 - RNA, 64 nt, Homo Sapiens
uuucuuaguauauagucagcauucuucauuuucacuuuguaauuguuucauuuaccgaaugaga

SEQ ID NO: 442458 - RNA, 64 nt, Homo Sapiens
uauuugaaaguaguguuaaaaauacauuaacuuccuuuguaauuucauccacauccaccuucgg

SEQ ID NO: 442459 - RNA, 64 nt, Homo Sapiens
gcucucugugguuugacuuaauuuggugcuuagucuuuguaaggaaagccacaaacaguucauc

SEQ ID NO: 442460 - RNA, 64 nt, Homo Sapiens
guuuaauucaaucuguaauaguaucagagaaugucuuuguaacuuaagaccucuaugaaugaau

SEQ ID NO: 442461 - RNA, 64 nt, Homo Sapiens
auuacccuguaauauuauauaaaaaaaaacauaacuuuguaaaugccaagguacuuuuuuauuu

SEQ ID NO: 442462 - RNA, 64 nt, Homo Sapiens
ugggagacaucugaaauauuugacagauugauaacuuuguaagacggcacacacggaguggcuu

SEQ ID NO: 442463 - RNA, 64 nt, Homo Sapiens
caggauucuuauuugugcuggcuaaugugguuuccuuuguaaacaugggaaaaaaaaaauccuu

SEQ ID NO: 442464 - RNA, 64 nt, Homo Sapiens
cagcauaaaaaugaaaaguuuuuuuaugugaggacuuuguaaguggguugauuaaaucuauaag

SEQ ID NO: 442465 - RNA, 64 nt, Homo Sapiens
agaauuuaccaguaacugugccaaaauccauuuccuuuguaacaacauauucaaauuccguaua

SEQ ID NO: 442466 - RNA, 64 nt, Homo Sapiens
cauuagucaguugcucauuuaggagacugaggggcuuuguaaaauaaauccuccacucucugga

SEQ ID NO: 442467 - RNA, 64 nt, Homo Sapiens
acaggaaaaaauaaacucuuauauagaucaaaagcuuuguaaccucagaaccucacuugguacc

SEQ ID NO: 442468 - RNA, 64 nt, Homo Sapiens
ggaacugccucuuuccuguuuagaauuuuaagugcuuuguaaugauggaauauuccccuaucuc

SEQ ID NO: 442469 - RNA, 62 nt, Homo Sapiens
cagccaaaacaaccaaacuauuuucuaaauaaaccuuuguaaucuaauguugggugccgcag

SEQ ID NO: 442470 - RNA, 64 nt, Homo Sapiens
uuauuuuauguugaauuauuuuuggagcugaaaucuuuguaauauuaaagcaacuaguuucuaa

SEQ ID NO: 442471 - RNA, 64 nt, Homo Sapiens
ucuuauguuuugccacaguuaacccauugugcuucuuuguaaucaaacaguuugugggagaaug

SEQ ID NO: 442472 - RNA, 64 nt, Homo Sapiens
uauuaggaugugggcugguuugcuuuucuaccaccuuuguaauuuuauguaucccaucuccuuu

SEQ ID NO: 442473 - RNA, 64 nt, Homo Sapiens
augcaauuuuuuucaggaugcaaaggcaauuauucuuuguaagcgggacauuuagaauauauuu

SEQ ID NO: 442474 - RNA, 64 nt, Homo Sapiens
ugcuuaaaaaagcuaaucccuaaaauaguuagaucuuuguaaaugcauauuaaauaauaaagua

SEQ ID NO: 442475 - RNA, 64 nt, Homo Sapiens
guaaugcaguuuuuaaaaaccuguaucugacccacuuuguaauuuuugcuccaauauccauucu

SEQ ID NO: 442476 - RNA, 64 nt, Homo Sapiens
guuacugcaucaucuguuuguaaucauuaucucacuuuguaaauaaaaacacaccuuaaaacau

SEQ ID NO: 442477 - RNA, 64 nt, Homo Sapiens
auuaugaauugaguccacaaaggaacacaaaacucuuuguaauucuguuaaaucuuuuauguag

SEQ ID NO: 442478 - RNA, 64 nt, Homo Sapiens
uaacuuauuagaaacccaaauugggacaacagugcuuuguaaauuguguugucuucagcaguca

SEQ ID NO: 442479 - RNA, 64 nt, Homo Sapiens
auuucuugcucaguuguuucaggcaagcccaagacuuuguaauuuuuaaagggcccaagauuuu

SEQ ID NO: 442480 - RNA, 64 nt, Homo Sapiens
agauuuaaaaagguuguauuacauauuguuuaaacuuuguaaguagaaauauaucuguuauaau

SEQ ID NO: 442481 - RNA, 64 nt, Homo Sapiens
cauauuacuguuucacauguacagcuuucuacuucuuuguaagaacaccaaccaaccaagguuu

SEQ ID NO: 442482 - RNA, 64 nt, Homo Sapiens
guaggcugcuuuggaaauaauucccauauccuugcuuuguaaguugguaauaucacuaugcauu

SEQ ID NO: 442483 - RNA, 64 nt, Homo Sapiens
agucccgugguugucuguacguguuugcaccgcacuuuguaaucgcuggcgcucaugggcccug

SEQ ID NO: 442484 - RNA, 64 nt, Homo Sapiens
acucccauuuuuacuuaacauguacaaaguuuuccuuuguaauccagucagauuuuuaaaguuu

SEQ ID NO: 442485 - RNA, 64 nt, Homo Sapiens
acaugugagguauagccacccccucuaaagaacgcuuuguaaauagguaaccuuaaagacagac

SEQ ID NO: 442486 - RNA, 64 nt, Homo Sapiens
ggaaauugaaaaugaccugggguauuugcuaagucuuuguaaacucucuuuuggauuuuuuuaa

SEQ ID NO: 442487 - RNA, 64 nt, Homo Sapiens
acuccagggcaaaaacgaaccccaccuagugaaacuuuguaagaccauagcagaaaaaccuaga

SEQ ID NO: 442488 - RNA, 64 nt, Homo Sapiens
agcacugagauuuauuuuaaugaaugauucugcacuuuguaaacguaaaugucgcuucuucaag

SEQ ID NO: 442489 - RNA, 64 nt, Homo Sapiens
acuugugauguuuuaaaauaguuggaauauuugucuuuguaauuugugaaaaacaguuuguaua

SEQ ID NO: 442490 - RNA, 64 nt, Homo Sapiens
ucuacaaauaauuuaccuuaauauggauggcuaacuuuguaauccuuauaguaaaagugcaauc

SEQ ID NO: 442491 - RNA, 64 nt, Homo Sapiens
cagacaagauaugcacuugacuucuccauucuaucuuuguaaaacugcucguuagcauggaaga

SEQ ID NO: 442492 - RNA, 64 nt, Homo Sapiens
auaacacaaugaguaauucugugauuaguagaagcuuuguaaucgaaaggaagacauaaguguu

SEQ ID NO: 442493 - RNA, 64 nt, Homo Sapiens
ggaaacuauaugggaugaacuaaagguuauuccucuuuguaauaaauguguguguguaguuacu

SEQ ID NO: 442494 - RNA, 64 nt, Homo Sapiens
uaugcuuucauauauccuugaugauaaccuuuuucuuuguaauugaauuuuaaguucuagcccc

SEQ ID NO: 442495 - RNA, 64 nt, Homo Sapiens
ugcaaagagguuggaucaaguuuuagcuguuuaacuuuguaagauugccuucuuauuuuacuuc

SEQ ID NO: 442496 - RNA, 64 nt, Homo Sapiens
aaauauuuuuugauuuugcgaaaagcccuuuaaacuuuguaaggaccuaaauaauaauaaaaaa

SEQ ID NO: 442497 - RNA, 64 nt, Homo Sapiens
ugacuucugacauguuggcagccuaaagccuugccuuuguaauuugcccaaguaauucacuaca

SEQ ID NO: 442498 - RNA, 64 nt, Homo Sapiens
ucuucugaaaucauuguaaaaaguauauuaaucucuuuguaaucuugcaagagucugauucuuu

SEQ ID NO: 442499 - RNA, 64 nt, Homo Sapiens
uaggaaaaauguauaauaaguuugcagcuauugacuuuguaauuaagcuuuguagcagaauaua

SEQ ID NO: 442500 - RNA, 64 nt, Homo Sapiens
aaacauuuuuaaaaauugucuuuuuuaaaagaagcuuuguaauaugaguuaaugugcugagcau

SEQ ID NO: 442501 - RNA, 64 nt, Homo Sapiens
auugaaugcaagcguggaaaguauaauuuguaggcuuuguaaugggggcagguuagaagucauu

SEQ ID NO: 442502 - RNA, 51 nt, Homo Sapiens; identical to SEQ ID NO: 66195

SEQ ID NO: 442503 - RNA, 64 nt, Homo Sapiens
uuuucuccuagauuuucccuaaggcauuuacagucuuuguaagcuaguuucucucaccuucuug

SEQ ID NO: 442504 - RNA, 64 nt, Homo Sapiens
uaaucagaaugaaaaauaauuccacagcucauuucuuuguaauaauggaaaacagugccaaacc

SEQ ID NO: 442505 - RNA, 64 nt, Homo Sapiens
cuuccauaagcaaaaugacauucacgagaacaaacuuuguaaauagugcuacuauaauaaguuu

SEQ ID NO: 442506 - RNA, 64 nt, Homo Sapiens
ucccauaaauugucuuugaagaacuuuguaguugcuuuguaauuuaucuuggauuuauuaugaa

SEQ ID NO: 442507 - RNA, 64 nt, Homo Sapiens
caaaagcaacuuugggugagaucaacguacaacucuuuguaaaaaugauuuuagaaauaagaua

SEQ ID NO: 442508 - RNA, 64 nt, Homo Sapiens
aacuugaagcuuuccaauggcgcuucucuauggacuuuguaaauaaguuauaucuuuguaauuu

SEQ ID NO: 442509 - RNA, 64 nt, Homo Sapiens
gcgcuucucuauggacuuuguaaauaaguuauaucuuuguaauuuuccugcuacuuuaucauuu

SEQ ID NO: 442510 - RNA, 64 nt, Homo Sapiens
gaaaaguuauaugcuguaguuuuuaguauuuugucuuuguaauuuacagaaguuauuggagaaa

SEQ ID NO: 442511 - RNA, 64 nt, Homo Sapiens
ucaaguccucaucuguuauauaaaauccuuucugcuuuguaaguuuucucuuuuugggauuuuc

SEQ ID NO: 442512 - RNA, 64 nt, Homo Sapiens
cuuccccucccauguugucgcacugaucacacugcuuuguaauuauuuucuuuauuguugguaa

SEQ ID NO: 442513 - RNA, 64 nt, Homo Sapiens
agaauguuuuguugggcuguguugaacauuauuucuuuguaaaugaauguuguaggaaugagga

SEQ ID NO: 442514 - RNA, 64 nt, Homo Sapiens
uauaacaugugauuauaauuuuucuuagcauuuucuuuguaaagaacuacaauauaaacuaguu

SEQ ID NO: 442515 - RNA, 64 nt, Homo Sapiens
gguacaguauguaacugcgggaaacccacugccccuuuguaagcuguggaacccaaacuguaug

SEQ ID NO: 442516 - RNA, 64 nt, Homo Sapiens
uuuuaauaauuuugauugaaacccuuuaacaacucuuuguaaauuuuaacucauuuuaguugau

SEQ ID NO: 442517 - RNA, 64 nt, Homo Sapiens
uaccaauuuguacauuuuaauuauucaauuucuacuuuguaaaaauagggaaauuauuugaagu

SEQ ID NO: 442518 - RNA, 64 nt, Homo Sapiens
augaauagcaaaugagaaaauguauauaaaagcacuuuguaaauuguaaaaguaguacagaugu

SEQ ID NO: 442519 - RNA, 64 nt, Homo Sapiens
uuucuacguauaaacacucuugaauagacuuccacuuuguaauuagaaaauuuuauggacagua

SEQ ID NO: 442520 - RNA, 64 nt, Homo Sapiens
uauuuugugaacacuuuugaaaauguacauguuccuuuguaauugacacuauauauuucuuaau

SEQ ID NO: 442521 - RNA, 64 nt, Homo Sapiens
ugacuccaaugccuguacugugucuacugcaccacuuuguaaacacuucaauuuacuaucuuug

SEQ ID NO: 442522 - RNA, 64 nt, Homo Sapiens
ggaucccugagcuuucccaguagccuccaguuuccuuuguaagacccagggaucacuuagccau

SEQ ID NO: 442523 - RNA, 64 nt, Homo Sapiens
uccugagagccagccugacauuagacagaauacccuuuguaauacauuggaaauuuuuacucau

SEQ ID NO: 442524 - RNA, 64 nt, Homo Sapiens
gugauucauucauuauucuaguccugcuuuaguccuuuguaauuugugguaauuaugcuuuucu

SEQ ID NO: 442525 - RNA, 64 nt, Homo Sapiens
uaaauauuuuaauuacuauuuaaauaucucuuuacuuuguaauccuaugcauuuuacgcauuaa

SEQ ID NO: 442526 - RNA, 64 nt, Homo Sapiens
ugcugguuuauguucuaggaacucuucaugagcacuuuguaaacacccucuugcuuaauccucc

SEQ ID NO: 442527 - RNA, 64 nt, Homo Sapiens
uaauaugaagaagauauaucauauugugcaaccgcuuuguaaaucaccuuuacaauuaaacuaa

SEQ ID NO: 442528 - RNA, 64 nt, Homo Sapiens
uucauuccaaaaaugcccggguagccucuucaggcuuuguaauuauaacgugaauauuuauaca

SEQ ID NO: 442529 - RNA, 64 nt, Homo Sapiens
agcagauuuuuuuguucucaugcaggaaaguauacuuuguaaggaugauauauauuuuuuuuaa

SEQ ID NO: 442530 - RNA, 64 nt, Homo Sapiens
ugcaaagaaaaguuucaccucaacaguuaucacacuuuguaauuaagcacauuccaaacuuuag

SEQ ID NO: 442531 - RNA, 64 nt, Homo Sapiens
uagaauucaugaguguuuacuuuucaaaauuagucuuuguaacaaaaaagaccaguaacuuugu

SEQ ID NO: 442532 - RNA, 64 nt, Homo Sapiens
cacauucuuagcauauaacucuaauuuugcuaaacuuuguaaugugaacuugcuucccuuuuca

SEQ ID NO: 442533 - RNA, 64 nt, Homo Sapiens
uaagcaauaguuuauguccuagucucuuucuaagcuuuguaagcaaaaaauauccaaggaucag

SEQ ID NO: 442534 - RNA, 64 nt, Homo Sapiens
auauaaccccaaacuaagauuugcacagggucaucuuuguaauuauuuuggaaggucugaaaac

SEQ ID NO: 442535 - RNA, 64 nt, Homo Sapiens
gguagaaauauuacagaauaccuuaaauaucagacuuuguaacauguaaaagaguuuauacagg

SEQ ID NO: 442536 - RNA, 64 nt, Homo Sapiens
ucauauugaguaaaugaaugauaauauguaggcacuuuguaaauauggcugcaaguggaagcgg

SEQ ID NO: 442537 - RNA, 64 nt, Homo Sapiens
auauuuugggcauucucagcuaauaaaaacucuucuuuguaaucuuugcauucugaggcugaac

SEQ ID NO: 442538 - RNA, 64 nt, Homo Sapiens
aauuuguaaacacugccagaauacuuucuagcugcuuuguaauuuuuuaagaguguuauuuugu

SEQ ID NO: 442539 - RNA, 64 nt, Homo Sapiens
uccagaauucugaguuaaagaaacaaaguauuugcuuuguaaaaggccaaaauucuauuuccua

SEQ ID NO: 442540 - RNA, 64 nt, Homo Sapiens
gucauuucugcuucagcucuuugcugcuucacuucuuuguaaaguuguaaccugaugguaauua

SEQ ID NO: 442541 - RNA, 64 nt, Homo Sapiens
ugagguuuugguaauuguagaccuguuucauaagcuuuguaauucagaaauccuuguauuuagu

SEQ ID NO: 442542 - RNA, 64 nt, Homo Sapiens
ugcagaaucaguuacaaacaucacaguucccaugcuuuguaauaacaccuggugaaaaaguuag

SEQ ID NO: 442543 - RNA, 64 nt, Homo Sapiens
aauaguggguggauagcaaguauauucuaaaaaacuuuguaaauaaaguuuuguggcuaaaaug

SEQ ID NO: 442544 - RNA, 64 nt, Homo Sapiens
auauugauagucacuagaguaauguauucuuaaccuuuguaagaacugaucucagcauguauuc

SEQ ID NO: 442545 - RNA, 64 nt, Homo Sapiens
cuaacaacaacaaagggcaguaaauuaaaguacucuuuguaagguacaguuaccgauuaaucua

SEQ ID NO: 442546 - RNA, 64 nt, Homo Sapiens
uuugaaauuacuguaccuagucuuuuuugcauuacuuuguaaccuuuuucuaugcaagagucuu

SEQ ID NO: 442547 - RNA, 64 nt, Homo Sapiens
caucuuuugguucuguucacugagcuaaauuuaucuuuguaaaucuuuuugagucuggggggug

SEQ ID NO: 442548 - RNA, 64 nt, Homo Sapiens
gcaagagcuucugggacagagacugcuuggccagcuuuguaaguaaguggcugccuccaaugug

SEQ ID NO: 442549 - RNA, 64 nt, Homo Sapiens
guugaugguuuugugauuuagcuggguaaacuaucuuuguaacagauaaguuauuuauaaaaau

SEQ ID NO: 442550 - RNA, 64 nt, Homo Sapiens
guugggaacagccaaagggauuccaaggcuaaaucuuuguaacagcucucuuucccccuugcua

SEQ ID NO: 442551 - RNA, 64 nt, Homo Sapiens
uagcgcuaaauaauuugaacgugaacuuaaaccucuuuguaaaauccuugauucagauauuuau

SEQ ID NO: 442552 - RNA, 64 nt, Homo Sapiens
acugcuauuguaauaaguguuauguauuuugugacuuuguaacauuaccaacugcugagauuuu

SEQ ID NO: 442553 - RNA, 64 nt, Homo Sapiens
uuccaagucauucucaccuaaacccucacugggacuuuguaaacgaaucuccuuguuguucuuu

SEQ ID NO: 442554 - RNA, 64 nt, Homo Sapiens
gccguacaauaaacaaauuagcauugucuguuuucuuuguaaauuuuuauucuuucuacugagg

SEQ ID NO: 442555 - RNA, 64 nt, Homo Sapiens
guuugugauacuugaaacaugggugauuauauugcuuuguaauggaagcaguaagggggaagga

SEQ ID NO: 442556 - RNA, 64 nt, Homo Sapiens
aacuuuuuaaaaauuaauuguuuuauacagucaacuuuguaaugauauggauuauguuuuagca

SEQ ID NO: 442557 - RNA, 64 nt, Homo Sapiens
acaacuuucacuauaaugugcaaaugaauaaugccuuuguaaccaacccauggaaaaaugccau

SEQ ID NO: 442558 - RNA, 64 nt, Homo Sapiens
acuuugauaugcuguuaucauugaagagggaguacuuuguaaccucuuugucacuggaugcuac

SEQ ID NO: 442559 - RNA, 64 nt, Homo Sapiens
gacuguaaauauauuuuuggcuuccauuuguaaucuuuguaauaauaauacagucaccuagaca

SEQ ID NO: 442560 - RNA, 64 nt, Homo Sapiens
cuuguaaauuuuauuuauacaucuguaaauguuccuuuguaaaaaaacaaauaacagaaacaaa

SEQ ID NO: 442561 - RNA, 64 nt, Homo Sapiens
agauuuaugguaacugguuucacauuacauuuaucuuuguaaaaaauuuuuaaaaguaguaagc

SEQ ID NO: 442562 - RNA, 64 nt, Homo Sapiens
ccagaacucuaauuggacaccacacucccuuccacuuuguaauaacugauacauaauuuaaaag

SEQ ID NO: 442563 - RNA, 64 nt, Homo Sapiens
aauguaauuucuuuccuuuuaauuuguguaucugcuuuguaauaguaauuuguacauauuuuag

SEQ ID NO: 442564 - RNA, 64 nt, Homo Sapiens
ugacaaucauguagaaaccugugaaauuuguuaucuuuguaaaaguuuuaagacauuuaaaaac

SEQ ID NO: 442565 - RNA, 64 nt, Homo Sapiens
ugugaaacuuuauuaauguaaccuaguauaauuucuuuguaauaacuagcacauauaugcaagc

SEQ ID NO: 442566 - RNA, 64 nt, Homo Sapiens
ccaauaaucauaguuauggagaaguguucauuuacuuuguaauuaucacugcuauuagacaauu

SEQ ID NO: 442567 - RNA, 64 nt, Homo Sapiens
acuugcuuguuuuccuuauucccaagaaaguauccuuuguaaaauuuuuucauuguguguauuu

SEQ ID NO: 442568 - RNA, 64 nt, Homo Sapiens
gccaauaacugguuuaaugucaauuuuugacugacuuuguaaaaaaaagaguaauguauuaccu

SEQ ID NO: 442569 - RNA, 64 nt, Homo Sapiens
cauguuugagauggguggccuuuuuauguuccugcuuuguaauugcaguuauguuuacacauca

SEQ ID NO: 442570 - RNA, 64 nt, Homo Sapiens
gggggaagccuuugcaagaaaauugcauacaaggcuuuguaacgaucaagugcuaaucgaugga

SEQ ID NO: 442571 - RNA, 64 nt, Homo Sapiens
ugaauaccagcuggggagacacuagggaagggagcuuuguaagccuugauugcgaaaguccaaa

SEQ ID NO: 442572 - RNA, 64 nt, Homo Sapiens
gguaggauucucucuaaauuauuuauugaagaggcuuuguaaauagugcaccagugacaggugc

SEQ ID NO: 442573 - RNA, 64 nt, Homo Sapiens
ggccguaguuuauuuuaaaauauauuuuuaaaagcuuuguaaaaauuaugucauucucagaauu

SEQ ID NO: 442574 - RNA, 64 nt, Homo Sapiens
gugugcccuguaaccugacugguuaacagcaguccuuuguaaacaguguuuuaaacucuccuag

SEQ ID NO: 442575 - RNA, 64 nt, Homo Sapiens
uuuauacuuguagcaaauuguuuuaauucuguagcuuuguaauauguuuuaaaaucagaaacua

SEQ ID NO: 442576 - RNA, 64 nt, Homo Sapiens
cuccuaugucuguuacaaaacauaguuuauguagcuuuguaacauuccucagugccuguccaua

SEQ ID NO: 442577 - RNA, 64 nt, Homo Sapiens
auauucauaucuguuucauuuggaggauuuucuucuuuguaauguaaagaaauucaaaguuauc

SEQ ID NO: 442578 - RNA, 64 nt, Homo Sapiens
uauaaacauuaacuuuccuauaagaauauuuuggcuuuguaaucuauagccucaaauugguauu

SEQ ID NO: 442579 - RNA, 64 nt, Homo Sapiens
caacacucuuacaccuguuauggaaaaugucaaccuuuguaagaaaaccaaaauaaaaauugaa

SEQ ID NO: 442580 - RNA, 64 nt, Homo Sapiens
acaccucacagcagcuucgugcuuuuguacagaccuuuguaacaaguguacagaaaacucauuu

SEQ ID NO: 442581 - RNA, 64 nt, Homo Sapiens
gcgcuacguuuauugccucgucuuauucacugaccuuuguaaugauacacagugaauucuuuuu

SEQ ID NO: 442582 - RNA, 64 nt, Homo Sapiens
cuauuuuuuuaauguacccuaccuucaguauucucuuuguaaguuggugacuugcaucuguggc

SEQ ID NO: 442583 - RNA, 64 nt, Homo Sapiens
uuuucuaauuaauagccaaagauuucauaucuaacuuuguaaccagaauuauacaguaaguuga

SEQ ID NO: 442584 - RNA, 64 nt, Homo Sapiens
cgugcccaggggcccacagggaacccugcuugcacuuuguaacauguuuacuuuucagggcauc

SEQ ID NO: 442585 - RNA, 64 nt, Homo Sapiens
auucugcugcccuccaccauuuauuuuuacagugcuuuguaauuuuuuucaucaguuccuuaaa

SEQ ID NO: 442586 - RNA, 64 nt, Homo Sapiens
ccugggcuggaagucaaagccuggggggacauuccuuuguaaaagaccccagacauccugcaac

SEQ ID NO: 442587 - RNA, 64 nt, Homo Sapiens
aacuuuggucucccuacauuuuuaauaaaugauccuuuguaaauuauuuuguuuuuaaaaugug

SEQ ID NO: 442588 - RNA, 64 nt, Homo Sapiens
uugaaauaaguaauacuuucaaaucaauaagaugcuuuguaaagucaauaguauggaucuuuuu

SEQ ID NO: 442589 - RNA, 64 nt, Homo Sapiens
uauaucugaaccuaaugguuaaauaaaaaagaaccuuuguaaaauuuaaauaccaaaagaggga

SEQ ID NO: 442590 - RNA, 64 nt, Homo Sapiens
gggauauggacaaguaaguacuucugugacuuaacuuuguaaagucugccccucuuccuucuuc

SEQ ID NO: 442591 - RNA, 64 nt, Homo Sapiens
uuuuuuuuuugcuuuuaccuaauguuauguuaugcuuuguaaauuugaguauaaaaagaacccc

SEQ ID NO: 442592 - RNA, 64 nt, Homo Sapiens
guuuagcaaaauaacugauuacacagcaguuugacuuuguaaaauaaaacauacaguuuauucc

SEQ ID NO: 442593 - RNA, 64 nt, Homo Sapiens
guguagaagcauuccuucuuuucuuucuaguggucuuuguaagacuuagcuuuuuaauuguugu

SEQ ID NO: 442594 - RNA, 64 nt, Homo Sapiens
aaacugcaauuuuauaaauuaaggagaucgguaucuuuguaauacagggggagggggagagagc

SEQ ID NO: 442595 - RNA, 64 nt, Homo Sapiens
aaauguaucaauauguuauauuaugugugaguuucuuuguaauaugauaaauaggacaaaucau

SEQ ID NO: 442596 - RNA, 64 nt, Homo Sapiens
caucacaagccauagugguaaugcuucaguuuuucuuuguaagcgcagcauuuuucuuaaggcu

SEQ ID NO: 442597 - RNA, 64 nt, Homo Sapiens
uaagguccuugugcaucuuacuaugccggaugaccuuuguaagucauggagacccaccacgucu

SEQ ID NO: 442598 - RNA, 64 nt, Homo Sapiens
uguuagcuucaauuaauuagcuguuuuagcauuucuuuguaaaaagucuugccuuucuucccug

SEQ ID NO: 442599 - RNA, 64 nt, Homo Sapiens
uuuauauuccaaauauugcugguauuauaauaugcuuuguaaauauuagguuaaguauuauuua

SEQ ID NO: 442600 - RNA, 64 nt, Homo Sapiens
aucuguccccaguucuuccaucagccucucugaacuuuguaaaaacacagaaugaaagggcauc

SEQ ID NO: 442601 - RNA, 64 nt, Homo Sapiens
aaaaccacauuggagauguuugugaaacauguuucuuuguaaugauuauauuaugaagcuuuua

SEQ ID NO: 442602 - RNA, 64 nt, Homo Sapiens
aaaauuauuuguauuuuuaauauggauuucaaaucuuuguaauaugucuuaguucagacucaua

SEQ ID NO: 442603 - RNA, 64 nt, Homo Sapiens
acaguaaaauaauccaccgucugagacccagccucuuuguaaguucaugcuguuuaagugcagg

SEQ ID NO: 442604 - RNA, 64 nt, Homo Sapiens
gcaaaagccucagaaagggaaugguguguuguaucuuuguaagagacguguguccuuugguacu

SEQ ID NO: 442605 - RNA, 64 nt, Homo Sapiens
aaaauuuagguaagcaggcuaacauauguaacuccuuuguaaccuauuucugaaacuccauuau

SEQ ID NO: 442606 - RNA, 64 nt, Homo Sapiens
uaaauuggagcuuuuagcuuuaaggaaaguauagcuuuguaauuaaaacuauguguaaauauau

SEQ ID NO: 442607 - RNA, 64 nt, Homo Sapiens
gaaaucacuaaacucuaguacauuauagcaggugcuuuguaaucuggaauggagaagagguagg

SEQ ID NO: 442608 - RNA, 64 nt, Homo Sapiens
agugugccuggcugguuugcagauauuuguucugcuuuguaaaaauuggccauuagugcauuua

SEQ ID NO: 442609 - RNA, 64 nt, Homo Sapiens
gagaggaaacuaauggaguuucauuguaacuguccuuuguaauuuauauaaauguauuauuuuc

SEQ ID NO: 442610 - RNA, 64 nt, Homo Sapiens
uguaugaaaauguccucuucuucaaagguauaggcuuuguaaugaauuagauuuucugccaaua

SEQ ID NO: 442611 - RNA, 64 nt, Homo Sapiens
uagaggaauuauacaaaauuaauauauaugaguccuuuguaauuuauuuuuuuuugagacagga

SEQ ID NO: 442612 - RNA, 64 nt, Homo Sapiens
agcucuaaacuagccuugaaguuuacagacaugacuuuguaaauguauuguuuuucuuuguugu

SEQ ID NO: 442613 - RNA, 64 nt, Homo Sapiens
agucaauuucaguucagcuaacauauauuaauaccuuuguaacucuuugcuauggcuuuuguua

SEQ ID NO: 442614 - RNA, 64 nt, Homo Sapiens
cagaacaaacauauuuaugaucaugaauaaugugcuuuguaaaaagauuucaaguuauuaggaa

SEQ ID NO: 442615 - RNA, 64 nt, Homo Sapiens
cagggguucuaauuacugucugugagaguuacuacuuuguaacuuaugguuucugcuucaguau

SEQ ID NO: 442616 - RNA, 64 nt, Homo Sapiens
cuguguaauucuauuguaauaaacuggcagguaucuuuguaacuauaaauagugcaugcucagc

SEQ ID NO: 442617 - RNA, 64 nt, Homo Sapiens
uauuuaguugauuuuaauuauuugcucuucuugucuuuguaaucucaccaggagauuacaauuu

SEQ ID NO: 442618 - RNA, 64 nt, Homo Sapiens
uucuucaccacagacaccuuuuaagauuuauaaccuuuguaauggaaaaacucucagggcccua

SEQ ID NO: 442619 - RNA, 64 nt, Homo Sapiens
aguauuuugccacaccuguaguugcaguugcuuucuuuguaauaaaggcuuaccccucucuagg

SEQ ID NO: 442620 - RNA, 64 nt, Homo Sapiens
uauacaaauaaucuaacacauaaaucauaugguccuuuguaaaauguaaaugugguaggaaaua

SEQ ID NO: 442621 - RNA, 64 nt, Homo Sapiens
aguauuuuuauacuucauccagauaccuccuucccuuuguaaauggugucuacgguuaagcaac

SEQ ID NO: 442622 - RNA, 64 nt, Homo Sapiens
uuuugcacuauuguuuuggcccaagagauuguugcuuuguaacuauagccuauacugcauuagc

SEQ ID NO: 442623 - RNA, 64 nt, Homo Sapiens
gagucuguaauaggauuuccaaagaacaguauugcuuuguaauaugccaaaucauuucaacuga

SEQ ID NO: 442624 - RNA, 64 nt, Homo Sapiens
uucgguuuaagguuucagggcacuuagucuuuaacuuuguaaggauccuuuuccuucugaccaa

SEQ ID NO: 442625 - RNA, 64 nt, Homo Sapiens
cuuaaauauuuuauucuauuuuuagugucguacgcuuuguaagauuagugguauccuauauuac

SEQ ID NO: 442626 - RNA, 64 nt, Homo Sapiens
uuaauuccaugaaagucuuaguucauuggaaguucuuuguaauugacuuucuuccauauaugug

SEQ ID NO: 442627 - RNA, 64 nt, Homo Sapiens
cagaaugauuccguuuuugccugugccuaauuuacuuuguaaaccacuuugugauagguuugua

SEQ ID NO: 442628 - RNA, 64 nt, Homo Sapiens
ucaaagcaguaauaucuucuauagcuguuuuucccuuuguaauauugugcuuuucagagacgcc

SEQ ID NO: 442629 - RNA, 64 nt, Homo Sapiens
ugucuuagauaauaaaacuauguacuuguuauuucuuuguaaaaacaggggaaacuguguaagc

SEQ ID NO: 442630 - RNA, 64 nt, Homo Sapiens
aguuaaagauuugaaagagauaagugcucugcuccuuuguaaaauguuucccaccauuucccuu

SEQ ID NO: 442631 - RNA, 64 nt, Homo Sapiens
guaugauguaaauuuucaguuuuaugaaaagaaacuuuguaaaacuuuuguaaagaaguauauu

SEQ ID NO: 442632 - RNA, 64 nt, Homo Sapiens
acuauccaugaagggaaagcuuuaauacuuaaggcuuuguaaaaaaguauguccucauagaacu

SEQ ID NO: 442633 - RNA, 64 nt, Homo Sapiens
acuggugcuguucauucauauacuaauuuacaaacuuuguaaagaucaggagacugaaaguuca

SEQ ID NO: 442634 - RNA, 64 nt, Homo Sapiens
uuucugauugauaggauuagccacacaaaaaauccuuuguaaaauaauaaccacacacagauaa

SEQ ID NO: 442635 - RNA, 64 nt, Homo Sapiens
uuuuaaaugcauaaagggggacuuuuuuacaagucuuuguaaaaaaggugccaaauuccauuua

SEQ ID NO: 442636 - RNA, 64 nt, Homo Sapiens
uagugagggaaucuaauuaagauuucaugcuguucuuuguaaugauaaauguuuccggacuaaa

SEQ ID NO: 442637 - RNA, 64 nt, Homo Sapiens
cauagauguuggaacuaccuuuuuacuccccauacuuuguaaguaaugcuuccagauuaaccug

SEQ ID NO: 442638 - RNA, 64 nt, Homo Sapiens
uuccauaugugaauguaagcucuuaacuaugucucuuuguaauguguaauuucuuucugaaaua

SEQ ID NO: 442639 - RNA, 64 nt, Homo Sapiens
uugugaaauucuagaaaaaaauauuaccaccucucuuuguaauuuacuuuacuuguaugaauuu

SEQ ID NO: 442640 - RNA, 64 nt, Homo Sapiens
ucccugcacugugucaucuuuucaaggcauuugucuuuguaauauuuuccauaaauuuggacug

SEQ ID NO: 442641 - RNA, 64 nt, Homo Sapiens
uuaaauuacccuauccuuuguucucuacuguuuucuuuguaauguaugacuacgagagugauac

SEQ ID NO: 442642 - RNA, 64 nt, Homo Sapiens
acuuuuuuucuuuuuuugacucguugacaagugucuuuguaauauguuuuuaguucccuuuuuu

SEQ ID NO: 442643 - RNA, 64 nt, Homo Sapiens
uaacagcauuuuuacuuucuguacaacaaaaaagcuuuguaaauaaaaucuuaacauuuugggu

SEQ ID NO: 442644 - RNA, 64 nt, Homo Sapiens
cuauguuucuugcauuaugaaggcuacaucugugcuuuguaaguaccacuucaaaaaauaguuc

SEQ ID NO: 442645 - RNA, 64 nt, Homo Sapiens
auuuagagcuuugugcuuuucucucauuccaucacuuuguaaugaugauacuuaacaugagcag

SEQ ID NO: 442646 - RNA, 64 nt, Homo Sapiens
aggggcuuuaucuaugaaaaaguaguaaauaguucuuuguaaccugugugaagcagcagccagc

SEQ ID NO: 442647 - RNA, 64 nt, Homo Sapiens
gucauugaggguuuguuuguguuuucaucaaugucuuuguaaagcacaaauuaucugccuuaaa

SEQ ID NO: 442648 - RNA, 64 nt, Homo Sapiens
guuggagucguuuugagaugagcauuagccccagcuuuguaaccaaugaggaacacuuacuuau

SEQ ID NO: 442649 - RNA, 64 nt, Homo Sapiens
caguguugagauggggauaaacauuaguaaaugucuuuguaagucaaguuaagagaaacuuuau

SEQ ID NO: 442650 - RNA, 64 nt, Homo Sapiens
uguaauuacaguuuuuguaagucugccuguuuuucuuuguaauugaggaugucaauacaagauu

SEQ ID NO: 442651 - RNA, 64 nt, Homo Sapiens
uauauauauacuuguuuuucucuuauuaguuaaacuuuguaaaaacugucaauuugcucuagug

SEQ ID NO: 442652 - RNA, 64 nt, Homo Sapiens
acccaucgggaagagacuuuacuccaucuccccgcuuuguaaauucaacacugguuaauuucac

SEQ ID NO: 442653 - RNA, 64 nt, Homo Sapiens
cucuuuuguaacuaucgacagagcccuugagacacuuuguaaugucaguuccugaccuuccucu

SEQ ID NO: 442654 - RNA, 64 nt, Homo Sapiens
acucuuuggcauggguaaauaaaggcugcaaguacuuuguaaucuaauuaagugcccaauauug

SEQ ID NO: 442655 - RNA, 64 nt, Homo Sapiens
uaauauacucaucauagaaaaaaauuuucguagucuuuguaaaaaauuaccaguauaucagagg

SEQ ID NO: 442656 - RNA, 64 nt, Homo Sapiens
aauggaauuauucauuuuucuaguggacagagaccuuuguaacccaaacgguuucuccugugga

SEQ ID NO: 442657 - RNA, 64 nt, Homo Sapiens
aaauuauuuuaaagugacugauaaaccaccccugcuuuguaacauuuaggccguggugaaguug

SEQ ID NO: 442658 - RNA, 64 nt, Homo Sapiens
gucuuauuuguguaauaaagccuuucaugucgugcuuuguaaauaaugucuguuuuguuacaua

SEQ ID NO: 442659 - RNA, 64 nt, Homo Sapiens
gaaguucuuucaguaagaugguggggcuggaaaucuuuguaaagauuuaaacauuagagcugga

SEQ ID NO: 442660 - RNA, 64 nt, Homo Sapiens
auugaaguguguaauaaagcucauuuaacuuuaacuuuguaaauuuuaauacaauagagacuuu

SEQ ID NO: 442661 - RNA, 64 nt, Homo Sapiens
aaaaacuguuuggaaccacaccaaugauauuuuucuuuguaauacuugaaauuuauuuuuuuau

SEQ ID NO: 442662 - RNA, 64 nt, Homo Sapiens
cugagaucauugguagccagggguugcuaccaaacuuuguaaccucaaggacaaaaugaggaag

SEQ ID NO: 442663 - RNA, 64 nt, Homo Sapiens
aaauaaagaagacaugaauuguuuuaagucuacacuuuguaauuagcuaaguugugcaguauuu

SEQ ID NO: 442664 - RNA, 64 nt, Homo Sapiens
cuaaucuagaccaaagaaugguauuuucacuuuucuuuguaacauugaaugguuugaaguacuc

SEQ ID NO: 442665 - RNA, 64 nt, Homo Sapiens
auuucaauagaaauuuuuauuucauuuucaauuacuuuguaaauucguguguauuuaguacacu

SEQ ID NO: 442666 - RNA, 64 nt, Homo Sapiens
uuuaccugagacuuucaguucguuuguauucuaccuuuguaaaacagccuauagaugaugaugu

SEQ ID NO: 442667 - RNA, 64 nt, Homo Sapiens
auguaucuuuugguuguuugauuuuucuuucuuucuuuguaaauaguucugaguucugucaaau

SEQ ID NO: 442668 - RNA, 64 nt, Homo Sapiens
agcuuuuguacuagcccaguauuuauuuacauugcuuuguaauauaaaucuguuuuagaacugc

SEQ ID NO: 442669 - RNA, 64 nt, Homo Sapiens
ucccucugccccucccccagccaugccagcuggccuuuguaagugcaggaaaccgaguagaaaa

SEQ ID NO: 442670 - RNA, 64 nt, Homo Sapiens
cugaguuauauaaggcuacuucaugacaagacugcuuuguaauauuucacuuuguuuuacuaca

SEQ ID NO: 442671 - RNA, 64 nt, Homo Sapiens
gauucuugccucuagcaauguucugcccuuucaucuuuguaagaccauuaaaaaaagcacuggg

SEQ ID NO: 442672 - RNA, 64 nt, Homo Sapiens
cacuugacuuugcuaauggccucuuucuaaugggcuuuguaaacucuacagcucagauacugau

SEQ ID NO: 442673 - RNA, 64 nt, Homo Sapiens
uacuugaugaguuuauaucuguuauuuuuguuuccuuuguaauuaacuauguaauuuuguccuu

SEQ ID NO: 442674 - RNA, 64 nt, Homo Sapiens
ucuuauucugggagaacauagaggauuuccaggacuuuguaaguaaagguggcuggagagagcu

SEQ ID NO: 442675 - RNA, 64 nt, Homo Sapiens
uuauuauuccagagaguauauguuuguuuuaaaucuuuguaaaguaaaaaggcuuuuaaaauuu

SEQ ID NO: 442676 - RNA, 64 nt, Homo Sapiens
ucaaaacauuucccaugagcuuccaacaucuauacuuuguaaagaauauacauuuuucuuaaug

SEQ ID NO: 442677 - RNA, 64 nt, Homo Sapiens
ggcuucuaacagaauucaacaagugcuacugucccuuuguaauucagaaaguggcuuugacacc

SEQ ID NO: 442678 - RNA, 64 nt, Homo Sapiens
ucaguagccguccugcaggcggcucccagaaggccuuuguaaaaucccaggugagcccuggauu

SEQ ID NO: 442679 - RNA, 64 nt, Homo Sapiens
cccauauuuuuaacucuuccuguggccaacuucacuuuguaagagcuuccucaggcuucucacc

SEQ ID NO: 442680 - RNA, 64 nt, Homo Sapiens
aaguuuaccuuuugacuggauugcuaacacuuuucuuuguaaagggucuuuccagagcuuauag

SEQ ID NO: 442681 - RNA, 64 nt, Homo Sapiens
cuguacugugggccgggcgcggagcuacaccuuucuuuguaaaagguuauuccuuuccuuuccu

SEQ ID NO: 442682 - RNA, 64 nt, Homo Sapiens
aaauugauugaagauuuuaacaccuuaugauguacuuuguaaaauuuccucccaaggguucugg

SEQ ID NO: 442683 - RNA, 64 nt, Homo Sapiens
cuagacacuagauuguaguugauuucauuuuauucuuuguaauuuuuacuagcgagaaaucuuu

SEQ ID NO: 442684 - RNA, 64 nt, Homo Sapiens
uuuguucuauaugaauaaaaaacuguaugaaugacuuuguaaauagucaguaaaaaaacacaaa

SEQ ID NO: 442685 - RNA, 64 nt, Homo Sapiens
gcauggcuuaaccuggugaugaaauuucuaacuacuuuguaacuuuuaacucuaacacccuuca

SEQ ID NO: 442686 - RNA, 64 nt, Homo Sapiens
uuuaaagucuuaaacuuuuccagggcgaauacuacuuuguaacuuuguuaaugguuaauauagg

SEQ ID NO: 442687 - RNA, 64 nt, Homo Sapiens
acacaucuuuaauaauguuauauauaucuaggaacuuuguaacaaucuauuuguuuuguacaug

SEQ ID NO: 442688 - RNA, 64 nt, Homo Sapiens
uuguuacuaaagugucuaguuuugaagcuaaaaccuuuguaauauuuuuucauuuucaguuauu

SEQ ID NO: 442689 - RNA, 64 nt, Homo Sapiens
agaaaaauauggccuugaugggguuuccuaacagcuuuguaauaguauaaauugguuccugaga

SEQ ID NO: 442690 - RNA, 64 nt, Homo Sapiens
aauuugugaauuguguauaaaaagauuggcaauucuuuguaaagagacuacuacaaaauuggaa

SEQ ID NO: 442691 - RNA, 64 nt, Homo Sapiens
uaacuaaauaauguaauggcgaaccugccguuugcuuuguaacgcauaauagaacaacguuuau

SEQ ID NO: 442692 - RNA, 64 nt, Homo Sapiens
gauucuggacauaugcaucaaagaaucggauggucuuuguaacuaauagaugaacuaagagaaa

SEQ ID NO: 442693 - RNA, 64 nt, Homo Sapiens
uauuguaguuagaaauuguauucaugaaaugaaacuuuguaacuuaucacugcuuaacuucauc

SEQ ID NO: 442694 - RNA, 64 nt, Homo Sapiens
uuuugacuuaaguagaaguaauaugcucucauuucuuuguaaucuagauuuuccuauguugaau

SEQ ID NO: 442695 - RNA, 64 nt, Homo Sapiens
auuaguacacaaaacuaagaaucuuuagacuuaucuuuguaacuaauuaggguggaaguuauga

SEQ ID NO: 442696 - RNA, 64 nt, Homo Sapiens
ggcaauaaacauguuuucauguaauacuggcuuacuuuguaauuuacaucuguaacuuucauau

SEQ ID NO: 442697 - RNA, 64 nt, Homo Sapiens
gaacauguaacuucucucacaagaguacucuuuacuuuguaaucauauacaaugucaacuuuuu

SEQ ID NO: 442698 - RNA, 64 nt, Homo Sapiens
uuuguugagaugaguuugcuguacugacgcugcacuuuguaaacagauuaccaguuuuuuacuu

SEQ ID NO: 442699 - RNA, 64 nt, Homo Sapiens
guuacacuguguuuuaaauuacuuuaaaaauaaacuuuguaagcagauuuuaauuuagucuuug

SEQ ID NO: 442700 - RNA, 64 nt, Homo Sapiens
acaagagcugcugcuauaacuuccaguuuuacaucuuuguaaaauuguaucucaaaggcagaaa

SEQ ID NO: 442701 - RNA, 64 nt, Homo Sapiens
cuaauaugcuguuuccauuaugacacagcagcuccuuuguaaguaccaggucauguccaucccu

SEQ ID NO: 442702 - RNA, 64 nt, Homo Sapiens
caagagagaacagggugguauucuaaguauguuucuuuguaacaucuuuagcaguaggacagag

SEQ ID NO: 442703 - RNA, 64 nt, Homo Sapiens
uauuauuauuauuauuuuuugagauggagucucacuuuguaacccaggcuggaaugcaauggca

SEQ ID NO: 442704 - RNA, 64 nt, Homo Sapiens
aaaagacuuuauuguucuaauuauccagauguaccuuuguaaaauagcucuuuuaugaauuagc

SEQ ID NO: 442705 - RNA, 64 nt, Homo Sapiens
aagcuuugaacaauuguguuuucgucacaggagucuuuguaaugcuuguacaguugaugucgau

SEQ ID NO: 442706 - RNA, 64 nt, Homo Sapiens
uauggagcccauuguaccuuaauaauuuuuuguacuuuguaaaaguauuuuucuuuguauauga

SEQ ID NO: 442707 - RNA, 64 nt, Homo Sapiens
acauauagaacuguuacaaucuaggaauaacacccuuuguaacucaugaaaggugucaucauca

SEQ ID NO: 442708 - RNA, 64 nt, Homo Sapiens
uuacacaucucgugaaaacuguccuaucguggggcuuuguaauggcugaagaguugaucccuuu

SEQ ID NO: 442709 - RNA, 64 nt, Homo Sapiens
auuuuuaauauguaaggaauuuugaaaauauuaucuuuguaauuuguagauuuguuuuguguug

SEQ ID NO: 442710 - RNA, 64 nt, Homo Sapiens
ggaaggauuguacugaaggcuuuccugaagcagccuuuguaagucacagcccuuuuaucucugc

SEQ ID NO: 442711 - RNA, 64 nt, Homo Sapiens
gcucuuagcacacucacagaauuguauaaaauaccuuuguaacguccuagcugacucagcauag

SEQ ID NO: 442712 - RNA, 64 nt, Homo Sapiens
gucuucagagcagcccuacuuugugauuccaauucuuuguaauucauaagauaaccacuugauu

SEQ ID NO: 442713 - RNA, 64 nt, Homo Sapiens
ugaagaguagaauuccaagagucucaauuuaaggcuuuguaaaacuuugucaugugauuuuuga

SEQ ID NO: 442714 - RNA, 64 nt, Homo Sapiens
gcuuggugccucuuaggacugauugucaccuagccuuuguaaccucgucggaccuugugauuug

SEQ ID NO: 442715 - RNA, 64 nt, Homo Sapiens
auuuaaaaauguaaaaacgagguauuuauaugaccuuuguaaccauggaggauauuauuaugug

SEQ ID NO: 442716 - RNA, 64 nt, Homo Sapiens
ccagaguuucggacagcccaggcucuggcggggucuuuguaagacugaggacagaagggacuag

SEQ ID NO: 442717 - RNA, 64 nt, Homo Sapiens
uuuugugacugucaccugaguuccagcuuugauccuuuguaagauuuaaauaaggggaggguug

SEQ ID NO: 442718 - RNA, 64 nt, Homo Sapiens
cugcuccucuccacugcccaagccuucagccucccuuuguaaugcuccgguucccugagggaug

SEQ ID NO: 442719 - RNA, 64 nt, Homo Sapiens
uguuuucugagagcacagggcaaccucacggagacuuuguaauuuauaauggaagcaagacuuc

SEQ ID NO: 442720 - RNA, 64 nt, Homo Sapiens
aaguuuuuuuucuggguucaguauacuuguauaacuuuguaaauucccauagaaaauugggugu

SEQ ID NO: 442721 - RNA, 64 nt, Homo Sapiens
acuccacccaacacguuuuugcaaagcaagaagucuuuguaagacaccuuaaacaaaguccuuc

SEQ ID NO: 442722 - RNA, 64 nt, Homo Sapiens
gcccugauggucauuuuucuaaacagaggcccugcuuuguaauauguggccaaggagauaauuu

SEQ ID NO: 442723 - RNA, 64 nt, Homo Sapiens
uucauguuuuucuguagcacugggcccaaauauucuuuguaaagaaaaucgcugcagcaaaaac

SEQ ID NO: 442724 - RNA, 64 nt, Homo Sapiens
uauuuaagucggcagcuuucuaauuuaaucuuagcuuuguaauucauguuuugcuuuuguggac

SEQ ID NO: 442725 - RNA, 64 nt, Homo Sapiens
ucaccaaauaaucuuaccucuagucuacuuacaacuuuguaaggguuucuaagcuaugcccauu

SEQ ID NO: 442726 - RNA, 64 nt, Homo Sapiens
augaaaaucaaaugaugcaaaauauauacaagcacuuuguaaauuguaaaaugauacaaaauuu

SEQ ID NO: 442727 - RNA, 64 nt, Homo Sapiens
guugugugaagcucuuggcuuuuuuccaacguuacuuuguaacuaaugaggguggauguucauu

SEQ ID NO: 442728 - RNA, 64 nt, Homo Sapiens
auguuauuguugacucucucccaagugccuugaucuuuguaauaucuccuguuguuucuaugau

SEQ ID NO: 442729 - RNA, 64 nt, Homo Sapiens
ugauacaagaaacaaccuuggaaaaguuauuucccuuuguaauaccuuuaaaaauccagaguau

SEQ ID NO: 442730 - RNA, 64 nt, Homo Sapiens
acauaaccuuaaaaaggacuauauuaaucaccuucuuuguaaucccuucacagucccagguuua

SEQ ID NO: 442731 - RNA, 64 nt, Homo Sapiens
gcauuuaaggaaacuagacaaguaaaauuauccucuuuguaauuuaaugaaaagguacaacaga

SEQ ID NO: 442732 - RNA, 56 nt, Homo Sapiens; identical to SEQ ID NO: 66425

SEQ ID NO: 442733 - RNA, 64 nt, Homo Sapiens
agccaaagaucauuuuuuuauauagacuucagcccuuuguaaauauuguaacuggggaguauag

SEQ ID NO: 442734 - RNA, 64 nt, Homo Sapiens
cccaacaauuaaaucuugccuuuacacacccaaacuuuguaauuuuagucuuggugaaauauaa

SEQ ID NO: 442735 - RNA, 64 nt, Homo Sapiens
ucagggugcuuuuauauauaagagcagcagccgccuuuguaaagugugaucuaugagaauugga

SEQ ID NO: 442736 - RNA, 64 nt, Homo Sapiens
aaucaguagaacuuacacauccuaggaaaucuuucuuuguaaguaauucuuuuggucucaagug

SEQ ID NO: 442737 - RNA, 64 nt, Homo Sapiens
uuacugucaccuugauggacaaguuucaauaaaacuuuguaaaaauaauuggacaugugccugg

SEQ ID NO: 442738 - RNA, 64 nt, Homo Sapiens
ugggccauggagcuggcccagaggccccucagcccuuuguaaagucugaugaaggcaggggugg

SEQ ID NO: 442739 - RNA, 64 nt, Homo Sapiens
aagauagaaaggaacaagacuaaaauuguaaauacuuuguaaacaucagcauuuguacuugaau

SEQ ID NO: 442740 - RNA, 64 nt, Homo Sapiens
ugaggauaucaucuagaucagcaggucaccuuaucuuuguaagaagaaccucucacaagcuggg

SEQ ID NO: 442741 - RNA, 64 nt, Homo Sapiens
caugcaucuuuucuccauaagggggucuccaaaacuuuguaaauggaggguaggccucagacca

SEQ ID NO: 442742 - RNA, 64 nt, Homo Sapiens
agguguguugaauuuguuuugggcucuggaaucccuuuguaaauuuuccucagccucgaaaagu

SEQ ID NO: 442743 - RNA, 64 nt, Homo Sapiens
caaagaauuguuuaaaaugggagucuaccucccucuuuguaaaugcuaagguugggaggcuaac

SEQ ID NO: 442744 - RNA, 64 nt, Homo Sapiens
caccugacagaaaaaaaagacuuucauuuuuuuucuuuguaauguuuccuuuucuuuuucuuuc

SEQ ID NO: 442745 - RNA, 64 nt, Homo Sapiens
aguagcauccuuauauaauaaugcacagaaaauacuuuguaaaaucaaacauugugaucuauaa

SEQ ID NO: 442746 - RNA, 64 nt, Homo Sapiens
augcccauuacuuuuuuaacucuauauuguuuaacuuuguaagaaauuuucugcuuuguauauu

SEQ ID NO: 442747 - RNA, 64 nt, Homo Sapiens
cacuaguguuugucauuuauagaacuccagccaccuuuguaaagauguugauuuuagaagaugg

SEQ ID NO: 442748 - RNA, 64 nt, Homo Sapiens
ucaccaccuucccagcucucuaacaugcauuugucuuuguaauguaaugcuguugccucaucua

SEQ ID NO: 442749 - RNA, 64 nt, Homo Sapiens
aaggggguaggggacacagcgucaggcauugacacuuuguaagacuccugucuuucucauccag

SEQ ID NO: 442750 - RNA, 64 nt, Homo Sapiens
aagugaaaaacuauacuuuuaauaucauuaauuucuuuguaaccgggguuucugcaucaauuag

SEQ ID NO: 442751 - RNA, 64 nt, Homo Sapiens
cauggcugaaaguagcuuuuuccagcuuuaagcacuuuguaagagcuuuauuuaaagucuucug

SEQ ID NO: 442752 - RNA, 64 nt, Homo Sapiens
uuaaauauguaagugcuauaaaauguugcuuuggcuuuguaaauucgucagucaaaccccuuua

SEQ ID NO: 442753 - RNA, 64 nt, Homo Sapiens
auuuuugcuuguguugucgcugacuaugccuuaccuuuguaaauuuuuuucucuuuauguaguu

SEQ ID NO: 442754 - RNA, 64 nt, Homo Sapiens
uugagcuauuggacuucacuauuuacauuccguacuuuguaaacuuuaaaugaaauggggagau

SEQ ID NO: 442755 - RNA, 64 nt, Homo Sapiens
aaaaaacacauagcaaggaguacugguggaaagucuuuguaaggaccuuacauuguaacaaucu

SEQ ID NO: 442756 - RNA, 64 nt, Homo Sapiens
ggcugguuaguaaauuauugggccagcaaacuuucuuuguaaaauugguuuuugauagaacaga

SEQ ID NO: 442757 - RNA, 64 nt, Homo Sapiens
auugacuucagccccuaagaugacaucugaaaugcuuuguaauucuacugaagagcucaaugau

SEQ ID NO: 442758 - RNA, 64 nt, Homo Sapiens
aauuaaccuagcaauaaaaacagacuauuauuaucuuuguaauauuaacuguaacuaaguucaa

SEQ ID NO: 442759 - RNA, 64 nt, Homo Sapiens
cuagauuggugguguuuuauccgucaaacacaaucuuuguaaaguuucucugcucucauuuaac

SEQ ID NO: 442760 - RNA, 64 nt, Homo Sapiens
cagcacuuccucuugcccucccugcuugcugggucuuuguaaccgucuagagagggucgucugg

SEQ ID NO: 442761 - RNA, 64 nt, Homo Sapiens
augcagaugaagaggguaggaacuaaauaaaggacuuuguaagccaaagugguugggcugcuuu

SEQ ID NO: 442762 - RNA, 64 nt, Homo Sapiens
cucccaccccagaucccagggacucauccugugacuuuguaaccacacucauuccuuucaaaca

SEQ ID NO: 442763 - RNA, 64 nt, Homo Sapiens
uguuuuaaauguacagacauauuuaacuggugcacuuuguaaauucccuggggaaaacuugcag

SEQ ID NO: 442764 - RNA, 64 nt, Homo Sapiens
ggcacuggauucuaaguaguugccaucuugaauccuuuguaauaaagccauacuuuugugugug

SEQ ID NO: 442765 - RNA, 64 nt, Homo Sapiens
ucaaccugcucauuaaaucaucucucuauuaguucuuuguaaaucacuuaguacauuagagcua

SEQ ID NO: 442766 - RNA, 64 nt, Homo Sapiens
augaauauuuacauauuuuguuucaauuauguagcuuuguaacuauaaaugauauggcauguac

SEQ ID NO: 442767 - RNA, 64 nt, Homo Sapiens
auaauuuuuuccuuauuuauaggggaaagacuggcuuuguaauuaguggcuuuuuguuucccca

SEQ ID NO: 442768 - RNA, 64 nt, Homo Sapiens
uucuuauauaauuaauuaguaggaccauaaucaacuuuguaauauguauauuacuuuuauuuuu

SEQ ID NO: 442769 - RNA, 64 nt, Homo Sapiens
auuugaacauuguuuuaaucuuuugaugaaguaacuuuguaauuucagaauauucuucuaagua

SEQ ID NO: 442770 - RNA, 64 nt, Homo Sapiens
uuuggggaaaaaagcacauaaaaaaaagaaguuacuuuguaauuuaagguugaacuuugccaaa

SEQ ID NO: 442771 - RNA, 64 nt, Homo Sapiens
agcaguucacauuuuuccacaaaaaauaaaauuacuuuguaaauauaguuaauuuguucuuacc

SEQ ID NO: 442772 - RNA, 64 nt, Homo Sapiens
uaaugaauaggucugaaaacgaauucuuuggguucuuuguaauuuacuucuacuggacaucaca

SEQ ID NO: 442773 - RNA, 64 nt, Homo Sapiens
cugaaugaccauaauagaaaucauaggcuuaauucuuuguaaauuauauuggguuugcuuuauu

SEQ ID NO: 442774 - RNA, 64 nt, Homo Sapiens
uaacaugggcaaauaucugaauauauuuauauaacuuuguaauauuuuaaaagcuuugcaaccu

SEQ ID NO: 442775 - RNA, 64 nt, Homo Sapiens
ccccccagguacgauagggaaugggugguauuugcuuuguaacuaguuuugggaauaggcauca

SEQ ID NO: 442776 - RNA, 64 nt, Homo Sapiens
ggaugggggaaacacagcaguucuugguaaaguccuuuguaauaauaguuugauuuuuuuauuu

SEQ ID NO: 442777 - RNA, 64 nt, Homo Sapiens
uauggaauguucuuauuuagcuuaucauaaucuacuuuguaaaacaugcugaaaccucacugug

SEQ ID NO: 442778 - RNA, 64 nt, Homo Sapiens
uggaauucagaaagguuacccccuuccucugugucuuuguaaggauacauuuggaagaacauac

SEQ ID NO: 442779 - RNA, 64 nt, Homo Sapiens
cgucauugaagucugcuugauuaaaccauaauaucuuuguaauaauuggauuuaaaaugcuaug

SEQ ID NO: 442780 - RNA, 64 nt, Homo Sapiens
uuuuauuaauuuaaaauagaacgcuugagaggcacuuuguaaagauuuguuaaacuggaaacgu

SEQ ID NO: 442781 - RNA, 64 nt, Homo Sapiens
cuauuccauauuguauccacaauuuaugauaucacuuuguaacccauacauuuauacaauuaua

SEQ ID NO: 442782 - RNA, 64 nt, Homo Sapiens
agcugcuuagauuuagaaaucuacucuugcuggucuuuguaaguugcaugaauauuugacuuug

SEQ ID NO: 442783 - RNA, 64 nt, Homo Sapiens
ucucucucagcaaaauaaaacugugaugugucuucuuuguaaaaguuuagguauaaaaugcuau

SEQ ID NO: 442784 - RNA, 64 nt, Homo Sapiens
uaaaaagaccauuaacuuaaagugguguuaaaugcuuuguaaagcugagaucuaaauggggaca

SEQ ID NO: 442785 - RNA, 64 nt, Homo Sapiens
auccugggcagccaaccaggcaacaccaaggacucuuuguaaacgauagcugaucgugugcacg

SEQ ID NO: 442786 - RNA, 64 nt, Homo Sapiens
gaugagauugcuuccuaccuucaaauuugcagcacuuuguaaauuuaucagcaacauaaauuua

SEQ ID NO: 442787 - RNA, 64 nt, Homo Sapiens
uuaguuuauugcuuuaccaucauaucuaugaaaccuuuguaaauuauuuuaaacuugugauagg

SEQ ID NO: 442788 - RNA, 64 nt, Homo Sapiens
uagcuuccuaugaaaaugugaguacauguauuuucuuuguaaagguguuuguauuuucaacugg

SEQ ID NO: 442789 - RNA, 64 nt, Homo Sapiens
ggacauugaacaaacaaacucaugaagaaagagucuuuguaaauaaagauucaccaggcacugg

SEQ ID NO: 442790 - RNA, 64 nt, Homo Sapiens
ugaaauuguaaagaaaauacuaguuuaaugugcucuuuguaaaaagucauaauucauaaaauuu

SEQ ID NO: 442791 - RNA, 64 nt, Homo Sapiens
uguuuccuuauauugguaauucauaguaaugaaacuuuguaaaggaacaaagaggaaaucaucu

SEQ ID NO: 442792 - RNA, 64 nt, Homo Sapiens
acaaucagccauaacaaguucaaggaccuuguggcuuuguaacacagagggcuuacagccucag

SEQ ID NO: 442793 - RNA, 64 nt, Homo Sapiens
cuuagauaauagagccuagcagauauuuuaaacucuuuguaaaaaaauaguuacauuucacaaa

SEQ ID NO: 442794 - RNA, 64 nt, Homo Sapiens
uuuguacugcuuuggagaguaagacuuuugacuucuuuguaaguuccuggagaaugggaguguu

SEQ ID NO: 442795 - RNA, 64 nt, Homo Sapiens
ggucaggauaaaaaccaaaucauaugggggaacacuuuguaaauauaacccuaaugaugcaagu

SEQ ID NO: 442796 - RNA, 64 nt, Homo Sapiens
uacuuaucuccaaaaaacuuacaucacauuaucccuuuguaagcauaauuuuuuuacccauaag

SEQ ID NO: 442797 - RNA, 64 nt, Homo Sapiens
uuguauaugaaucaaaacaauggggcaggaaauacuuuguaacuuuucauuuucguuaagaauu

SEQ ID NO: 442798 - RNA, 64 nt, Homo Sapiens
aauuauugaauugugagaacauguaagucucagucuuuguaauuuucugguuuuuacuuuuuua

SEQ ID NO: 442799 - RNA, 64 nt, Homo Sapiens
uaugugguuugccccaagugugcacuauuuaauacuuuguaauaugccaccaagaguacugaca

SEQ ID NO: 442800 - RNA, 64 nt, Homo Sapiens
uuuccuaugcaguuuagccaccuucucauuaauucuuuguaacagcaaauccuaggcucagagg

SEQ ID NO: 442801 - RNA, 64 nt, Homo Sapiens
acaggaggaucucuaaagcaguagccaaacaccacuuuguaaaaggacucuuccaucagagaug

SEQ ID NO: 442802 - RNA, 64 nt, Homo Sapiens
uuaaaauagcuuaaaaguuuguaaaaaaaugaaucuuuguaauuacuuaauauguuaguuaaga

SEQ ID NO: 442803 - RNA, 64 nt, Homo Sapiens
ugaucuaugaauguuuuucuuaaaauuuacaaagcuuuguaaauuagauuuucuuuaauaaaau

SEQ ID NO: 442804 - RNA, 64 nt, Homo Sapiens
uaucuaauucacaaauuaauuucuggaaauuaaacuuuguaaauuaaguuuuugccuauaagaa

SEQ ID NO: 442805 - RNA, 64 nt, Homo Sapiens
ugaagaugucaauaagcuugcauuaagccaccugcuuuguaaguggauugauuaauaaauaacu

SEQ ID NO: 442806 - RNA, 64 nt, Homo Sapiens
guaaauuaaauguuauuugaaaauguuauaagagcuuuguaaauauuucagaaaauaugggaua

SEQ ID NO: 442807 - RNA, 64 nt, Homo Sapiens
aaguguuuacaggaugcccuucugaaggguaguccuuuguaaagcuguacagacuuugcaguuu

SEQ ID NO: 442808 - RNA, 64 nt, Homo Sapiens
augugguuugcccucaauugagcacuguuuauuacuuuguaauaugccacugugaguacugaca

SEQ ID NO: 442809 - RNA, 64 nt, Homo Sapiens
gcuguaaggcugggcugcugcgacacaggcagcgcuuuguaaacugugaagccauauacgugaa

SEQ ID NO: 442810 - RNA, 64 nt, Homo Sapiens
caagggcaauucccaucucauccaucacucaggucuuuguaaagggugcagccaagcucugcag

SEQ ID NO: 442811 - RNA, 64 nt, Homo Sapiens
acuagugauugucagacugguauggaggugacugcuuuguaagguuuugucguuucuaauacag

SEQ ID NO: 442812 - RNA, 64 nt, Homo Sapiens
guugugcucaacuucuaggguagaugacucagcucuuuguaaaucgucuuauuuuccuucuucc

SEQ ID NO: 442813 - RNA, 64 nt, Homo Sapiens
ugccaccaagaguacugacaugcacuauuuaauacuuuguaauauaugugguuugccccaagug

SEQ ID NO: 442814 - RNA, 64 nt, Homo Sapiens
ugccacugugaguacugacaugcacuguuuauuacuuuguaauaaugcgguuugcccucaagug

SEQ ID NO: 442815 - RNA, 64 nt, Homo Sapiens
uauggcuccaugcugugugagaccugccgugguccuuuguaaacaguuuuaguggccuguccuu

SEQ ID NO: 442816 - RNA, 64 nt, Homo Sapiens
cauccaugcuguuguguguaacucaccauaaugccuuuguaauuuuuugagacuggccucuuuu

SEQ ID NO: 442817 - RNA, 64 nt, Homo Sapiens
cuuuaaucaauaaaauuaauaaugaaaaguagaacuuuguaauacaauacauuguacaugaaaa

SEQ ID NO: 442818 - RNA, 64 nt, Homo Sapiens
auuucuuuaagauucagccuuuaauuuguugcagcuuuguaaauuaaagcauccgguucuaaaa

SEQ ID NO: 442819 - RNA, 64 nt, Homo Sapiens
uguuauacaaucagaagguggaaagcaaaaaguacuuuguaaagcagaaguuccagacagauga

SEQ ID NO: 442820 - RNA, 64 nt, Homo Sapiens
uaaaaggaaaaacuggaaauucuuguguuggaaacuuuguaauggcacugggguauuguuggcu

SEQ ID NO: 442821 - RNA, 64 nt, Homo Sapiens
uguaaagcgcugugcacacgauguaugugaaacacuuuguaaccugugaggaauugaugagaug

SEQ ID NO: 442822 - RNA, 64 nt, Homo Sapiens
gaguuuuacgacuuagagucuucucagucauuuccuuuguaacauucaaagacucgaauucauu

SEQ ID NO: 442823 - RNA, 64 nt, Homo Sapiens
cauugacauuuuauuuuccauaaaacuaugaacacuuuguaaaauacauagaggugauaaguaa

SEQ ID NO: 442824 - RNA, 64 nt, Homo Sapiens
uagcgccuacuucacggaaacuugugccuuuaaacuuuguaaacuuaaacacagccgagaaguu

SEQ ID NO: 442825 - RNA, 64 nt, Homo Sapiens
guuuaaauuauucagugcuaaucauuguuuuuuccuuuguaaauguugauucagaaaaggaaag

SEQ ID NO: 442826 - RNA, 64 nt, Homo Sapiens
auauguuacugccccacccuaacugaucaauguacuuuguaauccucccacccuuaagaagguu

SEQ ID NO: 442827 - RNA, 64 nt, Homo Sapiens
uuccuggauuauucaaaaugauguauguugaagccuuuguaaauugucagaugcugugcaaaug

SEQ ID NO: 442828 - RNA, 64 nt, Homo Sapiens
cuuagauuuaaaaagugaaagaaacugcaggcgccuuuguaaaaugcaaaauauuuaauuaaaa

SEQ ID NO: 442829 - RNA, 64 nt, Homo Sapiens
caccccugucucucaccuccaccaaccccacucacuuuguaacuucaucacugacccggccaau

SEQ ID NO: 442830 - RNA, 64 nt, Homo Sapiens
ugacguugaucuccugguagcaugaccuuuuggccuuuguaagacacacagccuuucuguauca

SEQ ID NO: 442831 - RNA, 64 nt, Homo Sapiens
caaacacguagcauuugcaccccuccaaagccaucuuuguaaaggaaaacguauuuguaauuga

SEQ ID NO: 442832 - RNA, 64 nt, Homo Sapiens
uuacuacagauugacacguuuuuaauuagcuguccuuuguaagaagucaggaaaucugaugcug

SEQ ID NO: 442833 - RNA, 64 nt, Homo Sapiens
gucuuagaaugcgaaucuguguuaagaaucuagucuuuguaauagaaguuucccaguggcauuc

SEQ ID NO: 442834 - RNA, 64 nt, Homo Sapiens
auaggaacuucagaggcuuuguuuaaacgcaaagcuuuguaaaagccacaaggucugagcugaa

SEQ ID NO: 442835 - RNA, 64 nt, Homo Sapiens
cagccaccaccaaaaagcaacagaagacacugcucuuuguaaccuaauacugcuaccuucaggg

SEQ ID NO: 442836 - RNA, 64 nt, Homo Sapiens
aaacaaaauaaaguuuguacagaggccaccgugccuuuguaaagaaguggggagaaaaaaacca

SEQ ID NO: 442837 - RNA, 64 nt, Homo Sapiens
uucucuaaacgucaggccugcagauccuggccgccuuuguaacccagagcuuuuuggaaauacu

SEQ ID NO: 442838 - RNA, 64 nt, Homo Sapiens
gauguggacauaauugccuaagauuuggcaauagcuuuguaagucaaacucugcuuccuuggac

SEQ ID NO: 442839 - RNA, 64 nt, Homo Sapiens
uauaaaacuaaggaaaacucaaaugcuguacugacuuuguaaaaaucuguguuagaaguguugc

SEQ ID NO: 442840 - RNA, 64 nt, Homo Sapiens
cuuucuaugugacauuucucuaaauuuaauccuucuuuguaauauauaguguuuggacagcuga

SEQ ID NO: 442841 - RNA, 64 nt, Homo Sapiens
uaaacuuugaccaagaaauuaggccacucauguucuuuguaacuuugaagagucaucugauucg

SEQ ID NO: 442842 - RNA, 64 nt, Homo Sapiens
uuaugggacaaaaaucaauucuuagucgaaucagcuuuguaaugcuggcuguuuucuucugggg

SEQ ID NO: 442843 - RNA, 64 nt, Homo Sapiens
aauucuugcucuucuagggggccuguuuuaauaacuuuguaaggaugucaccuauaugggauuu

SEQ ID NO: 442844 - RNA, 64 nt, Homo Sapiens
auagcaacucauuuauuucauuuuggucuuaaugcuuuguaaacaggucaaaaaauacugucau

SEQ ID NO: 442845 - RNA, 64 nt, Homo Sapiens
ucuccaucccuauucccuccucugaaaugcaccccuuuguaauugaggacaaggugguucugug

SEQ ID NO: 442846 - RNA, 64 nt, Homo Sapiens
uuguuuaugucagagcuuuguuguaagccucucacuuuguaaggaaauucuuauuggguagguu

SEQ ID NO: 442847 - RNA, 64 nt, Homo Sapiens
aauuuuuuugcauuuaugaacggcuguuuuucuacuuuguaauugugagacauuuucuugggga

SEQ ID NO: 442848 - RNA, 64 nt, Homo Sapiens
aacuguuaugccuuuuauuuguuugcaaggaugucuuuguaauguguuucaugaauagaauauc

SEQ ID NO: 442849 - RNA, 64 nt, Homo Sapiens
ugucacauaggaauuguucagcaacagaaagauacuuuguaaugagaagguacaaauuugagua

SEQ ID NO: 442850 - RNA, 64 nt, Homo Sapiens
aauuugagaaaaaucugggucuuucuaaaaacugcuuuguaaguuacuuuuucuuuaugacuuc

SEQ ID NO: 442851 - RNA, 64 nt, Homo Sapiens
ugcccugcauccccccuccucugccugagugugucuuuguaaugucagcuggcaucauacaaag

SEQ ID NO: 442852 - RNA, 64 nt, Homo Sapiens
agcagggacugugagagacaaccagcagcauccucuuuguaaucacagggcagggaucagaguu

SEQ ID NO: 442853 - RNA, 64 nt, Homo Sapiens
uccaggccugaaccccucccgugcuguaauaaaucuuuguaaauaacugcugagacuccucuuu

SEQ ID NO: 442854 - RNA, 64 nt, Homo Sapiens
cucgaacccacacugcaacaggaacugugagagucuuuguaaguaaacugcccugucuagguca

SEQ ID NO: 442855 - RNA, 64 nt, Homo Sapiens
uugcagaccugggacuuuagggcuaaccaguucucuuuguaaggacuugugccucuugggagac

SEQ ID NO: 442856 - RNA, 64 nt, Homo Sapiens
uagacucuacauugggcagccuuuaaauaugauucuuuguaaugcuaaauagccuuuuuuucuc

SEQ ID NO: 442857 - RNA, 64 nt, Homo Sapiens
auauauauacuuuuucauauauaauuagaucuuucuuuguaauuucauauguaguucuucauag

SEQ ID NO: 442858 - RNA, 64 nt, Homo Sapiens
uccuugguugauaacugucuugauacuuuucauucuuuguaagaggccaaaucgucuaaggacg

SEQ ID NO: 442859 - RNA, 64 nt, Homo Sapiens
ugaucagugugcuaaaucucucugccuguuuggacuuuguaauuauuuuuuuagcaguaauuaa

SEQ ID NO: 442860 - RNA, 64 nt, Homo Sapiens
gcugaaaacuaccuguggguuaaggauguaguuccuuuguaagggugggcaggccucguaagaa

SEQ ID NO: 442861 - RNA, 64 nt, Homo Sapiens
ccagcccccugucgccugucgucggugcuaauuccuuuguaauuggaaggacccgcuuccuguu

SEQ ID NO: 442862 - RNA, 64 nt, Homo Sapiens
uuuuggacauugaaagauguuacauucauauaaacuuuguaacuaaggcugcaucuuuauaugu

SEQ ID NO: 442863 - RNA, 64 nt, Homo Sapiens
aaauauguuuuguaguaacacauuguauuuagugcuuuguaauacuugagucugggauuauccg

SEQ ID NO: 442864 - RNA, 64 nt, Homo Sapiens
gauuuuuuguaaagucauugauaugcagucacuucuuuguaaauuuuggcacaaauauuuuauc

SEQ ID NO: 442865 - RNA, 64 nt, Homo Sapiens
gaagaugcucuuccagagacuccaaaguaacgaccuuuguaaguacaucaccaugacaucucuc

SEQ ID NO: 442866 - RNA, 64 nt, Homo Sapiens
aaugcugcauacuuucuggaucuguaucucuuggcuuuguaauacccuccuuugcccugggaca

SEQ ID NO: 442867 - RNA, 64 nt, Homo Sapiens
uauggaguauugugcacaaccuugucuggauuaacuuuguaauucucgcccugcugcauuugcu

SEQ ID NO: 442868 - RNA, 64 nt, Homo Sapiens
aaucaaaauuaccuuauaucuuggucauguuggucuuuguaacaauauucagucacaagucauu

SEQ ID NO: 442869 - RNA, 64 nt, Homo Sapiens
uauuggccuuuuagugaguaauagacuuauuuuccuuuguaauguuuuagacuuuuuuuuauaa

SEQ ID NO: 442870 - RNA, 64 nt, Homo Sapiens
aaacucucggagaaauaaaagcgagcucaauucacuuuguaagagauuacaucaagcuaauugu

SEQ ID NO: 442871 - RNA, 64 nt, Homo Sapiens
ugaggguggaggugggaauagaccucaauuuccacuuuguaaaaacuacacaauucuccuucgg

SEQ ID NO: 442872 - RNA, 64 nt, Homo Sapiens
uccacagggacuguucuauacauguaaaauagggcuuuguaaacguuacugaggaccaaagaua

SEQ ID NO: 442873 - RNA, 64 nt, Homo Sapiens
aauaaaguuuggggugaugagguuguagagaacucuuuguaagcccuugguacugcagagucug

SEQ ID NO: 442874 - RNA, 64 nt, Homo Sapiens
ucuugcaguuuuguaagcccugcuauuguaaggucuuuguaaaauuaccuccccuuuucuaugu

SEQ ID NO: 442875 - RNA, 64 nt, Homo Sapiens
accaagguaccgauuucugccuuugaacgugcuucuuuguaauggugcaauugucuuuuuuuuc

SEQ ID NO: 442876 - RNA, 64 nt, Homo Sapiens
aguuuccccucccccaccccuaaauauuaguugccuuuguaaaccuguacucuccacauuauuu

SEQ ID NO: 442877 - RNA, 64 nt, Homo Sapiens
auggacaucacuuuuuuuuugcagauuuguucaacuuuguaaauuuccguuucuuaaguauugc

SEQ ID NO: 442878 - RNA, 64 nt, Homo Sapiens
uaaggaaauaacaauguaguguaugggaagaguucuuuguaaugaguaguacaugggaaaaaca

SEQ ID NO: 442879 - RNA, 64 nt, Homo Sapiens
aauuggcuaaaagaaucaucuugaauuauucuaccuuuguaaacuaaaaaaaaauaaaauuauu

SEQ ID NO: 442880 - RNA, 64 nt, Homo Sapiens
aaaaauaaaauuauuuugaacuccuguacuugcucuuuguaaaagaauacaugaucuugaacag

SEQ ID NO: 442881 - RNA, 64 nt, Homo Sapiens
uaccaagguucccguuaacaguuuuuguuaaacccuuuguaaaauucagaaauaugaauaaaua

SEQ ID NO: 442882 - RNA, 64 nt, Homo Sapiens
uugauacuuuccuaagaauucuagguguaugauacuuuguaaagagaaauucauguuuacuuuu

SEQ ID NO: 442883 - RNA, 64 nt, Homo Sapiens
acuuauaacaugguguaucugcaaaugguuguaacuuuguaaguacauggaaaauguuaaggaa

SEQ ID NO: 442884 - RNA, 64 nt, Homo Sapiens
aagcacaucggaaccagagguaaauaaucaggugcuuuguaaccguggugguuuuucguucucu

SEQ ID NO: 442885 - RNA, 64 nt, Homo Sapiens
uaucuggaagggaaagcacacuuccgugcucuggcuuuguaacuguucaaagaugagggccugg

SEQ ID NO: 442886 - RNA, 64 nt, Homo Sapiens
uguacuguggauuguacauuuaacuuuggaauggcuuuguaauaaucagucuuaagaaaauguu

SEQ ID NO: 442887 - RNA, 64 nt, Homo Sapiens
caugcuuuacugccauugcuguaugcuuuacugucuuuguaaaaaucccccucuccccuuuucu

SEQ ID NO: 442888 - RNA, 64 nt, Homo Sapiens
uuuauccaugauauucaguacaacucugucauuucuuuguaauauuuaaaaaauauuaguaaag

SEQ ID NO: 442889 - RNA, 64 nt, Homo Sapiens
gaaaauguuuugaauuuauaaaauuaauguuuuucuuuguaacauuuauauauauuuuuuaaca

SEQ ID NO: 442890 - RNA, 64 nt, Homo Sapiens
cauuuugauuuguauucaaguacucuucaaguaucuuuguaaugaagguuuggcuacuuguaua

SEQ ID NO: 442891 - RNA, 64 nt, Homo Sapiens
uugaucaguauuccuccucuaucaccuuuuuagacuuuguaagguaaauauuuggacuaacuuu

SEQ ID NO: 442892 - RNA, 64 nt, Homo Sapiens
aaauugcugggccauaugaaaaaucaauaguuagcuuuguaagaaacagucaaacuguuuucca

SEQ ID NO: 442893 - RNA, 64 nt, Homo Sapiens
ccuaucuaucauacucccaaauuccuucuugcaucuuuguaauuucucacucuuccuucucccu

SEQ ID NO: 442894 - RNA, 64 nt, Homo Sapiens
uuggagauauuuuccaacaggccaagaaaaacaacuuuguaaauuuguucuguauuuuuaaauu

SEQ ID NO: 442895 - RNA, 64 nt, Homo Sapiens
augaacaaacaugagacuguccaaauauucacugcuuuguaaaaaaaccuuauaaaaacagguu

SEQ ID NO: 442896 - RNA, 64 nt, Homo Sapiens
aaauugguuucuguaaauccacaguuggucaagacuuuguaaaguuacugggauagucagguaa

SEQ ID NO: 442897 - RNA, 64 nt, Homo Sapiens
agaaaaaaaaauuuuuucugugacuuauacauaacuuuguaaaaucaguauuugguggucccua

SEQ ID NO: 442898 - RNA, 64 nt, Homo Sapiens
uugcauucuauuuauugugaggugcugccaucaacuuuguaagaggaagcacccaucuucacuu

SEQ ID NO: 442899 - RNA, 64 nt, Homo Sapiens
acggagaggaacaaaccaucuuggggcucauugucuuuguaauuaaauguaggauacuuuuuau

SEQ ID NO: 442900 - RNA, 64 nt, Homo Sapiens
agauucaaauuagauagucagacauuuuucuucucuuuguaaguauucauugcuuuacauacua

SEQ ID NO: 442901 - RNA, 64 nt, Homo Sapiens
uuuuacaaauuguuuaauacgaaagcuaaauuuucuuuguaaguaaaucugccuaauuuuucuu

SEQ ID NO: 442902 - RNA, 64 nt, Homo Sapiens
uuguugagggcccucuuguuaggaugaucugcuccuuuguaacgaccaggagcaagagaccaga

SEQ ID NO: 442903 - RNA, 64 nt, Homo Sapiens
acuuggggaguaaggacauuaauguacuuucucccuuuguaaagaugugugaaaucuaagcagu

SEQ ID NO: 442904 - RNA, 63 nt, Homo Sapiens; identical to SEQ ID NO: 67316

SEQ ID NO: 442905 - RNA, 64 nt, Homo Sapiens
cccgacuuccucugccaguuauugacacagcucucuuuguaagagaggaaagaaacuaaaccca

SEQ ID NO: 442906 - RNA, 64 nt, Homo Sapiens
cgcaggugucccggucugcauaagccucgugugccuuuguaaaguccaccuacacuuuugacca

SEQ ID NO: 442907 - RNA, 63 nt, Homo Sapiens
auaucagugauacugaugagaauaaacuaaacgccuuuguaacagccuugccgcaugcucguu

SEQ ID NO: 442908 - RNA, 64 nt, Homo Sapiens
accgcugggcucgcuggugaccgccacagccccgcuuuguaaccagggaauacacagucauuuc

SEQ ID NO: 442909 - RNA, 64 nt, Homo Sapiens
uucuugaaccccgaccacuaccccagguuucuaacuuuguaacuugcuucugaugugggucccu

SEQ ID NO: 442910 - RNA, 64 nt, Homo Sapiens
gagagaggacagguccucaacaaauggcaugugacuuuguaaguguagaauugcugugagguau

SEQ ID NO: 442911 - RNA, 64 nt, Homo Sapiens
gccccgccccagggcaauguuggacccccuuuuacuuuguaaaguuuguauuuauuccccuuua

SEQ ID NO: 442912 - RNA, 64 nt, Homo Sapiens
gggcccguccuaggaauggauguggggauggucgcuuuguaaugugcugguucucuuuuuuuuu

SEQ ID NO: 442913 - RNA, 64 nt, Homo Sapiens
uuggaaaauucaccaccucuagcuccucacuguucuuuguaauuaacacgcuguugguaaucuu

SEQ ID NO: 442914 - RNA, 64 nt, Homo Sapiens
aucccgccccaaacguccgcuuuccuuuucucuacuuuguaauuuauugaucaguuucuguugg

SEQ ID NO: 442915 - RNA, 64 nt, Homo Sapiens
uuccugcccucuaauuugggggcagcaguuugugcuuuguaagcuucagucuuauuuauagugu

SEQ ID NO: 442916 - RNA, 64 nt, Homo Sapiens
acauaugugggaggcuuucaugagguguguugcacuuuguaacugucuagagcucuugauggaa

SEQ ID NO: 442917 - RNA, 64 nt, Homo Sapiens
gaacggguacuacacuuuauuagaagucuuggcacuuuguaacgaaaaaggcaaccaaccacau

SEQ ID NO: 442918 - RNA, 64 nt, Homo Sapiens
uuugacgagaaaguugguugcauuucacaugguacuuuguaaaucuguugucuuaaugccauuu

SEQ ID NO: 442919 - RNA, 64 nt, Homo Sapiens
uucagaauauuucuagaaugagauguaacccauucuuuguaagguuuuccaggucaguacguaa

SEQ ID NO: 442920 - RNA, 64 nt, Homo Sapiens
ugacacauuugaaaucauuguaacaaucugcuuucuuuguaacaacauauuugcacaaguacag

SEQ ID NO: 442921 - RNA, 64 nt, Homo Sapiens
aauguuaaagccagaaguuggccucugcucuuaucuuuguaauaggaagaaguguaacucacca

SEQ ID NO: 442922 - RNA, 64 nt, Homo Sapiens
aaguaucuuucaguuuuauauuuuauguauuucacuuuguaacaguauaauacauauguuguac

SEQ ID NO: 442923 - RNA, 64 nt, Homo Sapiens
aaaccuaaaaaguacaguguguuuaucacgagagcuuuguaagguacuucacuuccacuuuaaa

SEQ ID NO: 442924 - RNA, 64 nt, Homo Sapiens
aauucuacaaaaaaauguuguuaauaaaugucugcuuuguaaaagcaguuuugcaauuuuuuaa

SEQ ID NO: 442925 - RNA, 64 nt, Homo Sapiens
gcugugguugcugugacaguuucguuuucugaaucuuuguaaugcucuuccacccugcucgugc

SEQ ID NO: 442926 - RNA, 64 nt, Homo Sapiens
aaaucugaacuaacuugcuuuuagaagucuuuuucuuuguaagcauuguaaaugcuaauaaauc

SEQ ID NO: 442927 - RNA, 64 nt, Homo Sapiens
guguguccccuguccugccccaccgguuugcuggcuuuguaauaacauaagaccauugugguug

SEQ ID NO: 442928 - RNA, 64 nt, Homo Sapiens
gccucuugaagcuuuuucugccuccugauucucucuuuguaaacuauuuucaaauuguuuuuca

SEQ ID NO: 442929 - RNA, 64 nt, Homo Sapiens
aauacaguauuuuccaugguucugccugcacuuacuuuguaaugccacgguugagauugagaga

SEQ ID NO: 442930 - RNA, 63 nt, Homo Sapiens
uggaugugaaucuuacauuccuuuucaucauuuccuuuguaaaaaugacgagugcuggguuuu

SEQ ID NO: 442931 - RNA, 64 nt, Homo Sapiens
uuuuucguuuuaaauuuuagauuuuauuuuagugcuuuguaauuaauugggguuuauauugaua

SEQ ID NO: 442932 - RNA, 64 nt, Homo Sapiens
ggaauggcuucaaaauaagucacgaacacaaauucuuuguaaauuauguaaauuccuguuuaua

SEQ ID NO: 442933 - RNA, 64 nt, Homo Sapiens
gucuuccccacccagcucuccccugcgccccugucuuuguaaauugacccuucuggaguggggg

SEQ ID NO: 442934 - RNA, 62 nt, Homo Sapiens
acccuaauaaacaccugcucacuggcuggguauucuuuguaaccaguguuucuggcuccugc

SEQ ID NO: 442935 - RNA, 64 nt, Homo Sapiens
auguauccagaguaguuggauucaagugcuguuucuuuguaaaaagcauuagaaacauugagag

SEQ ID NO: 442936 - RNA, 64 nt, Homo Sapiens
cuguauuuuacccuugagcuacagccuaaagaugcuuuguaaagcuaagcacguuugggaagga

SEQ ID NO: 442937 - RNA, 64 nt, Homo Sapiens
aauuuucauucucauuaggagaagugacucuagucuuuguaagcccugcuucacagaauaaugg

SEQ ID NO: 442938 - RNA, 64 nt, Homo Sapiens
ucugauuucuuuucaccauugcacaccaaucuuacuuuguaaauuuaauugugugaacuuggaa

SEQ ID NO: 442939 - RNA, 64 nt, Homo Sapiens
acagugaauaaccucuuggagaaaucuucuagcacuuuguaaacaaagagaaaaguacaagaca

SEQ ID NO: 442940 - RNA, 64 nt, Homo Sapiens
ggggccuugcccccaccucccaacuguuuaaacccuuuguaaccaagucauaggacuggcaaag

SEQ ID NO: 442941 - RNA, 64 nt, Homo Sapiens
accacucaaauaaaagucuccauauugcaacaaucuuuguaagaucuaucaaacaaaugacuuu

SEQ ID NO: 442942 - RNA, 64 nt, Homo Sapiens
acuauguguucuggugugucaucuguaaaaguuucuuuguaaaugguaucuuuucaauuaaugu

SEQ ID NO: 442943 - RNA, 64 nt, Homo Sapiens
agggaccaccucccuggggccugcuccuccuugucuuuguaaaauggaacugcagggaacuucu

SEQ ID NO: 442944 - RNA, 64 nt, Homo Sapiens
cagugcauuuuucagauuuguauaugguaaaagccuuuguaaaauugagacuggcagcaguggg

SEQ ID NO: 442945 - RNA, 64 nt, Homo Sapiens
uguugaaguuaauuugaauucgggcuucauaguucuuuguaauaguuccaacaguggccuucuc

SEQ ID NO: 442946 - RNA, 64 nt, Homo Sapiens
auggaaauaugguguccacguaaguccagucugucuuuguaagcacacugcccaaccccagguc

SEQ ID NO: 442947 - RNA, 64 nt, Homo Sapiens
cuugugucuggacuaaguuaaaagaauuaaaauacuuuguaauguccugggcuuugggaaaugu

SEQ ID NO: 442948 - RNA, 64 nt, Homo Sapiens
cauuaguuuaauuuucuucaaaaugaaaauacugcuuuguaauuacaaaaugagacacaccuau

SEQ ID NO: 442949 - RNA, 64 nt, Homo Sapiens
uuuauaucccggaauauuucccuccggcuuucgccuuuguaacucccaucuguggacccaucgu

SEQ ID NO: 442950 - RNA, 64 nt, Homo Sapiens
guuuggaaacuuucuuuuacuuaacuuuagauugcuuuguaaauaauccuaaaaucagguuuac

SEQ ID NO: 442951 - RNA, 64 nt, Homo Sapiens
ugauuugauuauacuguaaauacuggucaucuaacuuuguaauucaaagaacugaagaugagaa

SEQ ID NO: 442952 - RNA, 64 nt, Homo Sapiens
uaaggcaagcccucucucaguuucauuucucagacuuuguaauacucgaggcuaacgauguagg

SEQ ID NO: 442953 - RNA, 64 nt, Homo Sapiens
ucagugcuggggacugaggcuuaaaaaauucucccuuuguaaccagagccacaggccuaaguca

SEQ ID NO: 442954 - RNA, 64 nt, Homo Sapiens
ucccucucucauuggccuauacaucucuuaggaccuuuguaaugguguccaugcaccuuuagag

SEQ ID NO: 442955 - RNA, 64 nt, Homo Sapiens
acgccaggcggcauccuuuucuaugaaguguugacuuuguaaaucugcccacacccagcuggcc

SEQ ID NO: 442956 - RNA, 64 nt, Homo Sapiens
guguggggaagguuggagaagaguuagguuugugcuuuguaaucuuggcauccauguuuugugc

SEQ ID NO: 442957 - RNA, 64 nt, Homo Sapiens
acaaguguuacuugugccgggaaaauuuugcugucuuuguaauuuuaaaacuuuaaaauaaauu

SEQ ID NO: 442958 - RNA, 64 nt, Homo Sapiens
gcuguuuaucaucagcuccucugaaaugugaucccuuuguaacugugcucaucacuucgccagu

SEQ ID NO: 442959 - RNA, 64 nt, Homo Sapiens
cgcagucacacauuaggguuggugauacagagcucuuuguaaacugcuacugaaagcuauccca

SEQ ID NO: 442960 - RNA, 64 nt, Homo Sapiens
uaaaaaacugaaaaaaaaaaaaagcuuuuuauuacuuuguaauuuuuuuuuuuaauuaaagagc

SEQ ID NO: 442961 - RNA, 64 nt, Homo Sapiens
uauuuuauaugaccuauaaagaagucaucugucucuuuguaaaugugacugccaaauaauauuu

SEQ ID NO: 442962 - RNA, 64 nt, Homo Sapiens
accuaaucugagaccgugcuuccucccccucgcccuuuguaauaguuagacuccugggaugccc

SEQ ID NO: 442963 - RNA, 64 nt, Homo Sapiens
acucaaggccaacugucacaaggaacugcucugucuuuguaacuugcuuagaauucugagaggc

SEQ ID NO: 442964 - RNA, 64 nt, Homo Sapiens
cggcuggaccacgucucccuggcugcauccaaggcuuuguaaacggcaguguucuugggggugg

SEQ ID NO: 442965 - RNA, 64 nt, Homo Sapiens
uucaaagaccaguuuguaccgaugaaacgcgcaacuuuguaaucccaacacuuucuauuuucua

SEQ ID NO: 442966 - RNA, 64 nt, Homo Sapiens
uugccuucuuauuuuacuucuuuuagcuguuuaacuuuguaagaugcaaagagguuggaucaag

SEQ ID NO: 442967 - RNA, 64 nt, Homo Sapiens
gggucuuucauagccaaacuuguauauuuaaauucuuuguaauaauaauauccaaaucaucauc

SEQ ID NO: 442968 - RNA, 64 nt, Homo Sapiens
uuacauaccgugagaaguuacguaacauuuacuccuuuguaaauguuucccuaucaucagacaa

SEQ ID NO: 442969 - RNA, 64 nt, Homo Sapiens
acauacuuauauagaggaauuuauguaaccaugacuuuguaauuuugagaauuccucccaguga

SEQ ID NO: 442970 - RNA, 64 nt, Homo Sapiens
ggaauuaauaaaacaaagucauacaacacauuuucuuuguaauugagaacuagauaacauggua

SEQ ID NO: 442971 - RNA, 64 nt, Homo Sapiens
cucacccccaaugaggucuuaggcagauucuuuacuuuguaauucaaaaggccuguuaaccuuu

SEQ ID NO: 442972 - RNA, 64 nt, Homo Sapiens
cuuggaaaaaaaauacuagccuagcuggucauuucuuuguaagguaguuagcaauuuuaagucu

SEQ ID NO: 442973 - RNA, 64 nt, Homo Sapiens
caaaugagauuuuguacauggaguugacauaauacuuuguaaauugaauuuuuuaaagaaauag

SEQ ID NO: 442974 - RNA, 64 nt, Homo Sapiens
aagaaucguucaacugucaaucagccucuugauucuuuguaaauugccaggguggguggguaca

SEQ ID NO: 442975 - RNA, 64 nt, Homo Sapiens
accacucugcuuccuuggacaauaucaguaauagcuuuguaagugauguggacguaauugccua

SEQ ID NO: 442976 - RNA, 64 nt, Homo Sapiens
auuugcccucccaucccguuuagaguuauuuaggcuuuguaacgauugggggauaaaaagaugu

SEQ ID NO: 442977 - RNA, 64 nt, Homo Sapiens
cuuaaaacacuaacggaaacccauggaguuuguccuuuguaaaaauuuuaaacacagugucuug

SEQ ID NO: 442978 - RNA, 64 nt, Homo Sapiens
guacuccaaugguguacaaugucuuuugcacaaacuuuguaacuuuuguuacugugaauucaaa

SEQ ID NO: 442979 - RNA, 64 nt, Homo Sapiens
ggguuuuuaauauaaagguguuaagcuuauuuugcuuuguaaguaaagaauguguauauuguga

SEQ ID NO: 442980 - RNA, 64 nt, Homo Sapiens
agcuguuuuguuuuguguuguugaauuugaaagccuuuguaaauaucaauauaauguaccaaug

SEQ ID NO: 442981 - RNA, 64 nt, Homo Sapiens
ugaaagcuauauacuugugcuaucuaaagcacuacuuuguaaagaugacuacccaagauuguaa

SEQ ID NO: 442982 - RNA, 64 nt, Homo Sapiens
uuguuuucaaugaauuaagaaagauuaaauauaucuuuguaaauuauuuuaugucauaguuuaa

SEQ ID NO: 442983 - RNA, 64 nt, Homo Sapiens
aagaaaaauguauauagcugcuauauuuaagagacuuuguaaaaagguguuuugccagccugaa

SEQ ID NO: 442984 - RNA, 64 nt, Homo Sapiens
auaaacaccgaggcuuacuguugcuauaugccuccuuuguaaaaauauaagauuuugguucuac

SEQ ID NO: 442985 - RNA, 64 nt, Homo Sapiens
auuugcaucuguuuagaaaccguggcuuucaucgcuuuguaaaacguaguauuccugagcaaaa

SEQ ID NO: 442986 - RNA, 64 nt, Homo Sapiens
ugguuuuguaggcaggcugugcauacuaggaaggcuuuguaaacguccucucagaagcacaagu

SEQ ID NO: 442987 - RNA, 64 nt, Homo Sapiens
gugcagauauuuugaaaggcagauuuccuuauuucuuuguaauuuuugcuuuuagcagauauga

SEQ ID NO: 442988 - RNA, 64 nt, Homo Sapiens
uauuuaaaacugcuauuuucgccugaaaagccaacuuuguaacaucucucaaaaagcuuauuaa

SEQ ID NO: 442989 - RNA, 64 nt, Homo Sapiens
gagaugccaguaguguucaaauuucacaaaaauacuuuguaaauaagcaaagccaauggagagu

SEQ ID NO: 442990 - RNA, 64 nt, Homo Sapiens
augauguguggaggcuauucuaaucuacuuugaacuuuguaaaagaaugaaaagcacauaaaug

SEQ ID NO: 442991 - RNA, 64 nt, Homo Sapiens
aaaugcaaucggugugccuuuuauuucuucucuacuuuguaaccaauacuuuuggacuugaaaa

SEQ ID NO: 442992 - RNA, 64 nt, Homo Sapiens
uucacaaccgcuguccauugagcuaucaaaaugucuuuguaauucuauaauuugaauaauuuug

SEQ ID NO: 442993 - RNA, 64 nt, Homo Sapiens
caaacucaagaaaacugguauucgucucuuugugcuuuguaaaguuguaccccaaugcaaaacc

SEQ ID NO: 442994 - RNA, 64 nt, Homo Sapiens
ugaccugcgaauuacccuaauugauauuacaguucuuuguaaaauagccguuuggaaguguucu

SEQ ID NO: 442995 - RNA, 64 nt, Homo Sapiens
cuaauaaugcacucaguuuaauaggagauacaaacuuuguaauuaaaauccaugguuaucugag

SEQ ID NO: 442996 - RNA, 64 nt, Homo Sapiens
gccaaauuucuccuuccacuacauauuccugugucuuuguaaugauccugccccucacuucuua

SEQ ID NO: 442997 - RNA, 64 nt, Homo Sapiens
uccacuuagccuacuacaggaaagcuacuacugccuuuguaacuagauaacgagagggggaaaa

SEQ ID NO: 442998 - RNA, 64 nt, Homo Sapiens
agguauucugccagccugaacuauauuuaagaaacuuuguaaaaaauaaaaauguauauagcug

SEQ ID NO: 442999 - RNA, 62 nt, Homo Sapiens; identical to SEQ ID NO: 70699

SEQ ID NO: 443000 - RNA, 63 nt, Homo Sapiens; identical to SEQ ID NO: 70700

SEQ ID NO: 443001 - RNA, 63 nt, Homo Sapiens; identical to SEQ ID NO: 70701

SEQ ID NO: 443002 - RNA, 63 nt, Homo Sapiens; identical to SEQ ID NO: 70702

SEQ ID NO: 443003 - RNA, 63 nt, Homo Sapiens; identical to SEQ ID NO: 70703

SEQ ID NO: 443004 - RNA, 63 nt, Homo Sapiens; identical to SEQ ID NO: 70704

SEQ ID NO: 443005 - RNA, 63 nt, Homo Sapiens; identical to SEQ ID NO: 70705

SEQ ID NO: 443006 - RNA, 63 nt, Homo Sapiens; identical to SEQ ID NO: 70706

SEQ ID NO: 443007 - RNA, 63 nt, Homo Sapiens; identical to SEQ ID NO: 70707

SEQ ID NO: 443008 - RNA, 63 nt, Homo Sapiens; identical to SEQ ID NO: 70708

SEQ ID NO: 443009 - RNA, 63 nt, Homo Sapiens; identical to SEQ ID NO: 70709

SEQ ID NO: 443010 - RNA, 63 nt, Homo Sapiens; identical to SEQ ID NO: 70710

SEQ ID NO: 443011 - RNA, 63 nt, Homo Sapiens; identical to SEQ ID NO: 70711

SEQ ID NO: 443012 - RNA, 63 nt, Homo Sapiens; identical to SEQ ID NO: 70712

SEQ ID NO: 443013 - RNA, 63 nt, Homo Sapiens; identical to SEQ ID NO: 70713

SEQ ID NO: 443014 - RNA, 63 nt, Homo Sapiens; identical to SEQ ID NO: 70714

SEQ ID NO: 443015 - RNA, 63 nt, Homo Sapiens; identical to SEQ ID NO: 70715

SEQ ID NO: 443016 - RNA, 63 nt, Homo Sapiens; identical to SEQ ID NO: 70716

SEQ ID NO: 443017 - RNA, 63 nt, Homo Sapiens; identical to SEQ ID NO: 70717

SEQ ID NO: 443018 - RNA, 63 nt, Homo Sapiens; identical to SEQ ID NO: 70718

SEQ ID NO: 443019 - RNA, 63 nt, Homo Sapiens; identical to SEQ ID NO: 70719

SEQ ID NO: 443020 - RNA, 63 nt, Homo Sapiens; identical to SEQ ID NO: 70720

SEQ ID NO: 443021 - RNA, 63 nt, Homo Sapiens; identical to SEQ ID NO: 70721

SEQ ID NO: 443022 - RNA, 64 nt, Homo Sapiens; identical to SEQ ID NO: 239676

SEQ ID NO: 443023 - RNA, 64 nt, Homo Sapiens; identical to SEQ ID NO: 239677

SEQ ID NO: 443024 - RNA, 64 nt, Homo Sapiens; identical to SEQ ID NO: 239678

SEQ ID NO: 443025 - RNA, 64 nt, Homo Sapiens; identical to SEQ ID NO: 239679

SEQ ID NO: 443026 - RNA, 64 nt, Homo Sapiens; identical to SEQ ID NO: 239680

SEQ ID NO: 443027 - RNA, 64 nt, Homo Sapiens; identical to SEQ ID NO: 239681

SEQ ID NO: 443028 - RNA, 64 nt, Homo Sapiens; identical to SEQ ID NO: 239682

SEQ ID NO: 443029 - RNA, 64 nt, Homo Sapiens; identical to SEQ ID NO: 239683

SEQ ID NO: 443030 - RNA, 64 nt, Homo Sapiens; identical to SEQ ID NO: 239684

SEQ ID NO: 443031 - RNA, 64 nt, Homo Sapiens; identical to SEQ ID NO: 239685

SEQ ID NO: 443032 - RNA, 64 nt, Homo Sapiens; identical to SEQ ID NO: 239686

SEQ ID NO: 443033 - RNA, 64 nt, Homo Sapiens; identical to SEQ ID NO: 239687

SEQ ID NO: 443034 - RNA, 64 nt, Homo Sapiens; identical to SEQ ID NO: 239688

SEQ ID NO: 443035 - RNA, 64 nt, Homo Sapiens; identical to SEQ ID NO: 239689

SEQ ID NO: 443036 - RNA, 64 nt, Homo Sapiens; identical to SEQ ID NO: 239690

SEQ ID NO: 443037 - RNA, 64 nt, Homo Sapiens; identical to SEQ ID NO: 239691

SEQ ID NO: 443038 - RNA, 64 nt, Homo Sapiens; identical to SEQ ID NO: 239692

SEQ ID NO: 443039 - RNA, 64 nt, Homo Sapiens; identical to SEQ ID NO: 239693

SEQ ID NO: 443040 - RNA, 64 nt, Homo Sapiens; identical to SEQ ID NO: 239694

SEQ ID NO: 443041 - RNA, 64 nt, Homo Sapiens; identical to SEQ ID NO: 239695

SEQ ID NO: 443042 - RNA, 64 nt, Homo Sapiens; identical to SEQ ID NO: 239696

SEQ ID NO: 443043 - RNA, 64 nt, Homo Sapiens; identical to SEQ ID NO: 239697

SEQ ID NO: 443044 - RNA, 64 nt, Homo Sapiens; identical to SEQ ID NO: 239698

SEQ ID NO: 443045 - RNA, 64 nt, Homo Sapiens; identical to SEQ ID NO: 239699

SEQ ID NO: 443046 - RNA, 64 nt, Homo Sapiens; identical to SEQ ID NO: 239700

SEQ ID NO: 443047 - RNA, 64 nt, Homo Sapiens; identical to SEQ ID NO: 239701

SEQ ID NO: 443048 - RNA, 64 nt, Homo Sapiens; identical to SEQ ID NO: 239702

SEQ ID NO: 443049 - RNA, 64 nt, Homo Sapiens; identical to SEQ ID NO: 239703

SEQ ID NO: 443050 - RNA, 64 nt, Homo Sapiens; identical to SEQ ID NO: 239704

SEQ ID NO: 443051 - RNA, 64 nt, Homo Sapiens; identical to SEQ ID NO: 239705

SEQ ID NO: 443052 - RNA, 64 nt, Homo Sapiens; identical to SEQ ID NO: 239706

SEQ ID NO: 443053 - RNA, 64 nt, Homo Sapiens; identical to SEQ ID NO: 239707

SEQ ID NO: 443054 - RNA, 64 nt, Homo Sapiens; identical to SEQ ID NO: 239708

SEQ ID NO: 443055 - RNA, 64 nt, Homo Sapiens; identical to SEQ ID NO: 239709

SEQ ID NO: 443056 - RNA, 64 nt, Homo Sapiens; identical to SEQ ID NO: 239710

SEQ ID NO: 443057 - RNA, 64 nt, Homo Sapiens; identical to SEQ ID NO: 239711

SEQ ID NO: 443058 - RNA, 64 nt, Homo Sapiens; identical to SEQ ID NO: 239712

SEQ ID NO: 443059 - RNA, 64 nt, Homo Sapiens; identical to SEQ ID NO: 239713

SEQ ID NO: 443060 - RNA, 64 nt, Homo Sapiens; identical to SEQ ID NO: 239714

SEQ ID NO: 443061 - RNA, 64 nt, Homo Sapiens; identical to SEQ ID NO: 239715

SEQ ID NO: 443062 - RNA, 64 nt, Homo Sapiens; identical to SEQ ID NO: 239716

SEQ ID NO: 443063 - RNA, 64 nt, Homo Sapiens; identical to SEQ ID NO: 239717

SEQ ID NO: 443064 - RNA, 64 nt, Homo Sapiens; identical to SEQ ID NO: 239718

SEQ ID NO: 443065 - RNA, 64 nt, Homo Sapiens; identical to SEQ ID NO: 239719

SEQ ID NO: 443066 - RNA, 64 nt, Homo Sapiens; identical to SEQ ID NO: 239720

SEQ ID NO: 443067 - RNA, 64 nt, Homo Sapiens; identical to SEQ ID NO: 239721

SEQ ID NO: 443068 - RNA, 64 nt, Homo Sapiens; identical to SEQ ID NO: 239722

SEQ ID NO: 443069 - RNA, 64 nt, Homo Sapiens; identical to SEQ ID NO: 239723

SEQ ID NO: 443070 - RNA, 64 nt, Homo Sapiens; identical to SEQ ID NO: 239724

SEQ ID NO: 443071 - RNA, 64 nt, Homo Sapiens; identical to SEQ ID NO: 239725

SEQ ID NO: 443072 - RNA, 64 nt, Homo Sapiens; identical to SEQ ID NO: 239726

SEQ ID NO: 443073 - RNA, 64 nt, Homo Sapiens; identical to SEQ ID NO: 239727

SEQ ID NO: 443074 - RNA, 64 nt, Homo Sapiens; identical to SEQ ID NO: 239728

SEQ ID NO: 443075 - RNA, 64 nt, Homo Sapiens; identical to SEQ ID NO: 239729

SEQ ID NO: 443076 - RNA, 64 nt, Homo Sapiens; identical to SEQ ID NO: 239730

SEQ ID NO: 443077 - RNA, 64 nt, Homo Sapiens; identical to SEQ ID NO: 239731

SEQ ID NO: 443078 - RNA, 64 nt, Homo Sapiens; identical to SEQ ID NO: 239732

SEQ ID NO: 443079 - RNA, 64 nt, Homo Sapiens; identical to SEQ ID NO: 239733

SEQ ID NO: 443080 - RNA, 64 nt, Homo Sapiens; identical to SEQ ID NO: 239734

SEQ ID NO: 443081 - RNA, 64 nt, Homo Sapiens; identical to SEQ ID NO: 239735

SEQ ID NO: 443082 - RNA, 64 nt, Homo Sapiens; identical to SEQ ID NO: 239736

SEQ ID NO: 443083 - RNA, 64 nt, Homo Sapiens; identical to SEQ ID NO: 239737

SEQ ID NO: 443084 - RNA, 64 nt, Homo Sapiens; identical to SEQ ID NO: 239738

SEQ ID NO: 443085 - RNA, 64 nt, Homo Sapiens; identical to SEQ ID NO: 239739

SEQ ID NO: 443086 - RNA, 64 nt, Homo Sapiens; identical to SEQ ID NO: 239740

SEQ ID NO: 443087 - RNA, 64 nt, Homo Sapiens; identical to SEQ ID NO: 239741

SEQ ID NO: 443088 - RNA, 64 nt, Homo Sapiens; identical to SEQ ID NO: 239742

SEQ ID NO: 443089 - RNA, 64 nt, Homo Sapiens; identical to SEQ ID NO: 239743

SEQ ID NO: 443090 - RNA, 64 nt, Homo Sapiens; identical to SEQ ID NO: 239744

SEQ ID NO: 443091 - RNA, 64 nt, Homo Sapiens; identical to SEQ ID NO: 239745

SEQ ID NO: 443092 - RNA, 64 nt, Homo Sapiens; identical to SEQ ID NO: 239746

SEQ ID NO: 443093 - RNA, 64 nt, Homo Sapiens
uuacucgucugaauauugcuuuuagccguguuuuauaacauagacgagcaguagggucuguuua

SEQ ID NO: 443094 - RNA, 64 nt, Homo Sapiens
ugccauaacaugugguaacaauaguucauuucucauaacauauaugagguauacaaaauuuucu

SEQ ID NO: 443095 - RNA, 64 nt, Homo Sapiens
cuucuccuuauaaauaaguucagacauacauuuaauaacauagggugacuuguguuuuuaggua

SEQ ID NO: 443096 - RNA, 64 nt, Homo Sapiens
agcuguguaguauaucaaauuaauuugcuaccuaauaacauagaaaguaaauaucuuugugguc

SEQ ID NO: 443097 - RNA, 64 nt, Homo Sapiens
ucugaaacacauguguaacaguuucagauaugccauaacauacaaaaaaacugagaacucugcu

SEQ ID NO: 443098 - RNA, 64 nt, Homo Sapiens
aauccgcaagcugggugugcagagcuauucacuaauaacauagaauguuucuucucugccuuaa

SEQ ID NO: 443099 - RNA, 64 nt, Homo Sapiens
acgagagcuugaguugucaauuuugcuuaacaaaauaacauacguguuauuaaugauuaugaac

SEQ ID NO: 443100 - RNA, 64 nt, Homo Sapiens
aaacacaucacuauauguagguuagggagguuguauaacauaaacuacaaacuuucuuugguag

SEQ ID NO: 443101 - RNA, 64 nt, Homo Sapiens
cuaguguuuaguuggauuaacuuauuauuacuguauaacauaugcaacauuauuguauuuucca

SEQ ID NO: 443102 - RNA, 64 nt, Homo Sapiens
auuuuaaaagaaauuuaaaucaaauagacucauaauaacauauaugacuguuuauucucuugac

SEQ ID NO: 443103 - RNA, 64 nt, Homo Sapiens
ucacuucacaaccuucuuggcacauuuuuauaacauaacauaacgauauagugguaauggcuuu

SEQ ID NO: 443104 - RNA, 64 nt, Homo Sapiens
auaacucacuucacaaccuugcuuucacauuuuuauaacauaaccuuaggauauagugguaaug

SEQ ID NO: 443105 - RNA, 64 nt, Homo Sapiens
ucauauuuagccauaguauaugauagauugccccauaacauaguuuuucaucaagaguuuauua

SEQ ID NO: 443106 - RNA, 64 nt, Homo Sapiens
uguuucagcaguacaaaggcauguuuuaaaaucuauaacauaaagaauaaggaauagcuuugua

SEQ ID NO: 443107 - RNA, 64 nt, Homo Sapiens
caucaaaccauuuucuucaagcuccaucuugaccauaacauauuaccagucuuuuucuguuuuu

SEQ ID NO: 443108 - RNA, 64 nt, Homo Sapiens
acaguauuuuuaggauucauguaaauaacauaaaauaacauaaauuccagauuuaacauaagua

SEQ ID NO: 443109 - RNA, 64 nt, Homo Sapiens
auaacauaaaacaguauuuuaacauaaguaguaaauaacauaaagaauguguuguuccagauuu

SEQ ID NO: 443110 - RNA, 64 nt, Homo Sapiens; identical to SEQ ID NO: 361536

SEQ ID NO: 443111 - RNA, 64 nt, Homo Sapiens; identical to SEQ ID NO: 361537

SEQ ID NO: 443112 - RNA, 64 nt, Homo Sapiens; identical to SEQ ID NO: 361538

SEQ ID NO: 443113 - RNA, 64 nt, Homo Sapiens; identical to SEQ ID NO: 361539

SEQ ID NO: 443114 - RNA, 64 nt, Homo Sapiens; identical to SEQ ID NO: 361540

SEQ ID NO: 443115 - RNA, 64 nt, Homo Sapiens; identical to SEQ ID NO: 361541

SEQ ID NO: 443116 - RNA, 64 nt, Homo Sapiens; identical to SEQ ID NO: 361542

SEQ ID NO: 443117 - RNA, 64 nt, Homo Sapiens; identical to SEQ ID NO: 361543

SEQ ID NO: 443118 - RNA, 64 nt, Homo Sapiens; identical to SEQ ID NO: 361544

SEQ ID NO: 443119 - RNA, 64 nt, Homo Sapiens; identical to SEQ ID NO: 361545

SEQ ID NO: 443120 - RNA, 64 nt, Homo Sapiens; identical to SEQ ID NO: 361546

SEQ ID NO: 443121 - RNA, 64 nt, Homo Sapiens; identical to SEQ ID NO: 361547

SEQ ID NO: 443122 - RNA, 64 nt, Homo Sapiens; identical to SEQ ID NO: 361548

SEQ ID NO: 443123 - RNA, 64 nt, Homo Sapiens; identical to SEQ ID NO: 361549

SEQ ID NO: 443124 - RNA, 64 nt, Homo Sapiens; identical to SEQ ID NO: 361550

SEQ ID NO: 443125 - RNA, 64 nt, Homo Sapiens; identical to SEQ ID NO: 361551

SEQ ID NO: 443126 - RNA, 64 nt, Homo Sapiens; identical to SEQ ID NO: 361552

SEQ ID NO: 443127 - RNA, 64 nt, Homo Sapiens; identical to SEQ ID NO: 361553

SEQ ID NO: 443128 - RNA, 64 nt, Homo Sapiens; identical to SEQ ID NO: 361554

SEQ ID NO: 443129 - RNA, 64 nt, Homo Sapiens; identical to SEQ ID NO: 361555

SEQ ID NO: 443130 - RNA, 64 nt, Homo Sapiens; identical to SEQ ID NO: 361556

SEQ ID NO: 443131 - RNA, 64 nt, Homo Sapiens
acacacuuguugauuaauggcgcaauguaagacucgggauuagucuguggggauagugaggcau

SEQ ID NO: 443132 - RNA, 64 nt, Homo Sapiens
agugaggggugacccuuuagugagcuuagcacagcgggauuaaacaguccuuuaaccagcacag

SEQ ID NO: 443133 - RNA, 64 nt, Homo Sapiens
agcugauacuuguuugggcacaccuccaaguucucgggauuagaaggacaagagcacucccagg

SEQ ID NO: 443134 - RNA, 64 nt, Homo Sapiens
agaacguccuugcagacugacacuaaaacguccacgggauuaacuggaugacaaacggaagauc

SEQ ID NO: 443135 - RNA, 64 nt, Homo Sapiens
ugaugucgugguccaguugcagccuaauggugaacgggauuacaacauagcaaauacuguuuga

SEQ ID NO: 443136 - RNA, 64 nt, Homo Sapiens
ggcgugagccacugcgccuggccucccaaagugccgggauuacacucgugauccacccgccucg

SEQ ID NO: 443137 - RNA, 64 nt, Homo Sapiens
uauuugcaaaaugugcuaaagucaaugauuuuuacgggauuauugacuucugcuuauggaaaac

SEQ ID NO: 443138 - RNA, 64 nt, Homo Sapiens
aaagaacaacaagaugaccuacuuuuuuuuuuaccgggauuauagggcccaggagccaauguga

SEQ ID NO: 443139 - RNA, 64 nt, Homo Sapiens
cacauucuagaaaugauucuccaucacuuaacgccgggauuauauuaaaggcaaaucauuccca

SEQ ID NO: 443140 - RNA, 64 nt, Homo Sapiens
ucaagugauccucuuaccuuggccucccaaacaccgggauuauaggcgugagcccccgugccug

SEQ ID NO: 443141 - RNA, 64 nt, Homo Sapiens
caggugaucaacccaccuuggccucccuaaaugccgggauuacaggcaugagccaccgcuccca

SEQ ID NO: 443142 - RNA, 64 nt, Homo Sapiens
cugauccaccugccucagccucccaaagugccgccgggauuacaggcgugagccaccaugccug

SEQ ID NO: 443143 - RNA, 64 nt, Homo Sapiens
uuguuauuaccuguauuuucuuuuaacuuuagaacgggauuauccaaugcuuugccuuauaguu

SEQ ID NO: 443144 - RNA, 64 nt, Homo Sapiens
ccucgugauccacccgccuuggccucccaaagugcgggauuacaagcgugaaccacccugccca

SEQ ID NO: 443145 - RNA, 64 nt, Homo Sapiens
gcucuucugucuauaaauuuuaauuauauuuucucgggauuauuccauguucagcagaguauuu

SEQ ID NO: 443146 - RNA, 64 nt, Homo Sapiens
aguauauuuuuuuauucuugaauccaaagauacacgggauuaaucuauauuuaaaauuagaugg

SEQ ID NO: 443147 - RNA, 64 nt, Homo Sapiens
ucaagcgauucuccugccucagccucucaaguagcgggauuacaggcgcccaccaccaaaaauu

SEQ ID NO: 443148 - RNA, 64 nt, Homo Sapiens
uacagcagccacuauucaccacacaccaaaaaaccgggauuauucugccguaugcuucaguggc

SEQ ID NO: 443149 - RNA, 64 nt, Homo Sapiens
uaaaagacggcuaguuggccagucauagacuggucgggauuaagagaugauccuuuaagcaagc

SEQ ID NO: 443150 - RNA, 64 nt, Homo Sapiens
caagugguccuccugccucagccucccacaggaucgggauuacaggcaagagccuccacgcccg

SEQ ID NO: 443151 - RNA, 64 nt, Homo Sapiens
caaaugagccuccugcuucagucucccaaauugccgggauuacaggcaugagccacugugucug

SEQ ID NO: 443152 - RNA, 64 nt, Homo Sapiens
cucagccacugagcugccucaaccggccaaggaacgggauuaugaugacuaugcggacuucuau

SEQ ID NO: 443153 - RNA, 64 nt, Homo Sapiens
caaugaggcuuuacaaccuuccuuuguuuuggcucgggauuacuuccuggcugucuaauaauug

SEQ ID NO: 443154 - RNA, 64 nt, Homo Sapiens
uauguuuuuccuugcuugcagcuuuucuuccuaccgggauuaccaagaaggaaggacuuaaaua

SEQ ID NO: 443155 - RNA, 64 nt, Homo Sapiens
ccuauuuaagacuuuaaggguuuguggggcggggcgggauuaacacaacauuuggcuuuguuuu

SEQ ID NO: 443156 - RNA, 64 nt, Homo Sapiens
ggcaugagccuccacaccugaccucccaaagugccgggauuacacucgugaucugcccgccuug

SEQ ID NO: 443157 - RNA, 64 nt, Homo Sapiens
aaaaaaguaauuaaaaagacacuuuuaccgaacucgggauuacagaaacacggaguuuccauuu

SEQ ID NO: 443158 - RNA, 64 nt, Homo Sapiens; identical to SEQ ID NO: 42317

SEQ ID NO: 443159 - RNA, 64 nt, Homo Sapiens; identical to SEQ ID NO: 42318

SEQ ID NO: 443160 - RNA, 64 nt, Homo Sapiens; identical to SEQ ID NO: 42319

SEQ ID NO: 443161 - RNA, 64 nt, Homo Sapiens; identical to SEQ ID NO: 42320

SEQ ID NO: 443162 - RNA, 64 nt, Homo Sapiens; identical to SEQ ID NO: 42321

SEQ ID NO: 443163 - RNA, 64 nt, Homo Sapiens; identical to SEQ ID NO: 42322

SEQ ID NO: 443164 - RNA, 64 nt, Homo Sapiens; identical to SEQ ID NO: 42323

SEQ ID NO: 443165 - RNA, 64 nt, Homo Sapiens; identical to SEQ ID NO: 42324

SEQ ID NO: 443166 - RNA, 64 nt, Homo Sapiens; identical to SEQ ID NO: 42325

SEQ ID NO: 443167 - RNA, 64 nt, Homo Sapiens; identical to SEQ ID NO: 42326

SEQ ID NO: 443168 - RNA, 64 nt, Homo Sapiens; identical to SEQ ID NO: 42327

SEQ ID NO: 443169 - RNA, 64 nt, Homo Sapiens; identical to SEQ ID NO: 42328

SEQ ID NO: 443170 - RNA, 64 nt, Homo Sapiens; identical to SEQ ID NO: 42329

SEQ ID NO: 443171 - RNA, 64 nt, Homo Sapiens; identical to SEQ ID NO: 42330

SEQ ID NO: 443172 - RNA, 64 nt, Homo Sapiens; identical to SEQ ID NO: 42331

SEQ ID NO: 443173 - RNA, 64 nt, Homo Sapiens; identical to SEQ ID NO: 42332

SEQ ID NO: 443174 - RNA, 64 nt, Homo Sapiens
cccucucuccccaccuucccucucccggcaacaucucugggaaucaacagcauauugacacguu

SEQ ID NO: 443175 - RNA, 64 nt, Homo Sapiens
caaaccuggcaagucaccugcagcccauggugagcucugggaagugugguugaggccuuggggu

SEQ ID NO: 443176 - RNA, 64 nt, Homo Sapiens
caaucggagacaaaagcaguuucucuccaacucccucugggaaggugaccuggccagagccaag

SEQ ID NO: 443177 - RNA, 64 nt, Homo Sapiens
gggacagauggacagacagccacccugagaaccccucugggaaaaucuauuccugccaccacug

SEQ ID NO: 443178 - RNA, 64 nt, Homo Sapiens
ugagugcccucagauggucaaaacccaguuuucccucugggagccuaaaccaggcugcaucgga

SEQ ID NO: 443179 - RNA, 64 nt, Homo Sapiens
uugacuccaccccuguccugagcuggaauagguccucugggaugccagcucuccccuuugugcu

SEQ ID NO: 443180 - RNA, 64 nt, Homo Sapiens
cucuuugagcuucugcgaugccggccuuccguuccucugggaggcuugaaguucugcaaagaug

SEQ ID NO: 443181 - RNA, 64 nt, Homo Sapiens
uaggcccccuuaaaucuagaccuccaaaccuggacucugggacuucagggcucuagacccgagc

SEQ ID NO: 443182 - RNA, 64 nt, Homo Sapiens
cagcuccccccgccaaaaaacuuuucuaaaccaccucugggacucgggcccaggacuguggcuc

SEQ ID NO: 443183 - RNA, 64 nt, Homo Sapiens
cccaguucuguuuucaguaucaggaucuuagcuacucugggauaggcuguuggucuccagggca

SEQ ID NO: 443184 - RNA, 64 nt, Homo Sapiens
cuuggcccugcucacagagacaggaagcgucucacucugggagcccccacccucaagcauuccu

SEQ ID NO: 443185 - RNA, 64 nt, Homo Sapiens
agucauacugacaaaccaauagcaaaagaaaauacucugggaauuuuauauguauaaaaauagg

SEQ ID NO: 443186 - RNA, 64 nt, Homo Sapiens
cagaaccuagauauuuuguguuggcugauagaaacucugggaaacuacuuuugauuucauuuac

SEQ ID NO: 443187 - RNA, 64 nt, Homo Sapiens
guuacauuguuugucugucuaauuuauucaauuccucugggaauuagaacucaguuuuaacuag

SEQ ID NO: 443188 - RNA, 64 nt, Homo Sapiens
gcugacccagccccuugagaaaucggaucuggggcucugggauacauaaauuagaggucuccaa

SEQ ID NO: 443189 - RNA, 64 nt, Homo Sapiens
agaagauccauuugucuuuguggugucccugguccucugggaaucauucugaagagggagguuu

SEQ ID NO: 443190 - RNA, 64 nt, Homo Sapiens
aagauaauggcuucugauucgauggaagugcauccucugggaaaaggaucaugccagaaauagg

SEQ ID NO: 443191 - RNA, 64 nt, Homo Sapiens
gccuuuaucagucauuuauuggcugugagaaguucucugggaguguggguacauuugaaggcaa

SEQ ID NO: 443192 - RNA, 64 nt, Homo Sapiens
aacagaaaagagccauggauggagcccuugggcucucugggaaaugggaaaucagccaaaggac

SEQ ID NO: 443193 - RNA, 64 nt, Homo Sapiens
uccccaggaccacuggcugccaacuccugccgcccucugggacugccccucagucccaggagag

SEQ ID NO: 443194 - RNA, 64 nt, Homo Sapiens
gcauguuucuugguaagggugcccagucaagugucucugggagcccccucuucucugucaucgu

SEQ ID NO: 443195 - RNA, 64 nt, Homo Sapiens
gccccuggcucaggcugucauccuuuucccugugcucugggaaacaccucuuucucauucauuc

SEQ ID NO: 443196 - RNA, 64 nt, Homo Sapiens
ugugaaagggaucccuguccccaguccccucacucucugggagcauugguggagggagcaggug

SEQ ID NO: 443197 - RNA, 64 nt, Homo Sapiens
ccugagaugggagaggcaggcucccuuggucagacucugggacuguggggcagacauggagccc

SEQ ID NO: 443198 - RNA, 64 nt, Homo Sapiens
ccauccuuccaaaacggaaucagcaggacucuuucucugggaaaacucucucucgaccuccaaa

SEQ ID NO: 443199 - RNA, 64 nt, Homo Sapiens
ccgugucuuuccagacaauggagggcacccuaggcucugggauccugcgagccuucagagcuag

SEQ ID NO: 443200 - RNA, 64 nt, Homo Sapiens
ggaggggccuggagggccagagcugcaucaggcucucugggagagcuccaggguccagcccaca

SEQ ID NO: 443201 - RNA, 64 nt, Homo Sapiens
ugggaugauaaagaugaggccgcgcccacggcaccucugggagccgggcucgagggcagggacu

SEQ ID NO: 443202 - RNA, 64 nt, Homo Sapiens
cacccaccaccacccaccacagaaaagcacaaaccucugggaaagacaacgucucucgggggcc

SEQ ID NO: 443203 - RNA, 64 nt, Homo Sapiens
agccugcagucuggagacaagcucuuccggagugcucugggagccaggccagggugugagggag

SEQ ID NO: 443204 - RNA, 64 nt, Homo Sapiens
gaaugguucuuagaaaucugaugaggccucugcucucugggauguggcccucucuaugcagguu

SEQ ID NO: 443205 - RNA, 64 nt, Homo Sapiens
auucuucucugccuugcccugcucucuccuguugcucugggauugcacuucugaaugaaguagc

SEQ ID NO: 443206 - RNA, 64 nt, Homo Sapiens
gauguuaccuuuggguuuuuauguucuuaguuaacucugggaaacugcauauucuggaucauag

SEQ ID NO: 443207 - RNA, 64 nt, Homo Sapiens
uaaauuacguagucagcauucuuuacauuucaagcucugggauaauaaugucuuagacaauuac

SEQ ID NO: 443208 - RNA, 64 nt, Homo Sapiens
cuauguuggggcggcaagcgacgugcagguggagcucugggaugcccagcgccccaccaccacc

SEQ ID NO: 443209 - RNA, 64 nt, Homo Sapiens
cauuuuccugcuuugccccucuccggggaaggggcucugggaggccccaucccccacaguccag

SEQ ID NO: 443210 - RNA, 64 nt, Homo Sapiens
cgcagaugcccacacagccaaggugugcgagugccucugggaggaacaggccuugggaggccuc

SEQ ID NO: 443211 - RNA, 64 nt, Homo Sapiens
cccgccccauugcugccaauccaguguccugggccucugggaugugggccacagagguagugag

SEQ ID NO: 443212 - RNA, 64 nt, Homo Sapiens
uacucugcaaguugaccuggcacuugauaccagacucugggagagaugugacagggagugaaga

SEQ ID NO: 443213 - RNA, 64 nt, Homo Sapiens
cagacaggcucugucaaugugaugugauugccuucucugggauuucacacugacaacauaacag

SEQ ID NO: 443214 - RNA, 64 nt, Homo Sapiens
aaggccacaugggcugaugcacuggcagaugcuucucugggagcuucuguuccuccaugcccaa

SEQ ID NO: 443215 - RNA, 64 nt, Homo Sapiens
gcagcuggaauggaacccagucaccaggacccagcucugggaguagcccgaagaauucugcugc

SEQ ID NO: 443216 - RNA, 64 nt, Homo Sapiens
ccuucguucuucagcccgacuggaggaacagcagcucugggaggcacagagugcaggucucagg

SEQ ID NO: 443217 - RNA, 64 nt, Homo Sapiens
cguggcugcugcagggcacauggagggaccuacccucugggaaagcccuugugucccucccaga

SEQ ID NO: 443218 - RNA, 64 nt, Homo Sapiens
gaggaagaagaaaggggcccucugggcacucugccucugggagaccaggguagcugcccugggg

SEQ ID NO: 443219 - RNA, 64 nt, Homo Sapiens
auugcuagccuucuaccccaagugccccucccugcucugggagccucucucugugcagguggcc

SEQ ID NO: 443220 - RNA, 64 nt, Homo Sapiens
cacugaccauugugaaauucagcuugaagacuggcucugggacacagagaaggagccggggacc

SEQ ID NO: 443221 - RNA, 64 nt, Homo Sapiens
uggacugugguuuuuccagaccguuagugauguucucugggaaguaccaguugucgaagaugau

SEQ ID NO: 443222 - RNA, 64 nt, Homo Sapiens
gcagaccauccaggucugucuggugccucaugcucucugggauuacauaccaagcuuugggaca

SEQ ID NO: 443223 - RNA, 64 nt, Homo Sapiens
gcauggcauauagugauauaaaggaaccauacuucucugggacaaauagauuuagacaaauguu

SEQ ID NO: 443224 - RNA, 64 nt, Homo Sapiens
cagugccugagucacagcugccuggguucuagaucucugggaacugucuaggccucggugcugg

SEQ ID NO: 443225 - RNA, 64 nt, Homo Sapiens
cagcaccugagucacagcugccuggguucuagaccucugggaacaaucaguggugagugacugg

SEQ ID NO: 443226 - RNA, 64 nt, Homo Sapiens
uuacugucugguaggaaggacugcgcguccugcccucugggaggauaugcuagugauguacgag

SEQ ID NO: 443227 - RNA, 64 nt, Homo Sapiens
cugacagugcccagcaugaagccucuuccagggccucugggagccugugcccucccauagcacu

SEQ ID NO: 443228 - RNA, 64 nt, Homo Sapiens
ugagugccuacuguguguugggugccauuccaggcucugggauuuuuuuuuuuuuuuuuuuaag

SEQ ID NO: 443229 - RNA, 64 nt, Homo Sapiens
gguuacaggcaugagccacugugcccagcccaggcucugggaauauugagauaaauaagaugcu

SEQ ID NO: 443230 - RNA, 64 nt, Homo Sapiens
gccugucugggauuccccacuugugccugggguccucugggauuucuuugucauguacagacuc

SEQ ID NO: 443231 - RNA, 64 nt, Homo Sapiens
caggguagcaguucuuccagaaucccaagagcuucucugggauuuucuugugauaucugauucc

SEQ ID NO: 443232 - RNA, 64 nt, Homo Sapiens
ucagaucugagauuuccuaguuaugucuggggcccucugggagcuguuaucaucucagaucucu

SEQ ID NO: 443233 - RNA, 64 nt, Homo Sapiens
ccgaggaagggggauugauucuguaaucucagcacucugggagaccgggcgaaguggcccaugc

SEQ ID NO: 443234 - RNA, 64 nt, Homo Sapiens
ugugccgagcuggcuccccaugcaguggcgagggcucugggagggcaucauguaucugggagca

SEQ ID NO: 443235 - RNA, 64 nt, Homo Sapiens
ucccucccaccgaaggccugauggcuacucaccccucugggauggcuaugggagaggaggagug

SEQ ID NO: 443236 - RNA, 64 nt, Homo Sapiens
agcucuuggucaaagcacuguugcuauaagcuaucucugggaugccucuaggcccccuucccuc

SEQ ID NO: 443237 - RNA, 64 nt, Homo Sapiens
ugggaugccucuaggcccccuucccucuacacaccucugggaaaagauuacacuguauuaacuc

SEQ ID NO: 443238 - RNA, 64 nt, Homo Sapiens
gaaggcugucuucuuuugagagauagagaggggccucugggaugcuagaaguuugaugagugga

SEQ ID NO: 443239 - RNA, 64 nt, Homo Sapiens
uuguggacuggggagcgugggaaggugccccuuccucugggagaccauagggagggagcuagaa

SEQ ID NO: 443240 - RNA, 64 nt, Homo Sapiens
uucuggagacaagaaaaucaucacucuggugccuugguggcagcaccacugccugcucccugga

SEQ ID NO: 443241 - RNA, 64 nt, Homo Sapiens
aucucuacuaaaaauacaaaaaauuagccaggcgugguggcaggcgccuguagucccagcuacu

SEQ ID NO: 443242 - RNA, 64 nt, Homo Sapiens
aggucaacuguuggcacuguggcaugaaucaaggugguggcagcaaacuucuaguaguuuugau

SEQ ID NO: 443243 - RNA, 64 nt, Homo Sapiens
cgucucuacuaaaauuacaaaaauuagccgggcgugguggcagaucccuuguagucccagcuac

SEQ ID NO: 443244 - RNA, 64 nt, Homo Sapiens
uacuuuaggagcaauaaugccaaugacuuauuuuugguggcaaauuauuaaaauuagaauuaua

SEQ ID NO: 443245 - RNA, 64 nt, Homo Sapiens
caccuguagucccagguacuaaauuagucgggugugguggcacaaacaacaaaaacaaaaacac

SEQ ID NO: 443246 - RNA, 64 nt, Homo Sapiens
uuuaaccccaaauuuccuuuggcuauuaaaaaagugguggcaaaagacauccucaaaagaaaga

SEQ ID NO: 443247 - RNA, 64 nt, Homo Sapiens
gugcacagauacacauacacgguauucccaagagugguggcagcucaaaaugauauguuugagu

SEQ ID NO: 443248 - RNA, 64 nt, Homo Sapiens
aaauacaaaaaaaaaaaaaaaaaaaagccaggcaugguggcacacaccuguaaucccagcuacu

SEQ ID NO: 443249 - RNA, 64 nt, Homo Sapiens
aaaaauacaaaaaaaaaaaaaaauuagcugggcaugguggcacacaccuguagucccagcuacu

SEQ ID NO: 443250 - RNA, 64 nt, Homo Sapiens
ugccuguggucccagcuacuaaauuagccaggugugguggcaugucuccacaaaaaaauucaaa

SEQ ID NO: 443251 - RNA, 64 nt, Homo Sapiens
ugccuguaauccuagcuacuaaauuagcugggcaugguggcaguaucucuacuaaaaauacaaa

SEQ ID NO: 443252 - RNA, 64 nt, Homo Sapiens
accauuccccaaauugaauacccccagaugcaugugguggcaucccuacgccucccugcugccu

SEQ ID NO: 443253 - RNA, 64 nt, Homo Sapiens
agaagagaggcccagcacagagcacagcuaccucugguggcaggcugggagugucagugcuagc

SEQ ID NO: 443254 - RNA, 64 nt, Homo Sapiens
auuggcaccauuacccaggucuugauuugcuagcugguggcagauguuuuacagagcaggguca

SEQ ID NO: 443255 - RNA, 64 nt, Homo Sapiens
gauuuuuuuccuccaugcaucuuuugccaaugggugguggcauugagguuagacaaaagugauu

SEQ ID NO: 443256 - RNA, 64 nt, Homo Sapiens
uggggcuguggaugggagggcccaugcccugccgugguggcagcucuccuuguugcccccaaag

SEQ ID NO: 443257 - RNA, 64 nt, Homo Sapiens
uuaucccucuggggggugggcacugcacacagggugguggcacauuccuccauuccugcucucc

SEQ ID NO: 443258 - RNA, 64 nt, Homo Sapiens
gugagacuccaccucaaaaaacugugcuccagccugguggcacacagugagcugagaucaugcc

SEQ ID NO: 443259 - RNA, 64 nt, Homo Sapiens
ugccuguagucuuagcuacuaaauuagcugggugugguggcaugcaacucuacuaaaaauacaa

SEQ ID NO: 443260 - RNA, 64 nt, Homo Sapiens
ccccuccucuagcugugggggugagggucccaugugguggcacaggcccccuugagugggguua

SEQ ID NO: 443261 - RNA, 64 nt, Homo Sapiens
uuagcagcggaacaaggagucagacauuuuaagaugguggcaguagaggcuauggacagggcau

SEQ ID NO: 443262 - RNA, 64 nt, Homo Sapiens
aacucagaggcuuagcucgccucuuuaggguccaugguggcagcagagaggcagaagugggagu

SEQ ID NO: 443263 - RNA, 64 nt, Homo Sapiens
ugaaggaugguuccuggccccucugagugacagcugguggcagcacuccuugcuggggggcacu

SEQ ID NO: 443264 - RNA, 64 nt, Homo Sapiens
uucagccuagggauaccugagccgggugccuguuugguggcagcggcagccugaggaggaggag

SEQ ID NO: 443265 - RNA, 64 nt, Homo Sapiens
ggacagcacucacacucuucaaucucuaggaaguugguggcaagagcuguagagugcugcccga

SEQ ID NO: 443266 - RNA, 64 nt, Homo Sapiens
auaaaugugcuguuaaacacuugaaugaagagaaugguggcagaaugagugagcaagcagauug

SEQ ID NO: 443267 - RNA, 64 nt, Homo Sapiens
uugauuauauguuuuuaaaaaccugaagcuuuuuugguggcaggaccuuucaauaaauauuuau

SEQ ID NO: 443268 - RNA, 64 nt, Homo Sapiens
ccgucucuacuaaaaauacaaaauuggcagggugugguggcacaugccuauaaucccagcuacu

SEQ ID NO: 443269 - RNA, 64 nt, Homo Sapiens
uaucucuacaaaaaauacaaaaauuagccagacaugguggcacaugccuuuagucccagcuacu

SEQ ID NO: 443270 - RNA, 64 nt, Homo Sapiens
auuuuuuguuucccagguauagcaggcuuauguuugguggcauuaaauugguuucuuuaaaaug

SEQ ID NO: 443271 - RNA, 64 nt, Homo Sapiens
uugguggcauuaaauugguuucuuuaaaaugcuuugguggcacuuuuguaaacagauugcuucu

SEQ ID NO: 443272 - RNA, 64 nt, Homo Sapiens
agggaaccccuagagagaggcuccucuguggacaugguggcagccugggccauggaagcuguga

SEQ ID NO: 443273 - RNA, 64 nt, Homo Sapiens
ugccaucauggucauugccucugguaaaguauuuugguggcagcgcugcagucagaagggugug

SEQ ID NO: 443274 - RNA, 64 nt, Homo Sapiens
cacccguaguuccagcuacuaaaaaagcugggugugguggcacaccgucucuacuaaaaaauac

SEQ ID NO: 443275 - RNA, 64 nt, Homo Sapiens
uggcugugcaaggaagacccaucgcgcucugaucugguggcaucccaaguaacguagucauauc

SEQ ID NO: 443276 - RNA, 64 nt, Homo Sapiens
cagaaggcucugcuauaggacccgguguuccucuugguggcagauaccugcuaaaugccacuga

SEQ ID NO: 443277 - RNA, 64 nt, Homo Sapiens
guaauuagguuucuaagcuguauacuguguuuauugguggcagugacaccaaagauagaggcaa

SEQ ID NO: 443278 - RNA, 64 nt, Homo Sapiens
uguagcaaauaaauccuuugaaagagcuccaaauugguggcauuauccuuucaaaaucucaggg

SEQ ID NO: 443279 - RNA, 64 nt, Homo Sapiens
agucucuauugaaaauacaaaaauuagcucagugugguggcacacacuuguaaucccagcuacu

SEQ ID NO: 443280 - RNA, 64 nt, Homo Sapiens
gcaagcaggacuuugaggcaagugugggccacugugguggcaguggaggugggguguuugggag

SEQ ID NO: 443281 - RNA, 64 nt, Homo Sapiens
uccuggauguuguguguaucgagaggccaaaggcugguggcaagugcacggggcacagcggagu

SEQ ID NO: 443282 - RNA, 64 nt, Homo Sapiens
uucuuaaaguuaccacaucccacaaaauggcccuugguggcagcaauagagcaaagguuaccuu

SEQ ID NO: 443283 - RNA, 64 nt, Homo Sapiens
ugucucuacaaaaaauacaaaaauuaaccaggcaugguggcaugcaccuguagucccagcuacu

SEQ ID NO: 443284 - RNA, 64 nt, Homo Sapiens
cugucucuacuaaaaauacaaaaauagcugggcaugguggcacgcaccucuacucccagcuacu

SEQ ID NO: 443285 - RNA, 64 nt, Homo Sapiens
ggaggccuccugacuuauucauaguauugucgccugguggcauuggugugggguagcuuguccu

SEQ ID NO: 443286 - RNA, 64 nt, Homo Sapiens
uacauagaaauuuuauuauaaaaguagcuggggaugguggcacacaccuguagucccagcuacu

SEQ ID NO: 443287 - RNA, 64 nt, Homo Sapiens
cccccuccccaucaccuuuggugggggcagggccugguggcaccugugcaauaaugucuguguu

SEQ ID NO: 443288 - RNA, 64 nt, Homo Sapiens
acuugccauccccuacagcacagaggaagagugaugguggcaugcuggugguggcgggugcugg

SEQ ID NO: 443289 - RNA, 64 nt, Homo Sapiens
ccaggcuccuuuagcgcccaguuggguggaugccugguggcagcugcgguccacccaggagccc

SEQ ID NO: 443290 - RNA, 64 nt, Homo Sapiens
gacuuggaagcuccgcuuucuacccagcgagcccugguggcagugggagcugccuguucagcuc

SEQ ID NO: 443291 - RNA, 64 nt, Homo Sapiens
cauuugcuacucgccgggcagacuuuaaucggggugguggcaauggucguggaggccgagggcg

SEQ ID NO: 443292 - RNA, 64 nt, Homo Sapiens
cauuaggacccaugggccguggaggcuauggaggugguggcagugguggugguggccgaggagg

SEQ ID NO: 443293 - RNA, 64 nt, Homo Sapiens
uuguccuaggggguaacuacggggaugaucgucgugguggcagaggaggcuaugaucgaggcgg

SEQ ID NO: 443294 - RNA, 64 nt, Homo Sapiens
cuucuucccuucccaccccucacucagcuucucgugguggcaggagguaugucugacaggacag

SEQ ID NO: 443295 - RNA, 64 nt, Homo Sapiens
auuugaaaguuagccuccucccuugccaccgucuugguggcaguagcgaugcaagaaugauggg

SEQ ID NO: 443296 - RNA, 64 nt, Homo Sapiens
gcagguuggcaagugggcugggaccacaggauggugguggcauuccugccacuucuaugucucu

SEQ ID NO: 443297 - RNA, 64 nt, Homo Sapiens
caccuguaaucguagcugagaaauuagccaggcaugguggcacaaucucuacuaaaaaauacaa

SEQ ID NO: 443298 - RNA, 64 nt, Homo Sapiens
cgccugaaaucccagcuacuaaauuagccgggugugguggcaggccgucucuacuaaaauacau

SEQ ID NO: 443299 - RNA, 64 nt, Homo Sapiens
ccgucucuacuaaaaacagaaaauuauccgggcgugguggcacaugacuguaaucccagcuacu

SEQ ID NO: 443300 - RNA, 64 nt, Homo Sapiens
aaaaaauaguaauaauacaaaaauuagcugggcgugguggcacaugccaguaauuccaucuacu

SEQ ID NO: 443301 - RNA, 64 nt, Homo Sapiens
ggaggccuuaccacuccuauggaagcaccaggguugguggcaucgcucacccuccucggggagg

SEQ ID NO: 443302 - RNA, 64 nt, Homo Sapiens
ggaggaggcugaggaggcugcaccucaggccuggugguggcaguugugugcccuguuccuugcc

SEQ ID NO: 443303 - RNA, 64 nt, Homo Sapiens
acacggggugcuggauucaauuaguuagggacucugguggcacuaauauggaccugggguaccu

SEQ ID NO: 443304 - RNA, 64 nt, Homo Sapiens
acugagccuagaccauggagcaugugacaggcugugguggcaccccagcagugaggagcuggga

SEQ ID NO: 443305 - RNA, 64 nt, Homo Sapiens
cccauaggauccuguaugguccacucaaguuuagaccaguuaaacuaauuacaacugauuuaau

SEQ ID NO: 443306 - RNA, 64 nt, Homo Sapiens
uucuuaaaauaugugcuuuauaugucuuugggucaccaguuaccucuguaauguucugucccag

SEQ ID NO: 443307 - RNA, 64 nt, Homo Sapiens
cgccccgagaccccaccccgagaccccaccccggaccaguuacauucguuccuggcaaaagcaa

SEQ ID NO: 443308 - RNA, 64 nt, Homo Sapiens
auaauuucaccaggcuaaauaaaggaaaauggaaaccaguuaagaggcacaguguacagaggag

SEQ ID NO: 443309 - RNA, 64 nt, Homo Sapiens; identical to SEQ ID NO: 150207

SEQ ID NO: 443310 - RNA, 64 nt, Homo Sapiens; identical to SEQ ID NO: 150208

SEQ ID NO: 443311 - RNA, 64 nt, Homo Sapiens; identical to SEQ ID NO: 150209

SEQ ID NO: 443312 - RNA, 64 nt, Homo Sapiens; identical to SEQ ID NO: 150210

SEQ ID NO: 443313 - RNA, 64 nt, Homo Sapiens; identical to SEQ ID NO: 150211

SEQ ID NO: 443314 - RNA, 64 nt, Homo Sapiens; identical to SEQ ID NO: 150212

SEQ ID NO: 443315 - RNA, 64 nt, Homo Sapiens; identical to SEQ ID NO: 150213

SEQ ID NO: 443316 - RNA, 64 nt, Homo Sapiens; identical to SEQ ID NO: 150214

SEQ ID NO: 443317 - RNA, 64 nt, Homo Sapiens
aagguggccagccugguucucuucccugcucaggcugccagagaggugguaaauggcagaaagg

SEQ ID NO: 443318 - RNA, 64 nt, Homo Sapiens
agccuguggcuuguggccugugaccugugaccuucugccagaauugucaugccucugaggcccc

SEQ ID NO: 443319 - RNA, 64 nt, Homo Sapiens
ccaccuagggaccacguuaguugaaaaguucgcucugccagaaagagucaggacaccuggcuuc

SEQ ID NO: 443320 - RNA, 64 nt, Homo Sapiens
gcccacgaccgggucgacccgcccagccccucuccugccagacacgucuguccugucaccugcc

SEQ ID NO: 443321 - RNA, 64 nt, Homo Sapiens
cucagccugaggucuggugaugccccuaccuccacugccagacccugaaagcaccaaggguccc

SEQ ID NO: 443322 - RNA, 64 nt, Homo Sapiens
gccucagcacaggugucaggucagccuccuccagcugccagagcguccuguuuguggagugcaa

SEQ ID NO: 443323 - RNA, 64 nt, Homo Sapiens
ccugugggcagccgcgccagcugccgggacacugcugccagaccugcccccaggguaagucuug

SEQ ID NO: 443324 - RNA, 64 nt, Homo Sapiens
cgcccaacuacgacccgcucugcucacucugcaccugccagagacgaacggugaucugugaccc

SEQ ID NO: 443325 - RNA, 64 nt, Homo Sapiens
ucuggaaggagaaaaaguguaaagugagauggaacugccagauuacacuccuuagcacuuuaag

SEQ ID NO: 443326 - RNA, 64 nt, Homo Sapiens
cucggcacuuggggggagacuucacugggaggaccugccagaauagcuguggcuuaugcagaug

SEQ ID NO: 443327 - RNA, 64 nt, Homo Sapiens
gaucgcccugcuggcugccggcaccgcccuccugcugccagagacgaggcaggcacagcugcca

SEQ ID NO: 443328 - RNA, 64 nt, Homo Sapiens
cgcccuccugcugccagagacgaggcaggcacagcugccagagaccauccaggacguggagaga

SEQ ID NO: 443329 - RNA, 64 nt, Homo Sapiens
gaggccccucuuguggugcaugcaagcgcugggccugccagacacccucucugcaacuccuguu

SEQ ID NO: 443330 - RNA, 64 nt, Homo Sapiens
ucccaagccggaguucacagcugaugggcacaggcugccagagccagcuccccaagagacaguc

SEQ ID NO: 443331 - RNA, 64 nt, Homo Sapiens
ggccagcccuggcuucuccucuguuccagcuugucugccagaagccuuccccugcaaggugccc

SEQ ID NO: 443332 - RNA, 64 nt, Homo Sapiens
uuccggucugcuagcacccucagccugggagcuacugccagaggcuggcguaguggggcagcug

SEQ ID NO: 443333 - RNA, 64 nt, Homo Sapiens
gcugagauuguaggcaugaaucucuuaccacagccugccagaguuugaacuggccucaagugau

SEQ ID NO: 443334 - RNA, 64 nt, Homo Sapiens
aaucuuaaaaauguaaacugcacccuccacacugcugccagagcucuuaacugucccuuccaac

SEQ ID NO: 443335 - RNA, 64 nt, Homo Sapiens
uacuagagauaucauaauagcuuugcuucuguuacugccagagugucugucauguccagauuua

SEQ ID NO: 443336 - RNA, 64 nt, Homo Sapiens
cgucuaaaugucugucauguuaaaacucaguguacugccagauuuugccugcuugguguccagu

SEQ ID NO: 443337 - RNA, 64 nt, Homo Sapiens
gaggaccucgccccaagcaagccagugagcagcccugccagacuacugccagacugagaaaccc

SEQ ID NO: 443338 - RNA, 64 nt, Homo Sapiens
cccaagcaagccagugagcagcccugccagacuacugccagacugagaaacccagaagcuggua

SEQ ID NO: 443339 - RNA, 64 nt, Homo Sapiens
aguccuggccccugaaucaccagagccaccaagccugccagaggggucucauucauggcuuggg

SEQ ID NO: 443340 - RNA, 64 nt, Homo Sapiens
ggggugagaagaaucaucucugcaccucgggucucugccagaggaagacuuaagcaucccugcg

SEQ ID NO: 443341 - RNA, 64 nt, Homo Sapiens
gagcaaucugugacuccuaaaauggguuggggcccugccagaguuaaagcagugacuggagggu

SEQ ID NO: 443342 - RNA, 64 nt, Homo Sapiens
caaggcuguccugucccccaggcacccaaggauccugccagacagcacacuuuggaggaagguc

SEQ ID NO: 443343 - RNA, 64 nt, Homo Sapiens
aucgaacaagugcaauuaacgucucuccuggcuucugccagaaaaagagaagcacgcugucccc

SEQ ID NO: 443344 - RNA, 64 nt, Homo Sapiens
uggccuuucccagaugcugcggaaucuuccaguucugccagaauggacgccucuccccuggucu

SEQ ID NO: 443345 - RNA, 64 nt, Homo Sapiens; identical to SEQ ID NO: 159009

SEQ ID NO: 443346 - RNA, 64 nt, Homo Sapiens; identical to SEQ ID NO: 159010

SEQ ID NO: 443347 - RNA, 64 nt, Homo Sapiens; identical to SEQ ID NO: 159011

SEQ ID NO: 443348 - RNA, 64 nt, Homo Sapiens; identical to SEQ ID NO: 159012

SEQ ID NO: 443349 - RNA, 64 nt, Homo Sapiens; identical to SEQ ID NO: 159013

SEQ ID NO: 443350 - RNA, 64 nt, Homo Sapiens; identical to SEQ ID NO: 159014

SEQ ID NO: 443351 - RNA, 64 nt, Homo Sapiens
cuuuuccugggagucuacaagauuuuuaaaaggccgcaaaaaauggauaaacugccaagaacca

SEQ ID NO: 443352 - RNA, 64 nt, Homo Sapiens
uguuuauuucuaauguccuuaaacucuacauggucgcaaaaauguuuaauucuuuaaaaaguaa

SEQ ID NO: 443353 - RNA, 64 nt, Homo Sapiens
aagacaaaaaaaaaccaaaaccaaauguuuuaaacgcaaaaaaaauagaucgucagggaauagc

SEQ ID NO: 443354 - RNA, 64 nt, Homo Sapiens
aaaaaaaucuugguguguuuuuaaaaauauuuuucgcaaaaaaauguaagaaaaaaaaauuuau

SEQ ID NO: 443355 - RNA, 64 nt, Homo Sapiens
cacaguccaaagucucaucucuuuucagcauuaacgcaaaaaucagucccccaaagucuuaacu

SEQ ID NO: 443356 - RNA, 64 nt, Homo Sapiens
gaagguuugcgcaagagacgcuccuuggauuuaucgcaaaaacuccuggagcugcucuccuggc

SEQ ID NO: 443357 - RNA, 64 nt, Homo Sapiens
uggccccugcaggagucaggaggcauggaguccccgcaaaaaccgcacucggucgggccuccac

SEQ ID NO: 443358 - RNA, 64 nt, Homo Sapiens
cugcaaaagagaacaccaaucccauccacacucacgcaaaaaccgcgaugccgacaagaaaacu

SEQ ID NO: 443359 - RNA, 64 nt, Homo Sapiens
accuagaaauuaagcaaaaaagacaugauaaacacgcaaaaaaaucugcccacuuuaccuacgg

SEQ ID NO: 443360 - RNA, 64 nt, Homo Sapiens
ugauuaaagaaguuucuuauuuaaacaucucagacgcaaaaauuacauuaaauuuuuguauauu

SEQ ID NO: 443361 - RNA, 64 nt, Homo Sapiens
cauguuuagcaaaaaccaauucaguuccauuccccgcaaaaaaccccuaacuuuacucugaacu

SEQ ID NO: 443362 - RNA, 64 nt, Homo Sapiens
uuuaucucccaaauaagaugucuaguuguggcugcgcaaaaacaaacaggcgcccuauuuucuu

SEQ ID NO: 443363 - RNA, 64 nt, Homo Sapiens
acagcagaguugauuaagaaaaaugaagaaaaaacgcaaaaagagaacacauguagaagguggu

SEQ ID NO: 443364 - RNA, 64 nt, Homo Sapiens
gcucuugcuuugacuuagguuaaggaaauucuaacgcaaaaauauggccucuuguagucuuggc

SEQ ID NO: 443365 - RNA, 64 nt, Homo Sapiens
aaccagaacacacaguguggugcacuggaucuuacgcaaaaaagcugccuaccaagacacuacu

SEQ ID NO: 443366 - RNA, 64 nt, Homo Sapiens
guggaauaccuaaggauagcaccgcuuuuguucucgcaaaaacguaucuccuaauuugaggcuc

SEQ ID NO: 443367 - RNA, 64 nt, Homo Sapiens
uucuacuguaaaaugcaauuugaaaaaaauaaaacgcaaaaaaagaaacuguaaaggaaaccaa

SEQ ID NO: 443368 - RNA, 64 nt, Homo Sapiens
cacuccuggagaucuccguagaugaacaugagaccgcaaaaauuugugguauaugaucuuaaau

SEQ ID NO: 443369 - RNA, 64 nt, Homo Sapiens
uccggugcacaaaugcuuucucuucaaggcauggcgcaaaaaagccacuacuuccagaagcauc

SEQ ID NO: 443370 - RNA, 64 nt, Homo Sapiens
uaaaagucaaaccaaacuuccaccccccgccccccgcaaaaaagucuagucaauucugaaccac

SEQ ID NO: 443371 - RNA, 64 nt, Homo Sapiens
auccuaggcaacagagcgagacucugucuccccccgcaaaaaaaaaaaagaaagaaagaaagag

SEQ ID NO: 443372 - RNA, 64 nt, Homo Sapiens
uucaucaggccuuggagcagucacugcuuuauuccgcaaaaauuauuugguaggaaauuuuugg

SEQ ID NO: 443373 - RNA, 64 nt, Homo Sapiens
uaaacaaaucaucuuugucaguuaaguauaguugcgcaaaaauuguuaaauccuuugucuuuau

SEQ ID NO: 443374 - RNA, 64 nt, Homo Sapiens
gaaaaggaaaaaccccgugcuuacgaagaggaaacgcaaaaaaacuggcugccucaggcuucuc

SEQ ID NO: 443375 - RNA, 64 nt, Homo Sapiens
gcacuccagccugggcgcaagaccaagacuuaaacgcaaaaaaaaaaaaaaaaaaaaaaaaaaa

SEQ ID NO: 443376 - RNA, 64 nt, Homo Sapiens
aaaaaaaaaaaagaaaagaagagugagacuccaucgcaaaaaaacaguucagccuggaugauga

SEQ ID NO: 443377 - RNA, 64 nt, Homo Sapiens
uucugcacauuacccauauauuaacuuuuuuuaacgcaaaaauacaaagcucacaucugggaga

SEQ ID NO: 443378 - RNA, 64 nt, Homo Sapiens
uccuuuacagagguucggacugucuaacuacauacgcaaaaacuguguauagcauguguauuaa

SEQ ID NO: 443379 - RNA, 64 nt, Homo Sapiens
auuuuaagacuuucugaacugaaaaggaaacacacgcaaaaacuuaguauaagggaacucaagg

SEQ ID NO: 443380 - RNA, 64 nt, Homo Sapiens
cuagcuggaauaauaaugccuggaaccuuauuuucgcaaaaaacuuuuguuuucuucauucauu

SEQ ID NO: 443381 - RNA, 64 nt, Homo Sapiens
ggaaucaugccguuugcaaagcacugacauaaaacgcaaaaacauaggcuaggauaacuuuaga

SEQ ID NO: 443382 - RNA, 64 nt, Homo Sapiens
agcaaguuuuuauuagggaugaugccccacaagccgcaaaaacccacaugucgguagguuccgu

SEQ ID NO: 443383 - RNA, 64 nt, Homo Sapiens
cugucugacuguagcuuugugaaauaucuuaaaacgcaaaaaccaauuguguccugaaaauugu

SEQ ID NO: 443384 - RNA, 64 nt, Homo Sapiens
aagugggaaaugaaguucagauacacaacagacucgcaaaaauacucagaacuugaccaugaag

SEQ ID NO: 443385 - RNA, 64 nt, Homo Sapiens
cuauaaaaagcaccggaucuuuuccaucuaauuccgcaaaaauugaucauuugcaaagucaaaa

SEQ ID NO: 443386 - RNA, 64 nt, Homo Sapiens
aacuacagaaaaauuacuuguuuaugaaucucuacgcaaaaaaugcugugacccucaauucaua

SEQ ID NO: 443387 - RNA, 62 nt, Homo Sapiens
uugagugauguccauuccaucauuagggcuacucgcaaaagaccauauguugauucuaccug

SEQ ID NO: 443388 - RNA, 62 nt, Homo Sapiens
guguuuauuucuaauguccuaacucuacauggucgcaaaaauuuaauucuuuaaaaaguaaa

SEQ ID NO: 443389 - RNA, 62 nt, Homo Sapiens
aaaaaaaaucuugguguguuuaaaaauauuuuucgcaaaaaaguaagaaaaaaaaauuuauu

SEQ ID NO: 443390 - RNA, 62 nt, Homo Sapiens
ugaagguuugcgcaagagacuccuuggauuuaucgcaaaaaccuggagcugcucuccuggcc

SEQ ID NO: 443391 - RNA, 62 nt, Homo Sapiens
ccaccuagauuuuaagcaguaaauaaaacauuucgcaaaagauuaaaguugaauuuuacagu

SEQ ID NO: 443392 - RNA, 62 nt, Homo Sapiens
gugauuguggaucaggaggggaaugucaggauucgcaaaauggacuuuucauuugucaagua

SEQ ID NO: 443393 - RNA, 62 nt, Homo Sapiens
uggaauaccuaaggauagcaccgcuuuuguucucgcaaaaacguaucuccuaauuugaggcu

SEQ ID NO: 443394 - RNA, 62 nt, Homo Sapiens
gaccucacuggccuguggugacugcacacagcucgcaaaacugucuuuggauguucaaauga

SEQ ID NO: 443395 - RNA, 62 nt, Homo Sapiens
cuguaauggccacugaagcacgugagagacccucgcaaaaugaugugaaaggaccaguuucu

SEQ ID NO: 443396 - RNA, 62 nt, Homo Sapiens
cuagaagaacuggaaacaacacucucucuacuucgcaaaagagaggaacaacaucaaaggga

SEQ ID NO: 443397 - RNA, 62 nt, Homo Sapiens
gauucaaaccaguaacuuaguaaaauugaccuucgcaaaaccucacugggggagugccuugu

SEQ ID NO: 443398 - RNA, 62 nt, Homo Sapiens
aaaaaaaaaaaaagaaaagaagugagacuccaucgcaaaaaaaguucagccuggaugaugag

SEQ ID NO: 443399 - RNA, 62 nt, Homo Sapiens
auuagaauuucauaugacauucaugccuggcuucgcaaaauguuucaaguacuguaacugug

SEQ ID NO: 443400 - RNA, 62 nt, Homo Sapiens
aaccaaacuucuggcuaggccccucaaacaugucgcaaaauggguugaguuucucuaaggac

SEQ ID NO: 443401 - RNA, 62 nt, Homo Sapiens
ccuagcuggaauaauaaugcggaaccuuauuuucgcaaaaaauuuguuuucuucauucauuu

SEQ ID NO: 443402 - RNA, 62 nt, Homo Sapiens
agaaaaaacaguggccuuugaucauuuauuuuucgcaaaagggucuucuucauauauaugau

SEQ ID NO: 443403 - RNA, 62 nt, Homo Sapiens
aagggacggcuaaccuuuauugacaaucuauaucgcaaaagucaggaaagagguugugagcu

SEQ ID NO: 443404 - RNA, 62 nt, Homo Sapiens
aacaggauuuacugaguagaugugauugacuuucgcaaaauaauaauggggaaaaaaagucu

SEQ ID NO: 443405 - RNA, 62 nt, Homo Sapiens
cugcuuuagacaacugugacagacuauauggcucgcaaaacugcaaauauuuccuauccuuu

SEQ ID NO: 443406 - RNA, 62 nt, Homo Sapiens
auucugaagcuucugcagucucaugggaaccaucgcaaaauuaaaaauguguuucccucaaa

SEQ ID NO: 443407 - RNA, 62 nt, Homo Sapiens
gaucaucugaucugauccucuuguacggaugaucgcaaaacugagguguagagaggggaaug

SEQ ID NO: 443408 - RNA, 62 nt, Homo Sapiens
aaagugggaaaugaaguucauacacaacagacucgcaaaaauucagaacuugaccaugaaga

SEQ ID NO: 443409 - RNA, 64 nt, Homo Sapiens
gauugagugauguccauuccaucauuagggcuacucgcaaaagaccauauguugauucuaccug

SEQ ID NO: 443410 - RNA, 64 nt, Homo Sapiens
guguuuauuucuaauguccuaaaacucuacauggucgcaaaaauauuuaauucuuuaaaaagua

SEQ ID NO: 443411 - RNA, 64 nt, Homo Sapiens
aaaaaaaaucuugguguguuuuuaaaaauauuuuucgcaaaaaaauguaagaaaaaaaaauuua

SEQ ID NO: 443412 - RNA, 64 nt, Homo Sapiens
ugaagguuugcgcaagagacccuccuuggauuuaucgcaaaaacgccuggagcugcucuccugg

SEQ ID NO: 443413 - RNA, 64 nt, Homo Sapiens
acccaccuagauuuuaagcaguaaauaaaacauuucgcaaaagauuaaaguugaauuuuacagu

SEQ ID NO: 443414 - RNA, 64 nt, Homo Sapiens
cugugauuguggaucaggaggggaaugucaggauucgcaaaauggacuuuucauuugucaagua

SEQ ID NO: 443415 - RNA, 64 nt, Homo Sapiens
uguggaauaccuaaggauagcaccgcuuuuguucucgcaaaaacguaucuccuaauuugaggcu

SEQ ID NO: 443416 - RNA, 64 nt, Homo Sapiens
gugaccucacuggccuguggugacugcacacagcucgcaaaacugucuuuggauguucaaauga

SEQ ID NO: 443417 - RNA, 64 nt, Homo Sapiens
aacuguaauggccacugaagcacgugagagacccucgcaaaaugaugugaaaggaccaguuucu

SEQ ID NO: 443418 - RNA, 64 nt, Homo Sapiens
cuagaagaacuggaaacaacgaacucucucuacuucgcaaaagaaggaggaacaacaucaaagg

SEQ ID NO: 443419 - RNA, 64 nt, Homo Sapiens
augauucaaaccaguaacuuaguaaaauugaccuucgcaaaaccucacugggggagugccuugu

SEQ ID NO: 443420 - RNA, 64 nt, Homo Sapiens
aaaaaaaaaaaaagaaaagaagagugagacuccaucgcaaaaaagcaguucagccuggaugaug

SEQ ID NO: 443421 - RNA, 64 nt, Homo Sapiens
uuauuagaauuucauaugacauucaugccuggcuucgcaaaauguuucaaguacuguaacugug

SEQ ID NO: 443422 - RNA, 64 nt, Homo Sapiens
aaccaaacuucuggcuaggcaccccucaaacaugucgcaaaaugaggguugaguuucucuaagg

SEQ ID NO: 443423 - RNA, 64 nt, Homo Sapiens
ccuagcuggaauaauaaugcuuggaaccuuauuuucgcaaaaaaauuuuguuuucuucauucau

SEQ ID NO: 443424 - RNA, 64 nt, Homo Sapiens
agaaaaaacaguggccuuugauaucauuuauuuuucgcaaaagguugucuucuucauauauaug

SEQ ID NO: 443425 - RNA, 64 nt, Homo Sapiens
ucaagggacggcuaaccuuuauugacaaucuauaucgcaaaagucaggaaagagguugugagcu

SEQ ID NO: 443426 - RNA, 64 nt, Homo Sapiens
aacaggauuuacugaguagacuugugauugacuuucgcaaaauaagauaauggggaaaaaaagu

SEQ ID NO: 443427 - RNA, 64 nt, Homo Sapiens
ggcugcuuuagacaacugugacagacuauauggcucgcaaaacugcaaauauuuccuauccuuu

SEQ ID NO: 443428 - RNA, 64 nt, Homo Sapiens
auucugaagcuucugcagucaaucaugggaaccaucgcaaaauuguaaaaauguguuucccuca

SEQ ID NO: 443429 - RNA, 64 nt, Homo Sapiens
gagaucaucugaucugauccucuuguacggaugaucgcaaaacugagguguagagaggggaaug

SEQ ID NO: 443430 - RNA, 64 nt, Homo Sapiens
aaagugggaaaugaaguucagauacacaacagacucgcaaaaauucucagaacuugaccaugaa

SEQ ID NO: 443431 - RNA, 64 nt, Homo Sapiens; identical to SEQ ID NO: 238652

SEQ ID NO: 443432 - RNA, 64 nt, Homo Sapiens; identical to SEQ ID NO: 238653

SEQ ID NO: 443433 - RNA, 64 nt, Homo Sapiens; identical to SEQ ID NO: 238654

SEQ ID NO: 443434 - RNA, 64 nt, Homo Sapiens; identical to SEQ ID NO: 238655

SEQ ID NO: 443435 - RNA, 64 nt, Homo Sapiens; identical to SEQ ID NO: 238656

SEQ ID NO: 443436 - RNA, 64 nt, Homo Sapiens; identical to SEQ ID NO: 238657

SEQ ID NO: 443437 - RNA, 64 nt, Homo Sapiens; identical to SEQ ID NO: 238658

SEQ ID NO: 443438 - RNA, 64 nt, Homo Sapiens; identical to SEQ ID NO: 238659

SEQ ID NO: 443439 - RNA, 64 nt, Homo Sapiens; identical to SEQ ID NO: 238660

SEQ ID NO: 443440 - RNA, 64 nt, Homo Sapiens; identical to SEQ ID NO: 238661

SEQ ID NO: 443441 - RNA, 64 nt, Homo Sapiens; identical to SEQ ID NO: 238662

SEQ ID NO: 443442 - RNA, 64 nt, Homo Sapiens; identical to SEQ ID NO: 238663

SEQ ID NO: 443443 - RNA, 64 nt, Homo Sapiens; identical to SEQ ID NO: 238664

SEQ ID NO: 443444 - RNA, 64 nt, Homo Sapiens; identical to SEQ ID NO: 238665

SEQ ID NO: 443445 - RNA, 64 nt, Homo Sapiens; identical to SEQ ID NO: 238666

SEQ ID NO: 443446 - RNA, 64 nt, Homo Sapiens; identical to SEQ ID NO: 238667

SEQ ID NO: 443447 - RNA, 64 nt, Homo Sapiens; identical to SEQ ID NO: 238668

SEQ ID NO: 443448 - RNA, 64 nt, Homo Sapiens; identical to SEQ ID NO: 238669

SEQ ID NO: 443449 - RNA, 64 nt, Homo Sapiens; identical to SEQ ID NO: 238670

SEQ ID NO: 443450 - RNA, 64 nt, Homo Sapiens; identical to SEQ ID NO: 238671

SEQ ID NO: 443451 - RNA, 64 nt, Homo Sapiens; identical to SEQ ID NO: 238672

SEQ ID NO: 443452 - RNA, 64 nt, Homo Sapiens; identical to SEQ ID NO: 238673

SEQ ID NO: 443453 - RNA, 64 nt, Homo Sapiens; identical to SEQ ID NO: 238674

SEQ ID NO: 443454 - RNA, 64 nt, Homo Sapiens; identical to SEQ ID NO: 238675

SEQ ID NO: 443455 - RNA, 64 nt, Homo Sapiens; identical to SEQ ID NO: 238676

SEQ ID NO: 443456 - RNA, 64 nt, Homo Sapiens; identical to SEQ ID NO: 238677

SEQ ID NO: 443457 - RNA, 64 nt, Homo Sapiens; identical to SEQ ID NO: 238678

SEQ ID NO: 443458 - RNA, 64 nt, Homo Sapiens; identical to SEQ ID NO: 238679

SEQ ID NO: 443459 - RNA, 64 nt, Homo Sapiens; identical to SEQ ID NO: 238680

SEQ ID NO: 443460 - RNA, 64 nt, Homo Sapiens; identical to SEQ ID NO: 238681

SEQ ID NO: 443461 - RNA, 64 nt, Homo Sapiens; identical to SEQ ID NO: 238682

SEQ ID NO: 443462 - RNA, 64 nt, Homo Sapiens; identical to SEQ ID NO: 238683

SEQ ID NO: 443463 - RNA, 64 nt, Homo Sapiens; identical to SEQ ID NO: 238684

SEQ ID NO: 443464 - RNA, 64 nt, Homo Sapiens; identical to SEQ ID NO: 238685

SEQ ID NO: 443465 - RNA, 64 nt, Homo Sapiens; identical to SEQ ID NO: 238686

SEQ ID NO: 443466 - RNA, 64 nt, Homo Sapiens; identical to SEQ ID NO: 238687

SEQ ID NO: 443467 - RNA, 64 nt, Homo Sapiens; identical to SEQ ID NO: 238688

SEQ ID NO: 443468 - RNA, 64 nt, Homo Sapiens; identical to SEQ ID NO: 238689

SEQ ID NO: 443469 - RNA, 64 nt, Homo Sapiens; identical to SEQ ID NO: 238690

SEQ ID NO: 443470 - RNA, 64 nt, Homo Sapiens; identical to SEQ ID NO: 238691

SEQ ID NO: 443471 - RNA, 64 nt, Homo Sapiens; identical to SEQ ID NO: 238692

SEQ ID NO: 443472 - RNA, 64 nt, Homo Sapiens; identical to SEQ ID NO: 238693

SEQ ID NO: 443473 - RNA, 64 nt, Homo Sapiens; identical to SEQ ID NO: 238694

SEQ ID NO: 443474 - RNA, 64 nt, Homo Sapiens; identical to SEQ ID NO: 238695

SEQ ID NO: 443475 - RNA, 64 nt, Homo Sapiens; identical to SEQ ID NO: 238696

SEQ ID NO: 443476 - RNA, 64 nt, Homo Sapiens; identical to SEQ ID NO: 238697

SEQ ID NO: 443477 - RNA, 64 nt, Homo Sapiens; identical to SEQ ID NO: 238698

SEQ ID NO: 443478 - RNA, 64 nt, Homo Sapiens; identical to SEQ ID NO: 238699

SEQ ID NO: 443479 - RNA, 64 nt, Homo Sapiens; identical to SEQ ID NO: 238700

SEQ ID NO: 443480 - RNA, 64 nt, Homo Sapiens; identical to SEQ ID NO: 238701

SEQ ID NO: 443481 - RNA, 64 nt, Homo Sapiens; identical to SEQ ID NO: 238702

SEQ ID NO: 443482 - RNA, 64 nt, Homo Sapiens; identical to SEQ ID NO: 238703

SEQ ID NO: 443483 - RNA, 64 nt, Homo Sapiens; identical to SEQ ID NO: 238704

SEQ ID NO: 443484 - RNA, 64 nt, Homo Sapiens; identical to SEQ ID NO: 238705

SEQ ID NO: 443485 - RNA, 64 nt, Homo Sapiens; identical to SEQ ID NO: 238706

SEQ ID NO: 443486 - RNA, 64 nt, Homo Sapiens; identical to SEQ ID NO: 238707

SEQ ID NO: 443487 - RNA, 64 nt, Homo Sapiens; identical to SEQ ID NO: 238708

SEQ ID NO: 443488 - RNA, 64 nt, Homo Sapiens; identical to SEQ ID NO: 238709

SEQ ID NO: 443489 - RNA, 64 nt, Homo Sapiens; identical to SEQ ID NO: 238710

SEQ ID NO: 443490 - RNA, 64 nt, Homo Sapiens; identical to SEQ ID NO: 238711

SEQ ID NO: 443491 - RNA, 64 nt, Homo Sapiens; identical to SEQ ID NO: 238712

SEQ ID NO: 443492 - RNA, 64 nt, Homo Sapiens; identical to SEQ ID NO: 238713

SEQ ID NO: 443493 - RNA, 64 nt, Homo Sapiens; identical to SEQ ID NO: 238714

SEQ ID NO: 443494 - RNA, 64 nt, Homo Sapiens; identical to SEQ ID NO: 238715

SEQ ID NO: 443495 - RNA, 64 nt, Homo Sapiens; identical to SEQ ID NO: 238716

SEQ ID NO: 443496 - RNA, 64 nt, Homo Sapiens; identical to SEQ ID NO: 238717

SEQ ID NO: 443497 - RNA, 64 nt, Homo Sapiens; identical to SEQ ID NO: 238718

SEQ ID NO: 443498 - RNA, 64 nt, Homo Sapiens; identical to SEQ ID NO: 238719

SEQ ID NO: 443499 - RNA, 64 nt, Homo Sapiens; identical to SEQ ID NO: 168996

SEQ ID NO: 443500 - RNA, 64 nt, Homo Sapiens; identical to SEQ ID NO: 168997

SEQ ID NO: 443501 - RNA, 64 nt, Homo Sapiens; identical to SEQ ID NO: 168998

SEQ ID NO: 443502 - RNA, 64 nt, Homo Sapiens; identical to SEQ ID NO: 168999

SEQ ID NO: 443503 - RNA, 64 nt, Homo Sapiens; identical to SEQ ID NO: 169000

SEQ ID NO: 443504 - RNA, 64 nt, Homo Sapiens; identical to SEQ ID NO: 169001

SEQ ID NO: 443505 - RNA, 64 nt, Homo Sapiens; identical to SEQ ID NO: 169002

SEQ ID NO: 443506 - RNA, 64 nt, Homo Sapiens; identical to SEQ ID NO: 169003

SEQ ID NO: 443507 - RNA, 64 nt, Homo Sapiens; identical to SEQ ID NO: 107011

SEQ ID NO: 443508 - RNA, 64 nt, Homo Sapiens; identical to SEQ ID NO: 107012

SEQ ID NO: 443509 - RNA, 64 nt, Homo Sapiens; identical to SEQ ID NO: 107013

SEQ ID NO: 443510 - RNA, 64 nt, Homo Sapiens; identical to SEQ ID NO: 107014

SEQ ID NO: 443511 - RNA, 64 nt, Homo Sapiens; identical to SEQ ID NO: 107015

SEQ ID NO: 443512 - RNA, 64 nt, Homo Sapiens; identical to SEQ ID NO: 107016

SEQ ID NO: 443513 - RNA, 64 nt, Homo Sapiens; identical to SEQ ID NO: 107017

SEQ ID NO: 443514 - RNA, 64 nt, Homo Sapiens; identical to SEQ ID NO: 107018

SEQ ID NO: 443515 - RNA, 64 nt, Homo Sapiens; identical to SEQ ID NO: 107019

SEQ ID NO: 443516 - RNA, 64 nt, Homo Sapiens; identical to SEQ ID NO: 107020

SEQ ID NO: 443517 - RNA, 64 nt, Homo Sapiens; identical to SEQ ID NO: 107021

SEQ ID NO: 443518 - RNA, 64 nt, Homo Sapiens; identical to SEQ ID NO: 107022

SEQ ID NO: 443519 - RNA, 64 nt, Homo Sapiens; identical to SEQ ID NO: 107023

SEQ ID NO: 443520 - RNA, 64 nt, Homo Sapiens; identical to SEQ ID NO: 107024

SEQ ID NO: 443521 - RNA, 64 nt, Homo Sapiens; identical to SEQ ID NO: 107025

SEQ ID NO: 443522 - RNA, 64 nt, Homo Sapiens; identical to SEQ ID NO: 107026

SEQ ID NO: 443523 - RNA, 64 nt, Homo Sapiens; identical to SEQ ID NO: 107027

SEQ ID NO: 443524 - RNA, 64 nt, Homo Sapiens; identical to SEQ ID NO: 107028

SEQ ID NO: 443525 - RNA, 64 nt, Homo Sapiens; identical to SEQ ID NO: 107029

SEQ ID NO: 443526 - RNA, 64 nt, Homo Sapiens; identical to SEQ ID NO: 107030

SEQ ID NO: 443527 - RNA, 64 nt, Homo Sapiens; identical to SEQ ID NO: 107031

SEQ ID NO: 443528 - RNA, 64 nt, Homo Sapiens; identical to SEQ ID NO: 107032

SEQ ID NO: 443529 - RNA, 63 nt, Homo Sapiens
gguggcaaaggcacuuguccguugcaaaggagcugaggucaagguuagcaaaccacuccuuuu

SEQ ID NO: 443530 - RNA, 63 nt, Homo Sapiens
ucacugcggacaucaagggcaacaugaaacaggugaggucagggggaaaaauuauccccggac

SEQ ID NO: 443531 - RNA, 63 nt, Homo Sapiens
gguugguggggugucaucacacacagggugggcugaggucagacugagcuauaagaggggugg

SEQ ID NO: 443532 - RNA, 63 nt, Homo Sapiens
uugagcacugauguaaauuacuuagaucuucuuugaggucagaauucagcgaucacgguaggc

SEQ ID NO: 443533 - RNA, 63 nt, Homo Sapiens
cagcagaauagcaaaaacuuugcucaggacauuugaggucaaauugaagacggaagacggaag

SEQ ID NO: 443534 - RNA, 63 nt, Homo Sapiens
uguccccucugcaugcccuuaaacauuggacagugaggucacaguccacccacccucucucug

SEQ ID NO: 443535 - RNA, 63 nt, Homo Sapiens
aguacucugggaagccaaggcaggcagaucacuugaggucaggaguucgagaccagccuggcc

SEQ ID NO: 443536 - RNA, 63 nt, Homo Sapiens
aguucaagaccagcccgggccgggcagaucgcuugaggucaggagcacuuugggaggcugagg

SEQ ID NO: 443537 - RNA, 63 nt, Homo Sapiens
aguucaagaccagccuggcccagguggaucaccugaggucaggaguacuuugggaggccgagu

SEQ ID NO: 443538 - RNA, 63 nt, Homo Sapiens
augggggcucuuucgcugcagccuccaccgugcugaggucaggaggccgacguggcaguugug

SEQ ID NO: 443539 - RNA, 63 nt, Homo Sapiens
cuucacugaauuucuucaaaaccauugcagaagugaggucauccuugaaaaguggcagaaaaa

SEQ ID NO: 443540 - RNA, 63 nt, Homo Sapiens
agauugagaccuuccuggcuggugggcaaaucaugaggucaggccagcacuuugggaggccga

SEQ ID NO: 443541 - RNA, 63 nt, Homo Sapiens
aucagaagcuaagcuggguguauuccaagauacugaggucauaacauaguauuccucaguauc

SEQ ID NO: 443542 - RNA, 63 nt, Homo Sapiens
agcacuuugggaggccaagguggguggaccacaugaggucaggaguuugagaucagccuggcc

SEQ ID NO: 443543 - RNA, 63 nt, Homo Sapiens
ccagcacuuugggaggccaagacgggcggaucaugaggucaagagaucaagaucauccuggcc

SEQ ID NO: 443544 - RNA, 63 nt, Homo Sapiens
aacacuuuaggagaccaaggcgggcagaucacuugaggucagaaguuugagaccagccaggcc

SEQ ID NO: 443545 - RNA, 63 nt, Homo Sapiens
agcacucugggaggcugagacagguagaucauuugaggucaggaguucaaaaccaaccugguc

SEQ ID NO: 443546 - RNA, 63 nt, Homo Sapiens
agcccagcucuccagggggcagguggaggccggugaggucaggauuuggccagagccuucagg

SEQ ID NO: 443547 - RNA, 63 nt, Homo Sapiens
uguggauuuggccagagccugguguucccuuccugaggucacaaggggcuuuggacuccugag

SEQ ID NO: 443548 - RNA, 63 nt, Homo Sapiens
agcacuuugggaggcugaggcaggugaaucaccugaggucaggaguucaagaccagccuggcc

SEQ ID NO: 443549 - RNA, 63 nt, Homo Sapiens
ugauaaccuaagagcauuaagcucugaguccagugaggucauagcaguguaugcuccuugccc

SEQ ID NO: 443550 - RNA, 63 nt, Homo Sapiens
agcacuuugggaguccaaggcaggcauaucauuugaggucaggaguuuaagaccagccuggcu

SEQ ID NO: 443551 - RNA, 63 nt, Homo Sapiens
gcaugugaguaaacacaccugcgcagcccuggcugaggucacuaggcuggccagaggcaggac

SEQ ID NO: 443552 - RNA, 63 nt, Homo Sapiens
uccagauuguaaauguaccaucuuaaacaacucugaggucaccaaacaguaguuauuugacug

SEQ ID NO: 443553 - RNA, 63 nt, Homo Sapiens
cccagcacuuugggagguugcggguggaucacuugaggucaggaguucgagaccagccuggcc

SEQ ID NO: 443554 - RNA, 63 nt, Homo Sapiens
uuaauguuucacagcgaucuaaaacaaguauggugaggucacuaaaauguguaucugagugag

SEQ ID NO: 443555 - RNA, 63 nt, Homo Sapiens
ccaccacuggaguggauggggguggcggguggcugaggucacagcaugcccgaguccugcaag

SEQ ID NO: 443556 - RNA, 63 nt, Homo Sapiens
aguucaagacuagccuggcccggguggaucaccugaggucaggagcacuuugggaggcagggg

SEQ ID NO: 443557 - RNA, 63 nt, Homo Sapiens
aguucaagaccagccuguccugguaggaucaccugaggucaggagcacuuugagaggcugagg

SEQ ID NO: 443558 - RNA, 63 nt, Homo Sapiens
ggacagccagagcuuucuauguacuguuaaaauugaggucacauauuuucuuuuguauccugg

SEQ ID NO: 443559 - RNA, 63 nt, Homo Sapiens
ugauguacuuaaaggaauaauaaaugcauaauaugaggucaguggacgccauuuucuguuaua

SEQ ID NO: 443560 - RNA, 63 nt, Homo Sapiens
aguucgagaccagccuggccugaaucacuugauugaggucaggcuuugggaggcugaggcggg

SEQ ID NO: 443561 - RNA, 63 nt, Homo Sapiens
aguucgagaccagccugaccaggguggaucacuugaggucaggagcacuuugcaaggccgagg

SEQ ID NO: 443562 - RNA, 63 nt, Homo Sapiens
gggguggccccuaacccaccuaauuagucaccaugaggucacugaaacacagucguugcagau

SEQ ID NO: 443563 - RNA, 63 nt, Homo Sapiens
caucuccuugaugucugugaagggcaccucugcugaggucagaguccuacucuguaacccuag

SEQ ID NO: 443564 - RNA, 63 nt, Homo Sapiens
auggggagcugcugccuuuguccuaccaggcccugaggucaggcugugggcuggguggcccca

SEQ ID NO: 443565 - RNA, 63 nt, Homo Sapiens
ucugaggccaguauccuccacgucaggucucucugaggucagguccuagcagaucguggggaa

SEQ ID NO: 443566 - RNA, 63 nt, Homo Sapiens
agcacuuugggaggccaaggcugguggaucaccugaggucaggaguucgagaccagccuggcc

SEQ ID NO: 443567 - RNA, 63 nt, Homo Sapiens
agcacuuugggaggcuuaggcggcuggaucaccugaggucaggaguucaagaccagccugguc

SEQ ID NO: 443568 - RNA, 63 nt, Homo Sapiens
uugaagacggaaaccggaaaugcucaggacauuugaggucaaacagcagaauaacaaaaacuu

SEQ ID NO: 443569 - RNA, 63 nt, Homo Sapiens
auucagccaucaugguaggcuuacggucuucuuugaggucaaauucuugagcacugauauaaa

SEQ ID NO: 443570 - RNA, 63 nt, Homo Sapiens
agcucgagaccagccuggcccaggcggaucacuugaggucaggagcacuuugggaggcugagg

SEQ ID NO: 443571 - RNA, 63 nt, Homo Sapiens
agcucaagaccagccuggcccgggcggaucacuugaggucaggagcauuuugggaggccaagg

SEQ ID NO: 443572 - RNA, 63 nt, Homo Sapiens
gugugugagugggaggagagggcagagguccccugaggucaugcauuguaaucaucauagaag

SEQ ID NO: 443573 - RNA, 63 nt, Homo Sapiens
ccugaggguguuaguaccuaguggugaaacggaugaggucauuucuaagguguguugcccgug

SEQ ID NO: 443574 - RNA, 63 nt, Homo Sapiens
uaagaauaaggggcccugaaugucaugaaggcuugaggucagccuacagauaacaggauuauu

SEQ ID NO: 443575 - RNA, 63 nt, Homo Sapiens
ucaccugauucaaggacuuugcuagcuagguuuugaggucaggcuucaguaacuguagucuug

SEQ ID NO: 443576 - RNA, 63 nt, Homo Sapiens
uuggccacagugcucucagccagcacuaagggcugaggucaauaccgcagaccuuggggagga

SEQ ID NO: 443577 - RNA, 63 nt, Homo Sapiens
ccugacacagucccucagagauggcccuggcucugaggucacaucagcuagguuugggaggcc

SEQ ID NO: 443578 - RNA, 63 nt, Homo Sapiens
uacggcuguggccgugcaggcaggugaccucuaugaggucaccguuaggaccauccuccagga

SEQ ID NO: 443579 - RNA, 63 nt, Homo Sapiens
cugugcugugugaugggcagugccgugccucucugaggucagguauuccuguggagggaccuc

SEQ ID NO: 443580 - RNA, 63 nt, Homo Sapiens
cucaaauauggcauugcucaaaucugcuguguaugaggucacagggcccagcuguggcagggg

SEQ ID NO: 443581 - RNA, 63 nt, Homo Sapiens
agcacuuugggaggccaaggcaggcagaucaccugaggucaggaguuugagaccagccuggcc

SEQ ID NO: 443582 - RNA, 63 nt, Homo Sapiens
aguucgagaccagccuggccugguggcucacgcugaggucaggaacugggcgguggccgggcg

SEQ ID NO: 443583 - RNA, 63 nt, Homo Sapiens
agaucgagaccagccuggccugggcagaucagcugaggucaggagcacuuugggaggccgagg

SEQ ID NO: 443584 - RNA, 64 nt, Homo Sapiens; identical to SEQ ID NO: 172267

SEQ ID NO: 443585 - RNA, 64 nt, Homo Sapiens; identical to SEQ ID NO: 172268

SEQ ID NO: 443586 - RNA, 64 nt, Homo Sapiens; identical to SEQ ID NO: 172269

SEQ ID NO: 443587 - RNA, 64 nt, Homo Sapiens; identical to SEQ ID NO: 172270

SEQ ID NO: 443588 - RNA, 64 nt, Homo Sapiens; identical to SEQ ID NO: 172271

SEQ ID NO: 443589 - RNA, 64 nt, Homo Sapiens; identical to SEQ ID NO: 172272

SEQ ID NO: 443590 - RNA, 64 nt, Homo Sapiens; identical to SEQ ID NO: 172273

SEQ ID NO: 443591 - RNA, 64 nt, Homo Sapiens; identical to SEQ ID NO: 172274

SEQ ID NO: 443592 - RNA, 64 nt, Homo Sapiens; identical to SEQ ID NO: 172275

SEQ ID NO: 443593 - RNA, 64 nt, Homo Sapiens; identical to SEQ ID NO: 172276

SEQ ID NO: 443594 - RNA, 64 nt, Homo Sapiens; identical to SEQ ID NO: 172277

SEQ ID NO: 443595 - RNA, 64 nt, Homo Sapiens; identical to SEQ ID NO: 172278

SEQ ID NO: 443596 - RNA, 64 nt, Homo Sapiens; identical to SEQ ID NO: 172279

SEQ ID NO: 443597 - RNA, 64 nt, Homo Sapiens; identical to SEQ ID NO: 172280

SEQ ID NO: 443598 - RNA, 64 nt, Homo Sapiens; identical to SEQ ID NO: 172281

SEQ ID NO: 443599 - RNA, 64 nt, Homo Sapiens; identical to SEQ ID NO: 172282

SEQ ID NO: 443600 - RNA, 64 nt, Homo Sapiens; identical to SEQ ID NO: 172283

SEQ ID NO: 443601 - RNA, 64 nt, Homo Sapiens; identical to SEQ ID NO: 172284

SEQ ID NO: 443602 - RNA, 64 nt, Homo Sapiens; identical to SEQ ID NO: 172285

SEQ ID NO: 443603 - RNA, 64 nt, Homo Sapiens; identical to SEQ ID NO: 172286

SEQ ID NO: 443604 - RNA, 64 nt, Homo Sapiens; identical to SEQ ID NO: 172287

SEQ ID NO: 443605 - RNA, 64 nt, Homo Sapiens; identical to SEQ ID NO: 172288

SEQ ID NO: 443606 - RNA, 64 nt, Homo Sapiens; identical to SEQ ID NO: 172289

SEQ ID NO: 443607 - RNA, 64 nt, Homo Sapiens; identical to SEQ ID NO: 172290

SEQ ID NO: 443608 - RNA, 64 nt, Homo Sapiens; identical to SEQ ID NO: 172291

SEQ ID NO: 443609 - RNA, 64 nt, Homo Sapiens; identical to SEQ ID NO: 172292

SEQ ID NO: 443610 - RNA, 64 nt, Homo Sapiens; identical to SEQ ID NO: 172293

SEQ ID NO: 443611 - RNA, 64 nt, Homo Sapiens; identical to SEQ ID NO: 172294

SEQ ID NO: 443612 - RNA, 64 nt, Homo Sapiens; identical to SEQ ID NO: 172295

SEQ ID NO: 443613 - RNA, 64 nt, Homo Sapiens; identical to SEQ ID NO: 172296

SEQ ID NO: 443614 - RNA, 64 nt, Homo Sapiens; identical to SEQ ID NO: 172297

SEQ ID NO: 443615 - RNA, 64 nt, Homo Sapiens; identical to SEQ ID NO: 172298

SEQ ID NO: 443616 - RNA, 64 nt, Homo Sapiens; identical to SEQ ID NO: 172299

SEQ ID NO: 443617 - RNA, 64 nt, Homo Sapiens; identical to SEQ ID NO: 172300

SEQ ID NO: 443618 - RNA, 64 nt, Homo Sapiens; identical to SEQ ID NO: 172301

SEQ ID NO: 443619 - RNA, 64 nt, Homo Sapiens; identical to SEQ ID NO: 172302

SEQ ID NO: 443620 - RNA, 64 nt, Homo Sapiens; identical to SEQ ID NO: 172303

SEQ ID NO: 443621 - RNA, 64 nt, Homo Sapiens; identical to SEQ ID NO: 172304

SEQ ID NO: 443622 - RNA, 64 nt, Homo Sapiens; identical to SEQ ID NO: 172305

SEQ ID NO: 443623 - RNA, 64 nt, Homo Sapiens; identical to SEQ ID NO: 172306

SEQ ID NO: 443624 - RNA, 64 nt, Homo Sapiens; identical to SEQ ID NO: 172307

SEQ ID NO: 443625 - RNA, 64 nt, Homo Sapiens; identical to SEQ ID NO: 172308

SEQ ID NO: 443626 - RNA, 64 nt, Homo Sapiens; identical to SEQ ID NO: 172309

SEQ ID NO: 443627 - RNA, 64 nt, Homo Sapiens; identical to SEQ ID NO: 172310

SEQ ID NO: 443628 - RNA, 65 nt, Homo Sapiens
cucgcucugucgcccaggcuuuuuuuuuuuuuuuugagacggaguugaagaaggcaaaaaacuuu

SEQ ID NO: 443629 - RNA, 65 nt, Homo Sapiens
cucacucuuccgcccaggcuuuuuuuuuuuuuuuugagacggaguauauaagggauaauuuuucu

SEQ ID NO: 443630 - RNA, 65 nt, Homo Sapiens
acagugguauauuggggaauuuuuuuuuuuuuuuugagacggagucuggcucugucacccaggcu

SEQ ID NO: 443631 - RNA, 65 nt, Homo Sapiens
acacccagcuaauuuuuuuuuuuuuuuuuuuauuugagacggaguuucgcucugucgcccaggcu

SEQ ID NO: 443632 - RNA, 65 nt, Homo Sapiens
uuuaccauguuggcuaggcuuuuuuauuuuuaguagagacggaauccaccaugccuggcuaauuu

SEQ ID NO: 443633 - RNA, 65 nt, Homo Sapiens
uucccucuugucacccaggcuuauuuuaauuuuuugagacggaguucuuuuucuuuuuuuuuuuu

SEQ ID NO: 443634 - RNA, 65 nt, Homo Sapiens
uucaccauguuggccaggcuuuuguauuuuuaguagagacggagugccaccaugcccggcuaauu

SEQ ID NO: 443635 - RNA, 65 nt, Homo Sapiens
uucgcucuugucaccccagcuuuuuuuuuuuuuuugagacggagucccauccucuucuuuuuuuu

SEQ ID NO: 443636 - RNA, 65 nt, Homo Sapiens
cucgcucugucauccaggcugcuuugcuuuguuuugagacggaguuguguauuuuguuuuguuuu

SEQ ID NO: 443637 - RNA, 65 nt, Homo Sapiens
cuauguugcccaggcuguuaauggaagcuugugaggagacggacucucuaauaccugagccaaga

SEQ ID NO: 443638 - RNA, 65 nt, Homo Sapiens
ugcaccauguuggccaggcuuuuguauuuuuaguagagacggagucgccaccaugcccggcuaau

SEQ ID NO: 443639 - RNA, 65 nt, Homo Sapiens
uuuguucuuguugcccaggcuuuuuuuuuuuuuuugagacggaguacagagaacgcuacuaauga

SEQ ID NO: 443640 - RNA, 64 nt, Homo Sapiens
acacucagggccagacccaccauccuggacuggcgaggaagaucagugccuccugcucugccca

SEQ ID NO: 443641 - RNA, 64 nt, Homo Sapiens
uuagagcagggcuggucauacccucuggaguucagaggaagagguaggaccagugcuuuuuugu

SEQ ID NO: 443642 - RNA, 64 nt, Homo Sapiens
auauauuagguaggucaaucuuaauuggucucaagaggaagaacugucugucauuucgguaagu

SEQ ID NO: 443643 - RNA, 64 nt, Homo Sapiens
gaacugucugucauuucgguaaguaggauacugugaggaagaccaaaaagagauauggaugcuu

SEQ ID NO: 443644 - RNA, 64 nt, Homo Sapiens
caacaaguauaccccaccagggccugagugacuagaggaagaggacgaggccuuguuggcacua

SEQ ID NO: 443645 - RNA, 64 nt, Homo Sapiens
agaaaacuuuuuuuuagcuucaccgaugacaacagaggaagaagggaacugggauuuggguaag

SEQ ID NO: 443646 - RNA, 64 nt, Homo Sapiens
ccgcacugggcuuccugaccuaagcaguaugacugaggaagagcagauugcuuaugccaugcag

SEQ ID NO: 443647 - RNA, 64 nt, Homo Sapiens
ccaggccaccaaggacggcaagaaggacaagaaggaggaagacaagaagugagacuggagggaa

SEQ ID NO: 443648 - RNA, 56 nt, Homo Sapiens
uuaacuacuuccugucaugaaggcuagaggaagacuuccuggaacugccuuucuuc

SEQ ID NO: 443649 - RNA, 64 nt, Homo Sapiens
gccaagagccugaggcugaagggaaaaguacacagaggaagauauuuuacaaaccaggucagug

SEQ ID NO: 443650 - RNA, 64 nt, Homo Sapiens
agaggaggaguugccacgaacaccacuccuggaugaggaagaggaggaaaauccugacaaggcu

SEQ ID NO: 443651 - RNA, 64 nt, Homo Sapiens
gaggggauguaugaacggccaaauucccaugugagaggaagaugaccugauccaccuagccuuu

SEQ ID NO: 443652 - RNA, 64 nt, Homo Sapiens
ucucuugcaaauuaauaaucgaugguaugaguuagaggaagaauacugaacucugucugagugg

SEQ ID NO: 443653 - RNA, 64 nt, Homo Sapiens
aaagaggaagcgcugaauuagccaugaacaaggugaggaagaaguucugcugauggaacagcca

SEQ ID NO: 443654 - RNA, 64 nt, Homo Sapiens
aaacaaacuacggagcuggggauugagcccaggagaggaagaacgcagugaggcuuguccagau

SEQ ID NO: 443655 - RNA, 64 nt, Homo Sapiens
aggcgagggaaucagaaauuaaagcagcccugaggaggaagagggacacugaccuucugcuggg

SEQ ID NO: 443656 - RNA, 64 nt, Homo Sapiens
ugugcagaccaagagcaccacacugcuggaggaagaggaagauuauucaacaacauccauacag

SEQ ID NO: 443657 - RNA, 64 nt, Homo Sapiens
aagauuugugcagaccaagaauacagcacugcuggaggaagaggcucaacauucaacaacaucc

SEQ ID NO: 443658 - RNA, 64 nt, Homo Sapiens
gagaaaucucugcauccccauuagggagggagaggaggaagacugaggaagcuggggaaagugg

SEQ ID NO: 443659 - RNA, 64 nt, Homo Sapiens
gguaaacugagcuagccccuuauuguuagggaaagaggaagaagaugcagucugaugccaggua

SEQ ID NO: 443660 - RNA, 64 nt, Homo Sapiens
cagcagcaucccaagaaggaagcagcagagguaagaggaagagggcagagcacacacuggcuca

SEQ ID NO: 443661 - RNA, 64 nt, Homo Sapiens
cuacagcaucugaaaggaauggaggcagaaagaggaggaagaagcaaaaaaaagaaaaagaaaa

SEQ ID NO: 443662 - RNA, 64 nt, Homo Sapiens
gagggccuccaagugagagauuuggauagagaaugaggaagacagccuugaaggauggaugaaa

SEQ ID NO: 443663 - RNA, 64 nt, Homo Sapiens
cauucacaacugagcaagacuaacucuccucaaugaggaagaaucagccagcuuacacaggcau

SEQ ID NO: 443664 - RNA, 64 nt, Homo Sapiens
ucagaaacaaccagccuugaaggcuacaacugacgaggaagacucuguuucgaauauagccaca

SEQ ID NO: 443665 - RNA, 64 nt, Homo Sapiens
ucagaaaccaccagccuugaaggguacaagugacgaggaagauucuguuuuggguauagccaga

SEQ ID NO: 443666 - RNA, 64 nt, Homo Sapiens
aggagggacaagaaucaauggauaagcguggguggaggaagauccaaacagaaaagugcaaagu

SEQ ID NO: 443667 - RNA, 64 nt, Homo Sapiens
aaguuauuccccaucuuccaaggguugaauucuggaggaagaagacacauuccuaguuccccgu

SEQ ID NO: 443668 - RNA, 64 nt, Homo Sapiens
caaaagcagaaaccccugauuggcaagaaaaaaugaggaagaagaaaagacacuucuuacauug

SEQ ID NO: 443669 - RNA, 64 nt, Homo Sapiens
caaaaguggaaaccccugaucagcaagagaaaaugaggaagaaggaaaggcacuucuuacaugg

SEQ ID NO: 443670 - RNA, 64 nt, Homo Sapiens
cuggaaccuuucuuugacaggcagggcacauggggaggaagagagcccugacccaccuggcaaa

SEQ ID NO: 443671 - RNA, 64 nt, Homo Sapiens
ccucugucuuucccacgacucucacuccaccagugaggaagaugcauccccuuuagauucgugc

SEQ ID NO: 443672 - RNA, 64 nt, Homo Sapiens
gcaccucuucccccauggcagaagggaggcacuggaggaagacgccaggguggggagauccugg

SEQ ID NO: 443673 - RNA, 64 nt, Homo Sapiens
agggaaggaaguguuugugugagaggaagaacgagaggaagagauggaugaacagagaagggaa

SEQ ID NO: 443674 - RNA, 64 nt, Homo Sapiens
gagaggaagagaagggaaggcagagaagggaagagaggaagaacuuugaggcaaguuggaugaa

SEQ ID NO: 443675 - RNA, 64 nt, Homo Sapiens
aaguccgggagaaccauaugaaggagcaggaggagaggaagaaacuuuuuuuccuucuuuucca

SEQ ID NO: 443676 - RNA, 64 nt, Homo Sapiens
uuugcccaagaggcaucucaguacuccagcaauggaggaagaauagagaauuuugccuggcaau

SEQ ID NO: 443677 - RNA, 64 nt, Homo Sapiens
aagcauuguccagagguaggcccucugagcccaggaggaagagaugguccaggcucuggugaag

SEQ ID NO: 443678 - RNA, 64 nt, Homo Sapiens
gaaaacaauuuuuauuuggcguagggugagcuuagaggaagaaacuuuuguuaccugacaugcc

SEQ ID NO: 443679 - RNA, 64 nt, Homo Sapiens
agucuuugcacuauauuaccaguauaugguuuccgaggaagauuaucuacugcaaaacaccacu

SEQ ID NO: 443680 - RNA, 64 nt, Homo Sapiens
aaguuguacuucugacuaaacuggaauuaugagugaggaagaguguuuacuaaauaaaugacug

SEQ ID NO: 443681 - RNA, 64 nt, Homo Sapiens
uguauucccccaucuagccauuucggaagacaccgaggaagaggaggaagaugaagaccaggac

SEQ ID NO: 443682 - RNA, 64 nt, Homo Sapiens
ccaucuagccauuucggaagacaccgaggaagaggaggaagaugaagaccaggacuacagcuuu

SEQ ID NO: 443683 - RNA, 64 nt, Homo Sapiens
agucaaucagcagaggagagcauuugauaacuaagaggaagacuugcaaagccguuuucucaug

SEQ ID NO: 443684 - RNA, 64 nt, Homo Sapiens
ccuuucaccuccaauucccgugaucccaaaagaagaggaagacuccaggagggguauagauugu

SEQ ID NO: 443685 - RNA, 64 nt, Homo Sapiens
gugccggggaagggaguccgcgaccugggguagggaggaagaggugcuacagccccccaacccc

SEQ ID NO: 443686 - RNA, 64 nt, Homo Sapiens
guaggaaucccggcuccuuuauguuagcgcgcucgaggaagaaguuccaauuguuaauaacgcu

SEQ ID NO: 443687 - RNA, 64 nt, Homo Sapiens
ggccuuuggcgagagcuccacggaaagugaugaggaggaagaagagggcuguggucauacacac

SEQ ID NO: 443688 - RNA, 64 nt, Homo Sapiens
cccuccuucccucucuucugccugauagagggaagaggaagaggaggacgaacagagauccuga

SEQ ID NO: 443689 - RNA, 64 nt, Homo Sapiens
agucacagagagcaagccaagacauccagggaaagaggaagaaaggccuuagugugccccagca

SEQ ID NO: 443690 - RNA, 64 nt, Homo Sapiens
ccccaggaccaacaacacccugguuuggagcugggaggaagaagggggccugagagagccccag

SEQ ID NO: 443691 - RNA, 64 nt, Homo Sapiens
uuccuucaauuuuuccuaagaaauagcaugcuuggaggaagauugggaagaggggcugggguuu

SEQ ID NO: 443692 - RNA, 64 nt, Homo Sapiens
uauuucuggaaugugagacuagaguuggggcauugaggaagagaugaacaugacaaaaguugcc

SEQ ID NO: 443693 - RNA, 64 nt, Homo Sapiens
uucccuugcuucugcauaaagaauuuuuucacuggaggaagauucugucuucaaaaucucauua

SEQ ID NO: 443694 - RNA, 64 nt, Homo Sapiens
agacauuaugggccuggaagauauuaacaucacagaggaagaccacugucccaaauccugauaa

SEQ ID NO: 443695 - RNA, 64 nt, Homo Sapiens
gggaagaauuagguuugaauggguugggugggaggaggaagaaagcucaucuugagaagcaggc

SEQ ID NO: 443696 - RNA, 64 nt, Homo Sapiens
gggaagaauuagguuugaauggguugggugggaggaggaagaaaguugccacugagaagcaggc

SEQ ID NO: 443697 - RNA, 64 nt, Homo Sapiens
uugcuaccaaacuuuguaaccucaaggacaaaaugaggaagauguguucauuguggacucuaaa

SEQ ID NO: 443698 - RNA, 64 nt, Homo Sapiens
uguuuugcguugugcacuacaucauuucucuccugaggaagaauuuuaaacauguacagcucau

SEQ ID NO: 443699 - RNA, 64 nt, Homo Sapiens
aggcuuuguuuuccaucagcgcuaccaugaccccgaggaagagcgcucagagaagccuaggugg

SEQ ID NO: 443700 - RNA, 64 nt, Homo Sapiens
auucccuuggguuuggaccccaaaaggccagguagaggaagaaugaccaggugaggugguggaa

SEQ ID NO: 443701 - RNA, 64 nt, Homo Sapiens
caauuuucuuuggaaucuaacaggaaucuagccugaggaagaagggaggucuccauuucuaugu

SEQ ID NO: 443702 - RNA, 64 nt, Homo Sapiens
uucuaccaaaaguaaaaaggguuguauuaagucagaggaagaugccucuccauuuucccucucu

SEQ ID NO: 443703 - RNA, 64 nt, Homo Sapiens
agucagugggcacaagacagagggucaggguggagaggaagauccagggaacaggaggaggaag

SEQ ID NO: 443704 - RNA, 64 nt, Homo Sapiens
gucaggguggagaggaagauucagggaacaggaggaggaagagguggaagagcugcuggcugca

SEQ ID NO: 443705 - RNA, 64 nt, Homo Sapiens
auauagagaugcauucacagggguuggcugggaggaggaagaccauucugugaccaaaauaccu

SEQ ID NO: 443706 - RNA, 64 nt, Homo Sapiens
aaagaaaggucgcagcaguagcuuuggggaaagggaggaagauauggcacuucuccaaccccgg

SEQ ID NO: 443707 - RNA, 64 nt, Homo Sapiens
ggugaggacagcaccagacugucugcuagaggcagaggaagaaguguggaggugcuggcauuca

SEQ ID NO: 443708 - RNA, 64 nt, Homo Sapiens
gcucagagccugacucugagcaacugaaucaagugaggaagaggaagggcagcacccccacuuu

SEQ ID NO: 443709 - RNA, 64 nt, Homo Sapiens
ugguggagccucagggccaguuagguccuggguggaggaagaagaaaaacaaaacacacguaca

SEQ ID NO: 443710 - RNA, 64 nt, Homo Sapiens
cuaaauugcaaagaucugcuuuggaauagcuguggaggaagaaccaguucaggaauuaagauac

SEQ ID NO: 443711 - RNA, 64 nt, Homo Sapiens
gcuuuuaacacaguucccugccuggauuagcaaagaggaagacaaugguuaagauugauggugg

SEQ ID NO: 443712 - RNA, 64 nt, Homo Sapiens
agaagugaccaugggcugggaggagguggaggaggaggaagaggagaaggaaaagugacgaaga

SEQ ID NO: 443713 - RNA, 64 nt, Homo Sapiens
gagcuuuuuugugaaacucagaucagccacccaggaggaagagcgggcugaggaaacccagagg

SEQ ID NO: 443714 - RNA, 64 nt, Homo Sapiens
gccaugucuucaaagucugauuugugaugaggcagaggaagauauuucuaaucggucuugccca

SEQ ID NO: 443715 - RNA, 64 nt, Homo Sapiens
accacccacucuccucugccucaguaaguaucuggaggaagaaaacaggugaaagaagaaguaa

SEQ ID NO: 443716 - RNA, 64 nt, Homo Sapiens
uucaauagaacaugcaagaacaugggcuaucagggaggaagaugaggaaggaaacauagaaaga

SEQ ID NO: 443717 - RNA, 64 nt, Homo Sapiens
cgcuaauucagcauguguucgaucccaagauggagaggaagaaauaaaaagcccuaugugaaaa

SEQ ID NO: 443718 - RNA, 64 nt, Homo Sapiens
uuuucuuguguuuuaagaauuaggagacauggaagaggaagaacaaaguccccucuguaguugg

SEQ ID NO: 443719 - RNA, 64 nt, Homo Sapiens
aguuguggggcauaagacaccgggaaugagggaggaggaagacaguuguguuuucucuuuaaac

SEQ ID NO: 443720 - RNA, 64 nt, Homo Sapiens
accccacccgugccugugagugaggugggugggagaggaagaaaguugggguucuccaggcuca

SEQ ID NO: 443721 - RNA, 64 nt, Homo Sapiens
gagauagugccauugcacuccggccugggcaacagaggaagacugccucaaacaaacaaaaaac

SEQ ID NO: 443722 - RNA, 64 nt, Homo Sapiens
gcugaugaguguggcuucccggcacuggguuggggaggaagagauccuggcucacuuugcaguu

SEQ ID NO: 443723 - RNA, 64 nt, Homo Sapiens
ggggugagcagguguauuaauacagcagguaguggaggaagaggaccagaaggaaggaaugggc

SEQ ID NO: 443724 - RNA, 64 nt, Homo Sapiens
agacaggacgaggcagaaaaccgggagugggguagaggaagacgaccaaguuggaauuccacgc

SEQ ID NO: 443725 - RNA, 64 nt, Homo Sapiens
gagacuguggagcucugggggauuaggggauggggaggaagagagaugggaaagggcgaacgag

SEQ ID NO: 443726 - RNA, 64 nt, Homo Sapiens
agcccagcucugggaacugaacaugagaaagggagaggaagagagagaaagggcagaggaagag

SEQ ID NO: 443727 - RNA, 64 nt, Homo Sapiens
caugagaaagggagaggaagauggagaaagggcagaggaagagaaggaagaggaagagugaggg

SEQ ID NO: 443728 - RNA, 64 nt, Homo Sapiens
agcagcagcaggauggugaagucucuauggugcugaggaagagcgcagcccagccagcagcaca

SEQ ID NO: 443729 - RNA, 64 nt, Homo Sapiens
augcggucagcagucucaggccaaccacauacacgaggaagaagcgaauugggugcacagcacc

SEQ ID NO: 443730 - RNA, 64 nt, Homo Sapiens
aaagaguagccggcuucagugccugccuuggggugaggaagacaccucugccccaguggauuag

SEQ ID NO: 443731 - RNA, 64 nt, Homo Sapiens
agaaggccuaaagaacagagcuaaggguuucccugaggaagaaauucugccugaggacagcagc

SEQ ID NO: 443732 - RNA, 64 nt, Homo Sapiens
gggccugccccugccagcaggugccagggcuggugaggaagagcuggggggcagagguaaagcc

SEQ ID NO: 443733 - RNA, 64 nt, Homo Sapiens
cacccugugaccacgauggugaccgugacugugggaggaagaacuggacccaggacggagcggg

SEQ ID NO: 443734 - RNA, 64 nt, Homo Sapiens
gggugcagccugccacaggcuccucauccggacugaggaagacgaggacagggaggaggaaaag

SEQ ID NO: 443735 - RNA, 64 nt, Homo Sapiens
gacugaggaagacgaggacagggaggaggaaaaggaggaagaggaggacaaaaagggggaggag

SEQ ID NO: 443736 - RNA, 64 nt, Homo Sapiens
aauuaaacauggagaaaccacgucagaggagggugaggaagacucccagacucaucugaaggau

SEQ ID NO: 443737 - RNA, 64 nt, Homo Sapiens
acccagacucaucugaaggaaaggaucuuugauggaggaagaagugaagaccuagacucaucug

SEQ ID NO: 443738 - RNA, 64 nt, Homo Sapiens
gauuuucuccaucaguucacgcccaaauggaauggaggaagauuccccacugaaugcuugccuu

SEQ ID NO: 443739 - RNA, 64 nt, Homo Sapiens
ccagauuuccuuaugcuuggaaagagcaggaccagaggaagaauuugaggaaguggaggcuggu

SEQ ID NO: 443740 - RNA, 64 nt, Homo Sapiens
uggauguguuauucuugcccucucuuuugaggcucucucauaaccccucuauuucuagagacaa

SEQ ID NO: 443741 - RNA, 64 nt, Homo Sapiens
uuuucugguuacuaauuagcuucaggauacgcugcucucauacuugggcuguaguuuggagaca

SEQ ID NO: 443742 - RNA, 64 nt, Homo Sapiens
caccuuggucauggauuagcgcccaggaaggaugcucucauaagaggaaggaugcucucauaag

SEQ ID NO: 443743 - RNA, 64 nt, Homo Sapiens
gcccaggaaggaugcucucagcccaggaaggaugcucucauaagccuuuucuggcaagagaagg

SEQ ID NO: 443744 - RNA, 64 nt, Homo Sapiens; identical to SEQ ID NO: 315595

SEQ ID NO: 443745 - RNA, 64 nt, Homo Sapiens; identical to SEQ ID NO: 315596

SEQ ID NO: 443746 - RNA, 64 nt, Homo Sapiens; identical to SEQ ID NO: 315597

SEQ ID NO: 443747 - RNA, 64 nt, Homo Sapiens; identical to SEQ ID NO: 315598

SEQ ID NO: 443748 - RNA, 64 nt, Homo Sapiens; identical to SEQ ID NO: 315599

SEQ ID NO: 443749 - RNA, 64 nt, Homo Sapiens; identical to SEQ ID NO: 315600

SEQ ID NO: 443750 - RNA, 64 nt, Homo Sapiens; identical to SEQ ID NO: 315601

SEQ ID NO: 443751 - RNA, 64 nt, Homo Sapiens; identical to SEQ ID NO: 315602

SEQ ID NO: 443752 - RNA, 64 nt, Homo Sapiens; identical to SEQ ID NO: 315603

SEQ ID NO: 443753 - RNA, 64 nt, Homo Sapiens; identical to SEQ ID NO: 315604

SEQ ID NO: 443754 - RNA, 64 nt, Homo Sapiens; identical to SEQ ID NO: 315605

SEQ ID NO: 443755 - RNA, 64 nt, Homo Sapiens; identical to SEQ ID NO: 315606

SEQ ID NO: 443756 - RNA, 64 nt, Homo Sapiens
uuuggcagcaauggugggccacccagggccucugaguagccacccaaagccuagccgcuguucu

SEQ ID NO: 443757 - RNA, 64 nt, Homo Sapiens
uggugcaagccacauauguaauuuuaaauauucuaguagccacauuaauaaaguaaaaagaaac

SEQ ID NO: 443758 - RNA, 64 nt, Homo Sapiens
gggugggggccugugggccagaggacuccaugacaguagccauggagucccaccugugccaggu

SEQ ID NO: 443759 - RNA, 64 nt, Homo Sapiens
aaguagcugccccucauucuggccaguucuuuccaguagccauggggcuggcuacaagaagcaa

SEQ ID NO: 443760 - RNA, 64 nt, Homo Sapiens
uccuuguuccagcugaaaacuagcaauaacaaaaaguagccauccacacacgcguguguuauug

SEQ ID NO: 443761 - RNA, 64 nt, Homo Sapiens
acaaagucuuuuuagggcaaugccaagugcugccaguagccaaaccaaacacauacauggauuu

SEQ ID NO: 443762 - RNA, 64 nt, Homo Sapiens
caaccccguggggaccgggggagagucgggggccaguagccagcccacauucgcugaagcgaug

SEQ ID NO: 443763 - RNA, 63 nt, Homo Sapiens
ugcauugcuuagauuugauugaaugcagggccgaguagccagcagaucuucuugaguugguga

SEQ ID NO: 443764 - RNA, 64 nt, Homo Sapiens
uacugugaaaaagggauguuagcauucauuagaguaugaggaugagucccaagaagguucuuug

SEQ ID NO: 443765 - RNA, 64 nt, Homo Sapiens
uuuaaacccacuacgcagggaugaggugcuauaauaugaggaccuuuuaacuuccaucauuuuc

SEQ ID NO: 443766 - RNA, 64 nt, Homo Sapiens
augucccugggccagggucugccuuaaugcuucauaugaggagguggcucacaguacagcaugu

SEQ ID NO: 443767 - RNA, 64 nt, Homo Sapiens
gguuuuggaucuugaaugugugacggcccucaucuaugaggaaacagggucauguuugcagggg

SEQ ID NO: 443768 - RNA, 64 nt, Homo Sapiens
augcaaguaagucaagccucgaaccaaaacguucuaugaggagcaguuaccucuucauagccau

SEQ ID NO: 443769 - RNA, 64 nt, Homo Sapiens
ugaaaaacuagggaccacaaaggcuuuuguccucuaugaggauguugaauugauggaucucuaa

SEQ ID NO: 443770 - RNA, 64 nt, Homo Sapiens
aucauagguuaccauuuuauugaagaucucauuauaugaggaaauaaaaagcucaaggacuuua

SEQ ID NO: 443771 - RNA, 64 nt, Homo Sapiens
ugagaucacaucuuugucacuucagucaaacauuuaugaggaaauucagugaaaauaauuuuau

SEQ ID NO: 443772 - RNA, 64 nt, Homo Sapiens
ccucgcuauagcaaaaauagaaauuaugauaauauaugaggagguucacuauuuaaacuaugau

SEQ ID NO: 443773 - RNA, 64 nt, Homo Sapiens
cauucugucuuucaaaagguaaguaagaaaacaauaugaggagaaggugcuuguuaugucuaga

SEQ ID NO: 443774 - RNA, 64 nt, Homo Sapiens
uuaguguuuucucagaaucagcaacucaagguacuaugaggauuuuucucacugacauaauuug

SEQ ID NO: 443775 - RNA, 64 nt, Homo Sapiens
auuugauuacauacuaaauaagaggauauguuaauaugaggaaauguaaauuaaauuaguuaua

SEQ ID NO: 443776 - RNA, 64 nt, Homo Sapiens
uaagauaauucauacuggaaggaaacccuacaaauaugaggaaugucucaaagcuuuuuacuga

SEQ ID NO: 443777 - RNA, 64 nt, Homo Sapiens
gucuauguaaauaccagaauuuauaguagaaauauaugaggaagcgacacuucgaauauucuac

SEQ ID NO: 443778 - RNA, 64 nt, Homo Sapiens
acuguucucucuguaccaugccuuuguggcccaggauaaucaacgugaacuacccagggcagcc

SEQ ID NO: 443779 - RNA, 64 nt, Homo Sapiens
accugccugucaccucagggagggcaggacuggggauaaucagaggggggagaggcugcuucga

SEQ ID NO: 443780 - RNA, 64 nt, Homo Sapiens
gucucaaccaaaauauuccuguuggaaucaugaugauaaucauagcagcacuuuucacagcauc

SEQ ID NO: 443781 - RNA, 64 nt, Homo Sapiens
agcaagaaaauauaaauacaguuaacugcauuaagauaaucacguuaaaauuguuacuaugcag

SEQ ID NO: 443782 - RNA, 64 nt, Homo Sapiens
uacugagugaagaaagacgguggacaagaaacaagauaaucaguuuauuuagguuaaauaucug

SEQ ID NO: 443783 - RNA, 64 nt, Homo Sapiens
uaucaguacaagugccgcauuuuaauaaaauugugauaaucagucaucuguuaaaugaugagca

SEQ ID NO: 443784 - RNA, 64 nt, Homo Sapiens
uagagacagacguauaauuuuuauggaauuacaugauaaucauauucggauuuauagaagcauu

SEQ ID NO: 443785 - RNA, 64 nt, Homo Sapiens
aagcauuuuacaaguauugcaaucauugaguagagauaaucaugguauuuucaucagcuuggua

SEQ ID NO: 443786 - RNA, 64 nt, Homo Sapiens
cacacaugcacgcacacacacauacacacaugcacgcacgcacgcaugcacaccaauuuauguu

SEQ ID NO: 443787 - RNA, 64 nt, Homo Sapiens
caugcacgcacacacacauacacacaugcacgcacgcacgcaugcacaccaauuuauguuuuua

SEQ ID NO: 443788 - RNA, 64 nt, Homo Sapiens
acgcaugcacagauaugcuguccggacacacacacgcacgcagauaugcugccuggacacacac

SEQ ID NO: 443789 - RNA, 64 nt, Homo Sapiens
gcacacacgugcagauaugcuguccggauacacacgcacgcacacaugcagauaugcugccugg

SEQ ID NO: 443790 - RNA, 64 nt, Homo Sapiens
cacccacgcgcacuuacacgaggcguggcacgcacgcacgcacccccaaagcuuaagucucugc

SEQ ID NO: 443791 - RNA, 64 nt, Homo Sapiens
cacccacccacgcgcacuuacugcaggcguggcacgcacgcacgguaucccaaagcuuaagucu

SEQ ID NO: 443792 - RNA, 64 nt, Homo Sapiens
gggagcuagaggguugugacccuucauacacacacgcacgcacgcacacaaacaugcacacacg

SEQ ID NO: 443793 - RNA, 64 nt, Homo Sapiens
gcuagaggguugugacccuucauacacacacgcacgcacgcacacaaacaugcacacacgcaug

SEQ ID NO: 443794 - RNA, 64 nt, Homo Sapiens
cucggggacuuugugcaugcgcccgccccacgcacgcacgcacaggcaggggggcggcgggugg

SEQ ID NO: 443795 - RNA, 64 nt, Homo Sapiens
cacacucggggacuuugugcgugggcccgccccacgcacgcacgcccgggcaggggggcggcgg

SEQ ID NO: 443796 - RNA, 64 nt, Homo Sapiens
cacgcagacaggucgauuugcccaggcccgcgcccgcacgcacgcacgcacacggccccgcaca

SEQ ID NO: 443797 - RNA, 64 nt, Homo Sapiens
cagacaggucgauuugcccaggcccgcgcccgcacgcacgcacgcacacggccccgcacacagc

SEQ ID NO: 443798 - RNA, 64 nt, Homo Sapiens
caggucgauuugcccaggcccgcgcccgcacgcacgcacgcacacggccccgcacacagccccg

SEQ ID NO: 443799 - RNA, 64 nt, Homo Sapiens; identical to SEQ ID NO: 98228

SEQ ID NO: 443800 - RNA, 64 nt, Homo Sapiens; identical to SEQ ID NO: 98229

SEQ ID NO: 443801 - RNA, 64 nt, Homo Sapiens; identical to SEQ ID NO: 98230

SEQ ID NO: 443802 - RNA, 64 nt, Homo Sapiens; identical to SEQ ID NO: 98231

SEQ ID NO: 443803 - RNA, 64 nt, Homo Sapiens; identical to SEQ ID NO: 98232

SEQ ID NO: 443804 - RNA, 64 nt, Homo Sapiens; identical to SEQ ID NO: 98233

SEQ ID NO: 443805 - RNA, 64 nt, Homo Sapiens; identical to SEQ ID NO: 98234

SEQ ID NO: 443806 - RNA, 64 nt, Homo Sapiens; identical to SEQ ID NO: 98235

SEQ ID NO: 443807 - RNA, 64 nt, Homo Sapiens; identical to SEQ ID NO: 98236

SEQ ID NO: 443808 - RNA, 64 nt, Homo Sapiens; identical to SEQ ID NO: 98237

SEQ ID NO: 443809 - RNA, 64 nt, Homo Sapiens; identical to SEQ ID NO: 98238

SEQ ID NO: 443810 - RNA, 64 nt, Homo Sapiens; identical to SEQ ID NO: 98239

SEQ ID NO: 443811 - RNA, 64 nt, Homo Sapiens; identical to SEQ ID NO: 98240

SEQ ID NO: 443812 - RNA, 64 nt, Homo Sapiens; identical to SEQ ID NO: 98241

SEQ ID NO: 443813 - RNA, 64 nt, Homo Sapiens; identical to SEQ ID NO: 98242

SEQ ID NO: 443814 - RNA, 64 nt, Homo Sapiens; identical to SEQ ID NO: 98243

SEQ ID NO: 443815 - RNA, 64 nt, Homo Sapiens; identical to SEQ ID NO: 98244

SEQ ID NO: 443816 - RNA, 64 nt, Homo Sapiens; identical to SEQ ID NO: 98245

SEQ ID NO: 443817 - RNA, 64 nt, Homo Sapiens; identical to SEQ ID NO: 98246

SEQ ID NO: 443818 - RNA, 64 nt, Homo Sapiens; identical to SEQ ID NO: 98247

SEQ ID NO: 443819 - RNA, 64 nt, Homo Sapiens; identical to SEQ ID NO: 98248

SEQ ID NO: 443820 - RNA, 64 nt, Homo Sapiens; identical to SEQ ID NO: 98249

SEQ ID NO: 443821 - RNA, 64 nt, Homo Sapiens; identical to SEQ ID NO: 98250

SEQ ID NO: 443822 - RNA, 64 nt, Homo Sapiens; identical to SEQ ID NO: 98251

SEQ ID NO: 443823 - RNA, 64 nt, Homo Sapiens; identical to SEQ ID NO: 98252

SEQ ID NO: 443824 - RNA, 64 nt, Homo Sapiens; identical to SEQ ID NO: 98253

SEQ ID NO: 443825 - RNA, 64 nt, Homo Sapiens; identical to SEQ ID NO: 98254

SEQ ID NO: 443826 - RNA, 64 nt, Homo Sapiens; identical to SEQ ID NO: 98255

SEQ ID NO: 443827 - RNA, 64 nt, Homo Sapiens; identical to SEQ ID NO: 98256

SEQ ID NO: 443828 - RNA, 64 nt, Homo Sapiens; identical to SEQ ID NO: 98257

SEQ ID NO: 443829 - RNA, 64 nt, Homo Sapiens; identical to SEQ ID NO: 98258

SEQ ID NO: 443830 - RNA, 64 nt, Homo Sapiens; identical to SEQ ID NO: 98259

SEQ ID NO: 443831 - RNA, 64 nt, Homo Sapiens; identical to SEQ ID NO: 98260

SEQ ID NO: 443832 - RNA, 64 nt, Homo Sapiens; identical to SEQ ID NO: 98261

SEQ ID NO: 443833 - RNA, 64 nt, Homo Sapiens; identical to SEQ ID NO: 98262

SEQ ID NO: 443834 - RNA, 64 nt, Homo Sapiens; identical to SEQ ID NO: 98263

SEQ ID NO: 443835 - RNA, 64 nt, Homo Sapiens; identical to SEQ ID NO: 98264

SEQ ID NO: 443836 - RNA, 64 nt, Homo Sapiens; identical to SEQ ID NO: 189531

SEQ ID NO: 443837 - RNA, 64 nt, Homo Sapiens; identical to SEQ ID NO: 189532

SEQ ID NO: 443838 - RNA, 64 nt, Homo Sapiens; identical to SEQ ID NO: 189533

SEQ ID NO: 443839 - RNA, 64 nt, Homo Sapiens; identical to SEQ ID NO: 189534

SEQ ID NO: 443840 - RNA, 64 nt, Homo Sapiens; identical to SEQ ID NO: 189535

SEQ ID NO: 443841 - RNA, 64 nt, Homo Sapiens; identical to SEQ ID NO: 189536

SEQ ID NO: 443842 - RNA, 64 nt, Homo Sapiens; identical to SEQ ID NO: 189537

SEQ ID NO: 443843 - RNA, 64 nt, Homo Sapiens; identical to SEQ ID NO: 189538

SEQ ID NO: 443844 - RNA, 64 nt, Homo Sapiens; identical to SEQ ID NO: 189539

SEQ ID NO: 443845 - RNA, 64 nt, Homo Sapiens; identical to SEQ ID NO: 189540

SEQ ID NO: 443846 - RNA, 64 nt, Homo Sapiens; identical to SEQ ID NO: 189541

SEQ ID NO: 443847 - RNA, 64 nt, Homo Sapiens; identical to SEQ ID NO: 189542

SEQ ID NO: 443848 - RNA, 64 nt, Homo Sapiens; identical to SEQ ID NO: 189543

SEQ ID NO: 443849 - RNA, 64 nt, Homo Sapiens; identical to SEQ ID NO: 189544

SEQ ID NO: 443850 - RNA, 64 nt, Homo Sapiens; identical to SEQ ID NO: 189545

SEQ ID NO: 443851 - RNA, 64 nt, Homo Sapiens; identical to SEQ ID NO: 189546

SEQ ID NO: 443852 - RNA, 64 nt, Homo Sapiens; identical to SEQ ID NO: 189547

SEQ ID NO: 443853 - RNA, 64 nt, Homo Sapiens; identical to SEQ ID NO: 189548

SEQ ID NO: 443854 - RNA, 64 nt, Homo Sapiens; identical to SEQ ID NO: 189549

SEQ ID NO: 443855 - RNA, 64 nt, Homo Sapiens; identical to SEQ ID NO: 189550

SEQ ID NO: 443856 - RNA, 64 nt, Homo Sapiens; identical to SEQ ID NO: 189551

SEQ ID NO: 443857 - RNA, 64 nt, Homo Sapiens; identical to SEQ ID NO: 189552

SEQ ID NO: 443858 - RNA, 64 nt, Homo Sapiens; identical to SEQ ID NO: 189553

SEQ ID NO: 443859 - RNA, 64 nt, Homo Sapiens; identical to SEQ ID NO: 189554

SEQ ID NO: 443860 - RNA, 64 nt, Homo Sapiens; identical to SEQ ID NO: 189555

SEQ ID NO: 443861 - RNA, 64 nt, Homo Sapiens; identical to SEQ ID NO: 189556

SEQ ID NO: 443862 - RNA, 64 nt, Homo Sapiens; identical to SEQ ID NO: 189557

SEQ ID NO: 443863 - RNA, 64 nt, Homo Sapiens; identical to SEQ ID NO: 189558

SEQ ID NO: 443864 - RNA, 64 nt, Homo Sapiens; identical to SEQ ID NO: 189559

SEQ ID NO: 443865 - RNA, 53 nt, Homo Sapiens; identical to SEQ ID NO: 189560

SEQ ID NO: 443866 - RNA, 64 nt, Homo Sapiens; identical to SEQ ID NO: 189561

SEQ ID NO: 443867 - RNA, 64 nt, Homo Sapiens; identical to SEQ ID NO: 189562

SEQ ID NO: 443868 - RNA, 63 nt, Homo Sapiens; identical to SEQ ID NO: 189563

SEQ ID NO: 443869 - RNA, 64 nt, Homo Sapiens; identical to SEQ ID NO: 189564

SEQ ID NO: 443870 - RNA, 64 nt, Homo Sapiens; identical to SEQ ID NO: 189565

SEQ ID NO: 443871 - RNA, 64 nt, Homo Sapiens; identical to SEQ ID NO: 189566

SEQ ID NO: 443872 - RNA, 64 nt, Homo Sapiens; identical to SEQ ID NO: 189567

SEQ ID NO: 443873 - RNA, 64 nt, Homo Sapiens; identical to SEQ ID NO: 189568

SEQ ID NO: 443874 - RNA, 64 nt, Homo Sapiens; identical to SEQ ID NO: 189569

SEQ ID NO: 443875 - RNA, 64 nt, Homo Sapiens; identical to SEQ ID NO: 189570

SEQ ID NO: 443876 - RNA, 64 nt, Homo Sapiens; identical to SEQ ID NO: 189571

SEQ ID NO: 443877 - RNA, 64 nt, Homo Sapiens; identical to SEQ ID NO: 189572

SEQ ID NO: 443878 - RNA, 64 nt, Homo Sapiens; identical to SEQ ID NO: 189573

SEQ ID NO: 443879 - RNA, 64 nt, Homo Sapiens; identical to SEQ ID NO: 189574

SEQ ID NO: 443880 - RNA, 64 nt, Homo Sapiens; identical to SEQ ID NO: 189575

SEQ ID NO: 443881 - RNA, 64 nt, Homo Sapiens; identical to SEQ ID NO: 189576

SEQ ID NO: 443882 - RNA, 64 nt, Homo Sapiens; identical to SEQ ID NO: 189577

SEQ ID NO: 443883 - RNA, 64 nt, Homo Sapiens; identical to SEQ ID NO: 189578

SEQ ID NO: 443884 - RNA, 64 nt, Homo Sapiens; identical to SEQ ID NO: 189579

SEQ ID NO: 443885 - RNA, 64 nt, Homo Sapiens; identical to SEQ ID NO: 189580

SEQ ID NO: 443886 - RNA, 64 nt, Homo Sapiens; identical to SEQ ID NO: 189581

SEQ ID NO: 443887 - RNA, 64 nt, Homo Sapiens; identical to SEQ ID NO: 189582

SEQ ID NO: 443888 - RNA, 64 nt, Homo Sapiens; identical to SEQ ID NO: 189583

SEQ ID NO: 443889 - RNA, 64 nt, Homo Sapiens; identical to SEQ ID NO: 189584

SEQ ID NO: 443890 - RNA, 64 nt, Homo Sapiens; identical to SEQ ID NO: 189585

SEQ ID NO: 443891 - RNA, 64 nt, Homo Sapiens; identical to SEQ ID NO: 189586

SEQ ID NO: 443892 - RNA, 64 nt, Homo Sapiens; identical to SEQ ID NO: 189587

SEQ ID NO: 443893 - RNA, 64 nt, Homo Sapiens; identical to SEQ ID NO: 189588

SEQ ID NO: 443894 - RNA, 64 nt, Homo Sapiens; identical to SEQ ID NO: 189589

SEQ ID NO: 443895 - RNA, 64 nt, Homo Sapiens; identical to SEQ ID NO: 189590

SEQ ID NO: 443896 - RNA, 64 nt, Homo Sapiens; identical to SEQ ID NO: 189591

SEQ ID NO: 443897 - RNA, 64 nt, Homo Sapiens; identical to SEQ ID NO: 189592

SEQ ID NO: 443898 - RNA, 64 nt, Homo Sapiens; identical to SEQ ID NO: 189593

SEQ ID NO: 443899 - RNA, 64 nt, Homo Sapiens; identical to SEQ ID NO: 189594

SEQ ID NO: 443900 - RNA, 64 nt, Homo Sapiens; identical to SEQ ID NO: 189595

SEQ ID NO: 443901 - RNA, 64 nt, Homo Sapiens; identical to SEQ ID NO: 189596

SEQ ID NO: 443902 - RNA, 64 nt, Homo Sapiens; identical to SEQ ID NO: 189597

SEQ ID NO: 443903 - RNA, 64 nt, Homo Sapiens; identical to SEQ ID NO: 189598

SEQ ID NO: 443904 - RNA, 62 nt, Homo Sapiens
uuucuuuccacacaggauuccguuggugaaccuguaaaaacaaaacaaacaaaacaaaacaa

SEQ ID NO: 443905 - RNA, 62 nt, Homo Sapiens
cagagcaggacgcucuaggccaaaucuauuuuuguaaaaaugcucaugccuaugggugacug

SEQ ID NO: 443906 - RNA, 62 nt, Homo Sapiens
uuuauugagauugaauuaugccaccacguuuauguaaaaaugaagguggcaccguggugaga

SEQ ID NO: 443907 - RNA, 62 nt, Homo Sapiens
uggugagaccuaaugagaaauaguuacucaguuguaaaaauuuugauuuauucucuuucuuc

SEQ ID NO: 443908 - RNA, 62 nt, Homo Sapiens
uuugucaucuguuagacucuguaugugugauuuguaaaaagcaggcugaaacuauggacaug

SEQ ID NO: 443909 - RNA, 62 nt, Homo Sapiens
ugaaccccuaggcuucaggaaaacugcucuuuuguaaaaagaauagcgaugacauuuucuaa

SEQ ID NO: 443910 - RNA, 62 nt, Homo Sapiens
auuugcacuguucagacauauauauguauguauguaaaaauuauauauacacaaauuagcug

SEQ ID NO: 443911 - RNA, 62 nt, Homo Sapiens
cuaaagagacuuggcaccagcuuuguucaaacuguaaaaauagcaauuugccccuacucgcu

SEQ ID NO: 443912 - RNA, 62 nt, Homo Sapiens
ccuuuuaaguuacugacaucagcuuccaccaguguaaaaauugaguaaaaccugaaguuuug

SEQ ID NO: 443913 - RNA, 62 nt, Homo Sapiens
uagauauauuccaagccgccugacgaucuaauuguaaaaaguaaagcauacaaauacuagaa

SEQ ID NO: 443914 - RNA, 62 nt, Homo Sapiens
gacaacuuuagauucugaggucaagacuugauuguaaaaauugcaagacagaaauaagagaa

SEQ ID NO: 443915 - RNA, 62 nt, Homo Sapiens
gauguuucauccucugauugcuuuucaugacguguaaaaaauagcguccuauaauccuagac

SEQ ID NO: 443916 - RNA, 62 nt, Homo Sapiens
ggagauuucagaagacgggcgguaggcacagguguaaaaagguuguaaaaaggggagauuuc

SEQ ID NO: 443917 - RNA, 62 nt, Homo Sapiens
ggagauuucgguaggcacagaguaggcacaguuguaaaaaggacuuggaauaucagcagagu

SEQ ID NO: 443918 - RNA, 62 nt, Homo Sapiens
aaaaaaaaaaaaaggcaaaguuguaaaacuuauguaaaaaaacacuguaaaaauguauuauc

SEQ ID NO: 443919 - RNA, 62 nt, Homo Sapiens
uauuaucuuguaaaacuuauacaucaggucacuguaaaaaugcaaguugcaaaguuguaucc

SEQ ID NO: 443920 - RNA, 62 nt, Homo Sapiens
gaaaaaaugaagaaaaauguauuuucccuuuauguaaaaauuagugaauaucuuaugaauua

SEQ ID NO: 443921 - RNA, 62 nt, Homo Sapiens
ggaacuugagagcuuuuacugugauucuucaauguaaaaaauaaacaacaaugucaaacugu

SEQ ID NO: 443922 - RNA, 62 nt, Homo Sapiens
auauauacaaguguaugauguuuuuaccucuguguaaaaaauugauuuuuuuauaauaagcc

SEQ ID NO: 443923 - RNA, 62 nt, Homo Sapiens
cuuccaaugccuaagugucuaacaaggccauauguaaaaaccucauuuauacuuggggaaaa

SEQ ID NO: 443924 - RNA, 62 nt, Homo Sapiens
aaauaaguuauaacuguuauguauuuaaauauuguaaaaagaauagcuggcgagugcuuucu

SEQ ID NO: 443925 - RNA, 62 nt, Homo Sapiens
aacagcaaacaaaaaggugaaaaggaaucuaguguaaaaaacucauuaucuuuaaugaagac

SEQ ID NO: 443926 - RNA, 62 nt, Homo Sapiens
gcaguaaauauuuacuauuuaaaugucuuucauguaaaaaguccaacaacaauguguuguaa

SEQ ID NO: 443927 - RNA, 62 nt, Homo Sapiens
ucuuucauguaaaaagugcaacaacaauguguuguaaaaauguuguguugcagccucaacca

SEQ ID NO: 443928 - RNA, 62 nt, Homo Sapiens
agaucuagaguuuagagacacucaaguguggcuguaaaaaucguuuaaguuuacgucauugu

SEQ ID NO: 443929 - RNA, 62 nt, Homo Sapiens
uuauuugaaaucuccuaaguaaacaugagcgauguaaaaacugcucagauugucgaguuagu

SEQ ID NO: 443930 - RNA, 62 nt, Homo Sapiens
uaaaagaccauaagcaaacugguuauuuaaaauguaaaaaggaauaugaaagucuuauuaaa

SEQ ID NO: 443931 - RNA, 62 nt, Homo Sapiens
aaaggcauugauauuuuagaugcacccguguuuguaaaaauguagagcacaauggaauuaug

SEQ ID NO: 443932 - RNA, 62 nt, Homo Sapiens
uuaguguauuagagaaguuuccagagaugucauguaaaaaagauuucuuccauuaacugcuu

SEQ ID NO: 443933 - RNA, 62 nt, Homo Sapiens
guugaguucuguuuaaagaauuuuuuuaaaauuguaaaaauugcuauuuuugagggauguau

SEQ ID NO: 443934 - RNA, 62 nt, Homo Sapiens
ugcaugggauauuugauuaccaccugaucaaauguaaaaacaugaguccuugugauuaggcc

SEQ ID NO: 443935 - RNA, 62 nt, Homo Sapiens
gggcugcauucuuguugguauucugccuaacuuguaaaaaggcagcaagacuuuauaauucc

SEQ ID NO: 443936 - RNA, 62 nt, Homo Sapiens
aggggaaauacuuuaauuuuuuuucuuaauaguguaaaaauucccugagcuaagcuaaaacc

SEQ ID NO: 443937 - RNA, 62 nt, Homo Sapiens
ucuucaaacacucuuaaauuuuucuuaaguaauguaaaaauggaacugccaauuuuauuucu

SEQ ID NO: 443938 - RNA, 62 nt, Homo Sapiens
ucuuauucauuaaaugaauucaacauuuucucuguaaaaacaauagaguuucaguacaugaa

SEQ ID NO: 443939 - RNA, 62 nt, Homo Sapiens
aauguacauaaauguuacauuuguaaagaaaauguaaaaauguaacuauagcauaugaauug

SEQ ID NO: 443940 - RNA, 62 nt, Homo Sapiens
uacuacauuugaaauuauuuuacaaaauuuccuguaaaaaaaccaguaccuauuuuuacucu

SEQ ID NO: 443941 - RNA, 62 nt, Homo Sapiens
uuuguuuauauagaccuaucaauaagaucauuuguaaaaaugaggauaccuggagcacaagg

SEQ ID NO: 443942 - RNA, 62 nt, Homo Sapiens
aguauauauacauaucuuuuugugauguuacuuguaaaaaaacaugugaagaugugaucauu

SEQ ID NO: 443943 - RNA, 62 nt, Homo Sapiens
acuguagcuuauauucuuuaucuguguuauuuuguaaaaauaauuaacacaguauucauuca

SEQ ID NO: 443944 - RNA, 62 nt, Homo Sapiens
ucuucuucugagaaugugacuuuuucugguguuguaaaaaagaaaaaaaaaagaaugcucau

SEQ ID NO: 443945 - RNA, 62 nt, Homo Sapiens
guuguaaaaaagaaaaaaaaaagaaugcucauuguaaaaauaaaaaaauaauaauaagcaag

SEQ ID NO: 443946 - RNA, 62 nt, Homo Sapiens
gggaauuucuuuuccuacgggguacgugauuuuguaaaaaggaaguauuucucccaaaauug

SEQ ID NO: 443947 - RNA, 62 nt, Homo Sapiens
ugcuaguuuaaaaaagaaaauauguaauauaauguaaaaaaaaacaaaaaaaagcuuuuaug

SEQ ID NO: 443948 - RNA, 62 nt, Homo Sapiens
gaaaacguuugauuauuuucucaguguauuuuuguaaaaaauauauaaaggggguguuaauc

SEQ ID NO: 443949 - RNA, 62 nt, Homo Sapiens
ugccaccaguguccacccuccggcccccgucuuguaaaaaggggaggagaauuagccaaaca

SEQ ID NO: 443950 - RNA, 62 nt, Homo Sapiens
acgucucacuugaaauugcuuuguauacauuuuguaaaaauauuuauaaaauguuuuguaaa

SEQ ID NO: 443951 - RNA, 62 nt, Homo Sapiens
auacauuuuguaaaaauauuuauaaaauguuuuguaaaaaaaaaaaaacuauaacaaauugc

SEQ ID NO: 443952 - RNA, 62 nt, Homo Sapiens
cugauaaaacucagaauuucuuuuuaagcaguuguaaaaauugucauguuguaauucauuac

SEQ ID NO: 443953 - RNA, 62 nt, Homo Sapiens
ugaaccucaugcaugaaagcagcacauuaaauuguaaaaauacaaacagaucgugugaucau

SEQ ID NO: 443954 - RNA, 62 nt, Homo Sapiens
uaauuaaagaaaugcauguggugagaaaucuauguaaaaaaacccaugaagcaagaauagau

SEQ ID NO: 443955 - RNA, 62 nt, Homo Sapiens
uccuuaugucugaugcugucccaaauggccaguguaaaaauggagugaauagauccuaaguc

SEQ ID NO: 443956 - RNA, 62 nt, Homo Sapiens
auuguuuuuggauauaaagcguauuauguauuuguaaaaaccgacuuuuugagcaccuuuca

SEQ ID NO: 443957 - RNA, 62 nt, Homo Sapiens
uuuaugguaacugguuucuuuacauuuaucuuuguaaaaagauuaaaaguaguaagccacau

SEQ ID NO: 443958 - RNA, 62 nt, Homo Sapiens
ucaccauggcuuucauccaaggguacagcuuuuguaaaaaugaggacguugaguggauuccu

SEQ ID NO: 443959 - RNA, 62 nt, Homo Sapiens
guuuccuuagaagucauaaauuuauuauuuauuguaaaaaaacugcaaaucccaaaucuuuc

SEQ ID NO: 443960 - RNA, 62 nt, Homo Sapiens
agaguauuuauacuggaaagaaacccuacaaauguaaaaaacguggcaaugccuuuaacugg

SEQ ID NO: 443961 - RNA, 62 nt, Homo Sapiens
uaagaauccauacugaagaaaacuccuggaaguguaaaaaauguggcaacacuuuuaauaaa

SEQ ID NO: 443962 - RNA, 62 nt, Homo Sapiens
agcccuauggaauuugcaaucugugauugccuuguaaaaaggagagugcauauggcacugca

SEQ ID NO: 443963 - RNA, 62 nt, Homo Sapiens
uagaaaauauaugaaccaaagugauuugaguuuguaaaaauguaaaauaguaugaacaaaau

SEQ ID NO: 443964 - RNA, 62 nt, Homo Sapiens
aaaaguuugcuuguuuaaaaugacaguugugauguaaaaaguuuaagaaauaugaaugugag

SEQ ID NO: 443965 - RNA, 62 nt, Homo Sapiens
acuuuuuuaaagcugaguaguuaagaauucccuguaaaaacaaaacccuguaaauugagccu

SEQ ID NO: 443966 - RNA, 62 nt, Homo Sapiens
aaagcaaguguaauuaauucaaguacuguuaauguaaaaaauauuagagaacugugauuuaa

SEQ ID NO: 443967 - RNA, 62 nt, Homo Sapiens
ggaaauggugcaugucauugaaggugguuuauuguaaaaacaacuuccaaaaacaagggaac

SEQ ID NO: 443968 - RNA, 62 nt, Homo Sapiens
cauuguagauaauugaauguguuuuccccguuuguaaaaagaaugugccuguaaaccaagga

SEQ ID NO: 443969 - RNA, 62 nt, Homo Sapiens
aacggcuucucugauauuuaagcagacgaugcuguaaaaacuccuggucaacuuagcuuuua

SEQ ID NO: 443970 - RNA, 62 nt, Homo Sapiens
gccuauuuauauauguugaauacaauuucaaauguaaaaacaaaaaguugugcaugggcuua

SEQ ID NO: 443971 - RNA, 62 nt, Homo Sapiens
caauuuaaauuuuaauacaguaaaaaacaacuuguaaaaaugaauguaaauagaacacuaau

SEQ ID NO: 443972 - RNA, 62 nt, Homo Sapiens
aaauauuuuuuaauuuaauggucaguauauuuuguaaaaaucauguuaauuuauuucauagu

SEQ ID NO: 443973 - RNA, 62 nt, Homo Sapiens
ucugagcagcauuuugguauuuaaacauuucuuguaaaaagcugagacaguuuguaagaaaa

SEQ ID NO: 443974 - RNA, 62 nt, Homo Sapiens
uuagaggcuuaccccuguaauguacauuuuuuuguaaaaaguauauauccaaagauauagug

SEQ ID NO: 443975 - RNA, 62 nt, Homo Sapiens
aaaguguaaaauauguauauuauuuguuaaauuguaaaaaaaagaggauguauuuauauaau

SEQ ID NO: 443976 - RNA, 62 nt, Homo Sapiens
auucuuaguuugugggccuuaaagaaaaaagauguaaaaaccaagacucccucucaaaagaa

SEQ ID NO: 443977 - RNA, 62 nt, Homo Sapiens
accugacuuaguaaugcgaaaccauuuaaaaauguaaaaacgguauuuauaugaccuuugua

SEQ ID NO: 443978 - RNA, 62 nt, Homo Sapiens
uaaauauacuauugcacuaaaaccaaaauuacuguaaaaaaaccuuaaaucucuuguauggc

SEQ ID NO: 443979 - RNA, 62 nt, Homo Sapiens
gugguuuggccauuaauuuguauuuuagaaaauguaaaaaugggccugcugaggcugcccca

SEQ ID NO: 443980 - RNA, 62 nt, Homo Sapiens
aaaaaucucaguuauguuuucuuuauguacaguguaaaaaaaccugugaaugccaaaguaaa

SEQ ID NO: 443981 - RNA, 62 nt, Homo Sapiens
uuaaagaauaaaaauacuucaaaaaauuaaaauguaaaaaaaaaauuaaguucugaaaauug

SEQ ID NO: 443982 - RNA, 62 nt, Homo Sapiens
uguauuauacaucuguauuucagcuucuugcuuguaaaaauaguaaaaaaaagucuuaacaa

SEQ ID NO: 443983 - RNA, 62 nt, Homo Sapiens
agucuuaacaacagcuucuuauaaacucuaaguguaaaaaaauuccuuccugccccaaaauu

SEQ ID NO: 443984 - RNA, 62 nt, Homo Sapiens
uuucuaagaauguuuuucuauaaauuacuaauuguaaaaagucuugcuuuuuaaaacaaguu

SEQ ID NO: 443985 - RNA, 62 nt, Homo Sapiens
cuccuugaggauagggauagguaagguaaacuuguaaaaaggaugucacagaagucacuuuu

SEQ ID NO: 443986 - RNA, 62 nt, Homo Sapiens
guaaagaggaugcugccuuaagaauugcauguuguaaaaaaucuuuuuggaaaauacagacu

SEQ ID NO: 443987 - RNA, 62 nt, Homo Sapiens
uauuuaucaaaauuaugugagguuccaaaauauguaaaaaugauaauaauaaaaaaagauua

SEQ ID NO: 443988 - RNA, 62 nt, Homo Sapiens
aaguaguucagcaucuaucgaagaacaaaaacuguaaaaagggacuuauugagguaaauuaa

SEQ ID NO: 443989 - RNA, 62 nt, Homo Sapiens
uuuaauaauuggguggagaaccccaccgagcuuguaaaaaacuugucucagggaaaaucuuc

SEQ ID NO: 443990 - RNA, 62 nt, Homo Sapiens
auacacaaaaaucagauuuaguaacuaaagguuguaaaaaauuguaaaacugguuguacaau

SEQ ID NO: 443991 - RNA, 62 nt, Homo Sapiens
caauagaugucucacacagaacaauacaaauauguaaaaaaucuuucaccacauauucuugc

SEQ ID NO: 443992 - RNA, 62 nt, Homo Sapiens
uugcugguuuauaccuauguucauuuauaugcuguaaaaaaguaguagcuucuucuacaaug

SEQ ID NO: 443993 - RNA, 62 nt, Homo Sapiens
augcuguaaaaaaguaguagcuucuucuacaauguaaaaauaaauguacauacaaaaaaaug

SEQ ID NO: 443994 - RNA, 62 nt, Homo Sapiens
aaaauuuaaaguuaaaugauauauuuuugagauguaaaaaaaaagcucuaauuauugcagac

SEQ ID NO: 443995 - RNA, 62 nt, Homo Sapiens
uuaaaaagcuguuuccaagucaucuucuuuacuguaaaaauaauuuucauuaugccccauca

SEQ ID NO: 443996 - RNA, 62 nt, Homo Sapiens
gggaggaggcaaggucugcuaucaggaguuacuguaaaaacaagaacuggaagcucguguuu

SEQ ID NO: 443997 - RNA, 62 nt, Homo Sapiens
uuguugcuuggcuuuuaaagaugguguauguuuguaaaaauauucuucugggcucaaaagcu

SEQ ID NO: 443998 - RNA, 62 nt, Homo Sapiens
ucgggcuuuaauuugcuaaagcugugcacauauguaaaaaaaaaaaaaaaaagauuauuuua

SEQ ID NO: 443999 - RNA, 62 nt, Homo Sapiens
aagaugauaaagcauuugaaugguacaguagauguaaaaaaaauucaguuuaaaagaacauu

SEQ ID NO: 444000 - RNA, 62 nt, Homo Sapiens
uuuucuccuauacuugggcuacauuuuuugauuguaaaaauauuugauggccuuuugaugaa

SEQ ID NO: 444001 - RNA, 62 nt, Homo Sapiens
caccuaugcaauauggcuuaucuauauuuauuuguaaaaauccaagcauaguuuaaaauaug

SEQ ID NO: 444002 - RNA, 62 nt, Homo Sapiens
aaaaaugaaaguuaugacauuagcuuuaaagguguaaaaaagauguuucacuaauguaacgg

SEQ ID NO: 444003 - RNA, 62 nt, Homo Sapiens
uaauaaaaauguuaauuuuggaagugcaguuuuguaaaaaccuuuuucagucaaacaguaaa

SEQ ID NO: 444004 - RNA, 62 nt, Homo Sapiens
aaaaaaaaaaaaaagacaaagugauaaaaaacuguaaaaaaacgacagaguccauguuggag

SEQ ID NO: 444005 - RNA, 62 nt, Homo Sapiens
gaaaaagaccucguggagaaaaacucuauuuuuguaaaaaggggggggugggaggggaagaa

SEQ ID NO: 444006 - RNA, 62 nt, Homo Sapiens
gugggaaaacauacauuacuaaacaguaugaauguaaaaaauaaaggaugcacacugcaaag

SEQ ID NO: 444007 - RNA, 62 nt, Homo Sapiens
guggaaaagcauuuagauacaaacccuuugaguguaaaaaauaaaguacucacacuggagau

SEQ ID NO: 444008 - RNA, 62 nt, Homo Sapiens
gugggaaaguguucguauauaaacccuaugaauguaaaaaauaaagaacucacacuggagaa

SEQ ID NO: 444009 - RNA, 62 nt, Homo Sapiens
guagaaaauccuuuauugauaaaccguaucaguguaaaaaauagagaauucacacuagugag

SEQ ID NO: 444010 - RNA, 62 nt, Homo Sapiens
cuuuucuuuguuauucaacagaauguaaagauuguaaaaaagacacuggugacaaacccuau

SEQ ID NO: 444011 - RNA, 62 nt, Homo Sapiens
auguuguaaauauuuggcaauuuaagacauuguguaaaaagcaaucuguaaaaacaucucca

SEQ ID NO: 444012 - RNA, 62 nt, Homo Sapiens
uggcaauuuaagacauuguguaaaaagcaaucuguaaaaacaucuccaggcuuugauuuuug

SEQ ID NO: 444013 - RNA, 62 nt, Homo Sapiens
gaagaaaguggcagguuuucucgaaacugcauuguaaaaagauuuacucuaccaauguuaug

SEQ ID NO: 444014 - RNA, 62 nt, Homo Sapiens
gcaccuggaguuucaaaacaaguuuuaaucauuguaaaaaaaguuuuuaaaaauuauauucc

SEQ ID NO: 444015 - RNA, 62 nt, Homo Sapiens
uugacaucuuuuuuuuuaaugaaauauaugcauguaaaaacuguaggucuucagcauaagcu

SEQ ID NO: 444016 - RNA, 62 nt, Homo Sapiens
acauuuaauuauaaacaauaauugaccugcaguguaaaaagcauuuacuaaccaguuuuuau

SEQ ID NO: 444017 - RNA, 62 nt, Homo Sapiens
aaaaaaauauauauauauauggaauaacauuuuguaaaaaaaccaccaaaaugauccagucu

SEQ ID NO: 444018 - RNA, 62 nt, Homo Sapiens
agaauugucaaccaauuucuuuaauugaacauuguaaaaaacaggaauaaguacuuuugugu

SEQ ID NO: 444019 - RNA, 62 nt, Homo Sapiens
aaugcacaguaaauaugugaauuuuuccuagauguaaaaaaaaaaaucuuucauauaaagac

SEQ ID NO: 444020 - RNA, 62 nt, Homo Sapiens
aaaaaaagccaagauuucauaccaaacauuuguguaaaaaaaaucacuaguguggcuaaaua

SEQ ID NO: 444021 - RNA, 62 nt, Homo Sapiens
aaaauacuuguugaaaagccuucauagcaacuuguaaaaaauauauauauauaaauuuuaau

SEQ ID NO: 444022 - RNA, 62 nt, Homo Sapiens
gaauaacuguaugcagguuugaauuguauagguguaaaaaggauaaaaacauugcuuuuguu

SEQ ID NO: 444023 - RNA, 62 nt, Homo Sapiens
ucccuaauugauuauauaguucuucauuugucuguaaaaauucuguaaagcuacuuguguuc

SEQ ID NO: 444024 - RNA, 64 nt, Homo Sapiens; identical to SEQ ID NO: 55166

SEQ ID NO: 444025 - RNA, 64 nt, Homo Sapiens; identical to SEQ ID NO: 55167

SEQ ID NO: 444026 - RNA, 64 nt, Homo Sapiens; identical to SEQ ID NO: 55168

SEQ ID NO: 444027 - RNA, 64 nt, Homo Sapiens; identical to SEQ ID NO: 55169

SEQ ID NO: 444028 - RNA, 64 nt, Homo Sapiens; identical to SEQ ID NO: 55170

SEQ ID NO: 444029 - RNA, 64 nt, Homo Sapiens; identical to SEQ ID NO: 55171

SEQ ID NO: 444030 - RNA, 64 nt, Homo Sapiens; identical to SEQ ID NO: 55172

SEQ ID NO: 444031 - RNA, 64 nt, Homo Sapiens; identical to SEQ ID NO: 55173

SEQ ID NO: 444032 - RNA, 64 nt, Homo Sapiens; identical to SEQ ID NO: 55174

SEQ ID NO: 444033 - RNA, 64 nt, Homo Sapiens; identical to SEQ ID NO: 55175

SEQ ID NO: 444034 - RNA, 64 nt, Homo Sapiens; identical to SEQ ID NO: 55176

SEQ ID NO: 444035 - RNA, 64 nt, Homo Sapiens; identical to SEQ ID NO: 55177

SEQ ID NO: 444036 - RNA, 64 nt, Homo Sapiens; identical to SEQ ID NO: 345901

SEQ ID NO: 444037 - RNA, 64 nt, Homo Sapiens; identical to SEQ ID NO: 345902

SEQ ID NO: 444038 - RNA, 64 nt, Homo Sapiens; identical to SEQ ID NO: 345903

SEQ ID NO: 444039 - RNA, 64 nt, Homo Sapiens; identical to SEQ ID NO: 345904

SEQ ID NO: 444040 - RNA, 64 nt, Homo Sapiens; identical to SEQ ID NO: 345905

SEQ ID NO: 444041 - RNA, 64 nt, Homo Sapiens; identical to SEQ ID NO: 345906

SEQ ID NO: 444042 - RNA, 64 nt, Homo Sapiens; identical to SEQ ID NO: 345907

SEQ ID NO: 444043 - RNA, 64 nt, Homo Sapiens; identical to SEQ ID NO: 345908

SEQ ID NO: 444044 - RNA, 64 nt, Homo Sapiens; identical to SEQ ID NO: 345909

SEQ ID NO: 444045 - RNA, 64 nt, Homo Sapiens; identical to SEQ ID NO: 345910

SEQ ID NO: 444046 - RNA, 64 nt, Homo Sapiens; identical to SEQ ID NO: 345911

SEQ ID NO: 444047 - RNA, 64 nt, Homo Sapiens; identical to SEQ ID NO: 345912

SEQ ID NO: 444048 - RNA, 64 nt, Homo Sapiens; identical to SEQ ID NO: 345913

SEQ ID NO: 444049 - RNA, 64 nt, Homo Sapiens; identical to SEQ ID NO: 345914

SEQ ID NO: 444050 - RNA, 64 nt, Homo Sapiens; identical to SEQ ID NO: 345915

SEQ ID NO: 444051 - RNA, 64 nt, Homo Sapiens; identical to SEQ ID NO: 345916

SEQ ID NO: 444052 - RNA, 64 nt, Homo Sapiens; identical to SEQ ID NO: 345917

SEQ ID NO: 444053 - RNA, 64 nt, Homo Sapiens; identical to SEQ ID NO: 345918

SEQ ID NO: 444054 - RNA, 64 nt, Homo Sapiens; identical to SEQ ID NO: 345919

SEQ ID NO: 444055 - RNA, 64 nt, Homo Sapiens; identical to SEQ ID NO: 345920

SEQ ID NO: 444056 - RNA, 64 nt, Homo Sapiens; identical to SEQ ID NO: 345921

SEQ ID NO: 444057 - RNA, 64 nt, Homo Sapiens; identical to SEQ ID NO: 345922

SEQ ID NO: 444058 - RNA, 64 nt, Homo Sapiens; identical to SEQ ID NO: 345923

SEQ ID NO: 444059 - RNA, 64 nt, Homo Sapiens; identical to SEQ ID NO: 345924

SEQ ID NO: 444060 - RNA, 64 nt, Homo Sapiens; identical to SEQ ID NO: 345925

SEQ ID NO: 444061 - RNA, 64 nt, Homo Sapiens; identical to SEQ ID NO: 345926

SEQ ID NO: 444062 - RNA, 64 nt, Homo Sapiens; identical to SEQ ID NO: 345927

SEQ ID NO: 444063 - RNA, 64 nt, Homo Sapiens; identical to SEQ ID NO: 345928

SEQ ID NO: 444064 - RNA, 64 nt, Homo Sapiens; identical to SEQ ID NO: 345929

SEQ ID NO: 444065 - RNA, 64 nt, Homo Sapiens; identical to SEQ ID NO: 345930

SEQ ID NO: 444066 - RNA, 64 nt, Homo Sapiens; identical to SEQ ID NO: 345931

SEQ ID NO: 444067 - RNA, 64 nt, Homo Sapiens; identical to SEQ ID NO: 345932

SEQ ID NO: 444068 - RNA, 64 nt, Homo Sapiens; identical to SEQ ID NO: 345933

SEQ ID NO: 444069 - RNA, 64 nt, Homo Sapiens; identical to SEQ ID NO: 345934

SEQ ID NO: 444070 - RNA, 64 nt, Homo Sapiens; identical to SEQ ID NO: 345935

SEQ ID NO: 444071 - RNA, 64 nt, Homo Sapiens; identical to SEQ ID NO: 345936

SEQ ID NO: 444072 - RNA, 64 nt, Homo Sapiens; identical to SEQ ID NO: 345937

SEQ ID NO: 444073 - RNA, 64 nt, Homo Sapiens; identical to SEQ ID NO: 345938

SEQ ID NO: 444074 - RNA, 64 nt, Homo Sapiens; identical to SEQ ID NO: 345939

SEQ ID NO: 444075 - RNA, 64 nt, Homo Sapiens; identical to SEQ ID NO: 345940

SEQ ID NO: 444076 - RNA, 64 nt, Homo Sapiens; identical to SEQ ID NO: 345941

SEQ ID NO: 444077 - RNA, 64 nt, Homo Sapiens; identical to SEQ ID NO: 345942

SEQ ID NO: 444078 - RNA, 64 nt, Homo Sapiens; identical to SEQ ID NO: 345943

SEQ ID NO: 444079 - RNA, 64 nt, Homo Sapiens; identical to SEQ ID NO: 345944

SEQ ID NO: 444080 - RNA, 64 nt, Homo Sapiens; identical to SEQ ID NO: 345945

SEQ ID NO: 444081 - RNA, 64 nt, Homo Sapiens; identical to SEQ ID NO: 345946

SEQ ID NO: 444082 - RNA, 64 nt, Homo Sapiens; identical to SEQ ID NO: 345947

SEQ ID NO: 444083 - RNA, 64 nt, Homo Sapiens; identical to SEQ ID NO: 345948

SEQ ID NO: 444084 - RNA, 64 nt, Homo Sapiens; identical to SEQ ID NO: 345949

SEQ ID NO: 444085 - RNA, 64 nt, Homo Sapiens; identical to SEQ ID NO: 345950

SEQ ID NO: 444086 - RNA, 64 nt, Homo Sapiens; identical to SEQ ID NO: 345951

SEQ ID NO: 444087 - RNA, 64 nt, Homo Sapiens; identical to SEQ ID NO: 345952

SEQ ID NO: 444088 - RNA, 64 nt, Homo Sapiens; identical to SEQ ID NO: 345953

SEQ ID NO: 444089 - RNA, 64 nt, Homo Sapiens; identical to SEQ ID NO: 345954

SEQ ID NO: 444090 - RNA, 64 nt, Homo Sapiens; identical to SEQ ID NO: 345955

SEQ ID NO: 444091 - RNA, 64 nt, Homo Sapiens; identical to SEQ ID NO: 345956

SEQ ID NO: 444092 - RNA, 64 nt, Homo Sapiens; identical to SEQ ID NO: 345957

SEQ ID NO: 444093 - RNA, 64 nt, Homo Sapiens; identical to SEQ ID NO: 345958

SEQ ID NO: 444094 - RNA, 64 nt, Homo Sapiens; identical to SEQ ID NO: 345959

SEQ ID NO: 444095 - RNA, 64 nt, Homo Sapiens; identical to SEQ ID NO: 345960

SEQ ID NO: 444096 - RNA, 64 nt, Homo Sapiens; identical to SEQ ID NO: 345961

SEQ ID NO: 444097 - RNA, 64 nt, Homo Sapiens; identical to SEQ ID NO: 345962

SEQ ID NO: 444098 - RNA, 64 nt, Homo Sapiens; identical to SEQ ID NO: 345963

SEQ ID NO: 444099 - RNA, 64 nt, Homo Sapiens; identical to SEQ ID NO: 345964

SEQ ID NO: 444100 - RNA, 64 nt, Homo Sapiens; identical to SEQ ID NO: 345965

SEQ ID NO: 444101 - RNA, 64 nt, Homo Sapiens; identical to SEQ ID NO: 345966

SEQ ID NO: 444102 - RNA, 64 nt, Homo Sapiens; identical to SEQ ID NO: 345967

SEQ ID NO: 444103 - RNA, 50 nt, Homo Sapiens; identical to SEQ ID NO: 345968

SEQ ID NO: 444104 - RNA, 64 nt, Homo Sapiens; identical to SEQ ID NO: 345969

SEQ ID NO: 444105 - RNA, 64 nt, Homo Sapiens; identical to SEQ ID NO: 345970

SEQ ID NO: 444106 - RNA, 64 nt, Homo Sapiens; identical to SEQ ID NO: 345971

SEQ ID NO: 444107 - RNA, 64 nt, Homo Sapiens; identical to SEQ ID NO: 345972

SEQ ID NO: 444108 - RNA, 64 nt, Homo Sapiens; identical to SEQ ID NO: 345973

SEQ ID NO: 444109 - RNA, 64 nt, Homo Sapiens; identical to SEQ ID NO: 345974

SEQ ID NO: 444110 - RNA, 64 nt, Homo Sapiens; identical to SEQ ID NO: 345975

SEQ ID NO: 444111 - RNA, 64 nt, Homo Sapiens; identical to SEQ ID NO: 345976

SEQ ID NO: 444112 - RNA, 64 nt, Homo Sapiens; identical to SEQ ID NO: 345977

SEQ ID NO: 444113 - RNA, 64 nt, Homo Sapiens; identical to SEQ ID NO: 345978

SEQ ID NO: 444114 - RNA, 64 nt, Homo Sapiens; identical to SEQ ID NO: 345979

SEQ ID NO: 444115 - RNA, 64 nt, Homo Sapiens; identical to SEQ ID NO: 345980

SEQ ID NO: 444116 - RNA, 64 nt, Homo Sapiens; identical to SEQ ID NO: 345981

SEQ ID NO: 444117 - RNA, 64 nt, Homo Sapiens; identical to SEQ ID NO: 345982

SEQ ID NO: 444118 - RNA, 64 nt, Homo Sapiens; identical to SEQ ID NO: 345983

SEQ ID NO: 444119 - RNA, 64 nt, Homo Sapiens; identical to SEQ ID NO: 345984

SEQ ID NO: 444120 - RNA, 64 nt, Homo Sapiens; identical to SEQ ID NO: 345985

SEQ ID NO: 444121 - RNA, 64 nt, Homo Sapiens; identical to SEQ ID NO: 345986

SEQ ID NO: 444122 - RNA, 64 nt, Homo Sapiens; identical to SEQ ID NO: 345987

SEQ ID NO: 444123 - RNA, 64 nt, Homo Sapiens; identical to SEQ ID NO: 345988

SEQ ID NO: 444124 - RNA, 64 nt, Homo Sapiens; identical to SEQ ID NO: 345989

SEQ ID NO: 444125 - RNA, 64 nt, Homo Sapiens; identical to SEQ ID NO: 345990

SEQ ID NO: 444126 - RNA, 64 nt, Homo Sapiens; identical to SEQ ID NO: 345991

SEQ ID NO: 444127 - RNA, 64 nt, Homo Sapiens; identical to SEQ ID NO: 345992

SEQ ID NO: 444128 - RNA, 51 nt, Homo Sapiens; identical to SEQ ID NO: 345993

SEQ ID NO: 444129 - RNA, 64 nt, Homo Sapiens; identical to SEQ ID NO: 345994

SEQ ID NO: 444130 - RNA, 64 nt, Homo Sapiens; identical to SEQ ID NO: 345995

SEQ ID NO: 444131 - RNA, 64 nt, Homo Sapiens; identical to SEQ ID NO: 345996

SEQ ID NO: 444132 - RNA, 64 nt, Homo Sapiens; identical to SEQ ID NO: 345997

SEQ ID NO: 444133 - RNA, 64 nt, Homo Sapiens; identical to SEQ ID NO: 345998

SEQ ID NO: 444134 - RNA, 64 nt, Homo Sapiens; identical to SEQ ID NO: 345999

SEQ ID NO: 444135 - RNA, 64 nt, Homo Sapiens; identical to SEQ ID NO: 346000

SEQ ID NO: 444136 - RNA, 64 nt, Homo Sapiens; identical to SEQ ID NO: 346001

SEQ ID NO: 444137 - RNA, 64 nt, Homo Sapiens; identical to SEQ ID NO: 346002

SEQ ID NO: 444138 - RNA, 64 nt, Homo Sapiens; identical to SEQ ID NO: 346003

SEQ ID NO: 444139 - RNA, 64 nt, Homo Sapiens; identical to SEQ ID NO: 346004

SEQ ID NO: 444140 - RNA, 64 nt, Homo Sapiens; identical to SEQ ID NO: 346005

SEQ ID NO: 444141 - RNA, 64 nt, Homo Sapiens; identical to SEQ ID NO: 346006

SEQ ID NO: 444142 - RNA, 64 nt, Homo Sapiens; identical to SEQ ID NO: 346007

SEQ ID NO: 444143 - RNA, 64 nt, Homo Sapiens; identical to SEQ ID NO: 346008

SEQ ID NO: 444144 - RNA, 64 nt, Homo Sapiens; identical to SEQ ID NO: 346009

SEQ ID NO: 444145 - RNA, 64 nt, Homo Sapiens; identical to SEQ ID NO: 346010

SEQ ID NO: 444146 - RNA, 64 nt, Homo Sapiens; identical to SEQ ID NO: 346011

SEQ ID NO: 444147 - RNA, 64 nt, Homo Sapiens; identical to SEQ ID NO: 346012

SEQ ID NO: 444148 - RNA, 64 nt, Homo Sapiens; identical to SEQ ID NO: 346013

SEQ ID NO: 444149 - RNA, 64 nt, Homo Sapiens; identical to SEQ ID NO: 346014

SEQ ID NO: 444150 - RNA, 64 nt, Homo Sapiens; identical to SEQ ID NO: 346015

SEQ ID NO: 444151 - RNA, 64 nt, Homo Sapiens; identical to SEQ ID NO: 346016

SEQ ID NO: 444152 - RNA, 64 nt, Homo Sapiens; identical to SEQ ID NO: 346017

SEQ ID NO: 444153 - RNA, 64 nt, Homo Sapiens; identical to SEQ ID NO: 346018

SEQ ID NO: 444154 - RNA, 64 nt, Homo Sapiens; identical to SEQ ID NO: 346019

SEQ ID NO: 444155 - RNA, 64 nt, Homo Sapiens; identical to SEQ ID NO: 346020

SEQ ID NO: 444156 - RNA, 64 nt, Homo Sapiens; identical to SEQ ID NO: 346021

SEQ ID NO: 444157 - RNA, 64 nt, Homo Sapiens; identical to SEQ ID NO: 346022

SEQ ID NO: 444158 - RNA, 64 nt, Homo Sapiens; identical to SEQ ID NO: 346023

SEQ ID NO: 444159 - RNA, 64 nt, Homo Sapiens; identical to SEQ ID NO: 346024

SEQ ID NO: 444160 - RNA, 64 nt, Homo Sapiens; identical to SEQ ID NO: 346025

SEQ ID NO: 444161 - RNA, 64 nt, Homo Sapiens; identical to SEQ ID NO: 346026

SEQ ID NO: 444162 - RNA, 64 nt, Homo Sapiens; identical to SEQ ID NO: 346027

SEQ ID NO: 444163 - RNA, 64 nt, Homo Sapiens; identical to SEQ ID NO: 346028

SEQ ID NO: 444164 - RNA, 64 nt, Homo Sapiens; identical to SEQ ID NO: 346029

SEQ ID NO: 444165 - RNA, 64 nt, Homo Sapiens; identical to SEQ ID NO: 346030

SEQ ID NO: 444166 - RNA, 64 nt, Homo Sapiens; identical to SEQ ID NO: 346031

SEQ ID NO: 444167 - RNA, 64 nt, Homo Sapiens; identical to SEQ ID NO: 346032

SEQ ID NO: 444168 - RNA, 64 nt, Homo Sapiens; identical to SEQ ID NO: 346033

SEQ ID NO: 444169 - RNA, 64 nt, Homo Sapiens; identical to SEQ ID NO: 346034

SEQ ID NO: 444170 - RNA, 64 nt, Homo Sapiens; identical to SEQ ID NO: 346035

SEQ ID NO: 444171 - RNA, 64 nt, Homo Sapiens; identical to SEQ ID NO: 346036

SEQ ID NO: 444172 - RNA, 64 nt, Homo Sapiens; identical to SEQ ID NO: 346037

SEQ ID NO: 444173 - RNA, 64 nt, Homo Sapiens; identical to SEQ ID NO: 346038

SEQ ID NO: 444174 - RNA, 64 nt, Homo Sapiens; identical to SEQ ID NO: 346039

SEQ ID NO: 444175 - RNA, 64 nt, Homo Sapiens; identical to SEQ ID NO: 346040

SEQ ID NO: 444176 - RNA, 64 nt, Homo Sapiens; identical to SEQ ID NO: 346041

SEQ ID NO: 444177 - RNA, 64 nt, Homo Sapiens; identical to SEQ ID NO: 346042

SEQ ID NO: 444178 - RNA, 64 nt, Homo Sapiens; identical to SEQ ID NO: 346043

SEQ ID NO: 444179 - RNA, 64 nt, Homo Sapiens; identical to SEQ ID NO: 346044

SEQ ID NO: 444180 - RNA, 64 nt, Homo Sapiens; identical to SEQ ID NO: 346045

SEQ ID NO: 444181 - RNA, 64 nt, Homo Sapiens; identical to SEQ ID NO: 346046

SEQ ID NO: 444182 - RNA, 64 nt, Homo Sapiens; identical to SEQ ID NO: 346047

SEQ ID NO: 444183 - RNA, 64 nt, Homo Sapiens; identical to SEQ ID NO: 346048

SEQ ID NO: 444184 - RNA, 64 nt, Homo Sapiens; identical to SEQ ID NO: 346049

SEQ ID NO: 444185 - RNA, 64 nt, Homo Sapiens; identical to SEQ ID NO: 346050

SEQ ID NO: 444186 - RNA, 64 nt, Homo Sapiens; identical to SEQ ID NO: 346051

SEQ ID NO: 444187 - RNA, 64 nt, Homo Sapiens; identical to SEQ ID NO: 346052

SEQ ID NO: 444188 - RNA, 64 nt, Homo Sapiens; identical to SEQ ID NO: 346053

SEQ ID NO: 444189 - RNA, 64 nt, Homo Sapiens; identical to SEQ ID NO: 346054

SEQ ID NO: 444190 - RNA, 64 nt, Homo Sapiens; identical to SEQ ID NO: 346055

SEQ ID NO: 444191 - RNA, 64 nt, Homo Sapiens; identical to SEQ ID NO: 346056

SEQ ID NO: 444192 - RNA, 64 nt, Homo Sapiens; identical to SEQ ID NO: 346057

SEQ ID NO: 444193 - RNA, 64 nt, Homo Sapiens; identical to SEQ ID NO: 346058

SEQ ID NO: 444194 - RNA, 64 nt, Homo Sapiens; identical to SEQ ID NO: 346059

SEQ ID NO: 444195 - RNA, 64 nt, Homo Sapiens; identical to SEQ ID NO: 346060

SEQ ID NO: 444196 - RNA, 64 nt, Homo Sapiens; identical to SEQ ID NO: 346061

SEQ ID NO: 444197 - RNA, 64 nt, Homo Sapiens; identical to SEQ ID NO: 346062

SEQ ID NO: 444198 - RNA, 64 nt, Homo Sapiens; identical to SEQ ID NO: 346063

SEQ ID NO: 444199 - RNA, 64 nt, Homo Sapiens; identical to SEQ ID NO: 346064

SEQ ID NO: 444200 - RNA, 64 nt, Homo Sapiens; identical to SEQ ID NO: 346065

SEQ ID NO: 444201 - RNA, 64 nt, Homo Sapiens; identical to SEQ ID NO: 346066

SEQ ID NO: 444202 - RNA, 64 nt, Homo Sapiens; identical to SEQ ID NO: 346067

SEQ ID NO: 444203 - RNA, 64 nt, Homo Sapiens; identical to SEQ ID NO: 346068

SEQ ID NO: 444204 - RNA, 64 nt, Homo Sapiens; identical to SEQ ID NO: 346069

SEQ ID NO: 444205 - RNA, 64 nt, Homo Sapiens; identical to SEQ ID NO: 346070

SEQ ID NO: 444206 - RNA, 64 nt, Homo Sapiens; identical to SEQ ID NO: 346071

SEQ ID NO: 444207 - RNA, 64 nt, Homo Sapiens; identical to SEQ ID NO: 346072

SEQ ID NO: 444208 - RNA, 64 nt, Homo Sapiens; identical to SEQ ID NO: 346073

SEQ ID NO: 444209 - RNA, 64 nt, Homo Sapiens; identical to SEQ ID NO: 346074

SEQ ID NO: 444210 - RNA, 64 nt, Homo Sapiens; identical to SEQ ID NO: 346075

SEQ ID NO: 444211 - RNA, 64 nt, Homo Sapiens; identical to SEQ ID NO: 346076

SEQ ID NO: 444212 - RNA, 64 nt, Homo Sapiens; identical to SEQ ID NO: 346077

SEQ ID NO: 444213 - RNA, 64 nt, Homo Sapiens; identical to SEQ ID NO: 346078

SEQ ID NO: 444214 - RNA, 64 nt, Homo Sapiens; identical to SEQ ID NO: 346079

SEQ ID NO: 444215 - RNA, 64 nt, Homo Sapiens; identical to SEQ ID NO: 346080

SEQ ID NO: 444216 - RNA, 64 nt, Homo Sapiens; identical to SEQ ID NO: 346081

SEQ ID NO: 444217 - RNA, 64 nt, Homo Sapiens; identical to SEQ ID NO: 346082

SEQ ID NO: 444218 - RNA, 64 nt, Homo Sapiens; identical to SEQ ID NO: 346083

SEQ ID NO: 444219 - RNA, 64 nt, Homo Sapiens; identical to SEQ ID NO: 346084

SEQ ID NO: 444220 - RNA, 64 nt, Homo Sapiens; identical to SEQ ID NO: 346085

SEQ ID NO: 444221 - RNA, 64 nt, Homo Sapiens; identical to SEQ ID NO: 346086

SEQ ID NO: 444222 - RNA, 64 nt, Homo Sapiens; identical to SEQ ID NO: 346087

SEQ ID NO: 444223 - RNA, 64 nt, Homo Sapiens; identical to SEQ ID NO: 346088

SEQ ID NO: 444224 - RNA, 64 nt, Homo Sapiens; identical to SEQ ID NO: 346089

SEQ ID NO: 444225 - RNA, 64 nt, Homo Sapiens; identical to SEQ ID NO: 346090

SEQ ID NO: 444226 - RNA, 64 nt, Homo Sapiens; identical to SEQ ID NO: 346091

SEQ ID NO: 444227 - RNA, 64 nt, Homo Sapiens; identical to SEQ ID NO: 346092

SEQ ID NO: 444228 - RNA, 64 nt, Homo Sapiens; identical to SEQ ID NO: 346093

SEQ ID NO: 444229 - RNA, 64 nt, Homo Sapiens; identical to SEQ ID NO: 346094

SEQ ID NO: 444230 - RNA, 64 nt, Homo Sapiens; identical to SEQ ID NO: 346095

SEQ ID NO: 444231 - RNA, 59 nt, Homo Sapiens; identical to SEQ ID NO: 346096

SEQ ID NO: 444232 - RNA, 64 nt, Homo Sapiens; identical to SEQ ID NO: 346097

SEQ ID NO: 444233 - RNA, 64 nt, Homo Sapiens; identical to SEQ ID NO: 346098

SEQ ID NO: 444234 - RNA, 64 nt, Homo Sapiens; identical to SEQ ID NO: 346099

SEQ ID NO: 444235 - RNA, 64 nt, Homo Sapiens; identical to SEQ ID NO: 346100

SEQ ID NO: 444236 - RNA, 64 nt, Homo Sapiens; identical to SEQ ID NO: 346101

SEQ ID NO: 444237 - RNA, 64 nt, Homo Sapiens; identical to SEQ ID NO: 346102

SEQ ID NO: 444238 - RNA, 64 nt, Homo Sapiens; identical to SEQ ID NO: 346103

SEQ ID NO: 444239 - RNA, 64 nt, Homo Sapiens; identical to SEQ ID NO: 346104

SEQ ID NO: 444240 - RNA, 64 nt, Homo Sapiens; identical to SEQ ID NO: 346105

SEQ ID NO: 444241 - RNA, 64 nt, Homo Sapiens; identical to SEQ ID NO: 346106

SEQ ID NO: 444242 - RNA, 64 nt, Homo Sapiens; identical to SEQ ID NO: 346107

SEQ ID NO: 444243 - RNA, 64 nt, Homo Sapiens; identical to SEQ ID NO: 346108

SEQ ID NO: 444244 - RNA, 64 nt, Homo Sapiens; identical to SEQ ID NO: 346109

SEQ ID NO: 444245 - RNA, 64 nt, Homo Sapiens; identical to SEQ ID NO: 346110

SEQ ID NO: 444246 - RNA, 64 nt, Homo Sapiens; identical to SEQ ID NO: 346111

SEQ ID NO: 444247 - RNA, 64 nt, Homo Sapiens; identical to SEQ ID NO: 346112

SEQ ID NO: 444248 - RNA, 64 nt, Homo Sapiens; identical to SEQ ID NO: 346113

SEQ ID NO: 444249 - RNA, 64 nt, Homo Sapiens; identical to SEQ ID NO: 346114

SEQ ID NO: 444250 - RNA, 64 nt, Homo Sapiens; identical to SEQ ID NO: 346115

SEQ ID NO: 444251 - RNA, 64 nt, Homo Sapiens; identical to SEQ ID NO: 346116

SEQ ID NO: 444252 - RNA, 64 nt, Homo Sapiens; identical to SEQ ID NO: 218520

SEQ ID NO: 444253 - RNA, 64 nt, Homo Sapiens; identical to SEQ ID NO: 218521

SEQ ID NO: 444254 - RNA, 64 nt, Homo Sapiens; identical to SEQ ID NO: 218522

SEQ ID NO: 444255 - RNA, 64 nt, Homo Sapiens; identical to SEQ ID NO: 218523

SEQ ID NO: 444256 - RNA, 64 nt, Homo Sapiens; identical to SEQ ID NO: 218524

SEQ ID NO: 444257 - RNA, 64 nt, Homo Sapiens; identical to SEQ ID NO: 218525

SEQ ID NO: 444258 - RNA, 64 nt, Homo Sapiens; identical to SEQ ID NO: 218526

SEQ ID NO: 444259 - RNA, 64 nt, Homo Sapiens; identical to SEQ ID NO: 218527

SEQ ID NO: 444260 - RNA, 64 nt, Homo Sapiens; identical to SEQ ID NO: 218528

SEQ ID NO: 444261 - RNA, 64 nt, Homo Sapiens; identical to SEQ ID NO: 218529

SEQ ID NO: 444262 - RNA, 64 nt, Homo Sapiens; identical to SEQ ID NO: 218530

SEQ ID NO: 444263 - RNA, 64 nt, Homo Sapiens; identical to SEQ ID NO: 218531

SEQ ID NO: 444264 - RNA, 64 nt, Homo Sapiens; identical to SEQ ID NO: 218532

SEQ ID NO: 444265 - RNA, 64 nt, Homo Sapiens; identical to SEQ ID NO: 218533

SEQ ID NO: 444266 - RNA, 64 nt, Homo Sapiens; identical to SEQ ID NO: 218534

SEQ ID NO: 444267 - RNA, 64 nt, Homo Sapiens; identical to SEQ ID NO: 218535

SEQ ID NO: 444268 - RNA, 64 nt, Homo Sapiens; identical to SEQ ID NO: 218536

SEQ ID NO: 444269 - RNA, 64 nt, Homo Sapiens; identical to SEQ ID NO: 218537

SEQ ID NO: 444270 - RNA, 64 nt, Homo Sapiens; identical to SEQ ID NO: 218538

SEQ ID NO: 444271 - RNA, 61 nt, Homo Sapiens; identical to SEQ ID NO: 218539

SEQ ID NO: 444272 - RNA, 64 nt, Homo Sapiens; identical to SEQ ID NO: 218540

SEQ ID NO: 444273 - RNA, 64 nt, Homo Sapiens; identical to SEQ ID NO: 218541

SEQ ID NO: 444274 - RNA, 64 nt, Homo Sapiens; identical to SEQ ID NO: 218542

SEQ ID NO: 444275 - RNA, 64 nt, Homo Sapiens; identical to SEQ ID NO: 218543

SEQ ID NO: 444276 - RNA, 64 nt, Homo Sapiens; identical to SEQ ID NO: 218544

SEQ ID NO: 444277 - RNA, 64 nt, Homo Sapiens; identical to SEQ ID NO: 218545

SEQ ID NO: 444278 - RNA, 64 nt, Homo Sapiens; identical to SEQ ID NO: 218546

SEQ ID NO: 444279 - RNA, 64 nt, Homo Sapiens; identical to SEQ ID NO: 218547

SEQ ID NO: 444280 - RNA, 64 nt, Homo Sapiens; identical to SEQ ID NO: 218548

SEQ ID NO: 444281 - RNA, 64 nt, Homo Sapiens; identical to SEQ ID NO: 218549

SEQ ID NO: 444282 - RNA, 64 nt, Homo Sapiens; identical to SEQ ID NO: 218550

SEQ ID NO: 444283 - RNA, 64 nt, Homo Sapiens; identical to SEQ ID NO: 218551

SEQ ID NO: 444284 - RNA, 64 nt, Homo Sapiens; identical to SEQ ID NO: 218552

SEQ ID NO: 444285 - RNA, 64 nt, Homo Sapiens; identical to SEQ ID NO: 218553

SEQ ID NO: 444286 - RNA, 63 nt, Homo Sapiens; identical to SEQ ID NO: 218554

SEQ ID NO: 444287 - RNA, 64 nt, Homo Sapiens; identical to SEQ ID NO: 218555

SEQ ID NO: 444288 - RNA, 64 nt, Homo Sapiens; identical to SEQ ID NO: 218556

SEQ ID NO: 444289 - RNA, 64 nt, Homo Sapiens; identical to SEQ ID NO: 218557

SEQ ID NO: 444290 - RNA, 64 nt, Homo Sapiens; identical to SEQ ID NO: 218558

SEQ ID NO: 444291 - RNA, 64 nt, Homo Sapiens; identical to SEQ ID NO: 218559

SEQ ID NO: 444292 - RNA, 64 nt, Homo Sapiens; identical to SEQ ID NO: 218560

SEQ ID NO: 444293 - RNA, 64 nt, Homo Sapiens; identical to SEQ ID NO: 218561

SEQ ID NO: 444294 - RNA, 64 nt, Homo Sapiens; identical to SEQ ID NO: 218562

SEQ ID NO: 444295 - RNA, 64 nt, Homo Sapiens; identical to SEQ ID NO: 218563

SEQ ID NO: 444296 - RNA, 64 nt, Homo Sapiens; identical to SEQ ID NO: 218564

SEQ ID NO: 444297 - RNA, 64 nt, Homo Sapiens; identical to SEQ ID NO: 218565

SEQ ID NO: 444298 - RNA, 64 nt, Homo Sapiens; identical to SEQ ID NO: 218566

SEQ ID NO: 444299 - RNA, 64 nt, Homo Sapiens; identical to SEQ ID NO: 218567

SEQ ID NO: 444300 - RNA, 64 nt, Homo Sapiens; identical to SEQ ID NO: 218568

SEQ ID NO: 444301 - RNA, 64 nt, Homo Sapiens; identical to SEQ ID NO: 218569

SEQ ID NO: 444302 - RNA, 64 nt, Homo Sapiens; identical to SEQ ID NO: 218570

SEQ ID NO: 444303 - RNA, 64 nt, Homo Sapiens; identical to SEQ ID NO: 218571

SEQ ID NO: 444304 - RNA, 64 nt, Homo Sapiens; identical to SEQ ID NO: 218572

SEQ ID NO: 444305 - RNA, 64 nt, Homo Sapiens; identical to SEQ ID NO: 218573

SEQ ID NO: 444306 - RNA, 64 nt, Homo Sapiens; identical to SEQ ID NO: 218574

SEQ ID NO: 444307 - RNA, 64 nt, Homo Sapiens; identical to SEQ ID NO: 218575

SEQ ID NO: 444308 - RNA, 64 nt, Homo Sapiens; identical to SEQ ID NO: 218576

SEQ ID NO: 444309 - RNA, 64 nt, Homo Sapiens; identical to SEQ ID NO: 218577

SEQ ID NO: 444310 - RNA, 64 nt, Homo Sapiens; identical to SEQ ID NO: 218578

SEQ ID NO: 444311 - RNA, 64 nt, Homo Sapiens; identical to SEQ ID NO: 218579

SEQ ID NO: 444312 - RNA, 64 nt, Homo Sapiens; identical to SEQ ID NO: 218580

SEQ ID NO: 444313 - RNA, 64 nt, Homo Sapiens; identical to SEQ ID NO: 218581

SEQ ID NO: 444314 - RNA, 64 nt, Homo Sapiens; identical to SEQ ID NO: 218582

SEQ ID NO: 444315 - RNA, 64 nt, Homo Sapiens; identical to SEQ ID NO: 218583

SEQ ID NO: 444316 - RNA, 64 nt, Homo Sapiens; identical to SEQ ID NO: 218584

SEQ ID NO: 444317 - RNA, 64 nt, Homo Sapiens; identical to SEQ ID NO: 218585

SEQ ID NO: 444318 - RNA, 64 nt, Homo Sapiens; identical to SEQ ID NO: 218586

SEQ ID NO: 444319 - RNA, 64 nt, Homo Sapiens; identical to SEQ ID NO: 218587

SEQ ID NO: 444320 - RNA, 64 nt, Homo Sapiens; identical to SEQ ID NO: 218588

SEQ ID NO: 444321 - RNA, 64 nt, Homo Sapiens; identical to SEQ ID NO: 218589

SEQ ID NO: 444322 - RNA, 64 nt, Homo Sapiens; identical to SEQ ID NO: 218590

SEQ ID NO: 444323 - RNA, 64 nt, Homo Sapiens; identical to SEQ ID NO: 218591

SEQ ID NO: 444324 - RNA, 64 nt, Homo Sapiens; identical to SEQ ID NO: 218592

SEQ ID NO: 444325 - RNA, 64 nt, Homo Sapiens; identical to SEQ ID NO: 218593

SEQ ID NO: 444326 - RNA, 64 nt, Homo Sapiens; identical to SEQ ID NO: 218594

SEQ ID NO: 444327 - RNA, 64 nt, Homo Sapiens; identical to SEQ ID NO: 218595

SEQ ID NO: 444328 - RNA, 64 nt, Homo Sapiens; identical to SEQ ID NO: 218596

SEQ ID NO: 444329 - RNA, 64 nt, Homo Sapiens; identical to SEQ ID NO: 218597

SEQ ID NO: 444330 - RNA, 64 nt, Homo Sapiens; identical to SEQ ID NO: 218598

SEQ ID NO: 444331 - RNA, 64 nt, Homo Sapiens; identical to SEQ ID NO: 218599

SEQ ID NO: 444332 - RNA, 64 nt, Homo Sapiens; identical to SEQ ID NO: 218600

SEQ ID NO: 444333 - RNA, 64 nt, Homo Sapiens; identical to SEQ ID NO: 218601

SEQ ID NO: 444334 - RNA, 64 nt, Homo Sapiens; identical to SEQ ID NO: 218602

SEQ ID NO: 444335 - RNA, 64 nt, Homo Sapiens; identical to SEQ ID NO: 218603

SEQ ID NO: 444336 - RNA, 64 nt, Homo Sapiens; identical to SEQ ID NO: 218604

SEQ ID NO: 444337 - RNA, 64 nt, Homo Sapiens; identical to SEQ ID NO: 218605

SEQ ID NO: 444338 - RNA, 64 nt, Homo Sapiens; identical to SEQ ID NO: 218606

SEQ ID NO: 444339 - RNA, 64 nt, Homo Sapiens; identical to SEQ ID NO: 218607

SEQ ID NO: 444340 - RNA, 64 nt, Homo Sapiens; identical to SEQ ID NO: 218608

SEQ ID NO: 444341 - RNA, 64 nt, Homo Sapiens; identical to SEQ ID NO: 218609

SEQ ID NO: 444342 - RNA, 64 nt, Homo Sapiens; identical to SEQ ID NO: 218610

SEQ ID NO: 444343 - RNA, 64 nt, Homo Sapiens; identical to SEQ ID NO: 218611

SEQ ID NO: 444344 - RNA, 64 nt, Homo Sapiens; identical to SEQ ID NO: 218612

SEQ ID NO: 444345 - RNA, 62 nt, Homo Sapiens; identical to SEQ ID NO: 218613

SEQ ID NO: 444346 - RNA, 64 nt, Homo Sapiens; identical to SEQ ID NO: 218614

SEQ ID NO: 444347 - RNA, 64 nt, Homo Sapiens; identical to SEQ ID NO: 218615

SEQ ID NO: 444348 - RNA, 64 nt, Homo Sapiens; identical to SEQ ID NO: 218616

SEQ ID NO: 444349 - RNA, 64 nt, Homo Sapiens; identical to SEQ ID NO: 218617

SEQ ID NO: 444350 - RNA, 64 nt, Homo Sapiens; identical to SEQ ID NO: 218618

SEQ ID NO: 444351 - RNA, 64 nt, Homo Sapiens; identical to SEQ ID NO: 218619

SEQ ID NO: 444352 - RNA, 64 nt, Homo Sapiens; identical to SEQ ID NO: 218620

SEQ ID NO: 444353 - RNA, 64 nt, Homo Sapiens; identical to SEQ ID NO: 218621

SEQ ID NO: 444354 - RNA, 64 nt, Homo Sapiens; identical to SEQ ID NO: 218622

SEQ ID NO: 444355 - RNA, 64 nt, Homo Sapiens; identical to SEQ ID NO: 218623

SEQ ID NO: 444356 - RNA, 64 nt, Homo Sapiens; identical to SEQ ID NO: 218624

SEQ ID NO: 444357 - RNA, 64 nt, Homo Sapiens; identical to SEQ ID NO: 218625

SEQ ID NO: 444358 - RNA, 64 nt, Homo Sapiens; identical to SEQ ID NO: 218626

SEQ ID NO: 444359 - RNA, 64 nt, Homo Sapiens; identical to SEQ ID NO: 218627

SEQ ID NO: 444360 - RNA, 64 nt, Homo Sapiens; identical to SEQ ID NO: 218628

SEQ ID NO: 444361 - RNA, 64 nt, Homo Sapiens; identical to SEQ ID NO: 218629

SEQ ID NO: 444362 - RNA, 64 nt, Homo Sapiens; identical to SEQ ID NO: 218630

SEQ ID NO: 444363 - RNA, 64 nt, Homo Sapiens; identical to SEQ ID NO: 218631

SEQ ID NO: 444364 - RNA, 64 nt, Homo Sapiens; identical to SEQ ID NO: 218632

SEQ ID NO: 444365 - RNA, 64 nt, Homo Sapiens; identical to SEQ ID NO: 218633

SEQ ID NO: 444366 - RNA, 64 nt, Homo Sapiens; identical to SEQ ID NO: 218634

SEQ ID NO: 444367 - RNA, 64 nt, Homo Sapiens; identical to SEQ ID NO: 218635

SEQ ID NO: 444368 - RNA, 64 nt, Homo Sapiens; identical to SEQ ID NO: 218636

SEQ ID NO: 444369 - RNA, 64 nt, Homo Sapiens; identical to SEQ ID NO: 218637

SEQ ID NO: 444370 - RNA, 64 nt, Homo Sapiens; identical to SEQ ID NO: 218638

SEQ ID NO: 444371 - RNA, 64 nt, Homo Sapiens; identical to SEQ ID NO: 218639

SEQ ID NO: 444372 - RNA, 64 nt, Homo Sapiens; identical to SEQ ID NO: 218640

SEQ ID NO: 444373 - RNA, 64 nt, Homo Sapiens; identical to SEQ ID NO: 218641

SEQ ID NO: 444374 - RNA, 64 nt, Homo Sapiens; identical to SEQ ID NO: 218642

SEQ ID NO: 444375 - RNA, 64 nt, Homo Sapiens; identical to SEQ ID NO: 218643

SEQ ID NO: 444376 - RNA, 64 nt, Homo Sapiens; identical to SEQ ID NO: 218644

SEQ ID NO: 444377 - RNA, 64 nt, Homo Sapiens; identical to SEQ ID NO: 218645

SEQ ID NO: 444378 - RNA, 64 nt, Homo Sapiens; identical to SEQ ID NO: 218646

SEQ ID NO: 444379 - RNA, 64 nt, Homo Sapiens; identical to SEQ ID NO: 218647

SEQ ID NO: 444380 - RNA, 64 nt, Homo Sapiens; identical to SEQ ID NO: 218648

SEQ ID NO: 444381 - RNA, 64 nt, Homo Sapiens; identical to SEQ ID NO: 218649

SEQ ID NO: 444382 - RNA, 64 nt, Homo Sapiens; identical to SEQ ID NO: 218650

SEQ ID NO: 444383 - RNA, 64 nt, Homo Sapiens; identical to SEQ ID NO: 218651

SEQ ID NO: 444384 - RNA, 64 nt, Homo Sapiens; identical to SEQ ID NO: 218652

SEQ ID NO: 444385 - RNA, 64 nt, Homo Sapiens; identical to SEQ ID NO: 218653

SEQ ID NO: 444386 - RNA, 64 nt, Homo Sapiens; identical to SEQ ID NO: 218654

SEQ ID NO: 444387 - RNA, 64 nt, Homo Sapiens; identical to SEQ ID NO: 218655

SEQ ID NO: 444388 - RNA, 64 nt, Homo Sapiens; identical to SEQ ID NO: 218656

SEQ ID NO: 444389 - RNA, 64 nt, Homo Sapiens; identical to SEQ ID NO: 218657

SEQ ID NO: 444390 - RNA, 64 nt, Homo Sapiens; identical to SEQ ID NO: 218658

SEQ ID NO: 444391 - RNA, 64 nt, Homo Sapiens; identical to SEQ ID NO: 218659

SEQ ID NO: 444392 - RNA, 64 nt, Homo Sapiens; identical to SEQ ID NO: 218660

SEQ ID NO: 444393 - RNA, 64 nt, Homo Sapiens; identical to SEQ ID NO: 218661

SEQ ID NO: 444394 - RNA, 61 nt, Homo Sapiens; identical to SEQ ID NO: 218662

SEQ ID NO: 444395 - RNA, 64 nt, Homo Sapiens; identical to SEQ ID NO: 218663

SEQ ID NO: 444396 - RNA, 64 nt, Homo Sapiens; identical to SEQ ID NO: 218664

SEQ ID NO: 444397 - RNA, 64 nt, Homo Sapiens; identical to SEQ ID NO: 218665

SEQ ID NO: 444398 - RNA, 64 nt, Homo Sapiens; identical to SEQ ID NO: 218666

SEQ ID NO: 444399 - RNA, 64 nt, Homo Sapiens; identical to SEQ ID NO: 218667

SEQ ID NO: 444400 - RNA, 64 nt, Homo Sapiens; identical to SEQ ID NO: 218668

SEQ ID NO: 444401 - RNA, 64 nt, Homo Sapiens; identical to SEQ ID NO: 218669

SEQ ID NO: 444402 - RNA, 64 nt, Homo Sapiens; identical to SEQ ID NO: 218670

SEQ ID NO: 444403 - RNA, 64 nt, Homo Sapiens; identical to SEQ ID NO: 218671

SEQ ID NO: 444404 - RNA, 64 nt, Homo Sapiens; identical to SEQ ID NO: 218672

SEQ ID NO: 444405 - RNA, 64 nt, Homo Sapiens; identical to SEQ ID NO: 218673

SEQ ID NO: 444406 - RNA, 64 nt, Homo Sapiens; identical to SEQ ID NO: 218674

SEQ ID NO: 444407 - RNA, 64 nt, Homo Sapiens; identical to SEQ ID NO: 218675

SEQ ID NO: 444408 - RNA, 64 nt, Homo Sapiens; identical to SEQ ID NO: 218676

SEQ ID NO: 444409 - RNA, 64 nt, Homo Sapiens; identical to SEQ ID NO: 218677

SEQ ID NO: 444410 - RNA, 64 nt, Homo Sapiens; identical to SEQ ID NO: 218678

SEQ ID NO: 444411 - RNA, 64 nt, Homo Sapiens; identical to SEQ ID NO: 218679

SEQ ID NO: 444412 - RNA, 64 nt, Homo Sapiens; identical to SEQ ID NO: 218680

SEQ ID NO: 444413 - RNA, 64 nt, Homo Sapiens; identical to SEQ ID NO: 218681

SEQ ID NO: 444414 - RNA, 64 nt, Homo Sapiens; identical to SEQ ID NO: 218682

SEQ ID NO: 444415 - RNA, 64 nt, Homo Sapiens; identical to SEQ ID NO: 218683

SEQ ID NO: 444416 - RNA, 64 nt, Homo Sapiens; identical to SEQ ID NO: 218684

SEQ ID NO: 444417 - RNA, 64 nt, Homo Sapiens; identical to SEQ ID NO: 218685

SEQ ID NO: 444418 - RNA, 59 nt, Homo Sapiens; identical to SEQ ID NO: 218686

SEQ ID NO: 444419 - RNA, 64 nt, Homo Sapiens; identical to SEQ ID NO: 218687

SEQ ID NO: 444420 - RNA, 64 nt, Homo Sapiens; identical to SEQ ID NO: 218688

SEQ ID NO: 444421 - RNA, 64 nt, Homo Sapiens; identical to SEQ ID NO: 218689

SEQ ID NO: 444422 - RNA, 64 nt, Homo Sapiens; identical to SEQ ID NO: 218690

SEQ ID NO: 444423 - RNA, 64 nt, Homo Sapiens; identical to SEQ ID NO: 218691

SEQ ID NO: 444424 - RNA, 64 nt, Homo Sapiens; identical to SEQ ID NO: 218692

SEQ ID NO: 444425 - RNA, 64 nt, Homo Sapiens; identical to SEQ ID NO: 218693

SEQ ID NO: 444426 - RNA, 64 nt, Homo Sapiens; identical to SEQ ID NO: 218694

SEQ ID NO: 444427 - RNA, 64 nt, Homo Sapiens; identical to SEQ ID NO: 218695

SEQ ID NO: 444428 - RNA, 64 nt, Homo Sapiens; identical to SEQ ID NO: 218696

SEQ ID NO: 444429 - RNA, 64 nt, Homo Sapiens; identical to SEQ ID NO: 218697

SEQ ID NO: 444430 - RNA, 64 nt, Homo Sapiens; identical to SEQ ID NO: 218698

SEQ ID NO: 444431 - RNA, 64 nt, Homo Sapiens; identical to SEQ ID NO: 218699

SEQ ID NO: 444432 - RNA, 64 nt, Homo Sapiens; identical to SEQ ID NO: 218700

SEQ ID NO: 444433 - RNA, 64 nt, Homo Sapiens; identical to SEQ ID NO: 218701

SEQ ID NO: 444434 - RNA, 64 nt, Homo Sapiens; identical to SEQ ID NO: 218702

SEQ ID NO: 444435 - RNA, 64 nt, Homo Sapiens; identical to SEQ ID NO: 218703

SEQ ID NO: 444436 - RNA, 64 nt, Homo Sapiens; identical to SEQ ID NO: 218704

SEQ ID NO: 444437 - RNA, 64 nt, Homo Sapiens; identical to SEQ ID NO: 218705

SEQ ID NO: 444438 - RNA, 64 nt, Homo Sapiens; identical to SEQ ID NO: 218706

SEQ ID NO: 444439 - RNA, 64 nt, Homo Sapiens; identical to SEQ ID NO: 218707

SEQ ID NO: 444440 - RNA, 64 nt, Homo Sapiens; identical to SEQ ID NO: 218708

SEQ ID NO: 444441 - RNA, 64 nt, Homo Sapiens; identical to SEQ ID NO: 218709

SEQ ID NO: 444442 - RNA, 64 nt, Homo Sapiens; identical to SEQ ID NO: 218710

SEQ ID NO: 444443 - RNA, 64 nt, Homo Sapiens; identical to SEQ ID NO: 218711

SEQ ID NO: 444444 - RNA, 64 nt, Homo Sapiens; identical to SEQ ID NO: 218712

SEQ ID NO: 444445 - RNA, 64 nt, Homo Sapiens; identical to SEQ ID NO: 218713

SEQ ID NO: 444446 - RNA, 64 nt, Homo Sapiens; identical to SEQ ID NO: 218714

SEQ ID NO: 444447 - RNA, 64 nt, Homo Sapiens; identical to SEQ ID NO: 218715

SEQ ID NO: 444448 - RNA, 64 nt, Homo Sapiens; identical to SEQ ID NO: 218716

SEQ ID NO: 444449 - RNA, 64 nt, Homo Sapiens; identical to SEQ ID NO: 218717

SEQ ID NO: 444450 - RNA, 64 nt, Homo Sapiens; identical to SEQ ID NO: 218718

SEQ ID NO: 444451 - RNA, 64 nt, Homo Sapiens; identical to SEQ ID NO: 218719

SEQ ID NO: 444452 - RNA, 64 nt, Homo Sapiens; identical to SEQ ID NO: 218720

SEQ ID NO: 444453 - RNA, 64 nt, Homo Sapiens; identical to SEQ ID NO: 218721

SEQ ID NO: 444454 - RNA, 64 nt, Homo Sapiens; identical to SEQ ID NO: 218722

SEQ ID NO: 444455 - RNA, 64 nt, Homo Sapiens; identical to SEQ ID NO: 218723

SEQ ID NO: 444456 - RNA, 64 nt, Homo Sapiens; identical to SEQ ID NO: 218724

SEQ ID NO: 444457 - RNA, 64 nt, Homo Sapiens; identical to SEQ ID NO: 218725

SEQ ID NO: 444458 - RNA, 64 nt, Homo Sapiens; identical to SEQ ID NO: 218726

SEQ ID NO: 444459 - RNA, 64 nt, Homo Sapiens; identical to SEQ ID NO: 218727

SEQ ID NO: 444460 - RNA, 64 nt, Homo Sapiens; identical to SEQ ID NO: 218728

SEQ ID NO: 444461 - RNA, 64 nt, Homo Sapiens; identical to SEQ ID NO: 218729

SEQ ID NO: 444462 - RNA, 64 nt, Homo Sapiens; identical to SEQ ID NO: 218730

SEQ ID NO: 444463 - RNA, 64 nt, Homo Sapiens; identical to SEQ ID NO: 218731

SEQ ID NO: 444464 - RNA, 64 nt, Homo Sapiens; identical to SEQ ID NO: 218732

SEQ ID NO: 444465 - RNA, 64 nt, Homo Sapiens; identical to SEQ ID NO: 218733

SEQ ID NO: 444466 - RNA, 64 nt, Homo Sapiens; identical to SEQ ID NO: 218734

SEQ ID NO: 444467 - RNA, 64 nt, Homo Sapiens; identical to SEQ ID NO: 218735

SEQ ID NO: 444468 - RNA, 64 nt, Homo Sapiens; identical to SEQ ID NO: 218736

SEQ ID NO: 444469 - RNA, 64 nt, Homo Sapiens; identical to SEQ ID NO: 218737

SEQ ID NO: 444470 - RNA, 64 nt, Homo Sapiens; identical to SEQ ID NO: 218738

SEQ ID NO: 444471 - RNA, 64 nt, Homo Sapiens; identical to SEQ ID NO: 218739

SEQ ID NO: 444472 - RNA, 64 nt, Homo Sapiens; identical to SEQ ID NO: 218740

SEQ ID NO: 444473 - RNA, 64 nt, Homo Sapiens; identical to SEQ ID NO: 218741

SEQ ID NO: 444474 - RNA, 64 nt, Homo Sapiens; identical to SEQ ID NO: 218742

SEQ ID NO: 444475 - RNA, 64 nt, Homo Sapiens; identical to SEQ ID NO: 218743

SEQ ID NO: 444476 - RNA, 64 nt, Homo Sapiens; identical to SEQ ID NO: 218744

SEQ ID NO: 444477 - RNA, 64 nt, Homo Sapiens; identical to SEQ ID NO: 218745

SEQ ID NO: 444478 - RNA, 64 nt, Homo Sapiens; identical to SEQ ID NO: 218746

SEQ ID NO: 444479 - RNA, 64 nt, Homo Sapiens; identical to SEQ ID NO: 218747

SEQ ID NO: 444480 - RNA, 64 nt, Homo Sapiens; identical to SEQ ID NO: 218748

SEQ ID NO: 444481 - RNA, 64 nt, Homo Sapiens; identical to SEQ ID NO: 218749

SEQ ID NO: 444482 - RNA, 64 nt, Homo Sapiens; identical to SEQ ID NO: 218750

SEQ ID NO: 444483 - RNA, 64 nt, Homo Sapiens; identical to SEQ ID NO: 218751

SEQ ID NO: 444484 - RNA, 64 nt, Homo Sapiens; identical to SEQ ID NO: 218752

SEQ ID NO: 444485 - RNA, 64 nt, Homo Sapiens; identical to SEQ ID NO: 218753

SEQ ID NO: 444486 - RNA, 64 nt, Homo Sapiens; identical to SEQ ID NO: 218754

SEQ ID NO: 444487 - RNA, 64 nt, Homo Sapiens; identical to SEQ ID NO: 218755

SEQ ID NO: 444488 - RNA, 64 nt, Homo Sapiens; identical to SEQ ID NO: 218756

SEQ ID NO: 444489 - RNA, 64 nt, Homo Sapiens; identical to SEQ ID NO: 218757

SEQ ID NO: 444490 - RNA, 64 nt, Homo Sapiens; identical to SEQ ID NO: 218758

SEQ ID NO: 444491 - RNA, 64 nt, Homo Sapiens; identical to SEQ ID NO: 218759

SEQ ID NO: 444492 - RNA, 64 nt, Homo Sapiens; identical to SEQ ID NO: 218760

SEQ ID NO: 444493 - RNA, 64 nt, Homo Sapiens; identical to SEQ ID NO: 218761

SEQ ID NO: 444494 - RNA, 64 nt, Homo Sapiens; identical to SEQ ID NO: 218762

SEQ ID NO: 444495 - RNA, 64 nt, Homo Sapiens; identical to SEQ ID NO: 218763

SEQ ID NO: 444496 - RNA, 64 nt, Homo Sapiens; identical to SEQ ID NO: 218764

SEQ ID NO: 444497 - RNA, 64 nt, Homo Sapiens; identical to SEQ ID NO: 218765

SEQ ID NO: 444498 - RNA, 64 nt, Homo Sapiens; identical to SEQ ID NO: 218766

SEQ ID NO: 444499 - RNA, 64 nt, Homo Sapiens; identical to SEQ ID NO: 218767

SEQ ID NO: 444500 - RNA, 64 nt, Homo Sapiens; identical to SEQ ID NO: 218768

SEQ ID NO: 444501 - RNA, 64 nt, Homo Sapiens; identical to SEQ ID NO: 218769

SEQ ID NO: 444502 - RNA, 64 nt, Homo Sapiens; identical to SEQ ID NO: 218770

SEQ ID NO: 444503 - RNA, 64 nt, Homo Sapiens; identical to SEQ ID NO: 218771

SEQ ID NO: 444504 - RNA, 64 nt, Homo Sapiens; identical to SEQ ID NO: 218772

SEQ ID NO: 444505 - RNA, 64 nt, Homo Sapiens; identical to SEQ ID NO: 218773

SEQ ID NO: 444506 - RNA, 64 nt, Homo Sapiens; identical to SEQ ID NO: 218774

SEQ ID NO: 444507 - RNA, 64 nt, Homo Sapiens; identical to SEQ ID NO: 218775

SEQ ID NO: 444508 - RNA, 64 nt, Homo Sapiens; identical to SEQ ID NO: 218776

SEQ ID NO: 444509 - RNA, 64 nt, Homo Sapiens; identical to SEQ ID NO: 218777

SEQ ID NO: 444510 - RNA, 64 nt, Homo Sapiens; identical to SEQ ID NO: 218778

SEQ ID NO: 444511 - RNA, 64 nt, Homo Sapiens; identical to SEQ ID NO: 218779

SEQ ID NO: 444512 - RNA, 64 nt, Homo Sapiens; identical to SEQ ID NO: 218780

SEQ ID NO: 444513 - RNA, 64 nt, Homo Sapiens; identical to SEQ ID NO: 218781

SEQ ID NO: 444514 - RNA, 64 nt, Homo Sapiens; identical to SEQ ID NO: 218782

SEQ ID NO: 444515 - RNA, 64 nt, Homo Sapiens; identical to SEQ ID NO: 218783

SEQ ID NO: 444516 - RNA, 64 nt, Homo Sapiens; identical to SEQ ID NO: 218784

SEQ ID NO: 444517 - RNA, 64 nt, Homo Sapiens; identical to SEQ ID NO: 218785

SEQ ID NO: 444518 - RNA, 64 nt, Homo Sapiens; identical to SEQ ID NO: 218786

SEQ ID NO: 444519 - RNA, 64 nt, Homo Sapiens; identical to SEQ ID NO: 218787

SEQ ID NO: 444520 - RNA, 64 nt, Homo Sapiens; identical to SEQ ID NO: 218788

SEQ ID NO: 444521 - RNA, 64 nt, Homo Sapiens; identical to SEQ ID NO: 218789

SEQ ID NO: 444522 - RNA, 64 nt, Homo Sapiens; identical to SEQ ID NO: 218790

SEQ ID NO: 444523 - RNA, 64 nt, Homo Sapiens; identical to SEQ ID NO: 218791

SEQ ID NO: 444524 - RNA, 64 nt, Homo Sapiens; identical to SEQ ID NO: 218792

SEQ ID NO: 444525 - RNA, 64 nt, Homo Sapiens; identical to SEQ ID NO: 218793

SEQ ID NO: 444526 - RNA, 64 nt, Homo Sapiens; identical to SEQ ID NO: 218794

SEQ ID NO: 444527 - RNA, 64 nt, Homo Sapiens; identical to SEQ ID NO: 218795

SEQ ID NO: 444528 - RNA, 64 nt, Homo Sapiens; identical to SEQ ID NO: 218796

SEQ ID NO: 444529 - RNA, 64 nt, Homo Sapiens; identical to SEQ ID NO: 218797

SEQ ID NO: 444530 - RNA, 64 nt, Homo Sapiens; identical to SEQ ID NO: 218798

SEQ ID NO: 444531 - RNA, 64 nt, Homo Sapiens; identical to SEQ ID NO: 218799

SEQ ID NO: 444532 - RNA, 64 nt, Homo Sapiens; identical to SEQ ID NO: 218800

SEQ ID NO: 444533 - RNA, 64 nt, Homo Sapiens; identical to SEQ ID NO: 218801

SEQ ID NO: 444534 - RNA, 64 nt, Homo Sapiens; identical to SEQ ID NO: 218802

SEQ ID NO: 444535 - RNA, 64 nt, Homo Sapiens; identical to SEQ ID NO: 218803

SEQ ID NO: 444536 - RNA, 64 nt, Homo Sapiens; identical to SEQ ID NO: 218804

SEQ ID NO: 444537 - RNA, 64 nt, Homo Sapiens; identical to SEQ ID NO: 218805

SEQ ID NO: 444538 - RNA, 64 nt, Homo Sapiens; identical to SEQ ID NO: 218806

SEQ ID NO: 444539 - RNA, 64 nt, Homo Sapiens; identical to SEQ ID NO: 218807

SEQ ID NO: 444540 - RNA, 64 nt, Homo Sapiens; identical to SEQ ID NO: 218808

SEQ ID NO: 444541 - RNA, 59 nt, Homo Sapiens; identical to SEQ ID NO: 218809

SEQ ID NO: 444542 - RNA, 64 nt, Homo Sapiens; identical to SEQ ID NO: 218810

SEQ ID NO: 444543 - RNA, 64 nt, Homo Sapiens; identical to SEQ ID NO: 218811

SEQ ID NO: 444544 - RNA, 64 nt, Homo Sapiens
aaaauuaaaaagaauacaaaaacucuucuaauaaaugaaguaaaguauuccuacacauauuaga

SEQ ID NO: 444545 - RNA, 64 nt, Homo Sapiens
uuauaaauguauuuaugcugaccuaagaucaacaaugaaguauuaauucuguuuuaaaucaaug

SEQ ID NO: 444546 - RNA, 64 nt, Homo Sapiens
auguuguuauuuggauuucugcacuguuuaacaaaugaaguaaaagaaaaacacuacugcaauc

SEQ ID NO: 444547 - RNA, 64 nt, Homo Sapiens
acugguaguuacagucuuagguuaaaguauucuaaugaaguaugggaacuaaauugcugguuuu

SEQ ID NO: 444548 - RNA, 64 nt, Homo Sapiens
gggaagagugggagggggaguuaaauccagucuuaugaaguauuguuauuaaaugucuuuuuaa

SEQ ID NO: 444549 - RNA, 64 nt, Homo Sapiens
uauauuuuuacuauuaaaauauucaguuuuuuaaaugaaguagaacuugaguucauguuuuaua

SEQ ID NO: 444550 - RNA, 64 nt, Homo Sapiens
uggauuuugaccauugauuaccuuucucaauguaaugaaguauuuuacagucaauuuguggugu

SEQ ID NO: 444551 - RNA, 64 nt, Homo Sapiens
aacuucaucaguucaaauaaguuuuaauugucaaaugaaguauaaacacaugaacuuucuagaa

SEQ ID NO: 444552 - RNA, 64 nt, Homo Sapiens
ucauguaauauaagugaacauuugcuauuuacaaaugaaguauugucagaacuauaacauucaa

SEQ ID NO: 444553 - RNA, 64 nt, Homo Sapiens
aacccauuuuggugcaauauuuuauuaacuagguaugaaguauagacuaaguugcaagaucuua

SEQ ID NO: 444554 - RNA, 64 nt, Homo Sapiens
aacuuuaaaauauuaaguuuuuaaaaaaucaaauaugaaguauguucagcaaaggcauaauuuu

SEQ ID NO: 444555 - RNA, 64 nt, Homo Sapiens
uauuagaaaagaaaucagaccuaaauaaucauugaugaaguaugucaguuacaagcacaaaaga

SEQ ID NO: 444556 - RNA, 64 nt, Homo Sapiens
aaguuaauaauuauauuagcaaaguguuaaucuaaugaaguaaaaaacuccuguguggcagaaa

SEQ ID NO: 444557 - RNA, 64 nt, Homo Sapiens
uacacaauagacuacuuacuacucagcaauaaaaaugaaguaacuuucaauaaaugcaauauua

SEQ ID NO: 444558 - RNA, 64 nt, Homo Sapiens
agcaagacaugcuuaguguggucuuaugacaucuaugaaguagucaacucuaauccauaaacgg

SEQ ID NO: 444559 - RNA, 64 nt, Homo Sapiens
gcuuuaauuccuugcugguaaugguaacagccccaugaaguacccaauuggaauacauuucaag

SEQ ID NO: 444560 - RNA, 64 nt, Homo Sapiens
uuucuuuuaccauugaccauuauuauagggacccaugaaguaaaugucacaaucaucuuacuag

SEQ ID NO: 444561 - RNA, 64 nt, Homo Sapiens
aaaaaguacgugaccagucugguaagaaguauuaaugaaguagcuaauauuacagcuucauuuu

SEQ ID NO: 444562 - RNA, 64 nt, Homo Sapiens
cauuuuguguaacuaauguaugaaguaaaguucuaugaaguaugcaacucuuugcauuacaaua

SEQ ID NO: 444563 - RNA, 64 nt, Homo Sapiens
guucuaugaaguaugcauuucuuugcauuacaauaugaaguaaaucugccuaaaauaugcaacu

SEQ ID NO: 444564 - RNA, 64 nt, Homo Sapiens
aaaauguuauuaguuuuauuauacccaaucccugaugaaguauucaacugaguauuacccaguu

SEQ ID NO: 444565 - RNA, 64 nt, Homo Sapiens
cacuauuauuauccucauuuucuuaaacauccccaugaaguaaaguaaauucauuucauuuagu

SEQ ID NO: 444566 - RNA, 64 nt, Homo Sapiens
aggccuuuugagcaagcgccaaugaguuucaggaaugaaguagaagguaguuauuuaaaaauaa

SEQ ID NO: 444567 - RNA, 64 nt, Homo Sapiens
gcuucaugagcccagaccaaaagcccacagugaaaugaaguacccuuuuguaaauagcauuuuu

SEQ ID NO: 444568 - RNA, 64 nt, Homo Sapiens
uaagugcauuucugcaaagaucaagauaagcuggaugaaguagugugcauuuguaauacuauug

SEQ ID NO: 444569 - RNA, 64 nt, Homo Sapiens
cuugccuuauuuucuaguuugugaacaagaacgaaugaaguacuauuauugauaacuuauauau

SEQ ID NO: 444570 - RNA, 64 nt, Homo Sapiens
acuugggaguuauuuacuguguuccucuggcagccaauaaaaucaucauaagcccuuuguaaua

SEQ ID NO: 444571 - RNA, 64 nt, Homo Sapiens
guucuguaugcuucuauuccaaaucauucauuaccaauaaaaacgaaauaccacccuuuccauu

SEQ ID NO: 444572 - RNA, 64 nt, Homo Sapiens
auuaaaucacauuuagugcuguauaauuugcaugcaauaaaauucaauaaaauuaaauguaaaa

SEQ ID NO: 444573 - RNA, 64 nt, Homo Sapiens
auuuagugcuguauaauuugcaugcaauaaaauucaauaaaauuaaauguaaaauuaaaugagu

SEQ ID NO: 444574 - RNA, 64 nt, Homo Sapiens
ggcauuuaaaucagcccugugacuaugaccaagccaauaaaaagaagccuuggcaccuguugga

SEQ ID NO: 444575 - RNA, 64 nt, Homo Sapiens
ucaauauaacuuucuuugggacacauagaaucaucaauaaaaacccuaucacacucuguuaaaa

SEQ ID NO: 444576 - RNA, 64 nt, Homo Sapiens
cagcauucacaaaaugaggagagaccugucauugcaauaaaagcuauuuuuauauaugguuaaa

SEQ ID NO: 444577 - RNA, 64 nt, Homo Sapiens
cauuuaaaaauuuaggggauaugagaaguuauaccaauaaaaaguaauacaaaauaagugggaa

SEQ ID NO: 444578 - RNA, 64 nt, Homo Sapiens
auuuauauuuucccucucuugccuuucuuauuugcaauaaaagguauugagccauuuuuuaaau

SEQ ID NO: 444579 - RNA, 64 nt, Homo Sapiens
augcaucacggaucaauagacuguacuuauuuuccaauaaaauuuucaaacuuuguacuguuau

SEQ ID NO: 444580 - RNA, 64 nt, Homo Sapiens
cuuguaaccagauacauaaagagcucuuacaacucaauaaaaggcaaguaauuuaaaaauaggc

SEQ ID NO: 444581 - RNA, 64 nt, Homo Sapiens
guaacaaaauaucacaugcauaaauauuauguaucaauaaaauuuuuuaaugggcaaaggauuu

SEQ ID NO: 444582 - RNA, 64 nt, Homo Sapiens
ucagguuuuuuuccugauuuuagagagcuguuugcaauaaaaagggcacaguuugaugaagggc

SEQ ID NO: 444583 - RNA, 64 nt, Homo Sapiens
caaauauaaguuuccaugcucauccaauuuaguucaauaaaauuaauaucaucucuagcacugc

SEQ ID NO: 444584 - RNA, 64 nt, Homo Sapiens
ugcacagaacagaugcaaauaauuuuuauuuauucaauaaaauauuuaaaaaccaaaccaauaa

SEQ ID NO: 444585 - RNA, 64 nt, Homo Sapiens
uuuauuuauucaauaaaauauuuaaaaaccaaaccaauaaaauuuaagaauauuguuuauaggu

SEQ ID NO: 444586 - RNA, 64 nt, Homo Sapiens
uuaagaucauuuuuaagaagauaaguauagacagcaauaaaauguuauuugcacuacauauaug

SEQ ID NO: 444587 - RNA, 64 nt, Homo Sapiens
uaaggcuguucaugagaaggugcauuuauuuugacaauaaaacuaaacuguuucccaaaauaag

SEQ ID NO: 444588 - RNA, 64 nt, Homo Sapiens
uaugcacaaaugugaacacccccugucagccuuucaauaaaagucccuccguuccgcuagccua

SEQ ID NO: 444589 - RNA, 64 nt, Homo Sapiens
cugguccaacgaagacacuguccaccucaaaugacaauaaaaaaucuggucaugaucucugauc

SEQ ID NO: 444590 - RNA, 64 nt, Homo Sapiens
auuauuggcaaauaaauuggaauaaaaaaaguaucaauaaaauaccuuacuuucccauuguaac

SEQ ID NO: 444591 - RNA, 64 nt, Homo Sapiens
aguaucaauaaaauaauuaucuuucccauuguaacaauaaaaaaucuauauccuugacaccuua

SEQ ID NO: 444592 - RNA, 64 nt, Homo Sapiens
ucacaaguaauaacugcuguaaauugucauacgccaauaaaauggaugcaacagggacccuugu

SEQ ID NO: 444593 - RNA, 64 nt, Homo Sapiens
gaaccaaaggauauuuccagugccuagagaggggcaauaaaaauugcguuaacauacuuuguuu

SEQ ID NO: 444594 - RNA, 64 nt, Homo Sapiens
uuuggcaggaagcuuguugcuuuucaaaugucaccaauaaaaguuaguauuuuaaaaaaauugu

SEQ ID NO: 444595 - RNA, 64 nt, Homo Sapiens
uuauguggaagguaaauauaccucaucuugguaucaauaaaaacccacaccagaguucuauuua

SEQ ID NO: 444596 - RNA, 64 nt, Homo Sapiens
uguguuaaacucaauugcuuaacugucuauagggcaauaaaaucauauccacuggucacaucau

SEQ ID NO: 444597 - RNA, 64 nt, Homo Sapiens
ugcauggggguuaagcugauguuaaaacaguuugcaauaaaaaaaaaugaaucagcuuaaguca

SEQ ID NO: 444598 - RNA, 64 nt, Homo Sapiens
ucaccauuugguccucuuuaaucuuugaggguuucaauaaaaauuguucacucauaucuguguu

SEQ ID NO: 444599 - RNA, 64 nt, Homo Sapiens
ccaaacuuuguauguacguuaccuaacaagauuucaauaaaaaugaaagcagaauuuguuugau

SEQ ID NO: 444600 - RNA, 64 nt, Homo Sapiens
aagacauugaaggaccaauuacauuucacgaggacaauaaaaauaacaucuuaacuguauauga

SEQ ID NO: 444601 - RNA, 64 nt, Homo Sapiens
aauuuacaugauagguuaacguaaacagguguaccaauaaaaagauagcaaucaaucauaauua

SEQ ID NO: 444602 - RNA, 64 nt, Homo Sapiens
gagaagaaaaaagagaaaccaccaucucccccgccaauaaaaaagauaaauaacaaguuauagu

SEQ ID NO: 444603 - RNA, 64 nt, Homo Sapiens
caucagugcuauuuggauguaugacacgaaucugcaauaaaagcauucccagauuauccuugua

SEQ ID NO: 444604 - RNA, 64 nt, Homo Sapiens
acaacugcaaaguaccuucaaaauuaagucucuacaauaaaaacagacaacucuuucuuuaaau

SEQ ID NO: 444605 - RNA, 64 nt, Homo Sapiens
cucccauucuaugugucaucaauaguguccuaugcaauaaaauuauuugcaggucuuuaaauca

SEQ ID NO: 444606 - RNA, 64 nt, Homo Sapiens
gaaaggaugaucaaaaauaaugcauccagcaguacaauaaaaguaaaccacaaaaaaauaccuc

SEQ ID NO: 444607 - RNA, 64 nt, Homo Sapiens
aauaauaauaaaaccuuccagugagacuccaucucaauaaaauuacuccagccugggugacaga

SEQ ID NO: 444608 - RNA, 64 nt, Homo Sapiens
caaaacuguucuuugaaaagugaaaagagaaaaucaauaaaaccagaguaaaaaucagugaaau

SEQ ID NO: 444609 - RNA, 64 nt, Homo Sapiens
cugaauauguacuuuuaacacaagagagacuauucaauaaaaacucacugggucuuucaugucu

SEQ ID NO: 444610 - RNA, 64 nt, Homo Sapiens
ucuuuuuuauauuguccuccaccuccaucauuuucaauaaaagauagggcuuuugcucccuugu

SEQ ID NO: 444611 - RNA, 64 nt, Homo Sapiens
gucucagcaacaguggaauucauauaaccuaugccaauaaaaaucacacacacacacacacaaa

SEQ ID NO: 444612 - RNA, 64 nt, Homo Sapiens
guguucaauggaugaauuucacauaauaggugcucaauaaaaauccuggaacagugucuggugc

SEQ ID NO: 444613 - RNA, 64 nt, Homo Sapiens
aacauaaugugaucaugcucuaacuucaauauaccaauaaaauaaucagcuugcaauuucugau

SEQ ID NO: 444614 - RNA, 64 nt, Homo Sapiens
auuuugaacuaacaguaauaacuucuugaaaauccaauaaaauuggcaaaagauugugaaaauu

SEQ ID NO: 444615 - RNA, 64 nt, Homo Sapiens
uguugucuucaaaggcaggagaaaauaauguucacaauaaaaugugcuaacaauguuuuguuuc

SEQ ID NO: 444616 - RNA, 64 nt, Homo Sapiens
gaauaaaagaaaagcugacaguauauucugguuucaauaaaaugaccuaucagaaaguagaauu

SEQ ID NO: 444617 - RNA, 64 nt, Homo Sapiens
guuacaugcaccuucagugugccuuguugugccucaauaaaaaaaaguccaggcaaguuacaau

SEQ ID NO: 444618 - RNA, 64 nt, Homo Sapiens
augguguucuaauuagugggcaguacaguauugacaauaaaaggucuuuaucaagauugaaagu

SEQ ID NO: 444619 - RNA, 64 nt, Homo Sapiens
uuuuuaugacuacagauuuucuauguaaaauuaccaauaaaauaaaaguauagccccacuuaua

SEQ ID NO: 444620 - RNA, 64 nt, Homo Sapiens
uugauuauuuagcuuuauaaagcggacuaguaaacaauaaaacacauuuauuguaauguuuacu

SEQ ID NO: 444621 - RNA, 64 nt, Homo Sapiens
uaauucauuuaagaagagaugcuuuauaaaauagcaauaaaaaauauuuuuaggaaaauauuaa

SEQ ID NO: 444622 - RNA, 64 nt, Homo Sapiens
uuauaugaaagaaugaaaauuuuauuuuuugacccaauaaaaugguguaggguuuuauuuuauu

SEQ ID NO: 444623 - RNA, 64 nt, Homo Sapiens
uauucuguuucuuucguuagauaaauuaaccuagcaauaaaaaaagacuauuauuaucuuugua

SEQ ID NO: 444624 - RNA, 64 nt, Homo Sapiens
augaauaccacaaaagauguuuccagacaucaagcaauaaaaaaaggucuaguuucgguaacug

SEQ ID NO: 444625 - RNA, 64 nt, Homo Sapiens
uggcauuaauacaaaccucagcauuugucuaauacaauaaaaacaagucuucgauucucagaga

SEQ ID NO: 444626 - RNA, 64 nt, Homo Sapiens
gaaugagcugguucuuuccauacauacauacauacaauaaaaccagauucugucucaaaauaaa

SEQ ID NO: 444627 - RNA, 64 nt, Homo Sapiens
cuacuaaauguacagauaugcaaauuccauagcucaauaaaagaaucugauacuuagaccaaaa

SEQ ID NO: 444628 - RNA, 64 nt, Homo Sapiens
cugcagaaaaaauauuguaguuugaauauuuaagcaauaaaacugcuagugaguuauuguaagc

SEQ ID NO: 444629 - RNA, 64 nt, Homo Sapiens
auucuuaucacuuccuauccgguauuuaauaauacaauaaaaaugugggggggaaagaugacau

SEQ ID NO: 444630 - RNA, 64 nt, Homo Sapiens
cucaaaauaaauggucuuuaauuauuuguuaugacaauaaaacaaauacacagaauguguacag

SEQ ID NO: 444631 - RNA, 64 nt, Homo Sapiens
aaugucugcaugcuauuuuaaaagcaaaaggaaacaauaaaaggaaaauaccacagacacaguu

SEQ ID NO: 444632 - RNA, 64 nt, Homo Sapiens
agcuaaaugggcuaggugaauccaguuuccuuggcaauaaaaugguugcugaaucuguuugggu

SEQ ID NO: 444633 - RNA, 64 nt, Homo Sapiens
uaaaauauaaauuaaaaaagugggccaccuauuucaauaaaaaagaguucuguuucacaaguuu

SEQ ID NO: 444634 - RNA, 64 nt, Homo Sapiens
acauaaguggacauguuuaugaguauauagauagcaauaaaauaaguaauacaguaaacugaaa

SEQ ID NO: 444635 - RNA, 64 nt, Homo Sapiens
uaccucaauacauguucuuuuuacguucuuauaccaauaaaaggugacaugguuaaucuggaac

SEQ ID NO: 444636 - RNA, 64 nt, Homo Sapiens
ccauagggaagagagagagggggacuucagagaccaauaaaagcgcuggcacugaagaucucca

SEQ ID NO: 444637 - RNA, 64 nt, Homo Sapiens
ugccaugcugcuaugaagacuacuuuuagaucaacaauaaaaaaaaaccuacaaaaaaaccuuu

SEQ ID NO: 444638 - RNA, 64 nt, Homo Sapiens
ccuuauuuuuauuuauuuuuguacugugcugauucaauaaaaugcacugaccauccauuacaga

SEQ ID NO: 444639 - RNA, 64 nt, Homo Sapiens
cuaaugaagaaaagagagaagaaucaaauagaugcaauaaaaaaugauaaagggaauaucauca

SEQ ID NO: 444640 - RNA, 64 nt, Homo Sapiens
caauauccuugaugaacauugaugugaaaauccucaauaaaauacuggcaaaccgaauccagca

SEQ ID NO: 444641 - RNA, 64 nt, Homo Sapiens
ugggccccaccacgcucucaagagaacgcaccugcaauaaaacagucuugucggccagcugccc

SEQ ID NO: 444642 - RNA, 64 nt, Homo Sapiens
caagcugugaagaaaaauauauaucaauguuuuccaauaaaauacagugacuaccugauuuggc

SEQ ID NO: 444643 - RNA, 64 nt, Homo Sapiens
aacucuaaaaucacagcugucaugcacccccucgcaauaaaaccucuuuccaccuuccccuauc

SEQ ID NO: 444644 - RNA, 64 nt, Homo Sapiens
aacuagaaaaaaaaaagguucaaugucacaaaagcaauaaaacagagagaaaauccacaaauuc

SEQ ID NO: 444645 - RNA, 64 nt, Homo Sapiens
uagacuugguuuuuuuguguagcgcuggcauaaacaauaaaaaggcucacguauuucuauuguc

SEQ ID NO: 444646 - RNA, 64 nt, Homo Sapiens
gcauuuuaagaaauaaggugccugguuucccaaccaauaaaauguaauucuacaagaggaauca

SEQ ID NO: 444647 - RNA, 64 nt, Homo Sapiens
guguuacuguuuaccauggcaguaauggggcaaacaauaaaaugcaaugugaaaugauuugaug

SEQ ID NO: 444648 - RNA, 64 nt, Homo Sapiens
aaaaucauucuggagguggcauguccuugacucacaauaaaaauuuuagaaaacuauugaaaga

SEQ ID NO: 444649 - RNA, 64 nt, Homo Sapiens
uacucauagaauggaagugauaauguccagcugcuccaucgauauggucaaagagaaagaacuc

SEQ ID NO: 444650 - RNA, 64 nt, Homo Sapiens
ggccugccaaggugaagagauacagccuuccguauccaucgaagcagaugcucugaacccugag

SEQ ID NO: 444651 - RNA, 64 nt, Homo Sapiens
ccagcuaggcuacacccaucaugcgccgcccuccuccaucgagggagaggccugaagggacugc

SEQ ID NO: 444652 - RNA, 64 nt, Homo Sapiens
acuggaaaagaggcuagcuugccaucaggacuaauccaucgaugagacacugcucagcacuuca

SEQ ID NO: 444653 - RNA, 64 nt, Homo Sapiens
gccggucuccugcuucuuuauucuaagaggcaccuccaucgaggaucauaaccacucaucuaau

SEQ ID NO: 444654 - RNA, 64 nt, Homo Sapiens
uccugcagcaucaccauaagcagugcagggugucuccaucgagcuguuugguuccauguguguu

SEQ ID NO: 444655 - RNA, 64 nt, Homo Sapiens
uguuucauaaguuuuuugguaaacuuuuccuuuguccaucgagguuuaaguugucaugugacag

SEQ ID NO: 444656 - RNA, 64 nt, Homo Sapiens
gaccguccccuggaggaaagucauuccugccuaauccaucgagagaaagaggcuuacgaaaaac

SEQ ID NO: 444657 - RNA, 64 nt, Homo Sapiens
gacacugcauugcuucucauggcucucuugcuccuccaucgauguuggaagccugagaggcgcc

SEQ ID NO: 444658 - RNA, 64 nt, Homo Sapiens
gggaacucacuuccuuuggaucugcuugaauaccuccaucgaugagcugcugcacugucucagu

SEQ ID NO: 444659 - RNA, 64 nt, Homo Sapiens
uaccacacuguuaggccuuuauuuuauuuuauuuuccaucgaaagcauuggaggcccagugcaa

SEQ ID NO: 444660 - RNA, 64 nt, Homo Sapiens
uuuacuaaauagaauuacuggugaagcagauuuauccaucgagacuaucugguaugcguuaugu

SEQ ID NO: 444661 - RNA, 64 nt, Homo Sapiens
gucuccuuuaugcaucugcaacuuuaaggcauaguccaucgaucuacagggugaucucauuuga

SEQ ID NO: 444662 - RNA, 64 nt, Homo Sapiens
uccgcuaauagggagggcugugcgauuaaaggcuuccaucgauuggguaguguccuucaagugg

SEQ ID NO: 444663 - RNA, 64 nt, Homo Sapiens
gcccggugcuugggggaggaugggccauguccccuccaucgaguuugcagcugcagcccauccc

SEQ ID NO: 444664 - RNA, 64 nt, Homo Sapiens
cccccgaugcccaaagcagcaucuuccagcacuuuccaucgaggacuuggguggcagagugugg

SEQ ID NO: 444665 - RNA, 64 nt, Homo Sapiens
guuccauuauguccuggauacagaggcgagaaacuccaucgagucggauccagagcacggcacu

SEQ ID NO: 444666 - RNA, 64 nt, Homo Sapiens
aagaguccuuggaacaagcaaaaggaccacauaguccaucgaaguaaacggaggacuuggggaa

SEQ ID NO: 444667 - RNA, 64 nt, Homo Sapiens
guaaaccucugucaccuggaccuugcuuagauauuccaucgauuuuguccaacaaacaauuucu

SEQ ID NO: 444668 - RNA, 64 nt, Homo Sapiens
uauuguccuuuuuuacuggaagacguacgcauacuccaucgauguuguauuugcaguggcugag

SEQ ID NO: 444669 - RNA, 64 nt, Homo Sapiens
cccccucaacuuugagacugcaggaguugaagccuccaucgacucagccccuucuuccuggacc

SEQ ID NO: 444670 - RNA, 64 nt, Homo Sapiens
guaggaagaauucggauccuuaccauuggaaucuuccaucgaacauacucaaacacuuuuggac

SEQ ID NO: 444671 - RNA, 64 nt, Homo Sapiens
guguccugcauguaugccauguauguugcaugaauccaucgauuuguauuaauguagggcagaa

SEQ ID NO: 444672 - RNA, 64 nt, Homo Sapiens
uuaaacaggaaugcuuagcauuuggccuucaagauccaucgacccuauuuaagugcauaagguc

SEQ ID NO: 444673 - RNA, 64 nt, Homo Sapiens
ucccccagaaucuuggcuguuuacaaaucacguguccaucgagcacgucugaaaccccugguag

SEQ ID NO: 444674 - RNA, 64 nt, Homo Sapiens
uucagcaauguugaucucauaaaaggaaaaacaaaagauuuaaguauucuauauaccaaguuuu

SEQ ID NO: 444675 - RNA, 64 nt, Homo Sapiens
agagugauaugcuugcugcuuaaucaaaggauuaaagauuuaaagaugucuaugucuucuauuu

SEQ ID NO: 444676 - RNA, 64 nt, Homo Sapiens
uucaugcucacuucuuaaaaaauaacugaaaauaaagauuuauuacuuucucuuauuggugggu

SEQ ID NO: 444677 - RNA, 64 nt, Homo Sapiens
aaucucaguuaccuacuauuguuacuuuuuggauaagauuuauugaaacuuuuauguuauaaga

SEQ ID NO: 444678 - RNA, 64 nt, Homo Sapiens
guauuaaauggccuucggguuaaacuacccaaguaagauuuacuggguuuuaaaaaauguuugc

SEQ ID NO: 444679 - RNA, 64 nt, Homo Sapiens
ccaccagggguauuucagcucugaauuucaugagaagauuuauuuguuuuguggcauaauauaa

SEQ ID NO: 444680 - RNA, 64 nt, Homo Sapiens
cuuccuguuuuaagcagcucuaaaacauagacugaagauuuauuuuuaauauguugacuuuauu

SEQ ID NO: 444681 - RNA, 64 nt, Homo Sapiens
aaaguagcaguuugguaugaguuggcaugcauacaagauuuacuaagugggauaagcuaauuau

SEQ ID NO: 444682 - RNA, 64 nt, Homo Sapiens
aacucuacuaauuuuuagauauucauuaauaggaaagauuuaauguuacagcaucuacucuuug

SEQ ID NO: 444683 - RNA, 64 nt, Homo Sapiens
aaaaguuguaccuugacccuagaauuccuuuuauaagauuuaauuguaauugucucaaagcauc

SEQ ID NO: 444684 - RNA, 64 nt, Homo Sapiens
ugugcaagauuguuaacuaaggcugggaaauaauaagauuuagaguccuaauuuucaauauauc

SEQ ID NO: 444685 - RNA, 64 nt, Homo Sapiens
gacuuuuuaauguaaaaguaauuauuguaagaaaaagauuuaauuguuccauguguauuuuauu

SEQ ID NO: 444686 - RNA, 64 nt, Homo Sapiens
cacaaguuuuggagggcuuucuuuaaaggcacaaaagauuuauuuagcauuuuuauacaaauau

SEQ ID NO: 444687 - RNA, 64 nt, Homo Sapiens
augagcaacccauuauuugcuggcaaauauuuucaagauuuaauauuuuaguauacagagugau

SEQ ID NO: 444688 - RNA, 64 nt, Homo Sapiens
uuagcaaaaauagcuuuuuacuucaucaguugcuaagauuuaauacuuuggauucaucaaagug

SEQ ID NO: 444689 - RNA, 64 nt, Homo Sapiens
cuagauuaaaaauagacuagaacagguucauuuuaagauuuacuuggaagagcaaagaaggaaa

SEQ ID NO: 444690 - RNA, 64 nt, Homo Sapiens
cuuuugaggaaugaugugauguguagagaauagaaagauuuagauauaugccugugacaggaau

SEQ ID NO: 444691 - RNA, 64 nt, Homo Sapiens
guguuacguguuacauggagugaggguagaugugaagauuuaaaacgauugauggauuuaagga

SEQ ID NO: 444692 - RNA, 64 nt, Homo Sapiens
guaucuacuucugguacuaauccagaaaaauaacaagauuuauagguaaauuucuuaaacauua

SEQ ID NO: 444693 - RNA, 64 nt, Homo Sapiens
guaaauuucuuaaacauuaucuaacaaacagaacaagauuuaagaaaaaaguuaacuuuucaua

SEQ ID NO: 444694 - RNA, 64 nt, Homo Sapiens
cugugggauggguaagaaauccacaaacaaaauuaagauuuaaaguauuuuccaucauuucaaa

SEQ ID NO: 444695 - RNA, 64 nt, Homo Sapiens
cacaauuuuucuucuuuaauauaguuuagccaguaagauuuaauacugaaaacauguuaaggcu

SEQ ID NO: 444696 - RNA, 64 nt, Homo Sapiens
agauauuuuggagauaaacauuaauaugugaaaaaagauuuagauacuaaauccuauguuuaca

SEQ ID NO: 444697 - RNA, 64 nt, Homo Sapiens
guuuauuuugagcucugcauuggaucuccaaauaaagauuuaguccuuccuuugaggaaggaug

SEQ ID NO: 444698 - RNA, 64 nt, Homo Sapiens
uaacaggcucccagcugaauggcucccuuccaggaagauuuauuacacacaaacgagagggcuu

SEQ ID NO: 444699 - RNA, 64 nt, Homo Sapiens
aguaauuuuuaugaaucuguuuuaugaguuagguaagauuuagccuuucugcagucugucucau

SEQ ID NO: 444700 - RNA, 64 nt, Homo Sapiens
uagacaggacagauacucucaacagacaagaaaaaagauuuagcuuaucacaagaagcagacaa

SEQ ID NO: 444701 - RNA, 64 nt, Homo Sapiens
agauuugaaaaucuuuaaugaacuggagaacacuaagauuuaaacucgaaaauucguuguucaa

SEQ ID NO: 444702 - RNA, 64 nt, Homo Sapiens
auauaugccuccuguguacuuuuggagaaaacugaagauuuaguuuccauuuuucuuuauaaua

SEQ ID NO: 444703 - RNA, 64 nt, Homo Sapiens
auuucuuuaaauagaaaaaguguuggggaaaauaaagauuuaauccuuaccugaucacaaauua

SEQ ID NO: 444704 - RNA, 64 nt, Homo Sapiens
aaaacuagcuaaagacaacaaccaucauuuugaaaagauuuauucccguuuucuagaguucuug

SEQ ID NO: 444705 - RNA, 64 nt, Homo Sapiens
caaccucacaaccuuggcugagucuugagacugaaagauuuagccauaauguaaacugccucaa

SEQ ID NO: 444706 - RNA, 64 nt, Homo Sapiens
gauuuguauuuaagaauuguuuuuaaaaaauuuuaagauuuacacaauguuucucuguaaauau

SEQ ID NO: 444707 - RNA, 64 nt, Homo Sapiens
accuuuguaauguucuucaccucagggcccuauuaagauuuauauaagcauagggggaaaaacu

SEQ ID NO: 444708 - RNA, 64 nt, Homo Sapiens
aaaagauuucggcaucgacagauuccuccaaaaaaagauuuaaaacuuuugccuccguccaaaa

SEQ ID NO: 444709 - RNA, 64 nt, Homo Sapiens
uucugagaagcaggaaucgcaaagaaaucgcuugaagauuuacuaagaaaggccaugaaauaga

SEQ ID NO: 444710 - RNA, 64 nt, Homo Sapiens
ugaacacauuuacacauaucccuuagguuuucucaagauuuaagaacaaaacaacagacuucau

SEQ ID NO: 444711 - RNA, 64 nt, Homo Sapiens
aaauauauauugauuaaaauauugaguuaaaaauaagauuuaaacauaucauagcacuaaaaag

SEQ ID NO: 444712 - RNA, 64 nt, Homo Sapiens
ucagcacacacuuacagagcuguaauaauuggagaagauuuaugucugccuuccuuguuaauuu

SEQ ID NO: 444713 - RNA, 64 nt, Homo Sapiens
caguugaaaacuuguaaucuucagcauauguguaaagauuuauaguaaauaauuggaaaaguaa

SEQ ID NO: 444714 - RNA, 64 nt, Homo Sapiens
cacaucucugcuggaaagucaacauguaguaagcaagauuuaacuguuugauuauaacugugca

SEQ ID NO: 444715 - RNA, 64 nt, Homo Sapiens
acuugauuucuuaucuguguuuguguuggcaugcaagauuuagguacuuaucaaagauaauggg

SEQ ID NO: 444716 - RNA, 64 nt, Homo Sapiens
aauuuguuuauuuuauuaaaaaucuagaauauuaaagauuuauacuuuuaauauugaauauagu

SEQ ID NO: 444717 - RNA, 64 nt, Homo Sapiens
cuuaggcuuuuaaacaaauacauggaaugguugaaagauuuauuuugcucgugcuuagcuaaau

SEQ ID NO: 444718 - RNA, 64 nt, Homo Sapiens
gacaucaaaaguucuucuggcaggugggauugugaagauuuacuuccaugaauguuaaaaugua

SEQ ID NO: 444719 - RNA, 64 nt, Homo Sapiens
uucuuauuucaaauuugauuuaacagcuuguccaaagauuuaaagaagaggagucacuaagccc

SEQ ID NO: 444720 - RNA, 64 nt, Homo Sapiens
aauaaaauguaaauuaucugaaaggacagaauauaagauuuaaccauguuugacguauuuuaau

SEQ ID NO: 444721 - RNA, 64 nt, Homo Sapiens
auuacauuuuugaaagguuuaugauuccaaaauaaagauuuauaugacuggugauacuggcuuu

SEQ ID NO: 444722 - RNA, 64 nt, Homo Sapiens
uccaaccugaguauuguaggggaaggaaauuuacaagauuuaauaggaaaugaaacagcuugaa

SEQ ID NO: 444723 - RNA, 64 nt, Homo Sapiens
cguggucagaauaaguuuuacacgaagcaggugaaagauuuaguucuuuucaaaguaacuuauu

SEQ ID NO: 444724 - RNA, 64 nt, Homo Sapiens
uucuacauggcuugauuacauagcaaacaagaccaagauuuagggcugucuuaaacaucacugc

SEQ ID NO: 444725 - RNA, 64 nt, Homo Sapiens
gcagugguggcacguagagaacuagaugguaauaaagauuuaaaacuaugaagaagguuacagu

SEQ ID NO: 444726 - RNA, 64 nt, Homo Sapiens
agaaauauuugaaggcaguaaaaaugaaaaagacaagauuuauggguguguauuuacuuuagaa

SEQ ID NO: 444727 - RNA, 64 nt, Homo Sapiens
uauucauucuuuacauauaauuuaggaaagaauaaagauuuauaauugucauaaaauuaauaaa

SEQ ID NO: 444728 - RNA, 64 nt, Homo Sapiens; identical to SEQ ID NO: 51753

SEQ ID NO: 444729 - RNA, 64 nt, Homo Sapiens; identical to SEQ ID NO: 51754

SEQ ID NO: 444730 - RNA, 64 nt, Homo Sapiens; identical to SEQ ID NO: 51755

SEQ ID NO: 444731 - RNA, 64 nt, Homo Sapiens; identical to SEQ ID NO: 51756

SEQ ID NO: 444732 - RNA, 64 nt, Homo Sapiens; identical to SEQ ID NO: 51757

SEQ ID NO: 444733 - RNA, 64 nt, Homo Sapiens; identical to SEQ ID NO: 51758

SEQ ID NO: 444734 - RNA, 64 nt, Homo Sapiens; identical to SEQ ID NO: 51759

SEQ ID NO: 444735 - RNA, 64 nt, Homo Sapiens; identical to SEQ ID NO: 51760

SEQ ID NO: 444736 - RNA, 64 nt, Homo Sapiens; identical to SEQ ID NO: 51761

SEQ ID NO: 444737 - RNA, 64 nt, Homo Sapiens; identical to SEQ ID NO: 51762

SEQ ID NO: 444738 - RNA, 64 nt, Homo Sapiens; identical to SEQ ID NO: 51763

SEQ ID NO: 444739 - RNA, 64 nt, Homo Sapiens; identical to SEQ ID NO: 51764

SEQ ID NO: 444740 - RNA, 64 nt, Homo Sapiens
uacauuaagucauauauuagcagguuaaauggucaagggauaccacuauggauuuuguaggugu

SEQ ID NO: 444741 - RNA, 64 nt, Homo Sapiens
uaauuuaaugcugaggagagauauugauuaguuaaagggauaauuacuacucauuuaucauugu

SEQ ID NO: 444742 - RNA, 64 nt, Homo Sapiens
aaguguggcaauacucuuucacuuaauucuuuacaagggauaucaaagccauaauggacuucau

SEQ ID NO: 444743 - RNA, 64 nt, Homo Sapiens
agccauaauggacuucauuaguuuuaggguagggaagggauacuaauuacuuauuucuuucaaa

SEQ ID NO: 444744 - RNA, 64 nt, Homo Sapiens
gcauaguuaacaacaaagagccaaaagaucaaagaagggauacuuucagaugguugucuugugu

SEQ ID NO: 444745 - RNA, 64 nt, Homo Sapiens
uuuauuaccugcuuaaugguccaccuggaacuaaaagggauacuauuuucuaacaagguauauc

SEQ ID NO: 444746 - RNA, 64 nt, Homo Sapiens
aucauuguuuauuacuggucacuuagaaaauuaaaagggauagggccaggcacaguggcuuaug

SEQ ID NO: 444747 - RNA, 64 nt, Homo Sapiens
agacuccgucucaaagaaacaaacaaaaaauuaaaagggauagaauauaaugaaauauauuuug

SEQ ID NO: 444748 - RNA, 64 nt, Homo Sapiens
uuuaauauuuaauaagauuuucugggauaacaguaagggauauuagauaauauaccguauguau

SEQ ID NO: 444749 - RNA, 64 nt, Homo Sapiens
guauguauuuauuacuagucuuuuccucuaggaaaagggauacuuugauaauuaaggccagagg

SEQ ID NO: 444750 - RNA, 64 nt, Homo Sapiens
gcuuugguggauguuccaccggugacgugaugaaugugggaaggcccuacuagcuggaaacucu

SEQ ID NO: 444751 - RNA, 64 nt, Homo Sapiens
cuuugaucagaggaugcauagugaauguaaugaaugugggaacgccauacuagugagaaaccac

SEQ ID NO: 444752 - RNA, 64 nt, Homo Sapiens
ccacaucuuguuccacaucaaaagguguaauguaugugggaagaucauaucagagagagauccu

SEQ ID NO: 444753 - RNA, 64 nt, Homo Sapiens
ccuuuugcaagugggcccacaacucuaugagauaugugggaaggaagaauuccuuccagagaua

SEQ ID NO: 444754 - RNA, 60 nt, Homo Sapiens
uguggguuuucuuuuuuuuugugcaaaugaugugggaauucuggaggaaaaaaccuuuga

SEQ ID NO: 444755 - RNA, 64 nt, Homo Sapiens
gauuuaauuuuuccuauugcuuaagaaaacaauaugugggaaauauguccuuguaggcucuguu

SEQ ID NO: 444756 - RNA, 64 nt, Homo Sapiens
aaagagauaagaggaggaaguacgcaacagauaaugugggaaaauugcagccuacuguaguaga

SEQ ID NO: 444757 - RNA, 64 nt, Homo Sapiens
guggggaagaaggggaucucgcuccugccccugcugugggaaaggcucuggcaucugagcccga

SEQ ID NO: 444758 - RNA, 64 nt, Homo Sapiens
caagcaaggcccuucuaccucccccacugccuaaugugggaacccuggguuugagcccugccuc

SEQ ID NO: 444759 - RNA, 64 nt, Homo Sapiens
gauuuucugccaaaugccauggaggagucuucaaugugggaagguucuucacuguguugagcug

SEQ ID NO: 444760 - RNA, 64 nt, Homo Sapiens
ggcaggcucugguuucugcucugugccucuuuuaugugggaaaguucaugaauuccuggaauuu

SEQ ID NO: 444761 - RNA, 64 nt, Homo Sapiens
uccccacggauggcgguggagggucugcagcuggugugggaacuugcccucggguggggcuggu

SEQ ID NO: 444762 - RNA, 52 nt, Homo Sapiens
gagucagaauauuuuugaaagcugugggaaccugcugaaacuggccuuguag

SEQ ID NO: 444763 - RNA, 64 nt, Homo Sapiens
cuuuguacuacugcaaacuuaaaaguuuuucaaaugugggaaacgugugggaaggcuuguugaa

SEQ ID NO: 444764 - RNA, 64 nt, Homo Sapiens
ugcaaacuuaaaaguuuuucaaaugugggaaacgugugggaaggcuuguugaacuuuggcgcac

SEQ ID NO: 444765 - RNA, 64 nt, Homo Sapiens
acggaagaagucucuaugagaagagcuccuuuaaugugggaauugauacacaagaagguacuua

SEQ ID NO: 444766 - RNA, 64 nt, Homo Sapiens
caugaagcuggaggcagagauuggagugauacauugugggaacccucagaagauaggaaaaaag

SEQ ID NO: 444767 - RNA, 64 nt, Homo Sapiens
auaaauaaauguucuacaccaacuuucagugauuugugggaaaaaauuauuucccacugaccua

SEQ ID NO: 444768 - RNA, 64 nt, Homo Sapiens
auauguacaauuauuugauuuacaaggcaggauaugugggaagaaucacaaugucauuuccuaa

SEQ ID NO: 444769 - RNA, 64 nt, Homo Sapiens
ugcaugguaauauaccuuauuggugcucaacauuugugggaaauuagaggguuggugagauuuu

SEQ ID NO: 444770 - RNA, 64 nt, Homo Sapiens
uuccuucccuuuauucccuugaaaaaagagaaucugugggaaauaggcagauauagcuuuuuaa

SEQ ID NO: 444771 - RNA, 64 nt, Homo Sapiens
uauuuauugauuuuaaaaguuuuacauguaggagugugggaaugaaggaauucuggagcuuuuu

SEQ ID NO: 444772 - RNA, 64 nt, Homo Sapiens
auauauuaauuucuuauguuuguaaguuuggcuuugugggaauagguguggagaaauuaaagag

SEQ ID NO: 444773 - RNA, 64 nt, Homo Sapiens
guuccaucccaagucacagcugcccuaggucccgugugggaaugcucgugugauggaugguccu

SEQ ID NO: 444774 - RNA, 64 nt, Homo Sapiens
cguccuuuacucaacaacccuccaauccggaugcugugggaagggccgggucacucggauacca

SEQ ID NO: 444775 - RNA, 64 nt, Homo Sapiens
auuuucuucuuccccagaagugcacuccugcuuuugugggaaaaagaaagucauuacuuacuac

SEQ ID NO: 444776 - RNA, 64 nt, Homo Sapiens
uguguuugucauauuuuucuuauguauguguacgugugggaacccaagugugcagguuccuuug

SEQ ID NO: 444777 - RNA, 64 nt, Homo Sapiens
ucugagaguauuacagagugagguguugggcaguugugggaacucagcaggaaacggguaggug

SEQ ID NO: 444778 - RNA, 64 nt, Homo Sapiens
aagcaacauugugaucuuucuuccccgccacgugugugggaaugauugaguccuguuugcaagc

SEQ ID NO: 444779 - RNA, 64 nt, Homo Sapiens
ucuuuaagaacaguugcaggaucuggcucgccucugugggaagccggcauuacaggugcuuggu

SEQ ID NO: 444780 - RNA, 64 nt, Homo Sapiens
cauucauaguggcaauguacacagucauaaggaaugugggaagccuuccuuggugucucagauc

SEQ ID NO: 444781 - RNA, 64 nt, Homo Sapiens
uccaauagaagagaagacauaugaauguaaggaaugugggaaaaucuuggcuccuuccauaggc

SEQ ID NO: 444782 - RNA, 64 nt, Homo Sapiens
uuacacuggagagaaacccuaugaguguaagcaaugugggaaagccuuuguuuccuucacuucc

SEQ ID NO: 444783 - RNA, 64 nt, Homo Sapiens
gcacagaggagagaagcucugugaauguaagcauugugggaaagcauucauaucugccaagauc

SEQ ID NO: 444784 - RNA, 64 nt, Homo Sapiens
ucacacuggagagaagcccuaugaauauaagcaaugugggaaagccuucagaucagccucgcac

SEQ ID NO: 444785 - RNA, 64 nt, Homo Sapiens
ucacaguggagaaaaacucuaugaguguaagcaaugugggaaagucuucagaucugucaagaac

SEQ ID NO: 444786 - RNA, 64 nt, Homo Sapiens
gcacagaggagaggcgcccuaagaauguaagcauugugggaaagcauucauaucugccaagauc

SEQ ID NO: 444787 - RNA, 64 nt, Homo Sapiens
ucauacgagagagaauccguaugaauguaaggauugugggaaagcauucagcuugcuuaauugc

SEQ ID NO: 444788 - RNA, 64 nt, Homo Sapiens
ucacacuggggagaaaccguaucaauguaagcaaugugggaaagccgucagaucagccucaaga

SEQ ID NO: 444789 - RNA, 60 nt, Homo Sapiens
ucuggagaaagaccuuauaaauguuagauaugugggaaaggccuuuauucugccaaguca

SEQ ID NO: 444790 - RNA, 64 nt, Homo Sapiens
ucacacuggagagaaacccuaugaguguaagcaaugugggaaagccuucagaugugccccacac

SEQ ID NO: 444791 - RNA, 64 nt, Homo Sapiens
acucacuggagagaaacccuaugaguguaaggaaugugggaaagccuucagaucugccucacac

SEQ ID NO: 444792 - RNA, 64 nt, Homo Sapiens
acacucuggagaaagaccuuauaaauguaagacaugugggaaaggcuuuuauucucccacguca

SEQ ID NO: 444793 - RNA, 64 nt, Homo Sapiens
ucacacuggagagaaacccuaugaguguaagcaaugugggaaagccuucagaucugccucaauc

SEQ ID NO: 444794 - RNA, 64 nt, Homo Sapiens
ucacccugaagagaagcccuacgaguguaagcaaugugggaaagccuucagaucugccccacac

SEQ ID NO: 444795 - RNA, 64 nt, Homo Sapiens
ucacacuggagagaaacccuaugaguguaaggaaugugggaaagccuucagaucugccaagaac

SEQ ID NO: 444796 - RNA, 64 nt, Homo Sapiens
gcacucuguagaaagaccuuauaaauguaagauaugugggaaaggcuuuuauucugccaaguca

SEQ ID NO: 444797 - RNA, 64 nt, Homo Sapiens
uuacacuggagagaaacccuaugaguguaagcaaugugggaaagccuuuauuucuuucacuucu

SEQ ID NO: 444798 - RNA, 64 nt, Homo Sapiens
ucacauuagauugaaacccuacgaaugcaguauaugugggaaagccuuuagucauaggucgucc

SEQ ID NO: 444799 - RNA, 64 nt, Homo Sapiens
ucauacuggagagaaaccuuacgaauguauuaaaugugggaagaccuucagcuguaguucaaac

SEQ ID NO: 444800 - RNA, 64 nt, Homo Sapiens
ucauacuggagaaaagccauauaaauguagugagugugggaaagcuuuuagcaaaggcucgaau

SEQ ID NO: 444801 - RNA, 64 nt, Homo Sapiens
uuauacuguagagaaaucauaugaagucaauaaaugugggaaagccuuugucaguauuaauccc

SEQ ID NO: 444802 - RNA, 64 nt, Homo Sapiens
ucacacuaggaaaaaucuguguacauguagcaaaugugggaaagacuauaggcaauaggaaucu

SEQ ID NO: 444803 - RNA, 64 nt, Homo Sapiens
ucacacuggagagaaaccuuaugaaugcagugaaugugggaaagcuuuuauucagaugucaaac

SEQ ID NO: 444804 - RNA, 64 nt, Homo Sapiens
ucauacuggagagaaaccuuaucauuguaaucaaugugggaaagcuuucagucagagacaaaau

SEQ ID NO: 444805 - RNA, 64 nt, Homo Sapiens
ucacacaggggagaaacccuaugaauguaauaaaugugggaaagccuuuucucagugcucauua

SEQ ID NO: 444806 - RNA, 64 nt, Homo Sapiens
ucauacuggugagaaacccuuugaauguaaugaaugugggaaagcauucucucaaagagcaucc

SEQ ID NO: 444807 - RNA, 60 nt, Homo Sapiens
gugggagaaaagccauauaaaugugagaagugugggaagggcuuuggcugggccucaacu

SEQ ID NO: 444808 - RNA, 64 nt, Homo Sapiens
ccacagcagagaaaaaccauucaaauaugagaacugugggaagagcuuuguacauagaucauau

SEQ ID NO: 444809 - RNA, 64 nt, Homo Sapiens
ucacacuggagaaagaccuuuugaaugcagcauuugugggaaauccuuuagaugucgcuccaca

SEQ ID NO: 444810 - RNA, 64 nt, Homo Sapiens
ucacacuggugaaaggccuuaugaguguagugaaugugggaaauucuuuaggcacaacucaaau

SEQ ID NO: 444811 - RNA, 64 nt, Homo Sapiens
ucacacuagggaaagaacuuacaaaugcagcaaaugugggaaauuuuuuauggacagcuccaca

SEQ ID NO: 444812 - RNA, 64 nt, Homo Sapiens
ucauacuggagaaaagccuuaugagugcagugaaugugggaaagucuuuagauacaacuccagc

SEQ ID NO: 444813 - RNA, 51 nt, Homo Sapiens
gaagaguucaugugcagugaaugugggaaauuauuuugucacuuuuuuuuu

SEQ ID NO: 444814 - RNA, 64 nt, Homo Sapiens
caaacauccauggauuucccauaaauuugagguaugugggaagcauguguagcuauguuguacu

SEQ ID NO: 444815 - RNA, 64 nt, Homo Sapiens
ucacacuagagaaaggccuuaugaauguagugaaugugggaaauccuuuagcuuaagguccaac

SEQ ID NO: 444816 - RNA, 64 nt, Homo Sapiens
aguucauacuggagaaaggcaugagugcgggcagugugggaaauccuuuagccgaaaaucuagc

SEQ ID NO: 444817 - RNA, 64 nt, Homo Sapiens
ucacacuggagaaaggccuuaugagugcagugacugugggaaauccuuugcugaaaacuccagc

SEQ ID NO: 444818 - RNA, 64 nt, Homo Sapiens
gucauacaucaaauagcugcauacauuccagguaugugggaacugcauaguauuuuucgaccug

SEQ ID NO: 444819 - RNA, 62 nt, Homo Sapiens
auacuggagagaaaccuuaggagugcagucauugugggaaagcuuucauccagaggucuccc

SEQ ID NO: 444820 - RNA, 64 nt, Homo Sapiens
auauccuggagaaaagcccuacgaaugcauugauugugggaaagccuucaaugaucgcucaacc

SEQ ID NO: 444821 - RNA, 64 nt, Homo Sapiens
cauacauuacucuugcagguaugaauguaaaaaaugugggaaaagcacacugcaaagaaacagu

SEQ ID NO: 444822 - RNA, 64 nt, Homo Sapiens
ccuuuuauuguugcaguucuacaaauguaaggaaugugggaaagucauacuggagagaaacccu

SEQ ID NO: 444823 - RNA, 64 nt, Homo Sapiens
cuuacuugucuccuuuagguaugaauguaaacugugugggaaaaucacacugcacagaaacacu

SEQ ID NO: 444824 - RNA, 64 nt, Homo Sapiens
ccuucaguuaccacuguacuacaaaugcaaggaaugugggaaagucauacuggagagaaacccu

SEQ ID NO: 444825 - RNA, 64 nt, Homo Sapiens
uguucguauaucacaacucuaugaauguaaaaaaugugggaaagucacacuggagaaaaacccu

SEQ ID NO: 444826 - RNA, 64 nt, Homo Sapiens
ccuucauuuaccgccauucuacaaauguaaggaaugugggaaacucauacuggagagaaacccu

SEQ ID NO: 444827 - RNA, 64 nt, Homo Sapiens
ccuucaguugucaacguucuacaaauguaaggccugugggaaagacacagugcagggauagucu

SEQ ID NO: 444828 - RNA, 64 nt, Homo Sapiens
ccuucaguuaucugcagucuauaaauguaagaaaugugggaaacggaauauggagagaagccau

SEQ ID NO: 444829 - RNA, 64 nt, Homo Sapiens
cuucaggaaccuggccacuacuacagagacgugaugugggaaacgauccuucacagaaaaaacu

SEQ ID NO: 444830 - RNA, 64 nt, Homo Sapiens
ugaucgauuuuuuuuuaacauaugauauaaggaaugugggaaagcucacacuggagagaugcug

SEQ ID NO: 444831 - RNA, 64 nt, Homo Sapiens
ccuuucauaauuuuuauuccccuauaaauguaaaugugggaaagaacuuacacuggacagaaac

SEQ ID NO: 444832 - RNA, 64 nt, Homo Sapiens
cauucauuaauuuuauuuuaauaaauguguggaaugugggaaagacucauuggaaagauacucu

SEQ ID NO: 444833 - RNA, 64 nt, Homo Sapiens
cauuugguuguuuccaguacaugaauguaaauaaugugggaaagucauaugggagagaagccau

SEQ ID NO: 444834 - RNA, 64 nt, Homo Sapiens
ccuuuagugaucuuuauuccucuauaaauguaaaugugggaaaggacucacacuagggagaaaa

SEQ ID NO: 444835 - RNA, 64 nt, Homo Sapiens
ccuuuguuuauuucauuggacaaaaugcaagauaugugggaaagcacacuggagauggaccuca

SEQ ID NO: 444836 - RNA, 64 nt, Homo Sapiens
cguuaucucauagcucaagcaugaaugcaagcagugugggaaagcacuggagagaagaaacucu

SEQ ID NO: 444837 - RNA, 64 nt, Homo Sapiens
gcuuugauuguuccaguacaauaaauguaagauaugugggaaaggcacacuagagauggaccuc

SEQ ID NO: 444838 - RNA, 64 nt, Homo Sapiens
cauuugaucaucugggaagcaugaauguaagcaaugugggaaagucacagugcagagaaacccc

SEQ ID NO: 444839 - RNA, 64 nt, Homo Sapiens
ccuucagugcuuccacuuccguacauguaaacaaugugggaaagucacacuggagagaaacucu

SEQ ID NO: 444840 - RNA, 64 nt, Homo Sapiens
cauuuuucuggcccaguuuaauaaauguaaguugugugggaaaggcagcauggagauggaccuu

SEQ ID NO: 444841 - RNA, 64 nt, Homo Sapiens
acuuuuaccugucccucagcagaaauauaagaaaugugggaaacucacauugcagagaaacuuc

SEQ ID NO: 444842 - RNA, 64 nt, Homo Sapiens
ccuuugcuuguuuccuaccuaugaguuuaaggaaugugggaaggucauacuggugagaaacccu

SEQ ID NO: 444843 - RNA, 64 nt, Homo Sapiens
uuuuuaauaauuauccaacuaucaguguaaagaaugugggaaggucacaaaggagagaaacccu

SEQ ID NO: 444844 - RNA, 64 nt, Homo Sapiens
ccuucauuuguuuuuuugauaugaauguaaugaaugugggaaugucacaguggggagaaacccu

SEQ ID NO: 444845 - RNA, 64 nt, Homo Sapiens
gaauauagaaauaauauucauauauagugaaaagugugggaaaauuuuaggaaagugucuauga

SEQ ID NO: 444846 - RNA, 64 nt, Homo Sapiens
cuuccagcccucuguuaauuauaaaaacaauauaugugggaaaaauguaguuggaagaacuacu

SEQ ID NO: 444847 - RNA, 64 nt, Homo Sapiens
acugaguccaacuagauuagagaaaauagagcauugugggaaaaaaauuugucaaaacuaggug

SEQ ID NO: 444848 - RNA, 64 nt, Homo Sapiens
uaauuuuauaauccauuuaaaaacugucauguuuugugggaaaaacuucuaguccaaauauaag

SEQ ID NO: 444849 - RNA, 64 nt, Homo Sapiens
uggacuccaacaagcaugugacugugagauugugugugggaaaauguauuuaacuacucugugu

SEQ ID NO: 444850 - RNA, 64 nt, Homo Sapiens
uauugugccagggauggggaaaugggggggguugugugggaagaguacuuauuauuguguuuuc

SEQ ID NO: 444851 - RNA, 64 nt, Homo Sapiens
agcauaacagggcaaugcagagagaccuacaagaugugggaaucuuuguuacagaaaugauccc

SEQ ID NO: 444852 - RNA, 64 nt, Homo Sapiens
accugcagacacaaaaugaggagccuuggagacaugugggaaacacaaaauggauuaauugggu

SEQ ID NO: 444853 - RNA, 64 nt, Homo Sapiens; identical to SEQ ID NO: 414846

SEQ ID NO: 444854 - RNA, 64 nt, Homo Sapiens; identical to SEQ ID NO: 414847

SEQ ID NO: 444855 - RNA, 64 nt, Homo Sapiens; identical to SEQ ID NO: 414848

SEQ ID NO: 444856 - RNA, 64 nt, Homo Sapiens; identical to SEQ ID NO: 414849

SEQ ID NO: 444857 - RNA, 64 nt, Homo Sapiens; identical to SEQ ID NO: 414850

SEQ ID NO: 444858 - RNA, 64 nt, Homo Sapiens; identical to SEQ ID NO: 414851

SEQ ID NO: 444859 - RNA, 64 nt, Homo Sapiens; identical to SEQ ID NO: 414852

SEQ ID NO: 444860 - RNA, 64 nt, Homo Sapiens; identical to SEQ ID NO: 414853

SEQ ID NO: 444861 - RNA, 64 nt, Homo Sapiens; identical to SEQ ID NO: 414854

SEQ ID NO: 444862 - RNA, 64 nt, Homo Sapiens; identical to SEQ ID NO: 414855

SEQ ID NO: 444863 - RNA, 64 nt, Homo Sapiens; identical to SEQ ID NO: 414856

SEQ ID NO: 444864 - RNA, 64 nt, Homo Sapiens; identical to SEQ ID NO: 414857

SEQ ID NO: 444865 - RNA, 64 nt, Homo Sapiens; identical to SEQ ID NO: 414858

SEQ ID NO: 444866 - RNA, 64 nt, Homo Sapiens; identical to SEQ ID NO: 414859

SEQ ID NO: 444867 - RNA, 64 nt, Homo Sapiens; identical to SEQ ID NO: 414860

SEQ ID NO: 444868 - RNA, 64 nt, Homo Sapiens; identical to SEQ ID NO: 414861

SEQ ID NO: 444869 - RNA, 64 nt, Homo Sapiens; identical to SEQ ID NO: 414862

SEQ ID NO: 444870 - RNA, 61 nt, Homo Sapiens; identical to SEQ ID NO: 414863

SEQ ID NO: 444871 - RNA, 64 nt, Homo Sapiens; identical to SEQ ID NO: 414864

SEQ ID NO: 444872 - RNA, 64 nt, Homo Sapiens; identical to SEQ ID NO: 414865

SEQ ID NO: 444873 - RNA, 64 nt, Homo Sapiens
aauaccaaauuaauuuugaaugcuuuuguuuccuaagagauaauggcaugguuucauauguuau

SEQ ID NO: 444874 - RNA, 64 nt, Homo Sapiens
auguucugaacaaacuugaaugaugaaaguauuaaagagauaucaguauuugagguuuguauuu

SEQ ID NO: 444875 - RNA, 64 nt, Homo Sapiens
ggaacacuggcagacuguguuaauaagaauggaaaagagauauguguuccaaggccagggacag

SEQ ID NO: 444876 - RNA, 64 nt, Homo Sapiens
uugggcaugugggcuucaacgagugauauggagcaagagauauuagaaagggacaaugauagua

SEQ ID NO: 444877 - RNA, 64 nt, Homo Sapiens
accaccucugaagaaguucaaaaaaaauuauaugaagagauaaaccaaguuuuuggaaaugguc

SEQ ID NO: 444878 - RNA, 64 nt, Homo Sapiens
aucaucaagggaagaagcuuggaucacugucucaaagagauauuaaaauuuuauacauuuaaaa

SEQ ID NO: 444879 - RNA, 64 nt, Homo Sapiens
aaggcugcaaggauuggggacagcacacacagcuaagagauaaguccaucuuucuccuuucuuc

SEQ ID NO: 444880 - RNA, 60 nt, Homo Sapiens
cuguaaaggagggggaagggugagacuagaaagagauacaccugccuugucguucgguaa

SEQ ID NO: 444881 - RNA, 64 nt, Homo Sapiens
ugcaucaugaauuacauguauuaaaaguuuuugaaagagauaagauugugaauuagaaacauuu

SEQ ID NO: 444882 - RNA, 64 nt, Homo Sapiens
aaugguuuacacuuuaacaacaguaaaaauuaaaaagagauaccuguuuguuuuagaaaaguua

SEQ ID NO: 444883 - RNA, 64 nt, Homo Sapiens
auaggguauugguaaagaaacggucaacauucuaaagagauacagucugaccuuuacuuuucuc

SEQ ID NO: 444884 - RNA, 64 nt, Homo Sapiens
cuuuguuucauuguucugucaauaauuguuaccaaagagauaaaaauaaaagcagaauguauau

SEQ ID NO: 444885 - RNA, 64 nt, Homo Sapiens
ggacgcuaccuugcuuuucuucugguaaagaagaaagagauaagcuucagauagagggugguau

SEQ ID NO: 444886 - RNA, 64 nt, Homo Sapiens
auuguuacucacacuuauguucugcacuaccaacaagagauaaauucugguuuuuagcccuuuc

SEQ ID NO: 444887 - RNA, 64 nt, Homo Sapiens
agagaccauaaaugacaagguuuugacauuuuugaagagauaauaaauguuuuaauuuggcagu

SEQ ID NO: 444888 - RNA, 64 nt, Homo Sapiens
aagaauaaagccaucauaagaccucaugccacagaagagauaaaagugcuuuuuauaccaucca

SEQ ID NO: 444889 - RNA, 63 nt, Homo Sapiens
ucuugaacaccugaggccuuccuggugcccaccaggcacuacggcuuccucuccagaaugugg

SEQ ID NO: 444890 - RNA, 63 nt, Homo Sapiens
cccugacagacauccagccccuaguaauacuuaaggcacuauggcacuuagcuuugaagugac

SEQ ID NO: 444891 - RNA, 63 nt, Homo Sapiens
uucaguuaggcugcacaaguaacauuaccuaaaaggcacuaacaugcucagguuccccagaaa

SEQ ID NO: 444892 - RNA, 63 nt, Homo Sapiens
aggacucuggagccagaguagaggcuguggcccaggcacuaccugcuggcucccaccuauggu

SEQ ID NO: 444893 - RNA, 63 nt, Homo Sapiens
uauuugguauuaaacuccaaaugagccauaggaaggcacuacaugaaauaaugcacugaguau

SEQ ID NO: 444894 - RNA, 63 nt, Homo Sapiens
caggugagggucuucuggacucuaagacgguaaaggcacuaaagucacuuuaaagcuuuugga

SEQ ID NO: 444895 - RNA, 63 nt, Homo Sapiens
uuguccaauguauuuguuucucagaccuugccuaggcacuaaaaauaaaauacuaggucauug

SEQ ID NO: 444896 - RNA, 63 nt, Homo Sapiens
cauggcucuaaaaaguuuugcccuuuuuaaggaaggcacuaaaaagagcuguccugguaucua

SEQ ID NO: 444897 - RNA, 63 nt, Homo Sapiens
aaauguaauguugauuccucaagaaugaaaugaaggcacuacauugaaauauguuuuguauaa

SEQ ID NO: 444898 - RNA, 63 nt, Homo Sapiens
aggucaggauuagacuucaggcauucauaaggcaggcacuaucagaaaguguacgccaacuaa

SEQ ID NO: 444899 - RNA, 63 nt, Homo Sapiens
ugcauaaaguauuaaagucauagaauuugggacaggcacuauuugguagauccaugugcaugc

SEQ ID NO: 444900 - RNA, 63 nt, Homo Sapiens
uccuuuccugacaauggcagaguucauaaguaaaggcacuaaaucaaaagugaagaaaaaguu

SEQ ID NO: 444901 - RNA, 63 nt, Homo Sapiens
uagaaguuugcuuuuucccuuccaagauacaaaaggcacuacauaugaacggaugccucagug

SEQ ID NO: 444902 - RNA, 63 nt, Homo Sapiens
agcaguauuuuaagguugguccuccauccccagaggcacuaaaccaccaguucugccuggcuu

SEQ ID NO: 444903 - RNA, 63 nt, Homo Sapiens
cucugcuuggacaaguuucuguuauggaguauaaggcacuaaccaaagucggcugcaacauug

SEQ ID NO: 444904 - RNA, 63 nt, Homo Sapiens
cccaggaaagaugacagcacagggguauuacucaggcacuaaccaggggaugagaaguuuuca

SEQ ID NO: 444905 - RNA, 63 nt, Homo Sapiens
gaaauccugugccuggaaugcaguugugggagcaggcacuaauucucuauauguauguguucc

SEQ ID NO: 444906 - RNA, 63 nt, Homo Sapiens
auauauuucuuccagccuuuacuuuuaaaaagcaggcacuaauguauuuaaaauguaaaauaa

SEQ ID NO: 444907 - RNA, 63 nt, Homo Sapiens
cgguggcccugucccucccaccucugugaccucaggcacuagccuuuggcucuggagacagcc

SEQ ID NO: 444908 - RNA, 63 nt, Homo Sapiens
uaugugaaaagucgcccaaaaugcaaccuugaaaggcacuacugacuuuguucuuauuggaua

SEQ ID NO: 444909 - RNA, 63 nt, Homo Sapiens
aaagaagaaugaauuaagggaacacuagacagaaggcacuaaaaaauauuuuaugguugaaaa

SEQ ID NO: 444910 - RNA, 63 nt, Homo Sapiens
aggaccagcccaaccccaugcacagacuaacguaggcacuauacccgcuggccaggggcucca

SEQ ID NO: 444911 - RNA, 63 nt, Homo Sapiens
guauuuauauugaagcuuguuucaucuaguguuaggcacuauaaaugguauuugaauuaaaug

SEQ ID NO: 444912 - RNA, 63 nt, Homo Sapiens
cugggauucaagacagucuuccacccagugaauaggcacuaccuugggggaagucuucugaga

SEQ ID NO: 444913 - RNA, 63 nt, Homo Sapiens
ugacuuuaggauuugcauuuagaauuaugagaaaggcacuagaagagcacuuuuucuuuguuu

SEQ ID NO: 444914 - RNA, 63 nt, Homo Sapiens
uggguuuuggggggacgcuaucuggcucuggacaggcacuaucagguuguguguggaagguga

SEQ ID NO: 444915 - RNA, 63 nt, Homo Sapiens
auuaccccagggccaucugugucccugaaccagaggcacuaggcagcugagucaagcuuggag

SEQ ID NO: 444916 - RNA, 63 nt, Homo Sapiens
augucuguaaagcauauuuaccucuugggagauaggcacuauguaaauaagguaaaauuucug

SEQ ID NO: 444917 - RNA, 63 nt, Homo Sapiens
caggggaaaagugccucauaguuaggaaaguuuaggcacuaguugggaguaauauucaauuaa

SEQ ID NO: 444918 - RNA, 63 nt, Homo Sapiens
uggcagcaccaucuaaaccuuuucuucucuuugaggcacuacccuuauucugaagugaccacu

SEQ ID NO: 444919 - RNA, 63 nt, Homo Sapiens
ugucauugaucuugcccccaucuuugcugucucaggcacuacaaucuaauugcuaacaaaugc

SEQ ID NO: 444920 - RNA, 63 nt, Homo Sapiens
gggccuuucccuuccuuuccagggcuguggggcaggcacuagggcuaaauaugugccuuccuc

SEQ ID NO: 444921 - RNA, 62 nt, Homo Sapiens
acuaagauaucccagaagaaucauuagggagcaggcacuaccaaacuguucagcaaagguag

SEQ ID NO: 444922 - RNA, 63 nt, Homo Sapiens
uucugggggagacaugcucuccccacaggggggaggcacuaagucaugguccuggcuggaagg

SEQ ID NO: 444923 - RNA, 63 nt, Homo Sapiens
uaaaauguuuaaaaacaaaacaaaacaaaaaagaggcacuagucuaucugcaauuacucaacg

SEQ ID NO: 444924 - RNA, 63 nt, Homo Sapiens
gguucuccuugcugugugugacacagcagacagaggcacuauuccuggugcaguauuucaggg

SEQ ID NO: 444925 - RNA, 63 nt, Homo Sapiens
acaaacaaagcuauuggguguccaugauauaccaggcacuaugcuagguguugagaauguaaa

SEQ ID NO: 444926 - RNA, 63 nt, Homo Sapiens
caaguacuucugcugaaacaaauuuauuuggcuaggcacuaaguuguuuuccagugaauagua

SEQ ID NO: 444927 - RNA, 63 nt, Homo Sapiens
ggaguuuggggaaagccaaaaguagaccugucuaggcacuaagcuaauagggcagucgccaga

SEQ ID NO: 444928 - RNA, 63 nt, Homo Sapiens
gauguuaguaacuuuuagugcagggaaucagaaaggcacuaaucucagcuaugaaaugaccuc

SEQ ID NO: 444929 - RNA, 63 nt, Homo Sapiens
uuccuuuauuucuggcucacagaggcagccacgaggcacuacaccaaguauuauauaaaagcc

SEQ ID NO: 444930 - RNA, 63 nt, Homo Sapiens
ucucuuuagcccucuuccugcacuugggagcaaaggcacuaccaguagagaagggccauccag

SEQ ID NO: 444931 - RNA, 63 nt, Homo Sapiens
ggcucccuugacguuuggcaguccgcccuguccaggcacuagaagagggugccggggaaggga

SEQ ID NO: 444932 - RNA, 63 nt, Homo Sapiens
uuuuauuaggaaauauuuaaaucaggguauaguaggcacuaaguuuaggccuuuuuuuaaaaa

SEQ ID NO: 444933 - RNA, 63 nt, Homo Sapiens
cuauucucugaaagaugcagucuacuguguaacaggcacuaugauucacuucuuuuuaaagua

SEQ ID NO: 444934 - RNA, 63 nt, Homo Sapiens
augaaauggcaggaugccaaauggaaaaaugauaggcacuacaaggcaacuuuaucaguauca

SEQ ID NO: 444935 - RNA, 63 nt, Homo Sapiens
gauuguguguauguauguuuaauauaacaugacaggcacuaggacgucugccuuuuuaaggca

SEQ ID NO: 444936 - RNA, 63 nt, Homo Sapiens
caacaaagauguacucuuaaacucaguaucaccaggcacuauauuucaucuuugaggcuuuug

SEQ ID NO: 444937 - RNA, 63 nt, Homo Sapiens
uacacgauucuuauuuuauaagaaacagcugagaggcacuauggauuagucuucugaagugaa

SEQ ID NO: 444938 - RNA, 63 nt, Homo Sapiens
uucuuacaauaacuaaaccacuuaaaaugaucaaggcacuaauguuuuggucugaaaagcugu

SEQ ID NO: 444939 - RNA, 63 nt, Homo Sapiens
aucagauggcaagcucaguguucugcaaggucaaggcacuagugccuucugcaagccaagugg

SEQ ID NO: 444940 - RNA, 63 nt, Homo Sapiens
aaauguggauaauaacuaccaauaaacuacuugaggcacuaggagaacaguauuugacuuuga

SEQ ID NO: 444941 - RNA, 63 nt, Homo Sapiens
auccucaggcuggcggccaaggccugccccuggaggcacuagaggagggcaucugucuguggg

SEQ ID NO: 444942 - RNA, 63 nt, Homo Sapiens
ugauggggacgggguccaggagggccacugggaaggcacuauccagaaauaguggacagaggu

SEQ ID NO: 444943 - RNA, 63 nt, Homo Sapiens
agcuccccgcccuaaaaggaggcagugaggaccaggcacuauuuccuccgagguuacuucuac

SEQ ID NO: 444944 - RNA, 63 nt, Homo Sapiens
ucugaugcuguuuuuguuccaaauauaaacgaaaggcacuagucagccgccugcauagacuuu

SEQ ID NO: 444945 - RNA, 63 nt, Homo Sapiens
cucagaagcccuucugaugcucuucagugagggaggcacuaccauuugaagugaccccauguc

SEQ ID NO: 444946 - RNA, 63 nt, Homo Sapiens
cauucaagaaaucauuauugagucaccauugacaggcacuauucuaaucaguaguucacuuua

SEQ ID NO: 444947 - RNA, 63 nt, Homo Sapiens
aagguaaacauggagacuuaaacauaaagaaauaggcacuauacaauggggacauaaaaaaag

SEQ ID NO: 444948 - RNA, 63 nt, Homo Sapiens
gacccuguuuugcuuaacccugguaccuugcauaggcacuaugucaaggacuucugaggagcc

SEQ ID NO: 444949 - RNA, 63 nt, Homo Sapiens
aaagagcugacuacugagaaccaugagggcugcaggcacuacaauuuucugccuccaucccac

SEQ ID NO: 444950 - RNA, 63 nt, Homo Sapiens
uggaggauucuuugguaucuuacuguuugguuaaggcacuaauuuuacuuaccuauuagauuu

SEQ ID NO: 444951 - RNA, 63 nt, Homo Sapiens
agaauauaaaugauucuauuaaaauaugcuguaaggcacuauauucauuuucucauuaacgau

SEQ ID NO: 444952 - RNA, 63 nt, Homo Sapiens
caaagcccugagaagaauauuucuuuggaccccaggcacuaggggccaccugccugggagucu

SEQ ID NO: 444953 - RNA, 63 nt, Homo Sapiens
uuugcccccgacggcugugacgcagccggagggaggcacuagucaccgacagcggccuugaag

SEQ ID NO: 444954 - RNA, 63 nt, Homo Sapiens
aacuaaaacugaaaacuaaguccuuuuauaggcaggcacuaguuaggguuaaaucauuuaagg

SEQ ID NO: 444955 - RNA, 63 nt, Homo Sapiens
ccuuuacagaugaccaugcuuguuuaccugugcaggcacuaguaggaguguaaggaaacauca

SEQ ID NO: 444956 - RNA, 63 nt, Homo Sapiens
ccuuuacagaugacaaugcuuguauaccugugcaggcacuaguagcagugugaagaagcuugg

SEQ ID NO: 444957 - RNA, 63 nt, Homo Sapiens
ccuuuacagaugaccauucuuguuuaccugugcaggcacuaguaggaguguuaagaagcaucg

SEQ ID NO: 444958 - RNA, 63 nt, Homo Sapiens
ccuuuacagaugaccauucuuguauaccugugcaggcacuaguagcaguguaaagaagugucg

SEQ ID NO: 444959 - RNA, 63 nt, Homo Sapiens
ccuuuacagaugaccaugcuuguuuaccugugcaggcacuaguaggaguguaaagaagcaucg

SEQ ID NO: 444960 - RNA, 63 nt, Homo Sapiens
acuuuacagaugaccaugcuuguauaccugugcaggcacuaguagcaguguaaagaagcgucg

SEQ ID NO: 444961 - RNA, 63 nt, Homo Sapiens
cccuuacagaggaccaugcuuauucagcucuuaaggcacuaguaggaguauuaaucaacauug

SEQ ID NO: 444962 - RNA, 63 nt, Homo Sapiens
gccaccugccacaguaaagcggggugugaaccaaggcacuacugcagugcaggggaccugugu

SEQ ID NO: 444963 - RNA, 63 nt, Homo Sapiens
gccucucugggcccuacagccugagacuguuggaggcacuagguagaaguaaucaaguagcau

SEQ ID NO: 444964 - RNA, 63 nt, Homo Sapiens
ucuccauuuucagacugaggugauuuacgaguuaggcacuacaaagauacuuguagcugucug

SEQ ID NO: 444965 - RNA, 63 nt, Homo Sapiens
ucugauuuauugcaauguucaaguauguacacgaggcacuacuguuuucaucuguaaauaguu

SEQ ID NO: 444966 - RNA, 63 nt, Homo Sapiens
aaucgguguugucacucacuucauucucuguuuaggcacuaaacaucacaggucaaguugaag

SEQ ID NO: 444967 - RNA, 63 nt, Homo Sapiens
acuccagcuggaagucacgguagacaaggagagaggcacuagaaaaaaaaaaaacaaaaaaac

SEQ ID NO: 444968 - RNA, 63 nt, Homo Sapiens
cauuuuaaggagaggaaagaauuggaccagaagaggcacuagccaaggagagggcggugacau

SEQ ID NO: 444969 - RNA, 63 nt, Homo Sapiens
cagggacuuguguacugguuaugggggugccagaggcacuaggcuugggguggggaggucccg

SEQ ID NO: 444970 - RNA, 63 nt, Homo Sapiens
aaggaggagguccuccgugguacauacugggucaggcacuagcauggaggagggucacagagu

SEQ ID NO: 444971 - RNA, 63 nt, Homo Sapiens
auuggcacagaccaguuucagagaaauacuuucaggcacuaagacuaaucgaaugaacaaagu

SEQ ID NO: 444972 - RNA, 63 nt, Homo Sapiens
aaaaaaagaaauuugaugcccagauaauauauuaggcacuacugauuuuuuaguuaaauugau

SEQ ID NO: 444973 - RNA, 63 nt, Homo Sapiens
aaauugcaauccagcacacgugugagaaagaagaggcacuagucuaaaaggcugcauugcggg

SEQ ID NO: 444974 - RNA, 63 nt, Homo Sapiens
uuaacuagguuuacaacugguggaccacacaccaggcacuaaucaccuggugaggauuuggca

SEQ ID NO: 444975 - RNA, 63 nt, Homo Sapiens
acaauuacagaaucaugauuugucaacuuacaaaggcacuauagaguaaggggauuuggaaac

SEQ ID NO: 444976 - RNA, 63 nt, Homo Sapiens
ggggcugaggucaggaguauaaguaccugccuuaggcacuauuccuuauauaacaaaaauauu

SEQ ID NO: 444977 - RNA, 63 nt, Homo Sapiens
gccuauuugaaugacaaaggugccaguagugccaggcacuacacagagaggaaguggauuugu

SEQ ID NO: 444978 - RNA, 63 nt, Homo Sapiens
aucucacacugcaccaagcacccacugugcaccaggcacuaagucucuagccucuuucucccu

SEQ ID NO: 444979 - RNA, 63 nt, Homo Sapiens
cuccucuccacgucccagaacuggcccagcugcaggcacuaagaagcuccuccccugagacaa

SEQ ID NO: 444980 - RNA, 63 nt, Homo Sapiens
aggggacccccagaaacaggagucaggaaaaugaggcacuaagccuaagaaguucccugguuu

SEQ ID NO: 444981 - RNA, 63 nt, Homo Sapiens
ucgucugcauuccagcaaaaauaucaacucguaaggcacuaguacaguuaaacugacaucuua

SEQ ID NO: 444982 - RNA, 63 nt, Homo Sapiens
augacagaggaggcucaagggaagagauugcccaggcacuaccacucugcucacauguucccc

SEQ ID NO: 444983 - RNA, 63 nt, Homo Sapiens
uuagcuauguuuuucccaucaauaagauaccaaaggcacuauuugacggacuagaagacugua

SEQ ID NO: 444984 - RNA, 63 nt, Homo Sapiens
cugaauuuugcuugaagauccuauuuaagccaaaggcacuagccucaguuucucugucuguac

SEQ ID NO: 444985 - RNA, 63 nt, Homo Sapiens
uuuuggagggggcgacuacccauaccccaagccaggcacuagaugacgcugagagagaaccau

SEQ ID NO: 444986 - RNA, 63 nt, Homo Sapiens
cuagaucuggugccuagaagccuacucugugcaaggcacuaugaaauaaguauguauugagug

SEQ ID NO: 444987 - RNA, 63 nt, Homo Sapiens
uuuguucucuuuuugggugauuaaaaaacugacaggcacuauaauuucuguaacacacuaaca

SEQ ID NO: 444988 - RNA, 63 nt, Homo Sapiens
uucugagaacaugugaaacuauguuaaaacugaaggcacuauauauuuuuacauaaaagcuug

SEQ ID NO: 444989 - RNA, 63 nt, Homo Sapiens
gauuguuaagagaaaagcuuuggcuuauuuuucaggcacuaaguuauacucuuguuaucaaaa

SEQ ID NO: 444990 - RNA, 63 nt, Homo Sapiens
caacagauaguucagaaacacuuuuuaucugcaaggcacuauucuagauccagaagaugcaau

SEQ ID NO: 444991 - RNA, 63 nt, Homo Sapiens
gaagaaaaauagccucaaucucccaccccauguaggcacuaccuccccaauuacccuuagaaa

SEQ ID NO: 444992 - RNA, 63 nt, Homo Sapiens
uguauugcuuuaguaugcuggcuuguacauaguaggcacuaaauacauguuuguugguugauu

SEQ ID NO: 444993 - RNA, 63 nt, Homo Sapiens
aaaaucaagugcuagacacacuggcugcuacuaaggcacuagccucuguagcuggugguggca

SEQ ID NO: 444994 - RNA, 63 nt, Homo Sapiens
caggugcccccuccaggccugacuggcuccgccaggcacuaaccugccauaacccuuugugcu

SEQ ID NO: 444995 - RNA, 63 nt, Homo Sapiens
gcagagcuaguaaugcuuuugcugugauaccuuaggcacuaaaauuucugucuacuaagugau

SEQ ID NO: 444996 - RNA, 63 nt, Homo Sapiens
caugcaauuaaaacaaaacaaacacaaacaaggaggcacuaagccuauucugacaccacuggu

SEQ ID NO: 444997 - RNA, 63 nt, Homo Sapiens
gcacaccaaagccuccuccccuccccacuuccuaggcacuaggaucucucuguggcuuccccu

SEQ ID NO: 444998 - RNA, 63 nt, Homo Sapiens
acgugaugugcaccaccucgaucucgguguuucaggcacuaaagcaacaaaacaacccauagu

SEQ ID NO: 444999 - RNA, 63 nt, Homo Sapiens
cugggcccucacucugccuaggggagcugggccaggcacuagccuuugcccagggaggugggc

SEQ ID NO: 445000 - RNA, 63 nt, Homo Sapiens
gagcccucugcucacuggcacuuccugacucaaaggcacuaacagugcucaugugccuuccag

SEQ ID NO: 445001 - RNA, 63 nt, Homo Sapiens
cccucccgaacccagggucaaccugccuaccacaggcacuagaaggacgaaucugccuacugc

SEQ ID NO: 445002 - RNA, 63 nt, Homo Sapiens
uacuaagaaauauguacagcuaccccuguuuucaggcacuauguuugagaacauuuuagccau

SEQ ID NO: 445003 - RNA, 63 nt, Homo Sapiens
gugggcaaggauggguccagaagaccccacuucaggcacuaagaggggcuggaccuggcggca

SEQ ID NO: 445004 - RNA, 63 nt, Homo Sapiens
agauuagaucuucuugguucccugugagguuucaggcacuaaaacucuauguggggaagggag

SEQ ID NO: 445005 - RNA, 63 nt, Homo Sapiens
cuucggaggaaaaaaguugcuauugcccguuaaaggcacuagaguuaguguuuuaucccuaaa

SEQ ID NO: 445006 - RNA, 63 nt, Homo Sapiens
ugguuuuuuccucuggaagaagauucaagggaaaggcacuaaaggauguauguguauaaaaac

SEQ ID NO: 445007 - RNA, 63 nt, Homo Sapiens
gguuccucuuagcuauuuaacugagcagagaaaaggcacuaacucuguuccuguucugauauu

SEQ ID NO: 445008 - RNA, 63 nt, Homo Sapiens
ggacgucagcuucuucauuuuacuggugugggcaggcacuagucaggccucuacacuucugcu

SEQ ID NO: 445009 - RNA, 63 nt, Homo Sapiens
ugucuggggcuucgauccuuuccucccucugccaggcacuauggguccaagguccucauccca

SEQ ID NO: 445010 - RNA, 63 nt, Homo Sapiens
cccaggcugcggagaacccaggugggauccugaaggcacuagcugacagacgggccccucaau

SEQ ID NO: 445011 - RNA, 63 nt, Homo Sapiens
gaacaaguuaccugucacauugaagaaaaggguaggcacuaaagggagaacacagaaagaaga

SEQ ID NO: 445012 - RNA, 63 nt, Homo Sapiens
gucaucaagcaguuacugaucagauuaagaaucaggcacuagugauacacauucauuuuuaaa

SEQ ID NO: 445013 - RNA, 63 nt, Homo Sapiens
ccaucaugcacuugcuaugugcaaggccuuuuuaggcacuagagauauagcagugaccaaaac

SEQ ID NO: 445014 - RNA, 63 nt, Homo Sapiens
ugcccauuguaaaaacacauccacagacaguccaggcacuaaggcugaaugggaucaggguau

SEQ ID NO: 445015 - RNA, 63 nt, Homo Sapiens
gagacucugacuuuuauuucggcacuggugaggaggcacuaaggccacugucacaagccggca

SEQ ID NO: 445016 - RNA, 63 nt, Homo Sapiens
cucagcugagggggguguuuugccuggauucccaggcacuaagccagcgggcugccccuccuc

SEQ ID NO: 445017 - RNA, 63 nt, Homo Sapiens
acgcacaaauggggagagaaguguuuauuuuguaggcacuaaggguuucuaaaacccuuaaca

SEQ ID NO: 445018 - RNA, 63 nt, Homo Sapiens
cagagagcuugcugcugcggggguggagcaguaaggcacuaccacuuggaacagggcucaggu

SEQ ID NO: 445019 - RNA, 63 nt, Homo Sapiens
cuuguucuauccaggcccucaacaaauuggaugaggcacuaugcccugggaucauccuuacuc

SEQ ID NO: 445020 - RNA, 63 nt, Homo Sapiens
aaaauuuuuguuugguuauaucgaaauaguuacaggcacuaaaguuaguaaagaaaaguuuac

SEQ ID NO: 445021 - RNA, 63 nt, Homo Sapiens
ugcuacugaugcugucauguggaaacuauuuaaaggcacuauuauaaauuuauccuauaagau

SEQ ID NO: 445022 - RNA, 63 nt, Homo Sapiens
agaaggcuuuucagcaccaucuaauguuuuaaaaggcacuaguuuuaagugcacagcucauaa

SEQ ID NO: 445023 - RNA, 63 nt, Homo Sapiens
acugaaguagcucuagaaagacacauguauacaaggcacuauuguacacacuuugcugaauau

SEQ ID NO: 445024 - RNA, 63 nt, Homo Sapiens
aguggagcaugagcucugggguaggauuuggucaggcacuaggagcuagaccuugacaaauug

SEQ ID NO: 445025 - RNA, 63 nt, Homo Sapiens
cuaaaucaaaccauaaaugauuaagaacaguugaggcacuacaugcauuauacuaagacacca

SEQ ID NO: 445026 - RNA, 63 nt, Homo Sapiens
ccuuggugacuuccuggggccuagcccugacccaggcacuaggaacuuucccagugacuuccc

SEQ ID NO: 445027 - RNA, 65 nt, Homo Sapiens
ugccuaugggugacugccuucucccagaguuuucuuuggagaacagaaagaagaaaggaaagaaa

SEQ ID NO: 445028 - RNA, 65 nt, Homo Sapiens
uaguuucugaaaccgcucagauguuuuggggaaaguuggagaagccguggccuugcgagaggugg

SEQ ID NO: 445029 - RNA, 65 nt, Homo Sapiens
gggacccgggcaggcccccagcaccccaugcugacuuggagaaccccagaucucuggggcccagc

SEQ ID NO: 445030 - RNA, 65 nt, Homo Sapiens
cgcagacaccggggcuggguuucucuuuccucuuuuuggagaaaaggaacagggcaguggaauga

SEQ ID NO: 445031 - RNA, 65 nt, Homo Sapiens
uaaacccuuuccuccucccauuuugacauuugcacuuggagaacacuugaguugugaagguuuug

SEQ ID NO: 445032 - RNA, 65 nt, Homo Sapiens
ucuggaggggagagaaggauucuagggguguggaguuggagaaagaggcuuccuugagccacccu

SEQ ID NO: 445033 - RNA, 65 nt, Homo Sapiens
uacauuaggaaacaauggcagucaaacccauggcuuuggagaaaguaaauguuugccagaaagga

SEQ ID NO: 445034 - RNA, 65 nt, Homo Sapiens
ggugcuggugcggauggacacuaaugcagccacgauuggagaauacuuugcuucauaguauugga

SEQ ID NO: 445035 - RNA, 65 nt, Homo Sapiens
uaucagagcaaacaucauguagauagcacaaguauuuggagaaacguuguuuguuuuguuaccaa

SEQ ID NO: 445036 - RNA, 65 nt, Homo Sapiens
aauaauuuaaaauaauuauuguauaauaucuacauuuggagaauuuugaacuaucaagcauauac

SEQ ID NO: 445037 - RNA, 65 nt, Homo Sapiens
aagacgguaaaggcacuaaagucacuuuaaagcuuuuggagaagcaggagggcauuggcuuaacc

SEQ ID NO: 445038 - RNA, 65 nt, Homo Sapiens
caaaucugaaggacuucaucucccgcuuugagggcuuggagaagaucucugccuacaugaagucc

SEQ ID NO: 445039 - RNA, 65 nt, Homo Sapiens
uaccuggcauggacugauguuuuuaggcacagaaguuggagaagagauuucaugaaagacaacau

SEQ ID NO: 445040 - RNA, 65 nt, Homo Sapiens
ucuguguuuucagaauuuccauuucuacuaaccucuuggagaaaaagaaauugaauuagagguaa

SEQ ID NO: 445041 - RNA, 65 nt, Homo Sapiens
gcccuaaaagcuggagacacagauguccagagugauuggagaauguccugggggaaugaaguucc

SEQ ID NO: 445042 - RNA, 65 nt, Homo Sapiens
uuucccugaggcuuuggggucagaguauauguuguuuggagaaagagggcaaucaggacucuucu

SEQ ID NO: 445043 - RNA, 65 nt, Homo Sapiens
uuucuggccuggcuuucccucucagacauagcucuuuggagaacuagguguuguaauucaguuau

SEQ ID NO: 445044 - RNA, 65 nt, Homo Sapiens
acauugucaaaacuaccaauuccagguuaacuuuguuggagaauuucccccacccccauccagug

SEQ ID NO: 445045 - RNA, 65 nt, Homo Sapiens
cugcugguuccccagcccuuuucccuggcccuggcuuggagaaucuguuuucaaucuccacugau

SEQ ID NO: 445046 - RNA, 65 nt, Homo Sapiens
acuuggaggcaggauccaggcacagcuccccucacuuggagaaccuugacucucuugauggaaca

SEQ ID NO: 445047 - RNA, 65 nt, Homo Sapiens
aauaaaacacugucuuuucaggauugcuucauggauuggagaacuuucuaaccaaaaauuaaaaa

SEQ ID NO: 445048 - RNA, 65 nt, Homo Sapiens
uagacuuaguaccagaaccaaaaauaccuagauuuuuggagaacuuauuacauacauagaaacau

SEQ ID NO: 445049 - RNA, 65 nt, Homo Sapiens
agaacccagccuacucuagaauuucagcagugacauuggagaauauuuuuaauuugcugcaguac

SEQ ID NO: 445050 - RNA, 55 nt, Homo Sapiens
gcuacacaccccagccuuaagucucuuggagaagcuggugcugugagccagagga

SEQ ID NO: 445051 - RNA, 65 nt, Homo Sapiens
gggcaaggagagaagugagagcuacaauuccagcauuggagaagcgaggggcggggcgucaacgg

SEQ ID NO: 445052 - RNA, 65 nt, Homo Sapiens
caggggcuaguuuggcuuuuccaaguggguuuucuuuggagaaucugaugccaugcaauuggcau

SEQ ID NO: 445053 - RNA, 65 nt, Homo Sapiens
uugucguagacuugugcaauauauacuguuguggguuggagaaaaguggaaagcuacacugggaa

SEQ ID NO: 445054 - RNA, 65 nt, Homo Sapiens
cugguaggcaaauuguuaggcagaauaaugguauguuggagaaauacaccugucucuuauucuua

SEQ ID NO: 445055 - RNA, 65 nt, Homo Sapiens
uaccuuugguaaauacaccauaccauaauaucugcuuggagaaccacaaugcacauuagcauauu

SEQ ID NO: 445056 - RNA, 65 nt, Homo Sapiens
uaauuaacuagcauuuagccagcuuuuucuugcccuuggagaaaaagaaucauucucaaccugau

SEQ ID NO: 445057 - RNA, 65 nt, Homo Sapiens
uucugcagcauggcuuuuuaaggaaaucuucauaauuggagaaagcuuuuauuuuaauacauugu

SEQ ID NO: 445058 - RNA, 65 nt, Homo Sapiens
aaauuaacaauaaagaauuucuaaaaauauaucuguuggagaaaggcuguggcuccauauuucaa

SEQ ID NO: 445059 - RNA, 65 nt, Homo Sapiens
augcugagaauuuguauugaaaugggggagccuaauuggagaauggucauuagaaacaauugguu

SEQ ID NO: 445060 - RNA, 65 nt, Homo Sapiens
guucuguugcccugauuuauggucuucuggucuccuuggagaaaggccaaggcggcggcagagcu

SEQ ID NO: 445061 - RNA, 65 nt, Homo Sapiens
cuucauaaaaucuaugaauacuuggaggauauauuuuggagaauguauaaaacagacuuacucuc

SEQ ID NO: 445062 - RNA, 65 nt, Homo Sapiens
cccuaucagcacagggaucucaggcugucuggaaguuggagaauuauguacgcaaagggcagccc

SEQ ID NO: 445063 - RNA, 65 nt, Homo Sapiens
agaaaaaucuuggggcuucccauggacauuuuacuuuggagaaaccuaggaaagacauguaagag

SEQ ID NO: 445064 - RNA, 65 nt, Homo Sapiens
gaugagcuacgccuugaugacuguagcaugucaguuuggagaaauacgcuuuuuggaagacauuu

SEQ ID NO: 445065 - RNA, 65 nt, Homo Sapiens
gcaggagaguaccugggaauuuauuuacuuccuuguuggagaagguuccugaguuaaaagucuau

SEQ ID NO: 445066 - RNA, 65 nt, Homo Sapiens
ucaaaccuucaagcccuagguuucccuuguuacuguuggagaaacggcuccagguggaagcaugc

SEQ ID NO: 445067 - RNA, 65 nt, Homo Sapiens
agaaagaaaggaaagaacucaagauaucuguaucuuuggagaaggauuccauagaaaacuguaga

SEQ ID NO: 445068 - RNA, 65 nt, Homo Sapiens
cuugccuauaauucuauaaauuaaguuaaguuuuauuggagaaauguuauaguuuuauaacuggc

SEQ ID NO: 445069 - RNA, 65 nt, Homo Sapiens
gucauaaauuacuguuuugcgaacuaugcuaauuuuuggagaaauucuuuuuacuguugaacuua

SEQ ID NO: 445070 - RNA, 65 nt, Homo Sapiens
ggucagaagccccaaacggcaauaagaaaacugucuuggagaaugucaucccauccuugccaaaa

SEQ ID NO: 445071 - RNA, 65 nt, Homo Sapiens
ggaaugugaaagcugucauuuuggauccuuuggguuuggagaaaguuuucuuggacuacuuuaau

SEQ ID NO: 445072 - RNA, 65 nt, Homo Sapiens
agauggaugcuuauugaagcuuuacucucuucuauuuggagaauaauacaagccuuggguccaug

SEQ ID NO: 445073 - RNA, 65 nt, Homo Sapiens
ucaggcuuuugauaaaugcuucuuaagagaccgcauuggagaauuaaaaaaugccuuuucauugg

SEQ ID NO: 445074 - RNA, 65 nt, Homo Sapiens
agugcuuuaguaguaguuuagauuucucaggucauuuggagaacaucccagagcugaggcaaggg

SEQ ID NO: 445075 - RNA, 65 nt, Homo Sapiens
uuuaaaaaacccagaaaaacaaaaguuuuaauguauuggagaaguaagugcuauguggcgagaaa

SEQ ID NO: 445076 - RNA, 65 nt, Homo Sapiens
cauaacauuugaagaucaaauucccuguuaccuuuuuggagaauuugagaccaaagggauaucug

SEQ ID NO: 445077 - RNA, 65 nt, Homo Sapiens
ugacagggcugguccaggccucucaaugcacgaaguuggagaaccguaggcacggacacacccag

SEQ ID NO: 445078 - RNA, 65 nt, Homo Sapiens
gcacccauaucugugugcccaaguggagugacuauuuggagaauacaggaaggcggcaggcagag

SEQ ID NO: 445079 - RNA, 65 nt, Homo Sapiens
ggaaaucauaaaaucauccuaagcaaacaucacauuuggagaagaauacacucuaucacauauuu

SEQ ID NO: 445080 - RNA, 65 nt, Homo Sapiens
agccauuauuuuagccacagcuauaucccuucuuuuuggagaacucauguauauauuacucugca

SEQ ID NO: 445081 - RNA, 65 nt, Homo Sapiens
cugaacuguuacaaaccccuucuccccaugggaccuuggagaaaacucuuccuguucugcacccc

SEQ ID NO: 445082 - RNA, 65 nt, Homo Sapiens
aguagucguaagauuaguugucuucauuaggggacuuggagaaccugaucaugagguuaaaauuu

SEQ ID NO: 445083 - RNA, 65 nt, Homo Sapiens
uguaccagcagugugucaggugcugcagagcguucuuggagaaggcccacugaggcagguucgug

SEQ ID NO: 445084 - RNA, 65 nt, Homo Sapiens
auaccuggcauagagaaaaauauauaccugguacauuggagaaaaauaauuacacuuucaaagag

SEQ ID NO: 445085 - RNA, 65 nt, Homo Sapiens
ugguuguaaguggacaugcaaaccaaaauuggggauuggagaagucagacucacuagacuuuugg

SEQ ID NO: 445086 - RNA, 65 nt, Homo Sapiens
uaaauuccugucaaaaucaauucagaaauucuaacuuggagaauuuaacauuuuacucuuguaaa

SEQ ID NO: 445087 - RNA, 65 nt, Homo Sapiens
ucaucuugcaagcaaaucccauuucuugaaaagccuuggagaacucgguuugguagacuuggaca

SEQ ID NO: 445088 - RNA, 65 nt, Homo Sapiens
ggcagugauuuuguuccaaaacuuuguauacacauuuggagaaaaguacuuuauauuuucagugu

SEQ ID NO: 445089 - RNA, 65 nt, Homo Sapiens
ccugcaagaaauauacugacaugaacaggcaguucuuggagaagaaagagcauuucuuuaaguac

SEQ ID NO: 445090 - RNA, 65 nt, Homo Sapiens
gcacuccagccugggcaacagagcaagacccugucuuggagaaaccagaauuuuggaagagcaaa

SEQ ID NO: 445091 - RNA, 65 nt, Homo Sapiens
gugaguggcucuuugcaugaacacugugcaagguguuggagaaauccaaagcugaccaaaacaug

SEQ ID NO: 445092 - RNA, 65 nt, Homo Sapiens
cuggccuucacgcucuugaucgucuuuccuuuguauuggagaaggacugggucagagaucuguug

SEQ ID NO: 445093 - RNA, 65 nt, Homo Sapiens
aguguuuuuuacucuuuucucaugcacauguuacguuggagaaaauguuuacaaaaaugguuuug

SEQ ID NO: 445094 - RNA, 65 nt, Homo Sapiens
agacugacaccucacugaggaagggagacauauucuuggagaacuuuccaucugcuuguauuuuc

SEQ ID NO: 445095 - RNA, 65 nt, Homo Sapiens
agauaucaaguuuugaauauuauucaggaagcacuuuggagaaugugggaguccuacuguuuugc

SEQ ID NO: 445096 - RNA, 65 nt, Homo Sapiens
ugggugagaagcaggcuggugagacugggcugagguuggagaaggggcagccgggggcacugcug

SEQ ID NO: 445097 - RNA, 65 nt, Homo Sapiens
cucacuuuauucuuguauggcuuugguaggcauacuuggagaacauaucccacauuaggaauuga

SEQ ID NO: 445098 - RNA, 65 nt, Homo Sapiens
agccugagaguuugagggcuuuaauccuuuaaaacuuggagaagcuggcugggcgcgguggcuca

SEQ ID NO: 445099 - RNA, 65 nt, Homo Sapiens
gcauuuauuugaugacuuaauauuuuucacuaccuuuggagaacagaugaacauuauucaccaug

SEQ ID NO: 445100 - RNA, 65 nt, Homo Sapiens
guucaauuagcaguucaaauuaaagaagaugguuauuggagaacuuuuuugaaugguuuuguauu

SEQ ID NO: 445101 - RNA, 65 nt, Homo Sapiens
aaugcaucuuuuuuccucugccauucuuguguugauuggagaauuuuucuguauguaauuagaaa

SEQ ID NO: 445102 - RNA, 65 nt, Homo Sapiens
guuucuggauuucauacuguaacauucaggaauucuuggagaaaauggguuuauucacugaacuc

SEQ ID NO: 445103 - RNA, 65 nt, Homo Sapiens
ggcucggaaagccuuaagcaaagaugggaggauuuuuggagaauccaucaugauugguguaaaac

SEQ ID NO: 445104 - RNA, 65 nt, Homo Sapiens
guccucucaaaacaaacacccucuugcaaccagcuuuggagaaagcccagcuccugugugcucac

SEQ ID NO: 445105 - RNA, 65 nt, Homo Sapiens
cuggcuggcccuguaauuuaaauuaaaauaaaauuuuggagaaacagcauugucugucuuuauga

SEQ ID NO: 445106 - RNA, 65 nt, Homo Sapiens
ugagggacacaaggacuugggugcaucaggacgccuuggagaagcguggcuuccugccacccugc

SEQ ID NO: 445107 - RNA, 65 nt, Homo Sapiens
gugcagagagaggcaggaaggaucccugaagagucuuggagaaaagguucugugcccucaggugg

SEQ ID NO: 445108 - RNA, 65 nt, Homo Sapiens
guaucugaaucacuggggauuaugauucacccucuuuggagaacaugcucucuuuucacccccca

SEQ ID NO: 445109 - RNA, 65 nt, Homo Sapiens
ugcuuauauuuaucgcuuggcucaaguucugcccuuuggagaaauacugagcaagucuuucauuc

SEQ ID NO: 445110 - RNA, 65 nt, Homo Sapiens
augugagauuuccacauuauugaacaucuuugagauuggagaauuugguuaaguauauaauaaau

SEQ ID NO: 445111 - RNA, 65 nt, Homo Sapiens
ccgugugagaagugaaugcuugggccgcugccacguuggagaagccucagggccaugcugaggcc

SEQ ID NO: 445112 - RNA, 65 nt, Homo Sapiens
ucacaacccuucucuguuggugaggccugggcugguuggagaagggggucugcgaugcagcggcg

SEQ ID NO: 445113 - RNA, 65 nt, Homo Sapiens
uucuguuugucucuuuucaugugaggacuaccauuuuggagaaggucuugcacuacaccucuguu

SEQ ID NO: 445114 - RNA, 65 nt, Homo Sapiens
gucuauccagguccuuugccgccaugcguauuucuuuggagaaaggucuuuuccugugcuuacgg

SEQ ID NO: 445115 - RNA, 65 nt, Homo Sapiens
cagcccagcuuggcguggggcaguugagaauuccuuuggagaaaacacagaaauucuguugaaga

SEQ ID NO: 445116 - RNA, 65 nt, Homo Sapiens
gcacaaucaacuuuucugagucaccaaguguggaauuggagaaaagugacgcuacuaaccugaca

SEQ ID NO: 445117 - RNA, 65 nt, Homo Sapiens
aagugaauuuacuucgacuuauauucaguggcauuuuggagaacaauagaauuuuuaaauaguau

SEQ ID NO: 445118 - RNA, 65 nt, Homo Sapiens
auguaauuuugucuuuggaagucaaaauaacauacuuggagaaguguguuuguuuuuaucaaaau

SEQ ID NO: 445119 - RNA, 65 nt, Homo Sapiens
ugcauuaucuuaaaaggcagaauucuguagcauacuuggagaaacuuuucuagagguuggcuuuc

SEQ ID NO: 445120 - RNA, 65 nt, Homo Sapiens
ugaagaaaaaggcuggcugacuucagagaagucaguuggagaaaagcaguguuccucaccaauaa

SEQ ID NO: 445121 - RNA, 65 nt, Homo Sapiens
ugugccuuucauucauuaccgcagcgguccucaaguuggagaaaacugguaccgucuaguacuau

SEQ ID NO: 445122 - RNA, 65 nt, Homo Sapiens
aaugaaggugucaaagagucuaauagcacagcaguuuggagaagaagaauaugccugcucaaaau

SEQ ID NO: 445123 - RNA, 65 nt, Homo Sapiens
uacauucugaagcauccccaucaggcuccaucuguuuggagaaaauuuggaaaaucacacaguuu

SEQ ID NO: 445124 - RNA, 65 nt, Homo Sapiens
gauggaaauggauuggauugucaaauuauuauuuauuggagaaaaaaaccugaucuacacauuuu

SEQ ID NO: 445125 - RNA, 65 nt, Homo Sapiens
aaacuuaggaaauagugaauaaggugcauuuaacuuuggagaaauacuuuuauggcuuuggugga

SEQ ID NO: 445126 - RNA, 65 nt, Homo Sapiens
gugguuuuugaacaggaaaaucauaauucauaucauuggagaaguauuuauuuucaaauaucaaa

SEQ ID NO: 445127 - RNA, 65 nt, Homo Sapiens
gaggagucagagagaaucccuagucuucaagcagauuggagaaacccuugaaaagacaucaagca

SEQ ID NO: 445128 - RNA, 65 nt, Homo Sapiens
cuaaaugaaaaggacacauucugaaaucccuuuuguuggagaauaagucagucugaggggaaaug

SEQ ID NO: 445129 - RNA, 65 nt, Homo Sapiens
gaaauaaguccuagacuggacucuugagggacauauuggagaaucuuaagaaaugcaagcuuguu

SEQ ID NO: 445130 - RNA, 65 nt, Homo Sapiens
uucccaggaaauuagcuuuccagccccuuuauauauuggagaaguuguuuuagcuucugcagaag

SEQ ID NO: 445131 - RNA, 65 nt, Homo Sapiens
uacauuguucuugguuuuguuucucgaucuuuuguuuggagaacagcuggcuaaggaugacucua

SEQ ID NO: 445132 - RNA, 65 nt, Homo Sapiens
guucauuuguuccuuggaccuuaaucauuugcauuuuggagaaaauuuuuucugcuuuaaaaguc

SEQ ID NO: 445133 - RNA, 65 nt, Homo Sapiens
agaguuuaggaauucuacuagccagagauagucacuuggagaaacuuucuauauauccuucuaaa

SEQ ID NO: 445134 - RNA, 65 nt, Homo Sapiens
aaaucuugaugucauuacuccugaauuauuacauuuuggagaauaagagggcauuuuauuuuauu

SEQ ID NO: 445135 - RNA, 65 nt, Homo Sapiens
guuuugauccaagucaaguguagccucucagccuuuuggagaaaaaugaaacaauuuauuucaac

SEQ ID NO: 445136 - RNA, 65 nt, Homo Sapiens
gugggcagagcccugacccacagcuguguuacugcuuggagaagcauauguaggggcauacccug

SEQ ID NO: 445137 - RNA, 65 nt, Homo Sapiens
cuauuuaaaguugccugaagauuuugcugugguguuuggagaagcagagggugaacuugcuguug

SEQ ID NO: 445138 - RNA, 65 nt, Homo Sapiens
agauuugcucagcuuuuugaaauguuaagauguguuuggagaaggcugcaugacuuuguuuuucc

SEQ ID NO: 445139 - RNA, 65 nt, Homo Sapiens
ccuaggcagcagccaccuucucaggaaacaaggccuuggagaaaucagugccugugugaagaugg

SEQ ID NO: 445140 - RNA, 65 nt, Homo Sapiens
agcuggaccuuccauucuagaauuaugagaccaccuuggagaaaggugugugguacaugacauug

SEQ ID NO: 445141 - RNA, 65 nt, Homo Sapiens
uuucucuguuugccuuggguugaauaacuuaucuuuuggagaauagcuuuaaguggcuuagacac

SEQ ID NO: 445142 - RNA, 65 nt, Homo Sapiens
acaaguuggaugacacuacucccaacuuuuuaaauuuggagaaaaccaucaaggucgaggaagcc

SEQ ID NO: 445143 - RNA, 65 nt, Homo Sapiens
aagaaauugcuagauuacccaaagaaauagaucaguuggagaaaauacaaaacaauucaaagcuc

SEQ ID NO: 445144 - RNA, 65 nt, Homo Sapiens
aguauuuaaaagaaauaccagugagugccuuaaaguuggagaaguaacugcccaugcccagaaau

SEQ ID NO: 445145 - RNA, 65 nt, Homo Sapiens
augaauaaaaaauaauuuugcuguuguaguauacauuggagaaacuggcagguuuuauuuccauu

SEQ ID NO: 445146 - RNA, 65 nt, Homo Sapiens
uccaagccaggaagaugggcuaugaucaugccagauuggagaagagucugaggguguacguuuga

SEQ ID NO: 445147 - RNA, 65 nt, Homo Sapiens
gaaaugaaaagccacgucauaaaacuccacaggguuuggagaauaggcaaagacacgggaacuga

SEQ ID NO: 445148 - RNA, 65 nt, Homo Sapiens
uagacacaaucucuuauuuugucacaucacaugauuuggagaaauacaagacuuugggcucuuau

SEQ ID NO: 445149 - RNA, 65 nt, Homo Sapiens
caugacggauaguuuaggauuucauguggagauuuuuggagaaacuucaauuguccuucagauaa

SEQ ID NO: 445150 - RNA, 65 nt, Homo Sapiens
acuuuuucauacuuuugugacacagauggaacgguuuggagaagcccuguacaguauuugcauuc

SEQ ID NO: 445151 - RNA, 57 nt, Homo Sapiens
uauucugaaaacauugacucauugggcuuggagaaucaucccuuccauuuuguuuaa

SEQ ID NO: 445152 - RNA, 65 nt, Homo Sapiens
cacagcagcacgccuuaauccccuguccaagugccuuggagaacuguucagucugaaaugcagcu

SEQ ID NO: 445153 - RNA, 65 nt, Homo Sapiens
aucuggagaugagauugaugccugguggaagaagcuuggagaagaccugaagcacauacaagcac

SEQ ID NO: 445154 - RNA, 65 nt, Homo Sapiens
gagauggcaagagggcaggcugggcauuugaggaauuggagaaugugccugggcuguggaccuac

SEQ ID NO: 445155 - RNA, 65 nt, Homo Sapiens
caccugcacagcagagcucaaggcugucaacagucuuggagaagccgaugccaaguacaccugca

SEQ ID NO: 445156 - RNA, 65 nt, Homo Sapiens
ccuuagcacaauuuucuaaaaaaaaaaaucagaaauuggagaaaugcuugccaaaaaaaaaaaaa

SEQ ID NO: 445157 - RNA, 65 nt, Homo Sapiens
acaaggacaacuuuauguagugcauggacaguuguuuggagaacagcugcccaggugggguuucc

SEQ ID NO: 445158 - RNA, 65 nt, Homo Sapiens
cacagccucaccuucucacuuuaaggguguuagucuuggagaagacuugaauuuuuuggggacua

SEQ ID NO: 445159 - RNA, 65 nt, Homo Sapiens
aaggagcaaaaacaaauuuuuggcagaagcugaaauuggagaacccuuauuucuuaacugcuauu

SEQ ID NO: 445160 - RNA, 65 nt, Homo Sapiens
ucugcacuuucuuauauauaugaugccaagauuuuuuggagaacacucuuugugacacuucaucc

SEQ ID NO: 445161 - RNA, 65 nt, Homo Sapiens
augcauuugggucacuaauuugaacaccuuucauauuggagaaucaaaugauuguaugcuuaugc

SEQ ID NO: 445162 - RNA, 65 nt, Homo Sapiens
gaacucacaaacugauguuauuuaaaggaaaggauuuggagaauuagaugaaauaaacuuauuac

SEQ ID NO: 445163 - RNA, 65 nt, Homo Sapiens
uagcaguaccaagggaucucaaucacuugggagcuuuggagaaaaguacuucggcugcaugagau

SEQ ID NO: 445164 - RNA, 65 nt, Homo Sapiens
aacaacaaaagccaauuagaagcugggagucaguguuggagaagaccacgcccaucuggaguggg

SEQ ID NO: 445165 - RNA, 65 nt, Homo Sapiens
aucucuaauuccagugucuuuacacagcaaauaaauuggagaauauugcucccauauaaacuugu

SEQ ID NO: 445166 - RNA, 65 nt, Homo Sapiens
guuuucaguuucuuuccuucugugaacgaugagacuuggagaacgggcugguccuucaccacuuc

SEQ ID NO: 445167 - RNA, 65 nt, Homo Sapiens
gugaggugccgagcugggugcuugacaucauuugcuuggagaagcagcugcuaguagacccauuu

SEQ ID NO: 445168 - RNA, 65 nt, Homo Sapiens
uacaucaauauguauauauguauuucuauauagacuuggagaauacugccaaaacauuuaugaca

SEQ ID NO: 445169 - RNA, 65 nt, Homo Sapiens
uuuuggguguggaggccauuuuuagagauacagaauuggagaagacuugcaaaacagcuagauuu

SEQ ID NO: 445170 - RNA, 65 nt, Homo Sapiens
ugugucauguugguuuuugguacuuguauugucauuuggagaaacaauaaaagauuucuaaacca

SEQ ID NO: 445171 - RNA, 65 nt, Homo Sapiens
ucuaucugggaacacugagaagggugaccaaugcguuggagaacgagggagggcuucauagcaga

SEQ ID NO: 445172 - RNA, 65 nt, Homo Sapiens
caaaagagcaugcagugcuguugaauaacccucacuuggagaaccaagagaauccugucguuuaa

SEQ ID NO: 445173 - RNA, 65 nt, Homo Sapiens
ugccccugaauguggucgaugccaaaggaagauccuuggagaagucaucagugcguugaaacaaa

SEQ ID NO: 445174 - RNA, 65 nt, Homo Sapiens
uuugcagagugugugcuuggcuguggcagccuagcuuggagaagcugcuguuggugcaagggaga

SEQ ID NO: 445175 - RNA, 65 nt, Homo Sapiens
uggaugccuaaggcauaaagucugugcaauauuucuuggagaauucccagcuuucuugcuugccu

SEQ ID NO: 445176 - RNA, 65 nt, Homo Sapiens
gaaaaacacucuauaacagaacaacuuuuuuaacuuuggagaaaaauuuucugugccuucaaggg

SEQ ID NO: 445177 - RNA, 65 nt, Homo Sapiens
uuuucugauuauuguuaaaccuucaggaaauucuuuuggagaauagcuuuauaccuagcaagcca

SEQ ID NO: 445178 - RNA, 65 nt, Homo Sapiens
uugccuuuuuucuuggcuccgugcaauuugugcaauuggagaaucuaaugcugggaacacaaaua

SEQ ID NO: 445179 - RNA, 65 nt, Homo Sapiens
aaggacugagaaaugaccauuuuauaaaucuagacuuggagaauuaacaggauucacauuguuaa

SEQ ID NO: 445180 - RNA, 59 nt, Homo Sapiens
cagguguguauaagaguacaaggagaacauuggagaaaaacaauuaccagccauacuaa

SEQ ID NO: 445181 - RNA, 65 nt, Homo Sapiens
gauucaaaauaguguagauucugauuuucuggccuuuggagaaguuagcaacugcagcuaacagg

SEQ ID NO: 445182 - RNA, 65 nt, Homo Sapiens
cuguucagucacagauauauggaaauauuggauucuuggagaaaaaaaguauaugaaaauauacu

SEQ ID NO: 445183 - RNA, 65 nt, Homo Sapiens
agauaaugaauuaagcaacucacauuuacucaauauuggagaaguuacaugugugccccuaaaga

SEQ ID NO: 445184 - RNA, 65 nt, Homo Sapiens
auuuaaacaccucaauguagauucaaugaaaacuguuggagaaauccuaguguuuucauaaugua

SEQ ID NO: 445185 - RNA, 65 nt, Homo Sapiens
auuacagaucauauaagcaauauacauaaacaguuuuggagaaaauagguuuuaaaaauaaguuu

SEQ ID NO: 445186 - RNA, 65 nt, Homo Sapiens
uauauuuuaaagaacaagacgagccucagaaucauuuggagaaacuguaucuuguaaucaugauu

SEQ ID NO: 445187 - RNA, 65 nt, Homo Sapiens
cauagaacaaggugaaagacauaaaucacuaaggauuggagaacuaccaaucaaucaaaaaauaa

SEQ ID NO: 445188 - RNA, 65 nt, Homo Sapiens
aaagacauaaacuuggaguccgucugguuuaauuauuggagaaucgauucccaaguccaggaaga

SEQ ID NO: 445189 - RNA, 65 nt, Homo Sapiens
uuuuaguauuuugucuuuguaauuuacagaaguuauuggagaaaauaaacuuguuucauuuugca

SEQ ID NO: 445190 - RNA, 65 nt, Homo Sapiens
cacccagggaaugggggucuaugagacaaccccacuuggagaagaaugggguuagggucucuaau

SEQ ID NO: 445191 - RNA, 65 nt, Homo Sapiens
ggugcuuuuuauacaacuuuccaucccccacacaguuggagaauaauuuguagaccauggcaguu

SEQ ID NO: 445192 - RNA, 65 nt, Homo Sapiens
aguauacauggugauguacaucuguagcaaagcucuuggagaaaaugaagacugaagaaagcaaa

SEQ ID NO: 445193 - RNA, 65 nt, Homo Sapiens
caugaggaacauucauucuguauuuuuuuucccuguuggagaaagugggaaauuauaaugucgaa

SEQ ID NO: 445194 - RNA, 65 nt, Homo Sapiens
uuauucugucuaucaaauaguacuucuaccacuguuuggagaaaauugaagaaaagaauaagaug

SEQ ID NO: 445195 - RNA, 65 nt, Homo Sapiens
aguugaauaugauuuggucaguugcucguuguaacuuggagaaauuccuauaaaguaagaucucc

SEQ ID NO: 445196 - RNA, 65 nt, Homo Sapiens
uuaauuccuucugcuauaugucacacaguuguuauuuggagaaccaaguauguauugcaugaaaa

SEQ ID NO: 445197 - RNA, 65 nt, Homo Sapiens
gaaugccuuauuuuugaauucuuuagauuuuuaaauuggagaaaagcacuuaaaguuuuuuauau

SEQ ID NO: 445198 - RNA, 65 nt, Homo Sapiens
gugugagcauuugcaauguaagggccucagcuuccuuggagaagccaccccagguuuccagacau

SEQ ID NO: 445199 - RNA, 65 nt, Homo Sapiens
ugcaucucccugauugguauugcuguagaacauauuuggagaaguuuguuugucuuugguguuua

SEQ ID NO: 445200 - RNA, 65 nt, Homo Sapiens
uuggaguuugaacccguuuugguugcauuucauuuuuggagaacuuaauuaacgugagauuggca

SEQ ID NO: 445201 - RNA, 65 nt, Homo Sapiens
acuuagaacauuuuuugaaauucaguuuacagaaauuggagaaaaugcuuuuuaaacaaguguuu

SEQ ID NO: 445202 - RNA, 65 nt, Homo Sapiens
ugaugggucuugcugggugcuguguggggcgcauauuggagaaggguaaugccagaagccaggaa

SEQ ID NO: 445203 - RNA, 65 nt, Homo Sapiens
cccuuggaaccccaaggccaaguugguucaaacuguuggagaacagaguuggccugcaucuggaa

SEQ ID NO: 445204 - RNA, 65 nt, Homo Sapiens
guacuauuuuuauaaagcaagaacuauuccaugccuuggagaaugaaucauuuuuagauugugac

SEQ ID NO: 445205 - RNA, 65 nt, Homo Sapiens
cuuuuggaggugaaaucuaauuauuggugagagucuuggagaacaggcuguuuccagucucaaag

SEQ ID NO: 445206 - RNA, 65 nt, Homo Sapiens
cguaaagauucauuuuucaaucacugauuuuauaauuggagaaugcagccuuugguagcuaacag

SEQ ID NO: 445207 - RNA, 65 nt, Homo Sapiens
uagcacuugccuugaaaagauaucucuuuucaggguuggagaaauuuuuguuuuauuggaaugca

SEQ ID NO: 445208 - RNA, 65 nt, Homo Sapiens
gugguuagcacauucaucaguaggauggauguauauuggagaaggugugagacuuuauuguccuc

SEQ ID NO: 445209 - RNA, 65 nt, Homo Sapiens
uacuccagcaaaaugaaggauuuuuagggaagcuguuggagaaaagggguuaccuccaugugccc

SEQ ID NO: 445210 - RNA, 65 nt, Homo Sapiens
cauaugaaaagcauaguuggggucacaggacccaauuggagaaauuguucaacaauucugugaaa

SEQ ID NO: 445211 - RNA, 65 nt, Homo Sapiens
caaagaaaauuaaaguuuucuuccagcagcuguuuuuggagaagaacaucccuuaauuugaggug

SEQ ID NO: 445212 - RNA, 65 nt, Homo Sapiens
gaauguuugucuggagcagacuaucaggcugauuuuuggagaaauguauguuccuuuguauguuc

SEQ ID NO: 445213 - RNA, 65 nt, Homo Sapiens
acaagguacccagaauuuuuacuucaacaagaugcuuggagaacaucugauguuaagcacauguu

SEQ ID NO: 445214 - RNA, 65 nt, Homo Sapiens
auuaaauugcugcauuucgcuguuucuuauuuugauuggagaaaagaagugagaucauacugguu

SEQ ID NO: 445215 - RNA, 65 nt, Homo Sapiens
ggaagaauaacacuguugcucacaaugaaggagacuuggagaagagccagcugguaguccaucag

SEQ ID NO: 445216 - RNA, 65 nt, Homo Sapiens
uauuuaauaaaaaaacaaucguuauuuucaguauuuuggagaaauaugcuuuuugaauguuauuu

SEQ ID NO: 445217 - RNA, 65 nt, Homo Sapiens
agggcucuucucaggggcuccuccuccucugucuuuuggagaacccagcgcauccugcagggcuu

SEQ ID NO: 445218 - RNA, 65 nt, Homo Sapiens
ucuucacagccccgacaucacuggacauuggaaccuuggagaaugacuuaaacccugugccucag

SEQ ID NO: 445219 - RNA, 65 nt, Homo Sapiens
gccagggccgugccuggagcacugcagagaugacuuuggagaaagcaaagcagugacccagugac

SEQ ID NO: 445220 - RNA, 65 nt, Homo Sapiens
guagaagaaagauacaagugaaaauuaggaguggauuggagaaauuggggggaaauagaagagua

SEQ ID NO: 445221 - RNA, 65 nt, Homo Sapiens
aaggcuuuuuaacccauuuuugaagagggugaaguuuggagaacaaauuuaaaaaccaucaguca

SEQ ID NO: 445222 - RNA, 65 nt, Homo Sapiens
uuaaaucucagaauuacuaagcauguggcauaaauuuggagaaaauaauaugacuagaaaaauua

SEQ ID NO: 445223 - RNA, 65 nt, Homo Sapiens
ucuucguguccaccuggguccaguccugaaucaucuuggagaaacaccuugguuucuaggauggu

SEQ ID NO: 445224 - RNA, 65 nt, Homo Sapiens
ggaguuguauuggcaagagggaggggugagagcuguuggagaacugagaaugagguuuuuuuuuu

SEQ ID NO: 445225 - RNA, 65 nt, Homo Sapiens
ucuauugcccugcaacgucccaucuauacgagguguuggagaaggugaagaacccucccauucac

SEQ ID NO: 445226 - RNA, 65 nt, Homo Sapiens
ucccugcuugugcaggccaguggaggcucuugggcuuggagaacacgugugucucuguguaugug

SEQ ID NO: 445227 - RNA, 65 nt, Homo Sapiens
aaguggggcaacguguggaggaagccccucauaauuuggagaaaacuugauacaauagaagcuga

SEQ ID NO: 445228 - RNA, 65 nt, Homo Sapiens
ccaaccuguucaagucuaccaauuauaagggcaaauuggagaaaaagaaaaaauauauacucaag

SEQ ID NO: 445229 - RNA, 65 nt, Homo Sapiens
ccguuuguuuguuggaguggugccagguacugguuuuggagaacuugucuacaaccagggauuga

SEQ ID NO: 445230 - RNA, 65 nt, Homo Sapiens
agagugcauaccagaauugaauauaccauaugggauuggagaaagacaaauguggaagaaaucau

SEQ ID NO: 445231 - RNA, 65 nt, Homo Sapiens
gcugagaaagggaaaagacacacaagucgcguggguuggagaagccagagccauuccaccucccc

SEQ ID NO: 445232 - RNA, 65 nt, Homo Sapiens
gguggcgugcucuagcccucucaguuaccagcucuuuggagaaggaucaaaauucagauggaaug

SEQ ID NO: 445233 - RNA, 65 nt, Homo Sapiens
ccugaaacagacuacucuuugccuuuuugcugcaguuggagaagaaacugaauuugaaaaauguc

SEQ ID NO: 445234 - RNA, 65 nt, Homo Sapiens
gcaaagaauuuaaaguggcuccuuuaauuggugacuuggagaaagcuaggucaaggguuuauuau

SEQ ID NO: 445235 - RNA, 65 nt, Homo Sapiens
uaacagaguuugggggagagagcaagauggguuccuuggagaagcugauuugccaagaugcacau

SEQ ID NO: 445236 - RNA, 65 nt, Homo Sapiens
uugccaccuaagcaguaaaacaugauauugaccacuuggagaacucagaaaauuauuuuaaauuu

SEQ ID NO: 445237 - RNA, 65 nt, Homo Sapiens
agagaaguaaaggaauauaugccuccuguguacuuuuggagaaaacugaagauuuaguuuccauu

SEQ ID NO: 445238 - RNA, 65 nt, Homo Sapiens
agcuuaaacauuucaccagaugaugcuggaagcucuuggagaaaacaggaucauccuuuuguacu

SEQ ID NO: 445239 - RNA, 65 nt, Homo Sapiens
uggacccuaguucaguuuagcaaggagaaagcccuuuggagaaacugacaaaacacaaguuggac

SEQ ID NO: 445240 - RNA, 65 nt, Homo Sapiens
gcugaaggucaguaauuccguuuaguuccauaaaauuggagaacuuugauuccuugaagagccua

SEQ ID NO: 445241 - RNA, 65 nt, Homo Sapiens
cacaguaaagggaaacccugaugcuugcuucagcauuggagaauuuaaacaugaugaauguggag

SEQ ID NO: 445242 - RNA, 65 nt, Homo Sapiens
agaaccgugaacuggaaaaggagaagucccggcuguuggagaaggcgaccaacaacaacgaggag

SEQ ID NO: 445243 - RNA, 65 nt, Homo Sapiens
aauggacgaauucuugagcaugguggugaagagaguuggagaaggaguggagaugggggcggggg

SEQ ID NO: 445244 - RNA, 65 nt, Homo Sapiens
cguacucuagggccaaauccgggccgagguuacauuuggagaacccauagucucagagaucugua

SEQ ID NO: 445245 - RNA, 65 nt, Homo Sapiens
gcagaagagacgucccgcuuggggugaggcuugacuuggagaaagcgguggccagcccauuuucu

SEQ ID NO: 445246 - RNA, 65 nt, Homo Sapiens
gugaauguauguacuguauuuacacagagauggucuuggagaauucauccagguuaaccuugaua

SEQ ID NO: 445247 - RNA, 65 nt, Homo Sapiens
gcuugaggccagaagugcaauuuaggaggcugagguuggagaauccaugccuauaauccuggcau

SEQ ID NO: 445248 - RNA, 65 nt, Homo Sapiens
ugaugcauaaagcugugauaucaaaaagcugcuuuuuggagaagaccaaguggccaaguccuuua

SEQ ID NO: 445249 - RNA, 65 nt, Homo Sapiens
ugacucaaauauauacuugaagaguaauuuaugcuuuggagaauugggcccuaaccuaaaaucgg

SEQ ID NO: 445250 - RNA, 65 nt, Homo Sapiens
ucuugugcaauuagccuggcgugagaaauauuugcuuggagaagccaaugugggguuuguaauag

SEQ ID NO: 445251 - RNA, 65 nt, Homo Sapiens
agacaugcuuuuccagcuguaauggucagagcuaguuggagaaugguuuuguuugguauguacaa

SEQ ID NO: 445252 - RNA, 65 nt, Homo Sapiens
gaagcaaaggugaaugacagaauuaggagcuuguuuuggagaaaugcagucucuucagguagcua

SEQ ID NO: 445253 - RNA, 65 nt, Homo Sapiens
ugccgaaaaguugccaaauauuuuauaaugucuuuuuggagaaauuauacuuugugcuuuauggu

SEQ ID NO: 445254 - RNA, 65 nt, Homo Sapiens
gagacaggagggguaaaaccgauauauagaggauuuuggagaagaaaggaauauuuucuucuuaa

SEQ ID NO: 445255 - RNA, 65 nt, Homo Sapiens
auggauaaguaguguuuccuuccgucuuugcuguuuuggagaaugacuuaacaauauacauaugu

SEQ ID NO: 445256 - RNA, 65 nt, Homo Sapiens
uaccacacaaaacaaugaauuuuccaugguuaaguuuggagaaaagucuccauuuuuaucaaggu

SEQ ID NO: 445257 - RNA, 65 nt, Homo Sapiens
ggagcucuguggcuucccacuggagaaacugugaauuggagaaauacuucgauuuuucuggucug

SEQ ID NO: 445258 - RNA, 65 nt, Homo Sapiens
uguuuuuuucucucacuauaguauaagaaucuauuuuggagaaaaaaagaaaauaugagggucuc

SEQ ID NO: 445259 - RNA, 65 nt, Homo Sapiens
guggggggagggggaugggguccuucuaggaguccuuggagaaaaguaagaaaccaggaguguuu

SEQ ID NO: 445260 - RNA, 65 nt, Homo Sapiens
ucaccagggcaggagaggacucagccuccuguguuuuggagaaggggcccaauguguguugacga

SEQ ID NO: 445261 - RNA, 65 nt, Homo Sapiens
uugcucaaauguuguucaacaccagaaaauuuauauuggagaaaagcacuguaaauguaaugcau

SEQ ID NO: 445262 - RNA, 65 nt, Homo Sapiens
uuguucaaacuuuguucaauaccaggaaauuuauauuggagaaaaacccuaugaguguaaugaau

SEQ ID NO: 445263 - RNA, 65 nt, Homo Sapiens
guugucacgcuugauuguagguaagauaauuuauauuggagaaaaauccuccaaguaugaagaau

SEQ ID NO: 445264 - RNA, 65 nt, Homo Sapiens
uugcucaaacuuuguucgacaucagggaauuuguauuggagaaaaacccugcaaauguaauaaau

SEQ ID NO: 445265 - RNA, 65 nt, Homo Sapiens
gauugccuugaucuggcacuuacugauacaagcauuuggagaagagaaaauucaaauauaagaaa

SEQ ID NO: 445266 - RNA, 65 nt, Homo Sapiens
auggacuuuccugugauuuguuuuuaaucauucauuuggagaagaggcaugaccuuuguauuuca

SEQ ID NO: 445267 - RNA, 65 nt, Homo Sapiens
uucaugcuauuaguauuuucauaccuuagucacauuuggagaauucacaugggaauaaaauucca

SEQ ID NO: 445268 - RNA, 65 nt, Homo Sapiens
uugcagguuugguuuuuucucauuugucuguggcauuggagaauauucucgguuuaaacagacua

SEQ ID NO: 445269 - RNA, 65 nt, Homo Sapiens
gcuuauugucuagugaaacucguuaauuuguaguguuggagaagaacugaaaucauacuucuuag

SEQ ID NO: 445270 - RNA, 65 nt, Homo Sapiens
auuccauguagucuucaauuuuuaauuuuuaagaauuggagaauuucuaauguuaaaguuaguuu

SEQ ID NO: 445271 - RNA, 65 nt, Homo Sapiens
auaauaucugcauuaugcuggaaaaaaauagaccuuuggagaauacuuaaauaaaacaugugcau

SEQ ID NO: 445272 - RNA, 65 nt, Homo Sapiens
cccaggugauucuguaaguugucccucaacuguacuuggagaaaucguguuuuaaagcaguaguc

SEQ ID NO: 445273 - RNA, 65 nt, Homo Sapiens
cgugcaggaauagcaacagcaauuuccgggaggucuuggagaagcuggagagcgaccccgucugc

SEQ ID NO: 445274 - RNA, 65 nt, Homo Sapiens
gccuuuuauuaguucuuugauagcuaagaugguuguuggagaaagugcuuaagccacuguuuaug

SEQ ID NO: 445275 - RNA, 65 nt, Homo Sapiens
aguccuguaaaugaaugcucugggcuagauacagcuuggagaaccugcuggccuuguuagacagc

SEQ ID NO: 445276 - RNA, 65 nt, Homo Sapiens
uuaggaaagccuggguuggguggagcagaaccaucuuggagaagaugacaguucccuguccuccc

SEQ ID NO: 445277 - RNA, 65 nt, Homo Sapiens
aggaaacucugcaaggcuaauguaacacauuguaauuggagaagaagacacccccuuccaaauuc

SEQ ID NO: 445278 - RNA, 65 nt, Homo Sapiens
aaaacuagcuguggcauuccgcagcauuuugacccuuggagaagauuaagcuuguuguuggaaga

SEQ ID NO: 445279 - RNA, 65 nt, Homo Sapiens
auaugaauguauucgggaggcauuuaauccgguucuuggagaaaccuaccgagcuggaagcaagc

SEQ ID NO: 445280 - RNA, 65 nt, Homo Sapiens
uaagguggaguccuacuuguacugcuuggggacuauuggagaaaauaugucuucaagugaccugu

SEQ ID NO: 445281 - RNA, 65 nt, Homo Sapiens
uaaaccgccuccacguggcgugccgaagugaauuguuggagaaugguagucuuuuguauuuuccc

SEQ ID NO: 445282 - RNA, 65 nt, Homo Sapiens
uacucuguaggcaugacagcauuuaaugugugaccuuggagaaguaugaguguuccugugcccau

SEQ ID NO: 445283 - RNA, 65 nt, Homo Sapiens
acaaauauguucucugaaugauaacuauuacaguguuggagaacaguguuugucauggugaaauu

SEQ ID NO: 445284 - RNA, 65 nt, Homo Sapiens
ucuguggugcagugugugaagggucggagaggcguuuggagaaggagcugggugcagaagcugug

SEQ ID NO: 445285 - RNA, 65 nt, Homo Sapiens
agggauuaaaaauaaggauaagcaaagcuaucaacuuggagaaacugaauuacugaauauuucag

SEQ ID NO: 445286 - RNA, 65 nt, Homo Sapiens
agaaccacaaacacagaucaaaaagccugcucaauuuggagaaauuuuuaaaaacuauauucagu

SEQ ID NO: 445287 - RNA, 65 nt, Homo Sapiens
agauugccuuuucaugcaguccuuaccaaaguagguuggagaauuugcccacagaagucaucaga

SEQ ID NO: 445288 - RNA, 65 nt, Homo Sapiens
uagaggaggagaaagaauccuaucuccugcagagauuggagaaggauaugauaugaagggggacu

SEQ ID NO: 445289 - RNA, 65 nt, Homo Sapiens
guguuaauuguguggaaugaucuacauagauuaaauuggagaaaccugggcgcuguaaguuaagc

SEQ ID NO: 445290 - RNA, 65 nt, Homo Sapiens
gcauccucuuuuguguaguuuguuuguuuguuuuuuuggagaagaguuuccuuuuuuuguuuguu

SEQ ID NO: 445291 - RNA, 65 nt, Homo Sapiens
uuuccuuuuguugcauuuguauugcauacagguuauuggagaaauacuuaaaagaaagauuuccc

SEQ ID NO: 445292 - RNA, 65 nt, Homo Sapiens
uuuagacagcagcucuguguaacucggaggggaguuuggagaaauaaucugaguguugccugcug

SEQ ID NO: 445293 - RNA, 65 nt, Homo Sapiens
uuggggaaguguuuucugaaagccacaguguucuguuggagaaacuucacacuaccaggcccugc

SEQ ID NO: 445294 - RNA, 65 nt, Homo Sapiens
aaauuaaacauuuggcccugugaagaugaaugacuuuggagaagcguuucccagaaucagacuuu

SEQ ID NO: 445295 - RNA, 65 nt, Homo Sapiens
cauuuaagcugccucggguugagucaccaggucgcuuggagaagucaguggagauaaauguccua

SEQ ID NO: 445296 - RNA, 65 nt, Homo Sapiens
uuaaaauauaacuucaagaaaagaguaaacauccauuggagaacacggcugaaaauuauugugcu

SEQ ID NO: 445297 - RNA, 65 nt, Homo Sapiens
uuaaagaucaugaauuugugacuuaguucugcccuuuggagaacaaaagaaagcagucuuccauc

SEQ ID NO: 445298 - RNA, 65 nt, Homo Sapiens
uaaacaauggugccccagaaagcugcaggugguguuuggagaagcaguuacuuuucaguuacaag

SEQ ID NO: 445299 - RNA, 65 nt, Homo Sapiens
uaaagcaguauuuaaugcaauuuccaguuauuucuuuggagaauuuuaugucauuguuccauuac

SEQ ID NO: 445300 - RNA, 65 nt, Homo Sapiens
aaugaguucagaugaucacaaacaggugaguuuuguuggagaagaaaguuggaguaggagacuuu

SEQ ID NO: 445301 - RNA, 65 nt, Homo Sapiens
cccaauaagaggcucuguuuuccacugaagcuuuguuggagaaagagaauaugaaaauuacacau

SEQ ID NO: 445302 - RNA, 65 nt, Homo Sapiens
ugugugaagacaugaaaguuuaauguacagaaugguuggagaaaugccuauggugaauuaaagcu

SEQ ID NO: 445303 - RNA, 65 nt, Homo Sapiens
acauugccuuuguguuaauagucaaauacuuaccuuuggagaauacuuaccuuuggaggaaugua

SEQ ID NO: 445304 - RNA, 65 nt, Homo Sapiens
gaauaaccuugcugauaagaaaaaaagggacaauauuggagaaacuaccucuuguuuaauugauc

SEQ ID NO: 445305 - RNA, 65 nt, Homo Sapiens
gucugguaccuuccccuccugccccugcaccagcuuuggagaauggauuuggagugucuugggcg

SEQ ID NO: 445306 - RNA, 65 nt, Homo Sapiens
ccagucucccaggcccccuggguguugggagcccuuuggagaacgacagaaaucagaggagagac

SEQ ID NO: 445307 - RNA, 65 nt, Homo Sapiens
guccagcaugcauccuggccuuggggcuuuuuuauuuggagaaccuaagcaguguagacaaaccc

SEQ ID NO: 445308 - RNA, 65 nt, Homo Sapiens
auauucauuugguuguggagcuauagcuugacuccuuggagaacagccacguugucauugugagu

SEQ ID NO: 445309 - RNA, 65 nt, Homo Sapiens
ugaugugaaaauuggaccuccugcuauuuuacuauuuggagaauacuuuucaucaacauguagag

SEQ ID NO: 445310 - RNA, 65 nt, Homo Sapiens
ugccauuacuuguauaucugaaaaauuaugaauuauuggagaaaauccaaaauagcagaaauugu

SEQ ID NO: 445311 - RNA, 65 nt, Homo Sapiens
cugggucagccaaguuucaugcaugcauaccgauauuggagaaauuucugcagaauauuguaauu

SEQ ID NO: 445312 - RNA, 65 nt, Homo Sapiens
ccuccuucagagcccuuugucagucuccuuguugcuuggagaacaugcaaagucuuguacugaag

SEQ ID NO: 445313 - RNA, 65 nt, Homo Sapiens
ggaugaggaaaagaagagccuuugcugauaaagaguuggagaacauuaugcuggagagagaauau

SEQ ID NO: 445314 - RNA, 65 nt, Homo Sapiens
aaguggauuaauauuaaaacuauguauauuaaucauuggagaagggggaagaggaaaugaaaaua

SEQ ID NO: 445315 - RNA, 60 nt, Homo Sapiens
uagccgagacuggagccuagaggcuggaucuuggagaaugugagaagccagccagaggca

SEQ ID NO: 445316 - RNA, 65 nt, Homo Sapiens
uuugcaaaagaaauaggcuuuucuucuuuuuuaaauuggagaaaucucugcucugguugaccugg

SEQ ID NO: 445317 - RNA, 65 nt, Homo Sapiens
gcaggcaucuguggggaaucccagccugcagguucuuggagaagcaggugaaccuaaggaugaaa

SEQ ID NO: 445318 - RNA, 65 nt, Homo Sapiens
gcucaugcacaucagcugguggagcaggccuggccuuggagaacgagaccugugugccaggggca

SEQ ID NO: 445319 - RNA, 65 nt, Homo Sapiens
ugcguccuugugaagcucgucuccauguggcuuucuuggagaaaggcuccccuggggcaagaggg

SEQ ID NO: 445320 - RNA, 65 nt, Homo Sapiens
ucggagaggucaggagaccgaccccaccacuaacuuuggagaaaauguggguuugcuuuuuaaag

SEQ ID NO: 445321 - RNA, 65 nt, Homo Sapiens
uacguaaucagaaauuugugaaaguuacaugucauuuggagaaaauuuuucuggaaaaguuaaaa

SEQ ID NO: 445322 - RNA, 65 nt, Homo Sapiens
uuuccuucaagcagaaacaaacgguuugaacauaauuggagaaccaccggccaauguccaaaauu

SEQ ID NO: 445323 - RNA, 65 nt, Homo Sapiens
cacugugggcuaggguggucacuuggagagggagcuuggagaacucacggccaagggccacggga

SEQ ID NO: 445324 - RNA, 65 nt, Homo Sapiens
uauguaaauuaccaaggcacugguucuuuaaagauuuggagaagauacguguguuuuuuagagcu

SEQ ID NO: 445325 - RNA, 65 nt, Homo Sapiens
gggacucauauaaauaguugaaacaucuaaagcuguuggagaagauguguaaaaaguacucagaa

SEQ ID NO: 445326 - RNA, 65 nt, Homo Sapiens
cccgcuuuuucuggaacagcauuccuuggacaccauuggagaagcggugcuuuugcaagacugga

SEQ ID NO: 445327 - RNA, 65 nt, Homo Sapiens
cuugggacugggacagucuuuuaaggcuguuuugcuuggagaagaagguuuuuaaaacauggaug

SEQ ID NO: 445328 - RNA, 65 nt, Homo Sapiens
uguuuaccaguaaauacaucuguuuuuguuuuguuuuggagaauuaaagaacaaaagcuuuuagu

SEQ ID NO: 445329 - RNA, 65 nt, Homo Sapiens
cuacuuuuugacuuacauggaagauauacuuugcuuuggagaaauuuuuuaaaaagaagagaaag

SEQ ID NO: 445330 - RNA, 65 nt, Homo Sapiens
ucgcccaucccccccgcggcgccuuguuuuuguauuuggagaaccacuccgccccauccugcagg

SEQ ID NO: 445331 - RNA, 65 nt, Homo Sapiens
gaaguugaacgagcauaguccaaaaagaaaugauguuggagaaggugauuccuuuuuucaaaauc

SEQ ID NO: 445332 - RNA, 65 nt, Homo Sapiens
cuuuuacuaaauauacaagauuuacuacuagaaauuuggagaaagaacacuaacacauguacuug

SEQ ID NO: 445333 - RNA, 65 nt, Homo Sapiens
agaacucaugagagacaagcaguaagaaacuucuuuuggagaaacaacagaccagaucuuuacuc

SEQ ID NO: 445334 - RNA, 65 nt, Homo Sapiens
uacuacaguuucacagaauaccugagaagacacacuuggagaaaccuuuuggguguaaugaaugu

SEQ ID NO: 445335 - RNA, 65 nt, Homo Sapiens
uagccuuacuucuacuuccagaugcagugccucuuuuggagaagacauguuuauuuuucauguuc

SEQ ID NO: 445336 - RNA, 65 nt, Homo Sapiens
gggagggaagaguguguccuggcaggaagccaccauuggagaaggugaggccaguaaccaucuca

SEQ ID NO: 445337 - RNA, 65 nt, Homo Sapiens
ugauuuuacauaucuguuuggauuauagcuaggauuuggagaauaaguguguacagaucacaaaa

SEQ ID NO: 445338 - RNA, 65 nt, Homo Sapiens
uuuuuuaagcaagagaaagacaacuguucugcggguuggagaaaauacaauuuuuuuuuuuuuuu

SEQ ID NO: 445339 - RNA, 65 nt, Homo Sapiens
uacuauugcugcauacccggggugggauggggugguuggagaaccagaacuauuuuuaaaacauu

SEQ ID NO: 445340 - RNA, 65 nt, Homo Sapiens
ccugaacuggggaauuugaacauuccuuuacauuguuggagaaaugaagccaaaguuauucagau

SEQ ID NO: 445341 - RNA, 65 nt, Homo Sapiens
gucuauaugguucuccaagaaacugaaugaauccauuggagaagcgguggauaacuagccagaca

SEQ ID NO: 445342 - RNA, 65 nt, Homo Sapiens
aauuauguucuuuagacacugcuaccugaaaacuguuggagaaauaauguuuaaaguuauuuaag

SEQ ID NO: 445343 - RNA, 65 nt, Homo Sapiens
cuuaaaacccugaugcaaacuucuccuuucagugguuggagaaauuggccgaguucaaccauuca

SEQ ID NO: 445344 - RNA, 65 nt, Homo Sapiens
ccuguaugugguguuuuaacgacauagggagucauuuggagaaagaaaauucuaaccaaacccca

SEQ ID NO: 445345 - RNA, 65 nt, Homo Sapiens
auggaagcuacaccccuacaauguacagcccgugcuuggagaaccgaauggucagccuaagggua

SEQ ID NO: 445346 - RNA, 65 nt, Homo Sapiens
caaccagauacaucugcuggugcuggugucucucuuuggagaaacccagaacuguggugccaaau

SEQ ID NO: 445347 - RNA, 65 nt, Homo Sapiens
agaaugcuacuguauuuuacauacaaugcauacuguuggagaacaauuugccaaauaacaaaagc

SEQ ID NO: 445348 - RNA, 65 nt, Homo Sapiens
uguaccuuuuuugucaacuccuuucuguuuucggauuggagaagaugauaccuugaucuuuccca

SEQ ID NO: 445349 - RNA, 65 nt, Homo Sapiens
uuccaaucuuuccucccaagugugacuaaggcacguuggagaacaacaccuuaaauaaaagugau

SEQ ID NO: 445350 - RNA, 65 nt, Homo Sapiens
aagaugaauuauagcuccggagaaugugggugguauuggagaaaggaaaagcuaaauaaccuuua

SEQ ID NO: 445351 - RNA, 65 nt, Homo Sapiens
gaaccaaguccuuggauaucuagaaccaagucuacuuggagaaaagcuguaucuacucuguggag

SEQ ID NO: 445352 - RNA, 65 nt, Homo Sapiens
uguuuaacauuuucaagccuagcagcuguacgacuuuggagaaguuuaagucacaccuaccacug

SEQ ID NO: 445353 - RNA, 65 nt, Homo Sapiens
uuaaugagaaaauuuuagaaugugcuaccaucuacuuggagaagucacacuccaguauuaauauu

SEQ ID NO: 445354 - RNA, 65 nt, Homo Sapiens
ugcaaacuaccgucgcucaggaggcccaaacuugauuggagaauugccccauaggaugucauauu

SEQ ID NO: 445355 - RNA, 65 nt, Homo Sapiens
uauuuaauaaaaccuguuaauuauguguuacaaaauuggagaaaggaaugcagauuacacugauc

SEQ ID NO: 445356 - RNA, 65 nt, Homo Sapiens
uuuaugucagcacacacuuauuaauuuuguaauaauuggagaagacgugcguucugccuuccuug

SEQ ID NO: 445357 - RNA, 65 nt, Homo Sapiens
ggagugcagucauaaucuuaccuuuccuuucgacauuggagaauucacauuggugucucuuuuuu

SEQ ID NO: 445358 - RNA, 65 nt, Homo Sapiens
acucgugagcacaucuuuagauaaaguuuugugcuuuggagaaugauguccuuuccuuucugaaa

SEQ ID NO: 445359 - RNA, 65 nt, Homo Sapiens
ugcggcagagaagccaugcgcgccuguguggaaauuuggagaagugcacccuaggggggcaccug

SEQ ID NO: 445360 - RNA, 65 nt, Homo Sapiens
uauuucccagugugucuuuuaugucuuugaauguuuuggagaaaagucuaugccugucuaaaaau

SEQ ID NO: 445361 - RNA, 65 nt, Homo Sapiens
auauuuuaaauuaaagccuucuaauguuccacuguuuggagaacagaagauagcaggcuguguau

SEQ ID NO: 445362 - RNA, 65 nt, Homo Sapiens
cugcaaacacuguguauagugagacuuguucuacuuuggagaacagguuaccuuuugaaaaugag

SEQ ID NO: 445363 - RNA, 55 nt, Homo Sapiens
auggcucucucaagccaugaccacauuggagaaaugguuuuuauugucaaccuua

SEQ ID NO: 445364 - RNA, 65 nt, Homo Sapiens
auagucaguuuaguucauauguucugaaaacuguuuuggagaaagauagacagaaaaaugucauc

SEQ ID NO: 445365 - RNA, 65 nt, Homo Sapiens
guaauucucagaaccagucucagggagauauaugcuuggagaacucugccuuccaucaacugcag

SEQ ID NO: 445366 - RNA, 65 nt, Homo Sapiens
ugccaugaauuaagauggaugacuggaaaaagguguuggagaaagaguuaaagaugaggaagaga

SEQ ID NO: 445367 - RNA, 65 nt, Homo Sapiens
cgcaaguaccaggaggacauaaccgcuguggccuguuggagaacagccaguagccuugguaauau

SEQ ID NO: 445368 - RNA, 65 nt, Homo Sapiens
cauuguuacaugaaagugauagauagcaacaaguuuuggagaagagagagggagauaaaaggggg

SEQ ID NO: 445369 - RNA, 65 nt, Homo Sapiens
ugauuuucuacaugaaucaaacacagaaacaacuuuuggagaaauuaaauucugagugugacuuc

SEQ ID NO: 445370 - RNA, 65 nt, Homo Sapiens
acgcuccccugacacugaagaggauccacaacuccuuggagaaacacccucacgucuguugccgc

SEQ ID NO: 445371 - RNA, 65 nt, Homo Sapiens
uuuauauagauguaucuuuuaaaaauaguucacguuuggagaauucuuuuguacucauuugcuuu

SEQ ID NO: 445372 - RNA, 65 nt, Homo Sapiens
cuagcucugacuuugcuguuuccagugguaugaccuuggagaagucacuuauccucuuggagccu

SEQ ID NO: 445373 - RNA, 65 nt, Homo Sapiens
uguucucucuggacucuugccuagcucacaaggcuuuggagaauugucuuccuaaaucggggcac

SEQ ID NO: 445374 - RNA, 65 nt, Homo Sapiens
auuggaaagcaucuaguccagugggaagccagggguuggagaaggugcuacaucccucuucccau

SEQ ID NO: 445375 - RNA, 65 nt, Homo Sapiens
ugccuucuagaaucagaucuguuuggggcuggggguuggagaauaaaagcaggagaagucuaugg

SEQ ID NO: 445376 - RNA, 65 nt, Homo Sapiens
uccucugcuguguucuguguguccaguguagccuauuggagaaucggucucauuagagugacucu

SEQ ID NO: 445377 - RNA, 65 nt, Homo Sapiens
cauucucugaaaauacuguauguacacagacugauuuggagaacagaguuguuuaauagagaaaa

SEQ ID NO: 445378 - RNA, 65 nt, Homo Sapiens
aaaugauauuuagaaaguuagguaagaggauuuuuuuggagaaaauguccauauccagguuagcu

SEQ ID NO: 445379 - RNA, 65 nt, Homo Sapiens
gggaggaauaggagcaaaucaauaaaugauacaucuuggagaagauaaacuuguauuacauauca

SEQ ID NO: 445380 - RNA, 65 nt, Homo Sapiens
gagaggaaagguuugagaagaccauccauguauuuuuggagaagagggaaggaguuuuauguuaa

SEQ ID NO: 445381 - RNA, 65 nt, Homo Sapiens
cagggggcugccuugggcccccuugcuugcagugguuggagaaccuugucaagguuguccccaga

SEQ ID NO: 445382 - RNA, 65 nt, Homo Sapiens
gccucucuagcagucaacucgguacagaagaaagauuggagaaggaugucuuugggagggaagaa

SEQ ID NO: 445383 - RNA, 65 nt, Homo Sapiens
ggggguugggaacuuaugcaccaccuuccagaaacuuggagaaaugcugagggugcccaccaagc

SEQ ID NO: 445384 - RNA, 65 nt, Homo Sapiens
uacuucaaccagagcagggaggacucauuccugccuuggagaaaacccagcugugguuggaucaa

SEQ ID NO: 445385 - RNA, 65 nt, Homo Sapiens
ggagagaauuaguagggcaagaauuuucuaaagcuuuggagaaaagagcaugaaagucaaaacug

SEQ ID NO: 445386 - RNA, 65 nt, Homo Sapiens
gagaagaaguuguagcagaguuaggggccuggggauuggagaacgcugguucaguggcuggagua

SEQ ID NO: 445387 - RNA, 65 nt, Homo Sapiens
aucaaaaccccaaacaaacaaauaaguaccuuuuauuggagaaaacuaaaaaauuuuacugucua

SEQ ID NO: 445388 - RNA, 65 nt, Homo Sapiens
acuuauuacacuaucuaaccgguauguauuauggauuggagaagcauguugaaauaaugauagua

SEQ ID NO: 445389 - RNA, 65 nt, Homo Sapiens
uggaauaaaguuacaccuggguuggaacucugaaguuggagaaggauaaugcucuauccucuaag

SEQ ID NO: 445390 - RNA, 65 nt, Homo Sapiens
agguaaaggaugaggguucaagcgcuaguggaggguuggagaagggcagguuugaccaggaaagc

SEQ ID NO: 445391 - RNA, 65 nt, Homo Sapiens
cgguuuugaaagcaacuccuuuguucaauaugaucuuggagaacaccaggaacaagaagagaccc

SEQ ID NO: 445392 - RNA, 65 nt, Homo Sapiens
cagugcuugaaauggacaaggaagaguggacagucuuggagaacaugaauaaaugugaaggcugu

SEQ ID NO: 445393 - RNA, 65 nt, Homo Sapiens
ccucgcugucucccuagagccagggcccugcggauuuggagaagggagcggggcaggacuuccag

SEQ ID NO: 445394 - RNA, 65 nt, Homo Sapiens
cagagaaagguuuuagacuccaguuuaccuuucucuuggagaaacucaaugcuaaucccaccuuu

SEQ ID NO: 445395 - RNA, 65 nt, Homo Sapiens
aauguucacacacuuuucuugcguacucaacuaaauuggagaauguuucugaagaaaauuggaug

SEQ ID NO: 445396 - RNA, 65 nt, Homo Sapiens
ugaaggcucgaguucugcuguucuguaaaagagaauuggagaaugaaaccugcuccaacagagau

SEQ ID NO: 445397 - RNA, 65 nt, Homo Sapiens
auccugucauuucuguucuugucccucauacaucuuuggagaaccgggcuccagacuuuguuccc

SEQ ID NO: 445398 - RNA, 65 nt, Homo Sapiens
uuggacaggacccagcccugcaccguucacuguauuuggagaaaaugguaagaguuccauaccgg

SEQ ID NO: 445399 - RNA, 65 nt, Homo Sapiens
cuguguauguguggaaauaaaaauguauuguacuuuuggagaauuuuuuguaggcauuuuucugu

SEQ ID NO: 445400 - RNA, 65 nt, Homo Sapiens
ugggcucuggccaucugcaacccugaacgugcagguuggagaacgaaugaauacaaauuuuauug

SEQ ID NO: 445401 - RNA, 65 nt, Homo Sapiens
acagccuuuccuacauccuucccucacucccaugauuggagaaaugauucauugggugaugagug

SEQ ID NO: 445402 - RNA, 65 nt, Homo Sapiens
cagcagcugggcugucagggccauaguagcucccuuuggagaacagggaaagccuggaggcuucc

SEQ ID NO: 445403 - RNA, 65 nt, Homo Sapiens
ggacagugcaacaaguaacgagacuauuuuguauuuuggagaauucauauuauggagaaccuaac

SEQ ID NO: 445404 - RNA, 65 nt, Homo Sapiens
aaauuccuaccaggaaagaauacauauccaauagauuggagaaagccagagauuagcccucauuc

SEQ ID NO: 445405 - RNA, 65 nt, Homo Sapiens
gaauuuuucacaaagagcaaugacuuuauuuugcauuggagaacuccuggagauaagcuguacaa

SEQ ID NO: 445406 - RNA, 65 nt, Homo Sapiens
caaggaaggaggcggugacauccaaggcuuuaucuuuggagaaggguguuagugagggccucaag

SEQ ID NO: 445407 - RNA, 65 nt, Homo Sapiens
cgucuugcuuugucacccacaggggaaacuuuuuuuuggagaaggaagucuucauuuggggccaa

SEQ ID NO: 445408 - RNA, 65 nt, Homo Sapiens
ggaggugagcaaauuaacgguuauuggucuggaaauuggagaaauuaaggaucugauacaucuag

SEQ ID NO: 445409 - RNA, 65 nt, Homo Sapiens
gaauuaaguugacuugaaaugugugcacuaugagauuggagaaauauaauuaaagaaccuggugg

SEQ ID NO: 445410 - RNA, 65 nt, Homo Sapiens
gaggcugaggguagagggaggugggugggaaucucuuggagaacucuuguuuaaaagaaaaucag

SEQ ID NO: 445411 - RNA, 65 nt, Homo Sapiens
aucuguagcuuguugaaaaaaggcauuucagaguguuggagaagacacugacugggacccugaag

SEQ ID NO: 445412 - RNA, 65 nt, Homo Sapiens
aaaaagggcgguggaggggauaguaauuccuaaucuuggagaauaauuuucaaaaaccuaauccg

SEQ ID NO: 445413 - RNA, 65 nt, Homo Sapiens
uuuggggcacguuuuccuacgagcuuuaaaguacuuuggagaaacagaauuaaauacauuucauu

SEQ ID NO: 445414 - RNA, 65 nt, Homo Sapiens
ggcagaucaaaagaggugaacggagaaugauguucuuggagaacacuagaggaacuuggaucuuc

SEQ ID NO: 445415 - RNA, 65 nt, Homo Sapiens
uaggugaagaugcaaccagauuuaacucugaauacuuggagaaacauauaaaagaaguugugcua

SEQ ID NO: 445416 - RNA, 65 nt, Homo Sapiens
cccaaacuccuucuccacuguaaauuugcaaguuuuuggagaaccggucaaguaguuuuaauaug

SEQ ID NO: 445417 - RNA, 65 nt, Homo Sapiens
ugcagccucacgcaccauccaaagcugagacaaaauuggagaagcgugaaaaaugcucucccagc

SEQ ID NO: 445418 - RNA, 65 nt, Homo Sapiens
aguaggaacaacacaugguacaaaucuacuagacauuggagaaacaauugcacaucaguaugugc

SEQ ID NO: 445419 - RNA, 65 nt, Homo Sapiens
cugguucccguuuuccagaggaaaacccuguguccuuggagaaagcuuuauuucugcagguuggu

SEQ ID NO: 445420 - RNA, 65 nt, Homo Sapiens
aaggacaccguuacccaugccccuucaucacauacuuggagaacaagcuuguguggucagcucuu

SEQ ID NO: 445421 - RNA, 65 nt, Homo Sapiens
uuucuuacucauuucaguccuuaaaaucauacaucuuggagaaccaagauuuauggaguaaggac

SEQ ID NO: 445422 - RNA, 65 nt, Homo Sapiens
gacuggagccauaaaguuaauuugcaccuagcuuuuuggagaauagccaugauuaacugcuauuc

SEQ ID NO: 445423 - RNA, 65 nt, Homo Sapiens
ucaguuuuuuaaaaauagacuguaguauccuuucauuggagaauuuacaaaaauaucaucuacag

SEQ ID NO: 445424 - RNA, 65 nt, Homo Sapiens
uguucaaaccaaagaaacaaugaucuacucaaacauuggagaaaaaaacugccagaggaggaguu

SEQ ID NO: 445425 - RNA, 65 nt, Homo Sapiens
uccagcuuucgucugucaucagacauugaagagauuuggagaaauguaaagcagcaguacucuuc

SEQ ID NO: 445426 - RNA, 65 nt, Homo Sapiens
guagauggguauauaacaguuuggaaauacuaucuuuggagaauguauuuuuguauuuauaaauc

SEQ ID NO: 445427 - RNA, 65 nt, Homo Sapiens
ggugagcaggcacauugacuuucuguugagguaccuuggagaagcugagccauucugaggacauc

SEQ ID NO: 445428 - RNA, 65 nt, Homo Sapiens
agauuuuuaaaggaauauuucagaguuuaaucuuuuuggagaaguuauguucuuuaaucggguac

SEQ ID NO: 445429 - RNA, 65 nt, Homo Sapiens
uuuauguauguucagccagauaguaaaugggauuuuuggagaaauaagauaacuacaaaguuucu

SEQ ID NO: 445430 - RNA, 65 nt, Homo Sapiens
ugucaaauuacagccaaugauucaugauagugcuuuuggagaacugaaaguauuaucuaauuaag

SEQ ID NO: 445431 - RNA, 65 nt, Homo Sapiens
cuggaguuguuaugaacaugcauugcagauuguucuuggagaauuuagcuaggaauuguuaagca

SEQ ID NO: 445432 - RNA, 65 nt, Homo Sapiens
aaaacuguacugcuuguucaacugacuuuugucuuuuggagaaaauuugcaucacugaggaugaa

SEQ ID NO: 445433 - RNA, 65 nt, Homo Sapiens
aaagaaaagcaaaugaguguauuuagcaacugguguuggagaaaaccauaauagagauugauaag

SEQ ID NO: 445434 - RNA, 65 nt, Homo Sapiens
uucuuaguugggugaauuaaucauaugcuuauggcuuggagaaauucuuuuccaguauuaaacac

SEQ ID NO: 445435 - RNA, 65 nt, Homo Sapiens
uuuucuuguucccguagaagaaagaagaaagguguuuggagaauucgagugccuaggaugccaga

SEQ ID NO: 445436 - RNA, 65 nt, Homo Sapiens
cuaagacaaagauauuuagguugagcagcuauuaauuggagaauugguacagagacgcuccagau

SEQ ID NO: 445437 - RNA, 65 nt, Homo Sapiens
gaagccuggcugcagcuucccauuugguuacgagguuggagaaaaagucaaaguccccuccuggg

SEQ ID NO: 445438 - RNA, 65 nt, Homo Sapiens
auauagcaucuggaagaucauuuugaaauuguuccuuggagaaaugaaaacaguguguaaacaaa

SEQ ID NO: 445439 - RNA, 65 nt, Homo Sapiens
uacuuucuugucaaacaaaaccaauggcucuggguuuggagaacacaguggcugguuuuaaaaau

SEQ ID NO: 445440 - RNA, 65 nt, Homo Sapiens
gcugccuuucccaaaugggaaaggugcugacagaguuggagaaaaaagaauagacucauuuuucc

SEQ ID NO: 445441 - RNA, 65 nt, Homo Sapiens
cugcuugugcugggaaaugcaacucacucauguauuuggagaaacaggaguguucacuuaucuag

SEQ ID NO: 445442 - RNA, 65 nt, Homo Sapiens
uuaucaaaaauuucauggaaaccuuugugggguuuuuggagaagggaaaacuucuuuuaaaccuc

SEQ ID NO: 445443 - RNA, 65 nt, Homo Sapiens
gauugaacuuuucaagacauguuuauucggagaauuuggagaaguggggagagauauuuucuuau

SEQ ID NO: 445444 - RNA, 65 nt, Homo Sapiens
caaugcagaacugaugggaaccuaaaccuugacaguuggagaagcgaucaauauaacaauauaau

SEQ ID NO: 445445 - RNA, 65 nt, Homo Sapiens
acaugcauauaauucuguagacagguauuuugauauuggagaauagaaguuuaaaaauucuuuaa

SEQ ID NO: 445446 - RNA, 65 nt, Homo Sapiens
uguauuuguguucacuucuauagacuauugaaauuuuggagaaaaaucaaugcuuauauauuccu

SEQ ID NO: 445447 - RNA, 65 nt, Homo Sapiens
ugcuauucuuccuguuguccauaauaggacucgacuuggagaaauauacaaaaaugaaaauauuu

SEQ ID NO: 445448 - RNA, 65 nt, Homo Sapiens
agaucuccgugcccuacagauuggagccuggguuuuuggagaaagaucuuaguugucauaauccc

SEQ ID NO: 445449 - RNA, 65 nt, Homo Sapiens
gaagggcccccauggcccugagugauuuuauuguuuuggagaaugccuuuuagauaggaucuagg

SEQ ID NO: 445450 - RNA, 65 nt, Homo Sapiens
ccauggccaaaacgauugugauauuucacuggugguuggagaaaaaacuaaaaugaaccaaaccc

SEQ ID NO: 445451 - RNA, 65 nt, Homo Sapiens
agguuguccguguccuuaacuuuguagugaauuuauuggagaauguaucaauguguauguggcug

SEQ ID NO: 445452 - RNA, 65 nt, Homo Sapiens
uuugugcccuguguuuuauaaacuauuuucuauauuuggagaaagaaaaugaauugaaccauuuc

SEQ ID NO: 445453 - RNA, 65 nt, Homo Sapiens
auaguagauuuuaauuugacccguuucacuuuuuguuggagaaaauuaucaacagcaaacuucag

SEQ ID NO: 445454 - RNA, 65 nt, Homo Sapiens
ccacugugccucagagaccagggcuccagccccucuuggagaagucucagcuaagcucacguccu

SEQ ID NO: 445455 - RNA, 65 nt, Homo Sapiens
ugaagccagcuggacuuccugggucgaguggggccuuggagaacuuuucugucuuacaagaggau

SEQ ID NO: 445456 - RNA, 65 nt, Homo Sapiens
gagaauugcucauucauauuuuuucuguugcuugcuuggagaauuugcucuuuuuuuggcauaua

SEQ ID NO: 445457 - RNA, 65 nt, Homo Sapiens
caaccuuugcacacucaccugagcccuggggacccuuggagaaauuaggugucaccugcuguggc

SEQ ID NO: 445458 - RNA, 65 nt, Homo Sapiens
cacaugaaacauuugcaaaauuguuuuugguuggauuggagaaguaauccuagggaaggguggug

SEQ ID NO: 445459 - RNA, 65 nt, Homo Sapiens
uuugauaccaaacaauucaaaaguuggaucugaguuuggagaaagauauuuccaaccuaaguggg

SEQ ID NO: 445460 - RNA, 65 nt, Homo Sapiens
aacaaacuauguagugugucccuauuauaaaugcauuggagaaguauuuuuaugagacucuuuac

SEQ ID NO: 445461 - RNA, 65 nt, Homo Sapiens
ugaggccucuuauguguaaucaaaugugaaaguacuuggagaaacguuagaagucugcuaaagau

SEQ ID NO: 445462 - RNA, 65 nt, Homo Sapiens
gcuuagaaauucagcauuugcaacauucauagucuuuggagaaauuuucuguggagguggaaaag

SEQ ID NO: 445463 - RNA, 65 nt, Homo Sapiens
cucaguuccaacuugugauuucuagaauuuccacuuuggagaauaugccuggagugacacuacac

SEQ ID NO: 445464 - RNA, 65 nt, Homo Sapiens
uguuuaaauaguucuguuguuugcuuuucucaauuuuggagaagauuuuuaaaaauuuaacauga

SEQ ID NO: 445465 - RNA, 65 nt, Homo Sapiens
augauagaugauauacuagaauucuugccacaauauuggagaauaaauuuuuacuugcggugacu

SEQ ID NO: 445466 - RNA, 65 nt, Homo Sapiens
acaggcucaaaguggggcugggggucuuggccacauuggagaaaacagaaguucugccucugccu

SEQ ID NO: 445467 - RNA, 65 nt, Homo Sapiens
ccugccccgagcccuagguggggccaggaggugccuuggagaagccagccagagcagagagggcu

SEQ ID NO: 445468 - RNA, 65 nt, Homo Sapiens
cacagacucugagaagcgaagaccaugucuccucguuggagaaacccaauagcaggggaagcugg

SEQ ID NO: 445469 - RNA, 65 nt, Homo Sapiens
guguguguaaugcaaauuaguuaaaacaaauaguuuuggagaaaguuaaaacuagcuuuagagua

SEQ ID NO: 445470 - RNA, 65 nt, Homo Sapiens
uccagaaucauucuccuuucugcccauaaagggccuuggagaauugcuuuaagaagagugaaugu

SEQ ID NO: 445471 - RNA, 65 nt, Homo Sapiens
caggagccugggaccccgcaugucccaaaaugggauuggagaagcuggagagaaagcagaagagg

SEQ ID NO: 445472 - RNA, 65 nt, Homo Sapiens
auuuuuggguguuccuggcaguuuaaaaaaauugguuggagaauuuagguuuuuauuaguaccau

SEQ ID NO: 445473 - RNA, 59 nt, Homo Sapiens
gugcccagggcugcaccugaaaaggggcauuggagaagugcagcugccgugccugaugu

SEQ ID NO: 445474 - RNA, 65 nt, Homo Sapiens
caguguggugaugccaugcccaucaugggaggcuuuuggagaaacagaauguuugggcaggggcu

SEQ ID NO: 445475 - RNA, 65 nt, Homo Sapiens
caucuuccacuggaacguuucacugcaaacacaccuuggagaaguggcaucagucaacagagagg

SEQ ID NO: 445476 - RNA, 65 nt, Homo Sapiens
gugaagccagcugggcuccugagucugguggggacuuggagaaccuuuaugucuagcuaagggau

SEQ ID NO: 445477 - RNA, 65 nt, Homo Sapiens
auccacacucuguaucuggcuacucugguggggacuuggagaaccuuuguguccacacucuguau

SEQ ID NO: 445478 - RNA, 65 nt, Homo Sapiens
aaacacccuccuggcacaacgcucuacccugcagcuuggagaacuccgcuggauggggagucuca

SEQ ID NO: 445479 - RNA, 65 nt, Homo Sapiens
gguggaucaccugaauucucucagcugucaauggcuuggagaacaucucaugggcccaagucauc

SEQ ID NO: 445480 - RNA, 65 nt, Homo Sapiens
uuuuguugaaauagcuuuacuguuucucaaguguuuuggagaaaaaaaucaacccugcaaucacu

SEQ ID NO: 445481 - RNA, 65 nt, Homo Sapiens
guuggccaaagugaaggaaucuuuuuucaguuuuauuggagaaacugaaggguaacauucuaaca

SEQ ID NO: 445482 - RNA, 65 nt, Homo Sapiens
cggcuguggcugacaguggcucuggccaggguugcuuggagaaggcucagugugccugggacagg

SEQ ID NO: 445483 - RNA, 65 nt, Homo Sapiens
uuaauuuccaaaucaggaacauuggacuggaauguuuggagaaugggaaagcggauaaaacuuuc

SEQ ID NO: 445484 - RNA, 65 nt, Homo Sapiens
gugaaguuuguuuuuucgccgauggacuuaucccuuuggagaagauuguuuguaguuacauuuag

SEQ ID NO: 445485 - RNA, 65 nt, Homo Sapiens
uggauggccuuaggguuccugggugcagccagcuuuuggagaaccggcggccuggccuagaccag

SEQ ID NO: 445486 - RNA, 65 nt, Homo Sapiens
agcugcugagcauggcuuuccgcugcuggccagcauuggagaagacuuugugacuuggaaaggua

SEQ ID NO: 445487 - RNA, 65 nt, Homo Sapiens
agcucacugcucucuagaaaguccccugcucaccauuggagaauccaggucccaguucacaugua

SEQ ID NO: 445488 - RNA, 65 nt, Homo Sapiens
uggugcugaaauccaccuuucuuguugccgucgaguuggagaaaguaaccggccucaugacuagc

SEQ ID NO: 445489 - RNA, 65 nt, Homo Sapiens
aaguuugugauuaguccuuaggauucaggauguuguuggagaaacugugugauggugcaaggaau

SEQ ID NO: 445490 - RNA, 65 nt, Homo Sapiens
gguggccucgccggagcuaggggaccgcaugccgcuuggagaagggcugccugacugccucagca

SEQ ID NO: 445491 - RNA, 65 nt, Homo Sapiens
gaguacauuuuuaaaauuuugaggcauuucaggaguuggagaacgccuuuucuccagcaacugca

SEQ ID NO: 445492 - RNA, 65 nt, Homo Sapiens
uacagcaucauggaugcuguuaugaucagggaauuuuggagaaacgcggauggugaggacacagc

SEQ ID NO: 445493 - RNA, 65 nt, Homo Sapiens
gauucccaaguccaggaagacaucugguuuaauuauuggagaaucaaagacauaaacuuggaguc

SEQ ID NO: 445494 - RNA, 65 nt, Homo Sapiens
uuuacuuuuccucagaagauugagcugucuuuuauuuggagaauaaaaugaaguucugaaaaaaa

SEQ ID NO: 445495 - RNA, 65 nt, Homo Sapiens
guuugccaagaagugaucuguuuuaaaggucauauuuggagaaagggcaaggaauugggucugcu

SEQ ID NO: 445496 - RNA, 65 nt, Homo Sapiens
uuggauguguuugggggcggggggauggaagugacuuggagaauguguuugggaugaaauaacua

SEQ ID NO: 445497 - RNA, 65 nt, Homo Sapiens
uuuauaaaccacugaaagggauagagaagugaacauuggagaaagccaguagcaacugugagaaa

SEQ ID NO: 445498 - RNA, 65 nt, Homo Sapiens
guggaggaucaguagcuguuaugaugccagaccauuuggagaaguaucagaggccugaccggaca

SEQ ID NO: 445499 - RNA, 65 nt, Homo Sapiens
ccaagcccuuggggugacucggcuuccaggagcuguuggagaaaugaggaugucugucccugucu

SEQ ID NO: 445500 - RNA, 65 nt, Homo Sapiens
ggcauuccuacuggagaaaaaucugacuuggaaaguuggagaagacucaacugcugguagcauuu

SEQ ID NO: 445501 - RNA, 65 nt, Homo Sapiens
gaggcuggcugggggagaaauggaggagggcuuguuuggagaaggcacagguguggguguccugu

SEQ ID NO: 445502 - RNA, 65 nt, Homo Sapiens
cugauuccuuuuuuguugucgggacagggccaguguuggagaauuggggcucggaccccucacug

SEQ ID NO: 445503 - RNA, 65 nt, Homo Sapiens
gcuuuggcagaagagugaaaucugcucugugggguuuggagaaauucagugagaauucgugcauc

SEQ ID NO: 445504 - RNA, 65 nt, Homo Sapiens
caccucuggcucuugugcuugacacaggugcagcuuuggagaacugucuuguguaaacguuugca

SEQ ID NO: 445505 - RNA, 65 nt, Homo Sapiens
gacauggggcugaaucucaguugaaaggugguugcuuggagaaggaggggaagaugcuggacuca

SEQ ID NO: 445506 - RNA, 65 nt, Homo Sapiens
ucacccuuucccuuuuucuuaggaaaucugccuuauuggagaaaauccaaaaacuacauauuugu

SEQ ID NO: 445507 - RNA, 65 nt, Homo Sapiens
ggaucuguccaauaaacgcuaaccugcucuaaacuuuggagaacuuacuccauagcuaccaaguu

SEQ ID NO: 445508 - RNA, 65 nt, Homo Sapiens
agaggagagaaaagagggccggugugcacauauguuuggagaaauauugccacucaguuccucug

SEQ ID NO: 445509 - RNA, 65 nt, Homo Sapiens
aggguagagagagguugcuaaaggcagaagugaauuuggagaacugccagauaucaaaccugagg

SEQ ID NO: 445510 - RNA, 65 nt, Homo Sapiens
acaaggguuuuguccugaauuaaaaaccccaccauuuggagaauugaguugaaguccaaccuauu

SEQ ID NO: 445511 - RNA, 65 nt, Homo Sapiens
uguugcugagacccccccccacccuccagcuccucuuggagaagcccagccuucaugccuucccc

SEQ ID NO: 445512 - RNA, 65 nt, Homo Sapiens
caaggaaggcggaagaauggcccuaucaggugguuuuggagaaaacucagaaaucaggacauccc

SEQ ID NO: 445513 - RNA, 65 nt, Homo Sapiens
auuuuuuuuuuaaauaauaucagugcagaauauuuuuggagaacguauuaacaacugaggaaggc

SEQ ID NO: 445514 - RNA, 65 nt, Homo Sapiens
uuaauguuuuucauuuaucagcauaccuuguucaauuggagaauuacaacaacauaaaaauccuu

SEQ ID NO: 445515 - RNA, 65 nt, Homo Sapiens
gcauguguggggugugugugauguguucuggucacuuggagaaggguacaccuggcaucuguggc

SEQ ID NO: 445516 - RNA, 65 nt, Homo Sapiens
gugugugugggaugcgugugguguguccuagucacuuggagaaggggugugggcgcgucuguggu

SEQ ID NO: 445517 - RNA, 65 nt, Homo Sapiens
aucugaugccuuuuucuuugcugagccucaggcuguuggagaagcggaacugucugcccaggagc

SEQ ID NO: 445518 - RNA, 65 nt, Homo Sapiens
uuauggaagcauguguaaaauuauacuuucaguaauuggagaauucagagauugcauuucuagca

SEQ ID NO: 445519 - RNA, 65 nt, Homo Sapiens
accuuguauugugauauuaacuggcaaagauccucuuggagaaaccuuucccagguacaguuuca

SEQ ID NO: 445520 - RNA, 65 nt, Homo Sapiens
auaaugaagcugauuuuuuagcugagauagaagcuuuggagaaaaugaaugaagaucacguucag

SEQ ID NO: 445521 - RNA, 65 nt, Homo Sapiens
uuucguuuuuguuucccuuuaguauuuaauggucuuuggagaaaaaauaauaaaacagaguguua

SEQ ID NO: 445522 - RNA, 65 nt, Homo Sapiens
ccucagaauucagaagauauccacuaccucccagcuuggagaacaauuuugccucccacacccag

SEQ ID NO: 445523 - RNA, 65 nt, Homo Sapiens
ggugcuaguuggcaauagaucucacacacuuugauuuggagaauugauugcacgaguguguuuuc

SEQ ID NO: 445524 - RNA, 65 nt, Homo Sapiens
guucacagagauggaugcauguucugauugccucuuuggagaagcucaucagaaacucaaaagaa

SEQ ID NO: 445525 - RNA, 65 nt, Homo Sapiens
ugagcaucguggaugggugcacggagacacgcaccuuggagaaaugaggggagauggaccaagaa

SEQ ID NO: 445526 - RNA, 65 nt, Homo Sapiens
uaggguuguuacaacugucacuagcggaggucacuuuggagaagggugggccuuacauccagugu

SEQ ID NO: 445527 - RNA, 65 nt, Homo Sapiens
ucaauaaaauugcugggaauauuugacucuccguauuggagaaaauaaaauuacaacauuacgac

SEQ ID NO: 445528 - RNA, 65 nt, Homo Sapiens
acaucauuacuggaaaccuauuaaacauuagcaaauuggagaauaguuuuaauauaguaaaugua

SEQ ID NO: 445529 - RNA, 65 nt, Homo Sapiens
gugguagcgcugggggugauuuuaggcagcaagaauuggagaacucacacugcgaaaagaaaacc

SEQ ID NO: 445530 - RNA, 65 nt, Homo Sapiens
guuggggugugaaagccucaagugacucagccugguuggagaacugccccacccaguaucuucug

SEQ ID NO: 445531 - RNA, 65 nt, Homo Sapiens
aaagucuucaguaacgcuacaacgauugcaaaucauuggagaauccauaaugaagagagaucuuc

SEQ ID NO: 445532 - RNA, 65 nt, Homo Sapiens
caacucaaaucauauuagacaucggagaaaucacuuuggagaaaggucuuuugagugcacugagu

SEQ ID NO: 445533 - RNA, 65 nt, Homo Sapiens
aaaaagccagggugugccagacccuccugcuggccuuggagaagcccuaaucaggugagccacuc

SEQ ID NO: 445534 - RNA, 65 nt, Homo Sapiens
cuuuuauaucaaaaguggagacauuugccccccauuuggagaaugagacuccacagugacuugcc

SEQ ID NO: 445535 - RNA, 65 nt, Homo Sapiens
uugugcacuaucacugggaacaaggauguggaauguuggagaacauggaaaacaagaaauacugu

SEQ ID NO: 445536 - RNA, 65 nt, Homo Sapiens
uugaaugcuaccccccaaguauugauuuaggggcuuuggagaacuuccguauaagcucaaugagu

SEQ ID NO: 445537 - RNA, 65 nt, Homo Sapiens
acccugcaaauguaauaaauaucagggaauucagauuggagaaaauuacuuaaacuuuguucaac

SEQ ID NO: 445538 - RNA, 65 nt, Homo Sapiens
cuauagcccuuuaguuauuuucauuuuguuuuuaguuggagaacuuuuuauuuaguuagaacacu

SEQ ID NO: 445539 - RNA, 65 nt, Homo Sapiens
acucuaugaauagaauauaccugggaaaaauaauguuggagaaauuggacuacagcuuauucagc

SEQ ID NO: 445540 - RNA, 65 nt, Homo Sapiens
uagugucagaauugaauuauggagucugcacuaacuuggagaagucuuggacugcacuaacuugu

SEQ ID NO: 445541 - RNA, 65 nt, Homo Sapiens
cauaaugaagagagaucuuaaacgauuacaaaucauuggagaaucaaagucuucaguaaugcuac

SEQ ID NO: 445542 - RNA, 65 nt, Homo Sapiens
uauaaugaauaaagaucuaaaaccauugcaaaucauuggagaaucaaagucuucaguaacgcuac

SEQ ID NO: 445543 - RNA, 65 nt, Homo Sapiens
cauaaugagagaucuuacaaaaccauugcaaaucauuggagaaucaaaguuuucaguaaugcuac

SEQ ID NO: 445544 - RNA, 65 nt, Homo Sapiens
cacagugaagagaucuuacaaaccauugcacaucauuggagaaucaaaguuuucaguaaugcuac

SEQ ID NO: 445545 - RNA, 65 nt, Homo Sapiens
acuugaagaauguaaugccaacuuacuucucccucuuggagaaagcuaggcuaauugugacugug

SEQ ID NO: 445546 - RNA, 65 nt, Homo Sapiens
cccucuagaaacauauuggccuggguucaagagaguuggagaaaccuguacuuguaccuaaggcc

SEQ ID NO: 445547 - RNA, 65 nt, Homo Sapiens
cacaccugaguaagauccugcagucucauuaaauauuggagaauagcuuaugagugcagugaguc

SEQ ID NO: 445548 - RNA, 65 nt, Homo Sapiens
ucuugugaauuacacagcaaauugguaacucccucuuggagaauucauggguaaauauguguuga

SEQ ID NO: 445549 - RNA, 65 nt, Homo Sapiens
gucaugugagugaagagaugucacugucuguggucuuggagaacuagucucguagcugaggggug

SEQ ID NO: 445550 - RNA, 65 nt, Homo Sapiens
gccaaccaccuugaaaccuuuagaacaucucugcuuuggagaaagacccagagaucaggcagagg

SEQ ID NO: 445551 - RNA, 65 nt, Homo Sapiens
aagauguuaaaacagucccguggaaggagcagggguuggagaaaggcaucccaaagcuucgaugg

SEQ ID NO: 445552 - RNA, 65 nt, Homo Sapiens
acucucagagacucccaggaguuguugaacuauauuuggagaaaacagccacugaauauuaucau

SEQ ID NO: 445553 - RNA, 65 nt, Homo Sapiens
uugggguaaaugcuuugaggcccagggaccaaucuuuggagaaaguagauauuuccaucaaagcc

SEQ ID NO: 445554 - RNA, 65 nt, Homo Sapiens
augcgaauacagcucacagagaaacgcaugugcuauuggagaacaggucuuuguggagaucuaaa

SEQ ID NO: 445555 - RNA, 65 nt, Homo Sapiens
auguaacauuuaaacauuaauuuaaaaagggaaccuuggagaauucuuuuguucacuaguuccuu

SEQ ID NO: 445556 - RNA, 65 nt, Homo Sapiens
acugcagcgccaagcggcauccaccaagcaucaaguuggagaaaagggaacccaagcaguagaga

SEQ ID NO: 445557 - RNA, 65 nt, Homo Sapiens
cucuagguuuccaggccucacagccaagcugaagcuuggagaaaacucugcauucccaugagggc

SEQ ID NO: 445558 - RNA, 65 nt, Homo Sapiens
gaggcugaggugggagaaucacuugaguccuggaguuggagaacagccuggaaagccuggcgaua

SEQ ID NO: 445559 - RNA, 65 nt, Homo Sapiens
cugagcaccuuggugagcaagccuggcuuuaaagauuggagaagagcuucuggcaccagaacccu

SEQ ID NO: 445560 - RNA, 65 nt, Homo Sapiens
uaccuuugcaguguugccgaaucacagcaguucuguuggagaaacgcuugguuuccggauccaga

SEQ ID NO: 445561 - RNA, 65 nt, Homo Sapiens
aaauuuccucccugccucaugugagaccacaggguuuggagaagcaguuggaacccacguguggu

SEQ ID NO: 445562 - RNA, 65 nt, Homo Sapiens
ggaaagccacuuacuggcuuuugacaugacuucucuuggagaauaaguggacuccaagcuaacuc

SEQ ID NO: 445563 - RNA, 65 nt, Homo Sapiens
agucagguguuccuuccuaaaaaaaaaagucuauuuuggagaauugaaauaauucauggaaggga

SEQ ID NO: 445564 - RNA, 65 nt, Homo Sapiens
ucucuucugguaauuuuuauaauugagaaaaugauuuggagaacuaaacaccuccugaguuuugc

SEQ ID NO: 445565 - RNA, 65 nt, Homo Sapiens
gggaggccucuuggagacacagaaccuccuucucuuuggagaaugcucuuccucuccaaagcgcc

SEQ ID NO: 445566 - RNA, 65 nt, Homo Sapiens
ccuccuuguugcaugaggucuaaggguuucucaaauuggagaaccugggacugguggugccaaga

SEQ ID NO: 445567 - RNA, 65 nt, Homo Sapiens
agaauuauccccacuucacaauguuuggccuuguguuggagaaaguccuguacaugaaccagguc

SEQ ID NO: 445568 - RNA, 65 nt, Homo Sapiens
gauggucaguuagccugucuaagaauguuuugguauuggagaaggaaccaaccccaacaacaaaa

SEQ ID NO: 445569 - RNA, 65 nt, Homo Sapiens
accgcaugaagauacuuguaccuuggugguugaacuuggagaaaggaccugccagcucucggagu

SEQ ID NO: 445570 - RNA, 65 nt, Homo Sapiens
caguuaucuuuagcagauauuaaaaauugaaaacuuuggagaacucauuucaaguuaugauucag

SEQ ID NO: 445571 - RNA, 65 nt, Homo Sapiens
gugccuucagcaggacucuuaauaucugcugcaacuuggagaaccucccugcccugaaaugugaa

SEQ ID NO: 445572 - RNA, 65 nt, Homo Sapiens
auuacaaacacgggcggaaggcacucaggcuuucguuggagaaacagaaauaaggccuucuuuug

SEQ ID NO: 445573 - RNA, 65 nt, Homo Sapiens
gauuucugaggagugugugaauucccuacagauuuuuggagaaaguguaggaagaaaaaggaugc

SEQ ID NO: 445574 - RNA, 65 nt, Homo Sapiens
caugaagagguauucaucuguagaacgacuucacguuggagaaaggaaacucauucuuacgaaau

SEQ ID NO: 445575 - RNA, 65 nt, Homo Sapiens
uguggcuggaacacaaacaacuuggguggguuccuuuggagaagagcagcaagccugcacacggg

SEQ ID NO: 445576 - RNA, 65 nt, Homo Sapiens
ucucgcugggaccuggucccuuuguugcaggcggcuuggagaaagggcagugggacgcuggccac

SEQ ID NO: 445577 - RNA, 65 nt, Homo Sapiens
ggccaguugcagguuaagccccagaaaaguucaccuuggagaagcuccgagaacacacagauugu

SEQ ID NO: 445578 - RNA, 65 nt, Homo Sapiens
aucaagaauauuuguggagguagguguggggaagguuggagaagaguuagguuugugcuuuguaa

SEQ ID NO: 445579 - RNA, 65 nt, Homo Sapiens
aauuggcucuuuggaggcgagaggaaggggagaacuuggagaauaguuuuugcuuuggggguaga

SEQ ID NO: 445580 - RNA, 65 nt, Homo Sapiens
ccuccccuacuucucccuugcucccaaagcuuuccuuggagaagggcccuccugcagcuggaccc

SEQ ID NO: 445581 - RNA, 65 nt, Homo Sapiens
gcugcuacuuaacaaggaagaggcuugugcuccccuuggagaagggcuggaggcugugugcgggc

SEQ ID NO: 445582 - RNA, 65 nt, Homo Sapiens
ggaaagcuccaucaaagagggaaauucggcaagacuuggagaaaaacaucaaugcuuuuccucag

SEQ ID NO: 445583 - RNA, 65 nt, Homo Sapiens
gccagcugcccuuucgucccgccuacagcugaagguuggagaaauaucuuuuccaaguucccaag

SEQ ID NO: 445584 - RNA, 65 nt, Homo Sapiens
aaggccgucuccccuuagccaaguccuccucaggcuuggagaacuuccucagcgucaccuccuuc

SEQ ID NO: 445585 - RNA, 65 nt, Homo Sapiens
agucgcgcaccgaaaaacuaaaaauaaugggcgcuuuggagaagaguguggagucauucucauug

SEQ ID NO: 445586 - RNA, 65 nt, Homo Sapiens
uuuuuuauuucagucacuccugauaaauaacaaauuuggagaaauaaaaauaucuaaaauaaauu

SEQ ID NO: 445587 - RNA, 65 nt, Homo Sapiens
gaaagggcacuuggcaaccacuaugugaagggugauuggagaaggacaagacuguggaaugggga

SEQ ID NO: 445588 - RNA, 65 nt, Homo Sapiens
caagacuguggaauggggaauaaggaaggaggaguuuggagaaugacuccaaagguuugagcuug

SEQ ID NO: 445589 - RNA, 65 nt, Homo Sapiens
cggugaggcacucuggaauaugacccuaccagagguuggagaacaaacuugggcagccggaaccc

SEQ ID NO: 445590 - RNA, 65 nt, Homo Sapiens
ccugaugaucaaccugccuccccuccauagucuuguuggagaagcccagagagaaugggacucca

SEQ ID NO: 445591 - RNA, 65 nt, Homo Sapiens
gagauggcgucuaccagaaggggauggacuucauuuuggagaagcucaaccauggggacugggug

SEQ ID NO: 445592 - RNA, 65 nt, Homo Sapiens
gaaaauuauuucuuggggauuaaucagauuuuaccuuggagaaauaacucaaugaaauaagcugc

SEQ ID NO: 445593 - RNA, 65 nt, Homo Sapiens
auggacugaucuuuaaacuaaaguuagggguuuuguuggagaaaagugcaauuuuuaaaaucuag

SEQ ID NO: 445594 - RNA, 65 nt, Homo Sapiens
uauuggacuuuguccucucuaaugaacugagcaauuuggagaaugcacaagacucucagguauag

SEQ ID NO: 445595 - RNA, 65 nt, Homo Sapiens
gcaaguuauauguucacaaaaagcagccaauuuuauuggagaaaaauugccuucuuugccuagcc

SEQ ID NO: 445596 - RNA, 65 nt, Homo Sapiens
ucaacaugucuccuacugagaauguuugcugaacauuggagaauccuugguuggaagggaauaga

SEQ ID NO: 445597 - RNA, 65 nt, Homo Sapiens
cuugcaguuaucuuagcauucuacugcucuaaaaguuggagaagugugugcaauauucuuaaaua

SEQ ID NO: 445598 - RNA, 65 nt, Homo Sapiens
cucacguuuuuuaacucaugauauagauugaguacuuggagaauaaugaaugagcaacaccaugc

SEQ ID NO: 445599 - RNA, 65 nt, Homo Sapiens
acauuucuuuacagguuaaacacugcucuaguuucuuggagaaucggagggauagaacaucacaa

SEQ ID NO: 445600 - RNA, 65 nt, Homo Sapiens
uuacaaccuggguugcagaaugcacagaugcugcuuuggagaacugauaaaacucagaggaaauu

SEQ ID NO: 445601 - RNA, 65 nt, Homo Sapiens
ggcuaggacagggaacagggagccugaguacaggcuuggagaaauucucuguugaucacagaggg

SEQ ID NO: 445602 - RNA, 65 nt, Homo Sapiens
uaagaacuuaacaauaaagcgcaauagguauuuucuuggagaaugcuuccaucuugcugugauuu

SEQ ID NO: 445603 - RNA, 65 nt, Homo Sapiens
cguuuuuaacugcaacuuucauuugucuuuuuauuuuggagaaagcuguauaugcuggguauuuc

SEQ ID NO: 445604 - RNA, 65 nt, Homo Sapiens
uucauauaauuaaaaagaauuugguuaauaagaauuuggagaauggaaaauacauuuuuagguuc

SEQ ID NO: 445605 - RNA, 66 nt, Homo Sapiens
augccuaugggugacugccuucucccagaguuuucuuuggagaacagaaagaagaaaggaaagaaa

SEQ ID NO: 445606 - RNA, 66 nt, Homo Sapiens
auaguuucugaaaccgcucagauguuuuggggaaaguuggagaagccguggccuugcgagaggugg

SEQ ID NO: 445607 - RNA, 66 nt, Homo Sapiens
agggacccgggcaggcccccagcaccccaugcugacuuggagaaccccagaucucuggggcccagc

SEQ ID NO: 445608 - RNA, 66 nt, Homo Sapiens
ucgcagacaccggggcuggguuucucuuuccucuuuuuggagaaaaggaacagggcaguggaauga

SEQ ID NO: 445609 - RNA, 66 nt, Homo Sapiens
uuaaacccuuuccuccucccauuuugacauuugcacuuggagaacacuugaguugugaagguuuug

SEQ ID NO: 445610 - RNA, 66 nt, Homo Sapiens
aucuggaggggagagaaggauucuagggguguggaguuggagaaagaggcuuccuugagccacccu

SEQ ID NO: 445611 - RNA, 66 nt, Homo Sapiens
cuacauuaggaaacaauggcagucaaacccauggcuuuggagaaaguaaauguuugccagaaagga

SEQ ID NO: 445612 - RNA, 66 nt, Homo Sapiens
gggugcuggugcggauggacacuaaugcagccacgauuggagaauacuuugcuucauaguauugga

SEQ ID NO: 445613 - RNA, 66 nt, Homo Sapiens
uuaucagagcaaacaucauguagauagcacaaguauuuggagaaacguuguuuguuuuguuaccaa

SEQ ID NO: 445614 - RNA, 66 nt, Homo Sapiens
uaauaauuuaaaauaauuauuguauaauaucuacauuuggagaauuuugaacuaucaagcauauac

SEQ ID NO: 445615 - RNA, 66 nt, Homo Sapiens
uaagacgguaaaggcacuaaagucacuuuaaagcuuuuggagaagcaggagggcauuggcuuaacc

SEQ ID NO: 445616 - RNA, 66 nt, Homo Sapiens
ccaaaucugaaggacuucaucucccgcuuugagggcuuggagaagaucucugccuacaugaagucc

SEQ ID NO: 445617 - RNA, 66 nt, Homo Sapiens
guaccuggcauggacugauguuuuuaggcacagaaguuggagaagagauuucaugaaagacaacau

SEQ ID NO: 445618 - RNA, 66 nt, Homo Sapiens
uucuguguuuucagaauuuccauuucuacuaaccucuuggagaaaaagaaauugaauuagagguaa

SEQ ID NO: 445619 - RNA, 66 nt, Homo Sapiens
agcccuaaaagcuggagacacagauguccagagugauuggagaauguccugggggaaugaaguucc

SEQ ID NO: 445620 - RNA, 66 nt, Homo Sapiens
cuuucccugaggcuuuggggucagaguauauguuguuuggagaaagagggcaaucaggacucuucu

SEQ ID NO: 445621 - RNA, 66 nt, Homo Sapiens
uuuucuggccuggcuuucccucucagacauagcucuuuggagaacuagguguuguaauucaguuau

SEQ ID NO: 445622 - RNA, 66 nt, Homo Sapiens
uacauugucaaaacuaccaauuccagguuaacuuuguuggagaauuucccccacccccauccagug

SEQ ID NO: 445623 - RNA, 66 nt, Homo Sapiens
ccugcugguuccccagcccuuuucccuggcccuggcuuggagaaucuguuuucaaucuccacugau

SEQ ID NO: 445624 - RNA, 66 nt, Homo Sapiens
gacuuggaggcaggauccaggcacagcuccccucacuuggagaaccuugacucucuugauggaaca

SEQ ID NO: 445625 - RNA, 66 nt, Homo Sapiens
uaauaaaacacugucuuuucaggauugcuucauggauuggagaacuuucuaaccaaaaauuaaaaa

SEQ ID NO: 445626 - RNA, 66 nt, Homo Sapiens
uuagacuuaguaccagaaccaaaaauaccuagauuuuuggagaacuuauuacauacauagaaacau

SEQ ID NO: 445627 - RNA, 66 nt, Homo Sapiens
uagaacccagccuacucuagaauuucagcagugacauuggagaauauuuuuaauuugcugcaguac

SEQ ID NO: 445628 - RNA, 55 nt, Homo Sapiens; identical to SEQ ID NO: 445050

SEQ ID NO: 445629 - RNA, 66 nt, Homo Sapiens
agggcaaggagagaagugagagcuacaauuccagcauuggagaagcgaggggcggggcgucaacgg

SEQ ID NO: 445630 - RNA, 66 nt, Homo Sapiens
ccaggggcuaguuuggcuuuuccaaguggguuuucuuuggagaaucugaugccaugcaauuggcau

SEQ ID NO: 445631 - RNA, 66 nt, Homo Sapiens
uuugucguagacuugugcaauauauacuguuguggguuggagaaaaguggaaagcuacacugggaa

SEQ ID NO: 445632 - RNA, 66 nt, Homo Sapiens
gcugguaggcaaauuguuaggcagaauaaugguauguuggagaaauacaccugucucuuauucuua

SEQ ID NO: 445633 - RNA, 66 nt, Homo Sapiens
guaccuuugguaaauacaccauaccauaauaucugcuuggagaaccacaaugcacauuagcauauu

SEQ ID NO: 445634 - RNA, 66 nt, Homo Sapiens
uuaauuaacuagcauuuagccagcuuuuucuugcccuuggagaaaaagaaucauucucaaccugau

SEQ ID NO: 445635 - RNA, 66 nt, Homo Sapiens
uucugcagcauggcuuuuuauaggaaaucuucauaauuggagaaagucuuuuauuuuaauacauug

SEQ ID NO: 445636 - RNA, 66 nt, Homo Sapiens
aaauuaacaauaaagaauuuacuaaaaauauaucuguuggagaaagugcuguggcuccauauuuca

SEQ ID NO: 445637 - RNA, 66 nt, Homo Sapiens
augcugagaauuuguauugauaaugggggagccuaauuggagaaugggucauuagaaacaauuggu

SEQ ID NO: 445638 - RNA, 66 nt, Homo Sapiens
guucuguugcccugauuuauuggucuucuggucuccuuggagaaagugccaaggcggcggcagagc

SEQ ID NO: 445639 - RNA, 66 nt, Homo Sapiens
cuucauaaaaucuaugaauaccuuggaggauauauuuuggagaaugcuauaaaacagacuuacucu

SEQ ID NO: 445640 - RNA, 66 nt, Homo Sapiens
cccuaucagcacagggaucuccaggcugucuggaaguuggagaauucauguacgcaaagggcagcc

SEQ ID NO: 445641 - RNA, 66 nt, Homo Sapiens
agaaaaaucuuggggcuuccgcauggacauuuuacuuuggagaaacucuaggaaagacauguaaga

SEQ ID NO: 445642 - RNA, 66 nt, Homo Sapiens
gaugagcuacgccuugaugaucuguagcaugucaguuuggagaaauaacgcuuuuuggaagacauu

SEQ ID NO: 445643 - RNA, 66 nt, Homo Sapiens
gcaggagaguaccugggaauuuuauuuacuuccuuguuggagaaggguuccugaguuaaaagucua

SEQ ID NO: 445644 - RNA, 66 nt, Homo Sapiens
ucaaaccuucaagcccuaggcuuucccuuguuacuguuggagaaaccggcuccagguggaagcaug

SEQ ID NO: 445645 - RNA, 66 nt, Homo Sapiens
agaaagaaaggaaagaacucaaagauaucuguaucuuuggagaagguauuccauagaaaacuguag

SEQ ID NO: 445646 - RNA, 66 nt, Homo Sapiens
cuugccuauaauucuauaaacuuaaguuaaguuuuauuggagaaauaguuauaguuuuauaacugg

SEQ ID NO: 445647 - RNA, 66 nt, Homo Sapiens
gucauaaauuacuguuuugcagaacuaugcuaauuuuuggagaaauuucuuuuuacuguugaacuu

SEQ ID NO: 445648 - RNA, 66 nt, Homo Sapiens
ggucagaagccccaaacggcaaauaagaaaacugucuuggagaauguucaucccauccuugccaaa

SEQ ID NO: 445649 - RNA, 66 nt, Homo Sapiens
ggaaugugaaagcugucauuuuuggauccuuuggguuuggagaaaguuuuucuuggacuacuuuaa

SEQ ID NO: 445650 - RNA, 66 nt, Homo Sapiens
agauggaugcuuauugaagcguuuacucucuucuauuuggagaauaaauacaagccuuggguccau

SEQ ID NO: 445651 - RNA, 66 nt, Homo Sapiens
ucaggcuuuugauaaaugcugucuuaagagaccgcauuggagaauuuaaaaaaugccuuuucauug

SEQ ID NO: 445652 - RNA, 66 nt, Homo Sapiens
agugcuuuaguaguaguuuaggauuucucaggucauuuggagaacagucccagagcugaggcaagg

SEQ ID NO: 445653 - RNA, 66 nt, Homo Sapiens
uuuaaaaaacccagaaaaacaaaaaguuuuaauguauuggagaagugaagugcuauguggcgagaa

SEQ ID NO: 445654 - RNA, 66 nt, Homo Sapiens
cauaacauuugaagaucaaaguucccuguuaccuuuuuggagaauugugagaccaaagggauaucu

SEQ ID NO: 445655 - RNA, 66 nt, Homo Sapiens
ugacagggcugguccaggccgucucaaugcacgaaguuggagaacccguaggcacggacacaccca

SEQ ID NO: 445656 - RNA, 66 nt, Homo Sapiens
gcacccauaucugugugcccgaaguggagugacuauuuggagaauaccaggaaggcggcaggcaga

SEQ ID NO: 445657 - RNA, 66 nt, Homo Sapiens
ggaaaucauaaaaucauccuuaagcaaacaucacauuuggagaagagauacacucuaucacauauu

SEQ ID NO: 445658 - RNA, 66 nt, Homo Sapiens
agccauuauuuuagccacagacuauaucccuucuuuuuggagaacuucauguauauauuacucugc

SEQ ID NO: 445659 - RNA, 66 nt, Homo Sapiens
cugaacuguuacaaaccccucucuccccaugggaccuuggagaaaaucucuuccuguucugcaccc

SEQ ID NO: 445660 - RNA, 66 nt, Homo Sapiens
aguagucguaagauuaguuguucuucauuaggggacuuggagaaccaugaucaugagguuaaaauu

SEQ ID NO: 445661 - RNA, 66 nt, Homo Sapiens
guguaccagcagugugucaggugcugcagagcguucuuggagaaggcccacugaggcagguucgug

SEQ ID NO: 445662 - RNA, 66 nt, Homo Sapiens
uauaccuggcauagagaaaaauauauaccugguacauuggagaaaaauaauuacacuuucaaagag

SEQ ID NO: 445663 - RNA, 66 nt, Homo Sapiens
augguuguaaguggacaugcaaaccaaaauuggggauuggagaagucagacucacuagacuuuugg

SEQ ID NO: 445664 - RNA, 66 nt, Homo Sapiens
guaaauuccugucaaaaucaauucagaaauucuaacuuggagaauuuaacauuuuacucuuguaaa

SEQ ID NO: 445665 - RNA, 66 nt, Homo Sapiens
uucaucuugcaagcaaaucccauuucuugaaaagccuuggagaacucgguuugguagacuuggaca

SEQ ID NO: 445666 - RNA, 66 nt, Homo Sapiens
aggcagugauuuuguuccaaaacuuuguauacacauuuggagaaaaguacuuuauauuuucagugu

SEQ ID NO: 445667 - RNA, 66 nt, Homo Sapiens
cccugcaagaaauauacugacaugaacaggcaguucuuggagaagaaagagcauuucuuuaaguac

SEQ ID NO: 445668 - RNA, 66 nt, Homo Sapiens
ugcacuccagccugggcaacagagcaagacccugucuuggagaaaccagaauuuuggaagagcaaa

SEQ ID NO: 445669 - RNA, 66 nt, Homo Sapiens
ugugaguggcucuuugcaugaacacugugcaagguguuggagaaauccaaagcugaccaaaacaug

SEQ ID NO: 445670 - RNA, 66 nt, Homo Sapiens
gcuggccuucacgcucuugaucgucuuuccuuuguauuggagaaggacugggucagagaucuguug

SEQ ID NO: 445671 - RNA, 66 nt, Homo Sapiens
caguguuuuuuacucuuuucucaugcacauguuacguuggagaaaauguuuacaaaaaugguuuug

SEQ ID NO: 445672 - RNA, 66 nt, Homo Sapiens
gagacugacaccucacugaggaagggagacauauucuuggagaacuuuccaucugcuuguauuuuc

SEQ ID NO: 445673 - RNA, 66 nt, Homo Sapiens
gagauaucaaguuuugaauauuauucaggaagcacuuuggagaaugugggaguccuacuguuuugc

SEQ ID NO: 445674 - RNA, 66 nt, Homo Sapiens
gugggugagaagcaggcuggugagacugggcugagguuggagaaggggcagccgggggcacugcug

SEQ ID NO: 445675 - RNA, 66 nt, Homo Sapiens
gcucacuuuauucuuguauggcuuugguaggcauacuuggagaacauaucccacauuaggaauuga

SEQ ID NO: 445676 - RNA, 66 nt, Homo Sapiens
aagccugagaguuugagggcuuuaauccuuuaaaacuuggagaagcuggcugggcgcgguggcuca

SEQ ID NO: 445677 - RNA, 66 nt, Homo Sapiens
agcauuuauuugaugacuuaauauuuuucacuaccuuuggagaacagaugaacauuauucaccaug

SEQ ID NO: 445678 - RNA, 66 nt, Homo Sapiens
uguucaauuagcaguucaaauuaaagaagaugguuauuggagaacuuuuuugaaugguuuuguauu

SEQ ID NO: 445679 - RNA, 66 nt, Homo Sapiens
uaaugcaucuuuuuuccucugccauucuuguguugauuggagaauuuuucuguauguaauuagaaa

SEQ ID NO: 445680 - RNA, 66 nt, Homo Sapiens
uguuucuggauuucauacuguaacauucaggaauucuuggagaaaauggguuuauucacugaacuc

SEQ ID NO: 445681 - RNA, 66 nt, Homo Sapiens
aggcucggaaagccuuaagcaaagaugggaggauuuuuggagaauccaucaugauugguguaaaac

SEQ ID NO: 445682 - RNA, 66 nt, Homo Sapiens
aguccucucaaaacaaacacccucuugcaaccagcuuuggagaaagcccagcuccugugugcucac

SEQ ID NO: 445683 - RNA, 66 nt, Homo Sapiens
ucuggcuggcccuguaauuuaaauuaaaauaaaauuuuggagaaacagcauugucugucuuuauga

SEQ ID NO: 445684 - RNA, 66 nt, Homo Sapiens
cugagggacacaaggacuugggugcaucaggacgccuuggagaagcguggcuuccugccacccugc

SEQ ID NO: 445685 - RNA, 66 nt, Homo Sapiens
ugugcagagagaggcaggaaggaucccugaagagucuuggagaaaagguucugugcccucaggugg

SEQ ID NO: 445686 - RNA, 66 nt, Homo Sapiens
aguaucugaaucacuggggauuaugauucacccucuuuggagaacaugcucucuuuucacccccca

SEQ ID NO: 445687 - RNA, 66 nt, Homo Sapiens
uugcuuauauuuaucgcuuggcucaaguucugcccuuuggagaaauacugagcaagucuuucauuc

SEQ ID NO: 445688 - RNA, 66 nt, Homo Sapiens
augugagauuuccacauuauuugaacaucuuugagauuggagaauuaugguuaaguauauaauaaa

SEQ ID NO: 445689 - RNA, 66 nt, Homo Sapiens
ccgugugagaagugaaugcucugggccgcugccacguuggagaagcgcucagggccaugcugaggc

SEQ ID NO: 445690 - RNA, 66 nt, Homo Sapiens
ucacaacccuucucuguugggugaggccugggcugguuggagaaggugggucugcgaugcagcggc

SEQ ID NO: 445691 - RNA, 66 nt, Homo Sapiens
uucuguuugucucuuuucauugugaggacuaccauuuuggagaaggcucuugcacuacaccucugu

SEQ ID NO: 445692 - RNA, 66 nt, Homo Sapiens
gucuauccagguccuuugccggccaugcguauuucuuuggagaaagugucuuuuccugugcuuacg

SEQ ID NO: 445693 - RNA, 66 nt, Homo Sapiens
cagcccagcuuggcguggggacaguugagaauuccuuuggagaaaagcacagaaauucuguugaag

SEQ ID NO: 445694 - RNA, 66 nt, Homo Sapiens
gcacaaucaacuuuucugagaucaccaaguguggaauuggagaaaaugugacgcuacuaaccugac

SEQ ID NO: 445695 - RNA, 66 nt, Homo Sapiens
aagugaauuuacuucgacuuuauauucaguggcauuuuggagaacaaauagaauuuuuaaauagua

SEQ ID NO: 445696 - RNA, 66 nt, Homo Sapiens
auguaauuuugucuuuggaaugucaaaauaacauacuuggagaagugguguuuguuuuuaucaaaa

SEQ ID NO: 445697 - RNA, 66 nt, Homo Sapiens
ugcauuaucuuaaaaggcagcaauucuguagcauacuuggagaaacuuuuucuagagguuggcuuu

SEQ ID NO: 445698 - RNA, 66 nt, Homo Sapiens
ugaagaaaaaggcuggcugaacuucagagaagucaguuggagaaaaggcaguguuccucaccaaua

SEQ ID NO: 445699 - RNA, 66 nt, Homo Sapiens
ugugccuuucauucauuaccugcagcgguccucaaguuggagaaaagcugguaccgucuaguacua

SEQ ID NO: 445700 - RNA, 66 nt, Homo Sapiens
aaugaaggugucaaagagucuuaauagcacagcaguuuggagaagacagaauaugccugcucaaaa

SEQ ID NO: 445701 - RNA, 66 nt, Homo Sapiens
uacauucugaagcauccccauucaggcuccaucuguuuggagaaaaguuuggaaaaucacacaguu

SEQ ID NO: 445702 - RNA, 66 nt, Homo Sapiens
agauggaaauggauuggauugucaaauuauuauuuauuggagaaaaaaaccugaucuacacauuuu

SEQ ID NO: 445703 - RNA, 66 nt, Homo Sapiens
gaaacuuaggaaauagugaauaaggugcauuuaacuuuggagaaauacuuuuauggcuuuggugga

SEQ ID NO: 445704 - RNA, 66 nt, Homo Sapiens
ggugguuuuugaacaggaaaaucauaauucauaucauuggagaaguauuuauuuucaaauaucaaa

SEQ ID NO: 445705 - RNA, 66 nt, Homo Sapiens
agaggagucagagagaaucccuagucuucaagcagauuggagaaacccuugaaaagacaucaagca

SEQ ID NO: 445706 - RNA, 66 nt, Homo Sapiens
acuaaaugaaaaggacacauucugaaaucccuuuuguuggagaauaagucagucugaggggaaaug

SEQ ID NO: 445707 - RNA, 66 nt, Homo Sapiens
agaaauaaguccuagacuggacucuugagggacauauuggagaaucuuaagaaaugcaagcuuguu

SEQ ID NO: 445708 - RNA, 66 nt, Homo Sapiens
uuucccaggaaauuagcuuuccagccccuuuauauauuggagaaguuguuuuagcuucugcagaag

SEQ ID NO: 445709 - RNA, 66 nt, Homo Sapiens
uuacauuguucuugguuuuguuucucgaucuuuuguuuggagaacagcuggcuaaggaugacucua

SEQ ID NO: 445710 - RNA, 66 nt, Homo Sapiens
uguucauuuguuccuuggaccuuaaucauuugcauuuuggagaaaauuuuuucugcuuuaaaaguc

SEQ ID NO: 445711 - RNA, 66 nt, Homo Sapiens
aagaguuuaggaauucuacuagccagagauagucacuuggagaaacuuucuauauauccuucuaaa

SEQ ID NO: 445712 - RNA, 66 nt, Homo Sapiens
aaaaucuugaugucauuacuccugaauuauuacauuuuggagaauaagagggcauuuuauuuuauu

SEQ ID NO: 445713 - RNA, 66 nt, Homo Sapiens
uguuuugauccaagucaaguguagccucucagccuuuuggagaaaaaugaaacaauuuauuucaac

SEQ ID NO: 445714 - RNA, 66 nt, Homo Sapiens
ggugggcagagcccugacccacagcuguguuacugcuuggagaagcauauguaggggcauacccug

SEQ ID NO: 445715 - RNA, 66 nt, Homo Sapiens
ucuauuuaaaguugccugaagauuuugcugugguguuuggagaagcagagggugaacuugcuguug

SEQ ID NO: 445716 - RNA, 66 nt, Homo Sapiens
gagauuugcucagcuuuuugaaauguuaagauguguuuggagaaggcugcaugacuuuguuuuucc

SEQ ID NO: 445717 - RNA, 66 nt, Homo Sapiens
accuaggcagcagccaccuucucaggaaacaaggccuuggagaaaucagugccugugugaagaugg

SEQ ID NO: 445718 - RNA, 66 nt, Homo Sapiens
cagcuggaccuuccauucuagaauuaugagaccaccuuggagaaaggugugugguacaugacauug

SEQ ID NO: 445719 - RNA, 66 nt, Homo Sapiens
cuuucucuguuugccuuggguugaauaacuuaucuuuuggagaauagcuuuaaguggcuuagacac

SEQ ID NO: 445720 - RNA, 66 nt, Homo Sapiens
gacaaguuggaugacacuacucccaacuuuuuaaauuuggagaaaaccaucaaggucgaggaagcc

SEQ ID NO: 445721 - RNA, 66 nt, Homo Sapiens
gaagaaauugcuagauuacccaaagaaauagaucaguuggagaaaauacaaaacaauucaaagcuc

SEQ ID NO: 445722 - RNA, 66 nt, Homo Sapiens
aaguauuuaaaagaaauaccagugagugccuuaaaguuggagaaguaacugcccaugcccagaaau

SEQ ID NO: 445723 - RNA, 66 nt, Homo Sapiens
caugaauaaaaaauaauuuugcuguuguaguauacauuggagaaacuggcagguuuuauuuccauu

SEQ ID NO: 445724 - RNA, 66 nt, Homo Sapiens
uccaagccaggaagaugggcauaugaucaugccagauuggagaagaugucugaggguguacguuug

SEQ ID NO: 445725 - RNA, 66 nt, Homo Sapiens
gaaaugaaaagccacgucauaaaaacuccacaggguuuggagaauaaggcaaagacacgggaacug

SEQ ID NO: 445726 - RNA, 66 nt, Homo Sapiens
uagacacaaucucuuauuuuugucacaucacaugauuuggagaaauuacaagacuuugggcucuua

SEQ ID NO: 445727 - RNA, 66 nt, Homo Sapiens
caugacggauaguuuaggauauucauguggagauuuuuggagaaacuuucaauuguccuucagaua

SEQ ID NO: 445728 - RNA, 66 nt, Homo Sapiens
acuuuuucauacuuuugugaccacagauggaacgguuuggagaagcaccuguacaguauuugcauu

SEQ ID NO: 445729 - RNA, 57 nt, Homo Sapiens; identical to SEQ ID NO: 445151

SEQ ID NO: 445730 - RNA, 66 nt, Homo Sapiens
cacagcagcacgccuuaaucucccuguccaagugccuuggagaacuuguucagucugaaaugcagc

SEQ ID NO: 445731 - RNA, 66 nt, Homo Sapiens
aucuggagaugagauugaugcccugguggaagaagcuuggagaagacccugaagcacauacaagca

SEQ ID NO: 445732 - RNA, 66 nt, Homo Sapiens
gagauggcaagagggcaggccugggcauuugaggaauuggagaaugaugccugggcuguggaccua

SEQ ID NO: 445733 - RNA, 66 nt, Homo Sapiens
caccugcacagcagagcucaaaggcugucaacagucuuggagaagcacgaugccaaguacaccugc

SEQ ID NO: 445734 - RNA, 66 nt, Homo Sapiens
ccuuagcacaauuuucuaaaaaaaaaaaaucagaaauuggagaaauggcuugccaaaaaaaaaaaa

SEQ ID NO: 445735 - RNA, 66 nt, Homo Sapiens
acaaggacaacuuuauguagcugcauggacaguuguuuggagaacacgcugcccaggugggguuuc

SEQ ID NO: 445736 - RNA, 66 nt, Homo Sapiens
cacagccucaccuucucacuauuaaggguguuagucuuggagaagaacuugaauuuuuuggggacu

SEQ ID NO: 445737 - RNA, 66 nt, Homo Sapiens
aaggagcaaaaacaaauuuuuuggcagaagcugaaauuggagaaccacuuauuucuuaacugcuau

SEQ ID NO: 445738 - RNA, 66 nt, Homo Sapiens
ucugcacuuucuuauauauacugaugccaagauuuuuuggagaacaccucuuugugacacuucauc

SEQ ID NO: 445739 - RNA, 66 nt, Homo Sapiens
augcauuugggucacuaauucugaacaccuuucauauuggagaaucuaaaugauuguaugcuuaug

SEQ ID NO: 445740 - RNA, 66 nt, Homo Sapiens
gaacucacaaacugauguuacuuuaaaggaaaggauuuggagaauuaagaugaaauaaacuuauua

SEQ ID NO: 445741 - RNA, 66 nt, Homo Sapiens
uagcaguaccaagggaucucuaaucacuugggagcuuuggagaaaacguacuucggcugcaugaga

SEQ ID NO: 445742 - RNA, 66 nt, Homo Sapiens
aacaacaaaagccaauuagagagcugggagucaguguuggagaagacccacgcccaucuggagugg

SEQ ID NO: 445743 - RNA, 66 nt, Homo Sapiens
aaucucuaauuccagugucuuuacacagcaaauaaauuggagaauauugcucccauauaaacuugu

SEQ ID NO: 445744 - RNA, 66 nt, Homo Sapiens
uguuuucaguuucuuuccuucugugaacgaugagacuuggagaacgggcugguccuucaccacuuc

SEQ ID NO: 445745 - RNA, 66 nt, Homo Sapiens
ugugaggugccgagcugggugcuugacaucauuugcuuggagaagcagcugcuaguagacccauuu

SEQ ID NO: 445746 - RNA, 66 nt, Homo Sapiens
auacaucaauauguauauauguauuucuauauagacuuggagaauacugccaaaacauuuaugaca

SEQ ID NO: 445747 - RNA, 66 nt, Homo Sapiens
uuuuuggguguggaggccauuuuuagagauacagaauuggagaagacuugcaaaacagcuagauuu

SEQ ID NO: 445748 - RNA, 66 nt, Homo Sapiens
gugugucauguugguuuuugguacuuguauugucauuuggagaaacaauaaaagauuucuaaacca

SEQ ID NO: 445749 - RNA, 66 nt, Homo Sapiens
aucuaucugggaacacugagaagggugaccaaugcguuggagaacgagggagggcuucauagcaga

SEQ ID NO: 445750 - RNA, 66 nt, Homo Sapiens
gcaaaagagcaugcagugcuguugaauaacccucacuuggagaaccaagagaauccugucguuuaa

SEQ ID NO: 445751 - RNA, 66 nt, Homo Sapiens
uugccccugaauguggucgaugccaaaggaagauccuuggagaagucaucagugcguugaaacaaa

SEQ ID NO: 445752 - RNA, 66 nt, Homo Sapiens
guuugcagagugugugcuuggcuguggcagccuagcuuggagaagcugcuguuggugcaagggaga

SEQ ID NO: 445753 - RNA, 66 nt, Homo Sapiens
uggaugccuaaggcauaaaguucugugcaauauuucuuggagaauuucccagcuuucuugcuugcc

SEQ ID NO: 445754 - RNA, 66 nt, Homo Sapiens
gaaaaacacucuauaacagagacaacuuuuuuaacuuuggagaaaauauuuucugugccuucaagg

SEQ ID NO: 445755 - RNA, 66 nt, Homo Sapiens
uuuucugauuauuguuaaacacuucaggaaauucuuuuggagaauaagcuuuauaccuagcaagcc

SEQ ID NO: 445756 - RNA, 66 nt, Homo Sapiens
uugccuuuuuucuuggcuccagugcaauuugugcaauuggagaaucuuaaugcugggaacacaaau

SEQ ID NO: 445757 - RNA, 66 nt, Homo Sapiens
aaggacugagaaaugaccauauuuauaaaucuagacuuggagaauucaacaggauucacauuguua

SEQ ID NO: 445758 - RNA, 59 nt, Homo Sapiens; identical to SEQ ID NO: 445180

SEQ ID NO: 445759 - RNA, 66 nt, Homo Sapiens
gauucaaaauaguguagauugcugauuuucuggccuuuggagaaguauagcaacugcagcuaacag

SEQ ID NO: 445760 - RNA, 66 nt, Homo Sapiens
cuguucagucacagauauauuggaaauauuggauucuuggagaaaagaaaguauaugaaaauauac

SEQ ID NO: 445761 - RNA, 66 nt, Homo Sapiens
agauaaugaauuaagcaacuacacauuuacucaauauuggagaagucuacaugugugccccuaaag

SEQ ID NO: 445762 - RNA, 66 nt, Homo Sapiens
auuuaaacaccucaauguagaauucaaugaaaacuguuggagaaaugccuaguguuuucauaaugu

SEQ ID NO: 445763 - RNA, 66 nt, Homo Sapiens
auuacagaucauauaagcaauuauacauaaacaguuuuggagaaaaguagguuuuaaaaauaaguu

SEQ ID NO: 445764 - RNA, 66 nt, Homo Sapiens
uauauuuuaaagaacaagacugagccucagaaucauuuggagaaacauguaucuuguaaucaugau

SEQ ID NO: 445765 - RNA, 66 nt, Homo Sapiens
cauagaacaaggugaaagacaauaaaucacuaaggauuggagaacucaccaaucaaucaaaaaaua

SEQ ID NO: 445766 - RNA, 66 nt, Homo Sapiens
gaaagacauaaacuuggaguccgucugguuuaauuauuggagaaucgauucccaaguccaggaaga

SEQ ID NO: 445767 - RNA, 66 nt, Homo Sapiens
uuuuuaguauuuugucuuuguaauuuacagaaguuauuggagaaaauaaacuuguuucauuuugca

SEQ ID NO: 445768 - RNA, 66 nt, Homo Sapiens
gcacccagggaaugggggucuaugagacaaccccacuuggagaagaaugggguuagggucucuaau

SEQ ID NO: 445769 - RNA, 66 nt, Homo Sapiens
gggugcuuuuuauacaacuuuccaucccccacacaguuggagaauaauuuguagaccauggcaguu

SEQ ID NO: 445770 - RNA, 66 nt, Homo Sapiens
caguauacauggugauguacaucuguagcaaagcucuuggagaaaaugaagacugaagaaagcaaa

SEQ ID NO: 445771 - RNA, 66 nt, Homo Sapiens
gcaugaggaacauucauucuguauuuuuuuucccuguuggagaaagugggaaauuauaaugucgaa

SEQ ID NO: 445772 - RNA, 66 nt, Homo Sapiens
uuuauucugucuaucaaauaguacuucuaccacuguuuggagaaaauugaagaaaagaauaagaug

SEQ ID NO: 445773 - RNA, 66 nt, Homo Sapiens
uaguugaauaugauuuggucaguugcucguuguaacuuggagaaauuccuauaaaguaagaucucc

SEQ ID NO: 445774 - RNA, 66 nt, Homo Sapiens
cuuaauuccuucugcuauaugucacacaguuguuauuuggagaaccaaguauguauugcaugaaaa

SEQ ID NO: 445775 - RNA, 66 nt, Homo Sapiens
ugaaugccuuauuuuugaauucuuuagauuuuuaaauuggagaaaagcacuuaaaguuuuuuauau

SEQ ID NO: 445776 - RNA, 66 nt, Homo Sapiens
ugugugagcauuugcaauguaagggccucagcuuccuuggagaagccaccccagguuuccagacau

SEQ ID NO: 445777 - RNA, 66 nt, Homo Sapiens
uugcaucucccugauugguauugcuguagaacauauuuggagaaguuuguuugucuuugguguuua

SEQ ID NO: 445778 - RNA, 66 nt, Homo Sapiens
uuuggaguuugaacccguuuugguugcauuucauuuuuggagaacuuaauuaacgugagauuggca

SEQ ID NO: 445779 - RNA, 66 nt, Homo Sapiens
cacuuagaacauuuuuugaaauucaguuuacagaaauuggagaaaaugcuuuuuaaacaaguguuu

SEQ ID NO: 445780 - RNA, 66 nt, Homo Sapiens
gugaugggucuugcugggugcuguguggggcgcauauuggagaaggguaaugccagaagccaggaa

SEQ ID NO: 445781 - RNA, 66 nt, Homo Sapiens
acccuuggaaccccaaggccaaguugguucaaacuguuggagaacagaguuggccugcaucuggaa

SEQ ID NO: 445782 - RNA, 66 nt, Homo Sapiens
aguacuauuuuuauaaagcaagaacuauuccaugccuuggagaaugaaucauuuuuagauugugac

SEQ ID NO: 445783 - RNA, 66 nt, Homo Sapiens
ucuuuuggaggugaaaucuaauuauuggugagagucuuggagaacaggcuguuuccagucucaaag

SEQ ID NO: 445784 - RNA, 66 nt, Homo Sapiens
cguaaagauucauuuuucaagucacugauuuuauaauuggagaauggcagccuuugguagcuaaca

SEQ ID NO: 445785 - RNA, 66 nt, Homo Sapiens
uagcacuugccuugaaaagaauaucucuuuucaggguuggagaaaucuuuuguuuuauuggaaugc

SEQ ID NO: 445786 - RNA, 66 nt, Homo Sapiens
gugguuagcacauucaucagcuaggauggauguauauuggagaaggcugugagacuuuauuguccu

SEQ ID NO: 445787 - RNA, 66 nt, Homo Sapiens
uacuccagcaaaaugaaggacuuuuuagggaagcuguuggagaaaaagggguuaccuccaugugcc

SEQ ID NO: 445788 - RNA, 66 nt, Homo Sapiens
cauaugaaaagcauaguuggaggucacaggacccaauuggagaaauauguucaacaauucugugaa

SEQ ID NO: 445789 - RNA, 66 nt, Homo Sapiens
caaagaaaauuaaaguuuucguuccagcagcuguuuuuggagaagaaacaucccuuaauuugaggu

SEQ ID NO: 445790 - RNA, 66 nt, Homo Sapiens
gaauguuugucuggagcagaccuaucaggcugauuuuuggagaaauuguauguuccuuuguauguu

SEQ ID NO: 445791 - RNA, 66 nt, Homo Sapiens
acaagguacccagaauuuuuuacuucaacaagaugcuuggagaacauucugauguuaagcacaugu

SEQ ID NO: 445792 - RNA, 66 nt, Homo Sapiens
auuaaauugcugcauuucgcuuguuucuuauuuugauuggagaaaaagaagugagaucauacuggu

SEQ ID NO: 445793 - RNA, 66 nt, Homo Sapiens
ggaagaauaacacuguugcugcacaaugaaggagacuuggagaagaugccagcugguaguccauca

SEQ ID NO: 445794 - RNA, 66 nt, Homo Sapiens
uauuuaauaaaaaaacaaucuguuauuuucaguauuuuggagaaauaaugcuuuuugaauguuauu

SEQ ID NO: 445795 - RNA, 66 nt, Homo Sapiens
agggcucuucucaggggcucucuccuccucugucuuuuggagaaccucagcgcauccugcagggcu

SEQ ID NO: 445796 - RNA, 66 nt, Homo Sapiens
ucuucacagccccgacaucagcuggacauuggaaccuuggagaaugaacuuaaacccugugccuca

SEQ ID NO: 445797 - RNA, 66 nt, Homo Sapiens
agccagggccgugccuggagcacugcagagaugacuuuggagaaagcaaagcagugacccagugac

SEQ ID NO: 445798 - RNA, 66 nt, Homo Sapiens
uguagaagaaagauacaagugaaaauuaggaguggauuggagaaauuggggggaaauagaagagua

SEQ ID NO: 445799 - RNA, 66 nt, Homo Sapiens
aaaggcuuuuuaacccauuuuugaagagggugaaguuuggagaacaaauuuaaaaaccaucaguca

SEQ ID NO: 445800 - RNA, 66 nt, Homo Sapiens
cuuaaaucucagaauuacuaagcauguggcauaaauuuggagaaaauaauaugacuagaaaaauua

SEQ ID NO: 445801 - RNA, 66 nt, Homo Sapiens
gucuucguguccaccuggguccaguccugaaucaucuuggagaaacaccuugguuucuaggauggu

SEQ ID NO: 445802 - RNA, 66 nt, Homo Sapiens
aggaguuguauuggcaagagggaggggugagagcuguuggagaacugagaaugagguuuuuuuuuu

SEQ ID NO: 445803 - RNA, 66 nt, Homo Sapiens
uucuauugcccugcaacgucccaucuauacgagguguuggagaaggugaagaacccucccauucac

SEQ ID NO: 445804 - RNA, 66 nt, Homo Sapiens
aucccugcuugugcaggccaguggaggcucuugggcuuggagaacacgugugucucuguguaugug

SEQ ID NO: 445805 - RNA, 66 nt, Homo Sapiens
caaguggggcaacguguggaggaagccccucauaauuuggagaaaacuugauacaauagaagcuga

SEQ ID NO: 445806 - RNA, 66 nt, Homo Sapiens
accaaccuguucaagucuaccaauuauaagggcaaauuggagaaaaagaaaaaauauauacucaag

SEQ ID NO: 445807 - RNA, 66 nt, Homo Sapiens
cccguuuguuuguuggaguggugccagguacugguuuuggagaacuugucuacaaccagggauuga

SEQ ID NO: 445808 - RNA, 66 nt, Homo Sapiens
aagagugcauaccagaauugaauauaccauaugggauuggagaaagacaaauguggaagaaaucau

SEQ ID NO: 445809 - RNA, 66 nt, Homo Sapiens
ggcugagaaagggaaaagacacacaagucgcguggguuggagaagccagagccauuccaccucccc

SEQ ID NO: 445810 - RNA, 66 nt, Homo Sapiens
ugguggcgugcucuagcccucucaguuaccagcucuuuggagaaggaucaaaauucagauggaaug

SEQ ID NO: 445811 - RNA, 66 nt, Homo Sapiens
uccugaaacagacuacucuuugccuuuuugcugcaguuggagaagaaacugaauuugaaaaauguc

SEQ ID NO: 445812 - RNA, 66 nt, Homo Sapiens
agcaaagaauuuaaaguggcuccuuuaauuggugacuuggagaaagcuaggucaaggguuuauuau

SEQ ID NO: 445813 - RNA, 66 nt, Homo Sapiens
uuaacagaguuugggggagagagcaagauggguuccuuggagaagcugauuugccaagaugcacau

SEQ ID NO: 445814 - RNA, 66 nt, Homo Sapiens
uuugccaccuaagcaguaaaacaugauauugaccacuuggagaacucagaaaauuauuuuaaauuu

SEQ ID NO: 445815 - RNA, 66 nt, Homo Sapiens
gagagaaguaaaggaauauaugccuccuguguacuuuuggagaaaacugaagauuuaguuuccauu

SEQ ID NO: 445816 - RNA, 66 nt, Homo Sapiens
agcuuaaacauuucaccagauugaugcuggaagcucuuggagaaaaucaggaucauccuuuuguac

SEQ ID NO: 445817 - RNA, 66 nt, Homo Sapiens
uggacccuaguucaguuuagccaaggagaaagcccuuuggagaaacgugacaaaacacaaguugga

SEQ ID NO: 445818 - RNA, 66 nt, Homo Sapiens
gcugaaggucaguaauuccgauuuaguuccauaaaauuggagaacuuuugauuccuugaagagccu

SEQ ID NO: 445819 - RNA, 66 nt, Homo Sapiens
cacaguaaagggaaacccuggaugcuugcuucagcauuggagaauuauaaacaugaugaaugugga

SEQ ID NO: 445820 - RNA, 66 nt, Homo Sapiens
agaaccgugaacuggaaaagggagaagucccggcuguuggagaaggucgaccaacaacaacgagga

SEQ ID NO: 445821 - RNA, 66 nt, Homo Sapiens
aauggacgaauucuugagcagugguggugaagagaguuggagaagggaguggagaugggggcgggg

SEQ ID NO: 445822 - RNA, 66 nt, Homo Sapiens
cguacucuagggccaaauccagggccgagguuacauuuggagaaccacauagucucagagaucugu

SEQ ID NO: 445823 - RNA, 66 nt, Homo Sapiens
gcagaagagacgucccgcuuuggggugaggcuugacuuggagaaaggcgguggccagcccauuuuc

SEQ ID NO: 445824 - RNA, 66 nt, Homo Sapiens
gugaauguauguacuguauuauacacagagauggucuuggagaauuucauccagguuaaccuugau

SEQ ID NO: 445825 - RNA, 66 nt, Homo Sapiens
gcuugaggccagaagugcaauuuuaggaggcugagguuggagaaucucaugccuauaauccuggca

SEQ ID NO: 445826 - RNA, 66 nt, Homo Sapiens
ugaugcauaaagcugugauaaucaaaaagcugcuuuuuggagaagagccaaguggccaaguccuuu

SEQ ID NO: 445827 - RNA, 66 nt, Homo Sapiens
ugacucaaauauauacuugagagaguaauuuaugcuuuggagaauuagggcccuaaccuaaaaucg

SEQ ID NO: 445828 - RNA, 66 nt, Homo Sapiens
ucuugugcaauuagccuggcggugagaaauauuugcuuggagaagcucaaugugggguuuguaaua

SEQ ID NO: 445829 - RNA, 66 nt, Homo Sapiens
agacaugcuuuuccagcuguaaauggucagagcuaguuggagaauguguuuuguuugguauguaca

SEQ ID NO: 445830 - RNA, 66 nt, Homo Sapiens
gaagcaaaggugaaugacagaaauuaggagcuuguuuuggagaaauagcagucucuucagguagcu

SEQ ID NO: 445831 - RNA, 66 nt, Homo Sapiens
ugccgaaaaguugccaaauauuuuuauaaugucuuuuuggagaaauauauacuuugugcuuuaugg

SEQ ID NO: 445832 - RNA, 66 nt, Homo Sapiens
gagacaggagggguaaaaccagauauauagaggauuuuggagaagaaaaggaauauuuucuucuua

SEQ ID NO: 445833 - RNA, 66 nt, Homo Sapiens
auggauaaguaguguuuccuuuccgucuuugcuguuuuggagaauggacuuaacaauauacauaug

SEQ ID NO: 445834 - RNA, 66 nt, Homo Sapiens
uaccacacaaaacaaugaauuuuuccaugguuaaguuuggagaaaaugucuccauuuuuaucaagg

SEQ ID NO: 445835 - RNA, 66 nt, Homo Sapiens
ggagcucuguggcuucccacguggagaaacugugaauuggagaaaucacuucgauuuuucuggucu

SEQ ID NO: 445836 - RNA, 66 nt, Homo Sapiens
guguuuuuuucucucacuauaguauaagaaucuauuuuggagaaaaaaagaaaauaugagggucuc

SEQ ID NO: 445837 - RNA, 66 nt, Homo Sapiens
gguggggggagggggaugggguccuucuaggaguccuuggagaaaaguaagaaaccaggaguguuu

SEQ ID NO: 445838 - RNA, 66 nt, Homo Sapiens
cucaccagggcaggagaggacucagccuccuguguuuuggagaaggggcccaauguguguugacga

SEQ ID NO: 445839 - RNA, 66 nt, Homo Sapiens
guugcucaaauguuguucaacaccagaaaauuuauauuggagaaaagcacuguaaauguaaugcau

SEQ ID NO: 445840 - RNA, 66 nt, Homo Sapiens
guuguucaaacuuuguucaauaccaggaaauuuauauuggagaaaaacccuaugaguguaaugaau

SEQ ID NO: 445841 - RNA, 66 nt, Homo Sapiens
gguugucacgcuugauuguagguaagauaauuuauauuggagaaaaauccuccaaguaugaagaau

SEQ ID NO: 445842 - RNA, 66 nt, Homo Sapiens
guugcucaaacuuuguucgacaucagggaauuuguauuggagaaaaacccugcaaauguaauaaau

SEQ ID NO: 445843 - RNA, 66 nt, Homo Sapiens
ggauugccuugaucuggcacuuacugauacaagcauuuggagaagagaaaauucaaauauaagaaa

SEQ ID NO: 445844 - RNA, 66 nt, Homo Sapiens
aauggacuuuccugugauuuguuuuuaaucauucauuuggagaagaggcaugaccuuuguauuuca

SEQ ID NO: 445845 - RNA, 66 nt, Homo Sapiens
uuucaugcuauuaguauuuucauaccuuagucacauuuggagaauucacaugggaauaaaauucca

SEQ ID NO: 445846 - RNA, 66 nt, Homo Sapiens
uuugcagguuugguuuuuucucauuugucuguggcauuggagaauauucucgguuuaaacagacua

SEQ ID NO: 445847 - RNA, 66 nt, Homo Sapiens
agcuuauugucuagugaaacucguuaauuuguaguguuggagaagaacugaaaucauacuucuuag

SEQ ID NO: 445848 - RNA, 66 nt, Homo Sapiens
gauuccauguagucuucaauuuuuaauuuuuaagaauuggagaauuucuaauguuaaaguuaguuu

SEQ ID NO: 445849 - RNA, 66 nt, Homo Sapiens
cauaauaucugcauuaugcuggaaaaaaauagaccuuuggagaauacuuaaauaaaacaugugcau

SEQ ID NO: 445850 - RNA, 66 nt, Homo Sapiens
ucccaggugauucuguaaguugucccucaacuguacuuggagaaaucguguuuuaaagcaguaguc

SEQ ID NO: 445851 - RNA, 66 nt, Homo Sapiens
ccgugcaggaauagcaacagcaauuuccgggaggucuuggagaagcuggagagcgaccccgucugc

SEQ ID NO: 445852 - RNA, 66 nt, Homo Sapiens
agccuuuuauuaguucuuugauagcuaagaugguuguuggagaaagugcuuaagccacuguuuaug

SEQ ID NO: 445853 - RNA, 66 nt, Homo Sapiens
gaguccuguaaaugaaugcucugggcuagauacagcuuggagaaccugcuggccuuguuagacagc

SEQ ID NO: 445854 - RNA, 66 nt, Homo Sapiens
uuuaggaaagccuggguuggguggagcagaaccaucuuggagaagaugacaguucccuguccuccc

SEQ ID NO: 445855 - RNA, 66 nt, Homo Sapiens
aggaaacucugcaaggcuaacuguaacacauuguaauuggagaagaaagacacccccuuccaaauu

SEQ ID NO: 445856 - RNA, 66 nt, Homo Sapiens
aaaacuagcuguggcauuccagcagcauuuugacccuuggagaagauuuaagcuuguuguuggaag

SEQ ID NO: 445857 - RNA, 66 nt, Homo Sapiens
auaugaauguauucgggaggccauuuaauccgguucuuggagaaacacuaccgagcuggaagcaag

SEQ ID NO: 445858 - RNA, 66 nt, Homo Sapiens
uaagguggaguccuacuuguuacugcuuggggacuauuggagaaaauuaugucuucaagugaccug

SEQ ID NO: 445859 - RNA, 66 nt, Homo Sapiens
uaaaccgccuccacguggcgcugccgaagugaauuguuggagaaugcguagucuuuuguauuuucc

SEQ ID NO: 445860 - RNA, 66 nt, Homo Sapiens
uacucuguaggcaugacagcuauuuaaugugugaccuuggagaaguaaugaguguuccugugccca

SEQ ID NO: 445861 - RNA, 66 nt, Homo Sapiens
acaaauauguucucugaauguauaacuauuacaguguuggagaacagguguuugucauggugaaau

SEQ ID NO: 445862 - RNA, 66 nt, Homo Sapiens
ucuguggugcagugugugaaggggucggagaggcguuuggagaaggcagcugggugcagaagcugu

SEQ ID NO: 445863 - RNA, 66 nt, Homo Sapiens
agggauuaaaaauaaggauagagcaaagcuaucaacuuggagaaacgugaauuacugaauauuuca

SEQ ID NO: 445864 - RNA, 66 nt, Homo Sapiens
agaaccacaaacacagaucauaaaagccugcucaauuuggagaaauuuuuuaaaaacuauauucag

SEQ ID NO: 445865 - RNA, 66 nt, Homo Sapiens
agauugccuuuucaugcaguaccuuaccaaaguagguuggagaauuaugcccacagaagucaucag

SEQ ID NO: 445866 - RNA, 66 nt, Homo Sapiens
uagaggaggagaaagaauccuuaucuccugcagagauuggagaagggauaugauaugaagggggac

SEQ ID NO: 445867 - RNA, 66 nt, Homo Sapiens
guguuaauuguguggaaugacucuacauagauuaaauuggagaaacucugggcgcuguaaguuaag

SEQ ID NO: 445868 - RNA, 66 nt, Homo Sapiens
gcauccucuuuuguguaguuuuguuuguuuguuuuuuuggagaagauguuuccuuuuuuuguuugu

SEQ ID NO: 445869 - RNA, 66 nt, Homo Sapiens
uuuccuuuuguugcauuugucauugcauacagguuauuggagaaauuacuuaaaagaaagauuucc

SEQ ID NO: 445870 - RNA, 66 nt, Homo Sapiens
uuuagacagcagcucugugugaacucggaggggaguuuggagaaauaaaucugaguguugccugcu

SEQ ID NO: 445871 - RNA, 66 nt, Homo Sapiens
uuggggaaguguuuucugaacagccacaguguucuguuggagaaaccuucacacuaccaggcccug

SEQ ID NO: 445872 - RNA, 66 nt, Homo Sapiens
aaauuaaacauuuggcccuguugaagaugaaugacuuuggagaagcaguuucccagaaucagacuu

SEQ ID NO: 445873 - RNA, 66 nt, Homo Sapiens
cauuuaagcugccucggguuagagucaccaggucgcuuggagaagugcaguggagauaaauguccu

SEQ ID NO: 445874 - RNA, 66 nt, Homo Sapiens
uuuaaaauauaacuucaagaaaagaguaaacauccauuggagaacacggcugaaaauuauugugcu

SEQ ID NO: 445875 - RNA, 66 nt, Homo Sapiens
uuuaaagaucaugaauuugugacuuaguucugcccuuuggagaacaaaagaaagcagucuuccauc

SEQ ID NO: 445876 - RNA, 66 nt, Homo Sapiens
guaaacaauggugccccagaaagcugcaggugguguuuggagaagcaguuacuuuucaguuacaag

SEQ ID NO: 445877 - RNA, 66 nt, Homo Sapiens
uuaaagcaguauuuaaugcaauuuccaguuauuucuuuggagaauuuuaugucauuguuccauuac

SEQ ID NO: 445878 - RNA, 66 nt, Homo Sapiens
aaaugaguucagaugaucacaaacaggugaguuuuguuggagaagaaaguuggaguaggagacuuu

SEQ ID NO: 445879 - RNA, 66 nt, Homo Sapiens
acccaauaagaggcucuguuuuccacugaagcuuuguuggagaaagagaauaugaaaauuacacau

SEQ ID NO: 445880 - RNA, 66 nt, Homo Sapiens
augugugaagacaugaaaguuuaauguacagaaugguuggagaaaugccuauggugaauuaaagcu

SEQ ID NO: 445881 - RNA, 66 nt, Homo Sapiens
cacauugccuuuguguuaauagucaaauacuuaccuuuggagaauacuuaccuuuggaggaaugua

SEQ ID NO: 445882 - RNA, 66 nt, Homo Sapiens
ggaauaaccuugcugauaagaaaaaaagggacaauauuggagaaacuaccucuuguuuaauugauc

SEQ ID NO: 445883 - RNA, 66 nt, Homo Sapiens
ugucugguaccuuccccuccugccccugcaccagcuuuggagaauggauuuggagugucuugggcg

SEQ ID NO: 445884 - RNA, 66 nt, Homo Sapiens
ccagucucccaggcccccugcgguguugggagcccuuuggagaacgcacagaaaucagaggagaga

SEQ ID NO: 445885 - RNA, 66 nt, Homo Sapiens
guccagcaugcauccuggcccuuggggcuuuuuuauuuggagaaccguaagcaguguagacaaacc

SEQ ID NO: 445886 - RNA, 66 nt, Homo Sapiens
auauucauuugguuguggagucuauagcuugacuccuuggagaacaggccacguugucauugugag

SEQ ID NO: 445887 - RNA, 66 nt, Homo Sapiens
ugaugugaaaauuggaccucgcugcuauuuuacuauuuggagaauaucuuuucaucaacauguaga

SEQ ID NO: 445888 - RNA, 66 nt, Homo Sapiens
ugccauuacuuguauaucuguaaaaauuaugaauuauuggagaaaauuccaaaauagcagaaauug

SEQ ID NO: 445889 - RNA, 66 nt, Homo Sapiens
cugggucagccaaguuucauugcaugcauaccgauauuggagaaauauucugcagaauauuguaau

SEQ ID NO: 445890 - RNA, 66 nt, Homo Sapiens
ccuccuucagagcccuuugugcagucuccuuguugcuuggagaacagugcaaagucuuguacugaa

SEQ ID NO: 445891 - RNA, 66 nt, Homo Sapiens
aggaugaggaaaagaagagccuuugcugauaaagaguuggagaacauuaugcuggagagagaauau

SEQ ID NO: 445892 - RNA, 66 nt, Homo Sapiens
uaaguggauuaauauuaaaacuauguauauuaaucauuggagaagggggaagaggaaaugaaaaua

SEQ ID NO: 445893 - RNA, 60 nt, Homo Sapiens; identical to SEQ ID NO: 445315

SEQ ID NO: 445894 - RNA, 66 nt, Homo Sapiens
auuugcaaaagaaauaggcuuuucuucuuuuuuaaauuggagaaaucucugcucugguugaccugg

SEQ ID NO: 445895 - RNA, 66 nt, Homo Sapiens
ugcaggcaucuguggggaaucccagccugcagguucuuggagaagcaggugaaccuaaggaugaaa

SEQ ID NO: 445896 - RNA, 66 nt, Homo Sapiens
agcucaugcacaucagcugguggagcaggccuggccuuggagaacgagaccugugugccaggggca

SEQ ID NO: 445897 - RNA, 66 nt, Homo Sapiens
gugcguccuugugaagcucgucuccauguggcuuucuuggagaaaggcuccccuggggcaagaggg

SEQ ID NO: 445898 - RNA, 66 nt, Homo Sapiens
cucggagaggucaggagaccgaccccaccacuaacuuuggagaaaauguggguuugcuuuuuaaag

SEQ ID NO: 445899 - RNA, 66 nt, Homo Sapiens
uacguaaucagaaauuugugaaaaguuacaugucauuuggagaaaaauuuuucuggaaaaguuaaa

SEQ ID NO: 445900 - RNA, 66 nt, Homo Sapiens
uuuccuucaagcagaaacaauacgguuugaacauaauuggagaaccuaccggccaauguccaaaau

SEQ ID NO: 445901 - RNA, 66 nt, Homo Sapiens
cacugugggcuaggguggucaacuuggagagggagcuuggagaacuccacggccaagggccacggg

SEQ ID NO: 445902 - RNA, 66 nt, Homo Sapiens
uauguaaauuaccaaggcacuugguucuuuaaagauuuggagaagauuacguguguuuuuuagagc

SEQ ID NO: 445903 - RNA, 66 nt, Homo Sapiens
gggacucauauaaauaguugaaaacaucuaaagcuguuggagaagacuguguaaaaaguacucaga

SEQ ID NO: 445904 - RNA, 66 nt, Homo Sapiens
cccgcuuuuucuggaacagcaauuccuuggacaccauuggagaagcaggugcuuuugcaagacugg

SEQ ID NO: 445905 - RNA, 66 nt, Homo Sapiens
cuugggacugggacagucuuguuaaggcuguuuugcuuggagaagaaagguuuuuaaaacauggau

SEQ ID NO: 445906 - RNA, 66 nt, Homo Sapiens
uguuuaccaguaaauacaucuuguuuuuguuuuguuuuggagaauuaaaagaacaaaagcuuuuag

SEQ ID NO: 445907 - RNA, 66 nt, Homo Sapiens
cuacuuuuugacuuacaugggaagauauacuuugcuuuggagaaauguuuuuaaaaagaagagaaa

SEQ ID NO: 445908 - RNA, 66 nt, Homo Sapiens
ucgcccaucccccccgcggcggccuuguuuuuguauuuggagaacccacuccgccccauccugcag

SEQ ID NO: 445909 - RNA, 66 nt, Homo Sapiens
gaaguugaacgagcauagucccaaaaagaaaugauguuggagaagguugauuccuuuuuucaaaau

SEQ ID NO: 445910 - RNA, 66 nt, Homo Sapiens
gcuuuuacuaaauauacaagauuuacuacuagaaauuuggagaaagaacacuaacacauguacuug

SEQ ID NO: 445911 - RNA, 66 nt, Homo Sapiens
cagaacucaugagagacaagcaguaagaaacuucuuuuggagaaacaacagaccagaucuuuacuc

SEQ ID NO: 445912 - RNA, 66 nt, Homo Sapiens
cuacuacaguuucacagaauaccugagaagacacacuuggagaaaccuuuuggguguaaugaaugu

SEQ ID NO: 445913 - RNA, 66 nt, Homo Sapiens
uuagccuuacuucuacuuccagaugcagugccucuuuuggagaagacauguuuauuuuucauguuc

SEQ ID NO: 445914 - RNA, 66 nt, Homo Sapiens
ggggagggaagaguguguccuggcaggaagccaccauuggagaaggugaggccaguaaccaucuca

SEQ ID NO: 445915 - RNA, 66 nt, Homo Sapiens
cugauuuuacauaucuguuuggauuauagcuaggauuuggagaauaaguguguacagaucacaaaa

SEQ ID NO: 445916 - RNA, 66 nt, Homo Sapiens
uuuuuuuaagcaagagaaagacaacuguucugcggguuggagaaaauacaauuuuuuuuuuuuuuu

SEQ ID NO: 445917 - RNA, 66 nt, Homo Sapiens
uuacuauugcugcauacccggggugggauggggugguuggagaaccagaacuauuuuuaaaacauu

SEQ ID NO: 445918 - RNA, 66 nt, Homo Sapiens
accugaacuggggaauuugaacauuccuuuacauuguuggagaaaugaagccaaaguuauucagau

SEQ ID NO: 445919 - RNA, 66 nt, Homo Sapiens
agucuauaugguucuccaagaaacugaaugaauccauuggagaagcgguggauaacuagccagaca

SEQ ID NO: 445920 - RNA, 66 nt, Homo Sapiens
aaauuauguucuuuagacacugcuaccugaaaacuguuggagaaauaauguuuaaaguuauuuaag

SEQ ID NO: 445921 - RNA, 66 nt, Homo Sapiens
gcuuaaaacccugaugcaaacuucuccuuucagugguuggagaaauuggccgaguucaaccauuca

SEQ ID NO: 445922 - RNA, 66 nt, Homo Sapiens
ccuguaugugguguuuuaacagacauagggagucauuuggagaaaguaaaauucuaaccaaacccc

SEQ ID NO: 445923 - RNA, 66 nt, Homo Sapiens
auggaagcuacaccccuacaaauguacagcccgugcuuggagaaccggaauggucagccuaagggu

SEQ ID NO: 445924 - RNA, 66 nt, Homo Sapiens
caaccagauacaucugcugguugcuggugucucucuuuggagaaacaccagaacuguggugccaaa

SEQ ID NO: 445925 - RNA, 66 nt, Homo Sapiens
agaaugcuacuguauuuuaccauacaaugcauacuguuggagaacagauuugccaaauaacaaaag

SEQ ID NO: 445926 - RNA, 66 nt, Homo Sapiens
uguaccuuuuuugucaacucacuuucuguuuucggauuggagaagagugauaccuugaucuuuccc

SEQ ID NO: 445927 - RNA, 66 nt, Homo Sapiens
uuccaaucuuuccucccaaguugugacuaaggcacguuggagaacaaacaccuuaaauaaaaguga

SEQ ID NO: 445928 - RNA, 66 nt, Homo Sapiens
aagaugaauuauagcuccggaagaaugugggugguauuggagaaagagaaaagcuaaauaaccuuu

SEQ ID NO: 445929 - RNA, 66 nt, Homo Sapiens
gaaccaaguccuuggauaucguagaaccaagucuacuuggagaaaaggcuguaucuacucugugga

SEQ ID NO: 445930 - RNA, 66 nt, Homo Sapiens
uguuuaacauuuucaagccugagcagcuguacgacuuuggagaagucuuaagucacaccuaccacu

SEQ ID NO: 445931 - RNA, 66 nt, Homo Sapiens
uuaaugagaaaauuuuagaauugugcuaccaucuacuuggagaagugcacacuccaguauuaauau

SEQ ID NO: 445932 - RNA, 66 nt, Homo Sapiens
ugcaaacuaccgucgcucagugaggcccaaacuugauuggagaauuugccccauaggaugucauau

SEQ ID NO: 445933 - RNA, 66 nt, Homo Sapiens
uauuuaauaaaaccuguuaacuuauguguuacaaaauuggagaaagugaaugcagauuacacugau

SEQ ID NO: 445934 - RNA, 66 nt, Homo Sapiens
uuuaugucagcacacacuuaguuaauuuuguaauaauuggagaagaacgugcguucugccuuccuu

SEQ ID NO: 445935 - RNA, 66 nt, Homo Sapiens
ggagugcagucauaaucuuauccuuuccuuucgacauuggagaauuacacauuggugucucuuuuu

SEQ ID NO: 445936 - RNA, 66 nt, Homo Sapiens
acucgugagcacaucuuuagaauaaaguuuugugcuuuggagaauggauguccuuuccuuucugaa

SEQ ID NO: 445937 - RNA, 66 nt, Homo Sapiens
ugcggcagagaagccaugcggcgccuguguggaaauuuggagaaguagcacccuaggggggcaccu

SEQ ID NO: 445938 - RNA, 66 nt, Homo Sapiens
guauuucccagugugucuuuuaugucuuugaauguuuuggagaaaagucuaugccugucuaaaaau

SEQ ID NO: 445939 - RNA, 66 nt, Homo Sapiens
aauauuuuaaauuaaagccuucuaauguuccacuguuuggagaacagaagauagcaggcuguguau

SEQ ID NO: 445940 - RNA, 66 nt, Homo Sapiens
ucugcaaacacuguguauagugagacuuguucuacuuuggagaacagguuaccuuuugaaaaugag

SEQ ID NO: 445941 - RNA, 55 nt, Homo Sapiens; identical to SEQ ID NO: 445363

SEQ ID NO: 445942 - RNA, 66 nt, Homo Sapiens
uauagucaguuuaguucauauguucugaaaacuguuuuggagaaagauagacagaaaaaugucauc

SEQ ID NO: 445943 - RNA, 66 nt, Homo Sapiens
uguaauucucagaaccagucucagggagauauaugcuuggagaacucugccuuccaucaacugcag

SEQ ID NO: 445944 - RNA, 66 nt, Homo Sapiens
gugccaugaauuaagauggaugacuggaaaaagguguuggagaaagaguuaaagaugaggaagaga

SEQ ID NO: 445945 - RNA, 66 nt, Homo Sapiens
acgcaaguaccaggaggacauaaccgcuguggccuguuggagaacagccaguagccuugguaauau

SEQ ID NO: 445946 - RNA, 66 nt, Homo Sapiens
ccauuguuacaugaaagugauagauagcaacaaguuuuggagaagagagagggagauaaaaggggg

SEQ ID NO: 445947 - RNA, 66 nt, Homo Sapiens
gugauuuucuacaugaaucaaacacagaaacaacuuuuggagaaauuaaauucugagugugacuuc

SEQ ID NO: 445948 - RNA, 66 nt, Homo Sapiens
cacgcuccccugacacugaagaggauccacaacuccuuggagaaacacccucacgucuguugccgc

SEQ ID NO: 445949 - RNA, 66 nt, Homo Sapiens
uuuuauauagauguaucuuuuaaaaauaguucacguuuggagaauucuuuuguacucauuugcuuu

SEQ ID NO: 445950 - RNA, 66 nt, Homo Sapiens
ucuagcucugacuuugcuguuuccagugguaugaccuuggagaagucacuuauccucuuggagccu

SEQ ID NO: 445951 - RNA, 66 nt, Homo Sapiens
guguucucucuggacucuugccuagcucacaaggcuuuggagaauugucuuccuaaaucggggcac

SEQ ID NO: 445952 - RNA, 66 nt, Homo Sapiens
cauuggaaagcaucuaguccagugggaagccagggguuggagaaggugcuacaucccucuucccau

SEQ ID NO: 445953 - RNA, 66 nt, Homo Sapiens
cugccuucuagaaucagaucuguuuggggcuggggguuggagaauaaaagcaggagaagucuaugg

SEQ ID NO: 445954 - RNA, 66 nt, Homo Sapiens
uuccucugcuguguucuguguguccaguguagccuauuggagaaucggucucauuagagugacucu

SEQ ID NO: 445955 - RNA, 66 nt, Homo Sapiens
cauucucugaaaauacuguaauguacacagacugauuuggagaacaagaguuguuuaauagagaaa

SEQ ID NO: 445956 - RNA, 66 nt, Homo Sapiens
aaaugauauuuagaaaguuaugguaagaggauuuuuuuggagaaaauuguccauauccagguuagc

SEQ ID NO: 445957 - RNA, 66 nt, Homo Sapiens
gggaggaauaggagcaaaucaaauaaaugauacaucuuggagaagacuaaacuuguauuacauauc

SEQ ID NO: 445958 - RNA, 66 nt, Homo Sapiens
gagaggaaagguuugagaagaaccauccauguauuuuuggagaagaggggaaggaguuuuauguua

SEQ ID NO: 445959 - RNA, 66 nt, Homo Sapiens
cagggggcugccuugggcccaccuugcuugcagugguuggagaaccguugucaagguuguccccag

SEQ ID NO: 445960 - RNA, 66 nt, Homo Sapiens
gccucucuagcagucaacucagguacagaagaaagauuggagaagggaugucuuugggagggaaga

SEQ ID NO: 445961 - RNA, 66 nt, Homo Sapiens
ggggguugggaacuuaugcacccaccuuccagaaacuuggagaaauagcugagggugcccaccaag

SEQ ID NO: 445962 - RNA, 66 nt, Homo Sapiens
uacuucaaccagagcagggaaggacucauuccugccuuggagaaaaucccagcugugguuggauca

SEQ ID NO: 445963 - RNA, 66 nt, Homo Sapiens
ggagagaauuaguagggcaaggaauuuucuaaagcuuuggagaaaaugagcaugaaagucaaaacu

SEQ ID NO: 445964 - RNA, 66 nt, Homo Sapiens
gagaagaaguuguagcagagauuaggggccuggggauuggagaacgacugguucaguggcuggagu

SEQ ID NO: 445965 - RNA, 66 nt, Homo Sapiens
aucaaaaccccaaacaaacaaaauaaguaccuuuuauuggagaaaaacuaaaaaauuuuacugucu

SEQ ID NO: 445966 - RNA, 66 nt, Homo Sapiens
acuuauuacacuaucuaaccagguauguauuauggauuggagaagcgauguugaaauaaugauagu

SEQ ID NO: 445967 - RNA, 66 nt, Homo Sapiens
uggaauaaaguuacaccugggguuggaacucugaaguuggagaaggcauaaugcucuauccucuaa

SEQ ID NO: 445968 - RNA, 66 nt, Homo Sapiens
agguaaaggaugaggguucacagcgcuaguggaggguuggagaaggugcagguuugaccaggaaag

SEQ ID NO: 445969 - RNA, 66 nt, Homo Sapiens
cgguuuugaaagcaacuccucuuguucaauaugaucuuggagaacaaccaggaacaagaagagacc

SEQ ID NO: 445970 - RNA, 66 nt, Homo Sapiens
cagugcuugaaauggacaagugaagaguggacagucuuggagaacauugaauaaaugugaaggcug

SEQ ID NO: 445971 - RNA, 66 nt, Homo Sapiens
gccucgcugucucccuagagccagggcccugcggauuuggagaagggagcggggcaggacuuccag

SEQ ID NO: 445972 - RNA, 66 nt, Homo Sapiens
acagagaaagguuuuagacuccaguuuaccuuucucuuggagaaacucaaugcuaaucccaccuuu

SEQ ID NO: 445973 - RNA, 66 nt, Homo Sapiens
gaauguucacacacuuuucuugcguacucaacuaaauuggagaauguuucugaagaaaauuggaug

SEQ ID NO: 445974 - RNA, 66 nt, Homo Sapiens
augaaggcucgaguucugcuguucuguaaaagagaauuggagaaugaaaccugcuccaacagagau

SEQ ID NO: 445975 - RNA, 66 nt, Homo Sapiens
cauccugucauuucuguucuugucccucauacaucuuuggagaaccgggcuccagacuuuguuccc

SEQ ID NO: 445976 - RNA, 66 nt, Homo Sapiens
uuuggacaggacccagcccugcaccguucacuguauuuggagaaaaugguaagaguuccauaccgg

SEQ ID NO: 445977 - RNA, 66 nt, Homo Sapiens
acuguguauguguggaaauaaaaauguauuguacuuuuggagaauuuuuuguaggcauuuuucugu

SEQ ID NO: 445978 - RNA, 66 nt, Homo Sapiens
uugggcucuggccaucugcaacccugaacgugcagguuggagaacgaaugaauacaaauuuuauug

SEQ ID NO: 445979 - RNA, 66 nt, Homo Sapiens
aacagccuuuccuacauccuucccucacucccaugauuggagaaaugauucauugggugaugagug

SEQ ID NO: 445980 - RNA, 66 nt, Homo Sapiens
ucagcagcugggcugucagggccauaguagcucccuuuggagaacagggaaagccuggaggcuucc

SEQ ID NO: 445981 - RNA, 66 nt, Homo Sapiens
gggacagugcaacaaguaacgagacuauuuuguauuuuggagaauucauauuauggagaaccuaac

SEQ ID NO: 445982 - RNA, 66 nt, Homo Sapiens
uaaauuccuaccaggaaagaauacauauccaauagauuggagaaagccagagauuagcccucauuc

SEQ ID NO: 445983 - RNA, 66 nt, Homo Sapiens
ggaauuuuucacaaagagcaaugacuuuauuuugcauuggagaacuccuggagauaagcuguacaa

SEQ ID NO: 445984 - RNA, 66 nt, Homo Sapiens
caaggaaggaggcggugacaguccaaggcuuuaucuuuggagaagggguguuagugagggccucaa

SEQ ID NO: 445985 - RNA, 66 nt, Homo Sapiens
cgucuugcuuugucacccacaaggggaaacuuuuuuuuggagaaggcaagucuucauuuggggcca

SEQ ID NO: 445986 - RNA, 66 nt, Homo Sapiens
ggaggugagcaaauuaacggguuauuggucuggaaauuggagaaauuuaaggaucugauacaucua

SEQ ID NO: 445987 - RNA, 66 nt, Homo Sapiens
gaauuaaguugacuugaaauggugugcacuaugagauuggagaaaucauaauuaaagaaccuggug

SEQ ID NO: 445988 - RNA, 66 nt, Homo Sapiens
gaggcugaggguagagggagggugggugggaaucucuuggagaacuucuuguuuaaaagaaaauca

SEQ ID NO: 445989 - RNA, 66 nt, Homo Sapiens
aucuguagcuuguugaaaaagaggcauuucagaguguuggagaagaccacugacugggacccugaa

SEQ ID NO: 445990 - RNA, 66 nt, Homo Sapiens
aaaaagggcgguggaggggaguaguaauuccuaaucuuggagaauauauuuucaaaaaccuaaucc

SEQ ID NO: 445991 - RNA, 66 nt, Homo Sapiens
uuuggggcacguuuuccuacugagcuuuaaaguacuuuggagaaacaagaauuaaauacauuucau

SEQ ID NO: 445992 - RNA, 66 nt, Homo Sapiens
ggcagaucaaaagaggugaaccggagaaugauguucuuggagaacaacuagaggaacuuggaucuu

SEQ ID NO: 445993 - RNA, 66 nt, Homo Sapiens
uaggugaagaugcaaccagaauuuaacucugaauacuuggagaaaccauauaaaagaaguugugcu

SEQ ID NO: 445994 - RNA, 66 nt, Homo Sapiens
cccaaacuccuucuccacugguaaauuugcaaguuuuuggagaaccuggucaaguaguuuuaauau

SEQ ID NO: 445995 - RNA, 66 nt, Homo Sapiens
ugcagccucacgcaccaucccaaagcugagacaaaauuggagaagcugugaaaaaugcucucccag

SEQ ID NO: 445996 - RNA, 66 nt, Homo Sapiens
aguaggaacaacacaugguaccaaaucuacuagacauuggagaaacuaauugcacaucaguaugug

SEQ ID NO: 445997 - RNA, 66 nt, Homo Sapiens
cugguucccguuuuccagagugaaaacccuguguccuuggagaaagucuuuauuucugcagguugg

SEQ ID NO: 445998 - RNA, 66 nt, Homo Sapiens
aaggacaccguuacccaugcucccuucaucacauacuuggagaacacagcuuguguggucagcucu

SEQ ID NO: 445999 - RNA, 66 nt, Homo Sapiens
uuucuuacucauuucagucccuuaaaaucauacaucuuggagaaccgaagauuuauggaguaagga

SEQ ID NO: 446000 - RNA, 66 nt, Homo Sapiens
agacuggagccauaaaguuaauuugcaccuagcuuuuuggagaauagccaugauuaacugcuauuc

SEQ ID NO: 446001 - RNA, 66 nt, Homo Sapiens
uucaguuuuuuaaaaauagacuguaguauccuuucauuggagaauuuacaaaaauaucaucuacag

SEQ ID NO: 446002 - RNA, 66 nt, Homo Sapiens
guguucaaaccaaagaaacaaugaucuacucaaacauuggagaaaaaaacugccagaggaggaguu

SEQ ID NO: 446003 - RNA, 66 nt, Homo Sapiens
uuccagcuuucgucugucaucagacauugaagagauuuggagaaauguaaagcagcaguacucuuc

SEQ ID NO: 446004 - RNA, 66 nt, Homo Sapiens
aguagauggguauauaacaguuuggaaauacuaucuuuggagaauguauuuuuguauuuauaaauc

SEQ ID NO: 446005 - RNA, 66 nt, Homo Sapiens
gggugagcaggcacauugacuuucuguugagguaccuuggagaagcugagccauucugaggacauc

SEQ ID NO: 446006 - RNA, 66 nt, Homo Sapiens
uagauuuuuaaaggaauauuucagaguuuaaucuuuuuggagaaguuauguucuuuaaucggguac

SEQ ID NO: 446007 - RNA, 66 nt, Homo Sapiens
guuuauguauguucagccagauaguaaaugggauuuuuggagaaauaagauaacuacaaaguuucu

SEQ ID NO: 446008 - RNA, 66 nt, Homo Sapiens
ugucaaauuacagccaaugaguucaugauagugcuuuuggagaacuggaaaguauuaucuaauuaa

SEQ ID NO: 446009 - RNA, 66 nt, Homo Sapiens
cuggaguuguuaugaacaugacauugcagauuguucuuggagaauuuuagcuaggaauuguuaagc

SEQ ID NO: 446010 - RNA, 66 nt, Homo Sapiens
aaaacuguacugcuuguucaaacugacuuuugucuuuuggagaaaaauuugcaucacugaggauga

SEQ ID NO: 446011 - RNA, 66 nt, Homo Sapiens
aaagaaaagcaaaugagugugauuuagcaacugguguuggagaaaauccauaauagagauugauaa

SEQ ID NO: 446012 - RNA, 66 nt, Homo Sapiens
uucuuaguugggugaauuaacucauaugcuuauggcuuggagaaaucucuuuuccaguauuaaaca

SEQ ID NO: 446013 - RNA, 66 nt, Homo Sapiens
auuuucuuguucccguagaagaaagaagaaagguguuuggagaauucgagugccuaggaugccaga

SEQ ID NO: 446014 - RNA, 66 nt, Homo Sapiens
acuaagacaaagauauuuagguugagcagcuauuaauuggagaauugguacagagacgcuccagau

SEQ ID NO: 446015 - RNA, 66 nt, Homo Sapiens
ggaagccuggcugcagcuucccauuugguuacgagguuggagaaaaagucaaaguccccuccuggg

SEQ ID NO: 446016 - RNA, 66 nt, Homo Sapiens
uauauagcaucuggaagaucauuuugaaauuguuccuuggagaaaugaaaacaguguguaaacaaa

SEQ ID NO: 446017 - RNA, 66 nt, Homo Sapiens
guacuuucuugucaaacaaaaccaauggcucuggguuuggagaacacaguggcugguuuuaaaaau

SEQ ID NO: 446018 - RNA, 66 nt, Homo Sapiens
ggcugccuuucccaaaugggaaaggugcugacagaguuggagaaaaaagaauagacucauuuuucc

SEQ ID NO: 446019 - RNA, 66 nt, Homo Sapiens
ccugcuugugcugggaaaugcaacucacucauguauuuggagaaacaggaguguucacuuaucuag

SEQ ID NO: 446020 - RNA, 66 nt, Homo Sapiens
uuaucaaaaauuucauggaacaccuuugugggguuuuuggagaaggagaaaacuucuuuuaaaccu

SEQ ID NO: 446021 - RNA, 66 nt, Homo Sapiens
gauugaacuuuucaagacauuguuuauucggagaauuuggagaaguuggggagagauauuuucuua

SEQ ID NO: 446022 - RNA, 66 nt, Homo Sapiens
caaugcagaacugaugggaauccuaaaccuugacaguuggagaagcugaucaauauaacaauauaa

SEQ ID NO: 446023 - RNA, 66 nt, Homo Sapiens
acaugcauauaauucuguagaacagguauuuugauauuggagaauaggaaguuuaaaaauucuuua

SEQ ID NO: 446024 - RNA, 66 nt, Homo Sapiens
uguauuuguguucacuucuauuagacuauugaaauuuuggagaaaauaucaaugcuuauauauucc

SEQ ID NO: 446025 - RNA, 66 nt, Homo Sapiens
ugcuauucuuccuguuguccuauaauaggacucgacuuggagaaauaauacaaaaaugaaaauauu

SEQ ID NO: 446026 - RNA, 66 nt, Homo Sapiens
agaucuccgugcccuacagacuuggagccuggguuuuuggagaaagaaucuuaguugucauaaucc

SEQ ID NO: 446027 - RNA, 66 nt, Homo Sapiens
gaagggcccccauggcccuggagugauuuuauuguuuuggagaauggccuuuuagauaggaucuag

SEQ ID NO: 446028 - RNA, 66 nt, Homo Sapiens
ccauggccaaaacgauugugcauauuucacuggugguuggagaaaaaaacuaaaaugaaccaaacc

SEQ ID NO: 446029 - RNA, 66 nt, Homo Sapiens
agguuguccguguccuuaacguuuguagugaauuuauuggagaaugguaucaauguguauguggcu

SEQ ID NO: 446030 - RNA, 66 nt, Homo Sapiens
uuugugcccuguguuuuauacaacuauuuucuauauuuggagaaagaaaaaugaauugaaccauuu

SEQ ID NO: 446031 - RNA, 66 nt, Homo Sapiens
auaguagauuuuaauuugacgccguuucacuuuuuguuggagaaaauuuaucaacagcaaacuuca

SEQ ID NO: 446032 - RNA, 66 nt, Homo Sapiens
cccacugugccucagagaccagggcuccagccccucuuggagaagucucagcuaagcucacguccu

SEQ ID NO: 446033 - RNA, 66 nt, Homo Sapiens
gugaagccagcuggacuuccugggucgaguggggccuuggagaacuuuucugucuuacaagaggau

SEQ ID NO: 446034 - RNA, 66 nt, Homo Sapiens
ugagaauugcucauucauauuuuuucuguugcuugcuuggagaauuugcucuuuuuuuggcauaua

SEQ ID NO: 446035 - RNA, 66 nt, Homo Sapiens
gcaaccuuugcacacucaccugagcccuggggacccuuggagaaauuaggugucaccugcuguggc

SEQ ID NO: 446036 - RNA, 66 nt, Homo Sapiens
ucacaugaaacauuugcaaaauuguuuuugguuggauuggagaaguaauccuagggaaggguggug

SEQ ID NO: 446037 - RNA, 66 nt, Homo Sapiens
cuuugauaccaaacaauucaaaaguuggaucugaguuuggagaaagauauuuccaaccuaaguggg

SEQ ID NO: 446038 - RNA, 66 nt, Homo Sapiens
uaacaaacuauguagugugucccuauuauaaaugcauuggagaaguauuuuuaugagacucuuuac

SEQ ID NO: 446039 - RNA, 66 nt, Homo Sapiens
ugaggccucuuauguguaauucaaaugugaaaguacuuggagaaacgguuagaagucugcuaaaga

SEQ ID NO: 446040 - RNA, 66 nt, Homo Sapiens
gcuuagaaauucagcauuuggcaacauucauagucuuuggagaaauuuuucuguggagguggaaaa

SEQ ID NO: 446041 - RNA, 66 nt, Homo Sapiens
cucaguuccaacuugugauucucuagaauuuccacuuuggagaauauugccuggagugacacuaca

SEQ ID NO: 446042 - RNA, 66 nt, Homo Sapiens
uguuuaaauaguucuguuguauugcuuuucucaauuuuggagaagacuuuuuaaaaauuuaacaug

SEQ ID NO: 446043 - RNA, 66 nt, Homo Sapiens
augauagaugauauacuagauauucuugccacaauauuggagaauauaauuuuuacuugcggugac

SEQ ID NO: 446044 - RNA, 66 nt, Homo Sapiens
acaggcucaaaguggggcuguggggucuuggccacauuggagaaaagcagaaguucugccucugcc

SEQ ID NO: 446045 - RNA, 66 nt, Homo Sapiens
uccugccccgagcccuagguggggccaggaggugccuuggagaagccagccagagcagagagggcu

SEQ ID NO: 446046 - RNA, 66 nt, Homo Sapiens
ccacagacucugagaagcgaagaccaugucuccucguuggagaaacccaauagcaggggaagcugg

SEQ ID NO: 446047 - RNA, 66 nt, Homo Sapiens
uguguguguaaugcaaauuaguuaaaacaaauaguuuuggagaaaguuaaaacuagcuuuagagua

SEQ ID NO: 446048 - RNA, 66 nt, Homo Sapiens
uuccagaaucauucuccuuucugcccauaaagggccuuggagaauugcuuuaagaagagugaaugu

SEQ ID NO: 446049 - RNA, 66 nt, Homo Sapiens
ucaggagccugggaccccgcaugucccaaaaugggauuggagaagcuggagagaaagcagaagagg

SEQ ID NO: 446050 - RNA, 66 nt, Homo Sapiens
uauuuuuggguguuccuggcaguuuaaaaaaauugguuggagaauuuagguuuuuauuaguaccau

SEQ ID NO: 446051 - RNA, 59 nt, Homo Sapiens; identical to SEQ ID NO: 445473

SEQ ID NO: 446052 - RNA, 66 nt, Homo Sapiens
ccaguguggugaugccaugcccaucaugggaggcuuuuggagaaacagaauguuugggcaggggcu

SEQ ID NO: 446053 - RNA, 66 nt, Homo Sapiens
gcaucuuccacuggaacguuucacugcaaacacaccuuggagaaguggcaucagucaacagagagg

SEQ ID NO: 446054 - RNA, 66 nt, Homo Sapiens
ggugaagccagcugggcuccugagucugguggggacuuggagaaccuuuaugucuagcuaagggau

SEQ ID NO: 446055 - RNA, 66 nt, Homo Sapiens
aauccacacucuguaucuggcuacucugguggggacuuggagaaccuuuguguccacacucuguau

SEQ ID NO: 446056 - RNA, 66 nt, Homo Sapiens
caaacacccuccuggcacaacgcucuacccugcagcuuggagaacuccgcuggauggggagucuca

SEQ ID NO: 446057 - RNA, 66 nt, Homo Sapiens
agguggaucaccugaauucucucagcugucaauggcuuggagaacaucucaugggcccaagucauc

SEQ ID NO: 446058 - RNA, 66 nt, Homo Sapiens
cuuuuguugaaauagcuuuacuguuucucaaguguuuuggagaaaaaaaucaacccugcaaucacu

SEQ ID NO: 446059 - RNA, 66 nt, Homo Sapiens
uguuggccaaagugaaggaaucuuuuuucaguuuuauuggagaaacugaaggguaacauucuaaca

SEQ ID NO: 446060 - RNA, 66 nt, Homo Sapiens
ccggcuguggcugacaguggcucuggccaggguugcuuggagaaggcucagugugccugggacagg

SEQ ID NO: 446061 - RNA, 66 nt, Homo Sapiens
uuaauuuccaaaucaggaaccauuggacuggaauguuuggagaauggggaaagcggauaaaacuuu

SEQ ID NO: 446062 - RNA, 66 nt, Homo Sapiens
gugaaguuuguuuuuucgccggauggacuuaucccuuuggagaagaauuguuuguaguuacauuua

SEQ ID NO: 446063 - RNA, 66 nt, Homo Sapiens
uggauggccuuaggguuccuggggugcagccagcuuuuggagaaccuggcggccuggccuagacca

SEQ ID NO: 446064 - RNA, 66 nt, Homo Sapiens
agcugcugagcauggcuuucacgcugcuggccagcauuggagaagagcuuugugacuuggaaaggu

SEQ ID NO: 446065 - RNA, 66 nt, Homo Sapiens
agcucacugcucucuagaaaaguccccugcucaccauuggagaaucgcaggucccaguucacaugu

SEQ ID NO: 446066 - RNA, 66 nt, Homo Sapiens
uggugcugaaauccaccuuuccuuguugccgucgaguuggagaaagcuaaccggccucaugacuag

SEQ ID NO: 446067 - RNA, 66 nt, Homo Sapiens
aaguuugugauuaguccuuauggauucaggauguuguuggagaaacaugugugauggugcaaggaa

SEQ ID NO: 446068 - RNA, 66 nt, Homo Sapiens
gguggccucgccggagcuagagggaccgcaugccgcuuggagaaggagcugccugacugccucagc

SEQ ID NO: 446069 - RNA, 66 nt, Homo Sapiens
gaguacauuuuuaaaauuuuagaggcauuucaggaguuggagaacgcccuuuucuccagcaacugc

SEQ ID NO: 446070 - RNA, 66 nt, Homo Sapiens
uacagcaucauggaugcugucuaugaucagggaauuuuggagaaacagcggauggugaggacacag

SEQ ID NO: 446071 - RNA, 66 nt, Homo Sapiens
gauucccaaguccaggaagaccaucugguuuaauuauuggagaaucgaaagacauaaacuuggagu

SEQ ID NO: 446072 - RNA, 66 nt, Homo Sapiens
uuuuacuuuuccucagaagauugagcugucuuuuauuuggagaauaaaaugaaguucugaaaaaaa

SEQ ID NO: 446073 - RNA, 66 nt, Homo Sapiens
aguuugccaagaagugaucuguuuuaaaggucauauuuggagaaagggcaaggaauugggucugcu

SEQ ID NO: 446074 - RNA, 66 nt, Homo Sapiens
auuggauguguuugggggcggggggauggaagugacuuggagaauguguuugggaugaaauaacua

SEQ ID NO: 446075 - RNA, 66 nt, Homo Sapiens
auuuauaaaccacugaaagggauagagaagugaacauuggagaaagccaguagcaacugugagaaa

SEQ ID NO: 446076 - RNA, 66 nt, Homo Sapiens
uguggaggaucaguagcuguuaugaugccagaccauuuggagaaguaucagaggccugaccggaca

SEQ ID NO: 446077 - RNA, 66 nt, Homo Sapiens
uccaagcccuuggggugacucggcuuccaggagcuguuggagaaaugaggaugucugucccugucu

SEQ ID NO: 446078 - RNA, 66 nt, Homo Sapiens
ggcauuccuacuggagaaaauaucugacuuggaaaguuggagaagaucucaacugcugguagcauu

SEQ ID NO: 446079 - RNA, 66 nt, Homo Sapiens
gaggcuggcugggggagaaauuggaggagggcuuguuuggagaaggccacagguguggguguccug

SEQ ID NO: 446080 - RNA, 66 nt, Homo Sapiens
cugauuccuuuuuuguugucggggacagggccaguguuggagaauugggggcucggaccccucacu

SEQ ID NO: 446081 - RNA, 66 nt, Homo Sapiens
gcuuuggcagaagagugaaacucugcucugugggguuuggagaaauaucagugagaauucgugcau

SEQ ID NO: 446082 - RNA, 66 nt, Homo Sapiens
caccucuggcucuugugcuuagacacaggugcagcuuuggagaacuggucuuguguaaacguuugc

SEQ ID NO: 446083 - RNA, 66 nt, Homo Sapiens
gacauggggcugaaucucagauugaaaggugguugcuuggagaaggaaggggaagaugcuggacuc

SEQ ID NO: 446084 - RNA, 66 nt, Homo Sapiens
ucacccuuucccuuuuucuuuaggaaaucugccuuauuggagaaaaauccaaaaacuacauauuug

SEQ ID NO: 446085 - RNA, 66 nt, Homo Sapiens
ggaucuguccaauaaacgcuuaaccugcucuaaacuuuggagaacuauacuccauagcuaccaagu

SEQ ID NO: 446086 - RNA, 66 nt, Homo Sapiens
agaggagagaaaagagggccgggugugcacauauguuuggagaaauaauugccacucaguuccucu

SEQ ID NO: 446087 - RNA, 66 nt, Homo Sapiens
aggguagagagagguugcuagaaggcagaagugaauuuggagaacuugccagauaucaaaccugag

SEQ ID NO: 446088 - RNA, 66 nt, Homo Sapiens
acaaggguuuuguccugaauuuaaaaaccccaccauuuggagaauuggaguugaaguccaaccuau

SEQ ID NO: 446089 - RNA, 66 nt, Homo Sapiens
uguugcugagaccccccccccacccuccagcuccucuuggagaagccccagccuucaugccuuccc

SEQ ID NO: 446090 - RNA, 66 nt, Homo Sapiens
caaggaaggcggaagaauggccccuaucaggugguuuuggagaaaaccucagaaaucaggacaucc

SEQ ID NO: 446091 - RNA, 66 nt, Homo Sapiens
auuuuuuuuuuaaauaauauccagugcagaauauuuuuggagaacgcuauuaacaacugaggaagg

SEQ ID NO: 446092 - RNA, 66 nt, Homo Sapiens
uuaauguuuuucauuuaucaugcauaccuuguucaauuggagaauuaacaacaacauaaaaauccu

SEQ ID NO: 446093 - RNA, 66 nt, Homo Sapiens
gcauguguggggugugugugcauguguucuggucacuuggagaagguguacaccuggcaucugugg

SEQ ID NO: 446094 - RNA, 66 nt, Homo Sapiens
gugugugugggaugcguguguguguguccuagucacuuggagaagguggugugggcgcgucugugg

SEQ ID NO: 446095 - RNA, 66 nt, Homo Sapiens
aucugaugccuuuuucuuugccugagccucaggcuguuggagaagcgggaacugucugcccaggag

SEQ ID NO: 446096 - RNA, 66 nt, Homo Sapiens
uuuauggaagcauguguaaaauuauacuuucaguaauuggagaauucagagauugcauuucuagca

SEQ ID NO: 446097 - RNA, 66 nt, Homo Sapiens
uaccuuguauugugauauuaacuggcaaagauccucuuggagaaaccuuucccagguacaguuuca

SEQ ID NO: 446098 - RNA, 66 nt, Homo Sapiens
gauaaugaagcugauuuuuuagcugagauagaagcuuuggagaaaaugaaugaagaucacguucag

SEQ ID NO: 446099 - RNA, 66 nt, Homo Sapiens
auuucguuuuuguuucccuuuaguauuuaauggucuuuggagaaaaaauaauaaaacagaguguua

SEQ ID NO: 446100 - RNA, 66 nt, Homo Sapiens
ccucagaauucagaagauaugccacuaccucccagcuuggagaacagauuuugccucccacaccca

SEQ ID NO: 446101 - RNA, 66 nt, Homo Sapiens
ggugcuaguuggcaauagauccucacacacuuugauuuggagaauuggauugcacgaguguguuuu

SEQ ID NO: 446102 - RNA, 66 nt, Homo Sapiens
uguucacagagauggaugcauguucugauugccucuuuggagaagcucaucagaaacucaaaagaa

SEQ ID NO: 446103 - RNA, 66 nt, Homo Sapiens
cugagcaucguggaugggugcacggagacacgcaccuuggagaaaugaggggagauggaccaagaa

SEQ ID NO: 446104 - RNA, 66 nt, Homo Sapiens
auaggguuguuacaacugucacuagcggaggucacuuuggagaagggugggccuuacauccagugu

SEQ ID NO: 446105 - RNA, 66 nt, Homo Sapiens
gucaauaaaauugcugggaauauuugacucuccguauuggagaaaauaaaauuacaacauuacgac

SEQ ID NO: 446106 - RNA, 66 nt, Homo Sapiens
aacaucauuacuggaaaccuauuaaacauuagcaaauuggagaauaguuuuaauauaguaaaugua

SEQ ID NO: 446107 - RNA, 66 nt, Homo Sapiens
ggugguagcgcugggggugauuuuaggcagcaagaauuggagaacucacacugcgaaaagaaaacc

SEQ ID NO: 446108 - RNA, 66 nt, Homo Sapiens
uguuggggugugaaagccucaagugacucagccugguuggagaacugccccacccaguaucuucug

SEQ ID NO: 446109 - RNA, 66 nt, Homo Sapiens
caaagucuucaguaacgcuacaacgauugcaaaucauuggagaauccauaaugaagagagaucuuc

SEQ ID NO: 446110 - RNA, 66 nt, Homo Sapiens
acaacucaaaucauauuagacaucggagaaaucacuuuggagaaaggucuuuugagugcacugagu

SEQ ID NO: 446111 - RNA, 66 nt, Homo Sapiens
aaaaagccagggugugccagcacccuccugcuggccuuggagaagcgccuaaucaggugagccacu

SEQ ID NO: 446112 - RNA, 66 nt, Homo Sapiens
cuuuuauaucaaaaguggagcacauuugccccccauuuggagaaugcagacuccacagugacuugc

SEQ ID NO: 446113 - RNA, 66 nt, Homo Sapiens
uugugcacuaucacugggaaucaaggauguggaauguuggagaacaauggaaaacaagaaauacug

SEQ ID NO: 446114 - RNA, 66 nt, Homo Sapiens
uugaaugcuaccccccaaguuauugauuuaggggcuuuggagaacuguccguauaagcucaaugag

SEQ ID NO: 446115 - RNA, 66 nt, Homo Sapiens
acccugcaaauguaauaaaucaucagggaauucagauuggagaaaaguuacuuaaacuuuguucaa

SEQ ID NO: 446116 - RNA, 66 nt, Homo Sapiens
cuauagcccuuuaguuauuuuucauuuuguuuuuaguuggagaacuauuuuauuuaguuagaacac

SEQ ID NO: 446117 - RNA, 66 nt, Homo Sapiens
acucuaugaauagaauauacccugggaaaaauaauguuggagaaauguggacuacagcuuauucag

SEQ ID NO: 446118 - RNA, 66 nt, Homo Sapiens
uagugucagaauugaauuauuggagucugcacuaacuuggagaaguacuuggacugcacuaacuug

SEQ ID NO: 446119 - RNA, 66 nt, Homo Sapiens
cauaaugaagagagaucuuacaacgauuacaaaucauuggagaauccaaagucuucaguaaugcua

SEQ ID NO: 446120 - RNA, 66 nt, Homo Sapiens
uauaaugaauaaagaucuaacaaccauugcaaaucauuggagaauccaaagucuucaguaacgcua

SEQ ID NO: 446121 - RNA, 66 nt, Homo Sapiens
cauaaugagagaucuuacaacaaccauugcaaaucauuggagaauccaaaguuuucaguaaugcua

SEQ ID NO: 446122 - RNA, 66 nt, Homo Sapiens
cacagugaagagaucuuacacaaccauugcacaucauuggagaauccaaaguuuucaguaaugcua

SEQ ID NO: 446123 - RNA, 66 nt, Homo Sapiens
acuugaagaauguaaugccagacuuacuucucccucuuggagaaagccuaggcuaauugugacugu

SEQ ID NO: 446124 - RNA, 66 nt, Homo Sapiens
cccucuagaaacauauuggcccuggguucaagagaguuggagaaacgcuguacuuguaccuaaggc

SEQ ID NO: 446125 - RNA, 66 nt, Homo Sapiens
cacaccugaguaagauccugccagucucauuaaauauuggagaauaggcuuaugagugcagugagu

SEQ ID NO: 446126 - RNA, 66 nt, Homo Sapiens
ucuugugaauuacacagcaaaauugguaacucccucuuggagaauuucauggguaaauauguguug

SEQ ID NO: 446127 - RNA, 66 nt, Homo Sapiens
cgucaugugagugaagagaugucacugucuguggucuuggagaacuagucucguagcugaggggug

SEQ ID NO: 446128 - RNA, 66 nt, Homo Sapiens
agccaaccaccuugaaaccuuuagaacaucucugcuuuggagaaagacccagagaucaggcagagg

SEQ ID NO: 446129 - RNA, 66 nt, Homo Sapiens
caagauguuaaaacagucccguggaaggagcagggguuggagaaaggcaucccaaagcuucgaugg

SEQ ID NO: 446130 - RNA, 66 nt, Homo Sapiens
cacucucagagacucccaggaguuguugaacuauauuuggagaaaacagccacugaauauuaucau

SEQ ID NO: 446131 - RNA, 66 nt, Homo Sapiens
cuugggguaaaugcuuugaggcccagggaccaaucuuuggagaaaguagauauuuccaucaaagcc

SEQ ID NO: 446132 - RNA, 66 nt, Homo Sapiens
gaugcgaauacagcucacagagaaacgcaugugcuauuggagaacaggucuuuguggagaucuaaa

SEQ ID NO: 446133 - RNA, 66 nt, Homo Sapiens
cauguaacauuuaaacauuaauuuaaaaagggaaccuuggagaauucuuuuguucacuaguuccuu

SEQ ID NO: 446134 - RNA, 66 nt, Homo Sapiens
gacugcagcgccaagcggcauccaccaagcaucaaguuggagaaaagggaacccaagcaguagaga

SEQ ID NO: 446135 - RNA, 66 nt, Homo Sapiens
acucuagguuuccaggccucacagccaagcugaagcuuggagaaaacucugcauucccaugagggc

SEQ ID NO: 446136 - RNA, 66 nt, Homo Sapiens
ggaggcugaggugggagaaucacuugaguccuggaguuggagaacagccuggaaagccuggcgaua

SEQ ID NO: 446137 - RNA, 66 nt, Homo Sapiens
acugagcaccuuggugagcaagccuggcuuuaaagauuggagaagagcuucuggcaccagaacccu

SEQ ID NO: 446138 - RNA, 66 nt, Homo Sapiens
uuaccuuugcaguguugccgaaucacagcaguucuguuggagaaacgcuugguuuccggauccaga

SEQ ID NO: 446139 - RNA, 66 nt, Homo Sapiens
caaauuuccucccugccucaugugagaccacaggguuuggagaagcaguuggaacccacguguggu

SEQ ID NO: 446140 - RNA, 66 nt, Homo Sapiens
uggaaagccacuuacuggcuuuugacaugacuucucuuggagaauaaguggacuccaagcuaacuc

SEQ ID NO: 446141 - RNA, 65 nt, Homo Sapiens; identical to SEQ ID NO: 445563

SEQ ID NO: 446142 - RNA, 66 nt, Homo Sapiens
ucucuucugguaauuuuuaucaauugagaaaaugauuuggagaacucaaacaccuccugaguuuug

SEQ ID NO: 446143 - RNA, 66 nt, Homo Sapiens
gggaggccucuuggagacaccagaaccuccuucucuuuggagaaugccucuuccucuccaaagcgc

SEQ ID NO: 446144 - RNA, 66 nt, Homo Sapiens
ccuccuuguugcaugaggucauaaggguuucucaaauuggagaaccuugggacugguggugccaag

SEQ ID NO: 446145 - RNA, 66 nt, Homo Sapiens
agaauuauccccacuucacacauguuuggccuuguguuggagaaagcuccuguacaugaaccaggu

SEQ ID NO: 446146 - RNA, 66 nt, Homo Sapiens
gauggucaguuagccugucuaaagaauguuuugguauuggagaaggcaaccaaccccaacaacaaa

SEQ ID NO: 446147 - RNA, 66 nt, Homo Sapiens
accgcaugaagauacuuguauccuuggugguugaacuuggagaaagagaccugccagcucucggag

SEQ ID NO: 446148 - RNA, 66 nt, Homo Sapiens
ccaguuaucuuuagcagauauuaaaaauugaaaacuuuggagaacucauuucaaguuaugauucag

SEQ ID NO: 446149 - RNA, 66 nt, Homo Sapiens
ugugccuucagcaggacucuuaauaucugcugcaacuuggagaaccucccugcccugaaaugugaa

SEQ ID NO: 446150 - RNA, 66 nt, Homo Sapiens
cauuacaaacacgggcggaaggcacucaggcuuucguuggagaaacagaaauaaggccuucuuuug

SEQ ID NO: 446151 - RNA, 66 nt, Homo Sapiens
gauuucugaggagugugugacauucccuacagauuuuuggagaaagcuguaggaagaaaaaggaug

SEQ ID NO: 446152 - RNA, 66 nt, Homo Sapiens
caugaagagguauucaucuguuagaacgacuucacguuggagaaagagaaacucauucuuacgaaa

SEQ ID NO: 446153 - RNA, 66 nt, Homo Sapiens
uguggcuggaacacaaacaagcuuggguggguuccuuuggagaagaugcagcaagccugcacacgg

SEQ ID NO: 446154 - RNA, 66 nt, Homo Sapiens
gucucgcugggaccuggucccuuuguugcaggcggcuuggagaaagggcagugggacgcuggccac

SEQ ID NO: 446155 - RNA, 66 nt, Homo Sapiens
uggccaguugcagguuaagccccagaaaaguucaccuuggagaagcuccgagaacacacagauugu

SEQ ID NO: 446156 - RNA, 66 nt, Homo Sapiens
aaucaagaauauuuguggagguagguguggggaagguuggagaagaguuagguuugugcuuuguaa

SEQ ID NO: 446157 - RNA, 66 nt, Homo Sapiens
aaauuggcucuuuggaggcgagaggaaggggagaacuuggagaauaguuuuugcuuuggggguaga

SEQ ID NO: 446158 - RNA, 66 nt, Homo Sapiens
cccuccccuacuucucccuugcucccaaagcuuuccuuggagaagggcccuccugcagcuggaccc

SEQ ID NO: 446159 - RNA, 66 nt, Homo Sapiens
gcugcuacuuaacaaggaagcaggcuugugcuccccuuggagaaggugcuggaggcugugugcggg

SEQ ID NO: 446160 - RNA, 66 nt, Homo Sapiens
ggaaagcuccaucaaagaggggaaauucggcaagacuuggagaaaaaacaucaaugcuuuuccuca

SEQ ID NO: 446161 - RNA, 66 nt, Homo Sapiens
gccagcugcccuuucgucccggccuacagcugaagguuggagaaaugaucuuuuccaaguucccaa

SEQ ID NO: 446162 - RNA, 66 nt, Homo Sapiens
gaaggccgucuccccuuagccaaguccuccucaggcuuggagaacuuccucagcgucaccuccuuc

SEQ ID NO: 446163 - RNA, 66 nt, Homo Sapiens
gagucgcgcaccgaaaaacuaaaaauaaugggcgcuuuggagaagaguguggagucauucucauug

SEQ ID NO: 446164 - RNA, 66 nt, Homo Sapiens
auuuuuuauuucagucacuccugauaaauaacaaauuuggagaaauaaaaauaucuaaaauaaauu

SEQ ID NO: 446165 - RNA, 66 nt, Homo Sapiens
agaaagggcacuuggcaaccacuaugugaagggugauuggagaaggacaagacuguggaaugggga

SEQ ID NO: 446166 - RNA, 66 nt, Homo Sapiens
acaagacuguggaauggggaauaaggaaggaggaguuuggagaaugacuccaaagguuugagcuug

SEQ ID NO: 446167 - RNA, 66 nt, Homo Sapiens
gcggugaggcacucuggaauaugacccuaccagagguuggagaacaaacuugggcagccggaaccc

SEQ ID NO: 446168 - RNA, 66 nt, Homo Sapiens
cccugaugaucaaccugccuccccuccauagucuuguuggagaagcccagagagaaugggacucca

SEQ ID NO: 446169 - RNA, 66 nt, Homo Sapiens
ggagauggcgucuaccagaaggggauggacuucauuuuggagaagcucaaccauggggacugggug

SEQ ID NO: 446170 - RNA, 66 nt, Homo Sapiens
gaaaauuauuucuuggggaucuaaucagauuuuaccuuggagaaaugaacucaaugaaauaagcug

SEQ ID NO: 446171 - RNA, 66 nt, Homo Sapiens
auggacugaucuuuaaacuagaaguuagggguuuuguuggagaaaaagugcaauuuuuaaaaucua

SEQ ID NO: 446172 - RNA, 66 nt, Homo Sapiens
uauuggacuuuguccucucugaaugaacugagcaauuuggagaaugacacaagacucucagguaua

SEQ ID NO: 446173 - RNA, 66 nt, Homo Sapiens
gcaaguuauauguucacaaacaagcagccaauuuuauuggagaaaaaauugccuucuuugccuagc

SEQ ID NO: 446174 - RNA, 66 nt, Homo Sapiens
ucaacaugucuccuacugagaaauguuugcugaacauuggagaaucccuugguuggaagggaauag

SEQ ID NO: 446175 - RNA, 66 nt, Homo Sapiens
cuugcaguuaucuuagcauuacuacugcucuaaaaguuggagaaguugugugcaauauucuuaaau

SEQ ID NO: 446176 - RNA, 66 nt, Homo Sapiens
cucacguuuuuuaacucaugcauauagauugaguacuuggagaauaaaugaaugagcaacaccaug

SEQ ID NO: 446177 - RNA, 66 nt, Homo Sapiens
acauuucuuuacagguuaaaacacugcucuaguuucuuggagaaucaggagggauagaacaucaca

SEQ ID NO: 446178 - RNA, 66 nt, Homo Sapiens
uuacaaccuggguugcagaauugcacagaugcugcuuuggagaacuagauaaaacucagaggaaau

SEQ ID NO: 446179 - RNA, 66 nt, Homo Sapiens
ggcuaggacagggaacaggggagccugaguacaggcuuggagaaauuucucuguugaucacagagg

SEQ ID NO: 446180 - RNA, 66 nt, Homo Sapiens
uaagaacuuaacaauaaagcugcaauagguauuuucuuggagaaugucuuccaucuugcugugauu

SEQ ID NO: 446181 - RNA, 66 nt, Homo Sapiens
cguuuuuaacugcaacuuuccauuugucuuuuuauuuuggagaaagacuguauaugcuggguauuu

SEQ ID NO: 446182 - RNA, 66 nt, Homo Sapiens
auucauauaauuaaaaagaauuugguuaauaagaauuuggagaauggaaaauacauuuuuagguuc

SEQ ID NO: 446183 - RNA, 63 nt, Homo Sapiens; identical to SEQ ID NO: 444889

SEQ ID NO: 446184 - RNA, 63 nt, Homo Sapiens; identical to SEQ ID NO: 444890

SEQ ID NO: 446185 - RNA, 63 nt, Homo Sapiens; identical to SEQ ID NO: 444891

SEQ ID NO: 446186 - RNA, 63 nt, Homo Sapiens; identical to SEQ ID NO: 444892

SEQ ID NO: 446187 - RNA, 63 nt, Homo Sapiens; identical to SEQ ID NO: 444893

SEQ ID NO: 446188 - RNA, 63 nt, Homo Sapiens; identical to SEQ ID NO: 444894

SEQ ID NO: 446189 - RNA, 63 nt, Homo Sapiens; identical to SEQ ID NO: 444895

SEQ ID NO: 446190 - RNA, 63 nt, Homo Sapiens; identical to SEQ ID NO: 444896

SEQ ID NO: 446191 - RNA, 63 nt, Homo Sapiens; identical to SEQ ID NO: 444897

SEQ ID NO: 446192 - RNA, 63 nt, Homo Sapiens; identical to SEQ ID NO: 444898

SEQ ID NO: 446193 - RNA, 63 nt, Homo Sapiens; identical to SEQ ID NO: 444899

SEQ ID NO: 446194 - RNA, 63 nt, Homo Sapiens; identical to SEQ ID NO: 444900

SEQ ID NO: 446195 - RNA, 63 nt, Homo Sapiens; identical to SEQ ID NO: 444901

SEQ ID NO: 446196 - RNA, 63 nt, Homo Sapiens; identical to SEQ ID NO: 444902

SEQ ID NO: 446197 - RNA, 63 nt, Homo Sapiens; identical to SEQ ID NO: 444903

SEQ ID NO: 446198 - RNA, 63 nt, Homo Sapiens; identical to SEQ ID NO: 444904

SEQ ID NO: 446199 - RNA, 63 nt, Homo Sapiens; identical to SEQ ID NO: 444905

SEQ ID NO: 446200 - RNA, 63 nt, Homo Sapiens; identical to SEQ ID NO: 444906

SEQ ID NO: 446201 - RNA, 63 nt, Homo Sapiens; identical to SEQ ID NO: 444907

SEQ ID NO: 446202 - RNA, 63 nt, Homo Sapiens; identical to SEQ ID NO: 444908

SEQ ID NO: 446203 - RNA, 63 nt, Homo Sapiens; identical to SEQ ID NO: 444909

SEQ ID NO: 446204 - RNA, 63 nt, Homo Sapiens; identical to SEQ ID NO: 444910

SEQ ID NO: 446205 - RNA, 63 nt, Homo Sapiens; identical to SEQ ID NO: 444911

SEQ ID NO: 446206 - RNA, 63 nt, Homo Sapiens; identical to SEQ ID NO: 444912

SEQ ID NO: 446207 - RNA, 63 nt, Homo Sapiens; identical to SEQ ID NO: 444913

SEQ ID NO: 446208 - RNA, 63 nt, Homo Sapiens; identical to SEQ ID NO: 444914

SEQ ID NO: 446209 - RNA, 63 nt, Homo Sapiens; identical to SEQ ID NO: 444915

SEQ ID NO: 446210 - RNA, 63 nt, Homo Sapiens; identical to SEQ ID NO: 444916

SEQ ID NO: 446211 - RNA, 63 nt, Homo Sapiens; identical to SEQ ID NO: 444917

SEQ ID NO: 446212 - RNA, 63 nt, Homo Sapiens; identical to SEQ ID NO: 444918

SEQ ID NO: 446213 - RNA, 63 nt, Homo Sapiens; identical to SEQ ID NO: 444919

SEQ ID NO: 446214 - RNA, 63 nt, Homo Sapiens; identical to SEQ ID NO: 444920

SEQ ID NO: 446215 - RNA, 62 nt, Homo Sapiens; identical to SEQ ID NO: 444921

SEQ ID NO: 446216 - RNA, 63 nt, Homo Sapiens; identical to SEQ ID NO: 444922

SEQ ID NO: 446217 - RNA, 63 nt, Homo Sapiens; identical to SEQ ID NO: 444923

SEQ ID NO: 446218 - RNA, 63 nt, Homo Sapiens; identical to SEQ ID NO: 444924

SEQ ID NO: 446219 - RNA, 63 nt, Homo Sapiens; identical to SEQ ID NO: 444925

SEQ ID NO: 446220 - RNA, 63 nt, Homo Sapiens; identical to SEQ ID NO: 444926

SEQ ID NO: 446221 - RNA, 63 nt, Homo Sapiens; identical to SEQ ID NO: 444927

SEQ ID NO: 446222 - RNA, 63 nt, Homo Sapiens; identical to SEQ ID NO: 444928

SEQ ID NO: 446223 - RNA, 63 nt, Homo Sapiens; identical to SEQ ID NO: 444929

SEQ ID NO: 446224 - RNA, 63 nt, Homo Sapiens; identical to SEQ ID NO: 444930

SEQ ID NO: 446225 - RNA, 63 nt, Homo Sapiens; identical to SEQ ID NO: 444931

SEQ ID NO: 446226 - RNA, 63 nt, Homo Sapiens; identical to SEQ ID NO: 444932

SEQ ID NO: 446227 - RNA, 63 nt, Homo Sapiens; identical to SEQ ID NO: 444933

SEQ ID NO: 446228 - RNA, 63 nt, Homo Sapiens; identical to SEQ ID NO: 444934

SEQ ID NO: 446229 - RNA, 63 nt, Homo Sapiens; identical to SEQ ID NO: 444935

SEQ ID NO: 446230 - RNA, 63 nt, Homo Sapiens; identical to SEQ ID NO: 444936

SEQ ID NO: 446231 - RNA, 63 nt, Homo Sapiens; identical to SEQ ID NO: 444937

SEQ ID NO: 446232 - RNA, 63 nt, Homo Sapiens; identical to SEQ ID NO: 444938

SEQ ID NO: 446233 - RNA, 63 nt, Homo Sapiens; identical to SEQ ID NO: 444939

SEQ ID NO: 446234 - RNA, 63 nt, Homo Sapiens; identical to SEQ ID NO: 444940

SEQ ID NO: 446235 - RNA, 63 nt, Homo Sapiens; identical to SEQ ID NO: 444941

SEQ ID NO: 446236 - RNA, 63 nt, Homo Sapiens; identical to SEQ ID NO: 444942

SEQ ID NO: 446237 - RNA, 63 nt, Homo Sapiens; identical to SEQ ID NO: 444943

SEQ ID NO: 446238 - RNA, 63 nt, Homo Sapiens; identical to SEQ ID NO: 444944

SEQ ID NO: 446239 - RNA, 63 nt, Homo Sapiens; identical to SEQ ID NO: 444945

SEQ ID NO: 446240 - RNA, 63 nt, Homo Sapiens; identical to SEQ ID NO: 444946

SEQ ID NO: 446241 - RNA, 63 nt, Homo Sapiens; identical to SEQ ID NO: 444947

SEQ ID NO: 446242 - RNA, 63 nt, Homo Sapiens; identical to SEQ ID NO: 444948

SEQ ID NO: 446243 - RNA, 63 nt, Homo Sapiens; identical to SEQ ID NO: 444949

SEQ ID NO: 446244 - RNA, 63 nt, Homo Sapiens; identical to SEQ ID NO: 444950

SEQ ID NO: 446245 - RNA, 63 nt, Homo Sapiens; identical to SEQ ID NO: 444951

SEQ ID NO: 446246 - RNA, 63 nt, Homo Sapiens; identical to SEQ ID NO: 444952

SEQ ID NO: 446247 - RNA, 63 nt, Homo Sapiens; identical to SEQ ID NO: 444953

SEQ ID NO: 446248 - RNA, 63 nt, Homo Sapiens; identical to SEQ ID NO: 444954

SEQ ID NO: 446249 - RNA, 63 nt, Homo Sapiens; identical to SEQ ID NO: 444955

SEQ ID NO: 446250 - RNA, 63 nt, Homo Sapiens; identical to SEQ ID NO: 444956

SEQ ID NO: 446251 - RNA, 63 nt, Homo Sapiens; identical to SEQ ID NO: 444957

SEQ ID NO: 446252 - RNA, 63 nt, Homo Sapiens; identical to SEQ ID NO: 444958

SEQ ID NO: 446253 - RNA, 63 nt, Homo Sapiens; identical to SEQ ID NO: 444959

SEQ ID NO: 446254 - RNA, 63 nt, Homo Sapiens; identical to SEQ ID NO: 444960

SEQ ID NO: 446255 - RNA, 63 nt, Homo Sapiens; identical to SEQ ID NO: 444961

SEQ ID NO: 446256 - RNA, 63 nt, Homo Sapiens; identical to SEQ ID NO: 444962

SEQ ID NO: 446257 - RNA, 63 nt, Homo Sapiens; identical to SEQ ID NO: 444963

SEQ ID NO: 446258 - RNA, 63 nt, Homo Sapiens; identical to SEQ ID NO: 444964

SEQ ID NO: 446259 - RNA, 63 nt, Homo Sapiens; identical to SEQ ID NO: 444965

SEQ ID NO: 446260 - RNA, 63 nt, Homo Sapiens; identical to SEQ ID NO: 444966

SEQ ID NO: 446261 - RNA, 63 nt, Homo Sapiens; identical to SEQ ID NO: 444967

SEQ ID NO: 446262 - RNA, 63 nt, Homo Sapiens; identical to SEQ ID NO: 444968

SEQ ID NO: 446263 - RNA, 63 nt, Homo Sapiens; identical to SEQ ID NO: 444969

SEQ ID NO: 446264 - RNA, 63 nt, Homo Sapiens; identical to SEQ ID NO: 444970

SEQ ID NO: 446265 - RNA, 63 nt, Homo Sapiens; identical to SEQ ID NO: 444971

SEQ ID NO: 446266 - RNA, 63 nt, Homo Sapiens; identical to SEQ ID NO: 444972

SEQ ID NO: 446267 - RNA, 63 nt, Homo Sapiens; identical to SEQ ID NO: 444973

SEQ ID NO: 446268 - RNA, 63 nt, Homo Sapiens; identical to SEQ ID NO: 444974

SEQ ID NO: 446269 - RNA, 63 nt, Homo Sapiens; identical to SEQ ID NO: 444975

SEQ ID NO: 446270 - RNA, 63 nt, Homo Sapiens; identical to SEQ ID NO: 444976

SEQ ID NO: 446271 - RNA, 63 nt, Homo Sapiens; identical to SEQ ID NO: 444977

SEQ ID NO: 446272 - RNA, 63 nt, Homo Sapiens; identical to SEQ ID NO: 444978

SEQ ID NO: 446273 - RNA, 63 nt, Homo Sapiens; identical to SEQ ID NO: 444979

SEQ ID NO: 446274 - RNA, 63 nt, Homo Sapiens; identical to SEQ ID NO: 444980

SEQ ID NO: 446275 - RNA, 63 nt, Homo Sapiens; identical to SEQ ID NO: 444981

SEQ ID NO: 446276 - RNA, 63 nt, Homo Sapiens; identical to SEQ ID NO: 444982

SEQ ID NO: 446277 - RNA, 63 nt, Homo Sapiens; identical to SEQ ID NO: 444983

SEQ ID NO: 446278 - RNA, 63 nt, Homo Sapiens; identical to SEQ ID NO: 444984

SEQ ID NO: 446279 - RNA, 63 nt, Homo Sapiens; identical to SEQ ID NO: 444985

SEQ ID NO: 446280 - RNA, 63 nt, Homo Sapiens; identical to SEQ ID NO: 444986

SEQ ID NO: 446281 - RNA, 63 nt, Homo Sapiens; identical to SEQ ID NO: 444987

SEQ ID NO: 446282 - RNA, 63 nt, Homo Sapiens; identical to SEQ ID NO: 444988

SEQ ID NO: 446283 - RNA, 63 nt, Homo Sapiens; identical to SEQ ID NO: 444989

SEQ ID NO: 446284 - RNA, 63 nt, Homo Sapiens; identical to SEQ ID NO: 444990

SEQ ID NO: 446285 - RNA, 63 nt, Homo Sapiens; identical to SEQ ID NO: 444991

SEQ ID NO: 446286 - RNA, 63 nt, Homo Sapiens; identical to SEQ ID NO: 444992

SEQ ID NO: 446287 - RNA, 63 nt, Homo Sapiens; identical to SEQ ID NO: 444993

SEQ ID NO: 446288 - RNA, 63 nt, Homo Sapiens; identical to SEQ ID NO: 444994

SEQ ID NO: 446289 - RNA, 63 nt, Homo Sapiens; identical to SEQ ID NO: 444995

SEQ ID NO: 446290 - RNA, 63 nt, Homo Sapiens; identical to SEQ ID NO: 444996

SEQ ID NO: 446291 - RNA, 63 nt, Homo Sapiens; identical to SEQ ID NO: 444997

SEQ ID NO: 446292 - RNA, 63 nt, Homo Sapiens; identical to SEQ ID NO: 444998

SEQ ID NO: 446293 - RNA, 63 nt, Homo Sapiens; identical to SEQ ID NO: 444999

SEQ ID NO: 446294 - RNA, 63 nt, Homo Sapiens; identical to SEQ ID NO: 445000

SEQ ID NO: 446295 - RNA, 63 nt, Homo Sapiens; identical to SEQ ID NO: 445001

SEQ ID NO: 446296 - RNA, 63 nt, Homo Sapiens; identical to SEQ ID NO: 445002

SEQ ID NO: 446297 - RNA, 63 nt, Homo Sapiens; identical to SEQ ID NO: 445003

SEQ ID NO: 446298 - RNA, 63 nt, Homo Sapiens; identical to SEQ ID NO: 445004

SEQ ID NO: 446299 - RNA, 63 nt, Homo Sapiens; identical to SEQ ID NO: 445005

SEQ ID NO: 446300 - RNA, 63 nt, Homo Sapiens; identical to SEQ ID NO: 445006

SEQ ID NO: 446301 - RNA, 63 nt, Homo Sapiens; identical to SEQ ID NO: 445007

SEQ ID NO: 446302 - RNA, 63 nt, Homo Sapiens; identical to SEQ ID NO: 445008

SEQ ID NO: 446303 - RNA, 63 nt, Homo Sapiens; identical to SEQ ID NO: 445009

SEQ ID NO: 446304 - RNA, 63 nt, Homo Sapiens; identical to SEQ ID NO: 445010

SEQ ID NO: 446305 - RNA, 63 nt, Homo Sapiens; identical to SEQ ID NO: 445011

SEQ ID NO: 446306 - RNA, 63 nt, Homo Sapiens; identical to SEQ ID NO: 445012

SEQ ID NO: 446307 - RNA, 63 nt, Homo Sapiens; identical to SEQ ID NO: 445013

SEQ ID NO: 446308 - RNA, 63 nt, Homo Sapiens; identical to SEQ ID NO: 445014

SEQ ID NO: 446309 - RNA, 63 nt, Homo Sapiens; identical to SEQ ID NO: 445015

SEQ ID NO: 446310 - RNA, 63 nt, Homo Sapiens; identical to SEQ ID NO: 445016

SEQ ID NO: 446311 - RNA, 63 nt, Homo Sapiens; identical to SEQ ID NO: 445017

SEQ ID NO: 446312 - RNA, 63 nt, Homo Sapiens; identical to SEQ ID NO: 445018

SEQ ID NO: 446313 - RNA, 63 nt, Homo Sapiens; identical to SEQ ID NO: 445019

SEQ ID NO: 446314 - RNA, 63 nt, Homo Sapiens; identical to SEQ ID NO: 445020

SEQ ID NO: 446315 - RNA, 63 nt, Homo Sapiens; identical to SEQ ID NO: 445021

SEQ ID NO: 446316 - RNA, 63 nt, Homo Sapiens; identical to SEQ ID NO: 445022

SEQ ID NO: 446317 - RNA, 63 nt, Homo Sapiens; identical to SEQ ID NO: 445023

SEQ ID NO: 446318 - RNA, 63 nt, Homo Sapiens; identical to SEQ ID NO: 445024

SEQ ID NO: 446319 - RNA, 63 nt, Homo Sapiens; identical to SEQ ID NO: 445025

SEQ ID NO: 446320 - RNA, 63 nt, Homo Sapiens; identical to SEQ ID NO: 445026

SEQ ID NO: 446321 - RNA, 65 nt, Homo Sapiens; identical to SEQ ID NO: 445027

SEQ ID NO: 446322 - RNA, 65 nt, Homo Sapiens; identical to SEQ ID NO: 445028

SEQ ID NO: 446323 - RNA, 65 nt, Homo Sapiens; identical to SEQ ID NO: 445029

SEQ ID NO: 446324 - RNA, 65 nt, Homo Sapiens; identical to SEQ ID NO: 445030

SEQ ID NO: 446325 - RNA, 65 nt, Homo Sapiens; identical to SEQ ID NO: 445031

SEQ ID NO: 446326 - RNA, 65 nt, Homo Sapiens; identical to SEQ ID NO: 445032

SEQ ID NO: 446327 - RNA, 65 nt, Homo Sapiens; identical to SEQ ID NO: 445033

SEQ ID NO: 446328 - RNA, 65 nt, Homo Sapiens; identical to SEQ ID NO: 445034

SEQ ID NO: 446329 - RNA, 65 nt, Homo Sapiens; identical to SEQ ID NO: 445035

SEQ ID NO: 446330 - RNA, 65 nt, Homo Sapiens; identical to SEQ ID NO: 445036

SEQ ID NO: 446331 - RNA, 65 nt, Homo Sapiens; identical to SEQ ID NO: 445037

SEQ ID NO: 446332 - RNA, 65 nt, Homo Sapiens; identical to SEQ ID NO: 445038

SEQ ID NO: 446333 - RNA, 65 nt, Homo Sapiens; identical to SEQ ID NO: 445039

SEQ ID NO: 446334 - RNA, 65 nt, Homo Sapiens; identical to SEQ ID NO: 445040

SEQ ID NO: 446335 - RNA, 65 nt, Homo Sapiens; identical to SEQ ID NO: 445041

SEQ ID NO: 446336 - RNA, 65 nt, Homo Sapiens; identical to SEQ ID NO: 445042

SEQ ID NO: 446337 - RNA, 65 nt, Homo Sapiens; identical to SEQ ID NO: 445043

SEQ ID NO: 446338 - RNA, 65 nt, Homo Sapiens; identical to SEQ ID NO: 445044

SEQ ID NO: 446339 - RNA, 65 nt, Homo Sapiens; identical to SEQ ID NO: 445045

SEQ ID NO: 446340 - RNA, 65 nt, Homo Sapiens; identical to SEQ ID NO: 445046

SEQ ID NO: 446341 - RNA, 65 nt, Homo Sapiens; identical to SEQ ID NO: 445047

SEQ ID NO: 446342 - RNA, 65 nt, Homo Sapiens; identical to SEQ ID NO: 445048

SEQ ID NO: 446343 - RNA, 65 nt, Homo Sapiens; identical to SEQ ID NO: 445049

SEQ ID NO: 446344 - RNA, 55 nt, Homo Sapiens; identical to SEQ ID NO: 445050

SEQ ID NO: 446345 - RNA, 65 nt, Homo Sapiens; identical to SEQ ID NO: 445051

SEQ ID NO: 446346 - RNA, 65 nt, Homo Sapiens; identical to SEQ ID NO: 445052

SEQ ID NO: 446347 - RNA, 65 nt, Homo Sapiens; identical to SEQ ID NO: 445053

SEQ ID NO: 446348 - RNA, 65 nt, Homo Sapiens; identical to SEQ ID NO: 445054

SEQ ID NO: 446349 - RNA, 65 nt, Homo Sapiens; identical to SEQ ID NO: 445055

SEQ ID NO: 446350 - RNA, 65 nt, Homo Sapiens; identical to SEQ ID NO: 445056

SEQ ID NO: 446351 - RNA, 65 nt, Homo Sapiens; identical to SEQ ID NO: 445057

SEQ ID NO: 446352 - RNA, 65 nt, Homo Sapiens; identical to SEQ ID NO: 445058

SEQ ID NO: 446353 - RNA, 65 nt, Homo Sapiens; identical to SEQ ID NO: 445059

SEQ ID NO: 446354 - RNA, 65 nt, Homo Sapiens; identical to SEQ ID NO: 445060

SEQ ID NO: 446355 - RNA, 65 nt, Homo Sapiens; identical to SEQ ID NO: 445061

SEQ ID NO: 446356 - RNA, 65 nt, Homo Sapiens; identical to SEQ ID NO: 445062

SEQ ID NO: 446357 - RNA, 65 nt, Homo Sapiens; identical to SEQ ID NO: 445063

SEQ ID NO: 446358 - RNA, 65 nt, Homo Sapiens; identical to SEQ ID NO: 445064

SEQ ID NO: 446359 - RNA, 65 nt, Homo Sapiens; identical to SEQ ID NO: 445065

SEQ ID NO: 446360 - RNA, 65 nt, Homo Sapiens; identical to SEQ ID NO: 445066

SEQ ID NO: 446361 - RNA, 65 nt, Homo Sapiens; identical to SEQ ID NO: 445067

SEQ ID NO: 446362 - RNA, 65 nt, Homo Sapiens; identical to SEQ ID NO: 445068

SEQ ID NO: 446363 - RNA, 65 nt, Homo Sapiens; identical to SEQ ID NO: 445069

SEQ ID NO: 446364 - RNA, 65 nt, Homo Sapiens; identical to SEQ ID NO: 445070

SEQ ID NO: 446365 - RNA, 65 nt, Homo Sapiens; identical to SEQ ID NO: 445071

SEQ ID NO: 446366 - RNA, 65 nt, Homo Sapiens; identical to SEQ ID NO: 445072

SEQ ID NO: 446367 - RNA, 65 nt, Homo Sapiens; identical to SEQ ID NO: 445073

SEQ ID NO: 446368 - RNA, 65 nt, Homo Sapiens; identical to SEQ ID NO: 445074

SEQ ID NO: 446369 - RNA, 65 nt, Homo Sapiens; identical to SEQ ID NO: 445075

SEQ ID NO: 446370 - RNA, 65 nt, Homo Sapiens; identical to SEQ ID NO: 445076

SEQ ID NO: 446371 - RNA, 65 nt, Homo Sapiens; identical to SEQ ID NO: 445077

SEQ ID NO: 446372 - RNA, 65 nt, Homo Sapiens; identical to SEQ ID NO: 445078

SEQ ID NO: 446373 - RNA, 65 nt, Homo Sapiens; identical to SEQ ID NO: 445079

SEQ ID NO: 446374 - RNA, 65 nt, Homo Sapiens; identical to SEQ ID NO: 445080

SEQ ID NO: 446375 - RNA, 65 nt, Homo Sapiens; identical to SEQ ID NO: 445081

SEQ ID NO: 446376 - RNA, 65 nt, Homo Sapiens; identical to SEQ ID NO: 445082

SEQ ID NO: 446377 - RNA, 65 nt, Homo Sapiens; identical to SEQ ID NO: 445083

SEQ ID NO: 446378 - RNA, 65 nt, Homo Sapiens; identical to SEQ ID NO: 445084

SEQ ID NO: 446379 - RNA, 65 nt, Homo Sapiens; identical to SEQ ID NO: 445085

SEQ ID NO: 446380 - RNA, 65 nt, Homo Sapiens; identical to SEQ ID NO: 445086

SEQ ID NO: 446381 - RNA, 65 nt, Homo Sapiens; identical to SEQ ID NO: 445087

SEQ ID NO: 446382 - RNA, 65 nt, Homo Sapiens; identical to SEQ ID NO: 445088

SEQ ID NO: 446383 - RNA, 65 nt, Homo Sapiens; identical to SEQ ID NO: 445089

SEQ ID NO: 446384 - RNA, 65 nt, Homo Sapiens; identical to SEQ ID NO: 445090

SEQ ID NO: 446385 - RNA, 65 nt, Homo Sapiens; identical to SEQ ID NO: 445091

SEQ ID NO: 446386 - RNA, 65 nt, Homo Sapiens; identical to SEQ ID NO: 445092

SEQ ID NO: 446387 - RNA, 65 nt, Homo Sapiens; identical to SEQ ID NO: 445093

SEQ ID NO: 446388 - RNA, 65 nt, Homo Sapiens; identical to SEQ ID NO: 445094

SEQ ID NO: 446389 - RNA, 65 nt, Homo Sapiens; identical to SEQ ID NO: 445095

SEQ ID NO: 446390 - RNA, 65 nt, Homo Sapiens; identical to SEQ ID NO: 445096

SEQ ID NO: 446391 - RNA, 65 nt, Homo Sapiens; identical to SEQ ID NO: 445097

SEQ ID NO: 446392 - RNA, 65 nt, Homo Sapiens; identical to SEQ ID NO: 445098

SEQ ID NO: 446393 - RNA, 65 nt, Homo Sapiens; identical to SEQ ID NO: 445099

SEQ ID NO: 446394 - RNA, 65 nt, Homo Sapiens; identical to SEQ ID NO: 445100

SEQ ID NO: 446395 - RNA, 65 nt, Homo Sapiens; identical to SEQ ID NO: 445101

SEQ ID NO: 446396 - RNA, 65 nt, Homo Sapiens; identical to SEQ ID NO: 445102

SEQ ID NO: 446397 - RNA, 65 nt, Homo Sapiens; identical to SEQ ID NO: 445103

SEQ ID NO: 446398 - RNA, 65 nt, Homo Sapiens; identical to SEQ ID NO: 445104

SEQ ID NO: 446399 - RNA, 65 nt, Homo Sapiens; identical to SEQ ID NO: 445105

SEQ ID NO: 446400 - RNA, 65 nt, Homo Sapiens; identical to SEQ ID NO: 445106

SEQ ID NO: 446401 - RNA, 65 nt, Homo Sapiens; identical to SEQ ID NO: 445107

SEQ ID NO: 446402 - RNA, 65 nt, Homo Sapiens; identical to SEQ ID NO: 445108

SEQ ID NO: 446403 - RNA, 65 nt, Homo Sapiens; identical to SEQ ID NO: 445109

SEQ ID NO: 446404 - RNA, 65 nt, Homo Sapiens; identical to SEQ ID NO: 445110

SEQ ID NO: 446405 - RNA, 65 nt, Homo Sapiens; identical to SEQ ID NO: 445111

SEQ ID NO: 446406 - RNA, 65 nt, Homo Sapiens; identical to SEQ ID NO: 445112

SEQ ID NO: 446407 - RNA, 65 nt, Homo Sapiens; identical to SEQ ID NO: 445113

SEQ ID NO: 446408 - RNA, 65 nt, Homo Sapiens; identical to SEQ ID NO: 445114

SEQ ID NO: 446409 - RNA, 65 nt, Homo Sapiens; identical to SEQ ID NO: 445115

SEQ ID NO: 446410 - RNA, 65 nt, Homo Sapiens; identical to SEQ ID NO: 445116

SEQ ID NO: 446411 - RNA, 65 nt, Homo Sapiens; identical to SEQ ID NO: 445117

SEQ ID NO: 446412 - RNA, 65 nt, Homo Sapiens; identical to SEQ ID NO: 445118

SEQ ID NO: 446413 - RNA, 65 nt, Homo Sapiens; identical to SEQ ID NO: 445119

SEQ ID NO: 446414 - RNA, 65 nt, Homo Sapiens; identical to SEQ ID NO: 445120

SEQ ID NO: 446415 - RNA, 65 nt, Homo Sapiens; identical to SEQ ID NO: 445121

SEQ ID NO: 446416 - RNA, 65 nt, Homo Sapiens; identical to SEQ ID NO: 445122

SEQ ID NO: 446417 - RNA, 65 nt, Homo Sapiens; identical to SEQ ID NO: 445123

SEQ ID NO: 446418 - RNA, 65 nt, Homo Sapiens; identical to SEQ ID NO: 445124

SEQ ID NO: 446419 - RNA, 65 nt, Homo Sapiens; identical to SEQ ID NO: 445125

SEQ ID NO: 446420 - RNA, 65 nt, Homo Sapiens; identical to SEQ ID NO: 445126

SEQ ID NO: 446421 - RNA, 65 nt, Homo Sapiens; identical to SEQ ID NO: 445127

SEQ ID NO: 446422 - RNA, 65 nt, Homo Sapiens; identical to SEQ ID NO: 445128

SEQ ID NO: 446423 - RNA, 65 nt, Homo Sapiens; identical to SEQ ID NO: 445129

SEQ ID NO: 446424 - RNA, 65 nt, Homo Sapiens; identical to SEQ ID NO: 445130

SEQ ID NO: 446425 - RNA, 65 nt, Homo Sapiens; identical to SEQ ID NO: 445131

SEQ ID NO: 446426 - RNA, 65 nt, Homo Sapiens; identical to SEQ ID NO: 445132

SEQ ID NO: 446427 - RNA, 65 nt, Homo Sapiens; identical to SEQ ID NO: 445133

SEQ ID NO: 446428 - RNA, 65 nt, Homo Sapiens; identical to SEQ ID NO: 445134

SEQ ID NO: 446429 - RNA, 65 nt, Homo Sapiens; identical to SEQ ID NO: 445135

SEQ ID NO: 446430 - RNA, 65 nt, Homo Sapiens; identical to SEQ ID NO: 445136

SEQ ID NO: 446431 - RNA, 65 nt, Homo Sapiens; identical to SEQ ID NO: 445137

SEQ ID NO: 446432 - RNA, 65 nt, Homo Sapiens; identical to SEQ ID NO: 445138

SEQ ID NO: 446433 - RNA, 65 nt, Homo Sapiens; identical to SEQ ID NO: 445139

SEQ ID NO: 446434 - RNA, 65 nt, Homo Sapiens; identical to SEQ ID NO: 445140

SEQ ID NO: 446435 - RNA, 65 nt, Homo Sapiens; identical to SEQ ID NO: 445141

SEQ ID NO: 446436 - RNA, 65 nt, Homo Sapiens; identical to SEQ ID NO: 445142

SEQ ID NO: 446437 - RNA, 65 nt, Homo Sapiens; identical to SEQ ID NO: 445143

SEQ ID NO: 446438 - RNA, 65 nt, Homo Sapiens; identical to SEQ ID NO: 445144

SEQ ID NO: 446439 - RNA, 65 nt, Homo Sapiens; identical to SEQ ID NO: 445145

SEQ ID NO: 446440 - RNA, 65 nt, Homo Sapiens; identical to SEQ ID NO: 445146

SEQ ID NO: 446441 - RNA, 65 nt, Homo Sapiens; identical to SEQ ID NO: 445147

SEQ ID NO: 446442 - RNA, 65 nt, Homo Sapiens; identical to SEQ ID NO: 445148

SEQ ID NO: 446443 - RNA, 65 nt, Homo Sapiens; identical to SEQ ID NO: 445149

SEQ ID NO: 446444 - RNA, 65 nt, Homo Sapiens; identical to SEQ ID NO: 445150

SEQ ID NO: 446445 - RNA, 57 nt, Homo Sapiens; identical to SEQ ID NO: 445151

SEQ ID NO: 446446 - RNA, 65 nt, Homo Sapiens; identical to SEQ ID NO: 445152

SEQ ID NO: 446447 - RNA, 65 nt, Homo Sapiens; identical to SEQ ID NO: 445153

SEQ ID NO: 446448 - RNA, 65 nt, Homo Sapiens; identical to SEQ ID NO: 445154

SEQ ID NO: 446449 - RNA, 65 nt, Homo Sapiens; identical to SEQ ID NO: 445155

SEQ ID NO: 446450 - RNA, 65 nt, Homo Sapiens; identical to SEQ ID NO: 445156

SEQ ID NO: 446451 - RNA, 65 nt, Homo Sapiens; identical to SEQ ID NO: 445157

SEQ ID NO: 446452 - RNA, 65 nt, Homo Sapiens; identical to SEQ ID NO: 445158

SEQ ID NO: 446453 - RNA, 65 nt, Homo Sapiens; identical to SEQ ID NO: 445159

SEQ ID NO: 446454 - RNA, 65 nt, Homo Sapiens; identical to SEQ ID NO: 445160

SEQ ID NO: 446455 - RNA, 65 nt, Homo Sapiens; identical to SEQ ID NO: 445161

SEQ ID NO: 446456 - RNA, 65 nt, Homo Sapiens; identical to SEQ ID NO: 445162

SEQ ID NO: 446457 - RNA, 65 nt, Homo Sapiens; identical to SEQ ID NO: 445163

SEQ ID NO: 446458 - RNA, 65 nt, Homo Sapiens; identical to SEQ ID NO: 445164

SEQ ID NO: 446459 - RNA, 65 nt, Homo Sapiens; identical to SEQ ID NO: 445165

SEQ ID NO: 446460 - RNA, 65 nt, Homo Sapiens; identical to SEQ ID NO: 445166

SEQ ID NO: 446461 - RNA, 65 nt, Homo Sapiens; identical to SEQ ID NO: 445167

SEQ ID NO: 446462 - RNA, 65 nt, Homo Sapiens; identical to SEQ ID NO: 445168

SEQ ID NO: 446463 - RNA, 65 nt, Homo Sapiens; identical to SEQ ID NO: 445169

SEQ ID NO: 446464 - RNA, 65 nt, Homo Sapiens; identical to SEQ ID NO: 445170

SEQ ID NO: 446465 - RNA, 65 nt, Homo Sapiens; identical to SEQ ID NO: 445171

SEQ ID NO: 446466 - RNA, 65 nt, Homo Sapiens; identical to SEQ ID NO: 445172

SEQ ID NO: 446467 - RNA, 65 nt, Homo Sapiens; identical to SEQ ID NO: 445173

SEQ ID NO: 446468 - RNA, 65 nt, Homo Sapiens; identical to SEQ ID NO: 445174

SEQ ID NO: 446469 - RNA, 65 nt, Homo Sapiens; identical to SEQ ID NO: 445175

SEQ ID NO: 446470 - RNA, 65 nt, Homo Sapiens; identical to SEQ ID NO: 445176

SEQ ID NO: 446471 - RNA, 65 nt, Homo Sapiens; identical to SEQ ID NO: 445177

SEQ ID NO: 446472 - RNA, 65 nt, Homo Sapiens; identical to SEQ ID NO: 445178

SEQ ID NO: 446473 - RNA, 65 nt, Homo Sapiens; identical to SEQ ID NO: 445179

SEQ ID NO: 446474 - RNA, 59 nt, Homo Sapiens; identical to SEQ ID NO: 445180

SEQ ID NO: 446475 - RNA, 65 nt, Homo Sapiens; identical to SEQ ID NO: 445181

SEQ ID NO: 446476 - RNA, 65 nt, Homo Sapiens; identical to SEQ ID NO: 445182

SEQ ID NO: 446477 - RNA, 65 nt, Homo Sapiens; identical to SEQ ID NO: 445183

SEQ ID NO: 446478 - RNA, 65 nt, Homo Sapiens; identical to SEQ ID NO: 445184

SEQ ID NO: 446479 - RNA, 65 nt, Homo Sapiens; identical to SEQ ID NO: 445185

SEQ ID NO: 446480 - RNA, 65 nt, Homo Sapiens; identical to SEQ ID NO: 445186

SEQ ID NO: 446481 - RNA, 65 nt, Homo Sapiens; identical to SEQ ID NO: 445187

SEQ ID NO: 446482 - RNA, 65 nt, Homo Sapiens; identical to SEQ ID NO: 445188

SEQ ID NO: 446483 - RNA, 65 nt, Homo Sapiens; identical to SEQ ID NO: 445189

SEQ ID NO: 446484 - RNA, 65 nt, Homo Sapiens; identical to SEQ ID NO: 445190

SEQ ID NO: 446485 - RNA, 65 nt, Homo Sapiens; identical to SEQ ID NO: 445191

SEQ ID NO: 446486 - RNA, 65 nt, Homo Sapiens; identical to SEQ ID NO: 445192

SEQ ID NO: 446487 - RNA, 65 nt, Homo Sapiens; identical to SEQ ID NO: 445193

SEQ ID NO: 446488 - RNA, 65 nt, Homo Sapiens; identical to SEQ ID NO: 445194

SEQ ID NO: 446489 - RNA, 65 nt, Homo Sapiens; identical to SEQ ID NO: 445195

SEQ ID NO: 446490 - RNA, 65 nt, Homo Sapiens; identical to SEQ ID NO: 445196

SEQ ID NO: 446491 - RNA, 65 nt, Homo Sapiens; identical to SEQ ID NO: 445197

SEQ ID NO: 446492 - RNA, 65 nt, Homo Sapiens; identical to SEQ ID NO: 445198

SEQ ID NO: 446493 - RNA, 65 nt, Homo Sapiens; identical to SEQ ID NO: 445199

SEQ ID NO: 446494 - RNA, 65 nt, Homo Sapiens; identical to SEQ ID NO: 445200

SEQ ID NO: 446495 - RNA, 65 nt, Homo Sapiens; identical to SEQ ID NO: 445201

SEQ ID NO: 446496 - RNA, 65 nt, Homo Sapiens; identical to SEQ ID NO: 445202

SEQ ID NO: 446497 - RNA, 65 nt, Homo Sapiens; identical to SEQ ID NO: 445203

SEQ ID NO: 446498 - RNA, 65 nt, Homo Sapiens; identical to SEQ ID NO: 445204

SEQ ID NO: 446499 - RNA, 65 nt, Homo Sapiens; identical to SEQ ID NO: 445205

SEQ ID NO: 446500 - RNA, 65 nt, Homo Sapiens; identical to SEQ ID NO: 445206

SEQ ID NO: 446501 - RNA, 65 nt, Homo Sapiens; identical to SEQ ID NO: 445207

SEQ ID NO: 446502 - RNA, 65 nt, Homo Sapiens; identical to SEQ ID NO: 445208

SEQ ID NO: 446503 - RNA, 65 nt, Homo Sapiens; identical to SEQ ID NO: 445209

SEQ ID NO: 446504 - RNA, 65 nt, Homo Sapiens; identical to SEQ ID NO: 445210

SEQ ID NO: 446505 - RNA, 65 nt, Homo Sapiens; identical to SEQ ID NO: 445211

SEQ ID NO: 446506 - RNA, 65 nt, Homo Sapiens; identical to SEQ ID NO: 445212

SEQ ID NO: 446507 - RNA, 65 nt, Homo Sapiens; identical to SEQ ID NO: 445213

SEQ ID NO: 446508 - RNA, 65 nt, Homo Sapiens; identical to SEQ ID NO: 445214

SEQ ID NO: 446509 - RNA, 65 nt, Homo Sapiens; identical to SEQ ID NO: 445215

SEQ ID NO: 446510 - RNA, 65 nt, Homo Sapiens; identical to SEQ ID NO: 445216

SEQ ID NO: 446511 - RNA, 65 nt, Homo Sapiens; identical to SEQ ID NO: 445217

SEQ ID NO: 446512 - RNA, 65 nt, Homo Sapiens; identical to SEQ ID NO: 445218

SEQ ID NO: 446513 - RNA, 65 nt, Homo Sapiens; identical to SEQ ID NO: 445219

SEQ ID NO: 446514 - RNA, 65 nt, Homo Sapiens; identical to SEQ ID NO: 445220

SEQ ID NO: 446515 - RNA, 65 nt, Homo Sapiens; identical to SEQ ID NO: 445221

SEQ ID NO: 446516 - RNA, 65 nt, Homo Sapiens; identical to SEQ ID NO: 445222

SEQ ID NO: 446517 - RNA, 65 nt, Homo Sapiens; identical to SEQ ID NO: 445223

SEQ ID NO: 446518 - RNA, 65 nt, Homo Sapiens; identical to SEQ ID NO: 445224

SEQ ID NO: 446519 - RNA, 65 nt, Homo Sapiens; identical to SEQ ID NO: 445225

SEQ ID NO: 446520 - RNA, 65 nt, Homo Sapiens; identical to SEQ ID NO: 445226

SEQ ID NO: 446521 - RNA, 65 nt, Homo Sapiens; identical to SEQ ID NO: 445227

SEQ ID NO: 446522 - RNA, 65 nt, Homo Sapiens; identical to SEQ ID NO: 445228

SEQ ID NO: 446523 - RNA, 65 nt, Homo Sapiens; identical to SEQ ID NO: 445229

SEQ ID NO: 446524 - RNA, 65 nt, Homo Sapiens; identical to SEQ ID NO: 445230

SEQ ID NO: 446525 - RNA, 65 nt, Homo Sapiens; identical to SEQ ID NO: 445231

SEQ ID NO: 446526 - RNA, 65 nt, Homo Sapiens; identical to SEQ ID NO: 445232

SEQ ID NO: 446527 - RNA, 65 nt, Homo Sapiens; identical to SEQ ID NO: 445233

SEQ ID NO: 446528 - RNA, 65 nt, Homo Sapiens; identical to SEQ ID NO: 445234

SEQ ID NO: 446529 - RNA, 65 nt, Homo Sapiens; identical to SEQ ID NO: 445235

SEQ ID NO: 446530 - RNA, 65 nt, Homo Sapiens; identical to SEQ ID NO: 445236

SEQ ID NO: 446531 - RNA, 65 nt, Homo Sapiens; identical to SEQ ID NO: 445237

SEQ ID NO: 446532 - RNA, 65 nt, Homo Sapiens; identical to SEQ ID NO: 445238

SEQ ID NO: 446533 - RNA, 65 nt, Homo Sapiens; identical to SEQ ID NO: 445239

SEQ ID NO: 446534 - RNA, 65 nt, Homo Sapiens; identical to SEQ ID NO: 445240

SEQ ID NO: 446535 - RNA, 65 nt, Homo Sapiens; identical to SEQ ID NO: 445241

SEQ ID NO: 446536 - RNA, 65 nt, Homo Sapiens; identical to SEQ ID NO: 445242

SEQ ID NO: 446537 - RNA, 65 nt, Homo Sapiens; identical to SEQ ID NO: 445243

SEQ ID NO: 446538 - RNA, 65 nt, Homo Sapiens; identical to SEQ ID NO: 445244

SEQ ID NO: 446539 - RNA, 65 nt, Homo Sapiens; identical to SEQ ID NO: 445245

SEQ ID NO: 446540 - RNA, 65 nt, Homo Sapiens; identical to SEQ ID NO: 445246

SEQ ID NO: 446541 - RNA, 65 nt, Homo Sapiens; identical to SEQ ID NO: 445247

SEQ ID NO: 446542 - RNA, 65 nt, Homo Sapiens; identical to SEQ ID NO: 445248

SEQ ID NO: 446543 - RNA, 65 nt, Homo Sapiens; identical to SEQ ID NO: 445249

SEQ ID NO: 446544 - RNA, 65 nt, Homo Sapiens; identical to SEQ ID NO: 445250

SEQ ID NO: 446545 - RNA, 65 nt, Homo Sapiens; identical to SEQ ID NO: 445251

SEQ ID NO: 446546 - RNA, 65 nt, Homo Sapiens; identical to SEQ ID NO: 445252

SEQ ID NO: 446547 - RNA, 65 nt, Homo Sapiens; identical to SEQ ID NO: 445253

SEQ ID NO: 446548 - RNA, 65 nt, Homo Sapiens; identical to SEQ ID NO: 445254

SEQ ID NO: 446549 - RNA, 65 nt, Homo Sapiens; identical to SEQ ID NO: 445255

SEQ ID NO: 446550 - RNA, 65 nt, Homo Sapiens; identical to SEQ ID NO: 445256

SEQ ID NO: 446551 - RNA, 65 nt, Homo Sapiens; identical to SEQ ID NO: 445257

SEQ ID NO: 446552 - RNA, 65 nt, Homo Sapiens; identical to SEQ ID NO: 445258

SEQ ID NO: 446553 - RNA, 65 nt, Homo Sapiens; identical to SEQ ID NO: 445259

SEQ ID NO: 446554 - RNA, 65 nt, Homo Sapiens; identical to SEQ ID NO: 445260

SEQ ID NO: 446555 - RNA, 65 nt, Homo Sapiens; identical to SEQ ID NO: 445261

SEQ ID NO: 446556 - RNA, 65 nt, Homo Sapiens; identical to SEQ ID NO: 445262

SEQ ID NO: 446557 - RNA, 65 nt, Homo Sapiens; identical to SEQ ID NO: 445263

SEQ ID NO: 446558 - RNA, 65 nt, Homo Sapiens; identical to SEQ ID NO: 445264

SEQ ID NO: 446559 - RNA, 65 nt, Homo Sapiens; identical to SEQ ID NO: 445265

SEQ ID NO: 446560 - RNA, 65 nt, Homo Sapiens; identical to SEQ ID NO: 445266

SEQ ID NO: 446561 - RNA, 65 nt, Homo Sapiens; identical to SEQ ID NO: 445267

SEQ ID NO: 446562 - RNA, 65 nt, Homo Sapiens; identical to SEQ ID NO: 445268

SEQ ID NO: 446563 - RNA, 65 nt, Homo Sapiens; identical to SEQ ID NO: 445269

SEQ ID NO: 446564 - RNA, 65 nt, Homo Sapiens; identical to SEQ ID NO: 445270

SEQ ID NO: 446565 - RNA, 65 nt, Homo Sapiens; identical to SEQ ID NO: 445271

SEQ ID NO: 446566 - RNA, 65 nt, Homo Sapiens; identical to SEQ ID NO: 445272

SEQ ID NO: 446567 - RNA, 65 nt, Homo Sapiens; identical to SEQ ID NO: 445273

SEQ ID NO: 446568 - RNA, 65 nt, Homo Sapiens; identical to SEQ ID NO: 445274

SEQ ID NO: 446569 - RNA, 65 nt, Homo Sapiens; identical to SEQ ID NO: 445275

SEQ ID NO: 446570 - RNA, 65 nt, Homo Sapiens; identical to SEQ ID NO: 445276

SEQ ID NO: 446571 - RNA, 65 nt, Homo Sapiens; identical to SEQ ID NO: 445277

SEQ ID NO: 446572 - RNA, 65 nt, Homo Sapiens; identical to SEQ ID NO: 445278

SEQ ID NO: 446573 - RNA, 65 nt, Homo Sapiens; identical to SEQ ID NO: 445279

SEQ ID NO: 446574 - RNA, 65 nt, Homo Sapiens; identical to SEQ ID NO: 445280

SEQ ID NO: 446575 - RNA, 65 nt, Homo Sapiens; identical to SEQ ID NO: 445281

SEQ ID NO: 446576 - RNA, 65 nt, Homo Sapiens; identical to SEQ ID NO: 445282

SEQ ID NO: 446577 - RNA, 65 nt, Homo Sapiens; identical to SEQ ID NO: 445283

SEQ ID NO: 446578 - RNA, 65 nt, Homo Sapiens; identical to SEQ ID NO: 445284

SEQ ID NO: 446579 - RNA, 65 nt, Homo Sapiens; identical to SEQ ID NO: 445285

SEQ ID NO: 446580 - RNA, 65 nt, Homo Sapiens; identical to SEQ ID NO: 445286

SEQ ID NO: 446581 - RNA, 65 nt, Homo Sapiens; identical to SEQ ID NO: 445287

SEQ ID NO: 446582 - RNA, 65 nt, Homo Sapiens; identical to SEQ ID NO: 445288

SEQ ID NO: 446583 - RNA, 65 nt, Homo Sapiens; identical to SEQ ID NO: 445289

SEQ ID NO: 446584 - RNA, 65 nt, Homo Sapiens; identical to SEQ ID NO: 445290

SEQ ID NO: 446585 - RNA, 65 nt, Homo Sapiens; identical to SEQ ID NO: 445291

SEQ ID NO: 446586 - RNA, 65 nt, Homo Sapiens; identical to SEQ ID NO: 445292

SEQ ID NO: 446587 - RNA, 65 nt, Homo Sapiens; identical to SEQ ID NO: 445293

SEQ ID NO: 446588 - RNA, 65 nt, Homo Sapiens; identical to SEQ ID NO: 445294

SEQ ID NO: 446589 - RNA, 65 nt, Homo Sapiens; identical to SEQ ID NO: 445295

SEQ ID NO: 446590 - RNA, 65 nt, Homo Sapiens; identical to SEQ ID NO: 445296

SEQ ID NO: 446591 - RNA, 65 nt, Homo Sapiens; identical to SEQ ID NO: 445297

SEQ ID NO: 446592 - RNA, 65 nt, Homo Sapiens; identical to SEQ ID NO: 445298

SEQ ID NO: 446593 - RNA, 65 nt, Homo Sapiens; identical to SEQ ID NO: 445299

SEQ ID NO: 446594 - RNA, 65 nt, Homo Sapiens; identical to SEQ ID NO: 445300

SEQ ID NO: 446595 - RNA, 65 nt, Homo Sapiens; identical to SEQ ID NO: 445301

SEQ ID NO: 446596 - RNA, 65 nt, Homo Sapiens; identical to SEQ ID NO: 445302

SEQ ID NO: 446597 - RNA, 65 nt, Homo Sapiens; identical to SEQ ID NO: 445303

SEQ ID NO: 446598 - RNA, 65 nt, Homo Sapiens; identical to SEQ ID NO: 445304

SEQ ID NO: 446599 - RNA, 65 nt, Homo Sapiens; identical to SEQ ID NO: 445305

SEQ ID NO: 446600 - RNA, 65 nt, Homo Sapiens; identical to SEQ ID NO: 445306

SEQ ID NO: 446601 - RNA, 65 nt, Homo Sapiens; identical to SEQ ID NO: 445307

SEQ ID NO: 446602 - RNA, 65 nt, Homo Sapiens; identical to SEQ ID NO: 445308

SEQ ID NO: 446603 - RNA, 65 nt, Homo Sapiens; identical to SEQ ID NO: 445309

SEQ ID NO: 446604 - RNA, 65 nt, Homo Sapiens; identical to SEQ ID NO: 445310

SEQ ID NO: 446605 - RNA, 65 nt, Homo Sapiens; identical to SEQ ID NO: 445311

SEQ ID NO: 446606 - RNA, 65 nt, Homo Sapiens; identical to SEQ ID NO: 445312

SEQ ID NO: 446607 - RNA, 65 nt, Homo Sapiens; identical to SEQ ID NO: 445313

SEQ ID NO: 446608 - RNA, 65 nt, Homo Sapiens; identical to SEQ ID NO: 445314

SEQ ID NO: 446609 - RNA, 60 nt, Homo Sapiens; identical to SEQ ID NO: 445315

SEQ ID NO: 446610 - RNA, 65 nt, Homo Sapiens; identical to SEQ ID NO: 445316

SEQ ID NO: 446611 - RNA, 65 nt, Homo Sapiens; identical to SEQ ID NO: 445317

SEQ ID NO: 446612 - RNA, 65 nt, Homo Sapiens; identical to SEQ ID NO: 445318

SEQ ID NO: 446613 - RNA, 65 nt, Homo Sapiens; identical to SEQ ID NO: 445319

SEQ ID NO: 446614 - RNA, 65 nt, Homo Sapiens; identical to SEQ ID NO: 445320

SEQ ID NO: 446615 - RNA, 65 nt, Homo Sapiens; identical to SEQ ID NO: 445321

SEQ ID NO: 446616 - RNA, 65 nt, Homo Sapiens; identical to SEQ ID NO: 445322

SEQ ID NO: 446617 - RNA, 65 nt, Homo Sapiens; identical to SEQ ID NO: 445323

SEQ ID NO: 446618 - RNA, 65 nt, Homo Sapiens; identical to SEQ ID NO: 445324

SEQ ID NO: 446619 - RNA, 65 nt, Homo Sapiens; identical to SEQ ID NO: 445325

SEQ ID NO: 446620 - RNA, 65 nt, Homo Sapiens; identical to SEQ ID NO: 445326

SEQ ID NO: 446621 - RNA, 65 nt, Homo Sapiens; identical to SEQ ID NO: 445327

SEQ ID NO: 446622 - RNA, 65 nt, Homo Sapiens; identical to SEQ ID NO: 445328

SEQ ID NO: 446623 - RNA, 65 nt, Homo Sapiens; identical to SEQ ID NO: 445329

SEQ ID NO: 446624 - RNA, 65 nt, Homo Sapiens; identical to SEQ ID NO: 445330

SEQ ID NO: 446625 - RNA, 65 nt, Homo Sapiens; identical to SEQ ID NO: 445331

SEQ ID NO: 446626 - RNA, 65 nt, Homo Sapiens; identical to SEQ ID NO: 445332

SEQ ID NO: 446627 - RNA, 65 nt, Homo Sapiens; identical to SEQ ID NO: 445333

SEQ ID NO: 446628 - RNA, 65 nt, Homo Sapiens; identical to SEQ ID NO: 445334

SEQ ID NO: 446629 - RNA, 65 nt, Homo Sapiens; identical to SEQ ID NO: 445335

SEQ ID NO: 446630 - RNA, 65 nt, Homo Sapiens; identical to SEQ ID NO: 445336

SEQ ID NO: 446631 - RNA, 65 nt, Homo Sapiens; identical to SEQ ID NO: 445337

SEQ ID NO: 446632 - RNA, 65 nt, Homo Sapiens; identical to SEQ ID NO: 445338

SEQ ID NO: 446633 - RNA, 65 nt, Homo Sapiens; identical to SEQ ID NO: 445339

SEQ ID NO: 446634 - RNA, 65 nt, Homo Sapiens; identical to SEQ ID NO: 445340

SEQ ID NO: 446635 - RNA, 65 nt, Homo Sapiens; identical to SEQ ID NO: 445341

SEQ ID NO: 446636 - RNA, 65 nt, Homo Sapiens; identical to SEQ ID NO: 445342

SEQ ID NO: 446637 - RNA, 65 nt, Homo Sapiens; identical to SEQ ID NO: 445343

SEQ ID NO: 446638 - RNA, 65 nt, Homo Sapiens; identical to SEQ ID NO: 445344

SEQ ID NO: 446639 - RNA, 65 nt, Homo Sapiens; identical to SEQ ID NO: 445345

SEQ ID NO: 446640 - RNA, 65 nt, Homo Sapiens; identical to SEQ ID NO: 445346

SEQ ID NO: 446641 - RNA, 65 nt, Homo Sapiens; identical to SEQ ID NO: 445347

SEQ ID NO: 446642 - RNA, 65 nt, Homo Sapiens; identical to SEQ ID NO: 445348

SEQ ID NO: 446643 - RNA, 65 nt, Homo Sapiens; identical to SEQ ID NO: 445349

SEQ ID NO: 446644 - RNA, 65 nt, Homo Sapiens; identical to SEQ ID NO: 445350

SEQ ID NO: 446645 - RNA, 65 nt, Homo Sapiens; identical to SEQ ID NO: 445351

SEQ ID NO: 446646 - RNA, 65 nt, Homo Sapiens; identical to SEQ ID NO: 445352

SEQ ID NO: 446647 - RNA, 65 nt, Homo Sapiens; identical to SEQ ID NO: 445353

SEQ ID NO: 446648 - RNA, 65 nt, Homo Sapiens; identical to SEQ ID NO: 445354

SEQ ID NO: 446649 - RNA, 65 nt, Homo Sapiens; identical to SEQ ID NO: 445355

SEQ ID NO: 446650 - RNA, 65 nt, Homo Sapiens; identical to SEQ ID NO: 445356

SEQ ID NO: 446651 - RNA, 65 nt, Homo Sapiens; identical to SEQ ID NO: 445357

SEQ ID NO: 446652 - RNA, 65 nt, Homo Sapiens; identical to SEQ ID NO: 445358

SEQ ID NO: 446653 - RNA, 65 nt, Homo Sapiens; identical to SEQ ID NO: 445359

SEQ ID NO: 446654 - RNA, 65 nt, Homo Sapiens; identical to SEQ ID NO: 445360

SEQ ID NO: 446655 - RNA, 65 nt, Homo Sapiens; identical to SEQ ID NO: 445361

SEQ ID NO: 446656 - RNA, 65 nt, Homo Sapiens; identical to SEQ ID NO: 445362

SEQ ID NO: 446657 - RNA, 55 nt, Homo Sapiens; identical to SEQ ID NO: 445363

SEQ ID NO: 446658 - RNA, 65 nt, Homo Sapiens; identical to SEQ ID NO: 445364

SEQ ID NO: 446659 - RNA, 65 nt, Homo Sapiens; identical to SEQ ID NO: 445365

SEQ ID NO: 446660 - RNA, 65 nt, Homo Sapiens; identical to SEQ ID NO: 445366

SEQ ID NO: 446661 - RNA, 65 nt, Homo Sapiens; identical to SEQ ID NO: 445367

SEQ ID NO: 446662 - RNA, 65 nt, Homo Sapiens; identical to SEQ ID NO: 445368

SEQ ID NO: 446663 - RNA, 65 nt, Homo Sapiens; identical to SEQ ID NO: 445369

SEQ ID NO: 446664 - RNA, 65 nt, Homo Sapiens; identical to SEQ ID NO: 445370

SEQ ID NO: 446665 - RNA, 65 nt, Homo Sapiens; identical to SEQ ID NO: 445371

SEQ ID NO: 446666 - RNA, 65 nt, Homo Sapiens; identical to SEQ ID NO: 445372

SEQ ID NO: 446667 - RNA, 65 nt, Homo Sapiens; identical to SEQ ID NO: 445373

SEQ ID NO: 446668 - RNA, 65 nt, Homo Sapiens; identical to SEQ ID NO: 445374

SEQ ID NO: 446669 - RNA, 65 nt, Homo Sapiens; identical to SEQ ID NO: 445375

SEQ ID NO: 446670 - RNA, 65 nt, Homo Sapiens; identical to SEQ ID NO: 445376

SEQ ID NO: 446671 - RNA, 65 nt, Homo Sapiens; identical to SEQ ID NO: 445377

SEQ ID NO: 446672 - RNA, 65 nt, Homo Sapiens; identical to SEQ ID NO: 445378

SEQ ID NO: 446673 - RNA, 65 nt, Homo Sapiens; identical to SEQ ID NO: 445379

SEQ ID NO: 446674 - RNA, 65 nt, Homo Sapiens; identical to SEQ ID NO: 445380

SEQ ID NO: 446675 - RNA, 65 nt, Homo Sapiens; identical to SEQ ID NO: 445381

SEQ ID NO: 446676 - RNA, 65 nt, Homo Sapiens; identical to SEQ ID NO: 445382

SEQ ID NO: 446677 - RNA, 65 nt, Homo Sapiens; identical to SEQ ID NO: 445383

SEQ ID NO: 446678 - RNA, 65 nt, Homo Sapiens; identical to SEQ ID NO: 445384

SEQ ID NO: 446679 - RNA, 65 nt, Homo Sapiens; identical to SEQ ID NO: 445385

SEQ ID NO: 446680 - RNA, 65 nt, Homo Sapiens; identical to SEQ ID NO: 445386

SEQ ID NO: 446681 - RNA, 65 nt, Homo Sapiens; identical to SEQ ID NO: 445387

SEQ ID NO: 446682 - RNA, 65 nt, Homo Sapiens; identical to SEQ ID NO: 445388

SEQ ID NO: 446683 - RNA, 65 nt, Homo Sapiens; identical to SEQ ID NO: 445389

SEQ ID NO: 446684 - RNA, 65 nt, Homo Sapiens; identical to SEQ ID NO: 445390

SEQ ID NO: 446685 - RNA, 65 nt, Homo Sapiens; identical to SEQ ID NO: 445391

SEQ ID NO: 446686 - RNA, 65 nt, Homo Sapiens; identical to SEQ ID NO: 445392

SEQ ID NO: 446687 - RNA, 65 nt, Homo Sapiens; identical to SEQ ID NO: 445393

SEQ ID NO: 446688 - RNA, 65 nt, Homo Sapiens; identical to SEQ ID NO: 445394

SEQ ID NO: 446689 - RNA, 65 nt, Homo Sapiens; identical to SEQ ID NO: 445395

SEQ ID NO: 446690 - RNA, 65 nt, Homo Sapiens; identical to SEQ ID NO: 445396

SEQ ID NO: 446691 - RNA, 65 nt, Homo Sapiens; identical to SEQ ID NO: 445397

SEQ ID NO: 446692 - RNA, 65 nt, Homo Sapiens; identical to SEQ ID NO: 445398

SEQ ID NO: 446693 - RNA, 65 nt, Homo Sapiens; identical to SEQ ID NO: 445399

SEQ ID NO: 446694 - RNA, 65 nt, Homo Sapiens; identical to SEQ ID NO: 445400

SEQ ID NO: 446695 - RNA, 65 nt, Homo Sapiens; identical to SEQ ID NO: 445401

SEQ ID NO: 446696 - RNA, 65 nt, Homo Sapiens; identical to SEQ ID NO: 445402

SEQ ID NO: 446697 - RNA, 65 nt, Homo Sapiens; identical to SEQ ID NO: 445403

SEQ ID NO: 446698 - RNA, 65 nt, Homo Sapiens; identical to SEQ ID NO: 445404

SEQ ID NO: 446699 - RNA, 65 nt, Homo Sapiens; identical to SEQ ID NO: 445405

SEQ ID NO: 446700 - RNA, 65 nt, Homo Sapiens; identical to SEQ ID NO: 445406

SEQ ID NO: 446701 - RNA, 65 nt, Homo Sapiens; identical to SEQ ID NO: 445407

SEQ ID NO: 446702 - RNA, 65 nt, Homo Sapiens; identical to SEQ ID NO: 445408

SEQ ID NO: 446703 - RNA, 65 nt, Homo Sapiens; identical to SEQ ID NO: 445409

SEQ ID NO: 446704 - RNA, 65 nt, Homo Sapiens; identical to SEQ ID NO: 445410

SEQ ID NO: 446705 - RNA, 65 nt, Homo Sapiens; identical to SEQ ID NO: 445411

SEQ ID NO: 446706 - RNA, 65 nt, Homo Sapiens; identical to SEQ ID NO: 445412

SEQ ID NO: 446707 - RNA, 65 nt, Homo Sapiens; identical to SEQ ID NO: 445413

SEQ ID NO: 446708 - RNA, 65 nt, Homo Sapiens; identical to SEQ ID NO: 445414

SEQ ID NO: 446709 - RNA, 65 nt, Homo Sapiens; identical to SEQ ID NO: 445415

SEQ ID NO: 446710 - RNA, 65 nt, Homo Sapiens; identical to SEQ ID NO: 445416

SEQ ID NO: 446711 - RNA, 65 nt, Homo Sapiens; identical to SEQ ID NO: 445417

SEQ ID NO: 446712 - RNA, 65 nt, Homo Sapiens; identical to SEQ ID NO: 445418

SEQ ID NO: 446713 - RNA, 65 nt, Homo Sapiens; identical to SEQ ID NO: 445419

SEQ ID NO: 446714 - RNA, 65 nt, Homo Sapiens; identical to SEQ ID NO: 445420

SEQ ID NO: 446715 - RNA, 65 nt, Homo Sapiens; identical to SEQ ID NO: 445421

SEQ ID NO: 446716 - RNA, 65 nt, Homo Sapiens; identical to SEQ ID NO: 445422

SEQ ID NO: 446717 - RNA, 65 nt, Homo Sapiens; identical to SEQ ID NO: 445423

SEQ ID NO: 446718 - RNA, 65 nt, Homo Sapiens; identical to SEQ ID NO: 445424

SEQ ID NO: 446719 - RNA, 65 nt, Homo Sapiens; identical to SEQ ID NO: 445425

SEQ ID NO: 446720 - RNA, 65 nt, Homo Sapiens; identical to SEQ ID NO: 445426

SEQ ID NO: 446721 - RNA, 65 nt, Homo Sapiens; identical to SEQ ID NO: 445427

SEQ ID NO: 446722 - RNA, 65 nt, Homo Sapiens; identical to SEQ ID NO: 445428

SEQ ID NO: 446723 - RNA, 65 nt, Homo Sapiens; identical to SEQ ID NO: 445429

SEQ ID NO: 446724 - RNA, 65 nt, Homo Sapiens; identical to SEQ ID NO: 445430

SEQ ID NO: 446725 - RNA, 65 nt, Homo Sapiens; identical to SEQ ID NO: 445431

SEQ ID NO: 446726 - RNA, 65 nt, Homo Sapiens; identical to SEQ ID NO: 445432

SEQ ID NO: 446727 - RNA, 65 nt, Homo Sapiens; identical to SEQ ID NO: 445433

SEQ ID NO: 446728 - RNA, 65 nt, Homo Sapiens; identical to SEQ ID NO: 445434

SEQ ID NO: 446729 - RNA, 65 nt, Homo Sapiens; identical to SEQ ID NO: 445435

SEQ ID NO: 446730 - RNA, 65 nt, Homo Sapiens; identical to SEQ ID NO: 445436

SEQ ID NO: 446731 - RNA, 65 nt, Homo Sapiens; identical to SEQ ID NO: 445437

SEQ ID NO: 446732 - RNA, 65 nt, Homo Sapiens; identical to SEQ ID NO: 445438

SEQ ID NO: 446733 - RNA, 65 nt, Homo Sapiens; identical to SEQ ID NO: 445439

SEQ ID NO: 446734 - RNA, 65 nt, Homo Sapiens; identical to SEQ ID NO: 445440

SEQ ID NO: 446735 - RNA, 65 nt, Homo Sapiens; identical to SEQ ID NO: 445441

SEQ ID NO: 446736 - RNA, 65 nt, Homo Sapiens; identical to SEQ ID NO: 445442

SEQ ID NO: 446737 - RNA, 65 nt, Homo Sapiens; identical to SEQ ID NO: 445443

SEQ ID NO: 446738 - RNA, 65 nt, Homo Sapiens; identical to SEQ ID NO: 445444

SEQ ID NO: 446739 - RNA, 65 nt, Homo Sapiens; identical to SEQ ID NO: 445445

SEQ ID NO: 446740 - RNA, 65 nt, Homo Sapiens; identical to SEQ ID NO: 445446

SEQ ID NO: 446741 - RNA, 65 nt, Homo Sapiens; identical to SEQ ID NO: 445447

SEQ ID NO: 446742 - RNA, 65 nt, Homo Sapiens; identical to SEQ ID NO: 445448

SEQ ID NO: 446743 - RNA, 65 nt, Homo Sapiens; identical to SEQ ID NO: 445449

SEQ ID NO: 446744 - RNA, 65 nt, Homo Sapiens; identical to SEQ ID NO: 445450

SEQ ID NO: 446745 - RNA, 65 nt, Homo Sapiens; identical to SEQ ID NO: 445451

SEQ ID NO: 446746 - RNA, 65 nt, Homo Sapiens; identical to SEQ ID NO: 445452

SEQ ID NO: 446747 - RNA, 65 nt, Homo Sapiens; identical to SEQ ID NO: 445453

SEQ ID NO: 446748 - RNA, 65 nt, Homo Sapiens; identical to SEQ ID NO: 445454

SEQ ID NO: 446749 - RNA, 65 nt, Homo Sapiens; identical to SEQ ID NO: 445455

SEQ ID NO: 446750 - RNA, 65 nt, Homo Sapiens; identical to SEQ ID NO: 445456

SEQ ID NO: 446751 - RNA, 65 nt, Homo Sapiens; identical to SEQ ID NO: 445457

SEQ ID NO: 446752 - RNA, 65 nt, Homo Sapiens; identical to SEQ ID NO: 445458

SEQ ID NO: 446753 - RNA, 65 nt, Homo Sapiens; identical to SEQ ID NO: 445459

SEQ ID NO: 446754 - RNA, 65 nt, Homo Sapiens; identical to SEQ ID NO: 445460

SEQ ID NO: 446755 - RNA, 65 nt, Homo Sapiens; identical to SEQ ID NO: 445461

SEQ ID NO: 446756 - RNA, 65 nt, Homo Sapiens; identical to SEQ ID NO: 445462

SEQ ID NO: 446757 - RNA, 65 nt, Homo Sapiens; identical to SEQ ID NO: 445463

SEQ ID NO: 446758 - RNA, 65 nt, Homo Sapiens; identical to SEQ ID NO: 445464

SEQ ID NO: 446759 - RNA, 65 nt, Homo Sapiens; identical to SEQ ID NO: 445465

SEQ ID NO: 446760 - RNA, 65 nt, Homo Sapiens; identical to SEQ ID NO: 445466

SEQ ID NO: 446761 - RNA, 65 nt, Homo Sapiens; identical to SEQ ID NO: 445467

SEQ ID NO: 446762 - RNA, 65 nt, Homo Sapiens; identical to SEQ ID NO: 445468

SEQ ID NO: 446763 - RNA, 65 nt, Homo Sapiens; identical to SEQ ID NO: 445469

SEQ ID NO: 446764 - RNA, 65 nt, Homo Sapiens; identical to SEQ ID NO: 445470

SEQ ID NO: 446765 - RNA, 65 nt, Homo Sapiens; identical to SEQ ID NO: 445471

SEQ ID NO: 446766 - RNA, 65 nt, Homo Sapiens; identical to SEQ ID NO: 445472

SEQ ID NO: 446767 - RNA, 59 nt, Homo Sapiens; identical to SEQ ID NO: 445473

SEQ ID NO: 446768 - RNA, 65 nt, Homo Sapiens; identical to SEQ ID NO: 445474

SEQ ID NO: 446769 - RNA, 65 nt, Homo Sapiens; identical to SEQ ID NO: 445475

SEQ ID NO: 446770 - RNA, 65 nt, Homo Sapiens; identical to SEQ ID NO: 445476

SEQ ID NO: 446771 - RNA, 65 nt, Homo Sapiens; identical to SEQ ID NO: 445477

SEQ ID NO: 446772 - RNA, 65 nt, Homo Sapiens; identical to SEQ ID NO: 445478

SEQ ID NO: 446773 - RNA, 65 nt, Homo Sapiens; identical to SEQ ID NO: 445479

SEQ ID NO: 446774 - RNA, 65 nt, Homo Sapiens; identical to SEQ ID NO: 445480

SEQ ID NO: 446775 - RNA, 65 nt, Homo Sapiens; identical to SEQ ID NO: 445481

SEQ ID NO: 446776 - RNA, 65 nt, Homo Sapiens; identical to SEQ ID NO: 445482

SEQ ID NO: 446777 - RNA, 65 nt, Homo Sapiens; identical to SEQ ID NO: 445483

SEQ ID NO: 446778 - RNA, 65 nt, Homo Sapiens; identical to SEQ ID NO: 445484

SEQ ID NO: 446779 - RNA, 65 nt, Homo Sapiens; identical to SEQ ID NO: 445485

SEQ ID NO: 446780 - RNA, 65 nt, Homo Sapiens; identical to SEQ ID NO: 445486

SEQ ID NO: 446781 - RNA, 65 nt, Homo Sapiens; identical to SEQ ID NO: 445487

SEQ ID NO: 446782 - RNA, 65 nt, Homo Sapiens; identical to SEQ ID NO: 445488

SEQ ID NO: 446783 - RNA, 65 nt, Homo Sapiens; identical to SEQ ID NO: 445489

SEQ ID NO: 446784 - RNA, 65 nt, Homo Sapiens; identical to SEQ ID NO: 445490

SEQ ID NO: 446785 - RNA, 65 nt, Homo Sapiens; identical to SEQ ID NO: 445491

SEQ ID NO: 446786 - RNA, 65 nt, Homo Sapiens; identical to SEQ ID NO: 445492

SEQ ID NO: 446787 - RNA, 65 nt, Homo Sapiens; identical to SEQ ID NO: 445493

SEQ ID NO: 446788 - RNA, 65 nt, Homo Sapiens; identical to SEQ ID NO: 445494

SEQ ID NO: 446789 - RNA, 65 nt, Homo Sapiens; identical to SEQ ID NO: 445495

SEQ ID NO: 446790 - RNA, 65 nt, Homo Sapiens; identical to SEQ ID NO: 445496

SEQ ID NO: 446791 - RNA, 65 nt, Homo Sapiens; identical to SEQ ID NO: 445497

SEQ ID NO: 446792 - RNA, 65 nt, Homo Sapiens; identical to SEQ ID NO: 445498

SEQ ID NO: 446793 - RNA, 65 nt, Homo Sapiens; identical to SEQ ID NO: 445499

SEQ ID NO: 446794 - RNA, 65 nt, Homo Sapiens; identical to SEQ ID NO: 445500

SEQ ID NO: 446795 - RNA, 65 nt, Homo Sapiens; identical to SEQ ID NO: 445501

SEQ ID NO: 446796 - RNA, 65 nt, Homo Sapiens; identical to SEQ ID NO: 445502

SEQ ID NO: 446797 - RNA, 65 nt, Homo Sapiens; identical to SEQ ID NO: 445503

SEQ ID NO: 446798 - RNA, 65 nt, Homo Sapiens; identical to SEQ ID NO: 445504

SEQ ID NO: 446799 - RNA, 65 nt, Homo Sapiens; identical to SEQ ID NO: 445505

SEQ ID NO: 446800 - RNA, 65 nt, Homo Sapiens; identical to SEQ ID NO: 445506

SEQ ID NO: 446801 - RNA, 65 nt, Homo Sapiens; identical to SEQ ID NO: 445507

SEQ ID NO: 446802 - RNA, 65 nt, Homo Sapiens; identical to SEQ ID NO: 445508

SEQ ID NO: 446803 - RNA, 65 nt, Homo Sapiens; identical to SEQ ID NO: 445509

SEQ ID NO: 446804 - RNA, 65 nt, Homo Sapiens; identical to SEQ ID NO: 445510

SEQ ID NO: 446805 - RNA, 65 nt, Homo Sapiens; identical to SEQ ID NO: 445511

SEQ ID NO: 446806 - RNA, 65 nt, Homo Sapiens; identical to SEQ ID NO: 445512

SEQ ID NO: 446807 - RNA, 65 nt, Homo Sapiens; identical to SEQ ID NO: 445513

SEQ ID NO: 446808 - RNA, 65 nt, Homo Sapiens; identical to SEQ ID NO: 445514

SEQ ID NO: 446809 - RNA, 65 nt, Homo Sapiens; identical to SEQ ID NO: 445515

SEQ ID NO: 446810 - RNA, 65 nt, Homo Sapiens; identical to SEQ ID NO: 445516

SEQ ID NO: 446811 - RNA, 65 nt, Homo Sapiens; identical to SEQ ID NO: 445517

SEQ ID NO: 446812 - RNA, 65 nt, Homo Sapiens; identical to SEQ ID NO: 445518

SEQ ID NO: 446813 - RNA, 65 nt, Homo Sapiens; identical to SEQ ID NO: 445519

SEQ ID NO: 446814 - RNA, 65 nt, Homo Sapiens; identical to SEQ ID NO: 445520

SEQ ID NO: 446815 - RNA, 65 nt, Homo Sapiens; identical to SEQ ID NO: 445521

SEQ ID NO: 446816 - RNA, 65 nt, Homo Sapiens; identical to SEQ ID NO: 445522

SEQ ID NO: 446817 - RNA, 65 nt, Homo Sapiens; identical to SEQ ID NO: 445523

SEQ ID NO: 446818 - RNA, 65 nt, Homo Sapiens; identical to SEQ ID NO: 445524

SEQ ID NO: 446819 - RNA, 65 nt, Homo Sapiens; identical to SEQ ID NO: 445525

SEQ ID NO: 446820 - RNA, 65 nt, Homo Sapiens; identical to SEQ ID NO: 445526

SEQ ID NO: 446821 - RNA, 65 nt, Homo Sapiens; identical to SEQ ID NO: 445527

SEQ ID NO: 446822 - RNA, 65 nt, Homo Sapiens; identical to SEQ ID NO: 445528

SEQ ID NO: 446823 - RNA, 65 nt, Homo Sapiens; identical to SEQ ID NO: 445529

SEQ ID NO: 446824 - RNA, 65 nt, Homo Sapiens; identical to SEQ ID NO: 445530

SEQ ID NO: 446825 - RNA, 65 nt, Homo Sapiens; identical to SEQ ID NO: 445531

SEQ ID NO: 446826 - RNA, 65 nt, Homo Sapiens; identical to SEQ ID NO: 445532

SEQ ID NO: 446827 - RNA, 65 nt, Homo Sapiens; identical to SEQ ID NO: 445533

SEQ ID NO: 446828 - RNA, 65 nt, Homo Sapiens; identical to SEQ ID NO: 445534

SEQ ID NO: 446829 - RNA, 65 nt, Homo Sapiens; identical to SEQ ID NO: 445535

SEQ ID NO: 446830 - RNA, 65 nt, Homo Sapiens; identical to SEQ ID NO: 445536

SEQ ID NO: 446831 - RNA, 65 nt, Homo Sapiens; identical to SEQ ID NO: 445537

SEQ ID NO: 446832 - RNA, 65 nt, Homo Sapiens; identical to SEQ ID NO: 445538

SEQ ID NO: 446833 - RNA, 65 nt, Homo Sapiens; identical to SEQ ID NO: 445539

SEQ ID NO: 446834 - RNA, 65 nt, Homo Sapiens; identical to SEQ ID NO: 445540

SEQ ID NO: 446835 - RNA, 65 nt, Homo Sapiens; identical to SEQ ID NO: 445541

SEQ ID NO: 446836 - RNA, 65 nt, Homo Sapiens; identical to SEQ ID NO: 445542

SEQ ID NO: 446837 - RNA, 65 nt, Homo Sapiens; identical to SEQ ID NO: 445543

SEQ ID NO: 446838 - RNA, 65 nt, Homo Sapiens; identical to SEQ ID NO: 445544

SEQ ID NO: 446839 - RNA, 65 nt, Homo Sapiens; identical to SEQ ID NO: 445545

SEQ ID NO: 446840 - RNA, 65 nt, Homo Sapiens; identical to SEQ ID NO: 445546

SEQ ID NO: 446841 - RNA, 65 nt, Homo Sapiens; identical to SEQ ID NO: 445547

SEQ ID NO: 446842 - RNA, 65 nt, Homo Sapiens; identical to SEQ ID NO: 445548

SEQ ID NO: 446843 - RNA, 65 nt, Homo Sapiens; identical to SEQ ID NO: 445549

SEQ ID NO: 446844 - RNA, 65 nt, Homo Sapiens; identical to SEQ ID NO: 445550

SEQ ID NO: 446845 - RNA, 65 nt, Homo Sapiens; identical to SEQ ID NO: 445551

SEQ ID NO: 446846 - RNA, 65 nt, Homo Sapiens; identical to SEQ ID NO: 445552

SEQ ID NO: 446847 - RNA, 65 nt, Homo Sapiens; identical to SEQ ID NO: 445553

SEQ ID NO: 446848 - RNA, 65 nt, Homo Sapiens; identical to SEQ ID NO: 445554

SEQ ID NO: 446849 - RNA, 65 nt, Homo Sapiens; identical to SEQ ID NO: 445555

SEQ ID NO: 446850 - RNA, 65 nt, Homo Sapiens; identical to SEQ ID NO: 445556

SEQ ID NO: 446851 - RNA, 65 nt, Homo Sapiens; identical to SEQ ID NO: 445557

SEQ ID NO: 446852 - RNA, 65 nt, Homo Sapiens; identical to SEQ ID NO: 445558

SEQ ID NO: 446853 - RNA, 65 nt, Homo Sapiens; identical to SEQ ID NO: 445559

SEQ ID NO: 446854 - RNA, 65 nt, Homo Sapiens; identical to SEQ ID NO: 445560

SEQ ID NO: 446855 - RNA, 65 nt, Homo Sapiens; identical to SEQ ID NO: 445561

SEQ ID NO: 446856 - RNA, 65 nt, Homo Sapiens; identical to SEQ ID NO: 445562

SEQ ID NO: 446857 - RNA, 65 nt, Homo Sapiens; identical to SEQ ID NO: 445563

SEQ ID NO: 446858 - RNA, 65 nt, Homo Sapiens; identical to SEQ ID NO: 445564

SEQ ID NO: 446859 - RNA, 65 nt, Homo Sapiens; identical to SEQ ID NO: 445565

SEQ ID NO: 446860 - RNA, 65 nt, Homo Sapiens; identical to SEQ ID NO: 445566

SEQ ID NO: 446861 - RNA, 65 nt, Homo Sapiens; identical to SEQ ID NO: 445567

SEQ ID NO: 446862 - RNA, 65 nt, Homo Sapiens; identical to SEQ ID NO: 445568

SEQ ID NO: 446863 - RNA, 65 nt, Homo Sapiens; identical to SEQ ID NO: 445569

SEQ ID NO: 446864 - RNA, 65 nt, Homo Sapiens; identical to SEQ ID NO: 445570

SEQ ID NO: 446865 - RNA, 65 nt, Homo Sapiens; identical to SEQ ID NO: 445571

SEQ ID NO: 446866 - RNA, 65 nt, Homo Sapiens; identical to SEQ ID NO: 445572

SEQ ID NO: 446867 - RNA, 65 nt, Homo Sapiens; identical to SEQ ID NO: 445573

SEQ ID NO: 446868 - RNA, 65 nt, Homo Sapiens; identical to SEQ ID NO: 445574

SEQ ID NO: 446869 - RNA, 65 nt, Homo Sapiens; identical to SEQ ID NO: 445575

SEQ ID NO: 446870 - RNA, 65 nt, Homo Sapiens; identical to SEQ ID NO: 445576

SEQ ID NO: 446871 - RNA, 65 nt, Homo Sapiens; identical to SEQ ID NO: 445577

SEQ ID NO: 446872 - RNA, 65 nt, Homo Sapiens; identical to SEQ ID NO: 445578

SEQ ID NO: 446873 - RNA, 65 nt, Homo Sapiens; identical to SEQ ID NO: 445579

SEQ ID NO: 446874 - RNA, 65 nt, Homo Sapiens; identical to SEQ ID NO: 445580

SEQ ID NO: 446875 - RNA, 65 nt, Homo Sapiens; identical to SEQ ID NO: 445581

SEQ ID NO: 446876 - RNA, 65 nt, Homo Sapiens; identical to SEQ ID NO: 445582

SEQ ID NO: 446877 - RNA, 65 nt, Homo Sapiens; identical to SEQ ID NO: 445583

SEQ ID NO: 446878 - RNA, 65 nt, Homo Sapiens; identical to SEQ ID NO: 445584

SEQ ID NO: 446879 - RNA, 65 nt, Homo Sapiens; identical to SEQ ID NO: 445585

SEQ ID NO: 446880 - RNA, 65 nt, Homo Sapiens; identical to SEQ ID NO: 445586

SEQ ID NO: 446881 - RNA, 65 nt, Homo Sapiens; identical to SEQ ID NO: 445587

SEQ ID NO: 446882 - RNA, 65 nt, Homo Sapiens; identical to SEQ ID NO: 445588

SEQ ID NO: 446883 - RNA, 65 nt, Homo Sapiens; identical to SEQ ID NO: 445589

SEQ ID NO: 446884 - RNA, 65 nt, Homo Sapiens; identical to SEQ ID NO: 445590

SEQ ID NO: 446885 - RNA, 65 nt, Homo Sapiens; identical to SEQ ID NO: 445591

SEQ ID NO: 446886 - RNA, 65 nt, Homo Sapiens; identical to SEQ ID NO: 445592

SEQ ID NO: 446887 - RNA, 65 nt, Homo Sapiens; identical to SEQ ID NO: 445593

SEQ ID NO: 446888 - RNA, 65 nt, Homo Sapiens; identical to SEQ ID NO: 445594

SEQ ID NO: 446889 - RNA, 65 nt, Homo Sapiens; identical to SEQ ID NO: 445595

SEQ ID NO: 446890 - RNA, 65 nt, Homo Sapiens; identical to SEQ ID NO: 445596

SEQ ID NO: 446891 - RNA, 65 nt, Homo Sapiens; identical to SEQ ID NO: 445597

SEQ ID NO: 446892 - RNA, 65 nt, Homo Sapiens; identical to SEQ ID NO: 445598

SEQ ID NO: 446893 - RNA, 65 nt, Homo Sapiens; identical to SEQ ID NO: 445599

SEQ ID NO: 446894 - RNA, 65 nt, Homo Sapiens; identical to SEQ ID NO: 445600

SEQ ID NO: 446895 - RNA, 65 nt, Homo Sapiens; identical to SEQ ID NO: 445601

SEQ ID NO: 446896 - RNA, 65 nt, Homo Sapiens; identical to SEQ ID NO: 445602

SEQ ID NO: 446897 - RNA, 65 nt, Homo Sapiens; identical to SEQ ID NO: 445603

SEQ ID NO: 446898 - RNA, 65 nt, Homo Sapiens; identical to SEQ ID NO: 445604

SEQ ID NO: 446899 - RNA, 66 nt, Homo Sapiens; identical to SEQ ID NO: 445605

SEQ ID NO: 446900 - RNA, 66 nt, Homo Sapiens; identical to SEQ ID NO: 445606

SEQ ID NO: 446901 - RNA, 66 nt, Homo Sapiens; identical to SEQ ID NO: 445607

SEQ ID NO: 446902 - RNA, 66 nt, Homo Sapiens; identical to SEQ ID NO: 445608

SEQ ID NO: 446903 - RNA, 66 nt, Homo Sapiens; identical to SEQ ID NO: 445609

SEQ ID NO: 446904 - RNA, 66 nt, Homo Sapiens; identical to SEQ ID NO: 445610

SEQ ID NO: 446905 - RNA, 66 nt, Homo Sapiens; identical to SEQ ID NO: 445611

SEQ ID NO: 446906 - RNA, 66 nt, Homo Sapiens; identical to SEQ ID NO: 445612

SEQ ID NO: 446907 - RNA, 66 nt, Homo Sapiens; identical to SEQ ID NO: 445613

SEQ ID NO: 446908 - RNA, 66 nt, Homo Sapiens; identical to SEQ ID NO: 445614

SEQ ID NO: 446909 - RNA, 66 nt, Homo Sapiens; identical to SEQ ID NO: 445615

SEQ ID NO: 446910 - RNA, 66 nt, Homo Sapiens; identical to SEQ ID NO: 445616

SEQ ID NO: 446911 - RNA, 66 nt, Homo Sapiens; identical to SEQ ID NO: 445617

SEQ ID NO: 446912 - RNA, 66 nt, Homo Sapiens; identical to SEQ ID NO: 445618

SEQ ID NO: 446913 - RNA, 66 nt, Homo Sapiens; identical to SEQ ID NO: 445619

SEQ ID NO: 446914 - RNA, 66 nt, Homo Sapiens; identical to SEQ ID NO: 445620

SEQ ID NO: 446915 - RNA, 66 nt, Homo Sapiens; identical to SEQ ID NO: 445621

SEQ ID NO: 446916 - RNA, 66 nt, Homo Sapiens; identical to SEQ ID NO: 445622

SEQ ID NO: 446917 - RNA, 66 nt, Homo Sapiens; identical to SEQ ID NO: 445623

SEQ ID NO: 446918 - RNA, 66 nt, Homo Sapiens; identical to SEQ ID NO: 445624

SEQ ID NO: 446919 - RNA, 66 nt, Homo Sapiens; identical to SEQ ID NO: 445625

SEQ ID NO: 446920 - RNA, 66 nt, Homo Sapiens; identical to SEQ ID NO: 445626

SEQ ID NO: 446921 - RNA, 66 nt, Homo Sapiens; identical to SEQ ID NO: 445627

SEQ ID NO: 446922 - RNA, 55 nt, Homo Sapiens; identical to SEQ ID NO: 445050

SEQ ID NO: 446923 - RNA, 66 nt, Homo Sapiens; identical to SEQ ID NO: 445629

SEQ ID NO: 446924 - RNA, 66 nt, Homo Sapiens; identical to SEQ ID NO: 445630

SEQ ID NO: 446925 - RNA, 66 nt, Homo Sapiens; identical to SEQ ID NO: 445631

SEQ ID NO: 446926 - RNA, 66 nt, Homo Sapiens; identical to SEQ ID NO: 445632

SEQ ID NO: 446927 - RNA, 66 nt, Homo Sapiens; identical to SEQ ID NO: 445633

SEQ ID NO: 446928 - RNA, 66 nt, Homo Sapiens; identical to SEQ ID NO: 445634

SEQ ID NO: 446929 - RNA, 66 nt, Homo Sapiens; identical to SEQ ID NO: 445635

SEQ ID NO: 446930 - RNA, 66 nt, Homo Sapiens; identical to SEQ ID NO: 445636

SEQ ID NO: 446931 - RNA, 66 nt, Homo Sapiens; identical to SEQ ID NO: 445637

SEQ ID NO: 446932 - RNA, 66 nt, Homo Sapiens; identical to SEQ ID NO: 445638

SEQ ID NO: 446933 - RNA, 66 nt, Homo Sapiens; identical to SEQ ID NO: 445639

SEQ ID NO: 446934 - RNA, 66 nt, Homo Sapiens; identical to SEQ ID NO: 445640

SEQ ID NO: 446935 - RNA, 66 nt, Homo Sapiens; identical to SEQ ID NO: 445641

SEQ ID NO: 446936 - RNA, 66 nt, Homo Sapiens; identical to SEQ ID NO: 445642

SEQ ID NO: 446937 - RNA, 66 nt, Homo Sapiens; identical to SEQ ID NO: 445643

SEQ ID NO: 446938 - RNA, 66 nt, Homo Sapiens; identical to SEQ ID NO: 445644

SEQ ID NO: 446939 - RNA, 66 nt, Homo Sapiens; identical to SEQ ID NO: 445645

SEQ ID NO: 446940 - RNA, 66 nt, Homo Sapiens; identical to SEQ ID NO: 445646

SEQ ID NO: 446941 - RNA, 66 nt, Homo Sapiens; identical to SEQ ID NO: 445647

SEQ ID NO: 446942 - RNA, 66 nt, Homo Sapiens; identical to SEQ ID NO: 445648

SEQ ID NO: 446943 - RNA, 66 nt, Homo Sapiens; identical to SEQ ID NO: 445649

SEQ ID NO: 446944 - RNA, 66 nt, Homo Sapiens; identical to SEQ ID NO: 445650

SEQ ID NO: 446945 - RNA, 66 nt, Homo Sapiens; identical to SEQ ID NO: 445651

SEQ ID NO: 446946 - RNA, 66 nt, Homo Sapiens; identical to SEQ ID NO: 445652

SEQ ID NO: 446947 - RNA, 66 nt, Homo Sapiens; identical to SEQ ID NO: 445653

SEQ ID NO: 446948 - RNA, 66 nt, Homo Sapiens; identical to SEQ ID NO: 445654

SEQ ID NO: 446949 - RNA, 66 nt, Homo Sapiens; identical to SEQ ID NO: 445655

SEQ ID NO: 446950 - RNA, 66 nt, Homo Sapiens; identical to SEQ ID NO: 445656

SEQ ID NO: 446951 - RNA, 66 nt, Homo Sapiens; identical to SEQ ID NO: 445657

SEQ ID NO: 446952 - RNA, 66 nt, Homo Sapiens; identical to SEQ ID NO: 445658

SEQ ID NO: 446953 - RNA, 66 nt, Homo Sapiens; identical to SEQ ID NO: 445659

SEQ ID NO: 446954 - RNA, 66 nt, Homo Sapiens; identical to SEQ ID NO: 445660

SEQ ID NO: 446955 - RNA, 66 nt, Homo Sapiens; identical to SEQ ID NO: 445661

SEQ ID NO: 446956 - RNA, 66 nt, Homo Sapiens; identical to SEQ ID NO: 445662

SEQ ID NO: 446957 - RNA, 66 nt, Homo Sapiens; identical to SEQ ID NO: 445663

SEQ ID NO: 446958 - RNA, 66 nt, Homo Sapiens; identical to SEQ ID NO: 445664

SEQ ID NO: 446959 - RNA, 66 nt, Homo Sapiens; identical to SEQ ID NO: 445665

SEQ ID NO: 446960 - RNA, 66 nt, Homo Sapiens; identical to SEQ ID NO: 445666

SEQ ID NO: 446961 - RNA, 66 nt, Homo Sapiens; identical to SEQ ID NO: 445667

SEQ ID NO: 446962 - RNA, 66 nt, Homo Sapiens; identical to SEQ ID NO: 445668

SEQ ID NO: 446963 - RNA, 66 nt, Homo Sapiens; identical to SEQ ID NO: 445669

SEQ ID NO: 446964 - RNA, 66 nt, Homo Sapiens; identical to SEQ ID NO: 445670

SEQ ID NO: 446965 - RNA, 66 nt, Homo Sapiens; identical to SEQ ID NO: 445671

SEQ ID NO: 446966 - RNA, 66 nt, Homo Sapiens; identical to SEQ ID NO: 445672

SEQ ID NO: 446967 - RNA, 66 nt, Homo Sapiens; identical to SEQ ID NO: 445673

SEQ ID NO: 446968 - RNA, 66 nt, Homo Sapiens; identical to SEQ ID NO: 445674

SEQ ID NO: 446969 - RNA, 66 nt, Homo Sapiens; identical to SEQ ID NO: 445675

SEQ ID NO: 446970 - RNA, 66 nt, Homo Sapiens; identical to SEQ ID NO: 445676

SEQ ID NO: 446971 - RNA, 66 nt, Homo Sapiens; identical to SEQ ID NO: 445677

SEQ ID NO: 446972 - RNA, 66 nt, Homo Sapiens; identical to SEQ ID NO: 445678

SEQ ID NO: 446973 - RNA, 66 nt, Homo Sapiens; identical to SEQ ID NO: 445679

SEQ ID NO: 446974 - RNA, 66 nt, Homo Sapiens; identical to SEQ ID NO: 445680

SEQ ID NO: 446975 - RNA, 66 nt, Homo Sapiens; identical to SEQ ID NO: 445681

SEQ ID NO: 446976 - RNA, 66 nt, Homo Sapiens; identical to SEQ ID NO: 445682

SEQ ID NO: 446977 - RNA, 66 nt, Homo Sapiens; identical to SEQ ID NO: 445683

SEQ ID NO: 446978 - RNA, 66 nt, Homo Sapiens; identical to SEQ ID NO: 445684

SEQ ID NO: 446979 - RNA, 66 nt, Homo Sapiens; identical to SEQ ID NO: 445685

SEQ ID NO: 446980 - RNA, 66 nt, Homo Sapiens; identical to SEQ ID NO: 445686

SEQ ID NO: 446981 - RNA, 66 nt, Homo Sapiens; identical to SEQ ID NO: 445687

SEQ ID NO: 446982 - RNA, 66 nt, Homo Sapiens; identical to SEQ ID NO: 445688

SEQ ID NO: 446983 - RNA, 66 nt, Homo Sapiens; identical to SEQ ID NO: 445689

SEQ ID NO: 446984 - RNA, 66 nt, Homo Sapiens; identical to SEQ ID NO: 445690

SEQ ID NO: 446985 - RNA, 66 nt, Homo Sapiens; identical to SEQ ID NO: 445691

SEQ ID NO: 446986 - RNA, 66 nt, Homo Sapiens; identical to SEQ ID NO: 445692

SEQ ID NO: 446987 - RNA, 66 nt, Homo Sapiens; identical to SEQ ID NO: 445693

SEQ ID NO: 446988 - RNA, 66 nt, Homo Sapiens; identical to SEQ ID NO: 445694

SEQ ID NO: 446989 - RNA, 66 nt, Homo Sapiens; identical to SEQ ID NO: 445695

SEQ ID NO: 446990 - RNA, 66 nt, Homo Sapiens; identical to SEQ ID NO: 445696

SEQ ID NO: 446991 - RNA, 66 nt, Homo Sapiens; identical to SEQ ID NO: 445697

SEQ ID NO: 446992 - RNA, 66 nt, Homo Sapiens; identical to SEQ ID NO: 445698

SEQ ID NO: 446993 - RNA, 66 nt, Homo Sapiens; identical to SEQ ID NO: 445699

SEQ ID NO: 446994 - RNA, 66 nt, Homo Sapiens; identical to SEQ ID NO: 445700

SEQ ID NO: 446995 - RNA, 66 nt, Homo Sapiens; identical to SEQ ID NO: 445701

SEQ ID NO: 446996 - RNA, 66 nt, Homo Sapiens; identical to SEQ ID NO: 445702

SEQ ID NO: 446997 - RNA, 66 nt, Homo Sapiens; identical to SEQ ID NO: 445703

SEQ ID NO: 446998 - RNA, 66 nt, Homo Sapiens; identical to SEQ ID NO: 445704

SEQ ID NO: 446999 - RNA, 66 nt, Homo Sapiens; identical to SEQ ID NO: 445705

SEQ ID NO: 447000 - RNA, 66 nt, Homo Sapiens; identical to SEQ ID NO: 445706

SEQ ID NO: 447001 - RNA, 66 nt, Homo Sapiens; identical to SEQ ID NO: 445707

SEQ ID NO: 447002 - RNA, 66 nt, Homo Sapiens; identical to SEQ ID NO: 445708

SEQ ID NO: 447003 - RNA, 66 nt, Homo Sapiens; identical to SEQ ID NO: 445709

SEQ ID NO: 447004 - RNA, 66 nt, Homo Sapiens; identical to SEQ ID NO: 445710

SEQ ID NO: 447005 - RNA, 66 nt, Homo Sapiens; identical to SEQ ID NO: 445711

SEQ ID NO: 447006 - RNA, 66 nt, Homo Sapiens; identical to SEQ ID NO: 445712

SEQ ID NO: 447007 - RNA, 66 nt, Homo Sapiens; identical to SEQ ID NO: 445713

SEQ ID NO: 447008 - RNA, 66 nt, Homo Sapiens; identical to SEQ ID NO: 445714

SEQ ID NO: 447009 - RNA, 66 nt, Homo Sapiens; identical to SEQ ID NO: 445715

SEQ ID NO: 447010 - RNA, 66 nt, Homo Sapiens; identical to SEQ ID NO: 445716

SEQ ID NO: 447011 - RNA, 66 nt, Homo Sapiens; identical to SEQ ID NO: 445717

SEQ ID NO: 447012 - RNA, 66 nt, Homo Sapiens; identical to SEQ ID NO: 445718

SEQ ID NO: 447013 - RNA, 66 nt, Homo Sapiens; identical to SEQ ID NO: 445719

SEQ ID NO: 447014 - RNA, 66 nt, Homo Sapiens; identical to SEQ ID NO: 445720

SEQ ID NO: 447015 - RNA, 66 nt, Homo Sapiens; identical to SEQ ID NO: 445721

SEQ ID NO: 447016 - RNA, 66 nt, Homo Sapiens; identical to SEQ ID NO: 445722

SEQ ID NO: 447017 - RNA, 66 nt, Homo Sapiens; identical to SEQ ID NO: 445723

SEQ ID NO: 447018 - RNA, 66 nt, Homo Sapiens; identical to SEQ ID NO: 445724

SEQ ID NO: 447019 - RNA, 66 nt, Homo Sapiens; identical to SEQ ID NO: 445725

SEQ ID NO: 447020 - RNA, 66 nt, Homo Sapiens; identical to SEQ ID NO: 445726

SEQ ID NO: 447021 - RNA, 66 nt, Homo Sapiens; identical to SEQ ID NO: 445727

SEQ ID NO: 447022 - RNA, 66 nt, Homo Sapiens; identical to SEQ ID NO: 445728

SEQ ID NO: 447023 - RNA, 57 nt, Homo Sapiens; identical to SEQ ID NO: 445151

SEQ ID NO: 447024 - RNA, 66 nt, Homo Sapiens; identical to SEQ ID NO: 445730

SEQ ID NO: 447025 - RNA, 66 nt, Homo Sapiens; identical to SEQ ID NO: 445731

SEQ ID NO: 447026 - RNA, 66 nt, Homo Sapiens; identical to SEQ ID NO: 445732

SEQ ID NO: 447027 - RNA, 66 nt, Homo Sapiens; identical to SEQ ID NO: 445733

SEQ ID NO: 447028 - RNA, 66 nt, Homo Sapiens; identical to SEQ ID NO: 445734

SEQ ID NO: 447029 - RNA, 66 nt, Homo Sapiens; identical to SEQ ID NO: 445735

SEQ ID NO: 447030 - RNA, 66 nt, Homo Sapiens; identical to SEQ ID NO: 445736

SEQ ID NO: 447031 - RNA, 66 nt, Homo Sapiens; identical to SEQ ID NO: 445737

SEQ ID NO: 447032 - RNA, 66 nt, Homo Sapiens; identical to SEQ ID NO: 445738

SEQ ID NO: 447033 - RNA, 66 nt, Homo Sapiens; identical to SEQ ID NO: 445739

SEQ ID NO: 447034 - RNA, 66 nt, Homo Sapiens; identical to SEQ ID NO: 445740

SEQ ID NO: 447035 - RNA, 66 nt, Homo Sapiens; identical to SEQ ID NO: 445741

SEQ ID NO: 447036 - RNA, 66 nt, Homo Sapiens; identical to SEQ ID NO: 445742

SEQ ID NO: 447037 - RNA, 66 nt, Homo Sapiens; identical to SEQ ID NO: 445743

SEQ ID NO: 447038 - RNA, 66 nt, Homo Sapiens; identical to SEQ ID NO: 445744

SEQ ID NO: 447039 - RNA, 66 nt, Homo Sapiens; identical to SEQ ID NO: 445745

SEQ ID NO: 447040 - RNA, 66 nt, Homo Sapiens; identical to SEQ ID NO: 445746

SEQ ID NO: 447041 - RNA, 66 nt, Homo Sapiens; identical to SEQ ID NO: 445747

SEQ ID NO: 447042 - RNA, 66 nt, Homo Sapiens; identical to SEQ ID NO: 445748

SEQ ID NO: 447043 - RNA, 66 nt, Homo Sapiens; identical to SEQ ID NO: 445749

SEQ ID NO: 447044 - RNA, 66 nt, Homo Sapiens; identical to SEQ ID NO: 445750

SEQ ID NO: 447045 - RNA, 66 nt, Homo Sapiens; identical to SEQ ID NO: 445751

SEQ ID NO: 447046 - RNA, 66 nt, Homo Sapiens; identical to SEQ ID NO: 445752

SEQ ID NO: 447047 - RNA, 66 nt, Homo Sapiens; identical to SEQ ID NO: 445753

SEQ ID NO: 447048 - RNA, 66 nt, Homo Sapiens; identical to SEQ ID NO: 445754

SEQ ID NO: 447049 - RNA, 66 nt, Homo Sapiens; identical to SEQ ID NO: 445755

SEQ ID NO: 447050 - RNA, 66 nt, Homo Sapiens; identical to SEQ ID NO: 445756

SEQ ID NO: 447051 - RNA, 66 nt, Homo Sapiens; identical to SEQ ID NO: 445757

SEQ ID NO: 447052 - RNA, 59 nt, Homo Sapiens; identical to SEQ ID NO: 445180

SEQ ID NO: 447053 - RNA, 66 nt, Homo Sapiens; identical to SEQ ID NO: 445759

SEQ ID NO: 447054 - RNA, 66 nt, Homo Sapiens; identical to SEQ ID NO: 445760

SEQ ID NO: 447055 - RNA, 66 nt, Homo Sapiens; identical to SEQ ID NO: 445761

SEQ ID NO: 447056 - RNA, 66 nt, Homo Sapiens; identical to SEQ ID NO: 445762

SEQ ID NO: 447057 - RNA, 66 nt, Homo Sapiens; identical to SEQ ID NO: 445763

SEQ ID NO: 447058 - RNA, 66 nt, Homo Sapiens; identical to SEQ ID NO: 445764

SEQ ID NO: 447059 - RNA, 66 nt, Homo Sapiens; identical to SEQ ID NO: 445765

SEQ ID NO: 447060 - RNA, 66 nt, Homo Sapiens; identical to SEQ ID NO: 445766

SEQ ID NO: 447061 - RNA, 66 nt, Homo Sapiens; identical to SEQ ID NO: 445767

SEQ ID NO: 447062 - RNA, 66 nt, Homo Sapiens; identical to SEQ ID NO: 445768

SEQ ID NO: 447063 - RNA, 66 nt, Homo Sapiens; identical to SEQ ID NO: 445769

SEQ ID NO: 447064 - RNA, 66 nt, Homo Sapiens; identical to SEQ ID NO: 445770

SEQ ID NO: 447065 - RNA, 66 nt, Homo Sapiens; identical to SEQ ID NO: 445771

SEQ ID NO: 447066 - RNA, 66 nt, Homo Sapiens; identical to SEQ ID NO: 445772

SEQ ID NO: 447067 - RNA, 66 nt, Homo Sapiens; identical to SEQ ID NO: 445773

SEQ ID NO: 447068 - RNA, 66 nt, Homo Sapiens; identical to SEQ ID NO: 445774

SEQ ID NO: 447069 - RNA, 66 nt, Homo Sapiens; identical to SEQ ID NO: 445775

SEQ ID NO: 447070 - RNA, 66 nt, Homo Sapiens; identical to SEQ ID NO: 445776

SEQ ID NO: 447071 - RNA, 66 nt, Homo Sapiens; identical to SEQ ID NO: 445777

SEQ ID NO: 447072 - RNA, 66 nt, Homo Sapiens; identical to SEQ ID NO: 445778

SEQ ID NO: 447073 - RNA, 66 nt, Homo Sapiens; identical to SEQ ID NO: 445779

SEQ ID NO: 447074 - RNA, 66 nt, Homo Sapiens; identical to SEQ ID NO: 445780

SEQ ID NO: 447075 - RNA, 66 nt, Homo Sapiens; identical to SEQ ID NO: 445781

SEQ ID NO: 447076 - RNA, 66 nt, Homo Sapiens; identical to SEQ ID NO: 445782

SEQ ID NO: 447077 - RNA, 66 nt, Homo Sapiens; identical to SEQ ID NO: 445783

SEQ ID NO: 447078 - RNA, 66 nt, Homo Sapiens; identical to SEQ ID NO: 445784

SEQ ID NO: 447079 - RNA, 66 nt, Homo Sapiens; identical to SEQ ID NO: 445785

SEQ ID NO: 447080 - RNA, 66 nt, Homo Sapiens; identical to SEQ ID NO: 445786

SEQ ID NO: 447081 - RNA, 66 nt, Homo Sapiens; identical to SEQ ID NO: 445787

SEQ ID NO: 447082 - RNA, 66 nt, Homo Sapiens; identical to SEQ ID NO: 445788

SEQ ID NO: 447083 - RNA, 66 nt, Homo Sapiens; identical to SEQ ID NO: 445789

SEQ ID NO: 447084 - RNA, 66 nt, Homo Sapiens; identical to SEQ ID NO: 445790

SEQ ID NO: 447085 - RNA, 66 nt, Homo Sapiens; identical to SEQ ID NO: 445791

SEQ ID NO: 447086 - RNA, 66 nt, Homo Sapiens; identical to SEQ ID NO: 445792

SEQ ID NO: 447087 - RNA, 66 nt, Homo Sapiens; identical to SEQ ID NO: 445793

SEQ ID NO: 447088 - RNA, 66 nt, Homo Sapiens; identical to SEQ ID NO: 445794

SEQ ID NO: 447089 - RNA, 66 nt, Homo Sapiens; identical to SEQ ID NO: 445795

SEQ ID NO: 447090 - RNA, 66 nt, Homo Sapiens; identical to SEQ ID NO: 445796

SEQ ID NO: 447091 - RNA, 66 nt, Homo Sapiens; identical to SEQ ID NO: 445797

SEQ ID NO: 447092 - RNA, 66 nt, Homo Sapiens; identical to SEQ ID NO: 445798

SEQ ID NO: 447093 - RNA, 66 nt, Homo Sapiens; identical to SEQ ID NO: 445799

SEQ ID NO: 447094 - RNA, 66 nt, Homo Sapiens; identical to SEQ ID NO: 445800

SEQ ID NO: 447095 - RNA, 66 nt, Homo Sapiens; identical to SEQ ID NO: 445801

SEQ ID NO: 447096 - RNA, 66 nt, Homo Sapiens; identical to SEQ ID NO: 445802

SEQ ID NO: 447097 - RNA, 66 nt, Homo Sapiens; identical to SEQ ID NO: 445803

SEQ ID NO: 447098 - RNA, 66 nt, Homo Sapiens; identical to SEQ ID NO: 445804

SEQ ID NO: 447099 - RNA, 66 nt, Homo Sapiens; identical to SEQ ID NO: 445805

SEQ ID NO: 447100 - RNA, 66 nt, Homo Sapiens; identical to SEQ ID NO: 445806

SEQ ID NO: 447101 - RNA, 66 nt, Homo Sapiens; identical to SEQ ID NO: 445807

SEQ ID NO: 447102 - RNA, 66 nt, Homo Sapiens; identical to SEQ ID NO: 445808

SEQ ID NO: 447103 - RNA, 66 nt, Homo Sapiens; identical to SEQ ID NO: 445809

SEQ ID NO: 447104 - RNA, 66 nt, Homo Sapiens; identical to SEQ ID NO: 445810

SEQ ID NO: 447105 - RNA, 66 nt, Homo Sapiens; identical to SEQ ID NO: 445811

SEQ ID NO: 447106 - RNA, 66 nt, Homo Sapiens; identical to SEQ ID NO: 445812

SEQ ID NO: 447107 - RNA, 66 nt, Homo Sapiens; identical to SEQ ID NO: 445813

SEQ ID NO: 447108 - RNA, 66 nt, Homo Sapiens; identical to SEQ ID NO: 445814

SEQ ID NO: 447109 - RNA, 66 nt, Homo Sapiens; identical to SEQ ID NO: 445815

SEQ ID NO: 447110 - RNA, 66 nt, Homo Sapiens; identical to SEQ ID NO: 445816

SEQ ID NO: 447111 - RNA, 66 nt, Homo Sapiens; identical to SEQ ID NO: 445817

SEQ ID NO: 447112 - RNA, 66 nt, Homo Sapiens; identical to SEQ ID NO: 445818

SEQ ID NO: 447113 - RNA, 66 nt, Homo Sapiens; identical to SEQ ID NO: 445819

SEQ ID NO: 447114 - RNA, 66 nt, Homo Sapiens; identical to SEQ ID NO: 445820

SEQ ID NO: 447115 - RNA, 66 nt, Homo Sapiens; identical to SEQ ID NO: 445821

SEQ ID NO: 447116 - RNA, 66 nt, Homo Sapiens; identical to SEQ ID NO: 445822

SEQ ID NO: 447117 - RNA, 66 nt, Homo Sapiens; identical to SEQ ID NO: 445823

SEQ ID NO: 447118 - RNA, 66 nt, Homo Sapiens; identical to SEQ ID NO: 445824

SEQ ID NO: 447119 - RNA, 66 nt, Homo Sapiens; identical to SEQ ID NO: 445825

SEQ ID NO: 447120 - RNA, 66 nt, Homo Sapiens; identical to SEQ ID NO: 445826

SEQ ID NO: 447121 - RNA, 66 nt, Homo Sapiens; identical to SEQ ID NO: 445827

SEQ ID NO: 447122 - RNA, 66 nt, Homo Sapiens; identical to SEQ ID NO: 445828

SEQ ID NO: 447123 - RNA, 66 nt, Homo Sapiens; identical to SEQ ID NO: 445829

SEQ ID NO: 447124 - RNA, 66 nt, Homo Sapiens; identical to SEQ ID NO: 445830

SEQ ID NO: 447125 - RNA, 66 nt, Homo Sapiens; identical to SEQ ID NO: 445831

SEQ ID NO: 447126 - RNA, 66 nt, Homo Sapiens; identical to SEQ ID NO: 445832

SEQ ID NO: 447127 - RNA, 66 nt, Homo Sapiens; identical to SEQ ID NO: 445833

SEQ ID NO: 447128 - RNA, 66 nt, Homo Sapiens; identical to SEQ ID NO: 445834

SEQ ID NO: 447129 - RNA, 66 nt, Homo Sapiens; identical to SEQ ID NO: 445835

SEQ ID NO: 447130 - RNA, 66 nt, Homo Sapiens; identical to SEQ ID NO: 445836

SEQ ID NO: 447131 - RNA, 66 nt, Homo Sapiens; identical to SEQ ID NO: 445837

SEQ ID NO: 447132 - RNA, 66 nt, Homo Sapiens; identical to SEQ ID NO: 445838

SEQ ID NO: 447133 - RNA, 66 nt, Homo Sapiens; identical to SEQ ID NO: 445839

SEQ ID NO: 447134 - RNA, 66 nt, Homo Sapiens; identical to SEQ ID NO: 445840

SEQ ID NO: 447135 - RNA, 66 nt, Homo Sapiens; identical to SEQ ID NO: 445841

SEQ ID NO: 447136 - RNA, 66 nt, Homo Sapiens; identical to SEQ ID NO: 445842

SEQ ID NO: 447137 - RNA, 66 nt, Homo Sapiens; identical to SEQ ID NO: 445843

SEQ ID NO: 447138 - RNA, 66 nt, Homo Sapiens; identical to SEQ ID NO: 445844

SEQ ID NO: 447139 - RNA, 66 nt, Homo Sapiens; identical to SEQ ID NO: 445845

SEQ ID NO: 447140 - RNA, 66 nt, Homo Sapiens; identical to SEQ ID NO: 445846

SEQ ID NO: 447141 - RNA, 66 nt, Homo Sapiens; identical to SEQ ID NO: 445847

SEQ ID NO: 447142 - RNA, 66 nt, Homo Sapiens; identical to SEQ ID NO: 445848

SEQ ID NO: 447143 - RNA, 66 nt, Homo Sapiens; identical to SEQ ID NO: 445849

SEQ ID NO: 447144 - RNA, 66 nt, Homo Sapiens; identical to SEQ ID NO: 445850

SEQ ID NO: 447145 - RNA, 66 nt, Homo Sapiens; identical to SEQ ID NO: 445851

SEQ ID NO: 447146 - RNA, 66 nt, Homo Sapiens; identical to SEQ ID NO: 445852

SEQ ID NO: 447147 - RNA, 66 nt, Homo Sapiens; identical to SEQ ID NO: 445853

SEQ ID NO: 447148 - RNA, 66 nt, Homo Sapiens; identical to SEQ ID NO: 445854

SEQ ID NO: 447149 - RNA, 66 nt, Homo Sapiens; identical to SEQ ID NO: 445855

SEQ ID NO: 447150 - RNA, 66 nt, Homo Sapiens; identical to SEQ ID NO: 445856

SEQ ID NO: 447151 - RNA, 66 nt, Homo Sapiens; identical to SEQ ID NO: 445857

SEQ ID NO: 447152 - RNA, 66 nt, Homo Sapiens; identical to SEQ ID NO: 445858

SEQ ID NO: 447153 - RNA, 66 nt, Homo Sapiens; identical to SEQ ID NO: 445859

SEQ ID NO: 447154 - RNA, 66 nt, Homo Sapiens; identical to SEQ ID NO: 445860

SEQ ID NO: 447155 - RNA, 66 nt, Homo Sapiens; identical to SEQ ID NO: 445861

SEQ ID NO: 447156 - RNA, 66 nt, Homo Sapiens; identical to SEQ ID NO: 445862

SEQ ID NO: 447157 - RNA, 66 nt, Homo Sapiens; identical to SEQ ID NO: 445863

SEQ ID NO: 447158 - RNA, 66 nt, Homo Sapiens; identical to SEQ ID NO: 445864

SEQ ID NO: 447159 - RNA, 66 nt, Homo Sapiens; identical to SEQ ID NO: 445865

SEQ ID NO: 447160 - RNA, 66 nt, Homo Sapiens; identical to SEQ ID NO: 445866

SEQ ID NO: 447161 - RNA, 66 nt, Homo Sapiens; identical to SEQ ID NO: 445867

SEQ ID NO: 447162 - RNA, 66 nt, Homo Sapiens; identical to SEQ ID NO: 445868

SEQ ID NO: 447163 - RNA, 66 nt, Homo Sapiens; identical to SEQ ID NO: 445869

SEQ ID NO: 447164 - RNA, 66 nt, Homo Sapiens; identical to SEQ ID NO: 445870

SEQ ID NO: 447165 - RNA, 66 nt, Homo Sapiens; identical to SEQ ID NO: 445871

SEQ ID NO: 447166 - RNA, 66 nt, Homo Sapiens; identical to SEQ ID NO: 445872

SEQ ID NO: 447167 - RNA, 66 nt, Homo Sapiens; identical to SEQ ID NO: 445873

SEQ ID NO: 447168 - RNA, 66 nt, Homo Sapiens; identical to SEQ ID NO: 445874

SEQ ID NO: 447169 - RNA, 66 nt, Homo Sapiens; identical to SEQ ID NO: 445875

SEQ ID NO: 447170 - RNA, 66 nt, Homo Sapiens; identical to SEQ ID NO: 445876

SEQ ID NO: 447171 - RNA, 66 nt, Homo Sapiens; identical to SEQ ID NO: 445877

SEQ ID NO: 447172 - RNA, 66 nt, Homo Sapiens; identical to SEQ ID NO: 445878

SEQ ID NO: 447173 - RNA, 66 nt, Homo Sapiens; identical to SEQ ID NO: 445879

SEQ ID NO: 447174 - RNA, 66 nt, Homo Sapiens; identical to SEQ ID NO: 445880

SEQ ID NO: 447175 - RNA, 66 nt, Homo Sapiens; identical to SEQ ID NO: 445881

SEQ ID NO: 447176 - RNA, 66 nt, Homo Sapiens; identical to SEQ ID NO: 445882

SEQ ID NO: 447177 - RNA, 66 nt, Homo Sapiens; identical to SEQ ID NO: 445883

SEQ ID NO: 447178 - RNA, 66 nt, Homo Sapiens; identical to SEQ ID NO: 445884

SEQ ID NO: 447179 - RNA, 66 nt, Homo Sapiens; identical to SEQ ID NO: 445885

SEQ ID NO: 447180 - RNA, 66 nt, Homo Sapiens; identical to SEQ ID NO: 445886

SEQ ID NO: 447181 - RNA, 66 nt, Homo Sapiens; identical to SEQ ID NO: 445887

SEQ ID NO: 447182 - RNA, 66 nt, Homo Sapiens; identical to SEQ ID NO: 445888

SEQ ID NO: 447183 - RNA, 66 nt, Homo Sapiens; identical to SEQ ID NO: 445889

SEQ ID NO: 447184 - RNA, 66 nt, Homo Sapiens; identical to SEQ ID NO: 445890

SEQ ID NO: 447185 - RNA, 66 nt, Homo Sapiens; identical to SEQ ID NO: 445891

SEQ ID NO: 447186 - RNA, 66 nt, Homo Sapiens; identical to SEQ ID NO: 445892

SEQ ID NO: 447187 - RNA, 60 nt, Homo Sapiens; identical to SEQ ID NO: 445315

SEQ ID NO: 447188 - RNA, 66 nt, Homo Sapiens; identical to SEQ ID NO: 445894

SEQ ID NO: 447189 - RNA, 66 nt, Homo Sapiens; identical to SEQ ID NO: 445895

SEQ ID NO: 447190 - RNA, 66 nt, Homo Sapiens; identical to SEQ ID NO: 445896

SEQ ID NO: 447191 - RNA, 66 nt, Homo Sapiens; identical to SEQ ID NO: 445897

SEQ ID NO: 447192 - RNA, 66 nt, Homo Sapiens; identical to SEQ ID NO: 445898

SEQ ID NO: 447193 - RNA, 66 nt, Homo Sapiens; identical to SEQ ID NO: 445899

SEQ ID NO: 447194 - RNA, 66 nt, Homo Sapiens; identical to SEQ ID NO: 445900

SEQ ID NO: 447195 - RNA, 66 nt, Homo Sapiens; identical to SEQ ID NO: 445901

SEQ ID NO: 447196 - RNA, 66 nt, Homo Sapiens; identical to SEQ ID NO: 445902

SEQ ID NO: 447197 - RNA, 66 nt, Homo Sapiens; identical to SEQ ID NO: 445903

SEQ ID NO: 447198 - RNA, 66 nt, Homo Sapiens; identical to SEQ ID NO: 445904

SEQ ID NO: 447199 - RNA, 66 nt, Homo Sapiens; identical to SEQ ID NO: 445905

SEQ ID NO: 447200 - RNA, 66 nt, Homo Sapiens; identical to SEQ ID NO: 445906

SEQ ID NO: 447201 - RNA, 66 nt, Homo Sapiens; identical to SEQ ID NO: 445907

SEQ ID NO: 447202 - RNA, 66 nt, Homo Sapiens; identical to SEQ ID NO: 445908

SEQ ID NO: 447203 - RNA, 66 nt, Homo Sapiens; identical to SEQ ID NO: 445909

SEQ ID NO: 447204 - RNA, 66 nt, Homo Sapiens; identical to SEQ ID NO: 445910

SEQ ID NO: 447205 - RNA, 66 nt, Homo Sapiens; identical to SEQ ID NO: 445911

SEQ ID NO: 447206 - RNA, 66 nt, Homo Sapiens; identical to SEQ ID NO: 445912

SEQ ID NO: 447207 - RNA, 66 nt, Homo Sapiens; identical to SEQ ID NO: 445913

SEQ ID NO: 447208 - RNA, 66 nt, Homo Sapiens; identical to SEQ ID NO: 445914

SEQ ID NO: 447209 - RNA, 66 nt, Homo Sapiens; identical to SEQ ID NO: 445915

SEQ ID NO: 447210 - RNA, 66 nt, Homo Sapiens; identical to SEQ ID NO: 445916

SEQ ID NO: 447211 - RNA, 66 nt, Homo Sapiens; identical to SEQ ID NO: 445917

SEQ ID NO: 447212 - RNA, 66 nt, Homo Sapiens; identical to SEQ ID NO: 445918

SEQ ID NO: 447213 - RNA, 66 nt, Homo Sapiens; identical to SEQ ID NO: 445919

SEQ ID NO: 447214 - RNA, 66 nt, Homo Sapiens; identical to SEQ ID NO: 445920

SEQ ID NO: 447215 - RNA, 66 nt, Homo Sapiens; identical to SEQ ID NO: 445921

SEQ ID NO: 447216 - RNA, 66 nt, Homo Sapiens; identical to SEQ ID NO: 445922

SEQ ID NO: 447217 - RNA, 66 nt, Homo Sapiens; identical to SEQ ID NO: 445923

SEQ ID NO: 447218 - RNA, 66 nt, Homo Sapiens; identical to SEQ ID NO: 445924

SEQ ID NO: 447219 - RNA, 66 nt, Homo Sapiens; identical to SEQ ID NO: 445925

SEQ ID NO: 447220 - RNA, 66 nt, Homo Sapiens; identical to SEQ ID NO: 445926

SEQ ID NO: 447221 - RNA, 66 nt, Homo Sapiens; identical to SEQ ID NO: 445927

SEQ ID NO: 447222 - RNA, 66 nt, Homo Sapiens; identical to SEQ ID NO: 445928

SEQ ID NO: 447223 - RNA, 66 nt, Homo Sapiens; identical to SEQ ID NO: 445929

SEQ ID NO: 447224 - RNA, 66 nt, Homo Sapiens; identical to SEQ ID NO: 445930

SEQ ID NO: 447225 - RNA, 66 nt, Homo Sapiens; identical to SEQ ID NO: 445931

SEQ ID NO: 447226 - RNA, 66 nt, Homo Sapiens; identical to SEQ ID NO: 445932

SEQ ID NO: 447227 - RNA, 66 nt, Homo Sapiens; identical to SEQ ID NO: 445933

SEQ ID NO: 447228 - RNA, 66 nt, Homo Sapiens; identical to SEQ ID NO: 445934

SEQ ID NO: 447229 - RNA, 66 nt, Homo Sapiens; identical to SEQ ID NO: 445935

SEQ ID NO: 447230 - RNA, 66 nt, Homo Sapiens; identical to SEQ ID NO: 445936

SEQ ID NO: 447231 - RNA, 66 nt, Homo Sapiens; identical to SEQ ID NO: 445937

SEQ ID NO: 447232 - RNA, 66 nt, Homo Sapiens; identical to SEQ ID NO: 445938

SEQ ID NO: 447233 - RNA, 66 nt, Homo Sapiens; identical to SEQ ID NO: 445939

SEQ ID NO: 447234 - RNA, 66 nt, Homo Sapiens; identical to SEQ ID NO: 445940

SEQ ID NO: 447235 - RNA, 55 nt, Homo Sapiens; identical to SEQ ID NO: 445363

SEQ ID NO: 447236 - RNA, 66 nt, Homo Sapiens; identical to SEQ ID NO: 445942

SEQ ID NO: 447237 - RNA, 66 nt, Homo Sapiens; identical to SEQ ID NO: 445943

SEQ ID NO: 447238 - RNA, 66 nt, Homo Sapiens; identical to SEQ ID NO: 445944

SEQ ID NO: 447239 - RNA, 66 nt, Homo Sapiens; identical to SEQ ID NO: 445945

SEQ ID NO: 447240 - RNA, 66 nt, Homo Sapiens; identical to SEQ ID NO: 445946

SEQ ID NO: 447241 - RNA, 66 nt, Homo Sapiens; identical to SEQ ID NO: 445947

SEQ ID NO: 447242 - RNA, 66 nt, Homo Sapiens; identical to SEQ ID NO: 445948

SEQ ID NO: 447243 - RNA, 66 nt, Homo Sapiens; identical to SEQ ID NO: 445949

SEQ ID NO: 447244 - RNA, 66 nt, Homo Sapiens; identical to SEQ ID NO: 445950

SEQ ID NO: 447245 - RNA, 66 nt, Homo Sapiens; identical to SEQ ID NO: 445951

SEQ ID NO: 447246 - RNA, 66 nt, Homo Sapiens; identical to SEQ ID NO: 445952

SEQ ID NO: 447247 - RNA, 66 nt, Homo Sapiens; identical to SEQ ID NO: 445953

SEQ ID NO: 447248 - RNA, 66 nt, Homo Sapiens; identical to SEQ ID NO: 445954

SEQ ID NO: 447249 - RNA, 66 nt, Homo Sapiens; identical to SEQ ID NO: 445955

SEQ ID NO: 447250 - RNA, 66 nt, Homo Sapiens; identical to SEQ ID NO: 445956

SEQ ID NO: 447251 - RNA, 66 nt, Homo Sapiens; identical to SEQ ID NO: 445957

SEQ ID NO: 447252 - RNA, 66 nt, Homo Sapiens; identical to SEQ ID NO: 445958

SEQ ID NO: 447253 - RNA, 66 nt, Homo Sapiens; identical to SEQ ID NO: 445959

SEQ ID NO: 447254 - RNA, 66 nt, Homo Sapiens; identical to SEQ ID NO: 445960

SEQ ID NO: 447255 - RNA, 66 nt, Homo Sapiens; identical to SEQ ID NO: 445961

SEQ ID NO: 447256 - RNA, 66 nt, Homo Sapiens; identical to SEQ ID NO: 445962

SEQ ID NO: 447257 - RNA, 66 nt, Homo Sapiens; identical to SEQ ID NO: 445963

SEQ ID NO: 447258 - RNA, 66 nt, Homo Sapiens; identical to SEQ ID NO: 445964

SEQ ID NO: 447259 - RNA, 66 nt, Homo Sapiens; identical to SEQ ID NO: 445965

SEQ ID NO: 447260 - RNA, 66 nt, Homo Sapiens; identical to SEQ ID NO: 445966

SEQ ID NO: 447261 - RNA, 66 nt, Homo Sapiens; identical to SEQ ID NO: 445967

SEQ ID NO: 447262 - RNA, 66 nt, Homo Sapiens; identical to SEQ ID NO: 445968

SEQ ID NO: 447263 - RNA, 66 nt, Homo Sapiens; identical to SEQ ID NO: 445969

SEQ ID NO: 447264 - RNA, 66 nt, Homo Sapiens; identical to SEQ ID NO: 445970

SEQ ID NO: 447265 - RNA, 66 nt, Homo Sapiens; identical to SEQ ID NO: 445971

SEQ ID NO: 447266 - RNA, 66 nt, Homo Sapiens; identical to SEQ ID NO: 445972

SEQ ID NO: 447267 - RNA, 66 nt, Homo Sapiens; identical to SEQ ID NO: 445973

SEQ ID NO: 447268 - RNA, 66 nt, Homo Sapiens; identical to SEQ ID NO: 445974

SEQ ID NO: 447269 - RNA, 66 nt, Homo Sapiens; identical to SEQ ID NO: 445975

SEQ ID NO: 447270 - RNA, 66 nt, Homo Sapiens; identical to SEQ ID NO: 445976

SEQ ID NO: 447271 - RNA, 66 nt, Homo Sapiens; identical to SEQ ID NO: 445977

SEQ ID NO: 447272 - RNA, 66 nt, Homo Sapiens; identical to SEQ ID NO: 445978

SEQ ID NO: 447273 - RNA, 66 nt, Homo Sapiens; identical to SEQ ID NO: 445979

SEQ ID NO: 447274 - RNA, 66 nt, Homo Sapiens; identical to SEQ ID NO: 445980

SEQ ID NO: 447275 - RNA, 66 nt, Homo Sapiens; identical to SEQ ID NO: 445981

SEQ ID NO: 447276 - RNA, 66 nt, Homo Sapiens; identical to SEQ ID NO: 445982

SEQ ID NO: 447277 - RNA, 66 nt, Homo Sapiens; identical to SEQ ID NO: 445983

SEQ ID NO: 447278 - RNA, 66 nt, Homo Sapiens; identical to SEQ ID NO: 445984

SEQ ID NO: 447279 - RNA, 66 nt, Homo Sapiens; identical to SEQ ID NO: 445985

SEQ ID NO: 447280 - RNA, 66 nt, Homo Sapiens; identical to SEQ ID NO: 445986

SEQ ID NO: 447281 - RNA, 66 nt, Homo Sapiens; identical to SEQ ID NO: 445987

SEQ ID NO: 447282 - RNA, 66 nt, Homo Sapiens; identical to SEQ ID NO: 445988

SEQ ID NO: 447283 - RNA, 66 nt, Homo Sapiens; identical to SEQ ID NO: 445989

SEQ ID NO: 447284 - RNA, 66 nt, Homo Sapiens; identical to SEQ ID NO: 445990

SEQ ID NO: 447285 - RNA, 66 nt, Homo Sapiens; identical to SEQ ID NO: 445991

SEQ ID NO: 447286 - RNA, 66 nt, Homo Sapiens; identical to SEQ ID NO: 445992

SEQ ID NO: 447287 - RNA, 66 nt, Homo Sapiens; identical to SEQ ID NO: 445993

SEQ ID NO: 447288 - RNA, 66 nt, Homo Sapiens; identical to SEQ ID NO: 445994

SEQ ID NO: 447289 - RNA, 66 nt, Homo Sapiens; identical to SEQ ID NO: 445995

SEQ ID NO: 447290 - RNA, 66 nt, Homo Sapiens; identical to SEQ ID NO: 445996

SEQ ID NO: 447291 - RNA, 66 nt, Homo Sapiens; identical to SEQ ID NO: 445997

SEQ ID NO: 447292 - RNA, 66 nt, Homo Sapiens; identical to SEQ ID NO: 445998

SEQ ID NO: 447293 - RNA, 66 nt, Homo Sapiens; identical to SEQ ID NO: 445999

SEQ ID NO: 447294 - RNA, 66 nt, Homo Sapiens; identical to SEQ ID NO: 446000

SEQ ID NO: 447295 - RNA, 66 nt, Homo Sapiens; identical to SEQ ID NO: 446001

SEQ ID NO: 447296 - RNA, 66 nt, Homo Sapiens; identical to SEQ ID NO: 446002

SEQ ID NO: 447297 - RNA, 66 nt, Homo Sapiens; identical to SEQ ID NO: 446003

SEQ ID NO: 447298 - RNA, 66 nt, Homo Sapiens; identical to SEQ ID NO: 446004

SEQ ID NO: 447299 - RNA, 66 nt, Homo Sapiens; identical to SEQ ID NO: 446005

SEQ ID NO: 447300 - RNA, 66 nt, Homo Sapiens; identical to SEQ ID NO: 446006

SEQ ID NO: 447301 - RNA, 66 nt, Homo Sapiens; identical to SEQ ID NO: 446007

SEQ ID NO: 447302 - RNA, 66 nt, Homo Sapiens; identical to SEQ ID NO: 446008

SEQ ID NO: 447303 - RNA, 66 nt, Homo Sapiens; identical to SEQ ID NO: 446009

SEQ ID NO: 447304 - RNA, 66 nt, Homo Sapiens; identical to SEQ ID NO: 446010

SEQ ID NO: 447305 - RNA, 66 nt, Homo Sapiens; identical to SEQ ID NO: 446011

SEQ ID NO: 447306 - RNA, 66 nt, Homo Sapiens; identical to SEQ ID NO: 446012

SEQ ID NO: 447307 - RNA, 66 nt, Homo Sapiens; identical to SEQ ID NO: 446013

SEQ ID NO: 447308 - RNA, 66 nt, Homo Sapiens; identical to SEQ ID NO: 446014

SEQ ID NO: 447309 - RNA, 66 nt, Homo Sapiens; identical to SEQ ID NO: 446015

SEQ ID NO: 447310 - RNA, 66 nt, Homo Sapiens; identical to SEQ ID NO: 446016

SEQ ID NO: 447311 - RNA, 66 nt, Homo Sapiens; identical to SEQ ID NO: 446017

SEQ ID NO: 447312 - RNA, 66 nt, Homo Sapiens; identical to SEQ ID NO: 446018

SEQ ID NO: 447313 - RNA, 66 nt, Homo Sapiens; identical to SEQ ID NO: 446019

SEQ ID NO: 447314 - RNA, 66 nt, Homo Sapiens; identical to SEQ ID NO: 446020

SEQ ID NO: 447315 - RNA, 66 nt, Homo Sapiens; identical to SEQ ID NO: 446021

SEQ ID NO: 447316 - RNA, 66 nt, Homo Sapiens; identical to SEQ ID NO: 446022

SEQ ID NO: 447317 - RNA, 66 nt, Homo Sapiens; identical to SEQ ID NO: 446023

SEQ ID NO: 447318 - RNA, 66 nt, Homo Sapiens; identical to SEQ ID NO: 446024

SEQ ID NO: 447319 - RNA, 66 nt, Homo Sapiens; identical to SEQ ID NO: 446025

SEQ ID NO: 447320 - RNA, 66 nt, Homo Sapiens; identical to SEQ ID NO: 446026

SEQ ID NO: 447321 - RNA, 66 nt, Homo Sapiens; identical to SEQ ID NO: 446027

SEQ ID NO: 447322 - RNA, 66 nt, Homo Sapiens; identical to SEQ ID NO: 446028

SEQ ID NO: 447323 - RNA, 66 nt, Homo Sapiens; identical to SEQ ID NO: 446029

SEQ ID NO: 447324 - RNA, 66 nt, Homo Sapiens; identical to SEQ ID NO: 446030

SEQ ID NO: 447325 - RNA, 66 nt, Homo Sapiens; identical to SEQ ID NO: 446031

SEQ ID NO: 447326 - RNA, 66 nt, Homo Sapiens; identical to SEQ ID NO: 446032

SEQ ID NO: 447327 - RNA, 66 nt, Homo Sapiens; identical to SEQ ID NO: 446033

SEQ ID NO: 447328 - RNA, 66 nt, Homo Sapiens; identical to SEQ ID NO: 446034

SEQ ID NO: 447329 - RNA, 66 nt, Homo Sapiens; identical to SEQ ID NO: 446035

SEQ ID NO: 447330 - RNA, 66 nt, Homo Sapiens; identical to SEQ ID NO: 446036

SEQ ID NO: 447331 - RNA, 66 nt, Homo Sapiens; identical to SEQ ID NO: 446037

SEQ ID NO: 447332 - RNA, 66 nt, Homo Sapiens; identical to SEQ ID NO: 446038

SEQ ID NO: 447333 - RNA, 66 nt, Homo Sapiens; identical to SEQ ID NO: 446039

SEQ ID NO: 447334 - RNA, 66 nt, Homo Sapiens; identical to SEQ ID NO: 446040

SEQ ID NO: 447335 - RNA, 66 nt, Homo Sapiens; identical to SEQ ID NO: 446041

SEQ ID NO: 447336 - RNA, 66 nt, Homo Sapiens; identical to SEQ ID NO: 446042

SEQ ID NO: 447337 - RNA, 66 nt, Homo Sapiens; identical to SEQ ID NO: 446043

SEQ ID NO: 447338 - RNA, 66 nt, Homo Sapiens; identical to SEQ ID NO: 446044

SEQ ID NO: 447339 - RNA, 66 nt, Homo Sapiens; identical to SEQ ID NO: 446045

SEQ ID NO: 447340 - RNA, 66 nt, Homo Sapiens; identical to SEQ ID NO: 446046

SEQ ID NO: 447341 - RNA, 66 nt, Homo Sapiens; identical to SEQ ID NO: 446047

SEQ ID NO: 447342 - RNA, 66 nt, Homo Sapiens; identical to SEQ ID NO: 446048

SEQ ID NO: 447343 - RNA, 66 nt, Homo Sapiens; identical to SEQ ID NO: 446049

SEQ ID NO: 447344 - RNA, 66 nt, Homo Sapiens; identical to SEQ ID NO: 446050

SEQ ID NO: 447345 - RNA, 59 nt, Homo Sapiens; identical to SEQ ID NO: 445473

SEQ ID NO: 447346 - RNA, 66 nt, Homo Sapiens; identical to SEQ ID NO: 446052

SEQ ID NO: 447347 - RNA, 66 nt, Homo Sapiens; identical to SEQ ID NO: 446053

SEQ ID NO: 447348 - RNA, 66 nt, Homo Sapiens; identical to SEQ ID NO: 446054

SEQ ID NO: 447349 - RNA, 66 nt, Homo Sapiens; identical to SEQ ID NO: 446055

SEQ ID NO: 447350 - RNA, 66 nt, Homo Sapiens; identical to SEQ ID NO: 446056

SEQ ID NO: 447351 - RNA, 66 nt, Homo Sapiens; identical to SEQ ID NO: 446057

SEQ ID NO: 447352 - RNA, 66 nt, Homo Sapiens; identical to SEQ ID NO: 446058

SEQ ID NO: 447353 - RNA, 66 nt, Homo Sapiens; identical to SEQ ID NO: 446059

SEQ ID NO: 447354 - RNA, 66 nt, Homo Sapiens; identical to SEQ ID NO: 446060

SEQ ID NO: 447355 - RNA, 66 nt, Homo Sapiens; identical to SEQ ID NO: 446061

SEQ ID NO: 447356 - RNA, 66 nt, Homo Sapiens; identical to SEQ ID NO: 446062

SEQ ID NO: 447357 - RNA, 66 nt, Homo Sapiens; identical to SEQ ID NO: 446063

SEQ ID NO: 447358 - RNA, 66 nt, Homo Sapiens; identical to SEQ ID NO: 446064

SEQ ID NO: 447359 - RNA, 66 nt, Homo Sapiens; identical to SEQ ID NO: 446065

SEQ ID NO: 447360 - RNA, 66 nt, Homo Sapiens; identical to SEQ ID NO: 446066

SEQ ID NO: 447361 - RNA, 66 nt, Homo Sapiens; identical to SEQ ID NO: 446067

SEQ ID NO: 447362 - RNA, 66 nt, Homo Sapiens; identical to SEQ ID NO: 446068

SEQ ID NO: 447363 - RNA, 66 nt, Homo Sapiens; identical to SEQ ID NO: 446069

SEQ ID NO: 447364 - RNA, 66 nt, Homo Sapiens; identical to SEQ ID NO: 446070

SEQ ID NO: 447365 - RNA, 66 nt, Homo Sapiens; identical to SEQ ID NO: 446071

SEQ ID NO: 447366 - RNA, 66 nt, Homo Sapiens; identical to SEQ ID NO: 446072

SEQ ID NO: 447367 - RNA, 66 nt, Homo Sapiens; identical to SEQ ID NO: 446073

SEQ ID NO: 447368 - RNA, 66 nt, Homo Sapiens; identical to SEQ ID NO: 446074

SEQ ID NO: 447369 - RNA, 66 nt, Homo Sapiens; identical to SEQ ID NO: 446075

SEQ ID NO: 447370 - RNA, 66 nt, Homo Sapiens; identical to SEQ ID NO: 446076

SEQ ID NO: 447371 - RNA, 66 nt, Homo Sapiens; identical to SEQ ID NO: 446077

SEQ ID NO: 447372 - RNA, 66 nt, Homo Sapiens; identical to SEQ ID NO: 446078

SEQ ID NO: 447373 - RNA, 66 nt, Homo Sapiens; identical to SEQ ID NO: 446079

SEQ ID NO: 447374 - RNA, 66 nt, Homo Sapiens; identical to SEQ ID NO: 446080

SEQ ID NO: 447375 - RNA, 66 nt, Homo Sapiens; identical to SEQ ID NO: 446081

SEQ ID NO: 447376 - RNA, 66 nt, Homo Sapiens; identical to SEQ ID NO: 446082

SEQ ID NO: 447377 - RNA, 66 nt, Homo Sapiens; identical to SEQ ID NO: 446083

SEQ ID NO: 447378 - RNA, 66 nt, Homo Sapiens; identical to SEQ ID NO: 446084

SEQ ID NO: 447379 - RNA, 66 nt, Homo Sapiens; identical to SEQ ID NO: 446085

SEQ ID NO: 447380 - RNA, 66 nt, Homo Sapiens; identical to SEQ ID NO: 446086

SEQ ID NO: 447381 - RNA, 66 nt, Homo Sapiens; identical to SEQ ID NO: 446087

SEQ ID NO: 447382 - RNA, 66 nt, Homo Sapiens; identical to SEQ ID NO: 446088

SEQ ID NO: 447383 - RNA, 66 nt, Homo Sapiens; identical to SEQ ID NO: 446089

SEQ ID NO: 447384 - RNA, 66 nt, Homo Sapiens; identical to SEQ ID NO: 446090

SEQ ID NO: 447385 - RNA, 66 nt, Homo Sapiens; identical to SEQ ID NO: 446091

SEQ ID NO: 447386 - RNA, 66 nt, Homo Sapiens; identical to SEQ ID NO: 446092

SEQ ID NO: 447387 - RNA, 66 nt, Homo Sapiens; identical to SEQ ID NO: 446093

SEQ ID NO: 447388 - RNA, 66 nt, Homo Sapiens; identical to SEQ ID NO: 446094

SEQ ID NO: 447389 - RNA, 66 nt, Homo Sapiens; identical to SEQ ID NO: 446095

SEQ ID NO: 447390 - RNA, 66 nt, Homo Sapiens; identical to SEQ ID NO: 446096

SEQ ID NO: 447391 - RNA, 66 nt, Homo Sapiens; identical to SEQ ID NO: 446097

SEQ ID NO: 447392 - RNA, 66 nt, Homo Sapiens; identical to SEQ ID NO: 446098

SEQ ID NO: 447393 - RNA, 66 nt, Homo Sapiens; identical to SEQ ID NO: 446099

SEQ ID NO: 447394 - RNA, 66 nt, Homo Sapiens; identical to SEQ ID NO: 446100

SEQ ID NO: 447395 - RNA, 66 nt, Homo Sapiens; identical to SEQ ID NO: 446101

SEQ ID NO: 447396 - RNA, 66 nt, Homo Sapiens; identical to SEQ ID NO: 446102

SEQ ID NO: 447397 - RNA, 66 nt, Homo Sapiens; identical to SEQ ID NO: 446103

SEQ ID NO: 447398 - RNA, 66 nt, Homo Sapiens; identical to SEQ ID NO: 446104

SEQ ID NO: 447399 - RNA, 66 nt, Homo Sapiens; identical to SEQ ID NO: 446105

SEQ ID NO: 447400 - RNA, 66 nt, Homo Sapiens; identical to SEQ ID NO: 446106

SEQ ID NO: 447401 - RNA, 66 nt, Homo Sapiens; identical to SEQ ID NO: 446107

SEQ ID NO: 447402 - RNA, 66 nt, Homo Sapiens; identical to SEQ ID NO: 446108

SEQ ID NO: 447403 - RNA, 66 nt, Homo Sapiens; identical to SEQ ID NO: 446109

SEQ ID NO: 447404 - RNA, 66 nt, Homo Sapiens; identical to SEQ ID NO: 446110

SEQ ID NO: 447405 - RNA, 66 nt, Homo Sapiens; identical to SEQ ID NO: 446111

SEQ ID NO: 447406 - RNA, 66 nt, Homo Sapiens; identical to SEQ ID NO: 446112

SEQ ID NO: 447407 - RNA, 66 nt, Homo Sapiens; identical to SEQ ID NO: 446113

SEQ ID NO: 447408 - RNA, 66 nt, Homo Sapiens; identical to SEQ ID NO: 446114

SEQ ID NO: 447409 - RNA, 66 nt, Homo Sapiens; identical to SEQ ID NO: 446115

SEQ ID NO: 447410 - RNA, 66 nt, Homo Sapiens; identical to SEQ ID NO: 446116

SEQ ID NO: 447411 - RNA, 66 nt, Homo Sapiens; identical to SEQ ID NO: 446117

SEQ ID NO: 447412 - RNA, 66 nt, Homo Sapiens; identical to SEQ ID NO: 446118

SEQ ID NO: 447413 - RNA, 66 nt, Homo Sapiens; identical to SEQ ID NO: 446119

SEQ ID NO: 447414 - RNA, 66 nt, Homo Sapiens; identical to SEQ ID NO: 446120

SEQ ID NO: 447415 - RNA, 66 nt, Homo Sapiens; identical to SEQ ID NO: 446121

SEQ ID NO: 447416 - RNA, 66 nt, Homo Sapiens; identical to SEQ ID NO: 446122

SEQ ID NO: 447417 - RNA, 66 nt, Homo Sapiens; identical to SEQ ID NO: 446123

SEQ ID NO: 447418 - RNA, 66 nt, Homo Sapiens; identical to SEQ ID NO: 446124

SEQ ID NO: 447419 - RNA, 66 nt, Homo Sapiens; identical to SEQ ID NO: 446125

SEQ ID NO: 447420 - RNA, 66 nt, Homo Sapiens; identical to SEQ ID NO: 446126

SEQ ID NO: 447421 - RNA, 66 nt, Homo Sapiens; identical to SEQ ID NO: 446127

SEQ ID NO: 447422 - RNA, 66 nt, Homo Sapiens; identical to SEQ ID NO: 446128

SEQ ID NO: 447423 - RNA, 66 nt, Homo Sapiens; identical to SEQ ID NO: 446129

SEQ ID NO: 447424 - RNA, 66 nt, Homo Sapiens; identical to SEQ ID NO: 446130

SEQ ID NO: 447425 - RNA, 66 nt, Homo Sapiens; identical to SEQ ID NO: 446131

SEQ ID NO: 447426 - RNA, 66 nt, Homo Sapiens; identical to SEQ ID NO: 446132

SEQ ID NO: 447427 - RNA, 66 nt, Homo Sapiens; identical to SEQ ID NO: 446133

SEQ ID NO: 447428 - RNA, 66 nt, Homo Sapiens; identical to SEQ ID NO: 446134

SEQ ID NO: 447429 - RNA, 66 nt, Homo Sapiens; identical to SEQ ID NO: 446135

SEQ ID NO: 447430 - RNA, 66 nt, Homo Sapiens; identical to SEQ ID NO: 446136

SEQ ID NO: 447431 - RNA, 66 nt, Homo Sapiens; identical to SEQ ID NO: 446137

SEQ ID NO: 447432 - RNA, 66 nt, Homo Sapiens; identical to SEQ ID NO: 446138

SEQ ID NO: 447433 - RNA, 66 nt, Homo Sapiens; identical to SEQ ID NO: 446139

SEQ ID NO: 447434 - RNA, 66 nt, Homo Sapiens; identical to SEQ ID NO: 446140

SEQ ID NO: 447435 - RNA, 65 nt, Homo Sapiens; identical to SEQ ID NO: 445563

SEQ ID NO: 447436 - RNA, 66 nt, Homo Sapiens; identical to SEQ ID NO: 446142

SEQ ID NO: 447437 - RNA, 66 nt, Homo Sapiens; identical to SEQ ID NO: 446143

SEQ ID NO: 447438 - RNA, 66 nt, Homo Sapiens; identical to SEQ ID NO: 446144

SEQ ID NO: 447439 - RNA, 66 nt, Homo Sapiens; identical to SEQ ID NO: 446145

SEQ ID NO: 447440 - RNA, 66 nt, Homo Sapiens; identical to SEQ ID NO: 446146

SEQ ID NO: 447441 - RNA, 66 nt, Homo Sapiens; identical to SEQ ID NO: 446147

SEQ ID NO: 447442 - RNA, 66 nt, Homo Sapiens; identical to SEQ ID NO: 446148

SEQ ID NO: 447443 - RNA, 66 nt, Homo Sapiens; identical to SEQ ID NO: 446149

SEQ ID NO: 447444 - RNA, 66 nt, Homo Sapiens; identical to SEQ ID NO: 446150

SEQ ID NO: 447445 - RNA, 66 nt, Homo Sapiens; identical to SEQ ID NO: 446151

SEQ ID NO: 447446 - RNA, 66 nt, Homo Sapiens; identical to SEQ ID NO: 446152

SEQ ID NO: 447447 - RNA, 66 nt, Homo Sapiens; identical to SEQ ID NO: 446153

SEQ ID NO: 447448 - RNA, 66 nt, Homo Sapiens; identical to SEQ ID NO: 446154

SEQ ID NO: 447449 - RNA, 66 nt, Homo Sapiens; identical to SEQ ID NO: 446155

SEQ ID NO: 447450 - RNA, 66 nt, Homo Sapiens; identical to SEQ ID NO: 446156

SEQ ID NO: 447451 - RNA, 66 nt, Homo Sapiens; identical to SEQ ID NO: 446157

SEQ ID NO: 447452 - RNA, 66 nt, Homo Sapiens; identical to SEQ ID NO: 446158

SEQ ID NO: 447453 - RNA, 66 nt, Homo Sapiens; identical to SEQ ID NO: 446159

SEQ ID NO: 447454 - RNA, 66 nt, Homo Sapiens; identical to SEQ ID NO: 446160

SEQ ID NO: 447455 - RNA, 66 nt, Homo Sapiens; identical to SEQ ID NO: 446161

SEQ ID NO: 447456 - RNA, 66 nt, Homo Sapiens; identical to SEQ ID NO: 446162

SEQ ID NO: 447457 - RNA, 66 nt, Homo Sapiens; identical to SEQ ID NO: 446163

SEQ ID NO: 447458 - RNA, 66 nt, Homo Sapiens; identical to SEQ ID NO: 446164

SEQ ID NO: 447459 - RNA, 66 nt, Homo Sapiens; identical to SEQ ID NO: 446165

SEQ ID NO: 447460 - RNA, 66 nt, Homo Sapiens; identical to SEQ ID NO: 446166

SEQ ID NO: 447461 - RNA, 66 nt, Homo Sapiens; identical to SEQ ID NO: 446167

SEQ ID NO: 447462 - RNA, 66 nt, Homo Sapiens; identical to SEQ ID NO: 446168

SEQ ID NO: 447463 - RNA, 66 nt, Homo Sapiens; identical to SEQ ID NO: 446169

SEQ ID NO: 447464 - RNA, 66 nt, Homo Sapiens; identical to SEQ ID NO: 446170

SEQ ID NO: 447465 - RNA, 66 nt, Homo Sapiens; identical to SEQ ID NO: 446171

SEQ ID NO: 447466 - RNA, 66 nt, Homo Sapiens; identical to SEQ ID NO: 446172

SEQ ID NO: 447467 - RNA, 66 nt, Homo Sapiens; identical to SEQ ID NO: 446173

SEQ ID NO: 447468 - RNA, 66 nt, Homo Sapiens; identical to SEQ ID NO: 446174

SEQ ID NO: 447469 - RNA, 66 nt, Homo Sapiens; identical to SEQ ID NO: 446175

SEQ ID NO: 447470 - RNA, 66 nt, Homo Sapiens; identical to SEQ ID NO: 446176

SEQ ID NO: 447471 - RNA, 66 nt, Homo Sapiens; identical to SEQ ID NO: 446177

SEQ ID NO: 447472 - RNA, 66 nt, Homo Sapiens; identical to SEQ ID NO: 446178

SEQ ID NO: 447473 - RNA, 66 nt, Homo Sapiens; identical to SEQ ID NO: 446179

SEQ ID NO: 447474 - RNA, 66 nt, Homo Sapiens; identical to SEQ ID NO: 446180

SEQ ID NO: 447475 - RNA, 66 nt, Homo Sapiens; identical to SEQ ID NO: 446181

SEQ ID NO: 447476 - RNA, 66 nt, Homo Sapiens; identical to SEQ ID NO: 446182

SEQ ID NO: 447477 - RNA, 64 nt, Homo Sapiens
gacauccagccccuaguaauacuuaaggcacuauggcacuuagcuuugaagugacacgacccug

SEQ ID NO: 447478 - RNA, 64 nt, Homo Sapiens
gagauuuacuuucuuagaaauuaauaggggaaauggcacuuaauagagguuuaauggaaugaag

SEQ ID NO: 447479 - RNA, 64 nt, Homo Sapiens
ucuagggaccacccccgaugcauuggugagggugggcacuuauaaaugccugcuauuguuaagc

SEQ ID NO: 447480 - RNA, 64 nt, Homo Sapiens
uaagaaauggguccuuuuuccuccuaauguuuuuggcacuuaaaacauaaaauucauuauccua

SEQ ID NO: 447481 - RNA, 64 nt, Homo Sapiens
uuuaguugagaagauacaaaauguuuacaguguuggcacuuagaguuuuuaaauucaaguacau

SEQ ID NO: 447482 - RNA, 64 nt, Homo Sapiens
uuucucugacucgccccagaggucguggcucaaaggcacuuaggacgccuuaaauuuguaaaua

SEQ ID NO: 447483 - RNA, 64 nt, Homo Sapiens
uuuaauguuuguuacuguauuucuuuugaguugaggcacuuacauaacaaucuucuuugcuuuu

SEQ ID NO: 447484 - RNA, 64 nt, Homo Sapiens
gccggggauuaaaaagacuacccaaaagauuuuuggcacuuacaauuuuuaaaauaguuuaugu

SEQ ID NO: 447485 - RNA, 64 nt, Homo Sapiens
aucugaucaauuugaagucccuguuugggaaugaggcacuuaucagcaugaagaauuuuuucuc

SEQ ID NO: 447486 - RNA, 64 nt, Homo Sapiens
auaaauauauuauguuaacuugauaugcaugaauggcacuuaaaaggauuguugcugccagaac

SEQ ID NO: 447487 - RNA, 64 nt, Homo Sapiens
auguagauacgggcucaaaaccaggucacugcgaggcacuuaccuaaaugguaacgcuacggcc

SEQ ID NO: 447488 - RNA, 64 nt, Homo Sapiens
cuuaauuggggaaacugcuucgcccauccuagugggcacuuaagccugaagcccuaguagcugg

SEQ ID NO: 447489 - RNA, 64 nt, Homo Sapiens; identical to SEQ ID NO: 179148

SEQ ID NO: 447490 - RNA, 64 nt, Homo Sapiens; identical to SEQ ID NO: 179149

SEQ ID NO: 447491 - RNA, 64 nt, Homo Sapiens
cauaggaaacauauuauguguuugugaacacguaggcacuuaguacaaccuccacuggggcaac

SEQ ID NO: 447492 - RNA, 64 nt, Homo Sapiens
ugcacuuuuuuaugaagaaaugacaagcugacuuggcacuuaaguauauuuaaaaauuguuucu

SEQ ID NO: 447493 - RNA, 64 nt, Homo Sapiens
auagcuuccaauaaguaacucagagcccugcccuggcacuuaaaaauacuucagaaaauuucug

SEQ ID NO: 447494 - RNA, 64 nt, Homo Sapiens
uccaaacuauucucuuguagaaaauuuuccagugggcacuuaauggugcccuugaagaacuucc

SEQ ID NO: 447495 - RNA, 64 nt, Homo Sapiens
ggcuaccucugcacuuugucaaugcuucucuuguggcacuuaucacacuguauuuuacuuguuu

SEQ ID NO: 447496 - RNA, 64 nt, Homo Sapiens
uugauuuuuauuuuuuaaaugaaguggccucaaaggcacuuaauagaaaacuggcaacugggaa

SEQ ID NO: 447497 - RNA, 64 nt, Homo Sapiens
uugaucuuuuauuuuucuuucuguucaaaacagaggcacuuaauuuuauuauugcuuaugugcc

SEQ ID NO: 447498 - RNA, 64 nt, Homo Sapiens
accaaagcccaaagugguauuugcuguagaagauggcacuuauaccuguucuuaagacgugauu

SEQ ID NO: 447499 - RNA, 64 nt, Homo Sapiens
uuuuuugccccucuaaggguauugcuuuuucgguggcacuuacuuagucuuacugaugucaguu

SEQ ID NO: 447500 - RNA, 64 nt, Homo Sapiens
gaguuuauaugcaaugccuucauuagguaccaccggcacuuacaaaaugugcggacugaauccc

SEQ ID NO: 447501 - RNA, 64 nt, Homo Sapiens
ggcuucccaaugcuuucacucuuaucuacccuuuggcacuuaucuugcuuaucaacauaauaau

SEQ ID NO: 447502 - RNA, 64 nt, Homo Sapiens
cauggagucccuagugugacuggaauccugaaagggcacuuaauuuguaaacuucugaagacug

SEQ ID NO: 447503 - RNA, 64 nt, Homo Sapiens
ucugucugggucauucauuuaaacuagaagcagaggcacuuaaaacauguaccaggaaccauuu

SEQ ID NO: 447504 - RNA, 64 nt, Homo Sapiens
gacaguaaagcuguauuuuccuugaaaaugauuaggcacuuaaggcaaacuguuugcuccuccu

SEQ ID NO: 447505 - RNA, 64 nt, Homo Sapiens
aauccucuuggccccuuuccuuuagaaacuugguggcacuuauuaaugccucugauucugcagu

SEQ ID NO: 447506 - RNA, 64 nt, Homo Sapiens
uuuuuucuuuauaaagcuuuucuuucacuacauuggcacuuaaaucuuuaggaauuuuuaacuu

SEQ ID NO: 447507 - RNA, 64 nt, Homo Sapiens
uucugcagacacgccuuccccucagccacacccaggcacuuaagcacaagcagagugcacagcu

SEQ ID NO: 447508 - RNA, 64 nt, Homo Sapiens
cagggcuugaaacaauauuaggauuacuacccagggcacuuacuggugcauguuguaacauauc

SEQ ID NO: 447509 - RNA, 64 nt, Homo Sapiens
acccagaagggaccaaaagcggcccucaggguggggcacuuagcggcccgagugucugccccuc

SEQ ID NO: 447510 - RNA, 64 nt, Homo Sapiens
ggagcuugccaggaacccaguggccagggagcguggcacuuaccuuugucccuugcuucauucu

SEQ ID NO: 447511 - RNA, 64 nt, Homo Sapiens
gcugugccaggacugugacucauucccaguaaaaggcacuuaucgaagcugauaaccguccuuc

SEQ ID NO: 447512 - RNA, 64 nt, Homo Sapiens
gauucaaaucguuuauuucacacgcuguucuaauggcacuuaucauuagaaucuuaccuugugc

SEQ ID NO: 447513 - RNA, 64 nt, Homo Sapiens
uagccauucauguaugucagaagugcagaauuggggcacuuaauggucaccuuguaacaguuuu

SEQ ID NO: 447514 - RNA, 64 nt, Homo Sapiens
agaagacuguugccacuuaaccauuccaugcguuggcacuuaucuauuccugaaauuucuuuua

SEQ ID NO: 447515 - RNA, 64 nt, Homo Sapiens
guaaauggacuugccuuaaugugccuauguagcaggcacuuagagguuuccauguggacauaca

SEQ ID NO: 447516 - RNA, 64 nt, Homo Sapiens
cucucucacauauucacacgauguuauacguacaggcacuuacaugaugacuacagcagaagug

SEQ ID NO: 447517 - RNA, 64 nt, Homo Sapiens
uaucagaagaccacaaaaaugcuucuaaccugauggcacuuagccugugugaaaauggguuggu

SEQ ID NO: 447518 - RNA, 64 nt, Homo Sapiens
acucccaguaaaucuuggaaucuguggaagaaagggcacuuaaaccuugucaccacucuggggc

SEQ ID NO: 447519 - RNA, 64 nt, Homo Sapiens
auuuuaaagaugcagccagcacaaaacacaaguuggcacuuacaugcuucuggaacuuugaaac

SEQ ID NO: 447520 - RNA, 64 nt, Homo Sapiens
uuuauauuuuuuuaaaguagcuaacauagcaguaggcacuuaagcauuuagucaaugauauugg

SEQ ID NO: 447521 - RNA, 64 nt, Homo Sapiens
caccccaggagggugaguggccugagguaguuacggcacuuaaaacucccuugcuaccgaucug

SEQ ID NO: 447522 - RNA, 64 nt, Homo Sapiens
ggagaugacauuugcuuuggggagauagaacuguggcacuuaggcaguggagcucagaggacgg

SEQ ID NO: 447523 - RNA, 64 nt, Homo Sapiens
uacugagcagacuuuauaaaugagauaucuacaaggcacuuaaaguguuacagauguuuuaccu

SEQ ID NO: 447524 - RNA, 64 nt, Homo Sapiens
uaguauuucuuccagaagaagcuaaaauaagacuggcacuuacccugaagugcauuaauaaaac

SEQ ID NO: 447525 - RNA, 64 nt, Homo Sapiens
ggcuaccuucuauccucuguucccaaauggugguggcacuuauccugaagucgucaaugauuuc

SEQ ID NO: 447526 - RNA, 64 nt, Homo Sapiens
aguuuugggauauauacaaggauugccuugaucuggcacuuacugauacaagcauuuggagaag

SEQ ID NO: 447527 - RNA, 64 nt, Homo Sapiens
uggccagggaaacaguuggcuauucaucaucuucggcacuuaugacaacauuaacacagaaugc

SEQ ID NO: 447528 - RNA, 64 nt, Homo Sapiens
ccugucucugaauuguucccucccccgcaaugugggcacuuaccauguuccuggcacacuggac

SEQ ID NO: 447529 - RNA, 64 nt, Homo Sapiens
ugcaacagaaggguagguuagaugcuauuaagaaggcacuuaauaguacaucauguaagauggc

SEQ ID NO: 447530 - RNA, 64 nt, Homo Sapiens
cugaagucaucaaugauuucucccaaauggugguggcacuuaucggcuaccuucuauccucugu

SEQ ID NO: 447531 - RNA, 64 nt, Homo Sapiens
acaagugacugaacacuuccuggggagcuacaggggcacuuaacccaccacagcacagccucau

SEQ ID NO: 447532 - RNA, 64 nt, Homo Sapiens
uggacuuugagugagaagaugugauuuggaccauggcacuuaaaaacucuauaaccucaggcaa

SEQ ID NO: 447533 - RNA, 64 nt, Homo Sapiens
aaacuauucaucugucauauacuauugauccuuuggcacuuaaauaaaugugaaauccuccagg

SEQ ID NO: 447534 - RNA, 64 nt, Homo Sapiens
gcauuccaguucucccuccucucccucugugggaggcacuuacuuagugacggagggagaaauc

SEQ ID NO: 447535 - RNA, 64 nt, Homo Sapiens
cucccagagccuuuggugcccaccuccuggcuggggcacuuauggaagcuuccgggguggccuc

SEQ ID NO: 447536 - RNA, 64 nt, Homo Sapiens
ggagacucggauggggacauucauuccagcaggaggcacuuaggccaaccuuucauuuccuacu

SEQ ID NO: 447537 - RNA, 64 nt, Homo Sapiens
aauaauuagcagcguuaaauaacuaauguuuuauggcacuuaagcuuaauaaaguuauuuuggu

SEQ ID NO: 447538 - RNA, 64 nt, Homo Sapiens; identical to SEQ ID NO: 179150

SEQ ID NO: 447539 - RNA, 64 nt, Homo Sapiens; identical to SEQ ID NO: 179151

SEQ ID NO: 447540 - RNA, 64 nt, Homo Sapiens
uaugcguauuauaccaaaauguugcugaaaaaugggcacuuaaagcuuucagaauaugucagug

SEQ ID NO: 447541 - RNA, 64 nt, Homo Sapiens
aggaagaagcucuguacagauugccuauaguuuaggcacuuaauuuuagugggaacaccaaagu

SEQ ID NO: 447542 - RNA, 64 nt, Homo Sapiens
uacccagggaugccacccuugcuacuucuucauaggcacuuacugcugcaaagccauugguugg

SEQ ID NO: 447543 - RNA, 64 nt, Homo Sapiens
augaaagccuauaggucauuaaaugcuugacguuggcacuuaacuggauaagguuucagaguuc

SEQ ID NO: 447544 - RNA, 64 nt, Homo Sapiens
uguuucagcauagauuccaggggggcaccuccugggcacuuaggccgugucacuccugggccau

SEQ ID NO: 447545 - RNA, 64 nt, Homo Sapiens
gccuuuuccugaauuggaaaagaacaagauaccaggcacuuaaagcccaagagaucugugccau

SEQ ID NO: 447546 - RNA, 64 nt, Homo Sapiens
ugcaguaaauuacuguauuguaaauucucaguguggcacuuaccuguaaaugcaaugaaacuuu

SEQ ID NO: 447547 - RNA, 64 nt, Homo Sapiens
aaguuuuuuuuguuuauuuuacgcaucaaccuuuggcacuuacaaaaaaaaugguaauuauuuc

SEQ ID NO: 447548 - RNA, 64 nt, Homo Sapiens
uggcuuccaauuuuuggccauucuauuguuaauaggcacuuaagaauauuccucaguucaucca

SEQ ID NO: 447549 - RNA, 64 nt, Homo Sapiens
guuucuauguuauugaaaaaauaggaaucuuccuggcacuuaguuggaugcuaaaauuacauga

SEQ ID NO: 447550 - RNA, 64 nt, Homo Sapiens
agcauucuucaaauguuccccuuguacaggaccuggcacuuaguuguuuguaguaauuaauuac

SEQ ID NO: 447551 - RNA, 64 nt, Homo Sapiens
ugcagcauuucaccacucauggagcaaagugacaggcacuuagaggcugcaugauauuccccug

SEQ ID NO: 447552 - RNA, 64 nt, Homo Sapiens
uccaaggucuccagagggugcucauaaugcauguggcacuuaggggacagcuccuggaccaggu

SEQ ID NO: 447553 - RNA, 64 nt, Homo Sapiens
cagaauagauuucuucacuuacaaaugcauauugggcacuuauaauacagcaggaacucuucuc

SEQ ID NO: 447554 - RNA, 64 nt, Homo Sapiens
cguaggcaagaaguugaaaaacaguugauuugggggcacuuagguaccauaugccccauuccca

SEQ ID NO: 447555 - RNA, 64 nt, Homo Sapiens
ugugaagacugaaguguucuucaguaauugugcuggcacuuaggagagagaggagggggaauaa

SEQ ID NO: 447556 - RNA, 64 nt, Homo Sapiens
ccuggggcaaaacuauuucagcagaccugaagauggcacuuaugguggauuuaucuaaauggag

SEQ ID NO: 447557 - RNA, 64 nt, Homo Sapiens
auggagaaaucaguugugguuguccccuuugaggggcacuuaagaacuucuuuugcccccuucu

SEQ ID NO: 447558 - RNA, 64 nt, Homo Sapiens
ccccguuuuugcuguuucucggggcaggagccugggcacuuacucucuuuuccucaagggguuu

SEQ ID NO: 447559 - RNA, 64 nt, Homo Sapiens
gaauauaugaucggccaucauggggagggugcuuggcacuuauuccacagugccuauugauacu

SEQ ID NO: 447560 - RNA, 64 nt, Homo Sapiens
caagacaaaaagccacaaugcuccccuaucccuaggcacuuaacgagcagcauuuuauuuaccc

SEQ ID NO: 447561 - RNA, 64 nt, Homo Sapiens
aaacaaaaagaacaaaaaaagggugacggcuucuggcacuuagacaggcaaagggagagaggaa

SEQ ID NO: 447562 - RNA, 64 nt, Homo Sapiens
gugcgaguggcuugaaucucccaugauguuggagggcacuuagugggguugaaguaugacauaa

SEQ ID NO: 447563 - RNA, 64 nt, Homo Sapiens
ggggaagcugcggcuacacauuccacaaagugcuggcacuuacacccacaacccggaaggcugu

SEQ ID NO: 447564 - RNA, 64 nt, Homo Sapiens
uaaaacugaaagaggauucuaguucuucauaaacggcacuuaauuccagcugggagcagaacua

SEQ ID NO: 447565 - RNA, 64 nt, Homo Sapiens
agccauguauuacagcuacuacaugcuaccggacggcacuuacugccuggcgccgcccccuccc

SEQ ID NO: 447566 - RNA, 64 nt, Homo Sapiens
aauggagagaccugaaugucgaccauggggauggggcacuuaacacuggcuuggguuggaggga

SEQ ID NO: 447567 - RNA, 64 nt, Homo Sapiens
aaacccucguuucugauuaaugggacccagcaagggcacuuaacgaaucggaaucucugggggu

SEQ ID NO: 447568 - RNA, 64 nt, Homo Sapiens
augauaaugauuaacuuauauaaacagaacugguggcacuuaaaaauucacaagugcauuaaua

SEQ ID NO: 447569 - RNA, 64 nt, Homo Sapiens
gcuuauaaaagaacugcggcucgcgucuucaugaggcacuuaaaguugcacuuggaagagaucc

SEQ ID NO: 447570 - RNA, 64 nt, Homo Sapiens
cagcuuucaguaagugggugcuagcaccgagccuggcacuuaggugaauggugcuuucaaucuc

SEQ ID NO: 447571 - RNA, 64 nt, Homo Sapiens
uuuuggcuaguuuuugucugcuuggaugaccacaggcacuuagucccgcaauagaagggcacca

SEQ ID NO: 447572 - RNA, 64 nt, Homo Sapiens
uccucugauccccguguaagacugcccuggugucggcacuuaggaauguguaaaugguaaaguc

SEQ ID NO: 447573 - RNA, 64 nt, Homo Sapiens
aagacauagcgccugccagggaauaggaaaugagggcacuuacacauuaaugugaauuaguaau

SEQ ID NO: 447574 - RNA, 64 nt, Homo Sapiens
uuuuguuuuucguuuguugugauauagaacaaagggcacuuagcaaauuugaauuuguauaaua

SEQ ID NO: 447575 - RNA, 64 nt, Homo Sapiens
ucugccaggcaugguagcucaugccuguaacccuggcacuuaaggggccaaggcaggaggauca

SEQ ID NO: 447576 - RNA, 64 nt, Homo Sapiens
cugacuggcguuagcugauuaacccauguaaauaggcacuuaaauagaagcaggaaagggagac

SEQ ID NO: 447577 - RNA, 64 nt, Homo Sapiens
uguaaccuggcucuagggcacaggccccuccccuggcacuuagugggucuaauaaaguauguug

SEQ ID NO: 447578 - RNA, 64 nt, Homo Sapiens
aaaaaauguaaaaagucugagagaaacuacuuagggcacuuaggaauuggcaggacuuucugug

SEQ ID NO: 447579 - RNA, 64 nt, Homo Sapiens
gcugaacuggacagacaguguuccugagaggcugggcacuuagcuggaaaccgcccaccucccu

SEQ ID NO: 447580 - RNA, 64 nt, Homo Sapiens
ccauugaaaucagcaugacaaaaauaacacuguuggcacuuauagguaacgugauugauucagu

SEQ ID NO: 447581 - RNA, 64 nt, Homo Sapiens
guauguguggguguguguuacauacacagaaucaggcacuuaccugcaaacuccuuguaggucu

SEQ ID NO: 447582 - RNA, 64 nt, Homo Sapiens
gagaggaucuaaagcagccgucucucccugcugcggcacuuaugugccugugcacgucuucccu

SEQ ID NO: 447583 - RNA, 64 nt, Homo Sapiens
uuaaaaugagcucacugauaggggucuuuagaaaggcacuuaaaauaucacuguauuuggagau

SEQ ID NO: 447584 - RNA, 64 nt, Homo Sapiens
aggacaaagugaauuuaacccagcccacagcaugggcacuuaugcaauggggcugauaccuuca

SEQ ID NO: 447585 - RNA, 64 nt, Homo Sapiens
cagcgggucuccaguccccugacccagcucuaaaggcacuuaggacccagggaacauuucucac

SEQ ID NO: 447586 - RNA, 64 nt, Homo Sapiens
gagaacugaaagaggggaaaggaguacauuugagggcacuuaauacaaaguuaaugucagaaug

SEQ ID NO: 447587 - RNA, 64 nt, Homo Sapiens
cuacaaagauguaaaaaaauuagccacaugugcuggcacuuaccuguagucccagcuacuuggg

SEQ ID NO: 447588 - RNA, 64 nt, Homo Sapiens
ccaaugaacuuuagagaguucuugcauuggaacuggcacuuauuuucugaccaucgcugcuguu

SEQ ID NO: 447589 - RNA, 64 nt, Homo Sapiens
uuaagcaacugaaguuaaaauuguugaaggaaaaggcacuuaaauugguuacuuucauguccag

SEQ ID NO: 447590 - RNA, 64 nt, Homo Sapiens
cugagucacaggugugggauggagaguggggagaggcacuuaaucuguaacccccaaggaggaa

SEQ ID NO: 447591 - RNA, 64 nt, Homo Sapiens
cuuugguguuacacagcccaagaggacugagacuggcacuuagcccaagaggucugagcccugg

SEQ ID NO: 447592 - RNA, 64 nt, Homo Sapiens
cuucccuggcuuuuucaacuggaccaaagaugaaggcacuuauggacccuuugauggcuuggag

SEQ ID NO: 447593 - RNA, 64 nt, Homo Sapiens
acauguauauaauguauuuccuggauacaaacgaggcacuuaaucacaucgggaaaaugaaaaa

SEQ ID NO: 447594 - RNA, 64 nt, Homo Sapiens
caaaagauacagugauauaguaauauguaccaguggcacuuaacguuuuuguuuuuuuucaucu

SEQ ID NO: 447595 - RNA, 64 nt, Homo Sapiens
gaaugcuucucacuuuuuuuuuuuguuugaugcaggcacuuauuguaaauuuuagaaaccccuc

SEQ ID NO: 447596 - RNA, 64 nt, Homo Sapiens
cauagcaaagcucacuguauugggcuaauaauuuggcacuuauuagcuucucucauaaacugau

SEQ ID NO: 447597 - RNA, 64 nt, Homo Sapiens
accuuccucuuccagcaacugaaccucgccauaaggcacuuaucccugguuccuagcaccgcuu

SEQ ID NO: 447598 - RNA, 64 nt, Homo Sapiens
aauuccaaacauauaagaggcucccucuuaacacggcacuuagauacgugcuauuccaccuuuc

SEQ ID NO: 447599 - RNA, 64 nt, Homo Sapiens
aauuccaaacauacaagaggcucccucuuaacacggcacuuagacacgugcuguuccaccuucc

SEQ ID NO: 447600 - RNA, 64 nt, Homo Sapiens
aauuccaaacauacaagaggcucucucuuaacacggcacuuagacacgugcuguuccaccuucc

SEQ ID NO: 447601 - RNA, 64 nt, Homo Sapiens
aauuccaaacauacaagaggcucccucuugacguggcacuuacccacgugcuguuccaccuucc

SEQ ID NO: 447602 - RNA, 64 nt, Homo Sapiens
aauuccaaacauacaagaggcucccucuuaacacggcacuuacacacuugcuguuccaccuucc

SEQ ID NO: 447603 - RNA, 64 nt, Homo Sapiens; identical to SEQ ID NO: 179152

SEQ ID NO: 447604 - RNA, 64 nt, Homo Sapiens; identical to SEQ ID NO: 179153

SEQ ID NO: 447605 - RNA, 64 nt, Homo Sapiens
aaauauuaguaaauccuucaguugaaauguugguggcacuuaaucccagcccugccuguggccc

SEQ ID NO: 447606 - RNA, 64 nt, Homo Sapiens
cgccccucuucccccgacaucugggggcgcugguggcacuuacucuagguuggucucagacuau

SEQ ID NO: 447607 - RNA, 64 nt, Homo Sapiens
uucgccaucugauccccaugccuagcagagugcuggcacuuaguagguccucaauaaauauuua

SEQ ID NO: 447608 - RNA, 64 nt, Homo Sapiens
ugcauuuucugcugaaagaucauuauguuuaacaggcacuuaaucucaguaaagucaguugcca

SEQ ID NO: 447609 - RNA, 64 nt, Homo Sapiens
uugucauucaagccugugaauaaaaacccuguauggcacuuauuaugaggcuauuaaaagaauc

SEQ ID NO: 447610 - RNA, 64 nt, Homo Sapiens
gaggggguucugccccuugugaaggcccauuccuggcacuuagagacagaaagaacucagcaau

SEQ ID NO: 447611 - RNA, 64 nt, Homo Sapiens
ggcauaaaagauaagaauuggcucuccuguacagggcacuuacuacgaauggagcuugcagggc

SEQ ID NO: 447612 - RNA, 64 nt, Homo Sapiens
gagguuuuccugucuggcuucugagguuggagggggcacuuagcagugaaccuuaagucugggu

SEQ ID NO: 447613 - RNA, 64 nt, Homo Sapiens
guggcagggagugagguuggugagagaacaugugggcacuuaacucuucauguuccaguucauc

SEQ ID NO: 447614 - RNA, 64 nt, Homo Sapiens
cacacccugguuuuguguaguucucaccucgccuggcacuuaacuguguugugagcccucccgg

SEQ ID NO: 447615 - RNA, 64 nt, Homo Sapiens
gguccuuaccagagacgcccaguacguccugccuggcacuuacuggccacggcugagccuucag

SEQ ID NO: 447616 - RNA, 64 nt, Homo Sapiens
aagaaaacugucaaucagcuuauaacgacaauguggcacuuaauaaauacuugucagaacuuua

SEQ ID NO: 447617 - RNA, 64 nt, Homo Sapiens
caguugucucuucaaccucucuuuuggaaaaguuggcacuuaccuaaauuuuuuuuugaaacag

SEQ ID NO: 447618 - RNA, 64 nt, Homo Sapiens
cagauguaucuucaaccucucugcagcaagaguuggcacuuauuaauuuauuuuuuugaaacag

SEQ ID NO: 447619 - RNA, 65 nt, Homo Sapiens
acugugccuggguguauucuuuauacuguagauaauggagaaauuuucuaucucugucccuauuu

SEQ ID NO: 447620 - RNA, 65 nt, Homo Sapiens
gcagacaccggggcuggguuucucuuuccucuuuuuggagaaaaggaacagggcaguggaaugaa

SEQ ID NO: 447621 - RNA, 65 nt, Homo Sapiens
ccccuggcagcaguauuggaggggcuacaggcagcuggagaaaggggcccagccgcugacccacu

SEQ ID NO: 447622 - RNA, 65 nt, Homo Sapiens
uuuugcuaucaggaaguuuugaggagcaggcagaguggagaaagugggaauagggugcauugggg

SEQ ID NO: 447623 - RNA, 65 nt, Homo Sapiens
gucacuaauagaaugucuccaaagcuggauugauguggagaaaacaccuuucccuucuaguuuug

SEQ ID NO: 447624 - RNA, 65 nt, Homo Sapiens
cugaggucaggaguuuaagaccagccugaccaacauggagaaaccucgucucuacuaaaaauaca

SEQ ID NO: 447625 - RNA, 65 nt, Homo Sapiens
cuggaggggagagaaggauucuagggguguggaguuggagaaagaggcuuccuugagccacccuu

SEQ ID NO: 447626 - RNA, 65 nt, Homo Sapiens
cagcaacucacaaaacguagcacaaacauucauuauggagaaagcaucaggacuguugaguaacu

SEQ ID NO: 447627 - RNA, 65 nt, Homo Sapiens
acauuaggaaacaauggcagucaaacccauggcuuuggagaaaguaaauguuugccagaaaggaa

SEQ ID NO: 447628 - RNA, 65 nt, Homo Sapiens
gaagagaauccaacucaaccugcacacuugacaaguggagaaacagaagcccagagagagcacug

SEQ ID NO: 447629 - RNA, 65 nt, Homo Sapiens
cuccauccuguccccaaggacucacauacagugccuggagaaagccaaagaccuuuauuucuucc

SEQ ID NO: 447630 - RNA, 65 nt, Homo Sapiens
acaaacaagggagaagagugucagaaucagaaucauggagaaaaugggcggggguggugugggug

SEQ ID NO: 447631 - RNA, 65 nt, Homo Sapiens
gcaaccaaccauugcacuggccaaaucauuauuuauggagaaauccucuuugugucucuacucua

SEQ ID NO: 447632 - RNA, 65 nt, Homo Sapiens
aucagagcaaacaucauguagauagcacaaguauuuggagaaacguuguuuguuuuguuaccaaa

SEQ ID NO: 447633 - RNA, 65 nt, Homo Sapiens
gaauuuagaucuuauauugguuugcacaaguucccuggagaaaaaaauugcucuguguauaucuc

SEQ ID NO: 447634 - RNA, 65 nt, Homo Sapiens
cuguguuuucagaauuuccauuucuacuaaccucuuggagaaaaagaaauugaauuagagguaaa

SEQ ID NO: 447635 - RNA, 65 nt, Homo Sapiens
uucccugaggcuuuggggucagaguauauguuguuuggagaaagagggcaaucaggacucuucug

SEQ ID NO: 447636 - RNA, 65 nt, Homo Sapiens
cugaccagaccucgaacaucacagagcaacccuuauggagaaacuugcaaccaggaccuguccca

SEQ ID NO: 447637 - RNA, 65 nt, Homo Sapiens
ccgacagugccauccccaccuucaccucggagggauggagaaagaaguggagacaguccuuuccc

SEQ ID NO: 447638 - RNA, 65 nt, Homo Sapiens
ccaugcugggccagccagauaagucaggguccugguggagaaagaaaggcuaggaccauguccuc

SEQ ID NO: 447639 - RNA, 65 nt, Homo Sapiens
aaaccuguaaauaugaaagaacaaagguuauuuccuggagaaaagacaauuuauucaacaccaac

SEQ ID NO: 447640 - RNA, 65 nt, Homo Sapiens
acucaucauaugggcacaacucugguguccuucuauggagaaaaccucaaguaaaguuuuauucu

SEQ ID NO: 447641 - RNA, 65 nt, Homo Sapiens
agcugggcagcgucugcucuguguucuguguggaauggagaaaaaaacgccugcccugcugccuu

SEQ ID NO: 447642 - RNA, 65 nt, Homo Sapiens
agaaguauaaaaacaacuguauugaguugaggcuguggagaaauaaggacacauauaugggaaug

SEQ ID NO: 447643 - RNA, 65 nt, Homo Sapiens
cugcuccccccuccgaugcaugcucuucucucacauggagaaaaccaagacagaauugggaagcc

SEQ ID NO: 447644 - RNA, 65 nt, Homo Sapiens
acaacucucagucauucauuucacagauuuuuuuguggagaaauuucuguuuauauggaugaaau

SEQ ID NO: 447645 - RNA, 65 nt, Homo Sapiens
ucgcuauuaaauaaagaaaauuggaugcaagacaauggagaaacuuuaaaacuaaacaggaccac

SEQ ID NO: 447646 - RNA, 65 nt, Homo Sapiens
ugucguagacuugugcaauauauacuguuguggguuggagaaaaguggaaagcuacacugggaag

SEQ ID NO: 447647 - RNA, 65 nt, Homo Sapiens
ugguaggcaaauuguuaggcagaauaaugguauguuggagaaauacaccugucucuuauucuuau

SEQ ID NO: 447648 - RNA, 65 nt, Homo Sapiens
gggccggcccccuuccuggccccucauggcgggacuggagaaaugguccgcuuuccuggagccaa

SEQ ID NO: 447649 - RNA, 65 nt, Homo Sapiens
uccuucaagguggcagcuguuagggcugaaucuucuggagaaaaaggugccaucucaggagaaua

SEQ ID NO: 447650 - RNA, 65 nt, Homo Sapiens
aauuaacuagcauuuagccagcuuuuucuugcccuuggagaaaaagaaucauucucaaccugaua

SEQ ID NO: 447651 - RNA, 65 nt, Homo Sapiens
cuaggcaaacuacacccugugauuugaaaacaguguggagaaaaaugaaaaauaacacaaugcuu

SEQ ID NO: 447652 - RNA, 65 nt, Homo Sapiens
aguccugauagacugaaaauauaauaaacucaagcuggagaaauguagaguaauauauauucaga

SEQ ID NO: 447653 - RNA, 65 nt, Homo Sapiens
ucugcagcauggcuuuuuacggaaaucuucauaauuggagaaaguuuuuauuuuaauacauugua

SEQ ID NO: 447654 - RNA, 65 nt, Homo Sapiens
aauuaacaauaaagaauuuuuaaaaauauaucuguuggagaaagacuguggcuccauauuucaac

SEQ ID NO: 447655 - RNA, 65 nt, Homo Sapiens
ugcaguccucaggaagggggucuggggagagcggcuggagaaagagcucacuggcagguguggga

SEQ ID NO: 447656 - RNA, 65 nt, Homo Sapiens
uucuguugcccugauuuauggucuucuggucuccuuggagaaaggccaaggcggcggcagagcug

SEQ ID NO: 447657 - RNA, 65 nt, Homo Sapiens
gcauuuuaagaggagucucuauuuugauaaauuaguggagaaauggagccuuuuguuuuguuuuu

SEQ ID NO: 447658 - RNA, 65 nt, Homo Sapiens
ugguuucaauauaacucauuucuucccuuggcagcuggagaaauccagggaguccagcccuaccu

SEQ ID NO: 447659 - RNA, 65 nt, Homo Sapiens
ucuuuggaaagaccuagauucaguggcauccaggguggagaaagcucaccccccugucacccucc

SEQ ID NO: 447660 - RNA, 65 nt, Homo Sapiens
gaaaaaucuuggggcuuccaauggacauuuuacuuuggagaaacauaggaaagacauguaagagc

SEQ ID NO: 447661 - RNA, 65 nt, Homo Sapiens
augagcuacgccuugaugaauguagcaugucaguuuggagaaaugcgcuuuuuggaagacauuuc

SEQ ID NO: 447662 - RNA, 65 nt, Homo Sapiens
agggauccugaccgcagggcaggcauucauggagcuggagaaacccuguccagggccucacaggg

SEQ ID NO: 447663 - RNA, 65 nt, Homo Sapiens
uuaucaccuaaaauauacccuuaagugauagauaguggagaaaauuuuguaagaaaauguucauu

SEQ ID NO: 447664 - RNA, 65 nt, Homo Sapiens
caaaccuucaagcccuagguuucccuuguuacuguuggagaaacugcuccagguggaagcaugcu

SEQ ID NO: 447665 - RNA, 65 nt, Homo Sapiens
acuuagacucugugugccucuccuucucuuuugucuggagaaauccuuuugcuucuuucugucuu

SEQ ID NO: 447666 - RNA, 65 nt, Homo Sapiens
uugccuauaauucuauaaaguaaguuaaguuuuauuggagaaaucuuauaguuuuauaacuggcu

SEQ ID NO: 447667 - RNA, 65 nt, Homo Sapiens
ucauaaauuacuguuuugccaacuaugcuaauuuuuggagaaaugcuuuuuacuguugaacuuag

SEQ ID NO: 447668 - RNA, 65 nt, Homo Sapiens
gaaugugaaagcugucauuauggauccuuuggguuuggagaaagguuucuuggacuacuuuaauu

SEQ ID NO: 447669 - RNA, 65 nt, Homo Sapiens
ccacaccaugauuauuagccgccaugcugcugguauggagaaauuuaccuaaaacacauacguua

SEQ ID NO: 447670 - RNA, 65 nt, Homo Sapiens
aaaaauguuguacaacugacuuaugauguuacuuguggagaaacuuugguguuuuaaaguaaaaa

SEQ ID NO: 447671 - RNA, 65 nt, Homo Sapiens
uugaauagcuuauguacaaauguaucagucagugcuggagaaaucgugccaucucaauugugcuu

SEQ ID NO: 447672 - RNA, 65 nt, Homo Sapiens
gaauuuguuuaaauaacauuuuuauagaaaaugcauggagaaaagcuuucuaacugaauacuugu

SEQ ID NO: 447673 - RNA, 65 nt, Homo Sapiens
cuacuaaaaauacaaaguuaucagccugaccaacauggagaaacccugaggucaggaguucaaga

SEQ ID NO: 447674 - RNA, 65 nt, Homo Sapiens
acccucaagacaaaugacccgaccauaaauuuaaauggagaaagggcucaacaagagacuggaag

SEQ ID NO: 447675 - RNA, 65 nt, Homo Sapiens
aaaauaccucuuuauuuuuuaagaagaccagacuguggagaaauagacuggagcaucugacucac

SEQ ID NO: 447676 - RNA, 65 nt, Homo Sapiens
ccuugauucacaaugaaaugaagaguuaaaacagguggagaaauuaucucuuugaugucauaugg

SEQ ID NO: 447677 - RNA, 65 nt, Homo Sapiens
agcuccauugaccgaagccagacucauuccauaacuggagaaagacagaaacuccccguuuugcu

SEQ ID NO: 447678 - RNA, 65 nt, Homo Sapiens
ugucaccucccccaacccgaaauuuuguaccuuuguggagaaauggaagcugacuuucuauaggc

SEQ ID NO: 447679 - RNA, 65 nt, Homo Sapiens
auacuuauguuuugcucaucgcuuaguuauguugcuggagaaaagugacucauuuaaacuuugau

SEQ ID NO: 447680 - RNA, 65 nt, Homo Sapiens
ggaggugaaagauugaagaguugacguucguuucauggagaaagggaugggcugcugugugaaug

SEQ ID NO: 447681 - RNA, 65 nt, Homo Sapiens
agaaaaagcuuuaguuccaauuuccuguauuuagguggagaaaugacucaauauguuauauuugu

SEQ ID NO: 447682 - RNA, 65 nt, Homo Sapiens
ugaacuguuacaaaccccugcuccccaugggaccuuggagaaaacucuuccuguucugcaccccu

SEQ ID NO: 447683 - RNA, 65 nt, Homo Sapiens
uauuuuuaauuugugaugcuagcacuuuuaccacauggagaaauaugcccuuuaaugggauugaa

SEQ ID NO: 447684 - RNA, 65 nt, Homo Sapiens
ccaaagacuuuuccuauguauucugucuaaaagucuggagaaauccauuguaaagauugccuuug

SEQ ID NO: 447685 - RNA, 65 nt, Homo Sapiens
agcugcagagguucuguauuuuucaucuccuuuccuggagaaagcccaacugaaacauauaacgu

SEQ ID NO: 447686 - RNA, 65 nt, Homo Sapiens
acauacacauuauuccaccaauugacuuugaaaaguggagaaaguguauucuuuaaagagaauuu

SEQ ID NO: 447687 - RNA, 65 nt, Homo Sapiens
uaccuggcauagagaaaaauauauaccugguacauuggagaaaaauaauuacacuuucaaagaga

SEQ ID NO: 447688 - RNA, 65 nt, Homo Sapiens
uagauacauaaauaugguggucagcguuaauaaaguggagaaauauuggagaacuguuuaccuca

SEQ ID NO: 447689 - RNA, 65 nt, Homo Sapiens
cucccuucguguuguuuugcauggcuuugcaguuauggagaaaguggaaacccagcagucccuaa

SEQ ID NO: 447690 - RNA, 65 nt, Homo Sapiens
aguauccucguuugaaagauaauuaagaucccccguggagaaagcagugacacauucacacagcu

SEQ ID NO: 447691 - RNA, 65 nt, Homo Sapiens
acuggucacuguagcagguaaacacuacucuaacguggagaaaugagcuucaugcugagguagug

SEQ ID NO: 447692 - RNA, 65 nt, Homo Sapiens
gcagugauuuuguuccaaaacuuuguauacacauuuggagaaaaguacuuuauauuuucaguguu

SEQ ID NO: 447693 - RNA, 65 nt, Homo Sapiens
gggcacgcacggugcaucaagucuugggcagggcauggagaaacaaaugucuuguuauuauucuu

SEQ ID NO: 447694 - RNA, 65 nt, Homo Sapiens
cugaggucagcaguuaaagaccagccugaccaaaauggagaaaccccaucucuacuaaaaauaca

SEQ ID NO: 447695 - RNA, 65 nt, Homo Sapiens
uguauuauaggacucacgggaugccaucuagcaaguggagaaauagcaguccauuuucucuugca

SEQ ID NO: 447696 - RNA, 65 nt, Homo Sapiens
ugauggguuugauuuuuauaucaaaucaucaggcauggagaaauaucuuuuagaaguguuaaaau

SEQ ID NO: 447697 - RNA, 65 nt, Homo Sapiens
ucagugggcccgaacucgccagccccagcuuucaguggagaaagcgguccucugaaaugguuucc

SEQ ID NO: 447698 - RNA, 65 nt, Homo Sapiens
aacagaagggagggcagagcuggugcggcuggccauggagaaagcugacuuggcuggugugguac

SEQ ID NO: 447699 - RNA, 65 nt, Homo Sapiens
cacuccagccugggcaacagagcaagacccugucuuggagaaaccagaauuuuggaagagcaaau

SEQ ID NO: 447700 - RNA, 65 nt, Homo Sapiens
cugaggucgggaguucgaggccagccugaccaacauggagaaaccccgucucuucuaaaaauaca

SEQ ID NO: 447701 - RNA, 65 nt, Homo Sapiens
gacucuguuucgaauauagccacagaaauaaaggauggagaaaaaucugggacagguaauuuugc

SEQ ID NO: 447702 - RNA, 65 nt, Homo Sapiens
gauucuguuucgaacauagccacagaaauaaaggauggagaaaaaucugggacagguaauuuugc

SEQ ID NO: 447703 - RNA, 65 nt, Homo Sapiens
gguucuguuuugaguauagccagagaaaacaaggauggagaaaaaucuaggacagguaauuuuga

SEQ ID NO: 447704 - RNA, 65 nt, Homo Sapiens
gauucuuuuucgaauauaaccagaggaaaaaaggauggagaaauaucuaggaaagguaauuuugc

SEQ ID NO: 447705 - RNA, 65 nt, Homo Sapiens
gauucuuuuucgaauauaaccagagaaaaaaaggauggagaaauaucuaggaaagguaauuuugc

SEQ ID NO: 447706 - RNA, 65 nt, Homo Sapiens
gauucuguuuuggguauagccagagaaaacaaggauggagaaaaaucuaggacagguaauuuuga

SEQ ID NO: 447707 - RNA, 65 nt, Homo Sapiens
cugaggucaagaguucgagaccagccugaccaacauggagaaacccccaucucuacugaaaauac

SEQ ID NO: 447708 - RNA, 65 nt, Homo Sapiens
ugaguggcucuuugcaugaacacugugcaagguguuggagaaauccaaagcugaccaaaacaugg

SEQ ID NO: 447709 - RNA, 65 nt, Homo Sapiens
guguuuuuuacucuuuucucaugcacauguuacguuggagaaaauguuuacaaaaaugguuuugu

SEQ ID NO: 447710 - RNA, 65 nt, Homo Sapiens
aauacccuucccuucaacaacucuccagcucugaauggagaaacucucuaggccauccccucuuc

SEQ ID NO: 447711 - RNA, 65 nt, Homo Sapiens
ggauuuuggcaucuuguuuuucuaacaacaaacaauggagaaaaagaauugauucuuagugacac

SEQ ID NO: 447712 - RNA, 65 nt, Homo Sapiens
auaaaacaguauacugacaacuguuuacaagaaaguggagaaaaauguacauacauuuuuguaug

SEQ ID NO: 447713 - RNA, 65 nt, Homo Sapiens
uuaaaaagaguugccuauugaaaugaucauguuucuggagaaauuaagcuuauagacagcaugug

SEQ ID NO: 447714 - RNA, 65 nt, Homo Sapiens
gagaccucuggucagcaaacuggaacucaguaaacuggagaaauaguaucgaugggagguuucua

SEQ ID NO: 447715 - RNA, 65 nt, Homo Sapiens
uugguagaggguauaucuagugaauggagaauacauggagaaacuuaacuaaguuacacaagcau

SEQ ID NO: 447716 - RNA, 65 nt, Homo Sapiens
uuucuggauuucauacuguaacauucaggaauucuuggagaaaauggguuuauucacugaacucu

SEQ ID NO: 447717 - RNA, 65 nt, Homo Sapiens
guuuggaacuuagauuuccaauguguauauucuaauggagaaagcaagagguagaguuuguaugu

SEQ ID NO: 447718 - RNA, 65 nt, Homo Sapiens
uuggaauguacccaucugaaucaaaugcaaacuucuggagaaaacagagugccucuucccagaug

SEQ ID NO: 447719 - RNA, 65 nt, Homo Sapiens
uccucucaaaacaaacacccucuugcaaccagcuuuggagaaagcccagcuccugugugcucacu

SEQ ID NO: 447720 - RNA, 65 nt, Homo Sapiens
uacucugaaacaugguggccugagagaagaagagcuggagaaaaugaaagaagagcgugaaaggu

SEQ ID NO: 447721 - RNA, 65 nt, Homo Sapiens
gcaggagcaggggcagggggccacuguagugagcguggagaaauuuggaaacaccuauuucuuaa

SEQ ID NO: 447722 - RNA, 64 nt, Homo Sapiens
uggcuggcccuguaauuuaaauuaaaauaaaauuuuggagaaacagcauugucugucuuuauga

SEQ ID NO: 447723 - RNA, 65 nt, Homo Sapiens
ugcagagagaggcaggaaggaucccugaagagucuuggagaaaagguucugugcccucagguggg

SEQ ID NO: 447724 - RNA, 65 nt, Homo Sapiens
gcuaauaaaaucaaauaaaacuguaugaacucuaauggagaaaaaucuaauuauagcaaggugag

SEQ ID NO: 447725 - RNA, 65 nt, Homo Sapiens
gcuuauauuuaucgcuuggcucaaguucugcccuuuggagaaauacugagcaagucuuucauucu

SEQ ID NO: 447726 - RNA, 65 nt, Homo Sapiens
gacagaugaaaggagacaaugguuguguagggagauggagaaaaugcuuaaucugaggaugagac

SEQ ID NO: 447727 - RNA, 65 nt, Homo Sapiens
gagacagcuugcagauggcgggguuucaccaaggauggagaaaggcacguugccuucugcgcaaa

SEQ ID NO: 447728 - RNA, 65 nt, Homo Sapiens
ugguacucauuaaaaaaaaaagcuuacaagccagcuggagaaauagaucguucucugccucacau

SEQ ID NO: 447729 - RNA, 65 nt, Homo Sapiens
gaagggguuggcuuuuuaauagcauaucaaugugguggagaaaggaaggacagcaacaugaaaag

SEQ ID NO: 447730 - RNA, 65 nt, Homo Sapiens
uugcuaaagguuuuagcuuaucuuaagaggggaacuggagaaaccuuuggcuggucuuucaauuu

SEQ ID NO: 447731 - RNA, 65 nt, Homo Sapiens
gaaacgauugcucugauggguauugacaaauaaaauggagaaaauuaaauauuugaguauuuuua

SEQ ID NO: 447732 - RNA, 65 nt, Homo Sapiens
ucuauccagguccuuugccuccaugcguauuucuuuggagaaaggucuuuuccugugcuuacggg

SEQ ID NO: 447733 - RNA, 65 nt, Homo Sapiens
aucaaaaucauguauaccauccaaaauuaaaggaauggagaaauauuuuacuugagggggacguc

SEQ ID NO: 447734 - RNA, 65 nt, Homo Sapiens
uaaaauugcaauucuacuuagaagaaaaacuucucuggagaaaaagagcggaguuguuaaggacu

SEQ ID NO: 447735 - RNA, 65 nt, Homo Sapiens
agcccagcuuggcgugggguaguugagaauuccuuuggagaaaacacagaaauucuguugaagac

SEQ ID NO: 447736 - RNA, 65 nt, Homo Sapiens
cacaaucaacuuuucugagccaccaaguguggaauuggagaaaagugacgcuacuaaccugacau

SEQ ID NO: 447737 - RNA, 65 nt, Homo Sapiens
gcauuaucuuaaaaggcaguauucuguagcauacuuggagaaacuuuucuagagguuggcuuuca

SEQ ID NO: 447738 - RNA, 65 nt, Homo Sapiens
gaagaaaaaggcuggcugaauucagagaagucaguuggagaaaaucaguguuccucaccaauaac

SEQ ID NO: 447739 - RNA, 65 nt, Homo Sapiens
gugccuuucauucauuaccucagcgguccucaaguuggagaaaauugguaccgucuaguacuaug

SEQ ID NO: 447740 - RNA, 65 nt, Homo Sapiens
ccgucucuacuaaaaauacaccagccugaccaacauggagaaaccccgaggucaggaauucgaga

SEQ ID NO: 447741 - RNA, 65 nt, Homo Sapiens
uagaaauaaugccauaagucgcugcaauuaaaacauggagaaaaggggaaagauuuaaagugcag

SEQ ID NO: 447742 - RNA, 65 nt, Homo Sapiens
cacuagcagagugcaggaucagccccguggagugcuggagaaaugaagcugcauuguuggguaaa

SEQ ID NO: 447743 - RNA, 65 nt, Homo Sapiens
agagaccaacuuuuucauucgaagccuguguaucguggagaaacauuaagcaugacuuuagaugg

SEQ ID NO: 447744 - RNA, 65 nt, Homo Sapiens
acauucugaagcauccccaacaggcuccaucuguuuggagaaaauuuggaaaaucacacaguuuu

SEQ ID NO: 447745 - RNA, 65 nt, Homo Sapiens
uugaggccaggaguucaagaccagucuggccaauauggagaaaccuugucucuacuaaaaacaca

SEQ ID NO: 447746 - RNA, 65 nt, Homo Sapiens
gcaaaaggauuuguuuucacucugggaggagaggguggagaaagcacuugcuuucauccucuggc

SEQ ID NO: 447747 - RNA, 50 nt, Homo Sapiens
agaucacacaacuucagugauggagaaaucucaaguuacuggcuuuuaua

SEQ ID NO: 447748 - RNA, 65 nt, Homo Sapiens
auggaaauggauuggauugucaaauuauuauuuauuggagaaaaaaaccugaucuacacauuuuu

SEQ ID NO: 447749 - RNA, 65 nt, Homo Sapiens
aauauauacaagguaucauguagugauaauugcuguggagaaaaauaaagcaggggagggaguaa

SEQ ID NO: 447750 - RNA, 65 nt, Homo Sapiens
aacuuaggaaauagugaauaaggugcauuuaacuuuggagaaauacuuuuauggcuuugguggag

SEQ ID NO: 447751 - RNA, 65 nt, Homo Sapiens
aaguugcagacugccuuuaaaauagauuuuaucaguggagaaauggugauaguuuuuucuucagu

SEQ ID NO: 447752 - RNA, 65 nt, Homo Sapiens
aggcuccgccccagcccucagccccaggccccagcuggagaaaaaacauugcccagggauuagga

SEQ ID NO: 447753 - RNA, 65 nt, Homo Sapiens
aauuaugaaaacaccaaguuugaauaagaggaucauggagaaaaaaugagacccuaaaaaguuuc

SEQ ID NO: 447754 - RNA, 65 nt, Homo Sapiens
augcuaggcacuuuuguccagagccugcugucccauggagaaaaaguuuuaagcacugaaaaaau

SEQ ID NO: 447755 - RNA, 65 nt, Homo Sapiens
gaaaugcagagauuaagagcauauagaccaccuaguggagaaaaauggaguaaaggagauaagua

SEQ ID NO: 447756 - RNA, 65 nt, Homo Sapiens
aaacaggacagcagcucugcuagcuuggcuagugcuggagaaaguaccgggaagaaggagguggc

SEQ ID NO: 447757 - RNA, 65 nt, Homo Sapiens
aggagucagagagaaucccuagucuucaagcagauuggagaaacccuugaaaagacaucaagcac

SEQ ID NO: 447758 - RNA, 65 nt, Homo Sapiens
cuuccuccugcaguucuggaccauguggagcuacauggagaaauugcacagacagaaucacuuug

SEQ ID NO: 447759 - RNA, 65 nt, Homo Sapiens
gccaagauucugaguuuuacuaccaggcugaaugcuggagaaaacuggcuaucaucuuucagaag

SEQ ID NO: 447760 - RNA, 65 nt, Homo Sapiens
uucauuuguuccuuggaccuuaaucauuugcauuuuggagaaaauuuuuucugcuuuaaaagucu

SEQ ID NO: 447761 - RNA, 65 nt, Homo Sapiens
gaguuuaggaauucuacuagccagagauagucacuuggagaaacuuucuauauauccuucuaaau

SEQ ID NO: 447762 - RNA, 65 nt, Homo Sapiens
auagggaaauuuuuauugaaguaaauuugaaaugauggagaaauuucagaagcauaauaaaguuc

SEQ ID NO: 447763 - RNA, 65 nt, Homo Sapiens
guaccuagaaauucacaaaaaaauuaauaccucuguggagaaaacuucaaaacuuaaaaaaggac

SEQ ID NO: 447764 - RNA, 65 nt, Homo Sapiens
uuuugauccaagucaaguguagccucucagccuuuuggagaaaaaugaaacaauuuauuucaacu

SEQ ID NO: 447765 - RNA, 65 nt, Homo Sapiens
gcagagucugagggucccggggcccgguuggcagcuggagaaagaggcaaaaagcccguagccgg

SEQ ID NO: 447766 - RNA, 65 nt, Homo Sapiens
aaugaaggcagugggaaagcaaugccaaaugguuguggagaaaguggccggagccucccuggagu

SEQ ID NO: 447767 - RNA, 65 nt, Homo Sapiens
aaauuaacugagcuccuagagaagaacaauccucauggagaaacucuggaaaccuugacaauggc

SEQ ID NO: 447768 - RNA, 50 nt, Homo Sapiens
auguguuuccuuucagcugauggagaaacuuccucuuuuucaugaagaaa

SEQ ID NO: 447769 - RNA, 65 nt, Homo Sapiens
aacuagaauauccucagcagguggccuggccacucuggagaaagaaacccaaggaaagugagcac

SEQ ID NO: 447770 - RNA, 65 nt, Homo Sapiens
cuaggcagcagccaccuucucaggaaacaaggccuuggagaaaucagugccugugugaagauggu

SEQ ID NO: 447771 - RNA, 65 nt, Homo Sapiens
gcuggaccuuccauucuagaauuaugagaccaccuuggagaaaggugugugguacaugacauugg

SEQ ID NO: 447772 - RNA, 65 nt, Homo Sapiens
acauguuaagaguaauuuggauguggggguggggguggagaaaggggaagugguccagaaacaaa

SEQ ID NO: 447773 - RNA, 65 nt, Homo Sapiens
caaguuggaugacacuacucccaacuuuuuaaauuuggagaaaaccaucaaggucgaggaagccc

SEQ ID NO: 447774 - RNA, 65 nt, Homo Sapiens
uacaaaaauaugacaaucuuguaaguagcagacuauggagaaaaaugaguuaccuggagggucag

SEQ ID NO: 447775 - RNA, 65 nt, Homo Sapiens
cauauaaauuuuuguucauuuagaacugaguauucuggagaaaaccaauggucagcacuuuuggu

SEQ ID NO: 447776 - RNA, 65 nt, Homo Sapiens
agaaauugcuagauuacccaaagaaauagaucaguuggagaaaauacaaaacaauucaaagcucu

SEQ ID NO: 447777 - RNA, 65 nt, Homo Sapiens
uccccaaagaagguuuaaaauguacuaauaaaaacuggagaaauaggaauuugugaacuccuaaa

SEQ ID NO: 447778 - RNA, 65 nt, Homo Sapiens
gggaggggugcaaaagaggagaguaagaaacagcauggagaaaacccgguacgcucaaaaagaaa

SEQ ID NO: 447779 - RNA, 65 nt, Homo Sapiens
uccagcagccccagagaccagaacugauccagagcuggagaaagaagccgaaggcucuuagggag

SEQ ID NO: 447780 - RNA, 65 nt, Homo Sapiens
ugaauaaaaaauaauuuugcuguuguaguauacauuggagaaacuggcagguuuuauuuccauua

SEQ ID NO: 447781 - RNA, 65 nt, Homo Sapiens
auagcugguuucuauuaauuugaugcauguuuuaauggagaaaaaauuccauagugcuuuaaacg

SEQ ID NO: 447782 - RNA, 65 nt, Homo Sapiens
aagaauugugccuugcauauugauuuuucuaaagcuggagaaaggucagggcugggccauguggu

SEQ ID NO: 447783 - RNA, 65 nt, Homo Sapiens
cuuucagucuacuuuucuuaugcaauagaaggauguggagaaauggaaaaaaaaauuuucuguuu

SEQ ID NO: 447784 - RNA, 65 nt, Homo Sapiens
agacacaaucucuuauuuuuucacaucacaugauuuggagaaauucaagacuuugggcucuuaug

SEQ ID NO: 447785 - RNA, 65 nt, Homo Sapiens
gaaugaagaaggccuaaucuggaguuuggcaagaauggagaaaauuuuggaaaaaaugaggggag

SEQ ID NO: 447786 - RNA, 65 nt, Homo Sapiens
uugagacagccaagaaagcacugguggggacagaauggagaaauccuuucggggagcucagccgc

SEQ ID NO: 447787 - RNA, 65 nt, Homo Sapiens
ccgguaccugagcauuuuguaaagaacucuggauguggagaaauggaaaucagaagggaauauag

SEQ ID NO: 447788 - RNA, 65 nt, Homo Sapiens
augacggauaguuuaggaugucauguggagauuuuuggagaaaccucaauuguccuucagauaau

SEQ ID NO: 447789 - RNA, 65 nt, Homo Sapiens
cagaaccagguucugaaucagcucacgagcacaccuggagaaauucagaaugggcaugaccuuca

SEQ ID NO: 447790 - RNA, 65 nt, Homo Sapiens
aagccauuuuuccguaaaaauuuguccugauccaauggagaaagauguggccaagaagugauguc

SEQ ID NO: 447791 - RNA, 65 nt, Homo Sapiens
ccugagauugaaggaggaaaaggcugcuuaaaagauggagaaaaguggacaaaagggaguuacag

SEQ ID NO: 447792 - RNA, 65 nt, Homo Sapiens
auugucgggcaaccguuuauccuguuguuggaaacuggagaaaugaacacauacuccuuaauuua

SEQ ID NO: 447793 - RNA, 65 nt, Homo Sapiens
cuaucgggaaauggaagagauucauccaggucagguggagaaacagcugaguaugcucgaaauag

SEQ ID NO: 447794 - RNA, 65 nt, Homo Sapiens
cuuagcacaauuuucuaaaaaaaaaaaucagaaauuggagaaauccuugccaaaaaaaaaaaaaa

SEQ ID NO: 447795 - RNA, 65 nt, Homo Sapiens
aaauagauuuuuauuuaaauaaccauuugcuaaaauggagaaagugcaaccuauuuggguaaaga

SEQ ID NO: 447796 - RNA, 65 nt, Homo Sapiens
ucaucaaacaucaacaauuacauugaauauuuacauggagaaaaaaauacuagauaaacauuucg

SEQ ID NO: 447797 - RNA, 65 nt, Homo Sapiens
aaugcuacagccuauagcugcuccauugauauaucuggagaaauccagugucauacauauuuguu

SEQ ID NO: 447798 - RNA, 65 nt, Homo Sapiens
gguuaagagauccuguuucauucuaauccccaagcuggagaaacaaugagcucacuggaaauuca

SEQ ID NO: 447799 - RNA, 65 nt, Homo Sapiens
auagaaaguaguaagucguuuuccucuucuguuuauggagaaauaagccuuuccucuucuggucu

SEQ ID NO: 447800 - RNA, 65 nt, Homo Sapiens
agcaguaccaagggaucucaaucacuugggagcuuuggagaaaauuacuucggcugcaugagaua

SEQ ID NO: 447801 - RNA, 65 nt, Homo Sapiens
aagucagccagcgcauaggugcucccucuauauuauggagaaagcaaaacccugcaaaugaccaa

SEQ ID NO: 447802 - RNA, 65 nt, Homo Sapiens
gugucauguugguuuuugguacuuguauugucauuuggagaaacaauaaaagauuucuaaaccac

SEQ ID NO: 447803 - RNA, 65 nt, Homo Sapiens
auuaauaaaauuaugucuaugguauuuucaguuucuggagaaaaauacuuauagacaguuuaacu

SEQ ID NO: 447804 - RNA, 65 nt, Homo Sapiens
aauugugaaauuacuuucagugguuuaagaagcaauggagaaaaugauaauacagcauaauuuuu

SEQ ID NO: 447805 - RNA, 65 nt, Homo Sapiens
cuucaugccucuccaaaugugguuauucuaauaaauggagaaaugagccaaauaaaaguaguacu

SEQ ID NO: 447806 - RNA, 65 nt, Homo Sapiens
cccuacacccuuuagcuggaugcugucagaggcgauggagaaacgcaaaggugcguuaauuuuac

SEQ ID NO: 447807 - RNA, 65 nt, Homo Sapiens
ugucugacugcaaguuuuuuaaagaaaagaggaacuggagaaacgacuuccauugauguggacuu

SEQ ID NO: 447808 - RNA, 65 nt, Homo Sapiens
gugaugauagaaccagauauaaaauuguucagugauggagaaaagaaacgauaaauacuuuccaa

SEQ ID NO: 447809 - RNA, 65 nt, Homo Sapiens
gaaagcuauggaagaugauguacaaauguuauugauggagaaaaugguuggguguguccuuucug

SEQ ID NO: 447810 - RNA, 65 nt, Homo Sapiens
uugagccuaggaguucgagaccagccuaggcaacauggagaaaccccgucucuaucagaaauaca

SEQ ID NO: 447811 - RNA, 65 nt, Homo Sapiens
gguaguaagcuuggaaaaauaauuuaagaauacaauggagaaauguaaauaaguaucuauguaaa

SEQ ID NO: 447812 - RNA, 65 nt, Homo Sapiens
guagaaauauaucuguuauaauuauacaggcucuguggagaaauaaaguucaaaauauauuaauu

SEQ ID NO: 447813 - RNA, 65 nt, Homo Sapiens
aggaacaaggcaaggcugucaauuacaggaaguacuggagaaaauggacguguuaugacuccaga

SEQ ID NO: 447814 - RNA, 65 nt, Homo Sapiens
aaaaacacucuauaacagagcaacuuuuuuaacuuuggagaaaaguuuucugugccuucaaggga

SEQ ID NO: 447815 - RNA, 65 nt, Homo Sapiens
ugcacccuacaggcaaccagcaaguggagaaaugcuggagaaagccaaagcaaaagcuagagaag

SEQ ID NO: 447816 - RNA, 65 nt, Homo Sapiens
cuggagaaagcugcacccuaagcuagagaagcaaguggagaaaugccaccacugcccaaagcaaa

SEQ ID NO: 447817 - RNA, 65 nt, Homo Sapiens
cugcccagagggcgaugccuaggccuuccgccuuguggagaaaucugauaucaaugaguuccugg

SEQ ID NO: 447818 - RNA, 60 nt, Homo Sapiens
agguguguauaagaguacagaggagaacauuggagaaaacacaauuaccagccauacuaa

SEQ ID NO: 447819 - RNA, 65 nt, Homo Sapiens
aaauccucaggaaauuagauugaaaggguuugauauggagaaacaaaaguucauguuggccaugg

SEQ ID NO: 447820 - RNA, 65 nt, Homo Sapiens
uuuucccauaauaauaacuacccuuggcuaugacauggagaaagaauuuuacagauagaugcuuc

SEQ ID NO: 447821 - RNA, 65 nt, Homo Sapiens
uguucagucacagauauauugaaauauuggauucuuggagaaaacaaguauaugaaaauauacug

SEQ ID NO: 447822 - RNA, 65 nt, Homo Sapiens
caaaaugauacuuacugaacugguuaauuuuuacauggagaaaacguugauauguuuuauuucau

SEQ ID NO: 447823 - RNA, 65 nt, Homo Sapiens
agucauggcucucuuucuugucugucuuauaaaaauggagaaagguugcaaaaugcaacuugugc

SEQ ID NO: 447824 - RNA, 65 nt, Homo Sapiens
ccaucucuacuaaaaauacaccagccugaccaacauggagaaacccugaggucgggaguucuaga

SEQ ID NO: 447825 - RNA, 65 nt, Homo Sapiens
uuuaaacaccucaauguagguucaaugaaaacuguuggagaaauacuaguguuuucauaauguaa

SEQ ID NO: 447826 - RNA, 65 nt, Homo Sapiens
uuacagaucauauaagcaagauacauaaacaguuuuggagaaaaaagguuuuaaaaauaaguuuu

SEQ ID NO: 447827 - RNA, 65 nt, Homo Sapiens
uuucuuuuugagggcugugguacuugccuguucuguggagaaacuauuccuuggaacagagcuau

SEQ ID NO: 447828 - RNA, 65 nt, Homo Sapiens
auauuuuaaagaacaagacaagccucagaaucauuuggagaaacuguaucuuguaaucaugauug

SEQ ID NO: 447829 - RNA, 65 nt, Homo Sapiens
ugccauuuuucagugaagauauugcaugaaaaagauggagaaacagauuuaagauggacuuucuu

SEQ ID NO: 447830 - RNA, 65 nt, Homo Sapiens
auuauugcggaccgugguacccaguuuuaggaauguggagaaaggaauucuguugauuccguuga

SEQ ID NO: 447831 - RNA, 65 nt, Homo Sapiens
uuuaguauuuugucuuuguaauuuacagaaguuauuggagaaaauaaacuuguuucauuuugcau

SEQ ID NO: 447832 - RNA, 65 nt, Homo Sapiens
aaguuuuuguucuuuuuuuuuuuuccaucacucaguggagaaaagcuuuguuaaugaaagauuuu

SEQ ID NO: 447833 - RNA, 65 nt, Homo Sapiens
guauacauggugauguacaucuguagcaaagcucuuggagaaaaugaagacugaagaaagcaaag

SEQ ID NO: 447834 - RNA, 65 nt, Homo Sapiens
augaggaacauucauucuguauuuuuuuucccuguuggagaaagugggaaauuauaaugucgaac

SEQ ID NO: 447835 - RNA, 65 nt, Homo Sapiens
uauucugucuaucaaauaguacuucuaccacuguuuggagaaaauugaagaaaagaauaagauga

SEQ ID NO: 447836 - RNA, 65 nt, Homo Sapiens
guugaauaugauuuggucaguugcucguuguaacuuggagaaauuccuauaaaguaagaucuccu

SEQ ID NO: 447837 - RNA, 65 nt, Homo Sapiens
aaaucgugcaauaaccauaugcgacuauuuugccauggagaaaucugacagcauugcaaacaaua

SEQ ID NO: 447838 - RNA, 65 nt, Homo Sapiens
uuuggugaagugaaaaacagaaaaauaagacccuguggagaaauucguuguucccacugaaaugg

SEQ ID NO: 447839 - RNA, 65 nt, Homo Sapiens
aaugccuuauuuuugaauucuuuagauuuuuaaauuggagaaaagcacuuaaaguuuuuuauaua

SEQ ID NO: 447840 - RNA, 65 nt, Homo Sapiens
guccuggcacaguuuuuguaaagcccuugcacagcuggagaaauggcaucauuauaagcuaugag

SEQ ID NO: 447841 - RNA, 53 nt, Homo Sapiens
ccaaacuggcaagguccuaggcauggagaaacuccaagcuccucugugaagca

SEQ ID NO: 447842 - RNA, 65 nt, Homo Sapiens
aguuagaagaaaacuauuguacucuuuuguuuuaguggagaaauaauagaugucuguucaugugu

SEQ ID NO: 447843 - RNA, 65 nt, Homo Sapiens
cagaaaggcuuagccaaggccacaucugggaagaguggagaaauuugccacuugacgaucacgga

SEQ ID NO: 447844 - RNA, 65 nt, Homo Sapiens
cuuagaacauuuuuugaaauucaguuuacagaaauuggagaaaaugcuuuuuaaacaaguguuuc

SEQ ID NO: 447845 - RNA, 65 nt, Homo Sapiens
gggacagagccagauucagaguaaucuugacugaauggagaaaguuucugugcuaccccuacaaa

SEQ ID NO: 447846 - RNA, 65 nt, Homo Sapiens
gcagcuggaggcugcuguggggaccacacugauccuggagaaaagggauggagcugaaaaagaug

SEQ ID NO: 447847 - RNA, 65 nt, Homo Sapiens
guuucuucuuugagagucaugacuaccuucugguguggagaaauugccauuggaaaauuugacaa

SEQ ID NO: 447848 - RNA, 65 nt, Homo Sapiens
ucccaccaucaucacaacuguagucucauuugcaguggagaaaagaacccgacgucccacagcca

SEQ ID NO: 447849 - RNA, 65 nt, Homo Sapiens
ugagaccucagggaggcucugucucucuuaaaagguggagaaagaugccauucucucccuaaggu

SEQ ID NO: 447850 - RNA, 65 nt, Homo Sapiens
cugaggucgggaguucgagaccagcgugaccaacguggagaaacccccgucucuacuaaaaauac

SEQ ID NO: 447851 - RNA, 65 nt, Homo Sapiens
cacacacacacacacacacacacacacacacaaaguggagaaaaauguauacucaacaaugucau

SEQ ID NO: 447852 - RNA, 65 nt, Homo Sapiens
aaugcugaaaaguggcucagaugcagaguguucuguggagaaacugcagccccacuucuguuucc

SEQ ID NO: 447853 - RNA, 65 nt, Homo Sapiens
ccaucucuacuaaaaauacaccagccugaccaacguggagaaacccugaggucaggaguucgaga

SEQ ID NO: 447854 - RNA, 65 nt, Homo Sapiens
agcacuugccuugaaaagaaaucucuuuucaggguuggagaaauuuuuguuuuauuggaaugcau

SEQ ID NO: 447855 - RNA, 65 nt, Homo Sapiens
ccgucucuacuaaaaauacaccagccugaccaacauggagaaaccgugagguggggaguucgaga

SEQ ID NO: 447856 - RNA, 65 nt, Homo Sapiens
ucauuguauuagggcauacuuuuccaugaauaagauggagaaagccuugauagcacuacuuggag

SEQ ID NO: 447857 - RNA, 65 nt, Homo Sapiens
uacugaauuggcuuccagauagauuugugcaaacauggagaaaucgugaaccaaaaauagaaauu

SEQ ID NO: 447858 - RNA, 65 nt, Homo Sapiens
gggcauuagguauuaauugcugccauauuaguuaguggagaaaagauauuuuauuauaaauuaga

SEQ ID NO: 447859 - RNA, 65 nt, Homo Sapiens
acuccagcaaaaugaaggaguuuuagggaagcuguuggagaaaauggguuaccuccaugugcccu

SEQ ID NO: 447860 - RNA, 65 nt, Homo Sapiens
ucuauggaacuauuaucagcauuauggacugaaacuggagaaaauagcaaggucuucaagcucuc

SEQ ID NO: 447861 - RNA, 65 nt, Homo Sapiens
auaugaaaagcauaguuggugucacaggacccaauuggagaaaucguucaacaauucugugaaag

SEQ ID NO: 447862 - RNA, 65 nt, Homo Sapiens
cacauuaaaaagauaccaacaauuuuaccaaaagauggagaaaaguuugaaaaaggagaauugca

SEQ ID NO: 447863 - RNA, 65 nt, Homo Sapiens
gggaggaaagacaagaagaagaguagcauggcaacuggagaaaauguauuauccuagauccucag

SEQ ID NO: 447864 - RNA, 65 nt, Homo Sapiens
aacaaacuauguaaacaaaauaaugcaguaauauauggagaaauguauagauguuuauuuauuuu

SEQ ID NO: 447865 - RNA, 65 nt, Homo Sapiens
aauguuugucuggagcagaguaucaggcugauuuuuggagaaauguauguuccuuuguauguucc

SEQ ID NO: 447866 - RNA, 65 nt, Homo Sapiens
uauucacacuacuugcauguauuaguguucccauguggagaaaauugggaugucaucuuuuuaua

SEQ ID NO: 447867 - RNA, 65 nt, Homo Sapiens
uuaaauugcugcauuucgcaguuucuuauuuugauuggagaaaaaaagugagaucauacugguuu

SEQ ID NO: 447868 - RNA, 65 nt, Homo Sapiens
auuuaauaaaaaaacaaucauuauuuucaguauuuuggagaaauuugcuuuuugaauguuauuug

SEQ ID NO: 447869 - RNA, 65 nt, Homo Sapiens
gugcauaugccaauuuuuugacacacaaaaauugguggagaaauuaaaaguuaacuaaaugguug

SEQ ID NO: 447870 - RNA, 65 nt, Homo Sapiens
ccagggccgugccuggagcacugcagagaugacuuuggagaaagcaaagcagugacccagugacc

SEQ ID NO: 447871 - RNA, 65 nt, Homo Sapiens
uagaagaaagauacaagugaaaauuaggaguggauuggagaaauuggggggaaauagaagaguac

SEQ ID NO: 447872 - RNA, 65 nt, Homo Sapiens
acugcacuauuauaaacuauuaaaaugauagauuguggagaaaguaauuauuccaacacccaucu

SEQ ID NO: 447873 - RNA, 65 nt, Homo Sapiens
aagacacacacugcccuaaccucacuccaaaugucuggagaaauguguguagugcuuuuguuaaa

SEQ ID NO: 447874 - RNA, 65 nt, Homo Sapiens
uaaaucucagaauuacuaagcauguggcauaaauuuggagaaaauaauaugacuagaaaaauuag

SEQ ID NO: 447875 - RNA, 65 nt, Homo Sapiens
cuucguguccaccuggguccaguccugaaucaucuuggagaaacaccuugguuucuaggaugguu

SEQ ID NO: 447876 - RNA, 65 nt, Homo Sapiens
gagaauuuauuuccuucuccacucucuccaugcccuggagaaaaaaaaguccagaagaaaucaua

SEQ ID NO: 447877 - RNA, 65 nt, Homo Sapiens
aguggggcaacguguggaggaagccccucauaauuuggagaaaacuugauacaauagaagcugac

SEQ ID NO: 447878 - RNA, 65 nt, Homo Sapiens
caaccuguucaagucuaccaauuauaagggcaaauuggagaaaaagaaaaaauauauacucaaga

SEQ ID NO: 447879 - RNA, 65 nt, Homo Sapiens
auaaauaucaguuuuauucucauguaccuaaguuguggagaaaauaauugcauccuauaaacugc

SEQ ID NO: 447880 - RNA, 65 nt, Homo Sapiens
aagggaagauauuuugacacaagaaagcaggaacguggagaaauuggagcaggaaaagaaauuau

SEQ ID NO: 447881 - RNA, 65 nt, Homo Sapiens
acagcauguauuaugcacuucauuucucuacuguguggagaaagcaauaaacauuaugagaaugu

SEQ ID NO: 447882 - RNA, 65 nt, Homo Sapiens
gagugcauaccagaauugaauauaccauaugggauuggagaaagacaaauguggaagaaaucaua

SEQ ID NO: 447883 - RNA, 65 nt, Homo Sapiens
caguuacacaagcucuagucucaaaaugaaaguaauggagaaagacacugaaauuuagaaaauuu

SEQ ID NO: 447884 - RNA, 65 nt, Homo Sapiens
caaagaauuuaaaguggcuccuuuaauuggugacuuggagaaagcuaggucaaggguuuauuaua

SEQ ID NO: 447885 - RNA, 65 nt, Homo Sapiens
gagaaguaaaggaauauaugccuccuguguacuuuuggagaaaacugaagauuuaguuuccauuu

SEQ ID NO: 447886 - RNA, 65 nt, Homo Sapiens
gcuuaaacauuucaccagaagaugcuggaagcucuuggagaaaaaaggaucauccuuuuguacuu

SEQ ID NO: 447887 - RNA, 65 nt, Homo Sapiens
ggacccuaguucaguuuagaaaggagaaagcccuuuggagaaacugacaaaacacaaguuggacc

SEQ ID NO: 447888 - RNA, 65 nt, Homo Sapiens
cagaagagacgucccgcuucgggugaggcuugacuuggagaaagggguggccagcccauuuucug

SEQ ID NO: 447889 - RNA, 65 nt, Homo Sapiens
guguccucuaguggaagaaacuacagacuuaguaguggagaaauguuuucauugaugauaaacga

SEQ ID NO: 447890 - RNA, 65 nt, Homo Sapiens
aaauccucaagccaucaggauaauaugcucugggcuggagaaauguacuuguacucuucuuaugc

SEQ ID NO: 447891 - RNA, 65 nt, Homo Sapiens
ggaauaagaucugauuuucuuaauuaugccuaguauggagaaacaguauuguauagcuuugaaaa

SEQ ID NO: 447892 - RNA, 65 nt, Homo Sapiens
aagcaaaggugaaugacagcauuaggagcuuguuuuggagaaaugcagucucuucagguagcuaa

SEQ ID NO: 447893 - RNA, 65 nt, Homo Sapiens
gccgaaaaguugccaaauacuuuauaaugucuuuuuggagaaauuauacuuugugcuuuaugguu

SEQ ID NO: 447894 - RNA, 65 nt, Homo Sapiens
uguugauuuuguaccaaaguuuauuuuauguuuuguggagaaauugcuaacauccuaucucauaa

SEQ ID NO: 447895 - RNA, 65 nt, Homo Sapiens
acauuauauuuauugguuacguaaauaugucuauauggagaaagccauaagccaaagacucaagu

SEQ ID NO: 447896 - RNA, 65 nt, Homo Sapiens
agaaauauauccgucuuugaagccagacuguacuguggagaaagucuuuaccaguaacucaguga

SEQ ID NO: 447897 - RNA, 65 nt, Homo Sapiens
aaauguaaaacuggauaagauauaauuguagcacauggagaaagcgcuaggaacuaucagguguc

SEQ ID NO: 447898 - RNA, 65 nt, Homo Sapiens
accacacaaaacaaugaauuuuccaugguuaaguuuggagaaaauucuccauuuuuaucaagguu

SEQ ID NO: 447899 - RNA, 65 nt, Homo Sapiens
gagcucuguggcuucccaccggagaaacugugaauuggagaaaugcuucgauuuuucuggucugu

SEQ ID NO: 447900 - RNA, 65 nt, Homo Sapiens
gugaauuggagaaauggagcgauuuuucuggucuguggagaaacugguuuugcuguguucacuuc

SEQ ID NO: 447901 - RNA, 65 nt, Homo Sapiens
uuugcuguucuggggggugaaaauagacuaacuacuggagaaacaaagagagaaagaaaacccag

SEQ ID NO: 447902 - RNA, 65 nt, Homo Sapiens
guuuuuuucucucacuauaguauaagaaucuauuuuggagaaaaaaagaaaauaugagggucucg

SEQ ID NO: 447903 - RNA, 65 nt, Homo Sapiens
gcuugaaaaaccaagaggauaugaaaaucugucucuggagaaacaaagacgcaggcauacucagc

SEQ ID NO: 447904 - RNA, 65 nt, Homo Sapiens
ccccauugucuuauguagaauguggcaaugccaacuggagaaagggaagaaggacauauuaccuu

SEQ ID NO: 447905 - RNA, 65 nt, Homo Sapiens
uggggggagggggaugggguccuucuaggaguccuuggagaaaaguaagaaaccaggaguguuuc

SEQ ID NO: 447906 - RNA, 65 nt, Homo Sapiens
ccugccuguugcaaacgugaugcucccggauggaguggagaaacuaggagacugggacaagcaaa

SEQ ID NO: 447907 - RNA, 65 nt, Homo Sapiens
gcugcaaacaacccagaagcccauccucagaagacuggagaaaugauugaggaaugcaugggcac

SEQ ID NO: 447908 - RNA, 65 nt, Homo Sapiens
uccucaacuuuuacuaaacauaagguaauucauacuggagaaaagccauacaaaugagaagaaug

SEQ ID NO: 447909 - RNA, 65 nt, Homo Sapiens
ugcucaaauguuguucaacaccagaaaauuuauauuggagaaaagcacuguaaauguaaugcauu

SEQ ID NO: 447910 - RNA, 65 nt, Homo Sapiens
uccgcaaagcucacugaacauaaguuaauucauacuggagaaaaacccuacaaauguaaagaaug

SEQ ID NO: 447911 - RNA, 65 nt, Homo Sapiens
uccucaacucuuauuacacauaagauaauucacaguggagaaaaacccuacaaaugugaagaaug

SEQ ID NO: 447912 - RNA, 65 nt, Homo Sapiens
uugucacacuugauuguauauaagauaauucauacuggagaaaacucccagaaguggaguuuucc

SEQ ID NO: 447913 - RNA, 65 nt, Homo Sapiens
uguucaaacuuuguucaauaccaggaaauuuauauuggagaaaaacccuaugaguguaaugaauu

SEQ ID NO: 447914 - RNA, 65 nt, Homo Sapiens
uugucacgcuugauuguagguaagauaauuuauauuggagaaaaauccuccaaguaugaagaaug

SEQ ID NO: 447915 - RNA, 65 nt, Homo Sapiens
ugcucaaacuuuguucgacaucagggaauuuguauuggagaaaaacccugcaaauguaauaaaua

SEQ ID NO: 447916 - RNA, 65 nt, Homo Sapiens
uuccauccauucuguuacacuuuguauuuucuaacuggagaaaagagugaggaacagaauguuuu

SEQ ID NO: 447917 - RNA, 65 nt, Homo Sapiens
agggaccuuggaggaugaaggcgaguaugugacacuggagaaaaguggaccaggcaugucuuuug

SEQ ID NO: 447918 - RNA, 65 nt, Homo Sapiens
ugagaucgggaguuugagaccaagccugaccaauauggagaaacccugucucuacuaagaacaca

SEQ ID NO: 447919 - RNA, 65 nt, Homo Sapiens
agaaguauagcucuuuuccuaccugaacucuucccuggagaaaagauguuggcauugcugauugu

SEQ ID NO: 447920 - RNA, 65 nt, Homo Sapiens
auuacaguucagagcauugauccuggaaugugugcuggagaaauuuaaaauacugggguuuuuug

SEQ ID NO: 447921 - RNA, 65 nt, Homo Sapiens
ccaggugauucuguaaguugucccucaacuguacuuggagaaaucguguuuuaaagcaguagucc

SEQ ID NO: 447922 - RNA, 65 nt, Homo Sapiens
cccauuuccacuuuuagauucaagagguccagccguggagaaacauccgggacccucagacacug

SEQ ID NO: 447923 - RNA, 65 nt, Homo Sapiens
agccuacaagccccgagagaaugaugaauuggcacuggagaaagccgacguggugauggugacuc

SEQ ID NO: 447924 - RNA, 65 nt, Homo Sapiens
ccuuuuauuaguucuuugauagcuaagaugguuguuggagaaagugcuuaagccacuguuuaugu

SEQ ID NO: 447925 - RNA, 65 nt, Homo Sapiens
cagacugugggaaggaucaggugaggauggaaggauggagaaaaaaaaguuaucaagagaaagag

SEQ ID NO: 447926 - RNA, 65 nt, Homo Sapiens
acacacugguuuuaaucuguuuugauggcacacuauggagaaaggaccauuaguaggucuuuggu

SEQ ID NO: 447927 - RNA, 65 nt, Homo Sapiens
uaugaauguauucgggaggaauuuaauccgguucuuggagaaacauaccgagcuggaagcaagcc

SEQ ID NO: 447928 - RNA, 65 nt, Homo Sapiens
guuucuguucaacauguaccaccagacccuggaacuggagaaagagcggugccccuauacaaaac

SEQ ID NO: 447929 - RNA, 65 nt, Homo Sapiens
auuuuucuuuuuucuuuuuuuugcuaaacauuugcuggagaaaucgaauuggcauuucccaauau

SEQ ID NO: 447930 - RNA, 65 nt, Homo Sapiens
cgacaagagagcagagaaucgugcauugggauggguggagaaagauauaagcacaguugacaguu

SEQ ID NO: 447931 - RNA, 65 nt, Homo Sapiens
ccaucucuacuaaaaacacaccagccugaccaacauggagaaacccugagaucgcacguucgaga

SEQ ID NO: 447932 - RNA, 65 nt, Homo Sapiens
aagguggaguccuacuuguucugcuuggggacuauuggagaaaauaugucuucaagugaccugua

SEQ ID NO: 447933 - RNA, 65 nt, Homo Sapiens
gggauuaaaaauaaggauaagcaaagcuaucaacuuggagaaacagaauuacugaauauuucaga

SEQ ID NO: 447934 - RNA, 65 nt, Homo Sapiens
gaaccacaaacacagaucacaaagccugcucaauuuggagaaauauuuaaaaacuauauucagua

SEQ ID NO: 447935 - RNA, 63 nt, Homo Sapiens
agagaaagggauaaucaccuaagccccagucucuggagaaaagaggaaauggugcauucuuaa

SEQ ID NO: 447936 - RNA, 65 nt, Homo Sapiens
ccgucucuacuaaaaauacaccagccuggccaacauggagaaacucugaggucaggaguucaaga

SEQ ID NO: 447937 - RNA, 65 nt, Homo Sapiens
uguuaauuguguggaaugaacuacauagauuaaauuggagaaacgugggcgcuguaaguuaagcu

SEQ ID NO: 447938 - RNA, 65 nt, Homo Sapiens
uuccuuuuguugcauuuguguugcauacagguuauuggagaaauucuuaaaagaaagauuuccca

SEQ ID NO: 447939 - RNA, 65 nt, Homo Sapiens
uuagacagcagcucuguguuacucggaggggaguuuggagaaauuaucugaguguugccugcuga

SEQ ID NO: 447940 - RNA, 65 nt, Homo Sapiens
uggggaaguguuuucugaacgccacaguguucuguuggagaaacuucacacuaccaggcccugca

SEQ ID NO: 447941 - RNA, 65 nt, Homo Sapiens
uauuucaagaucuaguccaagcaacccuguagucauggagaaaggcaauaugcucugguuggcag

SEQ ID NO: 447942 - RNA, 65 nt, Homo Sapiens
uugaagaacaaguucaaacuuuuuugacaauauacuggagaaacuccacuucuugagcuuuaucu

SEQ ID NO: 447943 - RNA, 65 nt, Homo Sapiens
aucauaucuuucuaagcgguauucuauuuuguaaauggagaaacaaaaaaauuuaaauuguccug

SEQ ID NO: 447944 - RNA, 65 nt, Homo Sapiens
gaggauauauucuugcagacguacaguugucgaaguggagaaaauaagauacuaugcaagaaaau

SEQ ID NO: 447945 - RNA, 65 nt, Homo Sapiens
uaucaacagaacucuagccaaaggcugagucuagguggagaaaaacuaccguugagaagggaaga

SEQ ID NO: 447946 - RNA, 65 nt, Homo Sapiens
cugauaccaggcacagccuaucaucccuucaguucuggagaaagccaacaauaaucacaauauau

SEQ ID NO: 447947 - RNA, 65 nt, Homo Sapiens
ugugcagaggaaacuuaagcucaucacaaccuaaauggagaaagcggggguaacagucugcauca

SEQ ID NO: 447948 - RNA, 65 nt, Homo Sapiens
gauaugcuuauacacuguugaugcuggugagguuguggagaaaaaaaaaugucagaaaauaacag

SEQ ID NO: 447949 - RNA, 65 nt, Homo Sapiens
ccaucuuuacuaaaaauacaccagccuggccaacauggagaaacccugaggucaggaguucaaga

SEQ ID NO: 447950 - RNA, 65 nt, Homo Sapiens
guugauuuguugaacaauucaggaaucaagggcuguggagaaacucccucauguuguuggcaaca

SEQ ID NO: 447951 - RNA, 65 nt, Homo Sapiens
cuaugucauuagguggguacaaaacccaacugauguggagaaaaauugauguuugauguugauag

SEQ ID NO: 447952 - RNA, 65 nt, Homo Sapiens
gaagcugcuucugcccacaccgcagggacaagcccuggagaaaugggagcuuggggagaggaugg

SEQ ID NO: 447953 - RNA, 65 nt, Homo Sapiens
uacuggcaugguuaaagugguuuucacuuuuuaaauggagaaaauuucaguuaaauuaauaggau

SEQ ID NO: 447954 - RNA, 65 nt, Homo Sapiens
agugugccauucgacaacacauuguuauagcuacauggagaaagcucuguggauucaucacugug

SEQ ID NO: 447955 - RNA, 65 nt, Homo Sapiens
uuugauuuuuuaagguggauuuugguuguuauaaauggagaaagguaagaguucaaguucaaccc

SEQ ID NO: 447956 - RNA, 65 nt, Homo Sapiens
aauauuagacacuaauauuuucauagaaauuaggcuggagaaagaaggaagaaaugguuuucuua

SEQ ID NO: 447957 - RNA, 65 nt, Homo Sapiens
agcuuaaggaaugauacugugcucugcuuggugcauggagaaaaaggaagacccguacucuccac

SEQ ID NO: 447958 - RNA, 65 nt, Homo Sapiens
acauuccagaaguuaaucauuugaauucugaacacuggagaaaaaccgaaaaauggacggggcau

SEQ ID NO: 447959 - RNA, 65 nt, Homo Sapiens
uggaggacaacuuaucuucacuaagcugaaucagguggagaaaguaaucuccuugcaaucaugug

SEQ ID NO: 447960 - RNA, 65 nt, Homo Sapiens
aaagagcuuacauucaugugcuacuuuaacaugaauggagaaaauccguuuauggaaguacagug

SEQ ID NO: 447961 - RNA, 65 nt, Homo Sapiens
ccaauaagaggcucuguuuuccacugaagcuuuguuggagaaagagaauaugaaaauuacacauu

SEQ ID NO: 447962 - RNA, 65 nt, Homo Sapiens
gugugaagacaugaaaguuuaauguacagaaugguuggagaaaugccuauggugaauuaaagcuu

SEQ ID NO: 447963 - RNA, 65 nt, Homo Sapiens
aauaaccuugcugauaagaaaaaaagggacaauauuggagaaacuaccucuuguuuaauugaucu

SEQ ID NO: 447964 - RNA, 65 nt, Homo Sapiens
uggaaacucacuccccuacaaaagauggagcuuaauggagaaauugcaacuuucauuaaaaaaca

SEQ ID NO: 447965 - RNA, 65 nt, Homo Sapiens
gaagcgaaaagaccaagaucaaauaauagcugggguggagaaaaaaauagcucaagacacaguua

SEQ ID NO: 447966 - RNA, 65 nt, Homo Sapiens
gguauguuuccuucagaaugucaaguuaaugaaaauggagaaacugaaacugcaucaacaggaca

SEQ ID NO: 447967 - RNA, 65 nt, Homo Sapiens
aauauauauauauauauuguuuccauaagaagaaauggagaaaaaugcuccuccuggcuucuggc

SEQ ID NO: 447968 - RNA, 65 nt, Homo Sapiens
ccucuuucaaggcucccauuccccgaucaagaacauggagaaaguguucugggggaaggugucca

SEQ ID NO: 447969 - RNA, 65 nt, Homo Sapiens
ccaucucuacuaaaaauacaccagccugacuaacauggagaaaccaaucaccugagggcaggaga

SEQ ID NO: 447970 - RNA, 65 nt, Homo Sapiens
uaaauuguaauaauguaaaugaguaguauaauuuguggagaaaugacauuauuuaaaauauuugg

SEQ ID NO: 447971 - RNA, 65 nt, Homo Sapiens
gccauuacuuguauaucugaaaaauuaugaauuauuggagaaaauccaaaauagcagaaauugua

SEQ ID NO: 447972 - RNA, 65 nt, Homo Sapiens
ucuuaauuccuuguuguuuuagucagcaguucaccuggagaaagagcuggaaauagcuucuauau

SEQ ID NO: 447973 - RNA, 65 nt, Homo Sapiens
gcuucaggcuggugacuagcccaaaauagcugaaauggagaaaggaaaagucaccuaggcaacug

SEQ ID NO: 447974 - RNA, 65 nt, Homo Sapiens
aacaggcaaaacgugggugcaugcuccugacaguguggagaaaccagccacagugaguuggucaa

SEQ ID NO: 447975 - RNA, 65 nt, Homo Sapiens
gguacuggaaaacaugcagauucaacuguuuaggguggagaaagaaaauuugagaccaauuaaau

SEQ ID NO: 447976 - RNA, 65 nt, Homo Sapiens
agcaccccaaggacucagaaguguuuguguucugauggagaaaacggaaacugauuagauggguu

SEQ ID NO: 447977 - RNA, 65 nt, Homo Sapiens
ugggucagccaaguuucaugcaugcauaccgauauuggagaaaucucugcagaauauuguaauug

SEQ ID NO: 447978 - RNA, 65 nt, Homo Sapiens
acuaacaucuccuccaauaaaaagaaacuaugauguggagaaaggaauuuugccacaggguacua

SEQ ID NO: 447979 - RNA, 65 nt, Homo Sapiens
ccuggaauucuccaauggggucgccaaacaacaaauggagaaaaaaaguuuuacuuccuugcauu

SEQ ID NO: 447980 - RNA, 65 nt, Homo Sapiens
uugcaaaagaaauaggcuuuucuucuuuuuuaaauuggagaaaucucugcucugguugaccuggg

SEQ ID NO: 447981 - RNA, 65 nt, Homo Sapiens
uuugaaagggaaggaaaauagcuggcauuucuugcuggagaaaguuaucacaaguggaaagguua

SEQ ID NO: 447982 - RNA, 65 nt, Homo Sapiens
aagacguuuuuaguuuauuuguuguuaaguuaaacuggagaaaguuugucauccucauuuucaaa

SEQ ID NO: 447983 - RNA, 65 nt, Homo Sapiens
guaucccuuugugaaauuagcacuuuuggggccaauggagaaaugcagcauucacucucccuguc

SEQ ID NO: 447984 - RNA, 65 nt, Homo Sapiens
ccggggcccccuggucaccgagacucagccucugcuggagaaagccacgcccucccugcuagcac

SEQ ID NO: 447985 - RNA, 65 nt, Homo Sapiens
gggagccacugagcacagcaaggcaccaaagccccuggagaaaccgccagggcgaggugcgacca

SEQ ID NO: 447986 - RNA, 65 nt, Homo Sapiens
cuggggauucuagcuccacaaccaggccgugaggcuggagaaacuggcaguuauugcugucaaaa

SEQ ID NO: 447987 - RNA, 65 nt, Homo Sapiens
gcguccuugugaagcucgucuccauguggcuuucuuggagaaaggcuccccuggggcaagagggu

SEQ ID NO: 447988 - RNA, 65 nt, Homo Sapiens
cggagaggucaggagaccgaccccaccacuaacuuuggagaaaauguggguuugcuuuuuaaagg

SEQ ID NO: 447989 - RNA, 65 nt, Homo Sapiens
acguaaucagaaauuugugcaaguuacaugucauuuggagaaaauuuuucuggaaaaguuaaaaa

SEQ ID NO: 447990 - RNA, 65 nt, Homo Sapiens
guaauaauuucucaaugaauauagaaucacaguuguggagaaaaauugcaggguuuauauuuugu

SEQ ID NO: 447991 - RNA, 65 nt, Homo Sapiens
aaaaguaagaacagcucauccaucuucuccauaaguggagaaauguacuuuuggugucauuauuc

SEQ ID NO: 447992 - RNA, 65 nt, Homo Sapiens
aaaacugggucucucuccacguguguucauggagcuggagaaaccaugguaggacguguaccucu

SEQ ID NO: 447993 - RNA, 65 nt, Homo Sapiens
gagaggcccugccuggaccccacaguggguuagccuggagaaaauuugugagauuaaccuuggga

SEQ ID NO: 447994 - RNA, 50 nt, Homo Sapiens
gucuuagaaacauugaucauuggagaaaugcucccgaugaccgcauguga

SEQ ID NO: 447995 - RNA, 65 nt, Homo Sapiens
caaguccccaagaaaaaauuuuuuuuagccuucccuggagaaaaaauuuggucagucacaaauuc

SEQ ID NO: 447996 - RNA, 65 nt, Homo Sapiens
cuucaaggggagucaggguccacugucuugcuguauggagaaauuagggaucugggauaaagcca

SEQ ID NO: 447997 - RNA, 65 nt, Homo Sapiens
agccagaaguugaugugggaccaugugaaguguuguggagaaaaggaacuagacuuuccuuugca

SEQ ID NO: 447998 - RNA, 65 nt, Homo Sapiens
uacuuuuugacuuacaugggagauauacuuugcuuuggagaaaucuuuuaaaaagaagagaaaga

SEQ ID NO: 447999 - RNA, 65 nt, Homo Sapiens
aguuauauaugcugacaguugaauauucaaagcaauggagaaacauuaaaaauugugaauuauuu

SEQ ID NO: 448000 - RNA, 65 nt, Homo Sapiens
cuuaaacaaacccuggagaccugggcccuaggccauggagaaaacgaggccagugagggaagugg

SEQ ID NO: 448001 - RNA, 65 nt, Homo Sapiens
ggaauggauuguggaugugucggggacaguggggauggagaaaggcuugauggcauggacuggag

SEQ ID NO: 448002 - RNA, 65 nt, Homo Sapiens
ccaucucuacuaaaaauacaccagccugaccaacguggagaaacccuaaggccgggaguucaaga

SEQ ID NO: 448003 - RNA, 65 nt, Homo Sapiens
cagucucuacugaaaauacaccagccugaccaacauggagaaacccugaggucgggaguuugaga

SEQ ID NO: 448004 - RNA, 65 nt, Homo Sapiens
gaaaggcaggucuggggugucagauggagcaggaguggagaaaggaggccugccaacucagggga

SEQ ID NO: 448005 - RNA, 65 nt, Homo Sapiens
cucuaguugagaaaaaacauaaugaauauuuuuaauggagaaagaugaaaauacauuugacauag

SEQ ID NO: 448006 - RNA, 65 nt, Homo Sapiens
gggaagauuuacugguuuaacuagguuguuuuugauggagaaaaaccuuauuuucuuuuguaaga

SEQ ID NO: 448007 - RNA, 65 nt, Homo Sapiens
uuuuacuaaauauacaagauuuacuacuagaaauuuggagaaagaacacuaacacauguacuugu

SEQ ID NO: 448008 - RNA, 65 nt, Homo Sapiens
gaacucaugagagacaagcaguaagaaacuucuuuuggagaaacaacagaccagaucuuuacuca

SEQ ID NO: 448009 - RNA, 65 nt, Homo Sapiens
acuacaguuucacagaauaccugagaagacacacuuggagaaaccuuuuggguguaaugaaugug

SEQ ID NO: 448010 - RNA, 65 nt, Homo Sapiens
auuugaaaaugucaagcugauuuacuuuauucacauggagaaaagaauccacaaauuaaacugag

SEQ ID NO: 448011 - RNA, 65 nt, Homo Sapiens
ugaucuuuacacuguaauucucagcauacugauuauggagaaacacuuguuuugauuuuguuaua

SEQ ID NO: 448012 - RNA, 65 nt, Homo Sapiens
uuuaaacagcaacaauuuaaagcuaugaagucaccuggagaaaaggaacguugcucuuggacagc

SEQ ID NO: 448013 - RNA, 65 nt, Homo Sapiens
gaaagccuuaagaagauaaaugagcgcagcagagauggagaaauagacuuugccuuuuaccugag

SEQ ID NO: 448014 - RNA, 65 nt, Homo Sapiens
ggaaugcugguuuaucuuuguagauuguaaucgaauggagaaauuugcaguauuuuagccacuau

SEQ ID NO: 448015 - RNA, 65 nt, Homo Sapiens
uuuuuaagcaagagaaagacaacuguucugcggguuggagaaaauacaauuuuuuuuuuuuuuuu

SEQ ID NO: 448016 - RNA, 65 nt, Homo Sapiens
cagccuuuuuaccacugcagaagaaagacacaauguggagaaaucuuaggacugacaucccuuua

SEQ ID NO: 448017 - RNA, 65 nt, Homo Sapiens
cugaacuggggaauuugaacauuccuuuacauuguuggagaaaugaagccaaaguuauucagaug

SEQ ID NO: 448018 - RNA, 65 nt, Homo Sapiens
auuuugcuuuuugagccuuaaguguguuaguaggauggagaaacugugauggggacugggaaccu

SEQ ID NO: 448019 - RNA, 65 nt, Homo Sapiens
auuauguucuuuagacacugcuaccugaaaacuguuggagaaauaauguuuaaaguuauuuaaga

SEQ ID NO: 448020 - RNA, 65 nt, Homo Sapiens
uuaauagacuuaauacaugcaacagaagugacuucuggagaaagcucauggcuguguccacugca

SEQ ID NO: 448021 - RNA, 65 nt, Homo Sapiens
uuaaaacccugaugcaaacuucuccuuucagugguuggagaaauuggccgaguucaaccauucac

SEQ ID NO: 448022 - RNA, 65 nt, Homo Sapiens
aaaaauaauaauuuaagagucucauauggcuaagauggagaaacagguacuggacuuuucccucc

SEQ ID NO: 448023 - RNA, 65 nt, Homo Sapiens
cuguaugugguguuuuaaccacauagggagucauuuggagaaagcaaauucuaaccaaaccccag

SEQ ID NO: 448024 - RNA, 65 nt, Homo Sapiens
uggaucaagauucuagcccagcuugaaaucuagucuggagaaaacguucuacaucaugcauagua

SEQ ID NO: 448025 - RNA, 65 nt, Homo Sapiens
uacuuguuaaacucuaguuccacugaccuuaggcauggagaaaauuucuggcuugucauucugua

SEQ ID NO: 448026 - RNA, 65 nt, Homo Sapiens
aaccagauacaucugcuggagcuggugucucucuuuggagaaacccagaacuguggugccaaauu

SEQ ID NO: 448027 - RNA, 65 nt, Homo Sapiens
uccuagaaaaggucagacccuggaggacagcagcauggagaaagaguaaauuugccaugacuucc

SEQ ID NO: 448028 - RNA, 65 nt, Homo Sapiens
cagagcaguccagaaccaguagaaacaaauggccauggagaaacgcuuugagcagcuccaggcca

SEQ ID NO: 448029 - RNA, 65 nt, Homo Sapiens
aaaucacucccugaguuuaguggguugccuuauuauggagaaaaauuacaaggucugcauguaaa

SEQ ID NO: 448030 - RNA, 65 nt, Homo Sapiens
ggauugaaaaucaguuagaaagugguuuauuccacuggagaaaggauagggcagcucuuugugaa

SEQ ID NO: 448031 - RNA, 65 nt, Homo Sapiens
cugaaaguuaauaucuuaaguuagacaucaagaaauggagaaagaugcccaguuauuuugccuca

SEQ ID NO: 448032 - RNA, 65 nt, Homo Sapiens
caaaguccuauugauugcuucugguucugugaucauggagaaauaguaaucagggagcugagagc

SEQ ID NO: 448033 - RNA, 65 nt, Homo Sapiens
agaugaauuauagcuccggagaaugugggugguauuggagaaagaaaaagcuaaauaaccuuuaa

SEQ ID NO: 448034 - RNA, 65 nt, Homo Sapiens
cuaaauaaccuuuaagaauguucuacguauccuuguggagaaaagcuggaggggaaaaagaucca

SEQ ID NO: 448035 - RNA, 65 nt, Homo Sapiens
aaccaaguccuuggauaucuagaaccaagucuacuuggagaaaagcuguaucuacucuguggagu

SEQ ID NO: 448036 - RNA, 65 nt, Homo Sapiens
uguaaaauuuggucuuccagcuguaacagcaauaguggagaaaaaccuuucugcugcuuuugcug

SEQ ID NO: 448037 - RNA, 65 nt, Homo Sapiens
uaugcgccagggugcuuccggagaaaacuuaagcguggagaaaugcagccgcggcgaggccgucg

SEQ ID NO: 448038 - RNA, 65 nt, Homo Sapiens
agaagggggaacagucaguuagagacagaagaccguggagaaaucaaaacaaguuuggcagagca

SEQ ID NO: 448039 - RNA, 65 nt, Homo Sapiens
aauuuuucauuuuugcucaugaggcauuuguaauauggagaaaauccccugggccuuauccuaua

SEQ ID NO: 448040 - RNA, 65 nt, Homo Sapiens
ugcaauuuaccaaguugccucagugcccuuaagacuggagaaagcagggagggguguuggagagc

SEQ ID NO: 448041 - RNA, 65 nt, Homo Sapiens
ccaucucuacuaaaaauacaccagccuuaccaacauggagaaacccugaggucgggaguucgaga

SEQ ID NO: 448042 - RNA, 65 nt, Homo Sapiens
uauuauuuccaugaucaaaugguauuguauaucaguggagaaaugacuuuuccagugcauuacau

SEQ ID NO: 448043 - RNA, 65 nt, Homo Sapiens
auuucugggauuacaaugaaagucaugaggguaaauggagaaaaugaaucuguuaaauuucacaa

SEQ ID NO: 448044 - RNA, 65 nt, Homo Sapiens
auuuaauaaaaccuguuaauuauguguuacaaaauuggagaaaguaaugcagauuacacugaucu

SEQ ID NO: 448045 - RNA, 65 nt, Homo Sapiens
cugggaccuucucugguagcugccagaccggcugguggagaaacaggagacaaucuggggacuga

SEQ ID NO: 448046 - RNA, 65 nt, Homo Sapiens
auuucccagugugucuuuuaugucuuugaauguuuuggagaaaagucuaugccugucuaaaaaug

SEQ ID NO: 448047 - RNA, 56 nt, Homo Sapiens
auggcucucucaagccaugaccacauuggagaaaugguuuuuauugucaaccuuaa

SEQ ID NO: 448048 - RNA, 65 nt, Homo Sapiens
uagucaguuuaguucauauguucugaaaacuguuuuggagaaagauagacagaaaaaugucauca

SEQ ID NO: 448049 - RNA, 65 nt, Homo Sapiens
gccaugaauuaagauggaugacuggaaaaagguguuggagaaagaguuaaagaugaggaagagau

SEQ ID NO: 448050 - RNA, 58 nt, Homo Sapiens
agaauccccugacuggauaacucagggcuggagaaacaaagauuauaaagcacgagaa

SEQ ID NO: 448051 - RNA, 65 nt, Homo Sapiens
auaguaaaagaaaaagggguaucagucuaaucucauggagaaaaacuacuugcaaaaacuucuua

SEQ ID NO: 448052 - RNA, 65 nt, Homo Sapiens
ugaaacccaaucuuucaaaacaugaaagggggugauggagaaaaccuuagcuugguugucuaaag

SEQ ID NO: 448053 - RNA, 65 nt, Homo Sapiens
gauuuucuacaugaaucaaacacagaaacaacuuuuggagaaauuaaauucugagugugacuucu

SEQ ID NO: 448054 - RNA, 65 nt, Homo Sapiens
uggccuccaccccuucccuguuuguaaauauucuguggagaaaagaggacuucagggaguaaaaa

SEQ ID NO: 448055 - RNA, 65 nt, Homo Sapiens
cgcuccccugacacugaagaggauccacaacuccuuggagaaacacccucacgucuguugccgca

SEQ ID NO: 448056 - RNA, 65 nt, Homo Sapiens
gauggggugggcagggcugggagaacuuuguacaguggagaaauauuuauaaacuuaauuuugua

SEQ ID NO: 448057 - RNA, 65 nt, Homo Sapiens
guaccuagguuggaguccagccuaaucaagucaaauggagaaacaggcccagagaggaagguggc

SEQ ID NO: 448058 - RNA, 65 nt, Homo Sapiens
ggacaacccagcagggaguuccggggaguccgaaguggagaaaggcuggugggaacauggaggcc

SEQ ID NO: 448059 - RNA, 65 nt, Homo Sapiens
caauucacuuucuugagaggacaaaugaaaagcuguggagaaaauguccucauuaaaguauuaaa

SEQ ID NO: 448060 - RNA, 65 nt, Homo Sapiens
ugccaaguucaguguggauuuuucuuggugcucuauggagaaauggagucugugugcuuacugaa

SEQ ID NO: 448061 - RNA, 65 nt, Homo Sapiens
uggagugcuugggcagaaaguuguaaaguuugugcuggagaaagguuuauuuggacuuugauuac

SEQ ID NO: 448062 - RNA, 65 nt, Homo Sapiens
ucauguugcacacucuuugacagcaugcuguuuuguggagaaacuugcauucaugaagagcccau

SEQ ID NO: 448063 - RNA, 65 nt, Homo Sapiens
ucuuauuccuauaagcuauguguucagacugaaacuggagaaauuaugacuauuuuauuuauagu

SEQ ID NO: 448064 - RNA, 65 nt, Homo Sapiens
aaaaguauauucucacaguuuuuccccaggaagucuggagaaaaaguccucaugucaccaauuuc

SEQ ID NO: 448065 - RNA, 65 nt, Homo Sapiens
agguuuaaaauaagugugcacuuggacauaaagacuggagaaauaaacacugaggacuccaaaag

SEQ ID NO: 448066 - RNA, 65 nt, Homo Sapiens
ccacaggcacauaauucaacagcuuuaggggaacauggagaaagaaggagaccacauaccccaaa

SEQ ID NO: 448067 - RNA, 65 nt, Homo Sapiens
acuugagcuugccacucuguauaauucuaacauccuggagaaaaauggcaguuugaccgaaccug

SEQ ID NO: 448068 - RNA, 65 nt, Homo Sapiens
aacgcauucuguccaccauguaaaauaggccaaacuggagaaauacuguucauguauguaggagu

SEQ ID NO: 448069 - RNA, 65 nt, Homo Sapiens
caaaccgagcagggcugugucaauuaucaaccacguggagaaaaucacuuagcagcaacugaaga

SEQ ID NO: 448070 - RNA, 65 nt, Homo Sapiens
aaugauauuuagaaaguuaaguaagaggauuuuuuuggagaaaaaguccauauccagguuagcug

SEQ ID NO: 448071 - RNA, 65 nt, Homo Sapiens
caucauuugcauauguaucuauuuccacuuguguguggagaaauaugauuagagggucucugguc

SEQ ID NO: 448072 - RNA, 65 nt, Homo Sapiens
agugccuuuccuugcccuguucaaaaacaacuaccuggagaaaacuauagcuugcccucacuugc

SEQ ID NO: 448073 - RNA, 65 nt, Homo Sapiens
ccuucuacaauauuccacacguggagcacuguauguggagaaauuuuaacaagcugauguagagg

SEQ ID NO: 448074 - RNA, 65 nt, Homo Sapiens
aaggcucugaucauuuuguuacguguaguuucuaguggagaaaucgcauguggacucuuaacugu

SEQ ID NO: 448075 - RNA, 65 nt, Homo Sapiens
aguugugguuucagugaaucgaggggcacuuaagauggagaaaucgcccccuucuuguccccuuu

SEQ ID NO: 448076 - RNA, 65 nt, Homo Sapiens
gggguugggaacuuaugcagcaccuuccagaaacuuggagaaaugcugagggugcccaccaagcc

SEQ ID NO: 448077 - RNA, 65 nt, Homo Sapiens
acuucaaccagagcagggaggacucauuccugccuuggagaaaauccagcugugguuggaucaag

SEQ ID NO: 448078 - RNA, 65 nt, Homo Sapiens
cucaaugcuuacuguuacuaucaugaaaaguccaguggagaaaauuaugaaaaggaaucugaagg

SEQ ID NO: 448079 - RNA, 65 nt, Homo Sapiens
gagagaauuaguagggcaagaauuuucuaaagcuuuggagaaaagagcaugaaagucaaaacugg

SEQ ID NO: 448080 - RNA, 65 nt, Homo Sapiens
ggacucaggagcuaauacuguuagguggguuauccuggagaaaauuugccaaguugucuuugcuc

SEQ ID NO: 448081 - RNA, 65 nt, Homo Sapiens
ccuuaggaagacuaugagagcuucgugacagucucuggagaaaucaacagaaagcaucagcucug

SEQ ID NO: 448082 - RNA, 65 nt, Homo Sapiens
ucaaaaccccaaacaaacacauaaguaccuuuuauuggagaaaaauaaaaaauuuuacugucuaa

SEQ ID NO: 448083 - RNA, 65 nt, Homo Sapiens
cagagugacucaaaagccauuugcuacagcuagaguggagaaaaaucauuccaagaaccagccca

SEQ ID NO: 448084 - RNA, 65 nt, Homo Sapiens
ucagguuuguaggagacugauuuaauuuguuuugcuggagaaacagaaguaccauuagguuuaau

SEQ ID NO: 448085 - RNA, 65 nt, Homo Sapiens
auggaaaaccuucaagaucuguguucuuaacuggguggagaaagagucacaaauuucuagucaau

SEQ ID NO: 448086 - RNA, 65 nt, Homo Sapiens
auggcagccucagggcuuccaguaucaaggcugccuggagaaagggcucuaacauuacugccuuc

SEQ ID NO: 448087 - RNA, 65 nt, Homo Sapiens
cuggcauggauuugcacuagucaacauuauacccauggagaaacaaagaaucauccugucccaug

SEQ ID NO: 448088 - RNA, 65 nt, Homo Sapiens
acagugugccucaaacuccuguccacuuuccauccuggagaaagaagcccaccucauguccagcu

SEQ ID NO: 448089 - RNA, 65 nt, Homo Sapiens
acucuuugugcaagugccuuccugagcagaagaacuggagaaagggaaccacagagccaggagga

SEQ ID NO: 448090 - RNA, 65 nt, Homo Sapiens
cugagguagggaguucgagaccagccugaccaacauggagaaaccccaucucuacuaaaaauaaa

SEQ ID NO: 448091 - RNA, 56 nt, Homo Sapiens
uccucaaaaucuggaacugaggaggcuggagaaagggaaguggaaggcagugaaca

SEQ ID NO: 448092 - RNA, 65 nt, Homo Sapiens
guuucuuuuuuuuuuuuuuuccuauuggaucuuccuggagaaaauacuuuuuuuuuuuuuuuuuu

SEQ ID NO: 448093 - RNA, 65 nt, Homo Sapiens
agagaaagguuuuagacuccaguuuaccuuucucuuggagaaacucaaugcuaaucccaccuuuu

SEQ ID NO: 448094 - RNA, 65 nt, Homo Sapiens
uguuuacaaauucagaauuuugauagggguagauauggagaaagaccuauuuccugggucucugc

SEQ ID NO: 448095 - RNA, 65 nt, Homo Sapiens
aaaaagauaagagauagcaagugucagcaagggucuggagaaaagggaauuuuuguauacuguug

SEQ ID NO: 448096 - RNA, 65 nt, Homo Sapiens
gaaccugauguaccugaagcagauccuguauuugcuggagaaauucguggcugugcuagggggug

SEQ ID NO: 448097 - RNA, 65 nt, Homo Sapiens
auucacucacuccacccugccucugcaucccuuaauggagaaacgggccuaaaaccaaacgggua

SEQ ID NO: 448098 - RNA, 65 nt, Homo Sapiens
uggacaggacccagcccugcaccguucacuguauuuggagaaaaugguaagaguuccauaccggc

SEQ ID NO: 448099 - RNA, 65 nt, Homo Sapiens
cuucaagaggaagauagauuuucuaaccaagcagauggagaaaauccaaccagcucuucaggaga

SEQ ID NO: 448100 - RNA, 65 nt, Homo Sapiens
cuguauguuguaucuuuugcauguagcuuccuuaauggagaaaaaaaaaccuaauaaauuuccag

SEQ ID NO: 448101 - RNA, 65 nt, Homo Sapiens
gcugaguucuuaaagacugaagacaggcuauucucuggagaaaaauaaaauggaaauuguacuua

SEQ ID NO: 448102 - RNA, 61 nt, Homo Sapiens
aacuggcacaacguccuuaauuggguuuuuguggagaaaagaauguugucccaagaagaua

SEQ ID NO: 448103 - RNA, 65 nt, Homo Sapiens
uugaggucaggaguucgagaccagccugaccaacauggagaaacccugucucaacuaauaauaca

SEQ ID NO: 448104 - RNA, 65 nt, Homo Sapiens
guaguaagcuaaacugaaaauaaggugggcuucacuggagaaauggacuuacugcaaaugcugug

SEQ ID NO: 448105 - RNA, 65 nt, Homo Sapiens
acaugagauggaaucaggcagagaggcugggaugauggagaaagcucgaggugaaguuuuaaaaa

SEQ ID NO: 448106 - RNA, 65 nt, Homo Sapiens
uugcucuuuucaaaaccuaccagucccacuguggguggagaaauaaauggucuuucuccuccucg

SEQ ID NO: 448107 - RNA, 65 nt, Homo Sapiens
cagccuuuccuacauccuucccucacucccaugauuggagaaaugauucauugggugaugagugu

SEQ ID NO: 448108 - RNA, 65 nt, Homo Sapiens
acuggggagcucacuugagcucuugauaagaaauguggagaaaaguaaaaaccaagcuuugaaga

SEQ ID NO: 448109 - RNA, 65 nt, Homo Sapiens
uguccauugauugacaugagcaccccuguuuucucuggagaaauaccuccccucucuggggugcu

SEQ ID NO: 448110 - RNA, 65 nt, Homo Sapiens
gugaaguaauauggcccacacuuuauucaccacccuggagaaaaaaaaacccaggaauaugugga

SEQ ID NO: 448111 - RNA, 65 nt, Homo Sapiens
aauuccuaccaggaaagaauacauauccaauagauuggagaaagccagagauuagcccucauucc

SEQ ID NO: 448112 - RNA, 65 nt, Homo Sapiens
cuuccuugcaggagugacucucucagaaccacuccuggagaaagagcacagcacuccuguaacug

SEQ ID NO: 448113 - RNA, 65 nt, Homo Sapiens
ugggagaggccggccucaaauuaagggcaaagccauggagaaaugucuccacagugagagcaaca

SEQ ID NO: 448114 - RNA, 65 nt, Homo Sapiens
gaggugagcaaauuaacgguuauuggucuggaaauuggagaaaugaaggaucugauacaucuagu

SEQ ID NO: 448115 - RNA, 65 nt, Homo Sapiens
aaaacaguuuauuucaucuuuggaguagagauuucuggagaaaaacucuugugugcugugggcac

SEQ ID NO: 448116 - RNA, 65 nt, Homo Sapiens
ggcucuuauuaaacuuagaucacaacaguggcccauggagaaagaugccagaaaaggcuucuguu

SEQ ID NO: 448117 - RNA, 65 nt, Homo Sapiens
aauaguauauucuacauaaaauauuguuauuuugguggagaaaaaacauguucccgccugcaaau

SEQ ID NO: 448118 - RNA, 65 nt, Homo Sapiens
aauuaaguugacuugaaauuugugcacuaugagauuggagaaauguaauuaaagaaccugguggg

SEQ ID NO: 448119 - RNA, 65 nt, Homo Sapiens
cugucucuauuaaaaauacaccaaccugaccaacauggagaaacccugaggucgggaguucgaga

SEQ ID NO: 448120 - RNA, 65 nt, Homo Sapiens
ugacccugaucccaaaccugaaaagggucagggcauggagaaaggccucuucuguugccaaauag

SEQ ID NO: 448121 - RNA, 65 nt, Homo Sapiens
gugugccaacucuucaccuucucucugcagauggcuggagaaaggggucuucucugcaccaacca

SEQ ID NO: 448122 - RNA, 65 nt, Homo Sapiens
aaucuuuuucaaaguuuguggggaauuuggcuuuauggagaaaagcacaggacugaagcuuaauu

SEQ ID NO: 448123 - RNA, 65 nt, Homo Sapiens
uaaggaaaggaaugcugacugcaaacgggcaacucuggagaaaaacuugcagacuggauaugcaa

SEQ ID NO: 448124 - RNA, 65 nt, Homo Sapiens
uacuccccuuggccaggacaauggcuuuaguagucuggagaaaucaagugggaauggcuauauac

SEQ ID NO: 448125 - RNA, 65 nt, Homo Sapiens
ccacgaucuuccugaagaaguagugggaccuugacuggagaaacuacugcaacccuaacucacuc

SEQ ID NO: 448126 - RNA, 65 nt, Homo Sapiens
cgaagccaagagaauaugaauuugguguugggcacuggagaaaaaauuucuuucugcuuccacua

SEQ ID NO: 448127 - RNA, 65 nt, Homo Sapiens
uuggggcacguuuuccuacuagcuuuaaaguacuuuggagaaacugaauuaaauacauuucauug

SEQ ID NO: 448128 - RNA, 65 nt, Homo Sapiens
aggugaagaugcaaccagaauuaacucugaauacuuggagaaacuuauaaaagaaguugugcuau

SEQ ID NO: 448129 - RNA, 65 nt, Homo Sapiens
acaaauaagucaaaauaaucaaauccuuuacaagauggagaaacauaauuugaaauaacagccuu

SEQ ID NO: 448130 - RNA, 65 nt, Homo Sapiens
ggcaaaccagaaucacugugcgacucguggccacauggagaaacacccacugcuggacacguccc

SEQ ID NO: 448131 - RNA, 65 nt, Homo Sapiens
aucuagacuuucuuguauaccaaaaguagugcauguggagaaagaugauauuuggaacuuuauuc

SEQ ID NO: 448132 - RNA, 65 nt, Homo Sapiens
guaggaacaacacaugguacaaaucuacuagacauuggagaaacaauugcacaucaguaugugcc

SEQ ID NO: 448133 - RNA, 65 nt, Homo Sapiens
ugguucccguuuuccagaggaaaacccuguguccuuggagaaagcuuuauuucugcagguuggug

SEQ ID NO: 448134 - RNA, 65 nt, Homo Sapiens
guugggcuguugcaucgaguaagaaccaggaucucuggagaaacacaagaagggacauugucacc

SEQ ID NO: 448135 - RNA, 65 nt, Homo Sapiens
ucgucucuacuaaaaauucaccagccugaccaacauggagaaacccugaggucaggaguucuaga

SEQ ID NO: 448136 - RNA, 65 nt, Homo Sapiens
cugucucuacuaaaaauacaccagccugaccaacauggagaaacccugaggucacgaguucgaga

SEQ ID NO: 448137 - RNA, 65 nt, Homo Sapiens
ggcuggccccacagccucacucucaccuguuugcauggagaaaugaggcccugguggggcuggag

SEQ ID NO: 448138 - RNA, 65 nt, Homo Sapiens
uagagcccugauuaacuucaaggacaaacacuggcuggagaaagccagacugaugggaaugagac

SEQ ID NO: 448139 - RNA, 65 nt, Homo Sapiens
cuugagacucuugaagaaaauucagaaugaaguucuggagaaagguauguuacuguaguaauuac

SEQ ID NO: 448140 - RNA, 65 nt, Homo Sapiens
guucaaaccaaagaaacaaugaucuacucaaacauuggagaaaaaaacugccagaggaggaguug

SEQ ID NO: 448141 - RNA, 65 nt, Homo Sapiens
uaauuuaagaugcuauguaucuguuauuuaaaacauggagaaacagggccuuuauuccauucaua

SEQ ID NO: 448142 - RNA, 65 nt, Homo Sapiens
aaguuuccuaaaguuucuucaaguauuuuuuaagguggagaaaugcaggaauuguauaaccagaa

SEQ ID NO: 448143 - RNA, 65 nt, Homo Sapiens
ccagcuuucgucugucaucagacauugaagagauuuggagaaauguaaagcagcaguacucuucu

SEQ ID NO: 448144 - RNA, 65 nt, Homo Sapiens
cuccuagauagauucauucuaucuaguuguggggauggagaaaucuuuaaugguauauuuucggu

SEQ ID NO: 448145 - RNA, 65 nt, Homo Sapiens
ccuuuuaagccaugggugggucuaacuggcuuuuguggagaaauuagcacaccccaacuuuaaua

SEQ ID NO: 448146 - RNA, 65 nt, Homo Sapiens
uuauguuuguaaguuuggcuuugugggaauagguguggagaaauuaaagagugaaggccauauuu

SEQ ID NO: 448147 - RNA, 65 nt, Homo Sapiens
uuauguauguucagccagauaguaaaugggauuuuuggagaaauaagauaacuacaaaguuucua

SEQ ID NO: 448148 - RNA, 65 nt, Homo Sapiens
cccgcccccagcagugucgcuccaauucaaauuaguggagaaaagauuacaguaggcccugagcc

SEQ ID NO: 448149 - RNA, 65 nt, Homo Sapiens
aaacuguacugcuuguucaacugacuuuugucuuuuggagaaaaauugcaucacugaggaugaaa

SEQ ID NO: 448150 - RNA, 65 nt, Homo Sapiens
aagaaaagcaaaugaguguuuuuagcaacugguguuggagaaaaacauaauagagauugauaaga

SEQ ID NO: 448151 - RNA, 65 nt, Homo Sapiens
cccaaagccacuaguauuagaguaggggaagcggauggagaaaaaacccccacaaggggagaaaa

SEQ ID NO: 448152 - RNA, 65 nt, Homo Sapiens
gugacaacaauuugaaaauugaaugaggguaauccuggagaaauuggccaaaagucggaaaauga

SEQ ID NO: 448153 - RNA, 65 nt, Homo Sapiens
uggaccaaaggcuaaaaauagagaguauagaaugauggagaaaaaauuugugggggaaaaaaaag

SEQ ID NO: 448154 - RNA, 65 nt, Homo Sapiens
ucuuaguugggugaauuaaacauaugcuuauggcuuggagaaauucuuuuccaguauuaaacacu

SEQ ID NO: 448155 - RNA, 65 nt, Homo Sapiens
aagccuggcugcagcuucccauuugguuacgagguuggagaaaaagucaaaguccccuccugggc

SEQ ID NO: 448156 - RNA, 65 nt, Homo Sapiens
agagauuagagauaauugucuaguuagggggcagcuggagaaaauaagcuaaguuugcaauaaca

SEQ ID NO: 448157 - RNA, 65 nt, Homo Sapiens
uauagcaucuggaagaucauuuugaaauuguuccuuggagaaaugaaaacaguguguaaacaaaa

SEQ ID NO: 448158 - RNA, 65 nt, Homo Sapiens
uuugugaaaauaaagaacucuguagcucaccaagguggagaaacgcaauucagaaaaguaauuuc

SEQ ID NO: 448159 - RNA, 65 nt, Homo Sapiens
uaauauggaaaggggggaaaagaguaacuuuacaguggagaaaucugacagacaccagcucagcc

SEQ ID NO: 448160 - RNA, 65 nt, Homo Sapiens
cugccuuucccaaaugggaaaggugcugacagaguuggagaaaaaagaauagacucauuuuuccc

SEQ ID NO: 448161 - RNA, 65 nt, Homo Sapiens
aggccuggggcuaugcauacgcauuaagggccugcuggagaaaccuucacuccagacagacaggg

SEQ ID NO: 448162 - RNA, 65 nt, Homo Sapiens
agacaguuacuagcaauggggaaugcuugucacuguggagaaagaguuuuguauaugucugauac

SEQ ID NO: 448163 - RNA, 65 nt, Homo Sapiens
guagccucagaagcagagcuguuuggcagacuggcuggagaaauucccucuaggagacuugccug

SEQ ID NO: 448164 - RNA, 65 nt, Homo Sapiens
ugcuugugcugggaaaugcaacucacucauguauuuggagaaacaggaguguucacuuaucuagu

SEQ ID NO: 448165 - RNA, 65 nt, Homo Sapiens
aagcucaggguuuguugaauguauuuagccauagauggagaaacauuauuugguuagagugauau

SEQ ID NO: 448166 - RNA, 65 nt, Homo Sapiens
guauuuguguucacuucuauagacuauugaaauuuuggagaaaauucaaugcuuauauauuccuu

SEQ ID NO: 448167 - RNA, 65 nt, Homo Sapiens
aaauugcuauuuaccaggaagcaaauggaaaccgcuggagaaacaccaucugucaugacuguuug

SEQ ID NO: 448168 - RNA, 65 nt, Homo Sapiens
gcauucauaaaacaauuggaaguuugaaagauaucuggagaaaucaucuagugaauaaaaaaauu

SEQ ID NO: 448169 - RNA, 65 nt, Homo Sapiens
gcuauucuuccuguuguccauaauaggacucgacuuggagaaauuuacaaaaaugaaaauauuua

SEQ ID NO: 448170 - RNA, 65 nt, Homo Sapiens
gaucuccgugcccuacagacuggagccuggguuuuuggagaaagaucuuaguugucauaaucccu

SEQ ID NO: 448171 - RNA, 65 nt, Homo Sapiens
gcugccuggaugagaaacaggagugggccccgggcuggagaaagacccccuaagagacacauaca

SEQ ID NO: 448172 - RNA, 65 nt, Homo Sapiens
ggggggauagaaaauucuacacuacuuuuuauuacuggagaaaugucugggugccagaucccagc

SEQ ID NO: 448173 - RNA, 65 nt, Homo Sapiens
gaauggacaaagcucaggaacuguggaagggccaauggagaaaauaagaauuucuggaagaaagg

SEQ ID NO: 448174 - RNA, 65 nt, Homo Sapiens
aagcagaggaaggaaacauacugagguuagcccaauggagaaaugaugugugcagacaauucucc

SEQ ID NO: 448175 - RNA, 65 nt, Homo Sapiens
cauggccaaaacgauugugguauuucacuggugguuggagaaaacacuaaaaugaaccaaaccca

SEQ ID NO: 448176 - RNA, 65 nt, Homo Sapiens
uugugcccuguguuuuauaaacuauuuucuauauuuggagaaaguaaaugaauugaaccauuuca

SEQ ID NO: 448177 - RNA, 65 nt, Homo Sapiens
uaguagauuuuaauuugacucguuucacuuuuuguuggagaaaaauaucaacagcaaacuucagc

SEQ ID NO: 448178 - RNA, 65 nt, Homo Sapiens
auaucccaccaaccuccagucagugugguacaagguggagaaagccacugugccccacaaaacuu

SEQ ID NO: 448179 - RNA, 65 nt, Homo Sapiens
cucagggacccccaggaccaggaugugucucagccuggagaaauggugggggggcagugucuagg

SEQ ID NO: 448180 - RNA, 65 nt, Homo Sapiens
cugaagucaggaguucgagaccagccugaccaccauggagaaaccccgucucuacuaaaaauaca

SEQ ID NO: 448181 - RNA, 65 nt, Homo Sapiens
gagggcaggcuuggggaaaauggccaugcaggagguggagaaaauuggaacucuacucaacccau

SEQ ID NO: 448182 - RNA, 65 nt, Homo Sapiens
aaccuuugcacacucaccugagcccuggggacccuuggagaaauuaggugucaccugcuguggca

SEQ ID NO: 448183 - RNA, 65 nt, Homo Sapiens
ucucccuuaauaaaggagaaaaauauacugauggcuggagaaauuuuucucugccuuucaguuuu

SEQ ID NO: 448184 - RNA, 65 nt, Homo Sapiens
cugagguugggaguucgagaccagccugaccaacguggagaaaccccgucucuacuaaaaauaug

SEQ ID NO: 448185 - RNA, 65 nt, Homo Sapiens
caggcagucagguccaugugcacugcaaugccagguggagaaaucacagagagguaaaauggagg

SEQ ID NO: 448186 - RNA, 65 nt, Homo Sapiens
uugauaccaaacaauucaaaaguuggaucugaguuuggagaaagauauuuccaaccuaagugggu

SEQ ID NO: 448187 - RNA, 65 nt, Homo Sapiens
caagucagggggccacucugccucauuuaugcaaauggagaaaggcgcccucccuggggucccuu

SEQ ID NO: 448188 - RNA, 65 nt, Homo Sapiens
gagggccguaccccacccucagcaccccuuccauguggagaaaggagugaaaccuuuagggcagc

SEQ ID NO: 448189 - RNA, 65 nt, Homo Sapiens
ugguggcacugagcccccccaacacugugcccugguggagaaagcacugaccugucaugcccccc

SEQ ID NO: 448190 - RNA, 65 nt, Homo Sapiens
caaggaguccuuccacccugccuucagguucucucuggagaaagguuagagaccccaggacaauc

SEQ ID NO: 448191 - RNA, 65 nt, Homo Sapiens
gugcauuuaaggagauugggagacaauuagcagaauggagaaaguaagucuuuuuuuuuuccaaa

SEQ ID NO: 448192 - RNA, 65 nt, Homo Sapiens
gaggccucuuauguguaaugaaaugugaaaguacuuggagaaacuuuagaagucugcuaaagauc

SEQ ID NO: 448193 - RNA, 65 nt, Homo Sapiens
cgcaugggggugggccugguuccucagaaccugccuggagaaaugaagagaaauuguccaaagag

SEQ ID NO: 448194 - RNA, 65 nt, Homo Sapiens
cuuguaaagcugcauauucauuagaaucuuauuuauggagaaaaagauaccaauugaccugaacu

SEQ ID NO: 448195 - RNA, 65 nt, Homo Sapiens
cuuagaaauucagcauuugaaacauucauagucuuuggagaaauguucuguggagguggaaaagc

SEQ ID NO: 448196 - RNA, 65 nt, Homo Sapiens
auuuaaaauuguuuuaaauucagaucauagauuaauggagaaaacuaauaucuuuuaucaguguu

SEQ ID NO: 448197 - RNA, 65 nt, Homo Sapiens
ggaccagagagucugccccuacugucagcaaagccuggagaaaugcaaucaucuaaaagccagcc

SEQ ID NO: 448198 - RNA, 65 nt, Homo Sapiens
ggaaugucgcugcauucagcaggagaaugagcggguggagaaacuccgcuuuauggagcucaugc

SEQ ID NO: 448199 - RNA, 65 nt, Homo Sapiens
caguucuuccuugcccacuuugagagcaugucagcuggagaaaagaagcuaaacuucuucacccc

SEQ ID NO: 448200 - RNA, 65 nt, Homo Sapiens
aacugguggguuagggccuuagccagcagggguucuggagaaagacacccacuuggcuaugggag

SEQ ID NO: 448201 - RNA, 65 nt, Homo Sapiens
caggcucaaaguggggcugggggucuuggccacauuggagaaaaaagaaguucugccucugccug

SEQ ID NO: 448202 - RNA, 65 nt, Homo Sapiens
uaucaaaggucucaccauguuugacucaugaggccuggagaaaaguggagggacagugauggccu

SEQ ID NO: 448203 - RNA, 65 nt, Homo Sapiens
ccuaccccggcaggggcuuccggggccuuuucaccuggagaaacauucccacuccccuuuggccu

SEQ ID NO: 448204 - RNA, 65 nt, Homo Sapiens
acagacucugagaagcgaagaccaugucuccucguuggagaaacccaauagcaggggaagcuggg

SEQ ID NO: 448205 - RNA, 65 nt, Homo Sapiens
uuuccuuggggcugcaguuuugugguugaggggccuggagaaaaucauuuucuccccuuggcagu

SEQ ID NO: 448206 - RNA, 65 nt, Homo Sapiens
cuaaguuggggaguucaagaccagccugaccaacguggagaaacuccgucuccacuaaaauacaa

SEQ ID NO: 448207 - RNA, 65 nt, Homo Sapiens
uguguguaaugcaaauuaguuaaaacaaauaguuuuggagaaaguuaaaacuagcuuuagaguaa

SEQ ID NO: 448208 - RNA, 65 nt, Homo Sapiens
ccguuugugaauaaacuguucuucaucauugacacuggagaaagguguccuccaugcccucaggc

SEQ ID NO: 448209 - RNA, 65 nt, Homo Sapiens
aagucuguuauuaggaauaauccuuagccauguaauggagaaaggagcagucagcauucuuccaa

SEQ ID NO: 448210 - RNA, 65 nt, Homo Sapiens
augaaccagcuguaaaaacacauuucuggaacaacuggagaaaccggaguaugcccuggacugga

SEQ ID NO: 448211 - RNA, 65 nt, Homo Sapiens
uuuccuuccuuggaagagaaugucugaucuaaauguggagaaacuguagucucaggaccuaggga

SEQ ID NO: 448212 - RNA, 65 nt, Homo Sapiens
acaacuaggauguguugggugagauguuucagaucuggagaaaugagcaggugucgggaaaugug

SEQ ID NO: 448213 - RNA, 65 nt, Homo Sapiens
agggaauguucuaaaacuuuuucuuccuuaaaaaauggagaaaauugcacuugugcuugcugugu

SEQ ID NO: 448214 - RNA, 65 nt, Homo Sapiens
auaggaacaugcacaaagcaguuaauuaggcagccuggagaaaaccagagauccaguacagaaag

SEQ ID NO: 448215 - RNA, 65 nt, Homo Sapiens
ccaccuccccuugggcccacaccuccuucccucucuggagaaagggcccugggccugccucacca

SEQ ID NO: 448216 - RNA, 65 nt, Homo Sapiens
aguguggugaugccaugcccaucaugggaggcuuuuggagaaacagaauguuugggcaggggcug

SEQ ID NO: 448217 - RNA, 65 nt, Homo Sapiens
cugaggucgggaauucgagaccagccugaccaacauggagaaacuccaucucuacuaaaaauaca

SEQ ID NO: 448218 - RNA, 65 nt, Homo Sapiens
agcagggguuggagccauggccuucugggaaccuauggagaaagggaauccaaggaagcagccaa

SEQ ID NO: 448219 - RNA, 65 nt, Homo Sapiens
uuuguugaaauagcuuuacuguuucucaaguguuuuggagaaaaaaaucaacccugcaaucacuu

SEQ ID NO: 448220 - RNA, 65 nt, Homo Sapiens
uuggccaaagugaaggaaucuuuuuucaguuuuauuggagaaacugaaggguaacauucuaacaa

SEQ ID NO: 448221 - RNA, 65 nt, Homo Sapiens
aauuuauaauuuugaucgaguuucuuaaaagacccuggagaaagaguggcauuucuucuguuuca

SEQ ID NO: 448222 - RNA, 65 nt, Homo Sapiens
aucagaauucucccacaccaagugcaugucaguuguggagaaaacauagcaaaaagagccguacg

SEQ ID NO: 448223 - RNA, 65 nt, Homo Sapiens
cagauucacagcaugacagagugcccaucuuuuucuggagaaaguuugcugcccaucuggccugu

SEQ ID NO: 448224 - RNA, 65 nt, Homo Sapiens
uucucaguaggggaacgucaagaagucacagaaaauggagaaaaccucccagaaaaauuacaggc

SEQ ID NO: 448225 - RNA, 65 nt, Homo Sapiens
gagcaagcugcccccuccuuugucggccaagagccuggagaaaggcguggacagccucagggggc

SEQ ID NO: 448226 - RNA, 65 nt, Homo Sapiens
ggugcugaaauccaccuuuauuguugccgucgaguuggagaaaguaaccggccucaugacuagcc

SEQ ID NO: 448227 - RNA, 65 nt, Homo Sapiens
uaagucuucacugagggccauauggaggacuuguauggagaaauuauuuucuagaaauaaacagu

SEQ ID NO: 448228 - RNA, 65 nt, Homo Sapiens
uuuuguguguaugauauaugggauaacauaccugauggagaaaugcaguuguuugaaguuuucag

SEQ ID NO: 448229 - RNA, 65 nt, Homo Sapiens
uuucaauuucuuugaauacuggccuugcagcuaaauggagaaaugaauuaguuuuccucucacuu

SEQ ID NO: 448230 - RNA, 65 nt, Homo Sapiens
caccuggcuccagggccaguagguggaaguuuucauggagaaaagcuaugucggcugagcuacca

SEQ ID NO: 448231 - RNA, 65 nt, Homo Sapiens
aguuugugauuaguccuuaagauucaggauguuguuggagaaacagugugauggugcaaggaaug

SEQ ID NO: 448232 - RNA, 65 nt, Homo Sapiens
gcccuuccagggcggcagcacacgagaaaagccaguggagaaagcgccggccugggagaaagacu

SEQ ID NO: 448233 - RNA, 65 nt, Homo Sapiens
acagcaucauggaugcugugaugaucagggaauuuuggagaaacucggauggugaggacacagcu

SEQ ID NO: 448234 - RNA, 65 nt, Homo Sapiens
ccgucucuauuaaaaauacaagaccagccucaacauggagaaacccaccugaggucaggaguucg

SEQ ID NO: 448235 - RNA, 65 nt, Homo Sapiens
uuuuccugaaguuuuauuccauuauauugacaagauggagaaagcaagaucaugaaggugugcaa

SEQ ID NO: 448236 - RNA, 65 nt, Homo Sapiens
aacugaagaaagagaagucacaacaaaaggaagacuggagaaaugcuuacuucuagagggagaag

SEQ ID NO: 448237 - RNA, 65 nt, Homo Sapiens
cugaggucaggaguuugagaccagccuggccaacauggagaaacuccgucuccgcuaaaaauacg

SEQ ID NO: 448238 - RNA, 65 nt, Homo Sapiens
cugaggucgggaguuugagaccagcccgaccaacauggagaaacccugucucuacuaaaaauaca

SEQ ID NO: 448239 - RNA, 65 nt, Homo Sapiens
guuuucuuuuuuuagggagaagggcuuuucuuuaguggagaaauggaacucgccccccuaccccc

SEQ ID NO: 448240 - RNA, 65 nt, Homo Sapiens
uuugccaagaagugaucuguuuuaaaggucauauuuggagaaagggcaaggaauugggucugcuu

SEQ ID NO: 448241 - RNA, 65 nt, Homo Sapiens
uuaccuggugcugcgucuugcuuuugguuuccagcuggagaaaagaagacaagaaagucuugggc

SEQ ID NO: 448242 - RNA, 65 nt, Homo Sapiens
ccacuguggacgcccuggggcuuggcacccaccucuggagaaacucggggccaccuccacuccau

SEQ ID NO: 448243 - RNA, 65 nt, Homo Sapiens
uuauaaaccacugaaagggauagagaagugaacauuggagaaagccaguagcaacugugagaaau

SEQ ID NO: 448244 - RNA, 65 nt, Homo Sapiens
ccccucccgcugccccagaaguuucuaucauuccauggagaaagcuguguuccaaugaauccuac

SEQ ID NO: 448245 - RNA, 65 nt, Homo Sapiens
aagccaaagcugggcucaguggggaaggucaggaauggagaaauugccuuuucucguuagccucc

SEQ ID NO: 448246 - RNA, 65 nt, Homo Sapiens
cugaggucaggaguucgaaaccagccuggccaacauggagaaaccccaucucuacuaaaaauaca

SEQ ID NO: 448247 - RNA, 65 nt, Homo Sapiens
caagcccuuggggugacucggcuuccaggagcuguuggagaaaugaggaugucugucccugucug

SEQ ID NO: 448248 - RNA, 65 nt, Homo Sapiens
ccgccucuaguaaaaauacaccaaccugaccuacauggagaaacucugaggucaggauuucgaga

SEQ ID NO: 448249 - RNA, 65 nt, Homo Sapiens
ugucaguguuuuccuauaagaagaggcauuccuacuggagaaaaaucugacuuggaaaguuggag

SEQ ID NO: 448250 - RNA, 65 nt, Homo Sapiens
ugggaagcaaugguuugguuaucccagcauugcaauggagaaaaauaguuagugauaagauguuc

SEQ ID NO: 448251 - RNA, 65 nt, Homo Sapiens
aggacgcagagaagaacaaagggccccgugguuccuggagaaagcaucguuccgagaggucugga

SEQ ID NO: 448252 - RNA, 65 nt, Homo Sapiens
gaacacuuuugaacuauguauagguuucuuuuaucuggagaaaaagggagagcuugaccuccauc

SEQ ID NO: 448253 - RNA, 65 nt, Homo Sapiens
cuuuggcagaagagugaaagcugcucugugggguuuggagaaaugcagugagaauucgugcaucu

SEQ ID NO: 448254 - RNA, 65 nt, Homo Sapiens
aauauccugccaccucuaacuuagagccaaaaaacuggagaaacagguacugaaaguguaauuuc

SEQ ID NO: 448255 - RNA, 65 nt, Homo Sapiens
aagaucaugaaggugugcaaauucuguugacaagauggagaaagcuuuuccugaaguuuuauucc

SEQ ID NO: 448256 - RNA, 65 nt, Homo Sapiens
cacccuuucccuuuuucuuuggaaaucugccuuauuggagaaaauccaaaaacuacauauuugua

SEQ ID NO: 448257 - RNA, 65 nt, Homo Sapiens
ggaccuuccacacagggugcuuccugccuacaaaauggagaaauauaacuucucugagucugaau

SEQ ID NO: 448258 - RNA, 65 nt, Homo Sapiens
aaauuugacuugggaaagggaaaccaacuggcucauggagaaaacuacaugacuuagggaacuug

SEQ ID NO: 448259 - RNA, 65 nt, Homo Sapiens
gaggagagaaaagagggccagugugcacauauguuuggagaaauauugccacucaguuccucugg

SEQ ID NO: 448260 - RNA, 65 nt, Homo Sapiens
guuuugcaaacugaaagaucagaucucauguuaaguggagaaaggaauaaugcugaagaccccaa

SEQ ID NO: 448261 - RNA, 65 nt, Homo Sapiens
gcaagucuagagucucagaaauugggaaggaaaaguggagaaaugcugagcugcucaccggaguc

SEQ ID NO: 448262 - RNA, 54 nt, Homo Sapiens
gcagaggaagagacaugagagggauggagaaaggaggaggaagaggaagaguga

SEQ ID NO: 448263 - RNA, 65 nt, Homo Sapiens
gccaauuuuuaaaaacugcauaguuuuauuaagcauggagaaauuaaacauuauaccucuucuga

SEQ ID NO: 448264 - RNA, 65 nt, Homo Sapiens
gacagauuuaugcagcuauuuuggaguccaggggcuggagaaaaguaguuuucuucuaaccccug

SEQ ID NO: 448265 - RNA, 65 nt, Homo Sapiens
aagaucacgaaggugugcaaauuauauugacaagauggagaaagcuuuuccugaaguuuuauucc

SEQ ID NO: 448266 - RNA, 65 nt, Homo Sapiens
aaggaaggcggaagaauggaccuaucaggugguuuuggagaaaacucagaaaucaggacaucccc

SEQ ID NO: 448267 - RNA, 65 nt, Homo Sapiens
ggauccucuaaacugcagaucugcgauguggacacuggagaaaguaggccugggguggguaaguc

SEQ ID NO: 448268 - RNA, 65 nt, Homo Sapiens
cuguggucuccucaggauguuuacacaguaaagaguggagaaagaaugaauuguugaguuuauuu

SEQ ID NO: 448269 - RNA, 65 nt, Homo Sapiens
uuggaccauuauuuauaaucaggguagcauuaaaauggagaaaagaaaguuuucugaaaaaaugc

SEQ ID NO: 448270 - RNA, 65 nt, Homo Sapiens
aaccuggucugauuccuuccaacgugcacuucagcuggagaaagaaaccaagaagggaagcggcc

SEQ ID NO: 448271 - RNA, 65 nt, Homo Sapiens
uccagggugacucuccaaagaaauuggccuucagcuggagaaaacauuggguggagacucucacu

SEQ ID NO: 448272 - RNA, 65 nt, Homo Sapiens
ccuuguauugugauauuaacuggcaaagauccucuuggagaaaccuuucccagguacaguuucaa

SEQ ID NO: 448273 - RNA, 65 nt, Homo Sapiens
uaaugaagcugauuuuuuagcugagauagaagcuuuggagaaaaugaaugaagaucacguucaga

SEQ ID NO: 448274 - RNA, 65 nt, Homo Sapiens
uucguuuuuguuucccuuuaguauuuaauggucuuuggagaaaaaauaauaaaacagaguguuau

SEQ ID NO: 448275 - RNA, 65 nt, Homo Sapiens
cauucuucuuauucuagaggucucucuggaaaagauggagaaaaugaacaggacauggggcuccu

SEQ ID NO: 448276 - RNA, 65 nt, Homo Sapiens
uccggcugugaagucacugaacagaacgucgcugauggagaaagggcucccgcagaaggaacggc

SEQ ID NO: 448277 - RNA, 65 nt, Homo Sapiens
auucaaagaucugccaaauauauacuguuauguucuggagaaaauccugaauuugcaaccucugg

SEQ ID NO: 448278 - RNA, 57 nt, Homo Sapiens
ggagacucagaagaggacauauaucaguggagaaaauuacuuuuauuauuuggauga

SEQ ID NO: 448279 - RNA, 65 nt, Homo Sapiens
cccuuugucuuaugcccaaacaguaagaauucauauggagaaagucaccaguuaauucugggaua

SEQ ID NO: 448280 - RNA, 65 nt, Homo Sapiens
guccacucacagauuguucuaaauagaaaguuugcuggagaaagcccuacuauuuaguuauucua

SEQ ID NO: 448281 - RNA, 65 nt, Homo Sapiens
uugccacauauucggacuuauuugcucaaucuuucuggagaaaguuugugcccuugaaaaugcug

SEQ ID NO: 448282 - RNA, 65 nt, Homo Sapiens
agacuucagacccucagaccugccccggggccagguggagaaagugagggccguacaaggaagug

SEQ ID NO: 448283 - RNA, 65 nt, Homo Sapiens
gcccuggacucaggcuggcagaggggcuggugcccuggagaaaauaaagagaaggcuggagagaa

SEQ ID NO: 448284 - RNA, 65 nt, Homo Sapiens
aagcgucuuaauguucaaaacgccucucuuuggucuggagaaaaaaaaaaaaaaaaaaaaacaac

SEQ ID NO: 448285 - RNA, 65 nt, Homo Sapiens
caggguggugagauccauccacgauccagcuccgguggagaaagggcccaugucaagccuuguuc

SEQ ID NO: 448286 - RNA, 65 nt, Homo Sapiens
uagugguuccaucuuuaaggaagaagaauguuugauggagaaaauuuguggccaaugaagucuga

SEQ ID NO: 448287 - RNA, 65 nt, Homo Sapiens
uucuguuucuuucaacuacgugaaaggauucacaguggagaaagacccuguaagauaauuggcuu

SEQ ID NO: 448288 - RNA, 65 nt, Homo Sapiens
gccucgcaccuucaaaugcauggaaggacucacacuggagaaaaacccuaugaauguaagcagua

SEQ ID NO: 448289 - RNA, 65 nt, Homo Sapiens
uuccaguuccuuucgauaucuaaaaggacucacaguggagaaaaacucuaugaguguaagcaaug

SEQ ID NO: 448290 - RNA, 65 nt, Homo Sapiens
caugaaaggacacaaacacacauaagaauacacucuggagaaagaccuuauaaauguaagacaug

SEQ ID NO: 448291 - RNA, 65 nt, Homo Sapiens
uuuaguuccuuucaaauacaugaaagaacucaucauggagaaaaccaaacaaaugcuuuuuggaa

SEQ ID NO: 448292 - RNA, 65 nt, Homo Sapiens
gagcaucguggaugggugcacggagacacgcaccuuggagaaaugaggggagauggaccaagaaa

SEQ ID NO: 448293 - RNA, 64 nt, Homo Sapiens
cuguuuuguacaauuauuuuuuaaaaguaaacguguggagaaagaauccgggcuucuugguuua

SEQ ID NO: 448294 - RNA, 65 nt, Homo Sapiens
uugucacacuucauuguagguaagauaauucauacuggagaaaacgccuacaugugugaacaaua

SEQ ID NO: 448295 - RNA, 65 nt, Homo Sapiens
uuuucaaaccuuacuaaacauaagauaacucauacuggagaaaaaucuuacaaaugugaagaaug

SEQ ID NO: 448296 - RNA, 50 nt, Homo Sapiens
uuacuaaacauaauucauaauggagaaaaacccuacaaaugugaagaaug

SEQ ID NO: 448297 - RNA, 65 nt, Homo Sapiens
uugucacacuugauuguagguaagauaauucauacuggagaaaacuaccagugugaacaacgugg

SEQ ID NO: 448298 - RNA, 65 nt, Homo Sapiens
ccuggccuugugacagcuccccaaguguucuccgguggagaaacugcagaggacuggugggcggg

SEQ ID NO: 448299 - RNA, 65 nt, Homo Sapiens
aguucaaaccuuacuguacaucagagaauucauacuggagaaaagccauauaaauguagugagug

SEQ ID NO: 448300 - RNA, 65 nt, Homo Sapiens
caauaaaauugcugggaauauuugacucuccguauuggagaaaauaaaauuacaacauuacgaca

SEQ ID NO: 448301 - RNA, 65 nt, Homo Sapiens
cuaaggcaguggcaaagguagaacucaggcagggguggagaaaaggcguuggucgcagugauugg

SEQ ID NO: 448302 - RNA, 65 nt, Homo Sapiens
caccugaggucaggaguucaagaccagccucaacauggagaaaccccaucucuacuaaaaauaca

SEQ ID NO: 448303 - RNA, 65 nt, Homo Sapiens
cugagguccggauuucaagaccagcaugaccaacauggagaaaccccgucucuacuaaaaauaca

SEQ ID NO: 448304 - RNA, 65 nt, Homo Sapiens
acgaugacuccuggauucuccuuccugggugggccuggagaaagaggcugguguuaccugagauc

SEQ ID NO: 448305 - RNA, 65 nt, Homo Sapiens
aaucagcaaacaaaacagauguauagauuagaguguggagaaaacagaggaaaacuugcaguuac

SEQ ID NO: 448306 - RNA, 65 nt, Homo Sapiens
cuugcuuacaaaugucuaagguccccacugccugcuggagaaaaaacacacuccuuugcuuaacc

SEQ ID NO: 448307 - RNA, 65 nt, Homo Sapiens
caacauauuguggcuggacagcaggcaguacacacuggagaaagacugaaugccgugaacguggg

SEQ ID NO: 448308 - RNA, 65 nt, Homo Sapiens
agcuguacacugaagagucaucagagaguucacacuggagaaagaccuuuugaaugcagcauuug

SEQ ID NO: 448309 - RNA, 65 nt, Homo Sapiens
aacucaaaucauauuagacaucggagaaaucacuuuggagaaaggucuuuugagugcacugagug

SEQ ID NO: 448310 - RNA, 65 nt, Homo Sapiens
agcuccacacucauuagucaugagagaguucauacuggagaaaagccuuaugagugcagugaaug

SEQ ID NO: 448311 - RNA, 65 nt, Homo Sapiens
aggccuaacccuauucaacaccagaaaguuuacacuggagaaaggccuuagggugacagguuaug

SEQ ID NO: 448312 - RNA, 65 nt, Homo Sapiens
auuggggaaggcaggguuuuguauuguccagucccuggagaaaaucaugaaaugccugaguucau

SEQ ID NO: 448313 - RNA, 65 nt, Homo Sapiens
agguccaaccucauucaccaucagcgaguucauacuggagaaaggcaugagugcgggcagugugg

SEQ ID NO: 448314 - RNA, 65 nt, Homo Sapiens
aaaucuagccuuauuauacaucugagaguucacacuggagaaaggccuuaugagugcagugacug

SEQ ID NO: 448315 - RNA, 65 nt, Homo Sapiens
aacuccagccuuauuaaacacuugagaguucacacuggagaaaggccauaugaaugcauugauug

SEQ ID NO: 448316 - RNA, 65 nt, Homo Sapiens
ucaccugacguagagaguccaaggccugacaaacauggagaaaugucaucccuauuuaaaaaaau

SEQ ID NO: 448317 - RNA, 65 nt, Homo Sapiens
cgguugugacucauugaacaucagaggacauauccuggagaaaagcccuacgaaugcauugauug

SEQ ID NO: 448318 - RNA, 65 nt, Homo Sapiens
agaucggacugggguucccgauuuauuucuaggccuggagaaaggggccacugagacacaaaccu

SEQ ID NO: 448319 - RNA, 65 nt, Homo Sapiens
ccuaggaauguaaucaguguaugagagaacuuauauggagaaaccgauucuucucuuucuuguau

SEQ ID NO: 448320 - RNA, 65 nt, Homo Sapiens
cccuaugaauguaaaaaaugugaaagaacucacacuggagaaaaaucuguagguuuucaagcaca

SEQ ID NO: 448321 - RNA, 65 nt, Homo Sapiens
ucuagccagauuggagauacagacaguagucauuguggagaaacagagcgcuucggugaaaguaa

SEQ ID NO: 448322 - RNA, 65 nt, Homo Sapiens
cuauuuugagccaugggguuuuuaauguuguacuguggagaaaaauugauacuauuuuuuuuucu

SEQ ID NO: 448323 - RNA, 65 nt, Homo Sapiens
cccugcaaauguaauaaauuucagggaauucagauuggagaaaaauacuuaaacuuuguucaaca

SEQ ID NO: 448324 - RNA, 65 nt, Homo Sapiens
uucuacaugugugaacaguguaagguaaguuauacuggagaaaacuugucacacuugauuguagg

SEQ ID NO: 448325 - RNA, 65 nt, Homo Sapiens
uacuagaauaaacaaugugggguaagauaauauacuggagaaaacggcugucacacuugauugua

SEQ ID NO: 448326 - RNA, 65 nt, Homo Sapiens
cucuaugaauagaauauacuugggaaaaauaauguuggagaaauaggacuacagcuuauucagcc

SEQ ID NO: 448327 - RNA, 65 nt, Homo Sapiens
ccaucucuacuaaaaauacaccagccugaccaacauggagaaagccugaguuugggaguuugaga

SEQ ID NO: 448328 - RNA, 65 nt, Homo Sapiens
auguucugcugcguccccacuagaaaacagcaagauggagaaauaucauguccccaacucaaggc

SEQ ID NO: 448329 - RNA, 65 nt, Homo Sapiens
cuuuccucuggcaaaccccuugagagaguucacacuggagaaauaaaaauaaaacuucaacagau

SEQ ID NO: 448330 - RNA, 65 nt, Homo Sapiens
cuuugcaaguauaaugaauguacaauaauuuauacuggagaaaaacauuaaagccuuguaagaca

SEQ ID NO: 448331 - RNA, 65 nt, Homo Sapiens
acauacaaauguaagguuugcaggagaauucauacuggagaaaaaacaaaucacagcuugaaaga

SEQ ID NO: 448332 - RNA, 65 nt, Homo Sapiens
ccauagaaauguaagguuuguaggagaauucacacuggagaaaagcaaauccagcuucaaauaca

SEQ ID NO: 448333 - RNA, 65 nt, Homo Sapiens
ccaauuguacuaaaaauacaccagccugaccaacauggagaaacccugaggucgggaguucgaga

SEQ ID NO: 448334 - RNA, 65 nt, Homo Sapiens
cuugaagaauguaaugccagcuuacuucucccucuuggagaaagauaggcuaauugugacuguga

SEQ ID NO: 448335 - RNA, 65 nt, Homo Sapiens
ccgucucuacuaaaaaaaaaccauccuggcuaacguggagaaaccgcgaggucaggagaucgaga

SEQ ID NO: 448336 - RNA, 65 nt, Homo Sapiens
guaggcugacucaggaaacaauaaugaccaaaaaauggagaaaaacaaaaaaaaaaccggauaga

SEQ ID NO: 448337 - RNA, 65 nt, Homo Sapiens
ccucuagaaacauauuggcuuggguucaagagaguuggagaaaccuguacuuguaccuaaggccc

SEQ ID NO: 448338 - RNA, 65 nt, Homo Sapiens
cauuccaaauauaacuauuaucagagaacucaugcuggagaaagauggaaggcauuccaucaaca

SEQ ID NO: 448339 - RNA, 65 nt, Homo Sapiens
ccuugaguacacagugaaugaaucuguuagcacccuggagaaaguuaugaguggcaaauguggaa

SEQ ID NO: 448340 - RNA, 65 nt, Homo Sapiens
ccuuaugagugcugucaauccaggagaguucauacuggagaaaggacaucccgucucauuaaaca

SEQ ID NO: 448341 - RNA, 65 nt, Homo Sapiens
aaaugugguuuucuuuggggguugaaaguggaugauggagaaauaaugugcacauauggauguau

SEQ ID NO: 448342 - RNA, 65 nt, Homo Sapiens
ccaaccaccuugaaaccuuuagaacaucucugcuuuggagaaagacccagagaucaggcagaggu

SEQ ID NO: 448343 - RNA, 65 nt, Homo Sapiens
agauguuaaaacagucccguggaaggagcagggguuggagaaaggcaucccaaagcuucgaugga

SEQ ID NO: 448344 - RNA, 65 nt, Homo Sapiens
cucucagagacucccaggaguuguugaacuauauuuggagaaaacagccacugaauauuaucauu

SEQ ID NO: 448345 - RNA, 65 nt, Homo Sapiens
uuuucagaaagcacgaaaaauuauuuauaauagucuggagaaaaaacacacuguaauauuucaag

SEQ ID NO: 448346 - RNA, 65 nt, Homo Sapiens
ugggguaaaugcuuugaggcccagggaccaaucuuuggagaaaguagauauuuccaucaaagcca

SEQ ID NO: 448347 - RNA, 65 nt, Homo Sapiens
acuuaaucucucuggccucaauuuccuggugaauguggagaaaaauaauagugcccuucccaugg

SEQ ID NO: 448348 - RNA, 65 nt, Homo Sapiens
cugcagcgccaagcggcauccaccaagcaucaaguuggagaaaagggaacccaagcaguagagag

SEQ ID NO: 448349 - RNA, 65 nt, Homo Sapiens
agauguuauguaauaugcugagguggcgaccucaguggagaaauguaaagacugaauugaauuuu

SEQ ID NO: 448350 - RNA, 65 nt, Homo Sapiens
ucuagguuuccaggccucacagccaagcugaagcuuggagaaaacucugcauucccaugagggca

SEQ ID NO: 448351 - RNA, 65 nt, Homo Sapiens
ccugacccuccauguccugcccucaaaaaacuggguggagaaauaauuguuucuuuaaaggauau

SEQ ID NO: 448352 - RNA, 65 nt, Homo Sapiens
accuuugcaguguugccgaaucacagcaguucuguuggagaaacgcuugguuuccggauccagag

SEQ ID NO: 448353 - RNA, 65 nt, Homo Sapiens
uuggguugucagccauggacauggauuucaaccccuggagaaaacgaugucauuguucagcagcu

SEQ ID NO: 448354 - RNA, 65 nt, Homo Sapiens
cugaggucgggaguucgagaccagccugaccaacauggagaaaccccgucccuacuaaaaauaca

SEQ ID NO: 448355 - RNA, 65 nt, Homo Sapiens
ccgucucuacuaaaaauacaccagccugaccaacauggagaaacccugagguugggaguucaaga

SEQ ID NO: 448356 - RNA, 65 nt, Homo Sapiens
agaugucuuauccuggguccccaggggucaccacguggagaaaguagagauugaguuccuggaag

SEQ ID NO: 448357 - RNA, 65 nt, Homo Sapiens
aacucaccuucuauuuacucuguuaauuucaagacuggagaaauauaauuuguuuucuugaaaau

SEQ ID NO: 448358 - RNA, 65 nt, Homo Sapiens
ccaucucuacuaaaaauacaccagccugaccaacauggagaaacccggaggucaggaguucgaga

SEQ ID NO: 448359 - RNA, 65 nt, Homo Sapiens
ucaagagggaaucaucuggcucccuaauacugauguggagaaagcuuucugacccuacaaacagg

SEQ ID NO: 448360 - RNA, 65 nt, Homo Sapiens
gaauuauccccacuucacaguguuuggccuuguguuggagaaagaccuguacaugaaccagguca

SEQ ID NO: 448361 - RNA, 65 nt, Homo Sapiens
ggccccaaaaggugggaacuuccccauuuuauagauggagaaacuaacucuuaaguuaggcauua

SEQ ID NO: 448362 - RNA, 65 nt, Homo Sapiens
ggcucugagauuucacagguugccuguucuccagauggagaaacaggagcuggcaaugcccuacc

SEQ ID NO: 448363 - RNA, 65 nt, Homo Sapiens
ccgcaugaagauacuuguaacuuggugguugaacuuggagaaagaaccugccagcucucggaguc

SEQ ID NO: 448364 - RNA, 65 nt, Homo Sapiens
uaacauauuuauugggauuuuaagcaauauugugauggagaaaaacuugccggcucuuauuuuuc

SEQ ID NO: 448365 - RNA, 65 nt, Homo Sapiens
ggccaagauuuuucugcacaugggcuccucaaagcuggagaaagaaccccucagcucggaggcug

SEQ ID NO: 448366 - RNA, 65 nt, Homo Sapiens
agaagcggauaguguuuauggagaauggguuccuguggagaaaaauggugaagaaaacaaagaug

SEQ ID NO: 448367 - RNA, 65 nt, Homo Sapiens
cauaagaguaacaaaaaggaccagccugaccaacguggagaaacucugucucuacuaaaaauaca

SEQ ID NO: 448368 - RNA, 65 nt, Homo Sapiens
uuacaaacacgggcggaaggcacucaggcuuucguuggagaaacagaaauaaggccuucuuuuga

SEQ ID NO: 448369 - RNA, 65 nt, Homo Sapiens
cugaggucaggaguuugagaccagacugaccaacauggagaaaccccaucucuacuaaaauacaa

SEQ ID NO: 448370 - RNA, 65 nt, Homo Sapiens
auagagguagguugaguuuucuaggggaaaacaaauggagaaaagaggcaugaagaaaaguaaac

SEQ ID NO: 448371 - RNA, 65 nt, Homo Sapiens
agagguuuucuuaauuaacaaaaggacguaugccauggagaaacacacccgcgcacacagcugcu

SEQ ID NO: 448372 - RNA, 65 nt, Homo Sapiens
ccaaagaugaauccuucacuuuauuuuagaaugaauggagaaaugaaaauguuuguugaaguauc

SEQ ID NO: 448373 - RNA, 65 nt, Homo Sapiens
auuucugaggagugugugauuucccuacagauuuuuggagaaaggguaggaagaaaaaggaugca

SEQ ID NO: 448374 - RNA, 65 nt, Homo Sapiens
ggucagaaugaucugucagaauccauaaaguucccuggagaaauuggaaucuucucugaaaacua

SEQ ID NO: 448375 - RNA, 65 nt, Homo Sapiens
ugaaggaaaaaauuauguuugaccugcaaaaaugcuggagaaaaacagcacauguuaccaugucu

SEQ ID NO: 448376 - RNA, 65 nt, Homo Sapiens
augaagagguauucaucuguagaacgacuucacguuggagaaagcaaacucauucuuacgaaauu

SEQ ID NO: 448377 - RNA, 65 nt, Homo Sapiens
ggaaguaguagaauucagaaaaggacacagcguaauggagaaaggccaaacccaguguuaggaga

SEQ ID NO: 448378 - RNA, 65 nt, Homo Sapiens
aauuuuuauggguuuuuuugaaaacugagagauaauggagaaaauagcuucucaaguuaugaaau

SEQ ID NO: 448379 - RNA, 65 nt, Homo Sapiens
ccuggagaaggguguccccacgcugaccugaggucuggagaaaccagccggaggaacgggcaggc

SEQ ID NO: 448380 - RNA, 65 nt, Homo Sapiens
cucgcugggaccuggucccuuuguugcaggcggcuuggagaaagggcagugggacgcuggccacg

SEQ ID NO: 448381 - RNA, 65 nt, Homo Sapiens
ccaggaagggguguccaggacaauuaccuuccuucuggagaaacuucccuuaaucaaauaagaga

SEQ ID NO: 448382 - RNA, 65 nt, Homo Sapiens
gcaaugagaaggccaggaaaagaaagagcugaaaauggagaaagcccaagaguuagaacaguugg

SEQ ID NO: 448383 - RNA, 65 nt, Homo Sapiens
gcacccuuggguuggcaauagaaggugacauggaauggagaaaaccaagauuccagauggggaua

SEQ ID NO: 448384 - RNA, 65 nt, Homo Sapiens
ggcugugcuggggccagacucauaccaggagucacuggagaaaggcugggccagaagcuguugac

SEQ ID NO: 448385 - RNA, 65 nt, Homo Sapiens
ucucccuuuuuccuugauuucuguagacauaggucuggagaaauccaaggaauccgccaucuugg

SEQ ID NO: 448386 - RNA, 65 nt, Homo Sapiens
ccuggaacugccaaaacaaaccaagucccuccugcuggagaaaagcacuugcuggacagucugag

SEQ ID NO: 448387 - RNA, 65 nt, Homo Sapiens
cccuccagucugagagcaggcuggggccaggcgaguggagaaacgacccgaucucuuccuuugug

SEQ ID NO: 448388 - RNA, 65 nt, Homo Sapiens
cacaguuagaacuguuggauagaaagagcugaaaauggagaaagcgcaaugagaagaccaggaaa

SEQ ID NO: 448389 - RNA, 65 nt, Homo Sapiens
cagaguuagaacuguuggauagaaagagcugaaaauggagaaaacgcaaugagaaggccaggaaa

SEQ ID NO: 448390 - RNA, 65 nt, Homo Sapiens
ggcccuguuacuauuccuuugggacccagggcgccuggagaaagagcuggagggagaagcuguca

SEQ ID NO: 448391 - RNA, 65 nt, Homo Sapiens
ccaucucuacuaaaaauacaccagccuggccaacauggagaaaccuugaggucaggaguucaaga

SEQ ID NO: 448392 - RNA, 65 nt, Homo Sapiens
cccucccacggugcccaaacgacgggcacacagacuggagaaaacacuccauggcuaagaccaca

SEQ ID NO: 448393 - RNA, 65 nt, Homo Sapiens
ccucuuuaaaugaacaaguaaugauguguauuuccuggagaaauucgguucuuaauacugaaguc

SEQ ID NO: 448394 - RNA, 65 nt, Homo Sapiens
gaaagcuccaucaaagaggaaaauucggcaagacuuggagaaaagcaucaaugcuuuuccucagg

SEQ ID NO: 448395 - RNA, 65 nt, Homo Sapiens
ccagcugcccuuucguccccccuacagcugaagguuggagaaaugucuuuuccaaguucccaagg

SEQ ID NO: 448396 - RNA, 65 nt, Homo Sapiens
cucuaggccauccccucuuccucuccagcucugaauggagaaacuaauacccuucccuucaacaa

SEQ ID NO: 448397 - RNA, 65 nt, Homo Sapiens
ugucuugaaaauaaacugcuagaauaaagaaaugcuggagaaauugauuauaagagacuauagcu

SEQ ID NO: 448398 - RNA, 65 nt, Homo Sapiens
acagucuuuuuauuguggauugugaaaucaaaaucuggagaaaugcuuauaaaauauacuacuag

SEQ ID NO: 448399 - RNA, 65 nt, Homo Sapiens
uuuuuauuucagucacuccugauaaauaacaaauuuggagaaauaaaaauaucuaaaauaaauuu

SEQ ID NO: 448400 - RNA, 65 nt, Homo Sapiens
caaucaacaaaacuuuguuuuaaauauuguaauuguggagaaaaguaaacuuauaagcagaacuu

SEQ ID NO: 448401 - RNA, 65 nt, Homo Sapiens
aaccccugcauucugcucugcucuaauacacuaccuggagaaagucuuuuccuuauuuucaauaa

SEQ ID NO: 448402 - RNA, 65 nt, Homo Sapiens
ggugaaagcguuccguagcucgcucuaugaaggccuggagaaaccagaauccaagaccuccauuc

SEQ ID NO: 448403 - RNA, 65 nt, Homo Sapiens
guuuucguagcucaccaauguugagcaugaaucccuggagaaaucugcauauacaugaauauacc

SEQ ID NO: 448404 - RNA, 65 nt, Homo Sapiens
aaaauuauuucuuggggaugaaucagauuuuaccuuggagaaaugacucaaugaaauaagcugcu

SEQ ID NO: 448405 - RNA, 65 nt, Homo Sapiens
gaagaauaggccuguuuaauaguucccuacaagcauggagaaaaugauuggugaagacagacacc

SEQ ID NO: 448406 - RNA, 65 nt, Homo Sapiens
uggacugaucuuuaaacuauaguuagggguuuuguuggagaaaaaugcaauuuuuaaaaucuaga

SEQ ID NO: 448407 - RNA, 65 nt, Homo Sapiens
caaguuauauguucacaaaaagcagccaauuuuauuggagaaaaguugccuucuuugccuagcca

SEQ ID NO: 448408 - RNA, 65 nt, Homo Sapiens
gaugagaauuagcuaacauucugcaaggauaaauguggagaaaauuaaauauaugaacaaaaaag

SEQ ID NO: 448409 - RNA, 65 nt, Homo Sapiens
aaauuggacaaauccucaccaagacuaauuaaacauggagaaaccaucgucagaggagggugagg

SEQ ID NO: 448410 - RNA, 65 nt, Homo Sapiens
aaguaccaauuugaagggauuucucuuccuuuagguggagaaacaugcuguuauuuuagucuuua

SEQ ID NO: 448411 - RNA, 65 nt, Homo Sapiens
uaucuguaagaguguuuauauuugauugucaaugcuggagaaaaauuugguauccuuaucuagug

SEQ ID NO: 448412 - RNA, 65 nt, Homo Sapiens
ggccaguuuaaauaggcuuuuuaucaguuuugguguggagaaagagcucauaaucagucuccuuu

SEQ ID NO: 448413 - RNA, 65 nt, Homo Sapiens
acucaccucaggcuuacaaaauccugugcagcagcuggagaaagcugcuguuuuguauaguuacu

SEQ ID NO: 448414 - RNA, 65 nt, Homo Sapiens
auugagccuuaaacaaauggaaaagaaaguuauaauggagaaaaauuaccuacucaaugccuuuu

SEQ ID NO: 448415 - RNA, 65 nt, Homo Sapiens
gcuaggacagggaacagggagccugaguacaggcuuggagaaaugcucuguugaucacagaggga

SEQ ID NO: 448416 - RNA, 57 nt, Homo Sapiens
aaauuggacaaaucaucaccucacacauggagaaaccaggacaguggggaggauuag

SEQ ID NO: 448417 - RNA, 57 nt, Homo Sapiens
aaauuggacaaauccucacuucaaacauggagaaaccaggaggguggggaggacuag

SEQ ID NO: 448418 - RNA, 65 nt, Homo Sapiens
aguuucuuuagcugacagaaaacugccaaguuggguggagaaagggaggguaauaaccagacaca

SEQ ID NO: 448419 - RNA, 65 nt, Homo Sapiens
guuuuuaacugcaacuuucuuuugucuuuuuauuuuggagaaagcuguauaugcuggguauuuca

SEQ ID NO: 448420 - RNA, 65 nt, Homo Sapiens
aucauccagaagcacugugauauuguguaagcaucuggagaaaauucaguuaaaagaauaaaagu

SEQ ID NO: 448421 - RNA, 65 nt, Homo Sapiens
ucgccgcuagucuuaugagcuaucuacuaaaacuauggagaaacuuuguaugugcacacaaaagu

SEQ ID NO: 448422 - RNA, 63 nt, Homo Sapiens
ccuaugggugacugccuucucccagaguuuucuuuggagaacagaaagaagaaaggaaagaaa

SEQ ID NO: 448423 - RNA, 63 nt, Homo Sapiens
guuucugaaaccgcucagauguuuuggggaaaguuggagaagccguggccuugcgagaggugg

SEQ ID NO: 448424 - RNA, 63 nt, Homo Sapiens
gacccgggcaggcccccagcaccccaugcugacuuggagaaccccagaucucuggggcccagc

SEQ ID NO: 448425 - RNA, 63 nt, Homo Sapiens
cagacaccggggcuggguuucucuuuccucuuuuuggagaaaaggaacagggcaguggaauga

SEQ ID NO: 448426 - RNA, 63 nt, Homo Sapiens
aacccuuuccuccucccauuuugacauuugcacuuggagaacacuugaguugugaagguuuug

SEQ ID NO: 448427 - RNA, 63 nt, Homo Sapiens
uggaggggagagaaggauucuagggguguggaguuggagaaagaggcuuccuugagccacccu

SEQ ID NO: 448428 - RNA, 63 nt, Homo Sapiens
cauuaggaaacaauggcagucaaacccauggcuuuggagaaaguaaauguuugccagaaagga

SEQ ID NO: 448429 - RNA, 63 nt, Homo Sapiens
ugcuggugcggauggacacuaaugcagccacgauuggagaauacuuugcuucauaguauugga

SEQ ID NO: 448430 - RNA, 63 nt, Homo Sapiens
ucagagcaaacaucauguagauagcacaaguauuuggagaaacguuguuuguuuuguuaccaa

SEQ ID NO: 448431 - RNA, 63 nt, Homo Sapiens
uaauuuaaaauaauuauuguauaauaucuacauuuggagaauuuugaacuaucaagcauauac

SEQ ID NO: 448432 - RNA, 63 nt, Homo Sapiens
gacgguaaaggcacuaaagucacuuuaaagcuuuuggagaagcaggagggcauuggcuuaacc

SEQ ID NO: 448433 - RNA, 63 nt, Homo Sapiens
aaucugaaggacuucaucucccgcuuugagggcuuggagaagaucucugccuacaugaagucc

SEQ ID NO: 448434 - RNA, 63 nt, Homo Sapiens
ccuggcauggacugauguuuuuaggcacagaaguuggagaagagauuucaugaaagacaacau

SEQ ID NO: 448435 - RNA, 63 nt, Homo Sapiens
uguguuuucagaauuuccauuucuacuaaccucuuggagaaaaagaaauugaauuagagguaa

SEQ ID NO: 448436 - RNA, 63 nt, Homo Sapiens
ccuaaaagcuggagacacagauguccagagugauuggagaauguccugggggaaugaaguucc

SEQ ID NO: 448437 - RNA, 63 nt, Homo Sapiens
ucccugaggcuuuggggucagaguauauguuguuuggagaaagagggcaaucaggacucuucu

SEQ ID NO: 448438 - RNA, 63 nt, Homo Sapiens
ucuggccuggcuuucccucucagacauagcucuuuggagaacuagguguuguaauucaguuau

SEQ ID NO: 448439 - RNA, 63 nt, Homo Sapiens
auugucaaaacuaccaauuccagguuaacuuuguuggagaauuucccccacccccauccagug

SEQ ID NO: 448440 - RNA, 63 nt, Homo Sapiens
gcugguuccccagcccuuuucccuggcccuggcuuggagaaucuguuuucaaucuccacugau

SEQ ID NO: 448441 - RNA, 63 nt, Homo Sapiens
uuggaggcaggauccaggcacagcuccccucacuuggagaaccuugacucucuugauggaaca

SEQ ID NO: 448442 - RNA, 63 nt, Homo Sapiens
uaaaacacugucuuuucaggauugcuucauggauuggagaacuuucuaaccaaaaauuaaaaa

SEQ ID NO: 448443 - RNA, 63 nt, Homo Sapiens
gacuuaguaccagaaccaaaaauaccuagauuuuuggagaacuuauuacauacauagaaacau

SEQ ID NO: 448444 - RNA, 63 nt, Homo Sapiens
aacccagccuacucuagaauuucagcagugacauuggagaauauuuuuaauuugcugcaguac

SEQ ID NO: 448445 - RNA, 55 nt, Homo Sapiens; identical to SEQ ID NO: 445050

SEQ ID NO: 448446 - RNA, 63 nt, Homo Sapiens
gcaaggagagaagugagagcuacaauuccagcauuggagaagcgaggggcggggcgucaacgg

SEQ ID NO: 448447 - RNA, 63 nt, Homo Sapiens
ggggcuaguuuggcuuuuccaaguggguuuucuuuggagaaucugaugccaugcaauuggcau

SEQ ID NO: 448448 - RNA, 63 nt, Homo Sapiens
gucguagacuugugcaauauauacuguuguggguuggagaaaaguggaaagcuacacugggaa

SEQ ID NO: 448449 - RNA, 63 nt, Homo Sapiens
gguaggcaaauuguuaggcagaauaaugguauguuggagaaauacaccugucucuuauucuua

SEQ ID NO: 448450 - RNA, 63 nt, Homo Sapiens
ccuuugguaaauacaccauaccauaauaucugcuuggagaaccacaaugcacauuagcauauu

SEQ ID NO: 448451 - RNA, 63 nt, Homo Sapiens
auuaacuagcauuuagccagcuuuuucuugcccuuggagaaaaagaaucauucucaaccugau

SEQ ID NO: 448452 - RNA, 63 nt, Homo Sapiens
uucugcagcauggcuuuuuagaaaucuucauaauuggagaaaguuuauuuuaauacauuguag

SEQ ID NO: 448453 - RNA, 63 nt, Homo Sapiens
aaauuaacaauaaagaauuuaaaaauauaucuguuggagaaaguguggcuccauauuucaacu

SEQ ID NO: 448454 - RNA, 63 nt, Homo Sapiens
augcugagaauuuguauugaugggggagccuaauuggagaaugcauuagaaacaauugguuaa

SEQ ID NO: 448455 - RNA, 63 nt, Homo Sapiens
guucuguugcccugauuuauucuucuggucuccuuggagaaagcaaggcggcggcagagcugg

SEQ ID NO: 448456 - RNA, 63 nt, Homo Sapiens
cuucauaaaaucuaugaauauggaggauauauuuuggagaauguaaaacagacuuacucuccu

SEQ ID NO: 448457 - RNA, 63 nt, Homo Sapiens
cccuaucagcacagggaucuggcugucuggaaguuggagaauuguacgcaaagggcagcccca

SEQ ID NO: 448458 - RNA, 63 nt, Homo Sapiens
agaaaaaucuuggggcuuccuggacauuuuacuuuggagaaacaggaaagacauguaagagca

SEQ ID NO: 448459 - RNA, 63 nt, Homo Sapiens
gaugagcuacgccuugaugaguagcaugucaguuuggagaaaugcuuuuuggaagacauuucu

SEQ ID NO: 448460 - RNA, 63 nt, Homo Sapiens
gcaggagaguaccugggaauauuuacuuccuuguuggagaaggccugaguuaaaagucuauuu

SEQ ID NO: 448461 - RNA, 63 nt, Homo Sapiens
ucaaaccuucaagcccuaggucccuuguuacuguuggagaaaccuccagguggaagcaugcuu

SEQ ID NO: 448462 - RNA, 63 nt, Homo Sapiens
agaaagaaaggaaagaacucgauaucuguaucuuuggagaagguccauagaaaacuguagaaa

SEQ ID NO: 448463 - RNA, 63 nt, Homo Sapiens
cuugccuauaauucuauaaaaaguuaaguuuuauuggagaaauuauaguuuuauaacuggcuu

SEQ ID NO: 448464 - RNA, 63 nt, Homo Sapiens
gucauaaauuacuguuuugcacuaugcuaauuuuuggagaaauuuuuuacuguugaacuuaga

SEQ ID NO: 448465 - RNA, 63 nt, Homo Sapiens
ggucagaagccccaaacggcuaagaaaacugucuuggagaaugaucccauccuugccaaaaaa

SEQ ID NO: 448466 - RNA, 63 nt, Homo Sapiens
ggaaugugaaagcugucauuggauccuuuggguuuggagaaaguucuuggacuacuuuaauuu

SEQ ID NO: 448467 - RNA, 63 nt, Homo Sapiens
agauggaugcuuauugaagcuacucucuucuauuuggagaauaacaagccuuggguccauguu

SEQ ID NO: 448468 - RNA, 63 nt, Homo Sapiens
ucaggcuuuugauaaaugcuuuaagagaccgcauuggagaauuaaaaugccuuuucauugguc

SEQ ID NO: 448469 - RNA, 63 nt, Homo Sapiens
agugcuuuaguaguaguuuauuucucaggucauuuggagaacaccagagcugaggcaagggga

SEQ ID NO: 448470 - RNA, 63 nt, Homo Sapiens
uuuaaaaaacccagaaaaacaaguuuuaauguauuggagaagugugcuauguggcgagaaaaa

SEQ ID NO: 448471 - RNA, 63 nt, Homo Sapiens
cauaacauuugaagaucaaacccuguuaccuuuuuggagaauuagaccaaagggauaucuguu

SEQ ID NO: 448472 - RNA, 63 nt, Homo Sapiens
ugacagggcugguccaggccucaaugcacgaaguuggagaaccaggcacggacacacccaguc

SEQ ID NO: 448473 - RNA, 63 nt, Homo Sapiens
gcacccauaucugugugcccguggagugacuauuuggagaauaggaaggcggcaggcagagaa

SEQ ID NO: 448474 - RNA, 63 nt, Homo Sapiens
ggaaaucauaaaaucauccugcaaacaucacauuuggagaagaacacucuaucacauauuuaa

SEQ ID NO: 448475 - RNA, 63 nt, Homo Sapiens
agccauuauuuuagccacagauaucccuucuuuuuggagaacuuguauauauuacucugcacu

SEQ ID NO: 448476 - RNA, 63 nt, Homo Sapiens
cugaacuguuacaaaccccuuccccaugggaccuuggagaaaacuuccuguucugcaccccuc

SEQ ID NO: 448477 - RNA, 63 nt, Homo Sapiens
aguagucguaagauuaguuguucauuaggggacuuggagaaccaucaugagguuaaaauuuuc

SEQ ID NO: 448478 - RNA, 63 nt, Homo Sapiens
uaccagcagugugucaggugcugcagagcguucuuggagaaggcccacugaggcagguucgug

SEQ ID NO: 448479 - RNA, 63 nt, Homo Sapiens
accuggcauagagaaaaauauauaccugguacauuggagaaaaauaauuacacuuucaaagag

SEQ ID NO: 448480 - RNA, 63 nt, Homo Sapiens
guuguaaguggacaugcaaaccaaaauuggggauuggagaagucagacucacuagacuuuugg

SEQ ID NO: 448481 - RNA, 63 nt, Homo Sapiens
aauuccugucaaaaucaauucagaaauucuaacuuggagaauuuaacauuuuacucuuguaaa

SEQ ID NO: 448482 - RNA, 63 nt, Homo Sapiens
aucuugcaagcaaaucccauuucuugaaaagccuuggagaacucgguuugguagacuuggaca

SEQ ID NO: 448483 - RNA, 63 nt, Homo Sapiens
cagugauuuuguuccaaaacuuuguauacacauuuggagaaaaguacuuuauauuuucagugu

SEQ ID NO: 448484 - RNA, 63 nt, Homo Sapiens
ugcaagaaauauacugacaugaacaggcaguucuuggagaagaaagagcauuucuuuaaguac

SEQ ID NO: 448485 - RNA, 63 nt, Homo Sapiens
acuccagccugggcaacagagcaagacccugucuuggagaaaccagaauuuuggaagagcaaa

SEQ ID NO: 448486 - RNA, 63 nt, Homo Sapiens
gaguggcucuuugcaugaacacugugcaagguguuggagaaauccaaagcugaccaaaacaug

SEQ ID NO: 448487 - RNA, 63 nt, Homo Sapiens
ggccuucacgcucuugaucgucuuuccuuuguauuggagaaggacugggucagagaucuguug

SEQ ID NO: 448488 - RNA, 63 nt, Homo Sapiens
uguuuuuuacucuuuucucaugcacauguuacguuggagaaaauguuuacaaaaaugguuuug

SEQ ID NO: 448489 - RNA, 63 nt, Homo Sapiens
acugacaccucacugaggaagggagacauauucuuggagaacuuuccaucugcuuguauuuuc

SEQ ID NO: 448490 - RNA, 63 nt, Homo Sapiens
auaucaaguuuugaauauuauucaggaagcacuuuggagaaugugggaguccuacuguuuugc

SEQ ID NO: 448491 - RNA, 63 nt, Homo Sapiens
ggugagaagcaggcuggugagacugggcugagguuggagaaggggcagccgggggcacugcug

SEQ ID NO: 448492 - RNA, 63 nt, Homo Sapiens
cacuuuauucuuguauggcuuugguaggcauacuuggagaacauaucccacauuaggaauuga

SEQ ID NO: 448493 - RNA, 63 nt, Homo Sapiens
ccugagaguuugagggcuuuaauccuuuaaaacuuggagaagcuggcugggcgcgguggcuca

SEQ ID NO: 448494 - RNA, 63 nt, Homo Sapiens
auuuauuugaugacuuaauauuuuucacuaccuuuggagaacagaugaacauuauucaccaug

SEQ ID NO: 448495 - RNA, 63 nt, Homo Sapiens
ucaauuagcaguucaaauuaaagaagaugguuauuggagaacuuuuuugaaugguuuuguauu

SEQ ID NO: 448496 - RNA, 63 nt, Homo Sapiens
ugcaucuuuuuuccucugccauucuuguguugauuggagaauuuuucuguauguaauuagaaa

SEQ ID NO: 448497 - RNA, 63 nt, Homo Sapiens
uucuggauuucauacuguaacauucaggaauucuuggagaaaauggguuuauucacugaacuc

SEQ ID NO: 448498 - RNA, 63 nt, Homo Sapiens
cucggaaagccuuaagcaaagaugggaggauuuuuggagaauccaucaugauugguguaaaac

SEQ ID NO: 448499 - RNA, 63 nt, Homo Sapiens
ccucucaaaacaaacacccucuugcaaccagcuuuggagaaagcccagcuccugugugcucac

SEQ ID NO: 448500 - RNA, 63 nt, Homo Sapiens
ggcuggcccuguaauuuaaauuaaaauaaaauuuuggagaaacagcauugucugucuuuauga

SEQ ID NO: 448501 - RNA, 63 nt, Homo Sapiens
agggacacaaggacuugggugcaucaggacgccuuggagaagcguggcuuccugccacccugc

SEQ ID NO: 448502 - RNA, 63 nt, Homo Sapiens
gcagagagaggcaggaaggaucccugaagagucuuggagaaaagguucugugcccucaggugg

SEQ ID NO: 448503 - RNA, 63 nt, Homo Sapiens
aucugaaucacuggggauuaugauucacccucuuuggagaacaugcucucuuuucacccccca

SEQ ID NO: 448504 - RNA, 63 nt, Homo Sapiens
cuuauauuuaucgcuuggcucaaguucugcccuuuggagaaauacugagcaagucuuucauuc

SEQ ID NO: 448505 - RNA, 63 nt, Homo Sapiens
augugagauuuccacauuauaacaucuuugagauuggagaauuguuaaguauauaauaaauug

SEQ ID NO: 448506 - RNA, 63 nt, Homo Sapiens
ccgugugagaagugaaugcuggccgcugccacguuggagaagccagggccaugcugaggccug

SEQ ID NO: 448507 - RNA, 63 nt, Homo Sapiens
ucacaacccuucucuguuggaggccugggcugguuggagaagggucugcgaugcagcggcgug

SEQ ID NO: 448508 - RNA, 63 nt, Homo Sapiens
uucuguuugucucuuuucaugaggacuaccauuuuggagaagguugcacuacaccucuguugu

SEQ ID NO: 448509 - RNA, 63 nt, Homo Sapiens
gucuauccagguccuuugcccaugcguauuucuuuggagaaagcuuuuccugugcuuacgggc

SEQ ID NO: 448510 - RNA, 63 nt, Homo Sapiens
cagcccagcuuggcguggggguugagaauuccuuuggagaaaacagaaauucuguugaagaca

SEQ ID NO: 448511 - RNA, 63 nt, Homo Sapiens
gcacaaucaacuuuucugagaccaaguguggaauuggagaaaagacgcuacuaaccugacauc

SEQ ID NO: 448512 - RNA, 63 nt, Homo Sapiens
aagugaauuuacuucgacuuauucaguggcauuuuggagaacaagaauuuuuaaauaguauau

SEQ ID NO: 448513 - RNA, 63 nt, Homo Sapiens
auguaauuuugucuuuggaacaaaauaacauacuuggagaaguguuuguuuuuaucaaaaugu

SEQ ID NO: 448514 - RNA, 63 nt, Homo Sapiens
ugcauuaucuuaaaaggcaguucuguagcauacuuggagaaacuucuagagguuggcuuucaa

SEQ ID NO: 448515 - RNA, 63 nt, Homo Sapiens
ugaagaaaaaggcuggcugaucagagaagucaguuggagaaaaaguguuccucaccaauaacu

SEQ ID NO: 448516 - RNA, 63 nt, Homo Sapiens
ugugccuuucauucauuaccagcgguccucaaguuggagaaaagguaccgucuaguacuaugc

SEQ ID NO: 448517 - RNA, 63 nt, Homo Sapiens
aaugaaggugucaaagagucauagcacagcaguuuggagaagaaauaugccugcucaaaauua

SEQ ID NO: 448518 - RNA, 63 nt, Homo Sapiens
uacauucugaagcauccccaaggcuccaucuguuuggagaaaauggaaaaucacacaguuuuc

SEQ ID NO: 448519 - RNA, 63 nt, Homo Sapiens
uggaaauggauuggauugucaaauuauuauuuauuggagaaaaaaaccugaucuacacauuuu

SEQ ID NO: 448520 - RNA, 63 nt, Homo Sapiens
acuuaggaaauagugaauaaggugcauuuaacuuuggagaaauacuuuuauggcuuuggugga

SEQ ID NO: 448521 - RNA, 63 nt, Homo Sapiens
gguuuuugaacaggaaaaucauaauucauaucauuggagaaguauuuauuuucaaauaucaaa

SEQ ID NO: 448522 - RNA, 63 nt, Homo Sapiens
ggagucagagagaaucccuagucuucaagcagauuggagaaacccuugaaaagacaucaagca

SEQ ID NO: 448523 - RNA, 63 nt, Homo Sapiens
aaaugaaaaggacacauucugaaaucccuuuuguuggagaauaagucagucugaggggaaaug

SEQ ID NO: 448524 - RNA, 63 nt, Homo Sapiens
aauaaguccuagacuggacucuugagggacauauuggagaaucuuaagaaaugcaagcuuguu

SEQ ID NO: 448525 - RNA, 63 nt, Homo Sapiens
cccaggaaauuagcuuuccagccccuuuauauauuggagaaguuguuuuagcuucugcagaag

SEQ ID NO: 448526 - RNA, 63 nt, Homo Sapiens
cauuguucuugguuuuguuucucgaucuuuuguuuggagaacagcuggcuaaggaugacucua

SEQ ID NO: 448527 - RNA, 63 nt, Homo Sapiens
ucauuuguuccuuggaccuuaaucauuugcauuuuggagaaaauuuuuucugcuuuaaaaguc

SEQ ID NO: 448528 - RNA, 63 nt, Homo Sapiens
aguuuaggaauucuacuagccagagauagucacuuggagaaacuuucuauauauccuucuaaa

SEQ ID NO: 448529 - RNA, 63 nt, Homo Sapiens
aucuugaugucauuacuccugaauuauuacauuuuggagaauaagagggcauuuuauuuuauu

SEQ ID NO: 448530 - RNA, 63 nt, Homo Sapiens
uuugauccaagucaaguguagccucucagccuuuuggagaaaaaugaaacaauuuauuucaac

SEQ ID NO: 448531 - RNA, 63 nt, Homo Sapiens
gggcagagcccugacccacagcuguguuacugcuuggagaagcauauguaggggcauacccug

SEQ ID NO: 448532 - RNA, 63 nt, Homo Sapiens
auuuaaaguugccugaagauuuugcugugguguuuggagaagcagagggugaacuugcuguug

SEQ ID NO: 448533 - RNA, 63 nt, Homo Sapiens
auuugcucagcuuuuugaaauguuaagauguguuuggagaaggcugcaugacuuuguuuuucc

SEQ ID NO: 448534 - RNA, 63 nt, Homo Sapiens
uaggcagcagccaccuucucaggaaacaaggccuuggagaaaucagugccugugugaagaugg

SEQ ID NO: 448535 - RNA, 63 nt, Homo Sapiens
cuggaccuuccauucuagaauuaugagaccaccuuggagaaaggugugugguacaugacauug

SEQ ID NO: 448536 - RNA, 63 nt, Homo Sapiens
ucucuguuugccuuggguugaauaacuuaucuuuuggagaauagcuuuaaguggcuuagacac

SEQ ID NO: 448537 - RNA, 63 nt, Homo Sapiens
aaguuggaugacacuacucccaacuuuuuaaauuuggagaaaaccaucaaggucgaggaagcc

SEQ ID NO: 448538 - RNA, 63 nt, Homo Sapiens
gaaauugcuagauuacccaaagaaauagaucaguuggagaaaauacaaaacaauucaaagcuc

SEQ ID NO: 448539 - RNA, 63 nt, Homo Sapiens
uauuuaaaagaaauaccagugagugccuuaaaguuggagaaguaacugcccaugcccagaaau

SEQ ID NO: 448540 - RNA, 63 nt, Homo Sapiens
gaauaaaaaauaauuuugcuguuguaguauacauuggagaaacuggcagguuuuauuuccauu

SEQ ID NO: 448541 - RNA, 63 nt, Homo Sapiens
uccaagccaggaagaugggcugaucaugccagauuggagaagacugaggguguacguuugaua

SEQ ID NO: 448542 - RNA, 63 nt, Homo Sapiens
gaaaugaaaagccacgucauaacuccacaggguuuggagaauacaaagacacgggaacugaaa

SEQ ID NO: 448543 - RNA, 63 nt, Homo Sapiens
uagacacaaucucuuauuuucacaucacaugauuuggagaaauaagacuuugggcucuuaugu

SEQ ID NO: 448544 - RNA, 63 nt, Homo Sapiens
caugacggauaguuuaggaucauguggagauuuuuggagaaaccaauuguccuucagauaauu

SEQ ID NO: 448545 - RNA, 63 nt, Homo Sapiens
acuuuuucauacuuuugugacagauggaacgguuuggagaagcuguacaguauuugcauucca

SEQ ID NO: 448546 - RNA, 57 nt, Homo Sapiens; identical to SEQ ID NO: 445151

SEQ ID NO: 448547 - RNA, 63 nt, Homo Sapiens
cacagcagcacgccuuaauccuguccaagugccuuggagaacuucagucugaaaugcagcucc

SEQ ID NO: 448548 - RNA, 63 nt, Homo Sapiens
aucuggagaugagauugaugugguggaagaagcuuggagaagaugaagcacauacaagcaccc

SEQ ID NO: 448549 - RNA, 63 nt, Homo Sapiens
gagauggcaagagggcaggcggcauuugaggaauuggagaaugccugggcuguggaccuacug

SEQ ID NO: 448550 - RNA, 63 nt, Homo Sapiens
caccugcacagcagagcucagcugucaacagucuuggagaagcaugccaaguacaccugcaag

SEQ ID NO: 448551 - RNA, 63 nt, Homo Sapiens
ccuuagcacaauuuucuaaaaaaaaaucagaaauuggagaaauuugccaaaaaaaaaaaaaaa

SEQ ID NO: 448552 - RNA, 63 nt, Homo Sapiens
acaaggacaacuuuauguagcauggacaguuguuuggagaacaugcccaggugggguuuccug

SEQ ID NO: 448553 - RNA, 63 nt, Homo Sapiens
cacagccucaccuucucacuaaggguguuagucuuggagaagaugaauuuuuuggggacuauu

SEQ ID NO: 448554 - RNA, 63 nt, Homo Sapiens
aaggagcaaaaacaaauuuugcagaagcugaaauuggagaaccuauuucuuaacugcuauuug

SEQ ID NO: 448555 - RNA, 63 nt, Homo Sapiens
ucugcacuuucuuauauauaaugccaagauuuuuuggagaacacuuugugacacuucauccug

SEQ ID NO: 448556 - RNA, 63 nt, Homo Sapiens
augcauuugggucacuaauuaacaccuuucauauuggagaaucaugauuguaugcuuaugcug

SEQ ID NO: 448557 - RNA, 63 nt, Homo Sapiens
gaacucacaaacugauguuauaaaggaaaggauuuggagaauuaugaaauaaacuuauuacuu

SEQ ID NO: 448558 - RNA, 63 nt, Homo Sapiens
uagcaguaccaagggaucucucacuugggagcuuuggagaaaaacuucggcugcaugagauaa

SEQ ID NO: 448559 - RNA, 63 nt, Homo Sapiens
aacaacaaaagccaauuagacugggagucaguguuggagaagaacgcccaucuggagugggag

SEQ ID NO: 448560 - RNA, 63 nt, Homo Sapiens
cucuaauuccagugucuuuacacagcaaauaaauuggagaauauugcucccauauaaacuugu

SEQ ID NO: 448561 - RNA, 63 nt, Homo Sapiens
uuucaguuucuuuccuucugugaacgaugagacuuggagaacgggcugguccuucaccacuuc

SEQ ID NO: 448562 - RNA, 63 nt, Homo Sapiens
gaggugccgagcugggugcuugacaucauuugcuuggagaagcagcugcuaguagacccauuu

SEQ ID NO: 448563 - RNA, 63 nt, Homo Sapiens
caucaauauguauauauguauuucuauauagacuuggagaauacugccaaaacauuuaugaca

SEQ ID NO: 448564 - RNA, 63 nt, Homo Sapiens
uuggguguggaggccauuuuuagagauacagaauuggagaagacuugcaaaacagcuagauuu

SEQ ID NO: 448565 - RNA, 63 nt, Homo Sapiens
ugucauguugguuuuugguacuuguauugucauuuggagaaacaauaaaagauuucuaaacca

SEQ ID NO: 448566 - RNA, 63 nt, Homo Sapiens
uaucugggaacacugagaagggugaccaaugcguuggagaacgagggagggcuucauagcaga

SEQ ID NO: 448567 - RNA, 63 nt, Homo Sapiens
aaagagcaugcagugcuguugaauaacccucacuuggagaaccaagagaauccugucguuuaa

SEQ ID NO: 448568 - RNA, 63 nt, Homo Sapiens
ccccugaauguggucgaugccaaaggaagauccuuggagaagucaucagugcguugaaacaaa

SEQ ID NO: 448569 - RNA, 63 nt, Homo Sapiens
ugcagagugugugcuuggcuguggcagccuagcuuggagaagcugcuguuggugcaagggaga

SEQ ID NO: 448570 - RNA, 63 nt, Homo Sapiens
uggaugccuaaggcauaaagugugcaauauuucuuggagaauucagcuuucuugcuugccuuc

SEQ ID NO: 448571 - RNA, 63 nt, Homo Sapiens
gaaaaacacucuauaacagaaacuuuuuuaacuuuggagaaaauuucugugccuucaagggac

SEQ ID NO: 448572 - RNA, 63 nt, Homo Sapiens
uuuucugauuauuguuaaacucaggaaauucuuuuggagaauauuuauaccuagcaagccacu

SEQ ID NO: 448573 - RNA, 63 nt, Homo Sapiens
uugccuuuuuucuuggcuccgcaauuugugcaauuggagaaucaugcugggaacacaaauagu

SEQ ID NO: 448574 - RNA, 63 nt, Homo Sapiens
aaggacugagaaaugaccauuauaaaucuagacuuggagaauucaggauucacauuguuaauu

SEQ ID NO: 448575 - RNA, 59 nt, Homo Sapiens; identical to SEQ ID NO: 445180

SEQ ID NO: 448576 - RNA, 63 nt, Homo Sapiens
gauucaaaauaguguagauugauuuucuggccuuuggagaagugcaacugcagcuaacaggcu

SEQ ID NO: 448577 - RNA, 63 nt, Homo Sapiens
cuguucagucacagauauauaaauauuggauucuuggagaaaaaguauaugaaaauauacugg

SEQ ID NO: 448578 - RNA, 63 nt, Homo Sapiens
agauaaugaauuaagcaacucauuuacucaauauuggagaagucaugugugccccuaaagaca

SEQ ID NO: 448579 - RNA, 63 nt, Homo Sapiens
auuuaaacaccucaauguagucaaugaaaacuguuggagaaauuaguguuuucauaauguaau

SEQ ID NO: 448580 - RNA, 63 nt, Homo Sapiens
auuacagaucauauaagcaauacauaaacaguuuuggagaaaagguuuuaaaaauaaguuuua

SEQ ID NO: 448581 - RNA, 63 nt, Homo Sapiens
uauauuuuaaagaacaagacgccucagaaucauuuggagaaacuaucuuguaaucaugauuga

SEQ ID NO: 448582 - RNA, 63 nt, Homo Sapiens
cauagaacaaggugaaagacaaaucacuaaggauuggagaacucaaucaaucaaaaaauaaau

SEQ ID NO: 448583 - RNA, 63 nt, Homo Sapiens
agacauaaacuuggaguccgucugguuuaauuauuggagaaucgauucccaaguccaggaaga

SEQ ID NO: 448584 - RNA, 63 nt, Homo Sapiens
uuaguauuuugucuuuguaauuuacagaaguuauuggagaaaauaaacuuguuucauuuugca

SEQ ID NO: 448585 - RNA, 63 nt, Homo Sapiens
cccagggaaugggggucuaugagacaaccccacuuggagaagaaugggguuagggucucuaau

SEQ ID NO: 448586 - RNA, 63 nt, Homo Sapiens
ugcuuuuuauacaacuuuccaucccccacacaguuggagaauaauuuguagaccauggcaguu

SEQ ID NO: 448587 - RNA, 63 nt, Homo Sapiens
uauacauggugauguacaucuguagcaaagcucuuggagaaaaugaagacugaagaaagcaaa

SEQ ID NO: 448588 - RNA, 63 nt, Homo Sapiens
ugaggaacauucauucuguauuuuuuuucccuguuggagaaagugggaaauuauaaugucgaa

SEQ ID NO: 448589 - RNA, 63 nt, Homo Sapiens
auucugucuaucaaauaguacuucuaccacuguuuggagaaaauugaagaaaagaauaagaug

SEQ ID NO: 448590 - RNA, 63 nt, Homo Sapiens
uugaauaugauuuggucaguugcucguuguaacuuggagaaauuccuauaaaguaagaucucc

SEQ ID NO: 448591 - RNA, 63 nt, Homo Sapiens
aauuccuucugcuauaugucacacaguuguuauuuggagaaccaaguauguauugcaugaaaa

SEQ ID NO: 448592 - RNA, 63 nt, Homo Sapiens
augccuuauuuuugaauucuuuagauuuuuaaauuggagaaaagcacuuaaaguuuuuuauau

SEQ ID NO: 448593 - RNA, 63 nt, Homo Sapiens
gugagcauuugcaauguaagggccucagcuuccuuggagaagccaccccagguuuccagacau

SEQ ID NO: 448594 - RNA, 63 nt, Homo Sapiens
caucucccugauugguauugcuguagaacauauuuggagaaguuuguuugucuuugguguuua

SEQ ID NO: 448595 - RNA, 63 nt, Homo Sapiens
ggaguuugaacccguuuugguugcauuucauuuuuggagaacuuaauuaacgugagauuggca

SEQ ID NO: 448596 - RNA, 63 nt, Homo Sapiens
uuagaacauuuuuugaaauucaguuuacagaaauuggagaaaaugcuuuuuaaacaaguguuu

SEQ ID NO: 448597 - RNA, 63 nt, Homo Sapiens
augggucuugcugggugcuguguggggcgcauauuggagaaggguaaugccagaagccaggaa

SEQ ID NO: 448598 - RNA, 63 nt, Homo Sapiens
cuuggaaccccaaggccaaguugguucaaacuguuggagaacagaguuggccugcaucuggaa

SEQ ID NO: 448599 - RNA, 63 nt, Homo Sapiens
acuauuuuuauaaagcaagaacuauuccaugccuuggagaaugaaucauuuuuagauugugac

SEQ ID NO: 448600 - RNA, 63 nt, Homo Sapiens
uuuggaggugaaaucuaauuauuggugagagucuuggagaacaggcuguuuccagucucaaag

SEQ ID NO: 448601 - RNA, 63 nt, Homo Sapiens
cguaaagauucauuuuucaaacugauuuuauaauuggagaauggccuuugguagcuaacaguc

SEQ ID NO: 448602 - RNA, 63 nt, Homo Sapiens
uagcacuugccuugaaaagaucucuuuucaggguuggagaaauuuguuuuauuggaaugcaua

SEQ ID NO: 448603 - RNA, 63 nt, Homo Sapiens
gugguuagcacauucaucagggauggauguauauuggagaaggugagacuuuauuguccucua

SEQ ID NO: 448604 - RNA, 63 nt, Homo Sapiens
uacuccagcaaaaugaaggauuuagggaagcuguuggagaaaagguuaccuccaugugcccuu

SEQ ID NO: 448605 - RNA, 63 nt, Homo Sapiens
cauaugaaaagcauaguuggucacaggacccaauuggagaaauuucaacaauucugugaaagg

SEQ ID NO: 448606 - RNA, 63 nt, Homo Sapiens
caaagaaaauuaaaguuuucccagcagcuguuuuuggagaagaaucccuuaauuugagguguu

SEQ ID NO: 448607 - RNA, 63 nt, Homo Sapiens
gaauguuugucuggagcagaaucaggcugauuuuuggagaaauauguuccuuuguauguuccu

SEQ ID NO: 448608 - RNA, 63 nt, Homo Sapiens
acaagguacccagaauuuuuuucaacaagaugcuuggagaacaugauguuaagcacauguuac

SEQ ID NO: 448609 - RNA, 63 nt, Homo Sapiens
auuaaauugcugcauuucgcuuucuuauuuugauuggagaaaaagugagaucauacugguuug

SEQ ID NO: 448610 - RNA, 63 nt, Homo Sapiens
ggaagaauaacacuguugcucaaugaaggagacuuggagaagacagcugguaguccaucagca

SEQ ID NO: 448611 - RNA, 63 nt, Homo Sapiens
uauuuaauaaaaaaacaaucuauuuucaguauuuuggagaaaugcuuuuugaauguuauuugu

SEQ ID NO: 448612 - RNA, 63 nt, Homo Sapiens
agggcucuucucaggggcucccuccucugucuuuuggagaaccgcgcauccugcagggcuucu

SEQ ID NO: 448613 - RNA, 63 nt, Homo Sapiens
ucuucacagccccgacaucaggacauuggaaccuuggagaauguuaaacccugugccucagcu

SEQ ID NO: 448614 - RNA, 63 nt, Homo Sapiens
cagggccgugccuggagcacugcagagaugacuuuggagaaagcaaagcagugacccagugac

SEQ ID NO: 448615 - RNA, 63 nt, Homo Sapiens
agaagaaagauacaagugaaaauuaggaguggauuggagaaauuggggggaaauagaagagua

SEQ ID NO: 448616 - RNA, 63 nt, Homo Sapiens
ggcuuuuuaacccauuuuugaagagggugaaguuuggagaacaaauuuaaaaaccaucaguca

SEQ ID NO: 448617 - RNA, 63 nt, Homo Sapiens
aaaucucagaauuacuaagcauguggcauaaauuuggagaaaauaauaugacuagaaaaauua

SEQ ID NO: 448618 - RNA, 63 nt, Homo Sapiens
uucguguccaccuggguccaguccugaaucaucuuggagaaacaccuugguuucuaggauggu

SEQ ID NO: 448619 - RNA, 63 nt, Homo Sapiens
aguuguauuggcaagagggaggggugagagcuguuggagaacugagaaugagguuuuuuuuuu

SEQ ID NO: 448620 - RNA, 63 nt, Homo Sapiens
uauugcccugcaacgucccaucuauacgagguguuggagaaggugaagaacccucccauucac

SEQ ID NO: 448621 - RNA, 63 nt, Homo Sapiens
ccugcuugugcaggccaguggaggcucuugggcuuggagaacacgugugucucuguguaugug

SEQ ID NO: 448622 - RNA, 63 nt, Homo Sapiens
guggggcaacguguggaggaagccccucauaauuuggagaaaacuugauacaauagaagcuga

SEQ ID NO: 448623 - RNA, 63 nt, Homo Sapiens
aaccuguucaagucuaccaauuauaagggcaaauuggagaaaaagaaaaaauauauacucaag

SEQ ID NO: 448624 - RNA, 63 nt, Homo Sapiens
guuuguuuguuggaguggugccagguacugguuuuggagaacuugucuacaaccagggauuga

SEQ ID NO: 448625 - RNA, 63 nt, Homo Sapiens
agugcauaccagaauugaauauaccauaugggauuggagaaagacaaauguggaagaaaucau

SEQ ID NO: 448626 - RNA, 63 nt, Homo Sapiens
ugagaaagggaaaagacacacaagucgcguggguuggagaagccagagccauuccaccucccc

SEQ ID NO: 448627 - RNA, 63 nt, Homo Sapiens
uggcgugcucuagcccucucaguuaccagcucuuuggagaaggaucaaaauucagauggaaug

SEQ ID NO: 448628 - RNA, 63 nt, Homo Sapiens
ugaaacagacuacucuuugccuuuuugcugcaguuggagaagaaacugaauuugaaaaauguc

SEQ ID NO: 448629 - RNA, 63 nt, Homo Sapiens
aaagaauuuaaaguggcuccuuuaauuggugacuuggagaaagcuaggucaaggguuuauuau

SEQ ID NO: 448630 - RNA, 63 nt, Homo Sapiens
acagaguuugggggagagagcaagauggguuccuuggagaagcugauuugccaagaugcacau

SEQ ID NO: 448631 - RNA, 63 nt, Homo Sapiens
gccaccuaagcaguaaaacaugauauugaccacuuggagaacucagaaaauuauuuuaaauuu

SEQ ID NO: 448632 - RNA, 63 nt, Homo Sapiens
agaaguaaaggaauauaugccuccuguguacuuuuggagaaaacugaagauuuaguuuccauu

SEQ ID NO: 448633 - RNA, 63 nt, Homo Sapiens
agcuuaaacauuucaccagaaugcuggaagcucuuggagaaaaggaucauccuuuuguacuug

SEQ ID NO: 448634 - RNA, 63 nt, Homo Sapiens
uggacccuaguucaguuuagaggagaaagcccuuuggagaaacacaaaacacaaguuggacca

SEQ ID NO: 448635 - RNA, 63 nt, Homo Sapiens
gcugaaggucaguaauuccguaguuccauaaaauuggagaacugauuccuugaagagccuauu

SEQ ID NO: 448636 - RNA, 63 nt, Homo Sapiens
cacaguaaagggaaacccuggcuugcuucagcauuggagaauuaacaugaugaauguggagau

SEQ ID NO: 448637 - RNA, 63 nt, Homo Sapiens
agaaccgugaacuggaaaaggaagucccggcuguuggagaaggaccaacaacaacgaggagga

SEQ ID NO: 448638 - RNA, 63 nt, Homo Sapiens
aauggacgaauucuugagcaguggugaagagaguuggagaagguggagaugggggcgggggug

SEQ ID NO: 448639 - RNA, 63 nt, Homo Sapiens
cguacucuagggccaaauccgccgagguuacauuuggagaaccuagucucagagaucuguagg

SEQ ID NO: 448640 - RNA, 63 nt, Homo Sapiens
gcagaagagacgucccgcuuggugaggcuugacuuggagaaagguggccagcccauuuucugg

SEQ ID NO: 448641 - RNA, 63 nt, Homo Sapiens
gugaauguauguacuguauucacagagauggucuuggagaauuuccagguuaaccuugauaua

SEQ ID NO: 448642 - RNA, 63 nt, Homo Sapiens
gcuugaggccagaagugcaauaggaggcugagguuggagaaucugccuauaauccuggcauuu

SEQ ID NO: 448643 - RNA, 63 nt, Homo Sapiens
ugaugcauaaagcugugauaaaaaagcugcuuuuuggagaagaaaguggccaaguccuuuauc

SEQ ID NO: 448644 - RNA, 63 nt, Homo Sapiens
ugacucaaauauauacuugaaguaauuuaugcuuuggagaauugcccuaaccuaaaaucggag

SEQ ID NO: 448645 - RNA, 63 nt, Homo Sapiens
ucuugugcaauuagccuggcgagaaauauuugcuuggagaagcaugugggguuuguaauaggu

SEQ ID NO: 448646 - RNA, 63 nt, Homo Sapiens
agacaugcuuuuccagcuguuggucagagcuaguuggagaauguuuguuugguauguacaaaa

SEQ ID NO: 448647 - RNA, 63 nt, Homo Sapiens
gaagcaaaggugaaugacaguuaggagcuuguuuuggagaaauagucucuucagguagcuaaa

SEQ ID NO: 448648 - RNA, 63 nt, Homo Sapiens
ugccgaaaaguugccaaauauuauaaugucuuuuuggagaaauuacuuugugcuuuaugguuu

SEQ ID NO: 448649 - RNA, 63 nt, Homo Sapiens
gagacaggagggguaaaaccuauauagaggauuuuggagaagaggaauauuuucuucuuaaga

SEQ ID NO: 448650 - RNA, 63 nt, Homo Sapiens
auggauaaguaguguuuccucgucuuugcuguuuuggagaauguuaacaauauacauauguuc

SEQ ID NO: 448651 - RNA, 63 nt, Homo Sapiens
uaccacacaaaacaaugaauuccaugguuaaguuuggagaaaacuccauuuuuaucaagguuu

SEQ ID NO: 448652 - RNA, 63 nt, Homo Sapiens
ggagcucuguggcuucccacgagaaacugugaauuggagaaauuucgauuuuucuggucugug

SEQ ID NO: 448653 - RNA, 63 nt, Homo Sapiens
uuuuuuucucucacuauaguauaagaaucuauuuuggagaaaaaaagaaaauaugagggucuc

SEQ ID NO: 448654 - RNA, 63 nt, Homo Sapiens
ggggggagggggaugggguccuucuaggaguccuuggagaaaaguaagaaaccaggaguguuu

SEQ ID NO: 448655 - RNA, 63 nt, Homo Sapiens
accagggcaggagaggacucagccuccuguguuuuggagaaggggcccaauguguguugacga

SEQ ID NO: 448656 - RNA, 63 nt, Homo Sapiens
gcucaaauguuguucaacaccagaaaauuuauauuggagaaaagcacuguaaauguaaugcau

SEQ ID NO: 448657 - RNA, 63 nt, Homo Sapiens
guucaaacuuuguucaauaccaggaaauuuauauuggagaaaaacccuaugaguguaaugaau

SEQ ID NO: 448658 - RNA, 63 nt, Homo Sapiens
ugucacgcuugauuguagguaagauaauuuauauuggagaaaaauccuccaaguaugaagaau

SEQ ID NO: 448659 - RNA, 63 nt, Homo Sapiens
gcucaaacuuuguucgacaucagggaauuuguauuggagaaaaacccugcaaauguaauaaau

SEQ ID NO: 448660 - RNA, 63 nt, Homo Sapiens
uugccuugaucuggcacuuacugauacaagcauuuggagaagagaaaauucaaauauaagaaa

SEQ ID NO: 448661 - RNA, 63 nt, Homo Sapiens
ggacuuuccugugauuuguuuuuaaucauucauuuggagaagaggcaugaccuuuguauuuca

SEQ ID NO: 448662 - RNA, 63 nt, Homo Sapiens
caugcuauuaguauuuucauaccuuagucacauuuggagaauucacaugggaauaaaauucca

SEQ ID NO: 448663 - RNA, 63 nt, Homo Sapiens
gcagguuugguuuuuucucauuugucuguggcauuggagaauauucucgguuuaaacagacua

SEQ ID NO: 448664 - RNA, 63 nt, Homo Sapiens
uuauugucuagugaaacucguuaauuuguaguguuggagaagaacugaaaucauacuucuuag

SEQ ID NO: 448665 - RNA, 63 nt, Homo Sapiens
uccauguagucuucaauuuuuaauuuuuaagaauuggagaauuucuaauguuaaaguuaguuu

SEQ ID NO: 448666 - RNA, 63 nt, Homo Sapiens
aauaucugcauuaugcuggaaaaaaauagaccuuuggagaauacuuaaauaaaacaugugcau

SEQ ID NO: 448667 - RNA, 63 nt, Homo Sapiens
caggugauucuguaaguugucccucaacuguacuuggagaaaucguguuuuaaagcaguaguc

SEQ ID NO: 448668 - RNA, 63 nt, Homo Sapiens
ugcaggaauagcaacagcaauuuccgggaggucuuggagaagcuggagagcgaccccgucugc

SEQ ID NO: 448669 - RNA, 63 nt, Homo Sapiens
cuuuuauuaguucuuugauagcuaagaugguuguuggagaaagugcuuaagccacuguuuaug

SEQ ID NO: 448670 - RNA, 63 nt, Homo Sapiens
uccuguaaaugaaugcucugggcuagauacagcuuggagaaccugcuggccuuguuagacagc

SEQ ID NO: 448671 - RNA, 63 nt, Homo Sapiens
aggaaagccuggguuggguggagcagaaccaucuuggagaagaugacaguucccuguccuccc

SEQ ID NO: 448672 - RNA, 63 nt, Homo Sapiens
aggaaacucugcaaggcuaauaacacauuguaauuggagaagaacacccccuuccaaauucug

SEQ ID NO: 448673 - RNA, 63 nt, Homo Sapiens
aaaacuagcuguggcauuccagcauuuugacccuuggagaagaaagcuuguuguuggaagagc

SEQ ID NO: 448674 - RNA, 63 nt, Homo Sapiens
auaugaauguauucgggagguuuaauccgguucuuggagaaacaccgagcuggaagcaagcca

SEQ ID NO: 448675 - RNA, 63 nt, Homo Sapiens
uaagguggaguccuacuuguugcuuggggacuauuggagaaaaugucuucaagugaccuguac

SEQ ID NO: 448676 - RNA, 63 nt, Homo Sapiens
uaaaccgccuccacguggcgccgaagugaauuguuggagaaugagucuuuuguauuuucccug

SEQ ID NO: 448677 - RNA, 63 nt, Homo Sapiens
uacucuguaggcaugacagcuuaaugugugaccuuggagaagugaguguuccugugcccauau

SEQ ID NO: 448678 - RNA, 63 nt, Homo Sapiens
acaaauauguucucugaaugaacuauuacaguguuggagaacaguuugucauggugaaauuau

SEQ ID NO: 448679 - RNA, 63 nt, Homo Sapiens
ucuguggugcagugugugaagucggagaggcguuuggagaaggcugggugcagaagcuguggg

SEQ ID NO: 448680 - RNA, 63 nt, Homo Sapiens
agggauuaaaaauaaggauacaaagcuaucaacuuggagaaacaauuacugaauauuucagag

SEQ ID NO: 448681 - RNA, 63 nt, Homo Sapiens
agaaccacaaacacagaucaaagccugcucaauuuggagaaauuuaaaaacuauauucaguaa

SEQ ID NO: 448682 - RNA, 63 nt, Homo Sapiens
agauugccuuuucaugcaguuuaccaaaguagguuggagaauucccacagaagucaucagacc

SEQ ID NO: 448683 - RNA, 63 nt, Homo Sapiens
uagaggaggagaaagaauccucuccugcagagauuggagaaggaugauaugaagggggacuua

SEQ ID NO: 448684 - RNA, 63 nt, Homo Sapiens
guguuaauuguguggaaugauacauagauuaaauuggagaaacgggcgcuguaaguuaagcuc

SEQ ID NO: 448685 - RNA, 63 nt, Homo Sapiens
gcauccucuuuuguguaguuuuuguuuguuuuuuuggagaagauuccuuuuuuuguuuguuug

SEQ ID NO: 448686 - RNA, 63 nt, Homo Sapiens
uuuccuuuuguugcauuuguugcauacagguuauuggagaaauuuaaaagaaagauuucccau

SEQ ID NO: 448687 - RNA, 63 nt, Homo Sapiens
uuuagacagcagcucugugucucggaggggaguuuggagaaauucugaguguugccugcugaa

SEQ ID NO: 448688 - RNA, 63 nt, Homo Sapiens
uuggggaaguguuuucugaaccacaguguucuguuggagaaaccacacuaccaggcccugcag

SEQ ID NO: 448689 - RNA, 63 nt, Homo Sapiens
aaauuaaacauuuggcccugaagaugaaugacuuuggagaagcuucccagaaucagacuuuug

SEQ ID NO: 448690 - RNA, 63 nt, Homo Sapiens
cauuuaagcugccucggguugucaccaggucgcuuggagaaguguggagauaaauguccuaga

SEQ ID NO: 448691 - RNA, 63 nt, Homo Sapiens
aaaauauaacuucaagaaaagaguaaacauccauuggagaacacggcugaaaauuauugugcu

SEQ ID NO: 448692 - RNA, 63 nt, Homo Sapiens
aaagaucaugaauuugugacuuaguucugcccuuuggagaacaaaagaaagcagucuuccauc

SEQ ID NO: 448693 - RNA, 63 nt, Homo Sapiens
aacaauggugccccagaaagcugcaggugguguuuggagaagcaguuacuuuucaguuacaag

SEQ ID NO: 448694 - RNA, 63 nt, Homo Sapiens
aagcaguauuuaaugcaauuuccaguuauuucuuuggagaauuuuaugucauuguuccauuac

SEQ ID NO: 448695 - RNA, 63 nt, Homo Sapiens
ugaguucagaugaucacaaacaggugaguuuuguuggagaagaaaguuggaguaggagacuuu

SEQ ID NO: 448696 - RNA, 63 nt, Homo Sapiens
caauaagaggcucuguuuuccacugaagcuuuguuggagaaagagaauaugaaaauuacacau

SEQ ID NO: 448697 - RNA, 63 nt, Homo Sapiens
ugugaagacaugaaaguuuaauguacagaaugguuggagaaaugccuauggugaauuaaagcu

SEQ ID NO: 448698 - RNA, 63 nt, Homo Sapiens
auugccuuuguguuaauagucaaauacuuaccuuuggagaauacuuaccuuuggaggaaugua

SEQ ID NO: 448699 - RNA, 63 nt, Homo Sapiens
auaaccuugcugauaagaaaaaaagggacaauauuggagaaacuaccucuuguuuaauugauc

SEQ ID NO: 448700 - RNA, 63 nt, Homo Sapiens
cugguaccuuccccuccugccccugcaccagcuuuggagaauggauuuggagugucuugggcg

SEQ ID NO: 448701 - RNA, 63 nt, Homo Sapiens
ccagucucccaggcccccuguguugggagcccuuuggagaacgagaaaucagaggagagacgg

SEQ ID NO: 448702 - RNA, 63 nt, Homo Sapiens
guccagcaugcauccuggccggggcuuuuuuauuuggagaaccagcaguguagacaaacccuu

SEQ ID NO: 448703 - RNA, 63 nt, Homo Sapiens
auauucauuugguuguggagauagcuugacuccuuggagaacacacguugucauugugagucu

SEQ ID NO: 448704 - RNA, 63 nt, Homo Sapiens
ugaugugaaaauuggaccucgcuauuuuacuauuuggagaauauuucaucaacauguagagcu

SEQ ID NO: 448705 - RNA, 63 nt, Homo Sapiens
ugccauuacuuguauaucugaaauuaugaauuauuggagaaaacaaaauagcagaaauuguaa

SEQ ID NO: 448706 - RNA, 63 nt, Homo Sapiens
cugggucagccaaguuucauaugcauaccgauauuggagaaaucugcagaauauuguaauugc

SEQ ID NO: 448707 - RNA, 63 nt, Homo Sapiens
ccuccuucagagcccuuugugucuccuuguugcuuggagaacacaaagucuuguacugaagca

SEQ ID NO: 448708 - RNA, 63 nt, Homo Sapiens
augaggaaaagaagagccuuugcugauaaagaguuggagaacauuaugcuggagagagaauau

SEQ ID NO: 448709 - RNA, 63 nt, Homo Sapiens
guggauuaauauuaaaacuauguauauuaaucauuggagaagggggaagaggaaaugaaaaua

SEQ ID NO: 448710 - RNA, 60 nt, Homo Sapiens; identical to SEQ ID NO: 445315

SEQ ID NO: 448711 - RNA, 63 nt, Homo Sapiens
ugcaaaagaaauaggcuuuucuucuuuuuuaaauuggagaaaucucugcucugguugaccugg

SEQ ID NO: 448712 - RNA, 63 nt, Homo Sapiens
aggcaucuguggggaaucccagccugcagguucuuggagaagcaggugaaccuaaggaugaaa

SEQ ID NO: 448713 - RNA, 63 nt, Homo Sapiens
ucaugcacaucagcugguggagcaggccuggccuuggagaacgagaccugugugccaggggca

SEQ ID NO: 448714 - RNA, 63 nt, Homo Sapiens
cguccuugugaagcucgucuccauguggcuuucuuggagaaaggcuccccuggggcaagaggg

SEQ ID NO: 448715 - RNA, 63 nt, Homo Sapiens
ggagaggucaggagaccgaccccaccacuaacuuuggagaaaauguggguuugcuuuuuaaag

SEQ ID NO: 448716 - RNA, 63 nt, Homo Sapiens
uacguaaucagaaauuugugaguuacaugucauuuggagaaaauuucuggaaaaguuaaaaaa

SEQ ID NO: 448717 - RNA, 63 nt, Homo Sapiens
uuuccuucaagcagaaacaagguuugaacauaauuggagaacccggccaauguccaaaauuac

SEQ ID NO: 448718 - RNA, 63 nt, Homo Sapiens
cacugugggcuaggguggucuuggagagggagcuuggagaacucggccaagggccacgggaac

SEQ ID NO: 448719 - RNA, 63 nt, Homo Sapiens
uauguaaauuaccaaggcacguucuuuaaagauuuggagaagacguguguuuuuuagagcuug

SEQ ID NO: 448720 - RNA, 63 nt, Homo Sapiens
gggacucauauaaauaguugacaucuaaagcuguuggagaagauguaaaaaguacucagaaaa

SEQ ID NO: 448721 - RNA, 63 nt, Homo Sapiens
cccgcuuuuucuggaacagcuccuuggacaccauuggagaagcugcuuuugcaagacuggaau

SEQ ID NO: 448722 - RNA, 63 nt, Homo Sapiens
cuugggacugggacagucuuaaggcuguuuugcuuggagaagaguuuuuaaaacauggauguu

SEQ ID NO: 448723 - RNA, 63 nt, Homo Sapiens
uguuuaccaguaaauacaucuuuuuguuuuguuuuggagaauuagaacaaaagcuuuuaguug

SEQ ID NO: 448724 - RNA, 63 nt, Homo Sapiens
cuacuuuuugacuuacaugggauauacuuugcuuuggagaaauuuuaaaaagaagagaaagaa

SEQ ID NO: 448725 - RNA, 63 nt, Homo Sapiens
ucgcccaucccccccgcggccuuguuuuuguauuuggagaaccuccgccccauccugcagggc

SEQ ID NO: 448726 - RNA, 63 nt, Homo Sapiens
gaaguugaacgagcauagucaaaagaaaugauguuggagaaggauuccuuuuuucaaaaucca

SEQ ID NO: 448727 - RNA, 63 nt, Homo Sapiens
uuuacuaaauauacaagauuuacuacuagaaauuuggagaaagaacacuaacacauguacuug

SEQ ID NO: 448728 - RNA, 63 nt, Homo Sapiens
aacucaugagagacaagcaguaagaaacuucuuuuggagaaacaacagaccagaucuuuacuc

SEQ ID NO: 448729 - RNA, 63 nt, Homo Sapiens
cuacaguuucacagaauaccugagaagacacacuuggagaaaccuuuuggguguaaugaaugu

SEQ ID NO: 448730 - RNA, 63 nt, Homo Sapiens
gccuuacuucuacuuccagaugcagugccucuuuuggagaagacauguuuauuuuucauguuc

SEQ ID NO: 448731 - RNA, 63 nt, Homo Sapiens
gagggaagaguguguccuggcaggaagccaccauuggagaaggugaggccaguaaccaucuca

SEQ ID NO: 448732 - RNA, 63 nt, Homo Sapiens
auuuuacauaucuguuuggauuauagcuaggauuuggagaauaaguguguacagaucacaaaa

SEQ ID NO: 448733 - RNA, 63 nt, Homo Sapiens
uuuuaagcaagagaaagacaacuguucugcggguuggagaaaauacaauuuuuuuuuuuuuuu

SEQ ID NO: 448734 - RNA, 63 nt, Homo Sapiens
cuauugcugcauacccggggugggauggggugguuggagaaccagaacuauuuuuaaaacauu

SEQ ID NO: 448735 - RNA, 63 nt, Homo Sapiens
ugaacuggggaauuugaacauuccuuuacauuguuggagaaaugaagccaaaguuauucagau

SEQ ID NO: 448736 - RNA, 63 nt, Homo Sapiens
cuauaugguucuccaagaaacugaaugaauccauuggagaagcgguggauaacuagccagaca

SEQ ID NO: 448737 - RNA, 63 nt, Homo Sapiens
uuauguucuuuagacacugcuaccugaaaacuguuggagaaauaauguuuaaaguuauuuaag

SEQ ID NO: 448738 - RNA, 63 nt, Homo Sapiens
uaaaacccugaugcaaacuucuccuuucagugguuggagaaauuggccgaguucaaccauuca

SEQ ID NO: 448739 - RNA, 63 nt, Homo Sapiens
ccuguaugugguguuuuaaccauagggagucauuuggagaaagaauucuaaccaaaccccaga

SEQ ID NO: 448740 - RNA, 63 nt, Homo Sapiens
auggaagcuacaccccuacaguacagcccgugcuuggagaaccauggucagccuaaggguaau

SEQ ID NO: 448741 - RNA, 63 nt, Homo Sapiens
caaccagauacaucugcuggcuggugucucucuuuggagaaacagaacuguggugccaaauug

SEQ ID NO: 448742 - RNA, 63 nt, Homo Sapiens
agaaugcuacuguauuuuacacaaugcauacuguuggagaacauugccaaauaacaaaagcau

SEQ ID NO: 448743 - RNA, 63 nt, Homo Sapiens
uguaccuuuuuugucaacucuucuguuuucggauuggagaagaauaccuugaucuuucccacu

SEQ ID NO: 448744 - RNA, 63 nt, Homo Sapiens
uuccaaucuuuccucccaagugacuaaggcacguuggagaacaaccuuaaauaaaagugauug

SEQ ID NO: 448745 - RNA, 63 nt, Homo Sapiens
aagaugaauuauagcuccggaaugugggugguauuggagaaagaaagcuaaauaaccuuuaag

SEQ ID NO: 448746 - RNA, 63 nt, Homo Sapiens
gaaccaaguccuuggauaucgaaccaagucuacuuggagaaaauguaucuacucuguggagua

SEQ ID NO: 448747 - RNA, 63 nt, Homo Sapiens
uguuuaacauuuucaagccucagcuguacgacuuuggagaaguaagucacaccuaccacugag

SEQ ID NO: 448748 - RNA, 63 nt, Homo Sapiens
uuaaugagaaaauuuuagaaugcuaccaucuacuuggagaagucacuccaguauuaauauuug

SEQ ID NO: 448749 - RNA, 63 nt, Homo Sapiens
ugcaaacuaccgucgcucagggcccaaacuugauuggagaauucccauaggaugucauauuga

SEQ ID NO: 448750 - RNA, 63 nt, Homo Sapiens
uauuuaauaaaaccuguuaaauguguuacaaaauuggagaaagaugcagauuacacugaucuu

SEQ ID NO: 448751 - RNA, 63 nt, Homo Sapiens
uuuaugucagcacacacuuaaauuuuguaauaauuggagaagaugcguucugccuuccuuguu

SEQ ID NO: 448752 - RNA, 63 nt, Homo Sapiens
ggagugcagucauaaucuuauuuccuuucgacauuggagaauucauuggugucucuuuuuucc

SEQ ID NO: 448753 - RNA, 63 nt, Homo Sapiens
acucgugagcacaucuuuagaaaguuuugugcuuuggagaaugguccuuuccuuucugaaaau

SEQ ID NO: 448754 - RNA, 63 nt, Homo Sapiens
ugcggcagagaagccaugcgccuguguggaaauuuggagaaguacccuaggggggcaccugcg

SEQ ID NO: 448755 - RNA, 63 nt, Homo Sapiens
uuucccagugugucuuuuaugucuuugaauguuuuggagaaaagucuaugccugucuaaaaau

SEQ ID NO: 448756 - RNA, 63 nt, Homo Sapiens
auuuuaaauuaaagccuucuaauguuccacuguuuggagaacagaagauagcaggcuguguau

SEQ ID NO: 448757 - RNA, 63 nt, Homo Sapiens
gcaaacacuguguauagugagacuuguucuacuuuggagaacagguuaccuuuugaaaaugag

SEQ ID NO: 448758 - RNA, 55 nt, Homo Sapiens; identical to SEQ ID NO: 445363

SEQ ID NO: 448759 - RNA, 63 nt, Homo Sapiens
agucaguuuaguucauauguucugaaaacuguuuuggagaaagauagacagaaaaaugucauc

SEQ ID NO: 448760 - RNA, 63 nt, Homo Sapiens
aauucucagaaccagucucagggagauauaugcuuggagaacucugccuuccaucaacugcag

SEQ ID NO: 448761 - RNA, 63 nt, Homo Sapiens
ccaugaauuaagauggaugacuggaaaaagguguuggagaaagaguuaaagaugaggaagaga

SEQ ID NO: 448762 - RNA, 63 nt, Homo Sapiens
caaguaccaggaggacauaaccgcuguggccuguuggagaacagccaguagccuugguaauau

SEQ ID NO: 448763 - RNA, 63 nt, Homo Sapiens
uuguuacaugaaagugauagauagcaacaaguuuuggagaagagagagggagauaaaaggggg

SEQ ID NO: 448764 - RNA, 63 nt, Homo Sapiens
auuuucuacaugaaucaaacacagaaacaacuuuuggagaaauuaaauucugagugugacuuc

SEQ ID NO: 448765 - RNA, 63 nt, Homo Sapiens
gcuccccugacacugaagaggauccacaacuccuuggagaaacacccucacgucuguugccgc

SEQ ID NO: 448766 - RNA, 63 nt, Homo Sapiens
uauauagauguaucuuuuaaaaauaguucacguuuggagaauucuuuuguacucauuugcuuu

SEQ ID NO: 448767 - RNA, 63 nt, Homo Sapiens
agcucugacuuugcuguuuccagugguaugaccuuggagaagucacuuauccucuuggagccu

SEQ ID NO: 448768 - RNA, 63 nt, Homo Sapiens
uucucucuggacucuugccuagcucacaaggcuuuggagaauugucuuccuaaaucggggcac

SEQ ID NO: 448769 - RNA, 63 nt, Homo Sapiens
uggaaagcaucuaguccagugggaagccagggguuggagaaggugcuacaucccucuucccau

SEQ ID NO: 448770 - RNA, 63 nt, Homo Sapiens
ccuucuagaaucagaucuguuuggggcuggggguuggagaauaaaagcaggagaagucuaugg

SEQ ID NO: 448771 - RNA, 63 nt, Homo Sapiens
cucugcuguguucuguguguccaguguagccuauuggagaaucggucucauuagagugacucu

SEQ ID NO: 448772 - RNA, 63 nt, Homo Sapiens
cauucucugaaaauacuguauacacagacugauuuggagaacaguuguuuaauagagaaaaug

SEQ ID NO: 448773 - RNA, 63 nt, Homo Sapiens
aaaugauauuuagaaaguuauaagaggauuuuuuuggagaaaauccauauccagguuagcugg

SEQ ID NO: 448774 - RNA, 63 nt, Homo Sapiens
gggaggaauaggagcaaaucuaaaugauacaucuuggagaagaaacuuguauuacauaucaaa

SEQ ID NO: 448775 - RNA, 63 nt, Homo Sapiens
gagaggaaagguuugagaagcauccauguauuuuuggagaagagaaggaguuuuauguuaaac

SEQ ID NO: 448776 - RNA, 63 nt, Homo Sapiens
cagggggcugccuugggcccuugcuugcagugguuggagaaccgucaagguuguccccagacc

SEQ ID NO: 448777 - RNA, 63 nt, Homo Sapiens
gccucucuagcagucaacucuacagaagaaagauuggagaagggucuuugggagggaagaagg

SEQ ID NO: 448778 - RNA, 63 nt, Homo Sapiens
ggggguugggaacuuaugcaaccuuccagaaacuuggagaaauugagggugcccaccaagccc

SEQ ID NO: 448779 - RNA, 63 nt, Homo Sapiens
uacuucaaccagagcagggaacucauuccugccuuggagaaaacagcugugguuggaucaagg

SEQ ID NO: 448780 - RNA, 63 nt, Homo Sapiens
ggagagaauuaguagggcaaauuuucuaaagcuuuggagaaaagcaugaaagucaaaacugga

SEQ ID NO: 448781 - RNA, 63 nt, Homo Sapiens
gagaagaaguuguagcagagaggggccuggggauuggagaacggguucaguggcuggaguauu

SEQ ID NO: 448782 - RNA, 63 nt, Homo Sapiens
aucaaaaccccaaacaaacauaaguaccuuuuauuggagaaaaaaaaaauuuuacugucuaaa

SEQ ID NO: 448783 - RNA, 63 nt, Homo Sapiens
acuuauuacacuaucuaaccuauguauuauggauuggagaagcguugaaauaaugauaguagg

SEQ ID NO: 448784 - RNA, 63 nt, Homo Sapiens
uggaauaaaguuacaccugguggaacucugaaguuggagaaggaaugcucuauccucuaaggu

SEQ ID NO: 448785 - RNA, 63 nt, Homo Sapiens
agguaaaggaugaggguucacgcuaguggaggguuggagaaggagguuugaccaggaaagcag

SEQ ID NO: 448786 - RNA, 63 nt, Homo Sapiens
cgguuuugaaagcaacuccuguucaauaugaucuuggagaacaaggaacaagaagagacccuu

SEQ ID NO: 448787 - RNA, 63 nt, Homo Sapiens
cagugcuugaaauggacaagagaguggacagucuuggagaacaaauaaaugugaaggcuguga

SEQ ID NO: 448788 - RNA, 63 nt, Homo Sapiens
ucgcugucucccuagagccagggcccugcggauuuggagaagggagcggggcaggacuuccag

SEQ ID NO: 448789 - RNA, 63 nt, Homo Sapiens
gagaaagguuuuagacuccaguuuaccuuucucuuggagaaacucaaugcuaaucccaccuuu

SEQ ID NO: 448790 - RNA, 63 nt, Homo Sapiens
uguucacacacuuuucuugcguacucaacuaaauuggagaauguuucugaagaaaauuggaug

SEQ ID NO: 448791 - RNA, 63 nt, Homo Sapiens
aaggcucgaguucugcuguucuguaaaagagaauuggagaaugaaaccugcuccaacagagau

SEQ ID NO: 448792 - RNA, 63 nt, Homo Sapiens
ccugucauuucuguucuugucccucauacaucuuuggagaaccgggcuccagacuuuguuccc

SEQ ID NO: 448793 - RNA, 63 nt, Homo Sapiens
ggacaggacccagcccugcaccguucacuguauuuggagaaaaugguaagaguuccauaccgg

SEQ ID NO: 448794 - RNA, 63 nt, Homo Sapiens
guguauguguggaaauaaaaauguauuguacuuuuggagaauuuuuuguaggcauuuuucugu

SEQ ID NO: 448795 - RNA, 63 nt, Homo Sapiens
ggcucuggccaucugcaacccugaacgugcagguuggagaacgaaugaauacaaauuuuauug

SEQ ID NO: 448796 - RNA, 63 nt, Homo Sapiens
agccuuuccuacauccuucccucacucccaugauuggagaaaugauucauugggugaugagug

SEQ ID NO: 448797 - RNA, 63 nt, Homo Sapiens
gcagcugggcugucagggccauaguagcucccuuuggagaacagggaaagccuggaggcuucc

SEQ ID NO: 448798 - RNA, 63 nt, Homo Sapiens
acagugcaacaaguaacgagacuauuuuguauuuuggagaauucauauuauggagaaccuaac

SEQ ID NO: 448799 - RNA, 63 nt, Homo Sapiens
auuccuaccaggaaagaauacauauccaauagauuggagaaagccagagauuagcccucauuc

SEQ ID NO: 448800 - RNA, 63 nt, Homo Sapiens
auuuuucacaaagagcaaugacuuuauuuugcauuggagaacuccuggagauaagcuguacaa

SEQ ID NO: 448801 - RNA, 63 nt, Homo Sapiens
caaggaaggaggcggugacacaaggcuuuaucuuuggagaaggguuagugagggccucaaguc

SEQ ID NO: 448802 - RNA, 63 nt, Homo Sapiens
cgucuugcuuugucacccacgggaaacuuuuuuuuggagaagggucuucauuuggggccaaag

SEQ ID NO: 448803 - RNA, 63 nt, Homo Sapiens
ggaggugagcaaauuaacggauuggucuggaaauuggagaaauaggaucugauacaucuaguu

SEQ ID NO: 448804 - RNA, 63 nt, Homo Sapiens
gaauuaaguugacuugaaaugugcacuaugagauuggagaaauaauuaaagaaccuggugggu

SEQ ID NO: 448805 - RNA, 63 nt, Homo Sapiens
gaggcugaggguagagggaggggugggaaucucuuggagaacuuguuuaaaagaaaaucaggu

SEQ ID NO: 448806 - RNA, 63 nt, Homo Sapiens
aucuguagcuuguugaaaaagcauuucagaguguuggagaagacugacugggacccugaagag

SEQ ID NO: 448807 - RNA, 63 nt, Homo Sapiens
aaaaagggcgguggaggggaguaauuccuaaucuuggagaauauuucaaaaaccuaauccgua

SEQ ID NO: 448808 - RNA, 63 nt, Homo Sapiens
uuuggggcacguuuuccuacgcuuuaaaguacuuuggagaaacaauuaaauacauuucauuga

SEQ ID NO: 448809 - RNA, 63 nt, Homo Sapiens
ggcagaucaaaagaggugaagagaaugauguucuuggagaacaagaggaacuuggaucuuccg

SEQ ID NO: 448810 - RNA, 63 nt, Homo Sapiens
uaggugaagaugcaaccagauaacucugaauacuuggagaaacauaaaagaaguugugcuauu

SEQ ID NO: 448811 - RNA, 63 nt, Homo Sapiens
cccaaacuccuucuccacugaauuugcaaguuuuuggagaaccucaaguaguuuuaauaugua

SEQ ID NO: 448812 - RNA, 63 nt, Homo Sapiens
ugcagccucacgcaccauccagcugagacaaaauuggagaagcgaaaaaugcucucccagcaa

SEQ ID NO: 448813 - RNA, 63 nt, Homo Sapiens
aguaggaacaacacaugguaaaucuacuagacauuggagaaacuugcacaucaguaugugcca

SEQ ID NO: 448814 - RNA, 63 nt, Homo Sapiens
cugguucccguuuuccagagaaacccuguguccuuggagaaaguuauuucugcagguugguga

SEQ ID NO: 448815 - RNA, 63 nt, Homo Sapiens
aaggacaccguuacccaugccuucaucacauacuuggagaacacuuguguggucagcucuucc

SEQ ID NO: 448816 - RNA, 63 nt, Homo Sapiens
uuucuuacucauuucaguccaaaaucauacaucuuggagaaccgauuuauggaguaaggacuu

SEQ ID NO: 448817 - RNA, 63 nt, Homo Sapiens
cuggagccauaaaguuaauuugcaccuagcuuuuuggagaauagccaugauuaacugcuauuc

SEQ ID NO: 448818 - RNA, 63 nt, Homo Sapiens
aguuuuuuaaaaauagacuguaguauccuuucauuggagaauuuacaaaaauaucaucuacag

SEQ ID NO: 448819 - RNA, 63 nt, Homo Sapiens
uucaaaccaaagaaacaaugaucuacucaaacauuggagaaaaaaacugccagaggaggaguu

SEQ ID NO: 448820 - RNA, 63 nt, Homo Sapiens
cagcuuucgucugucaucagacauugaagagauuuggagaaauguaaagcagcaguacucuuc

SEQ ID NO: 448821 - RNA, 63 nt, Homo Sapiens
agauggguauauaacaguuuggaaauacuaucuuuggagaauguauuuuuguauuuauaaauc

SEQ ID NO: 448822 - RNA, 63 nt, Homo Sapiens
ugagcaggcacauugacuuucuguugagguaccuuggagaagcugagccauucugaggacauc

SEQ ID NO: 448823 - RNA, 63 nt, Homo Sapiens
auuuuuaaaggaauauuucagaguuuaaucuuuuuggagaaguuauguucuuuaaucggguac

SEQ ID NO: 448824 - RNA, 63 nt, Homo Sapiens
uauguauguucagccagauaguaaaugggauuuuuggagaaauaagauaacuacaaaguuucu

SEQ ID NO: 448825 - RNA, 63 nt, Homo Sapiens
ugucaaauuacagccaaugacaugauagugcuuuuggagaacuaaguauuaucuaauuaaguu

SEQ ID NO: 448826 - RNA, 63 nt, Homo Sapiens
cuggaguuguuaugaacauguugcagauuguucuuggagaauugcuaggaauuguuaagcaca

SEQ ID NO: 448827 - RNA, 63 nt, Homo Sapiens
aaaacuguacugcuuguucaugacuuuugucuuuuggagaaaaugcaucacugaggaugaaac

SEQ ID NO: 448828 - RNA, 63 nt, Homo Sapiens
aaagaaaagcaaaugaguguuuagcaacugguguuggagaaaaauaauagagauugauaagau

SEQ ID NO: 448829 - RNA, 63 nt, Homo Sapiens
uucuuaguugggugaauuaaauaugcuuauggcuuggagaaauuuuuccaguauuaaacacuc

SEQ ID NO: 448830 - RNA, 63 nt, Homo Sapiens
uucuuguucccguagaagaaagaagaaagguguuuggagaauucgagugccuaggaugccaga

SEQ ID NO: 448831 - RNA, 63 nt, Homo Sapiens
aagacaaagauauuuagguugagcagcuauuaauuggagaauugguacagagacgcuccagau

SEQ ID NO: 448832 - RNA, 63 nt, Homo Sapiens
agccuggcugcagcuucccauuugguuacgagguuggagaaaaagucaaaguccccuccuggg

SEQ ID NO: 448833 - RNA, 63 nt, Homo Sapiens
auagcaucuggaagaucauuuugaaauuguuccuuggagaaaugaaaacaguguguaaacaaa

SEQ ID NO: 448834 - RNA, 63 nt, Homo Sapiens
cuuucuugucaaacaaaaccaauggcucuggguuuggagaacacaguggcugguuuuaaaaau

SEQ ID NO: 448835 - RNA, 63 nt, Homo Sapiens
ugccuuucccaaaugggaaaggugcugacagaguuggagaaaaaagaauagacucauuuuucc

SEQ ID NO: 448836 - RNA, 63 nt, Homo Sapiens
gcuugugcugggaaaugcaacucacucauguauuuggagaaacaggaguguucacuuaucuag

SEQ ID NO: 448837 - RNA, 63 nt, Homo Sapiens
uuaucaaaaauuucauggaacuuugugggguuuuuggagaaggaaacuucuuuuaaaccucac

SEQ ID NO: 448838 - RNA, 63 nt, Homo Sapiens
gauugaacuuuucaagacauuuauucggagaauuuggagaaguggagagauauuuucuuaugu

SEQ ID NO: 448839 - RNA, 63 nt, Homo Sapiens
caaugcagaacugaugggaauaaaccuugacaguuggagaagcucaauauaacaauauaaucc

SEQ ID NO: 448840 - RNA, 63 nt, Homo Sapiens
acaugcauauaauucuguagagguauuuugauauuggagaauaaguuuaaaaauucuuuaaac

SEQ ID NO: 448841 - RNA, 63 nt, Homo Sapiens
uguauuuguguucacuucuagacuauugaaauuuuggagaaaacaaugcuuauauauuccuua

SEQ ID NO: 448842 - RNA, 63 nt, Homo Sapiens
ugcuauucuuccuguuguccaauaggacucgacuuggagaaauacaaaaaugaaaauauuuau

SEQ ID NO: 448843 - RNA, 63 nt, Homo Sapiens
agaucuccgugcccuacagaggagccuggguuuuuggagaaagcuuaguugucauaaucccuu

SEQ ID NO: 448844 - RNA, 63 nt, Homo Sapiens
gaagggcccccauggcccugugauuuuauuguuuuggagaauguuuuagauaggaucuaggag

SEQ ID NO: 448845 - RNA, 63 nt, Homo Sapiens
ccauggccaaaacgauugugauuucacuggugguuggagaaaacuaaaaugaaccaaacccau

SEQ ID NO: 448846 - RNA, 63 nt, Homo Sapiens
agguuguccguguccuuaacuguagugaauuuauuggagaaugucaauguguauguggcuguu

SEQ ID NO: 448847 - RNA, 63 nt, Homo Sapiens
uuugugcccuguguuuuauacuauuuucuauauuuggagaaagaaugaauugaaccauuucaa

SEQ ID NO: 448848 - RNA, 63 nt, Homo Sapiens
auaguagauuuuaauuugacguuucacuuuuuguuggagaaaaaucaacagcaaacuucagcc

SEQ ID NO: 448849 - RNA, 63 nt, Homo Sapiens
acugugccucagagaccagggcuccagccccucuuggagaagucucagcuaagcucacguccu

SEQ ID NO: 448850 - RNA, 63 nt, Homo Sapiens
aagccagcuggacuuccugggucgaguggggccuuggagaacuuuucugucuuacaagaggau

SEQ ID NO: 448851 - RNA, 63 nt, Homo Sapiens
gaauugcucauucauauuuuuucuguugcuugcuuggagaauuugcucuuuuuuuggcauaua

SEQ ID NO: 448852 - RNA, 63 nt, Homo Sapiens
accuuugcacacucaccugagcccuggggacccuuggagaaauuaggugucaccugcuguggc

SEQ ID NO: 448853 - RNA, 63 nt, Homo Sapiens
caugaaacauuugcaaaauuguuuuugguuggauuggagaaguaauccuagggaaggguggug

SEQ ID NO: 448854 - RNA, 63 nt, Homo Sapiens
ugauaccaaacaauucaaaaguuggaucugaguuuggagaaagauauuuccaaccuaaguggg

SEQ ID NO: 448855 - RNA, 63 nt, Homo Sapiens
caaacuauguagugugucccuauuauaaaugcauuggagaaguauuuuuaugagacucuuuac

SEQ ID NO: 448856 - RNA, 63 nt, Homo Sapiens
ugaggccucuuauguguaauaaugugaaaguacuuggagaaacuagaagucugcuaaagauca

SEQ ID NO: 448857 - RNA, 63 nt, Homo Sapiens
gcuuagaaauucagcauuugacauucauagucuuuggagaaauucuguggagguggaaaagca

SEQ ID NO: 448858 - RNA, 63 nt, Homo Sapiens
cucaguuccaacuugugauuuagaauuuccacuuuggagaauaccuggagugacacuacacuc

SEQ ID NO: 448859 - RNA, 63 nt, Homo Sapiens
uguuuaaauaguucuguugugcuuuucucaauuuuggagaagauuuaaaaauuuaacaugauu

SEQ ID NO: 448860 - RNA, 63 nt, Homo Sapiens
augauagaugauauacuagaucuugccacaauauuggagaauauuuuuacuugcggugacuau

SEQ ID NO: 448861 - RNA, 63 nt, Homo Sapiens
acaggcucaaaguggggcugggucuuggccacauuggagaaaagaaguucugccucugccugg

SEQ ID NO: 448862 - RNA, 63 nt, Homo Sapiens
ugccccgagcccuagguggggccaggaggugccuuggagaagccagccagagcagagagggcu

SEQ ID NO: 448863 - RNA, 63 nt, Homo Sapiens
cagacucugagaagcgaagaccaugucuccucguuggagaaacccaauagcaggggaagcugg

SEQ ID NO: 448864 - RNA, 63 nt, Homo Sapiens
guguguaaugcaaauuaguuaaaacaaauaguuuuggagaaaguuaaaacuagcuuuagagua

SEQ ID NO: 448865 - RNA, 63 nt, Homo Sapiens
cagaaucauucuccuuucugcccauaaagggccuuggagaauugcuuuaagaagagugaaugu

SEQ ID NO: 448866 - RNA, 63 nt, Homo Sapiens
ggagccugggaccccgcaugucccaaaaugggauuggagaagcuggagagaaagcagaagagg

SEQ ID NO: 448867 - RNA, 63 nt, Homo Sapiens
uuuuggguguuccuggcaguuuaaaaaaauugguuggagaauuuagguuuuuauuaguaccau

SEQ ID NO: 448868 - RNA, 59 nt, Homo Sapiens; identical to SEQ ID NO: 445473

SEQ ID NO: 448869 - RNA, 63 nt, Homo Sapiens
guguggugaugccaugcccaucaugggaggcuuuuggagaaacagaauguuugggcaggggcu

SEQ ID NO: 448870 - RNA, 63 nt, Homo Sapiens
ucuuccacuggaacguuucacugcaaacacaccuuggagaaguggcaucagucaacagagagg

SEQ ID NO: 448871 - RNA, 63 nt, Homo Sapiens
gaagccagcugggcuccugagucugguggggacuuggagaaccuuuaugucuagcuaagggau

SEQ ID NO: 448872 - RNA, 63 nt, Homo Sapiens
ccacacucuguaucuggcuacucugguggggacuuggagaaccuuuguguccacacucuguau

SEQ ID NO: 448873 - RNA, 63 nt, Homo Sapiens
acacccuccuggcacaacgcucuacccugcagcuuggagaacuccgcuggauggggagucuca

SEQ ID NO: 448874 - RNA, 63 nt, Homo Sapiens
uggaucaccugaauucucucagcugucaauggcuuggagaacaucucaugggcccaagucauc

SEQ ID NO: 448875 - RNA, 63 nt, Homo Sapiens
uuguugaaauagcuuuacuguuucucaaguguuuuggagaaaaaaaucaacccugcaaucacu

SEQ ID NO: 448876 - RNA, 63 nt, Homo Sapiens
uggccaaagugaaggaaucuuuuuucaguuuuauuggagaaacugaaggguaacauucuaaca

SEQ ID NO: 448877 - RNA, 63 nt, Homo Sapiens
gcuguggcugacaguggcucuggccaggguugcuuggagaaggcucagugugccugggacagg

SEQ ID NO: 448878 - RNA, 63 nt, Homo Sapiens
uuaauuuccaaaucaggaacuggacuggaauguuuggagaaugaaagcggauaaaacuuucau

SEQ ID NO: 448879 - RNA, 63 nt, Homo Sapiens
gugaaguuuguuuuuucgccuggacuuaucccuuuggagaagaguuuguaguuacauuuagga

SEQ ID NO: 448880 - RNA, 63 nt, Homo Sapiens
uggauggccuuaggguuccugugcagccagcuuuuggagaacccggccuggccuagaccaggg

SEQ ID NO: 448881 - RNA, 63 nt, Homo Sapiens
agcugcugagcauggcuuuccugcuggccagcauuggagaagauugugacuuggaaagguacg

SEQ ID NO: 448882 - RNA, 63 nt, Homo Sapiens
agcucacugcucucuagaaaccccugcucaccauuggagaaucggucccaguucacauguagu

SEQ ID NO: 448883 - RNA, 63 nt, Homo Sapiens
uggugcugaaauccaccuuuuguugccgucgaguuggagaaagaccggccucaugacuagccu

SEQ ID NO: 448884 - RNA, 63 nt, Homo Sapiens
aaguuugugauuaguccuuaauucaggauguuguuggagaaacugugauggugcaaggaaugg

SEQ ID NO: 448885 - RNA, 63 nt, Homo Sapiens
gguggccucgccggagcuaggaccgcaugccgcuuggagaaggugccugacugccucagcagg

SEQ ID NO: 448886 - RNA, 63 nt, Homo Sapiens
gaguacauuuuuaaaauuuuggcauuucaggaguuggagaacguuuucuccagcaacugcaga

SEQ ID NO: 448887 - RNA, 63 nt, Homo Sapiens
uacagcaucauggaugcuguugaucagggaauuuuggagaaacggauggugaggacacagcua

SEQ ID NO: 448888 - RNA, 63 nt, Homo Sapiens
gauucccaaguccaggaagaucugguuuaauuauuggagaaucagacauaaacuuggagucca

SEQ ID NO: 448889 - RNA, 63 nt, Homo Sapiens
uacuuuuccucagaagauugagcugucuuuuauuuggagaauaaaaugaaguucugaaaaaaa

SEQ ID NO: 448890 - RNA, 63 nt, Homo Sapiens
uugccaagaagugaucuguuuuaaaggucauauuuggagaaagggcaaggaauugggucugcu

SEQ ID NO: 448891 - RNA, 63 nt, Homo Sapiens
ggauguguuugggggcggggggauggaagugacuuggagaauguguuugggaugaaauaacua

SEQ ID NO: 448892 - RNA, 63 nt, Homo Sapiens
uauaaaccacugaaagggauagagaagugaacauuggagaaagccaguagcaacugugagaaa

SEQ ID NO: 448893 - RNA, 63 nt, Homo Sapiens
ggaggaucaguagcuguuaugaugccagaccauuuggagaaguaucagaggccugaccggaca

SEQ ID NO: 448894 - RNA, 63 nt, Homo Sapiens
aagcccuuggggugacucggcuuccaggagcuguuggagaaaugaggaugucugucccugucu

SEQ ID NO: 448895 - RNA, 63 nt, Homo Sapiens
ggcauuccuacuggagaaaacugacuuggaaaguuggagaagacaacugcugguagcauuuau

SEQ ID NO: 448896 - RNA, 63 nt, Homo Sapiens
gaggcuggcugggggagaaagaggagggcuuguuuggagaaggcagguguggguguccuguug

SEQ ID NO: 448897 - RNA, 63 nt, Homo Sapiens
cugauuccuuuuuuguugucgacagggccaguguuggagaauuggcucggaccccucacuggg

SEQ ID NO: 448898 - RNA, 63 nt, Homo Sapiens
gcuuuggcagaagagugaaaugcucugugggguuuggagaaauagugagaauucgugcaucuc

SEQ ID NO: 448899 - RNA, 63 nt, Homo Sapiens
caccucuggcucuugugcuucacaggugcagcuuuggagaacucuuguguaaacguuugcaga

SEQ ID NO: 448900 - RNA, 63 nt, Homo Sapiens
gacauggggcugaaucucaggaaaggugguugcuuggagaagggggaagaugcuggacucauu

SEQ ID NO: 448901 - RNA, 63 nt, Homo Sapiens
ucacccuuucccuuuuucuugaaaucugccuuauuggagaaaacaaaaacuacauauuuguag

SEQ ID NO: 448902 - RNA, 63 nt, Homo Sapiens
ggaucuguccaauaaacgcuccugcucuaaacuuuggagaacucuccauagcuaccaaguuaa

SEQ ID NO: 448903 - RNA, 63 nt, Homo Sapiens
agaggagagaaaagagggccugugcacauauguuuggagaaauugccacucaguuccucuggg

SEQ ID NO: 448904 - RNA, 63 nt, Homo Sapiens
aggguagagagagguugcuaggcagaagugaauuuggagaacucagauaucaaaccugaggaa

SEQ ID NO: 448905 - RNA, 63 nt, Homo Sapiens
acaaggguuuuguccugaauaaaaccccaccauuuggagaauuguugaaguccaaccuauuua

SEQ ID NO: 448906 - RNA, 63 nt, Homo Sapiens
uguugcugagacccccccccccuccagcuccucuuggagaagcagccuucaugccuuccccac

SEQ ID NO: 448907 - RNA, 63 nt, Homo Sapiens
caaggaaggcggaagaauggcuaucaggugguuuuggagaaaacagaaaucaggacauccccc

SEQ ID NO: 448908 - RNA, 63 nt, Homo Sapiens
auuuuuuuuuuaaauaauaugugcagaauauuuuuggagaacguuaacaacugaggaaggcca

SEQ ID NO: 448909 - RNA, 63 nt, Homo Sapiens
uuaauguuuuucauuuaucaauaccuuguucaauuggagaauuaacaacauaaaaauccuugc

SEQ ID NO: 448910 - RNA, 63 nt, Homo Sapiens
gcauguguggggugugugugguguucuggucacuuggagaaggacaccuggcaucuguggcau

SEQ ID NO: 448911 - RNA, 63 nt, Homo Sapiens
gugugugugggaugcgugugguguccuagucacuuggagaaggugugggcgcgucuguggugu

SEQ ID NO: 448912 - RNA, 63 nt, Homo Sapiens
aucugaugccuuuuucuuuggagccucaggcuguuggagaagcaacugucugcccaggagccu

SEQ ID NO: 448913 - RNA, 63 nt, Homo Sapiens
auggaagcauguguaaaauuauacuuucaguaauuggagaauucagagauugcauuucuagca

SEQ ID NO: 448914 - RNA, 63 nt, Homo Sapiens
cuuguauugugauauuaacuggcaaagauccucuuggagaaaccuuucccagguacaguuuca

SEQ ID NO: 448915 - RNA, 63 nt, Homo Sapiens
aaugaagcugauuuuuuagcugagauagaagcuuuggagaaaaugaaugaagaucacguucag

SEQ ID NO: 448916 - RNA, 63 nt, Homo Sapiens
ucguuuuuguuucccuuuaguauuuaauggucuuuggagaaaaaauaauaaaacagaguguua

SEQ ID NO: 448917 - RNA, 63 nt, Homo Sapiens
ccucagaauucagaagauauacuaccucccagcuuggagaacauuugccucccacacccagcc

SEQ ID NO: 448918 - RNA, 63 nt, Homo Sapiens
ggugcuaguuggcaauagaucacacacuuugauuuggagaauuuugcacgaguguguuuuccu

SEQ ID NO: 448919 - RNA, 63 nt, Homo Sapiens
ucacagagauggaugcauguucugauugccucuuuggagaagcucaucagaaacucaaaagaa

SEQ ID NO: 448920 - RNA, 63 nt, Homo Sapiens
agcaucguggaugggugcacggagacacgcaccuuggagaaaugaggggagauggaccaagaa

SEQ ID NO: 448921 - RNA, 63 nt, Homo Sapiens
ggguuguuacaacugucacuagcggaggucacuuuggagaagggugggccuuacauccagugu

SEQ ID NO: 448922 - RNA, 63 nt, Homo Sapiens
aauaaaauugcugggaauauuugacucuccguauuggagaaaauaaaauuacaacauuacgac

SEQ ID NO: 448923 - RNA, 63 nt, Homo Sapiens
aucauuacuggaaaccuauuaaacauuagcaaauuggagaauaguuuuaauauaguaaaugua

SEQ ID NO: 448924 - RNA, 63 nt, Homo Sapiens
gguagcgcugggggugauuuuaggcagcaagaauuggagaacucacacugcgaaaagaaaacc

SEQ ID NO: 448925 - RNA, 63 nt, Homo Sapiens
uggggugugaaagccucaagugacucagccugguuggagaacugccccacccaguaucuucug

SEQ ID NO: 448926 - RNA, 63 nt, Homo Sapiens
agucuucaguaacgcuacaacgauugcaaaucauuggagaauccauaaugaagagagaucuuc

SEQ ID NO: 448927 - RNA, 63 nt, Homo Sapiens
acucaaaucauauuagacaucggagaaaucacuuuggagaaaggucuuuugagugcacugagu

SEQ ID NO: 448928 - RNA, 63 nt, Homo Sapiens
aaaaagccagggugugccagccuccugcuggccuuggagaagcuaaucaggugagccacucac

SEQ ID NO: 448929 - RNA, 63 nt, Homo Sapiens
cuuuuauaucaaaaguggagauuugccccccauuuggagaaugacuccacagugacuugccac

SEQ ID NO: 448930 - RNA, 63 nt, Homo Sapiens
uugugcacuaucacugggaaaggauguggaauguuggagaacagaaaacaagaaauacuguca

SEQ ID NO: 448931 - RNA, 63 nt, Homo Sapiens
uugaaugcuaccccccaaguugauuuaggggcuuuggagaacucguauaagcucaaugaguau

SEQ ID NO: 448932 - RNA, 63 nt, Homo Sapiens
acccugcaaauguaauaaaucagggaauucagauuggagaaaaacuuaaacuuuguucaacau

SEQ ID NO: 448933 - RNA, 63 nt, Homo Sapiens
cuauagcccuuuaguuauuuauuuuguuuuuaguuggagaacuuuauuuaguuagaacacuuc

SEQ ID NO: 448934 - RNA, 63 nt, Homo Sapiens
acucuaugaauagaauauacgggaaaaauaauguuggagaaaugacuacagcuuauucagccu

SEQ ID NO: 448935 - RNA, 63 nt, Homo Sapiens
uagugucagaauugaauuauagucugcacuaacuuggagaaguuggacugcacuaacuugugg

SEQ ID NO: 448936 - RNA, 63 nt, Homo Sapiens
cauaaugaagagagaucuuacgauuacaaaucauuggagaaucagucuucaguaaugcuacaa

SEQ ID NO: 448937 - RNA, 63 nt, Homo Sapiens
uauaaugaauaaagaucuaaccauugcaaaucauuggagaaucagucuucaguaacgcuacaa

SEQ ID NO: 448938 - RNA, 63 nt, Homo Sapiens
cauaaugagagaucuuacaaccauugcaaaucauuggagaaucaguuuucaguaaugcuacaa

SEQ ID NO: 448939 - RNA, 63 nt, Homo Sapiens
cacagugaagagaucuuacaccauugcacaucauuggagaaucaguuuucaguaaugcuacaa

SEQ ID NO: 448940 - RNA, 63 nt, Homo Sapiens
acuugaagaauguaaugccauuacuucucccucuuggagaaagaggcuaauugugacugugac

SEQ ID NO: 448941 - RNA, 63 nt, Homo Sapiens
cccucuagaaacauauuggcggguucaagagaguuggagaaacguacuuguaccuaaggcccu

SEQ ID NO: 448942 - RNA, 63 nt, Homo Sapiens
cacaccugaguaagauccuggucucauuaaauauuggagaauauuaugagugcagugagucca

SEQ ID NO: 448943 - RNA, 63 nt, Homo Sapiens
ucuugugaauuacacagcaaugguaacucccucuuggagaauuuggguaaauauguguugaau

SEQ ID NO: 448944 - RNA, 63 nt, Homo Sapiens
caugugagugaagagaugucacugucuguggucuuggagaacuagucucguagcugaggggug

SEQ ID NO: 448945 - RNA, 63 nt, Homo Sapiens
caaccaccuugaaaccuuuagaacaucucugcuuuggagaaagacccagagaucaggcagagg

SEQ ID NO: 448946 - RNA, 63 nt, Homo Sapiens
gauguuaaaacagucccguggaaggagcagggguuggagaaaggcaucccaaagcuucgaugg

SEQ ID NO: 448947 - RNA, 63 nt, Homo Sapiens
ucucagagacucccaggaguuguugaacuauauuuggagaaaacagccacugaauauuaucau

SEQ ID NO: 448948 - RNA, 63 nt, Homo Sapiens
gggguaaaugcuuugaggcccagggaccaaucuuuggagaaaguagauauuuccaucaaagcc

SEQ ID NO: 448949 - RNA, 63 nt, Homo Sapiens
gcgaauacagcucacagagaaacgcaugugcuauuggagaacaggucuuuguggagaucuaaa

SEQ ID NO: 448950 - RNA, 63 nt, Homo Sapiens
guaacauuuaaacauuaauuuaaaaagggaaccuuggagaauucuuuuguucacuaguuccuu

SEQ ID NO: 448951 - RNA, 63 nt, Homo Sapiens
ugcagcgccaagcggcauccaccaagcaucaaguuggagaaaagggaacccaagcaguagaga

SEQ ID NO: 448952 - RNA, 63 nt, Homo Sapiens
cuagguuuccaggccucacagccaagcugaagcuuggagaaaacucugcauucccaugagggc

SEQ ID NO: 448953 - RNA, 63 nt, Homo Sapiens
ggcugaggugggagaaucacuugaguccuggaguuggagaacagccuggaaagccuggcgaua

SEQ ID NO: 448954 - RNA, 63 nt, Homo Sapiens
gagcaccuuggugagcaagccuggcuuuaaagauuggagaagagcuucuggcaccagaacccu

SEQ ID NO: 448955 - RNA, 63 nt, Homo Sapiens
ccuuugcaguguugccgaaucacagcaguucuguuggagaaacgcuugguuuccggauccaga

SEQ ID NO: 448956 - RNA, 63 nt, Homo Sapiens
auuuccucccugccucaugugagaccacaggguuuggagaagcaguuggaacccacguguggu

SEQ ID NO: 448957 - RNA, 63 nt, Homo Sapiens
aaagccacuuacuggcuuuugacaugacuucucuuggagaauaaguggacuccaagcuaacuc

SEQ ID NO: 448958 - RNA, 63 nt, Homo Sapiens
ucagguguuccuuccuaaaaaaaaaagucuauuuuggagaauugaaauaauucauggaaggga

SEQ ID NO: 448959 - RNA, 63 nt, Homo Sapiens
ucucuucugguaauuuuuauuugagaaaaugauuuggagaacuacaccuccugaguuuugcaa

SEQ ID NO: 448960 - RNA, 63 nt, Homo Sapiens
gggaggccucuuggagacacaaccuccuucucuuuggagaaugcuuccucuccaaagcgccag

SEQ ID NO: 448961 - RNA, 63 nt, Homo Sapiens
ccuccuuguugcaugaggucaggguuucucaaauuggagaaccggacugguggugccaagaua

SEQ ID NO: 448962 - RNA, 63 nt, Homo Sapiens
agaauuauccccacuucacaguuuggccuuguguuggagaaagcuguacaugaaccaggucau

SEQ ID NO: 448963 - RNA, 63 nt, Homo Sapiens
gauggucaguuagccugucugaauguuuugguauuggagaaggccaaccccaacaacaaaaaa

SEQ ID NO: 448964 - RNA, 63 nt, Homo Sapiens
accgcaugaagauacuuguauuggugguugaacuuggagaaagccugccagcucucggagucc

SEQ ID NO: 448965 - RNA, 63 nt, Homo Sapiens
guuaucuuuagcagauauuaaaaauugaaaacuuuggagaacucauuucaaguuaugauucag

SEQ ID NO: 448966 - RNA, 63 nt, Homo Sapiens
gccuucagcaggacucuuaauaucugcugcaacuuggagaaccucccugcccugaaaugugaa

SEQ ID NO: 448967 - RNA, 63 nt, Homo Sapiens
uacaaacacgggcggaaggcacucaggcuuucguuggagaaacagaaauaaggccuucuuuug

SEQ ID NO: 448968 - RNA, 63 nt, Homo Sapiens
gauuucugaggagugugugaucccuacagauuuuuggagaaaguaggaagaaaaaggaugcau

SEQ ID NO: 448969 - RNA, 63 nt, Homo Sapiens
caugaagagguauucaucuggaacgacuucacguuggagaaagaacucauucuuacgaaauua

SEQ ID NO: 448970 - RNA, 63 nt, Homo Sapiens
uguggcuggaacacaaacaauggguggguuccuuuggagaagaagcaagccugcacacgggcu

SEQ ID NO: 448971 - RNA, 63 nt, Homo Sapiens
ucgcugggaccuggucccuuuguugcaggcggcuuggagaaagggcagugggacgcuggccac

SEQ ID NO: 448972 - RNA, 63 nt, Homo Sapiens
ccaguugcagguuaagccccagaaaaguucaccuuggagaagcuccgagaacacacagauugu

SEQ ID NO: 448973 - RNA, 63 nt, Homo Sapiens
caagaauauuuguggagguagguguggggaagguuggagaagaguuagguuugugcuuuguaa

SEQ ID NO: 448974 - RNA, 63 nt, Homo Sapiens
uuggcucuuuggaggcgagaggaaggggagaacuuggagaauaguuuuugcuuuggggguaga

SEQ ID NO: 448975 - RNA, 63 nt, Homo Sapiens
uccccuacuucucccuugcucccaaagcuuuccuuggagaagggcccuccugcagcuggaccc

SEQ ID NO: 448976 - RNA, 63 nt, Homo Sapiens
gcugcuacuuaacaaggaaggcuugugcuccccuuggagaagguggaggcugugugcgggcag

SEQ ID NO: 448977 - RNA, 63 nt, Homo Sapiens
ggaaagcuccaucaaagaggaauucggcaagacuuggagaaaaaucaaugcuuuuccucagga

SEQ ID NO: 448978 - RNA, 63 nt, Homo Sapiens
gccagcugcccuuucguccccuacagcugaagguuggagaaaucuuuuccaaguucccaaggc

SEQ ID NO: 448979 - RNA, 63 nt, Homo Sapiens
ggccgucuccccuuagccaaguccuccucaggcuuggagaacuuccucagcgucaccuccuuc

SEQ ID NO: 448980 - RNA, 63 nt, Homo Sapiens
ucgcgcaccgaaaaacuaaaaauaaugggcgcuuuggagaagaguguggagucauucucauug

SEQ ID NO: 448981 - RNA, 63 nt, Homo Sapiens
uuuuauuucagucacuccugauaaauaacaaauuuggagaaauaaaaauaucuaaaauaaauu

SEQ ID NO: 448982 - RNA, 63 nt, Homo Sapiens
aagggcacuuggcaaccacuaugugaagggugauuggagaaggacaagacuguggaaugggga

SEQ ID NO: 448983 - RNA, 63 nt, Homo Sapiens
agacuguggaauggggaauaaggaaggaggaguuuggagaaugacuccaaagguuugagcuug

SEQ ID NO: 448984 - RNA, 63 nt, Homo Sapiens
gugaggcacucuggaauaugacccuaccagagguuggagaacaaacuugggcagccggaaccc

SEQ ID NO: 448985 - RNA, 63 nt, Homo Sapiens
ugaugaucaaccugccuccccuccauagucuuguuggagaagcccagagagaaugggacucca

SEQ ID NO: 448986 - RNA, 63 nt, Homo Sapiens
gauggcgucuaccagaaggggauggacuucauuuuggagaagcucaaccauggggacugggug

SEQ ID NO: 448987 - RNA, 63 nt, Homo Sapiens
gaaaauuauuucuuggggauaucagauuuuaccuuggagaaaucucaaugaaauaagcugcua

SEQ ID NO: 448988 - RNA, 63 nt, Homo Sapiens
auggacugaucuuuaaacuaguuagggguuuuguuggagaaaagcaauuuuuaaaaucuagaa

SEQ ID NO: 448989 - RNA, 63 nt, Homo Sapiens
uauuggacuuuguccucucuugaacugagcaauuuggagaaugcaagacucucagguauagaa

SEQ ID NO: 448990 - RNA, 63 nt, Homo Sapiens
gcaaguuauauguucacaaagcagccaauuuuauuggagaaaaugccuucuuugccuagccaa

SEQ ID NO: 448991 - RNA, 63 nt, Homo Sapiens
ucaacaugucuccuacugaguguuugcugaacauuggagaaucugguuggaagggaauagaaa

SEQ ID NO: 448992 - RNA, 63 nt, Homo Sapiens
cuugcaguuaucuuagcauuacugcucuaaaaguuggagaagugugcaauauucuuaaauacu

SEQ ID NO: 448993 - RNA, 63 nt, Homo Sapiens
cucacguuuuuuaacucaugauagauugaguacuuggagaauagaaugagcaacaccaugcau

SEQ ID NO: 448994 - RNA, 63 nt, Homo Sapiens
acauuucuuuacagguuaaacugcucuaguuucuuggagaaucagggauagaacaucacaaca

SEQ ID NO: 448995 - RNA, 63 nt, Homo Sapiens
uuacaaccuggguugcagaacacagaugcugcuuuggagaacuuaaaacucagaggaaauuug

SEQ ID NO: 448996 - RNA, 63 nt, Homo Sapiens
ggcuaggacagggaacagggccugaguacaggcuuggagaaauucuguugaucacagagggag

SEQ ID NO: 448997 - RNA, 63 nt, Homo Sapiens
uaagaacuuaacaauaaagcaauagguauuuucuuggagaauguccaucuugcugugauuugc

SEQ ID NO: 448998 - RNA, 63 nt, Homo Sapiens
cguuuuuaacugcaacuuucuugucuuuuuauuuuggagaaagguauaugcuggguauuucau

SEQ ID NO: 448999 - RNA, 63 nt, Homo Sapiens
cauauaauuaaaaagaauuugguuaauaagaauuuggagaauggaaaauacauuuuuagguuc

SEQ ID NO: 449000 - RNA, 64 nt, Homo Sapiens
gccuaugggugacugccuucucccagaguuuucuuuggagaacagaaagaagaaaggaaagaaa

SEQ ID NO: 449001 - RNA, 64 nt, Homo Sapiens
aguuucugaaaccgcucagauguuuuggggaaaguuggagaagccguggccuugcgagaggugg

SEQ ID NO: 449002 - RNA, 64 nt, Homo Sapiens
ggacccgggcaggcccccagcaccccaugcugacuuggagaaccccagaucucuggggcccagc

SEQ ID NO: 449003 - RNA, 64 nt, Homo Sapiens
gcagacaccggggcuggguuucucuuuccucuuuuuggagaaaaggaacagggcaguggaauga

SEQ ID NO: 449004 - RNA, 64 nt, Homo Sapiens
aaacccuuuccuccucccauuuugacauuugcacuuggagaacacuugaguugugaagguuuug

SEQ ID NO: 449005 - RNA, 64 nt, Homo Sapiens
cuggaggggagagaaggauucuagggguguggaguuggagaaagaggcuuccuugagccacccu

SEQ ID NO: 449006 - RNA, 64 nt, Homo Sapiens
acauuaggaaacaauggcagucaaacccauggcuuuggagaaaguaaauguuugccagaaagga

SEQ ID NO: 449007 - RNA, 64 nt, Homo Sapiens
gugcuggugcggauggacacuaaugcagccacgauuggagaauacuuugcuucauaguauugga

SEQ ID NO: 449008 - RNA, 64 nt, Homo Sapiens
aucagagcaaacaucauguagauagcacaaguauuuggagaaacguuguuuguuuuguuaccaa

SEQ ID NO: 449009 - RNA, 64 nt, Homo Sapiens
auaauuuaaaauaauuauuguauaauaucuacauuuggagaauuuugaacuaucaagcauauac

SEQ ID NO: 449010 - RNA, 64 nt, Homo Sapiens
agacgguaaaggcacuaaagucacuuuaaagcuuuuggagaagcaggagggcauuggcuuaacc

SEQ ID NO: 449011 - RNA, 64 nt, Homo Sapiens
aaaucugaaggacuucaucucccgcuuugagggcuuggagaagaucucugccuacaugaagucc

SEQ ID NO: 449012 - RNA, 64 nt, Homo Sapiens
accuggcauggacugauguuuuuaggcacagaaguuggagaagagauuucaugaaagacaacau

SEQ ID NO: 449013 - RNA, 64 nt, Homo Sapiens
cuguguuuucagaauuuccauuucuacuaaccucuuggagaaaaagaaauugaauuagagguaa

SEQ ID NO: 449014 - RNA, 64 nt, Homo Sapiens
cccuaaaagcuggagacacagauguccagagugauuggagaauguccugggggaaugaaguucc

SEQ ID NO: 449015 - RNA, 64 nt, Homo Sapiens
uucccugaggcuuuggggucagaguauauguuguuuggagaaagagggcaaucaggacucuucu

SEQ ID NO: 449016 - RNA, 64 nt, Homo Sapiens
uucuggccuggcuuucccucucagacauagcucuuuggagaacuagguguuguaauucaguuau

SEQ ID NO: 449017 - RNA, 64 nt, Homo Sapiens
cauugucaaaacuaccaauuccagguuaacuuuguuggagaauuucccccacccccauccagug

SEQ ID NO: 449018 - RNA, 64 nt, Homo Sapiens
ugcugguuccccagcccuuuucccuggcccuggcuuggagaaucuguuuucaaucuccacugau

SEQ ID NO: 449019 - RNA, 64 nt, Homo Sapiens
cuuggaggcaggauccaggcacagcuccccucacuuggagaaccuugacucucuugauggaaca

SEQ ID NO: 449020 - RNA, 64 nt, Homo Sapiens
auaaaacacugucuuuucaggauugcuucauggauuggagaacuuucuaaccaaaaauuaaaaa

SEQ ID NO: 449021 - RNA, 64 nt, Homo Sapiens
agacuuaguaccagaaccaaaaauaccuagauuuuuggagaacuuauuacauacauagaaacau

SEQ ID NO: 449022 - RNA, 64 nt, Homo Sapiens
gaacccagccuacucuagaauuucagcagugacauuggagaauauuuuuaauuugcugcaguac

SEQ ID NO: 449023 - RNA, 55 nt, Homo Sapiens; identical to SEQ ID NO: 445050

SEQ ID NO: 449024 - RNA, 64 nt, Homo Sapiens
ggcaaggagagaagugagagcuacaauuccagcauuggagaagcgaggggcggggcgucaacgg

SEQ ID NO: 449025 - RNA, 64 nt, Homo Sapiens
aggggcuaguuuggcuuuuccaaguggguuuucuuuggagaaucugaugccaugcaauuggcau

SEQ ID NO: 449026 - RNA, 64 nt, Homo Sapiens
ugucguagacuugugcaauauauacuguuguggguuggagaaaaguggaaagcuacacugggaa

SEQ ID NO: 449027 - RNA, 64 nt, Homo Sapiens
ugguaggcaaauuguuaggcagaauaaugguauguuggagaaauacaccugucucuuauucuua

SEQ ID NO: 449028 - RNA, 64 nt, Homo Sapiens
accuuugguaaauacaccauaccauaauaucugcuuggagaaccacaaugcacauuagcauauu

SEQ ID NO: 449029 - RNA, 64 nt, Homo Sapiens
aauuaacuagcauuuagccagcuuuuucuugcccuuggagaaaaagaaucauucucaaccugau

SEQ ID NO: 449030 - RNA, 64 nt, Homo Sapiens
uucugcagcauggcuuuuuaggaaaucuucauaauuggagaaaguuuuauuuuaauacauugua

SEQ ID NO: 449031 - RNA, 64 nt, Homo Sapiens
aaauuaacaauaaagaauuuuaaaaauauaucuguuggagaaagcuguggcuccauauuucaac

SEQ ID NO: 449032 - RNA, 64 nt, Homo Sapiens
augcugagaauuuguauugaaugggggagccuaauuggagaaugucauuagaaacaauugguua

SEQ ID NO: 449033 - RNA, 64 nt, Homo Sapiens
guucuguugcccugauuuaugucuucuggucuccuuggagaaagccaaggcggcggcagagcug

SEQ ID NO: 449034 - RNA, 64 nt, Homo Sapiens
cuucauaaaaucuaugaauauuggaggauauauuuuggagaaugauaaaacagacuuacucucc

SEQ ID NO: 449035 - RNA, 64 nt, Homo Sapiens
cccuaucagcacagggaucuaggcugucuggaaguuggagaauuuguacgcaaagggcagcccc

SEQ ID NO: 449036 - RNA, 64 nt, Homo Sapiens
agaaaaaucuuggggcuuccauggacauuuuacuuuggagaaacuaggaaagacauguaagagc

SEQ ID NO: 449037 - RNA, 64 nt, Homo Sapiens
gaugagcuacgccuugaugauguagcaugucaguuuggagaaaucgcuuuuuggaagacauuuc

SEQ ID NO: 449038 - RNA, 64 nt, Homo Sapiens
gcaggagaguaccugggaauuauuuacuuccuuguuggagaagguccugaguuaaaagucuauu

SEQ ID NO: 449039 - RNA, 64 nt, Homo Sapiens
ucaaaccuucaagcccuagguucccuuguuacuguuggagaaacgcuccagguggaagcaugcu

SEQ ID NO: 449040 - RNA, 64 nt, Homo Sapiens
agaaagaaaggaaagaacucagauaucuguaucuuuggagaagguuccauagaaaacuguagaa

SEQ ID NO: 449041 - RNA, 64 nt, Homo Sapiens
cuugccuauaauucuauaaauaaguuaaguuuuauuggagaaauuuauaguuuuauaacuggcu

SEQ ID NO: 449042 - RNA, 64 nt, Homo Sapiens
gucauaaauuacuguuuugcaacuaugcuaauuuuuggagaaaucuuuuuacuguugaacuuag

SEQ ID NO: 449043 - RNA, 64 nt, Homo Sapiens
ggucagaagccccaaacggcauaagaaaacugucuuggagaaugcaucccauccuugccaaaaa

SEQ ID NO: 449044 - RNA, 64 nt, Homo Sapiens
ggaaugugaaagcugucauuuggauccuuuggguuuggagaaaguuucuuggacuacuuuaauu

SEQ ID NO: 449045 - RNA, 64 nt, Homo Sapiens
agauggaugcuuauugaagcuuacucucuucuauuuggagaauauacaagccuuggguccaugu

SEQ ID NO: 449046 - RNA, 64 nt, Homo Sapiens
ucaggcuuuugauaaaugcucuuaagagaccgcauuggagaauuaaaaaugccuuuucauuggu

SEQ ID NO: 449047 - RNA, 64 nt, Homo Sapiens
agugcuuuaguaguaguuuaauuucucaggucauuuggagaacacccagagcugaggcaagggg

SEQ ID NO: 449048 - RNA, 64 nt, Homo Sapiens
uuuaaaaaacccagaaaaacaaaguuuuaauguauuggagaaguagugcuauguggcgagaaaa

SEQ ID NO: 449049 - RNA, 64 nt, Homo Sapiens
cauaacauuugaagaucaaaucccuguuaccuuuuuggagaauugagaccaaagggauaucugu

SEQ ID NO: 449050 - RNA, 64 nt, Homo Sapiens
ugacagggcugguccaggcccucaaugcacgaaguuggagaaccuaggcacggacacacccagu

SEQ ID NO: 449051 - RNA, 64 nt, Homo Sapiens
gcacccauaucugugugcccaguggagugacuauuuggagaauaaggaaggcggcaggcagaga

SEQ ID NO: 449052 - RNA, 64 nt, Homo Sapiens
ggaaaucauaaaaucauccuagcaaacaucacauuuggagaagauacacucuaucacauauuua

SEQ ID NO: 449053 - RNA, 64 nt, Homo Sapiens
agccauuauuuuagccacaguauaucccuucuuuuuggagaacuauguauauauuacucugcac

SEQ ID NO: 449054 - RNA, 64 nt, Homo Sapiens
cugaacuguuacaaaccccucuccccaugggaccuuggagaaaaucuuccuguucugcaccccu

SEQ ID NO: 449055 - RNA, 64 nt, Homo Sapiens
aguagucguaagauuaguugcuucauuaggggacuuggagaaccgaucaugagguuaaaauuuu

SEQ ID NO: 449056 - RNA, 64 nt, Homo Sapiens
guaccagcagugugucaggugcugcagagcguucuuggagaaggcccacugaggcagguucgug

SEQ ID NO: 449057 - RNA, 64 nt, Homo Sapiens
uaccuggcauagagaaaaauauauaccugguacauuggagaaaaauaauuacacuuucaaagag

SEQ ID NO: 449058 - RNA, 64 nt, Homo Sapiens
gguuguaaguggacaugcaaaccaaaauuggggauuggagaagucagacucacuagacuuuugg

SEQ ID NO: 449059 - RNA, 64 nt, Homo Sapiens
aaauuccugucaaaaucaauucagaaauucuaacuuggagaauuuaacauuuuacucuuguaaa

SEQ ID NO: 449060 - RNA, 64 nt, Homo Sapiens
caucuugcaagcaaaucccauuucuugaaaagccuuggagaacucgguuugguagacuuggaca

SEQ ID NO: 449061 - RNA, 64 nt, Homo Sapiens
gcagugauuuuguuccaaaacuuuguauacacauuuggagaaaaguacuuuauauuuucagugu

SEQ ID NO: 449062 - RNA, 64 nt, Homo Sapiens
cugcaagaaauauacugacaugaacaggcaguucuuggagaagaaagagcauuucuuuaaguac

SEQ ID NO: 449063 - RNA, 64 nt, Homo Sapiens
cacuccagccugggcaacagagcaagacccugucuuggagaaaccagaauuuuggaagagcaaa

SEQ ID NO: 449064 - RNA, 64 nt, Homo Sapiens
ugaguggcucuuugcaugaacacugugcaagguguuggagaaauccaaagcugaccaaaacaug

SEQ ID NO: 449065 - RNA, 64 nt, Homo Sapiens
uggccuucacgcucuugaucgucuuuccuuuguauuggagaaggacugggucagagaucuguug

SEQ ID NO: 449066 - RNA, 64 nt, Homo Sapiens
guguuuuuuacucuuuucucaugcacauguuacguuggagaaaauguuuacaaaaaugguuuug

SEQ ID NO: 449067 - RNA, 64 nt, Homo Sapiens
gacugacaccucacugaggaagggagacauauucuuggagaacuuuccaucugcuuguauuuuc

SEQ ID NO: 449068 - RNA, 64 nt, Homo Sapiens
gauaucaaguuuugaauauuauucaggaagcacuuuggagaaugugggaguccuacuguuuugc

SEQ ID NO: 449069 - RNA, 64 nt, Homo Sapiens
gggugagaagcaggcuggugagacugggcugagguuggagaaggggcagccgggggcacugcug

SEQ ID NO: 449070 - RNA, 64 nt, Homo Sapiens
ucacuuuauucuuguauggcuuugguaggcauacuuggagaacauaucccacauuaggaauuga

SEQ ID NO: 449071 - RNA, 64 nt, Homo Sapiens
gccugagaguuugagggcuuuaauccuuuaaaacuuggagaagcuggcugggcgcgguggcuca

SEQ ID NO: 449072 - RNA, 64 nt, Homo Sapiens
cauuuauuugaugacuuaauauuuuucacuaccuuuggagaacagaugaacauuauucaccaug

SEQ ID NO: 449073 - RNA, 64 nt, Homo Sapiens
uucaauuagcaguucaaauuaaagaagaugguuauuggagaacuuuuuugaaugguuuuguauu

SEQ ID NO: 449074 - RNA, 64 nt, Homo Sapiens
augcaucuuuuuuccucugccauucuuguguugauuggagaauuuuucuguauguaauuagaaa

SEQ ID NO: 449075 - RNA, 64 nt, Homo Sapiens
uuucuggauuucauacuguaacauucaggaauucuuggagaaaauggguuuauucacugaacuc

SEQ ID NO: 449076 - RNA, 64 nt, Homo Sapiens
gcucggaaagccuuaagcaaagaugggaggauuuuuggagaauccaucaugauugguguaaaac

SEQ ID NO: 449077 - RNA, 64 nt, Homo Sapiens
uccucucaaaacaaacacccucuugcaaccagcuuuggagaaagcccagcuccugugugcucac

SEQ ID NO: 449078 - RNA, 64 nt, Homo Sapiens; identical to SEQ ID NO: 447722

SEQ ID NO: 449079 - RNA, 64 nt, Homo Sapiens
gagggacacaaggacuugggugcaucaggacgccuuggagaagcguggcuuccugccacccugc

SEQ ID NO: 449080 - RNA, 64 nt, Homo Sapiens
ugcagagagaggcaggaaggaucccugaagagucuuggagaaaagguucugugcccucaggugg

SEQ ID NO: 449081 - RNA, 64 nt, Homo Sapiens
uaucugaaucacuggggauuaugauucacccucuuuggagaacaugcucucuuuucacccccca

SEQ ID NO: 449082 - RNA, 64 nt, Homo Sapiens
gcuuauauuuaucgcuuggcucaaguucugcccuuuggagaaauacugagcaagucuuucauuc

SEQ ID NO: 449083 - RNA, 64 nt, Homo Sapiens
augugagauuuccacauuaugaacaucuuugagauuggagaauugguuaaguauauaauaaauu

SEQ ID NO: 449084 - RNA, 64 nt, Homo Sapiens
ccgugugagaagugaaugcugggccgcugccacguuggagaagcucagggccaugcugaggccu

SEQ ID NO: 449085 - RNA, 64 nt, Homo Sapiens
ucacaacccuucucuguugggaggccugggcugguuggagaaggggucugcgaugcagcggcgu

SEQ ID NO: 449086 - RNA, 64 nt, Homo Sapiens
uucuguuugucucuuuucauugaggacuaccauuuuggagaaggcuugcacuacaccucuguug

SEQ ID NO: 449087 - RNA, 64 nt, Homo Sapiens
gucuauccagguccuuugccccaugcguauuucuuuggagaaagucuuuuccugugcuuacggg

SEQ ID NO: 449088 - RNA, 64 nt, Homo Sapiens
cagcccagcuuggcguggggaguugagaauuccuuuggagaaaaacagaaauucuguugaagac

SEQ ID NO: 449089 - RNA, 64 nt, Homo Sapiens
gcacaaucaacuuuucugagcaccaaguguggaauuggagaaaaugacgcuacuaaccugacau

SEQ ID NO: 449090 - RNA, 64 nt, Homo Sapiens
aagugaauuuacuucgacuuuauucaguggcauuuuggagaacauagaauuuuuaaauaguaua

SEQ ID NO: 449091 - RNA, 64 nt, Homo Sapiens
auguaauuuugucuuuggaaucaaaauaacauacuuggagaaguuguuuguuuuuaucaaaaug

SEQ ID NO: 449092 - RNA, 64 nt, Homo Sapiens
ugcauuaucuuaaaaggcagauucuguagcauacuuggagaaacuuucuagagguuggcuuuca

SEQ ID NO: 449093 - RNA, 64 nt, Homo Sapiens
ugaagaaaaaggcuggcugauucagagaagucaguuggagaaaacaguguuccucaccaauaac

SEQ ID NO: 449094 - RNA, 64 nt, Homo Sapiens
ugugccuuucauucauuacccagcgguccucaaguuggagaaaaugguaccgucuaguacuaug

SEQ ID NO: 449095 - RNA, 64 nt, Homo Sapiens
aaugaaggugucaaagagucaauagcacagcaguuuggagaagagaauaugccugcucaaaauu

SEQ ID NO: 449096 - RNA, 64 nt, Homo Sapiens
uacauucugaagcauccccacaggcuccaucuguuuggagaaaauuggaaaaucacacaguuuu

SEQ ID NO: 449097 - RNA, 64 nt, Homo Sapiens
auggaaauggauuggauugucaaauuauuauuuauuggagaaaaaaaccugaucuacacauuuu

SEQ ID NO: 449098 - RNA, 64 nt, Homo Sapiens
aacuuaggaaauagugaauaaggugcauuuaacuuuggagaaauacuuuuauggcuuuggugga

SEQ ID NO: 449099 - RNA, 64 nt, Homo Sapiens
ugguuuuugaacaggaaaaucauaauucauaucauuggagaaguauuuauuuucaaauaucaaa

SEQ ID NO: 449100 - RNA, 64 nt, Homo Sapiens
aggagucagagagaaucccuagucuucaagcagauuggagaaacccuugaaaagacaucaagca

SEQ ID NO: 449101 - RNA, 64 nt, Homo Sapiens
uaaaugaaaaggacacauucugaaaucccuuuuguuggagaauaagucagucugaggggaaaug

SEQ ID NO: 449102 - RNA, 64 nt, Homo Sapiens
aaauaaguccuagacuggacucuugagggacauauuggagaaucuuaagaaaugcaagcuuguu

SEQ ID NO: 449103 - RNA, 64 nt, Homo Sapiens
ucccaggaaauuagcuuuccagccccuuuauauauuggagaaguuguuuuagcuucugcagaag

SEQ ID NO: 449104 - RNA, 64 nt, Homo Sapiens
acauuguucuugguuuuguuucucgaucuuuuguuuggagaacagcuggcuaaggaugacucua

SEQ ID NO: 449105 - RNA, 64 nt, Homo Sapiens
uucauuuguuccuuggaccuuaaucauuugcauuuuggagaaaauuuuuucugcuuuaaaaguc

SEQ ID NO: 449106 - RNA, 64 nt, Homo Sapiens
gaguuuaggaauucuacuagccagagauagucacuuggagaaacuuucuauauauccuucuaaa

SEQ ID NO: 449107 - RNA, 64 nt, Homo Sapiens
aaucuugaugucauuacuccugaauuauuacauuuuggagaauaagagggcauuuuauuuuauu

SEQ ID NO: 449108 - RNA, 64 nt, Homo Sapiens
uuuugauccaagucaaguguagccucucagccuuuuggagaaaaaugaaacaauuuauuucaac

SEQ ID NO: 449109 - RNA, 64 nt, Homo Sapiens
ugggcagagcccugacccacagcuguguuacugcuuggagaagcauauguaggggcauacccug

SEQ ID NO: 449110 - RNA, 64 nt, Homo Sapiens
uauuuaaaguugccugaagauuuugcugugguguuuggagaagcagagggugaacuugcuguug

SEQ ID NO: 449111 - RNA, 64 nt, Homo Sapiens
gauuugcucagcuuuuugaaauguuaagauguguuuggagaaggcugcaugacuuuguuuuucc

SEQ ID NO: 449112 - RNA, 64 nt, Homo Sapiens
cuaggcagcagccaccuucucaggaaacaaggccuuggagaaaucagugccugugugaagaugg

SEQ ID NO: 449113 - RNA, 64 nt, Homo Sapiens
gcuggaccuuccauucuagaauuaugagaccaccuuggagaaaggugugugguacaugacauug

SEQ ID NO: 449114 - RNA, 64 nt, Homo Sapiens
uucucuguuugccuuggguugaauaacuuaucuuuuggagaauagcuuuaaguggcuuagacac

SEQ ID NO: 449115 - RNA, 64 nt, Homo Sapiens
caaguuggaugacacuacucccaacuuuuuaaauuuggagaaaaccaucaaggucgaggaagcc

SEQ ID NO: 449116 - RNA, 64 nt, Homo Sapiens
agaaauugcuagauuacccaaagaaauagaucaguuggagaaaauacaaaacaauucaaagcuc

SEQ ID NO: 449117 - RNA, 64 nt, Homo Sapiens
guauuuaaaagaaauaccagugagugccuuaaaguuggagaaguaacugcccaugcccagaaau

SEQ ID NO: 449118 - RNA, 64 nt, Homo Sapiens
ugaauaaaaaauaauuuugcuguuguaguauacauuggagaaacuggcagguuuuauuuccauu

SEQ ID NO: 449119 - RNA, 64 nt, Homo Sapiens
uccaagccaggaagaugggcaugaucaugccagauuggagaagaucugaggguguacguuugau

SEQ ID NO: 449120 - RNA, 64 nt, Homo Sapiens
gaaaugaaaagccacgucauaaacuccacaggguuuggagaauagcaaagacacgggaacugaa

SEQ ID NO: 449121 - RNA, 64 nt, Homo Sapiens
uagacacaaucucuuauuuuucacaucacaugauuuggagaaaucaagacuuugggcucuuaug

SEQ ID NO: 449122 - RNA, 64 nt, Homo Sapiens
caugacggauaguuuaggauucauguggagauuuuuggagaaacucaauuguccuucagauaau

SEQ ID NO: 449123 - RNA, 64 nt, Homo Sapiens
acuuuuucauacuuuugugaacagauggaacgguuuggagaagccuguacaguauuugcauucc

SEQ ID NO: 449124 - RNA, 57 nt, Homo Sapiens; identical to SEQ ID NO: 445151

SEQ ID NO: 449125 - RNA, 64 nt, Homo Sapiens
cacagcagcacgccuuaaucccuguccaagugccuuggagaacuuucagucugaaaugcagcuc

SEQ ID NO: 449126 - RNA, 64 nt, Homo Sapiens
aucuggagaugagauugaugcugguggaagaagcuuggagaagacugaagcacauacaagcacc

SEQ ID NO: 449127 - RNA, 64 nt, Homo Sapiens
gagauggcaagagggcaggcgggcauuugaggaauuggagaauggccugggcuguggaccuacu

SEQ ID NO: 449128 - RNA, 64 nt, Homo Sapiens
caccugcacagcagagcucaggcugucaacagucuuggagaagcgaugccaaguacaccugcaa

SEQ ID NO: 449129 - RNA, 64 nt, Homo Sapiens
ccuuagcacaauuuucuaaaaaaaaaaucagaaauuggagaaaucuugccaaaaaaaaaaaaaa

SEQ ID NO: 449130 - RNA, 64 nt, Homo Sapiens
acaaggacaacuuuauguaggcauggacaguuguuuggagaacacugcccaggugggguuuccu

SEQ ID NO: 449131 - RNA, 64 nt, Homo Sapiens
cacagccucaccuucucacuuaaggguguuagucuuggagaagauugaauuuuuuggggacuau

SEQ ID NO: 449132 - RNA, 64 nt, Homo Sapiens
aaggagcaaaaacaaauuuuggcagaagcugaaauuggagaaccuuauuucuuaacugcuauuu

SEQ ID NO: 449133 - RNA, 64 nt, Homo Sapiens
ucugcacuuucuuauauauagaugccaagauuuuuuggagaacaucuuugugacacuucauccu

SEQ ID NO: 449134 - RNA, 64 nt, Homo Sapiens
augcauuugggucacuaauugaacaccuuucauauuggagaaucaaugauuguaugcuuaugcu

SEQ ID NO: 449135 - RNA, 64 nt, Homo Sapiens
gaacucacaaacugauguuauuaaaggaaaggauuuggagaauugaugaaauaaacuuauuacu

SEQ ID NO: 449136 - RNA, 64 nt, Homo Sapiens
uagcaguaccaagggaucucaucacuugggagcuuuggagaaaauacuucggcugcaugagaua

SEQ ID NO: 449137 - RNA, 64 nt, Homo Sapiens
aacaacaaaagccaauuagagcugggagucaguguuggagaagacacgcccaucuggaguggga

SEQ ID NO: 449138 - RNA, 64 nt, Homo Sapiens
ucucuaauuccagugucuuuacacagcaaauaaauuggagaauauugcucccauauaaacuugu

SEQ ID NO: 449139 - RNA, 64 nt, Homo Sapiens
uuuucaguuucuuuccuucugugaacgaugagacuuggagaacgggcugguccuucaccacuuc

SEQ ID NO: 449140 - RNA, 64 nt, Homo Sapiens
ugaggugccgagcugggugcuugacaucauuugcuuggagaagcagcugcuaguagacccauuu

SEQ ID NO: 449141 - RNA, 64 nt, Homo Sapiens
acaucaauauguauauauguauuucuauauagacuuggagaauacugccaaaacauuuaugaca

SEQ ID NO: 449142 - RNA, 64 nt, Homo Sapiens
uuuggguguggaggccauuuuuagagauacagaauuggagaagacuugcaaaacagcuagauuu

SEQ ID NO: 449143 - RNA, 64 nt, Homo Sapiens
gugucauguugguuuuugguacuuguauugucauuuggagaaacaauaaaagauuucuaaacca

SEQ ID NO: 449144 - RNA, 64 nt, Homo Sapiens
cuaucugggaacacugagaagggugaccaaugcguuggagaacgagggagggcuucauagcaga

SEQ ID NO: 449145 - RNA, 64 nt, Homo Sapiens
aaaagagcaugcagugcuguugaauaacccucacuuggagaaccaagagaauccugucguuuaa

SEQ ID NO: 449146 - RNA, 64 nt, Homo Sapiens
gccccugaauguggucgaugccaaaggaagauccuuggagaagucaucagugcguugaaacaaa

SEQ ID NO: 449147 - RNA, 64 nt, Homo Sapiens
uugcagagugugugcuuggcuguggcagccuagcuuggagaagcugcuguuggugcaagggaga

SEQ ID NO: 449148 - RNA, 64 nt, Homo Sapiens
uggaugccuaaggcauaaagcugugcaauauuucuuggagaauuccagcuuucuugcuugccuu

SEQ ID NO: 449149 - RNA, 64 nt, Homo Sapiens
gaaaaacacucuauaacagacaacuuuuuuaacuuuggagaaaauuuucugugccuucaaggga

SEQ ID NO: 449150 - RNA, 64 nt, Homo Sapiens
uuuucugauuauuguuaaacuucaggaaauucuuuuggagaauacuuuauaccuagcaagccac

SEQ ID NO: 449151 - RNA, 64 nt, Homo Sapiens
uugccuuuuuucuuggcuccugcaauuugugcaauuggagaaucaaugcugggaacacaaauag

SEQ ID NO: 449152 - RNA, 64 nt, Homo Sapiens
aaggacugagaaaugaccauuuauaaaucuagacuuggagaauuacaggauucacauuguuaau

SEQ ID NO: 449153 - RNA, 59 nt, Homo Sapiens; identical to SEQ ID NO: 445180

SEQ ID NO: 449154 - RNA, 64 nt, Homo Sapiens
gauucaaaauaguguagauuugauuuucuggccuuuggagaaguagcaacugcagcuaacaggc

SEQ ID NO: 449155 - RNA, 64 nt, Homo Sapiens
cuguucagucacagauauaugaaauauuggauucuuggagaaaaaaguauaugaaaauauacug

SEQ ID NO: 449156 - RNA, 64 nt, Homo Sapiens
agauaaugaauuaagcaacuacauuuacucaauauuggagaaguacaugugugccccuaaagac

SEQ ID NO: 449157 - RNA, 64 nt, Homo Sapiens
auuuaaacaccucaauguaguucaaugaaaacuguuggagaaaucuaguguuuucauaauguaa

SEQ ID NO: 449158 - RNA, 64 nt, Homo Sapiens
auuacagaucauauaagcaaauacauaaacaguuuuggagaaaaagguuuuaaaaauaaguuuu

SEQ ID NO: 449159 - RNA, 64 nt, Homo Sapiens
uauauuuuaaagaacaagacagccucagaaucauuuggagaaacguaucuuguaaucaugauug

SEQ ID NO: 449160 - RNA, 64 nt, Homo Sapiens
cauagaacaaggugaaagacuaaaucacuaaggauuggagaacuccaaucaaucaaaaaauaaa

SEQ ID NO: 449161 - RNA, 64 nt, Homo Sapiens
aagacauaaacuuggaguccgucugguuuaauuauuggagaaucgauucccaaguccaggaaga

SEQ ID NO: 449162 - RNA, 64 nt, Homo Sapiens
uuuaguauuuugucuuuguaauuuacagaaguuauuggagaaaauaaacuuguuucauuuugca

SEQ ID NO: 449163 - RNA, 64 nt, Homo Sapiens
acccagggaaugggggucuaugagacaaccccacuuggagaagaaugggguuagggucucuaau

SEQ ID NO: 449164 - RNA, 64 nt, Homo Sapiens
gugcuuuuuauacaacuuuccaucccccacacaguuggagaauaauuuguagaccauggcaguu

SEQ ID NO: 449165 - RNA, 64 nt, Homo Sapiens
guauacauggugauguacaucuguagcaaagcucuuggagaaaaugaagacugaagaaagcaaa

SEQ ID NO: 449166 - RNA, 64 nt, Homo Sapiens
augaggaacauucauucuguauuuuuuuucccuguuggagaaagugggaaauuauaaugucgaa

SEQ ID NO: 449167 - RNA, 64 nt, Homo Sapiens
uauucugucuaucaaauaguacuucuaccacuguuuggagaaaauugaagaaaagaauaagaug

SEQ ID NO: 449168 - RNA, 64 nt, Homo Sapiens
guugaauaugauuuggucaguugcucguuguaacuuggagaaauuccuauaaaguaagaucucc

SEQ ID NO: 449169 - RNA, 64 nt, Homo Sapiens
uaauuccuucugcuauaugucacacaguuguuauuuggagaaccaaguauguauugcaugaaaa

SEQ ID NO: 449170 - RNA, 64 nt, Homo Sapiens
aaugccuuauuuuugaauucuuuagauuuuuaaauuggagaaaagcacuuaaaguuuuuuauau

SEQ ID NO: 449171 - RNA, 64 nt, Homo Sapiens
ugugagcauuugcaauguaagggccucagcuuccuuggagaagccaccccagguuuccagacau

SEQ ID NO: 449172 - RNA, 64 nt, Homo Sapiens
gcaucucccugauugguauugcuguagaacauauuuggagaaguuuguuugucuuugguguuua

SEQ ID NO: 449173 - RNA, 64 nt, Homo Sapiens
uggaguuugaacccguuuugguugcauuucauuuuuggagaacuuaauuaacgugagauuggca

SEQ ID NO: 449174 - RNA, 64 nt, Homo Sapiens
cuuagaacauuuuuugaaauucaguuuacagaaauuggagaaaaugcuuuuuaaacaaguguuu

SEQ ID NO: 449175 - RNA, 64 nt, Homo Sapiens
gaugggucuugcugggugcuguguggggcgcauauuggagaaggguaaugccagaagccaggaa

SEQ ID NO: 449176 - RNA, 64 nt, Homo Sapiens
ccuuggaaccccaaggccaaguugguucaaacuguuggagaacagaguuggccugcaucuggaa

SEQ ID NO: 449177 - RNA, 64 nt, Homo Sapiens
uacuauuuuuauaaagcaagaacuauuccaugccuuggagaaugaaucauuuuuagauugugac

SEQ ID NO: 449178 - RNA, 64 nt, Homo Sapiens
uuuuggaggugaaaucuaauuauuggugagagucuuggagaacaggcuguuuccagucucaaag

SEQ ID NO: 449179 - RNA, 64 nt, Homo Sapiens
cguaaagauucauuuuucaacacugauuuuauaauuggagaaugagccuuugguagcuaacagu

SEQ ID NO: 449180 - RNA, 64 nt, Homo Sapiens
uagcacuugccuugaaaagaaucucuuuucaggguuggagaaauuuuguuuuauuggaaugcau

SEQ ID NO: 449181 - RNA, 64 nt, Homo Sapiens
gugguuagcacauucaucagaggauggauguauauuggagaagggugagacuuuauuguccucu

SEQ ID NO: 449182 - RNA, 64 nt, Homo Sapiens
uacuccagcaaaaugaaggauuuuagggaagcuguuggagaaaaggguuaccuccaugugcccu

SEQ ID NO: 449183 - RNA, 64 nt, Homo Sapiens
cauaugaaaagcauaguugggucacaggacccaauuggagaaauguucaacaauucugugaaag

SEQ ID NO: 449184 - RNA, 64 nt, Homo Sapiens
caaagaaaauuaaaguuuucuccagcagcuguuuuuggagaagacaucccuuaauuugaggugu

SEQ ID NO: 449185 - RNA, 64 nt, Homo Sapiens
gaauguuugucuggagcagauaucaggcugauuuuuggagaaauuauguuccuuuguauguucc

SEQ ID NO: 449186 - RNA, 64 nt, Homo Sapiens
acaagguacccagaauuuuucuucaacaagaugcuuggagaacacugauguuaagcacauguua

SEQ ID NO: 449187 - RNA, 64 nt, Homo Sapiens
auuaaauugcugcauuucgcguuucuuauuuugauuggagaaaaaagugagaucauacugguuu

SEQ ID NO: 449188 - RNA, 64 nt, Homo Sapiens
ggaagaauaacacuguugcuacaaugaaggagacuuggagaagaccagcugguaguccaucagc

SEQ ID NO: 449189 - RNA, 64 nt, Homo Sapiens
uauuuaauaaaaaaacaaucuuauuuucaguauuuuggagaaauugcuuuuugaauguuauuug

SEQ ID NO: 449190 - RNA, 64 nt, Homo Sapiens
agggcucuucucaggggcucuccuccucugucuuuuggagaaccagcgcauccugcagggcuuc

SEQ ID NO: 449191 - RNA, 64 nt, Homo Sapiens
ucuucacagccccgacaucauggacauuggaaccuuggagaaugcuuaaacccugugccucagc

SEQ ID NO: 449192 - RNA, 64 nt, Homo Sapiens
ccagggccgugccuggagcacugcagagaugacuuuggagaaagcaaagcagugacccagugac

SEQ ID NO: 449193 - RNA, 64 nt, Homo Sapiens
uagaagaaagauacaagugaaaauuaggaguggauuggagaaauuggggggaaauagaagagua

SEQ ID NO: 449194 - RNA, 64 nt, Homo Sapiens
aggcuuuuuaacccauuuuugaagagggugaaguuuggagaacaaauuuaaaaaccaucaguca

SEQ ID NO: 449195 - RNA, 64 nt, Homo Sapiens
uaaaucucagaauuacuaagcauguggcauaaauuuggagaaaauaauaugacuagaaaaauua

SEQ ID NO: 449196 - RNA, 64 nt, Homo Sapiens
cuucguguccaccuggguccaguccugaaucaucuuggagaaacaccuugguuucuaggauggu

SEQ ID NO: 449197 - RNA, 64 nt, Homo Sapiens
gaguuguauuggcaagagggaggggugagagcuguuggagaacugagaaugagguuuuuuuuuu

SEQ ID NO: 449198 - RNA, 64 nt, Homo Sapiens
cuauugcccugcaacgucccaucuauacgagguguuggagaaggugaagaacccucccauucac

SEQ ID NO: 449199 - RNA, 64 nt, Homo Sapiens
cccugcuugugcaggccaguggaggcucuugggcuuggagaacacgugugucucuguguaugug

SEQ ID NO: 449200 - RNA, 64 nt, Homo Sapiens
aguggggcaacguguggaggaagccccucauaauuuggagaaaacuugauacaauagaagcuga

SEQ ID NO: 449201 - RNA, 64 nt, Homo Sapiens
caaccuguucaagucuaccaauuauaagggcaaauuggagaaaaagaaaaaauauauacucaag

SEQ ID NO: 449202 - RNA, 64 nt, Homo Sapiens
cguuuguuuguuggaguggugccagguacugguuuuggagaacuugucuacaaccagggauuga

SEQ ID NO: 449203 - RNA, 64 nt, Homo Sapiens
gagugcauaccagaauugaauauaccauaugggauuggagaaagacaaauguggaagaaaucau

SEQ ID NO: 449204 - RNA, 64 nt, Homo Sapiens
cugagaaagggaaaagacacacaagucgcguggguuggagaagccagagccauuccaccucccc

SEQ ID NO: 449205 - RNA, 64 nt, Homo Sapiens
guggcgugcucuagcccucucaguuaccagcucuuuggagaaggaucaaaauucagauggaaug

SEQ ID NO: 449206 - RNA, 64 nt, Homo Sapiens
cugaaacagacuacucuuugccuuuuugcugcaguuggagaagaaacugaauuugaaaaauguc

SEQ ID NO: 449207 - RNA, 64 nt, Homo Sapiens
caaagaauuuaaaguggcuccuuuaauuggugacuuggagaaagcuaggucaaggguuuauuau

SEQ ID NO: 449208 - RNA, 64 nt, Homo Sapiens
aacagaguuugggggagagagcaagauggguuccuuggagaagcugauuugccaagaugcacau

SEQ ID NO: 449209 - RNA, 64 nt, Homo Sapiens
ugccaccuaagcaguaaaacaugauauugaccacuuggagaacucagaaaauuauuuuaaauuu

SEQ ID NO: 449210 - RNA, 64 nt, Homo Sapiens
gagaaguaaaggaauauaugccuccuguguacuuuuggagaaaacugaagauuuaguuuccauu

SEQ ID NO: 449211 - RNA, 64 nt, Homo Sapiens
agcuuaaacauuucaccagagaugcuggaagcucuuggagaaaaaggaucauccuuuuguacuu

SEQ ID NO: 449212 - RNA, 64 nt, Homo Sapiens
uggacccuaguucaguuuagaaggagaaagcccuuuggagaaacgacaaaacacaaguuggacc

SEQ ID NO: 449213 - RNA, 64 nt, Homo Sapiens
gcugaaggucaguaauuccguuaguuccauaaaauuggagaacuugauuccuugaagagccuau

SEQ ID NO: 449214 - RNA, 64 nt, Homo Sapiens
cacaguaaagggaaacccugugcuugcuucagcauuggagaauuaaacaugaugaauguggaga

SEQ ID NO: 449215 - RNA, 64 nt, Homo Sapiens
agaaccgugaacuggaaaagagaagucccggcuguuggagaagggaccaacaacaacgaggagg

SEQ ID NO: 449216 - RNA, 64 nt, Homo Sapiens
aauggacgaauucuugagcagguggugaagagaguuggagaaggguggagaugggggcgggggu

SEQ ID NO: 449217 - RNA, 64 nt, Homo Sapiens
cguacucuagggccaaauccggccgagguuacauuuggagaaccauagucucagagaucuguag

SEQ ID NO: 449218 - RNA, 64 nt, Homo Sapiens
gcagaagagacgucccgcuugggugaggcuugacuuggagaaaggguggccagcccauuuucug

SEQ ID NO: 449219 - RNA, 64 nt, Homo Sapiens
gugaauguauguacuguauuacacagagauggucuuggagaauuauccagguuaaccuugauau

SEQ ID NO: 449220 - RNA, 64 nt, Homo Sapiens
gcuugaggccagaagugcaauuaggaggcugagguuggagaaucaugccuauaauccuggcauu

SEQ ID NO: 449221 - RNA, 64 nt, Homo Sapiens
ugaugcauaaagcugugauacaaaaagcugcuuuuuggagaagacaaguggccaaguccuuuau

SEQ ID NO: 449222 - RNA, 64 nt, Homo Sapiens
ugacucaaauauauacuugagaguaauuuaugcuuuggagaauuggcccuaaccuaaaaucgga

SEQ ID NO: 449223 - RNA, 64 nt, Homo Sapiens
ucuugugcaauuagccuggcugagaaauauuugcuuggagaagcaaugugggguuuguaauagg

SEQ ID NO: 449224 - RNA, 64 nt, Homo Sapiens
agacaugcuuuuccagcuguauggucagagcuaguuggagaauguuuuguuugguauguacaaa

SEQ ID NO: 449225 - RNA, 64 nt, Homo Sapiens
gaagcaaaggugaaugacagauuaggagcuuguuuuggagaaaucagucucuucagguagcuaa

SEQ ID NO: 449226 - RNA, 64 nt, Homo Sapiens
ugccgaaaaguugccaaauauuuauaaugucuuuuuggagaaauauacuuugugcuuuaugguu

SEQ ID NO: 449227 - RNA, 64 nt, Homo Sapiens
gagacaggagggguaaaaccauauauagaggauuuuggagaagaaggaauauuuucuucuuaag

SEQ ID NO: 449228 - RNA, 64 nt, Homo Sapiens
auggauaaguaguguuuccuccgucuuugcuguuuuggagaaugcuuaacaauauacauauguu

SEQ ID NO: 449229 - RNA, 64 nt, Homo Sapiens
uaccacacaaaacaaugaauuuccaugguuaaguuuggagaaaaucuccauuuuuaucaagguu

SEQ ID NO: 449230 - RNA, 64 nt, Homo Sapiens
ggagcucuguggcuucccacggagaaacugugaauuggagaaaucuucgauuuuucuggucugu

SEQ ID NO: 449231 - RNA, 64 nt, Homo Sapiens
guuuuuuucucucacuauaguauaagaaucuauuuuggagaaaaaaagaaaauaugagggucuc

SEQ ID NO: 449232 - RNA, 64 nt, Homo Sapiens
uggggggagggggaugggguccuucuaggaguccuuggagaaaaguaagaaaccaggaguguuu

SEQ ID NO: 449233 - RNA, 64 nt, Homo Sapiens
caccagggcaggagaggacucagccuccuguguuuuggagaaggggcccaauguguguugacga

SEQ ID NO: 449234 - RNA, 64 nt, Homo Sapiens
ugcucaaauguuguucaacaccagaaaauuuauauuggagaaaagcacuguaaauguaaugcau

SEQ ID NO: 449235 - RNA, 64 nt, Homo Sapiens
uguucaaacuuuguucaauaccaggaaauuuauauuggagaaaaacccuaugaguguaaugaau

SEQ ID NO: 449236 - RNA, 64 nt, Homo Sapiens
uugucacgcuugauuguagguaagauaauuuauauuggagaaaaauccuccaaguaugaagaau

SEQ ID NO: 449237 - RNA, 64 nt, Homo Sapiens
ugcucaaacuuuguucgacaucagggaauuuguauuggagaaaaacccugcaaauguaauaaau

SEQ ID NO: 449238 - RNA, 64 nt, Homo Sapiens
auugccuugaucuggcacuuacugauacaagcauuuggagaagagaaaauucaaauauaagaaa

SEQ ID NO: 449239 - RNA, 64 nt, Homo Sapiens
uggacuuuccugugauuuguuuuuaaucauucauuuggagaagaggcaugaccuuuguauuuca

SEQ ID NO: 449240 - RNA, 64 nt, Homo Sapiens
ucaugcuauuaguauuuucauaccuuagucacauuuggagaauucacaugggaauaaaauucca

SEQ ID NO: 449241 - RNA, 64 nt, Homo Sapiens
ugcagguuugguuuuuucucauuugucuguggcauuggagaauauucucgguuuaaacagacua

SEQ ID NO: 449242 - RNA, 64 nt, Homo Sapiens
cuuauugucuagugaaacucguuaauuuguaguguuggagaagaacugaaaucauacuucuuag

SEQ ID NO: 449243 - RNA, 64 nt, Homo Sapiens
uuccauguagucuucaauuuuuaauuuuuaagaauuggagaauuucuaauguuaaaguuaguuu

SEQ ID NO: 449244 - RNA, 64 nt, Homo Sapiens
uaauaucugcauuaugcuggaaaaaaauagaccuuuggagaauacuuaaauaaaacaugugcau

SEQ ID NO: 449245 - RNA, 64 nt, Homo Sapiens
ccaggugauucuguaaguugucccucaacuguacuuggagaaaucguguuuuaaagcaguaguc

SEQ ID NO: 449246 - RNA, 64 nt, Homo Sapiens
gugcaggaauagcaacagcaauuuccgggaggucuuggagaagcuggagagcgaccccgucugc

SEQ ID NO: 449247 - RNA, 64 nt, Homo Sapiens
ccuuuuauuaguucuuugauagcuaagaugguuguuggagaaagugcuuaagccacuguuuaug

SEQ ID NO: 449248 - RNA, 64 nt, Homo Sapiens
guccuguaaaugaaugcucugggcuagauacagcuuggagaaccugcuggccuuguuagacagc

SEQ ID NO: 449249 - RNA, 64 nt, Homo Sapiens
uaggaaagccuggguuggguggagcagaaccaucuuggagaagaugacaguucccuguccuccc

SEQ ID NO: 449250 - RNA, 64 nt, Homo Sapiens
aggaaacucugcaaggcuaaguaacacauuguaauuggagaagagacacccccuuccaaauucu

SEQ ID NO: 449251 - RNA, 64 nt, Homo Sapiens
aaaacuagcuguggcauucccagcauuuugacccuuggagaagauaagcuuguuguuggaagag

SEQ ID NO: 449252 - RNA, 64 nt, Homo Sapiens
auaugaauguauucgggaggauuuaauccgguucuuggagaaacuaccgagcuggaagcaagcc

SEQ ID NO: 449253 - RNA, 64 nt, Homo Sapiens
uaagguggaguccuacuugucugcuuggggacuauuggagaaaaaugucuucaagugaccugua

SEQ ID NO: 449254 - RNA, 64 nt, Homo Sapiens
uaaaccgccuccacguggcggccgaagugaauuguuggagaauguagucuuuuguauuuucccu

SEQ ID NO: 449255 - RNA, 64 nt, Homo Sapiens
uacucuguaggcaugacagcuuuaaugugugaccuuggagaaguugaguguuccugugcccaua

SEQ ID NO: 449256 - RNA, 64 nt, Homo Sapiens
acaaauauguucucugaauguaacuauuacaguguuggagaacauguuugucauggugaaauua

SEQ ID NO: 449257 - RNA, 64 nt, Homo Sapiens
ucuguggugcagugugugaaggucggagaggcguuuggagaagggcugggugcagaagcugugg

SEQ ID NO: 449258 - RNA, 64 nt, Homo Sapiens
agggauuaaaaauaaggauagcaaagcuaucaacuuggagaaacgaauuacugaauauuucaga

SEQ ID NO: 449259 - RNA, 64 nt, Homo Sapiens
agaaccacaaacacagaucaaaagccugcucaauuuggagaaauuuuaaaaacuauauucagua

SEQ ID NO: 449260 - RNA, 64 nt, Homo Sapiens
agauugccuuuucaugcagucuuaccaaaguagguuggagaauugcccacagaagucaucagac

SEQ ID NO: 449261 - RNA, 64 nt, Homo Sapiens
uagaggaggagaaagaauccaucuccugcagagauuggagaagguaugauaugaagggggacuu

SEQ ID NO: 449262 - RNA, 64 nt, Homo Sapiens
guguuaauuguguggaaugacuacauagauuaaauuggagaaacugggcgcuguaaguuaagcu

SEQ ID NO: 449263 - RNA, 64 nt, Homo Sapiens
gcauccucuuuuguguaguuguuuguuuguuuuuuuggagaagauuuccuuuuuuuguuuguuu

SEQ ID NO: 449264 - RNA, 64 nt, Homo Sapiens
uuuccuuuuguugcauuuguuugcauacagguuauuggagaaaucuuaaaagaaagauuuccca

SEQ ID NO: 449265 - RNA, 64 nt, Homo Sapiens
uuuagacagcagcucuguguacucggaggggaguuuggagaaauaucugaguguugccugcuga

SEQ ID NO: 449266 - RNA, 64 nt, Homo Sapiens
uuggggaaguguuuucugaagccacaguguucuguuggagaaacucacacuaccaggcccugca

SEQ ID NO: 449267 - RNA, 64 nt, Homo Sapiens
aaauuaaacauuuggcccuggaagaugaaugacuuuggagaagcuuucccagaaucagacuuuu

SEQ ID NO: 449268 - RNA, 64 nt, Homo Sapiens
cauuuaagcugccucggguuagucaccaggucgcuuggagaaguaguggagauaaauguccuag

SEQ ID NO: 449269 - RNA, 64 nt, Homo Sapiens
uaaaauauaacuucaagaaaagaguaaacauccauuggagaacacggcugaaaauuauugugcu

SEQ ID NO: 449270 - RNA, 64 nt, Homo Sapiens
uaaagaucaugaauuugugacuuaguucugcccuuuggagaacaaaagaaagcagucuuccauc

SEQ ID NO: 449271 - RNA, 64 nt, Homo Sapiens
aaacaauggugccccagaaagcugcaggugguguuuggagaagcaguuacuuuucaguuacaag

SEQ ID NO: 449272 - RNA, 64 nt, Homo Sapiens
aaagcaguauuuaaugcaauuuccaguuauuucuuuggagaauuuuaugucauuguuccauuac

SEQ ID NO: 449273 - RNA, 64 nt, Homo Sapiens
augaguucagaugaucacaaacaggugaguuuuguuggagaagaaaguuggaguaggagacuuu

SEQ ID NO: 449274 - RNA, 64 nt, Homo Sapiens
ccaauaagaggcucuguuuuccacugaagcuuuguuggagaaagagaauaugaaaauuacacau

SEQ ID NO: 449275 - RNA, 64 nt, Homo Sapiens
gugugaagacaugaaaguuuaauguacagaaugguuggagaaaugccuauggugaauuaaagcu

SEQ ID NO: 449276 - RNA, 64 nt, Homo Sapiens
cauugccuuuguguuaauagucaaauacuuaccuuuggagaauacuuaccuuuggaggaaugua

SEQ ID NO: 449277 - RNA, 64 nt, Homo Sapiens
aauaaccuugcugauaagaaaaaaagggacaauauuggagaaacuaccucuuguuuaauugauc

SEQ ID NO: 449278 - RNA, 64 nt, Homo Sapiens
ucugguaccuuccccuccugccccugcaccagcuuuggagaauggauuuggagugucuugggcg

SEQ ID NO: 449279 - RNA, 64 nt, Homo Sapiens
ccagucucccaggcccccugguguugggagcccuuuggagaacgcagaaaucagaggagagacg

SEQ ID NO: 449280 - RNA, 64 nt, Homo Sapiens
guccagcaugcauccuggccuggggcuuuuuuauuuggagaaccaagcaguguagacaaacccu

SEQ ID NO: 449281 - RNA, 64 nt, Homo Sapiens
auauucauuugguuguggaguauagcuugacuccuuggagaacaccacguugucauugugaguc

SEQ ID NO: 449282 - RNA, 64 nt, Homo Sapiens
ugaugugaaaauuggaccucugcuauuuuacuauuuggagaauauuuucaucaacauguagagc

SEQ ID NO: 449283 - RNA, 64 nt, Homo Sapiens
ugccauuacuuguauaucugaaaauuaugaauuauuggagaaaaccaaaauagcagaaauugua

SEQ ID NO: 449284 - RNA, 64 nt, Homo Sapiens
cugggucagccaaguuucaucaugcauaccgauauuggagaaauucugcagaauauuguaauug

SEQ ID NO: 449285 - RNA, 64 nt, Homo Sapiens
ccuccuucagagcccuuuguagucuccuuguugcuuggagaacagcaaagucuuguacugaagc

SEQ ID NO: 449286 - RNA, 64 nt, Homo Sapiens
gaugaggaaaagaagagccuuugcugauaaagaguuggagaacauuaugcuggagagagaauau

SEQ ID NO: 449287 - RNA, 64 nt, Homo Sapiens
aguggauuaauauuaaaacuauguauauuaaucauuggagaagggggaagaggaaaugaaaaua

SEQ ID NO: 449288 - RNA, 60 nt, Homo Sapiens; identical to SEQ ID NO: 445315

SEQ ID NO: 449289 - RNA, 64 nt, Homo Sapiens
uugcaaaagaaauaggcuuuucuucuuuuuuaaauuggagaaaucucugcucugguugaccugg

SEQ ID NO: 449290 - RNA, 64 nt, Homo Sapiens
caggcaucuguggggaaucccagccugcagguucuuggagaagcaggugaaccuaaggaugaaa

SEQ ID NO: 449291 - RNA, 64 nt, Homo Sapiens
cucaugcacaucagcugguggagcaggccuggccuuggagaacgagaccugugugccaggggca

SEQ ID NO: 449292 - RNA, 64 nt, Homo Sapiens
gcguccuugugaagcucgucuccauguggcuuucuuggagaaaggcuccccuggggcaagaggg

SEQ ID NO: 449293 - RNA, 64 nt, Homo Sapiens
cggagaggucaggagaccgaccccaccacuaacuuuggagaaaauguggguuugcuuuuuaaag

SEQ ID NO: 449294 - RNA, 64 nt, Homo Sapiens
uacguaaucagaaauuugugaaguuacaugucauuuggagaaaauuuucuggaaaaguuaaaaa

SEQ ID NO: 449295 - RNA, 64 nt, Homo Sapiens
uuuccuucaagcagaaacaacgguuugaacauaauuggagaaccccggccaauguccaaaauua

SEQ ID NO: 449296 - RNA, 64 nt, Homo Sapiens
cacugugggcuagggugguccuuggagagggagcuuggagaacuacggccaagggccacgggaa

SEQ ID NO: 449297 - RNA, 64 nt, Homo Sapiens
uauguaaauuaccaaggcacgguucuuuaaagauuuggagaagaacguguguuuuuuagagcuu

SEQ ID NO: 449298 - RNA, 64 nt, Homo Sapiens
gggacucauauaaauaguugaacaucuaaagcuguuggagaagaguguaaaaaguacucagaaa

SEQ ID NO: 449299 - RNA, 64 nt, Homo Sapiens
cccgcuuuuucuggaacagcuuccuuggacaccauuggagaagcgugcuuuugcaagacuggaa

SEQ ID NO: 449300 - RNA, 64 nt, Homo Sapiens
cuugggacugggacagucuuuaaggcuguuuugcuuggagaagagguuuuuaaaacauggaugu

SEQ ID NO: 449301 - RNA, 64 nt, Homo Sapiens
uguuuaccaguaaauacaucguuuuuguuuuguuuuggagaauuaagaacaaaagcuuuuaguu

SEQ ID NO: 449302 - RNA, 64 nt, Homo Sapiens
cuacuuuuugacuuacauggagauauacuuugcuuuggagaaauuuuuaaaaagaagagaaaga

SEQ ID NO: 449303 - RNA, 64 nt, Homo Sapiens
ucgcccaucccccccgcggcccuuguuuuuguauuuggagaacccuccgccccauccugcaggg

SEQ ID NO: 449304 - RNA, 64 nt, Homo Sapiens
gaaguugaacgagcauagucaaaaagaaaugauguuggagaagggauuccuuuuuucaaaaucc

SEQ ID NO: 449305 - RNA, 64 nt, Homo Sapiens
uuuuacuaaauauacaagauuuacuacuagaaauuuggagaaagaacacuaacacauguacuug

SEQ ID NO: 449306 - RNA, 64 nt, Homo Sapiens
gaacucaugagagacaagcaguaagaaacuucuuuuggagaaacaacagaccagaucuuuacuc

SEQ ID NO: 449307 - RNA, 64 nt, Homo Sapiens
acuacaguuucacagaauaccugagaagacacacuuggagaaaccuuuuggguguaaugaaugu

SEQ ID NO: 449308 - RNA, 64 nt, Homo Sapiens
agccuuacuucuacuuccagaugcagugccucuuuuggagaagacauguuuauuuuucauguuc

SEQ ID NO: 449309 - RNA, 64 nt, Homo Sapiens
ggagggaagaguguguccuggcaggaagccaccauuggagaaggugaggccaguaaccaucuca

SEQ ID NO: 449310 - RNA, 64 nt, Homo Sapiens
gauuuuacauaucuguuuggauuauagcuaggauuuggagaauaaguguguacagaucacaaaa

SEQ ID NO: 449311 - RNA, 64 nt, Homo Sapiens
uuuuuaagcaagagaaagacaacuguucugcggguuggagaaaauacaauuuuuuuuuuuuuuu

SEQ ID NO: 449312 - RNA, 64 nt, Homo Sapiens
acuauugcugcauacccggggugggauggggugguuggagaaccagaacuauuuuuaaaacauu

SEQ ID NO: 449313 - RNA, 64 nt, Homo Sapiens
cugaacuggggaauuugaacauuccuuuacauuguuggagaaaugaagccaaaguuauucagau

SEQ ID NO: 449314 - RNA, 64 nt, Homo Sapiens
ucuauaugguucuccaagaaacugaaugaauccauuggagaagcgguggauaacuagccagaca

SEQ ID NO: 449315 - RNA, 64 nt, Homo Sapiens
auuauguucuuuagacacugcuaccugaaaacuguuggagaaauaauguuuaaaguuauuuaag

SEQ ID NO: 449316 - RNA, 64 nt, Homo Sapiens
uuaaaacccugaugcaaacuucuccuuucagugguuggagaaauuggccgaguucaaccauuca

SEQ ID NO: 449317 - RNA, 64 nt, Homo Sapiens
ccuguaugugguguuuuaacacauagggagucauuuggagaaagaaauucuaaccaaaccccag

SEQ ID NO: 449318 - RNA, 64 nt, Homo Sapiens
auggaagcuacaccccuacauguacagcccgugcuuggagaaccaauggucagccuaaggguaa

SEQ ID NO: 449319 - RNA, 64 nt, Homo Sapiens
caaccagauacaucugcugggcuggugucucucuuuggagaaaccagaacuguggugccaaauu

SEQ ID NO: 449320 - RNA, 64 nt, Homo Sapiens
agaaugcuacuguauuuuacuacaaugcauacuguuggagaacauuugccaaauaacaaaagca

SEQ ID NO: 449321 - RNA, 64 nt, Homo Sapiens
uguaccuuuuuugucaacucuuucuguuuucggauuggagaagagauaccuugaucuuucccac

SEQ ID NO: 449322 - RNA, 64 nt, Homo Sapiens
uuccaaucuuuccucccaaggugacuaaggcacguuggagaacacaccuuaaauaaaagugauu

SEQ ID NO: 449323 - RNA, 64 nt, Homo Sapiens
aagaugaauuauagcuccgggaaugugggugguauuggagaaagaaaagcuaaauaaccuuuaa

SEQ ID NO: 449324 - RNA, 64 nt, Homo Sapiens
gaaccaaguccuuggauaucagaaccaagucuacuuggagaaaacuguaucuacucuguggagu

SEQ ID NO: 449325 - RNA, 64 nt, Homo Sapiens
uguuuaacauuuucaagccugcagcuguacgacuuuggagaaguuaagucacaccuaccacuga

SEQ ID NO: 449326 - RNA, 64 nt, Homo Sapiens
uuaaugagaaaauuuuagaagugcuaccaucuacuuggagaaguacacuccaguauuaauauuu

SEQ ID NO: 449327 - RNA, 64 nt, Homo Sapiens
ugcaaacuaccgucgcucagaggcccaaacuugauuggagaauuccccauaggaugucauauug

SEQ ID NO: 449328 - RNA, 64 nt, Homo Sapiens
uauuuaauaaaaccuguuaauauguguuacaaaauuggagaaagaaugcagauuacacugaucu

SEQ ID NO: 449329 - RNA, 64 nt, Homo Sapiens
uuuaugucagcacacacuuauaauuuuguaauaauuggagaagagugcguucugccuuccuugu

SEQ ID NO: 449330 - RNA, 64 nt, Homo Sapiens
ggagugcagucauaaucuuacuuuccuuucgacauuggagaauuacauuggugucucuuuuuuc

SEQ ID NO: 449331 - RNA, 64 nt, Homo Sapiens
acucgugagcacaucuuuaguaaaguuuugugcuuuggagaauguguccuuuccuuucugaaaa

SEQ ID NO: 449332 - RNA, 64 nt, Homo Sapiens
ugcggcagagaagccaugcggccuguguggaaauuuggagaagucacccuaggggggcaccugc

SEQ ID NO: 449333 - RNA, 64 nt, Homo Sapiens
auuucccagugugucuuuuaugucuuugaauguuuuggagaaaagucuaugccugucuaaaaau

SEQ ID NO: 449334 - RNA, 64 nt, Homo Sapiens
uauuuuaaauuaaagccuucuaauguuccacuguuuggagaacagaagauagcaggcuguguau

SEQ ID NO: 449335 - RNA, 64 nt, Homo Sapiens
ugcaaacacuguguauagugagacuuguucuacuuuggagaacagguuaccuuuugaaaaugag

SEQ ID NO: 449336 - RNA, 55 nt, Homo Sapiens; identical to SEQ ID NO: 445363

SEQ ID NO: 449337 - RNA, 64 nt, Homo Sapiens
uagucaguuuaguucauauguucugaaaacuguuuuggagaaagauagacagaaaaaugucauc

SEQ ID NO: 449338 - RNA, 64 nt, Homo Sapiens
uaauucucagaaccagucucagggagauauaugcuuggagaacucugccuuccaucaacugcag

SEQ ID NO: 449339 - RNA, 64 nt, Homo Sapiens
gccaugaauuaagauggaugacuggaaaaagguguuggagaaagaguuaaagaugaggaagaga

SEQ ID NO: 449340 - RNA, 64 nt, Homo Sapiens
gcaaguaccaggaggacauaaccgcuguggccuguuggagaacagccaguagccuugguaauau

SEQ ID NO: 449341 - RNA, 64 nt, Homo Sapiens
auuguuacaugaaagugauagauagcaacaaguuuuggagaagagagagggagauaaaaggggg

SEQ ID NO: 449342 - RNA, 64 nt, Homo Sapiens
gauuuucuacaugaaucaaacacagaaacaacuuuuggagaaauuaaauucugagugugacuuc

SEQ ID NO: 449343 - RNA, 64 nt, Homo Sapiens
cgcuccccugacacugaagaggauccacaacuccuuggagaaacacccucacgucuguugccgc

SEQ ID NO: 449344 - RNA, 64 nt, Homo Sapiens
uuauauagauguaucuuuuaaaaauaguucacguuuggagaauucuuuuguacucauuugcuuu

SEQ ID NO: 449345 - RNA, 64 nt, Homo Sapiens
uagcucugacuuugcuguuuccagugguaugaccuuggagaagucacuuauccucuuggagccu

SEQ ID NO: 449346 - RNA, 64 nt, Homo Sapiens
guucucucuggacucuugccuagcucacaaggcuuuggagaauugucuuccuaaaucggggcac

SEQ ID NO: 449347 - RNA, 64 nt, Homo Sapiens
uuggaaagcaucuaguccagugggaagccagggguuggagaaggugcuacaucccucuucccau

SEQ ID NO: 449348 - RNA, 64 nt, Homo Sapiens
gccuucuagaaucagaucuguuuggggcuggggguuggagaauaaaagcaggagaagucuaugg

SEQ ID NO: 449349 - RNA, 64 nt, Homo Sapiens
ccucugcuguguucuguguguccaguguagccuauuggagaaucggucucauuagagugacucu

SEQ ID NO: 449350 - RNA, 64 nt, Homo Sapiens
cauucucugaaaauacuguaguacacagacugauuuggagaacaaguuguuuaauagagaaaau

SEQ ID NO: 449351 - RNA, 64 nt, Homo Sapiens
aaaugauauuuagaaaguuaguaagaggauuuuuuuggagaaaaguccauauccagguuagcug

SEQ ID NO: 449352 - RNA, 64 nt, Homo Sapiens
gggaggaauaggagcaaaucauaaaugauacaucuuggagaagaaaacuuguauuacauaucaa

SEQ ID NO: 449353 - RNA, 64 nt, Homo Sapiens
gagaggaaagguuugagaagccauccauguauuuuuggagaagaggaaggaguuuuauguuaaa

SEQ ID NO: 449354 - RNA, 64 nt, Homo Sapiens
cagggggcugccuugggccccuugcuugcagugguuggagaaccugucaagguuguccccagac

SEQ ID NO: 449355 - RNA, 64 nt, Homo Sapiens
gccucucuagcagucaacucguacagaagaaagauuggagaaggugucuuugggagggaagaag

SEQ ID NO: 449356 - RNA, 64 nt, Homo Sapiens
ggggguugggaacuuaugcacaccuuccagaaacuuggagaaaucugagggugcccaccaagcc

SEQ ID NO: 449357 - RNA, 64 nt, Homo Sapiens
uacuucaaccagagcagggagacucauuccugccuuggagaaaaccagcugugguuggaucaag

SEQ ID NO: 449358 - RNA, 64 nt, Homo Sapiens
ggagagaauuaguagggcaaaauuuucuaaagcuuuggagaaaaagcaugaaagucaaaacugg

SEQ ID NO: 449359 - RNA, 64 nt, Homo Sapiens
gagaagaaguuguagcagaguaggggccuggggauuggagaacgugguucaguggcuggaguau

SEQ ID NO: 449360 - RNA, 64 nt, Homo Sapiens
aucaaaaccccaaacaaacaauaaguaccuuuuauuggagaaaauaaaaaauuuuacugucuaa

SEQ ID NO: 449361 - RNA, 64 nt, Homo Sapiens
acuuauuacacuaucuaaccguauguauuauggauuggagaagcuguugaaauaaugauaguag

SEQ ID NO: 449362 - RNA, 64 nt, Homo Sapiens
uggaauaaaguuacaccugguuggaacucugaaguuggagaagguaaugcucuauccucuaagg

SEQ ID NO: 449363 - RNA, 64 nt, Homo Sapiens
agguaaaggaugaggguucagcgcuaguggaggguuggagaaggcagguuugaccaggaaagca

SEQ ID NO: 449364 - RNA, 64 nt, Homo Sapiens
cgguuuugaaagcaacuccuuguucaauaugaucuuggagaacacaggaacaagaagagacccu

SEQ ID NO: 449365 - RNA, 64 nt, Homo Sapiens
cagugcuugaaauggacaagaagaguggacagucuuggagaacagaauaaaugugaaggcugug

SEQ ID NO: 449366 - RNA, 64 nt, Homo Sapiens
cucgcugucucccuagagccagggcccugcggauuuggagaagggagcggggcaggacuuccag

SEQ ID NO: 449367 - RNA, 64 nt, Homo Sapiens
agagaaagguuuuagacuccaguuuaccuuucucuuggagaaacucaaugcuaaucccaccuuu

SEQ ID NO: 449368 - RNA, 64 nt, Homo Sapiens
auguucacacacuuuucuugcguacucaacuaaauuggagaauguuucugaagaaaauuggaug

SEQ ID NO: 449369 - RNA, 64 nt, Homo Sapiens
gaaggcucgaguucugcuguucuguaaaagagaauuggagaaugaaaccugcuccaacagagau

SEQ ID NO: 449370 - RNA, 64 nt, Homo Sapiens
uccugucauuucuguucuugucccucauacaucuuuggagaaccgggcuccagacuuuguuccc

SEQ ID NO: 449371 - RNA, 64 nt, Homo Sapiens
uggacaggacccagcccugcaccguucacuguauuuggagaaaaugguaagaguuccauaccgg

SEQ ID NO: 449372 - RNA, 64 nt, Homo Sapiens
uguguauguguggaaauaaaaauguauuguacuuuuggagaauuuuuuguaggcauuuuucugu

SEQ ID NO: 449373 - RNA, 64 nt, Homo Sapiens
gggcucuggccaucugcaacccugaacgugcagguuggagaacgaaugaauacaaauuuuauug

SEQ ID NO: 449374 - RNA, 64 nt, Homo Sapiens
cagccuuuccuacauccuucccucacucccaugauuggagaaaugauucauugggugaugagug

SEQ ID NO: 449375 - RNA, 64 nt, Homo Sapiens
agcagcugggcugucagggccauaguagcucccuuuggagaacagggaaagccuggaggcuucc

SEQ ID NO: 449376 - RNA, 64 nt, Homo Sapiens
gacagugcaacaaguaacgagacuauuuuguauuuuggagaauucauauuauggagaaccuaac

SEQ ID NO: 449377 - RNA, 64 nt, Homo Sapiens
aauuccuaccaggaaagaauacauauccaauagauuggagaaagccagagauuagcccucauuc

SEQ ID NO: 449378 - RNA, 64 nt, Homo Sapiens
aauuuuucacaaagagcaaugacuuuauuuugcauuggagaacuccuggagauaagcuguacaa

SEQ ID NO: 449379 - RNA, 64 nt, Homo Sapiens
caaggaaggaggcggugacaccaaggcuuuaucuuuggagaagguguuagugagggccucaagu

SEQ ID NO: 449380 - RNA, 64 nt, Homo Sapiens
cgucuugcuuugucacccacggggaaacuuuuuuuuggagaaggagucuucauuuggggccaaa

SEQ ID NO: 449381 - RNA, 64 nt, Homo Sapiens
ggaggugagcaaauuaacgguauuggucuggaaauuggagaaauaaggaucugauacaucuagu

SEQ ID NO: 449382 - RNA, 64 nt, Homo Sapiens
gaauuaaguugacuugaaauugugcacuaugagauuggagaaauuaauuaaagaaccugguggg

SEQ ID NO: 449383 - RNA, 64 nt, Homo Sapiens
gaggcugaggguagagggagugggugggaaucucuuggagaacuuuguuuaaaagaaaaucagg

SEQ ID NO: 449384 - RNA, 64 nt, Homo Sapiens
aucuguagcuuguugaaaaaggcauuucagaguguuggagaagaacugacugggacccugaaga

SEQ ID NO: 449385 - RNA, 64 nt, Homo Sapiens
aaaaagggcgguggaggggaaguaauuccuaaucuuggagaauauuuucaaaaaccuaauccgu

SEQ ID NO: 449386 - RNA, 64 nt, Homo Sapiens
uuuggggcacguuuuccuacagcuuuaaaguacuuuggagaaacgaauuaaauacauuucauug

SEQ ID NO: 449387 - RNA, 64 nt, Homo Sapiens
ggcagaucaaaagaggugaaggagaaugauguucuuggagaacauagaggaacuuggaucuucc

SEQ ID NO: 449388 - RNA, 64 nt, Homo Sapiens
uaggugaagaugcaaccagauuaacucugaauacuuggagaaacuauaaaagaaguugugcuau

SEQ ID NO: 449389 - RNA, 64 nt, Homo Sapiens
cccaaacuccuucuccacugaaauuugcaaguuuuuggagaaccgucaaguaguuuuaauaugu

SEQ ID NO: 449390 - RNA, 64 nt, Homo Sapiens
ugcagccucacgcaccauccaagcugagacaaaauuggagaagcugaaaaaugcucucccagca

SEQ ID NO: 449391 - RNA, 64 nt, Homo Sapiens
aguaggaacaacacaugguaaaaucuacuagacauuggagaaacauugcacaucaguaugugcc

SEQ ID NO: 449392 - RNA, 64 nt, Homo Sapiens
cugguucccguuuuccagagaaaacccuguguccuuggagaaaguuuauuucugcagguuggug

SEQ ID NO: 449393 - RNA, 64 nt, Homo Sapiens
aaggacaccguuacccaugcccuucaucacauacuuggagaacagcuuguguggucagcucuuc

SEQ ID NO: 449394 - RNA, 64 nt, Homo Sapiens
uuucuuacucauuucaguccuaaaaucauacaucuuggagaaccagauuuauggaguaaggacu

SEQ ID NO: 449395 - RNA, 64 nt, Homo Sapiens
acuggagccauaaaguuaauuugcaccuagcuuuuuggagaauagccaugauuaacugcuauuc

SEQ ID NO: 449396 - RNA, 64 nt, Homo Sapiens
caguuuuuuaaaaauagacuguaguauccuuucauuggagaauuuacaaaaauaucaucuacag

SEQ ID NO: 449397 - RNA, 64 nt, Homo Sapiens
guucaaaccaaagaaacaaugaucuacucaaacauuggagaaaaaaacugccagaggaggaguu

SEQ ID NO: 449398 - RNA, 64 nt, Homo Sapiens
ccagcuuucgucugucaucagacauugaagagauuuggagaaauguaaagcagcaguacucuuc

SEQ ID NO: 449399 - RNA, 64 nt, Homo Sapiens
uagauggguauauaacaguuuggaaauacuaucuuuggagaauguauuuuuguauuuauaaauc

SEQ ID NO: 449400 - RNA, 64 nt, Homo Sapiens
gugagcaggcacauugacuuucuguugagguaccuuggagaagcugagccauucugaggacauc

SEQ ID NO: 449401 - RNA, 64 nt, Homo Sapiens
gauuuuuaaaggaauauuucagaguuuaaucuuuuuggagaaguuauguucuuuaaucggguac

SEQ ID NO: 449402 - RNA, 64 nt, Homo Sapiens
uuauguauguucagccagauaguaaaugggauuuuuggagaaauaagauaacuacaaaguuucu

SEQ ID NO: 449403 - RNA, 64 nt, Homo Sapiens
ugucaaauuacagccaaugaucaugauagugcuuuuggagaacuaaaguauuaucuaauuaagu

SEQ ID NO: 449404 - RNA, 64 nt, Homo Sapiens
cuggaguuguuaugaacaugauugcagauuguucuuggagaauuagcuaggaauuguuaagcac

SEQ ID NO: 449405 - RNA, 64 nt, Homo Sapiens
aaaacuguacugcuuguucacugacuuuugucuuuuggagaaaauugcaucacugaggaugaaa

SEQ ID NO: 449406 - RNA, 64 nt, Homo Sapiens
aaagaaaagcaaaugaguguuuuagcaacugguguuggagaaaacauaauagagauugauaaga

SEQ ID NO: 449407 - RNA, 64 nt, Homo Sapiens
uucuuaguugggugaauuaacauaugcuuauggcuuggagaaaucuuuuccaguauuaaacacu

SEQ ID NO: 449408 - RNA, 64 nt, Homo Sapiens
uuucuuguucccguagaagaaagaagaaagguguuuggagaauucgagugccuaggaugccaga

SEQ ID NO: 449409 - RNA, 64 nt, Homo Sapiens
uaagacaaagauauuuagguugagcagcuauuaauuggagaauugguacagagacgcuccagau

SEQ ID NO: 449410 - RNA, 64 nt, Homo Sapiens
aagccuggcugcagcuucccauuugguuacgagguuggagaaaaagucaaaguccccuccuggg

SEQ ID NO: 449411 - RNA, 64 nt, Homo Sapiens
uauagcaucuggaagaucauuuugaaauuguuccuuggagaaaugaaaacaguguguaaacaaa

SEQ ID NO: 449412 - RNA, 64 nt, Homo Sapiens
acuuucuugucaaacaaaaccaauggcucuggguuuggagaacacaguggcugguuuuaaaaau

SEQ ID NO: 449413 - RNA, 64 nt, Homo Sapiens
cugccuuucccaaaugggaaaggugcugacagaguuggagaaaaaagaauagacucauuuuucc

SEQ ID NO: 449414 - RNA, 64 nt, Homo Sapiens
ugcuugugcugggaaaugcaacucacucauguauuuggagaaacaggaguguucacuuaucuag

SEQ ID NO: 449415 - RNA, 64 nt, Homo Sapiens
uuaucaaaaauuucauggaaccuuugugggguuuuuggagaaggaaaacuucuuuuaaaccuca

SEQ ID NO: 449416 - RNA, 64 nt, Homo Sapiens
gauugaacuuuucaagacauuuuauucggagaauuuggagaagugggagagauauuuucuuaug

SEQ ID NO: 449417 - RNA, 64 nt, Homo Sapiens
caaugcagaacugaugggaacuaaaccuugacaguuggagaagcaucaauauaacaauauaauc

SEQ ID NO: 449418 - RNA, 64 nt, Homo Sapiens
acaugcauauaauucuguagcagguauuuugauauuggagaauaaaguuuaaaaauucuuuaaa

SEQ ID NO: 449419 - RNA, 64 nt, Homo Sapiens
uguauuuguguucacuucuaagacuauugaaauuuuggagaaaaucaaugcuuauauauuccuu

SEQ ID NO: 449420 - RNA, 64 nt, Homo Sapiens
ugcuauucuuccuguuguccuaauaggacucgacuuggagaaauuacaaaaaugaaaauauuua

SEQ ID NO: 449421 - RNA, 64 nt, Homo Sapiens
agaucuccgugcccuacagauggagccuggguuuuuggagaaagucuuaguugucauaaucccu

SEQ ID NO: 449422 - RNA, 64 nt, Homo Sapiens
gaagggcccccauggcccuggugauuuuauuguuuuggagaaugcuuuuagauaggaucuagga

SEQ ID NO: 449423 - RNA, 64 nt, Homo Sapiens
ccauggccaaaacgauuguguauuucacuggugguuggagaaaaacuaaaaugaaccaaaccca

SEQ ID NO: 449424 - RNA, 64 nt, Homo Sapiens
agguuguccguguccuuaacuuguagugaauuuauuggagaaugaucaauguguauguggcugu

SEQ ID NO: 449425 - RNA, 64 nt, Homo Sapiens
uuugugcccuguguuuuauaacuauuuucuauauuuggagaaagaaaugaauugaaccauuuca

SEQ ID NO: 449426 - RNA, 64 nt, Homo Sapiens
auaguagauuuuaauuugaccguuucacuuuuuguuggagaaaauaucaacagcaaacuucagc

SEQ ID NO: 449427 - RNA, 64 nt, Homo Sapiens
cacugugccucagagaccagggcuccagccccucuuggagaagucucagcuaagcucacguccu

SEQ ID NO: 449428 - RNA, 64 nt, Homo Sapiens
gaagccagcuggacuuccugggucgaguggggccuuggagaacuuuucugucuuacaagaggau

SEQ ID NO: 449429 - RNA, 64 nt, Homo Sapiens
agaauugcucauucauauuuuuucuguugcuugcuuggagaauuugcucuuuuuuuggcauaua

SEQ ID NO: 449430 - RNA, 64 nt, Homo Sapiens
aaccuuugcacacucaccugagcccuggggacccuuggagaaauuaggugucaccugcuguggc

SEQ ID NO: 449431 - RNA, 64 nt, Homo Sapiens
acaugaaacauuugcaaaauuguuuuugguuggauuggagaaguaauccuagggaaggguggug

SEQ ID NO: 449432 - RNA, 64 nt, Homo Sapiens
uugauaccaaacaauucaaaaguuggaucugaguuuggagaaagauauuuccaaccuaaguggg

SEQ ID NO: 449433 - RNA, 64 nt, Homo Sapiens
acaaacuauguagugugucccuauuauaaaugcauuggagaaguauuuuuaugagacucuuuac

SEQ ID NO: 449434 - RNA, 64 nt, Homo Sapiens
ugaggccucuuauguguaauaaaugugaaaguacuuggagaaacuuagaagucugcuaaagauc

SEQ ID NO: 449435 - RNA, 64 nt, Homo Sapiens
gcuuagaaauucagcauuugaacauucauagucuuuggagaaauuucuguggagguggaaaagc

SEQ ID NO: 449436 - RNA, 64 nt, Homo Sapiens
cucaguuccaacuugugauucuagaauuuccacuuuggagaauagccuggagugacacuacacu

SEQ ID NO: 449437 - RNA, 64 nt, Homo Sapiens
uguuuaaauaguucuguuguugcuuuucucaauuuuggagaagauuuuaaaaauuuaacaugau

SEQ ID NO: 449438 - RNA, 64 nt, Homo Sapiens
augauagaugauauacuagauucuugccacaauauuggagaauaauuuuuacuugcggugacua

SEQ ID NO: 449439 - RNA, 64 nt, Homo Sapiens
acaggcucaaaguggggcuggggucuuggccacauuggagaaaaagaaguucugccucugccug

SEQ ID NO: 449440 - RNA, 64 nt, Homo Sapiens
cugccccgagcccuagguggggccaggaggugccuuggagaagccagccagagcagagagggcu

SEQ ID NO: 449441 - RNA, 64 nt, Homo Sapiens
acagacucugagaagcgaagaccaugucuccucguuggagaaacccaauagcaggggaagcugg

SEQ ID NO: 449442 - RNA, 64 nt, Homo Sapiens
uguguguaaugcaaauuaguuaaaacaaauaguuuuggagaaaguuaaaacuagcuuuagagua

SEQ ID NO: 449443 - RNA, 64 nt, Homo Sapiens
ccagaaucauucuccuuucugcccauaaagggccuuggagaauugcuuuaagaagagugaaugu

SEQ ID NO: 449444 - RNA, 64 nt, Homo Sapiens
aggagccugggaccccgcaugucccaaaaugggauuggagaagcuggagagaaagcagaagagg

SEQ ID NO: 449445 - RNA, 64 nt, Homo Sapiens
uuuuuggguguuccuggcaguuuaaaaaaauugguuggagaauuuagguuuuuauuaguaccau

SEQ ID NO: 449446 - RNA, 59 nt, Homo Sapiens; identical to SEQ ID NO: 445473

SEQ ID NO: 449447 - RNA, 64 nt, Homo Sapiens
aguguggugaugccaugcccaucaugggaggcuuuuggagaaacagaauguuugggcaggggcu

SEQ ID NO: 449448 - RNA, 64 nt, Homo Sapiens
aucuuccacuggaacguuucacugcaaacacaccuuggagaaguggcaucagucaacagagagg

SEQ ID NO: 449449 - RNA, 64 nt, Homo Sapiens
ugaagccagcugggcuccugagucugguggggacuuggagaaccuuuaugucuagcuaagggau

SEQ ID NO: 449450 - RNA, 64 nt, Homo Sapiens
uccacacucuguaucuggcuacucugguggggacuuggagaaccuuuguguccacacucuguau

SEQ ID NO: 449451 - RNA, 64 nt, Homo Sapiens
aacacccuccuggcacaacgcucuacccugcagcuuggagaacuccgcuggauggggagucuca

SEQ ID NO: 449452 - RNA, 64 nt, Homo Sapiens
guggaucaccugaauucucucagcugucaauggcuuggagaacaucucaugggcccaagucauc

SEQ ID NO: 449453 - RNA, 64 nt, Homo Sapiens
uuuguugaaauagcuuuacuguuucucaaguguuuuggagaaaaaaaucaacccugcaaucacu

SEQ ID NO: 449454 - RNA, 64 nt, Homo Sapiens
uuggccaaagugaaggaaucuuuuuucaguuuuauuggagaaacugaaggguaacauucuaaca

SEQ ID NO: 449455 - RNA, 64 nt, Homo Sapiens
ggcuguggcugacaguggcucuggccaggguugcuuggagaaggcucagugugccugggacagg

SEQ ID NO: 449456 - RNA, 64 nt, Homo Sapiens
uuaauuuccaaaucaggaacuuggacuggaauguuuggagaauggaaagcggauaaaacuuuca

SEQ ID NO: 449457 - RNA, 64 nt, Homo Sapiens
gugaaguuuguuuuuucgccauggacuuaucccuuuggagaagauguuuguaguuacauuuagg

SEQ ID NO: 449458 - RNA, 64 nt, Homo Sapiens
uggauggccuuaggguuccuggugcagccagcuuuuggagaaccgcggccuggccuagaccagg

SEQ ID NO: 449459 - RNA, 64 nt, Homo Sapiens
agcugcugagcauggcuuucgcugcuggccagcauuggagaagauuugugacuuggaaagguac

SEQ ID NO: 449460 - RNA, 64 nt, Homo Sapiens
agcucacugcucucuagaaauccccugcucaccauuggagaaucaggucccaguucacauguag

SEQ ID NO: 449461 - RNA, 64 nt, Homo Sapiens
uggugcugaaauccaccuuuuuguugccgucgaguuggagaaagaaccggccucaugacuagcc

SEQ ID NO: 449462 - RNA, 64 nt, Homo Sapiens
aaguuugugauuaguccuuagauucaggauguuguuggagaaacgugugauggugcaaggaaug

SEQ ID NO: 449463 - RNA, 64 nt, Homo Sapiens
gguggccucgccggagcuagggaccgcaugccgcuuggagaaggcugccugacugccucagcag

SEQ ID NO: 449464 - RNA, 64 nt, Homo Sapiens
gaguacauuuuuaaaauuuuaggcauuucaggaguuggagaacgcuuuucuccagcaacugcag

SEQ ID NO: 449465 - RNA, 64 nt, Homo Sapiens
uacagcaucauggaugcuguaugaucagggaauuuuggagaaaccggauggugaggacacagcu

SEQ ID NO: 449466 - RNA, 64 nt, Homo Sapiens
gauucccaaguccaggaagaaucugguuuaauuauuggagaaucaagacauaaacuuggagucc

SEQ ID NO: 449467 - RNA, 64 nt, Homo Sapiens
uuacuuuuccucagaagauugagcugucuuuuauuuggagaauaaaaugaaguucugaaaaaaa

SEQ ID NO: 449468 - RNA, 64 nt, Homo Sapiens
uuugccaagaagugaucuguuuuaaaggucauauuuggagaaagggcaaggaauugggucugcu

SEQ ID NO: 449469 - RNA, 64 nt, Homo Sapiens
uggauguguuugggggcggggggauggaagugacuuggagaauguguuugggaugaaauaacua

SEQ ID NO: 449470 - RNA, 64 nt, Homo Sapiens
uuauaaaccacugaaagggauagagaagugaacauuggagaaagccaguagcaacugugagaaa

SEQ ID NO: 449471 - RNA, 64 nt, Homo Sapiens
uggaggaucaguagcuguuaugaugccagaccauuuggagaaguaucagaggccugaccggaca

SEQ ID NO: 449472 - RNA, 64 nt, Homo Sapiens
caagcccuuggggugacucggcuuccaggagcuguuggagaaaugaggaugucugucccugucu

SEQ ID NO: 449473 - RNA, 64 nt, Homo Sapiens
ggcauuccuacuggagaaaaucugacuuggaaaguuggagaagaucaacugcugguagcauuua

SEQ ID NO: 449474 - RNA, 64 nt, Homo Sapiens
gaggcuggcugggggagaaaggaggagggcuuguuuggagaaggacagguguggguguccuguu

SEQ ID NO: 449475 - RNA, 64 nt, Homo Sapiens
cugauuccuuuuuuguugucggacagggccaguguuggagaauugggcucggaccccucacugg

SEQ ID NO: 449476 - RNA, 64 nt, Homo Sapiens
gcuuuggcagaagagugaaacugcucugugggguuuggagaaaucagugagaauucgugcaucu

SEQ ID NO: 449477 - RNA, 64 nt, Homo Sapiens
caccucuggcucuugugcuuacacaggugcagcuuuggagaacuucuuguguaaacguuugcag

SEQ ID NO: 449478 - RNA, 64 nt, Homo Sapiens
gacauggggcugaaucucagugaaaggugguugcuuggagaaggggggaagaugcuggacucau

SEQ ID NO: 449479 - RNA, 64 nt, Homo Sapiens
ucacccuuucccuuuuucuuggaaaucugccuuauuggagaaaaccaaaaacuacauauuugua

SEQ ID NO: 449480 - RNA, 64 nt, Homo Sapiens
ggaucuguccaauaaacgcuaccugcucuaaacuuuggagaacuacuccauagcuaccaaguua

SEQ ID NO: 449481 - RNA, 64 nt, Homo Sapiens
agaggagagaaaagagggccgugugcacauauguuuggagaaauuugccacucaguuccucugg

SEQ ID NO: 449482 - RNA, 64 nt, Homo Sapiens
aggguagagagagguugcuaaggcagaagugaauuuggagaacuccagauaucaaaccugagga

SEQ ID NO: 449483 - RNA, 64 nt, Homo Sapiens
acaaggguuuuguccugaauaaaaaccccaccauuuggagaauuaguugaaguccaaccuauuu

SEQ ID NO: 449484 - RNA, 64 nt, Homo Sapiens
uguugcugagaccccccccccccuccagcuccucuuggagaagccagccuucaugccuucccca

SEQ ID NO: 449485 - RNA, 64 nt, Homo Sapiens
caaggaaggcggaagaauggccuaucaggugguuuuggagaaaaucagaaaucaggacaucccc

SEQ ID NO: 449486 - RNA, 64 nt, Homo Sapiens
auuuuuuuuuuaaauaauauagugcagaauauuuuuggagaacgauuaacaacugaggaaggcc

SEQ ID NO: 449487 - RNA, 64 nt, Homo Sapiens
uuaauguuuuucauuuaucacauaccuuguucaauuggagaauucaacaacauaaaaauccuug

SEQ ID NO: 449488 - RNA, 64 nt, Homo Sapiens
gcaugugugggguguguguguguguucuggucacuuggagaagguacaccuggcaucuguggca

SEQ ID NO: 449489 - RNA, 64 nt, Homo Sapiens
gugugugugggaugcguguguguguccuagucacuuggagaagggugugggcgcgucuguggug

SEQ ID NO: 449490 - RNA, 64 nt, Homo Sapiens
aucugaugccuuuuucuuugugagccucaggcuguuggagaagcgaacugucugcccaggagcc

SEQ ID NO: 449491 - RNA, 64 nt, Homo Sapiens
uauggaagcauguguaaaauuauacuuucaguaauuggagaauucagagauugcauuucuagca

SEQ ID NO: 449492 - RNA, 64 nt, Homo Sapiens
ccuuguauugugauauuaacuggcaaagauccucuuggagaaaccuuucccagguacaguuuca

SEQ ID NO: 449493 - RNA, 64 nt, Homo Sapiens
uaaugaagcugauuuuuuagcugagauagaagcuuuggagaaaaugaaugaagaucacguucag

SEQ ID NO: 449494 - RNA, 64 nt, Homo Sapiens
uucguuuuuguuucccuuuaguauuuaauggucuuuggagaaaaaauaauaaaacagaguguua

SEQ ID NO: 449495 - RNA, 64 nt, Homo Sapiens
ccucagaauucagaagauaucacuaccucccagcuuggagaacauuuugccucccacacccagc

SEQ ID NO: 449496 - RNA, 64 nt, Homo Sapiens
ggugcuaguuggcaauagauucacacacuuugauuuggagaauuauugcacgaguguguuuucc

SEQ ID NO: 449497 - RNA, 64 nt, Homo Sapiens
uucacagagauggaugcauguucugauugccucuuuggagaagcucaucagaaacucaaaagaa

SEQ ID NO: 449498 - RNA, 64 nt, Homo Sapiens
gagcaucguggaugggugcacggagacacgcaccuuggagaaaugaggggagauggaccaagaa

SEQ ID NO: 449499 - RNA, 64 nt, Homo Sapiens
aggguuguuacaacugucacuagcggaggucacuuuggagaagggugggccuuacauccagugu

SEQ ID NO: 449500 - RNA, 64 nt, Homo Sapiens
caauaaaauugcugggaauauuugacucuccguauuggagaaaauaaaauuacaacauuacgac

SEQ ID NO: 449501 - RNA, 64 nt, Homo Sapiens
caucauuacuggaaaccuauuaaacauuagcaaauuggagaauaguuuuaauauaguaaaugua

SEQ ID NO: 449502 - RNA, 64 nt, Homo Sapiens
ugguagcgcugggggugauuuuaggcagcaagaauuggagaacucacacugcgaaaagaaaacc

SEQ ID NO: 449503 - RNA, 64 nt, Homo Sapiens
uuggggugugaaagccucaagugacucagccugguuggagaacugccccacccaguaucuucug

SEQ ID NO: 449504 - RNA, 64 nt, Homo Sapiens
aagucuucaguaacgcuacaacgauugcaaaucauuggagaauccauaaugaagagagaucuuc

SEQ ID NO: 449505 - RNA, 64 nt, Homo Sapiens
aacucaaaucauauuagacaucggagaaaucacuuuggagaaaggucuuuugagugcacugagu

SEQ ID NO: 449506 - RNA, 64 nt, Homo Sapiens
aaaaagccagggugugccagcccuccugcuggccuuggagaagccuaaucaggugagccacuca

SEQ ID NO: 449507 - RNA, 64 nt, Homo Sapiens
cuuuuauaucaaaaguggagcauuugccccccauuuggagaauggacuccacagugacuugcca

SEQ ID NO: 449508 - RNA, 64 nt, Homo Sapiens
uugugcacuaucacugggaaaaggauguggaauguuggagaacaggaaaacaagaaauacuguc

SEQ ID NO: 449509 - RNA, 64 nt, Homo Sapiens
uugaaugcuaccccccaaguuugauuuaggggcuuuggagaacuccguauaagcucaaugagua

SEQ ID NO: 449510 - RNA, 64 nt, Homo Sapiens
acccugcaaauguaauaaauucagggaauucagauuggagaaaauacuuaaacuuuguucaaca

SEQ ID NO: 449511 - RNA, 64 nt, Homo Sapiens
cuauagcccuuuaguuauuucauuuuguuuuuaguuggagaacuuuuauuuaguuagaacacuu

SEQ ID NO: 449512 - RNA, 64 nt, Homo Sapiens
acucuaugaauagaauauacugggaaaaauaauguuggagaaauggacuacagcuuauucagcc

SEQ ID NO: 449513 - RNA, 64 nt, Homo Sapiens
uagugucagaauugaauuaugagucugcacuaacuuggagaaguuuggacugcacuaacuugug

SEQ ID NO: 449514 - RNA, 64 nt, Homo Sapiens
cauaaugaagagagaucuuaacgauuacaaaucauuggagaaucaagucuucaguaaugcuaca

SEQ ID NO: 449515 - RNA, 64 nt, Homo Sapiens
uauaaugaauaaagaucuaaaccauugcaaaucauuggagaaucaagucuucaguaacgcuaca

SEQ ID NO: 449516 - RNA, 64 nt, Homo Sapiens
cauaaugagagaucuuacaaaccauugcaaaucauuggagaaucaaguuuucaguaaugcuaca

SEQ ID NO: 449517 - RNA, 64 nt, Homo Sapiens
cacagugaagagaucuuacaaccauugcacaucauuggagaaucaaguuuucaguaaugcuaca

SEQ ID NO: 449518 - RNA, 64 nt, Homo Sapiens
acuugaagaauguaaugccacuuacuucucccucuuggagaaaguaggcuaauugugacuguga

SEQ ID NO: 449519 - RNA, 64 nt, Homo Sapiens
cccucuagaaacauauuggcuggguucaagagaguuggagaaacuguacuuguaccuaaggccc

SEQ ID NO: 449520 - RNA, 64 nt, Homo Sapiens
cacaccugaguaagauccugagucucauuaaauauuggagaauacuuaugagugcagugagucc

SEQ ID NO: 449521 - RNA, 64 nt, Homo Sapiens
ucuugugaauuacacagcaauugguaacucccucuuggagaauuauggguaaauauguguugaa

SEQ ID NO: 449522 - RNA, 64 nt, Homo Sapiens
ucaugugagugaagagaugucacugucuguggucuuggagaacuagucucguagcugaggggug

SEQ ID NO: 449523 - RNA, 64 nt, Homo Sapiens
ccaaccaccuugaaaccuuuagaacaucucugcuuuggagaaagacccagagaucaggcagagg

SEQ ID NO: 449524 - RNA, 64 nt, Homo Sapiens
agauguuaaaacagucccguggaaggagcagggguuggagaaaggcaucccaaagcuucgaugg

SEQ ID NO: 449525 - RNA, 64 nt, Homo Sapiens
cucucagagacucccaggaguuguugaacuauauuuggagaaaacagccacugaauauuaucau

SEQ ID NO: 449526 - RNA, 64 nt, Homo Sapiens
ugggguaaaugcuuugaggcccagggaccaaucuuuggagaaaguagauauuuccaucaaagcc

SEQ ID NO: 449527 - RNA, 64 nt, Homo Sapiens
ugcgaauacagcucacagagaaacgcaugugcuauuggagaacaggucuuuguggagaucuaaa

SEQ ID NO: 449528 - RNA, 64 nt, Homo Sapiens
uguaacauuuaaacauuaauuuaaaaagggaaccuuggagaauucuuuuguucacuaguuccuu

SEQ ID NO: 449529 - RNA, 64 nt, Homo Sapiens
cugcagcgccaagcggcauccaccaagcaucaaguuggagaaaagggaacccaagcaguagaga

SEQ ID NO: 449530 - RNA, 64 nt, Homo Sapiens
ucuagguuuccaggccucacagccaagcugaagcuuggagaaaacucugcauucccaugagggc

SEQ ID NO: 449531 - RNA, 64 nt, Homo Sapiens
aggcugaggugggagaaucacuugaguccuggaguuggagaacagccuggaaagccuggcgaua

SEQ ID NO: 449532 - RNA, 64 nt, Homo Sapiens
ugagcaccuuggugagcaagccuggcuuuaaagauuggagaagagcuucuggcaccagaacccu

SEQ ID NO: 449533 - RNA, 64 nt, Homo Sapiens
accuuugcaguguugccgaaucacagcaguucuguuggagaaacgcuugguuuccggauccaga

SEQ ID NO: 449534 - RNA, 64 nt, Homo Sapiens
aauuuccucccugccucaugugagaccacaggguuuggagaagcaguuggaacccacguguggu

SEQ ID NO: 449535 - RNA, 64 nt, Homo Sapiens
gaaagccacuuacuggcuuuugacaugacuucucuuggagaauaaguggacuccaagcuaacuc

SEQ ID NO: 449536 - RNA, 64 nt, Homo Sapiens
gucagguguuccuuccuaaaaaaaaaagucuauuuuggagaauugaaauaauucauggaaggga

SEQ ID NO: 449537 - RNA, 64 nt, Homo Sapiens
ucucuucugguaauuuuuauauugagaaaaugauuuggagaacuaacaccuccugaguuuugca

SEQ ID NO: 449538 - RNA, 64 nt, Homo Sapiens
gggaggccucuuggagacacgaaccuccuucucuuuggagaaugucuuccucuccaaagcgcca

SEQ ID NO: 449539 - RNA, 64 nt, Homo Sapiens
ccuccuuguugcaugaggucaaggguuucucaaauuggagaaccgggacugguggugccaagau

SEQ ID NO: 449540 - RNA, 64 nt, Homo Sapiens
agaauuauccccacuucacauguuuggccuuguguuggagaaagccuguacaugaaccagguca

SEQ ID NO: 449541 - RNA, 64 nt, Homo Sapiens
gauggucaguuagccugucuagaauguuuugguauuggagaaggaccaaccccaacaacaaaaa

SEQ ID NO: 449542 - RNA, 64 nt, Homo Sapiens
accgcaugaagauacuuguacuuggugguugaacuuggagaaagaccugccagcucucggaguc

SEQ ID NO: 449543 - RNA, 64 nt, Homo Sapiens
aguuaucuuuagcagauauuaaaaauugaaaacuuuggagaacucauuucaaguuaugauucag

SEQ ID NO: 449544 - RNA, 64 nt, Homo Sapiens
ugccuucagcaggacucuuaauaucugcugcaacuuggagaaccucccugcccugaaaugugaa

SEQ ID NO: 449545 - RNA, 64 nt, Homo Sapiens
uuacaaacacgggcggaaggcacucaggcuuucguuggagaaacagaaauaaggccuucuuuug

SEQ ID NO: 449546 - RNA, 64 nt, Homo Sapiens
gauuucugaggagugugugauucccuacagauuuuuggagaaagguaggaagaaaaaggaugca

SEQ ID NO: 449547 - RNA, 64 nt, Homo Sapiens
caugaagagguauucaucugagaacgacuucacguuggagaaagaaacucauucuuacgaaauu

SEQ ID NO: 449548 - RNA, 64 nt, Homo Sapiens
uguggcuggaacacaaacaauuggguggguuccuuuggagaagacagcaagccugcacacgggc

SEQ ID NO: 449549 - RNA, 64 nt, Homo Sapiens
cucgcugggaccuggucccuuuguugcaggcggcuuggagaaagggcagugggacgcuggccac

SEQ ID NO: 449550 - RNA, 64 nt, Homo Sapiens
gccaguugcagguuaagccccagaaaaguucaccuuggagaagcuccgagaacacacagauugu

SEQ ID NO: 449551 - RNA, 64 nt, Homo Sapiens
ucaagaauauuuguggagguagguguggggaagguuggagaagaguuagguuugugcuuuguaa

SEQ ID NO: 449552 - RNA, 64 nt, Homo Sapiens
auuggcucuuuggaggcgagaggaaggggagaacuuggagaauaguuuuugcuuuggggguaga

SEQ ID NO: 449553 - RNA, 64 nt, Homo Sapiens
cuccccuacuucucccuugcucccaaagcuuuccuuggagaagggcccuccugcagcuggaccc

SEQ ID NO: 449554 - RNA, 64 nt, Homo Sapiens
gcugcuacuuaacaaggaagggcuugugcuccccuuggagaaggcuggaggcugugugcgggca

SEQ ID NO: 449555 - RNA, 64 nt, Homo Sapiens
ggaaagcuccaucaaagaggaaauucggcaagacuuggagaaaacaucaaugcuuuuccucagg

SEQ ID NO: 449556 - RNA, 64 nt, Homo Sapiens
gccagcugcccuuucgucccccuacagcugaagguuggagaaauucuuuuccaaguucccaagg

SEQ ID NO: 449557 - RNA, 64 nt, Homo Sapiens
aggccgucuccccuuagccaaguccuccucaggcuuggagaacuuccucagcgucaccuccuuc

SEQ ID NO: 449558 - RNA, 64 nt, Homo Sapiens
gucgcgcaccgaaaaacuaaaaauaaugggcgcuuuggagaagaguguggagucauucucauug

SEQ ID NO: 449559 - RNA, 64 nt, Homo Sapiens
uuuuuauuucagucacuccugauaaauaacaaauuuggagaaauaaaaauaucuaaaauaaauu

SEQ ID NO: 449560 - RNA, 64 nt, Homo Sapiens
aaagggcacuuggcaaccacuaugugaagggugauuggagaaggacaagacuguggaaugggga

SEQ ID NO: 449561 - RNA, 64 nt, Homo Sapiens
aagacuguggaauggggaauaaggaaggaggaguuuggagaaugacuccaaagguuugagcuug

SEQ ID NO: 449562 - RNA, 64 nt, Homo Sapiens
ggugaggcacucuggaauaugacccuaccagagguuggagaacaaacuugggcagccggaaccc

SEQ ID NO: 449563 - RNA, 64 nt, Homo Sapiens
cugaugaucaaccugccuccccuccauagucuuguuggagaagcccagagagaaugggacucca

SEQ ID NO: 449564 - RNA, 64 nt, Homo Sapiens
agauggcgucuaccagaaggggauggacuucauuuuggagaagcucaaccauggggacugggug

SEQ ID NO: 449565 - RNA, 64 nt, Homo Sapiens
gaaaauuauuucuuggggauaaucagauuuuaccuuggagaaauacucaaugaaauaagcugcu

SEQ ID NO: 449566 - RNA, 64 nt, Homo Sapiens
auggacugaucuuuaaacuaaguuagggguuuuguuggagaaaaugcaauuuuuaaaaucuaga

SEQ ID NO: 449567 - RNA, 64 nt, Homo Sapiens
uauuggacuuuguccucucuaugaacugagcaauuuggagaaugacaagacucucagguauaga

SEQ ID NO: 449568 - RNA, 64 nt, Homo Sapiens
gcaaguuauauguucacaaaagcagccaauuuuauuggagaaaauugccuucuuugccuagcca

SEQ ID NO: 449569 - RNA, 64 nt, Homo Sapiens
ucaacaugucuccuacugagauguuugcugaacauuggagaaucuugguuggaagggaauagaa

SEQ ID NO: 449570 - RNA, 64 nt, Homo Sapiens
cuugcaguuaucuuagcauuuacugcucuaaaaguuggagaaguugugcaauauucuuaaauac

SEQ ID NO: 449571 - RNA, 64 nt, Homo Sapiens
cucacguuuuuuaacucauguauagauugaguacuuggagaauaugaaugagcaacaccaugca

SEQ ID NO: 449572 - RNA, 64 nt, Homo Sapiens
acauuucuuuacagguuaaaacugcucuaguuucuuggagaaucgagggauagaacaucacaac

SEQ ID NO: 449573 - RNA, 64 nt, Homo Sapiens
uuacaaccuggguugcagaagcacagaugcugcuuuggagaacuauaaaacucagaggaaauuu

SEQ ID NO: 449574 - RNA, 64 nt, Homo Sapiens
ggcuaggacagggaacaggggccugaguacaggcuuggagaaaucucuguugaucacagaggga

SEQ ID NO: 449575 - RNA, 64 nt, Homo Sapiens
uaagaacuuaacaauaaagccaauagguauuuucuuggagaauguuccaucuugcugugauuug

SEQ ID NO: 449576 - RNA, 64 nt, Homo Sapiens
cguuuuuaacugcaacuuucuuugucuuuuuauuuuggagaaaguguauaugcuggguauuuca

SEQ ID NO: 449577 - RNA, 64 nt, Homo Sapiens
ucauauaauuaaaaagaauuugguuaauaagaauuuggagaauggaaaauacauuuuuagguuc

SEQ ID NO: 449578 - RNA, 64 nt, Homo Sapiens; identical to SEQ ID NO: 133532

SEQ ID NO: 449579 - RNA, 64 nt, Homo Sapiens; identical to SEQ ID NO: 133533

SEQ ID NO: 449580 - RNA, 64 nt, Homo Sapiens; identical to SEQ ID NO: 133534

SEQ ID NO: 449581 - RNA, 64 nt, Homo Sapiens; identical to SEQ ID NO: 133535

SEQ ID NO: 449582 - RNA, 64 nt, Homo Sapiens; identical to SEQ ID NO: 133536

SEQ ID NO: 449583 - RNA, 64 nt, Homo Sapiens; identical to SEQ ID NO: 133537

SEQ ID NO: 449584 - RNA, 64 nt, Homo Sapiens; identical to SEQ ID NO: 133538

SEQ ID NO: 449585 - RNA, 64 nt, Homo Sapiens; identical to SEQ ID NO: 133539

SEQ ID NO: 449586 - RNA, 64 nt, Homo Sapiens
agugauccagccccaccaaggggccuccagagaccccaggaacaauaagugucuccucccacca

SEQ ID NO: 449587 - RNA, 64 nt, Homo Sapiens
auaaaucugcgagguaguuucuuugguauucuugcccaggaaauggguugauucaucacagauu

SEQ ID NO: 449588 - RNA, 64 nt, Homo Sapiens
cccacgaaggguuuuuagccagggaaaacugagccccaggaaaaccuaaccacugggcaggcag

SEQ ID NO: 449589 - RNA, 64 nt, Homo Sapiens
ccagagaugagacucuuagaaucaaaguguucagcccaggaagucuuggagaucccaccuucug

SEQ ID NO: 449590 - RNA, 64 nt, Homo Sapiens
uugagaaugagggccuggagggcggggcauuucacccaggaauaaaaccagagcagugagggcg

SEQ ID NO: 449591 - RNA, 64 nt, Homo Sapiens
cagagcagugagggcgggcggggcuugaaaugagcccaggaaacgguggagacuggagguggug

SEQ ID NO: 449592 - RNA, 64 nt, Homo Sapiens
ugcaagcauugccuguguuccugcccauuggguacccaggaaacggaucucuuccugaucuucc

SEQ ID NO: 449593 - RNA, 64 nt, Homo Sapiens
caagcuagcuuuuuaggggaugaagaacuggcugcccaggaagcgaacuuaacagccuugcucc

SEQ ID NO: 449594 - RNA, 64 nt, Homo Sapiens
uuugauuuuuaccguuucuuggcuacaauuuucucccaggaagcgggaaagaugagcuuuucua

SEQ ID NO: 449595 - RNA, 64 nt, Homo Sapiens
aucgauggccuugcagcacuggucuggagaagcucccaggaacagugugacgggggaaagccaa

SEQ ID NO: 449596 - RNA, 51 nt, Homo Sapiens
ggcgguuccaggucuugugagcccaggaaugaaagaggagaagaaacgcaa

SEQ ID NO: 449597 - RNA, 64 nt, Homo Sapiens
ugguugguugaacugaacauaucuugucuuagcacccaggaaacagaacuuuaagauauauaca

SEQ ID NO: 449598 - RNA, 64 nt, Homo Sapiens
gggggaggaugacaagccgcugcccaccuccaagcccaggaaacaguacaagauggcuaaggag

SEQ ID NO: 449599 - RNA, 64 nt, Homo Sapiens
ugcugacccagcaccacuucccagccaggagccccccaggaacagcacagaacagcagggccug

SEQ ID NO: 449600 - RNA, 64 nt, Homo Sapiens
agagguugcaguaagcugaggagaauugcuugaacccaggaagcuacucaggaggcugaggcag

SEQ ID NO: 449601 - RNA, 64 nt, Homo Sapiens
ugagaacaggauuuugagaagcagguuguuugagcccaggaauuacuaugggaggcugaggcaa

SEQ ID NO: 449602 - RNA, 64 nt, Homo Sapiens
ggguggaacugaggaagagcgagccugugacacccccaggaaggaugggcucugguucugccag

SEQ ID NO: 449603 - RNA, 64 nt, Homo Sapiens
agggacagcauuucucuggcuuugccaccacuuccccaggaaggagagagccuuggcgccucug

SEQ ID NO: 449604 - RNA, 64 nt, Homo Sapiens
ugccugcacaugagaggagaaggucugcuuccugcccaggaagggccgccacugcaguucugcu

SEQ ID NO: 449605 - RNA, 64 nt, Homo Sapiens
gccagcaagagcaaggcaugccucuggcagcuggcccaggaagaggcauccuggugccugcaua

SEQ ID NO: 449606 - RNA, 64 nt, Homo Sapiens
auaagucauugacaguuuccggcuuguucccagacccaggaaguaauucaguagcaacauagcu

SEQ ID NO: 449607 - RNA, 64 nt, Homo Sapiens
uugagcugcugagauuucaggaguaucuggauuacccaggaagguguaaccagcuuaguaacca

SEQ ID NO: 449608 - RNA, 64 nt, Homo Sapiens
acguggucuuccagcccaucggaggagugaggagcccaggaacgguucuuauaccacguuccac

SEQ ID NO: 449609 - RNA, 64 nt, Homo Sapiens
ggagccacagagcuggugcuuccuuggcaguuggcccaggaacugaaggcuggcacgugcagcg

SEQ ID NO: 449610 - RNA, 64 nt, Homo Sapiens
aguuugagguucauugucaucucuggaggccacccccaggaagguucaaaaaguguggccucag

SEQ ID NO: 449611 - RNA, 64 nt, Homo Sapiens
agcaccccuugccucuguggcucccaaaacaugccccaggaacaagugaugucauuuuauuccc

SEQ ID NO: 449612 - RNA, 64 nt, Homo Sapiens
gucuggcgggcgugggcagcuccuucugugcugucccaggaagucaccuugaagcauccuguuc

SEQ ID NO: 449613 - RNA, 64 nt, Homo Sapiens
gcugauuucaaaaucugggguccuuuuggccacccccaggaagguaauaauaaaacaacuuguu

SEQ ID NO: 449614 - RNA, 64 nt, Homo Sapiens
cugauggugcaagguccagucaggaggcuggaaacccaggaaagccaaaagcuggagugugagg

SEQ ID NO: 449615 - RNA, 64 nt, Homo Sapiens
aauacccuugaaagggucucaggacugagaguaccccaggaaagaaagagagcuaugauguccu

SEQ ID NO: 449616 - RNA, 64 nt, Homo Sapiens
augcucucauaagcaccuugaugcucucauaaggcccaggaaggaagagaagggcccaggaagg

SEQ ID NO: 449617 - RNA, 64 nt, Homo Sapiens
augcucucauaaggcccagguggcaagagaagggcccaggaaggcugccauccacggccuuuuc

SEQ ID NO: 449618 - RNA, 64 nt, Homo Sapiens
auagaugguaguuugguacuucugguucccagugcccaggaaugguccacucccaagaaauuca

SEQ ID NO: 449619 - RNA, 64 nt, Homo Sapiens
caaaaauuaggcugagacaggagaauugcuugaacccaggaagcagagguugcaaugagcugag

SEQ ID NO: 449620 - RNA, 61 nt, Homo Sapiens
aggaagaagacaacgaauaaacuuccuucaacccaggaagcgucuuuggugcuugggagac

SEQ ID NO: 449621 - RNA, 64 nt, Homo Sapiens
acgaaaaggaaguccccccaucagacucuggacacccaggaaucaaaagagaaaggacuuuuuu

SEQ ID NO: 449622 - RNA, 64 nt, Homo Sapiens
gugcugucuuugcugucuuauccuugcgucccagcccaggaacaucuuucauaaaggaccucau

SEQ ID NO: 449623 - RNA, 64 nt, Homo Sapiens
ugcucacacucuuaaaauggagugagugcugugucccaggaagcccuggacaaggaauguagga

SEQ ID NO: 449624 - RNA, 64 nt, Homo Sapiens
cuggucuccuugccuagugcugccaugauuggaacccaggaacugcccauuugggccugcauag

SEQ ID NO: 449625 - RNA, 64 nt, Homo Sapiens
gauagacuuuauaaacagugcauaaggauuuuuucccaggaaaaugguagaccgaagccuugug

SEQ ID NO: 449626 - RNA, 64 nt, Homo Sapiens
accuguggguugugcuaauuaaaggaagacuuggcccaggaaaagaagccaagacaguggcagc

SEQ ID NO: 449627 - RNA, 64 nt, Homo Sapiens
ccagcuccuuaaacugacgcgaugccaaggaggucccaggaaguccacuccaaucacccuacaa

SEQ ID NO: 449628 - RNA, 64 nt, Homo Sapiens
auagggaccucagggagccccagcuucuuacccacccaggaaacccuugguccagagaggacag

SEQ ID NO: 449629 - RNA, 64 nt, Homo Sapiens
auaagcccuaagggugguaggaacccaggagggacccaggaaacuaagauuugagauucagugc

SEQ ID NO: 449630 - RNA, 64 nt, Homo Sapiens
caaguacagccacuguaaauaacccucgucccugcccaggaacccagacuggacuucagucucc

SEQ ID NO: 449631 - RNA, 64 nt, Homo Sapiens
aggagggucaggccuguaccccagccuccugucccccaggaaccucacagggguaucaaaaaga

SEQ ID NO: 449632 - RNA, 64 nt, Homo Sapiens
ggugggcuggauuuuguaaauggguggggcugggcccaggaaggggcccuucacauuuuuggcc

SEQ ID NO: 449633 - RNA, 64 nt, Homo Sapiens
ccggcagagcccugagccccaugcaggagagagacccaggaagcgaagccuagcaggauuucag

SEQ ID NO: 449634 - RNA, 64 nt, Homo Sapiens
ccccacaccuaugggguuagcauucaugggggagcccaggaaccccuggcccuccccuccuugg

SEQ ID NO: 449635 - RNA, 61 nt, Homo Sapiens
ccagggcacuccacugcagcggcggcuggaccccaggaaccagucggaggucucagaguaa

SEQ ID NO: 449636 - RNA, 64 nt, Homo Sapiens
guuucuugggggacucacucaaucaucugcucaucccaggaauagucagaccagguucggauac

SEQ ID NO: 449637 - RNA, 64 nt, Homo Sapiens
ggaaucuggcuugguucgaggcugucccccaacacccaggaaugauugauuuugguccuccucc

SEQ ID NO: 449638 - RNA, 64 nt, Homo Sapiens
gauucuuacggaaaaaaauuuggacuuauuucuccccaggaaauuggguuucugaaauauuuua

SEQ ID NO: 449639 - RNA, 64 nt, Homo Sapiens
cuuuguacagcuuuaaguugaagagaagauuucucccaggaaauuagguauaaaccucuguaug

SEQ ID NO: 449640 - RNA, 64 nt, Homo Sapiens
gguauuuccaacacuuggcgcaauggacagaagccccaggaaggaaaaucuaguuaaaauaauc

SEQ ID NO: 449641 - RNA, 59 nt, Homo Sapiens
cuaggcucgguggcuggacaggcccccuccccaggaagcagggcuucaagaucuucuga

SEQ ID NO: 449642 - RNA, 64 nt, Homo Sapiens
ugaccagaugcccugcuccaucacaaccuccuuccccaggaaaacccacuuuccaaaagcccaa

SEQ ID NO: 449643 - RNA, 64 nt, Homo Sapiens
gcuggccuuccuucucuucugagcccuccccugccccaggaacccuggccucaccaaaacagca

SEQ ID NO: 449644 - RNA, 64 nt, Homo Sapiens
ccaggcgcccagcccugcggaggaggccggggcucccaggaagcggacgcccgguccccacaca

SEQ ID NO: 449645 - RNA, 64 nt, Homo Sapiens
uagugacauuggugagacaacagcccuaacacuucccaggaacugaagugccucaugugauuga

SEQ ID NO: 449646 - RNA, 64 nt, Homo Sapiens
gagcagaggaggucccagauaccaaguggcgccucccaggaaaggcugggagaagagguggccu

SEQ ID NO: 449647 - RNA, 64 nt, Homo Sapiens
cugggcacacgccaucccagagggcucaggaugccccaggaaggaaagaagggcaacagacuac

SEQ ID NO: 449648 - RNA, 64 nt, Homo Sapiens
acacuggaaaacugggaaauggccagcugugugucccaggaaauuccuccccuuauucuuccuu

SEQ ID NO: 449649 - RNA, 64 nt, Homo Sapiens
acuuugggaggugcaggcaggcagauggcuugagcccaggaauucaagaccaguccgagcaaca

SEQ ID NO: 449650 - RNA, 64 nt, Homo Sapiens
uaggcacuuucuuuccaugguugcccauaagacccccaggaagcgggcaccccaggaaccgcca

SEQ ID NO: 449651 - RNA, 64 nt, Homo Sapiens
gccauugcccauaagaccccggggaucugggcaccccaggaaccaaucugagccaugagaacga

SEQ ID NO: 449652 - RNA, 64 nt, Homo Sapiens
uucuccaccuguguuuaugggaaguaaugagaagcccaggaaaucuguuuggggaagaugcaag

SEQ ID NO: 449653 - RNA, 64 nt, Homo Sapiens
cuccggagccaacaccaccaaacauuuuccuuuacccaggaaaucaccagugcccaggaauuug

SEQ ID NO: 449654 - RNA, 64 nt, Homo Sapiens
ugaacauuuuccuuuacccaauggggcaccagugcccaggaauuuguggcaaggcuuggaugag

SEQ ID NO: 449655 - RNA, 64 nt, Homo Sapiens
ccagucucaucuaauuucuucacauucccagcuccccaggaaaguuucagauauauuuuaguaa

SEQ ID NO: 449656 - RNA, 64 nt, Homo Sapiens
uggccuucccuuccuagugcuuggccuuccagaccccaggaaguccccuccaguuugcuuuccu

SEQ ID NO: 449657 - RNA, 64 nt, Homo Sapiens
gcugccugcagaggacagguugagcaacagcuggcccaggaaagugaucagcuggauccccacg

SEQ ID NO: 449658 - RNA, 64 nt, Homo Sapiens
cagcaggugccucgauucccugcccuugugaccucccaggaaacagaacugaucugggacacua

SEQ ID NO: 449659 - RNA, 64 nt, Homo Sapiens
uggcucccuccuccccaucaagcacaagagagggcccaggaaaaaagguuucacauaaguguag

SEQ ID NO: 449660 - RNA, 64 nt, Homo Sapiens
aggucaagcaucuucggccgucuaucagcaguggcccaggaagggcugccucuaccaaccaccc

SEQ ID NO: 449661 - RNA, 64 nt, Homo Sapiens
agaagugaaauugucuuuauuagggguuauucgucccaggaaauagaaagggaagucaggguuc

SEQ ID NO: 449662 - RNA, 64 nt, Homo Sapiens
uuugagggguuccggugauguuuuguuugaaguucccaggaauagucucuuuguugcuauguuu

SEQ ID NO: 449663 - RNA, 64 nt, Homo Sapiens
uucuaggugggaccccgucuggggcuggcauccucccaggaaggaagggugucugauguggggu

SEQ ID NO: 449664 - RNA, 64 nt, Homo Sapiens
acuggaagccuucccccagcugggaccuccccagcccaggaaaagaugaaggaaggggcuaucc

SEQ ID NO: 449665 - RNA, 64 nt, Homo Sapiens
gaggaccagucaggaugaggcugggacuuucccacccaggaaaggaucaggccucaccccuccc

SEQ ID NO: 449666 - RNA, 64 nt, Homo Sapiens
uucggcaugucugcagccuguucuccuagccugcugcuuggagucagguugagcaucagugaga

SEQ ID NO: 449667 - RNA, 64 nt, Homo Sapiens
uuaaaaaaauaauugaaguguaagcuaaauaaaaugcuuggaguuuugccugggcuagugagag

SEQ ID NO: 449668 - RNA, 64 nt, Homo Sapiens
ucaggggaccuaggacaaauuggagauagcacugugcuuggagugacaaggcagcuuggucuag

SEQ ID NO: 449669 - RNA, 64 nt, Homo Sapiens
guggggguagaaauagacacuuuaaaaaacaccaugcuuggagguguaagggaaaaauuaauuu

SEQ ID NO: 449670 - RNA, 64 nt, Homo Sapiens
ccucaagugaucuaccugccucugccucccgaagugcuuggauuacaggugugagccacugugu

SEQ ID NO: 449671 - RNA, 64 nt, Homo Sapiens
aagugaauauacuuaauauauucuaguacagguaugcuuggaaauagggcguuuccuuuucaug

SEQ ID NO: 449672 - RNA, 64 nt, Homo Sapiens
agacuugggacugggacaguuguuaaggcuguuuugcuuggagaaaagguuuuuaaaacaugga

SEQ ID NO: 449673 - RNA, 64 nt, Homo Sapiens
aaaggacagcguggauaaaaucacuaagcucaagugcuuggauggugccuaauuuuauaaaaag

SEQ ID NO: 449674 - RNA, 64 nt, Homo Sapiens
aucugcuguaugucaacuuuuaauauguaaggaaugcuuggaauauuaucuuuguaauuauuuu

SEQ ID NO: 449675 - RNA, 64 nt, Homo Sapiens
ucgugcuuuaagugccuacagacaugugucaagcugcuuggaccuucagagguggcucuggaau

SEQ ID NO: 449676 - RNA, 64 nt, Homo Sapiens
aaagggugcauuucaggguggauagggcgcuggcugcuuggagcuguuugguaaaugccagguu

SEQ ID NO: 449677 - RNA, 64 nt, Homo Sapiens
uaggcccaggggcucugccauugggagggguggcugcuuggaaagagaggcaccucugcucuug

SEQ ID NO: 449678 - RNA, 64 nt, Homo Sapiens
caugaccauuuauuugccccuuucuccauccuguugcuuggaauguggaucugguagugagcca

SEQ ID NO: 449679 - RNA, 63 nt, Homo Sapiens
uuuucucuugcuauuuauauauauaugauaaaaaugcuuggaagaguccuuuaauuuaugguu

SEQ ID NO: 449680 - RNA, 64 nt, Homo Sapiens
cacagaaacgccugagagucacuuacccggccacugcuuggaagguuucccuccggggaaugcc

SEQ ID NO: 449681 - RNA, 64 nt, Homo Sapiens
uccggcuguggcugacaguggcucuggccaggguugcuuggagaaggcucagugugccugggac

SEQ ID NO: 449682 - RNA, 64 nt, Homo Sapiens
uugaaauuuacuguaacuguaugauucaaauugcugcuuggauucuguguuuguuuuucaagaa

SEQ ID NO: 449683 - RNA, 64 nt, Homo Sapiens
ugcauauuuauugcauugcugcuuggucuuucugugcuuggauucgugcgcccguggggucugc

SEQ ID NO: 449684 - RNA, 64 nt, Homo Sapiens
ucccuuuguagccauccaaugggcauugugugggugcuuggaacccgggaugacugagggggac

SEQ ID NO: 449685 - RNA, 64 nt, Homo Sapiens
ggaccaggggucccggaggaacccauuugugcucugcuuggacagcaggccuggcacugggagg

SEQ ID NO: 449686 - RNA, 64 nt, Homo Sapiens; identical to SEQ ID NO: 331879

SEQ ID NO: 449687 - RNA, 64 nt, Homo Sapiens; identical to SEQ ID NO: 331880

SEQ ID NO: 449688 - RNA, 64 nt, Homo Sapiens; identical to SEQ ID NO: 331881

SEQ ID NO: 449689 - RNA, 64 nt, Homo Sapiens; identical to SEQ ID NO: 331882

SEQ ID NO: 449690 - RNA, 64 nt, Homo Sapiens; identical to SEQ ID NO: 331883

SEQ ID NO: 449691 - RNA, 64 nt, Homo Sapiens; identical to SEQ ID NO: 331884

SEQ ID NO: 449692 - RNA, 64 nt, Homo Sapiens
gcuuuagaaauaguuuuaacuagcuuaguuuucugguuuccaaaacuaaaauagauuaaauccu

SEQ ID NO: 449693 - RNA, 64 nt, Homo Sapiens
aaucugaccacuaucuauaaauacauuggacauugguuuccaaaucucccuuucuucuucaguu

SEQ ID NO: 449694 - RNA, 64 nt, Homo Sapiens
gaggagccaaacacgggccuuggacuaggugcuagguuuccaggcugaagugugugccaggcuc

SEQ ID NO: 449695 - RNA, 64 nt, Homo Sapiens
gcucccaguggacaugucagagcaguacacacuugguuuccagacacuuccaucccucgggccc

SEQ ID NO: 449696 - RNA, 64 nt, Homo Sapiens
uuaugcgaguauuuguaacuauauaugaaauaaugguuuccauucauuugugauuaauuaauuu

SEQ ID NO: 449697 - RNA, 64 nt, Homo Sapiens
gauuccuucuuagccauggacauaccuucugucugguuuccacucauucuguaggacugucuug

SEQ ID NO: 449698 - RNA, 64 nt, Homo Sapiens
ucuugggucauugaucccuggcucagaggauagcgguuuccaucauaaaccaagaugaugaguu

SEQ ID NO: 449699 - RNA, 64 nt, Homo Sapiens
agacuuccuccuguucccugggucagaggauagcgguuuccaucauaaaccaagaugaugaguu

SEQ ID NO: 449700 - RNA, 64 nt, Homo Sapiens
cugcacauuguagagggaacaagggucagguaaggguuuccacugacacaggaccaguuuggaa

SEQ ID NO: 449701 - RNA, 64 nt, Homo Sapiens
uucaccguguguuagggugaauuauuugcugucggguuuccaguggaccagagccagccuaguc

SEQ ID NO: 449702 - RNA, 64 nt, Homo Sapiens
ugggguagugucagucggacugcacagggaacacgguuuccaguggcuuuggccccuacucggg

SEQ ID NO: 449703 - RNA, 64 nt, Homo Sapiens
guguuaaucauuugccuuacaagauguaccagacgguuuccaguacuaacaaagggaauaaaaa

SEQ ID NO: 449704 - RNA, 64 nt, Homo Sapiens
caaaauaaugaauuuuuuuuaaaaagcaauaccugguuuccaccuuggacugacuuugauccug

SEQ ID NO: 449705 - RNA, 64 nt, Homo Sapiens
augaauuaauuuaaauuaauucuaaagugacucugguuuccauuuuagucuauuagcuagaggg

SEQ ID NO: 449706 - RNA, 64 nt, Homo Sapiens
auaucaggggauuuuaguuccaagcagggacccugguuuccauacugcccucagcuggaguuug

SEQ ID NO: 449707 - RNA, 63 nt, Homo Sapiens
gcaguaaguaaaaacauucuccuagcauuaaaaugguuuccauaacuacuuuuguccuggcuu

SEQ ID NO: 449708 - RNA, 64 nt, Homo Sapiens
ggguccccgauuccaaugcuguuuuuuggggagugguuuccaggagcugccuggugucugcugu

SEQ ID NO: 449709 - RNA, 64 nt, Homo Sapiens
guggcaagaacuguggaccaugccagucccgucugguuuccaucccaccacuccaaggacugag

SEQ ID NO: 449710 - RNA, 64 nt, Homo Sapiens
aguuauacauugguguuuuguuuugcuugcuuuagguuuccaaagcgauuuagggauucuucag

SEQ ID NO: 449711 - RNA, 64 nt, Homo Sapiens
ugucuucauuguaguggguaccucucaagagacagguuuccaggccagugguuagcucacauug

SEQ ID NO: 449712 - RNA, 64 nt, Homo Sapiens
uuucuacaacugaucauuugcagcugcugguuuugguuuccaccuuacccuacuggcuguaaaa

SEQ ID NO: 449713 - RNA, 64 nt, Homo Sapiens
ggcacagacuucacacagcaccuccucucugcuggguuuccacacagccugucuucagauccug

SEQ ID NO: 449714 - RNA, 64 nt, Homo Sapiens
caggcccaugcccuccguccucagggagcccugggguuuccacaccugagaagccucaugggag

SEQ ID NO: 449715 - RNA, 64 nt, Homo Sapiens
uuggcgcgcagcccgggagacccaggacccugaggguuuccacccagaccugggcccugguucc

SEQ ID NO: 449716 - RNA, 64 nt, Homo Sapiens
aacagaagcaaaucauaucaaacggggauagaaugguuuccacugaggacauucagccugggaa

SEQ ID NO: 449717 - RNA, 64 nt, Homo Sapiens
aaggaggaagucaccagcucgaggcguguggauugguuuccacccggaacaggcucugugaugg

SEQ ID NO: 449718 - RNA, 64 nt, Homo Sapiens; identical to SEQ ID NO: 286103

SEQ ID NO: 449719 - RNA, 64 nt, Homo Sapiens; identical to SEQ ID NO: 286104

SEQ ID NO: 449720 - RNA, 64 nt, Homo Sapiens; identical to SEQ ID NO: 286105

SEQ ID NO: 449721 - RNA, 64 nt, Homo Sapiens; identical to SEQ ID NO: 286106

SEQ ID NO: 449722 - RNA, 64 nt, Homo Sapiens; identical to SEQ ID NO: 286107

SEQ ID NO: 449723 - RNA, 64 nt, Homo Sapiens; identical to SEQ ID NO: 286108

SEQ ID NO: 449724 - RNA, 64 nt, Homo Sapiens; identical to SEQ ID NO: 286109

SEQ ID NO: 449725 - RNA, 64 nt, Homo Sapiens; identical to SEQ ID NO: 286110

SEQ ID NO: 449726 - RNA, 64 nt, Homo Sapiens; identical to SEQ ID NO: 286111

SEQ ID NO: 449727 - RNA, 64 nt, Homo Sapiens; identical to SEQ ID NO: 286112

SEQ ID NO: 449728 - RNA, 64 nt, Homo Sapiens; identical to SEQ ID NO: 286113

SEQ ID NO: 449729 - RNA, 64 nt, Homo Sapiens; identical to SEQ ID NO: 286114

SEQ ID NO: 449730 - RNA, 64 nt, Homo Sapiens; identical to SEQ ID NO: 286115

SEQ ID NO: 449731 - RNA, 64 nt, Homo Sapiens; identical to SEQ ID NO: 286116

SEQ ID NO: 449732 - RNA, 64 nt, Homo Sapiens; identical to SEQ ID NO: 286117

SEQ ID NO: 449733 - RNA, 64 nt, Homo Sapiens; identical to SEQ ID NO: 286118

SEQ ID NO: 449734 - RNA, 64 nt, Homo Sapiens; identical to SEQ ID NO: 286119

SEQ ID NO: 449735 - RNA, 64 nt, Homo Sapiens; identical to SEQ ID NO: 286120

SEQ ID NO: 449736 - RNA, 64 nt, Homo Sapiens; identical to SEQ ID NO: 286121

SEQ ID NO: 449737 - RNA, 64 nt, Homo Sapiens; identical to SEQ ID NO: 286122

SEQ ID NO: 449738 - RNA, 64 nt, Homo Sapiens; identical to SEQ ID NO: 286123

SEQ ID NO: 449739 - RNA, 64 nt, Homo Sapiens; identical to SEQ ID NO: 286124

SEQ ID NO: 449740 - RNA, 64 nt, Homo Sapiens
ccauucauguacuuuuccuuauauuuccaaaacuguuacugagaaugggucaagaucagugaga

SEQ ID NO: 449741 - RNA, 64 nt, Homo Sapiens
uaacuucuaaaagguauuuuuauaagcaguucaaguuacugaaaaccuuuuaaaccuuucugaa

SEQ ID NO: 449742 - RNA, 64 nt, Homo Sapiens
cuauaagugaccuaaaauguacaggugugauccuguuacugauacauccugguguuacugaaaa

SEQ ID NO: 449743 - RNA, 64 nt, Homo Sapiens
aacaggugugauccuguuacguauucauccugguguuacugaaaagaccggcguagggacagau

SEQ ID NO: 449744 - RNA, 64 nt, Homo Sapiens
aaagccccuccucuuggcaccucagaaucacaguguuacugaucagggaugugaggcugcuguu

SEQ ID NO: 449745 - RNA, 64 nt, Homo Sapiens
uggugcugguugggguggggccugcagagucuuaguuacugauuucauuuucaauaaauguagg

SEQ ID NO: 449746 - RNA, 64 nt, Homo Sapiens
uagagacuaagcccucuuaauguuaugacuaauuguuacugauuauuuaaauguguuuguaugg

SEQ ID NO: 449747 - RNA, 64 nt, Homo Sapiens
guggcauuucaggguuaacauguuuuguuguuguguuacugaauggcuugcugcuguaaucuuu

SEQ ID NO: 449748 - RNA, 64 nt, Homo Sapiens
aaaugauaaguauccauuuaagcugagcuauuucguuacugagauccagauacuguuuuaggug

SEQ ID NO: 449749 - RNA, 64 nt, Homo Sapiens
cccaaaaauauauuccagguaaaggaggguaucaguuacugauagaaguauuguuuaugauaag

SEQ ID NO: 449750 - RNA, 64 nt, Homo Sapiens; identical to SEQ ID NO: 99880

SEQ ID NO: 449751 - RNA, 64 nt, Homo Sapiens; identical to SEQ ID NO: 99881

SEQ ID NO: 449752 - RNA, 64 nt, Homo Sapiens; identical to SEQ ID NO: 99882

SEQ ID NO: 449753 - RNA, 64 nt, Homo Sapiens; identical to SEQ ID NO: 99883

SEQ ID NO: 449754 - RNA, 64 nt, Homo Sapiens; identical to SEQ ID NO: 99884

SEQ ID NO: 449755 - RNA, 64 nt, Homo Sapiens; identical to SEQ ID NO: 99885

SEQ ID NO: 449756 - RNA, 64 nt, Homo Sapiens; identical to SEQ ID NO: 99886

SEQ ID NO: 449757 - RNA, 64 nt, Homo Sapiens; identical to SEQ ID NO: 99887

SEQ ID NO: 449758 - RNA, 64 nt, Homo Sapiens; identical to SEQ ID NO: 99888

SEQ ID NO: 449759 - RNA, 64 nt, Homo Sapiens; identical to SEQ ID NO: 99889

SEQ ID NO: 449760 - RNA, 64 nt, Homo Sapiens; identical to SEQ ID NO: 99890

SEQ ID NO: 449761 - RNA, 64 nt, Homo Sapiens; identical to SEQ ID NO: 99891

SEQ ID NO: 449762 - RNA, 64 nt, Homo Sapiens; identical to SEQ ID NO: 99892

SEQ ID NO: 449763 - RNA, 64 nt, Homo Sapiens; identical to SEQ ID NO: 99893

SEQ ID NO: 449764 - RNA, 64 nt, Homo Sapiens; identical to SEQ ID NO: 99894

SEQ ID NO: 449765 - RNA, 64 nt, Homo Sapiens; identical to SEQ ID NO: 99895

SEQ ID NO: 449766 - RNA, 64 nt, Homo Sapiens; identical to SEQ ID NO: 99896

SEQ ID NO: 449767 - RNA, 64 nt, Homo Sapiens; identical to SEQ ID NO: 99897

SEQ ID NO: 449768 - RNA, 64 nt, Homo Sapiens
acagggguguuuguuggauggguuuaaaaauaacuagaaaaacucaggcccauccauuuucuca

SEQ ID NO: 449769 - RNA, 64 nt, Homo Sapiens
uucuuaaaaucaguguuuccccuuugugcacuuguagaaaaaaaagaaaaaccuucuagagcug

SEQ ID NO: 449770 - RNA, 64 nt, Homo Sapiens
uuuuuuuucagaauaaacaacuaaauaacuguauuagaaaaaaaagaaacuuacuaaauaucau

SEQ ID NO: 449771 - RNA, 64 nt, Homo Sapiens
cauuuacuguuucuguuauaauaaaaggguauguuagaaaaacaaaaaggaggcugggcauggu

SEQ ID NO: 449772 - RNA, 64 nt, Homo Sapiens
ugcuguuaacuaaaaaugcugagaccccuuuuuauagaaaaacaaaaagacaucaagucuucuu

SEQ ID NO: 449773 - RNA, 64 nt, Homo Sapiens
cuguaauuugauuuacaugcauuagagcacacaguagaaaaacuuuagcuucauuaguaauaug

SEQ ID NO: 449774 - RNA, 64 nt, Homo Sapiens
aauaaauauugaggguuuccuagaaagccuugacuagaaaaaugaaaauuuuauuuuaucaucc

SEQ ID NO: 449775 - RNA, 64 nt, Homo Sapiens
ggggugaucuuuccaggaaauaauucugggaaauuagaaaaaguacagauaaaauacauucuuu

SEQ ID NO: 449776 - RNA, 64 nt, Homo Sapiens
aaugugauuacagguagaggcaccaaauugucuuuagaaaaauuaaugacauuuaucuucaaaa

SEQ ID NO: 449777 - RNA, 64 nt, Homo Sapiens
gacugaaauuuuaaagacaucuuuuugaacucaguagaaaaacagguagccuccaucuuuuaaa

SEQ ID NO: 449778 - RNA, 64 nt, Homo Sapiens
uugccuuucuuuuuuuaugacuguauaagccacauagaaaaaaguuuagcuguaacauccgauu

SEQ ID NO: 449779 - RNA, 64 nt, Homo Sapiens
aacaaccuaacaccagauucauauaggagauuuuuagaaaaaucaguacauauggauuuuguau

SEQ ID NO: 449780 - RNA, 64 nt, Homo Sapiens
aaaccaucauuauauucuuucacagaguuaaauauagaaaaaugcccagauaucauuaggauca

SEQ ID NO: 449781 - RNA, 64 nt, Homo Sapiens
cuaauaaucucuauuuauaacuaaaucauugagauagaaaaagauucccauugacuguagacuu

SEQ ID NO: 449782 - RNA, 64 nt, Homo Sapiens
auaauuuuagaucugaucagguaguagcuaaaauuagaaaaaaacaaaauagaugcuuaaagaa

SEQ ID NO: 449783 - RNA, 64 nt, Homo Sapiens
uuucugcccacuuuaccuaccaggaaauguaaaguagaaaaagaauucaaacaaacagcacuua

SEQ ID NO: 449784 - RNA, 64 nt, Homo Sapiens
ccggaaaaauacgccaagguuaugaaaugguccauagaaaaaaauaauauucugugugauggga

SEQ ID NO: 449785 - RNA, 64 nt, Homo Sapiens
uugaagacauuguauuaccauagaaaaauaacuuuagaaaaauagcuguugucuuauuauuaua

SEQ ID NO: 449786 - RNA, 64 nt, Homo Sapiens
acuuuagaaaaauauugaaggucuuauuauuauauagaaaaauauuccuauaugcuaugcuguu

SEQ ID NO: 449787 - RNA, 64 nt, Homo Sapiens
uuggguuuuuuucuuauuguuuucuccccaggguuagaaaaauugguauaaguuccuaauuaaa

SEQ ID NO: 449788 - RNA, 64 nt, Homo Sapiens
gcuaaagguucugggaagcuaauaauugaauuauuagaaaaacauuucagaauaggaaguaaau

SEQ ID NO: 449789 - RNA, 64 nt, Homo Sapiens
gggccagguuuauuuucuccuuuuuugagauuucuagaaaaaaugcugcuugcacauguugguu

SEQ ID NO: 449790 - RNA, 64 nt, Homo Sapiens
gugugcaguguguaaauacuuuaaauuauuaugcuagaaaaauaaaguuacauaccuugcugug

SEQ ID NO: 449791 - RNA, 64 nt, Homo Sapiens
aauggccaaaaugguugcaaucauucauacuaguuagaaaaauuauguguugaaauaaguggaa

SEQ ID NO: 449792 - RNA, 64 nt, Homo Sapiens
uuccagaaauaccugauuuugaaucauucaacaguagaaaaagaggcauauuuucauuacuuga

SEQ ID NO: 449793 - RNA, 64 nt, Homo Sapiens
gcauguggcauaaauuuggagaaaauaauaugacuagaaaaauuaguguuauauugggugugag

SEQ ID NO: 449794 - RNA, 64 nt, Homo Sapiens
acauauacagaauuagccaaaugguauaagacaauagaaaaaggcuguggauucuuugaggaca

SEQ ID NO: 449795 - RNA, 64 nt, Homo Sapiens
cauucuaucuacugauuuggugccuauuguaauauagaaaaaaauucugaugaaauguuaacaa

SEQ ID NO: 449796 - RNA, 64 nt, Homo Sapiens
ucacgauucauuuuugaaacaauucuuguuaugguagaaaaauucagcuaugaagagcuagaga

SEQ ID NO: 449797 - RNA, 64 nt, Homo Sapiens
auuuuaauuucacuaaaaugauuuuuugauugacuagaaaaaucguuauuugauauuuuaauuu

SEQ ID NO: 449798 - RNA, 64 nt, Homo Sapiens
caaauggauugcuucccaaaaccaaagacggcuauagaaaaacuuguguuuucccacauuuagg

SEQ ID NO: 449799 - RNA, 64 nt, Homo Sapiens
cagauccuuauagauacgguaagagccacauucguagaaaaacuucugguguggccagguuuua

SEQ ID NO: 449800 - RNA, 64 nt, Homo Sapiens
uaaguagcuugucaucaauccccuugucgaaaacuagaaaaaaaggaguugacccauauaaauu

SEQ ID NO: 449801 - RNA, 64 nt, Homo Sapiens
aaauguuaguaucucaauuauaucucuaaaacacuagaaaaaaguuaacucaaauacugugaac

SEQ ID NO: 449802 - RNA, 64 nt, Homo Sapiens
ggaggauuuuucugcauuguuuuaaacuggcauauagaaaaaaacuuacccgugucaauuaaca

SEQ ID NO: 449803 - RNA, 64 nt, Homo Sapiens
uaaguuuuuaaaaauaaauuauaaacuuggagauuagaaaaauaaagcaguugcuguagaauag

SEQ ID NO: 449804 - RNA, 64 nt, Homo Sapiens
uuugcuuuagaguuaaauauuccuaucuuaaguuuagaaaaauacaaaaaaccauuccaaggau

SEQ ID NO: 449805 - RNA, 64 nt, Homo Sapiens
ucugaagagcuagucuaucacaucucugaacugguagaaaaacaauuggaacuagucauuaacc

SEQ ID NO: 449806 - RNA, 64 nt, Homo Sapiens
ugaaacaacaaaacaauuacuagaggggagacauuagaaaaaaauguuaucucaggugagcugg

SEQ ID NO: 449807 - RNA, 64 nt, Homo Sapiens
uaaugguaguaaagaaacugacguuaucuccggcuagaaaaaaaaggccuuacuuugugauuau

SEQ ID NO: 449808 - RNA, 64 nt, Homo Sapiens
acucuacaaaaauuuugcagacacaguaguccccuagaaaaacagauuaaaaacauucauuuga

SEQ ID NO: 449809 - RNA, 64 nt, Homo Sapiens
guauuuaauuuggaucuggaagaauaguuugaaauagaaaaaaagauuaucaccuuagcaacuu

SEQ ID NO: 449810 - RNA, 64 nt, Homo Sapiens
caugaauuuagaaauauucaagugaggauggauuuagaaaaaaauugaaagaaguauuaaaaag

SEQ ID NO: 449811 - RNA, 64 nt, Homo Sapiens
auuagaacauucacuuuuguuggagguaguuggguagaaaaauuauaggcguuuuuuggggaug

SEQ ID NO: 449812 - RNA, 64 nt, Homo Sapiens
acugaagaugaaauauauaucacugcacuuuguuuagaaaaaaauuucuguagacucuaagaua

SEQ ID NO: 449813 - RNA, 64 nt, Homo Sapiens
uuuuggucuagccacuaaacauuuaacaauggauuagaaaaauauuuugacacuuuuaauuuuc

SEQ ID NO: 449814 - RNA, 64 nt, Homo Sapiens
auuauuuugcaguuaucugauggcagaaauuaucuagaaaaauuucacccaaaaaccauuuggc

SEQ ID NO: 449815 - RNA, 64 nt, Homo Sapiens
agaaauuauuaacuuuauugguacauuugaaaaguagaaaaauuacuaaaaauagcacauuuga

SEQ ID NO: 449816 - RNA, 64 nt, Homo Sapiens
uuuagaugucuuuuugugauaugaaaaaaagacguagaaaaauguaacauagcuguuuuaacaa

SEQ ID NO: 449817 - RNA, 64 nt, Homo Sapiens
cacccaccaugccgcacauucgacccaggacaauuagaaaaauuucugagaaggugaacuguua

SEQ ID NO: 449818 - RNA, 64 nt, Homo Sapiens
acaaacccaaagguaggaagcacguggucaugaauagaaaaaaauauuaugggauuggaagaaa

SEQ ID NO: 449819 - RNA, 64 nt, Homo Sapiens
ucaccuuuuuucuuccucuuauuauauuuuacuuuagaaaaauauugagcuuucauuuuuaaaa

SEQ ID NO: 449820 - RNA, 64 nt, Homo Sapiens
gucaggaaaccagcucguggucccucaugucagauagaaaaaaagaaaucuaggacuuccagcu

SEQ ID NO: 449821 - RNA, 64 nt, Homo Sapiens
cuuuagaguucagcucuaacaauauucuguuuaguagaaaaaucgccauaugccuguggagugg

SEQ ID NO: 449822 - RNA, 64 nt, Homo Sapiens
ucauccagccauaugccuguuuaugaaccucacauagaaaaauucacuuuagacuuaguaguaa

SEQ ID NO: 449823 - RNA, 64 nt, Homo Sapiens
guuuaaaaaaaagcauaaaaacauuuuaaaaacauagaaaaauucagcaaaccauuuuuaaagu

SEQ ID NO: 449824 - RNA, 64 nt, Homo Sapiens
gcaaaccauuuuuaaaguagaagaggguuuuagguagaaaaacauauucuugugcuuuuccuga

SEQ ID NO: 449825 - RNA, 64 nt, Homo Sapiens
acuuuuuaaguacuaagucauagcacuuugaagauagaaaaaccuuuuugaauacuuguuucuu

SEQ ID NO: 449826 - RNA, 64 nt, Homo Sapiens
ugauccaaaauauggauauguaaucugaugaauauagaaaaaaauugcugugcauuuuaaccaa

SEQ ID NO: 449827 - RNA, 64 nt, Homo Sapiens
agaaguugaccuuugcacuggcauuaaagagucauagaaaaagaaucauggauauuuaugaauu

SEQ ID NO: 449828 - RNA, 64 nt, Homo Sapiens
uauuuucuuugcauuugaauaauugucuuguacuuagaaaaaaggcgucuaugaaugaccagug

SEQ ID NO: 449829 - RNA, 64 nt, Homo Sapiens
ccuacuaagucccaacaggaccaugaucuagagauagaaaaaucguuucuuggcuuuccgaagg

SEQ ID NO: 449830 - RNA, 64 nt, Homo Sapiens
ggacacagaccagacuaagggggugggguuacuuuagaaaaaguugccaacaauggugugcugg

SEQ ID NO: 449831 - RNA, 64 nt, Homo Sapiens
acauggaauuucaaauauacauacaugcauauaauagaaaaaaacuguauuauauacaagugua

SEQ ID NO: 449832 - RNA, 64 nt, Homo Sapiens
uguucauuuuccucagucucguucaaucuguugauagaaaaaauguuugaaugcuuauauauuu

SEQ ID NO: 449833 - RNA, 64 nt, Homo Sapiens
ugcaagcaagcuguuaaagagagcauuauguagguagaaaaaaaauuucuaccagaaauuucca

SEQ ID NO: 449834 - RNA, 64 nt, Homo Sapiens
ggaaucaagaaguucgauucuuuauaugaaggguuagaaaaaccgugaaugcauuucguaguuc

SEQ ID NO: 449835 - RNA, 64 nt, Homo Sapiens
uaacauuuuaauguauauuguaccaauaucauuauagaaaaaaagaaucaaauuauauaaacag

SEQ ID NO: 449836 - RNA, 64 nt, Homo Sapiens
aaauacaaaaaaaaaaaagaaaaauuucuuuuucuagaaaaaauguuaauaaaauucuauugca

SEQ ID NO: 449837 - RNA, 64 nt, Homo Sapiens
gugguguuuuuuuuguuuguuuguuuguuuguuuuagaaaaauugggauuuccccccaccccgc

SEQ ID NO: 449838 - RNA, 64 nt, Homo Sapiens
ccagcacaagagaauuagagcuucagugagaauuuagaaaaauuauacuaaagugagaugcauu

SEQ ID NO: 449839 - RNA, 64 nt, Homo Sapiens
gaacucuucugcaaaaauggauauuauuagaaauuagaaaaaaauuacuaauuuuacacauuag

SEQ ID NO: 449840 - RNA, 64 nt, Homo Sapiens
uuugugcaaaagcuucaaauuaaaacagcugcauuagaaaaagaggcgcuucuccccuccccua

SEQ ID NO: 449841 - RNA, 64 nt, Homo Sapiens
uucccucucucuuuuuuuaacaaaugccuucuuauagaaaaacuuucuaagaggcaacaauuua

SEQ ID NO: 449842 - RNA, 64 nt, Homo Sapiens
auuguaacaguuuuaugucaaaugaucugugcuguagaaaaacauuaacccuuguucaaaaaag

SEQ ID NO: 449843 - RNA, 64 nt, Homo Sapiens
auuuagauguauagaaaaguaagaaaaucuuacuuagaaaaaagccccuugaaacuugcaggau

SEQ ID NO: 449844 - RNA, 64 nt, Homo Sapiens
caaauagcauucuuauucacuuuaugccgguauuuagaaaaaauaaauuauagcaaguaugauu

SEQ ID NO: 449845 - RNA, 64 nt, Homo Sapiens
aaguugauaguuaaagaacagagaucccaucucuuagaaaaacauccagcuuuggcaacagaac

SEQ ID NO: 449846 - RNA, 64 nt, Homo Sapiens
auuaggaauugcuagauaguuuuaauuuuuauaauagaaaaauguguggcaauaacuuuugaau

SEQ ID NO: 449847 - RNA, 64 nt, Homo Sapiens
aauguuugaaauacgaaggucuucugguuugguuuagaaaaaguggagaggaaaaguugauuaa

SEQ ID NO: 449848 - RNA, 64 nt, Homo Sapiens
uaggagugauagagaacaaauuuuuaaaauaguauagaaaaaagauuuaauuuacuauuucaga

SEQ ID NO: 449849 - RNA, 64 nt, Homo Sapiens
uagggugauaggauauucauaaauccauuucuuuuagaaaaaauuuuauauuugucacuuuaaa

SEQ ID NO: 449850 - RNA, 64 nt, Homo Sapiens
uucaauacaauuguaauguagaaauauaagaauuuagaaaaaaguaaacuugccauuugguuaa

SEQ ID NO: 449851 - RNA, 64 nt, Homo Sapiens
ccaaacaaaucuuucuacgcuuaaaugaucaaauuagaaaaaccaauuccuauaauuaauaugc

SEQ ID NO: 449852 - RNA, 64 nt, Homo Sapiens
aagauuuauacuuuuaauauugaauauaguuucguagaaaaacauuuuauauguacuauucuua

SEQ ID NO: 449853 - RNA, 64 nt, Homo Sapiens
ucucaaguuaccaaauuuuuuguaauccuuuuacuagaaaaaucuuuuuugaagaguuuuucuu

SEQ ID NO: 449854 - RNA, 64 nt, Homo Sapiens
cuugugcuugcuucggcagcauauauacugaaauuagaaaaagaaaacuuuucuuuuuuauuau

SEQ ID NO: 449855 - RNA, 64 nt, Homo Sapiens
uuuauuacucaaaguaaaaugaucauguaugagauagaaaaauuuuaaagcaacuuauguguuc

SEQ ID NO: 449856 - RNA, 64 nt, Homo Sapiens
aaccauuguuucuucaauugcuuggucacuugauuagaaaaauagaggccuuaugauucagcag

SEQ ID NO: 449857 - RNA, 64 nt, Homo Sapiens
gugcuuaauauuguuauugcguagaaaaaguauguagaaaaaaaaaaggggauugcuacaccau

SEQ ID NO: 449858 - RNA, 64 nt, Homo Sapiens
auguagaaaaaaagugcuuaauugcuacaccauguagaaaaaguuauuuggggauucaaagggg

SEQ ID NO: 449859 - RNA, 64 nt, Homo Sapiens
uucacgcagauccuugguuguugagaugguaccuuagaaaaaguaguuccgugguugaauauau

SEQ ID NO: 449860 - RNA, 64 nt, Homo Sapiens
uacacgcaguuccgugguuguugagaugguaccuuagaaaaaguccaaucccaggccuugugau

SEQ ID NO: 449861 - RNA, 64 nt, Homo Sapiens
guaugucgauugauaucgcugcuacaucagacucuagaaaaaagggcugagaggaagcaagacg

SEQ ID NO: 449862 - RNA, 64 nt, Homo Sapiens
cauugugagcucugguuauuuuucucuuguaccauagaaaaauguauaaaaauuaucaaaaagc

SEQ ID NO: 449863 - RNA, 64 nt, Homo Sapiens
ggggagaaaaagaaaacucuggcguuagaggauauagaaaaauauaaguacaauuguuacaaau

SEQ ID NO: 449864 - RNA, 64 nt, Homo Sapiens
ucugaacgcccccagaaaauugugccaaagaguuuagaaaaauaaauauacaauaaaaguaaac

SEQ ID NO: 449865 - RNA, 64 nt, Homo Sapiens
gggacugcagugcccaaggaauuucugcucugguuagaaaaaggacucugcuucaguccacuuc

SEQ ID NO: 449866 - RNA, 64 nt, Homo Sapiens
aaaggacucugcuucaguccacuucugcucugguuagaaaaaggacucugcuucaguccacagu

SEQ ID NO: 449867 - RNA, 64 nt, Homo Sapiens
aauguuagaagguuauuuaauauuucagagaaaauagaaaaaacuuugcaaguuuaauuugauu

SEQ ID NO: 449868 - RNA, 64 nt, Homo Sapiens
uuaaaauuggaagucauuaagggucuuagugcuuuagaaaaaagugauacauaaucuacaauaa

SEQ ID NO: 449869 - RNA, 64 nt, Homo Sapiens
uaacuggauuuaggccuacccacuggucaacgauuagaaaaauagcucagaaagucuuuauaac

SEQ ID NO: 449870 - RNA, 64 nt, Homo Sapiens
aauuuuucugccuuuuaccaagcagauuuuccuguagaaaaacuagauuuucaaauuauuuaga

SEQ ID NO: 449871 - RNA, 64 nt, Homo Sapiens
aauucuggcuuuauauuaaacuagaaaaaaggaguagaaaaaaccaaucuuuggucuuaguuuu

SEQ ID NO: 449872 - RNA, 64 nt, Homo Sapiens
gaguagaaaaaacaauucuguggucuuaguuuucuagaaaaaaguacacaauuucuucaaucuu

SEQ ID NO: 449873 - RNA, 64 nt, Homo Sapiens
acugguugcauguaaaauucacagaauaaucuaguagaaaaauagcaguaccauuggagaguua

SEQ ID NO: 449874 - RNA, 64 nt, Homo Sapiens
uuguuuauuuuuuauucuucuauuuuugugggaauagaaaaaaaggaaaguguuaacuuacggg

SEQ ID NO: 449875 - RNA, 64 nt, Homo Sapiens; identical to SEQ ID NO: 169308

SEQ ID NO: 449876 - RNA, 64 nt, Homo Sapiens; identical to SEQ ID NO: 169309

SEQ ID NO: 449877 - RNA, 64 nt, Homo Sapiens; identical to SEQ ID NO: 169310

SEQ ID NO: 449878 - RNA, 64 nt, Homo Sapiens; identical to SEQ ID NO: 169311

SEQ ID NO: 449879 - RNA, 64 nt, Homo Sapiens; identical to SEQ ID NO: 169312

SEQ ID NO: 449880 - RNA, 64 nt, Homo Sapiens; identical to SEQ ID NO: 169313

SEQ ID NO: 449881 - RNA, 64 nt, Homo Sapiens; identical to SEQ ID NO: 169314

SEQ ID NO: 449882 - RNA, 64 nt, Homo Sapiens; identical to SEQ ID NO: 169315

SEQ ID NO: 449883 - RNA, 64 nt, Homo Sapiens; identical to SEQ ID NO: 169316

SEQ ID NO: 449884 - RNA, 64 nt, Homo Sapiens; identical to SEQ ID NO: 169317

SEQ ID NO: 449885 - RNA, 64 nt, Homo Sapiens; identical to SEQ ID NO: 169318

SEQ ID NO: 449886 - RNA, 64 nt, Homo Sapiens; identical to SEQ ID NO: 169319

SEQ ID NO: 449887 - RNA, 64 nt, Homo Sapiens; identical to SEQ ID NO: 169320

SEQ ID NO: 449888 - RNA, 64 nt, Homo Sapiens; identical to SEQ ID NO: 169321

SEQ ID NO: 449889 - RNA, 64 nt, Homo Sapiens; identical to SEQ ID NO: 169322

SEQ ID NO: 449890 - RNA, 64 nt, Homo Sapiens; identical to SEQ ID NO: 169323

SEQ ID NO: 449891 - RNA, 64 nt, Homo Sapiens; identical to SEQ ID NO: 169324

SEQ ID NO: 449892 - RNA, 64 nt, Homo Sapiens; identical to SEQ ID NO: 169325

SEQ ID NO: 449893 - RNA, 64 nt, Homo Sapiens; identical to SEQ ID NO: 169326

SEQ ID NO: 449894 - RNA, 64 nt, Homo Sapiens; identical to SEQ ID NO: 169327

SEQ ID NO: 449895 - RNA, 64 nt, Homo Sapiens; identical to SEQ ID NO: 169328

SEQ ID NO: 449896 - RNA, 64 nt, Homo Sapiens; identical to SEQ ID NO: 169329

SEQ ID NO: 449897 - RNA, 64 nt, Homo Sapiens
ugcuaauggagaugaugguaaugauaaagacaacaacaaugauuaucaaguuccuguacacucu

SEQ ID NO: 449898 - RNA, 64 nt, Homo Sapiens
uccuacagcuaaagccucaggccauugccuaauuaacaaugaagauuucauggacauccuacac

SEQ ID NO: 449899 - RNA, 64 nt, Homo Sapiens
caucaagccccacaguucuuaauacaggagacccaacaaugaguggacaagucauggacauuca

SEQ ID NO: 449900 - RNA, 64 nt, Homo Sapiens
uaaaucgggaaggaugggaaaaacugcagucaucaacaaugauuaaucagcuguugcaggcagu

SEQ ID NO: 449901 - RNA, 64 nt, Homo Sapiens
agaguauauuuaaccuuuucauacauuuucugaaaacaaugaaacuguuacaaauuggaccuuu

SEQ ID NO: 449902 - RNA, 64 nt, Homo Sapiens
uaugaauaccgcagggcagcccaccuuugugguaaacaaugaauuuaaagcuuaaauuuaugaa

SEQ ID NO: 449903 - RNA, 64 nt, Homo Sapiens
ucauaauaauucucacugacguuaugggauucagaacaaugagaucugacaagcuuuagccuau

SEQ ID NO: 449904 - RNA, 64 nt, Homo Sapiens
caauguugaggacucaaaugccauuaacucacugaacaaugagaacagccagcccaccagccca

SEQ ID NO: 449905 - RNA, 64 nt, Homo Sapiens
agcgugcuggcccugaguacugaacuuucugaguaacaaugagauacguuacagaaccuauguu

SEQ ID NO: 449906 - RNA, 64 nt, Homo Sapiens
cugaaaccccacuuaagcauuguuuuuauauaaaaacaaugauaaagaugugaaacugugaaau

SEQ ID NO: 449907 - RNA, 64 nt, Homo Sapiens
guuagcuucacaccuucaaaccuaggauuuuaagaacaaugaaaauuuuuuaaaauuuggcuuu

SEQ ID NO: 449908 - RNA, 64 nt, Homo Sapiens
aaggccuuaugaacuguacgcaucuaaguugacuaacaaugacaaauggcccuacugauauuca

SEQ ID NO: 449909 - RNA, 64 nt, Homo Sapiens
auuagcucauucacuuauuuacaauuauuauucuaacaaugauuagcaucugagaucuaagaac

SEQ ID NO: 449910 - RNA, 64 nt, Homo Sapiens
aaaggaacuuaaguauugguuaauagucugucucaacaaugaguaaaugaaaguacaccuacac

SEQ ID NO: 449911 - RNA, 64 nt, Homo Sapiens
aaaaacucaaggagcaacuaauaguuccugcuaaaacaaugaauacuaaagccuuuauuuguua

SEQ ID NO: 449912 - RNA, 64 nt, Homo Sapiens
aagcagauucagaaaugaggcaguaacaggcucaaacaaugacacccccaccguugucucaugc

SEQ ID NO: 449913 - RNA, 64 nt, Homo Sapiens
uuaugaggaauuaaagguuagaguuaaauauaauaacaaugacuauuccucaaucugaaacaau

SEQ ID NO: 449914 - RNA, 64 nt, Homo Sapiens
uaaauauaauaacaaugacuauuccucaaucugaaacaaugaguuggaagccaaaauugucaca

SEQ ID NO: 449915 - RNA, 64 nt, Homo Sapiens
guaagauacuuuagaaagcauguaaaguacuagaaacaaugagguggcuucaauuagugcucau

SEQ ID NO: 449916 - RNA, 64 nt, Homo Sapiens
aacaccacauguucucacucauagauaggaauugaacaaugagaacacauggagacaggaaggg

SEQ ID NO: 449917 - RNA, 64 nt, Homo Sapiens
gcuacccugaaaagucaacaacuccucucgaaagaacaaugaccacagucaacauccucugagg

SEQ ID NO: 449918 - RNA, 64 nt, Homo Sapiens
cucauggcccuucacaagaggaagcacacuggguaacaaugaacagugacucagggaacuuaug

SEQ ID NO: 449919 - RNA, 64 nt, Homo Sapiens
ugggaaggggucagggugagaggcugcucuggagaacaaugagguccucauagcagcaggcagc

SEQ ID NO: 449920 - RNA, 64 nt, Homo Sapiens
gcucaauaaauguggaucaucagagacauuuaugaacaaugacagaagaaaaauuacccaaaua

SEQ ID NO: 449921 - RNA, 64 nt, Homo Sapiens
cagaaagggcuuugcuauuuuucccuuuugggaaaacaaugaaguguuuuaaguccugggugga

SEQ ID NO: 449922 - RNA, 64 nt, Homo Sapiens
aaaauugugaguaauaaaaugaacucacaguuucaacaaugacccacauuuuaccagucuaguu

SEQ ID NO: 449923 - RNA, 63 nt, Homo Sapiens
ucaccuugguuuccgcacaccuucgcaaugugaacaggucaggagucccucccguccaccucc

SEQ ID NO: 449924 - RNA, 63 nt, Homo Sapiens
ccuuucucuuccuucuaaacaugugucucucccacaggucauucuccugugacacguguacug

SEQ ID NO: 449925 - RNA, 63 nt, Homo Sapiens
gaucccuggucaagaucuguugcccaagauguuacaggucacaaugaccacauuugaaauugu

SEQ ID NO: 449926 - RNA, 63 nt, Homo Sapiens
ggugcucuaagcuuaaucccucagaauguguggacaggucagcuuagaagagauggggagauu

SEQ ID NO: 449927 - RNA, 63 nt, Homo Sapiens
ccacaggccaggcccagucacagcugggcuuccacaggucagaauaugggacaggacaugguc

SEQ ID NO: 449928 - RNA, 63 nt, Homo Sapiens
uacaagaagcaaaacugcccaugcaaagagaacacaggucacuuuucaaaacacuugcaucau

SEQ ID NO: 449929 - RNA, 63 nt, Homo Sapiens
cauuuauuucauuuuggucuuaaugcuuuguaaacaggucaaaaaauacugucauacucuaag

SEQ ID NO: 449930 - RNA, 63 nt, Homo Sapiens
uccagugggguggggggagggcaagcuggauuuacaggucacggcuggacugaaugggccuuu

SEQ ID NO: 449931 - RNA, 63 nt, Homo Sapiens
uggaccucaaagaauucuucagaccucauaguuacaggucauuauaucuacuauguugauuua

SEQ ID NO: 449932 - RNA, 63 nt, Homo Sapiens
cagggccacauuugcaugagacauggcugucucacaggucacagagccauuacaacagcuuac

SEQ ID NO: 449933 - RNA, 63 nt, Homo Sapiens
gcagagcccaucuacgcccaacacagagcucacacaggucacugcucucuaggcggacacacc

SEQ ID NO: 449934 - RNA, 63 nt, Homo Sapiens
cggucccagaggaggaccuagugacaucaugggacaggucaaagcauuagggccaccuccaug

SEQ ID NO: 449935 - RNA, 64 nt, Homo Sapiens
uucacauucauacauuuauuuuuuguguauaaauuuguuauaaguacaggauuauaaaauaaua

SEQ ID NO: 449936 - RNA, 64 nt, Homo Sapiens
ugcuuucuuucuuugacuccuugguuuauuuuuauuguuauaaauagauccuccccugcuauuu

SEQ ID NO: 449937 - RNA, 64 nt, Homo Sapiens
gaucucagcccuaaaccuagugcuaaucucucuuuuguuauagaaaaugugcaugcuuuucucu

SEQ ID NO: 449938 - RNA, 64 nt, Homo Sapiens
uuaauaugcaugcuucuuuaguuaaaagauaaguuuguuauauacgaaauacaguuauuaaaau

SEQ ID NO: 449939 - RNA, 64 nt, Homo Sapiens
uuuucccccuuagugaauuaguuuuaaaaugauauuguuauauacauacuaugaaauauguaua

SEQ ID NO: 449940 - RNA, 64 nt, Homo Sapiens
ugaaauauauuuaaaauauauugaauauuuuauauuguuauauccugacaagauuauaauauuu

SEQ ID NO: 449941 - RNA, 64 nt, Homo Sapiens
ccuacccuuaaggaauacucucuguaguaggcuguuguuauauuagacuuccuggaacacacug

SEQ ID NO: 449942 - RNA, 64 nt, Homo Sapiens
ucugaagaccugcagcagauuuaaauuacaacucuuguuauaacuuuuuaaaagauugugaaaa

SEQ ID NO: 449943 - RNA, 64 nt, Homo Sapiens
uucuaagcuuaagauaaaaguuuccugcuuuccauuguuauaaauagagugaaugaaaaaccac

SEQ ID NO: 449944 - RNA, 64 nt, Homo Sapiens
aguacauuaugaaucacauaauaaaaacugugucuuguuauaguuugcauuauuccaguaauau

SEQ ID NO: 449945 - RNA, 64 nt, Homo Sapiens
guauuauugguauucugauuacucucaauucuaauuguuauauauuugagcccauacaguguau

SEQ ID NO: 449946 - RNA, 64 nt, Homo Sapiens
ugagaaaguuaacuccaggauagguagguuucuauuguuauagcuagauguaaaucuuuaguuc

SEQ ID NO: 449947 - RNA, 64 nt, Homo Sapiens
aaaauaauaguguuucacagauaaucagugauuuuuguuauaugcaucaguaauauugaagguc

SEQ ID NO: 449948 - RNA, 64 nt, Homo Sapiens
gcucuauagucauccacaguuaguuuugugggacuuguuauaauauuguugucuuaaaacuuac

SEQ ID NO: 449949 - RNA, 64 nt, Homo Sapiens
uuauaacacuuaauacaauguaaaugcuauguaguuguuauaccauacugguuagugaauaauu

SEQ ID NO: 449950 - RNA, 64 nt, Homo Sapiens
uucuguuuuaagauuguaauuaaaaauuacuauuuuguuauauggaaugguuaauuuuuaccua

SEQ ID NO: 449951 - RNA, 64 nt, Homo Sapiens
uucuuccuaaaaauagaagagagauauuuaaaacuuguuauaacgccuauuguuuuucagaauu

SEQ ID NO: 449952 - RNA, 64 nt, Homo Sapiens
ucaaguuugaauguuacaaucaaucuuguuucuuuuguuauaagcccguaaacauuuuuguuug

SEQ ID NO: 449953 - RNA, 64 nt, Homo Sapiens
uguuaaccuuuuuuugacaagaaucacauguucguuguuauaagauaaaaauugugugaugaau

SEQ ID NO: 449954 - RNA, 64 nt, Homo Sapiens
aaguuuguauuauucuauuauuauaaucacagacuuguuauauaaaaggcaaagucuacuauaa

SEQ ID NO: 449955 - RNA, 64 nt, Homo Sapiens
guggcuagaacaucaauuacaaacauccaacuguuuguuauaaacuaaauacuguaauguuuca

SEQ ID NO: 449956 - RNA, 64 nt, Homo Sapiens
uuuuuuauuucuuucuuccucuucuucagugccauuguuauauggcauauuuucucauaaaugg

SEQ ID NO: 449957 - RNA, 64 nt, Homo Sapiens
uguuuauagcagguccuugaaaaauguuuuuguuuuguuauaauguuauaauuguuaugauguu

SEQ ID NO: 449958 - RNA, 64 nt, Homo Sapiens
uguuuguauccauuagucuaugguaaaauugguuuuguuauacaucauuucacuuaaaguugca

SEQ ID NO: 449959 - RNA, 64 nt, Homo Sapiens
aaauauacuuaaacaacaaacuuugaagaaaguguuguuauaaaauuauugaagcgauuucuau

SEQ ID NO: 449960 - RNA, 64 nt, Homo Sapiens
uaugaauaauugaaaaacaaaacacucacuggauuuguuauaauccguguuggcacuggauucu

SEQ ID NO: 449961 - RNA, 64 nt, Homo Sapiens
ucagugugcccuugaauccaguguauauaaugacuuguuauagcccuccgcacuguuacccagu

SEQ ID NO: 449962 - RNA, 64 nt, Homo Sapiens
cagugaaaauguauuauagaucuucaaagggaguuuguuauacauggauuaucugggguaauuu

SEQ ID NO: 449963 - RNA, 64 nt, Homo Sapiens
agagcauuuucauagugugcucauuucuaugguuuuguuauauagcauuuuucaacauuuaaug

SEQ ID NO: 449964 - RNA, 64 nt, Homo Sapiens
ugcuaaauucuucaccugugguaacucauuuugauuguuauaacaucucagcaccguuauuccc

SEQ ID NO: 449965 - RNA, 64 nt, Homo Sapiens
cccccuccucaagcugggccugcccuccaagugcuuguuauauaccuccacgggugucagccca

SEQ ID NO: 449966 - RNA, 64 nt, Homo Sapiens
gcaguaagauauauuuguguggcuaauauaauuguuguuauauauuucuaaccauuguuauaaa

SEQ ID NO: 449967 - RNA, 64 nt, Homo Sapiens
ggcuaauauaauuguuguuauuuguuucuaaccauuguuauaaagaaauaccaaaaaguaagcu

SEQ ID NO: 449968 - RNA, 64 nt, Homo Sapiens; identical to SEQ ID NO: 21335

SEQ ID NO: 449969 - RNA, 64 nt, Homo Sapiens; identical to SEQ ID NO: 21336

SEQ ID NO: 449970 - RNA, 64 nt, Homo Sapiens; identical to SEQ ID NO: 21337

SEQ ID NO: 449971 - RNA, 64 nt, Homo Sapiens; identical to SEQ ID NO: 21338

SEQ ID NO: 449972 - RNA, 64 nt, Homo Sapiens; identical to SEQ ID NO: 21339

SEQ ID NO: 449973 - RNA, 64 nt, Homo Sapiens; identical to SEQ ID NO: 21340

SEQ ID NO: 449974 - RNA, 64 nt, Homo Sapiens; identical to SEQ ID NO: 21341

SEQ ID NO: 449975 - RNA, 64 nt, Homo Sapiens; identical to SEQ ID NO: 21342

SEQ ID NO: 449976 - RNA, 64 nt, Homo Sapiens; identical to SEQ ID NO: 21343

SEQ ID NO: 449977 - RNA, 64 nt, Homo Sapiens; identical to SEQ ID NO: 21344

SEQ ID NO: 449978 - RNA, 64 nt, Homo Sapiens; identical to SEQ ID NO: 21345

SEQ ID NO: 449979 - RNA, 64 nt, Homo Sapiens; identical to SEQ ID NO: 21346

SEQ ID NO: 449980 - RNA, 64 nt, Homo Sapiens; identical to SEQ ID NO: 21347

SEQ ID NO: 449981 - RNA, 64 nt, Homo Sapiens; identical to SEQ ID NO: 21348

SEQ ID NO: 449982 - RNA, 64 nt, Homo Sapiens; identical to SEQ ID NO: 21349

SEQ ID NO: 449983 - RNA, 64 nt, Homo Sapiens; identical to SEQ ID NO: 114759

SEQ ID NO: 449984 - RNA, 64 nt, Homo Sapiens; identical to SEQ ID NO: 114760

SEQ ID NO: 449985 - RNA, 64 nt, Homo Sapiens; identical to SEQ ID NO: 114761

SEQ ID NO: 449986 - RNA, 64 nt, Homo Sapiens; identical to SEQ ID NO: 114762

SEQ ID NO: 449987 - RNA, 64 nt, Homo Sapiens; identical to SEQ ID NO: 114763

SEQ ID NO: 449988 - RNA, 64 nt, Homo Sapiens; identical to SEQ ID NO: 114764

SEQ ID NO: 449989 - RNA, 64 nt, Homo Sapiens; identical to SEQ ID NO: 114765

SEQ ID NO: 449990 - RNA, 64 nt, Homo Sapiens; identical to SEQ ID NO: 114766

SEQ ID NO: 449991 - RNA, 64 nt, Homo Sapiens; identical to SEQ ID NO: 114767

SEQ ID NO: 449992 - RNA, 64 nt, Homo Sapiens; identical to SEQ ID NO: 114768

SEQ ID NO: 449993 - RNA, 64 nt, Homo Sapiens; identical to SEQ ID NO: 114769

SEQ ID NO: 449994 - RNA, 64 nt, Homo Sapiens; identical to SEQ ID NO: 114770

SEQ ID NO: 449995 - RNA, 64 nt, Homo Sapiens; identical to SEQ ID NO: 114771

SEQ ID NO: 449996 - RNA, 64 nt, Homo Sapiens; identical to SEQ ID NO: 114772

SEQ ID NO: 449997 - RNA, 64 nt, Homo Sapiens; identical to SEQ ID NO: 114773

SEQ ID NO: 449998 - RNA, 64 nt, Homo Sapiens; identical to SEQ ID NO: 114774

SEQ ID NO: 449999 - RNA, 64 nt, Homo Sapiens; identical to SEQ ID NO: 114775

SEQ ID NO: 450000 - RNA, 64 nt, Homo Sapiens; identical to SEQ ID NO: 114776

SEQ ID NO: 450001 - RNA, 64 nt, Homo Sapiens; identical to SEQ ID NO: 114777

SEQ ID NO: 450002 - RNA, 64 nt, Homo Sapiens; identical to SEQ ID NO: 114778

SEQ ID NO: 450003 - RNA, 64 nt, Homo Sapiens; identical to SEQ ID NO: 114779

SEQ ID NO: 450004 - RNA, 64 nt, Homo Sapiens; identical to SEQ ID NO: 114780

SEQ ID NO: 450005 - RNA, 64 nt, Homo Sapiens; identical to SEQ ID NO: 114781

SEQ ID NO: 450006 - RNA, 64 nt, Homo Sapiens; identical to SEQ ID NO: 114782

SEQ ID NO: 450007 - RNA, 64 nt, Homo Sapiens; identical to SEQ ID NO: 114783

SEQ ID NO: 450008 - RNA, 64 nt, Homo Sapiens; identical to SEQ ID NO: 114784

SEQ ID NO: 450009 - RNA, 64 nt, Homo Sapiens; identical to SEQ ID NO: 114785

SEQ ID NO: 450010 - RNA, 64 nt, Homo Sapiens; identical to SEQ ID NO: 114786

SEQ ID NO: 450011 - RNA, 64 nt, Homo Sapiens; identical to SEQ ID NO: 114787

SEQ ID NO: 450012 - RNA, 64 nt, Homo Sapiens; identical to SEQ ID NO: 114788

SEQ ID NO: 450013 - RNA, 64 nt, Homo Sapiens; identical to SEQ ID NO: 114789

SEQ ID NO: 450014 - RNA, 64 nt, Homo Sapiens; identical to SEQ ID NO: 114790

SEQ ID NO: 450015 - RNA, 64 nt, Homo Sapiens; identical to SEQ ID NO: 114791

SEQ ID NO: 450016 - RNA, 64 nt, Homo Sapiens; identical to SEQ ID NO: 114792

SEQ ID NO: 450017 - RNA, 64 nt, Homo Sapiens; identical to SEQ ID NO: 114793

SEQ ID NO: 450018 - RNA, 64 nt, Homo Sapiens; identical to SEQ ID NO: 114794

SEQ ID NO: 450019 - RNA, 64 nt, Homo Sapiens; identical to SEQ ID NO: 114795

SEQ ID NO: 450020 - RNA, 64 nt, Homo Sapiens; identical to SEQ ID NO: 114796

SEQ ID NO: 450021 - RNA, 64 nt, Homo Sapiens; identical to SEQ ID NO: 114797

SEQ ID NO: 450022 - RNA, 64 nt, Homo Sapiens; identical to SEQ ID NO: 114798

SEQ ID NO: 450023 - RNA, 64 nt, Homo Sapiens; identical to SEQ ID NO: 114799

SEQ ID NO: 450024 - RNA, 64 nt, Homo Sapiens; identical to SEQ ID NO: 114800

SEQ ID NO: 450025 - RNA, 64 nt, Homo Sapiens; identical to SEQ ID NO: 114801

SEQ ID NO: 450026 - RNA, 64 nt, Homo Sapiens; identical to SEQ ID NO: 114802

SEQ ID NO: 450027 - RNA, 64 nt, Homo Sapiens; identical to SEQ ID NO: 114803

SEQ ID NO: 450028 - RNA, 64 nt, Homo Sapiens; identical to SEQ ID NO: 114804

SEQ ID NO: 450029 - RNA, 64 nt, Homo Sapiens; identical to SEQ ID NO: 114805

SEQ ID NO: 450030 - RNA, 64 nt, Homo Sapiens; identical to SEQ ID NO: 114806

SEQ ID NO: 450031 - RNA, 64 nt, Homo Sapiens; identical to SEQ ID NO: 114807

SEQ ID NO: 450032 - RNA, 62 nt, Homo Sapiens
gcugcugacgggcuuugucuguggaaggagacagaaggaaauugacccacucuccuaucucc

SEQ ID NO: 450033 - RNA, 62 nt, Homo Sapiens
uagaagcacauggagugcaauaggacauugugagaaggaauuuuucagggauucaucuacua

SEQ ID NO: 450034 - RNA, 62 nt, Homo Sapiens
uuaccuuuuggacaguaauuucuaucacaguuagaaggaaaugauagucaaauacacguuua

SEQ ID NO: 450035 - RNA, 62 nt, Homo Sapiens
gcucucaguauaagauuuuacuuuauuaaugcagaaggaauauggauauauuucuuuaaguc

SEQ ID NO: 450036 - RNA, 62 nt, Homo Sapiens
acccaggcugaguccauacugccccugaucccagaaggaaugcugaccccucgucguaugaa

SEQ ID NO: 450037 - RNA, 62 nt, Homo Sapiens
cucccucuauggggauggcuauuuuauuuuugagaaggaaaaaaaaagucauguauauauac

SEQ ID NO: 450038 - RNA, 62 nt, Homo Sapiens
agcuggagucagcacuguccagcagcaucccaagaaggaaagcagagguaagaggaagaggc

SEQ ID NO: 450039 - RNA, 62 nt, Homo Sapiens
gucucagaugaaagagagggaaggcgacaucaagaaggaaagagaaaaagcaagaagaagaa

SEQ ID NO: 450040 - RNA, 62 nt, Homo Sapiens
cccuuuuugucaauaacucuguaagaacaggcagaaggaaaauuuuucugaaaguggcugau

SEQ ID NO: 450041 - RNA, 62 nt, Homo Sapiens
aggcugguucugcacucucacuacagcccaugagaaggaaugcuggucaagccccauuuggu

SEQ ID NO: 450042 - RNA, 62 nt, Homo Sapiens
agacacucugccugccacucaggaaggugggaagaaggaauuagacuuggguggugggaaga

SEQ ID NO: 450043 - RNA, 62 nt, Homo Sapiens
ugggaagaaggaauuagacauggguggugggaagaaggaagguuaauaaguaaagugagacu

SEQ ID NO: 450044 - RNA, 62 nt, Homo Sapiens
caucccguccggaaaagaaggacccagagggaagaaggaacaguggaggcgggacgcccucc

SEQ ID NO: 450045 - RNA, 62 nt, Homo Sapiens
uucgggaggaacucuguugcuucgccuggacaagaaggaaaaugcugauuuccuccuugggu

SEQ ID NO: 450046 - RNA, 61 nt, Homo Sapiens; identical to SEQ ID NO: 106651

SEQ ID NO: 450047 - RNA, 62 nt, Homo Sapiens
uguuguguucauuuguugagccauaucucagaagaaggaaagggagcuacagaaaggagguu

SEQ ID NO: 450048 - RNA, 62 nt, Homo Sapiens
ccauauugugaaaaacuuuaguggacaagggcagaaggaagagggaagaccuguuaggaagc

SEQ ID NO: 450049 - RNA, 62 nt, Homo Sapiens
gauuugcugagaguuugaauguggaguguaagagaaggaagaguuaaugaugacauuaaggu

SEQ ID NO: 450050 - RNA, 62 nt, Homo Sapiens
aaugcacuugguuuauuguugggggugcucucagaaggaaccugugaaagccuuuaucaguc

SEQ ID NO: 450051 - RNA, 62 nt, Homo Sapiens
ccaaaacaugggaugaagcuaaaucaaugcuuagaaggaaauuuauagcuucaaauacuuau

SEQ ID NO: 450052 - RNA, 62 nt, Homo Sapiens
uaauugauaauaacaguccaaagaaagcagaaagaaggaaagccuagaacagaaauaaauga

SEQ ID NO: 450053 - RNA, 62 nt, Homo Sapiens
aaggaaauaugaaggcacuuccuuuuuuucuaagaaggaaguugcuagaugauuccuucauc

SEQ ID NO: 450054 - RNA, 62 nt, Homo Sapiens
cuguaaauaaaaggguuccaaccuuuuaaaaaagaaggaaaaaacuuuuuggugcuccagug

SEQ ID NO: 450055 - RNA, 62 nt, Homo Sapiens
auggaggaguuguuuggggagggaaaggagagagaaggaaaggagugagguauuucccgucu

SEQ ID NO: 450056 - RNA, 62 nt, Homo Sapiens
uuaaauaaaaugcugcugcuuugacaguaaagagaaggaaguauucugauuagcuguaucug

SEQ ID NO: 450057 - RNA, 62 nt, Homo Sapiens
cuccaucuccagugggaacucagagcugauggagaaggaagggagaucaggaagagaaggag

SEQ ID NO: 450058 - RNA, 62 nt, Homo Sapiens
cagggaggaggcagagaagaacccuccaccgcagaaggaaggccccagugagauguccccug

SEQ ID NO: 450059 - RNA, 62 nt, Homo Sapiens
gccaguucaaaagaauaguaagcuauguaaauagaaggaaugccaaccucugagaggugaaa

SEQ ID NO: 450060 - RNA, 62 nt, Homo Sapiens
auaagaauaaauuuaauuuagacaaaauuaaaagaaggaauguauuacuaaaaauauauaua

SEQ ID NO: 450061 - RNA, 62 nt, Homo Sapiens
gggaacauuggagcugacugagcaaaaggcugagaaggaacaucuggagaagguauuagcaa

SEQ ID NO: 450062 - RNA, 62 nt, Homo Sapiens
auuugugaacuggaagaaagagaaggagagcaagaaggaaaggaaaaaaaaaaagaagaaga

SEQ ID NO: 450063 - RNA, 62 nt, Homo Sapiens
uaauguuucuuaauaauccuagucaucuagagagaaggaaauagcuaaaaagcuaaaguacc

SEQ ID NO: 450064 - RNA, 62 nt, Homo Sapiens
cauuuuauugcagaagcuaaauagaaaugcugagaaggaacgugauucagggauuccuauga

SEQ ID NO: 450065 - RNA, 62 nt, Homo Sapiens
uaugucugccaaguuguuagaaucuuugaaucagaaggaaaaaaagcagcgcugguugacaa

SEQ ID NO: 450066 - RNA, 62 nt, Homo Sapiens
caaccugagauuuguaguccaggauuacaaccagaaggaaaguaugacagauuucuacuuaa

SEQ ID NO: 450067 - RNA, 62 nt, Homo Sapiens
uugcagcacuuucugaggcuuucacuguagggagaaggaaaccccaaggguagaauagccau

SEQ ID NO: 450068 - RNA, 62 nt, Homo Sapiens
ggauccaggaaccagugggauuggaugggagaagaaggaaggggguggcccgucacccccgc

SEQ ID NO: 450069 - RNA, 62 nt, Homo Sapiens
ggagaagccuggggaggagggggaggaagacaagaaggaagaggaggaggagaaggaagacg

SEQ ID NO: 450070 - RNA, 62 nt, Homo Sapiens
gggggaggaagacaagaaggaagaggaggaggagaaggaagacgaggagcuggacugggccu

SEQ ID NO: 450071 - RNA, 62 nt, Homo Sapiens
ugccugguguggagugacucugccccaccuggagaaggaagcguuguucccccagggggcuc

SEQ ID NO: 450072 - RNA, 62 nt, Homo Sapiens
aaccgaagagcaaacaaaagcauaccacuugaagaaggaaagauuucuaccaaauaguagag

SEQ ID NO: 450073 - RNA, 62 nt, Homo Sapiens
ggaaugaaaggaaaccuucccaaaagcaaaagagaaggaacauaguauauuuaaaaacuguu

SEQ ID NO: 450074 - RNA, 62 nt, Homo Sapiens
gugaggggucuguccauggggcgcugcggcuaagaaggaagaauaaauauauuuauuaagua

SEQ ID NO: 450075 - RNA, 62 nt, Homo Sapiens
auagcuuuuaucaauuuuuuuuuaagaaauggagaaggaaaauuuucauaaaaauuaaaugc

SEQ ID NO: 450076 - RNA, 62 nt, Homo Sapiens
aaggaaaaacuuguuacugaagagagaaagaaagaaggaaggguauugauaauuggacaaag

SEQ ID NO: 450077 - RNA, 62 nt, Homo Sapiens
auccuuuucuauuucccuagaaccuuaaugguagaaggaauugcaaagaaucaaguccaccc

SEQ ID NO: 450078 - RNA, 62 nt, Homo Sapiens
cucaugugacagauggggaaacugaggccuugagaaggaaaaaggcuaaucuaaguuccugc

SEQ ID NO: 450079 - RNA, 62 nt, Homo Sapiens
cugaacaaggucucagggguauugcuaagccaagaaggaacuuucccacacuacugaaugga

SEQ ID NO: 450080 - RNA, 62 nt, Homo Sapiens
guaaaagcccagaucacugugggcuggagaggagaaggaaagggucugcgccagcccugucc

SEQ ID NO: 450081 - RNA, 62 nt, Homo Sapiens
cuugcuucaagaauaaaccacaccagugaacaagaaggaaaggccuuuuggagugugucuuu

SEQ ID NO: 450082 - RNA, 62 nt, Homo Sapiens
gcuuauuaaaacaaaugauguauggggagaggagaaggaagggcaaggaaggaauugacaga

SEQ ID NO: 450083 - RNA, 62 nt, Homo Sapiens
gaguaucaaaggcagaaagggaugaaagacaaagaaggaaaaucugugaggugauaggcaag

SEQ ID NO: 450084 - RNA, 62 nt, Homo Sapiens
ggcuggcaagguggguuccacugccuugauggagaaggaaaauccccacccaccaaaugccu

SEQ ID NO: 450085 - RNA, 62 nt, Homo Sapiens
uggcaugauuagauugcaaagcaaugaacucaagaaggaauugaaauaaggagggacaugau

SEQ ID NO: 450086 - RNA, 62 nt, Homo Sapiens
uaggcuuuucugccugcuccugcuuaaacacaagaaggaauccuggauuuugcccucuccuu

SEQ ID NO: 450087 - RNA, 62 nt, Homo Sapiens
agggcaacaaugaaggaggacccagccaagcuagaaggaauuuuguggaugggagacagcag

SEQ ID NO: 450088 - RNA, 62 nt, Homo Sapiens
cucaacacaucccuucagugacucagagucucagaaggaaacccugacuccuggggccauuu

SEQ ID NO: 450089 - RNA, 62 nt, Homo Sapiens
gauacuuacauuucauggacaagcacuagcugagaaggaacucuggcaccaguauaacuaua

SEQ ID NO: 450090 - RNA, 62 nt, Homo Sapiens
acuuucacaaaauaaacuuauggaauacugggagaaggaauaccugagaacagcuuuaguca

SEQ ID NO: 450091 - RNA, 62 nt, Homo Sapiens
agcaagaccuuguuucucaaaaauaaauaaauagaaggaaauaaauguaaaaaugcugcaaa

SEQ ID NO: 450092 - RNA, 62 nt, Homo Sapiens
ucgagucgaguguaagggcccuucacaaaagcagaaggaacacuggcccaaacccccagcac

SEQ ID NO: 450093 - RNA, 62 nt, Homo Sapiens
cccuggguagaaacgcuuggucaugggaagagagaaggaaggaugggagaagggcaaagacu

SEQ ID NO: 450094 - RNA, 62 nt, Homo Sapiens
aaaaugagggguggcagggacaggugcuucagagaaggaaacuggggaacugagcucagagg

SEQ ID NO: 450095 - RNA, 62 nt, Homo Sapiens
ucuuucuccccauggccccacugcagaauuaaagaaggaagaagggaaggcggaggagucua

SEQ ID NO: 450096 - RNA, 62 nt, Homo Sapiens
agaaggaagaagggaaggcggaggagucuauaagaaggaaucaugauuucuauuuagcagau

SEQ ID NO: 450097 - RNA, 62 nt, Homo Sapiens
ggcucaguaugcuagcaacaagaagucuaucaagaaggaaauccgcauuccccccaaugugg

SEQ ID NO: 450098 - RNA, 62 nt, Homo Sapiens
ugacccaucggugaugcgcuccuguguguuugagaaggaaaacaucacaauuggcaauaaaa

SEQ ID NO: 450099 - RNA, 62 nt, Homo Sapiens
cagaauggcauguuuuauaauuaacugaauaaagaaggaagcauuauuauauauuauugugg

SEQ ID NO: 450100 - RNA, 62 nt, Homo Sapiens
uaacaugaauugauggucaauuucccuucagcagaaggaaaaggugauuuagaucaguagcu

SEQ ID NO: 450101 - RNA, 62 nt, Homo Sapiens
cauuaauaugugcaaagauuggcucuccaacaagaaggaaagcagggaggaagggagaccac

SEQ ID NO: 450102 - RNA, 62 nt, Homo Sapiens
cagaacgucgcugauggagaaagggcucccgcagaaggaacggccuguaccgugcgcuccgg

SEQ ID NO: 450103 - RNA, 62 nt, Homo Sapiens
ucauggaagagaugaacgccaugcuggcccggagaaggaaagccacgcaaguuggggagaaa

SEQ ID NO: 450104 - RNA, 62 nt, Homo Sapiens
ccauuaauuuuaggagcuucuggaagaggugaagaaggaauugcagaaagugaaagaggaaa

SEQ ID NO: 450105 - RNA, 62 nt, Homo Sapiens
guaagaggcgcugggcucggagccuguuuccaagaaggaauugguugucaucuggcaguguu

SEQ ID NO: 450106 - RNA, 62 nt, Homo Sapiens
ggaaaggcaguccuggacagaagacugucagcagaaggaaaguacuggacuacccgugggua

SEQ ID NO: 450107 - RNA, 62 nt, Homo Sapiens
acugugcacagguuugagaggacaaguucaucagaaggaaggcaguccuuagaagucacaua

SEQ ID NO: 450108 - RNA, 62 nt, Homo Sapiens
gaacauguuugugggccuuuugacugaguggcagaaggaaacugcucaggaagagaaacagg

SEQ ID NO: 450109 - RNA, 62 nt, Homo Sapiens
gacuucuuccuccuccuccuucccugacucacagaaggaaugcaaucacccagcaaguccua

SEQ ID NO: 450110 - RNA, 62 nt, Homo Sapiens
cucuugagccucugggaaugggaggggccaagagaaggaaaacccugucuuuagcacccuuu

SEQ ID NO: 450111 - RNA, 62 nt, Homo Sapiens
guuuuuuaaaggauauuuaacuuuuauggacuagaaggaaucacgagggcuacugcacaaua

SEQ ID NO: 450112 - RNA, 62 nt, Homo Sapiens
ccccagaagcagguggucugccccaggcauaaagaaggaaaauuggccaucuuucccaccuc

SEQ ID NO: 450113 - RNA, 62 nt, Homo Sapiens
gcaagcagcuagacuggugaauugggggaaauagaaggaacuaguaacugagacuccuccag

SEQ ID NO: 450114 - RNA, 62 nt, Homo Sapiens
gagaaaccaacaagagaucucgaacccugucuagaaggaauguauuuguugcuaaauuucgu

SEQ ID NO: 450115 - RNA, 62 nt, Homo Sapiens
aacaaaguggaaggaaagaugcucagguacagagaaggaaugucuuugguccucuugccauc

SEQ ID NO: 450116 - RNA, 62 nt, Homo Sapiens
gacaacccugugguuuccaaggagcugagaauagaaggaaacuagcuuacaugagaacagac

SEQ ID NO: 450117 - RNA, 62 nt, Homo Sapiens
guagaaauuuauuauuaaaauguaauccagagagaaggaaacuuuugcccagcacauggagc

SEQ ID NO: 450118 - RNA, 62 nt, Homo Sapiens
agagagagaaagaaagucucggaaggaaagagagaaggaaagcgcucagcaacauagaagag

SEQ ID NO: 450119 - RNA, 62 nt, Homo Sapiens
aaagaaagaugggaggaaguaagcaaaggaacagaaggaaggaggaaggagggaagaaaaga

SEQ ID NO: 450120 - RNA, 62 nt, Homo Sapiens
agggaagaaaagaaagcaaagaagggaagggcagaaggaaggggcggagaggggagaagaag

SEQ ID NO: 450121 - RNA, 62 nt, Homo Sapiens
gaagggcagaaggaaggaggggagaggggagaagaaggaagggcuuuuccuuugggggaggc

SEQ ID NO: 450122 - RNA, 62 nt, Homo Sapiens
uuuuacacagcacaugaagcaguaauccagaaagaaggaaaugcagaauuuuauuaucaaag

SEQ ID NO: 450123 - RNA, 62 nt, Homo Sapiens
cauuuucaggaaaguuuguaguauuacaaggcagaaggaaacacaguagcaaugguugcucu

SEQ ID NO: 450124 - RNA, 64 nt, Homo Sapiens
gcagaaccaaaacucacuuccuugagaagcacuucgaagccagauccacacccuaaggcuucag

SEQ ID NO: 450125 - RNA, 64 nt, Homo Sapiens
cccgcagccgcuacucacucaccgaagccguaaccgaagccaggugccuucagaccccgcuggg

SEQ ID NO: 450126 - RNA, 64 nt, Homo Sapiens
agggaaguuuuagucuuggcggguggaaaugagacgaagccacaguuaucacacuccagacucc

SEQ ID NO: 450127 - RNA, 64 nt, Homo Sapiens
cagggcgggguaggggagggcaggggcugagccccgaagccagcucaguaccugaggggcugcu

SEQ ID NO: 450128 - RNA, 64 nt, Homo Sapiens; identical to SEQ ID NO: 162601

SEQ ID NO: 450129 - RNA, 64 nt, Homo Sapiens; identical to SEQ ID NO: 162602

SEQ ID NO: 450130 - RNA, 64 nt, Homo Sapiens; identical to SEQ ID NO: 162603

SEQ ID NO: 450131 - RNA, 64 nt, Homo Sapiens; identical to SEQ ID NO: 162604

SEQ ID NO: 450132 - RNA, 64 nt, Homo Sapiens; identical to SEQ ID NO: 162605

SEQ ID NO: 450133 - RNA, 64 nt, Homo Sapiens; identical to SEQ ID NO: 162606

SEQ ID NO: 450134 - RNA, 64 nt, Homo Sapiens; identical to SEQ ID NO: 162607

SEQ ID NO: 450135 - RNA, 64 nt, Homo Sapiens; identical to SEQ ID NO: 162608

SEQ ID NO: 450136 - RNA, 64 nt, Homo Sapiens; identical to SEQ ID NO: 162609

SEQ ID NO: 450137 - RNA, 64 nt, Homo Sapiens; identical to SEQ ID NO: 162610

SEQ ID NO: 450138 - RNA, 64 nt, Homo Sapiens; identical to SEQ ID NO: 162611

SEQ ID NO: 450139 - RNA, 64 nt, Homo Sapiens; identical to SEQ ID NO: 162612

SEQ ID NO: 450140 - RNA, 64 nt, Homo Sapiens; identical to SEQ ID NO: 162613

SEQ ID NO: 450141 - RNA, 64 nt, Homo Sapiens; identical to SEQ ID NO: 162614

SEQ ID NO: 450142 - RNA, 64 nt, Homo Sapiens; identical to SEQ ID NO: 162615

SEQ ID NO: 450143 - RNA, 64 nt, Homo Sapiens; identical to SEQ ID NO: 162616

SEQ ID NO: 450144 - RNA, 64 nt, Homo Sapiens; identical to SEQ ID NO: 162617

SEQ ID NO: 450145 - RNA, 64 nt, Homo Sapiens; identical to SEQ ID NO: 162618

SEQ ID NO: 450146 - RNA, 64 nt, Homo Sapiens; identical to SEQ ID NO: 162619

SEQ ID NO: 450147 - RNA, 64 nt, Homo Sapiens; identical to SEQ ID NO: 162620

SEQ ID NO: 450148 - RNA, 64 nt, Homo Sapiens; identical to SEQ ID NO: 162621

SEQ ID NO: 450149 - RNA, 64 nt, Homo Sapiens; identical to SEQ ID NO: 162622

SEQ ID NO: 450150 - RNA, 64 nt, Homo Sapiens; identical to SEQ ID NO: 162623

SEQ ID NO: 450151 - RNA, 64 nt, Homo Sapiens; identical to SEQ ID NO: 162624

SEQ ID NO: 450152 - RNA, 64 nt, Homo Sapiens; identical to SEQ ID NO: 162625

SEQ ID NO: 450153 - RNA, 64 nt, Homo Sapiens; identical to SEQ ID NO: 162626

SEQ ID NO: 450154 - RNA, 64 nt, Homo Sapiens; identical to SEQ ID NO: 162627

SEQ ID NO: 450155 - RNA, 64 nt, Homo Sapiens; identical to SEQ ID NO: 162628

SEQ ID NO: 450156 - RNA, 64 nt, Homo Sapiens; identical to SEQ ID NO: 162629

SEQ ID NO: 450157 - RNA, 64 nt, Homo Sapiens; identical to SEQ ID NO: 162630

SEQ ID NO: 450158 - RNA, 64 nt, Homo Sapiens; identical to SEQ ID NO: 162631

SEQ ID NO: 450159 - RNA, 64 nt, Homo Sapiens; identical to SEQ ID NO: 162632

SEQ ID NO: 450160 - RNA, 64 nt, Homo Sapiens; identical to SEQ ID NO: 162633

SEQ ID NO: 450161 - RNA, 64 nt, Homo Sapiens; identical to SEQ ID NO: 162634

SEQ ID NO: 450162 - RNA, 64 nt, Homo Sapiens; identical to SEQ ID NO: 162635

SEQ ID NO: 450163 - RNA, 64 nt, Homo Sapiens; identical to SEQ ID NO: 162636

SEQ ID NO: 450164 - RNA, 64 nt, Homo Sapiens; identical to SEQ ID NO: 162637

SEQ ID NO: 450165 - RNA, 64 nt, Homo Sapiens; identical to SEQ ID NO: 162638

SEQ ID NO: 450166 - RNA, 64 nt, Homo Sapiens; identical to SEQ ID NO: 162639

SEQ ID NO: 450167 - RNA, 64 nt, Homo Sapiens; identical to SEQ ID NO: 162640

SEQ ID NO: 450168 - RNA, 64 nt, Homo Sapiens; identical to SEQ ID NO: 162641

SEQ ID NO: 450169 - RNA, 64 nt, Homo Sapiens; identical to SEQ ID NO: 162642

SEQ ID NO: 450170 - RNA, 64 nt, Homo Sapiens; identical to SEQ ID NO: 162643

SEQ ID NO: 450171 - RNA, 64 nt, Homo Sapiens; identical to SEQ ID NO: 162644

SEQ ID NO: 450172 - RNA, 64 nt, Homo Sapiens; identical to SEQ ID NO: 162645

SEQ ID NO: 450173 - RNA, 64 nt, Homo Sapiens; identical to SEQ ID NO: 162646

SEQ ID NO: 450174 - RNA, 64 nt, Homo Sapiens; identical to SEQ ID NO: 162647

SEQ ID NO: 450175 - RNA, 64 nt, Homo Sapiens; identical to SEQ ID NO: 162648

SEQ ID NO: 450176 - RNA, 64 nt, Homo Sapiens; identical to SEQ ID NO: 162649

SEQ ID NO: 450177 - RNA, 64 nt, Homo Sapiens; identical to SEQ ID NO: 162650

SEQ ID NO: 450178 - RNA, 64 nt, Homo Sapiens; identical to SEQ ID NO: 162651

SEQ ID NO: 450179 - RNA, 64 nt, Homo Sapiens; identical to SEQ ID NO: 162652

SEQ ID NO: 450180 - RNA, 64 nt, Homo Sapiens; identical to SEQ ID NO: 162653

SEQ ID NO: 450181 - RNA, 64 nt, Homo Sapiens; identical to SEQ ID NO: 162654

SEQ ID NO: 450182 - RNA, 64 nt, Homo Sapiens; identical to SEQ ID NO: 162655

SEQ ID NO: 450183 - RNA, 64 nt, Homo Sapiens; identical to SEQ ID NO: 162656

SEQ ID NO: 450184 - RNA, 64 nt, Homo Sapiens; identical to SEQ ID NO: 162657

SEQ ID NO: 450185 - RNA, 64 nt, Homo Sapiens; identical to SEQ ID NO: 162658

SEQ ID NO: 450186 - RNA, 64 nt, Homo Sapiens; identical to SEQ ID NO: 162659

SEQ ID NO: 450187 - RNA, 64 nt, Homo Sapiens; identical to SEQ ID NO: 162660

SEQ ID NO: 450188 - RNA, 64 nt, Homo Sapiens; identical to SEQ ID NO: 162661

SEQ ID NO: 450189 - RNA, 64 nt, Homo Sapiens; identical to SEQ ID NO: 162662

SEQ ID NO: 450190 - RNA, 64 nt, Homo Sapiens; identical to SEQ ID NO: 162663

SEQ ID NO: 450191 - RNA, 64 nt, Homo Sapiens; identical to SEQ ID NO: 162664

SEQ ID NO: 450192 - RNA, 64 nt, Homo Sapiens; identical to SEQ ID NO: 162665

SEQ ID NO: 450193 - RNA, 64 nt, Homo Sapiens; identical to SEQ ID NO: 162666

SEQ ID NO: 450194 - RNA, 64 nt, Homo Sapiens; identical to SEQ ID NO: 162667

SEQ ID NO: 450195 - RNA, 64 nt, Homo Sapiens; identical to SEQ ID NO: 162668

SEQ ID NO: 450196 - RNA, 64 nt, Homo Sapiens; identical to SEQ ID NO: 162669

SEQ ID NO: 450197 - RNA, 64 nt, Homo Sapiens; identical to SEQ ID NO: 162670

SEQ ID NO: 450198 - RNA, 64 nt, Homo Sapiens; identical to SEQ ID NO: 162671

SEQ ID NO: 450199 - RNA, 64 nt, Homo Sapiens; identical to SEQ ID NO: 162672

SEQ ID NO: 450200 - RNA, 64 nt, Homo Sapiens; identical to SEQ ID NO: 162673

SEQ ID NO: 450201 - RNA, 64 nt, Homo Sapiens; identical to SEQ ID NO: 162674

SEQ ID NO: 450202 - RNA, 64 nt, Homo Sapiens; identical to SEQ ID NO: 162675

SEQ ID NO: 450203 - RNA, 64 nt, Homo Sapiens; identical to SEQ ID NO: 162676

SEQ ID NO: 450204 - RNA, 64 nt, Homo Sapiens; identical to SEQ ID NO: 162677

SEQ ID NO: 450205 - RNA, 64 nt, Homo Sapiens; identical to SEQ ID NO: 162678

SEQ ID NO: 450206 - RNA, 64 nt, Homo Sapiens; identical to SEQ ID NO: 162679

SEQ ID NO: 450207 - RNA, 64 nt, Homo Sapiens; identical to SEQ ID NO: 162680

SEQ ID NO: 450208 - RNA, 64 nt, Homo Sapiens; identical to SEQ ID NO: 162681

SEQ ID NO: 450209 - RNA, 64 nt, Homo Sapiens; identical to SEQ ID NO: 162682

SEQ ID NO: 450210 - RNA, 64 nt, Homo Sapiens; identical to SEQ ID NO: 162683

SEQ ID NO: 450211 - RNA, 64 nt, Homo Sapiens; identical to SEQ ID NO: 162684

SEQ ID NO: 450212 - RNA, 64 nt, Homo Sapiens; identical to SEQ ID NO: 162685

SEQ ID NO: 450213 - RNA, 64 nt, Homo Sapiens; identical to SEQ ID NO: 162686

SEQ ID NO: 450214 - RNA, 64 nt, Homo Sapiens; identical to SEQ ID NO: 162687

SEQ ID NO: 450215 - RNA, 64 nt, Homo Sapiens; identical to SEQ ID NO: 162688

SEQ ID NO: 450216 - RNA, 64 nt, Homo Sapiens; identical to SEQ ID NO: 162689

SEQ ID NO: 450217 - RNA, 64 nt, Homo Sapiens; identical to SEQ ID NO: 162690

SEQ ID NO: 450218 - RNA, 64 nt, Homo Sapiens; identical to SEQ ID NO: 162691

SEQ ID NO: 450219 - RNA, 64 nt, Homo Sapiens; identical to SEQ ID NO: 162692

SEQ ID NO: 450220 - RNA, 64 nt, Homo Sapiens; identical to SEQ ID NO: 162693

SEQ ID NO: 450221 - RNA, 64 nt, Homo Sapiens; identical to SEQ ID NO: 162694

SEQ ID NO: 450222 - RNA, 64 nt, Homo Sapiens; identical to SEQ ID NO: 162695

SEQ ID NO: 450223 - RNA, 64 nt, Homo Sapiens; identical to SEQ ID NO: 162696

SEQ ID NO: 450224 - RNA, 64 nt, Homo Sapiens; identical to SEQ ID NO: 162697

SEQ ID NO: 450225 - RNA, 64 nt, Homo Sapiens; identical to SEQ ID NO: 162698

SEQ ID NO: 450226 - RNA, 64 nt, Homo Sapiens; identical to SEQ ID NO: 162699

SEQ ID NO: 450227 - RNA, 64 nt, Homo Sapiens; identical to SEQ ID NO: 162700

SEQ ID NO: 450228 - RNA, 64 nt, Homo Sapiens; identical to SEQ ID NO: 162701

SEQ ID NO: 450229 - RNA, 64 nt, Homo Sapiens; identical to SEQ ID NO: 162702

SEQ ID NO: 450230 - RNA, 64 nt, Homo Sapiens; identical to SEQ ID NO: 162703

SEQ ID NO: 450231 - RNA, 64 nt, Homo Sapiens; identical to SEQ ID NO: 162704

SEQ ID NO: 450232 - RNA, 64 nt, Homo Sapiens; identical to SEQ ID NO: 162705

SEQ ID NO: 450233 - RNA, 64 nt, Homo Sapiens; identical to SEQ ID NO: 162706

SEQ ID NO: 450234 - RNA, 64 nt, Homo Sapiens; identical to SEQ ID NO: 162707

SEQ ID NO: 450235 - RNA, 64 nt, Homo Sapiens; identical to SEQ ID NO: 162708

SEQ ID NO: 450236 - RNA, 64 nt, Homo Sapiens; identical to SEQ ID NO: 162709

SEQ ID NO: 450237 - RNA, 64 nt, Homo Sapiens; identical to SEQ ID NO: 162710

SEQ ID NO: 450238 - RNA, 64 nt, Homo Sapiens; identical to SEQ ID NO: 162711

SEQ ID NO: 450239 - RNA, 64 nt, Homo Sapiens; identical to SEQ ID NO: 162712

SEQ ID NO: 450240 - RNA, 64 nt, Homo Sapiens; identical to SEQ ID NO: 162713

SEQ ID NO: 450241 - RNA, 64 nt, Homo Sapiens; identical to SEQ ID NO: 162714

SEQ ID NO: 450242 - RNA, 64 nt, Homo Sapiens; identical to SEQ ID NO: 162715

SEQ ID NO: 450243 - RNA, 64 nt, Homo Sapiens; identical to SEQ ID NO: 162716

SEQ ID NO: 450244 - RNA, 64 nt, Homo Sapiens; identical to SEQ ID NO: 162717

SEQ ID NO: 450245 - RNA, 64 nt, Homo Sapiens; identical to SEQ ID NO: 162718

SEQ ID NO: 450246 - RNA, 64 nt, Homo Sapiens; identical to SEQ ID NO: 162719

SEQ ID NO: 450247 - RNA, 64 nt, Homo Sapiens; identical to SEQ ID NO: 162720

SEQ ID NO: 450248 - RNA, 64 nt, Homo Sapiens; identical to SEQ ID NO: 162721

SEQ ID NO: 450249 - RNA, 64 nt, Homo Sapiens; identical to SEQ ID NO: 162722

SEQ ID NO: 450250 - RNA, 64 nt, Homo Sapiens; identical to SEQ ID NO: 162723

SEQ ID NO: 450251 - RNA, 64 nt, Homo Sapiens; identical to SEQ ID NO: 162724

SEQ ID NO: 450252 - RNA, 64 nt, Homo Sapiens; identical to SEQ ID NO: 162725

SEQ ID NO: 450253 - RNA, 64 nt, Homo Sapiens; identical to SEQ ID NO: 162726

SEQ ID NO: 450254 - RNA, 64 nt, Homo Sapiens; identical to SEQ ID NO: 162727

SEQ ID NO: 450255 - RNA, 64 nt, Homo Sapiens; identical to SEQ ID NO: 162728

SEQ ID NO: 450256 - RNA, 64 nt, Homo Sapiens; identical to SEQ ID NO: 162729

SEQ ID NO: 450257 - RNA, 64 nt, Homo Sapiens; identical to SEQ ID NO: 162730

SEQ ID NO: 450258 - RNA, 64 nt, Homo Sapiens; identical to SEQ ID NO: 162731

SEQ ID NO: 450259 - RNA, 64 nt, Homo Sapiens; identical to SEQ ID NO: 162732

SEQ ID NO: 450260 - RNA, 64 nt, Homo Sapiens; identical to SEQ ID NO: 162733

SEQ ID NO: 450261 - RNA, 64 nt, Homo Sapiens; identical to SEQ ID NO: 162734

SEQ ID NO: 450262 - RNA, 64 nt, Homo Sapiens; identical to SEQ ID NO: 162735

SEQ ID NO: 450263 - RNA, 64 nt, Homo Sapiens; identical to SEQ ID NO: 162736

SEQ ID NO: 450264 - RNA, 64 nt, Homo Sapiens; identical to SEQ ID NO: 162737

SEQ ID NO: 450265 - RNA, 64 nt, Homo Sapiens; identical to SEQ ID NO: 162738

SEQ ID NO: 450266 - RNA, 64 nt, Homo Sapiens; identical to SEQ ID NO: 162739

SEQ ID NO: 450267 - RNA, 64 nt, Homo Sapiens; identical to SEQ ID NO: 162740

SEQ ID NO: 450268 - RNA, 64 nt, Homo Sapiens; identical to SEQ ID NO: 162741

SEQ ID NO: 450269 - RNA, 64 nt, Homo Sapiens; identical to SEQ ID NO: 162742

SEQ ID NO: 450270 - RNA, 64 nt, Homo Sapiens; identical to SEQ ID NO: 162743

SEQ ID NO: 450271 - RNA, 64 nt, Homo Sapiens; identical to SEQ ID NO: 162744

SEQ ID NO: 450272 - RNA, 63 nt, Homo Sapiens; identical to SEQ ID NO: 162745

SEQ ID NO: 450273 - RNA, 64 nt, Homo Sapiens; identical to SEQ ID NO: 162746

SEQ ID NO: 450274 - RNA, 64 nt, Homo Sapiens; identical to SEQ ID NO: 162747

SEQ ID NO: 450275 - RNA, 64 nt, Homo Sapiens; identical to SEQ ID NO: 162748

SEQ ID NO: 450276 - RNA, 64 nt, Homo Sapiens; identical to SEQ ID NO: 162749

SEQ ID NO: 450277 - RNA, 64 nt, Homo Sapiens; identical to SEQ ID NO: 162750

SEQ ID NO: 450278 - RNA, 64 nt, Homo Sapiens; identical to SEQ ID NO: 162751

SEQ ID NO: 450279 - RNA, 64 nt, Homo Sapiens; identical to SEQ ID NO: 162752

SEQ ID NO: 450280 - RNA, 64 nt, Homo Sapiens; identical to SEQ ID NO: 162753

SEQ ID NO: 450281 - RNA, 64 nt, Homo Sapiens; identical to SEQ ID NO: 162754

SEQ ID NO: 450282 - RNA, 64 nt, Homo Sapiens; identical to SEQ ID NO: 162755

SEQ ID NO: 450283 - RNA, 64 nt, Homo Sapiens; identical to SEQ ID NO: 162756

SEQ ID NO: 450284 - RNA, 64 nt, Homo Sapiens; identical to SEQ ID NO: 162757

SEQ ID NO: 450285 - RNA, 64 nt, Homo Sapiens; identical to SEQ ID NO: 162758

SEQ ID NO: 450286 - RNA, 64 nt, Homo Sapiens; identical to SEQ ID NO: 162759

SEQ ID NO: 450287 - RNA, 64 nt, Homo Sapiens; identical to SEQ ID NO: 162760

SEQ ID NO: 450288 - RNA, 64 nt, Homo Sapiens; identical to SEQ ID NO: 162761

SEQ ID NO: 450289 - RNA, 64 nt, Homo Sapiens; identical to SEQ ID NO: 162762

SEQ ID NO: 450290 - RNA, 64 nt, Homo Sapiens; identical to SEQ ID NO: 162763

SEQ ID NO: 450291 - RNA, 64 nt, Homo Sapiens; identical to SEQ ID NO: 162764

SEQ ID NO: 450292 - RNA, 64 nt, Homo Sapiens; identical to SEQ ID NO: 162765

SEQ ID NO: 450293 - RNA, 64 nt, Homo Sapiens; identical to SEQ ID NO: 162766

SEQ ID NO: 450294 - RNA, 64 nt, Homo Sapiens; identical to SEQ ID NO: 162767

SEQ ID NO: 450295 - RNA, 64 nt, Homo Sapiens; identical to SEQ ID NO: 162768

SEQ ID NO: 450296 - RNA, 64 nt, Homo Sapiens; identical to SEQ ID NO: 162769

SEQ ID NO: 450297 - RNA, 64 nt, Homo Sapiens; identical to SEQ ID NO: 162770

SEQ ID NO: 450298 - RNA, 64 nt, Homo Sapiens; identical to SEQ ID NO: 162771

SEQ ID NO: 450299 - RNA, 64 nt, Homo Sapiens; identical to SEQ ID NO: 162772

SEQ ID NO: 450300 - RNA, 64 nt, Homo Sapiens; identical to SEQ ID NO: 162773

SEQ ID NO: 450301 - RNA, 64 nt, Homo Sapiens; identical to SEQ ID NO: 162774

SEQ ID NO: 450302 - RNA, 64 nt, Homo Sapiens; identical to SEQ ID NO: 162775

SEQ ID NO: 450303 - RNA, 64 nt, Homo Sapiens; identical to SEQ ID NO: 162776

SEQ ID NO: 450304 - RNA, 64 nt, Homo Sapiens; identical to SEQ ID NO: 162777

SEQ ID NO: 450305 - RNA, 64 nt, Homo Sapiens; identical to SEQ ID NO: 162778

SEQ ID NO: 450306 - RNA, 64 nt, Homo Sapiens; identical to SEQ ID NO: 162779

SEQ ID NO: 450307 - RNA, 64 nt, Homo Sapiens; identical to SEQ ID NO: 162780

SEQ ID NO: 450308 - RNA, 64 nt, Homo Sapiens; identical to SEQ ID NO: 162781

SEQ ID NO: 450309 - RNA, 64 nt, Homo Sapiens; identical to SEQ ID NO: 162782

SEQ ID NO: 450310 - RNA, 64 nt, Homo Sapiens; identical to SEQ ID NO: 162783

SEQ ID NO: 450311 - RNA, 64 nt, Homo Sapiens; identical to SEQ ID NO: 162784

SEQ ID NO: 450312 - RNA, 64 nt, Homo Sapiens; identical to SEQ ID NO: 162785

SEQ ID NO: 450313 - RNA, 64 nt, Homo Sapiens; identical to SEQ ID NO: 162786

SEQ ID NO: 450314 - RNA, 64 nt, Homo Sapiens; identical to SEQ ID NO: 162787

SEQ ID NO: 450315 - RNA, 64 nt, Homo Sapiens; identical to SEQ ID NO: 162788

SEQ ID NO: 450316 - RNA, 64 nt, Homo Sapiens; identical to SEQ ID NO: 162789

SEQ ID NO: 450317 - RNA, 64 nt, Homo Sapiens; identical to SEQ ID NO: 162790

SEQ ID NO: 450318 - RNA, 64 nt, Homo Sapiens; identical to SEQ ID NO: 162791

SEQ ID NO: 450319 - RNA, 64 nt, Homo Sapiens; identical to SEQ ID NO: 162792

SEQ ID NO: 450320 - RNA, 64 nt, Homo Sapiens; identical to SEQ ID NO: 162793

SEQ ID NO: 450321 - RNA, 64 nt, Homo Sapiens; identical to SEQ ID NO: 162794

SEQ ID NO: 450322 - RNA, 64 nt, Homo Sapiens; identical to SEQ ID NO: 162795

SEQ ID NO: 450323 - RNA, 64 nt, Homo Sapiens; identical to SEQ ID NO: 162796

SEQ ID NO: 450324 - RNA, 64 nt, Homo Sapiens; identical to SEQ ID NO: 162797

SEQ ID NO: 450325 - RNA, 64 nt, Homo Sapiens; identical to SEQ ID NO: 162798

SEQ ID NO: 450326 - RNA, 64 nt, Homo Sapiens; identical to SEQ ID NO: 162799

SEQ ID NO: 450327 - RNA, 64 nt, Homo Sapiens; identical to SEQ ID NO: 162800

SEQ ID NO: 450328 - RNA, 64 nt, Homo Sapiens; identical to SEQ ID NO: 162801

SEQ ID NO: 450329 - RNA, 64 nt, Homo Sapiens; identical to SEQ ID NO: 162802

SEQ ID NO: 450330 - RNA, 64 nt, Homo Sapiens; identical to SEQ ID NO: 162803

SEQ ID NO: 450331 - RNA, 64 nt, Homo Sapiens; identical to SEQ ID NO: 162804

SEQ ID NO: 450332 - RNA, 64 nt, Homo Sapiens; identical to SEQ ID NO: 162805

SEQ ID NO: 450333 - RNA, 64 nt, Homo Sapiens; identical to SEQ ID NO: 162806

SEQ ID NO: 450334 - RNA, 64 nt, Homo Sapiens; identical to SEQ ID NO: 162807

SEQ ID NO: 450335 - RNA, 64 nt, Homo Sapiens; identical to SEQ ID NO: 162808

SEQ ID NO: 450336 - RNA, 64 nt, Homo Sapiens; identical to SEQ ID NO: 162809

SEQ ID NO: 450337 - RNA, 64 nt, Homo Sapiens; identical to SEQ ID NO: 162810

SEQ ID NO: 450338 - RNA, 64 nt, Homo Sapiens; identical to SEQ ID NO: 162811

SEQ ID NO: 450339 - RNA, 64 nt, Homo Sapiens; identical to SEQ ID NO: 162812

SEQ ID NO: 450340 - RNA, 64 nt, Homo Sapiens; identical to SEQ ID NO: 162813

SEQ ID NO: 450341 - RNA, 62 nt, Homo Sapiens; identical to SEQ ID NO: 162814

SEQ ID NO: 450342 - RNA, 64 nt, Homo Sapiens; identical to SEQ ID NO: 162815

SEQ ID NO: 450343 - RNA, 64 nt, Homo Sapiens; identical to SEQ ID NO: 162816

SEQ ID NO: 450344 - RNA, 64 nt, Homo Sapiens; identical to SEQ ID NO: 162817

SEQ ID NO: 450345 - RNA, 64 nt, Homo Sapiens; identical to SEQ ID NO: 162818

SEQ ID NO: 450346 - RNA, 64 nt, Homo Sapiens; identical to SEQ ID NO: 162819

SEQ ID NO: 450347 - RNA, 64 nt, Homo Sapiens; identical to SEQ ID NO: 162820

SEQ ID NO: 450348 - RNA, 64 nt, Homo Sapiens; identical to SEQ ID NO: 162821

SEQ ID NO: 450349 - RNA, 64 nt, Homo Sapiens; identical to SEQ ID NO: 162822

SEQ ID NO: 450350 - RNA, 64 nt, Homo Sapiens; identical to SEQ ID NO: 162823

SEQ ID NO: 450351 - RNA, 64 nt, Homo Sapiens; identical to SEQ ID NO: 162824

SEQ ID NO: 450352 - RNA, 64 nt, Homo Sapiens; identical to SEQ ID NO: 162825

SEQ ID NO: 450353 - RNA, 64 nt, Homo Sapiens; identical to SEQ ID NO: 162826

SEQ ID NO: 450354 - RNA, 64 nt, Homo Sapiens; identical to SEQ ID NO: 162827

SEQ ID NO: 450355 - RNA, 64 nt, Homo Sapiens; identical to SEQ ID NO: 162828

SEQ ID NO: 450356 - RNA, 64 nt, Homo Sapiens; identical to SEQ ID NO: 162829

SEQ ID NO: 450357 - RNA, 64 nt, Homo Sapiens; identical to SEQ ID NO: 162830

SEQ ID NO: 450358 - RNA, 64 nt, Homo Sapiens; identical to SEQ ID NO: 162831

SEQ ID NO: 450359 - RNA, 64 nt, Homo Sapiens; identical to SEQ ID NO: 162832

SEQ ID NO: 450360 - RNA, 64 nt, Homo Sapiens; identical to SEQ ID NO: 162833

SEQ ID NO: 450361 - RNA, 64 nt, Homo Sapiens; identical to SEQ ID NO: 162834

SEQ ID NO: 450362 - RNA, 64 nt, Homo Sapiens; identical to SEQ ID NO: 162835

SEQ ID NO: 450363 - RNA, 64 nt, Homo Sapiens; identical to SEQ ID NO: 162836

SEQ ID NO: 450364 - RNA, 64 nt, Homo Sapiens; identical to SEQ ID NO: 162837

SEQ ID NO: 450365 - RNA, 64 nt, Homo Sapiens; identical to SEQ ID NO: 162838

SEQ ID NO: 450366 - RNA, 64 nt, Homo Sapiens; identical to SEQ ID NO: 162839

SEQ ID NO: 450367 - RNA, 64 nt, Homo Sapiens; identical to SEQ ID NO: 162840

SEQ ID NO: 450368 - RNA, 64 nt, Homo Sapiens; identical to SEQ ID NO: 162841

SEQ ID NO: 450369 - RNA, 64 nt, Homo Sapiens; identical to SEQ ID NO: 162842

SEQ ID NO: 450370 - RNA, 64 nt, Homo Sapiens; identical to SEQ ID NO: 162843

SEQ ID NO: 450371 - RNA, 64 nt, Homo Sapiens; identical to SEQ ID NO: 162844

SEQ ID NO: 450372 - RNA, 64 nt, Homo Sapiens; identical to SEQ ID NO: 162845

SEQ ID NO: 450373 - RNA, 64 nt, Homo Sapiens; identical to SEQ ID NO: 162846

SEQ ID NO: 450374 - RNA, 64 nt, Homo Sapiens; identical to SEQ ID NO: 162847

SEQ ID NO: 450375 - RNA, 64 nt, Homo Sapiens; identical to SEQ ID NO: 162848

SEQ ID NO: 450376 - RNA, 64 nt, Homo Sapiens; identical to SEQ ID NO: 162849

SEQ ID NO: 450377 - RNA, 64 nt, Homo Sapiens; identical to SEQ ID NO: 162850

SEQ ID NO: 450378 - RNA, 64 nt, Homo Sapiens; identical to SEQ ID NO: 162851

SEQ ID NO: 450379 - RNA, 64 nt, Homo Sapiens; identical to SEQ ID NO: 162852

SEQ ID NO: 450380 - RNA, 64 nt, Homo Sapiens; identical to SEQ ID NO: 162853

SEQ ID NO: 450381 - RNA, 64 nt, Homo Sapiens; identical to SEQ ID NO: 162854

SEQ ID NO: 450382 - RNA, 64 nt, Homo Sapiens; identical to SEQ ID NO: 162855

SEQ ID NO: 450383 - RNA, 64 nt, Homo Sapiens; identical to SEQ ID NO: 162856

SEQ ID NO: 450384 - RNA, 64 nt, Homo Sapiens; identical to SEQ ID NO: 162857

SEQ ID NO: 450385 - RNA, 64 nt, Homo Sapiens; identical to SEQ ID NO: 162858

SEQ ID NO: 450386 - RNA, 64 nt, Homo Sapiens; identical to SEQ ID NO: 162859

SEQ ID NO: 450387 - RNA, 64 nt, Homo Sapiens; identical to SEQ ID NO: 162860

SEQ ID NO: 450388 - RNA, 64 nt, Homo Sapiens; identical to SEQ ID NO: 162861

SEQ ID NO: 450389 - RNA, 64 nt, Homo Sapiens; identical to SEQ ID NO: 162862

SEQ ID NO: 450390 - RNA, 64 nt, Homo Sapiens; identical to SEQ ID NO: 162863

SEQ ID NO: 450391 - RNA, 64 nt, Homo Sapiens; identical to SEQ ID NO: 162864

SEQ ID NO: 450392 - RNA, 64 nt, Homo Sapiens; identical to SEQ ID NO: 162865

SEQ ID NO: 450393 - RNA, 64 nt, Homo Sapiens; identical to SEQ ID NO: 162866

SEQ ID NO: 450394 - RNA, 64 nt, Homo Sapiens; identical to SEQ ID NO: 162867

SEQ ID NO: 450395 - RNA, 64 nt, Homo Sapiens; identical to SEQ ID NO: 162868

SEQ ID NO: 450396 - RNA, 64 nt, Homo Sapiens; identical to SEQ ID NO: 162869

SEQ ID NO: 450397 - RNA, 64 nt, Homo Sapiens; identical to SEQ ID NO: 162870

SEQ ID NO: 450398 - RNA, 64 nt, Homo Sapiens; identical to SEQ ID NO: 162871

SEQ ID NO: 450399 - RNA, 64 nt, Homo Sapiens; identical to SEQ ID NO: 162872

SEQ ID NO: 450400 - RNA, 64 nt, Homo Sapiens; identical to SEQ ID NO: 162873

SEQ ID NO: 450401 - RNA, 64 nt, Homo Sapiens; identical to SEQ ID NO: 162874

SEQ ID NO: 450402 - RNA, 64 nt, Homo Sapiens; identical to SEQ ID NO: 162875

SEQ ID NO: 450403 - RNA, 64 nt, Homo Sapiens; identical to SEQ ID NO: 162876

SEQ ID NO: 450404 - RNA, 64 nt, Homo Sapiens; identical to SEQ ID NO: 162877

SEQ ID NO: 450405 - RNA, 64 nt, Homo Sapiens; identical to SEQ ID NO: 162878

SEQ ID NO: 450406 - RNA, 64 nt, Homo Sapiens; identical to SEQ ID NO: 162879

SEQ ID NO: 450407 - RNA, 64 nt, Homo Sapiens; identical to SEQ ID NO: 162880

SEQ ID NO: 450408 - RNA, 64 nt, Homo Sapiens; identical to SEQ ID NO: 162881

SEQ ID NO: 450409 - RNA, 64 nt, Homo Sapiens; identical to SEQ ID NO: 162882

SEQ ID NO: 450410 - RNA, 64 nt, Homo Sapiens; identical to SEQ ID NO: 162883

SEQ ID NO: 450411 - RNA, 64 nt, Homo Sapiens; identical to SEQ ID NO: 162884

SEQ ID NO: 450412 - RNA, 64 nt, Homo Sapiens; identical to SEQ ID NO: 162885

SEQ ID NO: 450413 - RNA, 64 nt, Homo Sapiens; identical to SEQ ID NO: 162886

SEQ ID NO: 450414 - RNA, 64 nt, Homo Sapiens; identical to SEQ ID NO: 162887

SEQ ID NO: 450415 - RNA, 64 nt, Homo Sapiens; identical to SEQ ID NO: 162888

SEQ ID NO: 450416 - RNA, 64 nt, Homo Sapiens; identical to SEQ ID NO: 162889

SEQ ID NO: 450417 - RNA, 64 nt, Homo Sapiens; identical to SEQ ID NO: 162890

SEQ ID NO: 450418 - RNA, 64 nt, Homo Sapiens; identical to SEQ ID NO: 162891

SEQ ID NO: 450419 - RNA, 64 nt, Homo Sapiens; identical to SEQ ID NO: 162892

SEQ ID NO: 450420 - RNA, 64 nt, Homo Sapiens; identical to SEQ ID NO: 162893

SEQ ID NO: 450421 - RNA, 64 nt, Homo Sapiens; identical to SEQ ID NO: 162894

SEQ ID NO: 450422 - RNA, 64 nt, Homo Sapiens; identical to SEQ ID NO: 162895

SEQ ID NO: 450423 - RNA, 64 nt, Homo Sapiens; identical to SEQ ID NO: 162896

SEQ ID NO: 450424 - RNA, 64 nt, Homo Sapiens; identical to SEQ ID NO: 162897

SEQ ID NO: 450425 - RNA, 64 nt, Homo Sapiens; identical to SEQ ID NO: 162898

SEQ ID NO: 450426 - RNA, 64 nt, Homo Sapiens; identical to SEQ ID NO: 162899

SEQ ID NO: 450427 - RNA, 64 nt, Homo Sapiens; identical to SEQ ID NO: 162900

SEQ ID NO: 450428 - RNA, 64 nt, Homo Sapiens; identical to SEQ ID NO: 162901

SEQ ID NO: 450429 - RNA, 64 nt, Homo Sapiens; identical to SEQ ID NO: 162902

SEQ ID NO: 450430 - RNA, 64 nt, Homo Sapiens; identical to SEQ ID NO: 162903

SEQ ID NO: 450431 - RNA, 64 nt, Homo Sapiens; identical to SEQ ID NO: 162904

SEQ ID NO: 450432 - RNA, 64 nt, Homo Sapiens; identical to SEQ ID NO: 162905

SEQ ID NO: 450433 - RNA, 64 nt, Homo Sapiens; identical to SEQ ID NO: 162906

SEQ ID NO: 450434 - RNA, 64 nt, Homo Sapiens; identical to SEQ ID NO: 162907

SEQ ID NO: 450435 - RNA, 64 nt, Homo Sapiens; identical to SEQ ID NO: 162908

SEQ ID NO: 450436 - RNA, 64 nt, Homo Sapiens; identical to SEQ ID NO: 162909

SEQ ID NO: 450437 - RNA, 64 nt, Homo Sapiens; identical to SEQ ID NO: 162910

SEQ ID NO: 450438 - RNA, 64 nt, Homo Sapiens; identical to SEQ ID NO: 162911

SEQ ID NO: 450439 - RNA, 64 nt, Homo Sapiens; identical to SEQ ID NO: 162912

SEQ ID NO: 450440 - RNA, 64 nt, Homo Sapiens; identical to SEQ ID NO: 162913

SEQ ID NO: 450441 - RNA, 64 nt, Homo Sapiens; identical to SEQ ID NO: 162914

SEQ ID NO: 450442 - RNA, 64 nt, Homo Sapiens; identical to SEQ ID NO: 162915

SEQ ID NO: 450443 - RNA, 64 nt, Homo Sapiens; identical to SEQ ID NO: 162916

SEQ ID NO: 450444 - RNA, 64 nt, Homo Sapiens; identical to SEQ ID NO: 162917

SEQ ID NO: 450445 - RNA, 64 nt, Homo Sapiens; identical to SEQ ID NO: 162918

SEQ ID NO: 450446 - RNA, 64 nt, Homo Sapiens; identical to SEQ ID NO: 162919

SEQ ID NO: 450447 - RNA, 64 nt, Homo Sapiens; identical to SEQ ID NO: 162920

SEQ ID NO: 450448 - RNA, 64 nt, Homo Sapiens; identical to SEQ ID NO: 162921

SEQ ID NO: 450449 - RNA, 64 nt, Homo Sapiens; identical to SEQ ID NO: 162922

SEQ ID NO: 450450 - RNA, 53 nt, Homo Sapiens; identical to SEQ ID NO: 162923

SEQ ID NO: 450451 - RNA, 64 nt, Homo Sapiens; identical to SEQ ID NO: 162924

SEQ ID NO: 450452 - RNA, 64 nt, Homo Sapiens; identical to SEQ ID NO: 162925

SEQ ID NO: 450453 - RNA, 64 nt, Homo Sapiens; identical to SEQ ID NO: 162926

SEQ ID NO: 450454 - RNA, 64 nt, Homo Sapiens; identical to SEQ ID NO: 162927

SEQ ID NO: 450455 - RNA, 64 nt, Homo Sapiens; identical to SEQ ID NO: 162928

SEQ ID NO: 450456 - RNA, 64 nt, Homo Sapiens; identical to SEQ ID NO: 162929

SEQ ID NO: 450457 - RNA, 64 nt, Homo Sapiens; identical to SEQ ID NO: 162930

SEQ ID NO: 450458 - RNA, 64 nt, Homo Sapiens; identical to SEQ ID NO: 162931

SEQ ID NO: 450459 - RNA, 64 nt, Homo Sapiens; identical to SEQ ID NO: 162932

SEQ ID NO: 450460 - RNA, 64 nt, Homo Sapiens; identical to SEQ ID NO: 162933

SEQ ID NO: 450461 - RNA, 64 nt, Homo Sapiens; identical to SEQ ID NO: 162934

SEQ ID NO: 450462 - RNA, 64 nt, Homo Sapiens; identical to SEQ ID NO: 162935

SEQ ID NO: 450463 - RNA, 64 nt, Homo Sapiens; identical to SEQ ID NO: 162936

SEQ ID NO: 450464 - RNA, 64 nt, Homo Sapiens; identical to SEQ ID NO: 162937

SEQ ID NO: 450465 - RNA, 64 nt, Homo Sapiens; identical to SEQ ID NO: 162938

SEQ ID NO: 450466 - RNA, 64 nt, Homo Sapiens; identical to SEQ ID NO: 162939

SEQ ID NO: 450467 - RNA, 64 nt, Homo Sapiens; identical to SEQ ID NO: 162940

SEQ ID NO: 450468 - RNA, 64 nt, Homo Sapiens; identical to SEQ ID NO: 162941

SEQ ID NO: 450469 - RNA, 64 nt, Homo Sapiens; identical to SEQ ID NO: 162942

SEQ ID NO: 450470 - RNA, 64 nt, Homo Sapiens; identical to SEQ ID NO: 162943

SEQ ID NO: 450471 - RNA, 64 nt, Homo Sapiens; identical to SEQ ID NO: 162944

SEQ ID NO: 450472 - RNA, 64 nt, Homo Sapiens; identical to SEQ ID NO: 162945

SEQ ID NO: 450473 - RNA, 64 nt, Homo Sapiens; identical to SEQ ID NO: 162946

SEQ ID NO: 450474 - RNA, 64 nt, Homo Sapiens; identical to SEQ ID NO: 162947

SEQ ID NO: 450475 - RNA, 64 nt, Homo Sapiens; identical to SEQ ID NO: 162948

SEQ ID NO: 450476 - RNA, 64 nt, Homo Sapiens; identical to SEQ ID NO: 162949

SEQ ID NO: 450477 - RNA, 64 nt, Homo Sapiens; identical to SEQ ID NO: 162950

SEQ ID NO: 450478 - RNA, 64 nt, Homo Sapiens; identical to SEQ ID NO: 162951

SEQ ID NO: 450479 - RNA, 64 nt, Homo Sapiens; identical to SEQ ID NO: 162952

SEQ ID NO: 450480 - RNA, 64 nt, Homo Sapiens; identical to SEQ ID NO: 162953

SEQ ID NO: 450481 - RNA, 64 nt, Homo Sapiens; identical to SEQ ID NO: 162954

SEQ ID NO: 450482 - RNA, 64 nt, Homo Sapiens; identical to SEQ ID NO: 162955

SEQ ID NO: 450483 - RNA, 64 nt, Homo Sapiens; identical to SEQ ID NO: 162956

SEQ ID NO: 450484 - RNA, 64 nt, Homo Sapiens; identical to SEQ ID NO: 162957

SEQ ID NO: 450485 - RNA, 64 nt, Homo Sapiens; identical to SEQ ID NO: 162958

SEQ ID NO: 450486 - RNA, 64 nt, Homo Sapiens; identical to SEQ ID NO: 162959

SEQ ID NO: 450487 - RNA, 64 nt, Homo Sapiens; identical to SEQ ID NO: 162960

SEQ ID NO: 450488 - RNA, 64 nt, Homo Sapiens; identical to SEQ ID NO: 162961

SEQ ID NO: 450489 - RNA, 64 nt, Homo Sapiens; identical to SEQ ID NO: 162962

SEQ ID NO: 450490 - RNA, 64 nt, Homo Sapiens; identical to SEQ ID NO: 162963

SEQ ID NO: 450491 - RNA, 64 nt, Homo Sapiens; identical to SEQ ID NO: 162964

SEQ ID NO: 450492 - RNA, 64 nt, Homo Sapiens; identical to SEQ ID NO: 162965

SEQ ID NO: 450493 - RNA, 64 nt, Homo Sapiens; identical to SEQ ID NO: 162966

SEQ ID NO: 450494 - RNA, 64 nt, Homo Sapiens; identical to SEQ ID NO: 162967

SEQ ID NO: 450495 - RNA, 64 nt, Homo Sapiens; identical to SEQ ID NO: 162968

SEQ ID NO: 450496 - RNA, 64 nt, Homo Sapiens; identical to SEQ ID NO: 162969

SEQ ID NO: 450497 - RNA, 64 nt, Homo Sapiens; identical to SEQ ID NO: 162970

SEQ ID NO: 450498 - RNA, 64 nt, Homo Sapiens; identical to SEQ ID NO: 162971

SEQ ID NO: 450499 - RNA, 64 nt, Homo Sapiens; identical to SEQ ID NO: 162972

SEQ ID NO: 450500 - RNA, 64 nt, Homo Sapiens; identical to SEQ ID NO: 162973

SEQ ID NO: 450501 - RNA, 64 nt, Homo Sapiens; identical to SEQ ID NO: 162974

SEQ ID NO: 450502 - RNA, 64 nt, Homo Sapiens; identical to SEQ ID NO: 162975

SEQ ID NO: 450503 - RNA, 64 nt, Homo Sapiens; identical to SEQ ID NO: 162976

SEQ ID NO: 450504 - RNA, 64 nt, Homo Sapiens; identical to SEQ ID NO: 162977

SEQ ID NO: 450505 - RNA, 64 nt, Homo Sapiens; identical to SEQ ID NO: 162978

SEQ ID NO: 450506 - RNA, 64 nt, Homo Sapiens; identical to SEQ ID NO: 162979

SEQ ID NO: 450507 - RNA, 64 nt, Homo Sapiens; identical to SEQ ID NO: 162980

SEQ ID NO: 450508 - RNA, 64 nt, Homo Sapiens; identical to SEQ ID NO: 162981

SEQ ID NO: 450509 - RNA, 64 nt, Homo Sapiens; identical to SEQ ID NO: 162982

SEQ ID NO: 450510 - RNA, 64 nt, Homo Sapiens; identical to SEQ ID NO: 162983

SEQ ID NO: 450511 - RNA, 64 nt, Homo Sapiens; identical to SEQ ID NO: 162984

SEQ ID NO: 450512 - RNA, 64 nt, Homo Sapiens; identical to SEQ ID NO: 162985

SEQ ID NO: 450513 - RNA, 64 nt, Homo Sapiens; identical to SEQ ID NO: 162986

SEQ ID NO: 450514 - RNA, 64 nt, Homo Sapiens; identical to SEQ ID NO: 162987

SEQ ID NO: 450515 - RNA, 64 nt, Homo Sapiens; identical to SEQ ID NO: 162988

SEQ ID NO: 450516 - RNA, 64 nt, Homo Sapiens; identical to SEQ ID NO: 162989

SEQ ID NO: 450517 - RNA, 64 nt, Homo Sapiens; identical to SEQ ID NO: 162990

SEQ ID NO: 450518 - RNA, 64 nt, Homo Sapiens; identical to SEQ ID NO: 162991

SEQ ID NO: 450519 - RNA, 64 nt, Homo Sapiens; identical to SEQ ID NO: 162992

SEQ ID NO: 450520 - RNA, 64 nt, Homo Sapiens; identical to SEQ ID NO: 162993

SEQ ID NO: 450521 - RNA, 64 nt, Homo Sapiens; identical to SEQ ID NO: 162994

SEQ ID NO: 450522 - RNA, 64 nt, Homo Sapiens; identical to SEQ ID NO: 162995

SEQ ID NO: 450523 - RNA, 64 nt, Homo Sapiens; identical to SEQ ID NO: 162996

SEQ ID NO: 450524 - RNA, 64 nt, Homo Sapiens; identical to SEQ ID NO: 162997

SEQ ID NO: 450525 - RNA, 64 nt, Homo Sapiens; identical to SEQ ID NO: 162998

SEQ ID NO: 450526 - RNA, 64 nt, Homo Sapiens; identical to SEQ ID NO: 162999

SEQ ID NO: 450527 - RNA, 64 nt, Homo Sapiens; identical to SEQ ID NO: 163000

SEQ ID NO: 450528 - RNA, 64 nt, Homo Sapiens; identical to SEQ ID NO: 163001

SEQ ID NO: 450529 - RNA, 64 nt, Homo Sapiens; identical to SEQ ID NO: 163002

SEQ ID NO: 450530 - RNA, 64 nt, Homo Sapiens; identical to SEQ ID NO: 163003

SEQ ID NO: 450531 - RNA, 64 nt, Homo Sapiens; identical to SEQ ID NO: 163004

SEQ ID NO: 450532 - RNA, 64 nt, Homo Sapiens; identical to SEQ ID NO: 163005

SEQ ID NO: 450533 - RNA, 64 nt, Homo Sapiens; identical to SEQ ID NO: 163006

SEQ ID NO: 450534 - RNA, 64 nt, Homo Sapiens; identical to SEQ ID NO: 163007

SEQ ID NO: 450535 - RNA, 64 nt, Homo Sapiens; identical to SEQ ID NO: 163008

SEQ ID NO: 450536 - RNA, 64 nt, Homo Sapiens; identical to SEQ ID NO: 163009

SEQ ID NO: 450537 - RNA, 64 nt, Homo Sapiens; identical to SEQ ID NO: 163010

SEQ ID NO: 450538 - RNA, 64 nt, Homo Sapiens; identical to SEQ ID NO: 163011

SEQ ID NO: 450539 - RNA, 64 nt, Homo Sapiens; identical to SEQ ID NO: 163012

SEQ ID NO: 450540 - RNA, 64 nt, Homo Sapiens; identical to SEQ ID NO: 163013

SEQ ID NO: 450541 - RNA, 64 nt, Homo Sapiens; identical to SEQ ID NO: 163014

SEQ ID NO: 450542 - RNA, 64 nt, Homo Sapiens; identical to SEQ ID NO: 163015

SEQ ID NO: 450543 - RNA, 64 nt, Homo Sapiens; identical to SEQ ID NO: 163016

SEQ ID NO: 450544 - RNA, 64 nt, Homo Sapiens; identical to SEQ ID NO: 163017

SEQ ID NO: 450545 - RNA, 64 nt, Homo Sapiens; identical to SEQ ID NO: 163018

SEQ ID NO: 450546 - RNA, 64 nt, Homo Sapiens; identical to SEQ ID NO: 163019

SEQ ID NO: 450547 - RNA, 64 nt, Homo Sapiens; identical to SEQ ID NO: 163020

SEQ ID NO: 450548 - RNA, 64 nt, Homo Sapiens; identical to SEQ ID NO: 163021

SEQ ID NO: 450549 - RNA, 64 nt, Homo Sapiens; identical to SEQ ID NO: 163022

SEQ ID NO: 450550 - RNA, 64 nt, Homo Sapiens; identical to SEQ ID NO: 163023

SEQ ID NO: 450551 - RNA, 64 nt, Homo Sapiens; identical to SEQ ID NO: 163024

SEQ ID NO: 450552 - RNA, 64 nt, Homo Sapiens; identical to SEQ ID NO: 163025

SEQ ID NO: 450553 - RNA, 64 nt, Homo Sapiens; identical to SEQ ID NO: 163026

SEQ ID NO: 450554 - RNA, 64 nt, Homo Sapiens; identical to SEQ ID NO: 163027

SEQ ID NO: 450555 - RNA, 64 nt, Homo Sapiens; identical to SEQ ID NO: 163028

SEQ ID NO: 450556 - RNA, 64 nt, Homo Sapiens; identical to SEQ ID NO: 163029

SEQ ID NO: 450557 - RNA, 64 nt, Homo Sapiens; identical to SEQ ID NO: 163030

SEQ ID NO: 450558 - RNA, 64 nt, Homo Sapiens; identical to SEQ ID NO: 163031

SEQ ID NO: 450559 - RNA, 64 nt, Homo Sapiens; identical to SEQ ID NO: 163032

SEQ ID NO: 450560 - RNA, 64 nt, Homo Sapiens; identical to SEQ ID NO: 163033

SEQ ID NO: 450561 - RNA, 64 nt, Homo Sapiens; identical to SEQ ID NO: 163034

SEQ ID NO: 450562 - RNA, 64 nt, Homo Sapiens; identical to SEQ ID NO: 163035

SEQ ID NO: 450563 - RNA, 64 nt, Homo Sapiens; identical to SEQ ID NO: 163036

SEQ ID NO: 450564 - RNA, 64 nt, Homo Sapiens; identical to SEQ ID NO: 163037

SEQ ID NO: 450565 - RNA, 64 nt, Homo Sapiens; identical to SEQ ID NO: 163038

SEQ ID NO: 450566 - RNA, 64 nt, Homo Sapiens; identical to SEQ ID NO: 163039

SEQ ID NO: 450567 - RNA, 64 nt, Homo Sapiens; identical to SEQ ID NO: 163040

SEQ ID NO: 450568 - RNA, 64 nt, Homo Sapiens; identical to SEQ ID NO: 163041

SEQ ID NO: 450569 - RNA, 64 nt, Homo Sapiens; identical to SEQ ID NO: 163042

SEQ ID NO: 450570 - RNA, 64 nt, Homo Sapiens; identical to SEQ ID NO: 163043

SEQ ID NO: 450571 - RNA, 64 nt, Homo Sapiens; identical to SEQ ID NO: 163044

SEQ ID NO: 450572 - RNA, 64 nt, Homo Sapiens; identical to SEQ ID NO: 163045

SEQ ID NO: 450573 - RNA, 64 nt, Homo Sapiens; identical to SEQ ID NO: 163046

SEQ ID NO: 450574 - RNA, 64 nt, Homo Sapiens; identical to SEQ ID NO: 162809

SEQ ID NO: 450575 - RNA, 64 nt, Homo Sapiens; identical to SEQ ID NO: 163048

SEQ ID NO: 450576 - RNA, 64 nt, Homo Sapiens; identical to SEQ ID NO: 163049

SEQ ID NO: 450577 - RNA, 64 nt, Homo Sapiens; identical to SEQ ID NO: 163050

SEQ ID NO: 450578 - RNA, 64 nt, Homo Sapiens; identical to SEQ ID NO: 163051

SEQ ID NO: 450579 - RNA, 64 nt, Homo Sapiens; identical to SEQ ID NO: 163052

SEQ ID NO: 450580 - RNA, 64 nt, Homo Sapiens; identical to SEQ ID NO: 163053

SEQ ID NO: 450581 - RNA, 64 nt, Homo Sapiens; identical to SEQ ID NO: 163054

SEQ ID NO: 450582 - RNA, 64 nt, Homo Sapiens; identical to SEQ ID NO: 163055

SEQ ID NO: 450583 - RNA, 64 nt, Homo Sapiens; identical to SEQ ID NO: 163056

SEQ ID NO: 450584 - RNA, 64 nt, Homo Sapiens; identical to SEQ ID NO: 163057

SEQ ID NO: 450585 - RNA, 64 nt, Homo Sapiens; identical to SEQ ID NO: 163058

SEQ ID NO: 450586 - RNA, 64 nt, Homo Sapiens; identical to SEQ ID NO: 163059

SEQ ID NO: 450587 - RNA, 64 nt, Homo Sapiens; identical to SEQ ID NO: 163060

SEQ ID NO: 450588 - RNA, 64 nt, Homo Sapiens; identical to SEQ ID NO: 163061

SEQ ID NO: 450589 - RNA, 64 nt, Homo Sapiens; identical to SEQ ID NO: 163062

SEQ ID NO: 450590 - RNA, 64 nt, Homo Sapiens; identical to SEQ ID NO: 163063

SEQ ID NO: 450591 - RNA, 64 nt, Homo Sapiens; identical to SEQ ID NO: 163064

SEQ ID NO: 450592 - RNA, 64 nt, Homo Sapiens; identical to SEQ ID NO: 163065

SEQ ID NO: 450593 - RNA, 64 nt, Homo Sapiens; identical to SEQ ID NO: 163066

SEQ ID NO: 450594 - RNA, 64 nt, Homo Sapiens; identical to SEQ ID NO: 163067

SEQ ID NO: 450595 - RNA, 64 nt, Homo Sapiens; identical to SEQ ID NO: 163068

SEQ ID NO: 450596 - RNA, 64 nt, Homo Sapiens; identical to SEQ ID NO: 163069

SEQ ID NO: 450597 - RNA, 64 nt, Homo Sapiens; identical to SEQ ID NO: 163070

SEQ ID NO: 450598 - RNA, 64 nt, Homo Sapiens; identical to SEQ ID NO: 163071

SEQ ID NO: 450599 - RNA, 64 nt, Homo Sapiens; identical to SEQ ID NO: 163072

SEQ ID NO: 450600 - RNA, 64 nt, Homo Sapiens; identical to SEQ ID NO: 163073

SEQ ID NO: 450601 - RNA, 64 nt, Homo Sapiens; identical to SEQ ID NO: 163074

SEQ ID NO: 450602 - RNA, 64 nt, Homo Sapiens; identical to SEQ ID NO: 163075

SEQ ID NO: 450603 - RNA, 64 nt, Homo Sapiens; identical to SEQ ID NO: 163076

SEQ ID NO: 450604 - RNA, 64 nt, Homo Sapiens; identical to SEQ ID NO: 163077

SEQ ID NO: 450605 - RNA, 64 nt, Homo Sapiens; identical to SEQ ID NO: 163078

SEQ ID NO: 450606 - RNA, 64 nt, Homo Sapiens; identical to SEQ ID NO: 163079

SEQ ID NO: 450607 - RNA, 64 nt, Homo Sapiens; identical to SEQ ID NO: 163080

SEQ ID NO: 450608 - RNA, 64 nt, Homo Sapiens; identical to SEQ ID NO: 163081

SEQ ID NO: 450609 - RNA, 64 nt, Homo Sapiens; identical to SEQ ID NO: 163082

SEQ ID NO: 450610 - RNA, 64 nt, Homo Sapiens; identical to SEQ ID NO: 163083

SEQ ID NO: 450611 - RNA, 64 nt, Homo Sapiens; identical to SEQ ID NO: 163084

SEQ ID NO: 450612 - RNA, 64 nt, Homo Sapiens; identical to SEQ ID NO: 163085

SEQ ID NO: 450613 - RNA, 64 nt, Homo Sapiens; identical to SEQ ID NO: 163086

SEQ ID NO: 450614 - RNA, 64 nt, Homo Sapiens; identical to SEQ ID NO: 163087

SEQ ID NO: 450615 - RNA, 64 nt, Homo Sapiens; identical to SEQ ID NO: 163088

SEQ ID NO: 450616 - RNA, 64 nt, Homo Sapiens; identical to SEQ ID NO: 163089

SEQ ID NO: 450617 - RNA, 64 nt, Homo Sapiens; identical to SEQ ID NO: 163090

SEQ ID NO: 450618 - RNA, 64 nt, Homo Sapiens; identical to SEQ ID NO: 163091

SEQ ID NO: 450619 - RNA, 64 nt, Homo Sapiens; identical to SEQ ID NO: 163092

SEQ ID NO: 450620 - RNA, 64 nt, Homo Sapiens; identical to SEQ ID NO: 163093

SEQ ID NO: 450621 - RNA, 64 nt, Homo Sapiens; identical to SEQ ID NO: 163094

SEQ ID NO: 450622 - RNA, 64 nt, Homo Sapiens; identical to SEQ ID NO: 163095

SEQ ID NO: 450623 - RNA, 64 nt, Homo Sapiens; identical to SEQ ID NO: 163096

SEQ ID NO: 450624 - RNA, 64 nt, Homo Sapiens; identical to SEQ ID NO: 163097

SEQ ID NO: 450625 - RNA, 64 nt, Homo Sapiens; identical to SEQ ID NO: 163098

SEQ ID NO: 450626 - RNA, 64 nt, Homo Sapiens; identical to SEQ ID NO: 163099

SEQ ID NO: 450627 - RNA, 64 nt, Homo Sapiens; identical to SEQ ID NO: 163100

SEQ ID NO: 450628 - RNA, 64 nt, Homo Sapiens; identical to SEQ ID NO: 163101

SEQ ID NO: 450629 - RNA, 64 nt, Homo Sapiens; identical to SEQ ID NO: 163102

SEQ ID NO: 450630 - RNA, 64 nt, Homo Sapiens; identical to SEQ ID NO: 163103

SEQ ID NO: 450631 - RNA, 64 nt, Homo Sapiens; identical to SEQ ID NO: 163104

SEQ ID NO: 450632 - RNA, 64 nt, Homo Sapiens; identical to SEQ ID NO: 163105

SEQ ID NO: 450633 - RNA, 64 nt, Homo Sapiens; identical to SEQ ID NO: 163106

SEQ ID NO: 450634 - RNA, 64 nt, Homo Sapiens; identical to SEQ ID NO: 163107

SEQ ID NO: 450635 - RNA, 64 nt, Homo Sapiens; identical to SEQ ID NO: 163108

SEQ ID NO: 450636 - RNA, 64 nt, Homo Sapiens; identical to SEQ ID NO: 163109

SEQ ID NO: 450637 - RNA, 64 nt, Homo Sapiens; identical to SEQ ID NO: 163110

SEQ ID NO: 450638 - RNA, 64 nt, Homo Sapiens; identical to SEQ ID NO: 163111

SEQ ID NO: 450639 - RNA, 64 nt, Homo Sapiens; identical to SEQ ID NO: 163112

SEQ ID NO: 450640 - RNA, 64 nt, Homo Sapiens; identical to SEQ ID NO: 163113

SEQ ID NO: 450641 - RNA, 64 nt, Homo Sapiens; identical to SEQ ID NO: 163114

SEQ ID NO: 450642 - RNA, 64 nt, Homo Sapiens; identical to SEQ ID NO: 163115

SEQ ID NO: 450643 - RNA, 64 nt, Homo Sapiens; identical to SEQ ID NO: 163116

SEQ ID NO: 450644 - RNA, 64 nt, Homo Sapiens; identical to SEQ ID NO: 163117

SEQ ID NO: 450645 - RNA, 64 nt, Homo Sapiens; identical to SEQ ID NO: 163118

SEQ ID NO: 450646 - RNA, 64 nt, Homo Sapiens; identical to SEQ ID NO: 163119

SEQ ID NO: 450647 - RNA, 64 nt, Homo Sapiens; identical to SEQ ID NO: 163120

SEQ ID NO: 450648 - RNA, 64 nt, Homo Sapiens; identical to SEQ ID NO: 163121

SEQ ID NO: 450649 - RNA, 64 nt, Homo Sapiens; identical to SEQ ID NO: 163122

SEQ ID NO: 450650 - RNA, 64 nt, Homo Sapiens; identical to SEQ ID NO: 163123

SEQ ID NO: 450651 - RNA, 64 nt, Homo Sapiens; identical to SEQ ID NO: 163124

SEQ ID NO: 450652 - RNA, 64 nt, Homo Sapiens; identical to SEQ ID NO: 163125

SEQ ID NO: 450653 - RNA, 64 nt, Homo Sapiens; identical to SEQ ID NO: 163126

SEQ ID NO: 450654 - RNA, 64 nt, Homo Sapiens; identical to SEQ ID NO: 163127

SEQ ID NO: 450655 - RNA, 64 nt, Homo Sapiens; identical to SEQ ID NO: 163128

SEQ ID NO: 450656 - RNA, 64 nt, Homo Sapiens; identical to SEQ ID NO: 163129

SEQ ID NO: 450657 - RNA, 64 nt, Homo Sapiens; identical to SEQ ID NO: 163130

SEQ ID NO: 450658 - RNA, 64 nt, Homo Sapiens; identical to SEQ ID NO: 163131

SEQ ID NO: 450659 - RNA, 64 nt, Homo Sapiens; identical to SEQ ID NO: 163132

SEQ ID NO: 450660 - RNA, 64 nt, Homo Sapiens; identical to SEQ ID NO: 163133

SEQ ID NO: 450661 - RNA, 64 nt, Homo Sapiens; identical to SEQ ID NO: 163134

SEQ ID NO: 450662 - RNA, 64 nt, Homo Sapiens; identical to SEQ ID NO: 163135

SEQ ID NO: 450663 - RNA, 64 nt, Homo Sapiens; identical to SEQ ID NO: 163136

SEQ ID NO: 450664 - RNA, 64 nt, Homo Sapiens; identical to SEQ ID NO: 163137

SEQ ID NO: 450665 - RNA, 64 nt, Homo Sapiens; identical to SEQ ID NO: 163138

SEQ ID NO: 450666 - RNA, 64 nt, Homo Sapiens; identical to SEQ ID NO: 163139

SEQ ID NO: 450667 - RNA, 64 nt, Homo Sapiens; identical to SEQ ID NO: 163140

SEQ ID NO: 450668 - RNA, 64 nt, Homo Sapiens; identical to SEQ ID NO: 163141

SEQ ID NO: 450669 - RNA, 64 nt, Homo Sapiens; identical to SEQ ID NO: 163142

SEQ ID NO: 450670 - RNA, 64 nt, Homo Sapiens; identical to SEQ ID NO: 163143

SEQ ID NO: 450671 - RNA, 64 nt, Homo Sapiens; identical to SEQ ID NO: 163144

SEQ ID NO: 450672 - RNA, 64 nt, Homo Sapiens; identical to SEQ ID NO: 163145

SEQ ID NO: 450673 - RNA, 64 nt, Homo Sapiens; identical to SEQ ID NO: 163146

SEQ ID NO: 450674 - RNA, 64 nt, Homo Sapiens; identical to SEQ ID NO: 163147

SEQ ID NO: 450675 - RNA, 64 nt, Homo Sapiens; identical to SEQ ID NO: 163148

SEQ ID NO: 450676 - RNA, 64 nt, Homo Sapiens; identical to SEQ ID NO: 163149

SEQ ID NO: 450677 - RNA, 64 nt, Homo Sapiens; identical to SEQ ID NO: 163150

SEQ ID NO: 450678 - RNA, 64 nt, Homo Sapiens; identical to SEQ ID NO: 163151

SEQ ID NO: 450679 - RNA, 64 nt, Homo Sapiens; identical to SEQ ID NO: 163152

SEQ ID NO: 450680 - RNA, 64 nt, Homo Sapiens; identical to SEQ ID NO: 163153

SEQ ID NO: 450681 - RNA, 64 nt, Homo Sapiens; identical to SEQ ID NO: 163154

SEQ ID NO: 450682 - RNA, 64 nt, Homo Sapiens; identical to SEQ ID NO: 163155

SEQ ID NO: 450683 - RNA, 64 nt, Homo Sapiens; identical to SEQ ID NO: 163156

SEQ ID NO: 450684 - RNA, 64 nt, Homo Sapiens; identical to SEQ ID NO: 163157

SEQ ID NO: 450685 - RNA, 64 nt, Homo Sapiens; identical to SEQ ID NO: 163158

SEQ ID NO: 450686 - RNA, 64 nt, Homo Sapiens; identical to SEQ ID NO: 163159

SEQ ID NO: 450687 - RNA, 64 nt, Homo Sapiens; identical to SEQ ID NO: 163160

SEQ ID NO: 450688 - RNA, 64 nt, Homo Sapiens; identical to SEQ ID NO: 163161

SEQ ID NO: 450689 - RNA, 64 nt, Homo Sapiens; identical to SEQ ID NO: 163162

SEQ ID NO: 450690 - RNA, 64 nt, Homo Sapiens; identical to SEQ ID NO: 163163

SEQ ID NO: 450691 - RNA, 64 nt, Homo Sapiens; identical to SEQ ID NO: 163164

SEQ ID NO: 450692 - RNA, 64 nt, Homo Sapiens; identical to SEQ ID NO: 163165

SEQ ID NO: 450693 - RNA, 64 nt, Homo Sapiens; identical to SEQ ID NO: 163166

SEQ ID NO: 450694 - RNA, 64 nt, Homo Sapiens; identical to SEQ ID NO: 163167

SEQ ID NO: 450695 - RNA, 64 nt, Homo Sapiens; identical to SEQ ID NO: 163168

SEQ ID NO: 450696 - RNA, 64 nt, Homo Sapiens; identical to SEQ ID NO: 163169

SEQ ID NO: 450697 - RNA, 64 nt, Homo Sapiens; identical to SEQ ID NO: 163170

SEQ ID NO: 450698 - RNA, 64 nt, Homo Sapiens; identical to SEQ ID NO: 163171

SEQ ID NO: 450699 - RNA, 64 nt, Homo Sapiens; identical to SEQ ID NO: 163172

SEQ ID NO: 450700 - RNA, 64 nt, Homo Sapiens; identical to SEQ ID NO: 163173

SEQ ID NO: 450701 - RNA, 64 nt, Homo Sapiens; identical to SEQ ID NO: 163174

SEQ ID NO: 450702 - RNA, 64 nt, Homo Sapiens; identical to SEQ ID NO: 163175

SEQ ID NO: 450703 - RNA, 64 nt, Homo Sapiens; identical to SEQ ID NO: 163176

SEQ ID NO: 450704 - RNA, 64 nt, Homo Sapiens; identical to SEQ ID NO: 163177

SEQ ID NO: 450705 - RNA, 64 nt, Homo Sapiens; identical to SEQ ID NO: 163178

SEQ ID NO: 450706 - RNA, 64 nt, Homo Sapiens; identical to SEQ ID NO: 163179

SEQ ID NO: 450707 - RNA, 64 nt, Homo Sapiens; identical to SEQ ID NO: 163180

SEQ ID NO: 450708 - RNA, 64 nt, Homo Sapiens; identical to SEQ ID NO: 163181

SEQ ID NO: 450709 - RNA, 64 nt, Homo Sapiens; identical to SEQ ID NO: 163182

SEQ ID NO: 450710 - RNA, 64 nt, Homo Sapiens; identical to SEQ ID NO: 163183

SEQ ID NO: 450711 - RNA, 64 nt, Homo Sapiens; identical to SEQ ID NO: 163184

SEQ ID NO: 450712 - RNA, 64 nt, Homo Sapiens
uuguaggagguaggauauuuuauauucugccgcaggauagaacccacgcaaggauuuucuuuaa

SEQ ID NO: 450713 - RNA, 64 nt, Homo Sapiens
aaccuaaccacugggcaggcagaauuuguuugagggauagaacgacaacaaaauaaauguuccu

SEQ ID NO: 450714 - RNA, 64 nt, Homo Sapiens
aaagaaagauggaagaaggagaagccacucaguaggauagaagacauggaugauguuaaggaua

SEQ ID NO: 450715 - RNA, 64 nt, Homo Sapiens
cacucaguaggauagaagaaauggaugauguuaaggauagaagcuccagcagugaacuugggcc

SEQ ID NO: 450716 - RNA, 64 nt, Homo Sapiens
auuuuucuuuaaaugauaucacagaauuaauguuggauagaaauaucauuggauagaaaucugu

SEQ ID NO: 450717 - RNA, 64 nt, Homo Sapiens
uaucacagaauuaauguuggauagaaauaucauuggauagaaaucuguuugaaggaauuuuccu

SEQ ID NO: 450718 - RNA, 64 nt, Homo Sapiens
ggaagguggcagaaagucucauuucaggaaggagggauagaaggaaggaaggaaggaacccccc

SEQ ID NO: 450719 - RNA, 64 nt, Homo Sapiens
auucccaguuagggggugccuaacugagcaguagggauagaaggugugaaccugggagugcuuu

SEQ ID NO: 450720 - RNA, 64 nt, Homo Sapiens
agucuggcaggugggggaauaauccuucagugccagcacucagacucagguugcaaaauuagcu

SEQ ID NO: 450721 - RNA, 64 nt, Homo Sapiens
gacaucucccuggggucugguucacugcccccgcagcacucacacggggaaccugcuuccugcc

SEQ ID NO: 450722 - RNA, 64 nt, Homo Sapiens
cucccccuccucuucuggucucguuucugcuuucagcacucacuugugccugcucagcagagcc

SEQ ID NO: 450723 - RNA, 52 nt, Homo Sapiens
caccggaguucugcccauggucagcacucacgccaaugaaacuucgcuuuaa

SEQ ID NO: 450724 - RNA, 64 nt, Homo Sapiens
ugcagagauuugaggacauuagagggcauaaaggagcacucaauaaagacaaaauaaagguuaa

SEQ ID NO: 450725 - RNA, 64 nt, Homo Sapiens
aggacuuggugccuaauuuuacccugaggggcucagcacucauugugaccuugguuacuuuuuu

SEQ ID NO: 450726 - RNA, 64 nt, Homo Sapiens
acucagggucaaguuuuaacacaguuuauauuccagcacucaaauuuggaguguuuuccauuuu

SEQ ID NO: 450727 - RNA, 64 nt, Homo Sapiens
auuuuggguaucuuuuguagaagaaguuugucacagcacucaggugccaucugggcauacaaau

SEQ ID NO: 450728 - RNA, 64 nt, Homo Sapiens
augaggacauuccauccuucggccugccucugacagcacucaccacggccugucuucucguuca

SEQ ID NO: 450729 - RNA, 64 nt, Homo Sapiens
uguucuuucuuuuccugagugcuguguuuucagaagcacucacagcuugugcucaaguccucuu

SEQ ID NO: 450730 - RNA, 63 nt, Homo Sapiens
guaauaugcuaaccugaugcacugcugaaagaaaaugugaauuuuucguaauaauugcauuuu

SEQ ID NO: 450731 - RNA, 63 nt, Homo Sapiens
cauuccugcaaagcuugcuuuggggaguuggauaaugugaaaauuuuaaguaccuaggggaga

SEQ ID NO: 450732 - RNA, 63 nt, Homo Sapiens
caaguuuauguaguacuuaauguacaugauaugaaugugaagcauaaaauuaaauaaaauuuu

SEQ ID NO: 450733 - RNA, 63 nt, Homo Sapiens
aaagggaacauaauuuguuuaggcucccacauaaaugugaaucuggccaacaacuuugguuca

SEQ ID NO: 450734 - RNA, 63 nt, Homo Sapiens
ucuguuauuauacuuaaucuucuaaacuaaacuaaugugaacaguagggaagcaagggcccaa

SEQ ID NO: 450735 - RNA, 63 nt, Homo Sapiens
agcuguauuccuaaacaaauuguuuccuaaacaaaugugaaaaugugaacagugcugaaaggu

SEQ ID NO: 450736 - RNA, 63 nt, Homo Sapiens
uccuaaacaaauuguuuccuaaacaaaugugaaaaugugaacagugcugaaagguuuugugaa

SEQ ID NO: 450737 - RNA, 63 nt, Homo Sapiens
aauuauaauuaguuccucauuagcauuuugcuaaaugugaaugaugauccuaggcauuugcug

SEQ ID NO: 450738 - RNA, 63 nt, Homo Sapiens
uggguaacuagggaagauaauauuaaggaagacaaugugaaaagaaaaaugagccuggcaaga

SEQ ID NO: 450739 - RNA, 63 nt, Homo Sapiens
cuaguuuaaaaaauuauaaaugaaucuaaucaaaaugugaauaguagucaaaaggauaauuua

SEQ ID NO: 450740 - RNA, 63 nt, Homo Sapiens
guugaauugaaugucuauaaggucuaaagguagaaugugaauauugccacagaguucauugcu

SEQ ID NO: 450741 - RNA, 63 nt, Homo Sapiens
acccauauauacaacaaaguuuuuaaacaccuaaaugugaauauagaaacauagacucccaag

SEQ ID NO: 450742 - RNA, 63 nt, Homo Sapiens
uuaagucuucacuuucugugcagguauaauuuuaaugugaaaaugagauauaaaaguaggaaa

SEQ ID NO: 450743 - RNA, 63 nt, Homo Sapiens
gugaaaaguccaucuugcugauuugaugauugaaaugugaaagugaaguggaaggaaugaaug

SEQ ID NO: 450744 - RNA, 63 nt, Homo Sapiens
uguaggucaaaucaaauuaaagaugauuuuuuuaaugugaauaaaguuauguucugauaguuu

SEQ ID NO: 450745 - RNA, 63 nt, Homo Sapiens
uaguucucuuaucuuugaucguauauuucucauaaugugaaauaugaugagauucacuuaggg

SEQ ID NO: 450746 - RNA, 63 nt, Homo Sapiens
ccagccauuuuuuuaguuaguaaaaauccuauuaaugugaaccagccaggaauaacaguguua

SEQ ID NO: 450747 - RNA, 63 nt, Homo Sapiens
uaauugauguuugcaaugugaaauuaugcaauuaaugugaaaaaacuaauagaucaccuuaga

SEQ ID NO: 450748 - RNA, 63 nt, Homo Sapiens
acaauuuaguccucauuauuaaaaggaaaagaaaaugugaaacuuguuacaugauuuuuuaaa

SEQ ID NO: 450749 - RNA, 63 nt, Homo Sapiens
gugaaguggcuauccuaaaccagcacugauuaaaaugugaauaaaauugcuuuagcuucuggu

SEQ ID NO: 450750 - RNA, 63 nt, Homo Sapiens
guuuuccucauguucaguuaaaucacuuaucaaaaugugaacuauaagccugccgccaaaaua

SEQ ID NO: 450751 - RNA, 63 nt, Homo Sapiens
auacagacaggcaaacauuuaauaauugcaaugaaugugaauugcuaauuuaugagaaaaugu

SEQ ID NO: 450752 - RNA, 63 nt, Homo Sapiens
aagaaaagagccgcuugaauaaaaauggauaauaaugugaaggcacuuguacccgaucauaau

SEQ ID NO: 450753 - RNA, 63 nt, Homo Sapiens
augagaaaauuuauacuguagagaaacccuggaaaugugaagaacguggcaaaguucuuuacc

SEQ ID NO: 450754 - RNA, 63 nt, Homo Sapiens
auaagagaauucauaccggagagaaacuguacaaaugugaagaauauggcaaagccugugaau

SEQ ID NO: 450755 - RNA, 63 nt, Homo Sapiens
aagauaauucauucuggggaaaaaaaugcuacaaaugugaaaaacguggcagagccuucagac

SEQ ID NO: 450756 - RNA, 63 nt, Homo Sapiens
uaaugagaacucauacuggaggaaagucuuacaaaugugaagaauguggcagucuuuaaaucu

SEQ ID NO: 450757 - RNA, 63 nt, Homo Sapiens
uauuguaagacuuuugagaauauacuugauuaaaaugugaaagaagggauuguuaacuuauug

SEQ ID NO: 450758 - RNA, 63 nt, Homo Sapiens
uauauaauguuaauuuauugacuaguuugaaauaaugugaaguguuuuuuauaucagauuaau

SEQ ID NO: 450759 - RNA, 63 nt, Homo Sapiens
uuucacuuuuggcgacuagaaacaauuccaguaaaugugaaucucgacaaaucgaggacugaa

SEQ ID NO: 450760 - RNA, 63 nt, Homo Sapiens
gaacgagcgaacaacugagcccaagccggugagaaugugaaacaguuucucaaaggaaagaau

SEQ ID NO: 450761 - RNA, 63 nt, Homo Sapiens
uauauuccaggucaaaauuuccccauaguuauaaaugugaaaucaguucucucacaccaaggg

SEQ ID NO: 450762 - RNA, 63 nt, Homo Sapiens
guauuguaacuauuuuaagggaccaaugguuaaaaugugaauauuaaauuuaaaaugcagaga

SEQ ID NO: 450763 - RNA, 63 nt, Homo Sapiens
acauaagagucuuaaaagaaauaauacccauuuaaugugaaaagggaugaaaauaaugggagu

SEQ ID NO: 450764 - RNA, 63 nt, Homo Sapiens
auuuuuugucucucuccugaugacuucuauuuuaaugugaagaaguacgcucuaugcauagua

SEQ ID NO: 450765 - RNA, 63 nt, Homo Sapiens
gacaccacuaaagaaacgaucagacagaucuggaaugugaagcguuauagaagauaacuggcc

SEQ ID NO: 450766 - RNA, 63 nt, Homo Sapiens
uucuugauuaaaaguuauguaauaaccaaaugcaaugugaaauauuuuacuggacucuauuuu

SEQ ID NO: 450767 - RNA, 63 nt, Homo Sapiens; identical to SEQ ID NO: 450765

SEQ ID NO: 450768 - RNA, 63 nt, Homo Sapiens; identical to SEQ ID NO: 450766

SEQ ID NO: 450769 - RNA, 63 nt, Homo Sapiens
auauuugaaguauuaauuuuagauaaucaucuuaaugugaaagcuaggaaagauuuacacaau

SEQ ID NO: 450770 - RNA, 63 nt, Homo Sapiens
auuuggguuucaaauguuaaaauccaaaaacaaaaugugaaccuacauacucauucccaaagc

SEQ ID NO: 450771 - RNA, 63 nt, Homo Sapiens
cuggauuuuaauuggcauguuucauuaggugccaaugugaaguacuuuggucauucugcugug

SEQ ID NO: 450772 - RNA, 63 nt, Homo Sapiens
ucugucgauucaucuccaauuuccuucucuuggaaugugaagaauuucagucuaggaaagauu

SEQ ID NO: 450773 - RNA, 63 nt, Homo Sapiens
acugggugcuagacaagaagcccacagaagaaaaaugugaaaguggugaauaaguuauaaauu

SEQ ID NO: 450774 - RNA, 63 nt, Homo Sapiens
ccuuuucuuuagucccaaccacuaguuuuaacaaaugugaauuauugaaaugugaagggacaa

SEQ ID NO: 450775 - RNA, 63 nt, Homo Sapiens
caaccacuaguuuuaacaaaugugaauuauugaaaugugaagggacaaaaagaaucauacauu

SEQ ID NO: 450776 - RNA, 63 nt, Homo Sapiens
ugagugaagcucccuucaggugugaaugaagcuaaugugaaugguugaaugacugacccaaaa

SEQ ID NO: 450777 - RNA, 63 nt, Homo Sapiens
aagcuaaugugaaugugaguaugacugacccaaaaugugaaugauuugacacacaguuguuga

SEQ ID NO: 450778 - RNA, 63 nt, Homo Sapiens
uuaaaugaccugcaucaaguuagacacugugcuaaugugaauuucuguauuaucaauuucuca

SEQ ID NO: 450779 - RNA, 63 nt, Homo Sapiens
cuggcccagcuugcuggaaaugaaaaguaaauuaaugugaaacuucauuuucuguauuauaua

SEQ ID NO: 450780 - RNA, 63 nt, Homo Sapiens
acauaggaaaauucauacuggagagaaacuacaaaugugaagaauguguuaaagccuuuaaca

SEQ ID NO: 450781 - RNA, 63 nt, Homo Sapiens
guugagaaaauucguacuggagagaauccuacaaaugugaaaaauguggcaaauccuuuaacu

SEQ ID NO: 450782 - RNA, 63 nt, Homo Sapiens
auaagaaaauucauacuggaaagaaacccuacaaaugugaagucuguggcaaagcuuuuaacu

SEQ ID NO: 450783 - RNA, 63 nt, Homo Sapiens
uaagacaguuuauacuuugagagaaacccugcaaaugugaauaauguggcaauacuuuaaacc

SEQ ID NO: 450784 - RNA, 63 nt, Homo Sapiens
cuaacauaaaucauacuggugaaaaauccuagaaaugugaaaaauaucacaaagccuuuaaau

SEQ ID NO: 450785 - RNA, 63 nt, Homo Sapiens
auaagaaaauuuacacuagagagaaagccuacaaaugugaagaauguggcaaagccuuuaacc

SEQ ID NO: 450786 - RNA, 63 nt, Homo Sapiens
auaagauaauucauagcggagagaaaccccacaaaugugaagaauguggcagagcuuuuaacc

SEQ ID NO: 450787 - RNA, 63 nt, Homo Sapiens
auaagauaauucacaguggagaaaaacccuacaaaugugaagaauguggcaaagcuuuuaacc

SEQ ID NO: 450788 - RNA, 63 nt, Homo Sapiens
auaagaaaauucauaguaaagagaaacccuacaaaugugaacaguguggcaaggucuuuaaga

SEQ ID NO: 450789 - RNA, 63 nt, Homo Sapiens
acaagaagauucauacuagagagaaacccuacaaaugugaagaauguggcauaucuuuuaacc

SEQ ID NO: 450790 - RNA, 63 nt, Homo Sapiens
auaagaugauucacacuugaaugaaacccuacaaaugugaacgauguggcaguuguuuuaacu

SEQ ID NO: 450791 - RNA, 63 nt, Homo Sapiens
auaagaaaauucaaacuggagagaaacucuacaaaugugaagaauguggcaaagcuuuuaacc

SEQ ID NO: 450792 - RNA, 63 nt, Homo Sapiens
caccuaaaauucaugcaggagagaaacaccacaaaugugaaaaauuugguaaauucuuuaaca

SEQ ID NO: 450793 - RNA, 63 nt, Homo Sapiens
uccauacuagagagaagcccuacaaauguaaagaaugugaaaagucuuucagucagagcucaa

SEQ ID NO: 450794 - RNA, 63 nt, Homo Sapiens
auaaaagaauacacacuagagaaaaaccuuacaaaugugaagcaucugauaaauccugugaag

SEQ ID NO: 450795 - RNA, 63 nt, Homo Sapiens
uucacaugggaauaaaauuccauugcugcaaugaaugugaaaaagccaucagucaaagaaacu

SEQ ID NO: 450796 - RNA, 63 nt, Homo Sapiens
acuguuugagaaugaugcuacucugaucuaaugaaugugaacauguagauguuuuguguguau

SEQ ID NO: 450797 - RNA, 63 nt, Homo Sapiens
acacacuuguauauacauucuugagaacacugcaaugugaaaaucacguuugcuauuuauaaa

SEQ ID NO: 450798 - RNA, 63 nt, Homo Sapiens
agaaaacacugacuuuguuuuuauaaguuauuaaaugugaaauugaucugcaucagcuuauuu

SEQ ID NO: 450799 - RNA, 63 nt, Homo Sapiens
gaaaacauuuguaaggcugcaacauaauauuaaaaugugaauaaauaaauguucugauaaaau

SEQ ID NO: 450800 - RNA, 63 nt, Homo Sapiens
cuuuaaugaaagguggaaaauaauuuaacuuacaaugugaaaauacaaugugaaauguacaau

SEQ ID NO: 450801 - RNA, 63 nt, Homo Sapiens
uggaaaauaauuuaacuuacaaugugaaaauacaaugugaaauguacaauaaaucauauuuau

SEQ ID NO: 450802 - RNA, 63 nt, Homo Sapiens
uauaugccacuaauaaaaugaaucuaaacauugaaugugaauggcccucagaaaaucaucuag

SEQ ID NO: 450803 - RNA, 63 nt, Homo Sapiens
gucauauacuauugauccuuuggcacuuaaauaaaugugaaauccuccaggaauuuuccugug

SEQ ID NO: 450804 - RNA, 63 nt, Homo Sapiens
gaaaauguguuuacuucagaacggcacuacauaaaugugaaaaguuguugaucuugaaauauc

SEQ ID NO: 450805 - RNA, 63 nt, Homo Sapiens
uugacuuuaaugaaucuuugguguggaaugaaaaaugugaacuucuuacucauagugugguuu

SEQ ID NO: 450806 - RNA, 63 nt, Homo Sapiens
gaaucaaguaauucugcuuacuagagguccagcaaugugaaaaacggaaaauuuacaagcaac

SEQ ID NO: 450807 - RNA, 63 nt, Homo Sapiens
acugauaggcuuuuaagcuuugauuuaaauuugaaugugaaaugaauuuacugguauacuaag

SEQ ID NO: 450808 - RNA, 63 nt, Homo Sapiens
aauuugccagacagagaucagaauugaaccgucaaugugaaauaaagaguucuccuuguacuu

SEQ ID NO: 450809 - RNA, 63 nt, Homo Sapiens
uauguaaacaucauaaauaguaaauaaugauucaaugugaauuuuaaaaugcaaauauugcua

SEQ ID NO: 450810 - RNA, 63 nt, Homo Sapiens
gcgagccacggcagcccccuguaucuggauuguaaugugaaucuuuaggguaauuccuccagu

SEQ ID NO: 450811 - RNA, 63 nt, Homo Sapiens
ccaaacaggauuaacugugaagacuaauuuauaaaugugaaccuaagaaaacuccaccucuga

SEQ ID NO: 450812 - RNA, 63 nt, Homo Sapiens
uauaccaaauaaaguuucuaucuauauaccaaaaaugugaaguugcauuaagaaaauaaaauu

SEQ ID NO: 450813 - RNA, 63 nt, Homo Sapiens
auuuauauauugcacauucucuguuaauuuuuuaaugugaauauuuacugcauaugaggcuuu

SEQ ID NO: 450814 - RNA, 63 nt, Homo Sapiens
ugggaacaaaccucacuugagcugugccuagacaaugugaauuccuguguugcuaacagaagu

SEQ ID NO: 450815 - RNA, 63 nt, Homo Sapiens
acauuucuggaacauggauuuguguucaccuuaaaugugaaaauaaauccuauuuucuaugga

SEQ ID NO: 450816 - RNA, 63 nt, Homo Sapiens
auaugauuuuuaagagauuuauguucuacuuaaaaugugaauuguacuucugagcugccuuaa

SEQ ID NO: 450817 - RNA, 63 nt, Homo Sapiens
gcugugcacuugccuuguugcugaaguuccaauaaugugaaaaccaaaguagagguuuuuuuc

SEQ ID NO: 450818 - RNA, 63 nt, Homo Sapiens
ucauguuuuuucaaaucugugguuauuguaaucaaugugaauaaacguuacaaucauuuuuag

SEQ ID NO: 450819 - RNA, 63 nt, Homo Sapiens
aaauuacauagauggguguuaugcaggggagaaaaugugaauugaaacucucaagggaaggug

SEQ ID NO: 450820 - RNA, 63 nt, Homo Sapiens
ucauuaacaguuuguccuuaggaugcaaaugaaaaugugaauacauaccuuguuguacuguug

SEQ ID NO: 450821 - RNA, 63 nt, Homo Sapiens
uuaaucauaagccuuaauaagauuuuucuaagaaaugugaaauagaacaauuuucaucuaauu

SEQ ID NO: 450822 - RNA, 63 nt, Homo Sapiens
gagcuaguuuacaggcuuacugugauuuaagcaaaugugaaaagugaaaccuuaauuuuauca

SEQ ID NO: 450823 - RNA, 63 nt, Homo Sapiens
ggguuuccugaaacuggguuaauucuuuauagaaaugugaacacugaauuuauuuuaaaaaau

SEQ ID NO: 450824 - RNA, 63 nt, Homo Sapiens
ccuggugucuccugcccacccuggucccagguaaaugugaauggagacagguaugagaggcug

SEQ ID NO: 450825 - RNA, 63 nt, Homo Sapiens
ggugauaacugccucguuuaaauggucacaagaaaugugaagagagagcuagggcagacaugc

SEQ ID NO: 450826 - RNA, 63 nt, Homo Sapiens
auauuauuuggcuagaaauugcuguuuuuaauaaaugugaauuuuuuaaaaauaaagauuuuu

SEQ ID NO: 450827 - RNA, 63 nt, Homo Sapiens
gaaauuaaaacuuucuucauguaaacaauguuuaaugugaaaaauuucuguuagcugauugug

SEQ ID NO: 450828 - RNA, 63 nt, Homo Sapiens
cuguuaguguugacuaaagaguugacuagcugaaaugugaauuguuaaauauuuauaugcuuu

SEQ ID NO: 450829 - RNA, 63 nt, Homo Sapiens
cuuacucaacuugcuuuuuucauauagugucugaaugugaaguucauuuuuugaagcuuucua

SEQ ID NO: 450830 - RNA, 63 nt, Homo Sapiens
uauauucucaaguuuauuuuaucuggccuuagaaaugugaaguaaaagaauaaguauucuugc

SEQ ID NO: 450831 - RNA, 63 nt, Homo Sapiens
uuccacaaaauauccaacuugcagcugacaaaaaaugugaaauuuuuuuuggguaacaauccc

SEQ ID NO: 450832 - RNA, 63 nt, Homo Sapiens
uuuuugcuuauucauugaauaauaguaaugauaaaugugaacauagccagaaagcaaaaaaac

SEQ ID NO: 450833 - RNA, 63 nt, Homo Sapiens
gaauaagagcuuuuuuguuucuuggguuuuuaaaaugugaaucugcaaugaucauaaaaauua

SEQ ID NO: 450834 - RNA, 63 nt, Homo Sapiens
aaaaugugaaucugcaaugaucauaaaaauuaaaaugugaaugucaacaauaaaaagcaagac

SEQ ID NO: 450835 - RNA, 63 nt, Homo Sapiens
uguagacugccauuauguguggucuucccauuaaaugugaacauuuuaauauguaugcauuca

SEQ ID NO: 450836 - RNA, 63 nt, Homo Sapiens
ccacuccugcuuuccuaaggaugaaacagugauaaugugaacucaaaugagguuuccugggua

SEQ ID NO: 450837 - RNA, 63 nt, Homo Sapiens
cauguugcagaagaccagaucauuuuuauacagaaugugaaauacugauacaguuauucuuuu

SEQ ID NO: 450838 - RNA, 63 nt, Homo Sapiens
aguaaaaaugaaauaacugguuuguuugcugaaaaugugaaauaaacccuguuugcaccucga

SEQ ID NO: 450839 - RNA, 63 nt, Homo Sapiens
aaacccuguuugcaccucgacaguuaauauauuaaugugaaauuauuuauuugacaaaaaauc

SEQ ID NO: 450840 - RNA, 63 nt, Homo Sapiens
auaagauaauuaaugcuggagagaaacccuacaaaugugaagaauguggcaaagauuucuauu

SEQ ID NO: 450841 - RNA, 63 nt, Homo Sapiens
auaaaauaauucauaaaggagauaaauuauacaaaugugaagaauguggcaaagcuuuuaaca

SEQ ID NO: 450842 - RNA, 63 nt, Homo Sapiens
auaagauaauuuauacuggagagaagcccuacaaaugugaaaaauguggcaaaccuuuuaacc

SEQ ID NO: 450843 - RNA, 63 nt, Homo Sapiens
auuagauaauucaugcuggagagaaacccuacaaaugugaaaaauguggcaaagcuuuuaacc

SEQ ID NO: 450844 - RNA, 63 nt, Homo Sapiens
auaagauaacucauacuggagaaaaaucuuacaaaugugaagaauguggcaaagccuuuaucc

SEQ ID NO: 450845 - RNA, 63 nt, Homo Sapiens
acaaaauaauucauacaggagagaaacccuacaaaugugaagaaugugacaaagccuuuaacc

SEQ ID NO: 450846 - RNA, 63 nt, Homo Sapiens
uaaacauaauucauaauggagaaaaacccuacaaaugugaagaaugugucaaagcuuuuaacu

SEQ ID NO: 450847 - RNA, 63 nt, Homo Sapiens
acauaagggaauucauaauagagaaacccuacaaaugugaagaacguggccuggcuuuuaaca

SEQ ID NO: 450848 - RNA, 63 nt, Homo Sapiens
uuaaagaaaaucauucugcugaaaaauccuagaaaugugaagaaugugaaaaagccuuuaaau

SEQ ID NO: 450849 - RNA, 63 nt, Homo Sapiens
aucauucugcugaaaaauccuagaaaugugaagaaugugaaaaagccuuuaaaugauugucac

SEQ ID NO: 450850 - RNA, 63 nt, Homo Sapiens
augugacaaagccuuuaaaugagaaauccuagaaaugugaagaauaaaagaaaucauaugaau

SEQ ID NO: 450851 - RNA, 63 nt, Homo Sapiens
auguggcaagccuuuuagcugggaaacccuacaaaugugaagaauaagggaauuuauacagga

SEQ ID NO: 450852 - RNA, 63 nt, Homo Sapiens
acguggcaaagcuuuucauugaaaagcccuacaaaugugaaaauaaaagaauucauacuggag

SEQ ID NO: 450853 - RNA, 51 nt, Homo Sapiens; identical to SEQ ID NO: 250138

SEQ ID NO: 450854 - RNA, 63 nt, Homo Sapiens
aggaccagcgcaaugaaugccucagggcguuugaaugugaauuuguauccuguuagcuccauu

SEQ ID NO: 450855 - RNA, 63 nt, Homo Sapiens
uuaucuuaugagacucuguuuauguacccucgaaaugugaauguguauucucaguaguuccga

SEQ ID NO: 450856 - RNA, 63 nt, Homo Sapiens
auaauuccuauggacacuccacuuuuccugauuaaugugaaaaggauggggccuggaaaggca

SEQ ID NO: 450857 - RNA, 63 nt, Homo Sapiens
gaaaauauuuccugacuugaguguuccuuuuuaaaugugaauuuuuauuucuuuuuaauuauu

SEQ ID NO: 450858 - RNA, 63 nt, Homo Sapiens
aaaaauggaaaaaaacauaaaaagcagaauuuuaaugugaagacauuuuuugcuauaaucauu

SEQ ID NO: 450859 - RNA, 63 nt, Homo Sapiens
aacuuaugaauaaaaggaaaaagguauacuuacaaugugaaguucguguccuccuuauuuaaa

SEQ ID NO: 450860 - RNA, 63 nt, Homo Sapiens
gauccagaaauaagugcuguggguuauaauuugaaugugaacuauucuugagaaaaagauaaa

SEQ ID NO: 450861 - RNA, 63 nt, Homo Sapiens
aaauaagaugguguguauguaagaaauuuguaaaaugugaagagcuaucuacacuaaguucgu

SEQ ID NO: 450862 - RNA, 63 nt, Homo Sapiens
ggggggacuaugagaucaaaauauuuuuauuauaaugugaagacauugucuuuucacucuauc

SEQ ID NO: 450863 - RNA, 63 nt, Homo Sapiens
ucagaaaugacuuggccucauuuuggauuucauaaugugaaguauucaugauuuugaacuggu

SEQ ID NO: 450864 - RNA, 63 nt, Homo Sapiens
accauggcaguaauggggcaaacaauaaaaugcaaugugaaaugauuugaugauuugggaaau

SEQ ID NO: 450865 - RNA, 63 nt, Homo Sapiens
ccaucuuuuaugacugcaacgcuuucuaaaaugaaugugaauguuuuuuacaucuacguuguu

SEQ ID NO: 450866 - RNA, 63 nt, Homo Sapiens
gucuucauucaauguuaaaccacuugaaacauaaaugugaaauguuuagccuucuaauuaguu

SEQ ID NO: 450867 - RNA, 64 nt, Homo Sapiens
augugggagugcuacagcaggaaggguuugagaagaacccaacauuuuaaagcuaaacaaugga

SEQ ID NO: 450868 - RNA, 64 nt, Homo Sapiens
cuuggacuucagccuccagagaaggcccucaccagaacccaacccagcagucuacaggcuggaa

SEQ ID NO: 450869 - RNA, 64 nt, Homo Sapiens
gcaagggcuugauggugacaggcucccgaagaaugaacccaagaccccauagauaggccccugg

SEQ ID NO: 450870 - RNA, 64 nt, Homo Sapiens
ugcacacuccaggccucuagaagacuguaaauacgaacccaaucuccagagaaacccagggagg

SEQ ID NO: 450871 - RNA, 64 nt, Homo Sapiens
acccagcccagaucggaggacaaguuccucucuagaacccaauccaauuuggagccccagccca

SEQ ID NO: 450872 - RNA, 64 nt, Homo Sapiens
acccaauccaauuuggagccccagcccaacuccagaacccaacccuucucuagaauccagccca

SEQ ID NO: 450873 - RNA, 64 nt, Homo Sapiens
uuuauuuaaaauuuuuuugccaauggugccaaguaaugugaaugcuaauacugcuuaagaaaau

SEQ ID NO: 450874 - RNA, 64 nt, Homo Sapiens
guguucucuucuguuacugauauguaaguguggcaaugugaacugaagcugaugggcugagaac

SEQ ID NO: 450875 - RNA, 64 nt, Homo Sapiens
cuggccagagccaagaaacacuuucagaaaaacaaaugugaaggggagagacaggggccgcccu

SEQ ID NO: 450876 - RNA, 64 nt, Homo Sapiens; identical to SEQ ID NO: 250015

SEQ ID NO: 450877 - RNA, 64 nt, Homo Sapiens; identical to SEQ ID NO: 250016

SEQ ID NO: 450878 - RNA, 64 nt, Homo Sapiens; identical to SEQ ID NO: 250017

SEQ ID NO: 450879 - RNA, 64 nt, Homo Sapiens
gaacuccugauguuuuuucuacaaaaguccauaaaaugugaaaacuggagaagaucuuagaggu

SEQ ID NO: 450880 - RNA, 64 nt, Homo Sapiens
gucggcuugugaaaaguuguuaaacaacaugcuaaaugugaaaugucaacccucacucuaaacu

SEQ ID NO: 450881 - RNA, 64 nt, Homo Sapiens; identical to SEQ ID NO: 250018

SEQ ID NO: 450882 - RNA, 64 nt, Homo Sapiens; identical to SEQ ID NO: 250019

SEQ ID NO: 450883 - RNA, 64 nt, Homo Sapiens
gauuucauuaccuccuacuugccauucacccaucaaugugaaagucagggucacagcuggucug

SEQ ID NO: 450884 - RNA, 64 nt, Homo Sapiens
uuuacuuucuuccuugccuaugcagggcaaacaaaaugugaaauucugcccucagcugagcuga

SEQ ID NO: 450885 - RNA, 64 nt, Homo Sapiens; identical to SEQ ID NO: 250020

SEQ ID NO: 450886 - RNA, 64 nt, Homo Sapiens; identical to SEQ ID NO: 250021

SEQ ID NO: 450887 - RNA, 64 nt, Homo Sapiens
uuaaaguucauuauuuauuuuaccuuuuacugacaaugugaaacucgaagaaaauguucucuuu

SEQ ID NO: 450888 - RNA, 64 nt, Homo Sapiens
cuguuaacauauguucggacugcuucccuucaccaaugugaacaacuuuuuuucccaaacagug

SEQ ID NO: 450889 - RNA, 64 nt, Homo Sapiens
caguguaaaguuuaacacgguuugacaguaaauaaaugugaauuuuuucaaguaguuaacaugu

SEQ ID NO: 450890 - RNA, 64 nt, Homo Sapiens
aaauuagaguaccaacuuaauguuuuucucgaagaaugugaaaauaauuagaccuguuaaauua

SEQ ID NO: 450891 - RNA, 64 nt, Homo Sapiens
uuguuuuguuuuguuuuucucuuucacucagccaaaugugaaaguugugaauuuaggaaaauca

SEQ ID NO: 450892 - RNA, 64 nt, Homo Sapiens
uugcaauuugaaauauauucugguuguuuuucuaaaugugaagacuuaccaaaugaauuuuaga

SEQ ID NO: 450893 - RNA, 64 nt, Homo Sapiens
caacuuuccaggaagaaaagagggcaaagggaacaaugugaaaagaagcagaaaaucauaaaag

SEQ ID NO: 450894 - RNA, 64 nt, Homo Sapiens; identical to SEQ ID NO: 250022

SEQ ID NO: 450895 - RNA, 64 nt, Homo Sapiens; identical to SEQ ID NO: 250023

SEQ ID NO: 450896 - RNA, 64 nt, Homo Sapiens
agaagcugaggauccucacaggagcagacagagaaaugugaagggugggguuuuauguguggga

SEQ ID NO: 450897 - RNA, 64 nt, Homo Sapiens
aagagacuugccuuuuaaggaucgaaaguacgccaaugugaauuuccauuauuuucaauggaag

SEQ ID NO: 450898 - RNA, 64 nt, Homo Sapiens
aggcuuuggaaauuuaauguuaguugaaauguaaaaugugaaaacuuuagaucauuuguaguaa

SEQ ID NO: 450899 - RNA, 64 nt, Homo Sapiens
gugguuucuauauuuugagauguuuuuuccuuacaaugugaacucaucgugaucuuggaaauca

SEQ ID NO: 450900 - RNA, 64 nt, Homo Sapiens; identical to SEQ ID NO: 250024

SEQ ID NO: 450901 - RNA, 64 nt, Homo Sapiens; identical to SEQ ID NO: 250025

SEQ ID NO: 450902 - RNA, 64 nt, Homo Sapiens
aaggauacaguuuguuuuuagauguccuuuguccaaugugaacauuuauucauauuguuuugau

SEQ ID NO: 450903 - RNA, 64 nt, Homo Sapiens
uuuuuggugccuuacuuuuaucuuaauuuuugccaaugugaaaauuaaggauaaaucagaguua

SEQ ID NO: 450904 - RNA, 64 nt, Homo Sapiens
ugaauuuuggguuaaagguuuuggcugcuguaagaaugugaauuugaauguauuuugaauugua

SEQ ID NO: 450905 - RNA, 64 nt, Homo Sapiens
uuuuugcugguuaaccuuuaucauuuaucuuuguaaugugaacaugcuucagaguguaccuuuu

SEQ ID NO: 450906 - RNA, 64 nt, Homo Sapiens
cuaauucccuuuuucuaaggcacagagcugguaaaaugugaaguaauagugaaccuaacaguca

SEQ ID NO: 450907 - RNA, 64 nt, Homo Sapiens
cuccggauguugaaacaaccacaggucaagaaggaaugugaaucuguuguuuuauaagaguuua

SEQ ID NO: 450908 - RNA, 64 nt, Homo Sapiens
auuaggaggaucuagggacagaaggaaagugaaaaaugugaaaauacaaaauacccaagauuua

SEQ ID NO: 450909 - RNA, 64 nt, Homo Sapiens
ugcagcuucagcaguguugaacuguguguuuaaaaaugugaauuacuguuauuguauacuguaa

SEQ ID NO: 450910 - RNA, 64 nt, Homo Sapiens
cggcgucggcgcggggccagacugaagaagugugaaugugaaggccaugcaguguugcgguggc

SEQ ID NO: 450911 - RNA, 64 nt, Homo Sapiens
ggucugauuggcugcuuaaagucauuuuuuuagaaaugugaagaagcucuggugcuuuaguuag

SEQ ID NO: 450912 - RNA, 64 nt, Homo Sapiens
uggaauauuaccugugucauucuugguaccuggaaaugugaaucuugugccauuuagagggaac

SEQ ID NO: 450913 - RNA, 64 nt, Homo Sapiens
aacuucuugucuuuuuuucuggggggaggucuguaaugugaaaccaaguauuaggcuuuggggu

SEQ ID NO: 450914 - RNA, 63 nt, Homo Sapiens
uaaauacuguaccuuuauugaaugcauuauuuugaaugugaaggccgugaugcucaggcuuga

SEQ ID NO: 450915 - RNA, 64 nt, Homo Sapiens
cuacuaccacgaccuccccaacccacauccacucaaugugaacuaccaccuucccugacucaga

SEQ ID NO: 450916 - RNA, 64 nt, Homo Sapiens
ggagaggccgagcagcagccgaagugauuuugugaaugugaaguagacugcuuguuuugcacaa

SEQ ID NO: 450917 - RNA, 64 nt, Homo Sapiens
auauuugaaaacucaaugaauuucuaaguauaagaaugugaagauguuugggguuacuucuuug

SEQ ID NO: 450918 - RNA, 64 nt, Homo Sapiens
acaugccaguuuuuaaaauggcuuggggguuuucaaugugaaacucuccaccagccccucacag

SEQ ID NO: 450919 - RNA, 64 nt, Homo Sapiens; identical to SEQ ID NO: 250026

SEQ ID NO: 450920 - RNA, 64 nt, Homo Sapiens; identical to SEQ ID NO: 250027

SEQ ID NO: 450921 - RNA, 64 nt, Homo Sapiens
ucucccguauuucauuucugacaggucucuguguaaugugaagcucaauaaccaggugugagcu

SEQ ID NO: 450922 - RNA, 64 nt, Homo Sapiens
cugucauuacagacaacaggguuuggagaaagggaaugugaaagcuuuaauuuggauccuuugg

SEQ ID NO: 450923 - RNA, 64 nt, Homo Sapiens
agauaaaaagugaacuaucuuucuccagcuauagaaugugaauguaucuaaaugggauuuugag

SEQ ID NO: 450924 - RNA, 64 nt, Homo Sapiens
aacuuguuuuauaaaaagcaauuaguuuuucuaaaaugugaauaaggccauuuccuguccugga

SEQ ID NO: 450925 - RNA, 64 nt, Homo Sapiens
aggaccuggucaguuugaaauucugcuaguucaaaaugugaauugaaauugauuugcugaauuu

SEQ ID NO: 450926 - RNA, 64 nt, Homo Sapiens
ugccuaguaagcacuuugucucaaauucugugugaaugugaacuggauuagauaauagaugggg

SEQ ID NO: 450927 - RNA, 64 nt, Homo Sapiens
uaaucauuuggacaacucaacaugggaauagcuuaaugugaagaaaugugugaggcaaacuaug

SEQ ID NO: 450928 - RNA, 64 nt, Homo Sapiens
uugucuaaguacuguaauccagucuuuuaaaguaaaugugaaccgauuugcauuaaaauauaga

SEQ ID NO: 450929 - RNA, 64 nt, Homo Sapiens
gucauagguguucaaaagcgcaagaucauauucuaaugugaaaucuuuccccuccacuugcugc

SEQ ID NO: 450930 - RNA, 64 nt, Homo Sapiens
acuaaugugucucaggcucaacaugacgugguaaaaugugaaaauaugggggaaaauuauuuug

SEQ ID NO: 450931 - RNA, 64 nt, Homo Sapiens
caaagauuauagucauuguaaaacuguaaagugcaaugugaaauucaauaauucuacagaaaua

SEQ ID NO: 450932 - RNA, 64 nt, Homo Sapiens
cuauguucugggaaaauccauugcuguuuucaauaaugugaauguguuuuaggaaaagugaauc

SEQ ID NO: 450933 - RNA, 64 nt, Homo Sapiens
uuuggaaaguuauaaaggugaagaccauuuacuuaaugugaaguagucuucucaaguuucaagc

SEQ ID NO: 450934 - RNA, 64 nt, Homo Sapiens
aaaaauuuuggaacaauuagaaauuuuguaaaguaaugugaauucauuuucaguauuuuaaaua

SEQ ID NO: 450935 - RNA, 64 nt, Homo Sapiens
agcugccauuggugggaaucuauggaaucugacaaaugugaauggcuucccugugaguaaugcu

SEQ ID NO: 450936 - RNA, 64 nt, Homo Sapiens
uaagaugaacuaaacaaacauauugaaucagagaaaugugaagacacacacugguccugcagcu

SEQ ID NO: 450937 - RNA, 64 nt, Homo Sapiens
cagcagcuacugacugaauaaccacuuuuaaaggaaugugaaauuuaaauaauagacauacaga

SEQ ID NO: 450938 - RNA, 64 nt, Homo Sapiens
uggggcccccaucggagcccugcaaauuccgagaaaugugaaacuugguggggucagggaggaa

SEQ ID NO: 450939 - RNA, 64 nt, Homo Sapiens
uaauaggaauccuuuuuuuuuuuuuuaaagacuaaaugugaaaaaauaaucacuacuuaagcua

SEQ ID NO: 450940 - RNA, 64 nt, Homo Sapiens
agcugacucuuugcucuaauuuuggaaaaaaagaaaugugaagggucaacuccaacguaugugg

SEQ ID NO: 450941 - RNA, 64 nt, Homo Sapiens
auauuacguuguuucuuauagauuuuuuaaaaaaaaugugaaauuuuuccacacuauguguguu

SEQ ID NO: 450942 - RNA, 64 nt, Homo Sapiens
aguuucaaaaauuaaagaccuacaucacaggguuaaugugaagaaagcuuuauuuuucaaauga

SEQ ID NO: 450943 - RNA, 64 nt, Homo Sapiens
agcaugaauuuguaaugucuugagcucuauuaugaaugugaagccuuccccuuauccucccugu

SEQ ID NO: 450944 - RNA, 64 nt, Homo Sapiens
aaugcuugccaguacugccaaagcacugcugugaaaugugaaguacuuuguuuuuuuauuuuua

SEQ ID NO: 450945 - RNA, 64 nt, Homo Sapiens
agaagaugcagguuuaagaaguuaauauuuauaaaaugugaaagacacaguuacuaggauaacu

SEQ ID NO: 450946 - RNA, 64 nt, Homo Sapiens
caaaguugaaaugcaaaaauacuaauuagagaauaaugugaauaaaaugggaaucuucuuggua

SEQ ID NO: 450947 - RNA, 64 nt, Homo Sapiens
uuguguucuaaguggaaggagaguuacugaagggaaugugaauuuuuaccguuuguacuuaaga

SEQ ID NO: 450948 - RNA, 64 nt, Homo Sapiens
auuucuggcagugugggauggaugaaugaaguggaaugugaacuuugggcaaguuaagugggac

SEQ ID NO: 450949 - RNA, 64 nt, Homo Sapiens
aguagugaacuuauuuucaguagacauagaaaacaaugugaauauuuaaggucugugacuauag

SEQ ID NO: 450950 - RNA, 64 nt, Homo Sapiens
cuguuauuauuaacauuuauuuauuauuuuucuaaaugugaaagcaauacauaauuuagggaaa

SEQ ID NO: 450951 - RNA, 64 nt, Homo Sapiens
agaacuugcguucuguuaauggugccgaaauaacaaugugaaccugagacuggccugcaugaau

SEQ ID NO: 450952 - RNA, 64 nt, Homo Sapiens
cauggagccuuuacagaagcaucacauuuaaaccaaugugaauucaaaaaagagaaggaaacuu

SEQ ID NO: 450953 - RNA, 64 nt, Homo Sapiens
caacccuccccugcaaguuuguagcucaaguuguaaugugaaagucauauuuuauuuguggcau

SEQ ID NO: 450954 - RNA, 64 nt, Homo Sapiens; identical to SEQ ID NO: 250028

SEQ ID NO: 450955 - RNA, 64 nt, Homo Sapiens; identical to SEQ ID NO: 250029

SEQ ID NO: 450956 - RNA, 64 nt, Homo Sapiens
uaacauguugcuuuguauaaaaaucuuauuuauaaaugugaagcuuuuugaugccaucaaaacu

SEQ ID NO: 450957 - RNA, 64 nt, Homo Sapiens
uucagacuucguggguuuuguuuuuaagcaaaacaaugugaaaacauuuaaguuugaaauguug

SEQ ID NO: 450958 - RNA, 64 nt, Homo Sapiens
ccaggaguccugggucccuggccuccaaagcuggaaugugaacgcaugccacgguggucugacc

SEQ ID NO: 450959 - RNA, 64 nt, Homo Sapiens
guucugcccaguuucugagcuuaucuucugucagaaugugaaaaauauuuuuuagacuuaaguu

SEQ ID NO: 450960 - RNA, 55 nt, Homo Sapiens
uguaucugaguauugaaugaaacacaaugugaaaagucauuuagcccaaaacuaa

SEQ ID NO: 450961 - RNA, 64 nt, Homo Sapiens
auaaggcacguuuucacacagccuuauuuucaaaaaugugaaaugaggaaaaaaaaguauggag

SEQ ID NO: 450962 - RNA, 64 nt, Homo Sapiens
ugccagugacugcugcgcuggccaaucccaccauaaugugaauaggaggggcaggccuuuuuga

SEQ ID NO: 450963 - RNA, 64 nt, Homo Sapiens
cagagucuauuuuucuaaauauagcccuggggugaaugugaaucucuccuugcugucaucccac

SEQ ID NO: 450964 - RNA, 64 nt, Homo Sapiens
uuuuacagaaucagacagauuuguucacauaaagaaugugaaauccugaauuucuuucagcuuu

SEQ ID NO: 450965 - RNA, 64 nt, Homo Sapiens
uguccuccuaggauaagguuaagagguuagacgcaaugugaaaccccaagauuaagaggccagg

SEQ ID NO: 450966 - RNA, 64 nt, Homo Sapiens
ccuguaaguguacauguaguaugaacugacauaaaaugugaaaggacaaguuguacauuugugu

SEQ ID NO: 450967 - RNA, 64 nt, Homo Sapiens
uuaaauaaaauuuaugugccuuccugauugugucaaugugaaagcuaccuuuucucagaauggu

SEQ ID NO: 450968 - RNA, 64 nt, Homo Sapiens
ugagcagccagaaaucuauugagcuuuccagugcaaugugaauucucaacuugccuugaugucu

SEQ ID NO: 450969 - RNA, 64 nt, Homo Sapiens
guauuuacauaaacgugcaacaaaugagaccagcaaugugaacuuuuuuccuucuaaacaagga

SEQ ID NO: 450970 - RNA, 64 nt, Homo Sapiens
uuuucuaacugccucguagguacagauuuguuaaaaugugaacgagcaaauuucuugugguuug

SEQ ID NO: 450971 - RNA, 64 nt, Homo Sapiens
gcuuugcuuuucacgugauuaugcagguucacuaaaugugaacauacccccccccccccaugaa

SEQ ID NO: 450972 - RNA, 64 nt, Homo Sapiens
gaugugcucccaccacaugcugucucuucuguaaaaugugaaaacaaccucucugagccucagu

SEQ ID NO: 450973 - RNA, 64 nt, Homo Sapiens
gagaaguauuuacauuggagacuguuucugugauaaugugaaauaggagugguuaguaaacugc

SEQ ID NO: 450974 - RNA, 64 nt, Homo Sapiens
ucuuuggagauucucuugaguuagaagauggaaaaaugugaagaaaaguuugucaauccuuguu

SEQ ID NO: 450975 - RNA, 64 nt, Homo Sapiens
aggauuaacauauuguaaauauugcgguaucaacaaugugaauaaaaaaaacaaauuguguuuu

SEQ ID NO: 450976 - RNA, 64 nt, Homo Sapiens
ggggaauggaggaauggaaagcacaaggguugugaaugugaaagcuugagagaaaaggaauguu

SEQ ID NO: 450977 - RNA, 64 nt, Homo Sapiens
gugacuauuuacauguauaccuuuagaaauagaaaaugugaagagcccugccuuuuacuagcua

SEQ ID NO: 450978 - RNA, 64 nt, Homo Sapiens
aucuucucaugcaauuauuuaaaaguuguaaauaaaugugaaacuagggauagguccuuggguc

SEQ ID NO: 450979 - RNA, 64 nt, Homo Sapiens
ugcugcguuuuguuuucuuucaguuccucgggaaaaugugaaugcccuguagagaucaucuuua

SEQ ID NO: 450980 - RNA, 64 nt, Homo Sapiens
ugaaaucgauaauaccacagucugugguuggggaaaugugaaaguacaaccugauggcauuaau

SEQ ID NO: 450981 - RNA, 64 nt, Homo Sapiens
gguucccauaccaugaaugcacaaaguaauuuuaaaugugaacauuacucuauuuuuaaagauc

SEQ ID NO: 450982 - RNA, 64 nt, Homo Sapiens
gucaaagacaugucagugcugguacuaaaaauaaaaugugaaauugagcacugacaaaggauau

SEQ ID NO: 450983 - RNA, 64 nt, Homo Sapiens
uuuccacuaauuuugcaugcguauuuauaagaaaaaugugaauuuggugguuuuauucuaucgg

SEQ ID NO: 450984 - RNA, 64 nt, Homo Sapiens
aaaaagaaauaauugaccaaguaaguuugcauaaaaugugaauacuaaauguguccccaguugc

SEQ ID NO: 450985 - RNA, 64 nt, Homo Sapiens
ccauuuaaacacauuugaaacauacaaaaauagaaaugugaaagcauuuggugaaagccaaagc

SEQ ID NO: 450986 - RNA, 64 nt, Homo Sapiens
ggcaggaagacuuccagcuuucucuuuguucuucaaugugaaacugagaccaagucucucuaag

SEQ ID NO: 450987 - RNA, 64 nt, Homo Sapiens
cuucucuuuuuaauggagauugaaaagggagaauaaugugaauaucacggcuuauauuauuaaa

SEQ ID NO: 450988 - RNA, 64 nt, Homo Sapiens
ccucaucaucccaggggagaacuacauugggauaaaugugaagaaggcuuuuaagguaggucau

SEQ ID NO: 450989 - RNA, 64 nt, Homo Sapiens
uguuuuuacagacaacaucgaguaauggcuuguaaaugugaauuuugccagaggugguuuuuga

SEQ ID NO: 450990 - RNA, 64 nt, Homo Sapiens
uccaauuugugggaacaggaggggagaggaaacaaaugugaaguuguggacucuacccaggcag

SEQ ID NO: 450991 - RNA, 64 nt, Homo Sapiens
aucuuugagaaucucauacaucugugaaaaagauaaugugaaauaaacaguaaaaaaaaaaagu

SEQ ID NO: 450992 - RNA, 64 nt, Homo Sapiens
cauacaggauuugaacucagaucugucugauaggaaugugaaagcacggacucuuacugcuaac

SEQ ID NO: 450993 - RNA, 64 nt, Homo Sapiens
gaaugaaaccucuguggcucuuucgaaacgugaaaaugugaagaaagcuacuaacuuagcugua

SEQ ID NO: 450994 - RNA, 64 nt, Homo Sapiens
caggagcugauggcucacugggcucuuggaggggaaugugaagaaaccaaggagucacuuuuuc

SEQ ID NO: 450995 - RNA, 64 nt, Homo Sapiens
uauauugugguagcauguucaaaauccaacaaguaaugugaauuuuagauguaaauaucugcca

SEQ ID NO: 450996 - RNA, 64 nt, Homo Sapiens
ccuuugguaccuuaauuugacuguccucgcagagaaugugaacauguguguguguuguguuaau

SEQ ID NO: 450997 - RNA, 64 nt, Homo Sapiens
gaaagguaacuuauuucucuucugcacagagcauaaugugaaguuuuauaccuacuuuuaaaau

SEQ ID NO: 450998 - RNA, 64 nt, Homo Sapiens
uucaggaggguuuuuaaaaaguguuuaaaugucaaaugugaauuggugaugggugauggagggu

SEQ ID NO: 450999 - RNA, 64 nt, Homo Sapiens
aucucuacuccucaugacaugaagaaaaagacugaaugugaagggaguuucuguacuguaagcu

SEQ ID NO: 451000 - RNA, 64 nt, Homo Sapiens
guguuugagugcuucagauacauuuuucagauacaaugugaagacauugaagauaugugguccu

SEQ ID NO: 451001 - RNA, 64 nt, Homo Sapiens
uuauuguacuccuuccuuggagcugaaugcaaggaaugugaauucugaggaauuaagguagaau

SEQ ID NO: 451002 - RNA, 64 nt, Homo Sapiens
uauguuuugauuuuuuuugcuacugugcaaguuuaaugugaauaaaaucuuuguggaaugauga

SEQ ID NO: 451003 - RNA, 64 nt, Homo Sapiens
ugccucuuccuccccaccccacugcccccaccuuaaugugaauuugacugaugaaugaagagcg

SEQ ID NO: 451004 - RNA, 64 nt, Homo Sapiens
gaauggcaagaauguucuaguaaauguguaccaaaaugugaauuacuuuguacgauuacagucu

SEQ ID NO: 451005 - RNA, 64 nt, Homo Sapiens
uguuucccauagggcauuaguucucagauuuuggaaugugaaauaaucaccuaggaaguugguu

SEQ ID NO: 451006 - RNA, 64 nt, Homo Sapiens
aaaauaccuuuuuuugcaucuuuuuucaaaguuuaaugugaacuuuuagaaaagugauuaaugu

SEQ ID NO: 451007 - RNA, 64 nt, Homo Sapiens
uuuucaaccuacuuucauacugaagaugcagcaaaaugugaaugggaaaagagauggccugaga

SEQ ID NO: 451008 - RNA, 64 nt, Homo Sapiens; identical to SEQ ID NO: 250030

SEQ ID NO: 451009 - RNA, 64 nt, Homo Sapiens; identical to SEQ ID NO: 250031

SEQ ID NO: 451010 - RNA, 64 nt, Homo Sapiens
uuuggcaauuugucuuuuaagucuuaaccuugcuaaugugaauacugggaaagugauuuuuucu

SEQ ID NO: 451011 - RNA, 64 nt, Homo Sapiens
gaagaaaaguaugugauuuuuaccuuuuuuaacaaaugugaaaaagucaguuuuagaaauuucg

SEQ ID NO: 451012 - RNA, 64 nt, Homo Sapiens
ugaaacuaauaauuugauccucuuaaauuccuacaaugugaaacuguguuaaaaaaaaaaaaaa

SEQ ID NO: 451013 - RNA, 64 nt, Homo Sapiens
uguaauuuuuaaaaaggcuaaaaguaacuguuaaaaugugaaauuguauuugcuuaaaugcugg

SEQ ID NO: 451014 - RNA, 64 nt, Homo Sapiens
acccuuccuacggggaaucuguggacccacuaugaaugugaauagccuccaggaagaugucuuu

SEQ ID NO: 451015 - RNA, 64 nt, Homo Sapiens; identical to SEQ ID NO: 250032

SEQ ID NO: 451016 - RNA, 64 nt, Homo Sapiens; identical to SEQ ID NO: 250033

SEQ ID NO: 451017 - RNA, 64 nt, Homo Sapiens
auacugaucuuauaucuguuuguauguuugugugaaugugaaugcacagucuuucuaaagugug

SEQ ID NO: 451018 - RNA, 64 nt, Homo Sapiens
gucuaaauaucuguucauaaacgugguuuuacaaaaugugaaauaauggaauuggagauuguag

SEQ ID NO: 451019 - RNA, 64 nt, Homo Sapiens
cugaugacaugguauaggagcaacucauuuggaaaaugugaacaguggacagaucaaggcacuu

SEQ ID NO: 451020 - RNA, 64 nt, Homo Sapiens
augugucuguaagauuguccuuuauuaaguucucaaugugaaaauuugacauuguauguaucua

SEQ ID NO: 451021 - RNA, 64 nt, Homo Sapiens
cuauuauggguagccuuuuuauaaauucauugaaaaugugaauuacucuauuugaugauaaacu

SEQ ID NO: 451022 - RNA, 64 nt, Homo Sapiens
acaaaaccaaggaguacauuuggagugcaaugagaaugugaaaccuguaagaauccugaggacc

SEQ ID NO: 451023 - RNA, 64 nt, Homo Sapiens
gaaagugcuugcugugaugugugugaaacccuacaaugugaaagagcucaguuggcuuugugaa

SEQ ID NO: 451024 - RNA, 64 nt, Homo Sapiens
uuuguaaauaguccaugaugaaaggaauacuuauaaugugaagggaaaggagggaaaaaccaua

SEQ ID NO: 451025 - RNA, 64 nt, Homo Sapiens
auuugauuuucuacauuuaagaagacacaaaucaaaugugaaggugagcacauuuuauaauuug

SEQ ID NO: 451026 - RNA, 64 nt, Homo Sapiens
agggaguauuacuuuuauguugcuucugagaggcaaugugaaagcacaaaauaugugaauuugc

SEQ ID NO: 451027 - RNA, 64 nt, Homo Sapiens
uuacauuuuauuaacacuuguuauuuuacugcacaaugugaaguaguagucagaaaccauggau

SEQ ID NO: 451028 - RNA, 64 nt, Homo Sapiens
augaauugagcuccuggcccuuucauccuauggaaaugugaaggcuuaaagggaacaaauaaug

SEQ ID NO: 451029 - RNA, 64 nt, Homo Sapiens
gccacaucuuaccuguaaaguggaguagaaaccaaaugugaauauagcccaaaaguaaucgcuc

SEQ ID NO: 451030 - RNA, 64 nt, Homo Sapiens
ucaucacucaagaugccuccggcuuaugagaucuaaugugaaaaaaagcugaagacaaccaaga

SEQ ID NO: 451031 - RNA, 64 nt, Homo Sapiens; identical to SEQ ID NO: 250034

SEQ ID NO: 451032 - RNA, 64 nt, Homo Sapiens; identical to SEQ ID NO: 250035

SEQ ID NO: 451033 - RNA, 64 nt, Homo Sapiens
cuuauaucccugaauucugaucucugcacuuuugaaugugaaaguuguuuguuaauguugggau

SEQ ID NO: 451034 - RNA, 64 nt, Homo Sapiens
uaaccauaucugacaaaauuaaguaacaacugaaaaugugaaagauacggcuuuggagacaauc

SEQ ID NO: 451035 - RNA, 64 nt, Homo Sapiens
caagucugagcacaaaaagaguauguagagacugaaugugaaguuuuaugauucuaaucaagcu

SEQ ID NO: 451036 - RNA, 64 nt, Homo Sapiens
uacaaagugcaguagacuucaguuuuuauuugagaaugugaaagaugcacacuuuauaaccuua

SEQ ID NO: 451037 - RNA, 64 nt, Homo Sapiens
agcuuugaguguuccuucguuaccucuguaguaaaaugugaaaauaauaaauaugucuaucaaa

SEQ ID NO: 451038 - RNA, 64 nt, Homo Sapiens
cccaaguuuagaugugcauuaagaguuggaugaaaaugugaaagcugaaaaaaaauaagaaaga

SEQ ID NO: 451039 - RNA, 64 nt, Homo Sapiens
ccggcagcggccgaccuaggccuugggaaggagaaaugugaaaccaaaccuccugcuucuccca

SEQ ID NO: 451040 - RNA, 64 nt, Homo Sapiens
caaguuaauuauuucaaaauuagaaaaugcauggaaugugaacaaaacccagggcuuaaccugc

SEQ ID NO: 451041 - RNA, 64 nt, Homo Sapiens; identical to SEQ ID NO: 250036

SEQ ID NO: 451042 - RNA, 64 nt, Homo Sapiens; identical to SEQ ID NO: 250037

SEQ ID NO: 451043 - RNA, 64 nt, Homo Sapiens
ucauacauguuauuaguuguccacuucuaaauuuaaugugaauuauaguccuaaucuuuacuau

SEQ ID NO: 451044 - RNA, 64 nt, Homo Sapiens
uuucauuuggaaucacagaaaaaucgggaaagaaaaugugaagaaugggaucugcugcugcauu

SEQ ID NO: 451045 - RNA, 64 nt, Homo Sapiens
ccaaagacuacguuuugcagauacugcugaagcaaaugugaaugacaaauauaagguuuuaauu

SEQ ID NO: 451046 - RNA, 64 nt, Homo Sapiens
augauaaaguugugaaauaaccgugucuuuuuagaaugugaauguuucagcugugucccccagu

SEQ ID NO: 451047 - RNA, 64 nt, Homo Sapiens
aaauuauuuuggauuuuguaagcaaaaaucugaaaaugugaauauuugcugaacaccuugugga

SEQ ID NO: 451048 - RNA, 64 nt, Homo Sapiens
ugcuuuuacauuugggcuuaugagauguuugauaaaugugaauaucccauaggugccacaucua

SEQ ID NO: 451049 - RNA, 64 nt, Homo Sapiens
ucuuuccuaucauggaaucuucuaguaaagcuggaaugugaagcguaaagggagugcuuuguga

SEQ ID NO: 451050 - RNA, 64 nt, Homo Sapiens; identical to SEQ ID NO: 250038

SEQ ID NO: 451051 - RNA, 64 nt, Homo Sapiens; identical to SEQ ID NO: 250039

SEQ ID NO: 451052 - RNA, 64 nt, Homo Sapiens; identical to SEQ ID NO: 250040

SEQ ID NO: 451053 - RNA, 64 nt, Homo Sapiens; identical to SEQ ID NO: 250041

SEQ ID NO: 451054 - RNA, 64 nt, Homo Sapiens
auuucugccagcgcauguguccuuucaaggggaaaaugugaagcugaacccccuccagacaccc

SEQ ID NO: 451055 - RNA, 64 nt, Homo Sapiens
cagcacaauauggccuaaacugccauaguuuuagaaugugaaaaaaaugcauguuuacuuaccu

SEQ ID NO: 451056 - RNA, 64 nt, Homo Sapiens
uccucccucuccuuaccacgggucagaccuaaagaaugugaacacuuuuuuuuuuuuuucuggg

SEQ ID NO: 451057 - RNA, 64 nt, Homo Sapiens
acuuagauuuuugaggauuaugugacuaguaauaaaugugaaauaaauuuucaaaaaaguugac

SEQ ID NO: 451058 - RNA, 55 nt, Homo Sapiens
aaaauccacacauugcaugaaauacaaugugaaagcuccuuuguauaucuuggua

SEQ ID NO: 451059 - RNA, 64 nt, Homo Sapiens
uccuuauuuucauuuccaaacaacuacuaugauaaaugugaagaagauucuguuuuuuugugac

SEQ ID NO: 451060 - RNA, 64 nt, Homo Sapiens
uuuagagccagaaguaacuuugucccaguccuacaaugugaaaagagugaauaguugccucuuu

SEQ ID NO: 451061 - RNA, 64 nt, Homo Sapiens
uauaugcacacacacacagauaaugcuuccagugaaugugaacuucuuuucccuguggcacuga

SEQ ID NO: 451062 - RNA, 64 nt, Homo Sapiens
gucauucguuagucuacauguuucuaaacauauaaaugugaauuuaaucaauuccuuucauagu

SEQ ID NO: 451063 - RNA, 64 nt, Homo Sapiens; identical to SEQ ID NO: 250042

SEQ ID NO: 451064 - RNA, 64 nt, Homo Sapiens; identical to SEQ ID NO: 250043

SEQ ID NO: 451065 - RNA, 64 nt, Homo Sapiens
guuacgggguugauucugaccauaggaaguaugcaaugugaaucacuauuuacagagaaaccua

SEQ ID NO: 451066 - RNA, 64 nt, Homo Sapiens; identical to SEQ ID NO: 250044

SEQ ID NO: 451067 - RNA, 64 nt, Homo Sapiens; identical to SEQ ID NO: 250045

SEQ ID NO: 451068 - RNA, 64 nt, Homo Sapiens
auucuugcacaaaagugaucguuuucuuccaaacaaugugaauuuaaaaggucacacaaaagaa

SEQ ID NO: 451069 - RNA, 64 nt, Homo Sapiens
gugggaaugugugaaaauaauuggauuuuuaaacaaugugaauaaagaggcuuguguuuugauu

SEQ ID NO: 451070 - RNA, 64 nt, Homo Sapiens
uuggauacaguguaaaccagauccauauaaggugaaugugaaaugggagucuucugagggugau

SEQ ID NO: 451071 - RNA, 64 nt, Homo Sapiens
aauagaaaaauugcauuggaauagauuuuauuuaaaugugaaccaucaacaaccuacaacaaga

SEQ ID NO: 451072 - RNA, 64 nt, Homo Sapiens
cuuguacaauuaacugaagaauugauaauaacugaaugugaaacaucaauaaagaccacuuaau

SEQ ID NO: 451073 - RNA, 64 nt, Homo Sapiens
ucccuggccagccuuuccacuuauuuuucuacucaaugugaauauguuuguauucaaaugacga

SEQ ID NO: 451074 - RNA, 64 nt, Homo Sapiens
auucuaccacccuuaaaguugaauccaacagacaaaugugaacuuaacuugucaaauagauccu

SEQ ID NO: 451075 - RNA, 64 nt, Homo Sapiens
gcugauuugauggagcuacucagacauuuucaauaaugugaacucuaaauuuguaccuauguga

SEQ ID NO: 451076 - RNA, 64 nt, Homo Sapiens; identical to SEQ ID NO: 250046

SEQ ID NO: 451077 - RNA, 64 nt, Homo Sapiens; identical to SEQ ID NO: 250047

SEQ ID NO: 451078 - RNA, 64 nt, Homo Sapiens
gauuucuggccuugaggacguaaauuauuucaugaaugugaauauuguacaaaaaagcuuauca

SEQ ID NO: 451079 - RNA, 64 nt, Homo Sapiens
agugaaaaagacuucgcagcuauuucacaucccaaaugugaagaacucuuauuuuucuguaaaa

SEQ ID NO: 451080 - RNA, 64 nt, Homo Sapiens
aaaauugaaauggaaaaugucaaacuuugggcauaaugugaacuugcauccacugaugaacaug

SEQ ID NO: 451081 - RNA, 64 nt, Homo Sapiens
uguguguggugucaaaguuuaaugcgggagguucaaugugaagcaugugauaugucugagacug

SEQ ID NO: 451082 - RNA, 64 nt, Homo Sapiens
agugucauacuuuugugauuaaauaauuaauaagaaugugaauaugugcaaugggauacuuauu

SEQ ID NO: 451083 - RNA, 64 nt, Homo Sapiens; identical to SEQ ID NO: 250048

SEQ ID NO: 451084 - RNA, 64 nt, Homo Sapiens; identical to SEQ ID NO: 250049

SEQ ID NO: 451085 - RNA, 64 nt, Homo Sapiens
uguuguacuauacguauaacguccuaaaauuaaaaaugugaaacauaucuuauacuuaguauga

SEQ ID NO: 451086 - RNA, 64 nt, Homo Sapiens
uggaaacaacuucuaguauuaaaccaggaaggaaaaugugaacaaaaauacaacucuuuuuuuu

SEQ ID NO: 451087 - RNA, 64 nt, Homo Sapiens
uugauguaauaacugcuaaucucuggauccucuaaaugugaauuuagaauuuucuaagacaguc

SEQ ID NO: 451088 - RNA, 64 nt, Homo Sapiens
uauucugacauuccuaaaauuuugaccaaaauacaaugugaauugacuuaaaaaggcucagguu

SEQ ID NO: 451089 - RNA, 64 nt, Homo Sapiens
cggguucuguaguauuuguaacacucaaccaaacaaugugaaaauacagaauugaaaaagauaa

SEQ ID NO: 451090 - RNA, 64 nt, Homo Sapiens
cccaaacuuuucuuuuuggcuacugaaacauuaaaaugugaauuucaauuugaguuguucaggc

SEQ ID NO: 451091 - RNA, 64 nt, Homo Sapiens
gaagaauggaucccaaaaacuauagguauuuuagaaugugaauucuaugugaagacucugcuaa

SEQ ID NO: 451092 - RNA, 64 nt, Homo Sapiens
aauaaaauacagcaaauacuccucaaauaggcuaaaugugaacagucaaaugaaguaguguuaa

SEQ ID NO: 451093 - RNA, 64 nt, Homo Sapiens
guuuaauaacaugaguccccgcuucuucaucuauaaugugaaggacacgcuuuacuaagccucg

SEQ ID NO: 451094 - RNA, 64 nt, Homo Sapiens
uccacucuuuuauuauguuguauuugugcauaccaaugugaaaauaacuguagcuuauauucuu

SEQ ID NO: 451095 - RNA, 64 nt, Homo Sapiens
uugcaagagaaugauuuccaaaguaugauauggaaaugugaaguugaaguaauagcguaaagua

SEQ ID NO: 451096 - RNA, 64 nt, Homo Sapiens
accagguaauaauuauuuugaaagacacaaaccgaaugugaaauauuugccugggaguagagau

SEQ ID NO: 451097 - RNA, 64 nt, Homo Sapiens
caagugcagcucaauacuagauuauuuugcuaagaaugugaauuugugugugugugcucaggca

SEQ ID NO: 451098 - RNA, 64 nt, Homo Sapiens
agcuggaauuuuuuauucuuagaacggacgagauaaugugaacucaagguggaguggaugccuc

SEQ ID NO: 451099 - RNA, 64 nt, Homo Sapiens
aauucuauaggaacauaugaauuauuagccagguaaugugaauaauaaaaaccccaaacuguug

SEQ ID NO: 451100 - RNA, 64 nt, Homo Sapiens
gagaaggguugucacauuauaaaaucuuuaggaaaaugugaacuggaaaacgcuucggucaguu

SEQ ID NO: 451101 - RNA, 64 nt, Homo Sapiens
uuauaguuaagcaauuucaaaaaugcuccaaagaaaugugaaaggaccuuuugucacagcacuu

SEQ ID NO: 451102 - RNA, 64 nt, Homo Sapiens
cauaaugcggcccccuuccccagagcuuaccucgaaugugaaaucccuacuucuuauaaugcag

SEQ ID NO: 451103 - RNA, 64 nt, Homo Sapiens
uuauggaugauuuaagugucucacuaaagcaugaaaugugaauuuuuauuguuguacauacgau

SEQ ID NO: 451104 - RNA, 64 nt, Homo Sapiens
uucaaauaaagggcuguuucuacagguaacauuaaaugugaacucaacacuuccagagucuuua

SEQ ID NO: 451105 - RNA, 64 nt, Homo Sapiens; identical to SEQ ID NO: 250050

SEQ ID NO: 451106 - RNA, 64 nt, Homo Sapiens; identical to SEQ ID NO: 250051

SEQ ID NO: 451107 - RNA, 64 nt, Homo Sapiens; identical to SEQ ID NO: 250050

SEQ ID NO: 451108 - RNA, 64 nt, Homo Sapiens; identical to SEQ ID NO: 250051

SEQ ID NO: 451109 - RNA, 64 nt, Homo Sapiens
uacagaugugagcuucuauuuguuuagaagcauaaaugugaauuauauacaguuugaauuuugc

SEQ ID NO: 451110 - RNA, 64 nt, Homo Sapiens
uucugaaaagcgaauagcaguguuuucagaaacaaaugugaaagcagucaaauuaaguagauac

SEQ ID NO: 451111 - RNA, 64 nt, Homo Sapiens
ggcaccaggagacggccacagacacacacugcuaaaugugaagauggaacuaaacuggaaauua

SEQ ID NO: 451112 - RNA, 64 nt, Homo Sapiens
gaguuauaaagaaauacacuaaggagagguaguaaaugugaaccuuguugcaguguauaaggug

SEQ ID NO: 451113 - RNA, 64 nt, Homo Sapiens
uguacuguuacuaaaagcuuuauaugaaauuauuaaugugaaguuuuucauuuauaauucaagg

SEQ ID NO: 451114 - RNA, 64 nt, Homo Sapiens
uuagaggguuuugaaauguuuuucaaauaugugaaaugugaaacugcugucuuuuauauuaaag

SEQ ID NO: 451115 - RNA, 64 nt, Homo Sapiens
cguaauccaguauuuggaaaguaauccaguuugaaaugugaagauguauuccggcagaauagug

SEQ ID NO: 451116 - RNA, 64 nt, Homo Sapiens
ucauauaguggcucuacguaauguagccuguauuaaugugaaauauuuaccagaauauucaaua

SEQ ID NO: 451117 - RNA, 64 nt, Homo Sapiens
gguuggggucugcuccuaccccaccccauuuaacaaugugaagugacugaggcuggggugccuc

SEQ ID NO: 451118 - RNA, 64 nt, Homo Sapiens
ucugugaagcauucaaaucaaagcuaaaagccuaaaugugaaaugcuaaugacaagccugagaa

SEQ ID NO: 451119 - RNA, 64 nt, Homo Sapiens
uccugccucacaggugaagauuaaagagacaacgaaugugaaucaugcuugcagguuugagggc

SEQ ID NO: 451120 - RNA, 64 nt, Homo Sapiens
agccacuuugcagaauauguuaaaagaaaaauauaaugugaauuauuuuuauggaacucaguau

SEQ ID NO: 451121 - RNA, 64 nt, Homo Sapiens; identical to SEQ ID NO: 250054

SEQ ID NO: 451122 - RNA, 64 nt, Homo Sapiens; identical to SEQ ID NO: 250055

SEQ ID NO: 451123 - RNA, 64 nt, Homo Sapiens; identical to SEQ ID NO: 250056

SEQ ID NO: 451124 - RNA, 64 nt, Homo Sapiens
ccaguuucuugggcaagucacugaauggcaauuaaaugugaaacuuuuauuuuuuauggauacu

SEQ ID NO: 451125 - RNA, 64 nt, Homo Sapiens
ugaaggucaauaaauuauuauuuuuuuuuuucacaaugugaaacgguuuuguaaaacuguuauu

SEQ ID NO: 451126 - RNA, 64 nt, Homo Sapiens
ugccauguugccuuuucucuagucuuucaugugaaaugugaagccgccaggcccaguuaaugcu

SEQ ID NO: 451127 - RNA, 64 nt, Homo Sapiens
gauugauauauuguuguuagugauucuauauaagaaugugaaaaauguauuucauuagauucuc

SEQ ID NO: 451128 - RNA, 64 nt, Homo Sapiens
cauaaaauauauuaaaacuuuauuuaaaaaguauaaugugaaaagcauaucaaacguuuaacuu

SEQ ID NO: 451129 - RNA, 64 nt, Homo Sapiens; identical to SEQ ID NO: 250057

SEQ ID NO: 451130 - RNA, 64 nt, Homo Sapiens; identical to SEQ ID NO: 250058

SEQ ID NO: 451131 - RNA, 64 nt, Homo Sapiens
aauaagguaaaguauaucauuuugcuauuacuucaaugugaauaacaacauagaacugugauau

SEQ ID NO: 451132 - RNA, 64 nt, Homo Sapiens
uugucucuaaauauuuuuuaauuauuuugcuauuaaugugaaaguauauuauuaacaugaauau

SEQ ID NO: 451133 - RNA, 64 nt, Homo Sapiens
guguuucaaagguauguagucaagcguuuauuugaaugugaauagccugugccuggcuagaaaa

SEQ ID NO: 451134 - RNA, 64 nt, Homo Sapiens
uuuaacaggaauaggauagcuguagacauuuuuaaaugugaagcccuuguacaagcacauauga

SEQ ID NO: 451135 - RNA, 64 nt, Homo Sapiens
gaauuucaaaacaggaucuaaguaaaucgaauguaaugugaaugaagaaaaaaaaaggcauucu

SEQ ID NO: 451136 - RNA, 64 nt, Homo Sapiens
gaguuuuggcuuguucuaaauggucauuaugaugaaugugaaaagcugcugcuacuuuaaagug

SEQ ID NO: 451137 - RNA, 64 nt, Homo Sapiens
aaagugggguccuucggggcuccaaagccagugaaaugugaaggagcugagcccuggggacugu

SEQ ID NO: 451138 - RNA, 64 nt, Homo Sapiens
auuauuuaaaugcuuuuaaaccuuuaauauuuccaaugugaaagaagcgaucaugucaguuggc

SEQ ID NO: 451139 - RNA, 64 nt, Homo Sapiens
aauuaacugaauuugcucugcuacagacugaaauaaugugaauggaaugauuuuguugacauga

SEQ ID NO: 451140 - RNA, 64 nt, Homo Sapiens
uugccaagcuguccgugagaucugcuuuuccaagaaugugaaucuauuuuaacccucgcauucc

SEQ ID NO: 451141 - RNA, 64 nt, Homo Sapiens
caacucuuugguuaauaguaguagacuuaucuggaaugugaacaaauucugaaugcuuuuccac

SEQ ID NO: 451142 - RNA, 64 nt, Homo Sapiens
auaauaucuuuaauauaacuggaauucaauaaaaaaugugaacauuaaugauuuugcuacauuu

SEQ ID NO: 451143 - RNA, 64 nt, Homo Sapiens
aaauguguucuccuauuccugcuggacuuaguauaaugugaaaaagccccagagccugggcucu

SEQ ID NO: 451144 - RNA, 64 nt, Homo Sapiens
auugcaucugcauuuuccaagcuuguaaaaggcgaaugugaaauuauuuauguaacauuugcua

SEQ ID NO: 451145 - RNA, 64 nt, Homo Sapiens
uucuuuuuauuugggagauucugggauccagggcaaugugaauucacugugcguuuguaugugu

SEQ ID NO: 451146 - RNA, 64 nt, Homo Sapiens
uaauuuuauuuguacugacaucccuauuaugcaaaaugugaauuaccugauccaucaggaucag

SEQ ID NO: 451147 - RNA, 64 nt, Homo Sapiens
uuuuuuuuuaccgggauuauugggcccaggagccaaugugaacuccuccggcggggccuguccc

SEQ ID NO: 451148 - RNA, 64 nt, Homo Sapiens
aaaucuucaaaaucaguagagaucugagugauggaaugugaagcauacuugagagaaaaacuua

SEQ ID NO: 451149 - RNA, 64 nt, Homo Sapiens
uaauacugagaaaaaguccugucaguucagaaaaaaugugaagucuacuuuaguauuccuguaa

SEQ ID NO: 451150 - RNA, 64 nt, Homo Sapiens
uagagagccacuaggaggccugcaguuauuuuugaaugugaaaaugcauuugcguucaucuugu

SEQ ID NO: 451151 - RNA, 64 nt, Homo Sapiens
uacaucuugugguuauucuggguuguggaaggaaaaugugaaugaaaguagugcuggaugcaau

SEQ ID NO: 451152 - RNA, 64 nt, Homo Sapiens
gacaaaaaagaugcaguuuuccuuuguauugggaaaugugaaaauaaaauugucaacucuuuca

SEQ ID NO: 451153 - RNA, 64 nt, Homo Sapiens
cucucuccuccaccccaggcuuagaggacagaaaaaugugaagagacgccccacccacccucag

SEQ ID NO: 451154 - RNA, 64 nt, Homo Sapiens
aauagacucacacaguugccugaagcaguuggggaaugugaaagucucacugaguuaguucuua

SEQ ID NO: 451155 - RNA, 64 nt, Homo Sapiens
uuugacccuuuauauuuguucuaaaauaagucaaaaugugaaaauaauauuaaaucuaagauau

SEQ ID NO: 451156 - RNA, 64 nt, Homo Sapiens
aagaagaaucuaauaggaugcugguuguguauuaaaugugaaauugcauagauaaagguagaug

SEQ ID NO: 451157 - RNA, 64 nt, Homo Sapiens
agaaacagcugucaaaucucaaggugaagaucuaaaugugaacaguuuacuaaugcacuacuga

SEQ ID NO: 451158 - RNA, 64 nt, Homo Sapiens
ccacaugacuuuugcauccauuguauuaucagaaaaugugaagaagaaaaaaaugccauguuuu

SEQ ID NO: 451159 - RNA, 64 nt, Homo Sapiens
uagggccugugauuuccugucaguguccucagcuaaugugaacaguguuggucugcugguuaga

SEQ ID NO: 451160 - RNA, 64 nt, Homo Sapiens; identical to SEQ ID NO: 250059

SEQ ID NO: 451161 - RNA, 64 nt, Homo Sapiens; identical to SEQ ID NO: 250060

SEQ ID NO: 451162 - RNA, 64 nt, Homo Sapiens
uaauuuucugugagcacacuaaaagcgaaaaauaaaugugaauaaaauguacaaauuuguugug

SEQ ID NO: 451163 - RNA, 64 nt, Homo Sapiens
ucccugaaauuccguaaguacauagucaaaacacaaugugaagaauuuguuuaaaaacauccug

SEQ ID NO: 451164 - RNA, 64 nt, Homo Sapiens
cuugaguuccucauuuguugguaaaaagaaaaagaaugugaaaaugucucuuuuuuucuuggcu

SEQ ID NO: 451165 - RNA, 64 nt, Homo Sapiens
ugugacuucaccugaggcaucacagagacaaaagaaugugaagcuacuuaacaaaguaaggcaa

SEQ ID NO: 451166 - RNA, 64 nt, Homo Sapiens
uuaauauuuuguguugaucauuauuuccauucuuaaugugaaaaaaaguaauuauuuauacuua

SEQ ID NO: 451167 - RNA, 64 nt, Homo Sapiens
uaaugucuuuaagaaaaagaaaucaaucugcagaaaugugaagauuugcaagcaguguaaacug

SEQ ID NO: 451168 - RNA, 64 nt, Homo Sapiens
uacaguuaaacucauugucuguuuggaagaccagaaugugaagacaaguaguagaagaaaauga

SEQ ID NO: 451169 - RNA, 64 nt, Homo Sapiens
aacuucccuuucugcuuguguuaaguauguguaaaaugugaagugaaugaaacacucaguuguu

SEQ ID NO: 451170 - RNA, 64 nt, Homo Sapiens
agcgugguagccgacugugaggaaaagcagagggaaugugaaagaaaauaagagaauccacggg

SEQ ID NO: 451171 - RNA, 64 nt, Homo Sapiens
uucucugcucaccuugguuuccgcacaccuucgcaaugugaacaggucaggagucccucccguc

SEQ ID NO: 451172 - RNA, 64 nt, Homo Sapiens
ugaacuggagugccucugcuagcccucgacccugaaugugaacucugguagucuuagcaggggg

SEQ ID NO: 451173 - RNA, 64 nt, Homo Sapiens
ccugagauggagcugaacauaaaaguuaugcacaaaugugaacauacccugucagccuuucaau

SEQ ID NO: 451174 - RNA, 64 nt, Homo Sapiens
ggcaaugaucucuuauugaggcaggaggcagggaaaugugaaauuaauagcagugugcaugcag

SEQ ID NO: 451175 - RNA, 64 nt, Homo Sapiens
augaacuaguaugugacaaugguuuaaagggaugaaugugaauugauauugaaaguuucaaugu

SEQ ID NO: 451176 - RNA, 64 nt, Homo Sapiens
cagggaacuggggaaggcuguguagaauugaaucaaugugaacucuugggcaggucuagugagc

SEQ ID NO: 451177 - RNA, 64 nt, Homo Sapiens
gagcaaucagaauugugcuuuucugagauacugaaaugugaaaauuuuccuauuuucgaugaag

SEQ ID NO: 451178 - RNA, 64 nt, Homo Sapiens
agccucuugcccuguaccuugacuaauggacuaaaaugugaaaccuugguugggcucugccaaa

SEQ ID NO: 451179 - RNA, 64 nt, Homo Sapiens
agcaccaucaaaauauaauguauaagcuuuugagaaugugaaauugacguuuuguguagaucuu

SEQ ID NO: 451180 - RNA, 64 nt, Homo Sapiens; identical to SEQ ID NO: 250061

SEQ ID NO: 451181 - RNA, 64 nt, Homo Sapiens; identical to SEQ ID NO: 250062

SEQ ID NO: 451182 - RNA, 64 nt, Homo Sapiens; identical to SEQ ID NO: 250063

SEQ ID NO: 451183 - RNA, 64 nt, Homo Sapiens; identical to SEQ ID NO: 250064

SEQ ID NO: 451184 - RNA, 64 nt, Homo Sapiens
uguaauaaaauggaaaugaaugauuucaggaaauaaugugaacaaaaaacaaaagguucuaaga

SEQ ID NO: 451185 - RNA, 64 nt, Homo Sapiens
guaacuguccguaguaucagacaacuuucacuauaaugugaaauugaauaaugccuuuguaacc

SEQ ID NO: 451186 - RNA, 64 nt, Homo Sapiens
acgugauacuucgcaggcgugagaauauaaacucaaugugaaucuguggaaaacuggugacagu

SEQ ID NO: 451187 - RNA, 64 nt, Homo Sapiens
uuguaaccucaagauuaggauguaucagugucucaaugugaagauuuuuauuaaaguaugugug

SEQ ID NO: 451188 - RNA, 64 nt, Homo Sapiens
uuagcaaaaccaugaaugguauaguuggaaauaaaaugugaaaaaccggcaucuuguuacugca

SEQ ID NO: 451189 - RNA, 64 nt, Homo Sapiens
gaauauaacaauucagcuuauaaaaauauuuauuaaugugaaugaaaaucuacaauuucuucuu

SEQ ID NO: 451190 - RNA, 64 nt, Homo Sapiens
ucaaagaauuaaguucuaguuacacuuuuuaaaaaaugugaaagaauguuuaugaucccagcaa

SEQ ID NO: 451191 - RNA, 64 nt, Homo Sapiens
uaaucaacacuauugaacugcuucauugcacaacaaugugaauauggauuucaaagaccacugu

SEQ ID NO: 451192 - RNA, 64 nt, Homo Sapiens
aaagguguuugcguuauuagauugcuacucagcaaaugugaauacuaaugaagaaaacacugua

SEQ ID NO: 451193 - RNA, 64 nt, Homo Sapiens
aucuuuugugucuauauugauagauaauuuuucaaaugugaauuuaagaguucuauucuucagg

SEQ ID NO: 451194 - RNA, 64 nt, Homo Sapiens
aacauuauuuuuucaaagcacuaaaauguuuuaaaaugugaaaaacuccuuuugcaaaagcaga

SEQ ID NO: 451195 - RNA, 64 nt, Homo Sapiens
ccaugccuuacauuuacacauggagucagauuucaaugugaaaccguaagaaagagauuguguu

SEQ ID NO: 451196 - RNA, 64 nt, Homo Sapiens
cacgcgcuagaaaucgcaguuuccccagagauagaaugugaagaguagagccuguuugucuugc

SEQ ID NO: 451197 - RNA, 64 nt, Homo Sapiens
uauugauaucuccaugaugauaguugaauguugcaaugugaaaaaucugcuguuaacugcaacc

SEQ ID NO: 451198 - RNA, 64 nt, Homo Sapiens
aagaaaacuugaaaaaguauaagcauuuguuaaaaaugugaauuucuugaaugaauuucacauu

SEQ ID NO: 451199 - RNA, 64 nt, Homo Sapiens
acauauaauuuacuucuuauaaauugaagucuuaaaugugaaaccaagaaauguaaucaagcag

SEQ ID NO: 451200 - RNA, 64 nt, Homo Sapiens
ugauguuccuaagacccuugucccagauacucuaaaugugaauguaugagcugggggagucaac

SEQ ID NO: 451201 - RNA, 64 nt, Homo Sapiens
accacuuuuagaacuaugaguacuacuuuuguuaaaugugaaaaacccucacagaaagucaucg

SEQ ID NO: 451202 - RNA, 64 nt, Homo Sapiens
uaacucucagagaccuuaaaaagaaguuuacugcaaugugaauaauuuaaucucugguugccaa

SEQ ID NO: 451203 - RNA, 64 nt, Homo Sapiens; identical to SEQ ID NO: 250065

SEQ ID NO: 451204 - RNA, 64 nt, Homo Sapiens; identical to SEQ ID NO: 250066

SEQ ID NO: 451205 - RNA, 64 nt, Homo Sapiens; identical to SEQ ID NO: 250067

SEQ ID NO: 451206 - RNA, 64 nt, Homo Sapiens; identical to SEQ ID NO: 250068

SEQ ID NO: 451207 - RNA, 64 nt, Homo Sapiens; identical to SEQ ID NO: 250069

SEQ ID NO: 451208 - RNA, 64 nt, Homo Sapiens; identical to SEQ ID NO: 250070

SEQ ID NO: 451209 - RNA, 64 nt, Homo Sapiens; identical to SEQ ID NO: 250071

SEQ ID NO: 451210 - RNA, 64 nt, Homo Sapiens; identical to SEQ ID NO: 250072

SEQ ID NO: 451211 - RNA, 64 nt, Homo Sapiens; identical to SEQ ID NO: 250073

SEQ ID NO: 451212 - RNA, 64 nt, Homo Sapiens; identical to SEQ ID NO: 250074

SEQ ID NO: 451213 - RNA, 64 nt, Homo Sapiens; identical to SEQ ID NO: 250075

SEQ ID NO: 451214 - RNA, 64 nt, Homo Sapiens; identical to SEQ ID NO: 250076

SEQ ID NO: 451215 - RNA, 64 nt, Homo Sapiens; identical to SEQ ID NO: 250077

SEQ ID NO: 451216 - RNA, 51 nt, Homo Sapiens
auaugggugagaaauccuagaaaugugaagaaugugacaaagccuuuaagc

SEQ ID NO: 451217 - RNA, 64 nt, Homo Sapiens
cuuuuguauuuuauuuuucaaaauaaaagcuuucaaugugaagcauucugguaguuacauguuu

SEQ ID NO: 451218 - RNA, 64 nt, Homo Sapiens
ugcugcuaguuuuuaugagaaguauauuauauuaaaugugaauuuuuuaaauuuugcuucuuau

SEQ ID NO: 451219 - RNA, 64 nt, Homo Sapiens
ccuggcugugacuguggccgccacggccacccggaaugugaagggcgcuccgggcucugagccc

SEQ ID NO: 451220 - RNA, 64 nt, Homo Sapiens
auguggaggagacugcccuguccugagccuggaaaaugugaaacugucuccugcaaccugcugg

SEQ ID NO: 451221 - RNA, 64 nt, Homo Sapiens; identical to SEQ ID NO: 250078

SEQ ID NO: 451222 - RNA, 64 nt, Homo Sapiens; identical to SEQ ID NO: 250079

SEQ ID NO: 451223 - RNA, 64 nt, Homo Sapiens; identical to SEQ ID NO: 250080

SEQ ID NO: 451224 - RNA, 64 nt, Homo Sapiens
auuaaaaggaaaacagaaaaaggaaaaguaggcaaaugugaaaauaguuucaauauaucuuaug

SEQ ID NO: 451225 - RNA, 64 nt, Homo Sapiens
acaguaaauaauuguaucuuuccauagcuuuucaaaugugaaaucauuuuuggaagcuuggauc

SEQ ID NO: 451226 - RNA, 64 nt, Homo Sapiens; identical to SEQ ID NO: 250081

SEQ ID NO: 451227 - RNA, 64 nt, Homo Sapiens; identical to SEQ ID NO: 250082

SEQ ID NO: 451228 - RNA, 64 nt, Homo Sapiens
uaauaauuccacagccucuucuaacaaugccuacaaugugaauuccucccaaccucugggaucc

SEQ ID NO: 451229 - RNA, 64 nt, Homo Sapiens
ucauuuccauuucuaagcaggccaagaugaacacaaugugaauauggauucauuuuaucgagau

SEQ ID NO: 451230 - RNA, 64 nt, Homo Sapiens
aaaaaaagaaauuugauuuuaucauccaaucucaaaugugaaaaauuacccccucaauaucaug

SEQ ID NO: 451231 - RNA, 64 nt, Homo Sapiens
uguucuuacauuauggcucccuagucgaguuuucaaugugaauuaggguauaugaacaaauuuu

SEQ ID NO: 451232 - RNA, 64 nt, Homo Sapiens
gcggcuggacuuggagguagugcuuuccaaagccaaugugaacacuaggugcccagaaugaggc

SEQ ID NO: 451233 - RNA, 63 nt, Homo Sapiens
auguggcaaugcuuguaacugagaaacccugcaaaugugaagaauaagacaauucauauuuga

SEQ ID NO: 451234 - RNA, 64 nt, Homo Sapiens
auguggcaaagcuuuuaaccagagaaacccuacaaaugugaagacauaagagaauucauacugg

SEQ ID NO: 451235 - RNA, 64 nt, Homo Sapiens
aaauuauucaugcucucauaaaauuagauggaaaaaugugaaaaaaauuauuuucuccaaauaa

SEQ ID NO: 451236 - RNA, 64 nt, Homo Sapiens
uaaaaucuaaauaaaggaauugcauaaaaaacuaaaugugaauauuuauaaagucuuaaaugug

SEQ ID NO: 451237 - RNA, 64 nt, Homo Sapiens
uaaguaauuacugaacuuuaauuugugacagaauaaugugaaguacauagguagcacauuuauc

SEQ ID NO: 451238 - RNA, 64 nt, Homo Sapiens
caaauauuucuucguguuggggucuuuaugcuguaaugugaaagucagcugucaaagcuuaggu

SEQ ID NO: 451239 - RNA, 64 nt, Homo Sapiens
guuaauguagaaauguuuguuguagaugacgaugaaugugaagggaaugugugaaugccauauc

SEQ ID NO: 451240 - RNA, 64 nt, Homo Sapiens
cuacuucuuuaaaaacuccuucuaagcauauuaaaaugugaaauuuugcguacucucucucucu

SEQ ID NO: 451241 - RNA, 64 nt, Homo Sapiens; identical to SEQ ID NO: 250083

SEQ ID NO: 451242 - RNA, 64 nt, Homo Sapiens; identical to SEQ ID NO: 250084

SEQ ID NO: 451243 - RNA, 64 nt, Homo Sapiens
uauacccaaucaagaauagacccuucacacaggaaaugugaacaauuguuauauaugaacacuc

SEQ ID NO: 451244 - RNA, 64 nt, Homo Sapiens
ucuuccuccucaccagaaaucccugggcuuccacaaugugaacucacucauugucagguguccg

SEQ ID NO: 451245 - RNA, 64 nt, Homo Sapiens
uccuucagugauauacuuguucguucauuucuaaaaugugaagcuuuaggaccaaauuguuaga

SEQ ID NO: 451246 - RNA, 64 nt, Homo Sapiens; identical to SEQ ID NO: 250085

SEQ ID NO: 451247 - RNA, 64 nt, Homo Sapiens; identical to SEQ ID NO: 250086

SEQ ID NO: 451248 - RNA, 64 nt, Homo Sapiens
uuugagauuaaaguuagucuuaaaauguaaauaaaaugugaaacguguccucagagacugugcc

SEQ ID NO: 451249 - RNA, 64 nt, Homo Sapiens
gucccgaggcgcagcaauaauaaggcagcuguugaaugugaagggucccuuuggaaaauuaacc

SEQ ID NO: 451250 - RNA, 64 nt, Homo Sapiens; identical to SEQ ID NO: 250087

SEQ ID NO: 451251 - RNA, 64 nt, Homo Sapiens; identical to SEQ ID NO: 250088

SEQ ID NO: 451252 - RNA, 64 nt, Homo Sapiens; identical to SEQ ID NO: 250089

SEQ ID NO: 451253 - RNA, 64 nt, Homo Sapiens; identical to SEQ ID NO: 250090

SEQ ID NO: 451254 - RNA, 64 nt, Homo Sapiens
ugcuuuauuauagagacauuugaaaauauccauuaaugugaauaucaccugaauucagucuguu

SEQ ID NO: 451255 - RNA, 64 nt, Homo Sapiens
cccuucaucucuuacuugauagacuuacuaauaaaaugugaagacuagaccaauugucaugcuu

SEQ ID NO: 451256 - RNA, 64 nt, Homo Sapiens
aaaguaucugagauauacaaaucucccuguaggaaaugugaaagaaaagcacaacaaaacuagg

SEQ ID NO: 451257 - RNA, 64 nt, Homo Sapiens
aaaguaacacuuuguacauaacaaauacucagcaaaugugaaacuuuauuugcucuuacuucaa

SEQ ID NO: 451258 - RNA, 64 nt, Homo Sapiens
auuuuaugaauaauaugcagagaugcauauuaggaaugugaagccagaaugggucaguuguagc

SEQ ID NO: 451259 - RNA, 64 nt, Homo Sapiens
ugucugaauaaccugcgugucuaaaaccacgugaaaugugaaugauuauuggcaauauuaccuu

SEQ ID NO: 451260 - RNA, 64 nt, Homo Sapiens
uugagaaguucccauuauuauuucuguucuuacaaaugugaaacggaagcucauagaggugaga

SEQ ID NO: 451261 - RNA, 64 nt, Homo Sapiens
ccaaaguggauuuauccugcgcaauauaaaacaaaaugugaaaagagaaaacacuugaauugac

SEQ ID NO: 451262 - RNA, 64 nt, Homo Sapiens
uauaaaauaaauauaugcuaaguaaaauguuauaaaugugaagucauuuauuggcgguauacaa

SEQ ID NO: 451263 - RNA, 64 nt, Homo Sapiens
uucugaaucccuauuccaggcguggcaccuccacaaugugaauucuggccaggcucucccgagu

SEQ ID NO: 451264 - RNA, 64 nt, Homo Sapiens
guaauguuuuuacagcaacaaaaaauuuuuuaaaaaugugaaauaaguauuauuuuuacuguua

SEQ ID NO: 451265 - RNA, 64 nt, Homo Sapiens
cccaguggaucauguuggaaugaugaauuuauagaaugugaagauuacuggugaauuacagacc

SEQ ID NO: 451266 - RNA, 64 nt, Homo Sapiens
gcagcuguggguuuuaccaccaaaauaaauuggaaaugugaauccaacagcuucagaaagagcu

SEQ ID NO: 451267 - RNA, 64 nt, Homo Sapiens
aaaauuuaauucugacuuuuucaugguuucuaucaaugugaaauugggaaaguguaaauguuuu

SEQ ID NO: 451268 - RNA, 64 nt, Homo Sapiens
caucuuuccuugcaauauuuuaucuuucugauucaaugugaauccaacaguccuacuccgaugu

SEQ ID NO: 451269 - RNA, 64 nt, Homo Sapiens
uuuuuguagcuaaauuguaacuccuagaguauaaaaugugaaugaauagcaucuauguuacacu

SEQ ID NO: 451270 - RNA, 64 nt, Homo Sapiens
aaaaaccaccauuuauaauaauuccaccuaucuuaaugugaauuccuuugcaaaauuggauuaa

SEQ ID NO: 451271 - RNA, 64 nt, Homo Sapiens
ugcauuguaguuuaaccauaaaauguguuggacaaaugugaagacccaaugguguuuuucuugu

SEQ ID NO: 451272 - RNA, 64 nt, Homo Sapiens
gguaaaggucgaucuugauacaaaauauggaacaaaugugaacuauuaagccuauuguuuaaug

SEQ ID NO: 451273 - RNA, 64 nt, Homo Sapiens
uuauuuauaauagcaauaaaaugacagaugccuuaaugugaagcccaaaucuuuuucauaggua

SEQ ID NO: 451274 - RNA, 64 nt, Homo Sapiens; identical to SEQ ID NO: 250091

SEQ ID NO: 451275 - RNA, 64 nt, Homo Sapiens; identical to SEQ ID NO: 250092

SEQ ID NO: 451276 - RNA, 64 nt, Homo Sapiens
uugguugacugauguucaugaaaauccugcccaaaaugugaagccuuaaaaaauuuauacuuaa

SEQ ID NO: 451277 - RNA, 64 nt, Homo Sapiens
agaaucacguaguaaauguaaauacugcaccaaaaaugugaaaauagggugaagcuuugaaaua

SEQ ID NO: 451278 - RNA, 64 nt, Homo Sapiens
ucucacuagaauugguauggacugggaauuuaagaaugugaacuggggagaaaugcaguugcug

SEQ ID NO: 451279 - RNA, 64 nt, Homo Sapiens
cauuuaaaaaugauaauagcaaggcaguuuuaaaaaugugaaaaccaaauacauccaaaagggu

SEQ ID NO: 451280 - RNA, 64 nt, Homo Sapiens; identical to SEQ ID NO: 250093

SEQ ID NO: 451281 - RNA, 64 nt, Homo Sapiens; identical to SEQ ID NO: 250094

SEQ ID NO: 451282 - RNA, 64 nt, Homo Sapiens
auuauguaccuuuugauagauccacauaaaaagaaaugugaaguuuucuuuuacuaucuuuuca

SEQ ID NO: 451283 - RNA, 64 nt, Homo Sapiens
uuuugucuuuuucugcccaucugucuacuaauaaaaugugaaauaaaauaccuguauugcuacu

SEQ ID NO: 451284 - RNA, 64 nt, Homo Sapiens
agcugccuucaaggacuguuucagugugagucagaaugugaaaaaggaauaaaaaauacuguug

SEQ ID NO: 451285 - RNA, 64 nt, Homo Sapiens
gucucaaaaaaaauaaaauaaaaagucaauuuagaaugugaaauucugaccaccuuuuggcuuu

SEQ ID NO: 451286 - RNA, 64 nt, Homo Sapiens
aagacauuuuuccguuugcuuuuguuccaaugucaaugugaacguccacaugaaaccuacacac

SEQ ID NO: 451287 - RNA, 64 nt, Homo Sapiens
gugguuguaguugaaaauuuuauaaaauaccguuaaugugaaguuuuucuuuagucacagaagu

SEQ ID NO: 451288 - RNA, 64 nt, Homo Sapiens
ggagagcaagcaaaucuuuuuaaaaaauaguaugaaugugaauacuagaaaagauuuaaaaaau

SEQ ID NO: 451289 - RNA, 64 nt, Homo Sapiens
ugaagacugccaaggagcagauuuucucccuggaaaugugaaaacugaaccuauaacucugaua

SEQ ID NO: 451290 - RNA, 64 nt, Homo Sapiens; identical to SEQ ID NO: 250095

SEQ ID NO: 451291 - RNA, 64 nt, Homo Sapiens; identical to SEQ ID NO: 250096

SEQ ID NO: 451292 - RNA, 64 nt, Homo Sapiens
cacugugggagggaaggacaaggguucccuuggaaaugugaagggucuuggccucaucccucag

SEQ ID NO: 451293 - RNA, 64 nt, Homo Sapiens
guuggacaaauuuugaguuuuuuuaucauuaggaaaugugaaacguaaacugugcaagcuuucu

SEQ ID NO: 451294 - RNA, 64 nt, Homo Sapiens
gucauaauagcuuucccaucaaaugacauguucgaaugugaaagcccaccaaauuuacacaaca

SEQ ID NO: 451295 - RNA, 64 nt, Homo Sapiens
cauauuuagauuuuauauacagcaaaaucuggaaaaugugaaaguuucuguccuuaauuuuuug

SEQ ID NO: 451296 - RNA, 64 nt, Homo Sapiens
aacuuauuuaauuuauggcagcugggggaaaaaaaaugugaacuagacuaacuguaacuuaagu

SEQ ID NO: 451297 - RNA, 64 nt, Homo Sapiens
uauuuguguuuguuuugucuaaacaaacauaggaaaugugaaaagcuuuaugaaguaaaguuaa

SEQ ID NO: 451298 - RNA, 64 nt, Homo Sapiens
uugaaaauuacuacuuaaucuuuaaaaucaaguuaaugugaauuaaaugacucacaaaacugau

SEQ ID NO: 451299 - RNA, 64 nt, Homo Sapiens; identical to SEQ ID NO: 250097

SEQ ID NO: 451300 - RNA, 64 nt, Homo Sapiens; identical to SEQ ID NO: 250098

SEQ ID NO: 451301 - RNA, 64 nt, Homo Sapiens
aggcucaccuaaggaaacugugguuuugauacugaaugugaacaccaaaauaauaaaugucagc

SEQ ID NO: 451302 - RNA, 64 nt, Homo Sapiens
gugcauuacacuauucuuauuuaacaaagacaguaaugugaagauugcuguuagaaaaacagaa

SEQ ID NO: 451303 - RNA, 64 nt, Homo Sapiens
cugaaugauagagauauuuuugaaacuugaacauaaugugaaggcucuuucccugcagugucuu

SEQ ID NO: 451304 - RNA, 64 nt, Homo Sapiens
cgagacauuauaucuucucuuaguauucuuugcaaaugugaaaguaggggaugaggguuagcca

SEQ ID NO: 451305 - RNA, 64 nt, Homo Sapiens
acuagaaauaaaaacccacagcgauucuauggucaaugugaagggacagguuuggaagccacag

SEQ ID NO: 451306 - RNA, 64 nt, Homo Sapiens
cagagguuucggauucgugagcauucccaguaggaaugugaagcugugacugcgggcugggggg

SEQ ID NO: 451307 - RNA, 64 nt, Homo Sapiens
augucccuuuuaaccaugguauuugguuuaauaaaaugugaauaaaugacagcaauuuucuaau

SEQ ID NO: 451308 - RNA, 64 nt, Homo Sapiens
gucaucuuguacuuacaccuucuuuuuuuaaaaaaaugugaaaugauauauucccaugaaggau

SEQ ID NO: 451309 - RNA, 64 nt, Homo Sapiens
aucaaagucagggcaagaaacacugcuccucagcaaugugaagacaaugagauuaagcuucaau

SEQ ID NO: 451310 - RNA, 64 nt, Homo Sapiens
cucaguggccgcuccuucuuaggugcugcaacuaaaugugaaaguuggcccacuuccagggccc

SEQ ID NO: 451311 - RNA, 64 nt, Homo Sapiens
ccuuuuaauuuuuaauccauuacacuuuggaaagaaugugaaaugugugccagacaccgggcag

SEQ ID NO: 451312 - RNA, 64 nt, Homo Sapiens
uguuuaauguuacaguguugcuuacaguuuacagaaugugaagagaaugcagccaaugcauuuu

SEQ ID NO: 451313 - RNA, 64 nt, Homo Sapiens
ucuaccaaauaguagagcauugcugugacaagccaaugugaauuuagccagcagaacugaagug

SEQ ID NO: 451314 - RNA, 64 nt, Homo Sapiens
uacauuugacauagaaugaauauguauuguagacaaugugaaaauacacaguaauguuauuauc

SEQ ID NO: 451315 - RNA, 64 nt, Homo Sapiens
ugaugacuucuggcacgcgggaacaacgucuacaaaugugaagagcaaagccugucuuccgcua

SEQ ID NO: 451316 - RNA, 64 nt, Homo Sapiens
ggugaacaguagggcauuacauuugugugaauuaaaugugaacuucuguauuacguugcggcgu

SEQ ID NO: 451317 - RNA, 64 nt, Homo Sapiens
ugugaccucaucuagcuaugaauucugggaagucaaugugaaaaacauugcugcauucaugcaa

SEQ ID NO: 451318 - RNA, 64 nt, Homo Sapiens
aacuguaaauuugcauaacuggauguacuuagauaaugugaaauaaacauuaaagacaaggucu

SEQ ID NO: 451319 - RNA, 64 nt, Homo Sapiens
uuugauuuuguuauacuugacuuaacuuuauugcaaugugaauuaauugcacugcuaaguagga

SEQ ID NO: 451320 - RNA, 64 nt, Homo Sapiens
uuaggaacuacugaggaucagaguaauccaagcaaaugugaaucauuuuaccuuugacaaaggu

SEQ ID NO: 451321 - RNA, 64 nt, Homo Sapiens
auagucaauagucuucccauccaaacuauaagagaaugugaauuucuucaacaucauacuuaaa

SEQ ID NO: 451322 - RNA, 64 nt, Homo Sapiens
gcauugaucuuuuccacaaguauuaaacugccaaaaugugaauaugcaaagccuuucugaaucu

SEQ ID NO: 451323 - RNA, 64 nt, Homo Sapiens
gucugcagaacuuuguucuguuuucugccacaaaaaugugaauaguucagagugaaaaccuuuu

SEQ ID NO: 451324 - RNA, 64 nt, Homo Sapiens; identical to SEQ ID NO: 250099

SEQ ID NO: 451325 - RNA, 64 nt, Homo Sapiens; identical to SEQ ID NO: 250100

SEQ ID NO: 451326 - RNA, 64 nt, Homo Sapiens
ucucauguuugagugauuuuaaaauguuuuggugaaugugaaaacuaaaguuugugucaugaga

SEQ ID NO: 451327 - RNA, 64 nt, Homo Sapiens
uccuacguuuaaauaucuuugaaaguuuguauuaaaugugaauuuuaagaaauaauauuuauau

SEQ ID NO: 451328 - RNA, 64 nt, Homo Sapiens
ucccagucuaucaucaaccuugaguauucuacacaaugugaauucaagugccugauuaauugag

SEQ ID NO: 451329 - RNA, 64 nt, Homo Sapiens
cauuucaaagugacuucuaugaagcuuuuuuuuuaaugugaaauuuucagaauguuguuuuuuu

SEQ ID NO: 451330 - RNA, 64 nt, Homo Sapiens
acgggguaugugagauguuuugacacaggcaugcaaugugaaauacguguaucauggagaauga

SEQ ID NO: 451331 - RNA, 64 nt, Homo Sapiens
caucuugcccacaggccuguggcaaaaggauaaaaaugugaacgaaguuuaacauucugacuug

SEQ ID NO: 451332 - RNA, 64 nt, Homo Sapiens
cucaaauauuugcacuguauuaaauuuaaauguuaaugugaaaugguuuaaauuuuacaugcug

SEQ ID NO: 451333 - RNA, 64 nt, Homo Sapiens
gcuguaauuauaaaauauauuggcuuuuguuuucaaugugaaagauacauuaaauggacacaua

SEQ ID NO: 451334 - RNA, 64 nt, Homo Sapiens
ucccuccuuucaguauuuuucacuuguugccccaaaugugaaagcauuucauuccuuuaagagg

SEQ ID NO: 451335 - RNA, 64 nt, Homo Sapiens
cugccugaaaucaaacuugauuuaacucaguaagaaugugaauuauuuguucuacuuggguggu

SEQ ID NO: 451336 - RNA, 64 nt, Homo Sapiens
ggguguggucuguuacuuuaauguuucuguuuuuaaugugaaggccaagcaggcccugggaugg

SEQ ID NO: 451337 - RNA, 64 nt, Homo Sapiens
ggggaaaaggcaauaauuuucuaagacccgugugaaugugaagaaaagcaguauguuacugguu

SEQ ID NO: 451338 - RNA, 64 nt, Homo Sapiens
ggauuuuuuuuuaaauaaaaaaguuuacagaucaaaugugaaauaaauaugaauggaguggucc

SEQ ID NO: 451339 - RNA, 64 nt, Homo Sapiens
agaagaacaagaaauggauguaagccuggcccauaaugugaacauaaguaaucacuaaugcuca

SEQ ID NO: 451340 - RNA, 64 nt, Homo Sapiens
uccugggguaagagaaaaaaagcacaucacaacaaaugugaaagccuucauuauuacacguucc

SEQ ID NO: 451341 - RNA, 64 nt, Homo Sapiens; identical to SEQ ID NO: 250101

SEQ ID NO: 451342 - RNA, 64 nt, Homo Sapiens; identical to SEQ ID NO: 250102

SEQ ID NO: 451343 - RNA, 64 nt, Homo Sapiens
cccaugccguucuucuguguaauauuaagaacugaaugugaaguuuauagcuagccugggugua

SEQ ID NO: 451344 - RNA, 64 nt, Homo Sapiens
cagagguugaauuuuuuaaauaugcccuguccuaaaugugaagaaugaaaggacaagacacugu

SEQ ID NO: 451345 - RNA, 64 nt, Homo Sapiens
ugguccaggagaaggccaauugcaucucccagauaaugugaaaaguauuuuguauuguuucaau

SEQ ID NO: 451346 - RNA, 64 nt, Homo Sapiens
uuuguuaauuguucacuugucagaaauaauugauaaugugaauuggcuucuaacagaauucaac

SEQ ID NO: 451347 - RNA, 64 nt, Homo Sapiens
uacuugucugaaccccgugguugacuuacaaugaaaugugaaaucaaaaaauguuuucuuaccc

SEQ ID NO: 451348 - RNA, 64 nt, Homo Sapiens
auaugugaauuuuuuucaaaaucuguagucguuuaaugugaauuaaaaugcccauauuguaucu

SEQ ID NO: 451349 - RNA, 64 nt, Homo Sapiens
uucaugaaguuuuaaacuucagccuccgcuccuuaaugugaaacucuaugagacgagagagaga

SEQ ID NO: 451350 - RNA, 64 nt, Homo Sapiens
gcuuuuauauucuaauaguuuauuugucuuaaaaaaugugaaaucuaaguaauuuagaagauau

SEQ ID NO: 451351 - RNA, 64 nt, Homo Sapiens
aggccuucaccuugacucuuuuaguuucugccacaaugugaagacccaucuuccugaaaggaug

SEQ ID NO: 451352 - RNA, 64 nt, Homo Sapiens
gacacuguauugcuguauacgaguugcgacugaaaaugugaaacguccaaaccuaguuucccau

SEQ ID NO: 451353 - RNA, 64 nt, Homo Sapiens
acacuuuguguggaaaaaccguuaaaucuauagaaaugugaaauuuggauguagcuuguuagua

SEQ ID NO: 451354 - RNA, 64 nt, Homo Sapiens
ucuauguuuucaguauuaugcauacacuucuuaaaaugugaaaaguaguauuauugagucuuuu

SEQ ID NO: 451355 - RNA, 64 nt, Homo Sapiens
guauuauuuuaaaaaguggcaugugauugaagcaaaugugaaucaacuccugcaaugaauguuu

SEQ ID NO: 451356 - RNA, 64 nt, Homo Sapiens
ugcugccaaauguuauguagacaacucaguguucaaugugaaauaagaacaaaacugugcuguu

SEQ ID NO: 451357 - RNA, 64 nt, Homo Sapiens
auuuuuuuguggugauaaaauuguguaucucuauaaugugaaaucauacuuagauucacaaugg

SEQ ID NO: 451358 - RNA, 64 nt, Homo Sapiens
uuuguuuuucuauuaaaaagcaaucaagaaagauaaugugaaaaagaaaggaauuuagagguag

SEQ ID NO: 451359 - RNA, 64 nt, Homo Sapiens
augggauguaauccggauggccgcuucuguacuuaaugugaaauauuuagauaccuuuuugaac

SEQ ID NO: 451360 - RNA, 64 nt, Homo Sapiens
ccauucaagagcaaucuuugcuaaggaguaagugaaugugaagaguaccaacuacaacaauucu

SEQ ID NO: 451361 - RNA, 64 nt, Homo Sapiens
cuccuaauacugucaccuugggggugagaauuccaaugugaauuugcagggggagugggggaca

SEQ ID NO: 451362 - RNA, 64 nt, Homo Sapiens
cccacauuauuuauagaaaauguacaguugugugaaugugaaauaaauguccucaacucccuuc

SEQ ID NO: 451363 - RNA, 64 nt, Homo Sapiens
gguugcucugaggguuaaaugaaaauaaaaagaaaaugugaaacagcaccacagguacuugaca

SEQ ID NO: 451364 - RNA, 64 nt, Homo Sapiens
aggcugugagcuccuugggggcaggcccucaauaaaugugaacugcugcugccgccucugccgu

SEQ ID NO: 451365 - RNA, 64 nt, Homo Sapiens
aaauaaauauaauugggauuuuaaaaacaugagaaaugugaacugugauggggugggcagggcu

SEQ ID NO: 451366 - RNA, 64 nt, Homo Sapiens
gguuucuacugagcaaaauaccaucuaaaaggagaaugugaauaguuguauuuugaaaugaugu

SEQ ID NO: 451367 - RNA, 64 nt, Homo Sapiens
gcugagccaauagugauuuguuugcauaucaccuaaugugaaaagugcucaucugugaacucua

SEQ ID NO: 451368 - RNA, 64 nt, Homo Sapiens
uuaaugaaacccuauggagaauuuaucccuuuacaaugugaauagucaucuccuaauuuguuuc

SEQ ID NO: 451369 - RNA, 64 nt, Homo Sapiens
uucaaguucuaaggaagaaaagagucuccuuucgaaugugaagaaguaaauuuagaggaaauca

SEQ ID NO: 451370 - RNA, 64 nt, Homo Sapiens
aauaaauuguuauuuucgcacaaugggaaucucuaaugugaaaauguauucuaugaaaauaauu

SEQ ID NO: 451371 - RNA, 64 nt, Homo Sapiens
aaaagugagaagacauaaccaagacauggaaauaaaugugaaagcuggagccgaagagucaaag

SEQ ID NO: 451372 - RNA, 64 nt, Homo Sapiens
aucuccgugugugcaugugacugugcuggguuggaaugugaacaauaaagaggaauguccaagu

SEQ ID NO: 451373 - RNA, 64 nt, Homo Sapiens
uuugccuaucuuuaaacauuauaggguuuuuuuuaaugugaauucuguuacucuaaauagaaau

SEQ ID NO: 451374 - RNA, 64 nt, Homo Sapiens
cagauaguuguuuucauacauuggggauuuguucaaugugaaaucugaaaauacuguaaauacg

SEQ ID NO: 451375 - RNA, 64 nt, Homo Sapiens
cuggcacacugcucuuaagacauucaguuaauucaaugugaacagaaaucuaaaagaauuuuac

SEQ ID NO: 451376 - RNA, 64 nt, Homo Sapiens
aauuguauuacucuacuucuuuccaaguuuuucuaaugugaagaucuacaguuugucuuugcuu

SEQ ID NO: 451377 - RNA, 64 nt, Homo Sapiens
aaguauuuaacauguucaacuauaguuuguaaacaaugugaauaucauguguuuuccaggugga

SEQ ID NO: 451378 - RNA, 64 nt, Homo Sapiens
gaggaacaaguggguaucuccacacugugggcuuaaugugaauagaucuggagcccgggagagc

SEQ ID NO: 451379 - RNA, 64 nt, Homo Sapiens
auuaauauuaucgcaguauuguaagcuucguacaaaugugaagugcuauaugugaaaacauucu

SEQ ID NO: 451380 - RNA, 64 nt, Homo Sapiens
aaauggugucuggaagaaagauuaucagugagcaaaugugaaggagauucgauccucuuaaggc

SEQ ID NO: 451381 - RNA, 64 nt, Homo Sapiens
uuguuuaaagcuuaggcacauucaaucuaaauaaaaugugaauuaucaauuuuguauaguuuau

SEQ ID NO: 451382 - RNA, 64 nt, Homo Sapiens
cuuacgaauguacaacacaaauguuuuugcagucaaugugaauuuuuauguuuuuguugcauuu

SEQ ID NO: 451383 - RNA, 64 nt, Homo Sapiens
cccugugcugcuuguagacaccuaugaaauguaaaaugugaacucuccaucugauacuccauug

SEQ ID NO: 451384 - RNA, 64 nt, Homo Sapiens
cauagacuuauuuuuaaauuuauuuuuuaaaaucaaugugaaaauuuguaauucaaacaugcua

SEQ ID NO: 451385 - RNA, 64 nt, Homo Sapiens
ucagagaagugacacagaguugucguuauuucugaaugugaagccaauucuugagaguuguauc

SEQ ID NO: 451386 - RNA, 64 nt, Homo Sapiens
guuuguuaauauugcuguaacuccuguaauucuuaaugugaauauaucuguguucccuuagaua

SEQ ID NO: 451387 - RNA, 64 nt, Homo Sapiens
cagaauugcaagacugggugcuucuuucugagaaaaugugaaacccaacauaccauuauagucu

SEQ ID NO: 451388 - RNA, 64 nt, Homo Sapiens
uuuauuguacauucagugaguauccuguuauuuaaaugugaacacugguugaaaauguugaccc

SEQ ID NO: 451389 - RNA, 64 nt, Homo Sapiens; identical to SEQ ID NO: 250103

SEQ ID NO: 451390 - RNA, 64 nt, Homo Sapiens; identical to SEQ ID NO: 250104

SEQ ID NO: 451391 - RNA, 64 nt, Homo Sapiens
cugugaagaguggacagucuuuuggaguugaauaaaugugaaggacugaugauaaauuuguuac

SEQ ID NO: 451392 - RNA, 64 nt, Homo Sapiens
ucaguuuuucuugguuuauggaaauaucuauauuaaugugaaaauaauuaauuuagaauuguga

SEQ ID NO: 451393 - RNA, 64 nt, Homo Sapiens
uccuuucucuuucucucuucccucagaaacuagaaaugugaaugaggauuauuauaaaaggggg

SEQ ID NO: 451394 - RNA, 64 nt, Homo Sapiens
uuuaaaccaucuuggcuugugcuuuauucaaacuaaugugaaacaauaaauuuaaauauuauuu

SEQ ID NO: 451395 - RNA, 64 nt, Homo Sapiens
uuucacuuuuuggauugcaucuccccaaaaacuaaaugugaaaucccuaccauuucuagccucu

SEQ ID NO: 451396 - RNA, 64 nt, Homo Sapiens
uuguuuacaaucuacucaccaggcucauaccuacaaugugaacauacaguaugcccuuauuagc

SEQ ID NO: 451397 - RNA, 64 nt, Homo Sapiens
caucauccucagcagcaucgaggaagggccgaggaaugugaagccagaucucgggacucagauu

SEQ ID NO: 451398 - RNA, 64 nt, Homo Sapiens
ugaagcuggguagccuauugggguugagagggaaaaugugaaaucucagaauuuaucucccuua

SEQ ID NO: 451399 - RNA, 64 nt, Homo Sapiens
uuacaaguauugaaauaauuacuaauuaaucacaaaugugaaguuaugcaugauguaaaaaaua

SEQ ID NO: 451400 - RNA, 64 nt, Homo Sapiens
ccucuagauguguaauuacauggaaaauacuagcaaugugaaugcuuuuguaguaaccaucuug

SEQ ID NO: 451401 - RNA, 64 nt, Homo Sapiens
auaaauauuucaguagaaauuacuugcaaaaugaaaugugaauuguaaaacuuggccuaaacaa

SEQ ID NO: 451402 - RNA, 64 nt, Homo Sapiens; identical to SEQ ID NO: 250105

SEQ ID NO: 451403 - RNA, 64 nt, Homo Sapiens; identical to SEQ ID NO: 250106

SEQ ID NO: 451404 - RNA, 64 nt, Homo Sapiens; identical to SEQ ID NO: 250107

SEQ ID NO: 451405 - RNA, 64 nt, Homo Sapiens
auacucucaccauuuggauccuguguggagagggaaugugaaauuuacaucauuucuuuuuggg

SEQ ID NO: 451406 - RNA, 64 nt, Homo Sapiens
uuuuuguuacaaaucuucugaaaaaaaacaaaacaaugugaaacauuaaaauuaaaaggcauua

SEQ ID NO: 451407 - RNA, 64 nt, Homo Sapiens; identical to SEQ ID NO: 250108

SEQ ID NO: 451408 - RNA, 64 nt, Homo Sapiens; identical to SEQ ID NO: 250109

SEQ ID NO: 451409 - RNA, 64 nt, Homo Sapiens
uuauugcacagacugaauggcuuuacauguuucuaaugugaauuaggcaugugaagcagugggu

SEQ ID NO: 451410 - RNA, 64 nt, Homo Sapiens
ugggaccuuuccuccaucccguccacguaucaggaaugugaaugcgauugcggccccucaccuu

SEQ ID NO: 451411 - RNA, 64 nt, Homo Sapiens
cauaccauugguugacguuuaaauuagacaacuuaaugugaaauugaacccaccaccacaaagc

SEQ ID NO: 451412 - RNA, 64 nt, Homo Sapiens
uucccaauuacaggauuauaauuaggacaggaaaaaugugaaauuugcuucucccaccucugag

SEQ ID NO: 451413 - RNA, 64 nt, Homo Sapiens
ugggaguccacaaagacauaggccuauugaacaaaaugugaaacguaccagaauaggagauuau

SEQ ID NO: 451414 - RNA, 64 nt, Homo Sapiens
aaacaaaaaaaauuuguauguugggguuuuuaugaaugugaagcguuauuugucauuuacagua

SEQ ID NO: 451415 - RNA, 64 nt, Homo Sapiens
cauguggaagggacauuaaucuuccuggaaucaaaaugugaauuuuagggcuuaugguacaugg

SEQ ID NO: 451416 - RNA, 64 nt, Homo Sapiens
uacaacgcauauuuaucucuggcacaaccuuguaaaugugaaagggucuuuaauaguguugagu

SEQ ID NO: 451417 - RNA, 64 nt, Homo Sapiens
uggccucagacaggcuggccaggcuccacacagaaaugugaacucagacuuugcacacagccuc

SEQ ID NO: 451418 - RNA, 64 nt, Homo Sapiens
agacccuaccccaccacgaucucaccucugccucaaugugaauccagaaggagaaggaaggaga

SEQ ID NO: 451419 - RNA, 64 nt, Homo Sapiens
uacaacucguauuuaucucuggcacaaccuuguaaaugugaaagggucuuuaauaguguugagu

SEQ ID NO: 451420 - RNA, 64 nt, Homo Sapiens
caaagcuugucugguucucucagguaguauuuucaaugugaaucccuuucucacauacuguaca

SEQ ID NO: 451421 - RNA, 64 nt, Homo Sapiens
aaguuuuuuacuuccacagauuuuaucagugcuuaaugugaacucugugggcccagucauuggg

SEQ ID NO: 451422 - RNA, 55 nt, Homo Sapiens
ucaacccacaucaccaccugaguaaaaugugaaacugcacauauucuucaaauaa

SEQ ID NO: 451423 - RNA, 64 nt, Homo Sapiens
cauauuuuguauccuaaaauuaauuauugccuaaaaugugaaaggaauccaaggaauaguucag

SEQ ID NO: 451424 - RNA, 64 nt, Homo Sapiens
cauuguuuguagugcuauccuguuaaggucuuggaaugugaacacuuccuuucugagaaguuag

SEQ ID NO: 451425 - RNA, 64 nt, Homo Sapiens
uucuuucuaaaaauuuagaacccaugacaaaaugaaugugaauauuuagaagagccacgugaaa

SEQ ID NO: 451426 - RNA, 64 nt, Homo Sapiens
uguaccccuucauuuuaaaauguauacuauauuaaaugugaauugauuguauuauugauuguau

SEQ ID NO: 451427 - RNA, 64 nt, Homo Sapiens
guuucuuaaagcucugaacauuuugaaauaauguaaugugaaguaggaauagcugcauaagaca

SEQ ID NO: 451428 - RNA, 64 nt, Homo Sapiens
acuaauuuaaauuacuaucauuuaaacacauaucaaugugaaggaaggcauaccuaaggacuaa

SEQ ID NO: 451429 - RNA, 64 nt, Homo Sapiens
uuuuauuuguauuaguaauaagcaaaucuguauaaaugugaaauaaguaaauacauuauugaaa

SEQ ID NO: 451430 - RNA, 64 nt, Homo Sapiens
aucgacugacugcuuguugccugucuugaguacaaaugugaauggcgaguuuugcccaggccug

SEQ ID NO: 451431 - RNA, 64 nt, Homo Sapiens
acuacacccagcagagucccuccaggcgguucugaaugugaagcagagguaacuaugcaaagca

SEQ ID NO: 451432 - RNA, 64 nt, Homo Sapiens
augcucucccagcaaagcuggagugagcuagucaaaugugaaaaggguuagaagagagacaggg

SEQ ID NO: 451433 - RNA, 64 nt, Homo Sapiens
cucuucccguuccugcuuaccccuucuuguucugaaugugaaaguuuuuuaguuacucaaaagc

SEQ ID NO: 451434 - RNA, 64 nt, Homo Sapiens
cagagaaauaacuuguaaauaguuguguggugggaaugugaaagaaacauuauauuaaaaaaaa

SEQ ID NO: 451435 - RNA, 64 nt, Homo Sapiens
cccaggccgcagggggcaaguuucuagguuugugaaugugaagcaagaaaccuuuuuuaaacua

SEQ ID NO: 451436 - RNA, 64 nt, Homo Sapiens
ugagcuguuugaccagucacaauugaaaguguuaaaugugaacugaaauaguguaauuaaaaau

SEQ ID NO: 451437 - RNA, 64 nt, Homo Sapiens
agacaagagaaugcugucaauauugguguacuguaaugugaaucuaugcuggugaaaacaauuu

SEQ ID NO: 451438 - RNA, 64 nt, Homo Sapiens
uaaggguacucuaguuuuauguagaugauuucagaaugugaaggcugguuugccugucagucau

SEQ ID NO: 451439 - RNA, 64 nt, Homo Sapiens
gccagggaauaggaaaugagggcacuuacacauuaaugugaauuaguaauugugguauagaaau

SEQ ID NO: 451440 - RNA, 64 nt, Homo Sapiens
guauauuucagugagguauauuuuaauacugaucaaugugaacuuuucuaaauacucuauuguc

SEQ ID NO: 451441 - RNA, 64 nt, Homo Sapiens; identical to SEQ ID NO: 250110

SEQ ID NO: 451442 - RNA, 64 nt, Homo Sapiens; identical to SEQ ID NO: 250111

SEQ ID NO: 451443 - RNA, 64 nt, Homo Sapiens
ccaaaauuuucuacagagaguuaauuaucaccaaaaugugaaugguacauacaaaaccuggcau

SEQ ID NO: 451444 - RNA, 64 nt, Homo Sapiens
uuuaauuguaaaagauuaguugaaaaacuguaugaaugugaagaucacaugcuuagucauuuuu

SEQ ID NO: 451445 - RNA, 64 nt, Homo Sapiens
uuacuucaaguaacaugcuuagcuuucccuccuuaaugugaaaaaucaagggcuuacugacaua

SEQ ID NO: 451446 - RNA, 64 nt, Homo Sapiens
agacugcaucaacccgacauuccuuucuuauaccaaugugaaauuuccagaucaucuguaaacc

SEQ ID NO: 451447 - RNA, 64 nt, Homo Sapiens
auaaaauuauugaagcgauuucuauguggaaauaaaugugaaaaauaacuaugauauuuuggua

SEQ ID NO: 451448 - RNA, 64 nt, Homo Sapiens
ugauaagcauaggagguucuguuauuaaagaaacaaugugaaauaauguggaaauuaauacuga

SEQ ID NO: 451449 - RNA, 64 nt, Homo Sapiens
cucagucgggaagcuuuccagcuuccagcccuugaaugugaagugucauuggcaugucuggcag

SEQ ID NO: 451450 - RNA, 64 nt, Homo Sapiens
uuucuggcaaacguuucucaaaucugcuucauccaaugugaaguucaucuugcagcauuuacua

SEQ ID NO: 451451 - RNA, 64 nt, Homo Sapiens; identical to SEQ ID NO: 250112

SEQ ID NO: 451452 - RNA, 64 nt, Homo Sapiens; identical to SEQ ID NO: 250113

SEQ ID NO: 451453 - RNA, 64 nt, Homo Sapiens
aacuacugaaaacacuugguagcagagaaaaaaaaaugugaauaacguggugcauauuaaaaua

SEQ ID NO: 451454 - RNA, 64 nt, Homo Sapiens; identical to SEQ ID NO: 250114

SEQ ID NO: 451455 - RNA, 64 nt, Homo Sapiens; identical to SEQ ID NO: 250115

SEQ ID NO: 451456 - RNA, 64 nt, Homo Sapiens
uggccaaaagucggaaaaugugaacaaucugacaaaugugaagcgaauugccugagaacugcaa

SEQ ID NO: 451457 - RNA, 64 nt, Homo Sapiens
auuuagugaauacaguaaagguaauacaacauuuaaugugaaacuguaucuucugauuucaaag

SEQ ID NO: 451458 - RNA, 64 nt, Homo Sapiens
ucaguauguuuacuauugcuuaugaucugagcaaaaugugaacucaaucacuguucuauaggcu

SEQ ID NO: 451459 - RNA, 64 nt, Homo Sapiens
guaucacucuaaaaaacauuugguuuauuuuuguaaugugaaaacagugaccuuuucuucauuu

SEQ ID NO: 451460 - RNA, 64 nt, Homo Sapiens
ccaugauauuacugugcacuguaagugguuagugaaugugaaggagcuggcucugggugaguca

SEQ ID NO: 451461 - RNA, 64 nt, Homo Sapiens
auguaaucagacuaacaguuauauacuuggugauaaugugaaugauaauuagacacuuuagagg

SEQ ID NO: 451462 - RNA, 64 nt, Homo Sapiens
aaucaguauguuuuuagauuuguacauucggaagaaugugaaucaaaauauuauacuaauaugu

SEQ ID NO: 451463 - RNA, 64 nt, Homo Sapiens
auccguuuucauuguucacuagacuaggauauugaaugugaaacccuuuaacauagguuuuuaa

SEQ ID NO: 451464 - RNA, 64 nt, Homo Sapiens
aagauuguacacauuuuuuucaaugaaguacaauaaugugaacugcauguguaaacagcaucac

SEQ ID NO: 451465 - RNA, 64 nt, Homo Sapiens
augccaagaacuguauuuacugugguuguggacaaaugugaaaguaacuuuaugcuuaaauaaa

SEQ ID NO: 451466 - RNA, 64 nt, Homo Sapiens
uuuaggauagugugauguguaacaaacaaccucaaaugugaaugccuugauuuuauuuuuaugg

SEQ ID NO: 451467 - RNA, 64 nt, Homo Sapiens
auugugagaucuguaauuuuuuuuuuuuguagaaaaugugaauuuuuugguccucuaauuuguu

SEQ ID NO: 451468 - RNA, 64 nt, Homo Sapiens
caggaguguuauguuuugccacuauuauuuucagaaugugaagauuuuacucuuggcuuaauuu

SEQ ID NO: 451469 - RNA, 64 nt, Homo Sapiens
cuaugaauucuuuaggguagaaauuuauuuagcaaaugugaauucuuuugagaaaguaugaagu

SEQ ID NO: 451470 - RNA, 64 nt, Homo Sapiens
gaaaauagcaaaacaacaaaaaagcaaaccuuaaaaugugaagaaagugugaauuuuaguuuug

SEQ ID NO: 451471 - RNA, 64 nt, Homo Sapiens
ugugaaugcauauguaugugugguuacuuuuuauaaugugaaauaaugaauaaugaauuuacuc

SEQ ID NO: 451472 - RNA, 64 nt, Homo Sapiens
ucguaucuuuaaggagcauuggagauauuugggaaaugugaaguucuugccaagaggucuccca

SEQ ID NO: 451473 - RNA, 64 nt, Homo Sapiens
aaaggguguugcauuuuuacucuuuucagauguuaaugugaaaguuagagugguuuuuguuuuu

SEQ ID NO: 451474 - RNA, 64 nt, Homo Sapiens
gcuuagaauacugcaaaggauguaugugaucgucaaugugaauaccuugcagcaagcacuacaa

SEQ ID NO: 451475 - RNA, 64 nt, Homo Sapiens
uguagcuguaaaacgcugucaaaauaguuuguuuaaugugaacuagcggcgaccgcccuccgcg

SEQ ID NO: 451476 - RNA, 64 nt, Homo Sapiens; identical to SEQ ID NO: 250116

SEQ ID NO: 451477 - RNA, 64 nt, Homo Sapiens; identical to SEQ ID NO: 250117

SEQ ID NO: 451478 - RNA, 64 nt, Homo Sapiens
cagugacucuagggccaaaguauagauuaguuuaaaugugaauuuuaauguaaucaaaaugaaa

SEQ ID NO: 451479 - RNA, 52 nt, Homo Sapiens
cucggaaauaguaugguggucaaaugugaacuuuggguuaacugcacuuuga

SEQ ID NO: 451480 - RNA, 64 nt, Homo Sapiens
cuucccagaaauuucaaugcuuuaaacuguuuuaaaugugaauucucuuacuaaauccagauuu

SEQ ID NO: 451481 - RNA, 64 nt, Homo Sapiens
guuaacccucuaaacuuuccuaaacaacaugcuaaaugugaaauguuggcuugugaaaaguugu

SEQ ID NO: 451482 - RNA, 64 nt, Homo Sapiens
aucuuaaauuuagcuugucuugauacaauuuucaaaugugaacauuuaucacuagcagagagua

SEQ ID NO: 451483 - RNA, 64 nt, Homo Sapiens
gagcuuuacuuucaaaauguuugguacguuggaaaaugugaaaaccaaggcauguaggaaaaua

SEQ ID NO: 451484 - RNA, 64 nt, Homo Sapiens
aacaacagcaacaagaccagugaaaaaccacuuaaaugugaagggugggaggagggaggaaaga

SEQ ID NO: 451485 - RNA, 64 nt, Homo Sapiens
uuaccagcaguuccagccaaagcuaggaggaaaaaaugugaaucuccccauuccccuacuccug

SEQ ID NO: 451486 - RNA, 64 nt, Homo Sapiens
ugcauguucagauguuuacucuuauuccacacugaaugugaaaucacgcgaaccuaugacacuu

SEQ ID NO: 451487 - RNA, 64 nt, Homo Sapiens
gcugccuaaccacucaagagaauuuuacacaucuaaugugaacucuagagauuuagguuuaauu

SEQ ID NO: 451488 - RNA, 64 nt, Homo Sapiens
uucuaucauguaccguuagcucuuuaaacuuuuaaaugugaaaugccaccacacccagccucca

SEQ ID NO: 451489 - RNA, 64 nt, Homo Sapiens
uccugucucccaccucagcauggcccagaaaccaaaugugaacuccaccccuccugccccacuu

SEQ ID NO: 451490 - RNA, 64 nt, Homo Sapiens
cugaguaagguugcucucaggcuguacuaagauaaaugugaaguucuauuaaaucuuuuuuaau

SEQ ID NO: 451491 - RNA, 64 nt, Homo Sapiens
cuacaguuuccaggugaggccagacagcguccacaaugugaauccuuaauggugcucacuuuag

SEQ ID NO: 451492 - RNA, 64 nt, Homo Sapiens; identical to SEQ ID NO: 250118

SEQ ID NO: 451493 - RNA, 64 nt, Homo Sapiens; identical to SEQ ID NO: 250119

SEQ ID NO: 451494 - RNA, 64 nt, Homo Sapiens
aaaucuggaggagaggauaauuuccacuguguggaaugugaauaguuaaaugaaaaguuauggu

SEQ ID NO: 451495 - RNA, 64 nt, Homo Sapiens
gccuccuccucucaguauucucuccaaagauugaaaugugaagccccagccccacccucugccc

SEQ ID NO: 451496 - RNA, 64 nt, Homo Sapiens
caccuuaaacucuuguucaguucacauuaauugaaaugugaacuugccugucguuugcaacuuc

SEQ ID NO: 451497 - RNA, 64 nt, Homo Sapiens
gucgguucaugaaaagcuaugaaacagcaugcuaaaugugaaaugucaacccucacuaaacuuu

SEQ ID NO: 451498 - RNA, 64 nt, Homo Sapiens
cagaauuguauuucaguuuugaagauuuaaaaaaaaugugaaaauaaauauauauuaguauccu

SEQ ID NO: 451499 - RNA, 64 nt, Homo Sapiens; identical to SEQ ID NO: 250120

SEQ ID NO: 451500 - RNA, 64 nt, Homo Sapiens; identical to SEQ ID NO: 250121

SEQ ID NO: 451501 - RNA, 64 nt, Homo Sapiens; identical to SEQ ID NO: 250122

SEQ ID NO: 451502 - RNA, 64 nt, Homo Sapiens
gauccauccagacauuugcaaacgucaggagaaaaaugugaauuauuuauccagaugcauguca

SEQ ID NO: 451503 - RNA, 64 nt, Homo Sapiens
aauuauugcuuucauuccuuaccccccucaagcaaaugugaaaaguauacugaccuaagauucu

SEQ ID NO: 451504 - RNA, 64 nt, Homo Sapiens
cugcuuugugcugauaucagaacagcagaaauuaaaugugaaauguuucugaugacuuauguuc

SEQ ID NO: 451505 - RNA, 64 nt, Homo Sapiens
aggccccaggccagagccacccaaugaacagugcaaugugaaggaaggcaggagccugcagggg

SEQ ID NO: 451506 - RNA, 64 nt, Homo Sapiens
ccaaugcugauguccucaccacaugcggagaacaaaugugaagggaguaggauauugggucagu

SEQ ID NO: 451507 - RNA, 64 nt, Homo Sapiens
guaaacugagcccuuuguuuaaaaaacaauuccaaaugugaaacuagaaugagagggaagagau

SEQ ID NO: 451508 - RNA, 64 nt, Homo Sapiens
ccauuuauaucauagcagaagaaauaggauuaucaaugugaacugcuuagcauggugccuggua

SEQ ID NO: 451509 - RNA, 64 nt, Homo Sapiens
aagcuugucgguucaaagaggaaagaugaauuucaaugugaaaacacguuuuguugagggcugu

SEQ ID NO: 451510 - RNA, 64 nt, Homo Sapiens
caaguauggacucaugagcuauuguugguugcuaaaugugaaucacgcgggagugagugugccc

SEQ ID NO: 451511 - RNA, 64 nt, Homo Sapiens
uggauuaaacuuaaucuaaaauaggaacuuaaauaaugugaaacccacuuuuaacucuugaaau

SEQ ID NO: 451512 - RNA, 64 nt, Homo Sapiens
caugggcugacugagacaaugcaacaagaacacaaaugugaaauucaagcaacagaggaccaau

SEQ ID NO: 451513 - RNA, 64 nt, Homo Sapiens
uacuuggagaaacugaggccucugcuaaagaucaaaugugaaagcugucucugcagguuagaag

SEQ ID NO: 451514 - RNA, 64 nt, Homo Sapiens
uuauuuuuguuaaaacaggaauuauguagaauggaaugugaaaaugcauuuuggaaauguccuc

SEQ ID NO: 451515 - RNA, 64 nt, Homo Sapiens
aaauuauagucagccauaaaaacuauacuaucaaaaugugaauauaaauagguacaguaaugaa

SEQ ID NO: 451516 - RNA, 64 nt, Homo Sapiens
ugaagauuuauuucuuuuaaggacugcaacaaaaaaugugaaaacuaaccaacuaguuaccuuu

SEQ ID NO: 451517 - RNA, 64 nt, Homo Sapiens
aagcuauguguccaggguauugaguuuguucacuaaugugaaauucagaacuuuauaaaaaucu

SEQ ID NO: 451518 - RNA, 64 nt, Homo Sapiens
acaguuuuccugcaaaauuauuaaugagauuaauaaugugaaauuuauuuauaggaaaguuaua

SEQ ID NO: 451519 - RNA, 64 nt, Homo Sapiens
ugugggugcagugggcccaaccggccuccuucacaaugugaagccccugccuguuccccuucuc

SEQ ID NO: 451520 - RNA, 64 nt, Homo Sapiens
cagacugcauuuuaaaauugugaaauuguucauuaaugugaauauucccuugucaaaaauuagu

SEQ ID NO: 451521 - RNA, 64 nt, Homo Sapiens
uauuuauuugugaauaaacuaggaggcucugccuaaugugaauucuagacacuuugaggcaagc

SEQ ID NO: 451522 - RNA, 64 nt, Homo Sapiens
guuuacagggcauuccaagugauucuuaucaggaaaugugaaaaacacuccuguacauaaucgg

SEQ ID NO: 451523 - RNA, 64 nt, Homo Sapiens
cagaggcguucguaugugacccacagauggcgucaaugugaacaccucucuuugugcugaauuu

SEQ ID NO: 451524 - RNA, 64 nt, Homo Sapiens
auuccaggaaagagagauucccuggaaaauugaaaaugugaauccuagggggaaauuggggauu

SEQ ID NO: 451525 - RNA, 64 nt, Homo Sapiens
aaacagguguacaguuaucguuguacuuuuguacaaugugaauuuuguuaauaaauuauaaggu

SEQ ID NO: 451526 - RNA, 64 nt, Homo Sapiens
accaccauuaauuaguugggguggaguuuacuguaaugugaaauuuucacauuugaauuuuuua

SEQ ID NO: 451527 - RNA, 64 nt, Homo Sapiens
guuugaauacuugaaucaugcaggccaauauuauaaugugaaaagguaucuacucuauuuacac

SEQ ID NO: 451528 - RNA, 64 nt, Homo Sapiens
uuguuugucaaugauuugucagagaaccuguugaaaugugaauuaagaagcuaagaaaauauuu

SEQ ID NO: 451529 - RNA, 64 nt, Homo Sapiens
gccaagcacagugccugcauguauuuauccaauaaaugugaaauucuguccaguuuuguggugg

SEQ ID NO: 451530 - RNA, 64 nt, Homo Sapiens
auaauccauacuagagaaacacuauagauguaaaaaugugaaaaguuuuauucaaaauaucaaa

SEQ ID NO: 451531 - RNA, 64 nt, Homo Sapiens
gauuuugcuguauauuugugauagcacuuucuacaaugugaacuuuauuaaauacaaaacuucc

SEQ ID NO: 451532 - RNA, 64 nt, Homo Sapiens
gugaccguuugcuauauuccuuuuucuaugaaauaaugugaaugauaauaaaacagcuuugacu

SEQ ID NO: 451533 - RNA, 64 nt, Homo Sapiens
gacucaaggucacuagaaaugggccagcugggucaaugugaagccccaaauuugcccagauuca

SEQ ID NO: 451534 - RNA, 64 nt, Homo Sapiens
guaauuuaaaccuuggaucuucaaaaaauaaaauaaugugaagcaaaaccaacuaaaaagugau

SEQ ID NO: 451535 - RNA, 64 nt, Homo Sapiens
agugaggaucuugauuuggaucucuuuuuauuuaaaugugaauuucaacuuuugacaaucaaag

SEQ ID NO: 451536 - RNA, 64 nt, Homo Sapiens
gauuuucuagaagcacuauuuacacaaauaugcaaaugugaaauaaccgaucuauaacgugaag

SEQ ID NO: 451537 - RNA, 64 nt, Homo Sapiens
uuccuggcuuccaugugacuuauuuucagguuggaaugugaagguaggcgagggguucggagug

SEQ ID NO: 451538 - RNA, 64 nt, Homo Sapiens
cugacgaacugaaaagcuaaggggauuucguguaaaugugaacaaauuuggaaauccuagccaa

SEQ ID NO: 451539 - RNA, 64 nt, Homo Sapiens
ccggcggacacgccaaauuggacgucgcuguugaaaugugaaucgccgaguccaacagagaaag

SEQ ID NO: 451540 - RNA, 64 nt, Homo Sapiens
aacuuauuucccaguguaaaaugggaaugaacauaaugugaagacaagcucacaccuguaccug

SEQ ID NO: 451541 - RNA, 64 nt, Homo Sapiens
aaccgaaaacugggggcaagaauauuuuuggaauaaugugaauccaaaugacagagccuucaaa

SEQ ID NO: 451542 - RNA, 64 nt, Homo Sapiens
guaugcagaauguuguuggucagaaagcauggggaaugugaaggcuguugacuucuucccgacc

SEQ ID NO: 451543 - RNA, 64 nt, Homo Sapiens
uauauagucuuugcagagguugagcguguacguuaaugugaauggcccgccagaggccugaagc

SEQ ID NO: 451544 - RNA, 64 nt, Homo Sapiens
caucacagcugggaagacaugggacgacgaugacaaugugaaacugaugcuccaaccucccggg

SEQ ID NO: 451545 - RNA, 64 nt, Homo Sapiens
augcuggguagaagcuguuuuaauuccccuguugaaugugaaaaagguaguaguauuccugggu

SEQ ID NO: 451546 - RNA, 60 nt, Homo Sapiens
acacugaagagcaacccugaaaaauuacugaaugugaagaaauguaaguugguuuuauca

SEQ ID NO: 451547 - RNA, 64 nt, Homo Sapiens
gaggcugcauauccaugggcgggcagcauaagagaaugugaagcccuucagugagacgagacga

SEQ ID NO: 451548 - RNA, 64 nt, Homo Sapiens
auggcccaucacucggcuguggagaacaaagaccaaugugaagacacuacagaggauucugucu

SEQ ID NO: 451549 - RNA, 64 nt, Homo Sapiens
aaucuaauucuaaggaauaugagcuuuauguaauaaugugaaucaugguuuuucuuaguagauu

SEQ ID NO: 451550 - RNA, 64 nt, Homo Sapiens
cuugcagaagagcuugaaugggacgugcagcgagaaugugaaggauggagcagguagcucaucu

SEQ ID NO: 451551 - RNA, 64 nt, Homo Sapiens
uuuuauaucaucuugucaaauugcuucaguuguaaaugugaaaaaugggcuggggaaaggaggu

SEQ ID NO: 451552 - RNA, 64 nt, Homo Sapiens
ucauuuaaucccaggaaagaggcaucaaagcuagaaugugaauauaacuuuuguggaccaauac

SEQ ID NO: 451553 - RNA, 64 nt, Homo Sapiens
ucagauuucaagagagcucaagcuuucagaagucaaugugaaaauuccuuccuaggcuguccca

SEQ ID NO: 451554 - RNA, 64 nt, Homo Sapiens
uugaaucccacgcuucucuuuggaaacaauaugcaaugugaagcggucguguugugaguuuagu

SEQ ID NO: 451555 - RNA, 64 nt, Homo Sapiens
uuucuuguuuuccuuuuuagaaguuuuuuuccuuaaugugaaaguaauuugaccaaguuauaau

SEQ ID NO: 451556 - RNA, 64 nt, Homo Sapiens
aacacuuccugagcaccugcuacaugccaggcaaaaugugaaauuugcaugcuaugaggcuaaa

SEQ ID NO: 451557 - RNA, 64 nt, Homo Sapiens
ucuuuaaaagauuuuuuuauuguuaucaauaauaaaugugaacuauuuaaagaaaagaaugucu

SEQ ID NO: 451558 - RNA, 64 nt, Homo Sapiens
uugcccuugacaggugggggcuggcuggggccuuaaugugaaaagacaguggcaggcagcugga

SEQ ID NO: 451559 - RNA, 64 nt, Homo Sapiens
aauugagacggacuuugacaaaacacgaaaugguaaugugaagcuaagagcagagagugaccaa

SEQ ID NO: 451560 - RNA, 64 nt, Homo Sapiens
ucuuugucacuguccuguauaaagaaaugcacgaaaugugaaguuaaugaaagaaaaugugacc

SEQ ID NO: 451561 - RNA, 64 nt, Homo Sapiens
ucuuugucacuccauuuuguaaagaaaugcacaaaaugugaaaacuaacugcugaaaggugacc

SEQ ID NO: 451562 - RNA, 64 nt, Homo Sapiens
uuaagaaggaaacuugacuuaccuauuuagauuuaaugugaaaugaaguagugguauggauaua

SEQ ID NO: 451563 - RNA, 64 nt, Homo Sapiens
ucuggaaauuuucuuugggguuuuuaaggaaaauaaugugaaauuauuacuagagcaagauggg

SEQ ID NO: 451564 - RNA, 64 nt, Homo Sapiens
auuuuuuucauuucauuuuuacagauuuuauuuuaaugugaauuauugucuucuaugccacccu

SEQ ID NO: 451565 - RNA, 64 nt, Homo Sapiens
aaaaaaaaaaagauaccugacaaggauuacagugaaugugaaaagacgugacauugacaucaaa

SEQ ID NO: 451566 - RNA, 64 nt, Homo Sapiens
gaguuagauacuauuuuacuagccaaaguccuacaaugugaaaauuuuccuagaccugguuguc

SEQ ID NO: 451567 - RNA, 64 nt, Homo Sapiens
guuaauacuaguugugaccugaaacaauacucauaaugugaaguccaugaaucgcuucucuuuu

SEQ ID NO: 451568 - RNA, 64 nt, Homo Sapiens
aaaggaagaaaaucaaggaaaaaagucacuuuugaaugugaacauccuuaaagaaacaaagucc

SEQ ID NO: 451569 - RNA, 64 nt, Homo Sapiens
uuuggaagccuugaguucagcauagaguuuucaaaaugugaauccuggagaacccuccuaaauc

SEQ ID NO: 451570 - RNA, 64 nt, Homo Sapiens
caaaggcuucuggcucugcuuuuuccuuggauuaaaugugaaagcacugauugguuuucuuucu

SEQ ID NO: 451571 - RNA, 64 nt, Homo Sapiens
uaggaaauaaaaugugcccccuagacugaaaaugaaugugaaacguacagcagaagccucucuc

SEQ ID NO: 451572 - RNA, 64 nt, Homo Sapiens
cuccccuccccaucuguguuaaauucgcauguuuaaugugaacucccaggaaaaaaaaaaaaag

SEQ ID NO: 451573 - RNA, 64 nt, Homo Sapiens
caauagucaauuacauaaugaugugucccauggcaaugugaauccaauaucacagaaucagacc

SEQ ID NO: 451574 - RNA, 64 nt, Homo Sapiens
uuaccacuucuuuuuauggcacuugaacuucauaaaugugaagaaguauauauauauauauaua

SEQ ID NO: 451575 - RNA, 64 nt, Homo Sapiens
aaaucucauauauauaguuucugaguagguagaaaaugugaaauuguagcaacagcucacauga

SEQ ID NO: 451576 - RNA, 64 nt, Homo Sapiens
uuucuugcuucuccuuuuuaaagauacauaaagcaaugugaaaguucauaacuaaugcauagaa

SEQ ID NO: 451577 - RNA, 64 nt, Homo Sapiens; identical to SEQ ID NO: 250123

SEQ ID NO: 451578 - RNA, 64 nt, Homo Sapiens; identical to SEQ ID NO: 250124

SEQ ID NO: 451579 - RNA, 64 nt, Homo Sapiens
aacaugauuucuugccgggcguggugggguggggaaugugaauaggagugaaagugacucucag

SEQ ID NO: 451580 - RNA, 64 nt, Homo Sapiens
uccaggccgagaggaugcugucuaagcuuuugauaaugugaagcgcccagagguuuacaaguuu

SEQ ID NO: 451581 - RNA, 64 nt, Homo Sapiens
uuguauugaaaaagaucgcgaauaaaaaucaacaaaugugaaagcccagaaaaauauauucgua

SEQ ID NO: 451582 - RNA, 64 nt, Homo Sapiens
agggaaauuaaaccauucaugaauaaacuuuaaaaaugugaaguguccuuuuccuuuucacaau

SEQ ID NO: 451583 - RNA, 64 nt, Homo Sapiens
agucuuaaguuguuuaugcuuuaucagacuggcuaaugugaaagcauaauauuaugaaguuuau

SEQ ID NO: 451584 - RNA, 64 nt, Homo Sapiens
acuauaaggcagggaagguucauuuguaaguaguaaugugaacugaauugcauuaagagugugu

SEQ ID NO: 451585 - RNA, 64 nt, Homo Sapiens
caauuugaagaaagacugcauuguaauugagaggaaugugaaggugcauucaugggugcccuug

SEQ ID NO: 451586 - RNA, 64 nt, Homo Sapiens
acuuuuauaacaguuuaccacuaugcuugauuauaaugugaaaggcggaauucugaguguguua

SEQ ID NO: 451587 - RNA, 64 nt, Homo Sapiens
gauuuuaaaucaguguauaaucuagaugguaaaaaaugugaaauugggauuagggaccaaccaa

SEQ ID NO: 451588 - RNA, 64 nt, Homo Sapiens
ugaauuauguuucaucaaugugcagaauaaucacaaugugaauuaucaaauucuccucaaugcc

SEQ ID NO: 451589 - RNA, 64 nt, Homo Sapiens
cgucaauaacuucauuugcgguggaacgauuuccaaugugaagaggguugauuuaugcugggca

SEQ ID NO: 451590 - RNA, 64 nt, Homo Sapiens
uggacuucaugcaaguuggccaaaccauuuuuaaaaugugaagaauggcauauauguucaaauu

SEQ ID NO: 451591 - RNA, 64 nt, Homo Sapiens
agugaugguuuuugaaauaaggaugcaguuuaaaaaugugaaguuuuacaguucuguaaugcaa

SEQ ID NO: 451592 - RNA, 64 nt, Homo Sapiens
caaaaacuuguauguuaacuuaguuuuuauuauuaaugugaaagugaaaguauacuaaguaagu

SEQ ID NO: 451593 - RNA, 64 nt, Homo Sapiens
ucuugaauccuguuacaaauuguauuacaauaucaaugugaauagaaaauguacuguuuuagaa

SEQ ID NO: 451594 - RNA, 64 nt, Homo Sapiens
auuuuauguucaauccauauagacuauagaucaaaaugugaaacugaucgagcuguuaauuuuu

SEQ ID NO: 451595 - RNA, 64 nt, Homo Sapiens
aucaguguugucuauaaauacucuuucauuauggaaugugaaauuugcucagaaaagaugcuga

SEQ ID NO: 451596 - RNA, 64 nt, Homo Sapiens
aaaacaaaaauauaauggcuaaagugauggaauuaaugugaaaucagcacaaaauaugcauaua

SEQ ID NO: 451597 - RNA, 64 nt, Homo Sapiens
uaaacucuaauuaauuccaaacaaauaguuuauaaaugugaacuguaauugaacuuauccuaaa

SEQ ID NO: 451598 - RNA, 64 nt, Homo Sapiens
ggaccccccacccaggggaccugcuccgugagauaaugugaaauacgacuguggaccaaacgca

SEQ ID NO: 451599 - RNA, 64 nt, Homo Sapiens
uuuuuuaaucugcugccauauuguagcucaauacaaugugaauuuguuuuucguuuugggguuu

SEQ ID NO: 451600 - RNA, 64 nt, Homo Sapiens
cauguaagaauguacccuggaucaaaacacuauaaaugugaaaacuacaaggaagguuuuccau

SEQ ID NO: 451601 - RNA, 64 nt, Homo Sapiens
uuuaacuacuguaaggagaggagcggcguuggcaaaugugaaccaugagaauaucagugauacu

SEQ ID NO: 451602 - RNA, 64 nt, Homo Sapiens
uauaaaaguaaucauacuggugagaaauucuaaaaaugugaagacuauggcaaagucuuuaaau

SEQ ID NO: 451603 - RNA, 64 nt, Homo Sapiens; identical to SEQ ID NO: 250125

SEQ ID NO: 451604 - RNA, 64 nt, Homo Sapiens; identical to SEQ ID NO: 250126

SEQ ID NO: 451605 - RNA, 64 nt, Homo Sapiens; identical to SEQ ID NO: 250127

SEQ ID NO: 451606 - RNA, 64 nt, Homo Sapiens; identical to SEQ ID NO: 250128

SEQ ID NO: 451607 - RNA, 64 nt, Homo Sapiens; identical to SEQ ID NO: 250129

SEQ ID NO: 451608 - RNA, 64 nt, Homo Sapiens; identical to SEQ ID NO: 250130

SEQ ID NO: 451609 - RNA, 64 nt, Homo Sapiens; identical to SEQ ID NO: 250131

SEQ ID NO: 451610 - RNA, 64 nt, Homo Sapiens; identical to SEQ ID NO: 250132

SEQ ID NO: 451611 - RNA, 64 nt, Homo Sapiens; identical to SEQ ID NO: 250133

SEQ ID NO: 451612 - RNA, 64 nt, Homo Sapiens; identical to SEQ ID NO: 250134

SEQ ID NO: 451613 - RNA, 64 nt, Homo Sapiens
acaucggggaauuuaugcugguaggaaacuuucaaaugugaagaauauuggcaggucuauucuc

SEQ ID NO: 451614 - RNA, 64 nt, Homo Sapiens
gggaaacucaaucaauguuauugugaaaacugggaaugugaauguaauauauguagaaaaacau

SEQ ID NO: 451615 - RNA, 64 nt, Homo Sapiens
guucucugguuguuagcagcaaagaauucucacaaaugugaauaugggcgcacauuugccucau

SEQ ID NO: 451616 - RNA, 64 nt, Homo Sapiens
aggacacagacugcgaccagaacagaaauaugaaaaugugaaugacagcgucccccgugugugg

SEQ ID NO: 451617 - RNA, 64 nt, Homo Sapiens
aguacccccaaguccucucacuccuccagccuggaaugugaagugacuccccaaccccuuuggc

SEQ ID NO: 451618 - RNA, 64 nt, Homo Sapiens
gaauaaucucauccccccacccgacuucuuuugaaaugugaacguccuuccuugacugucuagc

SEQ ID NO: 451619 - RNA, 64 nt, Homo Sapiens
accucagagggcuuuucugaggauuaaauaaauaaaugugaagcacuuagaacugauggccagc

SEQ ID NO: 451620 - RNA, 64 nt, Homo Sapiens
caucauagacuucauacuggagagaaaccuuacaaaugugaagcaugugacaaaguuuucaguc

SEQ ID NO: 451621 - RNA, 64 nt, Homo Sapiens
gacagaggcggccccucccacggcucccaauaaaaaugugaaaaccaacccccgaacgugagca

SEQ ID NO: 451622 - RNA, 64 nt, Homo Sapiens
gcacagauuauuuuuauagugauuuuugcagcuaaaugugaaggcaacugucuuaagucccuuc

SEQ ID NO: 451623 - RNA, 64 nt, Homo Sapiens
gcaaguaacauugacuguaagaccucuguagggcaaugugaaaaucaugauugcuacagaagca

SEQ ID NO: 451624 - RNA, 64 nt, Homo Sapiens
uaacaugcacaggccugcuugugaaucaggacugaaugugaaagggaaguauugagugaggaca

SEQ ID NO: 451625 - RNA, 64 nt, Homo Sapiens
ggggcacccccuuuucuugcuccagaaaggauugaaugugaacgcuccaacagggaaggcucug

SEQ ID NO: 451626 - RNA, 64 nt, Homo Sapiens
cacuuuuuuuuuuuuuuuaauuguagcucaauacaaugugaacuaaguaaauccugccaccaug

SEQ ID NO: 451627 - RNA, 58 nt, Homo Sapiens
ucuucaucugugaaaaaucuaucgaaugaaugugaacuccucuccgcaggcucaauga

SEQ ID NO: 451628 - RNA, 64 nt, Homo Sapiens
aacagacaaaaaaucugugccagcgacaccccacaaugugaacagcaggggaaauguauuuaug

SEQ ID NO: 451629 - RNA, 64 nt, Homo Sapiens
uugcaauaaagcaagucauacagaucaccacaauaaugugaauaagauauugcaggcuccacuc

SEQ ID NO: 451630 - RNA, 64 nt, Homo Sapiens
augugauaaaguuuuaaaugugagaaauccuagaaaugugaagacaaaacauaaaucauagugu

SEQ ID NO: 451631 - RNA, 64 nt, Homo Sapiens; identical to SEQ ID NO: 250135

SEQ ID NO: 451632 - RNA, 64 nt, Homo Sapiens; identical to SEQ ID NO: 250136

SEQ ID NO: 451633 - RNA, 64 nt, Homo Sapiens; identical to SEQ ID NO: 250137

SEQ ID NO: 451634 - RNA, 51 nt, Homo Sapiens; identical to SEQ ID NO: 250138

SEQ ID NO: 451635 - RNA, 64 nt, Homo Sapiens
aaauugaauuuaauguugaauauuugcaaacauuaaugugaaauauauguaagaauugaugaug

SEQ ID NO: 451636 - RNA, 64 nt, Homo Sapiens
ugcgcgucucugcuaaaccagcagugccuugugcaaugugaauguaucuggccucugugcccca

SEQ ID NO: 451637 - RNA, 64 nt, Homo Sapiens
uuaauucuccccuaacaucccaaaaauuaccaaaaaugugaaaaaagcacacauuauaaaaauu

SEQ ID NO: 451638 - RNA, 64 nt, Homo Sapiens
guuguuagauguucucaguguuuuugugauaaagaaugugaacaggcgucuuuuccgacuucag

SEQ ID NO: 451639 - RNA, 64 nt, Homo Sapiens; identical to SEQ ID NO: 250139

SEQ ID NO: 451640 - RNA, 64 nt, Homo Sapiens; identical to SEQ ID NO: 250140

SEQ ID NO: 451641 - RNA, 64 nt, Homo Sapiens; identical to SEQ ID NO: 250141

SEQ ID NO: 451642 - RNA, 64 nt, Homo Sapiens
uggggugagggaucacugccagcagacaggcuaaaaugugaacgacuuuuuuuuguuuguuuug

SEQ ID NO: 451643 - RNA, 64 nt, Homo Sapiens
guccagugguagaauuugaggcgagucauguagaaaugugaagaauuuuagguucugugaacuu

SEQ ID NO: 451644 - RNA, 64 nt, Homo Sapiens
uccccaucuugguggccugcguuucccucccgugaaugugaaguuagccucccggagggcccca

SEQ ID NO: 451645 - RNA, 51 nt, Homo Sapiens
augugacaaaguuuccauuuaaaugugaagcauacuggagagaaaccuuag

SEQ ID NO: 451646 - RNA, 64 nt, Homo Sapiens
cugugacaaaguugucagucagagaaaucuuacaaaugugaagacaucauagucuucauacugc

SEQ ID NO: 451647 - RNA, 64 nt, Homo Sapiens
uugaaaucuuauugugcaucuacuauugcguuucaaugugaacuuugagguuuuuuggaaagcc

SEQ ID NO: 451648 - RNA, 64 nt, Homo Sapiens
acagagugaucagaagaguggaaauccuaaaaugaaugugaacaaccagaagugauuuggaaga

SEQ ID NO: 451649 - RNA, 64 nt, Homo Sapiens
uggcaaguaaccacuguucccaguuuuggccguaaaugugaauugaaugucgacacuguagcca

SEQ ID NO: 451650 - RNA, 64 nt, Homo Sapiens
gaggcucuguuuaaaauguccccaggaauuaauaaaugugaagagagaagccucccucauuccu

SEQ ID NO: 451651 - RNA, 64 nt, Homo Sapiens
acaucucgcuguggacgccuguaaauuacugagaaaugugaaacgugcaaucuugaaacugagg

SEQ ID NO: 451652 - RNA, 64 nt, Homo Sapiens
gccgguuggcgaucucccgacagcuggauccggcaaugugaagcuuuuguuuggguuuccccgc

SEQ ID NO: 451653 - RNA, 64 nt, Homo Sapiens
aauugucuuuaauuucugucagaaugcuauugaaaaugugaauugcaugacuuguagcauauuc

SEQ ID NO: 451654 - RNA, 64 nt, Homo Sapiens
ggagaaauguaaagacugaauugaauuuuaagcuaaugugaaaucagagaauguuguaauaagu

SEQ ID NO: 451655 - RNA, 64 nt, Homo Sapiens
gucccuccuugagcucaucagaaagguuuuaugaaaugugaaccauuuugggaaaagcugauca

SEQ ID NO: 451656 - RNA, 64 nt, Homo Sapiens; identical to SEQ ID NO: 250142

SEQ ID NO: 451657 - RNA, 64 nt, Homo Sapiens; identical to SEQ ID NO: 250143

SEQ ID NO: 451658 - RNA, 64 nt, Homo Sapiens
uagggcauucacagaguagcugugaguucuugguaaugugaaaaaggccuuguuuuucagaaau

SEQ ID NO: 451659 - RNA, 64 nt, Homo Sapiens
ugagguccagcccagaucugagaggaacccuggaaaugugaagucucuguugguuugggagaga

SEQ ID NO: 451660 - RNA, 64 nt, Homo Sapiens
agggugcugggagccccuagaaguuccaaaagagaaugugaagcagaucaaggaaacuucuguu

SEQ ID NO: 451661 - RNA, 64 nt, Homo Sapiens
uauuuuuugucuguuuauuuacgcuuuuauuggaaaugugaauaaguaaagaauuacuuguguu

SEQ ID NO: 451662 - RNA, 64 nt, Homo Sapiens
acauuagcaauaaguuaaacggguggggagggaaaaugugaaacuuuugggacaagcuuuacau

SEQ ID NO: 451663 - RNA, 64 nt, Homo Sapiens
aagccucccaggcacccgcuucuccuuagaggugaaugugaauguggaaauuccucuuuuagcc

SEQ ID NO: 451664 - RNA, 64 nt, Homo Sapiens
aaagccaagcaucacuugcagaagaaaagaaaugaaugugaaagaacugauaugccuucacuca

SEQ ID NO: 451665 - RNA, 64 nt, Homo Sapiens
aacguguuaaauaaaugucacuaaggauuuguacaaugugaaaugaccagugaauaaagagaau

SEQ ID NO: 451666 - RNA, 64 nt, Homo Sapiens
cccucgacaucuugaauugccuucuucaaccggaaaugugaagagccgcugcccucuggagaac

SEQ ID NO: 451667 - RNA, 64 nt, Homo Sapiens
auggcacugaccggugcuuuuguuuuauccuuacaaugugaauaggcgccuuuuuggccuguga

SEQ ID NO: 451668 - RNA, 64 nt, Homo Sapiens
cccaagagcagagucugggcuagcaaggcuggguaaugugaaggaccaguggccucgugguuau

SEQ ID NO: 451669 - RNA, 63 nt, Homo Sapiens
acuggccagucugggaaaccauuugaucugauuaaugugaaggucuucucagaaacagacuga

SEQ ID NO: 451670 - RNA, 64 nt, Homo Sapiens
ggcauugggagaagcagucuugcaauggcaaagaaaugugaaaacaggcaaagggauccauaug

SEQ ID NO: 451671 - RNA, 64 nt, Homo Sapiens
accaauaagcuggugacucaagacacgguaacuaaaugugaaaagcuucagaaccuucucugac

SEQ ID NO: 451672 - RNA, 64 nt, Homo Sapiens
uguggaaauaauuucccagccagaaucccuauacaaugugaauauauugaaaauaucacaaguu

SEQ ID NO: 451673 - RNA, 64 nt, Homo Sapiens
guaaguauccuuaaaaacaaaaucagacugaucuaaugugaaauauuuuuuuugucagcuuauc

SEQ ID NO: 451674 - RNA, 64 nt, Homo Sapiens
gccugcacucuuccugugggaccccacccucugaaaugugaaaaaccccgccccaccccacccc

SEQ ID NO: 451675 - RNA, 64 nt, Homo Sapiens
aucugcugcaacuuggagaaccucccugcccugaaaugugaaccaagcacacuuugguuccuuc

SEQ ID NO: 451676 - RNA, 64 nt, Homo Sapiens
uaaaaucaagugcaccuacaccaacugcucucaaaaugugaacugacuuuuuuuuuuuuuuuuu

SEQ ID NO: 451677 - RNA, 64 nt, Homo Sapiens
aaacagugagaaaagaaaggcuaaacacuauguaaaugugaauggaaacuuggaaauacucguu

SEQ ID NO: 451678 - RNA, 64 nt, Homo Sapiens
auguacuagugaacaccguccucgaucuguacgaaaugugaaauguuuagggacaucuccaugc

SEQ ID NO: 451679 - RNA, 64 nt, Homo Sapiens
uacauggagguaucucccgaaucauacaaaauuaaaugugaagaccguuuaugcauaccuucau

SEQ ID NO: 451680 - RNA, 64 nt, Homo Sapiens
guuauauucggucuuugaaacugacaaucuuugaaaugugaauacuguaacaauauguuuucuu

SEQ ID NO: 451681 - RNA, 64 nt, Homo Sapiens
uuuuguaguauguauuuuucuuucuguuuucuauaaugugaaacucugggggaauuuuuguuuu

SEQ ID NO: 451682 - RNA, 64 nt, Homo Sapiens
aacuuguugaaacuguggcuagcaguugcuucaaaaugugaauuuaaacagcaguauuacuaua

SEQ ID NO: 451683 - RNA, 64 nt, Homo Sapiens
aauuuaagucuuugaucgaauugcaagugaccacaaugugaaaguuuggaucaugcuaugucug

SEQ ID NO: 451684 - RNA, 64 nt, Homo Sapiens
cacaagcucuuucuggauacaggcacggagugugaaugugaagaugccacaaugcaaaugcuua

SEQ ID NO: 451685 - RNA, 64 nt, Homo Sapiens
cgaggaaaugucuuuagagcguauccaaggaaauaaugugaauguuuacuucugggcaauuuuu

SEQ ID NO: 451686 - RNA, 64 nt, Homo Sapiens; identical to SEQ ID NO: 250144

SEQ ID NO: 451687 - RNA, 64 nt, Homo Sapiens; identical to SEQ ID NO: 250145

SEQ ID NO: 451688 - RNA, 64 nt, Homo Sapiens
ugugggcaggauacuuuuccguaccauguauguuaaugugaaucugauagagauugauauuaau

SEQ ID NO: 451689 - RNA, 64 nt, Homo Sapiens
uugaaguauguuuagucagcaugcucaggaaauaaaugugaauugcccuugagaccugcuucua

SEQ ID NO: 451690 - RNA, 64 nt, Homo Sapiens
gaguugcuccagaugagucagugaguggugaaugaaugugaaggccuagggcauuacuguauac

SEQ ID NO: 451691 - RNA, 64 nt, Homo Sapiens
gggcugggacgugaccugugcugagggcugugagaaugugaaacaacagugugaaaauuggcug

SEQ ID NO: 451692 - RNA, 64 nt, Homo Sapiens
aaagaauggaguuguuggggcaggacaugcacacaaugugaaacagacaaaaugcauuacaccu

SEQ ID NO: 451693 - RNA, 64 nt, Homo Sapiens
aagaaccucuuaagaaguccucagaaccagaagcaaugugaacucucagcgcugguccuggugg

SEQ ID NO: 451694 - RNA, 64 nt, Homo Sapiens
ccgccacccuccucgcugccauucucugggcuggaaugugaagccucagucacucuaaaugaag

SEQ ID NO: 451695 - RNA, 64 nt, Homo Sapiens
accuggugucuuguaguauaaaauaaagagaagcaaugugaagcuguuguaaagaaacuguuga

SEQ ID NO: 451696 - RNA, 64 nt, Homo Sapiens
aaacauugcugaaaaccuaaguggcaguuggacuaaugugaaaacuggcugguuggauuuuggg

SEQ ID NO: 451697 - RNA, 64 nt, Homo Sapiens
auaaaugagauaauccacaggauuuuuuuuauccaaugugaauugauacacacagaggggaacc

SEQ ID NO: 451698 - RNA, 64 nt, Homo Sapiens
guuggggggacucuggcugaauugugagauauuuaaugugaaugcacuuuuguauggcguuuuu

SEQ ID NO: 451699 - RNA, 64 nt, Homo Sapiens
gggucucucccgagggauggcuuuagucuugaugaaugugaaccaugucggaauuguuagguag

SEQ ID NO: 451700 - RNA, 64 nt, Homo Sapiens
caguauuguggucauuuugaugauauguguguaaaaugugaauaauccaauuggugucuguacu

SEQ ID NO: 451701 - RNA, 64 nt, Homo Sapiens
gaaaauguggcauuagaguagaaauaucuuuggaaaugugaaagaccccauagugaaauauuug

SEQ ID NO: 451702 - RNA, 64 nt, Homo Sapiens; identical to SEQ ID NO: 250146

SEQ ID NO: 451703 - RNA, 64 nt, Homo Sapiens; identical to SEQ ID NO: 250147

SEQ ID NO: 451704 - RNA, 64 nt, Homo Sapiens
caauuuuaagucuuucuuuggucaacuuuuuuuuaaugugaaaaguuagguaagacacuuuuuu

SEQ ID NO: 451705 - RNA, 64 nt, Homo Sapiens
auuucacaccagcaggugucuggacgaaaacaucaaugugaauaagggccaagugcaguccugu

SEQ ID NO: 451706 - RNA, 64 nt, Homo Sapiens
cauuuaaauaagagagaaaugaugccguuuuuuaaaugugaagcagacuauaauucucagcucu

SEQ ID NO: 451707 - RNA, 64 nt, Homo Sapiens
uaggcuuuguagcaagaugagcaaugcuguuggaaaugugaagucaccaguggccuuaccccug

SEQ ID NO: 451708 - RNA, 64 nt, Homo Sapiens
cucccagcaccccauucuuguauacacauggcaaaaugugaagaaacuccuuucaucucagcag

SEQ ID NO: 451709 - RNA, 64 nt, Homo Sapiens
aaauuauuaugcaaaaaugaauguuuuuucaaaaaaugugaaauguauuuuauuuucuuuauuu

SEQ ID NO: 451710 - RNA, 64 nt, Homo Sapiens
uacuugauuaaggacuacagaauugggcccuuagaaugugaaaaaaaaaaguaauuaaaaagac

SEQ ID NO: 451711 - RNA, 64 nt, Homo Sapiens
uuuuuuucacauuuaagcaggaaugcaauauaaaaaugugaaucucuuaauucucagccaugug

SEQ ID NO: 451712 - RNA, 64 nt, Homo Sapiens
ccaagaaggcagggcaguuaaccuuuuuggugccaaugugaaauguaaaugauuuuauguuuuu

SEQ ID NO: 451713 - RNA, 64 nt, Homo Sapiens; identical to SEQ ID NO: 250148

SEQ ID NO: 451714 - RNA, 64 nt, Homo Sapiens; identical to SEQ ID NO: 250149

SEQ ID NO: 451715 - RNA, 64 nt, Homo Sapiens
aaaggcuguauucagcaaggcgcuaacuugcuuaaaugugaauuacuaacuucuaaaacuguac

SEQ ID NO: 451716 - RNA, 64 nt, Homo Sapiens
cacuacaagagcagaggauuaagguuuuuuuagaaaugugaaacaacauagcaguaaaauacau

SEQ ID NO: 451717 - RNA, 64 nt, Homo Sapiens
uaacaguugcuuuggauucucuaagaugaauccaaaugugaaagaugcauguuacugccaaaac

SEQ ID NO: 451718 - RNA, 64 nt, Homo Sapiens
ucuccagagcaucuugaacaggaauauuaagauaaaugugaaucugcaauggcugaaaagaguu

SEQ ID NO: 451719 - RNA, 64 nt, Homo Sapiens
ggugaaacuggugcugacuuucaguuuuaccgugaaugugaaaaauuuagcgugcgguuuccca

SEQ ID NO: 451720 - RNA, 64 nt, Homo Sapiens
ccaguauuuguuuaguauuuuuucgucugucuguaaugugaauuauguguggcauccauguugg

SEQ ID NO: 451721 - RNA, 64 nt, Homo Sapiens
cugguuuuaugaaaccaaagaacucuuaaauuauaaugugaaacuuacuguauuugacaaagga

SEQ ID NO: 451722 - RNA, 64 nt, Homo Sapiens
gacacaagacucucagguauucagaaaagagcaaaaugugaaaauuugcuuuuuuucuuccuau

SEQ ID NO: 451723 - RNA, 64 nt, Homo Sapiens
ugaaguggaaauauugucacauccucacugcaguaaugugaaagaucgaccugcccuauuuucu

SEQ ID NO: 451724 - RNA, 64 nt, Homo Sapiens
caguuguguaugauugcauuucgugauuauuuccaaugugaaaaagccuaaaccuauugauucc

SEQ ID NO: 451725 - RNA, 64 nt, Homo Sapiens
gaccacauuugauucaacugauuagcauacaucuaaugugaaaaaguuugacugcuugaaaaag

SEQ ID NO: 451726 - RNA, 64 nt, Homo Sapiens
agaaaauacuaaaauaaaaaguuuuuugauuaaaaaugugaacaucaucuuuuuaugacuaaua

SEQ ID NO: 451727 - RNA, 64 nt, Homo Sapiens
cucucgcugcugcuagguuugggccccugacugcaaugugaaacgacauauuacagccaguuug

SEQ ID NO: 451728 - RNA, 64 nt, Homo Sapiens
uaaaaagaauucuuccaaaauggcacaucaaagaaaugugaaauuaauuuuuuuaaaaauugag

SEQ ID NO: 451729 - RNA, 64 nt, Homo Sapiens
agugccugaggaccuuugcuuggugacuuuggguaaugugaaucacggaaacaacucuauuauc

SEQ ID NO: 451730 - RNA, 64 nt, Homo Sapiens
auuugacugugagacguccucuuucuuuccaagaaaugugaauuggacacaacugauaccuguu

SEQ ID NO: 451731 - RNA, 64 nt, Homo Sapiens
cuuacuuacuuuuuguacauagaauuuaaccuaaaaugugaacugaaguuauucuugaucagau

SEQ ID NO: 451732 - RNA, 64 nt, Homo Sapiens
cggguuaaagugaugaugauagaaaugaauuaaaaaugugaaauccgauaaccuaaaauaauuu

SEQ ID NO: 451733 - RNA, 64 nt, Homo Sapiens
caacuuuuccccagggcuuugccaaggcuuauuaaaugugaacccugcccuugcaaagcagcug

SEQ ID NO: 451734 - RNA, 64 nt, Homo Sapiens; identical to SEQ ID NO: 250150

SEQ ID NO: 451735 - RNA, 64 nt, Homo Sapiens; identical to SEQ ID NO: 250151

SEQ ID NO: 451736 - RNA, 64 nt, Homo Sapiens
agcaguaaaacugaugacauaguauucauuuagaaaugugaaugauaguuacagcaguggaaua

SEQ ID NO: 451737 - RNA, 64 nt, Homo Sapiens
augagcaguaaaauagaugaaauaaguacuuagaaaugugaaaaugggauaauaacagcagugg

SEQ ID NO: 451738 - RNA, 64 nt, Homo Sapiens
augcuuuauuuagcuguauggugcacuguaaugaaaugugaaaaauacuuuuccucacuuuguu

SEQ ID NO: 451739 - RNA, 64 nt, Homo Sapiens
auuuagcgugcgguuucccaucaguuuuacugugaaugugaaaaggugaaacuguugcugacuu

SEQ ID NO: 451740 - RNA, 64 nt, Homo Sapiens
uccaguauugugagaucaauuucugaccauaugaaaugugaaaaguauauguuucuguuacaau

SEQ ID NO: 451741 - RNA, 64 nt, Homo Sapiens
aucuuaauuugagacuuuuuuauaaugguuucguaaugugaaaucaaauacuaauuuaaacucu

SEQ ID NO: 451742 - RNA, 64 nt, Homo Sapiens
gucccggcucugucuucauucucacucacguggaaaugugaacucuaacaauccuucgcuuuuc

SEQ ID NO: 451743 - RNA, 64 nt, Homo Sapiens; identical to SEQ ID NO: 160748

SEQ ID NO: 451744 - RNA, 64 nt, Homo Sapiens; identical to SEQ ID NO: 160749

SEQ ID NO: 451745 - RNA, 64 nt, Homo Sapiens; identical to SEQ ID NO: 160750

SEQ ID NO: 451746 - RNA, 64 nt, Homo Sapiens; identical to SEQ ID NO: 160751

SEQ ID NO: 451747 - RNA, 64 nt, Homo Sapiens; identical to SEQ ID NO: 160752

SEQ ID NO: 451748 - RNA, 64 nt, Homo Sapiens; identical to SEQ ID NO: 160753

SEQ ID NO: 451749 - RNA, 64 nt, Homo Sapiens; identical to SEQ ID NO: 160754

SEQ ID NO: 451750 - RNA, 64 nt, Homo Sapiens; identical to SEQ ID NO: 160755

SEQ ID NO: 451751 - RNA, 64 nt, Homo Sapiens; identical to SEQ ID NO: 160756

SEQ ID NO: 451752 - RNA, 64 nt, Homo Sapiens; identical to SEQ ID NO: 160757

SEQ ID NO: 451753 - RNA, 64 nt, Homo Sapiens; identical to SEQ ID NO: 160758

SEQ ID NO: 451754 - RNA, 64 nt, Homo Sapiens; identical to SEQ ID NO: 160759

SEQ ID NO: 451755 - RNA, 64 nt, Homo Sapiens; identical to SEQ ID NO: 160760

SEQ ID NO: 451756 - RNA, 64 nt, Homo Sapiens; identical to SEQ ID NO: 160761

SEQ ID NO: 451757 - RNA, 64 nt, Homo Sapiens; identical to SEQ ID NO: 160762

SEQ ID NO: 451758 - RNA, 64 nt, Homo Sapiens; identical to SEQ ID NO: 160763

SEQ ID NO: 451759 - RNA, 64 nt, Homo Sapiens; identical to SEQ ID NO: 160764

SEQ ID NO: 451760 - RNA, 64 nt, Homo Sapiens; identical to SEQ ID NO: 160765

SEQ ID NO: 451761 - RNA, 64 nt, Homo Sapiens; identical to SEQ ID NO: 160766

SEQ ID NO: 451762 - RNA, 64 nt, Homo Sapiens; identical to SEQ ID NO: 160767

SEQ ID NO: 451763 - RNA, 64 nt, Homo Sapiens; identical to SEQ ID NO: 160768

SEQ ID NO: 451764 - RNA, 64 nt, Homo Sapiens; identical to SEQ ID NO: 160769

SEQ ID NO: 451765 - RNA, 64 nt, Homo Sapiens; identical to SEQ ID NO: 160770

SEQ ID NO: 451766 - RNA, 61 nt, Homo Sapiens; identical to SEQ ID NO: 160771

SEQ ID NO: 451767 - RNA, 64 nt, Homo Sapiens; identical to SEQ ID NO: 368902

SEQ ID NO: 451768 - RNA, 64 nt, Homo Sapiens; identical to SEQ ID NO: 368903

SEQ ID NO: 451769 - RNA, 64 nt, Homo Sapiens; identical to SEQ ID NO: 368904

SEQ ID NO: 451770 - RNA, 64 nt, Homo Sapiens; identical to SEQ ID NO: 368905

SEQ ID NO: 451771 - RNA, 64 nt, Homo Sapiens; identical to SEQ ID NO: 368906

SEQ ID NO: 451772 - RNA, 64 nt, Homo Sapiens; identical to SEQ ID NO: 368907

SEQ ID NO: 451773 - RNA, 64 nt, Homo Sapiens; identical to SEQ ID NO: 368908

SEQ ID NO: 451774 - RNA, 64 nt, Homo Sapiens; identical to SEQ ID NO: 368909

SEQ ID NO: 451775 - RNA, 64 nt, Homo Sapiens; identical to SEQ ID NO: 368910

SEQ ID NO: 451776 - RNA, 64 nt, Homo Sapiens; identical to SEQ ID NO: 368911

SEQ ID NO: 451777 - RNA, 64 nt, Homo Sapiens; identical to SEQ ID NO: 368912

SEQ ID NO: 451778 - RNA, 64 nt, Homo Sapiens; identical to SEQ ID NO: 368913

SEQ ID NO: 451779 - RNA, 64 nt, Homo Sapiens; identical to SEQ ID NO: 368914

SEQ ID NO: 451780 - RNA, 64 nt, Homo Sapiens; identical to SEQ ID NO: 368915

SEQ ID NO: 451781 - RNA, 64 nt, Homo Sapiens; identical to SEQ ID NO: 368916

SEQ ID NO: 451782 - RNA, 64 nt, Homo Sapiens; identical to SEQ ID NO: 368917

SEQ ID NO: 451783 - RNA, 64 nt, Homo Sapiens; identical to SEQ ID NO: 368917

SEQ ID NO: 451784 - RNA, 64 nt, Homo Sapiens; identical to SEQ ID NO: 368919

SEQ ID NO: 451785 - RNA, 64 nt, Homo Sapiens; identical to SEQ ID NO: 368920

SEQ ID NO: 451786 - RNA, 64 nt, Homo Sapiens; identical to SEQ ID NO: 167062

SEQ ID NO: 451787 - RNA, 64 nt, Homo Sapiens; identical to SEQ ID NO: 167063

SEQ ID NO: 451788 - RNA, 64 nt, Homo Sapiens; identical to SEQ ID NO: 167064

SEQ ID NO: 451789 - RNA, 64 nt, Homo Sapiens; identical to SEQ ID NO: 167065

SEQ ID NO: 451790 - RNA, 64 nt, Homo Sapiens; identical to SEQ ID NO: 167066

SEQ ID NO: 451791 - RNA, 64 nt, Homo Sapiens; identical to SEQ ID NO: 167067

SEQ ID NO: 451792 - RNA, 64 nt, Homo Sapiens; identical to SEQ ID NO: 167068

SEQ ID NO: 451793 - RNA, 64 nt, Homo Sapiens; identical to SEQ ID NO: 167069

SEQ ID NO: 451794 - RNA, 64 nt, Homo Sapiens; identical to SEQ ID NO: 167070

SEQ ID NO: 451795 - RNA, 64 nt, Homo Sapiens; identical to SEQ ID NO: 167071

SEQ ID NO: 451796 - RNA, 64 nt, Homo Sapiens; identical to SEQ ID NO: 167072

SEQ ID NO: 451797 - RNA, 64 nt, Homo Sapiens; identical to SEQ ID NO: 167073

SEQ ID NO: 451798 - RNA, 64 nt, Homo Sapiens; identical to SEQ ID NO: 167074

SEQ ID NO: 451799 - RNA, 64 nt, Homo Sapiens; identical to SEQ ID NO: 167075

SEQ ID NO: 451800 - RNA, 64 nt, Homo Sapiens; identical to SEQ ID NO: 167076

SEQ ID NO: 451801 - RNA, 64 nt, Homo Sapiens; identical to SEQ ID NO: 167077

SEQ ID NO: 451802 - RNA, 64 nt, Homo Sapiens; identical to SEQ ID NO: 167078

SEQ ID NO: 451803 - RNA, 64 nt, Homo Sapiens; identical to SEQ ID NO: 167079

SEQ ID NO: 451804 - RNA, 64 nt, Homo Sapiens; identical to SEQ ID NO: 167080

SEQ ID NO: 451805 - RNA, 64 nt, Homo Sapiens; identical to SEQ ID NO: 167081

SEQ ID NO: 451806 - RNA, 64 nt, Homo Sapiens; identical to SEQ ID NO: 167082

SEQ ID NO: 451807 - RNA, 64 nt, Homo Sapiens; identical to SEQ ID NO: 167083

SEQ ID NO: 451808 - RNA, 64 nt, Homo Sapiens; identical to SEQ ID NO: 167084

SEQ ID NO: 451809 - RNA, 64 nt, Homo Sapiens; identical to SEQ ID NO: 167085

SEQ ID NO: 451810 - RNA, 64 nt, Homo Sapiens; identical to SEQ ID NO: 167086

SEQ ID NO: 451811 - RNA, 64 nt, Homo Sapiens; identical to SEQ ID NO: 167087

SEQ ID NO: 451812 - RNA, 64 nt, Homo Sapiens; identical to SEQ ID NO: 162601

SEQ ID NO: 451813 - RNA, 64 nt, Homo Sapiens; identical to SEQ ID NO: 162602

SEQ ID NO: 451814 - RNA, 64 nt, Homo Sapiens; identical to SEQ ID NO: 162603

SEQ ID NO: 451815 - RNA, 64 nt, Homo Sapiens; identical to SEQ ID NO: 162604

SEQ ID NO: 451816 - RNA, 64 nt, Homo Sapiens; identical to SEQ ID NO: 162605

SEQ ID NO: 451817 - RNA, 64 nt, Homo Sapiens; identical to SEQ ID NO: 162606

SEQ ID NO: 451818 - RNA, 64 nt, Homo Sapiens; identical to SEQ ID NO: 162607

SEQ ID NO: 451819 - RNA, 64 nt, Homo Sapiens; identical to SEQ ID NO: 162608

SEQ ID NO: 451820 - RNA, 64 nt, Homo Sapiens; identical to SEQ ID NO: 162609

SEQ ID NO: 451821 - RNA, 64 nt, Homo Sapiens; identical to SEQ ID NO: 162610

SEQ ID NO: 451822 - RNA, 64 nt, Homo Sapiens; identical to SEQ ID NO: 162611

SEQ ID NO: 451823 - RNA, 64 nt, Homo Sapiens; identical to SEQ ID NO: 162612

SEQ ID NO: 451824 - RNA, 64 nt, Homo Sapiens; identical to SEQ ID NO: 162613

SEQ ID NO: 451825 - RNA, 64 nt, Homo Sapiens; identical to SEQ ID NO: 162614

SEQ ID NO: 451826 - RNA, 64 nt, Homo Sapiens; identical to SEQ ID NO: 162615

SEQ ID NO: 451827 - RNA, 64 nt, Homo Sapiens; identical to SEQ ID NO: 162616

SEQ ID NO: 451828 - RNA, 64 nt, Homo Sapiens; identical to SEQ ID NO: 162617

SEQ ID NO: 451829 - RNA, 64 nt, Homo Sapiens; identical to SEQ ID NO: 162618

SEQ ID NO: 451830 - RNA, 64 nt, Homo Sapiens; identical to SEQ ID NO: 162619

SEQ ID NO: 451831 - RNA, 64 nt, Homo Sapiens; identical to SEQ ID NO: 162620

SEQ ID NO: 451832 - RNA, 64 nt, Homo Sapiens; identical to SEQ ID NO: 162621

SEQ ID NO: 451833 - RNA, 64 nt, Homo Sapiens; identical to SEQ ID NO: 162622

SEQ ID NO: 451834 - RNA, 64 nt, Homo Sapiens; identical to SEQ ID NO: 162623

SEQ ID NO: 451835 - RNA, 64 nt, Homo Sapiens; identical to SEQ ID NO: 162624

SEQ ID NO: 451836 - RNA, 64 nt, Homo Sapiens; identical to SEQ ID NO: 162625

SEQ ID NO: 451837 - RNA, 64 nt, Homo Sapiens; identical to SEQ ID NO: 162626

SEQ ID NO: 451838 - RNA, 64 nt, Homo Sapiens; identical to SEQ ID NO: 162627

SEQ ID NO: 451839 - RNA, 64 nt, Homo Sapiens; identical to SEQ ID NO: 162628

SEQ ID NO: 451840 - RNA, 64 nt, Homo Sapiens; identical to SEQ ID NO: 162629

SEQ ID NO: 451841 - RNA, 64 nt, Homo Sapiens; identical to SEQ ID NO: 162630

SEQ ID NO: 451842 - RNA, 64 nt, Homo Sapiens; identical to SEQ ID NO: 162631

SEQ ID NO: 451843 - RNA, 64 nt, Homo Sapiens; identical to SEQ ID NO: 162632

SEQ ID NO: 451844 - RNA, 64 nt, Homo Sapiens; identical to SEQ ID NO: 162633

SEQ ID NO: 451845 - RNA, 64 nt, Homo Sapiens; identical to SEQ ID NO: 162634

SEQ ID NO: 451846 - RNA, 64 nt, Homo Sapiens; identical to SEQ ID NO: 162635

SEQ ID NO: 451847 - RNA, 64 nt, Homo Sapiens; identical to SEQ ID NO: 162636

SEQ ID NO: 451848 - RNA, 64 nt, Homo Sapiens; identical to SEQ ID NO: 162637

SEQ ID NO: 451849 - RNA, 64 nt, Homo Sapiens; identical to SEQ ID NO: 162638

SEQ ID NO: 451850 - RNA, 64 nt, Homo Sapiens; identical to SEQ ID NO: 162639

SEQ ID NO: 451851 - RNA, 64 nt, Homo Sapiens; identical to SEQ ID NO: 162640

SEQ ID NO: 451852 - RNA, 64 nt, Homo Sapiens; identical to SEQ ID NO: 162641

SEQ ID NO: 451853 - RNA, 64 nt, Homo Sapiens; identical to SEQ ID NO: 162642

SEQ ID NO: 451854 - RNA, 64 nt, Homo Sapiens; identical to SEQ ID NO: 162643

SEQ ID NO: 451855 - RNA, 64 nt, Homo Sapiens; identical to SEQ ID NO: 162644

SEQ ID NO: 451856 - RNA, 64 nt, Homo Sapiens; identical to SEQ ID NO: 162645

SEQ ID NO: 451857 - RNA, 64 nt, Homo Sapiens; identical to SEQ ID NO: 162646

SEQ ID NO: 451858 - RNA, 64 nt, Homo Sapiens; identical to SEQ ID NO: 162647

SEQ ID NO: 451859 - RNA, 64 nt, Homo Sapiens; identical to SEQ ID NO: 162648

SEQ ID NO: 451860 - RNA, 64 nt, Homo Sapiens; identical to SEQ ID NO: 162649

SEQ ID NO: 451861 - RNA, 64 nt, Homo Sapiens; identical to SEQ ID NO: 162650

SEQ ID NO: 451862 - RNA, 64 nt, Homo Sapiens; identical to SEQ ID NO: 162651

SEQ ID NO: 451863 - RNA, 64 nt, Homo Sapiens; identical to SEQ ID NO: 162652

SEQ ID NO: 451864 - RNA, 64 nt, Homo Sapiens; identical to SEQ ID NO: 162653

SEQ ID NO: 451865 - RNA, 64 nt, Homo Sapiens; identical to SEQ ID NO: 162654

SEQ ID NO: 451866 - RNA, 64 nt, Homo Sapiens; identical to SEQ ID NO: 162655

SEQ ID NO: 451867 - RNA, 64 nt, Homo Sapiens; identical to SEQ ID NO: 162656

SEQ ID NO: 451868 - RNA, 64 nt, Homo Sapiens; identical to SEQ ID NO: 162657

SEQ ID NO: 451869 - RNA, 64 nt, Homo Sapiens; identical to SEQ ID NO: 162658

SEQ ID NO: 451870 - RNA, 64 nt, Homo Sapiens; identical to SEQ ID NO: 162659

SEQ ID NO: 451871 - RNA, 64 nt, Homo Sapiens; identical to SEQ ID NO: 162660

SEQ ID NO: 451872 - RNA, 64 nt, Homo Sapiens; identical to SEQ ID NO: 162661

SEQ ID NO: 451873 - RNA, 64 nt, Homo Sapiens; identical to SEQ ID NO: 162662

SEQ ID NO: 451874 - RNA, 64 nt, Homo Sapiens; identical to SEQ ID NO: 162663

SEQ ID NO: 451875 - RNA, 64 nt, Homo Sapiens; identical to SEQ ID NO: 162664

SEQ ID NO: 451876 - RNA, 64 nt, Homo Sapiens; identical to SEQ ID NO: 162665

SEQ ID NO: 451877 - RNA, 64 nt, Homo Sapiens; identical to SEQ ID NO: 162666

SEQ ID NO: 451878 - RNA, 64 nt, Homo Sapiens; identical to SEQ ID NO: 162667

SEQ ID NO: 451879 - RNA, 64 nt, Homo Sapiens; identical to SEQ ID NO: 162668

SEQ ID NO: 451880 - RNA, 64 nt, Homo Sapiens; identical to SEQ ID NO: 162669

SEQ ID NO: 451881 - RNA, 64 nt, Homo Sapiens; identical to SEQ ID NO: 162670

SEQ ID NO: 451882 - RNA, 64 nt, Homo Sapiens; identical to SEQ ID NO: 162671

SEQ ID NO: 451883 - RNA, 64 nt, Homo Sapiens; identical to SEQ ID NO: 162672

SEQ ID NO: 451884 - RNA, 64 nt, Homo Sapiens; identical to SEQ ID NO: 162673

SEQ ID NO: 451885 - RNA, 64 nt, Homo Sapiens; identical to SEQ ID NO: 162674

SEQ ID NO: 451886 - RNA, 64 nt, Homo Sapiens; identical to SEQ ID NO: 162675

SEQ ID NO: 451887 - RNA, 64 nt, Homo Sapiens; identical to SEQ ID NO: 162676

SEQ ID NO: 451888 - RNA, 64 nt, Homo Sapiens; identical to SEQ ID NO: 162677

SEQ ID NO: 451889 - RNA, 64 nt, Homo Sapiens; identical to SEQ ID NO: 162678

SEQ ID NO: 451890 - RNA, 64 nt, Homo Sapiens; identical to SEQ ID NO: 162679

SEQ ID NO: 451891 - RNA, 64 nt, Homo Sapiens; identical to SEQ ID NO: 162680

SEQ ID NO: 451892 - RNA, 64 nt, Homo Sapiens; identical to SEQ ID NO: 162681

SEQ ID NO: 451893 - RNA, 64 nt, Homo Sapiens; identical to SEQ ID NO: 162682

SEQ ID NO: 451894 - RNA, 64 nt, Homo Sapiens; identical to SEQ ID NO: 162683

SEQ ID NO: 451895 - RNA, 64 nt, Homo Sapiens; identical to SEQ ID NO: 162684

SEQ ID NO: 451896 - RNA, 64 nt, Homo Sapiens; identical to SEQ ID NO: 162685

SEQ ID NO: 451897 - RNA, 64 nt, Homo Sapiens; identical to SEQ ID NO: 162686

SEQ ID NO: 451898 - RNA, 64 nt, Homo Sapiens; identical to SEQ ID NO: 162687

SEQ ID NO: 451899 - RNA, 64 nt, Homo Sapiens; identical to SEQ ID NO: 162688

SEQ ID NO: 451900 - RNA, 64 nt, Homo Sapiens; identical to SEQ ID NO: 162689

SEQ ID NO: 451901 - RNA, 64 nt, Homo Sapiens; identical to SEQ ID NO: 162690

SEQ ID NO: 451902 - RNA, 64 nt, Homo Sapiens; identical to SEQ ID NO: 162691

SEQ ID NO: 451903 - RNA, 64 nt, Homo Sapiens; identical to SEQ ID NO: 162692

SEQ ID NO: 451904 - RNA, 64 nt, Homo Sapiens; identical to SEQ ID NO: 162693

SEQ ID NO: 451905 - RNA, 64 nt, Homo Sapiens; identical to SEQ ID NO: 162694

SEQ ID NO: 451906 - RNA, 64 nt, Homo Sapiens; identical to SEQ ID NO: 162695

SEQ ID NO: 451907 - RNA, 64 nt, Homo Sapiens; identical to SEQ ID NO: 162696

SEQ ID NO: 451908 - RNA, 64 nt, Homo Sapiens; identical to SEQ ID NO: 162697

SEQ ID NO: 451909 - RNA, 64 nt, Homo Sapiens; identical to SEQ ID NO: 162698

SEQ ID NO: 451910 - RNA, 64 nt, Homo Sapiens; identical to SEQ ID NO: 162699

SEQ ID NO: 451911 - RNA, 64 nt, Homo Sapiens; identical to SEQ ID NO: 162700

SEQ ID NO: 451912 - RNA, 64 nt, Homo Sapiens; identical to SEQ ID NO: 162701

SEQ ID NO: 451913 - RNA, 64 nt, Homo Sapiens; identical to SEQ ID NO: 162702

SEQ ID NO: 451914 - RNA, 64 nt, Homo Sapiens; identical to SEQ ID NO: 162703

SEQ ID NO: 451915 - RNA, 64 nt, Homo Sapiens; identical to SEQ ID NO: 162704

SEQ ID NO: 451916 - RNA, 64 nt, Homo Sapiens; identical to SEQ ID NO: 162705

SEQ ID NO: 451917 - RNA, 64 nt, Homo Sapiens; identical to SEQ ID NO: 162706

SEQ ID NO: 451918 - RNA, 64 nt, Homo Sapiens; identical to SEQ ID NO: 162707

SEQ ID NO: 451919 - RNA, 64 nt, Homo Sapiens; identical to SEQ ID NO: 162708

SEQ ID NO: 451920 - RNA, 64 nt, Homo Sapiens; identical to SEQ ID NO: 162709

SEQ ID NO: 451921 - RNA, 64 nt, Homo Sapiens; identical to SEQ ID NO: 162710

SEQ ID NO: 451922 - RNA, 64 nt, Homo Sapiens; identical to SEQ ID NO: 162711

SEQ ID NO: 451923 - RNA, 64 nt, Homo Sapiens; identical to SEQ ID NO: 162712

SEQ ID NO: 451924 - RNA, 64 nt, Homo Sapiens; identical to SEQ ID NO: 162713

SEQ ID NO: 451925 - RNA, 64 nt, Homo Sapiens; identical to SEQ ID NO: 162714

SEQ ID NO: 451926 - RNA, 64 nt, Homo Sapiens; identical to SEQ ID NO: 162715

SEQ ID NO: 451927 - RNA, 64 nt, Homo Sapiens; identical to SEQ ID NO: 162716

SEQ ID NO: 451928 - RNA, 64 nt, Homo Sapiens; identical to SEQ ID NO: 162717

SEQ ID NO: 451929 - RNA, 64 nt, Homo Sapiens; identical to SEQ ID NO: 162718

SEQ ID NO: 451930 - RNA, 64 nt, Homo Sapiens; identical to SEQ ID NO: 162719

SEQ ID NO: 451931 - RNA, 64 nt, Homo Sapiens; identical to SEQ ID NO: 162720

SEQ ID NO: 451932 - RNA, 64 nt, Homo Sapiens; identical to SEQ ID NO: 162721

SEQ ID NO: 451933 - RNA, 64 nt, Homo Sapiens; identical to SEQ ID NO: 162722

SEQ ID NO: 451934 - RNA, 64 nt, Homo Sapiens; identical to SEQ ID NO: 162723

SEQ ID NO: 451935 - RNA, 64 nt, Homo Sapiens; identical to SEQ ID NO: 162724

SEQ ID NO: 451936 - RNA, 64 nt, Homo Sapiens; identical to SEQ ID NO: 162725

SEQ ID NO: 451937 - RNA, 64 nt, Homo Sapiens; identical to SEQ ID NO: 162726

SEQ ID NO: 451938 - RNA, 64 nt, Homo Sapiens; identical to SEQ ID NO: 162727

SEQ ID NO: 451939 - RNA, 64 nt, Homo Sapiens; identical to SEQ ID NO: 162728

SEQ ID NO: 451940 - RNA, 64 nt, Homo Sapiens; identical to SEQ ID NO: 162729

SEQ ID NO: 451941 - RNA, 64 nt, Homo Sapiens; identical to SEQ ID NO: 162730

SEQ ID NO: 451942 - RNA, 64 nt, Homo Sapiens; identical to SEQ ID NO: 162731

SEQ ID NO: 451943 - RNA, 64 nt, Homo Sapiens; identical to SEQ ID NO: 162732

SEQ ID NO: 451944 - RNA, 64 nt, Homo Sapiens; identical to SEQ ID NO: 162733

SEQ ID NO: 451945 - RNA, 64 nt, Homo Sapiens; identical to SEQ ID NO: 162734

SEQ ID NO: 451946 - RNA, 64 nt, Homo Sapiens; identical to SEQ ID NO: 162735

SEQ ID NO: 451947 - RNA, 64 nt, Homo Sapiens; identical to SEQ ID NO: 162736

SEQ ID NO: 451948 - RNA, 64 nt, Homo Sapiens; identical to SEQ ID NO: 162737

SEQ ID NO: 451949 - RNA, 64 nt, Homo Sapiens; identical to SEQ ID NO: 162738

SEQ ID NO: 451950 - RNA, 64 nt, Homo Sapiens; identical to SEQ ID NO: 162739

SEQ ID NO: 451951 - RNA, 64 nt, Homo Sapiens; identical to SEQ ID NO: 162740

SEQ ID NO: 451952 - RNA, 64 nt, Homo Sapiens; identical to SEQ ID NO: 162741

SEQ ID NO: 451953 - RNA, 64 nt, Homo Sapiens; identical to SEQ ID NO: 162742

SEQ ID NO: 451954 - RNA, 64 nt, Homo Sapiens; identical to SEQ ID NO: 162743

SEQ ID NO: 451955 - RNA, 64 nt, Homo Sapiens; identical to SEQ ID NO: 162744

SEQ ID NO: 451956 - RNA, 63 nt, Homo Sapiens; identical to SEQ ID NO: 162745

SEQ ID NO: 451957 - RNA, 64 nt, Homo Sapiens; identical to SEQ ID NO: 162746

SEQ ID NO: 451958 - RNA, 64 nt, Homo Sapiens; identical to SEQ ID NO: 162747

SEQ ID NO: 451959 - RNA, 64 nt, Homo Sapiens; identical to SEQ ID NO: 162748

SEQ ID NO: 451960 - RNA, 64 nt, Homo Sapiens; identical to SEQ ID NO: 162749

SEQ ID NO: 451961 - RNA, 64 nt, Homo Sapiens; identical to SEQ ID NO: 162750

SEQ ID NO: 451962 - RNA, 64 nt, Homo Sapiens; identical to SEQ ID NO: 162751

SEQ ID NO: 451963 - RNA, 64 nt, Homo Sapiens; identical to SEQ ID NO: 162752

SEQ ID NO: 451964 - RNA, 64 nt, Homo Sapiens; identical to SEQ ID NO: 162753

SEQ ID NO: 451965 - RNA, 64 nt, Homo Sapiens; identical to SEQ ID NO: 162754

SEQ ID NO: 451966 - RNA, 64 nt, Homo Sapiens; identical to SEQ ID NO: 162755

SEQ ID NO: 451967 - RNA, 64 nt, Homo Sapiens; identical to SEQ ID NO: 162756

SEQ ID NO: 451968 - RNA, 64 nt, Homo Sapiens; identical to SEQ ID NO: 162757

SEQ ID NO: 451969 - RNA, 64 nt, Homo Sapiens; identical to SEQ ID NO: 162758

SEQ ID NO: 451970 - RNA, 64 nt, Homo Sapiens; identical to SEQ ID NO: 162759

SEQ ID NO: 451971 - RNA, 64 nt, Homo Sapiens; identical to SEQ ID NO: 162760

SEQ ID NO: 451972 - RNA, 64 nt, Homo Sapiens; identical to SEQ ID NO: 162761

SEQ ID NO: 451973 - RNA, 64 nt, Homo Sapiens; identical to SEQ ID NO: 162762

SEQ ID NO: 451974 - RNA, 64 nt, Homo Sapiens; identical to SEQ ID NO: 162763

SEQ ID NO: 451975 - RNA, 64 nt, Homo Sapiens; identical to SEQ ID NO: 162764

SEQ ID NO: 451976 - RNA, 64 nt, Homo Sapiens; identical to SEQ ID NO: 162765

SEQ ID NO: 451977 - RNA, 64 nt, Homo Sapiens; identical to SEQ ID NO: 162766

SEQ ID NO: 451978 - RNA, 64 nt, Homo Sapiens; identical to SEQ ID NO: 162767

SEQ ID NO: 451979 - RNA, 64 nt, Homo Sapiens; identical to SEQ ID NO: 162768

SEQ ID NO: 451980 - RNA, 64 nt, Homo Sapiens; identical to SEQ ID NO: 162769

SEQ ID NO: 451981 - RNA, 64 nt, Homo Sapiens; identical to SEQ ID NO: 162770

SEQ ID NO: 451982 - RNA, 64 nt, Homo Sapiens; identical to SEQ ID NO: 162771

SEQ ID NO: 451983 - RNA, 64 nt, Homo Sapiens; identical to SEQ ID NO: 162772

SEQ ID NO: 451984 - RNA, 64 nt, Homo Sapiens; identical to SEQ ID NO: 162773

SEQ ID NO: 451985 - RNA, 64 nt, Homo Sapiens; identical to SEQ ID NO: 162774

SEQ ID NO: 451986 - RNA, 64 nt, Homo Sapiens; identical to SEQ ID NO: 162775

SEQ ID NO: 451987 - RNA, 64 nt, Homo Sapiens; identical to SEQ ID NO: 162776

SEQ ID NO: 451988 - RNA, 64 nt, Homo Sapiens; identical to SEQ ID NO: 162777

SEQ ID NO: 451989 - RNA, 64 nt, Homo Sapiens; identical to SEQ ID NO: 162778

SEQ ID NO: 451990 - RNA, 64 nt, Homo Sapiens; identical to SEQ ID NO: 162779

SEQ ID NO: 451991 - RNA, 64 nt, Homo Sapiens; identical to SEQ ID NO: 162780

SEQ ID NO: 451992 - RNA, 64 nt, Homo Sapiens; identical to SEQ ID NO: 162781

SEQ ID NO: 451993 - RNA, 64 nt, Homo Sapiens; identical to SEQ ID NO: 162782

SEQ ID NO: 451994 - RNA, 64 nt, Homo Sapiens; identical to SEQ ID NO: 162783

SEQ ID NO: 451995 - RNA, 64 nt, Homo Sapiens; identical to SEQ ID NO: 162784

SEQ ID NO: 451996 - RNA, 64 nt, Homo Sapiens; identical to SEQ ID NO: 162785

SEQ ID NO: 451997 - RNA, 64 nt, Homo Sapiens; identical to SEQ ID NO: 162786

SEQ ID NO: 451998 - RNA, 64 nt, Homo Sapiens; identical to SEQ ID NO: 162787

SEQ ID NO: 451999 - RNA, 64 nt, Homo Sapiens; identical to SEQ ID NO: 162788

SEQ ID NO: 452000 - RNA, 64 nt, Homo Sapiens; identical to SEQ ID NO: 162789

SEQ ID NO: 452001 - RNA, 64 nt, Homo Sapiens; identical to SEQ ID NO: 162790

SEQ ID NO: 452002 - RNA, 64 nt, Homo Sapiens; identical to SEQ ID NO: 162791

SEQ ID NO: 452003 - RNA, 64 nt, Homo Sapiens; identical to SEQ ID NO: 162792

SEQ ID NO: 452004 - RNA, 64 nt, Homo Sapiens; identical to SEQ ID NO: 162793

SEQ ID NO: 452005 - RNA, 64 nt, Homo Sapiens; identical to SEQ ID NO: 162794

SEQ ID NO: 452006 - RNA, 64 nt, Homo Sapiens; identical to SEQ ID NO: 162795

SEQ ID NO: 452007 - RNA, 64 nt, Homo Sapiens; identical to SEQ ID NO: 162796

SEQ ID NO: 452008 - RNA, 64 nt, Homo Sapiens; identical to SEQ ID NO: 162797

SEQ ID NO: 452009 - RNA, 64 nt, Homo Sapiens; identical to SEQ ID NO: 162798

SEQ ID NO: 452010 - RNA, 64 nt, Homo Sapiens; identical to SEQ ID NO: 162799

SEQ ID NO: 452011 - RNA, 64 nt, Homo Sapiens; identical to SEQ ID NO: 162800

SEQ ID NO: 452012 - RNA, 64 nt, Homo Sapiens; identical to SEQ ID NO: 162801

SEQ ID NO: 452013 - RNA, 64 nt, Homo Sapiens; identical to SEQ ID NO: 162802

SEQ ID NO: 452014 - RNA, 64 nt, Homo Sapiens; identical to SEQ ID NO: 162803

SEQ ID NO: 452015 - RNA, 64 nt, Homo Sapiens; identical to SEQ ID NO: 162804

SEQ ID NO: 452016 - RNA, 64 nt, Homo Sapiens; identical to SEQ ID NO: 162805

SEQ ID NO: 452017 - RNA, 64 nt, Homo Sapiens; identical to SEQ ID NO: 162806

SEQ ID NO: 452018 - RNA, 64 nt, Homo Sapiens; identical to SEQ ID NO: 162807

SEQ ID NO: 452019 - RNA, 64 nt, Homo Sapiens; identical to SEQ ID NO: 162808

SEQ ID NO: 452020 - RNA, 64 nt, Homo Sapiens; identical to SEQ ID NO: 162809

SEQ ID NO: 452021 - RNA, 64 nt, Homo Sapiens; identical to SEQ ID NO: 162810

SEQ ID NO: 452022 - RNA, 64 nt, Homo Sapiens; identical to SEQ ID NO: 162811

SEQ ID NO: 452023 - RNA, 64 nt, Homo Sapiens; identical to SEQ ID NO: 162812

SEQ ID NO: 452024 - RNA, 64 nt, Homo Sapiens; identical to SEQ ID NO: 162813

SEQ ID NO: 452025 - RNA, 62 nt, Homo Sapiens; identical to SEQ ID NO: 162814

SEQ ID NO: 452026 - RNA, 64 nt, Homo Sapiens; identical to SEQ ID NO: 162815

SEQ ID NO: 452027 - RNA, 64 nt, Homo Sapiens; identical to SEQ ID NO: 162816

SEQ ID NO: 452028 - RNA, 64 nt, Homo Sapiens; identical to SEQ ID NO: 162817

SEQ ID NO: 452029 - RNA, 64 nt, Homo Sapiens; identical to SEQ ID NO: 162818

SEQ ID NO: 452030 - RNA, 64 nt, Homo Sapiens; identical to SEQ ID NO: 162819

SEQ ID NO: 452031 - RNA, 64 nt, Homo Sapiens; identical to SEQ ID NO: 162820

SEQ ID NO: 452032 - RNA, 64 nt, Homo Sapiens; identical to SEQ ID NO: 162821

SEQ ID NO: 452033 - RNA, 64 nt, Homo Sapiens; identical to SEQ ID NO: 162822

SEQ ID NO: 452034 - RNA, 64 nt, Homo Sapiens; identical to SEQ ID NO: 162823

SEQ ID NO: 452035 - RNA, 64 nt, Homo Sapiens; identical to SEQ ID NO: 162824

SEQ ID NO: 452036 - RNA, 64 nt, Homo Sapiens; identical to SEQ ID NO: 162825

SEQ ID NO: 452037 - RNA, 64 nt, Homo Sapiens; identical to SEQ ID NO: 162826

SEQ ID NO: 452038 - RNA, 64 nt, Homo Sapiens; identical to SEQ ID NO: 162827

SEQ ID NO: 452039 - RNA, 64 nt, Homo Sapiens; identical to SEQ ID NO: 162828

SEQ ID NO: 452040 - RNA, 64 nt, Homo Sapiens; identical to SEQ ID NO: 162829

SEQ ID NO: 452041 - RNA, 64 nt, Homo Sapiens; identical to SEQ ID NO: 162830

SEQ ID NO: 452042 - RNA, 64 nt, Homo Sapiens; identical to SEQ ID NO: 162831

SEQ ID NO: 452043 - RNA, 64 nt, Homo Sapiens; identical to SEQ ID NO: 162832

SEQ ID NO: 452044 - RNA, 64 nt, Homo Sapiens; identical to SEQ ID NO: 162833

SEQ ID NO: 452045 - RNA, 64 nt, Homo Sapiens; identical to SEQ ID NO: 162834

SEQ ID NO: 452046 - RNA, 64 nt, Homo Sapiens; identical to SEQ ID NO: 162835

SEQ ID NO: 452047 - RNA, 64 nt, Homo Sapiens; identical to SEQ ID NO: 162836

SEQ ID NO: 452048 - RNA, 64 nt, Homo Sapiens; identical to SEQ ID NO: 162837

SEQ ID NO: 452049 - RNA, 64 nt, Homo Sapiens; identical to SEQ ID NO: 162838

SEQ ID NO: 452050 - RNA, 64 nt, Homo Sapiens; identical to SEQ ID NO: 162839

SEQ ID NO: 452051 - RNA, 64 nt, Homo Sapiens; identical to SEQ ID NO: 162840

SEQ ID NO: 452052 - RNA, 64 nt, Homo Sapiens; identical to SEQ ID NO: 162841

SEQ ID NO: 452053 - RNA, 64 nt, Homo Sapiens; identical to SEQ ID NO: 162842

SEQ ID NO: 452054 - RNA, 64 nt, Homo Sapiens; identical to SEQ ID NO: 162843

SEQ ID NO: 452055 - RNA, 64 nt, Homo Sapiens; identical to SEQ ID NO: 162844

SEQ ID NO: 452056 - RNA, 64 nt, Homo Sapiens; identical to SEQ ID NO: 162845

SEQ ID NO: 452057 - RNA, 64 nt, Homo Sapiens; identical to SEQ ID NO: 162846

SEQ ID NO: 452058 - RNA, 64 nt, Homo Sapiens; identical to SEQ ID NO: 162847

SEQ ID NO: 452059 - RNA, 64 nt, Homo Sapiens; identical to SEQ ID NO: 162848

SEQ ID NO: 452060 - RNA, 64 nt, Homo Sapiens; identical to SEQ ID NO: 162849

SEQ ID NO: 452061 - RNA, 64 nt, Homo Sapiens; identical to SEQ ID NO: 162850

SEQ ID NO: 452062 - RNA, 64 nt, Homo Sapiens; identical to SEQ ID NO: 162851

SEQ ID NO: 452063 - RNA, 64 nt, Homo Sapiens; identical to SEQ ID NO: 162852

SEQ ID NO: 452064 - RNA, 64 nt, Homo Sapiens; identical to SEQ ID NO: 162853

SEQ ID NO: 452065 - RNA, 64 nt, Homo Sapiens; identical to SEQ ID NO: 162854

SEQ ID NO: 452066 - RNA, 64 nt, Homo Sapiens; identical to SEQ ID NO: 162855

SEQ ID NO: 452067 - RNA, 64 nt, Homo Sapiens; identical to SEQ ID NO: 162856

SEQ ID NO: 452068 - RNA, 64 nt, Homo Sapiens; identical to SEQ ID NO: 162857

SEQ ID NO: 452069 - RNA, 64 nt, Homo Sapiens; identical to SEQ ID NO: 162858

SEQ ID NO: 452070 - RNA, 64 nt, Homo Sapiens; identical to SEQ ID NO: 162859

SEQ ID NO: 452071 - RNA, 64 nt, Homo Sapiens; identical to SEQ ID NO: 162860

SEQ ID NO: 452072 - RNA, 64 nt, Homo Sapiens; identical to SEQ ID NO: 162861

SEQ ID NO: 452073 - RNA, 64 nt, Homo Sapiens; identical to SEQ ID NO: 162862

SEQ ID NO: 452074 - RNA, 64 nt, Homo Sapiens; identical to SEQ ID NO: 162863

SEQ ID NO: 452075 - RNA, 64 nt, Homo Sapiens; identical to SEQ ID NO: 162864

SEQ ID NO: 452076 - RNA, 64 nt, Homo Sapiens; identical to SEQ ID NO: 162865

SEQ ID NO: 452077 - RNA, 64 nt, Homo Sapiens; identical to SEQ ID NO: 162866

SEQ ID NO: 452078 - RNA, 64 nt, Homo Sapiens; identical to SEQ ID NO: 162867

SEQ ID NO: 452079 - RNA, 64 nt, Homo Sapiens; identical to SEQ ID NO: 162868

SEQ ID NO: 452080 - RNA, 64 nt, Homo Sapiens; identical to SEQ ID NO: 162869

SEQ ID NO: 452081 - RNA, 64 nt, Homo Sapiens; identical to SEQ ID NO: 162870

SEQ ID NO: 452082 - RNA, 64 nt, Homo Sapiens; identical to SEQ ID NO: 162871

SEQ ID NO: 452083 - RNA, 64 nt, Homo Sapiens; identical to SEQ ID NO: 162872

SEQ ID NO: 452084 - RNA, 64 nt, Homo Sapiens; identical to SEQ ID NO: 162873

SEQ ID NO: 452085 - RNA, 64 nt, Homo Sapiens; identical to SEQ ID NO: 162874

SEQ ID NO: 452086 - RNA, 64 nt, Homo Sapiens; identical to SEQ ID NO: 162875

SEQ ID NO: 452087 - RNA, 64 nt, Homo Sapiens; identical to SEQ ID NO: 162876

SEQ ID NO: 452088 - RNA, 64 nt, Homo Sapiens; identical to SEQ ID NO: 162877

SEQ ID NO: 452089 - RNA, 64 nt, Homo Sapiens; identical to SEQ ID NO: 162878

SEQ ID NO: 452090 - RNA, 64 nt, Homo Sapiens; identical to SEQ ID NO: 162879

SEQ ID NO: 452091 - RNA, 64 nt, Homo Sapiens; identical to SEQ ID NO: 162880

SEQ ID NO: 452092 - RNA, 64 nt, Homo Sapiens; identical to SEQ ID NO: 162881

SEQ ID NO: 452093 - RNA, 64 nt, Homo Sapiens; identical to SEQ ID NO: 162882

SEQ ID NO: 452094 - RNA, 64 nt, Homo Sapiens; identical to SEQ ID NO: 162883

SEQ ID NO: 452095 - RNA, 64 nt, Homo Sapiens; identical to SEQ ID NO: 162884

SEQ ID NO: 452096 - RNA, 64 nt, Homo Sapiens; identical to SEQ ID NO: 162885

SEQ ID NO: 452097 - RNA, 64 nt, Homo Sapiens; identical to SEQ ID NO: 162886

SEQ ID NO: 452098 - RNA, 64 nt, Homo Sapiens; identical to SEQ ID NO: 162887

SEQ ID NO: 452099 - RNA, 64 nt, Homo Sapiens; identical to SEQ ID NO: 162888

SEQ ID NO: 452100 - RNA, 64 nt, Homo Sapiens; identical to SEQ ID NO: 162889

SEQ ID NO: 452101 - RNA, 64 nt, Homo Sapiens; identical to SEQ ID NO: 162890

SEQ ID NO: 452102 - RNA, 64 nt, Homo Sapiens; identical to SEQ ID NO: 162891

SEQ ID NO: 452103 - RNA, 64 nt, Homo Sapiens; identical to SEQ ID NO: 162892

SEQ ID NO: 452104 - RNA, 64 nt, Homo Sapiens; identical to SEQ ID NO: 162893

SEQ ID NO: 452105 - RNA, 64 nt, Homo Sapiens; identical to SEQ ID NO: 162894

SEQ ID NO: 452106 - RNA, 64 nt, Homo Sapiens; identical to SEQ ID NO: 162895

SEQ ID NO: 452107 - RNA, 64 nt, Homo Sapiens; identical to SEQ ID NO: 162896

SEQ ID NO: 452108 - RNA, 64 nt, Homo Sapiens; identical to SEQ ID NO: 162897

SEQ ID NO: 452109 - RNA, 64 nt, Homo Sapiens; identical to SEQ ID NO: 162898

SEQ ID NO: 452110 - RNA, 64 nt, Homo Sapiens; identical to SEQ ID NO: 162899

SEQ ID NO: 452111 - RNA, 64 nt, Homo Sapiens; identical to SEQ ID NO: 162900

SEQ ID NO: 452112 - RNA, 64 nt, Homo Sapiens; identical to SEQ ID NO: 162901

SEQ ID NO: 452113 - RNA, 64 nt, Homo Sapiens; identical to SEQ ID NO: 162902

SEQ ID NO: 452114 - RNA, 64 nt, Homo Sapiens; identical to SEQ ID NO: 162903

SEQ ID NO: 452115 - RNA, 64 nt, Homo Sapiens; identical to SEQ ID NO: 162904

SEQ ID NO: 452116 - RNA, 64 nt, Homo Sapiens; identical to SEQ ID NO: 162905

SEQ ID NO: 452117 - RNA, 64 nt, Homo Sapiens; identical to SEQ ID NO: 162906

SEQ ID NO: 452118 - RNA, 64 nt, Homo Sapiens; identical to SEQ ID NO: 162907

SEQ ID NO: 452119 - RNA, 64 nt, Homo Sapiens; identical to SEQ ID NO: 162908

SEQ ID NO: 452120 - RNA, 64 nt, Homo Sapiens; identical to SEQ ID NO: 162909

SEQ ID NO: 452121 - RNA, 64 nt, Homo Sapiens; identical to SEQ ID NO: 162910

SEQ ID NO: 452122 - RNA, 64 nt, Homo Sapiens; identical to SEQ ID NO: 162911

SEQ ID NO: 452123 - RNA, 64 nt, Homo Sapiens; identical to SEQ ID NO: 162912

SEQ ID NO: 452124 - RNA, 64 nt, Homo Sapiens; identical to SEQ ID NO: 162913

SEQ ID NO: 452125 - RNA, 64 nt, Homo Sapiens; identical to SEQ ID NO: 162914

SEQ ID NO: 452126 - RNA, 64 nt, Homo Sapiens; identical to SEQ ID NO: 162915

SEQ ID NO: 452127 - RNA, 64 nt, Homo Sapiens; identical to SEQ ID NO: 162916

SEQ ID NO: 452128 - RNA, 64 nt, Homo Sapiens; identical to SEQ ID NO: 162917

SEQ ID NO: 452129 - RNA, 64 nt, Homo Sapiens; identical to SEQ ID NO: 162918

SEQ ID NO: 452130 - RNA, 64 nt, Homo Sapiens; identical to SEQ ID NO: 162919

SEQ ID NO: 452131 - RNA, 64 nt, Homo Sapiens; identical to SEQ ID NO: 162920

SEQ ID NO: 452132 - RNA, 64 nt, Homo Sapiens; identical to SEQ ID NO: 162921

SEQ ID NO: 452133 - RNA, 64 nt, Homo Sapiens; identical to SEQ ID NO: 162922

SEQ ID NO: 452134 - RNA, 53 nt, Homo Sapiens; identical to SEQ ID NO: 162923

SEQ ID NO: 452135 - RNA, 64 nt, Homo Sapiens; identical to SEQ ID NO: 162924

SEQ ID NO: 452136 - RNA, 64 nt, Homo Sapiens; identical to SEQ ID NO: 162925

SEQ ID NO: 452137 - RNA, 64 nt, Homo Sapiens; identical to SEQ ID NO: 162926

SEQ ID NO: 452138 - RNA, 64 nt, Homo Sapiens; identical to SEQ ID NO: 162927

SEQ ID NO: 452139 - RNA, 64 nt, Homo Sapiens; identical to SEQ ID NO: 162928

SEQ ID NO: 452140 - RNA, 64 nt, Homo Sapiens; identical to SEQ ID NO: 162929

SEQ ID NO: 452141 - RNA, 64 nt, Homo Sapiens; identical to SEQ ID NO: 162930

SEQ ID NO: 452142 - RNA, 64 nt, Homo Sapiens; identical to SEQ ID NO: 162931

SEQ ID NO: 452143 - RNA, 64 nt, Homo Sapiens; identical to SEQ ID NO: 162932

SEQ ID NO: 452144 - RNA, 64 nt, Homo Sapiens; identical to SEQ ID NO: 162933

SEQ ID NO: 452145 - RNA, 64 nt, Homo Sapiens; identical to SEQ ID NO: 162934

SEQ ID NO: 452146 - RNA, 64 nt, Homo Sapiens; identical to SEQ ID NO: 162935

SEQ ID NO: 452147 - RNA, 64 nt, Homo Sapiens; identical to SEQ ID NO: 162936

SEQ ID NO: 452148 - RNA, 64 nt, Homo Sapiens; identical to SEQ ID NO: 162937

SEQ ID NO: 452149 - RNA, 64 nt, Homo Sapiens; identical to SEQ ID NO: 162938

SEQ ID NO: 452150 - RNA, 64 nt, Homo Sapiens; identical to SEQ ID NO: 162939

SEQ ID NO: 452151 - RNA, 64 nt, Homo Sapiens; identical to SEQ ID NO: 162940

SEQ ID NO: 452152 - RNA, 64 nt, Homo Sapiens; identical to SEQ ID NO: 162941

SEQ ID NO: 452153 - RNA, 64 nt, Homo Sapiens; identical to SEQ ID NO: 162942

SEQ ID NO: 452154 - RNA, 64 nt, Homo Sapiens; identical to SEQ ID NO: 162943

SEQ ID NO: 452155 - RNA, 64 nt, Homo Sapiens; identical to SEQ ID NO: 162944

SEQ ID NO: 452156 - RNA, 64 nt, Homo Sapiens; identical to SEQ ID NO: 162945

SEQ ID NO: 452157 - RNA, 64 nt, Homo Sapiens; identical to SEQ ID NO: 162946

SEQ ID NO: 452158 - RNA, 64 nt, Homo Sapiens; identical to SEQ ID NO: 162947

SEQ ID NO: 452159 - RNA, 64 nt, Homo Sapiens; identical to SEQ ID NO: 162948

SEQ ID NO: 452160 - RNA, 64 nt, Homo Sapiens; identical to SEQ ID NO: 162949

SEQ ID NO: 452161 - RNA, 64 nt, Homo Sapiens; identical to SEQ ID NO: 162950

SEQ ID NO: 452162 - RNA, 64 nt, Homo Sapiens; identical to SEQ ID NO: 162951

SEQ ID NO: 452163 - RNA, 64 nt, Homo Sapiens; identical to SEQ ID NO: 162952

SEQ ID NO: 452164 - RNA, 64 nt, Homo Sapiens; identical to SEQ ID NO: 162953

SEQ ID NO: 452165 - RNA, 64 nt, Homo Sapiens; identical to SEQ ID NO: 162954

SEQ ID NO: 452166 - RNA, 64 nt, Homo Sapiens; identical to SEQ ID NO: 162955

SEQ ID NO: 452167 - RNA, 64 nt, Homo Sapiens; identical to SEQ ID NO: 162956

SEQ ID NO: 452168 - RNA, 64 nt, Homo Sapiens; identical to SEQ ID NO: 162957

SEQ ID NO: 452169 - RNA, 64 nt, Homo Sapiens; identical to SEQ ID NO: 162958

SEQ ID NO: 452170 - RNA, 64 nt, Homo Sapiens; identical to SEQ ID NO: 162959

SEQ ID NO: 452171 - RNA, 64 nt, Homo Sapiens; identical to SEQ ID NO: 162960

SEQ ID NO: 452172 - RNA, 64 nt, Homo Sapiens; identical to SEQ ID NO: 162961

SEQ ID NO: 452173 - RNA, 64 nt, Homo Sapiens; identical to SEQ ID NO: 162962

SEQ ID NO: 452174 - RNA, 64 nt, Homo Sapiens; identical to SEQ ID NO: 162963

SEQ ID NO: 452175 - RNA, 64 nt, Homo Sapiens; identical to SEQ ID NO: 162964

SEQ ID NO: 452176 - RNA, 64 nt, Homo Sapiens; identical to SEQ ID NO: 162965

SEQ ID NO: 452177 - RNA, 64 nt, Homo Sapiens; identical to SEQ ID NO: 162966

SEQ ID NO: 452178 - RNA, 64 nt, Homo Sapiens; identical to SEQ ID NO: 162967

SEQ ID NO: 452179 - RNA, 64 nt, Homo Sapiens; identical to SEQ ID NO: 162968

SEQ ID NO: 452180 - RNA, 64 nt, Homo Sapiens; identical to SEQ ID NO: 162969

SEQ ID NO: 452181 - RNA, 64 nt, Homo Sapiens; identical to SEQ ID NO: 162970

SEQ ID NO: 452182 - RNA, 64 nt, Homo Sapiens; identical to SEQ ID NO: 162971

SEQ ID NO: 452183 - RNA, 64 nt, Homo Sapiens; identical to SEQ ID NO: 162972

SEQ ID NO: 452184 - RNA, 64 nt, Homo Sapiens; identical to SEQ ID NO: 162973

SEQ ID NO: 452185 - RNA, 64 nt, Homo Sapiens; identical to SEQ ID NO: 162974

SEQ ID NO: 452186 - RNA, 64 nt, Homo Sapiens; identical to SEQ ID NO: 162975

SEQ ID NO: 452187 - RNA, 64 nt, Homo Sapiens; identical to SEQ ID NO: 162976

SEQ ID NO: 452188 - RNA, 64 nt, Homo Sapiens; identical to SEQ ID NO: 162977

SEQ ID NO: 452189 - RNA, 64 nt, Homo Sapiens; identical to SEQ ID NO: 162978

SEQ ID NO: 452190 - RNA, 64 nt, Homo Sapiens; identical to SEQ ID NO: 162979

SEQ ID NO: 452191 - RNA, 64 nt, Homo Sapiens; identical to SEQ ID NO: 162980

SEQ ID NO: 452192 - RNA, 64 nt, Homo Sapiens; identical to SEQ ID NO: 162981

SEQ ID NO: 452193 - RNA, 64 nt, Homo Sapiens; identical to SEQ ID NO: 162982

SEQ ID NO: 452194 - RNA, 64 nt, Homo Sapiens; identical to SEQ ID NO: 162983

SEQ ID NO: 452195 - RNA, 64 nt, Homo Sapiens; identical to SEQ ID NO: 162984

SEQ ID NO: 452196 - RNA, 64 nt, Homo Sapiens; identical to SEQ ID NO: 162985

SEQ ID NO: 452197 - RNA, 64 nt, Homo Sapiens; identical to SEQ ID NO: 162986

SEQ ID NO: 452198 - RNA, 64 nt, Homo Sapiens; identical to SEQ ID NO: 162987

SEQ ID NO: 452199 - RNA, 64 nt, Homo Sapiens; identical to SEQ ID NO: 162988

SEQ ID NO: 452200 - RNA, 64 nt, Homo Sapiens; identical to SEQ ID NO: 162989

SEQ ID NO: 452201 - RNA, 64 nt, Homo Sapiens; identical to SEQ ID NO: 162990

SEQ ID NO: 452202 - RNA, 64 nt, Homo Sapiens; identical to SEQ ID NO: 162991

SEQ ID NO: 452203 - RNA, 64 nt, Homo Sapiens; identical to SEQ ID NO: 162992

SEQ ID NO: 452204 - RNA, 64 nt, Homo Sapiens; identical to SEQ ID NO: 162993

SEQ ID NO: 452205 - RNA, 64 nt, Homo Sapiens; identical to SEQ ID NO: 162994

SEQ ID NO: 452206 - RNA, 64 nt, Homo Sapiens; identical to SEQ ID NO: 162995

SEQ ID NO: 452207 - RNA, 64 nt, Homo Sapiens; identical to SEQ ID NO: 162996

SEQ ID NO: 452208 - RNA, 64 nt, Homo Sapiens; identical to SEQ ID NO: 162997

SEQ ID NO: 452209 - RNA, 64 nt, Homo Sapiens; identical to SEQ ID NO: 162998

SEQ ID NO: 452210 - RNA, 64 nt, Homo Sapiens; identical to SEQ ID NO: 162999

SEQ ID NO: 452211 - RNA, 64 nt, Homo Sapiens; identical to SEQ ID NO: 163000

SEQ ID NO: 452212 - RNA, 64 nt, Homo Sapiens; identical to SEQ ID NO: 163001

SEQ ID NO: 452213 - RNA, 64 nt, Homo Sapiens; identical to SEQ ID NO: 163002

SEQ ID NO: 452214 - RNA, 64 nt, Homo Sapiens; identical to SEQ ID NO: 163003

SEQ ID NO: 452215 - RNA, 64 nt, Homo Sapiens; identical to SEQ ID NO: 163004

SEQ ID NO: 452216 - RNA, 64 nt, Homo Sapiens; identical to SEQ ID NO: 163005

SEQ ID NO: 452217 - RNA, 64 nt, Homo Sapiens; identical to SEQ ID NO: 163006

SEQ ID NO: 452218 - RNA, 64 nt, Homo Sapiens; identical to SEQ ID NO: 163007

SEQ ID NO: 452219 - RNA, 64 nt, Homo Sapiens; identical to SEQ ID NO: 163008

SEQ ID NO: 452220 - RNA, 64 nt, Homo Sapiens; identical to SEQ ID NO: 163009

SEQ ID NO: 452221 - RNA, 64 nt, Homo Sapiens; identical to SEQ ID NO: 163010

SEQ ID NO: 452222 - RNA, 64 nt, Homo Sapiens; identical to SEQ ID NO: 163011

SEQ ID NO: 452223 - RNA, 64 nt, Homo Sapiens; identical to SEQ ID NO: 163012

SEQ ID NO: 452224 - RNA, 64 nt, Homo Sapiens; identical to SEQ ID NO: 163013

SEQ ID NO: 452225 - RNA, 64 nt, Homo Sapiens; identical to SEQ ID NO: 163014

SEQ ID NO: 452226 - RNA, 64 nt, Homo Sapiens; identical to SEQ ID NO: 163015

SEQ ID NO: 452227 - RNA, 64 nt, Homo Sapiens; identical to SEQ ID NO: 163016

SEQ ID NO: 452228 - RNA, 64 nt, Homo Sapiens; identical to SEQ ID NO: 163017

SEQ ID NO: 452229 - RNA, 64 nt, Homo Sapiens; identical to SEQ ID NO: 163018

SEQ ID NO: 452230 - RNA, 64 nt, Homo Sapiens; identical to SEQ ID NO: 163019

SEQ ID NO: 452231 - RNA, 64 nt, Homo Sapiens; identical to SEQ ID NO: 163020

SEQ ID NO: 452232 - RNA, 64 nt, Homo Sapiens; identical to SEQ ID NO: 163021

SEQ ID NO: 452233 - RNA, 64 nt, Homo Sapiens; identical to SEQ ID NO: 163022

SEQ ID NO: 452234 - RNA, 64 nt, Homo Sapiens; identical to SEQ ID NO: 163023

SEQ ID NO: 452235 - RNA, 64 nt, Homo Sapiens; identical to SEQ ID NO: 163024

SEQ ID NO: 452236 - RNA, 64 nt, Homo Sapiens; identical to SEQ ID NO: 163025

SEQ ID NO: 452237 - RNA, 64 nt, Homo Sapiens; identical to SEQ ID NO: 163026

SEQ ID NO: 452238 - RNA, 64 nt, Homo Sapiens; identical to SEQ ID NO: 163027

SEQ ID NO: 452239 - RNA, 64 nt, Homo Sapiens; identical to SEQ ID NO: 163028

SEQ ID NO: 452240 - RNA, 64 nt, Homo Sapiens; identical to SEQ ID NO: 163029

SEQ ID NO: 452241 - RNA, 64 nt, Homo Sapiens; identical to SEQ ID NO: 163030

SEQ ID NO: 452242 - RNA, 64 nt, Homo Sapiens; identical to SEQ ID NO: 163031

SEQ ID NO: 452243 - RNA, 64 nt, Homo Sapiens; identical to SEQ ID NO: 163032

SEQ ID NO: 452244 - RNA, 64 nt, Homo Sapiens; identical to SEQ ID NO: 163033

SEQ ID NO: 452245 - RNA, 64 nt, Homo Sapiens; identical to SEQ ID NO: 163034

SEQ ID NO: 452246 - RNA, 64 nt, Homo Sapiens; identical to SEQ ID NO: 163035

SEQ ID NO: 452247 - RNA, 64 nt, Homo Sapiens; identical to SEQ ID NO: 163036

SEQ ID NO: 452248 - RNA, 64 nt, Homo Sapiens; identical to SEQ ID NO: 163037

SEQ ID NO: 452249 - RNA, 64 nt, Homo Sapiens; identical to SEQ ID NO: 163038

SEQ ID NO: 452250 - RNA, 64 nt, Homo Sapiens; identical to SEQ ID NO: 163039

SEQ ID NO: 452251 - RNA, 64 nt, Homo Sapiens; identical to SEQ ID NO: 163040

SEQ ID NO: 452252 - RNA, 64 nt, Homo Sapiens; identical to SEQ ID NO: 163041

SEQ ID NO: 452253 - RNA, 64 nt, Homo Sapiens; identical to SEQ ID NO: 163042

SEQ ID NO: 452254 - RNA, 64 nt, Homo Sapiens; identical to SEQ ID NO: 163043

SEQ ID NO: 452255 - RNA, 64 nt, Homo Sapiens; identical to SEQ ID NO: 163044

SEQ ID NO: 452256 - RNA, 64 nt, Homo Sapiens; identical to SEQ ID NO: 163045

SEQ ID NO: 452257 - RNA, 64 nt, Homo Sapiens; identical to SEQ ID NO: 163046

SEQ ID NO: 452258 - RNA, 64 nt, Homo Sapiens; identical to SEQ ID NO: 162809

SEQ ID NO: 452259 - RNA, 64 nt, Homo Sapiens; identical to SEQ ID NO: 163048

SEQ ID NO: 452260 - RNA, 64 nt, Homo Sapiens; identical to SEQ ID NO: 163049

SEQ ID NO: 452261 - RNA, 64 nt, Homo Sapiens; identical to SEQ ID NO: 163050

SEQ ID NO: 452262 - RNA, 64 nt, Homo Sapiens; identical to SEQ ID NO: 163051

SEQ ID NO: 452263 - RNA, 64 nt, Homo Sapiens; identical to SEQ ID NO: 163052

SEQ ID NO: 452264 - RNA, 64 nt, Homo Sapiens; identical to SEQ ID NO: 163053

SEQ ID NO: 452265 - RNA, 64 nt, Homo Sapiens; identical to SEQ ID NO: 163054

SEQ ID NO: 452266 - RNA, 64 nt, Homo Sapiens; identical to SEQ ID NO: 163055

SEQ ID NO: 452267 - RNA, 64 nt, Homo Sapiens; identical to SEQ ID NO: 163056

SEQ ID NO: 452268 - RNA, 64 nt, Homo Sapiens; identical to SEQ ID NO: 163057

SEQ ID NO: 452269 - RNA, 64 nt, Homo Sapiens; identical to SEQ ID NO: 163058

SEQ ID NO: 452270 - RNA, 64 nt, Homo Sapiens; identical to SEQ ID NO: 163059

SEQ ID NO: 452271 - RNA, 64 nt, Homo Sapiens; identical to SEQ ID NO: 163060

SEQ ID NO: 452272 - RNA, 64 nt, Homo Sapiens; identical to SEQ ID NO: 163061

SEQ ID NO: 452273 - RNA, 64 nt, Homo Sapiens; identical to SEQ ID NO: 163062

SEQ ID NO: 452274 - RNA, 64 nt, Homo Sapiens; identical to SEQ ID NO: 163063

SEQ ID NO: 452275 - RNA, 64 nt, Homo Sapiens; identical to SEQ ID NO: 163064

SEQ ID NO: 452276 - RNA, 64 nt, Homo Sapiens; identical to SEQ ID NO: 163065

SEQ ID NO: 452277 - RNA, 64 nt, Homo Sapiens; identical to SEQ ID NO: 163066

SEQ ID NO: 452278 - RNA, 64 nt, Homo Sapiens; identical to SEQ ID NO: 163067

SEQ ID NO: 452279 - RNA, 64 nt, Homo Sapiens; identical to SEQ ID NO: 163068

SEQ ID NO: 452280 - RNA, 64 nt, Homo Sapiens; identical to SEQ ID NO: 163069

SEQ ID NO: 452281 - RNA, 64 nt, Homo Sapiens; identical to SEQ ID NO: 163070

SEQ ID NO: 452282 - RNA, 64 nt, Homo Sapiens; identical to SEQ ID NO: 163071

SEQ ID NO: 452283 - RNA, 64 nt, Homo Sapiens; identical to SEQ ID NO: 163072

SEQ ID NO: 452284 - RNA, 64 nt, Homo Sapiens; identical to SEQ ID NO: 163073

SEQ ID NO: 452285 - RNA, 64 nt, Homo Sapiens; identical to SEQ ID NO: 163074

SEQ ID NO: 452286 - RNA, 64 nt, Homo Sapiens; identical to SEQ ID NO: 163075

SEQ ID NO: 452287 - RNA, 64 nt, Homo Sapiens; identical to SEQ ID NO: 163076

SEQ ID NO: 452288 - RNA, 64 nt, Homo Sapiens; identical to SEQ ID NO: 163077

SEQ ID NO: 452289 - RNA, 64 nt, Homo Sapiens; identical to SEQ ID NO: 163078

SEQ ID NO: 452290 - RNA, 64 nt, Homo Sapiens; identical to SEQ ID NO: 163079

SEQ ID NO: 452291 - RNA, 64 nt, Homo Sapiens; identical to SEQ ID NO: 163080

SEQ ID NO: 452292 - RNA, 64 nt, Homo Sapiens; identical to SEQ ID NO: 163081

SEQ ID NO: 452293 - RNA, 64 nt, Homo Sapiens; identical to SEQ ID NO: 163082

SEQ ID NO: 452294 - RNA, 64 nt, Homo Sapiens; identical to SEQ ID NO: 163083

SEQ ID NO: 452295 - RNA, 64 nt, Homo Sapiens; identical to SEQ ID NO: 163084

SEQ ID NO: 452296 - RNA, 64 nt, Homo Sapiens; identical to SEQ ID NO: 163085

SEQ ID NO: 452297 - RNA, 64 nt, Homo Sapiens; identical to SEQ ID NO: 163086

SEQ ID NO: 452298 - RNA, 64 nt, Homo Sapiens; identical to SEQ ID NO: 163087

SEQ ID NO: 452299 - RNA, 64 nt, Homo Sapiens; identical to SEQ ID NO: 163088

SEQ ID NO: 452300 - RNA, 64 nt, Homo Sapiens; identical to SEQ ID NO: 163089

SEQ ID NO: 452301 - RNA, 64 nt, Homo Sapiens; identical to SEQ ID NO: 163090

SEQ ID NO: 452302 - RNA, 64 nt, Homo Sapiens; identical to SEQ ID NO: 163091

SEQ ID NO: 452303 - RNA, 64 nt, Homo Sapiens; identical to SEQ ID NO: 163092

SEQ ID NO: 452304 - RNA, 64 nt, Homo Sapiens; identical to SEQ ID NO: 163093

SEQ ID NO: 452305 - RNA, 64 nt, Homo Sapiens; identical to SEQ ID NO: 163094

SEQ ID NO: 452306 - RNA, 64 nt, Homo Sapiens; identical to SEQ ID NO: 163095

SEQ ID NO: 452307 - RNA, 64 nt, Homo Sapiens; identical to SEQ ID NO: 163096

SEQ ID NO: 452308 - RNA, 64 nt, Homo Sapiens; identical to SEQ ID NO: 163097

SEQ ID NO: 452309 - RNA, 64 nt, Homo Sapiens; identical to SEQ ID NO: 163098

SEQ ID NO: 452310 - RNA, 64 nt, Homo Sapiens; identical to SEQ ID NO: 163099

SEQ ID NO: 452311 - RNA, 64 nt, Homo Sapiens; identical to SEQ ID NO: 163100

SEQ ID NO: 452312 - RNA, 64 nt, Homo Sapiens; identical to SEQ ID NO: 163101

SEQ ID NO: 452313 - RNA, 64 nt, Homo Sapiens; identical to SEQ ID NO: 163102

SEQ ID NO: 452314 - RNA, 64 nt, Homo Sapiens; identical to SEQ ID NO: 163103

SEQ ID NO: 452315 - RNA, 64 nt, Homo Sapiens; identical to SEQ ID NO: 163104

SEQ ID NO: 452316 - RNA, 64 nt, Homo Sapiens; identical to SEQ ID NO: 163105

SEQ ID NO: 452317 - RNA, 64 nt, Homo Sapiens; identical to SEQ ID NO: 163106

SEQ ID NO: 452318 - RNA, 64 nt, Homo Sapiens; identical to SEQ ID NO: 163107

SEQ ID NO: 452319 - RNA, 64 nt, Homo Sapiens; identical to SEQ ID NO: 163108

SEQ ID NO: 452320 - RNA, 64 nt, Homo Sapiens; identical to SEQ ID NO: 163109

SEQ ID NO: 452321 - RNA, 64 nt, Homo Sapiens; identical to SEQ ID NO: 163110

SEQ ID NO: 452322 - RNA, 64 nt, Homo Sapiens; identical to SEQ ID NO: 163111

SEQ ID NO: 452323 - RNA, 64 nt, Homo Sapiens; identical to SEQ ID NO: 163112

SEQ ID NO: 452324 - RNA, 64 nt, Homo Sapiens; identical to SEQ ID NO: 163113

SEQ ID NO: 452325 - RNA, 64 nt, Homo Sapiens; identical to SEQ ID NO: 163114

SEQ ID NO: 452326 - RNA, 64 nt, Homo Sapiens; identical to SEQ ID NO: 163115

SEQ ID NO: 452327 - RNA, 64 nt, Homo Sapiens; identical to SEQ ID NO: 163116

SEQ ID NO: 452328 - RNA, 64 nt, Homo Sapiens; identical to SEQ ID NO: 163117

SEQ ID NO: 452329 - RNA, 64 nt, Homo Sapiens; identical to SEQ ID NO: 163118

SEQ ID NO: 452330 - RNA, 64 nt, Homo Sapiens; identical to SEQ ID NO: 163119

SEQ ID NO: 452331 - RNA, 64 nt, Homo Sapiens; identical to SEQ ID NO: 163120

SEQ ID NO: 452332 - RNA, 64 nt, Homo Sapiens; identical to SEQ ID NO: 163121

SEQ ID NO: 452333 - RNA, 64 nt, Homo Sapiens; identical to SEQ ID NO: 163122

SEQ ID NO: 452334 - RNA, 64 nt, Homo Sapiens; identical to SEQ ID NO: 163123

SEQ ID NO: 452335 - RNA, 64 nt, Homo Sapiens; identical to SEQ ID NO: 163124

SEQ ID NO: 452336 - RNA, 64 nt, Homo Sapiens; identical to SEQ ID NO: 163125

SEQ ID NO: 452337 - RNA, 64 nt, Homo Sapiens; identical to SEQ ID NO: 163126

SEQ ID NO: 452338 - RNA, 64 nt, Homo Sapiens; identical to SEQ ID NO: 163127

SEQ ID NO: 452339 - RNA, 64 nt, Homo Sapiens; identical to SEQ ID NO: 163128

SEQ ID NO: 452340 - RNA, 64 nt, Homo Sapiens; identical to SEQ ID NO: 163129

SEQ ID NO: 452341 - RNA, 64 nt, Homo Sapiens; identical to SEQ ID NO: 163130

SEQ ID NO: 452342 - RNA, 64 nt, Homo Sapiens; identical to SEQ ID NO: 163131

SEQ ID NO: 452343 - RNA, 64 nt, Homo Sapiens; identical to SEQ ID NO: 163132

SEQ ID NO: 452344 - RNA, 64 nt, Homo Sapiens; identical to SEQ ID NO: 163133

SEQ ID NO: 452345 - RNA, 64 nt, Homo Sapiens; identical to SEQ ID NO: 163134

SEQ ID NO: 452346 - RNA, 64 nt, Homo Sapiens; identical to SEQ ID NO: 163135

SEQ ID NO: 452347 - RNA, 64 nt, Homo Sapiens; identical to SEQ ID NO: 163136

SEQ ID NO: 452348 - RNA, 64 nt, Homo Sapiens; identical to SEQ ID NO: 163137

SEQ ID NO: 452349 - RNA, 64 nt, Homo Sapiens; identical to SEQ ID NO: 163138

SEQ ID NO: 452350 - RNA, 64 nt, Homo Sapiens; identical to SEQ ID NO: 163139

SEQ ID NO: 452351 - RNA, 64 nt, Homo Sapiens; identical to SEQ ID NO: 163140

SEQ ID NO: 452352 - RNA, 64 nt, Homo Sapiens; identical to SEQ ID NO: 163141

SEQ ID NO: 452353 - RNA, 64 nt, Homo Sapiens; identical to SEQ ID NO: 163142

SEQ ID NO: 452354 - RNA, 64 nt, Homo Sapiens; identical to SEQ ID NO: 163143

SEQ ID NO: 452355 - RNA, 64 nt, Homo Sapiens; identical to SEQ ID NO: 163144

SEQ ID NO: 452356 - RNA, 64 nt, Homo Sapiens; identical to SEQ ID NO: 163145

SEQ ID NO: 452357 - RNA, 64 nt, Homo Sapiens; identical to SEQ ID NO: 163146

SEQ ID NO: 452358 - RNA, 64 nt, Homo Sapiens; identical to SEQ ID NO: 163147

SEQ ID NO: 452359 - RNA, 64 nt, Homo Sapiens; identical to SEQ ID NO: 163148

SEQ ID NO: 452360 - RNA, 64 nt, Homo Sapiens; identical to SEQ ID NO: 163149

SEQ ID NO: 452361 - RNA, 64 nt, Homo Sapiens; identical to SEQ ID NO: 163150

SEQ ID NO: 452362 - RNA, 64 nt, Homo Sapiens; identical to SEQ ID NO: 163151

SEQ ID NO: 452363 - RNA, 64 nt, Homo Sapiens; identical to SEQ ID NO: 163152

SEQ ID NO: 452364 - RNA, 64 nt, Homo Sapiens; identical to SEQ ID NO: 163153

SEQ ID NO: 452365 - RNA, 64 nt, Homo Sapiens; identical to SEQ ID NO: 163154

SEQ ID NO: 452366 - RNA, 64 nt, Homo Sapiens; identical to SEQ ID NO: 163155

SEQ ID NO: 452367 - RNA, 64 nt, Homo Sapiens; identical to SEQ ID NO: 163156

SEQ ID NO: 452368 - RNA, 64 nt, Homo Sapiens; identical to SEQ ID NO: 163157

SEQ ID NO: 452369 - RNA, 64 nt, Homo Sapiens; identical to SEQ ID NO: 163158

SEQ ID NO: 452370 - RNA, 64 nt, Homo Sapiens; identical to SEQ ID NO: 163159

SEQ ID NO: 452371 - RNA, 64 nt, Homo Sapiens; identical to SEQ ID NO: 163160

SEQ ID NO: 452372 - RNA, 64 nt, Homo Sapiens; identical to SEQ ID NO: 163161

SEQ ID NO: 452373 - RNA, 64 nt, Homo Sapiens; identical to SEQ ID NO: 163162

SEQ ID NO: 452374 - RNA, 64 nt, Homo Sapiens; identical to SEQ ID NO: 163163

SEQ ID NO: 452375 - RNA, 64 nt, Homo Sapiens; identical to SEQ ID NO: 163164

SEQ ID NO: 452376 - RNA, 64 nt, Homo Sapiens; identical to SEQ ID NO: 163165

SEQ ID NO: 452377 - RNA, 64 nt, Homo Sapiens; identical to SEQ ID NO: 163166

SEQ ID NO: 452378 - RNA, 64 nt, Homo Sapiens; identical to SEQ ID NO: 163167

SEQ ID NO: 452379 - RNA, 64 nt, Homo Sapiens; identical to SEQ ID NO: 163168

SEQ ID NO: 452380 - RNA, 64 nt, Homo Sapiens; identical to SEQ ID NO: 163169

SEQ ID NO: 452381 - RNA, 64 nt, Homo Sapiens; identical to SEQ ID NO: 163170

SEQ ID NO: 452382 - RNA, 64 nt, Homo Sapiens; identical to SEQ ID NO: 163171

SEQ ID NO: 452383 - RNA, 64 nt, Homo Sapiens; identical to SEQ ID NO: 163172

SEQ ID NO: 452384 - RNA, 64 nt, Homo Sapiens; identical to SEQ ID NO: 163173

SEQ ID NO: 452385 - RNA, 64 nt, Homo Sapiens; identical to SEQ ID NO: 163174

SEQ ID NO: 452386 - RNA, 64 nt, Homo Sapiens; identical to SEQ ID NO: 163175

SEQ ID NO: 452387 - RNA, 64 nt, Homo Sapiens; identical to SEQ ID NO: 163176

SEQ ID NO: 452388 - RNA, 64 nt, Homo Sapiens; identical to SEQ ID NO: 163177

SEQ ID NO: 452389 - RNA, 64 nt, Homo Sapiens; identical to SEQ ID NO: 163178

SEQ ID NO: 452390 - RNA, 64 nt, Homo Sapiens; identical to SEQ ID NO: 163179

SEQ ID NO: 452391 - RNA, 64 nt, Homo Sapiens; identical to SEQ ID NO: 163180

SEQ ID NO: 452392 - RNA, 64 nt, Homo Sapiens; identical to SEQ ID NO: 163181

SEQ ID NO: 452393 - RNA, 64 nt, Homo Sapiens; identical to SEQ ID NO: 163182

SEQ ID NO: 452394 - RNA, 64 nt, Homo Sapiens; identical to SEQ ID NO: 163183

SEQ ID NO: 452395 - RNA, 64 nt, Homo Sapiens; identical to SEQ ID NO: 163184

SEQ ID NO: 452396 - RNA, 64 nt, Homo Sapiens; identical to SEQ ID NO: 243585

SEQ ID NO: 452397 - RNA, 64 nt, Homo Sapiens; identical to SEQ ID NO: 243586

SEQ ID NO: 452398 - RNA, 64 nt, Homo Sapiens; identical to SEQ ID NO: 243587

SEQ ID NO: 452399 - RNA, 64 nt, Homo Sapiens; identical to SEQ ID NO: 243588

SEQ ID NO: 452400 - RNA, 64 nt, Homo Sapiens; identical to SEQ ID NO: 243589

SEQ ID NO: 452401 - RNA, 64 nt, Homo Sapiens; identical to SEQ ID NO: 243590

SEQ ID NO: 452402 - RNA, 64 nt, Homo Sapiens; identical to SEQ ID NO: 243591

SEQ ID NO: 452403 - RNA, 64 nt, Homo Sapiens; identical to SEQ ID NO: 243592

SEQ ID NO: 452404 - RNA, 64 nt, Homo Sapiens; identical to SEQ ID NO: 243593

SEQ ID NO: 452405 - RNA, 64 nt, Homo Sapiens; identical to SEQ ID NO: 243594

SEQ ID NO: 452406 - RNA, 64 nt, Homo Sapiens; identical to SEQ ID NO: 243595

SEQ ID NO: 452407 - RNA, 64 nt, Homo Sapiens; identical to SEQ ID NO: 243596

SEQ ID NO: 452408 - RNA, 64 nt, Homo Sapiens; identical to SEQ ID NO: 243597

SEQ ID NO: 452409 - RNA, 64 nt, Homo Sapiens; identical to SEQ ID NO: 243598

SEQ ID NO: 452410 - RNA, 64 nt, Homo Sapiens; identical to SEQ ID NO: 243599

SEQ ID NO: 452411 - RNA, 64 nt, Homo Sapiens; identical to SEQ ID NO: 243600

SEQ ID NO: 452412 - RNA, 64 nt, Homo Sapiens; identical to SEQ ID NO: 243601

SEQ ID NO: 452413 - RNA, 64 nt, Homo Sapiens; identical to SEQ ID NO: 243602

SEQ ID NO: 452414 - RNA, 64 nt, Homo Sapiens; identical to SEQ ID NO: 243603

SEQ ID NO: 452415 - RNA, 64 nt, Homo Sapiens; identical to SEQ ID NO: 243604

SEQ ID NO: 452416 - RNA, 64 nt, Homo Sapiens; identical to SEQ ID NO: 243605

SEQ ID NO: 452417 - RNA, 64 nt, Homo Sapiens; identical to SEQ ID NO: 243606

SEQ ID NO: 452418 - RNA, 64 nt, Homo Sapiens; identical to SEQ ID NO: 243607

SEQ ID NO: 452419 - RNA, 64 nt, Homo Sapiens; identical to SEQ ID NO: 243608

SEQ ID NO: 452420 - RNA, 64 nt, Homo Sapiens; identical to SEQ ID NO: 243609

SEQ ID NO: 452421 - RNA, 64 nt, Homo Sapiens; identical to SEQ ID NO: 243610

SEQ ID NO: 452422 - RNA, 57 nt, Homo Sapiens; identical to SEQ ID NO: 243611

SEQ ID NO: 452423 - RNA, 64 nt, Homo Sapiens; identical to SEQ ID NO: 243612

SEQ ID NO: 452424 - RNA, 64 nt, Homo Sapiens; identical to SEQ ID NO: 243613

SEQ ID NO: 452425 - RNA, 64 nt, Homo Sapiens; identical to SEQ ID NO: 243614

SEQ ID NO: 452426 - RNA, 64 nt, Homo Sapiens; identical to SEQ ID NO: 243615

SEQ ID NO: 452427 - RNA, 64 nt, Homo Sapiens; identical to SEQ ID NO: 243616

SEQ ID NO: 452428 - RNA, 64 nt, Homo Sapiens; identical to SEQ ID NO: 243617

SEQ ID NO: 452429 - RNA, 64 nt, Homo Sapiens; identical to SEQ ID NO: 243618

SEQ ID NO: 452430 - RNA, 64 nt, Homo Sapiens; identical to SEQ ID NO: 243619

SEQ ID NO: 452431 - RNA, 64 nt, Homo Sapiens; identical to SEQ ID NO: 243620

SEQ ID NO: 452432 - RNA, 64 nt, Homo Sapiens; identical to SEQ ID NO: 243621

SEQ ID NO: 452433 - RNA, 64 nt, Homo Sapiens; identical to SEQ ID NO: 243622

SEQ ID NO: 452434 - RNA, 64 nt, Homo Sapiens; identical to SEQ ID NO: 243623

SEQ ID NO: 452435 - RNA, 64 nt, Homo Sapiens; identical to SEQ ID NO: 243624

SEQ ID NO: 452436 - RNA, 64 nt, Homo Sapiens; identical to SEQ ID NO: 243625

SEQ ID NO: 452437 - RNA, 64 nt, Homo Sapiens; identical to SEQ ID NO: 243626

SEQ ID NO: 452438 - RNA, 64 nt, Homo Sapiens; identical to SEQ ID NO: 243627

SEQ ID NO: 452439 - RNA, 64 nt, Homo Sapiens; identical to SEQ ID NO: 243628

SEQ ID NO: 452440 - RNA, 64 nt, Homo Sapiens; identical to SEQ ID NO: 243629

SEQ ID NO: 452441 - RNA, 64 nt, Homo Sapiens; identical to SEQ ID NO: 243630

SEQ ID NO: 452442 - RNA, 64 nt, Homo Sapiens; identical to SEQ ID NO: 243631

SEQ ID NO: 452443 - RNA, 64 nt, Homo Sapiens; identical to SEQ ID NO: 243632

SEQ ID NO: 452444 - RNA, 64 nt, Homo Sapiens; identical to SEQ ID NO: 243633

SEQ ID NO: 452445 - RNA, 59 nt, Homo Sapiens; identical to SEQ ID NO: 243634

SEQ ID NO: 452446 - RNA, 64 nt, Homo Sapiens; identical to SEQ ID NO: 243635

SEQ ID NO: 452447 - RNA, 64 nt, Homo Sapiens; identical to SEQ ID NO: 243636

SEQ ID NO: 452448 - RNA, 64 nt, Homo Sapiens; identical to SEQ ID NO: 243637

SEQ ID NO: 452449 - RNA, 64 nt, Homo Sapiens; identical to SEQ ID NO: 243638

SEQ ID NO: 452450 - RNA, 64 nt, Homo Sapiens; identical to SEQ ID NO: 243639

SEQ ID NO: 452451 - RNA, 64 nt, Homo Sapiens; identical to SEQ ID NO: 243640

SEQ ID NO: 452452 - RNA, 64 nt, Homo Sapiens; identical to SEQ ID NO: 243641

SEQ ID NO: 452453 - RNA, 64 nt, Homo Sapiens; identical to SEQ ID NO: 243642

SEQ ID NO: 452454 - RNA, 64 nt, Homo Sapiens; identical to SEQ ID NO: 243643

SEQ ID NO: 452455 - RNA, 60 nt, Homo Sapiens
agauuuccucuggaaugucuaaaaacguugccccauuaacguauguaaauguacagaaau

SEQ ID NO: 452456 - RNA, 60 nt, Homo Sapiens
uacagaauaggaccuauccagucaacaaacccccauuauguacuugcuauaaagccaccu

SEQ ID NO: 452457 - RNA, 60 nt, Homo Sapiens
aauugcuugaaauucacaugcccugcugguccccauuaacaagugguuuucuuaaugcag

SEQ ID NO: 452458 - RNA, 60 nt, Homo Sapiens
aauacaaagcacuacauucuaucaacaucaccccauuaagcaccccagguucgcugaucu

SEQ ID NO: 452459 - RNA, 60 nt, Homo Sapiens
aaacacugccccuuaaguccucagaaaccuccccauuaacuugaaucacccaacccugga

SEQ ID NO: 452460 - RNA, 60 nt, Homo Sapiens
aacagauacucccauaauaaaucauugaggccccauuauuccccuguuagccagcccucg

SEQ ID NO: 452461 - RNA, 60 nt, Homo Sapiens
uuaaauaggaaaaacaguauuuuuauuuggccccauuauuuuauuuuugguuuguauuau

SEQ ID NO: 452462 - RNA, 60 nt, Homo Sapiens
uuauuuuugguuuguauuauccacaucuggccccauuauugggauuacaaaugugagcca

SEQ ID NO: 452463 - RNA, 64 nt, Homo Sapiens
aucggugguuccgcuccguggacuggaaagcuguuccgcagagaaaacugaagguacaacaugu

SEQ ID NO: 452464 - RNA, 64 nt, Homo Sapiens
gaggagauuagcauggcccccugcgcgaggaagauccgcagauucaugcagcauuccauauuuu

SEQ ID NO: 452465 - RNA, 64 nt, Homo Sapiens; identical to SEQ ID NO: 94908

SEQ ID NO: 452466 - RNA, 64 nt, Homo Sapiens; identical to SEQ ID NO: 94909

SEQ ID NO: 452467 - RNA, 64 nt, Homo Sapiens; identical to SEQ ID NO: 94910

SEQ ID NO: 452468 - RNA, 64 nt, Homo Sapiens; identical to SEQ ID NO: 94911

SEQ ID NO: 452469 - RNA, 64 nt, Homo Sapiens; identical to SEQ ID NO: 94912

SEQ ID NO: 452470 - RNA, 64 nt, Homo Sapiens; identical to SEQ ID NO: 94913

SEQ ID NO: 452471 - RNA, 64 nt, Homo Sapiens; identical to SEQ ID NO: 94914

SEQ ID NO: 452472 - RNA, 64 nt, Homo Sapiens; identical to SEQ ID NO: 94915

SEQ ID NO: 452473 - RNA, 64 nt, Homo Sapiens; identical to SEQ ID NO: 94916

SEQ ID NO: 452474 - RNA, 64 nt, Homo Sapiens; identical to SEQ ID NO: 94917

SEQ ID NO: 452475 - RNA, 64 nt, Homo Sapiens; identical to SEQ ID NO: 94918

SEQ ID NO: 452476 - RNA, 64 nt, Homo Sapiens; identical to SEQ ID NO: 94919

SEQ ID NO: 452477 - RNA, 64 nt, Homo Sapiens; identical to SEQ ID NO: 94920

SEQ ID NO: 452478 - RNA, 64 nt, Homo Sapiens; identical to SEQ ID NO: 94921

SEQ ID NO: 452479 - RNA, 64 nt, Homo Sapiens; identical to SEQ ID NO: 94922

SEQ ID NO: 452480 - RNA, 64 nt, Homo Sapiens; identical to SEQ ID NO: 94923

SEQ ID NO: 452481 - RNA, 64 nt, Homo Sapiens; identical to SEQ ID NO: 94924

SEQ ID NO: 452482 - RNA, 64 nt, Homo Sapiens; identical to SEQ ID NO: 94925

SEQ ID NO: 452483 - RNA, 64 nt, Homo Sapiens; identical to SEQ ID NO: 94926

SEQ ID NO: 452484 - RNA, 64 nt, Homo Sapiens; identical to SEQ ID NO: 94927

SEQ ID NO: 452485 - RNA, 64 nt, Homo Sapiens; identical to SEQ ID NO: 94928

SEQ ID NO: 452486 - RNA, 64 nt, Homo Sapiens; identical to SEQ ID NO: 94929

SEQ ID NO: 452487 - RNA, 64 nt, Homo Sapiens; identical to SEQ ID NO: 94930

SEQ ID NO: 452488 - RNA, 64 nt, Homo Sapiens; identical to SEQ ID NO: 94931

SEQ ID NO: 452489 - RNA, 64 nt, Homo Sapiens; identical to SEQ ID NO: 138852

SEQ ID NO: 452490 - RNA, 64 nt, Homo Sapiens; identical to SEQ ID NO: 138853

SEQ ID NO: 452491 - RNA, 64 nt, Homo Sapiens; identical to SEQ ID NO: 138854

SEQ ID NO: 452492 - RNA, 64 nt, Homo Sapiens; identical to SEQ ID NO: 138855

SEQ ID NO: 452493 - RNA, 64 nt, Homo Sapiens; identical to SEQ ID NO: 138856

SEQ ID NO: 452494 - RNA, 64 nt, Homo Sapiens; identical to SEQ ID NO: 138857

SEQ ID NO: 452495 - RNA, 64 nt, Homo Sapiens; identical to SEQ ID NO: 138858

SEQ ID NO: 452496 - RNA, 64 nt, Homo Sapiens; identical to SEQ ID NO: 138859

SEQ ID NO: 452497 - RNA, 64 nt, Homo Sapiens; identical to SEQ ID NO: 138860

SEQ ID NO: 452498 - RNA, 64 nt, Homo Sapiens; identical to SEQ ID NO: 138861

SEQ ID NO: 452499 - RNA, 64 nt, Homo Sapiens; identical to SEQ ID NO: 138862

SEQ ID NO: 452500 - RNA, 64 nt, Homo Sapiens; identical to SEQ ID NO: 138863

SEQ ID NO: 452501 - RNA, 64 nt, Homo Sapiens; identical to SEQ ID NO: 138864

SEQ ID NO: 452502 - RNA, 64 nt, Homo Sapiens; identical to SEQ ID NO: 138865

SEQ ID NO: 452503 - RNA, 64 nt, Homo Sapiens; identical to SEQ ID NO: 138866

SEQ ID NO: 452504 - RNA, 64 nt, Homo Sapiens; identical to SEQ ID NO: 138867

SEQ ID NO: 452505 - RNA, 64 nt, Homo Sapiens; identical to SEQ ID NO: 138868

SEQ ID NO: 452506 - RNA, 64 nt, Homo Sapiens; identical to SEQ ID NO: 138869

SEQ ID NO: 452507 - RNA, 64 nt, Homo Sapiens; identical to SEQ ID NO: 138870

SEQ ID NO: 452508 - RNA, 64 nt, Homo Sapiens; identical to SEQ ID NO: 138871

SEQ ID NO: 452509 - RNA, 64 nt, Homo Sapiens; identical to SEQ ID NO: 138872

SEQ ID NO: 452510 - RNA, 64 nt, Homo Sapiens; identical to SEQ ID NO: 138873

SEQ ID NO: 452511 - RNA, 64 nt, Homo Sapiens; identical to SEQ ID NO: 138874

SEQ ID NO: 452512 - RNA, 64 nt, Homo Sapiens; identical to SEQ ID NO: 138875

SEQ ID NO: 452513 - RNA, 64 nt, Homo Sapiens; identical to SEQ ID NO: 138876

SEQ ID NO: 452514 - RNA, 64 nt, Homo Sapiens; identical to SEQ ID NO: 138877

SEQ ID NO: 452515 - RNA, 64 nt, Homo Sapiens; identical to SEQ ID NO: 138878

SEQ ID NO: 452516 - RNA, 64 nt, Homo Sapiens; identical to SEQ ID NO: 138879

SEQ ID NO: 452517 - RNA, 64 nt, Homo Sapiens; identical to SEQ ID NO: 138880

SEQ ID NO: 452518 - RNA, 64 nt, Homo Sapiens; identical to SEQ ID NO: 138881

SEQ ID NO: 452519 - RNA, 64 nt, Homo Sapiens; identical to SEQ ID NO: 138882

SEQ ID NO: 452520 - RNA, 64 nt, Homo Sapiens; identical to SEQ ID NO: 138883

SEQ ID NO: 452521 - RNA, 64 nt, Homo Sapiens; identical to SEQ ID NO: 138884

SEQ ID NO: 452522 - RNA, 64 nt, Homo Sapiens; identical to SEQ ID NO: 138885

SEQ ID NO: 452523 - RNA, 64 nt, Homo Sapiens; identical to SEQ ID NO: 138886

SEQ ID NO: 452524 - RNA, 64 nt, Homo Sapiens; identical to SEQ ID NO: 138887

SEQ ID NO: 452525 - RNA, 64 nt, Homo Sapiens; identical to SEQ ID NO: 138888

SEQ ID NO: 452526 - RNA, 64 nt, Homo Sapiens; identical to SEQ ID NO: 138889

SEQ ID NO: 452527 - RNA, 64 nt, Homo Sapiens; identical to SEQ ID NO: 138890

SEQ ID NO: 452528 - RNA, 64 nt, Homo Sapiens; identical to SEQ ID NO: 138891

SEQ ID NO: 452529 - RNA, 64 nt, Homo Sapiens; identical to SEQ ID NO: 138892

SEQ ID NO: 452530 - RNA, 64 nt, Homo Sapiens
ccaccccuagcccaggucagcuuuccuggagcuggcuaaugaaagccuccucaccucuucccaa

SEQ ID NO: 452531 - RNA, 64 nt, Homo Sapiens
ccaacgauaguuacucacaaguaaguaccuuaaugcuaaugagguccacuaaaaaggggaggaa

SEQ ID NO: 452532 - RNA, 64 nt, Homo Sapiens
aaacaaauccuguaacuaccuaaguuuuuuagcugcuaaugacaggcuuuaagaacauguggaa

SEQ ID NO: 452533 - RNA, 64 nt, Homo Sapiens
cuugccuuuuuuuccaccauauaugauccaccaugcuaaugacaguguuugugugcagagaagu

SEQ ID NO: 452534 - RNA, 64 nt, Homo Sapiens; identical to SEQ ID NO: 353564

SEQ ID NO: 452535 - RNA, 64 nt, Homo Sapiens; identical to SEQ ID NO: 353565

SEQ ID NO: 452536 - RNA, 64 nt, Homo Sapiens; identical to SEQ ID NO: 353566

SEQ ID NO: 452537 - RNA, 64 nt, Homo Sapiens; identical to SEQ ID NO: 353567

SEQ ID NO: 452538 - RNA, 64 nt, Homo Sapiens; identical to SEQ ID NO: 353568

SEQ ID NO: 452539 - RNA, 64 nt, Homo Sapiens; identical to SEQ ID NO: 353569

SEQ ID NO: 452540 - RNA, 64 nt, Homo Sapiens; identical to SEQ ID NO: 353570

SEQ ID NO: 452541 - RNA, 64 nt, Homo Sapiens; identical to SEQ ID NO: 353571

SEQ ID NO: 452542 - RNA, 64 nt, Homo Sapiens; identical to SEQ ID NO: 353572

SEQ ID NO: 452543 - RNA, 64 nt, Homo Sapiens; identical to SEQ ID NO: 353573

SEQ ID NO: 452544 - RNA, 64 nt, Homo Sapiens; identical to SEQ ID NO: 353574

SEQ ID NO: 452545 - RNA, 64 nt, Homo Sapiens
cuguugagugacugugaggaugaaccuucauacccuuuccaagacguguuacacagacagaccu

SEQ ID NO: 452546 - RNA, 64 nt, Homo Sapiens
aaauuuucauucuuaccaaaacaguuaacucuuucuuuccaaucaauuuauacaaaagaggucg

SEQ ID NO: 452547 - RNA, 64 nt, Homo Sapiens
uaugcguaugaguaaaauuacuuuuggagauaagcuuuccaaaacauguacgauuaaugugccc

SEQ ID NO: 452548 - RNA, 64 nt, Homo Sapiens
cagaaucaucucugauuccaugcauacucggguucuuuccaacuagacaggaaacaggcccaag

SEQ ID NO: 452549 - RNA, 64 nt, Homo Sapiens
cugagggagaaaaagaaaacauacauuaugaagccuuuccaaaauuaggugcuugguaaucacg

SEQ ID NO: 452550 - RNA, 64 nt, Homo Sapiens
agagucaaugauucuguucgacuaaauagcuguccuuuccaacacauugcuacuuuuuuaaaua

SEQ ID NO: 452551 - RNA, 64 nt, Homo Sapiens
gagaagaggggaguauccugaguuguaggaacugcuuuccaacuccaagcucccuccacaaguu

SEQ ID NO: 452552 - RNA, 64 nt, Homo Sapiens
uggcuuucuuuggccucugacccugcugcccauucuuuccaacaucacagaugaacugccucuc

SEQ ID NO: 452553 - RNA, 64 nt, Homo Sapiens
auuucuaaguagauuuuuugaccacacccagccccuuuccaaccugggauuacaggcaugagcc

SEQ ID NO: 452554 - RNA, 64 nt, Homo Sapiens
uccuuuuuuuuuuuuuuuuuaucaguaaauacuccuuuccaacuuugaauaaauaguaauauuu

SEQ ID NO: 452555 - RNA, 64 nt, Homo Sapiens
aaagagagggagguauggacugggggccagaguccuuuccaaggcuucuccaauucugcccaaa

SEQ ID NO: 452556 - RNA, 64 nt, Homo Sapiens
uaaccauuugcacuggaguucuaugcucucgcaccuuuccaaaguuaacagauuuugggguugu

SEQ ID NO: 452557 - RNA, 64 nt, Homo Sapiens
gaaggugauugauguagggauuuaaggagaggcacuuuccaacuaaggugaguuuugaucucuu

SEQ ID NO: 452558 - RNA, 64 nt, Homo Sapiens
cugcugauguggcagucaaugcuuuucaagguaucuuuccaaucccuguauccggcacugcuaa

SEQ ID NO: 452559 - RNA, 64 nt, Homo Sapiens
gugccuugcuuggugcucucuccaaguauguugucuuuccaauguacuuuauuuauagagacuu

SEQ ID NO: 452560 - RNA, 64 nt, Homo Sapiens
auguugucuuuccaaugguguuuauuuauagagacuuuccaaguucgaccagauuagcauuuac

SEQ ID NO: 452561 - RNA, 64 nt, Homo Sapiens
ucuaauuaaggcgagugcuccagagucgggucugcuuuccaaaguauaggacauuugaagaacu

SEQ ID NO: 452562 - RNA, 64 nt, Homo Sapiens
ccuguuuugucucuacuguguacucugaucguaucuuuccaaagugcagacucuugugaaguuu

SEQ ID NO: 452563 - RNA, 64 nt, Homo Sapiens
aaaaugagcccuauguagcagagcuagacuccaucuuuccaauaauucuaaugcuagucaccaa

SEQ ID NO: 452564 - RNA, 64 nt, Homo Sapiens
auuauauaauacauuucgaucaugaaaaaaaacacuuuccaacuuuauuguauuacaaaggaac

SEQ ID NO: 452565 - RNA, 64 nt, Homo Sapiens
caugacacugauuacaaauacuuuccuauucauacuuuccaauuaugagauggacuguggguac

SEQ ID NO: 452566 - RNA, 64 nt, Homo Sapiens
agcguuaauuaugcucuguuuccaacugcauuuccuuuccaauugaauuaaaguguggccucgu

SEQ ID NO: 452567 - RNA, 64 nt, Homo Sapiens
cuuauuaccuccccuaauccuugcauuucaguuucuuuccaaaauuguccaacucuccuccagg

SEQ ID NO: 452568 - RNA, 64 nt, Homo Sapiens
aaacuaaagccuggauuugaaggugcugaaaccacuuuccaaauccagagccagcucaucuucc

SEQ ID NO: 452569 - RNA, 64 nt, Homo Sapiens
ccauuguagauuagucucuucucacuaaaauuuacuuuccaacguagggccuaaaggaaaccuu

SEQ ID NO: 452570 - RNA, 64 nt, Homo Sapiens
auguccuggaggcagaugacaucuaaaauaugugcuuuccaaccagcacagcuggcgcucuuag

SEQ ID NO: 452571 - RNA, 64 nt, Homo Sapiens
cauuugggagauucuuuugccaggagagauucaacuuuccaaucuaaguauuccagagcauugc

SEQ ID NO: 452572 - RNA, 64 nt, Homo Sapiens
uuuucagugcagccaggagggcucuugggauuuccuuuccaaagcacaaaaauacugggaccca

SEQ ID NO: 452573 - RNA, 64 nt, Homo Sapiens
caucagcagacuuccugcucaucggcagaucccccuuuccaaccuguaacucugaugugcucug

SEQ ID NO: 452574 - RNA, 64 nt, Homo Sapiens
aauaccauuuuuuucuccuuuuguguuuuucccacuuuccaauguacucaagaaaauugaacaa

SEQ ID NO: 452575 - RNA, 64 nt, Homo Sapiens
ccuuccuuccuuuuccucccuccuucccuucucccuuuccaaccuccucccucccuuccuuccc

SEQ ID NO: 452576 - RNA, 64 nt, Homo Sapiens
ccuuccuuccuuuuccucccucccucccuucuuccuuuccaaccccauccuuccauucuucccc

SEQ ID NO: 452577 - RNA, 64 nt, Homo Sapiens
uaguaucuguagccauguccgugauuaaagacaacuuuccaaugauauugaguuuaacaccugu

SEQ ID NO: 452578 - RNA, 64 nt, Homo Sapiens
uuauuuucuugugcuucagcgccuuagguuuuuucuuuccaaguaguagggcagugcaugacug

SEQ ID NO: 452579 - RNA, 64 nt, Homo Sapiens
auuuaggaauguuuaguguauaaucuuuuucucucuuuccaaaaucauuucaagugaauuauuu

SEQ ID NO: 452580 - RNA, 64 nt, Homo Sapiens
ggcagcuugaaauguugguccuguuuuuaauuuucuuuccaaaauaauaauuaaccaucuaccu

SEQ ID NO: 452581 - RNA, 64 nt, Homo Sapiens
aaaauguuuuuuguuuuuuuuguccuuuucuugccuuuccaagagaguagcagaaaacuacuua

SEQ ID NO: 452582 - RNA, 64 nt, Homo Sapiens
ccaucauggaccagguccucacugugaagugcaucuuuccaagaguagauaaaauagagcacaa

SEQ ID NO: 452583 - RNA, 64 nt, Homo Sapiens
caguggcuguuguucugucuauggaucacccagccuuuccaaguuccuugaaagauuggucguu

SEQ ID NO: 452584 - RNA, 64 nt, Homo Sapiens
ugaauucuccugcagugccauuuaaauuauucuacuuuccaaacagacuaggcauauuucaggc

SEQ ID NO: 452585 - RNA, 64 nt, Homo Sapiens
gagcgauacuaaggcagacuaguuggccagaucacuuuccaaggggaaauacugcaacaugucc

SEQ ID NO: 452586 - RNA, 64 nt, Homo Sapiens
ucuggguucuugcaaguugccagucaagaccauucuuuccaaccugaagcuggggcgauguuug

SEQ ID NO: 452587 - RNA, 64 nt, Homo Sapiens
gagcacucaguguugaaucauugagcuccaccuccuuuccaagugaggcccucugaguuggaag

SEQ ID NO: 452588 - RNA, 64 nt, Homo Sapiens
acaugagacugugcaaagccaaagggacagauagcuuuccaagguuuaauccuuggagacaggg

SEQ ID NO: 452589 - RNA, 61 nt, Homo Sapiens
gugauuucacgaaaaagugaccuuacucgugcuuuccaacuucaagaccacagaaaaucag

SEQ ID NO: 452590 - RNA, 64 nt, Homo Sapiens
cugaaacagcuaggcccaaaucacaaguacaguccuuuccaacaccccugaaauucauagucag

SEQ ID NO: 452591 - RNA, 64 nt, Homo Sapiens
ugaacuugaagauuacauaagaggacauaugauucuuuccaagauggcuaccaacccauucaaa

SEQ ID NO: 452592 - RNA, 64 nt, Homo Sapiens
ugaacuugaagauuacaucagaagacauaugacucuuuccaagaaagcaguuaccucauucaaa

SEQ ID NO: 452593 - RNA, 64 nt, Homo Sapiens; identical to SEQ ID NO: 333540

SEQ ID NO: 452594 - RNA, 64 nt, Homo Sapiens; identical to SEQ ID NO: 333541

SEQ ID NO: 452595 - RNA, 64 nt, Homo Sapiens; identical to SEQ ID NO: 333542

SEQ ID NO: 452596 - RNA, 64 nt, Homo Sapiens; identical to SEQ ID NO: 333543

SEQ ID NO: 452597 - RNA, 64 nt, Homo Sapiens; identical to SEQ ID NO: 333544

SEQ ID NO: 452598 - RNA, 64 nt, Homo Sapiens; identical to SEQ ID NO: 333545

SEQ ID NO: 452599 - RNA, 54 nt, Homo Sapiens; identical to SEQ ID NO: 333546

SEQ ID NO: 452600 - RNA, 64 nt, Homo Sapiens; identical to SEQ ID NO: 333547

SEQ ID NO: 452601 - RNA, 60 nt, Homo Sapiens; identical to SEQ ID NO: 333548

SEQ ID NO: 452602 - RNA, 64 nt, Homo Sapiens; identical to SEQ ID NO: 333549

SEQ ID NO: 452603 - RNA, 64 nt, Homo Sapiens; identical to SEQ ID NO: 333550

SEQ ID NO: 452604 - RNA, 64 nt, Homo Sapiens; identical to SEQ ID NO: 333551

SEQ ID NO: 452605 - RNA, 64 nt, Homo Sapiens; identical to SEQ ID NO: 333552

SEQ ID NO: 452606 - RNA, 64 nt, Homo Sapiens; identical to SEQ ID NO: 333553

SEQ ID NO: 452607 - RNA, 64 nt, Homo Sapiens; identical to SEQ ID NO: 333554

SEQ ID NO: 452608 - RNA, 64 nt, Homo Sapiens; identical to SEQ ID NO: 333555

SEQ ID NO: 452609 - RNA, 64 nt, Homo Sapiens; identical to SEQ ID NO: 333556

SEQ ID NO: 452610 - RNA, 64 nt, Homo Sapiens; identical to SEQ ID NO: 333557

SEQ ID NO: 452611 - RNA, 64 nt, Homo Sapiens; identical to SEQ ID NO: 333558

SEQ ID NO: 452612 - RNA, 64 nt, Homo Sapiens; identical to SEQ ID NO: 333559

SEQ ID NO: 452613 - RNA, 64 nt, Homo Sapiens; identical to SEQ ID NO: 333560

SEQ ID NO: 452614 - RNA, 64 nt, Homo Sapiens; identical to SEQ ID NO: 333561

SEQ ID NO: 452615 - RNA, 64 nt, Homo Sapiens; identical to SEQ ID NO: 333562

SEQ ID NO: 452616 - RNA, 64 nt, Homo Sapiens; identical to SEQ ID NO: 333563

SEQ ID NO: 452617 - RNA, 64 nt, Homo Sapiens; identical to SEQ ID NO: 333564

SEQ ID NO: 452618 - RNA, 64 nt, Homo Sapiens; identical to SEQ ID NO: 333565

SEQ ID NO: 452619 - RNA, 64 nt, Homo Sapiens; identical to SEQ ID NO: 333566

SEQ ID NO: 452620 - RNA, 64 nt, Homo Sapiens; identical to SEQ ID NO: 333567

SEQ ID NO: 452621 - RNA, 64 nt, Homo Sapiens; identical to SEQ ID NO: 333568

SEQ ID NO: 452622 - RNA, 64 nt, Homo Sapiens; identical to SEQ ID NO: 333569

SEQ ID NO: 452623 - RNA, 64 nt, Homo Sapiens; identical to SEQ ID NO: 333570

SEQ ID NO: 452624 - RNA, 64 nt, Homo Sapiens; identical to SEQ ID NO: 333571

SEQ ID NO: 452625 - RNA, 64 nt, Homo Sapiens; identical to SEQ ID NO: 333572

SEQ ID NO: 452626 - RNA, 64 nt, Homo Sapiens; identical to SEQ ID NO: 333573

SEQ ID NO: 452627 - RNA, 64 nt, Homo Sapiens; identical to SEQ ID NO: 333574

SEQ ID NO: 452628 - RNA, 64 nt, Homo Sapiens; identical to SEQ ID NO: 333575

SEQ ID NO: 452629 - RNA, 64 nt, Homo Sapiens; identical to SEQ ID NO: 333576

SEQ ID NO: 452630 - RNA, 64 nt, Homo Sapiens; identical to SEQ ID NO: 333577

SEQ ID NO: 452631 - RNA, 64 nt, Homo Sapiens; identical to SEQ ID NO: 333578

SEQ ID NO: 452632 - RNA, 64 nt, Homo Sapiens; identical to SEQ ID NO: 333579

SEQ ID NO: 452633 - RNA, 64 nt, Homo Sapiens; identical to SEQ ID NO: 333580

SEQ ID NO: 452634 - RNA, 64 nt, Homo Sapiens; identical to SEQ ID NO: 333581

SEQ ID NO: 452635 - RNA, 64 nt, Homo Sapiens; identical to SEQ ID NO: 333582

SEQ ID NO: 452636 - RNA, 64 nt, Homo Sapiens; identical to SEQ ID NO: 333583

SEQ ID NO: 452637 - RNA, 64 nt, Homo Sapiens; identical to SEQ ID NO: 333584

SEQ ID NO: 452638 - RNA, 64 nt, Homo Sapiens; identical to SEQ ID NO: 333585

SEQ ID NO: 452639 - RNA, 64 nt, Homo Sapiens; identical to SEQ ID NO: 333586

SEQ ID NO: 452640 - RNA, 64 nt, Homo Sapiens; identical to SEQ ID NO: 333587

SEQ ID NO: 452641 - RNA, 64 nt, Homo Sapiens; identical to SEQ ID NO: 333588

SEQ ID NO: 452642 - RNA, 64 nt, Homo Sapiens; identical to SEQ ID NO: 333589

SEQ ID NO: 452643 - RNA, 64 nt, Homo Sapiens; identical to SEQ ID NO: 333590

SEQ ID NO: 452644 - RNA, 64 nt, Homo Sapiens
ucauuaagaaacaguuuacucauccaagaccagagucucagaacauuacccaguaugaucaugg

SEQ ID NO: 452645 - RNA, 64 nt, Homo Sapiens
agaaauaauuacccaguauggacaaagucacaaagucucagacuuuuuuuuuuuugaggcaucu

SEQ ID NO: 452646 - RNA, 64 nt, Homo Sapiens
gacgagggcucuccaagggaaagcaagacagagggucucagauguuguucagacaugugaagag

SEQ ID NO: 452647 - RNA, 64 nt, Homo Sapiens
acucccccaccugugguuuuaccccagcuccuaggucucagagaagggccccgcuucuccguac

SEQ ID NO: 452648 - RNA, 64 nt, Homo Sapiens
aaacaaaugaguuacucucuacaaauuacagauugucucagagacuuaaggauaauaggacaag

SEQ ID NO: 452649 - RNA, 64 nt, Homo Sapiens
uaacugguaaaggcugauuuggaaaguuuaccuugucucagaugucugaugauuccaauguguu

SEQ ID NO: 452650 - RNA, 64 nt, Homo Sapiens
gucggccuccggcaucuucgggaggcucucgcaggucucagaggugccuuugaugguggucuca

SEQ ID NO: 452651 - RNA, 64 nt, Homo Sapiens
gcacccaagcgcagcugggggaccccucagcuccgucucagagugcucuccgagacgcugaaga

SEQ ID NO: 452652 - RNA, 64 nt, Homo Sapiens
cccaggaccuugagugucauuuuuaccaccgucugucucagaguaugugaaucgcagcuguggg

SEQ ID NO: 452653 - RNA, 64 nt, Homo Sapiens
ccccaaaguuucgguuccuaaucugaaucagccagucucagauguuccgugugauugucuuuga

SEQ ID NO: 452654 - RNA, 64 nt, Homo Sapiens
gucaggcuuccuggugagccucagggagugcauggucucagaugccauccuucucuucuccagc

SEQ ID NO: 452655 - RNA, 62 nt, Homo Sapiens
uuccucucaccuccguguucucggggagugcguggucucagaucccauccugcuccucucca

SEQ ID NO: 452656 - RNA, 64 nt, Homo Sapiens
ucugcuaucgcuugcaugcugaugcaauuacgaugucucagagcaaagauuuuucuagccauca

SEQ ID NO: 452657 - RNA, 64 nt, Homo Sapiens
uuuuagccuggaaguuuguauccccacuccccaagucucagagcggagggucugguggacuuuc

SEQ ID NO: 452658 - RNA, 64 nt, Homo Sapiens
gugcgcuucugauuauuuuagccaggcaggaguggucucagaacugggcgcuacccugcagggu

SEQ ID NO: 452659 - RNA, 64 nt, Homo Sapiens
gccuggucuuacgccugugucccugggauucccugucucagauggaccacucagacggaggggc

SEQ ID NO: 452660 - RNA, 64 nt, Homo Sapiens
cggauacauuauuuuuucuuucuuucauagcugugucucagaaaggacccauuuguggcucuuu

SEQ ID NO: 452661 - RNA, 64 nt, Homo Sapiens
uuucuagccaucuaaauugacucuuccaauauaggucucagaaauccaauauuuggaguacaau

SEQ ID NO: 452662 - RNA, 64 nt, Homo Sapiens
gucacugauucacacccagucccugccacagaccgucucagacacgcacagugggccugcugca

SEQ ID NO: 452663 - RNA, 64 nt, Homo Sapiens
cugcaugauucacacccagucccugccacagaccgucucagacacgcacagugggccugcugca

SEQ ID NO: 452664 - RNA, 64 nt, Homo Sapiens; identical to SEQ ID NO: 452663

SEQ ID NO: 452665 - RNA, 64 nt, Homo Sapiens
aaguaguuucuguaccaauuaaaggauugacguggucucagauauugaugcaaaaaauuuuucc

SEQ ID NO: 452666 - RNA, 64 nt, Homo Sapiens
agguggucccugcuuucucuuucucuuucucugugucucagauggcgauuuugcugacagcugc

SEQ ID NO: 452667 - RNA, 64 nt, Homo Sapiens; identical to SEQ ID NO: 160465

SEQ ID NO: 452668 - RNA, 64 nt, Homo Sapiens; identical to SEQ ID NO: 160466

SEQ ID NO: 452669 - RNA, 64 nt, Homo Sapiens; identical to SEQ ID NO: 160467

SEQ ID NO: 452670 - RNA, 64 nt, Homo Sapiens; identical to SEQ ID NO: 160468

SEQ ID NO: 452671 - RNA, 64 nt, Homo Sapiens; identical to SEQ ID NO: 160469

SEQ ID NO: 452672 - RNA, 64 nt, Homo Sapiens; identical to SEQ ID NO: 160470

SEQ ID NO: 452673 - RNA, 64 nt, Homo Sapiens; identical to SEQ ID NO: 160471

SEQ ID NO: 452674 - RNA, 64 nt, Homo Sapiens; identical to SEQ ID NO: 160472

SEQ ID NO: 452675 - RNA, 64 nt, Homo Sapiens; identical to SEQ ID NO: 160473

SEQ ID NO: 452676 - RNA, 64 nt, Homo Sapiens; identical to SEQ ID NO: 160474

SEQ ID NO: 452677 - RNA, 64 nt, Homo Sapiens; identical to SEQ ID NO: 160475

SEQ ID NO: 452678 - RNA, 64 nt, Homo Sapiens; identical to SEQ ID NO: 154299

SEQ ID NO: 452679 - RNA, 64 nt, Homo Sapiens; identical to SEQ ID NO: 154300

SEQ ID NO: 452680 - RNA, 64 nt, Homo Sapiens; identical to SEQ ID NO: 154301

SEQ ID NO: 452681 - RNA, 64 nt, Homo Sapiens; identical to SEQ ID NO: 154302

SEQ ID NO: 452682 - RNA, 64 nt, Homo Sapiens; identical to SEQ ID NO: 154303

SEQ ID NO: 452683 - RNA, 64 nt, Homo Sapiens; identical to SEQ ID NO: 154304

SEQ ID NO: 452684 - RNA, 64 nt, Homo Sapiens; identical to SEQ ID NO: 154305

SEQ ID NO: 452685 - RNA, 64 nt, Homo Sapiens; identical to SEQ ID NO: 154306

SEQ ID NO: 452686 - RNA, 64 nt, Homo Sapiens; identical to SEQ ID NO: 154307

SEQ ID NO: 452687 - RNA, 64 nt, Homo Sapiens; identical to SEQ ID NO: 154308

SEQ ID NO: 452688 - RNA, 64 nt, Homo Sapiens; identical to SEQ ID NO: 154309

SEQ ID NO: 452689 - RNA, 64 nt, Homo Sapiens; identical to SEQ ID NO: 154310

SEQ ID NO: 452690 - RNA, 64 nt, Homo Sapiens; identical to SEQ ID NO: 154311

SEQ ID NO: 452691 - RNA, 64 nt, Homo Sapiens; identical to SEQ ID NO: 154312

SEQ ID NO: 452692 - RNA, 64 nt, Homo Sapiens; identical to SEQ ID NO: 154313

SEQ ID NO: 452693 - RNA, 54 nt, Homo Sapiens; identical to SEQ ID NO: 154314

SEQ ID NO: 452694 - RNA, 64 nt, Homo Sapiens; identical to SEQ ID NO: 154315

SEQ ID NO: 452695 - RNA, 64 nt, Homo Sapiens; identical to SEQ ID NO: 154316

SEQ ID NO: 452696 - RNA, 64 nt, Homo Sapiens; identical to SEQ ID NO: 154317

SEQ ID NO: 452697 - RNA, 64 nt, Homo Sapiens; identical to SEQ ID NO: 154318

SEQ ID NO: 452698 - RNA, 64 nt, Homo Sapiens; identical to SEQ ID NO: 154319

SEQ ID NO: 452699 - RNA, 64 nt, Homo Sapiens; identical to SEQ ID NO: 154320

SEQ ID NO: 452700 - RNA, 64 nt, Homo Sapiens; identical to SEQ ID NO: 154321

SEQ ID NO: 452701 - RNA, 64 nt, Homo Sapiens; identical to SEQ ID NO: 154322

SEQ ID NO: 452702 - RNA, 64 nt, Homo Sapiens; identical to SEQ ID NO: 154323

SEQ ID NO: 452703 - RNA, 64 nt, Homo Sapiens; identical to SEQ ID NO: 154324

SEQ ID NO: 452704 - RNA, 64 nt, Homo Sapiens; identical to SEQ ID NO: 154325

SEQ ID NO: 452705 - RNA, 64 nt, Homo Sapiens; identical to SEQ ID NO: 154326

SEQ ID NO: 452706 - RNA, 64 nt, Homo Sapiens; identical to SEQ ID NO: 154327

SEQ ID NO: 452707 - RNA, 64 nt, Homo Sapiens; identical to SEQ ID NO: 154328

SEQ ID NO: 452708 - RNA, 64 nt, Homo Sapiens; identical to SEQ ID NO: 154329

SEQ ID NO: 452709 - RNA, 64 nt, Homo Sapiens; identical to SEQ ID NO: 154330

SEQ ID NO: 452710 - RNA, 64 nt, Homo Sapiens; identical to SEQ ID NO: 154331

SEQ ID NO: 452711 - RNA, 64 nt, Homo Sapiens; identical to SEQ ID NO: 154332

SEQ ID NO: 452712 - RNA, 64 nt, Homo Sapiens; identical to SEQ ID NO: 154333

SEQ ID NO: 452713 - RNA, 64 nt, Homo Sapiens; identical to SEQ ID NO: 154334

SEQ ID NO: 452714 - RNA, 64 nt, Homo Sapiens; identical to SEQ ID NO: 154335

SEQ ID NO: 452715 - RNA, 64 nt, Homo Sapiens; identical to SEQ ID NO: 154336

SEQ ID NO: 452716 - RNA, 64 nt, Homo Sapiens; identical to SEQ ID NO: 154337

SEQ ID NO: 452717 - RNA, 64 nt, Homo Sapiens; identical to SEQ ID NO: 154338

SEQ ID NO: 452718 - RNA, 64 nt, Homo Sapiens; identical to SEQ ID NO: 154339

SEQ ID NO: 452719 - RNA, 64 nt, Homo Sapiens; identical to SEQ ID NO: 154340

SEQ ID NO: 452720 - RNA, 64 nt, Homo Sapiens; identical to SEQ ID NO: 154341

SEQ ID NO: 452721 - RNA, 64 nt, Homo Sapiens; identical to SEQ ID NO: 154342

SEQ ID NO: 452722 - RNA, 64 nt, Homo Sapiens; identical to SEQ ID NO: 154343

SEQ ID NO: 452723 - RNA, 64 nt, Homo Sapiens; identical to SEQ ID NO: 154344

SEQ ID NO: 452724 - RNA, 64 nt, Homo Sapiens; identical to SEQ ID NO: 154345

SEQ ID NO: 452725 - RNA, 55 nt, Homo Sapiens; identical to SEQ ID NO: 154346

SEQ ID NO: 452726 - RNA, 64 nt, Homo Sapiens; identical to SEQ ID NO: 154347

SEQ ID NO: 452727 - RNA, 64 nt, Homo Sapiens; identical to SEQ ID NO: 154348

SEQ ID NO: 452728 - RNA, 64 nt, Homo Sapiens; identical to SEQ ID NO: 154349

SEQ ID NO: 452729 - RNA, 64 nt, Homo Sapiens; identical to SEQ ID NO: 154350

SEQ ID NO: 452730 - RNA, 64 nt, Homo Sapiens; identical to SEQ ID NO: 154351

SEQ ID NO: 452731 - RNA, 64 nt, Homo Sapiens; identical to SEQ ID NO: 154352

SEQ ID NO: 452732 - RNA, 64 nt, Homo Sapiens; identical to SEQ ID NO: 154353

SEQ ID NO: 452733 - RNA, 64 nt, Homo Sapiens; identical to SEQ ID NO: 154354

SEQ ID NO: 452734 - RNA, 64 nt, Homo Sapiens; identical to SEQ ID NO: 154355

SEQ ID NO: 452735 - RNA, 64 nt, Homo Sapiens; identical to SEQ ID NO: 154356

SEQ ID NO: 452736 - RNA, 64 nt, Homo Sapiens
caucaauggcuuuauuuuuaacucuguuaaaacugauuaucacucagcuaagauaauugcguga

SEQ ID NO: 452737 - RNA, 64 nt, Homo Sapiens
cacuucaacauuucuauaacguaugguauuuuaagauuaucaauccuuuuguuuacacauuuuu

SEQ ID NO: 452738 - RNA, 64 nt, Homo Sapiens
ccuugccaacuaguaugcaggucaccuaggaauagauuaucaggagguugcagcaguacaucuc

SEQ ID NO: 452739 - RNA, 64 nt, Homo Sapiens
gcuaauacuuaggacaacgaagagguagcauaaggauuaucauucuuuguauaagauaccuggg

SEQ ID NO: 452740 - RNA, 64 nt, Homo Sapiens
uaacugggacuauagcaugccaccacacccagcugauuaucauauuuuuuuuuguagagguggg

SEQ ID NO: 452741 - RNA, 64 nt, Homo Sapiens; identical to SEQ ID NO: 452740

SEQ ID NO: 452742 - RNA, 64 nt, Homo Sapiens; identical to SEQ ID NO: 155373

SEQ ID NO: 452743 - RNA, 64 nt, Homo Sapiens; identical to SEQ ID NO: 155374

SEQ ID NO: 452744 - RNA, 62 nt, Homo Sapiens
ccuaccuccucuaccagugacguucgccaucauaccgccagcgcgacagccaccuggugcca

SEQ ID NO: 452745 - RNA, 58 nt, Homo Sapiens
gcuggccucacaagccccugccuacacauaccgccacuccugcuuggggccacccuga

SEQ ID NO: 452746 - RNA, 64 nt, Homo Sapiens
gaaaaugguaaaugcaaacgucccguuacaauuuuaccgccagugugcugucguucccccuccc

SEQ ID NO: 452747 - RNA, 64 nt, Homo Sapiens
uuacacgaaagccacagaguuguccauggcccuauaccgccaucaaacuauucuuuggcauugg

SEQ ID NO: 452748 - RNA, 64 nt, Homo Sapiens
acagcaggacacgccaccauuccaggguagcugguaccgccagaaacaggagugggucuugucc

SEQ ID NO: 452749 - RNA, 64 nt, Homo Sapiens
cccagcuaauuuuauuuuuugaacuacaggcauauaccgccacacucaggcacccaaauagcug

SEQ ID NO: 452750 - RNA, 64 nt, Homo Sapiens
aucgcaggucccaguguucaauucgccacgaaguuaccgccaguaauccgcaucaggcauucuc

SEQ ID NO: 452751 - RNA, 64 nt, Homo Sapiens
aauaauagagagcccagaaaucaaccugcacaccuaccgccaucuaaucuucaauagaaauggg

SEQ ID NO: 452752 - RNA, 64 nt, Homo Sapiens
ggccccuugcuggccacccucaggcuuccugaccuaccgccaguacacauugaacccuagaucu

SEQ ID NO: 452753 - RNA, 64 nt, Homo Sapiens
ggggcacaguggagacgcaggggcucugggcccguaccgccaacucgggucacaccugaacgcu

SEQ ID NO: 452754 - RNA, 64 nt, Homo Sapiens
uauucaagcucucagcuacuugguggugggagcuuaccgccaccuagcugcacugggcaugggg

SEQ ID NO: 452755 - RNA, 64 nt, Homo Sapiens
gcccacaggccacgacagacgcuggaugcccuccuaccgccagacaccuccccagaggccuugg

SEQ ID NO: 452756 - RNA, 64 nt, Homo Sapiens
gucaauuauguuugaaagccauggucuccauguguaccgccaaauggcaguccccguucgcauc

SEQ ID NO: 452757 - RNA, 64 nt, Homo Sapiens
ugcacaaugguauaauccccacuguccucaucucuaccgccaccuucuggcgcaacaagaaguu

SEQ ID NO: 452758 - RNA, 64 nt, Homo Sapiens
gcaaauacuccuuaucguuagaugugugauccacuaccgccaaaauaucaaagcaagauaagca

SEQ ID NO: 452759 - RNA, 64 nt, Homo Sapiens
uggagagaaaagguaguguuuuuguacaaggucauaccgccagaagccccaaauccuauuuugg

SEQ ID NO: 452760 - RNA, 64 nt, Homo Sapiens
acuguguccacuccugaggaugguuccagggaaauaccgccagaaaacaagaaggucagcccac

SEQ ID NO: 452761 - RNA, 64 nt, Homo Sapiens
uggcgccaggcccccacagugacauucccagaacuaccgccaggggguccacgagccugggccu

SEQ ID NO: 452762 - RNA, 64 nt, Homo Sapiens
acauaaacauuaaaccuuaaccaaagaagaacuuuaccgccaccaaaacagaaacaaccccaaa

SEQ ID NO: 452763 - RNA, 64 nt, Homo Sapiens
ucguuauuucuguuuguuuaagcugagccacggauaccgccacggguuucccucggcguuaguc

SEQ ID NO: 452764 - RNA, 64 nt, Homo Sapiens
gaaucuuccaguuauuagcaaacucagacgaauguaccgccaguauuaucagcagucaacaagc

SEQ ID NO: 452765 - RNA, 64 nt, Homo Sapiens
auucaaaccccagacucccggaauggaugagugguaccgccaaacugggacccucaauuaugca

SEQ ID NO: 452766 - RNA, 64 nt, Homo Sapiens
gcuggcugggguauucuuuuaccaaacucuguuuuaccgccagccccuuguacaccccaauccc

SEQ ID NO: 452767 - RNA, 64 nt, Homo Sapiens
uccuacaaaggagaaagauaaaaggcacaaagguuaccgccaaggcccgucagcuguguagugg

SEQ ID NO: 452768 - RNA, 64 nt, Homo Sapiens
cuacauccuacugcuuuggccuccccuuggaaucuaccgccacugcaugaaauaaacugcuauc

SEQ ID NO: 452769 - RNA, 64 nt, Homo Sapiens
cccagcuguaaggaccgggggucucccuccucacuaccgccagacaccccgguggaagcauuua

SEQ ID NO: 452770 - RNA, 64 nt, Homo Sapiens
cugcucgagcacaugaaaggggaaacccuucauuuaccgccauucuacaaauguaaggaaugug

SEQ ID NO: 452771 - RNA, 64 nt, Homo Sapiens
auguaagcaguccccaccgggaguuccccccugcuaccgccagagagguggacccacuccggau

SEQ ID NO: 452772 - RNA, 64 nt, Homo Sapiens
ccagcugcuucuggcaggggcccucggggacaucuaccgccaacauucccagugcuucccaagg

SEQ ID NO: 452773 - RNA, 64 nt, Homo Sapiens; identical to SEQ ID NO: 171830

SEQ ID NO: 452774 - RNA, 64 nt, Homo Sapiens; identical to SEQ ID NO: 171831

SEQ ID NO: 452775 - RNA, 64 nt, Homo Sapiens; identical to SEQ ID NO: 171832

SEQ ID NO: 452776 - RNA, 64 nt, Homo Sapiens; identical to SEQ ID NO: 171833

SEQ ID NO: 452777 - RNA, 64 nt, Homo Sapiens; identical to SEQ ID NO: 171834

SEQ ID NO: 452778 - RNA, 64 nt, Homo Sapiens; identical to SEQ ID NO: 171835

SEQ ID NO: 452779 - RNA, 64 nt, Homo Sapiens; identical to SEQ ID NO: 171836

SEQ ID NO: 452780 - RNA, 64 nt, Homo Sapiens; identical to SEQ ID NO: 171837

SEQ ID NO: 452781 - RNA, 64 nt, Homo Sapiens; identical to SEQ ID NO: 171838

SEQ ID NO: 452782 - RNA, 64 nt, Homo Sapiens; identical to SEQ ID NO: 171839

SEQ ID NO: 452783 - RNA, 64 nt, Homo Sapiens; identical to SEQ ID NO: 171840

SEQ ID NO: 452784 - RNA, 61 nt, Homo Sapiens; identical to SEQ ID NO: 171841

SEQ ID NO: 452785 - RNA, 64 nt, Homo Sapiens; identical to SEQ ID NO: 171842

SEQ ID NO: 452786 - RNA, 54 nt, Homo Sapiens; identical to SEQ ID NO: 171843

SEQ ID NO: 452787 - RNA, 64 nt, Homo Sapiens; identical to SEQ ID NO: 171844

SEQ ID NO: 452788 - RNA, 64 nt, Homo Sapiens; identical to SEQ ID NO: 171845

SEQ ID NO: 452789 - RNA, 64 nt, Homo Sapiens; identical to SEQ ID NO: 171846

SEQ ID NO: 452790 - RNA, 64 nt, Homo Sapiens; identical to SEQ ID NO: 171847

SEQ ID NO: 452791 - RNA, 64 nt, Homo Sapiens; identical to SEQ ID NO: 171848

SEQ ID NO: 452792 - RNA, 64 nt, Homo Sapiens; identical to SEQ ID NO: 171849

SEQ ID NO: 452793 - RNA, 64 nt, Homo Sapiens; identical to SEQ ID NO: 171850

SEQ ID NO: 452794 - RNA, 64 nt, Homo Sapiens; identical to SEQ ID NO: 171851

SEQ ID NO: 452795 - RNA, 64 nt, Homo Sapiens; identical to SEQ ID NO: 171852

SEQ ID NO: 452796 - RNA, 64 nt, Homo Sapiens; identical to SEQ ID NO: 171853

SEQ ID NO: 452797 - RNA, 64 nt, Homo Sapiens; identical to SEQ ID NO: 171854

SEQ ID NO: 452798 - RNA, 64 nt, Homo Sapiens; identical to SEQ ID NO: 171855

SEQ ID NO: 452799 - RNA, 64 nt, Homo Sapiens; identical to SEQ ID NO: 171856

SEQ ID NO: 452800 - RNA, 64 nt, Homo Sapiens; identical to SEQ ID NO: 171857

SEQ ID NO: 452801 - RNA, 64 nt, Homo Sapiens; identical to SEQ ID NO: 171858

SEQ ID NO: 452802 - RNA, 64 nt, Homo Sapiens; identical to SEQ ID NO: 171859

SEQ ID NO: 452803 - RNA, 64 nt, Homo Sapiens; identical to SEQ ID NO: 171860

SEQ ID NO: 452804 - RNA, 64 nt, Homo Sapiens; identical to SEQ ID NO: 171861

SEQ ID NO: 452805 - RNA, 64 nt, Homo Sapiens; identical to SEQ ID NO: 171862

SEQ ID NO: 452806 - RNA, 64 nt, Homo Sapiens; identical to SEQ ID NO: 171863

SEQ ID NO: 452807 - RNA, 64 nt, Homo Sapiens; identical to SEQ ID NO: 171864

SEQ ID NO: 452808 - RNA, 64 nt, Homo Sapiens; identical to SEQ ID NO: 171865

SEQ ID NO: 452809 - RNA, 64 nt, Homo Sapiens; identical to SEQ ID NO: 171866

SEQ ID NO: 452810 - RNA, 64 nt, Homo Sapiens; identical to SEQ ID NO: 171867

SEQ ID NO: 452811 - RNA, 64 nt, Homo Sapiens; identical to SEQ ID NO: 171868

SEQ ID NO: 452812 - RNA, 64 nt, Homo Sapiens; identical to SEQ ID NO: 171869

SEQ ID NO: 452813 - RNA, 64 nt, Homo Sapiens; identical to SEQ ID NO: 171870

SEQ ID NO: 452814 - RNA, 64 nt, Homo Sapiens; identical to SEQ ID NO: 171871

SEQ ID NO: 452815 - RNA, 64 nt, Homo Sapiens; identical to SEQ ID NO: 171872

SEQ ID NO: 452816 - RNA, 64 nt, Homo Sapiens; identical to SEQ ID NO: 171873

SEQ ID NO: 452817 - RNA, 64 nt, Homo Sapiens; identical to SEQ ID NO: 171874

SEQ ID NO: 452818 - RNA, 64 nt, Homo Sapiens; identical to SEQ ID NO: 171875

SEQ ID NO: 452819 - RNA, 64 nt, Homo Sapiens
uguggucuuuuuaaaaaauuguaacccucuagaaaauaucaaagaaaugaaccagacgugguuu

SEQ ID NO: 452820 - RNA, 64 nt, Homo Sapiens
uaacugaaucauuuuuuaacuuaaaaagcuggaaaauaucaaaugcuguuuuuuuuuuuucauu

SEQ ID NO: 452821 - RNA, 64 nt, Homo Sapiens
ugauuuuaaauaaaaaacauuccaucuuucauuuaauaucaauaucaaaagaagaagacaaaca

SEQ ID NO: 452822 - RNA, 64 nt, Homo Sapiens
uaaauaaaaaacauuccaucuuucauuuaauaucaauaucaaaagaagaagacaaacaucuauc

SEQ ID NO: 452823 - RNA, 64 nt, Homo Sapiens
uuuucuauuuuucuacuucauacuguuaaugucaaauaucaaaaauguuuuccagcaauaucaa

SEQ ID NO: 452824 - RNA, 64 nt, Homo Sapiens
cuguuaaugucaaauaucaaaaauguuuuccagcaauaucaaguuauggcaauggcaaaagucc

SEQ ID NO: 452825 - RNA, 64 nt, Homo Sapiens
auuaaaauggucacuuuacacaauaagagaaguaaauaucaaaccuaucuuauuagucuugugc

SEQ ID NO: 452826 - RNA, 64 nt, Homo Sapiens
uucauuuuaaguguauuagucagggaagcaguaaaauaucaauuaaagugagugugagaucacc

SEQ ID NO: 452827 - RNA, 64 nt, Homo Sapiens
caguguguauaaaguguguuugaacauuaugccaaauaucaagaugugaaggacuaauucagga

SEQ ID NO: 452828 - RNA, 64 nt, Homo Sapiens
auucaggaugcaaaaacguuauugggggguuguaaauaucaacuauucaacaguuuaggaugca

SEQ ID NO: 452829 - RNA, 64 nt, Homo Sapiens
gucaguaucuugaaaucaucaccaauauucuagaaauaucaaauaagaauacuuuaugauuuag

SEQ ID NO: 452830 - RNA, 64 nt, Homo Sapiens
gucaguaacaguguucuuuccaauuuacugccauaauaucaaagaauuaagguauuuuaguaug

SEQ ID NO: 452831 - RNA, 64 nt, Homo Sapiens
uuugguauaaaauaacuagauuguuuugacuaggaauaucaauaagaaagaucuuaauuccuug

SEQ ID NO: 452832 - RNA, 64 nt, Homo Sapiens
aaauguauauaggaauaugcugaaagacaaccagaauaucaagaauuucucuguaaugcauugu

SEQ ID NO: 452833 - RNA, 64 nt, Homo Sapiens
uauuuccaauccaucagacuauccuguuucagauaauaucaauuguuauuuucccccccaagcu

SEQ ID NO: 452834 - RNA, 64 nt, Homo Sapiens
aauccccagcagcugggacuugaugagucacuguaauaucaaaauauuuucauucaaaugagga

SEQ ID NO: 452835 - RNA, 64 nt, Homo Sapiens
uauaaaucuugaauuucuaauugagaaaauguuuaauaucaaucagaucagaauauucuaugua

SEQ ID NO: 452836 - RNA, 64 nt, Homo Sapiens
uaacuucccacauuuuccagugaucuugcuagacaauaucaaaaggugaucaguguuuacuuau

SEQ ID NO: 452837 - RNA, 64 nt, Homo Sapiens
acgguaaauauaguaucgucugcauuccagcaaaaauaucaacucguaaggcacuaguacaguu

SEQ ID NO: 452838 - RNA, 64 nt, Homo Sapiens
uagugaugcucugaaaugaaaguuugucuucacaaauaucaaaacaaaauggaggaaaacuaag

SEQ ID NO: 452839 - RNA, 64 nt, Homo Sapiens
uggcuguagauguuggaggcuagggaggcuaguaaauaucaaaaggaaaagggagugggaauug

SEQ ID NO: 452840 - RNA, 64 nt, Homo Sapiens
aaaggaaaagggagugggaauugcuaucauguaaaauaucaaaguuaaaauacuaaggugcauu

SEQ ID NO: 452841 - RNA, 64 nt, Homo Sapiens
uaaaaaaaaaaaaaaaaaagagagggcggggacaaauaucaaauuaagcaaguaaagaaaaaga

SEQ ID NO: 452842 - RNA, 64 nt, Homo Sapiens
guuguagucuuuuugcaaacucugauucuucagcaauaucaacguuuuaacaugcucaccucag

SEQ ID NO: 452843 - RNA, 64 nt, Homo Sapiens
uguugcuguuguuguuaauuuuguuaagaauuucaauaucaagacugacuggcaccaacacuuu

SEQ ID NO: 452844 - RNA, 64 nt, Homo Sapiens
cucagcuucaaauaaaguaaauugaaaugggaacaauaucaauauggugucuugauauauuuau

SEQ ID NO: 452845 - RNA, 64 nt, Homo Sapiens
uucugguuguauugggaacccaugcaguccaaggaauaucaaaauuuaaucuuccucuagcagg

SEQ ID NO: 452846 - RNA, 64 nt, Homo Sapiens
uucugauuguaugggaaccacaugcaguccaaggaauaucaaaauuuaauuuuccucuagcagg

SEQ ID NO: 452847 - RNA, 64 nt, Homo Sapiens; identical to SEQ ID NO: 250930

SEQ ID NO: 452848 - RNA, 64 nt, Homo Sapiens; identical to SEQ ID NO: 250931

SEQ ID NO: 452849 - RNA, 64 nt, Homo Sapiens; identical to SEQ ID NO: 250932

SEQ ID NO: 452850 - RNA, 64 nt, Homo Sapiens; identical to SEQ ID NO: 250933

SEQ ID NO: 452851 - RNA, 64 nt, Homo Sapiens; identical to SEQ ID NO: 250934

SEQ ID NO: 452852 - RNA, 64 nt, Homo Sapiens; identical to SEQ ID NO: 250935

SEQ ID NO: 452853 - RNA, 64 nt, Homo Sapiens; identical to SEQ ID NO: 452819

SEQ ID NO: 452854 - RNA, 64 nt, Homo Sapiens; identical to SEQ ID NO: 452820

SEQ ID NO: 452855 - RNA, 64 nt, Homo Sapiens; identical to SEQ ID NO: 452821

SEQ ID NO: 452856 - RNA, 64 nt, Homo Sapiens; identical to SEQ ID NO: 452822

SEQ ID NO: 452857 - RNA, 64 nt, Homo Sapiens; identical to SEQ ID NO: 452823

SEQ ID NO: 452858 - RNA, 64 nt, Homo Sapiens; identical to SEQ ID NO: 452824

SEQ ID NO: 452859 - RNA, 64 nt, Homo Sapiens; identical to SEQ ID NO: 452825

SEQ ID NO: 452860 - RNA, 64 nt, Homo Sapiens; identical to SEQ ID NO: 452826

SEQ ID NO: 452861 - RNA, 64 nt, Homo Sapiens; identical to SEQ ID NO: 452827

SEQ ID NO: 452862 - RNA, 64 nt, Homo Sapiens; identical to SEQ ID NO: 452828

SEQ ID NO: 452863 - RNA, 64 nt, Homo Sapiens; identical to SEQ ID NO: 452829

SEQ ID NO: 452864 - RNA, 64 nt, Homo Sapiens; identical to SEQ ID NO: 452830

SEQ ID NO: 452865 - RNA, 64 nt, Homo Sapiens; identical to SEQ ID NO: 452831

SEQ ID NO: 452866 - RNA, 64 nt, Homo Sapiens; identical to SEQ ID NO: 452832

SEQ ID NO: 452867 - RNA, 64 nt, Homo Sapiens; identical to SEQ ID NO: 452833

SEQ ID NO: 452868 - RNA, 64 nt, Homo Sapiens; identical to SEQ ID NO: 452834

SEQ ID NO: 452869 - RNA, 64 nt, Homo Sapiens; identical to SEQ ID NO: 452835

SEQ ID NO: 452870 - RNA, 64 nt, Homo Sapiens; identical to SEQ ID NO: 452836

SEQ ID NO: 452871 - RNA, 64 nt, Homo Sapiens; identical to SEQ ID NO: 452837

SEQ ID NO: 452872 - RNA, 64 nt, Homo Sapiens; identical to SEQ ID NO: 452838

SEQ ID NO: 452873 - RNA, 64 nt, Homo Sapiens; identical to SEQ ID NO: 452839

SEQ ID NO: 452874 - RNA, 64 nt, Homo Sapiens; identical to SEQ ID NO: 452840

SEQ ID NO: 452875 - RNA, 64 nt, Homo Sapiens; identical to SEQ ID NO: 452841

SEQ ID NO: 452876 - RNA, 64 nt, Homo Sapiens; identical to SEQ ID NO: 452842

SEQ ID NO: 452877 - RNA, 64 nt, Homo Sapiens; identical to SEQ ID NO: 452843

SEQ ID NO: 452878 - RNA, 64 nt, Homo Sapiens; identical to SEQ ID NO: 452844

SEQ ID NO: 452879 - RNA, 64 nt, Homo Sapiens; identical to SEQ ID NO: 452845

SEQ ID NO: 452880 - RNA, 64 nt, Homo Sapiens; identical to SEQ ID NO: 452846

SEQ ID NO: 452881 - RNA, 64 nt, Homo Sapiens; identical to SEQ ID NO: 250930

SEQ ID NO: 452882 - RNA, 64 nt, Homo Sapiens; identical to SEQ ID NO: 250931

SEQ ID NO: 452883 - RNA, 64 nt, Homo Sapiens; identical to SEQ ID NO: 250932

SEQ ID NO: 452884 - RNA, 64 nt, Homo Sapiens; identical to SEQ ID NO: 250933

SEQ ID NO: 452885 - RNA, 64 nt, Homo Sapiens; identical to SEQ ID NO: 250934

SEQ ID NO: 452886 - RNA, 64 nt, Homo Sapiens; identical to SEQ ID NO: 250935

SEQ ID NO: 452887 - RNA, 64 nt, Homo Sapiens; identical to SEQ ID NO: 452819

SEQ ID NO: 452888 - RNA, 64 nt, Homo Sapiens; identical to SEQ ID NO: 452820

SEQ ID NO: 452889 - RNA, 64 nt, Homo Sapiens; identical to SEQ ID NO: 452821

SEQ ID NO: 452890 - RNA, 64 nt, Homo Sapiens; identical to SEQ ID NO: 452822

SEQ ID NO: 452891 - RNA, 64 nt, Homo Sapiens; identical to SEQ ID NO: 452823

SEQ ID NO: 452892 - RNA, 64 nt, Homo Sapiens; identical to SEQ ID NO: 452824

SEQ ID NO: 452893 - RNA, 64 nt, Homo Sapiens; identical to SEQ ID NO: 452825

SEQ ID NO: 452894 - RNA, 64 nt, Homo Sapiens; identical to SEQ ID NO: 452826

SEQ ID NO: 452895 - RNA, 64 nt, Homo Sapiens; identical to SEQ ID NO: 452827

SEQ ID NO: 452896 - RNA, 64 nt, Homo Sapiens; identical to SEQ ID NO: 452828

SEQ ID NO: 452897 - RNA, 64 nt, Homo Sapiens; identical to SEQ ID NO: 452829

SEQ ID NO: 452898 - RNA, 64 nt, Homo Sapiens; identical to SEQ ID NO: 452830

SEQ ID NO: 452899 - RNA, 64 nt, Homo Sapiens; identical to SEQ ID NO: 452831

SEQ ID NO: 452900 - RNA, 64 nt, Homo Sapiens; identical to SEQ ID NO: 452832

SEQ ID NO: 452901 - RNA, 64 nt, Homo Sapiens; identical to SEQ ID NO: 452833

SEQ ID NO: 452902 - RNA, 64 nt, Homo Sapiens; identical to SEQ ID NO: 452834

SEQ ID NO: 452903 - RNA, 64 nt, Homo Sapiens; identical to SEQ ID NO: 452835

SEQ ID NO: 452904 - RNA, 64 nt, Homo Sapiens; identical to SEQ ID NO: 452836

SEQ ID NO: 452905 - RNA, 64 nt, Homo Sapiens; identical to SEQ ID NO: 452837

SEQ ID NO: 452906 - RNA, 64 nt, Homo Sapiens; identical to SEQ ID NO: 452838

SEQ ID NO: 452907 - RNA, 64 nt, Homo Sapiens; identical to SEQ ID NO: 452839

SEQ ID NO: 452908 - RNA, 64 nt, Homo Sapiens; identical to SEQ ID NO: 452840

SEQ ID NO: 452909 - RNA, 64 nt, Homo Sapiens; identical to SEQ ID NO: 452841

SEQ ID NO: 452910 - RNA, 64 nt, Homo Sapiens; identical to SEQ ID NO: 452842

SEQ ID NO: 452911 - RNA, 64 nt, Homo Sapiens; identical to SEQ ID NO: 452843

SEQ ID NO: 452912 - RNA, 64 nt, Homo Sapiens; identical to SEQ ID NO: 452844

SEQ ID NO: 452913 - RNA, 64 nt, Homo Sapiens; identical to SEQ ID NO: 452845

SEQ ID NO: 452914 - RNA, 64 nt, Homo Sapiens; identical to SEQ ID NO: 452846

SEQ ID NO: 452915 - RNA, 64 nt, Homo Sapiens; identical to SEQ ID NO: 250930

SEQ ID NO: 452916 - RNA, 64 nt, Homo Sapiens; identical to SEQ ID NO: 250931

SEQ ID NO: 452917 - RNA, 64 nt, Homo Sapiens; identical to SEQ ID NO: 250932

SEQ ID NO: 452918 - RNA, 64 nt, Homo Sapiens; identical to SEQ ID NO: 250933

SEQ ID NO: 452919 - RNA, 64 nt, Homo Sapiens; identical to SEQ ID NO: 250934

SEQ ID NO: 452920 - RNA, 64 nt, Homo Sapiens; identical to SEQ ID NO: 250935

SEQ ID NO: 452921 - RNA, 64 nt, Homo Sapiens; identical to SEQ ID NO: 86201

SEQ ID NO: 452922 - RNA, 64 nt, Homo Sapiens; identical to SEQ ID NO: 86202

SEQ ID NO: 452923 - RNA, 64 nt, Homo Sapiens; identical to SEQ ID NO: 86203

SEQ ID NO: 452924 - RNA, 64 nt, Homo Sapiens; identical to SEQ ID NO: 86204

SEQ ID NO: 452925 - RNA, 64 nt, Homo Sapiens; identical to SEQ ID NO: 86205

SEQ ID NO: 452926 - RNA, 64 nt, Homo Sapiens; identical to SEQ ID NO: 86206

SEQ ID NO: 452927 - RNA, 64 nt, Homo Sapiens; identical to SEQ ID NO: 86207

SEQ ID NO: 452928 - RNA, 64 nt, Homo Sapiens; identical to SEQ ID NO: 86208

SEQ ID NO: 452929 - RNA, 64 nt, Homo Sapiens; identical to SEQ ID NO: 86209

SEQ ID NO: 452930 - RNA, 64 nt, Homo Sapiens; identical to SEQ ID NO: 86210

SEQ ID NO: 452931 - RNA, 64 nt, Homo Sapiens; identical to SEQ ID NO: 86211

SEQ ID NO: 452932 - RNA, 64 nt, Homo Sapiens; identical to SEQ ID NO: 86212

SEQ ID NO: 452933 - RNA, 64 nt, Homo Sapiens; identical to SEQ ID NO: 86213

SEQ ID NO: 452934 - RNA, 64 nt, Homo Sapiens; identical to SEQ ID NO: 86214

SEQ ID NO: 452935 - RNA, 64 nt, Homo Sapiens; identical to SEQ ID NO: 86215

SEQ ID NO: 452936 - RNA, 64 nt, Homo Sapiens; identical to SEQ ID NO: 86216

SEQ ID NO: 452937 - RNA, 64 nt, Homo Sapiens; identical to SEQ ID NO: 86217

SEQ ID NO: 452938 - RNA, 64 nt, Homo Sapiens; identical to SEQ ID NO: 86218

SEQ ID NO: 452939 - RNA, 64 nt, Homo Sapiens; identical to SEQ ID NO: 86219

SEQ ID NO: 452940 - RNA, 64 nt, Homo Sapiens; identical to SEQ ID NO: 86220

SEQ ID NO: 452941 - RNA, 64 nt, Homo Sapiens; identical to SEQ ID NO: 86221

SEQ ID NO: 452942 - RNA, 64 nt, Homo Sapiens; identical to SEQ ID NO: 86222

SEQ ID NO: 452943 - RNA, 64 nt, Homo Sapiens; identical to SEQ ID NO: 86223

SEQ ID NO: 452944 - RNA, 64 nt, Homo Sapiens; identical to SEQ ID NO: 86224

SEQ ID NO: 452945 - RNA, 64 nt, Homo Sapiens; identical to SEQ ID NO: 86225

SEQ ID NO: 452946 - RNA, 64 nt, Homo Sapiens; identical to SEQ ID NO: 86226

SEQ ID NO: 452947 - RNA, 64 nt, Homo Sapiens; identical to SEQ ID NO: 86227

SEQ ID NO: 452948 - RNA, 64 nt, Homo Sapiens; identical to SEQ ID NO: 86228

SEQ ID NO: 452949 - RNA, 64 nt, Homo Sapiens; identical to SEQ ID NO: 86229

SEQ ID NO: 452950 - RNA, 64 nt, Homo Sapiens; identical to SEQ ID NO: 86230

SEQ ID NO: 452951 - RNA, 64 nt, Homo Sapiens; identical to SEQ ID NO: 86231

SEQ ID NO: 452952 - RNA, 64 nt, Homo Sapiens; identical to SEQ ID NO: 86232

SEQ ID NO: 452953 - RNA, 64 nt, Homo Sapiens; identical to SEQ ID NO: 86233

SEQ ID NO: 452954 - RNA, 64 nt, Homo Sapiens; identical to SEQ ID NO: 86234

SEQ ID NO: 452955 - RNA, 64 nt, Homo Sapiens; identical to SEQ ID NO: 86235

SEQ ID NO: 452956 - RNA, 64 nt, Homo Sapiens; identical to SEQ ID NO: 86236

SEQ ID NO: 452957 - RNA, 64 nt, Homo Sapiens; identical to SEQ ID NO: 86237

SEQ ID NO: 452958 - RNA, 64 nt, Homo Sapiens; identical to SEQ ID NO: 86238

SEQ ID NO: 452959 - RNA, 64 nt, Homo Sapiens; identical to SEQ ID NO: 86239

SEQ ID NO: 452960 - RNA, 64 nt, Homo Sapiens; identical to SEQ ID NO: 86240

SEQ ID NO: 452961 - RNA, 64 nt, Homo Sapiens; identical to SEQ ID NO: 86241

SEQ ID NO: 452962 - RNA, 64 nt, Homo Sapiens; identical to SEQ ID NO: 86242

SEQ ID NO: 452963 - RNA, 64 nt, Homo Sapiens; identical to SEQ ID NO: 86243

SEQ ID NO: 452964 - RNA, 64 nt, Homo Sapiens; identical to SEQ ID NO: 86244

SEQ ID NO: 452965 - RNA, 64 nt, Homo Sapiens; identical to SEQ ID NO: 86245

SEQ ID NO: 452966 - RNA, 64 nt, Homo Sapiens; identical to SEQ ID NO: 86246

SEQ ID NO: 452967 - RNA, 64 nt, Homo Sapiens; identical to SEQ ID NO: 86247

SEQ ID NO: 452968 - RNA, 64 nt, Homo Sapiens; identical to SEQ ID NO: 86248

SEQ ID NO: 452969 - RNA, 64 nt, Homo Sapiens; identical to SEQ ID NO: 86249

SEQ ID NO: 452970 - RNA, 64 nt, Homo Sapiens; identical to SEQ ID NO: 86250

SEQ ID NO: 452971 - RNA, 64 nt, Homo Sapiens; identical to SEQ ID NO: 86251

SEQ ID NO: 452972 - RNA, 64 nt, Homo Sapiens; identical to SEQ ID NO: 86252

SEQ ID NO: 452973 - RNA, 64 nt, Homo Sapiens; identical to SEQ ID NO: 86253

SEQ ID NO: 452974 - RNA, 64 nt, Homo Sapiens; identical to SEQ ID NO: 86254

SEQ ID NO: 452975 - RNA, 64 nt, Homo Sapiens; identical to SEQ ID NO: 86255

SEQ ID NO: 452976 - RNA, 64 nt, Homo Sapiens; identical to SEQ ID NO: 86256

SEQ ID NO: 452977 - RNA, 55 nt, Homo Sapiens; identical to SEQ ID NO: 86257

SEQ ID NO: 452978 - RNA, 64 nt, Homo Sapiens; identical to SEQ ID NO: 86258

SEQ ID NO: 452979 - RNA, 64 nt, Homo Sapiens; identical to SEQ ID NO: 86259

SEQ ID NO: 452980 - RNA, 64 nt, Homo Sapiens; identical to SEQ ID NO: 86260

SEQ ID NO: 452981 - RNA, 64 nt, Homo Sapiens; identical to SEQ ID NO: 86261

SEQ ID NO: 452982 - RNA, 64 nt, Homo Sapiens; identical to SEQ ID NO: 86262

SEQ ID NO: 452983 - RNA, 64 nt, Homo Sapiens; identical to SEQ ID NO: 86263

SEQ ID NO: 452984 - RNA, 64 nt, Homo Sapiens; identical to SEQ ID NO: 86264

SEQ ID NO: 452985 - RNA, 64 nt, Homo Sapiens; identical to SEQ ID NO: 86265

SEQ ID NO: 452986 - RNA, 64 nt, Homo Sapiens; identical to SEQ ID NO: 86266

SEQ ID NO: 452987 - RNA, 64 nt, Homo Sapiens; identical to SEQ ID NO: 86267

SEQ ID NO: 452988 - RNA, 64 nt, Homo Sapiens; identical to SEQ ID NO: 86268

SEQ ID NO: 452989 - RNA, 64 nt, Homo Sapiens; identical to SEQ ID NO: 86269

SEQ ID NO: 452990 - RNA, 64 nt, Homo Sapiens; identical to SEQ ID NO: 86270

SEQ ID NO: 452991 - RNA, 64 nt, Homo Sapiens; identical to SEQ ID NO: 86271

SEQ ID NO: 452992 - RNA, 64 nt, Homo Sapiens; identical to SEQ ID NO: 86272

SEQ ID NO: 452993 - RNA, 64 nt, Homo Sapiens; identical to SEQ ID NO: 86273

SEQ ID NO: 452994 - RNA, 64 nt, Homo Sapiens; identical to SEQ ID NO: 86274

SEQ ID NO: 452995 - RNA, 64 nt, Homo Sapiens; identical to SEQ ID NO: 86275

SEQ ID NO: 452996 - RNA, 64 nt, Homo Sapiens; identical to SEQ ID NO: 86276

SEQ ID NO: 452997 - RNA, 64 nt, Homo Sapiens; identical to SEQ ID NO: 86277

SEQ ID NO: 452998 - RNA, 64 nt, Homo Sapiens; identical to SEQ ID NO: 86278

SEQ ID NO: 452999 - RNA, 64 nt, Homo Sapiens; identical to SEQ ID NO: 213150

SEQ ID NO: 453000 - RNA, 64 nt, Homo Sapiens; identical to SEQ ID NO: 213151

SEQ ID NO: 453001 - RNA, 64 nt, Homo Sapiens; identical to SEQ ID NO: 213152

SEQ ID NO: 453002 - RNA, 64 nt, Homo Sapiens; identical to SEQ ID NO: 213153

SEQ ID NO: 453003 - RNA, 64 nt, Homo Sapiens; identical to SEQ ID NO: 213154

SEQ ID NO: 453004 - RNA, 64 nt, Homo Sapiens; identical to SEQ ID NO: 213155

SEQ ID NO: 453005 - RNA, 64 nt, Homo Sapiens; identical to SEQ ID NO: 277303

SEQ ID NO: 453006 - RNA, 64 nt, Homo Sapiens; identical to SEQ ID NO: 277304

SEQ ID NO: 453007 - RNA, 64 nt, Homo Sapiens; identical to SEQ ID NO: 277305

SEQ ID NO: 453008 - RNA, 64 nt, Homo Sapiens; identical to SEQ ID NO: 277306

SEQ ID NO: 453009 - RNA, 64 nt, Homo Sapiens; identical to SEQ ID NO: 277307

SEQ ID NO: 453010 - RNA, 64 nt, Homo Sapiens; identical to SEQ ID NO: 277308

SEQ ID NO: 453011 - RNA, 64 nt, Homo Sapiens; identical to SEQ ID NO: 277309

SEQ ID NO: 453012 - RNA, 64 nt, Homo Sapiens; identical to SEQ ID NO: 277310

SEQ ID NO: 453013 - RNA, 64 nt, Homo Sapiens; identical to SEQ ID NO: 277311

SEQ ID NO: 453014 - RNA, 64 nt, Homo Sapiens; identical to SEQ ID NO: 277312

SEQ ID NO: 453015 - RNA, 64 nt, Homo Sapiens; identical to SEQ ID NO: 277313

SEQ ID NO: 453016 - RNA, 64 nt, Homo Sapiens; identical to SEQ ID NO: 277314

SEQ ID NO: 453017 - RNA, 64 nt, Homo Sapiens; identical to SEQ ID NO: 277315

SEQ ID NO: 453018 - RNA, 64 nt, Homo Sapiens; identical to SEQ ID NO: 277316

SEQ ID NO: 453019 - RNA, 64 nt, Homo Sapiens; identical to SEQ ID NO: 277317

SEQ ID NO: 453020 - RNA, 64 nt, Homo Sapiens; identical to SEQ ID NO: 277318

SEQ ID NO: 453021 - RNA, 64 nt, Homo Sapiens; identical to SEQ ID NO: 277319

SEQ ID NO: 453022 - RNA, 64 nt, Homo Sapiens; identical to SEQ ID NO: 277320

SEQ ID NO: 453023 - RNA, 64 nt, Homo Sapiens; identical to SEQ ID NO: 277321

SEQ ID NO: 453024 - RNA, 64 nt, Homo Sapiens; identical to SEQ ID NO: 277322

SEQ ID NO: 453025 - RNA, 62 nt, Homo Sapiens; identical to SEQ ID NO: 277323

SEQ ID NO: 453026 - RNA, 64 nt, Homo Sapiens; identical to SEQ ID NO: 277324

SEQ ID NO: 453027 - RNA, 64 nt, Homo Sapiens; identical to SEQ ID NO: 277325

SEQ ID NO: 453028 - RNA, 64 nt, Homo Sapiens; identical to SEQ ID NO: 277326

SEQ ID NO: 453029 - RNA, 64 nt, Homo Sapiens; identical to SEQ ID NO: 277327

SEQ ID NO: 453030 - RNA, 64 nt, Homo Sapiens; identical to SEQ ID NO: 277328

SEQ ID NO: 453031 - RNA, 64 nt, Homo Sapiens; identical to SEQ ID NO: 277329

SEQ ID NO: 453032 - RNA, 64 nt, Homo Sapiens; identical to SEQ ID NO: 277330

SEQ ID NO: 453033 - RNA, 64 nt, Homo Sapiens; identical to SEQ ID NO: 277331

SEQ ID NO: 453034 - RNA, 64 nt, Homo Sapiens; identical to SEQ ID NO: 277332

SEQ ID NO: 453035 - RNA, 64 nt, Homo Sapiens
aauuuuuuuucccuuucuuucaucuuugauuccuggaccuaauauauucauaauucuaucaagu

SEQ ID NO: 453036 - RNA, 64 nt, Homo Sapiens
agauugauuucauuucuaaccagaaccuuaggcuggaccuaaauugugucuacugauuggcuau

SEQ ID NO: 453037 - RNA, 64 nt, Homo Sapiens; identical to SEQ ID NO: 79755

SEQ ID NO: 453038 - RNA, 64 nt, Homo Sapiens; identical to SEQ ID NO: 79756

SEQ ID NO: 453039 - RNA, 64 nt, Homo Sapiens; identical to SEQ ID NO: 79757

SEQ ID NO: 453040 - RNA, 64 nt, Homo Sapiens; identical to SEQ ID NO: 79758

SEQ ID NO: 453041 - RNA, 64 nt, Homo Sapiens; identical to SEQ ID NO: 79759

SEQ ID NO: 453042 - RNA, 64 nt, Homo Sapiens; identical to SEQ ID NO: 79760

SEQ ID NO: 453043 - RNA, 64 nt, Homo Sapiens; identical to SEQ ID NO: 79761

SEQ ID NO: 453044 - RNA, 64 nt, Homo Sapiens; identical to SEQ ID NO: 79762

SEQ ID NO: 453045 - RNA, 64 nt, Homo Sapiens; identical to SEQ ID NO: 79763

SEQ ID NO: 453046 - RNA, 64 nt, Homo Sapiens; identical to SEQ ID NO: 79764

SEQ ID NO: 453047 - RNA, 64 nt, Homo Sapiens; identical to SEQ ID NO: 79765

SEQ ID NO: 453048 - RNA, 64 nt, Homo Sapiens; identical to SEQ ID NO: 79766

SEQ ID NO: 453049 - RNA, 64 nt, Homo Sapiens; identical to SEQ ID NO: 79767

SEQ ID NO: 453050 - RNA, 64 nt, Homo Sapiens; identical to SEQ ID NO: 79768

SEQ ID NO: 453051 - RNA, 64 nt, Homo Sapiens; identical to SEQ ID NO: 79769

SEQ ID NO: 453052 - RNA, 64 nt, Homo Sapiens; identical to SEQ ID NO: 79770

SEQ ID NO: 453053 - RNA, 64 nt, Homo Sapiens; identical to SEQ ID NO: 79771

SEQ ID NO: 453054 - RNA, 64 nt, Homo Sapiens; identical to SEQ ID NO: 79772

SEQ ID NO: 453055 - RNA, 64 nt, Homo Sapiens; identical to SEQ ID NO: 79773

SEQ ID NO: 453056 - RNA, 64 nt, Homo Sapiens; identical to SEQ ID NO: 79774

SEQ ID NO: 453057 - RNA, 64 nt, Homo Sapiens; identical to SEQ ID NO: 79775

SEQ ID NO: 453058 - RNA, 64 nt, Homo Sapiens; identical to SEQ ID NO: 79776

SEQ ID NO: 453059 - RNA, 64 nt, Homo Sapiens; identical to SEQ ID NO: 79777

SEQ ID NO: 453060 - RNA, 64 nt, Homo Sapiens; identical to SEQ ID NO: 79778

SEQ ID NO: 453061 - RNA, 64 nt, Homo Sapiens; identical to SEQ ID NO: 79779

SEQ ID NO: 453062 - RNA, 64 nt, Homo Sapiens; identical to SEQ ID NO: 79780

SEQ ID NO: 453063 - RNA, 64 nt, Homo Sapiens; identical to SEQ ID NO: 79781

SEQ ID NO: 453064 - RNA, 64 nt, Homo Sapiens; identical to SEQ ID NO: 79782

SEQ ID NO: 453065 - RNA, 64 nt, Homo Sapiens; identical to SEQ ID NO: 79783

SEQ ID NO: 453066 - RNA, 64 nt, Homo Sapiens; identical to SEQ ID NO: 79784

SEQ ID NO: 453067 - RNA, 64 nt, Homo Sapiens; identical to SEQ ID NO: 79785

SEQ ID NO: 453068 - RNA, 64 nt, Homo Sapiens; identical to SEQ ID NO: 79786

SEQ ID NO: 453069 - RNA, 64 nt, Homo Sapiens; identical to SEQ ID NO: 79787

SEQ ID NO: 453070 - RNA, 64 nt, Homo Sapiens; identical to SEQ ID NO: 79788

SEQ ID NO: 453071 - RNA, 64 nt, Homo Sapiens; identical to SEQ ID NO: 79789

SEQ ID NO: 453072 - RNA, 64 nt, Homo Sapiens; identical to SEQ ID NO: 79790

SEQ ID NO: 453073 - RNA, 64 nt, Homo Sapiens; identical to SEQ ID NO: 79791

SEQ ID NO: 453074 - RNA, 64 nt, Homo Sapiens; identical to SEQ ID NO: 79792

SEQ ID NO: 453075 - RNA, 64 nt, Homo Sapiens; identical to SEQ ID NO: 79793

SEQ ID NO: 453076 - RNA, 64 nt, Homo Sapiens; identical to SEQ ID NO: 79794

SEQ ID NO: 453077 - RNA, 64 nt, Homo Sapiens; identical to SEQ ID NO: 79795

SEQ ID NO: 453078 - RNA, 64 nt, Homo Sapiens; identical to SEQ ID NO: 79796

SEQ ID NO: 453079 - RNA, 64 nt, Homo Sapiens; identical to SEQ ID NO: 79797

SEQ ID NO: 453080 - RNA, 64 nt, Homo Sapiens; identical to SEQ ID NO: 79798

SEQ ID NO: 453081 - RNA, 64 nt, Homo Sapiens; identical to SEQ ID NO: 79799

SEQ ID NO: 453082 - RNA, 64 nt, Homo Sapiens; identical to SEQ ID NO: 79800

SEQ ID NO: 453083 - RNA, 64 nt, Homo Sapiens; identical to SEQ ID NO: 79801

SEQ ID NO: 453084 - RNA, 64 nt, Homo Sapiens; identical to SEQ ID NO: 79802

SEQ ID NO: 453085 - RNA, 64 nt, Homo Sapiens; identical to SEQ ID NO: 79803

SEQ ID NO: 453086 - RNA, 64 nt, Homo Sapiens; identical to SEQ ID NO: 227775

SEQ ID NO: 453087 - RNA, 64 nt, Homo Sapiens; identical to SEQ ID NO: 227776

SEQ ID NO: 453088 - RNA, 64 nt, Homo Sapiens; identical to SEQ ID NO: 227777

SEQ ID NO: 453089 - RNA, 64 nt, Homo Sapiens; identical to SEQ ID NO: 227778

SEQ ID NO: 453090 - RNA, 64 nt, Homo Sapiens; identical to SEQ ID NO: 227779

SEQ ID NO: 453091 - RNA, 64 nt, Homo Sapiens; identical to SEQ ID NO: 227780

SEQ ID NO: 453092 - RNA, 64 nt, Homo Sapiens; identical to SEQ ID NO: 227781

SEQ ID NO: 453093 - RNA, 64 nt, Homo Sapiens; identical to SEQ ID NO: 227782

SEQ ID NO: 453094 - RNA, 64 nt, Homo Sapiens; identical to SEQ ID NO: 227783

SEQ ID NO: 453095 - RNA, 64 nt, Homo Sapiens; identical to SEQ ID NO: 227784

SEQ ID NO: 453096 - RNA, 64 nt, Homo Sapiens; identical to SEQ ID NO: 227785

SEQ ID NO: 453097 - RNA, 64 nt, Homo Sapiens
uagcacucagagaaugaagcagcaaugaagauugagacaauaaauuuguuguuuccugacuuua

SEQ ID NO: 453098 - RNA, 64 nt, Homo Sapiens
cuggugacacaugucuagacuuccucugccacaaagacaauacuaauuuaguguuugacauugc

SEQ ID NO: 453099 - RNA, 64 nt, Homo Sapiens
ugugcaugugugugucugucuuugugggaggguaagacaauaugaacaaacuaugaucacagug

SEQ ID NO: 453100 - RNA, 64 nt, Homo Sapiens
cuuggcuguaaucaguuaugccguauaggaugucagacaauaccacugguuaaaauaaagccua

SEQ ID NO: 453101 - RNA, 64 nt, Homo Sapiens
uugugagucaacuuuagaaccaaaguguuucugaagacaauaaagaaauuuguugauuuuguac

SEQ ID NO: 453102 - RNA, 64 nt, Homo Sapiens
auuguaauauaauaaauuugugauggaaagaaaaagacaauaaaaucuaguuaaucauaauauu

SEQ ID NO: 453103 - RNA, 64 nt, Homo Sapiens
ugaugaauauaagaaagggccaauaaucugaauaagacaauaugaguuuugcuaaggcacaaga

SEQ ID NO: 453104 - RNA, 64 nt, Homo Sapiens
cugaauaagacaauaugugauuugcuaaggcacaagacaauaauauaaaugcuucccauggagu

SEQ ID NO: 453105 - RNA, 64 nt, Homo Sapiens
ugcacaaaagauauaaacaggccaaccuuagaaaagacaauaaaauugcaaaauaaagaaaaau

SEQ ID NO: 453106 - RNA, 64 nt, Homo Sapiens
guuauuaacauagaugaagguguauacccaucaaagacaauacaaauuccaaaucuaucugagu

SEQ ID NO: 453107 - RNA, 64 nt, Homo Sapiens
auuucccaaacaauacaaaaagcaaauuacacacccucaccacuguucuuaucucuauagugau

SEQ ID NO: 453108 - RNA, 64 nt, Homo Sapiens
cucagggcugcaaaugucaagacauaacccuguuccucaccaucaugauaccagauacagguga

SEQ ID NO: 453109 - RNA, 64 nt, Homo Sapiens
ccccauccuauucuugguaaacuacaccacuuuuccucaccaacucguugaaguccucaccagu

SEQ ID NO: 453110 - RNA, 64 nt, Homo Sapiens
acuacaccacuuuuccucacgccgucguugaaguccucaccaguuuccuacagagucuaggcug

SEQ ID NO: 453111 - RNA, 64 nt, Homo Sapiens
cuagccauugcugcagugugcaguaccuccagagccucaccagaucaaggugccaggccugccc

SEQ ID NO: 453112 - RNA, 64 nt, Homo Sapiens
acucucucuccauuaucgaacgacugacuguaaaccucaccacacaggguggugcccuggcccc

SEQ ID NO: 453113 - RNA, 64 nt, Homo Sapiens
uuagcaucucugcuccccagaaaauuguaagcauccucaccagccuguggauacauucuuuauu

SEQ ID NO: 453114 - RNA, 64 nt, Homo Sapiens
uagccauagucucaaaccuggcugagccugccuuccucaccaccugucuccccaaggcuggggu

SEQ ID NO: 453115 - RNA, 64 nt, Homo Sapiens
cggcccggaaacagcgggaauagaagcuggagugccucaccacauuacgaucagcgugacagag

SEQ ID NO: 453116 - RNA, 64 nt, Homo Sapiens
acacacaacacaccucaccucacaccacagcacaccucaccacaccacaccgcacugcaccaua

SEQ ID NO: 453117 - RNA, 64 nt, Homo Sapiens
cacaccucaccacaccacaccgcacugcaccauaccucaccacaucucaccacaccacagcaca

SEQ ID NO: 453118 - RNA, 64 nt, Homo Sapiens
cauaccucaccacaucucaccacaccacagcacaccucaccacacaacacaccacaccccacac

SEQ ID NO: 453119 - RNA, 64 nt, Homo Sapiens
auccaaagugguugucugagacagaguuggaaacccucaccaacuggccucuucaccuuccaca

SEQ ID NO: 453120 - RNA, 64 nt, Homo Sapiens
cucagggaccagagggcuagguuggcacugcggcccucaccagguccugggcucggacccaacu

SEQ ID NO: 453121 - RNA, 64 nt, Homo Sapiens
accucccugacaccugggcugagucacuggggucccucaccagcguucauugcugucaccuccu

SEQ ID NO: 453122 - RNA, 64 nt, Homo Sapiens
cucuugcguuuuggcccccagacagugacgggacccucaccaucgcauccaucucaguguggag

SEQ ID NO: 453123 - RNA, 64 nt, Homo Sapiens
cucccuuucagggccagggcagguucccaggaggccucaccauacccugaccauugcccuagcc

SEQ ID NO: 453124 - RNA, 64 nt, Homo Sapiens
cuuggagucuguucuagggacacccccuguuggcccucaccagcccagaaucauguggccagcc

SEQ ID NO: 453125 - RNA, 64 nt, Homo Sapiens
agcccacccugcccgugggcggacgcagcuccacccucaccacuugucuccuucugggggucag

SEQ ID NO: 453126 - RNA, 64 nt, Homo Sapiens
gagaagauggaccggcucuuggcagcuuaggagaccucaccaaaguggcgggcagaugguggaa

SEQ ID NO: 453127 - RNA, 64 nt, Homo Sapiens
aagcaacaacgacaaaaaaaauuagccaagcauaguggcacaccccuguagucccagcuacuug

SEQ ID NO: 453128 - RNA, 64 nt, Homo Sapiens
accccagcucuacaaaaaaaauuagccuggugugguggcacaugccuguaguuccagcuacuca

SEQ ID NO: 453129 - RNA, 64 nt, Homo Sapiens
auacaaaaaaaaaaaaaaaaaaaagccaggcaugguggcacacaccuguaaucccagcuacucg

SEQ ID NO: 453130 - RNA, 64 nt, Homo Sapiens
aaauacaaaaaaaaaaaaaaauuagcugggcaugguggcacacaccuguagucccagcuacuug

SEQ ID NO: 453131 - RNA, 64 nt, Homo Sapiens
ucucuaucagaaauacaaaauuuagccgagugugguggcacaugccuguggccccagccacucu

SEQ ID NO: 453132 - RNA, 64 nt, Homo Sapiens
agggucgugcucuugucucccagacuggacugcaguggcacaaucauagcucacugcagcuuug

SEQ ID NO: 453133 - RNA, 64 nt, Homo Sapiens
aucccucugggggguggggacugcacacagggugguggcacauuccuccauuccugcucuccca

SEQ ID NO: 453134 - RNA, 64 nt, Homo Sapiens
uguccugacagacgaggagugaauccgagauaggguggcacaucaacccccagccacccucccg

SEQ ID NO: 453135 - RNA, 64 nt, Homo Sapiens
cucggcccgcugcagccucugcugcuggagugcaguggcacaauagucuuacucugucucccag

SEQ ID NO: 453136 - RNA, 64 nt, Homo Sapiens
cauggcucacugcagccuugcaggcuggagugcaguggcacaaucagagucuugcucugucucc

SEQ ID NO: 453137 - RNA, 64 nt, Homo Sapiens
gucucuacuaaaaauacaaaauuggcagggugugguggcacaugccuauaaucccagcuacuug

SEQ ID NO: 453138 - RNA, 64 nt, Homo Sapiens
ucucuacaaaaaauacaaaaauuagccagacaugguggcacaugccuuuagucccagcuacucu

SEQ ID NO: 453139 - RNA, 64 nt, Homo Sapiens
cugaggcccugagagggaaaggagcgcuggauucguggcacaguggcuggggcaggaggcuccu

SEQ ID NO: 453140 - RNA, 64 nt, Homo Sapiens
ccuguccucccagcacuuuggcuggcuggccaugguggcacacaagcugccauaggaagagggu

SEQ ID NO: 453141 - RNA, 64 nt, Homo Sapiens
agaaagcaaaugugaccugugucacuacgugacuguggcacacgccuuguucuuggccaaagac

SEQ ID NO: 453142 - RNA, 64 nt, Homo Sapiens
cccaucucuacuaaaaauacaaaauccaggcgugguggcacacaccuguagucccagcuacuca

SEQ ID NO: 453143 - RNA, 64 nt, Homo Sapiens
guaaguggcagugucucuuaucuguccauuuuagguggcacaaugacuguucuguucugucuuc

SEQ ID NO: 453144 - RNA, 64 nt, Homo Sapiens
caugucaaaauuuaccagaauaguggcugccaguguggcacauuugaucccagccccuguuggu

SEQ ID NO: 453145 - RNA, 64 nt, Homo Sapiens
ucucuacuaaaaauacaaaaauuagccgggugugguggcacaugccuguaaucccagcuacucg

SEQ ID NO: 453146 - RNA, 64 nt, Homo Sapiens
ucuguacacaaaauuuaaaaauuaguucaucgggguggcacacaucaguagucccagcuacucu

SEQ ID NO: 453147 - RNA, 64 nt, Homo Sapiens
gucucuacuaaaaacagaaaauuauccgggcgugguggcacaugacuguaaucccagcuacuca

SEQ ID NO: 453148 - RNA, 64 nt, Homo Sapiens
aaaauaguaauaauacaaaaauuagcugggcgugguggcacaugccaguaauuccaucuacucg

SEQ ID NO: 453149 - RNA, 64 nt, Homo Sapiens; identical to SEQ ID NO: 218381

SEQ ID NO: 453150 - RNA, 64 nt, Homo Sapiens; identical to SEQ ID NO: 218382

SEQ ID NO: 453151 - RNA, 64 nt, Homo Sapiens; identical to SEQ ID NO: 218383

SEQ ID NO: 453152 - RNA, 64 nt, Homo Sapiens; identical to SEQ ID NO: 218384

SEQ ID NO: 453153 - RNA, 64 nt, Homo Sapiens; identical to SEQ ID NO: 218385

SEQ ID NO: 453154 - RNA, 64 nt, Homo Sapiens; identical to SEQ ID NO: 218386

SEQ ID NO: 453155 - RNA, 64 nt, Homo Sapiens; identical to SEQ ID NO: 218387

SEQ ID NO: 453156 - RNA, 64 nt, Homo Sapiens; identical to SEQ ID NO: 218388

SEQ ID NO: 453157 - RNA, 64 nt, Homo Sapiens; identical to SEQ ID NO: 218389

SEQ ID NO: 453158 - RNA, 64 nt, Homo Sapiens; identical to SEQ ID NO: 218390

SEQ ID NO: 453159 - RNA, 64 nt, Homo Sapiens; identical to SEQ ID NO: 218391

SEQ ID NO: 453160 - RNA, 64 nt, Homo Sapiens; identical to SEQ ID NO: 218392

SEQ ID NO: 453161 - RNA, 64 nt, Homo Sapiens; identical to SEQ ID NO: 218393

SEQ ID NO: 453162 - RNA, 64 nt, Homo Sapiens; identical to SEQ ID NO: 218394

SEQ ID NO: 453163 - RNA, 64 nt, Homo Sapiens; identical to SEQ ID NO: 218395

SEQ ID NO: 453164 - RNA, 64 nt, Homo Sapiens; identical to SEQ ID NO: 218396

SEQ ID NO: 453165 - RNA, 64 nt, Homo Sapiens; identical to SEQ ID NO: 218397

SEQ ID NO: 453166 - RNA, 64 nt, Homo Sapiens; identical to SEQ ID NO: 218398

SEQ ID NO: 453167 - RNA, 64 nt, Homo Sapiens; identical to SEQ ID NO: 218399

SEQ ID NO: 453168 - RNA, 64 nt, Homo Sapiens; identical to SEQ ID NO: 218400

SEQ ID NO: 453169 - RNA, 64 nt, Homo Sapiens; identical to SEQ ID NO: 218401

SEQ ID NO: 453170 - RNA, 64 nt, Homo Sapiens; identical to SEQ ID NO: 218402

SEQ ID NO: 453171 - RNA, 64 nt, Homo Sapiens; identical to SEQ ID NO: 218403

SEQ ID NO: 453172 - RNA, 64 nt, Homo Sapiens; identical to SEQ ID NO: 218404

SEQ ID NO: 453173 - RNA, 64 nt, Homo Sapiens; identical to SEQ ID NO: 218405

SEQ ID NO: 453174 - RNA, 64 nt, Homo Sapiens; identical to SEQ ID NO: 218406

SEQ ID NO: 453175 - RNA, 64 nt, Homo Sapiens; identical to SEQ ID NO: 218407

SEQ ID NO: 453176 - RNA, 64 nt, Homo Sapiens; identical to SEQ ID NO: 218408

SEQ ID NO: 453177 - RNA, 64 nt, Homo Sapiens; identical to SEQ ID NO: 218409

SEQ ID NO: 453178 - RNA, 64 nt, Homo Sapiens; identical to SEQ ID NO: 218410

SEQ ID NO: 453179 - RNA, 64 nt, Homo Sapiens; identical to SEQ ID NO: 218411

SEQ ID NO: 453180 - RNA, 64 nt, Homo Sapiens; identical to SEQ ID NO: 218412

SEQ ID NO: 453181 - RNA, 64 nt, Homo Sapiens; identical to SEQ ID NO: 218413

SEQ ID NO: 453182 - RNA, 64 nt, Homo Sapiens; identical to SEQ ID NO: 218414

SEQ ID NO: 453183 - RNA, 64 nt, Homo Sapiens; identical to SEQ ID NO: 218415

SEQ ID NO: 453184 - RNA, 64 nt, Homo Sapiens; identical to SEQ ID NO: 218416

SEQ ID NO: 453185 - RNA, 64 nt, Homo Sapiens
aacagaaaugcaugaguaugugcaccaacaggcaugacaaaaauauuuauaguagugguguuca

SEQ ID NO: 453186 - RNA, 64 nt, Homo Sapiens
gauugggacaccuuuuuuucccccugaggaucacugacaaaaaacacugcaccaguaaggaagc

SEQ ID NO: 453187 - RNA, 64 nt, Homo Sapiens
aucaguuguuauuguuaucccuugaaagcgagggugacaaaaacaacaaaacaccguuauaaac

SEQ ID NO: 453188 - RNA, 64 nt, Homo Sapiens
guauaucuuaauucuggguugcuuguuuuuuaggugacaaaaauaaaauauuguauuuuaauuc

SEQ ID NO: 453189 - RNA, 64 nt, Homo Sapiens
aaauaaaaagccuaaauguuauuguuauuuauugugacaaaaggucugcaaagauauguuuuau

SEQ ID NO: 453190 - RNA, 64 nt, Homo Sapiens
uuagucuucaauagacugaaaccugccaugaacaugacaaaaggauaaaaaacuagugucaugu

SEQ ID NO: 453191 - RNA, 64 nt, Homo Sapiens
aguaauuguguuuacauuuuauggugccuaguauugacaaaauguuauuucccuacauuaaaca

SEQ ID NO: 453192 - RNA, 64 nt, Homo Sapiens
auugcaaagucaggaaucaucaggaacguuuagcugacaaaauacuugucuguuuuaaaaaccu

SEQ ID NO: 453193 - RNA, 64 nt, Homo Sapiens
gguauuaaaauacagaggaguauggucaaaucuuugacaaaauuuucaugaucuucucuaacaa

SEQ ID NO: 453194 - RNA, 64 nt, Homo Sapiens
ucgugagaaccugugggcaguauucaagcccugaugacaaaacccaguguuuuuuguuguuguu

SEQ ID NO: 453195 - RNA, 64 nt, Homo Sapiens
gauguuuacaggccugcuuuucuguuucagccuaugacaaaauuaguaaaauccauuuccuuuc

SEQ ID NO: 453196 - RNA, 64 nt, Homo Sapiens
ugccagaguuggggcauugaacccacucugaacaugacaaaaguuuccucuuuuccccgccugc

SEQ ID NO: 453197 - RNA, 64 nt, Homo Sapiens
ggcuggagucuucuagucccaagggauugggagaugacaaaaugaauuuuuuuuuucuuuuuug

SEQ ID NO: 453198 - RNA, 64 nt, Homo Sapiens
gcugggauuacaggcaugaaccacugugcccagcugacaaaaugaguucuuaaacuuuuuuuuu

SEQ ID NO: 453199 - RNA, 64 nt, Homo Sapiens
aguucuuaaacuuuuuuuuuccacugugcccagcugacaaaauggcugggauuacaggcaugaa

SEQ ID NO: 453200 - RNA, 64 nt, Homo Sapiens
aauuuuuuuuucuuuuuugaaagggauugggagaugacaaaaugggcuggagucuucuaguccc

SEQ ID NO: 453201 - RNA, 64 nt, Homo Sapiens
augagaaguuauuauucauacuguguugcucauuugacaaaauaagguaaggauuucauaauca

SEQ ID NO: 453202 - RNA, 64 nt, Homo Sapiens
cagaaagucgugguucaggcaguaugggccgcugugacaaaacaccuaagacuggguaguuuau

SEQ ID NO: 453203 - RNA, 64 nt, Homo Sapiens
auucauguauagccaauugacugcuguaagagaaugacaaaaaucucuuggugcuauuucauuc

SEQ ID NO: 453204 - RNA, 64 nt, Homo Sapiens
ugaagaaauauuaaacaaaaugggcuucagcaauugacaaaauuugugccacagaagcucagcc

SEQ ID NO: 453205 - RNA, 64 nt, Homo Sapiens
cacaccuaaagaaauuuuaauaaaaacugcuacaugacaaaaaccuuuuauauauagaucuaca

SEQ ID NO: 453206 - RNA, 64 nt, Homo Sapiens
gugacagguagcugggaccucaaaacuaugagagugacaaaauguucucaaacaauggaugaca

SEQ ID NO: 453207 - RNA, 64 nt, Homo Sapiens
cugacacaagagcaaauaagaauguauuugccuuugacaaaagauugguuuuaucuaaaaagua

SEQ ID NO: 453208 - RNA, 64 nt, Homo Sapiens
ucaagaagauaggagaagagauguucuugugaugugacaaaaugcgaaagcuacucucuuaguu

SEQ ID NO: 453209 - RNA, 64 nt, Homo Sapiens
uagggguuaccuagauaaugauuagagucaccuaugacaaaaaauuugcaacaauaggucuauu

SEQ ID NO: 453210 - RNA, 64 nt, Homo Sapiens
aaaguaaucuuacaacuauggguauaguuuuuauugacaaaagcuuuagaguuuuaugaaagau

SEQ ID NO: 453211 - RNA, 64 nt, Homo Sapiens
aaaaaugaugaugauauuauguagugucuccaucugacaaaacuacauggaagauggagaagcu

SEQ ID NO: 453212 - RNA, 64 nt, Homo Sapiens
cacaggauuauuucaagcuagucauugagguauaugacaaaauguaaauaacaaaaaacugaaa

SEQ ID NO: 453213 - RNA, 64 nt, Homo Sapiens
ucagaauucccaggcugaaaucagccauagcaguugacaaaacagcuauccccacaagugauga

SEQ ID NO: 453214 - RNA, 64 nt, Homo Sapiens
uaucaccaaaacccccuuucucuguuuaaaaaaaugacaaaagugauauaccggauuaaauuua

SEQ ID NO: 453215 - RNA, 64 nt, Homo Sapiens
ggcuucaucacaaauuuuuuacuaugucuguaguugacaaaagugugccuuguuuuuuauuuaa

SEQ ID NO: 453216 - RNA, 64 nt, Homo Sapiens
aaggaacauaccucaaaauaauaagagccaucuaugacaaaaccacagccaacaucauacugaa

SEQ ID NO: 453217 - RNA, 64 nt, Homo Sapiens
uacacaccuacaaccaucuaaucuuugacaaaguugacaaaaauacgcaauggggaaagaauuc

SEQ ID NO: 453218 - RNA, 64 nt, Homo Sapiens
uuaaccuaaccuucauccgaugccaauggacccaugacaaaaguggaggcacuugugacuagcc

SEQ ID NO: 453219 - RNA, 64 nt, Homo Sapiens
uggguaagcugaaacuaauacuucugcguguuagugacaaaaagcaguaagaaggccacagucu

SEQ ID NO: 453220 - RNA, 64 nt, Homo Sapiens
auaaaccagucucuuggagggcacaacccuuauuugacaaaacuuggauguuggcuugacugug

SEQ ID NO: 453221 - RNA, 64 nt, Homo Sapiens
uccaaaacaaaaauaaagaccuguccaaaaguuuugacaaaaauacugauugcucccaaauaaa

SEQ ID NO: 453222 - RNA, 64 nt, Homo Sapiens
aggggcauucacaaggcacaccagugcaagcagaugacaaaaaggugcagaaggcaaucuuaaa

SEQ ID NO: 453223 - RNA, 64 nt, Homo Sapiens
ucggcucucauucgaucgagcuauucucuuaaaaugacaaaaaguguccauaaagaggcugcug

SEQ ID NO: 453224 - RNA, 64 nt, Homo Sapiens
guuggcucaguaaugcucacgauaccaauuguuuugacaaaauaaauuuacuaaacuuggccua

SEQ ID NO: 453225 - RNA, 64 nt, Homo Sapiens
uuuaaaaacaaaucuuuucaauggcauaagaaguugacaaaaauuucuuaaagugcaauagauu

SEQ ID NO: 453226 - RNA, 64 nt, Homo Sapiens
cagacccggcauuggcaauguagcuguaauuuucugacaaaauuuaagacaaaauugucaacuu

SEQ ID NO: 453227 - RNA, 64 nt, Homo Sapiens
uacucuguucacuccacugaacaacugauuucauacaacugaguggccacugacauugaaugca

SEQ ID NO: 453228 - RNA, 64 nt, Homo Sapiens
ucauacaacugaguuacucuugacauugaaugcaacaacugauuccccaaguuuuuugggccac

SEQ ID NO: 453229 - RNA, 64 nt, Homo Sapiens
agugucuucucagaaacaaccagccuugaaggcuacaacugacgaggaagacucuguuucgaau

SEQ ID NO: 453230 - RNA, 64 nt, Homo Sapiens
agugucuucucagaaacaaccagccuugaaggcuacaacugaugagaaagauucuguuucgaac

SEQ ID NO: 453231 - RNA, 64 nt, Homo Sapiens
guuuuuaauuugcugacuuaucugucuagaggauacaacugaauuacauguagugguguggugu

SEQ ID NO: 453232 - RNA, 64 nt, Homo Sapiens
gcagcugucauauuucuggcaagacacucacuguacaacugaaagggagucgguuucucucuua

SEQ ID NO: 453233 - RNA, 64 nt, Homo Sapiens
gcaaaacaaaacgaaaaaagauuucucaguauacacaacugaaugaugauacuuacaauuuuua

SEQ ID NO: 453234 - RNA, 64 nt, Homo Sapiens
agugaguuuaaaaaaaaucuauaguuuccaauaaacaacugaaaaauuaucaugagauguguau

SEQ ID NO: 453235 - RNA, 64 nt, Homo Sapiens
agaagaaaauugaaaugagaaacuugcaaaagagacaacugauaccacaccuuaauuaucauuc

SEQ ID NO: 453236 - RNA, 64 nt, Homo Sapiens
uuucuagaaaauuuccacuuuguaaauaagauuuacaacugaugaauugcaaaagaaaugucgc

SEQ ID NO: 453237 - RNA, 64 nt, Homo Sapiens
ucuuagcuauuaaagaaguacacaaggucaauucacaacugauagguaauccuccuaaugaacc

SEQ ID NO: 453238 - RNA, 64 nt, Homo Sapiens
cgaagcaggccugaagccuaacagcaugccagacacaacugaauggcaggcuuaggucucacug

SEQ ID NO: 453239 - RNA, 64 nt, Homo Sapiens
uuuuuugcuaugacagaguaaugcuaacguaaggacaacugaguuugaucaguguuuaaucgca

SEQ ID NO: 453240 - RNA, 64 nt, Homo Sapiens
aagaaguuuugggcucacugcuaaaauagaguauacaacugaauguuuuuaagucaagauacug

SEQ ID NO: 453241 - RNA, 64 nt, Homo Sapiens
gacuccugauugcucuggaagccugcugauuucuacaacugaucauuugcagcugcugguuuug

SEQ ID NO: 453242 - RNA, 64 nt, Homo Sapiens
ccccuugcacuggucaucaguauuguguaaaggaacaacugauauacuugagugugcaagcaaa

SEQ ID NO: 453243 - RNA, 64 nt, Homo Sapiens
acauugguuuucugcagcuauauauuaaccuguuacaacugacauuuuuguguggcauaaauaa

SEQ ID NO: 453244 - RNA, 64 nt, Homo Sapiens
gcuuuacaguguucaugcuaaaaucguggccuuaacaacugaaaguucaaagaugagagcugaa

SEQ ID NO: 453245 - RNA, 64 nt, Homo Sapiens; identical to SEQ ID NO: 53765

SEQ ID NO: 453246 - RNA, 64 nt, Homo Sapiens; identical to SEQ ID NO: 53766

SEQ ID NO: 453247 - RNA, 64 nt, Homo Sapiens; identical to SEQ ID NO: 53767

SEQ ID NO: 453248 - RNA, 64 nt, Homo Sapiens; identical to SEQ ID NO: 53768

SEQ ID NO: 453249 - RNA, 64 nt, Homo Sapiens; identical to SEQ ID NO: 234645

SEQ ID NO: 453250 - RNA, 64 nt, Homo Sapiens; identical to SEQ ID NO: 234646

SEQ ID NO: 453251 - RNA, 64 nt, Homo Sapiens; identical to SEQ ID NO: 234647

SEQ ID NO: 453252 - RNA, 64 nt, Homo Sapiens; identical to SEQ ID NO: 234648

SEQ ID NO: 453253 - RNA, 64 nt, Homo Sapiens; identical to SEQ ID NO: 234649

SEQ ID NO: 453254 - RNA, 64 nt, Homo Sapiens; identical to SEQ ID NO: 234650

SEQ ID NO: 453255 - RNA, 64 nt, Homo Sapiens; identical to SEQ ID NO: 234651

SEQ ID NO: 453256 - RNA, 64 nt, Homo Sapiens; identical to SEQ ID NO: 234652

SEQ ID NO: 453257 - RNA, 64 nt, Homo Sapiens; identical to SEQ ID NO: 234653

SEQ ID NO: 453258 - RNA, 64 nt, Homo Sapiens; identical to SEQ ID NO: 234654

SEQ ID NO: 453259 - RNA, 64 nt, Homo Sapiens; identical to SEQ ID NO: 234655

SEQ ID NO: 453260 - RNA, 64 nt, Homo Sapiens; identical to SEQ ID NO: 234656

SEQ ID NO: 453261 - RNA, 64 nt, Homo Sapiens; identical to SEQ ID NO: 234657

SEQ ID NO: 453262 - RNA, 64 nt, Homo Sapiens; identical to SEQ ID NO: 234658

SEQ ID NO: 453263 - RNA, 64 nt, Homo Sapiens; identical to SEQ ID NO: 234659

SEQ ID NO: 453264 - RNA, 64 nt, Homo Sapiens; identical to SEQ ID NO: 234660

SEQ ID NO: 453265 - RNA, 64 nt, Homo Sapiens; identical to SEQ ID NO: 234661

SEQ ID NO: 453266 - RNA, 64 nt, Homo Sapiens; identical to SEQ ID NO: 234662

SEQ ID NO: 453267 - RNA, 64 nt, Homo Sapiens; identical to SEQ ID NO: 234663

SEQ ID NO: 453268 - RNA, 64 nt, Homo Sapiens; identical to SEQ ID NO: 234664

SEQ ID NO: 453269 - RNA, 64 nt, Homo Sapiens; identical to SEQ ID NO: 234665

SEQ ID NO: 453270 - RNA, 63 nt, Homo Sapiens; identical to SEQ ID NO: 234666

SEQ ID NO: 453271 - RNA, 64 nt, Homo Sapiens; identical to SEQ ID NO: 234667

SEQ ID NO: 453272 - RNA, 64 nt, Homo Sapiens; identical to SEQ ID NO: 234668

SEQ ID NO: 453273 - RNA, 64 nt, Homo Sapiens; identical to SEQ ID NO: 234669

SEQ ID NO: 453274 - RNA, 64 nt, Homo Sapiens; identical to SEQ ID NO: 234670

SEQ ID NO: 453275 - RNA, 64 nt, Homo Sapiens; identical to SEQ ID NO: 234671

SEQ ID NO: 453276 - RNA, 64 nt, Homo Sapiens; identical to SEQ ID NO: 234672

SEQ ID NO: 453277 - RNA, 64 nt, Homo Sapiens; identical to SEQ ID NO: 234673

SEQ ID NO: 453278 - RNA, 64 nt, Homo Sapiens; identical to SEQ ID NO: 234674

SEQ ID NO: 453279 - RNA, 64 nt, Homo Sapiens; identical to SEQ ID NO: 234675

SEQ ID NO: 453280 - RNA, 64 nt, Homo Sapiens; identical to SEQ ID NO: 234676

SEQ ID NO: 453281 - RNA, 64 nt, Homo Sapiens; identical to SEQ ID NO: 234677

SEQ ID NO: 453282 - RNA, 64 nt, Homo Sapiens; identical to SEQ ID NO: 234678

SEQ ID NO: 453283 - RNA, 64 nt, Homo Sapiens; identical to SEQ ID NO: 234679

SEQ ID NO: 453284 - RNA, 64 nt, Homo Sapiens; identical to SEQ ID NO: 234680

SEQ ID NO: 453285 - RNA, 64 nt, Homo Sapiens; identical to SEQ ID NO: 234681

SEQ ID NO: 453286 - RNA, 64 nt, Homo Sapiens; identical to SEQ ID NO: 234682

SEQ ID NO: 453287 - RNA, 64 nt, Homo Sapiens; identical to SEQ ID NO: 234683

SEQ ID NO: 453288 - RNA, 64 nt, Homo Sapiens; identical to SEQ ID NO: 234684

SEQ ID NO: 453289 - RNA, 64 nt, Homo Sapiens; identical to SEQ ID NO: 234685

SEQ ID NO: 453290 - RNA, 64 nt, Homo Sapiens; identical to SEQ ID NO: 234686

SEQ ID NO: 453291 - RNA, 64 nt, Homo Sapiens; identical to SEQ ID NO: 234687

SEQ ID NO: 453292 - RNA, 64 nt, Homo Sapiens; identical to SEQ ID NO: 234688

SEQ ID NO: 453293 - RNA, 64 nt, Homo Sapiens; identical to SEQ ID NO: 234689

SEQ ID NO: 453294 - RNA, 64 nt, Homo Sapiens; identical to SEQ ID NO: 234690

SEQ ID NO: 453295 - RNA, 64 nt, Homo Sapiens; identical to SEQ ID NO: 234691

SEQ ID NO: 453296 - RNA, 64 nt, Homo Sapiens; identical to SEQ ID NO: 234692

SEQ ID NO: 453297 - RNA, 64 nt, Homo Sapiens; identical to SEQ ID NO: 234693

SEQ ID NO: 453298 - RNA, 64 nt, Homo Sapiens; identical to SEQ ID NO: 234694

SEQ ID NO: 453299 - RNA, 64 nt, Homo Sapiens; identical to SEQ ID NO: 234695

SEQ ID NO: 453300 - RNA, 64 nt, Homo Sapiens; identical to SEQ ID NO: 234696

SEQ ID NO: 453301 - RNA, 64 nt, Homo Sapiens
cucgcucugucgcccaggcuuuuuuuuuuuuuuugagacggagugaagaaggcaaaaaacuuuu

SEQ ID NO: 453302 - RNA, 64 nt, Homo Sapiens
cucacucuuccgcccaggcuuuuuuuuuuuuuuugagacggaguuauaagggauaauuuuucuu

SEQ ID NO: 453303 - RNA, 64 nt, Homo Sapiens
cagugguauauuggggaauuuuuuuuuuuuuuuugagacggagucuggcucugucacccaggcu

SEQ ID NO: 453304 - RNA, 64 nt, Homo Sapiens
cacccagcuaauuuuuuuuuuuuuuuuuuuauuugagacggaguuucgcucugucgcccaggcu

SEQ ID NO: 453305 - RNA, 64 nt, Homo Sapiens
uuuaccauguuggcuaggcuuuuuauuuuuaguagagacggaaucaccaugccuggcuaauuuu

SEQ ID NO: 453306 - RNA, 64 nt, Homo Sapiens
uucccucuugucacccaggcuauuuuaauuuuuugagacggagucuuuuucuuuuuuuuuuuuu

SEQ ID NO: 453307 - RNA, 64 nt, Homo Sapiens
uucaccauguuggccaggcuuuguauuuuuaguagagacggaguccaccaugcccggcuaauuu

SEQ ID NO: 453308 - RNA, 64 nt, Homo Sapiens
uucgcucuugucaccccagcuuuuuuuuuuuuuugagacggaguccauccucuucuuuuuuuuu

SEQ ID NO: 453309 - RNA, 64 nt, Homo Sapiens
cucgcucugucauccaggcucuuugcuuuguuuugagacggaguguguauuuuguuuuguuuug

SEQ ID NO: 453310 - RNA, 64 nt, Homo Sapiens
cuauguugcccaggcuguuauggaagcuugugaggagacggacuucuaauaccugagccaagaa

SEQ ID NO: 453311 - RNA, 64 nt, Homo Sapiens
ugcaccauguuggccaggcuuuguauuuuuaguagagacggagugccaccaugcccggcuaauu

SEQ ID NO: 453312 - RNA, 64 nt, Homo Sapiens
uuuguucuuguugcccaggcuuuuuuuuuuuuuugagacggagucagagaacgcuacuaaugau

SEQ ID NO: 453313 - RNA, 64 nt, Homo Sapiens; identical to SEQ ID NO: 238476

SEQ ID NO: 453314 - RNA, 64 nt, Homo Sapiens; identical to SEQ ID NO: 238477

SEQ ID NO: 453315 - RNA, 53 nt, Homo Sapiens; identical to SEQ ID NO: 238478

SEQ ID NO: 453316 - RNA, 64 nt, Homo Sapiens; identical to SEQ ID NO: 238479

SEQ ID NO: 453317 - RNA, 64 nt, Homo Sapiens; identical to SEQ ID NO: 238480

SEQ ID NO: 453318 - RNA, 64 nt, Homo Sapiens; identical to SEQ ID NO: 238481

SEQ ID NO: 453319 - RNA, 64 nt, Homo Sapiens; identical to SEQ ID NO: 238482

SEQ ID NO: 453320 - RNA, 64 nt, Homo Sapiens; identical to SEQ ID NO: 238483

SEQ ID NO: 453321 - RNA, 64 nt, Homo Sapiens; identical to SEQ ID NO: 238484

SEQ ID NO: 453322 - RNA, 64 nt, Homo Sapiens; identical to SEQ ID NO: 238485

SEQ ID NO: 453323 - RNA, 64 nt, Homo Sapiens; identical to SEQ ID NO: 238486

SEQ ID NO: 453324 - RNA, 64 nt, Homo Sapiens; identical to SEQ ID NO: 238487

SEQ ID NO: 453325 - RNA, 64 nt, Homo Sapiens; identical to SEQ ID NO: 238488

SEQ ID NO: 453326 - RNA, 64 nt, Homo Sapiens; identical to SEQ ID NO: 238489

SEQ ID NO: 453327 - RNA, 64 nt, Homo Sapiens; identical to SEQ ID NO: 102259

SEQ ID NO: 453328 - RNA, 64 nt, Homo Sapiens; identical to SEQ ID NO: 102260

SEQ ID NO: 453329 - RNA, 64 nt, Homo Sapiens; identical to SEQ ID NO: 102261

SEQ ID NO: 453330 - RNA, 64 nt, Homo Sapiens; identical to SEQ ID NO: 102262

SEQ ID NO: 453331 - RNA, 64 nt, Homo Sapiens; identical to SEQ ID NO: 102263

SEQ ID NO: 453332 - RNA, 64 nt, Homo Sapiens; identical to SEQ ID NO: 102264

SEQ ID NO: 453333 - RNA, 64 nt, Homo Sapiens; identical to SEQ ID NO: 102265

SEQ ID NO: 453334 - RNA, 64 nt, Homo Sapiens; identical to SEQ ID NO: 102266

SEQ ID NO: 453335 - RNA, 64 nt, Homo Sapiens; identical to SEQ ID NO: 102267

SEQ ID NO: 453336 - RNA, 64 nt, Homo Sapiens; identical to SEQ ID NO: 102268

SEQ ID NO: 453337 - RNA, 64 nt, Homo Sapiens
aauggugauaauggauuaauuccucaaaggaagagcagaacaccugaaaaucagcaauuuccug

SEQ ID NO: 453338 - RNA, 64 nt, Homo Sapiens
aauggugaugauggauuaauuccuccaaggaagagcagaacaccugaaagccagcaauuuccug

SEQ ID NO: 453339 - RNA, 64 nt, Homo Sapiens
agcgggacaagcugcagaggaccugaagcagcaggcagaacagggguguuucagaaacuuggaa

SEQ ID NO: 453340 - RNA, 64 nt, Homo Sapiens
cuggcucaggaggacacugcguagcggauuuccugcagaacaucugcucugcagccagcuucag

SEQ ID NO: 453341 - RNA, 64 nt, Homo Sapiens
aguaguggaggagcguaugguuaagcccaaaggggcagaacaagaaagccacgggauuguauga

SEQ ID NO: 453342 - RNA, 64 nt, Homo Sapiens
ugagaggcaguaaagcagugaugaagacagugcagcagaacauugaaguccugauugcagcagu

SEQ ID NO: 453343 - RNA, 64 nt, Homo Sapiens
caagaaauggcgucugcucugguggcuuaagugagcagaacagguaguauuacaccaccggccc

SEQ ID NO: 453344 - RNA, 64 nt, Homo Sapiens
agaaaaaagaguccucuucuuuucccagccuuuugcagaacacaguagacagaacugccaccuu

SEQ ID NO: 453345 - RNA, 64 nt, Homo Sapiens
uuuccuuucucacccagaaccgagugcucagcuggcagaacaccuaacugccagcugcucuccc

SEQ ID NO: 453346 - RNA, 64 nt, Homo Sapiens
cuggcgggcuacaguuuagccaccugugggcagggcagaacagcgaugaccacccccucccuca

SEQ ID NO: 453347 - RNA, 64 nt, Homo Sapiens
aggguuuuacagaggaccaguuaguucugguggagcagaacacacugaugguggaagagcggga

SEQ ID NO: 453348 - RNA, 64 nt, Homo Sapiens
caaaacugaagaugguuugaaacagcuucacaaggcagaacaguaucaaaagaagaaucggaag

SEQ ID NO: 453349 - RNA, 64 nt, Homo Sapiens
guaaaagugcccgcgucuuuguccuggcuccguagcagaacacuccggcuucugaccggccuuu

SEQ ID NO: 453350 - RNA, 64 nt, Homo Sapiens
agaaauagccgccccuccccgagcgcaggaagacgcagaacaacgagugcagcuggagggaucu

SEQ ID NO: 453351 - RNA, 64 nt, Homo Sapiens
ggugauuaacucaacuaaaagaugcacaagcguuuuacaccagugggaagauuuggguuccuaa

SEQ ID NO: 453352 - RNA, 64 nt, Homo Sapiens
uaucaguuaauucaaacagagaaaaugaaaucccuuacaccagagacuuuuuuuuucuuauuaa

SEQ ID NO: 453353 - RNA, 64 nt, Homo Sapiens
gcucugguggcuuaagugagcagaacagguaguauuacaccaccggcccccuccccccagacuc

SEQ ID NO: 453354 - RNA, 64 nt, Homo Sapiens
ccucaugagggucuccacagggccggagcucagguuacaccacuccuucguccuuacaggagau

SEQ ID NO: 453355 - RNA, 64 nt, Homo Sapiens
augaggguuggguaggagcuuccaggccugggauuuacaccacgccuagcccagcagaggccuu

SEQ ID NO: 453356 - RNA, 64 nt, Homo Sapiens
agauucucugguuuuauggcuuuuuucccuuucuuuacaccauccucucccauaagcacccaug

SEQ ID NO: 453357 - RNA, 64 nt, Homo Sapiens; identical to SEQ ID NO: 296629

SEQ ID NO: 453358 - RNA, 64 nt, Homo Sapiens; identical to SEQ ID NO: 296630

SEQ ID NO: 453359 - RNA, 64 nt, Homo Sapiens; identical to SEQ ID NO: 296631

SEQ ID NO: 453360 - RNA, 64 nt, Homo Sapiens; identical to SEQ ID NO: 296632

SEQ ID NO: 453361 - RNA, 64 nt, Homo Sapiens; identical to SEQ ID NO: 296633

SEQ ID NO: 453362 - RNA, 64 nt, Homo Sapiens; identical to SEQ ID NO: 296634

SEQ ID NO: 453363 - RNA, 64 nt, Homo Sapiens; identical to SEQ ID NO: 296635

SEQ ID NO: 453364 - RNA, 64 nt, Homo Sapiens; identical to SEQ ID NO: 296636

SEQ ID NO: 453365 - RNA, 64 nt, Homo Sapiens; identical to SEQ ID NO: 296637

SEQ ID NO: 453366 - RNA, 64 nt, Homo Sapiens; identical to SEQ ID NO: 296638

SEQ ID NO: 453367 - RNA, 64 nt, Homo Sapiens; identical to SEQ ID NO: 296639

SEQ ID NO: 453368 - RNA, 64 nt, Homo Sapiens; identical to SEQ ID NO: 296640

SEQ ID NO: 453369 - RNA, 64 nt, Homo Sapiens; identical to SEQ ID NO: 296641

SEQ ID NO: 453370 - RNA, 64 nt, Homo Sapiens; identical to SEQ ID NO: 296642

SEQ ID NO: 453371 - RNA, 64 nt, Homo Sapiens; identical to SEQ ID NO: 296643

SEQ ID NO: 453372 - RNA, 64 nt, Homo Sapiens; identical to SEQ ID NO: 296644

SEQ ID NO: 453373 - RNA, 64 nt, Homo Sapiens; identical to SEQ ID NO: 296645

SEQ ID NO: 453374 - RNA, 64 nt, Homo Sapiens; identical to SEQ ID NO: 296646

SEQ ID NO: 453375 - RNA, 64 nt, Homo Sapiens; identical to SEQ ID NO: 296647

SEQ ID NO: 453376 - RNA, 64 nt, Homo Sapiens; identical to SEQ ID NO: 296648

SEQ ID NO: 453377 - RNA, 64 nt, Homo Sapiens; identical to SEQ ID NO: 296649

SEQ ID NO: 453378 - RNA, 64 nt, Homo Sapiens; identical to SEQ ID NO: 296650

SEQ ID NO: 453379 - RNA, 64 nt, Homo Sapiens; identical to SEQ ID NO: 296651

SEQ ID NO: 453380 - RNA, 64 nt, Homo Sapiens; identical to SEQ ID NO: 296652

SEQ ID NO: 453381 - RNA, 64 nt, Homo Sapiens; identical to SEQ ID NO: 296653

SEQ ID NO: 453382 - RNA, 64 nt, Homo Sapiens; identical to SEQ ID NO: 296654

SEQ ID NO: 453383 - RNA, 64 nt, Homo Sapiens; identical to SEQ ID NO: 296655

SEQ ID NO: 453384 - RNA, 64 nt, Homo Sapiens; identical to SEQ ID NO: 296656

SEQ ID NO: 453385 - RNA, 64 nt, Homo Sapiens; identical to SEQ ID NO: 296657

SEQ ID NO: 453386 - RNA, 64 nt, Homo Sapiens; identical to SEQ ID NO: 296658

SEQ ID NO: 453387 - RNA, 64 nt, Homo Sapiens; identical to SEQ ID NO: 296659

SEQ ID NO: 453388 - RNA, 64 nt, Homo Sapiens; identical to SEQ ID NO: 296660

SEQ ID NO: 453389 - RNA, 64 nt, Homo Sapiens; identical to SEQ ID NO: 296661

SEQ ID NO: 453390 - RNA, 64 nt, Homo Sapiens; identical to SEQ ID NO: 296662

SEQ ID NO: 453391 - RNA, 64 nt, Homo Sapiens; identical to SEQ ID NO: 296663

SEQ ID NO: 453392 - RNA, 64 nt, Homo Sapiens; identical to SEQ ID NO: 296664

SEQ ID NO: 453393 - RNA, 64 nt, Homo Sapiens; identical to SEQ ID NO: 296665

SEQ ID NO: 453394 - RNA, 64 nt, Homo Sapiens; identical to SEQ ID NO: 296666

SEQ ID NO: 453395 - RNA, 64 nt, Homo Sapiens; identical to SEQ ID NO: 296667

SEQ ID NO: 453396 - RNA, 64 nt, Homo Sapiens; identical to SEQ ID NO: 296668

SEQ ID NO: 453397 - RNA, 64 nt, Homo Sapiens; identical to SEQ ID NO: 296669

SEQ ID NO: 453398 - RNA, 64 nt, Homo Sapiens; identical to SEQ ID NO: 296670

SEQ ID NO: 453399 - RNA, 64 nt, Homo Sapiens; identical to SEQ ID NO: 296671

SEQ ID NO: 453400 - RNA, 64 nt, Homo Sapiens; identical to SEQ ID NO: 296672

SEQ ID NO: 453401 - RNA, 64 nt, Homo Sapiens; identical to SEQ ID NO: 296673

SEQ ID NO: 453402 - RNA, 64 nt, Homo Sapiens; identical to SEQ ID NO: 296674

SEQ ID NO: 453403 - RNA, 64 nt, Homo Sapiens; identical to SEQ ID NO: 296675

SEQ ID NO: 453404 - RNA, 64 nt, Homo Sapiens; identical to SEQ ID NO: 296676

SEQ ID NO: 453405 - RNA, 64 nt, Homo Sapiens; identical to SEQ ID NO: 296677

SEQ ID NO: 453406 - RNA, 64 nt, Homo Sapiens; identical to SEQ ID NO: 296678

SEQ ID NO: 453407 - RNA, 64 nt, Homo Sapiens; identical to SEQ ID NO: 296679

SEQ ID NO: 453408 - RNA, 64 nt, Homo Sapiens; identical to SEQ ID NO: 296680

SEQ ID NO: 453409 - RNA, 64 nt, Homo Sapiens; identical to SEQ ID NO: 296681

SEQ ID NO: 453410 - RNA, 64 nt, Homo Sapiens; identical to SEQ ID NO: 296682

SEQ ID NO: 453411 - RNA, 64 nt, Homo Sapiens; identical to SEQ ID NO: 296683

SEQ ID NO: 453412 - RNA, 64 nt, Homo Sapiens; identical to SEQ ID NO: 216180

SEQ ID NO: 453413 - RNA, 64 nt, Homo Sapiens; identical to SEQ ID NO: 216181

SEQ ID NO: 453414 - RNA, 64 nt, Homo Sapiens; identical to SEQ ID NO: 216182

SEQ ID NO: 453415 - RNA, 64 nt, Homo Sapiens; identical to SEQ ID NO: 216183

SEQ ID NO: 453416 - RNA, 64 nt, Homo Sapiens; identical to SEQ ID NO: 216184

SEQ ID NO: 453417 - RNA, 64 nt, Homo Sapiens; identical to SEQ ID NO: 216185

SEQ ID NO: 453418 - RNA, 64 nt, Homo Sapiens; identical to SEQ ID NO: 216186

SEQ ID NO: 453419 - RNA, 64 nt, Homo Sapiens; identical to SEQ ID NO: 216187

SEQ ID NO: 453420 - RNA, 64 nt, Homo Sapiens; identical to SEQ ID NO: 216188

SEQ ID NO: 453421 - RNA, 64 nt, Homo Sapiens; identical to SEQ ID NO: 216189

SEQ ID NO: 453422 - RNA, 64 nt, Homo Sapiens; identical to SEQ ID NO: 216190

SEQ ID NO: 453423 - RNA, 64 nt, Homo Sapiens; identical to SEQ ID NO: 216191

SEQ ID NO: 453424 - RNA, 64 nt, Homo Sapiens; identical to SEQ ID NO: 216192

SEQ ID NO: 453425 - RNA, 64 nt, Homo Sapiens; identical to SEQ ID NO: 216193

SEQ ID NO: 453426 - RNA, 64 nt, Homo Sapiens; identical to SEQ ID NO: 216194

SEQ ID NO: 453427 - RNA, 64 nt, Homo Sapiens; identical to SEQ ID NO: 216195

SEQ ID NO: 453428 - RNA, 64 nt, Homo Sapiens; identical to SEQ ID NO: 216196

SEQ ID NO: 453429 - RNA, 64 nt, Homo Sapiens; identical to SEQ ID NO: 216197

SEQ ID NO: 453430 - RNA, 64 nt, Homo Sapiens; identical to SEQ ID NO: 216198

SEQ ID NO: 453431 - RNA, 64 nt, Homo Sapiens; identical to SEQ ID NO: 216199

SEQ ID NO: 453432 - RNA, 64 nt, Homo Sapiens; identical to SEQ ID NO: 216200

SEQ ID NO: 453433 - RNA, 64 nt, Homo Sapiens; identical to SEQ ID NO: 216201

SEQ ID NO: 453434 - RNA, 64 nt, Homo Sapiens; identical to SEQ ID NO: 216202

SEQ ID NO: 453435 - RNA, 64 nt, Homo Sapiens; identical to SEQ ID NO: 216203

SEQ ID NO: 453436 - RNA, 64 nt, Homo Sapiens; identical to SEQ ID NO: 216204

SEQ ID NO: 453437 - RNA, 64 nt, Homo Sapiens; identical to SEQ ID NO: 216205

SEQ ID NO: 453438 - RNA, 64 nt, Homo Sapiens; identical to SEQ ID NO: 216206

SEQ ID NO: 453439 - RNA, 64 nt, Homo Sapiens; identical to SEQ ID NO: 216207

SEQ ID NO: 453440 - RNA, 64 nt, Homo Sapiens; identical to SEQ ID NO: 216208

SEQ ID NO: 453441 - RNA, 64 nt, Homo Sapiens; identical to SEQ ID NO: 216209

SEQ ID NO: 453442 - RNA, 64 nt, Homo Sapiens; identical to SEQ ID NO: 216210

SEQ ID NO: 453443 - RNA, 64 nt, Homo Sapiens; identical to SEQ ID NO: 216211

SEQ ID NO: 453444 - RNA, 64 nt, Homo Sapiens; identical to SEQ ID NO: 216212

SEQ ID NO: 453445 - RNA, 64 nt, Homo Sapiens; identical to SEQ ID NO: 216213

SEQ ID NO: 453446 - RNA, 64 nt, Homo Sapiens; identical to SEQ ID NO: 216214

SEQ ID NO: 453447 - RNA, 64 nt, Homo Sapiens; identical to SEQ ID NO: 97841

SEQ ID NO: 453448 - RNA, 64 nt, Homo Sapiens; identical to SEQ ID NO: 97842

SEQ ID NO: 453449 - RNA, 64 nt, Homo Sapiens; identical to SEQ ID NO: 97843

SEQ ID NO: 453450 - RNA, 64 nt, Homo Sapiens; identical to SEQ ID NO: 97844

SEQ ID NO: 453451 - RNA, 64 nt, Homo Sapiens; identical to SEQ ID NO: 97845

SEQ ID NO: 453452 - RNA, 64 nt, Homo Sapiens; identical to SEQ ID NO: 97846

SEQ ID NO: 453453 - RNA, 64 nt, Homo Sapiens; identical to SEQ ID NO: 97847

SEQ ID NO: 453454 - RNA, 64 nt, Homo Sapiens; identical to SEQ ID NO: 97848

SEQ ID NO: 453455 - RNA, 64 nt, Homo Sapiens
cucaaugaaaagggaguuucguaagcaaaauagaggacagaaaugcaguucaugaacuugcugg

SEQ ID NO: 453456 - RNA, 64 nt, Homo Sapiens
gugguuaugagccuccaggcgcaugcuguccaguggacagaacaucuggcgguugguugauugc

SEQ ID NO: 453457 - RNA, 64 nt, Homo Sapiens
uuguuuucccuuauuuuaaaagugauuuuuuuaaggacagaacuucuuccaaaagagagggaug

SEQ ID NO: 453458 - RNA, 64 nt, Homo Sapiens
agcaaggggagacauugugguagcuaucagacauggacagaaacugacuuagugcucacaagcc

SEQ ID NO: 453459 - RNA, 64 nt, Homo Sapiens
aacucaacucaaucugaaaguagagugucugagaggacagaagguaaugggaacuguagcugga

SEQ ID NO: 453460 - RNA, 64 nt, Homo Sapiens
gugagaagacauagggauuucaaccacacaguugggacagaagggacagugcaucuguucaucc

SEQ ID NO: 453461 - RNA, 64 nt, Homo Sapiens
uccaugccgcguggaugggcccaguucugggagaggacagaaaaggugguacaggguugucugc

SEQ ID NO: 453462 - RNA, 64 nt, Homo Sapiens
uuguuuuuacguuuucaaguucagcauuguauucggacagaagcugugacugaagacucagugc

SEQ ID NO: 453463 - RNA, 64 nt, Homo Sapiens
ucuggcaggaguaaauuagcgcccucauauucaaggacagaagcauuuacuauaggugaagaua

SEQ ID NO: 453464 - RNA, 64 nt, Homo Sapiens
ucucccccacucccuugcccgccauagccagaaaggacagaaucgcaugcuugugcagaaagaa

SEQ ID NO: 453465 - RNA, 64 nt, Homo Sapiens
ccuuucccaguuguuacccucagaaugacacaaaggacagaauugaauugcuacucgaaggugc

SEQ ID NO: 453466 - RNA, 64 nt, Homo Sapiens
aagauuaaaaccuggauccaaaucacaugguucaggacagaaacagaugaagugacuuccucaa

SEQ ID NO: 453467 - RNA, 64 nt, Homo Sapiens
augccaaaauauugcuuaugacggccuacugagcggacagaaugaaggcccuaccagagggaac

SEQ ID NO: 453468 - RNA, 64 nt, Homo Sapiens
gaacguccugcagcuucggggggagaagccgcagggacagaacucuuugagagaguuuaucauu

SEQ ID NO: 453469 - RNA, 64 nt, Homo Sapiens
gagguggcccuaucccuaggcaguggugcuaggaggacagaaggcuauaugggcguggcagagg

SEQ ID NO: 453470 - RNA, 64 nt, Homo Sapiens
cccgccuugugagccaggaagcagcgucucaucaggacagaagguaggaugaagacauggggua

SEQ ID NO: 453471 - RNA, 64 nt, Homo Sapiens
agguaggggggcuugauaacuuaacuuuccacguggacagaauuuuuuuuuuuguuuuguuuuu

SEQ ID NO: 453472 - RNA, 64 nt, Homo Sapiens
guccuaaagccaggaagagugacaaggcagguggggacagaaggaagaagccaggagccucccu

SEQ ID NO: 453473 - RNA, 64 nt, Homo Sapiens
accaagcguuacaaaaucaguaauuuauuuuaaaggacagaauuaauuauuuauucaugggaga

SEQ ID NO: 453474 - RNA, 64 nt, Homo Sapiens
ggaaaugcuuugggaugaguaucuguugaagaaaggacagaagacacaggaaagagaaaaagaa

SEQ ID NO: 453475 - RNA, 64 nt, Homo Sapiens; identical to SEQ ID NO: 363385

SEQ ID NO: 453476 - RNA, 64 nt, Homo Sapiens; identical to SEQ ID NO: 363386

SEQ ID NO: 453477 - RNA, 64 nt, Homo Sapiens; identical to SEQ ID NO: 363387

SEQ ID NO: 453478 - RNA, 64 nt, Homo Sapiens; identical to SEQ ID NO: 363388

SEQ ID NO: 453479 - RNA, 64 nt, Homo Sapiens; identical to SEQ ID NO: 363389

SEQ ID NO: 453480 - RNA, 64 nt, Homo Sapiens; identical to SEQ ID NO: 363390

SEQ ID NO: 453481 - RNA, 64 nt, Homo Sapiens; identical to SEQ ID NO: 363391

SEQ ID NO: 453482 - RNA, 64 nt, Homo Sapiens; identical to SEQ ID NO: 363392

SEQ ID NO: 453483 - RNA, 64 nt, Homo Sapiens; identical to SEQ ID NO: 363393

SEQ ID NO: 453484 - RNA, 64 nt, Homo Sapiens; identical to SEQ ID NO: 363394

SEQ ID NO: 453485 - RNA, 64 nt, Homo Sapiens; identical to SEQ ID NO: 363395

SEQ ID NO: 453486 - RNA, 64 nt, Homo Sapiens; identical to SEQ ID NO: 363396

SEQ ID NO: 453487 - RNA, 64 nt, Homo Sapiens; identical to SEQ ID NO: 363397

SEQ ID NO: 453488 - RNA, 64 nt, Homo Sapiens; identical to SEQ ID NO: 363398

SEQ ID NO: 453489 - RNA, 64 nt, Homo Sapiens; identical to SEQ ID NO: 363399

SEQ ID NO: 453490 - RNA, 64 nt, Homo Sapiens; identical to SEQ ID NO: 363400

SEQ ID NO: 453491 - RNA, 64 nt, Homo Sapiens; identical to SEQ ID NO: 363401

SEQ ID NO: 453492 - RNA, 64 nt, Homo Sapiens; identical to SEQ ID NO: 363402

SEQ ID NO: 453493 - RNA, 64 nt, Homo Sapiens; identical to SEQ ID NO: 363403

SEQ ID NO: 453494 - RNA, 64 nt, Homo Sapiens; identical to SEQ ID NO: 363404

SEQ ID NO: 453495 - RNA, 64 nt, Homo Sapiens; identical to SEQ ID NO: 363405

SEQ ID NO: 453496 - RNA, 64 nt, Homo Sapiens; identical to SEQ ID NO: 363406

SEQ ID NO: 453497 - RNA, 64 nt, Homo Sapiens; identical to SEQ ID NO: 363407

SEQ ID NO: 453498 - RNA, 64 nt, Homo Sapiens; identical to SEQ ID NO: 363408

SEQ ID NO: 453499 - RNA, 64 nt, Homo Sapiens; identical to SEQ ID NO: 363409

SEQ ID NO: 453500 - RNA, 64 nt, Homo Sapiens; identical to SEQ ID NO: 363410

SEQ ID NO: 453501 - RNA, 64 nt, Homo Sapiens; identical to SEQ ID NO: 363411

SEQ ID NO: 453502 - RNA, 64 nt, Homo Sapiens; identical to SEQ ID NO: 363412

SEQ ID NO: 453503 - RNA, 64 nt, Homo Sapiens; identical to SEQ ID NO: 363413

SEQ ID NO: 453504 - RNA, 64 nt, Homo Sapiens; identical to SEQ ID NO: 363414

SEQ ID NO: 453505 - RNA, 64 nt, Homo Sapiens; identical to SEQ ID NO: 363415

SEQ ID NO: 453506 - RNA, 64 nt, Homo Sapiens; identical to SEQ ID NO: 363416

SEQ ID NO: 453507 - RNA, 64 nt, Homo Sapiens; identical to SEQ ID NO: 363417

SEQ ID NO: 453508 - RNA, 64 nt, Homo Sapiens; identical to SEQ ID NO: 363418

SEQ ID NO: 453509 - RNA, 64 nt, Homo Sapiens; identical to SEQ ID NO: 363419

SEQ ID NO: 453510 - RNA, 64 nt, Homo Sapiens; identical to SEQ ID NO: 363420

SEQ ID NO: 453511 - RNA, 64 nt, Homo Sapiens; identical to SEQ ID NO: 363421

SEQ ID NO: 453512 - RNA, 64 nt, Homo Sapiens; identical to SEQ ID NO: 363422

SEQ ID NO: 453513 - RNA, 64 nt, Homo Sapiens; identical to SEQ ID NO: 363423

SEQ ID NO: 453514 - RNA, 64 nt, Homo Sapiens; identical to SEQ ID NO: 363424

SEQ ID NO: 453515 - RNA, 64 nt, Homo Sapiens; identical to SEQ ID NO: 363425

SEQ ID NO: 453516 - RNA, 64 nt, Homo Sapiens; identical to SEQ ID NO: 363426

SEQ ID NO: 453517 - RNA, 64 nt, Homo Sapiens; identical to SEQ ID NO: 363427

SEQ ID NO: 453518 - RNA, 64 nt, Homo Sapiens; identical to SEQ ID NO: 363428

SEQ ID NO: 453519 - RNA, 64 nt, Homo Sapiens; identical to SEQ ID NO: 363429

SEQ ID NO: 453520 - RNA, 64 nt, Homo Sapiens; identical to SEQ ID NO: 127504

SEQ ID NO: 453521 - RNA, 64 nt, Homo Sapiens; identical to SEQ ID NO: 127505

SEQ ID NO: 453522 - RNA, 64 nt, Homo Sapiens; identical to SEQ ID NO: 127506

SEQ ID NO: 453523 - RNA, 64 nt, Homo Sapiens; identical to SEQ ID NO: 127507

SEQ ID NO: 453524 - RNA, 64 nt, Homo Sapiens; identical to SEQ ID NO: 127508

SEQ ID NO: 453525 - RNA, 64 nt, Homo Sapiens; identical to SEQ ID NO: 127509

SEQ ID NO: 453526 - RNA, 64 nt, Homo Sapiens; identical to SEQ ID NO: 127510

SEQ ID NO: 453527 - RNA, 64 nt, Homo Sapiens; identical to SEQ ID NO: 127511

SEQ ID NO: 453528 - RNA, 64 nt, Homo Sapiens; identical to SEQ ID NO: 127512

SEQ ID NO: 453529 - RNA, 64 nt, Homo Sapiens; identical to SEQ ID NO: 127513

SEQ ID NO: 453530 - RNA, 64 nt, Homo Sapiens; identical to SEQ ID NO: 127514

SEQ ID NO: 453531 - RNA, 64 nt, Homo Sapiens; identical to SEQ ID NO: 127514

SEQ ID NO: 453532 - RNA, 64 nt, Homo Sapiens; identical to SEQ ID NO: 127516

SEQ ID NO: 453533 - RNA, 64 nt, Homo Sapiens; identical to SEQ ID NO: 127517

SEQ ID NO: 453534 - RNA, 64 nt, Homo Sapiens; identical to SEQ ID NO: 127518

SEQ ID NO: 453535 - RNA, 64 nt, Homo Sapiens; identical to SEQ ID NO: 127519

SEQ ID NO: 453536 - RNA, 64 nt, Homo Sapiens; identical to SEQ ID NO: 127520

SEQ ID NO: 453537 - RNA, 64 nt, Homo Sapiens; identical to SEQ ID NO: 127521

SEQ ID NO: 453538 - RNA, 64 nt, Homo Sapiens; identical to SEQ ID NO: 127522

SEQ ID NO: 453539 - RNA, 64 nt, Homo Sapiens; identical to SEQ ID NO: 127523

SEQ ID NO: 453540 - RNA, 64 nt, Homo Sapiens; identical to SEQ ID NO: 127524

SEQ ID NO: 453541 - RNA, 64 nt, Homo Sapiens; identical to SEQ ID NO: 127525

SEQ ID NO: 453542 - RNA, 64 nt, Homo Sapiens; identical to SEQ ID NO: 127526

SEQ ID NO: 453543 - RNA, 64 nt, Homo Sapiens; identical to SEQ ID NO: 127527

SEQ ID NO: 453544 - RNA, 64 nt, Homo Sapiens; identical to SEQ ID NO: 127528

SEQ ID NO: 453545 - RNA, 64 nt, Homo Sapiens; identical to SEQ ID NO: 127529

SEQ ID NO: 453546 - RNA, 64 nt, Homo Sapiens; identical to SEQ ID NO: 127530

SEQ ID NO: 453547 - RNA, 64 nt, Homo Sapiens; identical to SEQ ID NO: 127531

SEQ ID NO: 453548 - RNA, 64 nt, Homo Sapiens; identical to SEQ ID NO: 127532

SEQ ID NO: 453549 - RNA, 64 nt, Homo Sapiens; identical to SEQ ID NO: 127533

SEQ ID NO: 453550 - RNA, 64 nt, Homo Sapiens; identical to SEQ ID NO: 127534

SEQ ID NO: 453551 - RNA, 64 nt, Homo Sapiens; identical to SEQ ID NO: 127535

SEQ ID NO: 453552 - RNA, 64 nt, Homo Sapiens; identical to SEQ ID NO: 127536

SEQ ID NO: 453553 - RNA, 64 nt, Homo Sapiens; identical to SEQ ID NO: 127537

SEQ ID NO: 453554 - RNA, 64 nt, Homo Sapiens; identical to SEQ ID NO: 127538

SEQ ID NO: 453555 - RNA, 64 nt, Homo Sapiens; identical to SEQ ID NO: 127539

SEQ ID NO: 453556 - RNA, 64 nt, Homo Sapiens; identical to SEQ ID NO: 127540

SEQ ID NO: 453557 - RNA, 64 nt, Homo Sapiens; identical to SEQ ID NO: 127541

SEQ ID NO: 453558 - RNA, 64 nt, Homo Sapiens; identical to SEQ ID NO: 127542

SEQ ID NO: 453559 - RNA, 64 nt, Homo Sapiens; identical to SEQ ID NO: 127543

SEQ ID NO: 453560 - RNA, 64 nt, Homo Sapiens; identical to SEQ ID NO: 127544

SEQ ID NO: 453561 - RNA, 64 nt, Homo Sapiens; identical to SEQ ID NO: 127545

SEQ ID NO: 453562 - RNA, 64 nt, Homo Sapiens; identical to SEQ ID NO: 127546

SEQ ID NO: 453563 - RNA, 64 nt, Homo Sapiens; identical to SEQ ID NO: 127547

SEQ ID NO: 453564 - RNA, 64 nt, Homo Sapiens; identical to SEQ ID NO: 127548

SEQ ID NO: 453565 - RNA, 64 nt, Homo Sapiens; identical to SEQ ID NO: 127549

SEQ ID NO: 453566 - RNA, 64 nt, Homo Sapiens; identical to SEQ ID NO: 127550

SEQ ID NO: 453567 - RNA, 64 nt, Homo Sapiens; identical to SEQ ID NO: 127551

SEQ ID NO: 453568 - RNA, 64 nt, Homo Sapiens; identical to SEQ ID NO: 127552

SEQ ID NO: 453569 - RNA, 64 nt, Homo Sapiens; identical to SEQ ID NO: 127553

SEQ ID NO: 453570 - RNA, 64 nt, Homo Sapiens; identical to SEQ ID NO: 127554

SEQ ID NO: 453571 - RNA, 64 nt, Homo Sapiens; identical to SEQ ID NO: 127555

SEQ ID NO: 453572 - RNA, 64 nt, Homo Sapiens; identical to SEQ ID NO: 127556

SEQ ID NO: 453573 - RNA, 64 nt, Homo Sapiens; identical to SEQ ID NO: 379229

SEQ ID NO: 453574 - RNA, 64 nt, Homo Sapiens; identical to SEQ ID NO: 379230

SEQ ID NO: 453575 - RNA, 64 nt, Homo Sapiens; identical to SEQ ID NO: 379231

SEQ ID NO: 453576 - RNA, 64 nt, Homo Sapiens; identical to SEQ ID NO: 379232

SEQ ID NO: 453577 - RNA, 64 nt, Homo Sapiens; identical to SEQ ID NO: 379233

SEQ ID NO: 453578 - RNA, 64 nt, Homo Sapiens; identical to SEQ ID NO: 379234

SEQ ID NO: 453579 - RNA, 64 nt, Homo Sapiens; identical to SEQ ID NO: 379235

SEQ ID NO: 453580 - RNA, 64 nt, Homo Sapiens; identical to SEQ ID NO: 379236

SEQ ID NO: 453581 - RNA, 64 nt, Homo Sapiens; identical to SEQ ID NO: 379237

SEQ ID NO: 453582 - RNA, 64 nt, Homo Sapiens; identical to SEQ ID NO: 379238

SEQ ID NO: 453583 - RNA, 64 nt, Homo Sapiens; identical to SEQ ID NO: 379239

SEQ ID NO: 453584 - RNA, 64 nt, Homo Sapiens; identical to SEQ ID NO: 379240

SEQ ID NO: 453585 - RNA, 64 nt, Homo Sapiens; identical to SEQ ID NO: 379241

SEQ ID NO: 453586 - RNA, 64 nt, Homo Sapiens; identical to SEQ ID NO: 379242

SEQ ID NO: 453587 - RNA, 64 nt, Homo Sapiens; identical to SEQ ID NO: 379243

SEQ ID NO: 453588 - RNA, 64 nt, Homo Sapiens; identical to SEQ ID NO: 379244

SEQ ID NO: 453589 - RNA, 64 nt, Homo Sapiens; identical to SEQ ID NO: 379245

SEQ ID NO: 453590 - RNA, 64 nt, Homo Sapiens; identical to SEQ ID NO: 379246

SEQ ID NO: 453591 - RNA, 64 nt, Homo Sapiens; identical to SEQ ID NO: 379247

SEQ ID NO: 453592 - RNA, 64 nt, Homo Sapiens; identical to SEQ ID NO: 379248

SEQ ID NO: 453593 - RNA, 64 nt, Homo Sapiens; identical to SEQ ID NO: 379249

SEQ ID NO: 453594 - RNA, 64 nt, Homo Sapiens; identical to SEQ ID NO: 379250

SEQ ID NO: 453595 - RNA, 64 nt, Homo Sapiens; identical to SEQ ID NO: 379251

SEQ ID NO: 453596 - RNA, 64 nt, Homo Sapiens; identical to SEQ ID NO: 379252

SEQ ID NO: 453597 - RNA, 64 nt, Homo Sapiens; identical to SEQ ID NO: 379253

SEQ ID NO: 453598 - RNA, 64 nt, Homo Sapiens; identical to SEQ ID NO: 379254

SEQ ID NO: 453599 - RNA, 64 nt, Homo Sapiens; identical to SEQ ID NO: 379255

SEQ ID NO: 453600 - RNA, 64 nt, Homo Sapiens; identical to SEQ ID NO: 379256

SEQ ID NO: 453601 - RNA, 64 nt, Homo Sapiens; identical to SEQ ID NO: 379257

SEQ ID NO: 453602 - RNA, 64 nt, Homo Sapiens; identical to SEQ ID NO: 379258

SEQ ID NO: 453603 - RNA, 64 nt, Homo Sapiens; identical to SEQ ID NO: 379259

SEQ ID NO: 453604 - RNA, 64 nt, Homo Sapiens; identical to SEQ ID NO: 108826

SEQ ID NO: 453605 - RNA, 64 nt, Homo Sapiens; identical to SEQ ID NO: 108827

SEQ ID NO: 453606 - RNA, 64 nt, Homo Sapiens; identical to SEQ ID NO: 108828

SEQ ID NO: 453607 - RNA, 64 nt, Homo Sapiens; identical to SEQ ID NO: 108829

SEQ ID NO: 453608 - RNA, 64 nt, Homo Sapiens; identical to SEQ ID NO: 108830

SEQ ID NO: 453609 - RNA, 64 nt, Homo Sapiens; identical to SEQ ID NO: 108831

SEQ ID NO: 453610 - RNA, 64 nt, Homo Sapiens; identical to SEQ ID NO: 108832

SEQ ID NO: 453611 - RNA, 64 nt, Homo Sapiens; identical to SEQ ID NO: 108833

SEQ ID NO: 453612 - RNA, 64 nt, Homo Sapiens; identical to SEQ ID NO: 108834

SEQ ID NO: 453613 - RNA, 64 nt, Homo Sapiens; identical to SEQ ID NO: 108835

SEQ ID NO: 453614 - RNA, 64 nt, Homo Sapiens; identical to SEQ ID NO: 108836

SEQ ID NO: 453615 - RNA, 64 nt, Homo Sapiens; identical to SEQ ID NO: 108837

SEQ ID NO: 453616 - RNA, 64 nt, Homo Sapiens; identical to SEQ ID NO: 108838

SEQ ID NO: 453617 - RNA, 64 nt, Homo Sapiens; identical to SEQ ID NO: 108839

SEQ ID NO: 453618 - RNA, 64 nt, Homo Sapiens; identical to SEQ ID NO: 108840

SEQ ID NO: 453619 - RNA, 64 nt, Homo Sapiens; identical to SEQ ID NO: 108841

SEQ ID NO: 453620 - RNA, 64 nt, Homo Sapiens; identical to SEQ ID NO: 108842

SEQ ID NO: 453621 - RNA, 64 nt, Homo Sapiens; identical to SEQ ID NO: 108843

SEQ ID NO: 453622 - RNA, 64 nt, Homo Sapiens; identical to SEQ ID NO: 108844

SEQ ID NO: 453623 - RNA, 64 nt, Homo Sapiens; identical to SEQ ID NO: 108845

SEQ ID NO: 453624 - RNA, 64 nt, Homo Sapiens; identical to SEQ ID NO: 108846

SEQ ID NO: 453625 - RNA, 64 nt, Homo Sapiens; identical to SEQ ID NO: 108847

SEQ ID NO: 453626 - RNA, 64 nt, Homo Sapiens; identical to SEQ ID NO: 108848

SEQ ID NO: 453627 - RNA, 64 nt, Homo Sapiens; identical to SEQ ID NO: 108849

SEQ ID NO: 453628 - RNA, 64 nt, Homo Sapiens; identical to SEQ ID NO: 108850

SEQ ID NO: 453629 - RNA, 64 nt, Homo Sapiens; identical to SEQ ID NO: 108851

SEQ ID NO: 453630 - RNA, 64 nt, Homo Sapiens; identical to SEQ ID NO: 108852

SEQ ID NO: 453631 - RNA, 63 nt, Homo Sapiens; identical to SEQ ID NO: 108853

SEQ ID NO: 453632 - RNA, 64 nt, Homo Sapiens; identical to SEQ ID NO: 108854

SEQ ID NO: 453633 - RNA, 64 nt, Homo Sapiens
cugcaugagacacagccuucggccccauucuggaaaaggcaaaggccacaaaacuaaaaggccu

SEQ ID NO: 453634 - RNA, 64 nt, Homo Sapiens
agacaagacauccaggcaggaaggcuggguuugaaaaggcaaaacauucaguugagugaggcug

SEQ ID NO: 453635 - RNA, 64 nt, Homo Sapiens
gauugcucuuuauccagcccacagcaggggaaagaaaggcaacucgcaaagaugagauggaaga

SEQ ID NO: 453636 - RNA, 64 nt, Homo Sapiens
uugaacaugaugagaugugagaacuuacaaugaaaaaggcaauaaugauagaaauuauuucuua

SEQ ID NO: 453637 - RNA, 64 nt, Homo Sapiens
uucuauccaccaacagaaauuauaccauauagugaaaggcaauuuucuaaauaauuucauuacu

SEQ ID NO: 453638 - RNA, 64 nt, Homo Sapiens
aaccagauacauaaagagcucuuacaacucaauaaaaggcaaguaauuuaaaaauaggcaaaag

SEQ ID NO: 453639 - RNA, 64 nt, Homo Sapiens
uuuuuauggaugagcauaaaccuagucuuaguuuaaaggcaaacuaaaguugaggggaaauaau

SEQ ID NO: 453640 - RNA, 64 nt, Homo Sapiens
caguuauucacuuacagaugaaacuaaaacaaauaaaggcaagcuauuaucaguuugguaguuc

SEQ ID NO: 453641 - RNA, 64 nt, Homo Sapiens
auucaacagucccugugugaccuucugaguuuucaaaggcaaguaaucuggauuugccuugugu

SEQ ID NO: 453642 - RNA, 64 nt, Homo Sapiens
uucauuucuuccauuaacuguacugcuggacuucaaaggcaaagaugaaaguaacaguuauuga

SEQ ID NO: 453643 - RNA, 64 nt, Homo Sapiens
uaagauauaggaccaaaacaauaauaaaguggauaaaggcaaauaaaaucaguugacaauuaga

SEQ ID NO: 453644 - RNA, 64 nt, Homo Sapiens
gcgccuucugagaucaaaagggggguggaggaaaaaaggcaaaguaaacuaccaaaaaaaaagu

SEQ ID NO: 453645 - RNA, 64 nt, Homo Sapiens
augugggacuacuuggucgagagauuuguagacuaaaggcaauggaaaaucaaguauaaucccu

SEQ ID NO: 453646 - RNA, 64 nt, Homo Sapiens
agaaacaagcagaauuccaguuuguaacacgguuaaaggcaaugauguuuacuuuuggacuggg

SEQ ID NO: 453647 - RNA, 64 nt, Homo Sapiens
acaggcagaucugcuuggggaagcuaguuaugugaaaggcaaauagagucauacaguagcucaa

SEQ ID NO: 453648 - RNA, 64 nt, Homo Sapiens
augugaaaggcaaauagagucauacaguagcucaaaaggcaaccauaauucucuuuggugcagg

SEQ ID NO: 453649 - RNA, 64 nt, Homo Sapiens
aaaacuuagccucacuccacuuugugaugugagcaaaggcaaccacgggucaaaggcaaaggcc

SEQ ID NO: 453650 - RNA, 64 nt, Homo Sapiens
gccuuugugaugugagcaaaguucaggacgggucaaaggcaaaggaagggccucacagugaugg

SEQ ID NO: 453651 - RNA, 64 nt, Homo Sapiens
ucccaucgccuucccacccauucgccaacgcgggaaaggcaaggccuggcuuacuuagagcuuc

SEQ ID NO: 453652 - RNA, 64 nt, Homo Sapiens
ugucugugucccccugccgaacaaagcugggaguaaaggcaaaaccuugacacguguugguagc

SEQ ID NO: 453653 - RNA, 64 nt, Homo Sapiens
aaaauuuagcaagccacugagcuuuaaaaaaaaaaaaggcaauguuauuagauagcaguggcau

SEQ ID NO: 453654 - RNA, 64 nt, Homo Sapiens
cccagaacucagacaacagaacagaacucuagccaaaggcaagccuagguggagaaaaauauca

SEQ ID NO: 453655 - RNA, 64 nt, Homo Sapiens
aagaggaagacaagucuuggggccacacuggaagaaaggcaagaaggaaacagggaguucauuu

SEQ ID NO: 453656 - RNA, 64 nt, Homo Sapiens
cuuuauugucuaguuguuuuuuuucccccaagacaaaggcaaguuucccuaaguuugaguugau

SEQ ID NO: 453657 - RNA, 64 nt, Homo Sapiens
ugauaguuauuaaaaagaaaacaaaacaaaaaaaaaaggcaaggcacaacaaaaaaauauccug

SEQ ID NO: 453658 - RNA, 64 nt, Homo Sapiens
auguaugcauuuuuuuuaauucuuuuguaaacaaaaaggcaauggaucaauacuguaaauuggg

SEQ ID NO: 453659 - RNA, 64 nt, Homo Sapiens
ucuauuucagggauuguaaaauaguuucuauaguaaaggcaaugucugaacggaucagaguuuc

SEQ ID NO: 453660 - RNA, 64 nt, Homo Sapiens
caagguuguggccuuagguuaggaaaagagagaaaaaggcaaagauggugugugccuuuuauaa

SEQ ID NO: 453661 - RNA, 64 nt, Homo Sapiens
uggcuaaaaaaugaauaagaaagcucugggccagaaaggcaauuauaccaugcuuucagaacaa

SEQ ID NO: 453662 - RNA, 64 nt, Homo Sapiens
ugugcacucuggacucaagagacauugaagggagaaaggcaagaugcaccuguuaacuguguuc

SEQ ID NO: 453663 - RNA, 64 nt, Homo Sapiens
gguccagaaggagacaggcaugggcugggcccacaaaggcaaagcugguuaggauggcaggacg

SEQ ID NO: 453664 - RNA, 64 nt, Homo Sapiens
aauugucacucagcauaaugagcauuuaacauacaaaggcaauguacuguuuuguguugaucua

SEQ ID NO: 453665 - RNA, 64 nt, Homo Sapiens
ggaaucuccuacuuaauauaugaccaugacuuugaaaggcaaaagaggaaucaagaauaaauaa

SEQ ID NO: 453666 - RNA, 64 nt, Homo Sapiens
uguugaagauacuacgguguuucuucauauaguaaaaggcaaagaucacuuuucaacuuccaua

SEQ ID NO: 453667 - RNA, 64 nt, Homo Sapiens
gcuguuacaaauuuuuggcaacaaguuucuauuaaaaggcaaauauccuggauucacaguggga

SEQ ID NO: 453668 - RNA, 64 nt, Homo Sapiens
uuuggaauguucuugcgcuuugaguugauucaccaaaggcaaauguaauaacuucucaguguuu

SEQ ID NO: 453669 - RNA, 64 nt, Homo Sapiens
gugcggagccaaccaucacuaaaaaaaaaaaaaaaaaggcaauuagacuccaucucaaaaaaaa

SEQ ID NO: 453670 - RNA, 64 nt, Homo Sapiens
gucaaucauccgagauggguuuuccauuccaaagaaaggcaauaugguuccuuccuucccuccu

SEQ ID NO: 453671 - RNA, 64 nt, Homo Sapiens
aggauuuuaaagggcauugauagcauaccaaacaaaaggcaaaauaaagugaccuuuuuauaua

SEQ ID NO: 453672 - RNA, 64 nt, Homo Sapiens
auaaaauaagaagggggagugaaacagagaaagaaaaggcaaaagacugguuuguuugcuuaau

SEQ ID NO: 453673 - RNA, 64 nt, Homo Sapiens
ccaugaaaauaccauaggaagacauaaaacuuuaaaaggcaacucaaagaugauggaaacgcac

SEQ ID NO: 453674 - RNA, 64 nt, Homo Sapiens
gaaucuaacaggcacaguggcaucaauuaaaggcaaaggcaaucauggcggcccccccagcugu

SEQ ID NO: 453675 - RNA, 64 nt, Homo Sapiens
gcaaucgaaucuaacaggcaagcugucaucaauuaaaggcaaaggaaggcauggcggccccccc

SEQ ID NO: 453676 - RNA, 64 nt, Homo Sapiens
accugcagcucuguggaaagaggcaaaguccugaaaaggcaaaggguugucacuuagggcagcu

SEQ ID NO: 453677 - RNA, 64 nt, Homo Sapiens
ggccauagccaaggaucgauuccccaaccacagcaaaggcaacacucuuccuccagagaucacc

SEQ ID NO: 453678 - RNA, 64 nt, Homo Sapiens
cuucuucuucuucuuccuuaaagacauuuaagcuaaaggcaacucguacccaaauuuccaagac

SEQ ID NO: 453679 - RNA, 64 nt, Homo Sapiens
uuugcuuguucacugcagucuuaagaaagagguaaaaggcaagcaaaggagaugaaaucuguuc

SEQ ID NO: 453680 - RNA, 64 nt, Homo Sapiens
ccacuuaaaagaucucuguaaaaugacccacuggaaaggcaaaucugucaucaacuugggcaac

SEQ ID NO: 453681 - RNA, 64 nt, Homo Sapiens
gaaaguaauuagacuucuuauauaguuauuuaaaaaaggcaacuuauauauacauauauauaua

SEQ ID NO: 453682 - RNA, 64 nt, Homo Sapiens
acagagcaaaacucugucucaaaaaaaaaaaaaaaaaggcaaaauuaaagaauuucaagucccu

SEQ ID NO: 453683 - RNA, 64 nt, Homo Sapiens
acugaccucuacaguucauauuugcagugacauaaaaggcaaagaggagcuggcauggugguac

SEQ ID NO: 453684 - RNA, 64 nt, Homo Sapiens
ugcaggagaggagagccagccaccccaaguggauaaaggcaacucuuuuucaguucagauauca

SEQ ID NO: 453685 - RNA, 64 nt, Homo Sapiens
augcccauguaaggagcccaagggcuacacuacaaaaggcaagaguuagcccugcccaacagcc

SEQ ID NO: 453686 - RNA, 64 nt, Homo Sapiens
cgucggcuagcuucaggguauaugaagcaaaggcaaaggcaacacaccaacaugggagggaguu

SEQ ID NO: 453687 - RNA, 64 nt, Homo Sapiens
gcaacacgucggcuagcuucggaguuuaugaagcaaaggcaaagagaaaacaccaacaugggag

SEQ ID NO: 453688 - RNA, 64 nt, Homo Sapiens
gaauggcuacuuuuuucuauaucccaaucugagaaaaggcaaaacuaauaugaaagaaaaaugg

SEQ ID NO: 453689 - RNA, 64 nt, Homo Sapiens
cauuuggacaaucugcaaaacaaucuuggagucaaaaggcaaauguuucaggaucagaucaaua

SEQ ID NO: 453690 - RNA, 64 nt, Homo Sapiens; identical to SEQ ID NO: 199867

SEQ ID NO: 453691 - RNA, 64 nt, Homo Sapiens; identical to SEQ ID NO: 199868

SEQ ID NO: 453692 - RNA, 64 nt, Homo Sapiens; identical to SEQ ID NO: 199869

SEQ ID NO: 453693 - RNA, 64 nt, Homo Sapiens; identical to SEQ ID NO: 199870

SEQ ID NO: 453694 - RNA, 64 nt, Homo Sapiens; identical to SEQ ID NO: 199871

SEQ ID NO: 453695 - RNA, 64 nt, Homo Sapiens; identical to SEQ ID NO: 199872

SEQ ID NO: 453696 - RNA, 64 nt, Homo Sapiens; identical to SEQ ID NO: 199873

SEQ ID NO: 453697 - RNA, 64 nt, Homo Sapiens; identical to SEQ ID NO: 199874

SEQ ID NO: 453698 - RNA, 64 nt, Homo Sapiens; identical to SEQ ID NO: 199875

SEQ ID NO: 453699 - RNA, 64 nt, Homo Sapiens; identical to SEQ ID NO: 199876

SEQ ID NO: 453700 - RNA, 64 nt, Homo Sapiens; identical to SEQ ID NO: 76580

SEQ ID NO: 453701 - RNA, 64 nt, Homo Sapiens; identical to SEQ ID NO: 76581

SEQ ID NO: 453702 - RNA, 64 nt, Homo Sapiens; identical to SEQ ID NO: 76582

SEQ ID NO: 453703 - RNA, 64 nt, Homo Sapiens; identical to SEQ ID NO: 76583

SEQ ID NO: 453704 - RNA, 64 nt, Homo Sapiens; identical to SEQ ID NO: 76584

SEQ ID NO: 453705 - RNA, 64 nt, Homo Sapiens; identical to SEQ ID NO: 76585

SEQ ID NO: 453706 - RNA, 64 nt, Homo Sapiens; identical to SEQ ID NO: 76586

SEQ ID NO: 453707 - RNA, 64 nt, Homo Sapiens; identical to SEQ ID NO: 76587

SEQ ID NO: 453708 - RNA, 64 nt, Homo Sapiens; identical to SEQ ID NO: 76588

SEQ ID NO: 453709 - RNA, 64 nt, Homo Sapiens; identical to SEQ ID NO: 76589

SEQ ID NO: 453710 - RNA, 64 nt, Homo Sapiens; identical to SEQ ID NO: 76590

SEQ ID NO: 453711 - RNA, 64 nt, Homo Sapiens; identical to SEQ ID NO: 76591

SEQ ID NO: 453712 - RNA, 64 nt, Homo Sapiens; identical to SEQ ID NO: 76592

SEQ ID NO: 453713 - RNA, 64 nt, Homo Sapiens; identical to SEQ ID NO: 76593

SEQ ID NO: 453714 - RNA, 64 nt, Homo Sapiens; identical to SEQ ID NO: 212638

SEQ ID NO: 453715 - RNA, 64 nt, Homo Sapiens; identical to SEQ ID NO: 212639

SEQ ID NO: 453716 - RNA, 64 nt, Homo Sapiens; identical to SEQ ID NO: 212640

SEQ ID NO: 453717 - RNA, 64 nt, Homo Sapiens; identical to SEQ ID NO: 212641

SEQ ID NO: 453718 - RNA, 64 nt, Homo Sapiens; identical to SEQ ID NO: 212642

SEQ ID NO: 453719 - RNA, 64 nt, Homo Sapiens; identical to SEQ ID NO: 212643

SEQ ID NO: 453720 - RNA, 64 nt, Homo Sapiens; identical to SEQ ID NO: 212644

SEQ ID NO: 453721 - RNA, 64 nt, Homo Sapiens; identical to SEQ ID NO: 212645

SEQ ID NO: 453722 - RNA, 64 nt, Homo Sapiens; identical to SEQ ID NO: 212646

SEQ ID NO: 453723 - RNA, 64 nt, Homo Sapiens; identical to SEQ ID NO: 212647

SEQ ID NO: 453724 - RNA, 64 nt, Homo Sapiens; identical to SEQ ID NO: 212648

SEQ ID NO: 453725 - RNA, 64 nt, Homo Sapiens; identical to SEQ ID NO: 212649

SEQ ID NO: 453726 - RNA, 64 nt, Homo Sapiens; identical to SEQ ID NO: 212650

SEQ ID NO: 453727 - RNA, 64 nt, Homo Sapiens; identical to SEQ ID NO: 212651

SEQ ID NO: 453728 - RNA, 64 nt, Homo Sapiens; identical to SEQ ID NO: 212652

SEQ ID NO: 453729 - RNA, 64 nt, Homo Sapiens; identical to SEQ ID NO: 212653

SEQ ID NO: 453730 - RNA, 64 nt, Homo Sapiens; identical to SEQ ID NO: 212654

SEQ ID NO: 453731 - RNA, 64 nt, Homo Sapiens; identical to SEQ ID NO: 212655

SEQ ID NO: 453732 - RNA, 64 nt, Homo Sapiens; identical to SEQ ID NO: 212656

SEQ ID NO: 453733 - RNA, 64 nt, Homo Sapiens; identical to SEQ ID NO: 212657

SEQ ID NO: 453734 - RNA, 64 nt, Homo Sapiens; identical to SEQ ID NO: 212658

SEQ ID NO: 453735 - RNA, 64 nt, Homo Sapiens; identical to SEQ ID NO: 212659

SEQ ID NO: 453736 - RNA, 64 nt, Homo Sapiens; identical to SEQ ID NO: 212660

SEQ ID NO: 453737 - RNA, 64 nt, Homo Sapiens; identical to SEQ ID NO: 212661

SEQ ID NO: 453738 - RNA, 64 nt, Homo Sapiens; identical to SEQ ID NO: 212662

SEQ ID NO: 453739 - RNA, 64 nt, Homo Sapiens; identical to SEQ ID NO: 212663

SEQ ID NO: 453740 - RNA, 64 nt, Homo Sapiens; identical to SEQ ID NO: 212664

SEQ ID NO: 453741 - RNA, 64 nt, Homo Sapiens; identical to SEQ ID NO: 212665

SEQ ID NO: 453742 - RNA, 64 nt, Homo Sapiens; identical to SEQ ID NO: 212666

SEQ ID NO: 453743 - RNA, 62 nt, Homo Sapiens; identical to SEQ ID NO: 212667

SEQ ID NO: 453744 - RNA, 64 nt, Homo Sapiens; identical to SEQ ID NO: 212668

SEQ ID NO: 453745 - RNA, 64 nt, Homo Sapiens; identical to SEQ ID NO: 212669

SEQ ID NO: 453746 - RNA, 64 nt, Homo Sapiens; identical to SEQ ID NO: 212670

SEQ ID NO: 453747 - RNA, 64 nt, Homo Sapiens; identical to SEQ ID NO: 212671

SEQ ID NO: 453748 - RNA, 64 nt, Homo Sapiens; identical to SEQ ID NO: 212672

SEQ ID NO: 453749 - RNA, 64 nt, Homo Sapiens; identical to SEQ ID NO: 212673

SEQ ID NO: 453750 - RNA, 64 nt, Homo Sapiens; identical to SEQ ID NO: 212674

SEQ ID NO: 453751 - RNA, 64 nt, Homo Sapiens; identical to SEQ ID NO: 212675

SEQ ID NO: 453752 - RNA, 64 nt, Homo Sapiens; identical to SEQ ID NO: 212676

SEQ ID NO: 453753 - RNA, 64 nt, Homo Sapiens; identical to SEQ ID NO: 212677

SEQ ID NO: 453754 - RNA, 64 nt, Homo Sapiens; identical to SEQ ID NO: 212678

SEQ ID NO: 453755 - RNA, 64 nt, Homo Sapiens; identical to SEQ ID NO: 212679

SEQ ID NO: 453756 - RNA, 64 nt, Homo Sapiens
aagaggagcccgcuuccuguacauauauuuaagugacaaacacggucaaaagcuuaagggacag

SEQ ID NO: 453757 - RNA, 64 nt, Homo Sapiens
ugugggaguaugucugccgguuucaacacacacagacaaacacagccacacgcgcacacaagua

SEQ ID NO: 453758 - RNA, 64 nt, Homo Sapiens
gugaagccaacuaucccauaauucggacaaacaugacaaacacauugcaagauaaacagcugua

SEQ ID NO: 453759 - RNA, 64 nt, Homo Sapiens
acaaacacagugaagccaacacagcuguaauucggacaaacaugaucuuaaaguugcaagauaa

SEQ ID NO: 453760 - RNA, 64 nt, Homo Sapiens
uuauuugucggggaagaugaagagauauuuaaaagacaaacaccggaccucucuugugagccau

SEQ ID NO: 453761 - RNA, 64 nt, Homo Sapiens
gaauuuaagcaugaguggcccugcauuuuuaaaggacaaacaguugcaagugggagaugaaaac

SEQ ID NO: 453762 - RNA, 64 nt, Homo Sapiens
gaucucaaggccaucaauuauugggggagggagggacaaacacucccaaucauccaccagucag

SEQ ID NO: 453763 - RNA, 64 nt, Homo Sapiens
cccuaaacuugaaccauuuccuagugccuugcuagacaaacauaaaggggcaggguugugggga

SEQ ID NO: 453764 - RNA, 64 nt, Homo Sapiens
uuuguggcagauguuuuuccaaacaucauuuugagacaaacauuaguagugaucuaugccagca

SEQ ID NO: 453765 - RNA, 64 nt, Homo Sapiens
cacacaccagauaauauaaauuucucuuuauuuagacaaacacauaguauaagugaauuacuag

SEQ ID NO: 453766 - RNA, 64 nt, Homo Sapiens
auuaaaccuuaagccucaagccaaaauugaaugugacaaacaguguaacaaguuucaagcaacu

SEQ ID NO: 453767 - RNA, 64 nt, Homo Sapiens
agaauucuauuucucaugguuagacuggguugcugacaaacaucgaugcucuaagaaaacgcca

SEQ ID NO: 453768 - RNA, 64 nt, Homo Sapiens
accaaggcccaccaaggcagcagacuguuaaucagacaaacagaucucugagaaggugcaucag

SEQ ID NO: 453769 - RNA, 64 nt, Homo Sapiens
gggagcauuuccaggcaucuuuuaagggaacugugacaaacagccucgggcagaugaacacgga

SEQ ID NO: 453770 - RNA, 64 nt, Homo Sapiens
cccggacagacagacacagccugaaacagacccagacaaacagacagacagacacagccugaaa

SEQ ID NO: 453771 - RNA, 64 nt, Homo Sapiens
ccuagacagacagacacagauugaaacagacccagacaaacagacagacacagccugaaacaga

SEQ ID NO: 453772 - RNA, 51 nt, Homo Sapiens
uuaacgaaugguacgucugaggacaaacacaaacccuguuaauuauagaau

SEQ ID NO: 453773 - RNA, 64 nt, Homo Sapiens
aauccauuuaaucuucagugaagcaacucauuuggacaaacaguucuuuuacagugguuauaug

SEQ ID NO: 453774 - RNA, 64 nt, Homo Sapiens; identical to SEQ ID NO: 143712

SEQ ID NO: 453775 - RNA, 64 nt, Homo Sapiens; identical to SEQ ID NO: 143713

SEQ ID NO: 453776 - RNA, 64 nt, Homo Sapiens; identical to SEQ ID NO: 143714

SEQ ID NO: 453777 - RNA, 64 nt, Homo Sapiens; identical to SEQ ID NO: 143715

SEQ ID NO: 453778 - RNA, 64 nt, Homo Sapiens; identical to SEQ ID NO: 143716

SEQ ID NO: 453779 - RNA, 64 nt, Homo Sapiens; identical to SEQ ID NO: 143717

SEQ ID NO: 453780 - RNA, 64 nt, Homo Sapiens; identical to SEQ ID NO: 143718

SEQ ID NO: 453781 - RNA, 64 nt, Homo Sapiens; identical to SEQ ID NO: 143719

SEQ ID NO: 453782 - RNA, 64 nt, Homo Sapiens; identical to SEQ ID NO: 143720

SEQ ID NO: 453783 - RNA, 64 nt, Homo Sapiens; identical to SEQ ID NO: 143721

SEQ ID NO: 453784 - RNA, 64 nt, Homo Sapiens; identical to SEQ ID NO: 143722

SEQ ID NO: 453785 - RNA, 64 nt, Homo Sapiens; identical to SEQ ID NO: 143723

SEQ ID NO: 453786 - RNA, 64 nt, Homo Sapiens; identical to SEQ ID NO: 143724

SEQ ID NO: 453787 - RNA, 64 nt, Homo Sapiens; identical to SEQ ID NO: 143725

SEQ ID NO: 453788 - RNA, 64 nt, Homo Sapiens; identical to SEQ ID NO: 143726

SEQ ID NO: 453789 - RNA, 64 nt, Homo Sapiens; identical to SEQ ID NO: 143727

SEQ ID NO: 453790 - RNA, 64 nt, Homo Sapiens; identical to SEQ ID NO: 143728

SEQ ID NO: 453791 - RNA, 64 nt, Homo Sapiens; identical to SEQ ID NO: 143729

SEQ ID NO: 453792 - RNA, 64 nt, Homo Sapiens; identical to SEQ ID NO: 143730

SEQ ID NO: 453793 - RNA, 64 nt, Homo Sapiens; identical to SEQ ID NO: 143731

SEQ ID NO: 453794 - RNA, 64 nt, Homo Sapiens; identical to SEQ ID NO: 143732

SEQ ID NO: 453795 - RNA, 64 nt, Homo Sapiens; identical to SEQ ID NO: 143733

SEQ ID NO: 453796 - RNA, 64 nt, Homo Sapiens; identical to SEQ ID NO: 143734

SEQ ID NO: 453797 - RNA, 64 nt, Homo Sapiens; identical to SEQ ID NO: 143735

SEQ ID NO: 453798 - RNA, 64 nt, Homo Sapiens; identical to SEQ ID NO: 143736

SEQ ID NO: 453799 - RNA, 64 nt, Homo Sapiens; identical to SEQ ID NO: 143737

SEQ ID NO: 453800 - RNA, 64 nt, Homo Sapiens; identical to SEQ ID NO: 143738

SEQ ID NO: 453801 - RNA, 64 nt, Homo Sapiens; identical to SEQ ID NO: 143739

SEQ ID NO: 453802 - RNA, 64 nt, Homo Sapiens; identical to SEQ ID NO: 143740

SEQ ID NO: 453803 - RNA, 64 nt, Homo Sapiens; identical to SEQ ID NO: 143741

SEQ ID NO: 453804 - RNA, 64 nt, Homo Sapiens; identical to SEQ ID NO: 143742

SEQ ID NO: 453805 - RNA, 64 nt, Homo Sapiens; identical to SEQ ID NO: 143743

SEQ ID NO: 453806 - RNA, 64 nt, Homo Sapiens; identical to SEQ ID NO: 143744

SEQ ID NO: 453807 - RNA, 64 nt, Homo Sapiens; identical to SEQ ID NO: 143745

SEQ ID NO: 453808 - RNA, 64 nt, Homo Sapiens; identical to SEQ ID NO: 143746

SEQ ID NO: 453809 - RNA, 64 nt, Homo Sapiens; identical to SEQ ID NO: 143747

SEQ ID NO: 453810 - RNA, 64 nt, Homo Sapiens; identical to SEQ ID NO: 143748

SEQ ID NO: 453811 - RNA, 64 nt, Homo Sapiens; identical to SEQ ID NO: 143749

SEQ ID NO: 453812 - RNA, 64 nt, Homo Sapiens; identical to SEQ ID NO: 143750

SEQ ID NO: 453813 - RNA, 64 nt, Homo Sapiens; identical to SEQ ID NO: 143751

SEQ ID NO: 453814 - RNA, 64 nt, Homo Sapiens; identical to SEQ ID NO: 143752

SEQ ID NO: 453815 - RNA, 64 nt, Homo Sapiens; identical to SEQ ID NO: 143753

SEQ ID NO: 453816 - RNA, 64 nt, Homo Sapiens; identical to SEQ ID NO: 143754

SEQ ID NO: 453817 - RNA, 64 nt, Homo Sapiens; identical to SEQ ID NO: 143755

SEQ ID NO: 453818 - RNA, 64 nt, Homo Sapiens; identical to SEQ ID NO: 143756

SEQ ID NO: 453819 - RNA, 64 nt, Homo Sapiens; identical to SEQ ID NO: 143757

SEQ ID NO: 453820 - RNA, 64 nt, Homo Sapiens; identical to SEQ ID NO: 143758

SEQ ID NO: 453821 - RNA, 64 nt, Homo Sapiens; identical to SEQ ID NO: 143759

SEQ ID NO: 453822 - RNA, 64 nt, Homo Sapiens; identical to SEQ ID NO: 143760

SEQ ID NO: 453823 - RNA, 64 nt, Homo Sapiens; identical to SEQ ID NO: 143761

SEQ ID NO: 453824 - RNA, 64 nt, Homo Sapiens; identical to SEQ ID NO: 143762

SEQ ID NO: 453825 - RNA, 64 nt, Homo Sapiens; identical to SEQ ID NO: 143763

SEQ ID NO: 453826 - RNA, 64 nt, Homo Sapiens; identical to SEQ ID NO: 143764

SEQ ID NO: 453827 - RNA, 64 nt, Homo Sapiens; identical to SEQ ID NO: 143765

SEQ ID NO: 453828 - RNA, 64 nt, Homo Sapiens; identical to SEQ ID NO: 143766

SEQ ID NO: 453829 - RNA, 64 nt, Homo Sapiens; identical to SEQ ID NO: 143767

SEQ ID NO: 453830 - RNA, 64 nt, Homo Sapiens; identical to SEQ ID NO: 143768

SEQ ID NO: 453831 - RNA, 64 nt, Homo Sapiens; identical to SEQ ID NO: 143769

SEQ ID NO: 453832 - RNA, 64 nt, Homo Sapiens; identical to SEQ ID NO: 143770

SEQ ID NO: 453833 - RNA, 64 nt, Homo Sapiens; identical to SEQ ID NO: 143771

SEQ ID NO: 453834 - RNA, 64 nt, Homo Sapiens; identical to SEQ ID NO: 143772

SEQ ID NO: 453835 - RNA, 64 nt, Homo Sapiens; identical to SEQ ID NO: 143773

SEQ ID NO: 453836 - RNA, 64 nt, Homo Sapiens; identical to SEQ ID NO: 143774

SEQ ID NO: 453837 - RNA, 64 nt, Homo Sapiens; identical to SEQ ID NO: 143775

SEQ ID NO: 453838 - RNA, 64 nt, Homo Sapiens; identical to SEQ ID NO: 143776

SEQ ID NO: 453839 - RNA, 64 nt, Homo Sapiens; identical to SEQ ID NO: 143777

SEQ ID NO: 453840 - RNA, 64 nt, Homo Sapiens; identical to SEQ ID NO: 143778

SEQ ID NO: 453841 - RNA, 64 nt, Homo Sapiens; identical to SEQ ID NO: 143779

SEQ ID NO: 453842 - RNA, 64 nt, Homo Sapiens; identical to SEQ ID NO: 143780

SEQ ID NO: 453843 - RNA, 64 nt, Homo Sapiens; identical to SEQ ID NO: 143781

SEQ ID NO: 453844 - RNA, 64 nt, Homo Sapiens; identical to SEQ ID NO: 143782

SEQ ID NO: 453845 - RNA, 64 nt, Homo Sapiens; identical to SEQ ID NO: 143783

SEQ ID NO: 453846 - RNA, 64 nt, Homo Sapiens; identical to SEQ ID NO: 143784

SEQ ID NO: 453847 - RNA, 64 nt, Homo Sapiens; identical to SEQ ID NO: 143785

SEQ ID NO: 453848 - RNA, 64 nt, Homo Sapiens; identical to SEQ ID NO: 143786

SEQ ID NO: 453849 - RNA, 64 nt, Homo Sapiens; identical to SEQ ID NO: 143787

SEQ ID NO: 453850 - RNA, 64 nt, Homo Sapiens; identical to SEQ ID NO: 143788

SEQ ID NO: 453851 - RNA, 64 nt, Homo Sapiens; identical to SEQ ID NO: 143789

SEQ ID NO: 453852 - RNA, 57 nt, Homo Sapiens; identical to SEQ ID NO: 143790

SEQ ID NO: 453853 - RNA, 64 nt, Homo Sapiens; identical to SEQ ID NO: 143791

SEQ ID NO: 453854 - RNA, 64 nt, Homo Sapiens; identical to SEQ ID NO: 143792

SEQ ID NO: 453855 - RNA, 64 nt, Homo Sapiens; identical to SEQ ID NO: 143793

SEQ ID NO: 453856 - RNA, 64 nt, Homo Sapiens; identical to SEQ ID NO: 143794

SEQ ID NO: 453857 - RNA, 64 nt, Homo Sapiens; identical to SEQ ID NO: 143795

SEQ ID NO: 453858 - RNA, 64 nt, Homo Sapiens; identical to SEQ ID NO: 143796

SEQ ID NO: 453859 - RNA, 64 nt, Homo Sapiens; identical to SEQ ID NO: 143797

SEQ ID NO: 453860 - RNA, 64 nt, Homo Sapiens; identical to SEQ ID NO: 143798

SEQ ID NO: 453861 - RNA, 64 nt, Homo Sapiens; identical to SEQ ID NO: 143799

SEQ ID NO: 453862 - RNA, 64 nt, Homo Sapiens; identical to SEQ ID NO: 143800

SEQ ID NO: 453863 - RNA, 64 nt, Homo Sapiens; identical to SEQ ID NO: 143801

SEQ ID NO: 453864 - RNA, 64 nt, Homo Sapiens; identical to SEQ ID NO: 143802

SEQ ID NO: 453865 - RNA, 64 nt, Homo Sapiens; identical to SEQ ID NO: 143803

SEQ ID NO: 453866 - RNA, 64 nt, Homo Sapiens; identical to SEQ ID NO: 143804

SEQ ID NO: 453867 - RNA, 64 nt, Homo Sapiens; identical to SEQ ID NO: 143805

SEQ ID NO: 453868 - RNA, 64 nt, Homo Sapiens; identical to SEQ ID NO: 143806

SEQ ID NO: 453869 - RNA, 64 nt, Homo Sapiens; identical to SEQ ID NO: 143807

SEQ ID NO: 453870 - RNA, 64 nt, Homo Sapiens; identical to SEQ ID NO: 143808

SEQ ID NO: 453871 - RNA, 64 nt, Homo Sapiens; identical to SEQ ID NO: 143809

SEQ ID NO: 453872 - RNA, 64 nt, Homo Sapiens; identical to SEQ ID NO: 143810

SEQ ID NO: 453873 - RNA, 64 nt, Homo Sapiens; identical to SEQ ID NO: 143811

SEQ ID NO: 453874 - RNA, 64 nt, Homo Sapiens; identical to SEQ ID NO: 143812

SEQ ID NO: 453875 - RNA, 64 nt, Homo Sapiens; identical to SEQ ID NO: 307517

SEQ ID NO: 453876 - RNA, 64 nt, Homo Sapiens; identical to SEQ ID NO: 307518

SEQ ID NO: 453877 - RNA, 64 nt, Homo Sapiens; identical to SEQ ID NO: 307519

SEQ ID NO: 453878 - RNA, 64 nt, Homo Sapiens; identical to SEQ ID NO: 307520

SEQ ID NO: 453879 - RNA, 64 nt, Homo Sapiens; identical to SEQ ID NO: 307521

SEQ ID NO: 453880 - RNA, 64 nt, Homo Sapiens; identical to SEQ ID NO: 307522

SEQ ID NO: 453881 - RNA, 64 nt, Homo Sapiens; identical to SEQ ID NO: 307523

SEQ ID NO: 453882 - RNA, 64 nt, Homo Sapiens; identical to SEQ ID NO: 143712

SEQ ID NO: 453883 - RNA, 64 nt, Homo Sapiens; identical to SEQ ID NO: 143713

SEQ ID NO: 453884 - RNA, 64 nt, Homo Sapiens; identical to SEQ ID NO: 143714

SEQ ID NO: 453885 - RNA, 64 nt, Homo Sapiens; identical to SEQ ID NO: 143715

SEQ ID NO: 453886 - RNA, 64 nt, Homo Sapiens; identical to SEQ ID NO: 143716

SEQ ID NO: 453887 - RNA, 64 nt, Homo Sapiens; identical to SEQ ID NO: 143717

SEQ ID NO: 453888 - RNA, 64 nt, Homo Sapiens; identical to SEQ ID NO: 143718

SEQ ID NO: 453889 - RNA, 64 nt, Homo Sapiens; identical to SEQ ID NO: 143719

SEQ ID NO: 453890 - RNA, 64 nt, Homo Sapiens; identical to SEQ ID NO: 143720

SEQ ID NO: 453891 - RNA, 64 nt, Homo Sapiens; identical to SEQ ID NO: 143721

SEQ ID NO: 453892 - RNA, 64 nt, Homo Sapiens; identical to SEQ ID NO: 143722

SEQ ID NO: 453893 - RNA, 64 nt, Homo Sapiens; identical to SEQ ID NO: 143723

SEQ ID NO: 453894 - RNA, 64 nt, Homo Sapiens; identical to SEQ ID NO: 143724

SEQ ID NO: 453895 - RNA, 64 nt, Homo Sapiens; identical to SEQ ID NO: 143725

SEQ ID NO: 453896 - RNA, 64 nt, Homo Sapiens; identical to SEQ ID NO: 143726

SEQ ID NO: 453897 - RNA, 64 nt, Homo Sapiens; identical to SEQ ID NO: 143727

SEQ ID NO: 453898 - RNA, 64 nt, Homo Sapiens; identical to SEQ ID NO: 143728

SEQ ID NO: 453899 - RNA, 64 nt, Homo Sapiens; identical to SEQ ID NO: 143729

SEQ ID NO: 453900 - RNA, 64 nt, Homo Sapiens; identical to SEQ ID NO: 143730

SEQ ID NO: 453901 - RNA, 64 nt, Homo Sapiens; identical to SEQ ID NO: 143731

SEQ ID NO: 453902 - RNA, 64 nt, Homo Sapiens; identical to SEQ ID NO: 143732

SEQ ID NO: 453903 - RNA, 64 nt, Homo Sapiens; identical to SEQ ID NO: 143733

SEQ ID NO: 453904 - RNA, 64 nt, Homo Sapiens; identical to SEQ ID NO: 143734

SEQ ID NO: 453905 - RNA, 64 nt, Homo Sapiens; identical to SEQ ID NO: 143735

SEQ ID NO: 453906 - RNA, 64 nt, Homo Sapiens; identical to SEQ ID NO: 143736

SEQ ID NO: 453907 - RNA, 64 nt, Homo Sapiens; identical to SEQ ID NO: 143737

SEQ ID NO: 453908 - RNA, 64 nt, Homo Sapiens; identical to SEQ ID NO: 143738

SEQ ID NO: 453909 - RNA, 64 nt, Homo Sapiens; identical to SEQ ID NO: 143739

SEQ ID NO: 453910 - RNA, 64 nt, Homo Sapiens; identical to SEQ ID NO: 143740

SEQ ID NO: 453911 - RNA, 64 nt, Homo Sapiens; identical to SEQ ID NO: 143741

SEQ ID NO: 453912 - RNA, 64 nt, Homo Sapiens; identical to SEQ ID NO: 143742

SEQ ID NO: 453913 - RNA, 64 nt, Homo Sapiens; identical to SEQ ID NO: 143743

SEQ ID NO: 453914 - RNA, 64 nt, Homo Sapiens; identical to SEQ ID NO: 143744

SEQ ID NO: 453915 - RNA, 64 nt, Homo Sapiens; identical to SEQ ID NO: 143745

SEQ ID NO: 453916 - RNA, 64 nt, Homo Sapiens; identical to SEQ ID NO: 143746

SEQ ID NO: 453917 - RNA, 64 nt, Homo Sapiens; identical to SEQ ID NO: 143747

SEQ ID NO: 453918 - RNA, 64 nt, Homo Sapiens; identical to SEQ ID NO: 143748

SEQ ID NO: 453919 - RNA, 64 nt, Homo Sapiens; identical to SEQ ID NO: 143749

SEQ ID NO: 453920 - RNA, 64 nt, Homo Sapiens; identical to SEQ ID NO: 143750

SEQ ID NO: 453921 - RNA, 64 nt, Homo Sapiens; identical to SEQ ID NO: 143751

SEQ ID NO: 453922 - RNA, 64 nt, Homo Sapiens; identical to SEQ ID NO: 143752

SEQ ID NO: 453923 - RNA, 64 nt, Homo Sapiens; identical to SEQ ID NO: 143753

SEQ ID NO: 453924 - RNA, 64 nt, Homo Sapiens; identical to SEQ ID NO: 143754

SEQ ID NO: 453925 - RNA, 64 nt, Homo Sapiens; identical to SEQ ID NO: 143755

SEQ ID NO: 453926 - RNA, 64 nt, Homo Sapiens; identical to SEQ ID NO: 143756

SEQ ID NO: 453927 - RNA, 64 nt, Homo Sapiens; identical to SEQ ID NO: 143757

SEQ ID NO: 453928 - RNA, 64 nt, Homo Sapiens; identical to SEQ ID NO: 143758

SEQ ID NO: 453929 - RNA, 64 nt, Homo Sapiens; identical to SEQ ID NO: 143759

SEQ ID NO: 453930 - RNA, 64 nt, Homo Sapiens; identical to SEQ ID NO: 143760

SEQ ID NO: 453931 - RNA, 64 nt, Homo Sapiens; identical to SEQ ID NO: 143761

SEQ ID NO: 453932 - RNA, 64 nt, Homo Sapiens; identical to SEQ ID NO: 143762

SEQ ID NO: 453933 - RNA, 64 nt, Homo Sapiens; identical to SEQ ID NO: 143763

SEQ ID NO: 453934 - RNA, 64 nt, Homo Sapiens; identical to SEQ ID NO: 143764

SEQ ID NO: 453935 - RNA, 64 nt, Homo Sapiens; identical to SEQ ID NO: 143765

SEQ ID NO: 453936 - RNA, 64 nt, Homo Sapiens; identical to SEQ ID NO: 143766

SEQ ID NO: 453937 - RNA, 64 nt, Homo Sapiens; identical to SEQ ID NO: 143767

SEQ ID NO: 453938 - RNA, 64 nt, Homo Sapiens; identical to SEQ ID NO: 143768

SEQ ID NO: 453939 - RNA, 64 nt, Homo Sapiens; identical to SEQ ID NO: 143769

SEQ ID NO: 453940 - RNA, 64 nt, Homo Sapiens; identical to SEQ ID NO: 143770

SEQ ID NO: 453941 - RNA, 64 nt, Homo Sapiens; identical to SEQ ID NO: 143771

SEQ ID NO: 453942 - RNA, 64 nt, Homo Sapiens; identical to SEQ ID NO: 143772

SEQ ID NO: 453943 - RNA, 64 nt, Homo Sapiens; identical to SEQ ID NO: 143773

SEQ ID NO: 453944 - RNA, 64 nt, Homo Sapiens; identical to SEQ ID NO: 143774

SEQ ID NO: 453945 - RNA, 64 nt, Homo Sapiens; identical to SEQ ID NO: 143775

SEQ ID NO: 453946 - RNA, 64 nt, Homo Sapiens; identical to SEQ ID NO: 143776

SEQ ID NO: 453947 - RNA, 64 nt, Homo Sapiens; identical to SEQ ID NO: 143777

SEQ ID NO: 453948 - RNA, 64 nt, Homo Sapiens; identical to SEQ ID NO: 143778

SEQ ID NO: 453949 - RNA, 64 nt, Homo Sapiens; identical to SEQ ID NO: 143779

SEQ ID NO: 453950 - RNA, 64 nt, Homo Sapiens; identical to SEQ ID NO: 143780

SEQ ID NO: 453951 - RNA, 64 nt, Homo Sapiens; identical to SEQ ID NO: 143781

SEQ ID NO: 453952 - RNA, 64 nt, Homo Sapiens; identical to SEQ ID NO: 143782

SEQ ID NO: 453953 - RNA, 64 nt, Homo Sapiens; identical to SEQ ID NO: 143783

SEQ ID NO: 453954 - RNA, 64 nt, Homo Sapiens; identical to SEQ ID NO: 143784

SEQ ID NO: 453955 - RNA, 64 nt, Homo Sapiens; identical to SEQ ID NO: 143785

SEQ ID NO: 453956 - RNA, 64 nt, Homo Sapiens; identical to SEQ ID NO: 143786

SEQ ID NO: 453957 - RNA, 64 nt, Homo Sapiens; identical to SEQ ID NO: 143787

SEQ ID NO: 453958 - RNA, 64 nt, Homo Sapiens; identical to SEQ ID NO: 143788

SEQ ID NO: 453959 - RNA, 64 nt, Homo Sapiens; identical to SEQ ID NO: 143789

SEQ ID NO: 453960 - RNA, 57 nt, Homo Sapiens; identical to SEQ ID NO: 143790

SEQ ID NO: 453961 - RNA, 64 nt, Homo Sapiens; identical to SEQ ID NO: 143791

SEQ ID NO: 453962 - RNA, 64 nt, Homo Sapiens; identical to SEQ ID NO: 143792

SEQ ID NO: 453963 - RNA, 64 nt, Homo Sapiens; identical to SEQ ID NO: 143793

SEQ ID NO: 453964 - RNA, 64 nt, Homo Sapiens; identical to SEQ ID NO: 143794

SEQ ID NO: 453965 - RNA, 64 nt, Homo Sapiens; identical to SEQ ID NO: 143795

SEQ ID NO: 453966 - RNA, 64 nt, Homo Sapiens; identical to SEQ ID NO: 143796

SEQ ID NO: 453967 - RNA, 64 nt, Homo Sapiens; identical to SEQ ID NO: 143797

SEQ ID NO: 453968 - RNA, 64 nt, Homo Sapiens; identical to SEQ ID NO: 143798

SEQ ID NO: 453969 - RNA, 64 nt, Homo Sapiens; identical to SEQ ID NO: 143799

SEQ ID NO: 453970 - RNA, 64 nt, Homo Sapiens; identical to SEQ ID NO: 143800

SEQ ID NO: 453971 - RNA, 64 nt, Homo Sapiens; identical to SEQ ID NO: 143801

SEQ ID NO: 453972 - RNA, 64 nt, Homo Sapiens; identical to SEQ ID NO: 143802

SEQ ID NO: 453973 - RNA, 64 nt, Homo Sapiens; identical to SEQ ID NO: 143803

SEQ ID NO: 453974 - RNA, 64 nt, Homo Sapiens; identical to SEQ ID NO: 143804

SEQ ID NO: 453975 - RNA, 64 nt, Homo Sapiens; identical to SEQ ID NO: 143805

SEQ ID NO: 453976 - RNA, 64 nt, Homo Sapiens; identical to SEQ ID NO: 143806

SEQ ID NO: 453977 - RNA, 64 nt, Homo Sapiens; identical to SEQ ID NO: 143807

SEQ ID NO: 453978 - RNA, 64 nt, Homo Sapiens; identical to SEQ ID NO: 143808

SEQ ID NO: 453979 - RNA, 64 nt, Homo Sapiens; identical to SEQ ID NO: 143809

SEQ ID NO: 453980 - RNA, 64 nt, Homo Sapiens; identical to SEQ ID NO: 143810

SEQ ID NO: 453981 - RNA, 64 nt, Homo Sapiens; identical to SEQ ID NO: 143811

SEQ ID NO: 453982 - RNA, 64 nt, Homo Sapiens; identical to SEQ ID NO: 143812

SEQ ID NO: 453983 - RNA, 64 nt, Homo Sapiens; identical to SEQ ID NO: 307517

SEQ ID NO: 453984 - RNA, 64 nt, Homo Sapiens; identical to SEQ ID NO: 307518

SEQ ID NO: 453985 - RNA, 64 nt, Homo Sapiens; identical to SEQ ID NO: 307519

SEQ ID NO: 453986 - RNA, 64 nt, Homo Sapiens; identical to SEQ ID NO: 307520

SEQ ID NO: 453987 - RNA, 64 nt, Homo Sapiens; identical to SEQ ID NO: 307521

SEQ ID NO: 453988 - RNA, 64 nt, Homo Sapiens; identical to SEQ ID NO: 307522

SEQ ID NO: 453989 - RNA, 64 nt, Homo Sapiens; identical to SEQ ID NO: 307523

SEQ ID NO: 453990 - RNA, 64 nt, Homo Sapiens; identical to SEQ ID NO: 143712

SEQ ID NO: 453991 - RNA, 64 nt, Homo Sapiens; identical to SEQ ID NO: 143713

SEQ ID NO: 453992 - RNA, 64 nt, Homo Sapiens; identical to SEQ ID NO: 143714

SEQ ID NO: 453993 - RNA, 64 nt, Homo Sapiens; identical to SEQ ID NO: 143715

SEQ ID NO: 453994 - RNA, 64 nt, Homo Sapiens; identical to SEQ ID NO: 143716

SEQ ID NO: 453995 - RNA, 64 nt, Homo Sapiens; identical to SEQ ID NO: 143717

SEQ ID NO: 453996 - RNA, 64 nt, Homo Sapiens; identical to SEQ ID NO: 143718

SEQ ID NO: 453997 - RNA, 64 nt, Homo Sapiens; identical to SEQ ID NO: 143719

SEQ ID NO: 453998 - RNA, 64 nt, Homo Sapiens; identical to SEQ ID NO: 143720

SEQ ID NO: 453999 - RNA, 64 nt, Homo Sapiens; identical to SEQ ID NO: 143721

SEQ ID NO: 454000 - RNA, 64 nt, Homo Sapiens; identical to SEQ ID NO: 143722

SEQ ID NO: 454001 - RNA, 64 nt, Homo Sapiens; identical to SEQ ID NO: 143723

SEQ ID NO: 454002 - RNA, 64 nt, Homo Sapiens; identical to SEQ ID NO: 143724

SEQ ID NO: 454003 - RNA, 64 nt, Homo Sapiens; identical to SEQ ID NO: 143725

SEQ ID NO: 454004 - RNA, 64 nt, Homo Sapiens; identical to SEQ ID NO: 143726

SEQ ID NO: 454005 - RNA, 64 nt, Homo Sapiens; identical to SEQ ID NO: 143727

SEQ ID NO: 454006 - RNA, 64 nt, Homo Sapiens; identical to SEQ ID NO: 143728

SEQ ID NO: 454007 - RNA, 64 nt, Homo Sapiens; identical to SEQ ID NO: 143729

SEQ ID NO: 454008 - RNA, 64 nt, Homo Sapiens; identical to SEQ ID NO: 143730

SEQ ID NO: 454009 - RNA, 64 nt, Homo Sapiens; identical to SEQ ID NO: 143731

SEQ ID NO: 454010 - RNA, 64 nt, Homo Sapiens; identical to SEQ ID NO: 143732

SEQ ID NO: 454011 - RNA, 64 nt, Homo Sapiens; identical to SEQ ID NO: 143733

SEQ ID NO: 454012 - RNA, 64 nt, Homo Sapiens; identical to SEQ ID NO: 143734

SEQ ID NO: 454013 - RNA, 64 nt, Homo Sapiens; identical to SEQ ID NO: 143735

SEQ ID NO: 454014 - RNA, 64 nt, Homo Sapiens; identical to SEQ ID NO: 143736

SEQ ID NO: 454015 - RNA, 64 nt, Homo Sapiens; identical to SEQ ID NO: 143737

SEQ ID NO: 454016 - RNA, 64 nt, Homo Sapiens; identical to SEQ ID NO: 143738

SEQ ID NO: 454017 - RNA, 64 nt, Homo Sapiens; identical to SEQ ID NO: 143739

SEQ ID NO: 454018 - RNA, 64 nt, Homo Sapiens; identical to SEQ ID NO: 143740

SEQ ID NO: 454019 - RNA, 64 nt, Homo Sapiens; identical to SEQ ID NO: 143741

SEQ ID NO: 454020 - RNA, 64 nt, Homo Sapiens; identical to SEQ ID NO: 143742

SEQ ID NO: 454021 - RNA, 64 nt, Homo Sapiens; identical to SEQ ID NO: 143743

SEQ ID NO: 454022 - RNA, 64 nt, Homo Sapiens; identical to SEQ ID NO: 143744

SEQ ID NO: 454023 - RNA, 64 nt, Homo Sapiens; identical to SEQ ID NO: 143745

SEQ ID NO: 454024 - RNA, 64 nt, Homo Sapiens; identical to SEQ ID NO: 143746

SEQ ID NO: 454025 - RNA, 64 nt, Homo Sapiens; identical to SEQ ID NO: 143747

SEQ ID NO: 454026 - RNA, 64 nt, Homo Sapiens; identical to SEQ ID NO: 143748

SEQ ID NO: 454027 - RNA, 64 nt, Homo Sapiens; identical to SEQ ID NO: 143749

SEQ ID NO: 454028 - RNA, 64 nt, Homo Sapiens; identical to SEQ ID NO: 143750

SEQ ID NO: 454029 - RNA, 64 nt, Homo Sapiens; identical to SEQ ID NO: 143751

SEQ ID NO: 454030 - RNA, 64 nt, Homo Sapiens; identical to SEQ ID NO: 143752

SEQ ID NO: 454031 - RNA, 64 nt, Homo Sapiens; identical to SEQ ID NO: 143753

SEQ ID NO: 454032 - RNA, 64 nt, Homo Sapiens; identical to SEQ ID NO: 143754

SEQ ID NO: 454033 - RNA, 64 nt, Homo Sapiens; identical to SEQ ID NO: 143755

SEQ ID NO: 454034 - RNA, 64 nt, Homo Sapiens; identical to SEQ ID NO: 143756

SEQ ID NO: 454035 - RNA, 64 nt, Homo Sapiens; identical to SEQ ID NO: 143757

SEQ ID NO: 454036 - RNA, 64 nt, Homo Sapiens; identical to SEQ ID NO: 143758

SEQ ID NO: 454037 - RNA, 64 nt, Homo Sapiens; identical to SEQ ID NO: 143759

SEQ ID NO: 454038 - RNA, 64 nt, Homo Sapiens; identical to SEQ ID NO: 143760

SEQ ID NO: 454039 - RNA, 64 nt, Homo Sapiens; identical to SEQ ID NO: 143761

SEQ ID NO: 454040 - RNA, 64 nt, Homo Sapiens; identical to SEQ ID NO: 143762

SEQ ID NO: 454041 - RNA, 64 nt, Homo Sapiens; identical to SEQ ID NO: 143763

SEQ ID NO: 454042 - RNA, 64 nt, Homo Sapiens; identical to SEQ ID NO: 143764

SEQ ID NO: 454043 - RNA, 64 nt, Homo Sapiens; identical to SEQ ID NO: 143765

SEQ ID NO: 454044 - RNA, 64 nt, Homo Sapiens; identical to SEQ ID NO: 143766

SEQ ID NO: 454045 - RNA, 64 nt, Homo Sapiens; identical to SEQ ID NO: 143767

SEQ ID NO: 454046 - RNA, 64 nt, Homo Sapiens; identical to SEQ ID NO: 143768

SEQ ID NO: 454047 - RNA, 64 nt, Homo Sapiens; identical to SEQ ID NO: 143769

SEQ ID NO: 454048 - RNA, 64 nt, Homo Sapiens; identical to SEQ ID NO: 143770

SEQ ID NO: 454049 - RNA, 64 nt, Homo Sapiens; identical to SEQ ID NO: 143771

SEQ ID NO: 454050 - RNA, 64 nt, Homo Sapiens; identical to SEQ ID NO: 143772

SEQ ID NO: 454051 - RNA, 64 nt, Homo Sapiens; identical to SEQ ID NO: 143773

SEQ ID NO: 454052 - RNA, 64 nt, Homo Sapiens; identical to SEQ ID NO: 143774

SEQ ID NO: 454053 - RNA, 64 nt, Homo Sapiens; identical to SEQ ID NO: 143775

SEQ ID NO: 454054 - RNA, 64 nt, Homo Sapiens; identical to SEQ ID NO: 143776

SEQ ID NO: 454055 - RNA, 64 nt, Homo Sapiens; identical to SEQ ID NO: 143777

SEQ ID NO: 454056 - RNA, 64 nt, Homo Sapiens; identical to SEQ ID NO: 143778

SEQ ID NO: 454057 - RNA, 64 nt, Homo Sapiens; identical to SEQ ID NO: 143779

SEQ ID NO: 454058 - RNA, 64 nt, Homo Sapiens; identical to SEQ ID NO: 143780

SEQ ID NO: 454059 - RNA, 64 nt, Homo Sapiens; identical to SEQ ID NO: 143781

SEQ ID NO: 454060 - RNA, 64 nt, Homo Sapiens; identical to SEQ ID NO: 143782

SEQ ID NO: 454061 - RNA, 64 nt, Homo Sapiens; identical to SEQ ID NO: 143783

SEQ ID NO: 454062 - RNA, 64 nt, Homo Sapiens; identical to SEQ ID NO: 143784

SEQ ID NO: 454063 - RNA, 64 nt, Homo Sapiens; identical to SEQ ID NO: 143785

SEQ ID NO: 454064 - RNA, 64 nt, Homo Sapiens; identical to SEQ ID NO: 143786

SEQ ID NO: 454065 - RNA, 64 nt, Homo Sapiens; identical to SEQ ID NO: 143787

SEQ ID NO: 454066 - RNA, 64 nt, Homo Sapiens; identical to SEQ ID NO: 143788

SEQ ID NO: 454067 - RNA, 64 nt, Homo Sapiens; identical to SEQ ID NO: 143789

SEQ ID NO: 454068 - RNA, 57 nt, Homo Sapiens; identical to SEQ ID NO: 143790

SEQ ID NO: 454069 - RNA, 64 nt, Homo Sapiens; identical to SEQ ID NO: 143791

SEQ ID NO: 454070 - RNA, 64 nt, Homo Sapiens; identical to SEQ ID NO: 143792

SEQ ID NO: 454071 - RNA, 64 nt, Homo Sapiens; identical to SEQ ID NO: 143793

SEQ ID NO: 454072 - RNA, 64 nt, Homo Sapiens; identical to SEQ ID NO: 143794

SEQ ID NO: 454073 - RNA, 64 nt, Homo Sapiens; identical to SEQ ID NO: 143795

SEQ ID NO: 454074 - RNA, 64 nt, Homo Sapiens; identical to SEQ ID NO: 143796

SEQ ID NO: 454075 - RNA, 64 nt, Homo Sapiens; identical to SEQ ID NO: 143797

SEQ ID NO: 454076 - RNA, 64 nt, Homo Sapiens; identical to SEQ ID NO: 143798

SEQ ID NO: 454077 - RNA, 64 nt, Homo Sapiens; identical to SEQ ID NO: 143799

SEQ ID NO: 454078 - RNA, 64 nt, Homo Sapiens; identical to SEQ ID NO: 143800

SEQ ID NO: 454079 - RNA, 64 nt, Homo Sapiens; identical to SEQ ID NO: 143801

SEQ ID NO: 454080 - RNA, 64 nt, Homo Sapiens; identical to SEQ ID NO: 143802

SEQ ID NO: 454081 - RNA, 64 nt, Homo Sapiens; identical to SEQ ID NO: 143803

SEQ ID NO: 454082 - RNA, 64 nt, Homo Sapiens; identical to SEQ ID NO: 143804

SEQ ID NO: 454083 - RNA, 64 nt, Homo Sapiens; identical to SEQ ID NO: 143805

SEQ ID NO: 454084 - RNA, 64 nt, Homo Sapiens; identical to SEQ ID NO: 143806

SEQ ID NO: 454085 - RNA, 64 nt, Homo Sapiens; identical to SEQ ID NO: 143807

SEQ ID NO: 454086 - RNA, 64 nt, Homo Sapiens; identical to SEQ ID NO: 143808

SEQ ID NO: 454087 - RNA, 64 nt, Homo Sapiens; identical to SEQ ID NO: 143809

SEQ ID NO: 454088 - RNA, 64 nt, Homo Sapiens; identical to SEQ ID NO: 143810

SEQ ID NO: 454089 - RNA, 64 nt, Homo Sapiens; identical to SEQ ID NO: 143811

SEQ ID NO: 454090 - RNA, 64 nt, Homo Sapiens; identical to SEQ ID NO: 143812

SEQ ID NO: 454091 - RNA, 64 nt, Homo Sapiens; identical to SEQ ID NO: 307517

SEQ ID NO: 454092 - RNA, 64 nt, Homo Sapiens; identical to SEQ ID NO: 307518

SEQ ID NO: 454093 - RNA, 64 nt, Homo Sapiens; identical to SEQ ID NO: 307519

SEQ ID NO: 454094 - RNA, 64 nt, Homo Sapiens; identical to SEQ ID NO: 307520

SEQ ID NO: 454095 - RNA, 64 nt, Homo Sapiens; identical to SEQ ID NO: 307521

SEQ ID NO: 454096 - RNA, 64 nt, Homo Sapiens; identical to SEQ ID NO: 307522

SEQ ID NO: 454097 - RNA, 64 nt, Homo Sapiens; identical to SEQ ID NO: 307523

SEQ ID NO: 454098 - RNA, 64 nt, Homo Sapiens; identical to SEQ ID NO: 143712

SEQ ID NO: 454099 - RNA, 64 nt, Homo Sapiens; identical to SEQ ID NO: 143713

SEQ ID NO: 454100 - RNA, 64 nt, Homo Sapiens; identical to SEQ ID NO: 143714

SEQ ID NO: 454101 - RNA, 64 nt, Homo Sapiens; identical to SEQ ID NO: 143715

SEQ ID NO: 454102 - RNA, 64 nt, Homo Sapiens; identical to SEQ ID NO: 143716

SEQ ID NO: 454103 - RNA, 64 nt, Homo Sapiens; identical to SEQ ID NO: 143717

SEQ ID NO: 454104 - RNA, 64 nt, Homo Sapiens; identical to SEQ ID NO: 143718

SEQ ID NO: 454105 - RNA, 64 nt, Homo Sapiens; identical to SEQ ID NO: 143719

SEQ ID NO: 454106 - RNA, 64 nt, Homo Sapiens; identical to SEQ ID NO: 143720

SEQ ID NO: 454107 - RNA, 64 nt, Homo Sapiens; identical to SEQ ID NO: 143721

SEQ ID NO: 454108 - RNA, 64 nt, Homo Sapiens; identical to SEQ ID NO: 143722

SEQ ID NO: 454109 - RNA, 64 nt, Homo Sapiens; identical to SEQ ID NO: 143723

SEQ ID NO: 454110 - RNA, 64 nt, Homo Sapiens; identical to SEQ ID NO: 143724

SEQ ID NO: 454111 - RNA, 64 nt, Homo Sapiens; identical to SEQ ID NO: 143725

SEQ ID NO: 454112 - RNA, 64 nt, Homo Sapiens; identical to SEQ ID NO: 143726

SEQ ID NO: 454113 - RNA, 64 nt, Homo Sapiens; identical to SEQ ID NO: 143727

SEQ ID NO: 454114 - RNA, 64 nt, Homo Sapiens; identical to SEQ ID NO: 143728

SEQ ID NO: 454115 - RNA, 64 nt, Homo Sapiens; identical to SEQ ID NO: 143729

SEQ ID NO: 454116 - RNA, 64 nt, Homo Sapiens; identical to SEQ ID NO: 143730

SEQ ID NO: 454117 - RNA, 64 nt, Homo Sapiens; identical to SEQ ID NO: 143731

SEQ ID NO: 454118 - RNA, 64 nt, Homo Sapiens; identical to SEQ ID NO: 143732

SEQ ID NO: 454119 - RNA, 64 nt, Homo Sapiens; identical to SEQ ID NO: 143733

SEQ ID NO: 454120 - RNA, 64 nt, Homo Sapiens; identical to SEQ ID NO: 143734

SEQ ID NO: 454121 - RNA, 64 nt, Homo Sapiens; identical to SEQ ID NO: 143735

SEQ ID NO: 454122 - RNA, 64 nt, Homo Sapiens; identical to SEQ ID NO: 143736

SEQ ID NO: 454123 - RNA, 64 nt, Homo Sapiens; identical to SEQ ID NO: 143737

SEQ ID NO: 454124 - RNA, 64 nt, Homo Sapiens; identical to SEQ ID NO: 143738

SEQ ID NO: 454125 - RNA, 64 nt, Homo Sapiens; identical to SEQ ID NO: 143739

SEQ ID NO: 454126 - RNA, 64 nt, Homo Sapiens; identical to SEQ ID NO: 143740

SEQ ID NO: 454127 - RNA, 64 nt, Homo Sapiens; identical to SEQ ID NO: 143741

SEQ ID NO: 454128 - RNA, 64 nt, Homo Sapiens; identical to SEQ ID NO: 143742

SEQ ID NO: 454129 - RNA, 64 nt, Homo Sapiens; identical to SEQ ID NO: 143743

SEQ ID NO: 454130 - RNA, 64 nt, Homo Sapiens; identical to SEQ ID NO: 143744

SEQ ID NO: 454131 - RNA, 64 nt, Homo Sapiens; identical to SEQ ID NO: 143745

SEQ ID NO: 454132 - RNA, 64 nt, Homo Sapiens; identical to SEQ ID NO: 143746

SEQ ID NO: 454133 - RNA, 64 nt, Homo Sapiens; identical to SEQ ID NO: 143747

SEQ ID NO: 454134 - RNA, 64 nt, Homo Sapiens; identical to SEQ ID NO: 143748

SEQ ID NO: 454135 - RNA, 64 nt, Homo Sapiens; identical to SEQ ID NO: 143749

SEQ ID NO: 454136 - RNA, 64 nt, Homo Sapiens; identical to SEQ ID NO: 143750

SEQ ID NO: 454137 - RNA, 64 nt, Homo Sapiens; identical to SEQ ID NO: 143751

SEQ ID NO: 454138 - RNA, 64 nt, Homo Sapiens; identical to SEQ ID NO: 143752

SEQ ID NO: 454139 - RNA, 64 nt, Homo Sapiens; identical to SEQ ID NO: 143753

SEQ ID NO: 454140 - RNA, 64 nt, Homo Sapiens; identical to SEQ ID NO: 143754

SEQ ID NO: 454141 - RNA, 64 nt, Homo Sapiens; identical to SEQ ID NO: 143755

SEQ ID NO: 454142 - RNA, 64 nt, Homo Sapiens; identical to SEQ ID NO: 143756

SEQ ID NO: 454143 - RNA, 64 nt, Homo Sapiens; identical to SEQ ID NO: 143757

SEQ ID NO: 454144 - RNA, 64 nt, Homo Sapiens; identical to SEQ ID NO: 143758

SEQ ID NO: 454145 - RNA, 64 nt, Homo Sapiens; identical to SEQ ID NO: 143759

SEQ ID NO: 454146 - RNA, 64 nt, Homo Sapiens; identical to SEQ ID NO: 143760

SEQ ID NO: 454147 - RNA, 64 nt, Homo Sapiens; identical to SEQ ID NO: 143761

SEQ ID NO: 454148 - RNA, 64 nt, Homo Sapiens; identical to SEQ ID NO: 143762

SEQ ID NO: 454149 - RNA, 64 nt, Homo Sapiens; identical to SEQ ID NO: 143763

SEQ ID NO: 454150 - RNA, 64 nt, Homo Sapiens; identical to SEQ ID NO: 143764

SEQ ID NO: 454151 - RNA, 64 nt, Homo Sapiens; identical to SEQ ID NO: 143765

SEQ ID NO: 454152 - RNA, 64 nt, Homo Sapiens; identical to SEQ ID NO: 143766

SEQ ID NO: 454153 - RNA, 64 nt, Homo Sapiens; identical to SEQ ID NO: 143767

SEQ ID NO: 454154 - RNA, 64 nt, Homo Sapiens; identical to SEQ ID NO: 143768

SEQ ID NO: 454155 - RNA, 64 nt, Homo Sapiens; identical to SEQ ID NO: 143769

SEQ ID NO: 454156 - RNA, 64 nt, Homo Sapiens; identical to SEQ ID NO: 143770

SEQ ID NO: 454157 - RNA, 64 nt, Homo Sapiens; identical to SEQ ID NO: 143771

SEQ ID NO: 454158 - RNA, 64 nt, Homo Sapiens; identical to SEQ ID NO: 143772

SEQ ID NO: 454159 - RNA, 64 nt, Homo Sapiens; identical to SEQ ID NO: 143773

SEQ ID NO: 454160 - RNA, 64 nt, Homo Sapiens; identical to SEQ ID NO: 143774

SEQ ID NO: 454161 - RNA, 64 nt, Homo Sapiens; identical to SEQ ID NO: 143775

SEQ ID NO: 454162 - RNA, 64 nt, Homo Sapiens; identical to SEQ ID NO: 143776

SEQ ID NO: 454163 - RNA, 64 nt, Homo Sapiens; identical to SEQ ID NO: 143777

SEQ ID NO: 454164 - RNA, 64 nt, Homo Sapiens; identical to SEQ ID NO: 143778

SEQ ID NO: 454165 - RNA, 64 nt, Homo Sapiens; identical to SEQ ID NO: 143779

SEQ ID NO: 454166 - RNA, 64 nt, Homo Sapiens; identical to SEQ ID NO: 143780

SEQ ID NO: 454167 - RNA, 64 nt, Homo Sapiens; identical to SEQ ID NO: 143781

SEQ ID NO: 454168 - RNA, 64 nt, Homo Sapiens; identical to SEQ ID NO: 143782

SEQ ID NO: 454169 - RNA, 64 nt, Homo Sapiens; identical to SEQ ID NO: 143783

SEQ ID NO: 454170 - RNA, 64 nt, Homo Sapiens; identical to SEQ ID NO: 143784

SEQ ID NO: 454171 - RNA, 64 nt, Homo Sapiens; identical to SEQ ID NO: 143785

SEQ ID NO: 454172 - RNA, 64 nt, Homo Sapiens; identical to SEQ ID NO: 143786

SEQ ID NO: 454173 - RNA, 64 nt, Homo Sapiens; identical to SEQ ID NO: 143787

SEQ ID NO: 454174 - RNA, 64 nt, Homo Sapiens; identical to SEQ ID NO: 143788

SEQ ID NO: 454175 - RNA, 64 nt, Homo Sapiens; identical to SEQ ID NO: 143789

SEQ ID NO: 454176 - RNA, 57 nt, Homo Sapiens; identical to SEQ ID NO: 143790

SEQ ID NO: 454177 - RNA, 64 nt, Homo Sapiens; identical to SEQ ID NO: 143791

SEQ ID NO: 454178 - RNA, 64 nt, Homo Sapiens; identical to SEQ ID NO: 143792

SEQ ID NO: 454179 - RNA, 64 nt, Homo Sapiens; identical to SEQ ID NO: 143793

SEQ ID NO: 454180 - RNA, 64 nt, Homo Sapiens; identical to SEQ ID NO: 143794

SEQ ID NO: 454181 - RNA, 64 nt, Homo Sapiens; identical to SEQ ID NO: 143795

SEQ ID NO: 454182 - RNA, 64 nt, Homo Sapiens; identical to SEQ ID NO: 143796

SEQ ID NO: 454183 - RNA, 64 nt, Homo Sapiens; identical to SEQ ID NO: 143797

SEQ ID NO: 454184 - RNA, 64 nt, Homo Sapiens; identical to SEQ ID NO: 143798

SEQ ID NO: 454185 - RNA, 64 nt, Homo Sapiens; identical to SEQ ID NO: 143799

SEQ ID NO: 454186 - RNA, 64 nt, Homo Sapiens; identical to SEQ ID NO: 143800

SEQ ID NO: 454187 - RNA, 64 nt, Homo Sapiens; identical to SEQ ID NO: 143801

SEQ ID NO: 454188 - RNA, 64 nt, Homo Sapiens; identical to SEQ ID NO: 143802

SEQ ID NO: 454189 - RNA, 64 nt, Homo Sapiens; identical to SEQ ID NO: 143803

SEQ ID NO: 454190 - RNA, 64 nt, Homo Sapiens; identical to SEQ ID NO: 143804

SEQ ID NO: 454191 - RNA, 64 nt, Homo Sapiens; identical to SEQ ID NO: 143805

SEQ ID NO: 454192 - RNA, 64 nt, Homo Sapiens; identical to SEQ ID NO: 143806

SEQ ID NO: 454193 - RNA, 64 nt, Homo Sapiens; identical to SEQ ID NO: 143807

SEQ ID NO: 454194 - RNA, 64 nt, Homo Sapiens; identical to SEQ ID NO: 143808

SEQ ID NO: 454195 - RNA, 64 nt, Homo Sapiens; identical to SEQ ID NO: 143809

SEQ ID NO: 454196 - RNA, 64 nt, Homo Sapiens; identical to SEQ ID NO: 143810

SEQ ID NO: 454197 - RNA, 64 nt, Homo Sapiens; identical to SEQ ID NO: 143811

SEQ ID NO: 454198 - RNA, 64 nt, Homo Sapiens; identical to SEQ ID NO: 143812

SEQ ID NO: 454199 - RNA, 64 nt, Homo Sapiens; identical to SEQ ID NO: 307517

SEQ ID NO: 454200 - RNA, 64 nt, Homo Sapiens; identical to SEQ ID NO: 307518

SEQ ID NO: 454201 - RNA, 64 nt, Homo Sapiens; identical to SEQ ID NO: 307519

SEQ ID NO: 454202 - RNA, 64 nt, Homo Sapiens; identical to SEQ ID NO: 307520

SEQ ID NO: 454203 - RNA, 64 nt, Homo Sapiens; identical to SEQ ID NO: 307521

SEQ ID NO: 454204 - RNA, 64 nt, Homo Sapiens; identical to SEQ ID NO: 307522

SEQ ID NO: 454205 - RNA, 64 nt, Homo Sapiens; identical to SEQ ID NO: 307523

SEQ ID NO: 454206 - RNA, 64 nt, Homo Sapiens; identical to SEQ ID NO: 143712

SEQ ID NO: 454207 - RNA, 64 nt, Homo Sapiens; identical to SEQ ID NO: 143713

SEQ ID NO: 454208 - RNA, 64 nt, Homo Sapiens; identical to SEQ ID NO: 143714

SEQ ID NO: 454209 - RNA, 64 nt, Homo Sapiens; identical to SEQ ID NO: 143715

SEQ ID NO: 454210 - RNA, 64 nt, Homo Sapiens; identical to SEQ ID NO: 143716

SEQ ID NO: 454211 - RNA, 64 nt, Homo Sapiens; identical to SEQ ID NO: 143717

SEQ ID NO: 454212 - RNA, 64 nt, Homo Sapiens; identical to SEQ ID NO: 143718

SEQ ID NO: 454213 - RNA, 64 nt, Homo Sapiens; identical to SEQ ID NO: 143719

SEQ ID NO: 454214 - RNA, 64 nt, Homo Sapiens; identical to SEQ ID NO: 143720

SEQ ID NO: 454215 - RNA, 64 nt, Homo Sapiens; identical to SEQ ID NO: 143721

SEQ ID NO: 454216 - RNA, 64 nt, Homo Sapiens; identical to SEQ ID NO: 143722

SEQ ID NO: 454217 - RNA, 64 nt, Homo Sapiens; identical to SEQ ID NO: 143723

SEQ ID NO: 454218 - RNA, 64 nt, Homo Sapiens; identical to SEQ ID NO: 143724

SEQ ID NO: 454219 - RNA, 64 nt, Homo Sapiens; identical to SEQ ID NO: 143725

SEQ ID NO: 454220 - RNA, 64 nt, Homo Sapiens; identical to SEQ ID NO: 143726

SEQ ID NO: 454221 - RNA, 64 nt, Homo Sapiens; identical to SEQ ID NO: 143727

SEQ ID NO: 454222 - RNA, 64 nt, Homo Sapiens; identical to SEQ ID NO: 143728

SEQ ID NO: 454223 - RNA, 64 nt, Homo Sapiens; identical to SEQ ID NO: 143729

SEQ ID NO: 454224 - RNA, 64 nt, Homo Sapiens; identical to SEQ ID NO: 143730

SEQ ID NO: 454225 - RNA, 64 nt, Homo Sapiens; identical to SEQ ID NO: 143731

SEQ ID NO: 454226 - RNA, 64 nt, Homo Sapiens; identical to SEQ ID NO: 143732

SEQ ID NO: 454227 - RNA, 64 nt, Homo Sapiens; identical to SEQ ID NO: 143733

SEQ ID NO: 454228 - RNA, 64 nt, Homo Sapiens; identical to SEQ ID NO: 143734

SEQ ID NO: 454229 - RNA, 64 nt, Homo Sapiens; identical to SEQ ID NO: 143735

SEQ ID NO: 454230 - RNA, 64 nt, Homo Sapiens; identical to SEQ ID NO: 143736

SEQ ID NO: 454231 - RNA, 64 nt, Homo Sapiens; identical to SEQ ID NO: 143737

SEQ ID NO: 454232 - RNA, 64 nt, Homo Sapiens; identical to SEQ ID NO: 143738

SEQ ID NO: 454233 - RNA, 64 nt, Homo Sapiens; identical to SEQ ID NO: 143739

SEQ ID NO: 454234 - RNA, 64 nt, Homo Sapiens; identical to SEQ ID NO: 143740

SEQ ID NO: 454235 - RNA, 64 nt, Homo Sapiens; identical to SEQ ID NO: 143741

SEQ ID NO: 454236 - RNA, 64 nt, Homo Sapiens; identical to SEQ ID NO: 143742

SEQ ID NO: 454237 - RNA, 64 nt, Homo Sapiens; identical to SEQ ID NO: 143743

SEQ ID NO: 454238 - RNA, 64 nt, Homo Sapiens; identical to SEQ ID NO: 143744

SEQ ID NO: 454239 - RNA, 64 nt, Homo Sapiens; identical to SEQ ID NO: 143745

SEQ ID NO: 454240 - RNA, 64 nt, Homo Sapiens; identical to SEQ ID NO: 143746

SEQ ID NO: 454241 - RNA, 64 nt, Homo Sapiens; identical to SEQ ID NO: 143747

SEQ ID NO: 454242 - RNA, 64 nt, Homo Sapiens; identical to SEQ ID NO: 143748

SEQ ID NO: 454243 - RNA, 64 nt, Homo Sapiens; identical to SEQ ID NO: 143749

SEQ ID NO: 454244 - RNA, 64 nt, Homo Sapiens; identical to SEQ ID NO: 143750

SEQ ID NO: 454245 - RNA, 64 nt, Homo Sapiens; identical to SEQ ID NO: 143751

SEQ ID NO: 454246 - RNA, 64 nt, Homo Sapiens; identical to SEQ ID NO: 143752

SEQ ID NO: 454247 - RNA, 64 nt, Homo Sapiens; identical to SEQ ID NO: 143753

SEQ ID NO: 454248 - RNA, 64 nt, Homo Sapiens; identical to SEQ ID NO: 143754

SEQ ID NO: 454249 - RNA, 64 nt, Homo Sapiens; identical to SEQ ID NO: 143755

SEQ ID NO: 454250 - RNA, 64 nt, Homo Sapiens; identical to SEQ ID NO: 143756

SEQ ID NO: 454251 - RNA, 64 nt, Homo Sapiens; identical to SEQ ID NO: 143757

SEQ ID NO: 454252 - RNA, 64 nt, Homo Sapiens; identical to SEQ ID NO: 143758

SEQ ID NO: 454253 - RNA, 64 nt, Homo Sapiens; identical to SEQ ID NO: 143759

SEQ ID NO: 454254 - RNA, 64 nt, Homo Sapiens; identical to SEQ ID NO: 143760

SEQ ID NO: 454255 - RNA, 64 nt, Homo Sapiens; identical to SEQ ID NO: 143761

SEQ ID NO: 454256 - RNA, 64 nt, Homo Sapiens; identical to SEQ ID NO: 143762

SEQ ID NO: 454257 - RNA, 64 nt, Homo Sapiens; identical to SEQ ID NO: 143763

SEQ ID NO: 454258 - RNA, 64 nt, Homo Sapiens; identical to SEQ ID NO: 143764

SEQ ID NO: 454259 - RNA, 64 nt, Homo Sapiens; identical to SEQ ID NO: 143765

SEQ ID NO: 454260 - RNA, 64 nt, Homo Sapiens; identical to SEQ ID NO: 143766

SEQ ID NO: 454261 - RNA, 64 nt, Homo Sapiens; identical to SEQ ID NO: 143767

SEQ ID NO: 454262 - RNA, 64 nt, Homo Sapiens; identical to SEQ ID NO: 143768

SEQ ID NO: 454263 - RNA, 64 nt, Homo Sapiens; identical to SEQ ID NO: 143769

SEQ ID NO: 454264 - RNA, 64 nt, Homo Sapiens; identical to SEQ ID NO: 143770

SEQ ID NO: 454265 - RNA, 64 nt, Homo Sapiens; identical to SEQ ID NO: 143771

SEQ ID NO: 454266 - RNA, 64 nt, Homo Sapiens; identical to SEQ ID NO: 143772

SEQ ID NO: 454267 - RNA, 64 nt, Homo Sapiens; identical to SEQ ID NO: 143773

SEQ ID NO: 454268 - RNA, 64 nt, Homo Sapiens; identical to SEQ ID NO: 143774

SEQ ID NO: 454269 - RNA, 64 nt, Homo Sapiens; identical to SEQ ID NO: 143775

SEQ ID NO: 454270 - RNA, 64 nt, Homo Sapiens; identical to SEQ ID NO: 143776

SEQ ID NO: 454271 - RNA, 64 nt, Homo Sapiens; identical to SEQ ID NO: 143777

SEQ ID NO: 454272 - RNA, 64 nt, Homo Sapiens; identical to SEQ ID NO: 143778

SEQ ID NO: 454273 - RNA, 64 nt, Homo Sapiens; identical to SEQ ID NO: 143779

SEQ ID NO: 454274 - RNA, 64 nt, Homo Sapiens; identical to SEQ ID NO: 143780

SEQ ID NO: 454275 - RNA, 64 nt, Homo Sapiens; identical to SEQ ID NO: 143781

SEQ ID NO: 454276 - RNA, 64 nt, Homo Sapiens; identical to SEQ ID NO: 143782

SEQ ID NO: 454277 - RNA, 64 nt, Homo Sapiens; identical to SEQ ID NO: 143783

SEQ ID NO: 454278 - RNA, 64 nt, Homo Sapiens; identical to SEQ ID NO: 143784

SEQ ID NO: 454279 - RNA, 64 nt, Homo Sapiens; identical to SEQ ID NO: 143785

SEQ ID NO: 454280 - RNA, 64 nt, Homo Sapiens; identical to SEQ ID NO: 143786

SEQ ID NO: 454281 - RNA, 64 nt, Homo Sapiens; identical to SEQ ID NO: 143787

SEQ ID NO: 454282 - RNA, 64 nt, Homo Sapiens; identical to SEQ ID NO: 143788

SEQ ID NO: 454283 - RNA, 64 nt, Homo Sapiens; identical to SEQ ID NO: 143789

SEQ ID NO: 454284 - RNA, 57 nt, Homo Sapiens; identical to SEQ ID NO: 143790

SEQ ID NO: 454285 - RNA, 64 nt, Homo Sapiens; identical to SEQ ID NO: 143791

SEQ ID NO: 454286 - RNA, 64 nt, Homo Sapiens; identical to SEQ ID NO: 143792

SEQ ID NO: 454287 - RNA, 64 nt, Homo Sapiens; identical to SEQ ID NO: 143793

SEQ ID NO: 454288 - RNA, 64 nt, Homo Sapiens; identical to SEQ ID NO: 143794

SEQ ID NO: 454289 - RNA, 64 nt, Homo Sapiens; identical to SEQ ID NO: 143795

SEQ ID NO: 454290 - RNA, 64 nt, Homo Sapiens; identical to SEQ ID NO: 143796

SEQ ID NO: 454291 - RNA, 64 nt, Homo Sapiens; identical to SEQ ID NO: 143797

SEQ ID NO: 454292 - RNA, 64 nt, Homo Sapiens; identical to SEQ ID NO: 143798

SEQ ID NO: 454293 - RNA, 64 nt, Homo Sapiens; identical to SEQ ID NO: 143799

SEQ ID NO: 454294 - RNA, 64 nt, Homo Sapiens; identical to SEQ ID NO: 143800

SEQ ID NO: 454295 - RNA, 64 nt, Homo Sapiens; identical to SEQ ID NO: 143801

SEQ ID NO: 454296 - RNA, 64 nt, Homo Sapiens; identical to SEQ ID NO: 143802

SEQ ID NO: 454297 - RNA, 64 nt, Homo Sapiens; identical to SEQ ID NO: 143803

SEQ ID NO: 454298 - RNA, 64 nt, Homo Sapiens; identical to SEQ ID NO: 143804

SEQ ID NO: 454299 - RNA, 64 nt, Homo Sapiens; identical to SEQ ID NO: 143805

SEQ ID NO: 454300 - RNA, 64 nt, Homo Sapiens; identical to SEQ ID NO: 143806

SEQ ID NO: 454301 - RNA, 64 nt, Homo Sapiens; identical to SEQ ID NO: 143807

SEQ ID NO: 454302 - RNA, 64 nt, Homo Sapiens; identical to SEQ ID NO: 143808

SEQ ID NO: 454303 - RNA, 64 nt, Homo Sapiens; identical to SEQ ID NO: 143809

SEQ ID NO: 454304 - RNA, 64 nt, Homo Sapiens; identical to SEQ ID NO: 143810

SEQ ID NO: 454305 - RNA, 64 nt, Homo Sapiens; identical to SEQ ID NO: 143811

SEQ ID NO: 454306 - RNA, 64 nt, Homo Sapiens; identical to SEQ ID NO: 143812

SEQ ID NO: 454307 - RNA, 64 nt, Homo Sapiens; identical to SEQ ID NO: 307517

SEQ ID NO: 454308 - RNA, 64 nt, Homo Sapiens; identical to SEQ ID NO: 307518

SEQ ID NO: 454309 - RNA, 64 nt, Homo Sapiens; identical to SEQ ID NO: 307519

SEQ ID NO: 454310 - RNA, 64 nt, Homo Sapiens; identical to SEQ ID NO: 307520

SEQ ID NO: 454311 - RNA, 64 nt, Homo Sapiens; identical to SEQ ID NO: 307521

SEQ ID NO: 454312 - RNA, 64 nt, Homo Sapiens; identical to SEQ ID NO: 307522

SEQ ID NO: 454313 - RNA, 64 nt, Homo Sapiens; identical to SEQ ID NO: 307523

SEQ ID NO: 454314 - RNA, 64 nt, Homo Sapiens; identical to SEQ ID NO: 143712

SEQ ID NO: 454315 - RNA, 64 nt, Homo Sapiens; identical to SEQ ID NO: 143713

SEQ ID NO: 454316 - RNA, 64 nt, Homo Sapiens; identical to SEQ ID NO: 143714

SEQ ID NO: 454317 - RNA, 64 nt, Homo Sapiens; identical to SEQ ID NO: 143715

SEQ ID NO: 454318 - RNA, 64 nt, Homo Sapiens; identical to SEQ ID NO: 143716

SEQ ID NO: 454319 - RNA, 64 nt, Homo Sapiens; identical to SEQ ID NO: 143717

SEQ ID NO: 454320 - RNA, 64 nt, Homo Sapiens; identical to SEQ ID NO: 143718

SEQ ID NO: 454321 - RNA, 64 nt, Homo Sapiens; identical to SEQ ID NO: 143719

SEQ ID NO: 454322 - RNA, 64 nt, Homo Sapiens; identical to SEQ ID NO: 143720

SEQ ID NO: 454323 - RNA, 64 nt, Homo Sapiens; identical to SEQ ID NO: 143721

SEQ ID NO: 454324 - RNA, 64 nt, Homo Sapiens; identical to SEQ ID NO: 143722

SEQ ID NO: 454325 - RNA, 64 nt, Homo Sapiens; identical to SEQ ID NO: 143723

SEQ ID NO: 454326 - RNA, 64 nt, Homo Sapiens; identical to SEQ ID NO: 143724

SEQ ID NO: 454327 - RNA, 64 nt, Homo Sapiens; identical to SEQ ID NO: 143725

SEQ ID NO: 454328 - RNA, 64 nt, Homo Sapiens; identical to SEQ ID NO: 143726

SEQ ID NO: 454329 - RNA, 64 nt, Homo Sapiens; identical to SEQ ID NO: 143727

SEQ ID NO: 454330 - RNA, 64 nt, Homo Sapiens; identical to SEQ ID NO: 143728

SEQ ID NO: 454331 - RNA, 64 nt, Homo Sapiens; identical to SEQ ID NO: 143729

SEQ ID NO: 454332 - RNA, 64 nt, Homo Sapiens; identical to SEQ ID NO: 143730

SEQ ID NO: 454333 - RNA, 64 nt, Homo Sapiens; identical to SEQ ID NO: 143731

SEQ ID NO: 454334 - RNA, 64 nt, Homo Sapiens; identical to SEQ ID NO: 143732

SEQ ID NO: 454335 - RNA, 64 nt, Homo Sapiens; identical to SEQ ID NO: 143733

SEQ ID NO: 454336 - RNA, 64 nt, Homo Sapiens; identical to SEQ ID NO: 143734

SEQ ID NO: 454337 - RNA, 64 nt, Homo Sapiens; identical to SEQ ID NO: 143735

SEQ ID NO: 454338 - RNA, 64 nt, Homo Sapiens; identical to SEQ ID NO: 143736

SEQ ID NO: 454339 - RNA, 64 nt, Homo Sapiens; identical to SEQ ID NO: 143737

SEQ ID NO: 454340 - RNA, 64 nt, Homo Sapiens; identical to SEQ ID NO: 143738

SEQ ID NO: 454341 - RNA, 64 nt, Homo Sapiens; identical to SEQ ID NO: 143739

SEQ ID NO: 454342 - RNA, 64 nt, Homo Sapiens; identical to SEQ ID NO: 143740

SEQ ID NO: 454343 - RNA, 64 nt, Homo Sapiens; identical to SEQ ID NO: 143741

SEQ ID NO: 454344 - RNA, 64 nt, Homo Sapiens; identical to SEQ ID NO: 143742

SEQ ID NO: 454345 - RNA, 64 nt, Homo Sapiens; identical to SEQ ID NO: 143743

SEQ ID NO: 454346 - RNA, 64 nt, Homo Sapiens; identical to SEQ ID NO: 143744

SEQ ID NO: 454347 - RNA, 64 nt, Homo Sapiens; identical to SEQ ID NO: 143745

SEQ ID NO: 454348 - RNA, 64 nt, Homo Sapiens; identical to SEQ ID NO: 143746

SEQ ID NO: 454349 - RNA, 64 nt, Homo Sapiens; identical to SEQ ID NO: 143747

SEQ ID NO: 454350 - RNA, 64 nt, Homo Sapiens; identical to SEQ ID NO: 143748

SEQ ID NO: 454351 - RNA, 64 nt, Homo Sapiens; identical to SEQ ID NO: 143749

SEQ ID NO: 454352 - RNA, 64 nt, Homo Sapiens; identical to SEQ ID NO: 143750

SEQ ID NO: 454353 - RNA, 64 nt, Homo Sapiens; identical to SEQ ID NO: 143751

SEQ ID NO: 454354 - RNA, 64 nt, Homo Sapiens; identical to SEQ ID NO: 143752

SEQ ID NO: 454355 - RNA, 64 nt, Homo Sapiens; identical to SEQ ID NO: 143753

SEQ ID NO: 454356 - RNA, 64 nt, Homo Sapiens; identical to SEQ ID NO: 143754

SEQ ID NO: 454357 - RNA, 64 nt, Homo Sapiens; identical to SEQ ID NO: 143755

SEQ ID NO: 454358 - RNA, 64 nt, Homo Sapiens; identical to SEQ ID NO: 143756

SEQ ID NO: 454359 - RNA, 64 nt, Homo Sapiens; identical to SEQ ID NO: 143757

SEQ ID NO: 454360 - RNA, 64 nt, Homo Sapiens; identical to SEQ ID NO: 143758

SEQ ID NO: 454361 - RNA, 64 nt, Homo Sapiens; identical to SEQ ID NO: 143759

SEQ ID NO: 454362 - RNA, 64 nt, Homo Sapiens; identical to SEQ ID NO: 143760

SEQ ID NO: 454363 - RNA, 64 nt, Homo Sapiens; identical to SEQ ID NO: 143761

SEQ ID NO: 454364 - RNA, 64 nt, Homo Sapiens; identical to SEQ ID NO: 143762

SEQ ID NO: 454365 - RNA, 64 nt, Homo Sapiens; identical to SEQ ID NO: 143763

SEQ ID NO: 454366 - RNA, 64 nt, Homo Sapiens; identical to SEQ ID NO: 143764

SEQ ID NO: 454367 - RNA, 64 nt, Homo Sapiens; identical to SEQ ID NO: 143765

SEQ ID NO: 454368 - RNA, 64 nt, Homo Sapiens; identical to SEQ ID NO: 143766

SEQ ID NO: 454369 - RNA, 64 nt, Homo Sapiens; identical to SEQ ID NO: 143767

SEQ ID NO: 454370 - RNA, 64 nt, Homo Sapiens; identical to SEQ ID NO: 143768

SEQ ID NO: 454371 - RNA, 64 nt, Homo Sapiens; identical to SEQ ID NO: 143769

SEQ ID NO: 454372 - RNA, 64 nt, Homo Sapiens; identical to SEQ ID NO: 143770

SEQ ID NO: 454373 - RNA, 64 nt, Homo Sapiens; identical to SEQ ID NO: 143771

SEQ ID NO: 454374 - RNA, 64 nt, Homo Sapiens; identical to SEQ ID NO: 143772

SEQ ID NO: 454375 - RNA, 64 nt, Homo Sapiens; identical to SEQ ID NO: 143773

SEQ ID NO: 454376 - RNA, 64 nt, Homo Sapiens; identical to SEQ ID NO: 143774

SEQ ID NO: 454377 - RNA, 64 nt, Homo Sapiens; identical to SEQ ID NO: 143775

SEQ ID NO: 454378 - RNA, 64 nt, Homo Sapiens; identical to SEQ ID NO: 143776

SEQ ID NO: 454379 - RNA, 64 nt, Homo Sapiens; identical to SEQ ID NO: 143777

SEQ ID NO: 454380 - RNA, 64 nt, Homo Sapiens; identical to SEQ ID NO: 143778

SEQ ID NO: 454381 - RNA, 64 nt, Homo Sapiens; identical to SEQ ID NO: 143779

SEQ ID NO: 454382 - RNA, 64 nt, Homo Sapiens; identical to SEQ ID NO: 143780

SEQ ID NO: 454383 - RNA, 64 nt, Homo Sapiens; identical to SEQ ID NO: 143781

SEQ ID NO: 454384 - RNA, 64 nt, Homo Sapiens; identical to SEQ ID NO: 143782

SEQ ID NO: 454385 - RNA, 64 nt, Homo Sapiens; identical to SEQ ID NO: 143783

SEQ ID NO: 454386 - RNA, 64 nt, Homo Sapiens; identical to SEQ ID NO: 143784

SEQ ID NO: 454387 - RNA, 64 nt, Homo Sapiens; identical to SEQ ID NO: 143785

SEQ ID NO: 454388 - RNA, 64 nt, Homo Sapiens; identical to SEQ ID NO: 143786

SEQ ID NO: 454389 - RNA, 64 nt, Homo Sapiens; identical to SEQ ID NO: 143787

SEQ ID NO: 454390 - RNA, 64 nt, Homo Sapiens; identical to SEQ ID NO: 143788

SEQ ID NO: 454391 - RNA, 64 nt, Homo Sapiens; identical to SEQ ID NO: 143789

SEQ ID NO: 454392 - RNA, 57 nt, Homo Sapiens; identical to SEQ ID NO: 143790

SEQ ID NO: 454393 - RNA, 64 nt, Homo Sapiens; identical to SEQ ID NO: 143791

SEQ ID NO: 454394 - RNA, 64 nt, Homo Sapiens; identical to SEQ ID NO: 143792

SEQ ID NO: 454395 - RNA, 64 nt, Homo Sapiens; identical to SEQ ID NO: 143793

SEQ ID NO: 454396 - RNA, 64 nt, Homo Sapiens; identical to SEQ ID NO: 143794

SEQ ID NO: 454397 - RNA, 64 nt, Homo Sapiens; identical to SEQ ID NO: 143795

SEQ ID NO: 454398 - RNA, 64 nt, Homo Sapiens; identical to SEQ ID NO: 143796

SEQ ID NO: 454399 - RNA, 64 nt, Homo Sapiens; identical to SEQ ID NO: 143797

SEQ ID NO: 454400 - RNA, 64 nt, Homo Sapiens; identical to SEQ ID NO: 143798

SEQ ID NO: 454401 - RNA, 64 nt, Homo Sapiens; identical to SEQ ID NO: 143799

SEQ ID NO: 454402 - RNA, 64 nt, Homo Sapiens; identical to SEQ ID NO: 143800

SEQ ID NO: 454403 - RNA, 64 nt, Homo Sapiens; identical to SEQ ID NO: 143801

SEQ ID NO: 454404 - RNA, 64 nt, Homo Sapiens; identical to SEQ ID NO: 143802

SEQ ID NO: 454405 - RNA, 64 nt, Homo Sapiens; identical to SEQ ID NO: 143803

SEQ ID NO: 454406 - RNA, 64 nt, Homo Sapiens; identical to SEQ ID NO: 143804

SEQ ID NO: 454407 - RNA, 64 nt, Homo Sapiens; identical to SEQ ID NO: 143805

SEQ ID NO: 454408 - RNA, 64 nt, Homo Sapiens; identical to SEQ ID NO: 143806

SEQ ID NO: 454409 - RNA, 64 nt, Homo Sapiens; identical to SEQ ID NO: 143807

SEQ ID NO: 454410 - RNA, 64 nt, Homo Sapiens; identical to SEQ ID NO: 143808

SEQ ID NO: 454411 - RNA, 64 nt, Homo Sapiens; identical to SEQ ID NO: 143809

SEQ ID NO: 454412 - RNA, 64 nt, Homo Sapiens; identical to SEQ ID NO: 143810

SEQ ID NO: 454413 - RNA, 64 nt, Homo Sapiens; identical to SEQ ID NO: 143811

SEQ ID NO: 454414 - RNA, 64 nt, Homo Sapiens; identical to SEQ ID NO: 143812

SEQ ID NO: 454415 - RNA, 64 nt, Homo Sapiens; identical to SEQ ID NO: 307517

SEQ ID NO: 454416 - RNA, 64 nt, Homo Sapiens; identical to SEQ ID NO: 307518

SEQ ID NO: 454417 - RNA, 64 nt, Homo Sapiens; identical to SEQ ID NO: 307519

SEQ ID NO: 454418 - RNA, 64 nt, Homo Sapiens; identical to SEQ ID NO: 307520

SEQ ID NO: 454419 - RNA, 64 nt, Homo Sapiens; identical to SEQ ID NO: 307521

SEQ ID NO: 454420 - RNA, 64 nt, Homo Sapiens; identical to SEQ ID NO: 307522

SEQ ID NO: 454421 - RNA, 64 nt, Homo Sapiens; identical to SEQ ID NO: 307523

SEQ ID NO: 454422 - RNA, 64 nt, Homo Sapiens; identical to SEQ ID NO: 143712

SEQ ID NO: 454423 - RNA, 64 nt, Homo Sapiens; identical to SEQ ID NO: 143713

SEQ ID NO: 454424 - RNA, 64 nt, Homo Sapiens; identical to SEQ ID NO: 143714

SEQ ID NO: 454425 - RNA, 64 nt, Homo Sapiens; identical to SEQ ID NO: 143715

SEQ ID NO: 454426 - RNA, 64 nt, Homo Sapiens; identical to SEQ ID NO: 143716

SEQ ID NO: 454427 - RNA, 64 nt, Homo Sapiens; identical to SEQ ID NO: 143717

SEQ ID NO: 454428 - RNA, 64 nt, Homo Sapiens; identical to SEQ ID NO: 143718

SEQ ID NO: 454429 - RNA, 64 nt, Homo Sapiens; identical to SEQ ID NO: 143719

SEQ ID NO: 454430 - RNA, 64 nt, Homo Sapiens; identical to SEQ ID NO: 143720

SEQ ID NO: 454431 - RNA, 64 nt, Homo Sapiens; identical to SEQ ID NO: 143721

SEQ ID NO: 454432 - RNA, 64 nt, Homo Sapiens; identical to SEQ ID NO: 143722

SEQ ID NO: 454433 - RNA, 64 nt, Homo Sapiens; identical to SEQ ID NO: 143723

SEQ ID NO: 454434 - RNA, 64 nt, Homo Sapiens; identical to SEQ ID NO: 143724

SEQ ID NO: 454435 - RNA, 64 nt, Homo Sapiens; identical to SEQ ID NO: 143725

SEQ ID NO: 454436 - RNA, 64 nt, Homo Sapiens; identical to SEQ ID NO: 143726

SEQ ID NO: 454437 - RNA, 64 nt, Homo Sapiens; identical to SEQ ID NO: 143727

SEQ ID NO: 454438 - RNA, 64 nt, Homo Sapiens; identical to SEQ ID NO: 143728

SEQ ID NO: 454439 - RNA, 64 nt, Homo Sapiens; identical to SEQ ID NO: 143729

SEQ ID NO: 454440 - RNA, 64 nt, Homo Sapiens; identical to SEQ ID NO: 143730

SEQ ID NO: 454441 - RNA, 64 nt, Homo Sapiens; identical to SEQ ID NO: 143731

SEQ ID NO: 454442 - RNA, 64 nt, Homo Sapiens; identical to SEQ ID NO: 143732

SEQ ID NO: 454443 - RNA, 64 nt, Homo Sapiens; identical to SEQ ID NO: 143733

SEQ ID NO: 454444 - RNA, 64 nt, Homo Sapiens; identical to SEQ ID NO: 143734

SEQ ID NO: 454445 - RNA, 64 nt, Homo Sapiens; identical to SEQ ID NO: 143735

SEQ ID NO: 454446 - RNA, 64 nt, Homo Sapiens; identical to SEQ ID NO: 143736

SEQ ID NO: 454447 - RNA, 64 nt, Homo Sapiens; identical to SEQ ID NO: 143737

SEQ ID NO: 454448 - RNA, 64 nt, Homo Sapiens; identical to SEQ ID NO: 143738

SEQ ID NO: 454449 - RNA, 64 nt, Homo Sapiens; identical to SEQ ID NO: 143739

SEQ ID NO: 454450 - RNA, 64 nt, Homo Sapiens; identical to SEQ ID NO: 143740

SEQ ID NO: 454451 - RNA, 64 nt, Homo Sapiens; identical to SEQ ID NO: 143741

SEQ ID NO: 454452 - RNA, 64 nt, Homo Sapiens; identical to SEQ ID NO: 143742

SEQ ID NO: 454453 - RNA, 64 nt, Homo Sapiens; identical to SEQ ID NO: 143743

SEQ ID NO: 454454 - RNA, 64 nt, Homo Sapiens; identical to SEQ ID NO: 143744

SEQ ID NO: 454455 - RNA, 64 nt, Homo Sapiens; identical to SEQ ID NO: 143745

SEQ ID NO: 454456 - RNA, 64 nt, Homo Sapiens; identical to SEQ ID NO: 143746

SEQ ID NO: 454457 - RNA, 64 nt, Homo Sapiens; identical to SEQ ID NO: 143747

SEQ ID NO: 454458 - RNA, 64 nt, Homo Sapiens; identical to SEQ ID NO: 143748

SEQ ID NO: 454459 - RNA, 64 nt, Homo Sapiens; identical to SEQ ID NO: 143749

SEQ ID NO: 454460 - RNA, 64 nt, Homo Sapiens; identical to SEQ ID NO: 143750

SEQ ID NO: 454461 - RNA, 64 nt, Homo Sapiens; identical to SEQ ID NO: 143751

SEQ ID NO: 454462 - RNA, 64 nt, Homo Sapiens; identical to SEQ ID NO: 143752

SEQ ID NO: 454463 - RNA, 64 nt, Homo Sapiens; identical to SEQ ID NO: 143753

SEQ ID NO: 454464 - RNA, 64 nt, Homo Sapiens; identical to SEQ ID NO: 143754

SEQ ID NO: 454465 - RNA, 64 nt, Homo Sapiens; identical to SEQ ID NO: 143755

SEQ ID NO: 454466 - RNA, 64 nt, Homo Sapiens; identical to SEQ ID NO: 143756

SEQ ID NO: 454467 - RNA, 64 nt, Homo Sapiens; identical to SEQ ID NO: 143757

SEQ ID NO: 454468 - RNA, 64 nt, Homo Sapiens; identical to SEQ ID NO: 143758

SEQ ID NO: 454469 - RNA, 64 nt, Homo Sapiens; identical to SEQ ID NO: 143759

SEQ ID NO: 454470 - RNA, 64 nt, Homo Sapiens; identical to SEQ ID NO: 143760

SEQ ID NO: 454471 - RNA, 64 nt, Homo Sapiens; identical to SEQ ID NO: 143761

SEQ ID NO: 454472 - RNA, 64 nt, Homo Sapiens; identical to SEQ ID NO: 143762

SEQ ID NO: 454473 - RNA, 64 nt, Homo Sapiens; identical to SEQ ID NO: 143763

SEQ ID NO: 454474 - RNA, 64 nt, Homo Sapiens; identical to SEQ ID NO: 143764

SEQ ID NO: 454475 - RNA, 64 nt, Homo Sapiens; identical to SEQ ID NO: 143765

SEQ ID NO: 454476 - RNA, 64 nt, Homo Sapiens; identical to SEQ ID NO: 143766

SEQ ID NO: 454477 - RNA, 64 nt, Homo Sapiens; identical to SEQ ID NO: 143767

SEQ ID NO: 454478 - RNA, 64 nt, Homo Sapiens; identical to SEQ ID NO: 143768

SEQ ID NO: 454479 - RNA, 64 nt, Homo Sapiens; identical to SEQ ID NO: 143769

SEQ ID NO: 454480 - RNA, 64 nt, Homo Sapiens; identical to SEQ ID NO: 143770

SEQ ID NO: 454481 - RNA, 64 nt, Homo Sapiens; identical to SEQ ID NO: 143771

SEQ ID NO: 454482 - RNA, 64 nt, Homo Sapiens; identical to SEQ ID NO: 143772

SEQ ID NO: 454483 - RNA, 64 nt, Homo Sapiens; identical to SEQ ID NO: 143773

SEQ ID NO: 454484 - RNA, 64 nt, Homo Sapiens; identical to SEQ ID NO: 143774

SEQ ID NO: 454485 - RNA, 64 nt, Homo Sapiens; identical to SEQ ID NO: 143775

SEQ ID NO: 454486 - RNA, 64 nt, Homo Sapiens; identical to SEQ ID NO: 143776

SEQ ID NO: 454487 - RNA, 64 nt, Homo Sapiens; identical to SEQ ID NO: 143777

SEQ ID NO: 454488 - RNA, 64 nt, Homo Sapiens; identical to SEQ ID NO: 143778

SEQ ID NO: 454489 - RNA, 64 nt, Homo Sapiens; identical to SEQ ID NO: 143779

SEQ ID NO: 454490 - RNA, 64 nt, Homo Sapiens; identical to SEQ ID NO: 143780

SEQ ID NO: 454491 - RNA, 64 nt, Homo Sapiens; identical to SEQ ID NO: 143781

SEQ ID NO: 454492 - RNA, 64 nt, Homo Sapiens; identical to SEQ ID NO: 143782

SEQ ID NO: 454493 - RNA, 64 nt, Homo Sapiens; identical to SEQ ID NO: 143783

SEQ ID NO: 454494 - RNA, 64 nt, Homo Sapiens; identical to SEQ ID NO: 143784

SEQ ID NO: 454495 - RNA, 64 nt, Homo Sapiens; identical to SEQ ID NO: 143785

SEQ ID NO: 454496 - RNA, 64 nt, Homo Sapiens; identical to SEQ ID NO: 143786

SEQ ID NO: 454497 - RNA, 64 nt, Homo Sapiens; identical to SEQ ID NO: 143787

SEQ ID NO: 454498 - RNA, 64 nt, Homo Sapiens; identical to SEQ ID NO: 143788

SEQ ID NO: 454499 - RNA, 64 nt, Homo Sapiens; identical to SEQ ID NO: 143789

SEQ ID NO: 454500 - RNA, 57 nt, Homo Sapiens; identical to SEQ ID NO: 143790

SEQ ID NO: 454501 - RNA, 64 nt, Homo Sapiens; identical to SEQ ID NO: 143791

SEQ ID NO: 454502 - RNA, 64 nt, Homo Sapiens; identical to SEQ ID NO: 143792

SEQ ID NO: 454503 - RNA, 64 nt, Homo Sapiens; identical to SEQ ID NO: 143793

SEQ ID NO: 454504 - RNA, 64 nt, Homo Sapiens; identical to SEQ ID NO: 143794

SEQ ID NO: 454505 - RNA, 64 nt, Homo Sapiens; identical to SEQ ID NO: 143795

SEQ ID NO: 454506 - RNA, 64 nt, Homo Sapiens; identical to SEQ ID NO: 143796

SEQ ID NO: 454507 - RNA, 64 nt, Homo Sapiens; identical to SEQ ID NO: 143797

SEQ ID NO: 454508 - RNA, 64 nt, Homo Sapiens; identical to SEQ ID NO: 143798

SEQ ID NO: 454509 - RNA, 64 nt, Homo Sapiens; identical to SEQ ID NO: 143799

SEQ ID NO: 454510 - RNA, 64 nt, Homo Sapiens; identical to SEQ ID NO: 143800

SEQ ID NO: 454511 - RNA, 64 nt, Homo Sapiens; identical to SEQ ID NO: 143801

SEQ ID NO: 454512 - RNA, 64 nt, Homo Sapiens; identical to SEQ ID NO: 143802

SEQ ID NO: 454513 - RNA, 64 nt, Homo Sapiens; identical to SEQ ID NO: 143803

SEQ ID NO: 454514 - RNA, 64 nt, Homo Sapiens; identical to SEQ ID NO: 143804

SEQ ID NO: 454515 - RNA, 64 nt, Homo Sapiens; identical to SEQ ID NO: 143805

SEQ ID NO: 454516 - RNA, 64 nt, Homo Sapiens; identical to SEQ ID NO: 143806

SEQ ID NO: 454517 - RNA, 64 nt, Homo Sapiens; identical to SEQ ID NO: 143807

SEQ ID NO: 454518 - RNA, 64 nt, Homo Sapiens; identical to SEQ ID NO: 143808

SEQ ID NO: 454519 - RNA, 64 nt, Homo Sapiens; identical to SEQ ID NO: 143809

SEQ ID NO: 454520 - RNA, 64 nt, Homo Sapiens; identical to SEQ ID NO: 143810

SEQ ID NO: 454521 - RNA, 64 nt, Homo Sapiens; identical to SEQ ID NO: 143811

SEQ ID NO: 454522 - RNA, 64 nt, Homo Sapiens; identical to SEQ ID NO: 143812

SEQ ID NO: 454523 - RNA, 64 nt, Homo Sapiens; identical to SEQ ID NO: 307517

SEQ ID NO: 454524 - RNA, 64 nt, Homo Sapiens; identical to SEQ ID NO: 307518

SEQ ID NO: 454525 - RNA, 64 nt, Homo Sapiens; identical to SEQ ID NO: 307519

SEQ ID NO: 454526 - RNA, 64 nt, Homo Sapiens; identical to SEQ ID NO: 307520

SEQ ID NO: 454527 - RNA, 64 nt, Homo Sapiens; identical to SEQ ID NO: 307521

SEQ ID NO: 454528 - RNA, 64 nt, Homo Sapiens; identical to SEQ ID NO: 307522

SEQ ID NO: 454529 - RNA, 64 nt, Homo Sapiens; identical to SEQ ID NO: 307523

SEQ ID NO: 454530 - RNA, 64 nt, Homo Sapiens; identical to SEQ ID NO: 143712

SEQ ID NO: 454531 - RNA, 64 nt, Homo Sapiens; identical to SEQ ID NO: 143713

SEQ ID NO: 454532 - RNA, 64 nt, Homo Sapiens; identical to SEQ ID NO: 143714

SEQ ID NO: 454533 - RNA, 64 nt, Homo Sapiens; identical to SEQ ID NO: 143715

SEQ ID NO: 454534 - RNA, 64 nt, Homo Sapiens; identical to SEQ ID NO: 143716

SEQ ID NO: 454535 - RNA, 64 nt, Homo Sapiens; identical to SEQ ID NO: 143717

SEQ ID NO: 454536 - RNA, 64 nt, Homo Sapiens; identical to SEQ ID NO: 143718

SEQ ID NO: 454537 - RNA, 64 nt, Homo Sapiens; identical to SEQ ID NO: 143719

SEQ ID NO: 454538 - RNA, 64 nt, Homo Sapiens; identical to SEQ ID NO: 143720

SEQ ID NO: 454539 - RNA, 64 nt, Homo Sapiens; identical to SEQ ID NO: 143721

SEQ ID NO: 454540 - RNA, 64 nt, Homo Sapiens; identical to SEQ ID NO: 143722

SEQ ID NO: 454541 - RNA, 64 nt, Homo Sapiens; identical to SEQ ID NO: 143723

SEQ ID NO: 454542 - RNA, 64 nt, Homo Sapiens; identical to SEQ ID NO: 143724

SEQ ID NO: 454543 - RNA, 64 nt, Homo Sapiens; identical to SEQ ID NO: 143725

SEQ ID NO: 454544 - RNA, 64 nt, Homo Sapiens; identical to SEQ ID NO: 143726

SEQ ID NO: 454545 - RNA, 64 nt, Homo Sapiens; identical to SEQ ID NO: 143727

SEQ ID NO: 454546 - RNA, 64 nt, Homo Sapiens; identical to SEQ ID NO: 143728

SEQ ID NO: 454547 - RNA, 64 nt, Homo Sapiens; identical to SEQ ID NO: 143729

SEQ ID NO: 454548 - RNA, 64 nt, Homo Sapiens; identical to SEQ ID NO: 143730

SEQ ID NO: 454549 - RNA, 64 nt, Homo Sapiens; identical to SEQ ID NO: 143731

SEQ ID NO: 454550 - RNA, 64 nt, Homo Sapiens; identical to SEQ ID NO: 143732

SEQ ID NO: 454551 - RNA, 64 nt, Homo Sapiens; identical to SEQ ID NO: 143733

SEQ ID NO: 454552 - RNA, 64 nt, Homo Sapiens; identical to SEQ ID NO: 143734

SEQ ID NO: 454553 - RNA, 64 nt, Homo Sapiens; identical to SEQ ID NO: 143735

SEQ ID NO: 454554 - RNA, 64 nt, Homo Sapiens; identical to SEQ ID NO: 143736

SEQ ID NO: 454555 - RNA, 64 nt, Homo Sapiens; identical to SEQ ID NO: 143737

SEQ ID NO: 454556 - RNA, 64 nt, Homo Sapiens; identical to SEQ ID NO: 143738

SEQ ID NO: 454557 - RNA, 64 nt, Homo Sapiens; identical to SEQ ID NO: 143739

SEQ ID NO: 454558 - RNA, 64 nt, Homo Sapiens; identical to SEQ ID NO: 143740

SEQ ID NO: 454559 - RNA, 64 nt, Homo Sapiens; identical to SEQ ID NO: 143741

SEQ ID NO: 454560 - RNA, 64 nt, Homo Sapiens; identical to SEQ ID NO: 143742

SEQ ID NO: 454561 - RNA, 64 nt, Homo Sapiens; identical to SEQ ID NO: 143743

SEQ ID NO: 454562 - RNA, 64 nt, Homo Sapiens; identical to SEQ ID NO: 143744

SEQ ID NO: 454563 - RNA, 64 nt, Homo Sapiens; identical to SEQ ID NO: 143745

SEQ ID NO: 454564 - RNA, 64 nt, Homo Sapiens; identical to SEQ ID NO: 143746

SEQ ID NO: 454565 - RNA, 64 nt, Homo Sapiens; identical to SEQ ID NO: 143747

SEQ ID NO: 454566 - RNA, 64 nt, Homo Sapiens; identical to SEQ ID NO: 143748

SEQ ID NO: 454567 - RNA, 64 nt, Homo Sapiens; identical to SEQ ID NO: 143749

SEQ ID NO: 454568 - RNA, 64 nt, Homo Sapiens; identical to SEQ ID NO: 143750

SEQ ID NO: 454569 - RNA, 64 nt, Homo Sapiens; identical to SEQ ID NO: 143751

SEQ ID NO: 454570 - RNA, 64 nt, Homo Sapiens; identical to SEQ ID NO: 143752

SEQ ID NO: 454571 - RNA, 64 nt, Homo Sapiens; identical to SEQ ID NO: 143753

SEQ ID NO: 454572 - RNA, 64 nt, Homo Sapiens; identical to SEQ ID NO: 143754

SEQ ID NO: 454573 - RNA, 64 nt, Homo Sapiens; identical to SEQ ID NO: 143755

SEQ ID NO: 454574 - RNA, 64 nt, Homo Sapiens; identical to SEQ ID NO: 143756

SEQ ID NO: 454575 - RNA, 64 nt, Homo Sapiens; identical to SEQ ID NO: 143757

SEQ ID NO: 454576 - RNA, 64 nt, Homo Sapiens; identical to SEQ ID NO: 143758

SEQ ID NO: 454577 - RNA, 64 nt, Homo Sapiens; identical to SEQ ID NO: 143759

SEQ ID NO: 454578 - RNA, 64 nt, Homo Sapiens; identical to SEQ ID NO: 143760

SEQ ID NO: 454579 - RNA, 64 nt, Homo Sapiens; identical to SEQ ID NO: 143761

SEQ ID NO: 454580 - RNA, 64 nt, Homo Sapiens; identical to SEQ ID NO: 143762

SEQ ID NO: 454581 - RNA, 64 nt, Homo Sapiens; identical to SEQ ID NO: 143763

SEQ ID NO: 454582 - RNA, 64 nt, Homo Sapiens; identical to SEQ ID NO: 143764

SEQ ID NO: 454583 - RNA, 64 nt, Homo Sapiens; identical to SEQ ID NO: 143765

SEQ ID NO: 454584 - RNA, 64 nt, Homo Sapiens; identical to SEQ ID NO: 143766

SEQ ID NO: 454585 - RNA, 64 nt, Homo Sapiens; identical to SEQ ID NO: 143767

SEQ ID NO: 454586 - RNA, 64 nt, Homo Sapiens; identical to SEQ ID NO: 143768

SEQ ID NO: 454587 - RNA, 64 nt, Homo Sapiens; identical to SEQ ID NO: 143769

SEQ ID NO: 454588 - RNA, 64 nt, Homo Sapiens; identical to SEQ ID NO: 143770

SEQ ID NO: 454589 - RNA, 64 nt, Homo Sapiens; identical to SEQ ID NO: 143771

SEQ ID NO: 454590 - RNA, 64 nt, Homo Sapiens; identical to SEQ ID NO: 143772

SEQ ID NO: 454591 - RNA, 64 nt, Homo Sapiens; identical to SEQ ID NO: 143773

SEQ ID NO: 454592 - RNA, 64 nt, Homo Sapiens; identical to SEQ ID NO: 143774

SEQ ID NO: 454593 - RNA, 64 nt, Homo Sapiens; identical to SEQ ID NO: 143775

SEQ ID NO: 454594 - RNA, 64 nt, Homo Sapiens; identical to SEQ ID NO: 143776

SEQ ID NO: 454595 - RNA, 64 nt, Homo Sapiens; identical to SEQ ID NO: 143777

SEQ ID NO: 454596 - RNA, 64 nt, Homo Sapiens; identical to SEQ ID NO: 143778

SEQ ID NO: 454597 - RNA, 64 nt, Homo Sapiens; identical to SEQ ID NO: 143779

SEQ ID NO: 454598 - RNA, 64 nt, Homo Sapiens; identical to SEQ ID NO: 143780

SEQ ID NO: 454599 - RNA, 64 nt, Homo Sapiens; identical to SEQ ID NO: 143781

SEQ ID NO: 454600 - RNA, 64 nt, Homo Sapiens; identical to SEQ ID NO: 143782

SEQ ID NO: 454601 - RNA, 64 nt, Homo Sapiens; identical to SEQ ID NO: 143783

SEQ ID NO: 454602 - RNA, 64 nt, Homo Sapiens; identical to SEQ ID NO: 143784

SEQ ID NO: 454603 - RNA, 64 nt, Homo Sapiens; identical to SEQ ID NO: 143785

SEQ ID NO: 454604 - RNA, 64 nt, Homo Sapiens; identical to SEQ ID NO: 143786

SEQ ID NO: 454605 - RNA, 64 nt, Homo Sapiens; identical to SEQ ID NO: 143787

SEQ ID NO: 454606 - RNA, 64 nt, Homo Sapiens; identical to SEQ ID NO: 143788

SEQ ID NO: 454607 - RNA, 64 nt, Homo Sapiens; identical to SEQ ID NO: 143789

SEQ ID NO: 454608 - RNA, 57 nt, Homo Sapiens; identical to SEQ ID NO: 143790

SEQ ID NO: 454609 - RNA, 64 nt, Homo Sapiens; identical to SEQ ID NO: 143791

SEQ ID NO: 454610 - RNA, 64 nt, Homo Sapiens; identical to SEQ ID NO: 143792

SEQ ID NO: 454611 - RNA, 64 nt, Homo Sapiens; identical to SEQ ID NO: 143793

SEQ ID NO: 454612 - RNA, 64 nt, Homo Sapiens; identical to SEQ ID NO: 143794

SEQ ID NO: 454613 - RNA, 64 nt, Homo Sapiens; identical to SEQ ID NO: 143795

SEQ ID NO: 454614 - RNA, 64 nt, Homo Sapiens; identical to SEQ ID NO: 143796

SEQ ID NO: 454615 - RNA, 64 nt, Homo Sapiens; identical to SEQ ID NO: 143797

SEQ ID NO: 454616 - RNA, 64 nt, Homo Sapiens; identical to SEQ ID NO: 143798

SEQ ID NO: 454617 - RNA, 64 nt, Homo Sapiens; identical to SEQ ID NO: 143799

SEQ ID NO: 454618 - RNA, 64 nt, Homo Sapiens; identical to SEQ ID NO: 143800

SEQ ID NO: 454619 - RNA, 64 nt, Homo Sapiens; identical to SEQ ID NO: 143801

SEQ ID NO: 454620 - RNA, 64 nt, Homo Sapiens; identical to SEQ ID NO: 143802

SEQ ID NO: 454621 - RNA, 64 nt, Homo Sapiens; identical to SEQ ID NO: 143803

SEQ ID NO: 454622 - RNA, 64 nt, Homo Sapiens; identical to SEQ ID NO: 143804

SEQ ID NO: 454623 - RNA, 64 nt, Homo Sapiens; identical to SEQ ID NO: 143805

SEQ ID NO: 454624 - RNA, 64 nt, Homo Sapiens; identical to SEQ ID NO: 143806

SEQ ID NO: 454625 - RNA, 64 nt, Homo Sapiens; identical to SEQ ID NO: 143807

SEQ ID NO: 454626 - RNA, 64 nt, Homo Sapiens; identical to SEQ ID NO: 143808

SEQ ID NO: 454627 - RNA, 64 nt, Homo Sapiens; identical to SEQ ID NO: 143809

SEQ ID NO: 454628 - RNA, 64 nt, Homo Sapiens; identical to SEQ ID NO: 143810

SEQ ID NO: 454629 - RNA, 64 nt, Homo Sapiens; identical to SEQ ID NO: 143811

SEQ ID NO: 454630 - RNA, 64 nt, Homo Sapiens; identical to SEQ ID NO: 143812

SEQ ID NO: 454631 - RNA, 64 nt, Homo Sapiens; identical to SEQ ID NO: 307517

SEQ ID NO: 454632 - RNA, 64 nt, Homo Sapiens; identical to SEQ ID NO: 307518

SEQ ID NO: 454633 - RNA, 64 nt, Homo Sapiens; identical to SEQ ID NO: 307519

SEQ ID NO: 454634 - RNA, 64 nt, Homo Sapiens; identical to SEQ ID NO: 307520

SEQ ID NO: 454635 - RNA, 64 nt, Homo Sapiens; identical to SEQ ID NO: 307521

SEQ ID NO: 454636 - RNA, 64 nt, Homo Sapiens; identical to SEQ ID NO: 307522

SEQ ID NO: 454637 - RNA, 64 nt, Homo Sapiens; identical to SEQ ID NO: 307523

SEQ ID NO: 454638 - RNA, 64 nt, Homo Sapiens; identical to SEQ ID NO: 326636

SEQ ID NO: 454639 - RNA, 64 nt, Homo Sapiens; identical to SEQ ID NO: 326637

SEQ ID NO: 454640 - RNA, 64 nt, Homo Sapiens; identical to SEQ ID NO: 326638

SEQ ID NO: 454641 - RNA, 64 nt, Homo Sapiens; identical to SEQ ID NO: 326639

SEQ ID NO: 454642 - RNA, 64 nt, Homo Sapiens; identical to SEQ ID NO: 326640

SEQ ID NO: 454643 - RNA, 64 nt, Homo Sapiens
caaaggagaagaaauuacucguguucuugauaagggaagugagauggcaaagacuuacugguug

SEQ ID NO: 454644 - RNA, 64 nt, Homo Sapiens
aaaggaaaauuuuaagccaguauacucauagaauggaagugagcauguccagcugcuccaucga

SEQ ID NO: 454645 - RNA, 64 nt, Homo Sapiens
gaauauuucaguuuccugaaacauuuuuuuccauggaagugaggcaaaugcuuaaauauauaau

SEQ ID NO: 454646 - RNA, 64 nt, Homo Sapiens
gccucaguagaagagacgcacucuagacacauacggaagugaugugagcacaauggugggcccu

SEQ ID NO: 454647 - RNA, 64 nt, Homo Sapiens
gagugcagccucugcccggccgccaccccgucugggaagugaggagcgucucugccuggcugcc

SEQ ID NO: 454648 - RNA, 64 nt, Homo Sapiens
gaggagcgucucugcccggccgccaucccaucuaggaagugaggagcgccucuucccacccgcc

SEQ ID NO: 454649 - RNA, 64 nt, Homo Sapiens
gaggagcgccucuucccacccgccaucccaucuaggaagugaggagcuucucugccuggccgcc

SEQ ID NO: 454650 - RNA, 64 nt, Homo Sapiens
gaggagccccucugcccagcagccacccugucugggaagugaggagcgucuccgcccggcagcc

SEQ ID NO: 454651 - RNA, 64 nt, Homo Sapiens
ggugaggggcgccucugcccagcugccccuacugggaagugaggagccccucugccccgccagc

SEQ ID NO: 454652 - RNA, 64 nt, Homo Sapiens
ggcgaggggcgccucugcccggcugccccuacugggaagugaggagccccucugcccggccagc

SEQ ID NO: 454653 - RNA, 64 nt, Homo Sapiens
gguuaggggcgccucugcccggccgccccuacugggaagugaggagccccucugcccggccacc

SEQ ID NO: 454654 - RNA, 64 nt, Homo Sapiens
ccagagcauggcacaugagcugccagagccaacaggaagugagcggaggacaugcaccaaggcu

SEQ ID NO: 454655 - RNA, 64 nt, Homo Sapiens
ucgcucagagaugagauccuauucuucacuuaggggaagugaaauguaucuguuuuuaauuuuc

SEQ ID NO: 454656 - RNA, 64 nt, Homo Sapiens
gcuauuaaaacuacuguucauuuugggggcugggggaagugagccuguuuggaugauggaugcc

SEQ ID NO: 454657 - RNA, 64 nt, Homo Sapiens
aaauguagugccuuuaaaggaaaaaugaacacagggaagugacuuugcuacaaauaauguugcu

SEQ ID NO: 454658 - RNA, 64 nt, Homo Sapiens
augcagaaguuggguagagagguuaagaagaggaggaagugagacggggaagggaggagcaccu

SEQ ID NO: 454659 - RNA, 64 nt, Homo Sapiens
ccuucccagagcaagcaggcugcauuuuagcuauggaagugaccugcugugacacugugcucuc

SEQ ID NO: 454660 - RNA, 64 nt, Homo Sapiens
augccaccaaggcucgguccagcccaguaccgcuggaagugaauaaacuccggagggucggacg

SEQ ID NO: 454661 - RNA, 64 nt, Homo Sapiens
uccacauagggagggcuuagagcucacagccuugggaagugagacuagaagaggggagcagaaa

SEQ ID NO: 454662 - RNA, 64 nt, Homo Sapiens
gaggagcgccucugcccggccgccaucccaucuaggaagugaggagcgccucuucccagccgcc

SEQ ID NO: 454663 - RNA, 64 nt, Homo Sapiens
gaggagcgccucuucccagccgccaucccaucuaggaagugaggagcgucucugcccggccgcc

SEQ ID NO: 454664 - RNA, 64 nt, Homo Sapiens
gaggagccccuccgcccggcagccaccccaucugggaagugaggagcgucuacgcccgggcagc

SEQ ID NO: 454665 - RNA, 64 nt, Homo Sapiens
cugcccggccgccccugcccggccgccccuacugggaagugaggagccccucugccuggccacc

SEQ ID NO: 454666 - RNA, 64 nt, Homo Sapiens
gaacaggaacucagggugccccuucuacugccugggaagugaugugggagcuguuccuggacag

SEQ ID NO: 454667 - RNA, 64 nt, Homo Sapiens
ggucccaggcacacacccugcagaagacaagcagggaagugaaagugccucucagaaacgcggc

SEQ ID NO: 454668 - RNA, 64 nt, Homo Sapiens
auaaaucgagaggaguuauaagugggaaaaauuaggaagugauuuaaagauguagcucuggccc

SEQ ID NO: 454669 - RNA, 64 nt, Homo Sapiens
auuucggugacuuccgcaucccucuggaacuugaggaagugaacgucugaguaagaaacagaau

SEQ ID NO: 454670 - RNA, 64 nt, Homo Sapiens; identical to SEQ ID NO: 168507

SEQ ID NO: 454671 - RNA, 64 nt, Homo Sapiens; identical to SEQ ID NO: 168508

SEQ ID NO: 454672 - RNA, 64 nt, Homo Sapiens; identical to SEQ ID NO: 168509

SEQ ID NO: 454673 - RNA, 64 nt, Homo Sapiens; identical to SEQ ID NO: 168510

SEQ ID NO: 454674 - RNA, 64 nt, Homo Sapiens; identical to SEQ ID NO: 168511

SEQ ID NO: 454675 - RNA, 64 nt, Homo Sapiens; identical to SEQ ID NO: 168512

SEQ ID NO: 454676 - RNA, 64 nt, Homo Sapiens; identical to SEQ ID NO: 168513

SEQ ID NO: 454677 - RNA, 64 nt, Homo Sapiens; identical to SEQ ID NO: 168514

SEQ ID NO: 454678 - RNA, 64 nt, Homo Sapiens; identical to SEQ ID NO: 168515

SEQ ID NO: 454679 - RNA, 64 nt, Homo Sapiens; identical to SEQ ID NO: 168516

SEQ ID NO: 454680 - RNA, 64 nt, Homo Sapiens; identical to SEQ ID NO: 168517

SEQ ID NO: 454681 - RNA, 64 nt, Homo Sapiens; identical to SEQ ID NO: 168518

SEQ ID NO: 454682 - RNA, 64 nt, Homo Sapiens; identical to SEQ ID NO: 168519

SEQ ID NO: 454683 - RNA, 64 nt, Homo Sapiens; identical to SEQ ID NO: 168520

SEQ ID NO: 454684 - RNA, 64 nt, Homo Sapiens; identical to SEQ ID NO: 168521

SEQ ID NO: 454685 - RNA, 64 nt, Homo Sapiens; identical to SEQ ID NO: 168522

SEQ ID NO: 454686 - RNA, 64 nt, Homo Sapiens; identical to SEQ ID NO: 168523

SEQ ID NO: 454687 - RNA, 64 nt, Homo Sapiens; identical to SEQ ID NO: 168524

SEQ ID NO: 454688 - RNA, 64 nt, Homo Sapiens; identical to SEQ ID NO: 168525

SEQ ID NO: 454689 - RNA, 64 nt, Homo Sapiens; identical to SEQ ID NO: 168526

SEQ ID NO: 454690 - RNA, 64 nt, Homo Sapiens; identical to SEQ ID NO: 168527

SEQ ID NO: 454691 - RNA, 64 nt, Homo Sapiens; identical to SEQ ID NO: 168528

SEQ ID NO: 454692 - RNA, 64 nt, Homo Sapiens; identical to SEQ ID NO: 168529

SEQ ID NO: 454693 - RNA, 64 nt, Homo Sapiens; identical to SEQ ID NO: 168530

SEQ ID NO: 454694 - RNA, 64 nt, Homo Sapiens; identical to SEQ ID NO: 168531

SEQ ID NO: 454695 - RNA, 64 nt, Homo Sapiens; identical to SEQ ID NO: 168532

SEQ ID NO: 454696 - RNA, 64 nt, Homo Sapiens; identical to SEQ ID NO: 168533

SEQ ID NO: 454697 - RNA, 64 nt, Homo Sapiens; identical to SEQ ID NO: 307377

SEQ ID NO: 454698 - RNA, 64 nt, Homo Sapiens; identical to SEQ ID NO: 307378

SEQ ID NO: 454699 - RNA, 64 nt, Homo Sapiens; identical to SEQ ID NO: 307379

SEQ ID NO: 454700 - RNA, 64 nt, Homo Sapiens; identical to SEQ ID NO: 307380

SEQ ID NO: 454701 - RNA, 64 nt, Homo Sapiens; identical to SEQ ID NO: 307381

SEQ ID NO: 454702 - RNA, 64 nt, Homo Sapiens; identical to SEQ ID NO: 307382

SEQ ID NO: 454703 - RNA, 64 nt, Homo Sapiens; identical to SEQ ID NO: 254469

SEQ ID NO: 454704 - RNA, 64 nt, Homo Sapiens; identical to SEQ ID NO: 254470

SEQ ID NO: 454705 - RNA, 64 nt, Homo Sapiens; identical to SEQ ID NO: 254471

SEQ ID NO: 454706 - RNA, 64 nt, Homo Sapiens; identical to SEQ ID NO: 254472

SEQ ID NO: 454707 - RNA, 64 nt, Homo Sapiens; identical to SEQ ID NO: 254473

SEQ ID NO: 454708 - RNA, 64 nt, Homo Sapiens; identical to SEQ ID NO: 254474

SEQ ID NO: 454709 - RNA, 64 nt, Homo Sapiens; identical to SEQ ID NO: 254475

SEQ ID NO: 454710 - RNA, 64 nt, Homo Sapiens; identical to SEQ ID NO: 254476

SEQ ID NO: 454711 - RNA, 64 nt, Homo Sapiens; identical to SEQ ID NO: 254477

SEQ ID NO: 454712 - RNA, 64 nt, Homo Sapiens; identical to SEQ ID NO: 254478

SEQ ID NO: 454713 - RNA, 64 nt, Homo Sapiens; identical to SEQ ID NO: 254479

SEQ ID NO: 454714 - RNA, 64 nt, Homo Sapiens; identical to SEQ ID NO: 254480

SEQ ID NO: 454715 - RNA, 64 nt, Homo Sapiens; identical to SEQ ID NO: 254481

SEQ ID NO: 454716 - RNA, 64 nt, Homo Sapiens; identical to SEQ ID NO: 254482

SEQ ID NO: 454717 - RNA, 64 nt, Homo Sapiens; identical to SEQ ID NO: 254483

SEQ ID NO: 454718 - RNA, 64 nt, Homo Sapiens; identical to SEQ ID NO: 254484

SEQ ID NO: 454719 - RNA, 64 nt, Homo Sapiens; identical to SEQ ID NO: 254485

SEQ ID NO: 454720 - RNA, 64 nt, Homo Sapiens; identical to SEQ ID NO: 254486

SEQ ID NO: 454721 - RNA, 64 nt, Homo Sapiens; identical to SEQ ID NO: 254487

SEQ ID NO: 454722 - RNA, 64 nt, Homo Sapiens; identical to SEQ ID NO: 254488

SEQ ID NO: 454723 - RNA, 64 nt, Homo Sapiens; identical to SEQ ID NO: 254489

SEQ ID NO: 454724 - RNA, 51 nt, Homo Sapiens; identical to SEQ ID NO: 254490

SEQ ID NO: 454725 - RNA, 64 nt, Homo Sapiens; identical to SEQ ID NO: 254491

SEQ ID NO: 454726 - RNA, 64 nt, Homo Sapiens; identical to SEQ ID NO: 254492

SEQ ID NO: 454727 - RNA, 64 nt, Homo Sapiens; identical to SEQ ID NO: 254493

SEQ ID NO: 454728 - RNA, 64 nt, Homo Sapiens; identical to SEQ ID NO: 254494

SEQ ID NO: 454729 - RNA, 64 nt, Homo Sapiens; identical to SEQ ID NO: 254495

SEQ ID NO: 454730 - RNA, 64 nt, Homo Sapiens; identical to SEQ ID NO: 254496

SEQ ID NO: 454731 - RNA, 64 nt, Homo Sapiens; identical to SEQ ID NO: 254497

SEQ ID NO: 454732 - RNA, 64 nt, Homo Sapiens; identical to SEQ ID NO: 254498

SEQ ID NO: 454733 - RNA, 64 nt, Homo Sapiens; identical to SEQ ID NO: 254499

SEQ ID NO: 454734 - RNA, 64 nt, Homo Sapiens; identical to SEQ ID NO: 254500

SEQ ID NO: 454735 - RNA, 64 nt, Homo Sapiens; identical to SEQ ID NO: 254501

SEQ ID NO: 454736 - RNA, 64 nt, Homo Sapiens; identical to SEQ ID NO: 254502

SEQ ID NO: 454737 - RNA, 64 nt, Homo Sapiens; identical to SEQ ID NO: 254503

SEQ ID NO: 454738 - RNA, 64 nt, Homo Sapiens; identical to SEQ ID NO: 254504

SEQ ID NO: 454739 - RNA, 64 nt, Homo Sapiens; identical to SEQ ID NO: 254505

SEQ ID NO: 454740 - RNA, 64 nt, Homo Sapiens; identical to SEQ ID NO: 254506

SEQ ID NO: 454741 - RNA, 64 nt, Homo Sapiens; identical to SEQ ID NO: 254507

SEQ ID NO: 454742 - RNA, 64 nt, Homo Sapiens; identical to SEQ ID NO: 254508

SEQ ID NO: 454743 - RNA, 64 nt, Homo Sapiens; identical to SEQ ID NO: 254509

SEQ ID NO: 454744 - RNA, 64 nt, Homo Sapiens; identical to SEQ ID NO: 254510

SEQ ID NO: 454745 - RNA, 64 nt, Homo Sapiens; identical to SEQ ID NO: 254511

SEQ ID NO: 454746 - RNA, 64 nt, Homo Sapiens; identical to SEQ ID NO: 254512

SEQ ID NO: 454747 - RNA, 64 nt, Homo Sapiens; identical to SEQ ID NO: 254513

SEQ ID NO: 454748 - RNA, 64 nt, Homo Sapiens; identical to SEQ ID NO: 254514

SEQ ID NO: 454749 - RNA, 64 nt, Homo Sapiens; identical to SEQ ID NO: 254515

SEQ ID NO: 454750 - RNA, 64 nt, Homo Sapiens; identical to SEQ ID NO: 254516

SEQ ID NO: 454751 - RNA, 64 nt, Homo Sapiens; identical to SEQ ID NO: 254517

SEQ ID NO: 454752 - RNA, 64 nt, Homo Sapiens; identical to SEQ ID NO: 254518

SEQ ID NO: 454753 - RNA, 64 nt, Homo Sapiens; identical to SEQ ID NO: 254519

SEQ ID NO: 454754 - RNA, 64 nt, Homo Sapiens; identical to SEQ ID NO: 254520

SEQ ID NO: 454755 - RNA, 64 nt, Homo Sapiens; identical to SEQ ID NO: 254521

SEQ ID NO: 454756 - RNA, 64 nt, Homo Sapiens; identical to SEQ ID NO: 254522

SEQ ID NO: 454757 - RNA, 64 nt, Homo Sapiens
cccaccucucugcagaggcaaagucuacuuucugguaccucaaagaaaucauuguucaaucuuc

SEQ ID NO: 454758 - RNA, 64 nt, Homo Sapiens
ggccuagucugcauuuguuugcauauaugagaggguaccucaaauacuucuguuauguaucugu

SEQ ID NO: 454759 - RNA, 64 nt, Homo Sapiens
gucugucagacaaaaaggccuuaugucaccacugguaccucaguuuccucaucccauuuacagu

SEQ ID NO: 454760 - RNA, 64 nt, Homo Sapiens
ccccauuuccucacacuaaggccaaguaaacaggguaccucaaggauggagggcuuggcccagc

SEQ ID NO: 454761 - RNA, 64 nt, Homo Sapiens
cagauaucauccaggcccaaagcagaugguguggguaccucaccaauggauacacagagguugc

SEQ ID NO: 454762 - RNA, 64 nt, Homo Sapiens
gccagcucuacacagaggucguuaaauggugcagguaccucauaggacauggaaaugagaauag

SEQ ID NO: 454763 - RNA, 64 nt, Homo Sapiens
agcucuggaugucuuuggggugagguacacagagguaccucagacacagcacagggagaaaaac

SEQ ID NO: 454764 - RNA, 64 nt, Homo Sapiens
ugcaaaguuaggaaauggggccucagagagauuaguaccucacuucacagaugaagaaacagag

SEQ ID NO: 454765 - RNA, 58 nt, Homo Sapiens
gucucaugcucgguaccaucuggggcccguaccucacaauuauguuagcaccauguga

SEQ ID NO: 454766 - RNA, 64 nt, Homo Sapiens
gucaguuacauucagcagaaucucaaggguauccguaccucaaugcaaccagccaauccugcug

SEQ ID NO: 454767 - RNA, 64 nt, Homo Sapiens
cacacacccccaaccccaggugugcugcuaguggguaccucagugaaugguccucugggagggc

SEQ ID NO: 454768 - RNA, 64 nt, Homo Sapiens
uaucaacauuucugagcuacuuuuguuaguuucaguaccucagcaucaaggacaaccaaaaucc

SEQ ID NO: 454769 - RNA, 64 nt, Homo Sapiens
cugguauccagacugugaaaguaccaaaggcaugguaccucaguaaccuuucucucugggggcu

SEQ ID NO: 454770 - RNA, 64 nt, Homo Sapiens
cagaacucuuuuggcauaaauauuuguguucccaguaccucacuuguucggauuugacugccug

SEQ ID NO: 454771 - RNA, 64 nt, Homo Sapiens
uuuaucuggagcuggaaagaaaaauucuuuuucuguaccucaugccuaucugguaauguuuaau

SEQ ID NO: 454772 - RNA, 64 nt, Homo Sapiens
uaaauggguggguguuucugcacauaccucugcaguaccucaccagggagcauuccaguaucau

SEQ ID NO: 454773 - RNA, 64 nt, Homo Sapiens
gggccugaggccucaguggggguagggcaaggagguaccucacaggugggugugaggcccccuc

SEQ ID NO: 454774 - RNA, 64 nt, Homo Sapiens
uaauaauuauuagaaauacauuuaaaaacaucgaguaccucaagucaguuugccuugaaaaaua

SEQ ID NO: 454775 - RNA, 64 nt, Homo Sapiens
ugcacccgguacaaguggcucucaaguccaucaaguaccucaucucgucugguuccucaacccu

SEQ ID NO: 454776 - RNA, 64 nt, Homo Sapiens
cucggccaccgaaaccacgucuucaggaagaaaaguaccucaucccuagaauccuucgaucucg

SEQ ID NO: 454777 - RNA, 64 nt, Homo Sapiens
aggcagaguaaauaucuacuucagaugcucgccuguaccucaccggacuagagccgggauacuu

SEQ ID NO: 454778 - RNA, 64 nt, Homo Sapiens
gcugcuguuuagggaacuugccuacacaugugugguaccucacuguguguguuugugcgugcac

SEQ ID NO: 454779 - RNA, 64 nt, Homo Sapiens
guaaaaauugaacuguaaaccaaaugcaaaauuaguaccucaaaaauuuuuaagagcauccggc

SEQ ID NO: 454780 - RNA, 64 nt, Homo Sapiens
gaaauuugauagacucaaacuugaaaaugagugaguaccucagacaaauucugauauacauugc

SEQ ID NO: 454781 - RNA, 64 nt, Homo Sapiens
gaugcuuuggcaaugcccaagugugcaauacuguguaccucaugauucacauaucugcuuauca

SEQ ID NO: 454782 - RNA, 64 nt, Homo Sapiens
cacaugaauaguaaugugacuuuucauuuauuuuguaccucauuugauuuuccauauuaaaaaa

SEQ ID NO: 454783 - RNA, 64 nt, Homo Sapiens
uuaagcuaagacauguaaaaaaucccaaauggcaguaccucauuguuuacuuagcuuuuguacu

SEQ ID NO: 454784 - RNA, 64 nt, Homo Sapiens
aaaugugucuguguuucucuuuacauuccuuguuguaccucauuguucaauucacuuuuguaaa

SEQ ID NO: 454785 - RNA, 64 nt, Homo Sapiens
caaaaagcacaacuaauaaauugaauguuuccauguaccucacuuuauuucaguuaacaagaua

SEQ ID NO: 454786 - RNA, 64 nt, Homo Sapiens
gaucugcaugaccuauaaucuuugaaccacuuucguaccucauguuuuuauccagcacucuuau

SEQ ID NO: 454787 - RNA, 64 nt, Homo Sapiens
auuggauuauuuauaugaaguccauaauguucgaguaccucagggacauuuaagaguuggaggu

SEQ ID NO: 454788 - RNA, 64 nt, Homo Sapiens
aaguuaaacguagagugaccaaaacaguuuggcaguaccucaaaaaauggugcaccugcuuuga

SEQ ID NO: 454789 - RNA, 64 nt, Homo Sapiens
gaugacucaucuacagguuguuaagaaacaccugguaccucaaaugggaaggacuuggagagag

SEQ ID NO: 454790 - RNA, 64 nt, Homo Sapiens
cuucccacccagguaaccccgugggaacgugccaguaccucaccgcacgaccucacugaguccu

SEQ ID NO: 454791 - RNA, 64 nt, Homo Sapiens
aaaucaugcaaucuugcagugugaaaugauucauguaccucacacauuacuuuuuaacuuauau

SEQ ID NO: 454792 - RNA, 64 nt, Homo Sapiens
gggcuccugccugaucuuuguucuuuuucugagaguaccucauacuaccuuaguauggucugca

SEQ ID NO: 454793 - RNA, 64 nt, Homo Sapiens
gacuuugguaucagucaccauuucccuagaacacguaccucagauugccacuuuuguccuuaug

SEQ ID NO: 454794 - RNA, 64 nt, Homo Sapiens
auuuugucuccauacaaaucugaaccccaaguguguaccucauucuucccuuaucacugaaggc

SEQ ID NO: 454795 - RNA, 64 nt, Homo Sapiens
gcacugaagcuggaggacucgucuuuguguuucuguaccucaagagucacucuguuccuugacu

SEQ ID NO: 454796 - RNA, 64 nt, Homo Sapiens
ugugaccuucagcagauuuuuaacacaagucguuguaccucaguccucauugcuacaguacaag

SEQ ID NO: 454797 - RNA, 64 nt, Homo Sapiens
aguugcacauuacuucuacauuggaugagggaaaguaccucaugucaaaaucuuggucaucugu

SEQ ID NO: 454798 - RNA, 64 nt, Homo Sapiens
uguuuuaggugugagauguuagcaaggugccuuuguaccucagggaguuagcugucuagcgccu

SEQ ID NO: 454799 - RNA, 64 nt, Homo Sapiens
aacaaauacaccuauguaccucaaaacaucucacguaccucauauuacacauugcaugccugua

SEQ ID NO: 454800 - RNA, 64 nt, Homo Sapiens
ccaugagacccuggugccugccaucucccacccuguaccucaucuucagcccccagccccuccc

SEQ ID NO: 454801 - RNA, 64 nt, Homo Sapiens
uggacuccugcugggccuucgaagcacagguucuguaccucagaccugccccaggaacauggca

SEQ ID NO: 454802 - RNA, 64 nt, Homo Sapiens
uccugagccucccugugacgcucuggccuucucuguaccucagagugcagaaccacagacggcu

SEQ ID NO: 454803 - RNA, 64 nt, Homo Sapiens
ugcaaccucugccucccagguucaagcacuucucguaccucagacucccgaauagcugggauua

SEQ ID NO: 454804 - RNA, 64 nt, Homo Sapiens
gagccagugauggggcaggaccgaugccagccggguaccucaguuucuccuuuauugcucccgu

SEQ ID NO: 454805 - RNA, 64 nt, Homo Sapiens
auaccuccacugguuuccuggccucaaaguuguaguaccucacaauuuuuaguauuuagauugu

SEQ ID NO: 454806 - RNA, 64 nt, Homo Sapiens
aaauguauuauggugccauguaguaauauucuagguaccucacacucacauuuuuuguuuccau

SEQ ID NO: 454807 - RNA, 64 nt, Homo Sapiens
acccacuacaaauuuggaacauuuaaaaaaagauguaccucacuuucaugggaaauggcccuuc

SEQ ID NO: 454808 - RNA, 64 nt, Homo Sapiens
ugaaaugaagcaacagagaggaaauuguacauaaguaccucagcauuuaauccaaacagggguu

SEQ ID NO: 454809 - RNA, 64 nt, Homo Sapiens
aguaaaagaauuccuuagcaugaugucuguuuugguaccucagcaaugaaccuuuucuagaaau

SEQ ID NO: 454810 - RNA, 64 nt, Homo Sapiens
aggaccccggggggauggcccaggccugcgaggaguaccucagccagauccacaguugccaaac

SEQ ID NO: 454811 - RNA, 64 nt, Homo Sapiens
agggaccgcagguacgagguuuucuguucaacauguaccucacccccuggaacuggagaaagag

SEQ ID NO: 454812 - RNA, 64 nt, Homo Sapiens
aucagaguuggcaaaugauggauccauuguaucaguaccucacauuuaaaauuuuuaagaacuu

SEQ ID NO: 454813 - RNA, 64 nt, Homo Sapiens
gugguuguggacauggaagagcuuagggucagaaguaccucacauagaggcuccuccucugcug

SEQ ID NO: 454814 - RNA, 64 nt, Homo Sapiens
uagauuuuaaaaaaaagaauuagguuuagggaguguaccucagaaagcuuuuuauuacuugcua

SEQ ID NO: 454815 - RNA, 64 nt, Homo Sapiens
uuuuuaggggaggguggguuugcaauaauugaauguaccucaaaaaaauauuaagaccaaguca

SEQ ID NO: 454816 - RNA, 64 nt, Homo Sapiens
gagguaacccaggggucagcgucugugcuuggagguaccucagaggugagguggcaugggagau

SEQ ID NO: 454817 - RNA, 64 nt, Homo Sapiens
cugcugaguagcugguauacuucaaacgauucuuguaccucagcugcaaccucugccuccuaag

SEQ ID NO: 454818 - RNA, 64 nt, Homo Sapiens
uaccacuuaaugaaucucaaaauuuugaguaaauguaccucagucuaaucagacuuuuuaugac

SEQ ID NO: 454819 - RNA, 64 nt, Homo Sapiens
gcuuuuuucuucuuauuguauucuuuuggguuuuguaccucaaguuguauuuauaccucagaua

SEQ ID NO: 454820 - RNA, 64 nt, Homo Sapiens
agcuacagaaguucagccaucauguaaguuguuaguaccucacacgucucuuuuucauacauug

SEQ ID NO: 454821 - RNA, 64 nt, Homo Sapiens
aauuaaauaugcugucacaaagauguaaacuaauguaccucagucucuuagaauaccuauaaaa

SEQ ID NO: 454822 - RNA, 64 nt, Homo Sapiens
uccagagaccuuggguuagguauauccaucuucaguaccucauuggaucacuuuucuuucauca

SEQ ID NO: 454823 - RNA, 64 nt, Homo Sapiens
uugggggccauccugccccuccaacccgacauguguaccucagcuuuuucccucacuugcauca

SEQ ID NO: 454824 - RNA, 64 nt, Homo Sapiens; identical to SEQ ID NO: 454823

SEQ ID NO: 454825 - RNA, 64 nt, Homo Sapiens
guauuuauuguuucccaaaacuguaggauuuauuguaccucacauguuucuguuguuauuauuc

SEQ ID NO: 454826 - RNA, 64 nt, Homo Sapiens
gcuuuagcuggucacuuggaaauauuguucuuguguaccucauugcuuggaugagucagcuggg

SEQ ID NO: 454827 - RNA, 64 nt, Homo Sapiens
ccacauuacagccaugcuccgcugauguacagguguaccucaauaccucugugcagcccggaag

SEQ ID NO: 454828 - RNA, 64 nt, Homo Sapiens
caugguccccagcuucuccucaugguccccuucaguaccucacggugcccaggaugccauccac

SEQ ID NO: 454829 - RNA, 64 nt, Homo Sapiens
ucuggaaaauaacuuauaccguucugugaaaacgguaccucauugaaaaaaaaaaaagaaacca

SEQ ID NO: 454830 - RNA, 64 nt, Homo Sapiens
agcaagcgacucaagagcagggugcagcggccauguaccucaucgugccguggccaaguacaug

SEQ ID NO: 454831 - RNA, 64 nt, Homo Sapiens
uacauacauucauacuguagaaaccagcucauguguaccucauaucccauccuuaagagaagaa

SEQ ID NO: 454832 - RNA, 64 nt, Homo Sapiens
cugggccagagcuggguuaucaugguuggcuuagguaccucagguggcccaggagguccccccu

SEQ ID NO: 454833 - RNA, 64 nt, Homo Sapiens
cugaaggcaaagccucuaugugugaaacacagggguaccucaaaaauagaacaagagcacucca

SEQ ID NO: 454834 - RNA, 64 nt, Homo Sapiens
ucaacugcuacaaauaaauguaauaaugcacccgguaccucaauacacuuuacuguuucgaugc

SEQ ID NO: 454835 - RNA, 64 nt, Homo Sapiens
auuucuacgucaugugccuugaaauuugcauuuuguaccucaauuaucuuaaaaaucuuaugca

SEQ ID NO: 454836 - RNA, 64 nt, Homo Sapiens
cuuuagucccugucaagguucuggaaaguuuucuguaccucauuucuacaccacacucagacuu

SEQ ID NO: 454837 - RNA, 64 nt, Homo Sapiens
agaacaaugagaacauuugcacucuucagaguucguaccucaaauuuuuauuuuuaaugucuug

SEQ ID NO: 454838 - RNA, 64 nt, Homo Sapiens
uagcccuugggggcgucgugacuugcaucgacuuguaccucacucugggagaacuauggcagcu

SEQ ID NO: 454839 - RNA, 64 nt, Homo Sapiens
caggaggaggcugcccugaggggcuggggaggggguaccucaugaggaccaggguggagcugag

SEQ ID NO: 454840 - RNA, 64 nt, Homo Sapiens
uggccugggagucccucccugguuuuuauucucaguaccucaggcuccccuguguacuuggagg

SEQ ID NO: 454841 - RNA, 64 nt, Homo Sapiens
guccuuggaggaaacuuaagaugaauacaugcguguaccucacuuuacauaagaaauguauucc

SEQ ID NO: 454842 - RNA, 64 nt, Homo Sapiens
cauaaccaggucagaaauuuuauucagauaaucuguaccucaucaaucagaugaugacaauuua

SEQ ID NO: 454843 - RNA, 64 nt, Homo Sapiens
gugagcagagggcacugggcgggaaaggcacuggguaccucaggcgggagguacagcuggcaga

SEQ ID NO: 454844 - RNA, 64 nt, Homo Sapiens
ggauuguugggcuugggggagugcucaaucaugaguaccucaaauuccccaccccccccaccac

SEQ ID NO: 454845 - RNA, 64 nt, Homo Sapiens
gguuuuuguguacuuuuuucuuaccugggcuuguguaccucaguagggggcuugcuugguaugc

SEQ ID NO: 454846 - RNA, 64 nt, Homo Sapiens
cuguggcgggagcagaguccaauaggcacccccuguaccucaggcauggggggagccugggccu

SEQ ID NO: 454847 - RNA, 64 nt, Homo Sapiens
uuuugauuagccuucugaccaugauuaaaaugguguaccucaaaguagcugcuaaccuuaugug

SEQ ID NO: 454848 - RNA, 64 nt, Homo Sapiens
cagcccguggugaggcugcccgccgugcccugcaguaccucaagaucauggcaggcagcaagug

SEQ ID NO: 454849 - RNA, 64 nt, Homo Sapiens
ugacuguaauauuuaaauauuacccuccaagucuguaccucaaaugaauucuuuaaggagaugg

SEQ ID NO: 454850 - RNA, 64 nt, Homo Sapiens
caggaaagucggggcuuugauuagagcaaacccaguaccucagagggccuugccaaggucuacc

SEQ ID NO: 454851 - RNA, 64 nt, Homo Sapiens
uugucccuugacuuuagugugcagagcuauuuggguaccucauuuaauucuuuuucaucuauuu

SEQ ID NO: 454852 - RNA, 64 nt, Homo Sapiens
aguuacaugagcauguugugugagagucugcuuuguaccucaagaagcauguuuaacuggaagu

SEQ ID NO: 454853 - RNA, 64 nt, Homo Sapiens
aaaugcaaauuuuccccguugaacacuccuauuuguaccucaacauuaaugccccucucuuaca

SEQ ID NO: 454854 - RNA, 64 nt, Homo Sapiens
guccaauaugaaaaccguaagaaauauauccuguguaccucacuguuaacagcaacgaacccua

SEQ ID NO: 454855 - RNA, 64 nt, Homo Sapiens
gaagccacacuguuugcauggguguuacuugucuguaccucagagucugaggauguuaacuuug

SEQ ID NO: 454856 - RNA, 64 nt, Homo Sapiens
uguuuguaaacaugaauguucaggaacuacugauguaccucaaaaguuuguuuuauuaauugua

SEQ ID NO: 454857 - RNA, 64 nt, Homo Sapiens
gagugagcaagagcaagagcgcauggcuccugcuguaccucaaggugugggcuccugguggcug

SEQ ID NO: 454858 - RNA, 64 nt, Homo Sapiens
guucauuccuguuaccugcaaucaacuuauccuaguaccucaguuaaguuuuguuaacuguguc

SEQ ID NO: 454859 - RNA, 64 nt, Homo Sapiens
uguugaucccaccuuugaaggcaacagcagcucuguaccucaucugucaucagugacugccaua

SEQ ID NO: 454860 - RNA, 64 nt, Homo Sapiens
cagcagaacaucgcugggacucuccucccaccuuguaccucagcgaguaaugaaugaggcauau

SEQ ID NO: 454861 - RNA, 64 nt, Homo Sapiens
gagagaguuuuaacaauccauucacaagccuccuguaccucaguggaucuucagaacugcccuu

SEQ ID NO: 454862 - RNA, 64 nt, Homo Sapiens
guauuuuuuaaaggauucuuuacauaggugauuuguaccucagaugucagagacucauguuuaa

SEQ ID NO: 454863 - RNA, 64 nt, Homo Sapiens
ggaagcauguggaugacacaacuuuuguucccagguaccucauggcugccaacccucccggguc

SEQ ID NO: 454864 - RNA, 64 nt, Homo Sapiens
uggccaccucccgggcuguccgagggaccccaggguaccucacacucggagcucgccugcccug

SEQ ID NO: 454865 - RNA, 64 nt, Homo Sapiens
gugaaucugccugauccccuggcauuuggucagaguaccucagagcaccccacugcucaggggc

SEQ ID NO: 454866 - RNA, 64 nt, Homo Sapiens
cucuuaaguuuuuuguucagcuacuucacacugaguaccucaaaucugcucuggagucgauuau

SEQ ID NO: 454867 - RNA, 64 nt, Homo Sapiens
acauguucuuucaauuucuguauaccaauaaaagguaccucaauuaaucuggaacuuacguucu

SEQ ID NO: 454868 - RNA, 64 nt, Homo Sapiens
cuucccuuaucacugaaggaugaaccccaaguguguaccucauuauuuugucuccauacauauc

SEQ ID NO: 454869 - RNA, 64 nt, Homo Sapiens
caucaccagcuccuguggccuuguagaugacucuguaccucagugaagagugcaggcaaguaga

SEQ ID NO: 454870 - RNA, 64 nt, Homo Sapiens
auuccuaacaccucuuguaacuaaaagaaccauaguaccucacaucacagugcugguagaaaug

SEQ ID NO: 454871 - RNA, 64 nt, Homo Sapiens
ggggggcaggcguaccagacugcaagaccccccaguaccucaccgugccaaauaggaagaggug

SEQ ID NO: 454872 - RNA, 64 nt, Homo Sapiens
ggggaggcuuccuuaccaagugccccuuuagcugguaccucaguugacacaggggcccuuuccu

SEQ ID NO: 454873 - RNA, 64 nt, Homo Sapiens
cugauggugcccauguguucggagucuccgguguguaccucagagugagcgcugggaacagagu

SEQ ID NO: 454874 - RNA, 64 nt, Homo Sapiens
aggggcccuugaaaugucauaagaaacauacaguguaccucaaaaacaaaaacccagcacauac

SEQ ID NO: 454875 - RNA, 64 nt, Homo Sapiens
gcacagcuucuagguagccuauccucuaaacuggguaccucacucccaccuaagugaaauggcc

SEQ ID NO: 454876 - RNA, 64 nt, Homo Sapiens
uccuucuuucuucuggcuuuuuuucuuugaggacguaccucauugugcguggcugggggaggcc

SEQ ID NO: 454877 - RNA, 64 nt, Homo Sapiens
uuagucuuaaccacaguucucacucucuuaaaugguaccucaaaaagcuggagccucucugcca

SEQ ID NO: 454878 - RNA, 64 nt, Homo Sapiens
ugcuucaagaguuccacuuggcucucccaaauagguaccucaaaaacuguuagcaagcggcauu

SEQ ID NO: 454879 - RNA, 64 nt, Homo Sapiens
ucugugugauauuagacaaaauauuugcuucuugguaccucagcuguaaaaugaaacacaccua

SEQ ID NO: 454880 - RNA, 64 nt, Homo Sapiens
uaccaauagauaucuaugaauuugauauauauuuguaccucauauaaguggauucuacaguauu

SEQ ID NO: 454881 - RNA, 64 nt, Homo Sapiens
caagcaccgcucuguaugaauuuuacuaguccggguaccucauauaagaaaacuuaaguuuugg

SEQ ID NO: 454882 - RNA, 64 nt, Homo Sapiens
acccagacccugccucccucagcacggauucccuguaccucaaccccaacaccccaaccacagg

SEQ ID NO: 454883 - RNA, 64 nt, Homo Sapiens
ucucaguaccaauaucugccuguuuuuaauugcaguaccucacuacauuuuuaguuuuuuuguu

SEQ ID NO: 454884 - RNA, 64 nt, Homo Sapiens
cucucugucccucgcguuauucuuuagccucuugguaccucacauaaaggcaaaccucccagcu

SEQ ID NO: 454885 - RNA, 64 nt, Homo Sapiens
auuauuuaugaaggaaaaaauacauaaauaugaaguaccucauguugaauguuauuguacugua

SEQ ID NO: 454886 - RNA, 64 nt, Homo Sapiens
cccugcucuuccucagcugugugggucauaccguguaccucaguucccucuugcucaguggggg

SEQ ID NO: 454887 - RNA, 64 nt, Homo Sapiens
guagcauuugaggaaguaagagaaaagaaucaugguaccucaggguuucuuucccuuuacucgc

SEQ ID NO: 454888 - RNA, 64 nt, Homo Sapiens
ugaggacacugcggggguuggggggggggcgucuguaccucaggggaugccccgcuguggucac

SEQ ID NO: 454889 - RNA, 64 nt, Homo Sapiens
uaaagauguuuuguaccacaauggcuacuuggauguaccucacuuuuggcuuacuugguagaag

SEQ ID NO: 454890 - RNA, 64 nt, Homo Sapiens
ugugucacaugugagcaagcgguagggacauuguguaccucaguggaaggugggacagccggca

SEQ ID NO: 454891 - RNA, 64 nt, Homo Sapiens
ucaauucuuuacaccaaaguaugaacuggagaggguaccucaguuauaaggagucugagaauau

SEQ ID NO: 454892 - RNA, 64 nt, Homo Sapiens
uguacaccaaaaggccauggggaacuuugugcaaguaccucaucgcugagcaaauggagcuugc

SEQ ID NO: 454893 - RNA, 64 nt, Homo Sapiens
uaacaugcugacuaguaaccaugaagauucagauguaccucagcaaugcgccagagcaaagucu

SEQ ID NO: 454894 - RNA, 64 nt, Homo Sapiens
gcaacacuggccccacaguaaaagaggaagucuuguaccucaggcaggcccaucuagagcuauu

SEQ ID NO: 454895 - RNA, 64 nt, Homo Sapiens
auucaccuugucccuugccugccccucucuauuaguaccucauccuccacucaccguuccuuau

SEQ ID NO: 454896 - RNA, 64 nt, Homo Sapiens
cucaagaaaucaaaagauaguugauucuugccuuguaccucaaucuauucuguaaaauuaaaca

SEQ ID NO: 454897 - RNA, 64 nt, Homo Sapiens
aaaaggaacuaacuguugauacaagaacuugguuguaccucagggguauuauggugaacaaaaa

SEQ ID NO: 454898 - RNA, 64 nt, Homo Sapiens
auucuuuuucaacauguagggguuaccagaaccaguaccucaguuuagugggggacugaguuca

SEQ ID NO: 454899 - RNA, 64 nt, Homo Sapiens
agaauacagugguucaaguuuccacagcuuaagaguaccucaucuacauccaaacaaauucuuu

SEQ ID NO: 454900 - RNA, 64 nt, Homo Sapiens
cuauucuguaaaauuaaacauugauucuugccuuguaccucaaucucaagaaaucaaaagauag

SEQ ID NO: 454901 - RNA, 64 nt, Homo Sapiens; identical to SEQ ID NO: 336314

SEQ ID NO: 454902 - RNA, 64 nt, Homo Sapiens; identical to SEQ ID NO: 336315

SEQ ID NO: 454903 - RNA, 64 nt, Homo Sapiens; identical to SEQ ID NO: 336316

SEQ ID NO: 454904 - RNA, 64 nt, Homo Sapiens; identical to SEQ ID NO: 336317

SEQ ID NO: 454905 - RNA, 64 nt, Homo Sapiens; identical to SEQ ID NO: 336318

SEQ ID NO: 454906 - RNA, 64 nt, Homo Sapiens; identical to SEQ ID NO: 336319

SEQ ID NO: 454907 - RNA, 64 nt, Homo Sapiens; identical to SEQ ID NO: 336320

SEQ ID NO: 454908 - RNA, 64 nt, Homo Sapiens; identical to SEQ ID NO: 336321

SEQ ID NO: 454909 - RNA, 64 nt, Homo Sapiens; identical to SEQ ID NO: 336322

SEQ ID NO: 454910 - RNA, 64 nt, Homo Sapiens; identical to SEQ ID NO: 336323

SEQ ID NO: 454911 - RNA, 64 nt, Homo Sapiens; identical to SEQ ID NO: 336324

SEQ ID NO: 454912 - RNA, 64 nt, Homo Sapiens; identical to SEQ ID NO: 336325

SEQ ID NO: 454913 - RNA, 64 nt, Homo Sapiens; identical to SEQ ID NO: 336326

SEQ ID NO: 454914 - RNA, 64 nt, Homo Sapiens; identical to SEQ ID NO: 336327

SEQ ID NO: 454915 - RNA, 64 nt, Homo Sapiens; identical to SEQ ID NO: 336328

SEQ ID NO: 454916 - RNA, 64 nt, Homo Sapiens; identical to SEQ ID NO: 336329

SEQ ID NO: 454917 - RNA, 64 nt, Homo Sapiens; identical to SEQ ID NO: 336330

SEQ ID NO: 454918 - RNA, 64 nt, Homo Sapiens; identical to SEQ ID NO: 336331

SEQ ID NO: 454919 - RNA, 64 nt, Homo Sapiens; identical to SEQ ID NO: 336332

SEQ ID NO: 454920 - RNA, 64 nt, Homo Sapiens; identical to SEQ ID NO: 336333

SEQ ID NO: 454921 - RNA, 64 nt, Homo Sapiens
ggaaccucccugggccugucucagauugggauuaacauaaaagaguggaacuauccaaaagaga

SEQ ID NO: 454922 - RNA, 64 nt, Homo Sapiens
ccccuguacccagccaccuuccugacugggaaggacauaaaagguuuaaugucagggucaaacu

SEQ ID NO: 454923 - RNA, 64 nt, Homo Sapiens
aaaauuacuggggccccaugccugucuccacuaaacauaaaaacucugggaaacaaagcgagac

SEQ ID NO: 454924 - RNA, 64 nt, Homo Sapiens
accauaggauucagcaguucucucaaaggauuaaacauaaaauuuggaaaacaguuuggcaguu

SEQ ID NO: 454925 - RNA, 64 nt, Homo Sapiens
auacauuuauucugcuuaacacaaauuaaaacugacauaaaauuuuaugauaauaacaugauuc

SEQ ID NO: 454926 - RNA, 64 nt, Homo Sapiens
uacuguuuuaucugggcggugaggguauugauuuacauaaaaacuguagacaaacacaguacga

SEQ ID NO: 454927 - RNA, 64 nt, Homo Sapiens
auacauauauacaaaaauuagaaacaucaucucuacauaaaaaaaccagccugugcaacaucau

SEQ ID NO: 454928 - RNA, 64 nt, Homo Sapiens
gaguaaacuacagcagagaaaucuucuuuugcuaacauaaaaauuuuuuuaguaucaaauagug

SEQ ID NO: 454929 - RNA, 64 nt, Homo Sapiens
cagcuagcuuugaaauuggcugaugaaaaaauauacauaaaaggguaaaauucacacauacagc

SEQ ID NO: 454930 - RNA, 64 nt, Homo Sapiens
auugugcauguuuuguaugucauaguaugucgucacauaaaagggagggagcgaaaaaccauua

SEQ ID NO: 454931 - RNA, 64 nt, Homo Sapiens
ucagaagaccuaugaaaagaaaguuguaugugccacauaaaacucugaauauaaaaguugcugu

SEQ ID NO: 454932 - RNA, 64 nt, Homo Sapiens
agcacauaucuaucguaauauauguaauauauugacauaaaagacacaaacuaauauaaaguua

SEQ ID NO: 454933 - RNA, 64 nt, Homo Sapiens
uuuuuaaaaaauuagccaggcccaucucuacaaaacauaaaagauugggcaacacagggcgacc

SEQ ID NO: 454934 - RNA, 64 nt, Homo Sapiens
uccuacuuguuaaaaaagauuuggauaauucuauacauaaaaguacauuguaaauacauuauuc

SEQ ID NO: 454935 - RNA, 64 nt, Homo Sapiens
auaggaggcacuucuuuucauaaagagaagcuaaacauaaaaaggaauuuuaaauuuaacucuu

SEQ ID NO: 454936 - RNA, 64 nt, Homo Sapiens
auacauauauacacauaugcauguguguguguaaacauaaaaguccuuuauuauuaaaaaaugu

SEQ ID NO: 454937 - RNA, 64 nt, Homo Sapiens
aguuaaacuuuguuucucuaauagcuuuuuuuuuacauaaaaaaagacccaggaacuuaauagu

SEQ ID NO: 454938 - RNA, 64 nt, Homo Sapiens
uauauauuuauguuaaaguaauauuuuauuaucuacauaaaacagaaaugcacaauaccuucau

SEQ ID NO: 454939 - RNA, 64 nt, Homo Sapiens
aagcaggugaaaauguuaauagcaacuuuuaaaaacauaaaaaggucacuuuaaauguucuagu

SEQ ID NO: 454940 - RNA, 64 nt, Homo Sapiens
uuauucaguguaauuuaaguuucacuauucuggaacauaaaacuuucaugaagguaaagcuuuc

SEQ ID NO: 454941 - RNA, 64 nt, Homo Sapiens
acuaguauaauuuagucuuuucaugaauguacauacauaaaauuauacauaaaaauauuaaauu

SEQ ID NO: 454942 - RNA, 64 nt, Homo Sapiens
uagucuuuucaugaauguacauacauaaaauuauacauaaaaauauuaaauuauucauuucaaa

SEQ ID NO: 454943 - RNA, 64 nt, Homo Sapiens
guuugccaaagaaguuucugauuucuauuguuuaacauaaaauauuaucauggcuuucuacagu

SEQ ID NO: 454944 - RNA, 64 nt, Homo Sapiens
auuucuacaaugucaagacuagguuuugcacucuacauaaaauugucagcucucauauucuucc

SEQ ID NO: 454945 - RNA, 64 nt, Homo Sapiens
augcccauucaccuccuccuuagacuuaguuuugacauaaaacauacaggagaggaccugugga

SEQ ID NO: 454946 - RNA, 64 nt, Homo Sapiens
cuaaaauuuauuauaggaaaaaaagaaacauuuuacauaaaaugauaaagugacuauuaaccag

SEQ ID NO: 454947 - RNA, 64 nt, Homo Sapiens
aacuaauuuuuuaaauaaauacuggauaaacuuuacauaaaauuuuauucuacauacucauuug

SEQ ID NO: 454948 - RNA, 64 nt, Homo Sapiens
cuuucacuuuggcagaagcaagaaaagcauuaagacauaaaauuuugacuuuuuuuuuuuuuaa

SEQ ID NO: 454949 - RNA, 64 nt, Homo Sapiens
gacaucagcaaacaggaucaaugucaccuguggaacauaaaaagagaagaugcuggauuaaaag

SEQ ID NO: 454950 - RNA, 64 nt, Homo Sapiens
gaaauugauauuuuuucuggaacugaauucuuaaacauaaaacagauaaaaugcaucuuguuac

SEQ ID NO: 454951 - RNA, 64 nt, Homo Sapiens
uucuauaaacuguucuuuggaaaaauuaaguuauacauaaaauucauauuaaacuuuuuacaga

SEQ ID NO: 454952 - RNA, 64 nt, Homo Sapiens
cuccuuuugacuuauuugguauguuguauauauuacauaaaauaacuuuucaaauauaguuuaa

SEQ ID NO: 454953 - RNA, 64 nt, Homo Sapiens
aggauauuuguuuguauguuuauucaguauacuuacauaaaaauuauuucgccaucagccaaaa

SEQ ID NO: 454954 - RNA, 64 nt, Homo Sapiens
guauuuaaaacauuucauguauuucuuuagaacaacauaaaauuaaaauuuaacaucugcagug

SEQ ID NO: 454955 - RNA, 64 nt, Homo Sapiens
agucuuaugaauagacauaaauuguaauuugggaacauaaaaacuacugaauaaaucauguggc

SEQ ID NO: 454956 - RNA, 64 nt, Homo Sapiens
aagaguaaaugggggaaaaggcaguguuuaauuaacauaaaaacucauuuuuguauuucuugga

SEQ ID NO: 454957 - RNA, 64 nt, Homo Sapiens
auucuuguguucauguugucauuugaaacucuucacauaaaauuuucuaauauucauuuggaaa

SEQ ID NO: 454958 - RNA, 64 nt, Homo Sapiens
uuaguccuuugagacugacauuaauacaaaauguacauaaaacguacuguuuagcugaguucag

SEQ ID NO: 454959 - RNA, 64 nt, Homo Sapiens
uuaagaggggccaagaggaaaaaaauaaauaaaaacauaaaaaaguucuaugcugccaaagauu

SEQ ID NO: 454960 - RNA, 64 nt, Homo Sapiens
gaugaaaauguugcacauucuauaguugcaaaacacauaaaaggggacuuaacauuucacguug

SEQ ID NO: 454961 - RNA, 64 nt, Homo Sapiens
ucuuauauccccauauggaauuuauccaucaaccacauaaaaacaaacagugccuucugcccuc

SEQ ID NO: 454962 - RNA, 64 nt, Homo Sapiens
ugaugaugaauauaaaaaagaaauacauaaaaauacauaaaaucuuucugcuuuuuaaauacaa

SEQ ID NO: 454963 - RNA, 64 nt, Homo Sapiens
acauaaaaucugaugaugaauuaaauacaaaaauacauaaaaauauaggaaaguuuucugcuuu

SEQ ID NO: 454964 - RNA, 64 nt, Homo Sapiens
uagcuguguguggcgucuguaaauaaaaacgaauacauaaaaaugagacccugucucugcaaaa

SEQ ID NO: 454965 - RNA, 64 nt, Homo Sapiens
caagaaaacagcauggccagguccuguucuuccuacauaaaaugugguggagggagaugccugg

SEQ ID NO: 454966 - RNA, 64 nt, Homo Sapiens
caaggcaaagcccgcauaauuucccccgaccuaaacauaaaagagcgguugucagccccuuccu

SEQ ID NO: 454967 - RNA, 64 nt, Homo Sapiens
caaaaacaggaaucaugccgacuuuagagcacugacauaaaacgccugcaccuaggcuaggaua

SEQ ID NO: 454968 - RNA, 64 nt, Homo Sapiens
uuuucauccuuacaauccugucccaugguauuuaacauaaaaaaaaauaaaacuguuaacagau

SEQ ID NO: 454969 - RNA, 64 nt, Homo Sapiens
auugucuuaguuugagagauggcugaaauaaugaacauaaaaugcuauuuauaauaacaaguau

SEQ ID NO: 454970 - RNA, 64 nt, Homo Sapiens
acucacuggagagauacucuagguccuugcauagacauaaaagggaaaagcauugaguucucuc

SEQ ID NO: 454971 - RNA, 64 nt, Homo Sapiens
acucacagagcagaaaaacuuaacaccauugucaacauaaaacagaaagugaucgauuuuuuuu

SEQ ID NO: 454972 - RNA, 64 nt, Homo Sapiens
aaucauacuggugaggaacuucaaacuuuucuaaacauaaaauaacaguaauucugacaacacc

SEQ ID NO: 454973 - RNA, 64 nt, Homo Sapiens
acuuaaacuggagagaaacucuaaaucuuacuaaacauaaaaaagcaaagcauuuaacuggucc

SEQ ID NO: 454974 - RNA, 64 nt, Homo Sapiens
ugcaagaaaauguagaaauuuuaaaguguggcaaacauaaaauuuuaaaaaaaaaauuagauuc

SEQ ID NO: 454975 - RNA, 64 nt, Homo Sapiens
auucauacuggagggaacucucaacucuuacuaaacauaaaaaagcaaagccuuuuaccagucc

SEQ ID NO: 454976 - RNA, 64 nt, Homo Sapiens
cacuguugcaauaaaagcacccguaguagcaaaaacauaaaacaaauaaaacuucccccacauc

SEQ ID NO: 454977 - RNA, 64 nt, Homo Sapiens
agaggacugaccucuacaguucauauuugcagugacauaaaaggcaaagaggagcuggcauggu

SEQ ID NO: 454978 - RNA, 64 nt, Homo Sapiens
gugaugcaauaaccagcauaauaaaaaggcaaucacauaaaaaagaguuuagucgucuaaacau

SEQ ID NO: 454979 - RNA, 64 nt, Homo Sapiens
aagagagaggcugagaaaugcagagaagaauaagacauaaaauagcuccgaccuccaugauccg

SEQ ID NO: 454980 - RNA, 64 nt, Homo Sapiens
guauuuuuaggauucaugaaaauaacauaaaauaacauaaaacacagauuuaacauaaguagua

SEQ ID NO: 454981 - RNA, 64 nt, Homo Sapiens
acauaaaacaguauuuuuagauaaguaguaaauaacauaaaauauguguuguuccagauuuaac

SEQ ID NO: 454982 - RNA, 64 nt, Homo Sapiens
guuuuugcuaaauuuacaguauuuaggcuucuguacauaaaaguuauucuaaaccuccuaagau

SEQ ID NO: 454983 - RNA, 64 nt, Homo Sapiens
aaaaaaaaagauuuccaaaauuuugccaccguaaacauaaaaaaauguucuuuucauagucgua

SEQ ID NO: 454984 - RNA, 64 nt, Homo Sapiens
uuuuauuuucuucugauuuugcaacuaaaaugaaacauaaaaccagaauaaguauaaacauaaa

SEQ ID NO: 454985 - RNA, 64 nt, Homo Sapiens
ugaccauuuaacuuauggcugagacaaagugaaaacauaaaaugaaguucuuaaauuaguuaug

SEQ ID NO: 454986 - RNA, 64 nt, Homo Sapiens; identical to SEQ ID NO: 97018

SEQ ID NO: 454987 - RNA, 64 nt, Homo Sapiens; identical to SEQ ID NO: 97019

SEQ ID NO: 454988 - RNA, 64 nt, Homo Sapiens; identical to SEQ ID NO: 97020

SEQ ID NO: 454989 - RNA, 64 nt, Homo Sapiens; identical to SEQ ID NO: 97021

SEQ ID NO: 454990 - RNA, 64 nt, Homo Sapiens; identical to SEQ ID NO: 97022

SEQ ID NO: 454991 - RNA, 64 nt, Homo Sapiens; identical to SEQ ID NO: 97023

SEQ ID NO: 454992 - RNA, 64 nt, Homo Sapiens; identical to SEQ ID NO: 97024

SEQ ID NO: 454993 - RNA, 64 nt, Homo Sapiens; identical to SEQ ID NO: 97025

SEQ ID NO: 454994 - RNA, 64 nt, Homo Sapiens; identical to SEQ ID NO: 97026

SEQ ID NO: 454995 - RNA, 64 nt, Homo Sapiens; identical to SEQ ID NO: 97027

SEQ ID NO: 454996 - RNA, 64 nt, Homo Sapiens; identical to SEQ ID NO: 97028

SEQ ID NO: 454997 - RNA, 64 nt, Homo Sapiens; identical to SEQ ID NO: 124517

SEQ ID NO: 454998 - RNA, 64 nt, Homo Sapiens; identical to SEQ ID NO: 124518

SEQ ID NO: 454999 - RNA, 63 nt, Homo Sapiens; identical to SEQ ID NO: 124519

SEQ ID NO: 455000 - RNA, 64 nt, Homo Sapiens; identical to SEQ ID NO: 124520

SEQ ID NO: 455001 - RNA, 64 nt, Homo Sapiens; identical to SEQ ID NO: 124521

SEQ ID NO: 455002 - RNA, 64 nt, Homo Sapiens; identical to SEQ ID NO: 124522

SEQ ID NO: 455003 - RNA, 64 nt, Homo Sapiens; identical to SEQ ID NO: 124523

SEQ ID NO: 455004 - RNA, 64 nt, Homo Sapiens; identical to SEQ ID NO: 124524

SEQ ID NO: 455005 - RNA, 64 nt, Homo Sapiens; identical to SEQ ID NO: 124525

SEQ ID NO: 455006 - RNA, 64 nt, Homo Sapiens; identical to SEQ ID NO: 124526

SEQ ID NO: 455007 - RNA, 64 nt, Homo Sapiens; identical to SEQ ID NO: 124527

SEQ ID NO: 455008 - RNA, 64 nt, Homo Sapiens; identical to SEQ ID NO: 124528

SEQ ID NO: 455009 - RNA, 64 nt, Homo Sapiens; identical to SEQ ID NO: 124529

SEQ ID NO: 455010 - RNA, 64 nt, Homo Sapiens; identical to SEQ ID NO: 124530

SEQ ID NO: 455011 - RNA, 64 nt, Homo Sapiens; identical to SEQ ID NO: 124531

SEQ ID NO: 455012 - RNA, 64 nt, Homo Sapiens; identical to SEQ ID NO: 124532

SEQ ID NO: 455013 - RNA, 64 nt, Homo Sapiens; identical to SEQ ID NO: 124533

SEQ ID NO: 455014 - RNA, 64 nt, Homo Sapiens; identical to SEQ ID NO: 124534

SEQ ID NO: 455015 - RNA, 64 nt, Homo Sapiens; identical to SEQ ID NO: 124535

SEQ ID NO: 455016 - RNA, 64 nt, Homo Sapiens; identical to SEQ ID NO: 124536

SEQ ID NO: 455017 - RNA, 64 nt, Homo Sapiens; identical to SEQ ID NO: 124537

SEQ ID NO: 455018 - RNA, 64 nt, Homo Sapiens; identical to SEQ ID NO: 124538

SEQ ID NO: 455019 - RNA, 64 nt, Homo Sapiens; identical to SEQ ID NO: 124539

SEQ ID NO: 455020 - RNA, 64 nt, Homo Sapiens; identical to SEQ ID NO: 124540

SEQ ID NO: 455021 - RNA, 64 nt, Homo Sapiens; identical to SEQ ID NO: 124541

SEQ ID NO: 455022 - RNA, 64 nt, Homo Sapiens; identical to SEQ ID NO: 124542

SEQ ID NO: 455023 - RNA, 64 nt, Homo Sapiens; identical to SEQ ID NO: 124543

SEQ ID NO: 455024 - RNA, 64 nt, Homo Sapiens; identical to SEQ ID NO: 124544

SEQ ID NO: 455025 - RNA, 64 nt, Homo Sapiens; identical to SEQ ID NO: 124545

SEQ ID NO: 455026 - RNA, 64 nt, Homo Sapiens; identical to SEQ ID NO: 124546

SEQ ID NO: 455027 - RNA, 64 nt, Homo Sapiens; identical to SEQ ID NO: 124547

SEQ ID NO: 455028 - RNA, 64 nt, Homo Sapiens; identical to SEQ ID NO: 124548

SEQ ID NO: 455029 - RNA, 64 nt, Homo Sapiens; identical to SEQ ID NO: 124549

SEQ ID NO: 455030 - RNA, 64 nt, Homo Sapiens; identical to SEQ ID NO: 124550

SEQ ID NO: 455031 - RNA, 64 nt, Homo Sapiens; identical to SEQ ID NO: 124551

SEQ ID NO: 455032 - RNA, 64 nt, Homo Sapiens; identical to SEQ ID NO: 124552

SEQ ID NO: 455033 - RNA, 64 nt, Homo Sapiens; identical to SEQ ID NO: 124553

SEQ ID NO: 455034 - RNA, 64 nt, Homo Sapiens; identical to SEQ ID NO: 124554

SEQ ID NO: 455035 - RNA, 64 nt, Homo Sapiens; identical to SEQ ID NO: 124555

SEQ ID NO: 455036 - RNA, 64 nt, Homo Sapiens; identical to SEQ ID NO: 124556

SEQ ID NO: 455037 - RNA, 64 nt, Homo Sapiens; identical to SEQ ID NO: 124557

SEQ ID NO: 455038 - RNA, 64 nt, Homo Sapiens; identical to SEQ ID NO: 124558

SEQ ID NO: 455039 - RNA, 64 nt, Homo Sapiens; identical to SEQ ID NO: 124559

SEQ ID NO: 455040 - RNA, 64 nt, Homo Sapiens; identical to SEQ ID NO: 124560

SEQ ID NO: 455041 - RNA, 64 nt, Homo Sapiens; identical to SEQ ID NO: 124561

SEQ ID NO: 455042 - RNA, 64 nt, Homo Sapiens; identical to SEQ ID NO: 124562

SEQ ID NO: 455043 - RNA, 64 nt, Homo Sapiens; identical to SEQ ID NO: 124563

SEQ ID NO: 455044 - RNA, 64 nt, Homo Sapiens; identical to SEQ ID NO: 124564

SEQ ID NO: 455045 - RNA, 64 nt, Homo Sapiens; identical to SEQ ID NO: 124565

SEQ ID NO: 455046 - RNA, 64 nt, Homo Sapiens; identical to SEQ ID NO: 124566

SEQ ID NO: 455047 - RNA, 64 nt, Homo Sapiens; identical to SEQ ID NO: 124567

SEQ ID NO: 455048 - RNA, 64 nt, Homo Sapiens; identical to SEQ ID NO: 124568

SEQ ID NO: 455049 - RNA, 64 nt, Homo Sapiens; identical to SEQ ID NO: 124569

SEQ ID NO: 455050 - RNA, 64 nt, Homo Sapiens; identical to SEQ ID NO: 124570

SEQ ID NO: 455051 - RNA, 64 nt, Homo Sapiens; identical to SEQ ID NO: 124571

SEQ ID NO: 455052 - RNA, 64 nt, Homo Sapiens; identical to SEQ ID NO: 124572

SEQ ID NO: 455053 - RNA, 64 nt, Homo Sapiens; identical to SEQ ID NO: 124573

SEQ ID NO: 455054 - RNA, 64 nt, Homo Sapiens; identical to SEQ ID NO: 124574

SEQ ID NO: 455055 - RNA, 64 nt, Homo Sapiens; identical to SEQ ID NO: 124575

SEQ ID NO: 455056 - RNA, 64 nt, Homo Sapiens; identical to SEQ ID NO: 124576

SEQ ID NO: 455057 - RNA, 64 nt, Homo Sapiens; identical to SEQ ID NO: 124577

SEQ ID NO: 455058 - RNA, 64 nt, Homo Sapiens; identical to SEQ ID NO: 124578

SEQ ID NO: 455059 - RNA, 64 nt, Homo Sapiens; identical to SEQ ID NO: 124579

SEQ ID NO: 455060 - RNA, 64 nt, Homo Sapiens; identical to SEQ ID NO: 124580

SEQ ID NO: 455061 - RNA, 64 nt, Homo Sapiens; identical to SEQ ID NO: 124581

SEQ ID NO: 455062 - RNA, 64 nt, Homo Sapiens; identical to SEQ ID NO: 124582

SEQ ID NO: 455063 - RNA, 64 nt, Homo Sapiens; identical to SEQ ID NO: 124583

SEQ ID NO: 455064 - RNA, 64 nt, Homo Sapiens; identical to SEQ ID NO: 124584

SEQ ID NO: 455065 - RNA, 64 nt, Homo Sapiens; identical to SEQ ID NO: 124585

SEQ ID NO: 455066 - RNA, 64 nt, Homo Sapiens; identical to SEQ ID NO: 124586

SEQ ID NO: 455067 - RNA, 64 nt, Homo Sapiens; identical to SEQ ID NO: 124587

SEQ ID NO: 455068 - RNA, 64 nt, Homo Sapiens; identical to SEQ ID NO: 124588

SEQ ID NO: 455069 - RNA, 64 nt, Homo Sapiens; identical to SEQ ID NO: 124589

SEQ ID NO: 455070 - RNA, 64 nt, Homo Sapiens; identical to SEQ ID NO: 124590

SEQ ID NO: 455071 - RNA, 64 nt, Homo Sapiens; identical to SEQ ID NO: 124591

SEQ ID NO: 455072 - RNA, 64 nt, Homo Sapiens; identical to SEQ ID NO: 124592

SEQ ID NO: 455073 - RNA, 64 nt, Homo Sapiens; identical to SEQ ID NO: 124593

SEQ ID NO: 455074 - RNA, 64 nt, Homo Sapiens; identical to SEQ ID NO: 124594

SEQ ID NO: 455075 - RNA, 64 nt, Homo Sapiens; identical to SEQ ID NO: 124595

SEQ ID NO: 455076 - RNA, 64 nt, Homo Sapiens; identical to SEQ ID NO: 124596

SEQ ID NO: 455077 - RNA, 64 nt, Homo Sapiens; identical to SEQ ID NO: 124597

SEQ ID NO: 455078 - RNA, 64 nt, Homo Sapiens; identical to SEQ ID NO: 124598

SEQ ID NO: 455079 - RNA, 64 nt, Homo Sapiens; identical to SEQ ID NO: 124599

SEQ ID NO: 455080 - RNA, 64 nt, Homo Sapiens; identical to SEQ ID NO: 124600

SEQ ID NO: 455081 - RNA, 64 nt, Homo Sapiens; identical to SEQ ID NO: 124601

SEQ ID NO: 455082 - RNA, 64 nt, Homo Sapiens; identical to SEQ ID NO: 124602

SEQ ID NO: 455083 - RNA, 64 nt, Homo Sapiens; identical to SEQ ID NO: 124603

SEQ ID NO: 455084 - RNA, 64 nt, Homo Sapiens; identical to SEQ ID NO: 124604

SEQ ID NO: 455085 - RNA, 64 nt, Homo Sapiens; identical to SEQ ID NO: 124605

SEQ ID NO: 455086 - RNA, 64 nt, Homo Sapiens; identical to SEQ ID NO: 124606

SEQ ID NO: 455087 - RNA, 64 nt, Homo Sapiens; identical to SEQ ID NO: 124607

SEQ ID NO: 455088 - RNA, 64 nt, Homo Sapiens; identical to SEQ ID NO: 124608

SEQ ID NO: 455089 - RNA, 64 nt, Homo Sapiens; identical to SEQ ID NO: 124609

SEQ ID NO: 455090 - RNA, 64 nt, Homo Sapiens; identical to SEQ ID NO: 124610

SEQ ID NO: 455091 - RNA, 64 nt, Homo Sapiens; identical to SEQ ID NO: 124611

SEQ ID NO: 455092 - RNA, 64 nt, Homo Sapiens; identical to SEQ ID NO: 124612

SEQ ID NO: 455093 - RNA, 64 nt, Homo Sapiens; identical to SEQ ID NO: 124613

SEQ ID NO: 455094 - RNA, 64 nt, Homo Sapiens; identical to SEQ ID NO: 124614

SEQ ID NO: 455095 - RNA, 58 nt, Homo Sapiens; identical to SEQ ID NO: 124615

SEQ ID NO: 455096 - RNA, 64 nt, Homo Sapiens; identical to SEQ ID NO: 124616

SEQ ID NO: 455097 - RNA, 64 nt, Homo Sapiens; identical to SEQ ID NO: 124617

SEQ ID NO: 455098 - RNA, 64 nt, Homo Sapiens; identical to SEQ ID NO: 124618

SEQ ID NO: 455099 - RNA, 64 nt, Homo Sapiens; identical to SEQ ID NO: 124619

SEQ ID NO: 455100 - RNA, 64 nt, Homo Sapiens; identical to SEQ ID NO: 124620

SEQ ID NO: 455101 - RNA, 64 nt, Homo Sapiens; identical to SEQ ID NO: 124621

SEQ ID NO: 455102 - RNA, 64 nt, Homo Sapiens; identical to SEQ ID NO: 124622

SEQ ID NO: 455103 - RNA, 64 nt, Homo Sapiens; identical to SEQ ID NO: 124623

SEQ ID NO: 455104 - RNA, 64 nt, Homo Sapiens; identical to SEQ ID NO: 124624

SEQ ID NO: 455105 - RNA, 64 nt, Homo Sapiens; identical to SEQ ID NO: 124625

SEQ ID NO: 455106 - RNA, 64 nt, Homo Sapiens; identical to SEQ ID NO: 124626

SEQ ID NO: 455107 - RNA, 64 nt, Homo Sapiens; identical to SEQ ID NO: 124627

SEQ ID NO: 455108 - RNA, 64 nt, Homo Sapiens; identical to SEQ ID NO: 124628

SEQ ID NO: 455109 - RNA, 64 nt, Homo Sapiens; identical to SEQ ID NO: 124629

SEQ ID NO: 455110 - RNA, 64 nt, Homo Sapiens; identical to SEQ ID NO: 124630

SEQ ID NO: 455111 - RNA, 64 nt, Homo Sapiens; identical to SEQ ID NO: 124631

SEQ ID NO: 455112 - RNA, 64 nt, Homo Sapiens; identical to SEQ ID NO: 124632

SEQ ID NO: 455113 - RNA, 64 nt, Homo Sapiens; identical to SEQ ID NO: 124633

SEQ ID NO: 455114 - RNA, 64 nt, Homo Sapiens; identical to SEQ ID NO: 124634

SEQ ID NO: 455115 - RNA, 64 nt, Homo Sapiens; identical to SEQ ID NO: 124635

SEQ ID NO: 455116 - RNA, 64 nt, Homo Sapiens; identical to SEQ ID NO: 124636

SEQ ID NO: 455117 - RNA, 64 nt, Homo Sapiens; identical to SEQ ID NO: 124637

SEQ ID NO: 455118 - RNA, 64 nt, Homo Sapiens; identical to SEQ ID NO: 124638

SEQ ID NO: 455119 - RNA, 64 nt, Homo Sapiens; identical to SEQ ID NO: 124639

SEQ ID NO: 455120 - RNA, 64 nt, Homo Sapiens; identical to SEQ ID NO: 124640

SEQ ID NO: 455121 - RNA, 64 nt, Homo Sapiens; identical to SEQ ID NO: 124641

SEQ ID NO: 455122 - RNA, 64 nt, Homo Sapiens; identical to SEQ ID NO: 124642

SEQ ID NO: 455123 - RNA, 64 nt, Homo Sapiens; identical to SEQ ID NO: 124643

SEQ ID NO: 455124 - RNA, 64 nt, Homo Sapiens; identical to SEQ ID NO: 124644

SEQ ID NO: 455125 - RNA, 64 nt, Homo Sapiens; identical to SEQ ID NO: 124645

SEQ ID NO: 455126 - RNA, 64 nt, Homo Sapiens; identical to SEQ ID NO: 124646

SEQ ID NO: 455127 - RNA, 64 nt, Homo Sapiens; identical to SEQ ID NO: 124647

SEQ ID NO: 455128 - RNA, 64 nt, Homo Sapiens; identical to SEQ ID NO: 124648

SEQ ID NO: 455129 - RNA, 64 nt, Homo Sapiens; identical to SEQ ID NO: 124649

SEQ ID NO: 455130 - RNA, 64 nt, Homo Sapiens; identical to SEQ ID NO: 124650

SEQ ID NO: 455131 - RNA, 64 nt, Homo Sapiens; identical to SEQ ID NO: 124651

SEQ ID NO: 455132 - RNA, 64 nt, Homo Sapiens; identical to SEQ ID NO: 124652

SEQ ID NO: 455133 - RNA, 64 nt, Homo Sapiens; identical to SEQ ID NO: 124653

SEQ ID NO: 455134 - RNA, 64 nt, Homo Sapiens; identical to SEQ ID NO: 124654

SEQ ID NO: 455135 - RNA, 64 nt, Homo Sapiens; identical to SEQ ID NO: 124655

SEQ ID NO: 455136 - RNA, 64 nt, Homo Sapiens; identical to SEQ ID NO: 124656

SEQ ID NO: 455137 - RNA, 64 nt, Homo Sapiens; identical to SEQ ID NO: 124657

SEQ ID NO: 455138 - RNA, 64 nt, Homo Sapiens; identical to SEQ ID NO: 124658

SEQ ID NO: 455139 - RNA, 64 nt, Homo Sapiens; identical to SEQ ID NO: 124659

SEQ ID NO: 455140 - RNA, 64 nt, Homo Sapiens; identical to SEQ ID NO: 124660

SEQ ID NO: 455141 - RNA, 64 nt, Homo Sapiens; identical to SEQ ID NO: 124661

SEQ ID NO: 455142 - RNA, 64 nt, Homo Sapiens; identical to SEQ ID NO: 124662

SEQ ID NO: 455143 - RNA, 64 nt, Homo Sapiens; identical to SEQ ID NO: 124663

SEQ ID NO: 455144 - RNA, 64 nt, Homo Sapiens; identical to SEQ ID NO: 124664

SEQ ID NO: 455145 - RNA, 64 nt, Homo Sapiens; identical to SEQ ID NO: 124665

SEQ ID NO: 455146 - RNA, 64 nt, Homo Sapiens; identical to SEQ ID NO: 124666

SEQ ID NO: 455147 - RNA, 64 nt, Homo Sapiens; identical to SEQ ID NO: 124667

SEQ ID NO: 455148 - RNA, 64 nt, Homo Sapiens; identical to SEQ ID NO: 124668

SEQ ID NO: 455149 - RNA, 64 nt, Homo Sapiens; identical to SEQ ID NO: 124669

SEQ ID NO: 455150 - RNA, 64 nt, Homo Sapiens; identical to SEQ ID NO: 124670

SEQ ID NO: 455151 - RNA, 64 nt, Homo Sapiens; identical to SEQ ID NO: 124671

SEQ ID NO: 455152 - RNA, 64 nt, Homo Sapiens; identical to SEQ ID NO: 124672

SEQ ID NO: 455153 - RNA, 64 nt, Homo Sapiens; identical to SEQ ID NO: 124673

SEQ ID NO: 455154 - RNA, 64 nt, Homo Sapiens; identical to SEQ ID NO: 124674

SEQ ID NO: 455155 - RNA, 64 nt, Homo Sapiens; identical to SEQ ID NO: 124675

SEQ ID NO: 455156 - RNA, 64 nt, Homo Sapiens; identical to SEQ ID NO: 124676

SEQ ID NO: 455157 - RNA, 64 nt, Homo Sapiens; identical to SEQ ID NO: 124677

SEQ ID NO: 455158 - RNA, 64 nt, Homo Sapiens; identical to SEQ ID NO: 124678

SEQ ID NO: 455159 - RNA, 64 nt, Homo Sapiens; identical to SEQ ID NO: 124679

SEQ ID NO: 455160 - RNA, 64 nt, Homo Sapiens; identical to SEQ ID NO: 124680

SEQ ID NO: 455161 - RNA, 64 nt, Homo Sapiens; identical to SEQ ID NO: 124681

SEQ ID NO: 455162 - RNA, 64 nt, Homo Sapiens; identical to SEQ ID NO: 124682

SEQ ID NO: 455163 - RNA, 64 nt, Homo Sapiens; identical to SEQ ID NO: 124683

SEQ ID NO: 455164 - RNA, 64 nt, Homo Sapiens; identical to SEQ ID NO: 124684

SEQ ID NO: 455165 - RNA, 64 nt, Homo Sapiens; identical to SEQ ID NO: 124685

SEQ ID NO: 455166 - RNA, 64 nt, Homo Sapiens; identical to SEQ ID NO: 124686

SEQ ID NO: 455167 - RNA, 64 nt, Homo Sapiens; identical to SEQ ID NO: 124687

SEQ ID NO: 455168 - RNA, 64 nt, Homo Sapiens; identical to SEQ ID NO: 124688

SEQ ID NO: 455169 - RNA, 64 nt, Homo Sapiens; identical to SEQ ID NO: 124689

SEQ ID NO: 455170 - RNA, 64 nt, Homo Sapiens; identical to SEQ ID NO: 124690

SEQ ID NO: 455171 - RNA, 64 nt, Homo Sapiens; identical to SEQ ID NO: 124691

SEQ ID NO: 455172 - RNA, 64 nt, Homo Sapiens; identical to SEQ ID NO: 124692

SEQ ID NO: 455173 - RNA, 64 nt, Homo Sapiens; identical to SEQ ID NO: 124693

SEQ ID NO: 455174 - RNA, 64 nt, Homo Sapiens; identical to SEQ ID NO: 124694

SEQ ID NO: 455175 - RNA, 64 nt, Homo Sapiens; identical to SEQ ID NO: 124695

SEQ ID NO: 455176 - RNA, 64 nt, Homo Sapiens; identical to SEQ ID NO: 124696

SEQ ID NO: 455177 - RNA, 64 nt, Homo Sapiens; identical to SEQ ID NO: 124697

SEQ ID NO: 455178 - RNA, 64 nt, Homo Sapiens; identical to SEQ ID NO: 124698

SEQ ID NO: 455179 - RNA, 64 nt, Homo Sapiens; identical to SEQ ID NO: 124699

SEQ ID NO: 455180 - RNA, 64 nt, Homo Sapiens; identical to SEQ ID NO: 124700

SEQ ID NO: 455181 - RNA, 64 nt, Homo Sapiens; identical to SEQ ID NO: 124701

SEQ ID NO: 455182 - RNA, 64 nt, Homo Sapiens; identical to SEQ ID NO: 124702

SEQ ID NO: 455183 - RNA, 64 nt, Homo Sapiens; identical to SEQ ID NO: 124703

SEQ ID NO: 455184 - RNA, 64 nt, Homo Sapiens; identical to SEQ ID NO: 124704

SEQ ID NO: 455185 - RNA, 64 nt, Homo Sapiens; identical to SEQ ID NO: 124705

SEQ ID NO: 455186 - RNA, 64 nt, Homo Sapiens; identical to SEQ ID NO: 124706

SEQ ID NO: 455187 - RNA, 64 nt, Homo Sapiens; identical to SEQ ID NO: 124707

SEQ ID NO: 455188 - RNA, 64 nt, Homo Sapiens; identical to SEQ ID NO: 124708

SEQ ID NO: 455189 - RNA, 64 nt, Homo Sapiens; identical to SEQ ID NO: 124709

SEQ ID NO: 455190 - RNA, 64 nt, Homo Sapiens; identical to SEQ ID NO: 124710

SEQ ID NO: 455191 - RNA, 64 nt, Homo Sapiens; identical to SEQ ID NO: 124711

SEQ ID NO: 455192 - RNA, 64 nt, Homo Sapiens; identical to SEQ ID NO: 124712

SEQ ID NO: 455193 - RNA, 64 nt, Homo Sapiens; identical to SEQ ID NO: 124713

SEQ ID NO: 455194 - RNA, 64 nt, Homo Sapiens; identical to SEQ ID NO: 124714

SEQ ID NO: 455195 - RNA, 64 nt, Homo Sapiens; identical to SEQ ID NO: 124715

SEQ ID NO: 455196 - RNA, 64 nt, Homo Sapiens; identical to SEQ ID NO: 124716

SEQ ID NO: 455197 - RNA, 64 nt, Homo Sapiens; identical to SEQ ID NO: 124717

SEQ ID NO: 455198 - RNA, 64 nt, Homo Sapiens; identical to SEQ ID NO: 124718

SEQ ID NO: 455199 - RNA, 64 nt, Homo Sapiens; identical to SEQ ID NO: 124719

SEQ ID NO: 455200 - RNA, 64 nt, Homo Sapiens; identical to SEQ ID NO: 298977

SEQ ID NO: 455201 - RNA, 64 nt, Homo Sapiens; identical to SEQ ID NO: 298978

SEQ ID NO: 455202 - RNA, 64 nt, Homo Sapiens
guucugaaauauggaauguaaauuggacugucuggaaagcuaaaugaauuuguaaacaaaacaa

SEQ ID NO: 455203 - RNA, 64 nt, Homo Sapiens
agcaaauuuaugaaacuaaaauaugccuguugaugaaagcuaaagaucaugguagguuaagaaa

SEQ ID NO: 455204 - RNA, 64 nt, Homo Sapiens
uuuaaaaacaagacaucuccagguaggaaaaaaugaaagcuauuucaugcaaacauuaucuaau

SEQ ID NO: 455205 - RNA, 64 nt, Homo Sapiens
guggcagugauuggucuguuuguggagaauguaugaaagcuauuaauauucuagaauagauuaa

SEQ ID NO: 455206 - RNA, 64 nt, Homo Sapiens
gugauccuaaauaugacagucuuggaaaucaguagaaagcuaaacuaaaugaaucgcaaguuaa

SEQ ID NO: 455207 - RNA, 64 nt, Homo Sapiens
ugaaucgcaaguuaacuugguaagagcuauuuuagaaagcuaaagauaaccaguaaggaaauau

SEQ ID NO: 455208 - RNA, 64 nt, Homo Sapiens
acgucaguggggcaagaaaucuggagugagugaagaaagcuaaguugugaacaagaguguuuuu

SEQ ID NO: 455209 - RNA, 64 nt, Homo Sapiens
uaaaauuggaagagacuucaaagacugucaaguggaaagcuaucauuuccuaaauuaaggaacu

SEQ ID NO: 455210 - RNA, 64 nt, Homo Sapiens
auucagccuucaaacuacuacugaucaacuaaaggaaagcuaauaagguauuucuuuuaaacaa

SEQ ID NO: 455211 - RNA, 64 nt, Homo Sapiens
cguauuccgucugcacaggcaaccaaggccaguagaaagcuauggcugcaaaacccuggggugg

SEQ ID NO: 455212 - RNA, 63 nt, Homo Sapiens
aguguacaccugcaagggcucaggcauugcacacggugugaggcagcccugcugcacauggca

SEQ ID NO: 455213 - RNA, 63 nt, Homo Sapiens
ggucuacaccugcacaggcucaggcauugcacacggugugaagcagcccugcugcacagggug

SEQ ID NO: 455214 - RNA, 57 nt, Homo Sapiens
gggagucaccucgacacugagggcccucggugugaagaugaaccuuccaccgucuuc

SEQ ID NO: 455215 - RNA, 63 nt, Homo Sapiens
ccauauaauuagagaauuuuaagugcuuuagagcggugugauucuacugugcucagccuaguc

SEQ ID NO: 455216 - RNA, 64 nt, Homo Sapiens
caccaugccuuugaccagggguggccugaacacacaccuucagcuagcugucccacacaacuca

SEQ ID NO: 455217 - RNA, 64 nt, Homo Sapiens
aaagucuaccugggagacuaccaucugucaacugcaccuucagacuuugagagggaacaagaug

SEQ ID NO: 455218 - RNA, 64 nt, Homo Sapiens
ggugguuggggguaaggagcggggagaacuaaaacaccuucacuugccccuagcucagguggcu

SEQ ID NO: 455219 - RNA, 64 nt, Homo Sapiens
aaggaacucuauuggaagggguggaugaagaagucaccuucacccugcccugggaaagcaucca

SEQ ID NO: 455220 - RNA, 64 nt, Homo Sapiens
uuagggaucaaugaaggagagaaggucuuggaaucaccuucagucuuuggagacccagcugccu

SEQ ID NO: 455221 - RNA, 64 nt, Homo Sapiens
gcaagcaaaguggagagaaagaagaugcaucugucaccuucaucaggguccucagugcagagca

SEQ ID NO: 455222 - RNA, 64 nt, Homo Sapiens
guaaauuuagcaggaaaugcuauaauuuauguaucaccuucauuaaaagaaaacuugugaucua

SEQ ID NO: 455223 - RNA, 64 nt, Homo Sapiens
accuuaauaaaauuauucaccaccuccggacacucaccuucaggcugugauguguuuuacccag

SEQ ID NO: 455224 - RNA, 64 nt, Homo Sapiens
ugcugcgcacggcggccuaccuccacaccacaaccaccuucaccuggaugugcagccccuuccu

SEQ ID NO: 455225 - RNA, 64 nt, Homo Sapiens
uccucucaggcuaugccaucaccauacacaguggcaccuucaccugggcccaggaccugccccc

SEQ ID NO: 455226 - RNA, 64 nt, Homo Sapiens
uggacaacuuuucucauguugaagccacugccuucaccuucaccuucauccauguccaaccccc

SEQ ID NO: 455227 - RNA, 64 nt, Homo Sapiens
acuuuucucauguugaagccacugccuucaccuucaccuucauccauguccaacccccgacuuc

SEQ ID NO: 455228 - RNA, 64 nt, Homo Sapiens
cagauugaggagacacuggauaggcaaccaccuucaccuucacacuuugggaccuguccaaggg

SEQ ID NO: 455229 - RNA, 64 nt, Homo Sapiens
uucacacagauugaggagaccaaggguaggcaaccaccuucaccgucucccuuugggaccuguc

SEQ ID NO: 455230 - RNA, 64 nt, Homo Sapiens; identical to SEQ ID NO: 296934

SEQ ID NO: 455231 - RNA, 64 nt, Homo Sapiens; identical to SEQ ID NO: 296935

SEQ ID NO: 455232 - RNA, 64 nt, Homo Sapiens; identical to SEQ ID NO: 296936

SEQ ID NO: 455233 - RNA, 64 nt, Homo Sapiens; identical to SEQ ID NO: 296937

SEQ ID NO: 455234 - RNA, 64 nt, Homo Sapiens; identical to SEQ ID NO: 296938

SEQ ID NO: 455235 - RNA, 64 nt, Homo Sapiens; identical to SEQ ID NO: 296939

SEQ ID NO: 455236 - RNA, 64 nt, Homo Sapiens; identical to SEQ ID NO: 296940

SEQ ID NO: 455237 - RNA, 64 nt, Homo Sapiens; identical to SEQ ID NO: 296941

SEQ ID NO: 455238 - RNA, 64 nt, Homo Sapiens; identical to SEQ ID NO: 296942

SEQ ID NO: 455239 - RNA, 64 nt, Homo Sapiens; identical to SEQ ID NO: 296943

SEQ ID NO: 455240 - RNA, 64 nt, Homo Sapiens; identical to SEQ ID NO: 296944

SEQ ID NO: 455241 - RNA, 64 nt, Homo Sapiens; identical to SEQ ID NO: 296945

SEQ ID NO: 455242 - RNA, 64 nt, Homo Sapiens; identical to SEQ ID NO: 296946

SEQ ID NO: 455243 - RNA, 64 nt, Homo Sapiens; identical to SEQ ID NO: 296947

SEQ ID NO: 455244 - RNA, 64 nt, Homo Sapiens; identical to SEQ ID NO: 296948

SEQ ID NO: 455245 - RNA, 64 nt, Homo Sapiens; identical to SEQ ID NO: 296949

SEQ ID NO: 455246 - RNA, 64 nt, Homo Sapiens; identical to SEQ ID NO: 296950

SEQ ID NO: 455247 - RNA, 64 nt, Homo Sapiens; identical to SEQ ID NO: 296951

SEQ ID NO: 455248 - RNA, 64 nt, Homo Sapiens; identical to SEQ ID NO: 296952

SEQ ID NO: 455249 - RNA, 64 nt, Homo Sapiens; identical to SEQ ID NO: 296953

SEQ ID NO: 455250 - RNA, 64 nt, Homo Sapiens; identical to SEQ ID NO: 296954

SEQ ID NO: 455251 - RNA, 64 nt, Homo Sapiens; identical to SEQ ID NO: 296955

SEQ ID NO: 455252 - RNA, 64 nt, Homo Sapiens; identical to SEQ ID NO: 296956

SEQ ID NO: 455253 - RNA, 64 nt, Homo Sapiens; identical to SEQ ID NO: 296957

SEQ ID NO: 455254 - RNA, 64 nt, Homo Sapiens; identical to SEQ ID NO: 296958

SEQ ID NO: 455255 - RNA, 64 nt, Homo Sapiens; identical to SEQ ID NO: 296959

SEQ ID NO: 455256 - RNA, 64 nt, Homo Sapiens; identical to SEQ ID NO: 296960

SEQ ID NO: 455257 - RNA, 64 nt, Homo Sapiens; identical to SEQ ID NO: 296961

SEQ ID NO: 455258 - RNA, 64 nt, Homo Sapiens; identical to SEQ ID NO: 296962

SEQ ID NO: 455259 - RNA, 64 nt, Homo Sapiens; identical to SEQ ID NO: 296963

SEQ ID NO: 455260 - RNA, 64 nt, Homo Sapiens; identical to SEQ ID NO: 296964

SEQ ID NO: 455261 - RNA, 64 nt, Homo Sapiens; identical to SEQ ID NO: 296965

SEQ ID NO: 455262 - RNA, 64 nt, Homo Sapiens; identical to SEQ ID NO: 296966

SEQ ID NO: 455263 - RNA, 64 nt, Homo Sapiens; identical to SEQ ID NO: 296967

SEQ ID NO: 455264 - RNA, 64 nt, Homo Sapiens; identical to SEQ ID NO: 296968

SEQ ID NO: 455265 - RNA, 64 nt, Homo Sapiens; identical to SEQ ID NO: 296969

SEQ ID NO: 455266 - RNA, 64 nt, Homo Sapiens; identical to SEQ ID NO: 296970

SEQ ID NO: 455267 - RNA, 64 nt, Homo Sapiens; identical to SEQ ID NO: 296971

SEQ ID NO: 455268 - RNA, 64 nt, Homo Sapiens; identical to SEQ ID NO: 296972

SEQ ID NO: 455269 - RNA, 64 nt, Homo Sapiens; identical to SEQ ID NO: 296973

SEQ ID NO: 455270 - RNA, 64 nt, Homo Sapiens; identical to SEQ ID NO: 296974

SEQ ID NO: 455271 - RNA, 64 nt, Homo Sapiens; identical to SEQ ID NO: 296975

SEQ ID NO: 455272 - RNA, 64 nt, Homo Sapiens; identical to SEQ ID NO: 296976

SEQ ID NO: 455273 - RNA, 64 nt, Homo Sapiens; identical to SEQ ID NO: 296977

SEQ ID NO: 455274 - RNA, 64 nt, Homo Sapiens; identical to SEQ ID NO: 296978

SEQ ID NO: 455275 - RNA, 64 nt, Homo Sapiens; identical to SEQ ID NO: 296979

SEQ ID NO: 455276 - RNA, 64 nt, Homo Sapiens; identical to SEQ ID NO: 296980

SEQ ID NO: 455277 - RNA, 64 nt, Homo Sapiens; identical to SEQ ID NO: 296981

SEQ ID NO: 455278 - RNA, 64 nt, Homo Sapiens; identical to SEQ ID NO: 296982

SEQ ID NO: 455279 - RNA, 64 nt, Homo Sapiens; identical to SEQ ID NO: 296983

SEQ ID NO: 455280 - RNA, 64 nt, Homo Sapiens; identical to SEQ ID NO: 296984

SEQ ID NO: 455281 - RNA, 64 nt, Homo Sapiens; identical to SEQ ID NO: 296985

SEQ ID NO: 455282 - RNA, 64 nt, Homo Sapiens; identical to SEQ ID NO: 296986

SEQ ID NO: 455283 - RNA, 64 nt, Homo Sapiens; identical to SEQ ID NO: 296987

SEQ ID NO: 455284 - RNA, 64 nt, Homo Sapiens; identical to SEQ ID NO: 296988

SEQ ID NO: 455285 - RNA, 64 nt, Homo Sapiens; identical to SEQ ID NO: 296989

SEQ ID NO: 455286 - RNA, 64 nt, Homo Sapiens; identical to SEQ ID NO: 296990

SEQ ID NO: 455287 - RNA, 64 nt, Homo Sapiens; identical to SEQ ID NO: 296991

SEQ ID NO: 455288 - RNA, 64 nt, Homo Sapiens; identical to SEQ ID NO: 296992

SEQ ID NO: 455289 - RNA, 64 nt, Homo Sapiens; identical to SEQ ID NO: 296993

SEQ ID NO: 455290 - RNA, 64 nt, Homo Sapiens; identical to SEQ ID NO: 296994

SEQ ID NO: 455291 - RNA, 64 nt, Homo Sapiens; identical to SEQ ID NO: 193898

SEQ ID NO: 455292 - RNA, 64 nt, Homo Sapiens; identical to SEQ ID NO: 193899

SEQ ID NO: 455293 - RNA, 64 nt, Homo Sapiens; identical to SEQ ID NO: 193900

SEQ ID NO: 455294 - RNA, 64 nt, Homo Sapiens; identical to SEQ ID NO: 193901

SEQ ID NO: 455295 - RNA, 64 nt, Homo Sapiens; identical to SEQ ID NO: 193902

SEQ ID NO: 455296 - RNA, 64 nt, Homo Sapiens; identical to SEQ ID NO: 193903

SEQ ID NO: 455297 - RNA, 64 nt, Homo Sapiens; identical to SEQ ID NO: 193904

SEQ ID NO: 455298 - RNA, 64 nt, Homo Sapiens; identical to SEQ ID NO: 193905

SEQ ID NO: 455299 - RNA, 64 nt, Homo Sapiens; identical to SEQ ID NO: 193906

SEQ ID NO: 455300 - RNA, 64 nt, Homo Sapiens; identical to SEQ ID NO: 193907

SEQ ID NO: 455301 - RNA, 64 nt, Homo Sapiens; identical to SEQ ID NO: 193908

SEQ ID NO: 455302 - RNA, 64 nt, Homo Sapiens; identical to SEQ ID NO: 193909

SEQ ID NO: 455303 - RNA, 64 nt, Homo Sapiens; identical to SEQ ID NO: 193910

SEQ ID NO: 455304 - RNA, 64 nt, Homo Sapiens; identical to SEQ ID NO: 193911

SEQ ID NO: 455305 - RNA, 64 nt, Homo Sapiens; identical to SEQ ID NO: 193912

SEQ ID NO: 455306 - RNA, 64 nt, Homo Sapiens; identical to SEQ ID NO: 193913

SEQ ID NO: 455307 - RNA, 64 nt, Homo Sapiens; identical to SEQ ID NO: 193914

SEQ ID NO: 455308 - RNA, 64 nt, Homo Sapiens; identical to SEQ ID NO: 193915

SEQ ID NO: 455309 - RNA, 64 nt, Homo Sapiens; identical to SEQ ID NO: 193916

SEQ ID NO: 455310 - RNA, 64 nt, Homo Sapiens; identical to SEQ ID NO: 193917

SEQ ID NO: 455311 - RNA, 64 nt, Homo Sapiens; identical to SEQ ID NO: 193918

SEQ ID NO: 455312 - RNA, 64 nt, Homo Sapiens; identical to SEQ ID NO: 193919

SEQ ID NO: 455313 - RNA, 64 nt, Homo Sapiens; identical to SEQ ID NO: 257499

SEQ ID NO: 455314 - RNA, 64 nt, Homo Sapiens; identical to SEQ ID NO: 257500

SEQ ID NO: 455315 - RNA, 64 nt, Homo Sapiens; identical to SEQ ID NO: 257501

SEQ ID NO: 455316 - RNA, 64 nt, Homo Sapiens; identical to SEQ ID NO: 257502

SEQ ID NO: 455317 - RNA, 60 nt, Homo Sapiens
auagagccacuuacaguuuuuagguugucuugaaaggaggagcagguuuccccacucauc

SEQ ID NO: 455318 - RNA, 60 nt, Homo Sapiens
uagauuuuuuccaaaacccauguaggaaacugaaaggaaaugcaggaugcuuuuaacuga

SEQ ID NO: 455319 - RNA, 60 nt, Homo Sapiens
aaaaguagaagccugacuacucagauuagcugaaaggaaauuauauaaauauuaaugaau

SEQ ID NO: 455320 - RNA, 60 nt, Homo Sapiens
aaauguuuuaauaguagagcagauuaugaaugaaaggauauucugauuauugaagagguc

SEQ ID NO: 455321 - RNA, 60 nt, Homo Sapiens
gaaaagcagauggacuugaaucaguuuugaugaaaggaggcuaguuuguuacuuuaaaaa

SEQ ID NO: 455322 - RNA, 60 nt, Homo Sapiens
acacuuguguuuaagcaccauaguaagacgugaaaggaauauggacuccgauuuggagag

SEQ ID NO: 455323 - RNA, 60 nt, Homo Sapiens
gcggcgcucacccuccucagucccaguuucugaaaggacucagcugagaaaggacaacug

SEQ ID NO: 455324 - RNA, 60 nt, Homo Sapiens
aauagaauuaccauauuguuuuuccugguuugaaaggaccagauggaaagaaacugggca

SEQ ID NO: 455325 - RNA, 60 nt, Homo Sapiens
gcccauguuucagccucagcccacgccaggugaaaggaucagcaaugcucuguugccauc

SEQ ID NO: 455326 - RNA, 60 nt, Homo Sapiens
ggccccacacugccucuguggccuggacuuugaaaggaacccacugaacacuaauuauga

SEQ ID NO: 455327 - RNA, 60 nt, Homo Sapiens
cuuuacccuagaaggaagagacuuguuaaaugaaaggacuugugaacacugaugcaagaa

SEQ ID NO: 455328 - RNA, 60 nt, Homo Sapiens
uaauuguuuuauauuauaacaguccaaacaugaaaggaaauauccucuucuguugaaugc

SEQ ID NO: 455329 - RNA, 60 nt, Homo Sapiens
uccaccagacugucuugaguuauuguaccuugaaaggauuaaaaaaaaguaugcuagcac

SEQ ID NO: 455330 - RNA, 60 nt, Homo Sapiens
ccauuaguguguauaacagauuuaaagaaaugaaaggauaacaaggaacuacauuccaga

SEQ ID NO: 455331 - RNA, 60 nt, Homo Sapiens
cucaaauuuucaucugcacaaugaggcuguugaaaggaaaaaaagugagccucuaggaau

SEQ ID NO: 455332 - RNA, 60 nt, Homo Sapiens
auggcugcagauagaucccgcagucccuucugaaaggaacuguguagccagcagggaccu

SEQ ID NO: 455333 - RNA, 60 nt, Homo Sapiens
accucgaugauguaaauccaaaagcaauggugaaaggauagcuuggugugaacucgcuua

SEQ ID NO: 455334 - RNA, 60 nt, Homo Sapiens
aggaauuggagcagcuuuucguuuccccuuugaaaggagaggaagcuugagucaaaaugu

SEQ ID NO: 455335 - RNA, 60 nt, Homo Sapiens
accucuuaagaaaaaauaaaaaguaaaaaaugaaaggaaucuuuuuuagaaauagagaug

SEQ ID NO: 455336 - RNA, 60 nt, Homo Sapiens
uuauuucuucuccuuguggacaguuguuaaugaaaggaguaaggauuucccuuuuuuugu

SEQ ID NO: 455337 - RNA, 60 nt, Homo Sapiens
ggagugugcccagaccagcugggggagcauugaaaggacagcuuggggauggaauuuuuu

SEQ ID NO: 455338 - RNA, 60 nt, Homo Sapiens
cuauguuaacuaguuaaggauguuacauuuugaaaggauguauguuagauauauuauuug

SEQ ID NO: 455339 - RNA, 60 nt, Homo Sapiens
aacuugauaaccccuagaaagaagaggacaugaaaggaugcuggcuauauauguuaauga

SEQ ID NO: 455340 - RNA, 60 nt, Homo Sapiens
aagcacgugagagacccucgcaaaaugaugugaaaggaccaguuucuugaaguccagugu

SEQ ID NO: 455341 - RNA, 60 nt, Homo Sapiens
caggagagaacacggggagguuuguuugugugaaaggaaaguaguccaggcugucccuga

SEQ ID NO: 455342 - RNA, 60 nt, Homo Sapiens
guaguuuucauaaaacucauacaaaugaugugaaaggaaacauggguguggcauucucua

SEQ ID NO: 455343 - RNA, 60 nt, Homo Sapiens
aaaaagguugucucuugauuuuugcuacuuugaaaggaaaagccaaucuuuuauuguucc

SEQ ID NO: 455344 - RNA, 60 nt, Homo Sapiens
uguaccugucugaagagugacauuaaacuuugaaaggacuucacugcuccuuuacgauau

SEQ ID NO: 455345 - RNA, 60 nt, Homo Sapiens
auguagaaaauaaugaauuaaugagauuggugaaaggaaaucaugcaaaacauuugaaug

SEQ ID NO: 455346 - RNA, 60 nt, Homo Sapiens
aauauaucccugguaguuuuuaaauuuaaaugaaaggaaaugcuuuguuggaauggaauu

SEQ ID NO: 455347 - RNA, 60 nt, Homo Sapiens
agguuugaaaagaaaaaaaucuuccugauuugaaaggagguuacuugcacuuuauguaua

SEQ ID NO: 455348 - RNA, 60 nt, Homo Sapiens
gcuguccuugaacaaguaucaauguguuuaugaaaggaagaucuaaaucagacaggaguu

SEQ ID NO: 455349 - RNA, 60 nt, Homo Sapiens
aauggaacccuugcuauaguagugacaaagugaaaggaaauuuaggaggcauaggccauu

SEQ ID NO: 455350 - RNA, 53 nt, Homo Sapiens
uugucccaguucuuucaugagcaugaaaggagucacauagagaaaccccauga

SEQ ID NO: 455351 - RNA, 60 nt, Homo Sapiens
cuucaguccuuucuguuucuuucaacuacgugaaaggauucacaguggagaaagacccug

SEQ ID NO: 455352 - RNA, 60 nt, Homo Sapiens
cuuuguuuccuucacuuccuuucgauaucaugaaaggacucacacuggagagaaccccua

SEQ ID NO: 455353 - RNA, 60 nt, Homo Sapiens
auuccauaauuucucuucuuugcaaauacaugaaaggaugcacagaggagagaagcucug

SEQ ID NO: 455354 - RNA, 60 nt, Homo Sapiens
cuuuauuucuuccacuucuuuucaauaucaugaaaggacucacaugggagagaaacccua

SEQ ID NO: 455355 - RNA, 60 nt, Homo Sapiens
cuucauuucuucuaguucccuucaauaucaugaaaggacucacacuggagagaagcccua

SEQ ID NO: 455356 - RNA, 60 nt, Homo Sapiens
cuucagaucugucaagaaccuuucaauuuaugaaaggacacacacuggagagaaacccua

SEQ ID NO: 455357 - RNA, 60 nt, Homo Sapiens
auucaauuauuuuucuuccuugcauauacaugaaaggacucauacgagagagaauccgua

SEQ ID NO: 455358 - RNA, 60 nt, Homo Sapiens
uuucacuucuuccaguucuuuucaauaucaugaaaggacucacacuggggagaaaccgua

SEQ ID NO: 455359 - RNA, 60 nt, Homo Sapiens
cuucaaucuuuccaguuccuuucaguaucaugaaaggacucacacuggagagaaacccua

SEQ ID NO: 455360 - RNA, 60 nt, Homo Sapiens
cuucagaucugccucacaccuucaaauucaugaaaggacacaaacacacauaagaauaca

SEQ ID NO: 455361 - RNA, 60 nt, Homo Sapiens
cuucaguaguuccaguuccuuuugguaccaugaaaggacucacacuggagagaaacccua

SEQ ID NO: 455362 - RNA, 60 nt, Homo Sapiens
cuucagaucugccaagaaccuucgaauucaugaaaggacacaaacacacguaagaaugca

SEQ ID NO: 455363 - RNA, 60 nt, Homo Sapiens
cuuuauuucuuucacuucuuuucgauaacaugaaaggacucacacuggagagaaacccua

SEQ ID NO: 455364 - RNA, 60 nt, Homo Sapiens
cacacugcaaagaaacaguacccgaagacaugaaaggaugcuuuuauuguugcaguucug

SEQ ID NO: 455365 - RNA, 60 nt, Homo Sapiens
cauacuggagagaaacccuacucaaagacaugaaaggacuauuuagauacuacuacucag

SEQ ID NO: 455366 - RNA, 60 nt, Homo Sapiens
cacacuguacagaaacgcuacucgagcacaugaaaggaaucuucauuuaccgccauucug

SEQ ID NO: 455367 - RNA, 60 nt, Homo Sapiens
cacacuggagagaagccguauaaagcaacaugaaaggauucuucagucauuuuggucacu

SEQ ID NO: 455368 - RNA, 60 nt, Homo Sapiens
cacacuagggagaaaaucuauucaaagacaugaaaggacucuuuguuuauuucauuggau

SEQ ID NO: 455369 - RNA, 64 nt, Homo Sapiens; identical to SEQ ID NO: 91745

SEQ ID NO: 455370 - RNA, 64 nt, Homo Sapiens; identical to SEQ ID NO: 91746

SEQ ID NO: 455371 - RNA, 64 nt, Homo Sapiens; identical to SEQ ID NO: 91747

SEQ ID NO: 455372 - RNA, 64 nt, Homo Sapiens; identical to SEQ ID NO: 91748

SEQ ID NO: 455373 - RNA, 64 nt, Homo Sapiens; identical to SEQ ID NO: 91749

SEQ ID NO: 455374 - RNA, 64 nt, Homo Sapiens; identical to SEQ ID NO: 91750

SEQ ID NO: 455375 - RNA, 64 nt, Homo Sapiens; identical to SEQ ID NO: 91751

SEQ ID NO: 455376 - RNA, 64 nt, Homo Sapiens; identical to SEQ ID NO: 91752

SEQ ID NO: 455377 - RNA, 64 nt, Homo Sapiens; identical to SEQ ID NO: 91753

SEQ ID NO: 455378 - RNA, 64 nt, Homo Sapiens; identical to SEQ ID NO: 91754

SEQ ID NO: 455379 - RNA, 64 nt, Homo Sapiens; identical to SEQ ID NO: 91755

SEQ ID NO: 455380 - RNA, 64 nt, Homo Sapiens; identical to SEQ ID NO: 91756

SEQ ID NO: 455381 - RNA, 64 nt, Homo Sapiens; identical to SEQ ID NO: 91757

SEQ ID NO: 455382 - RNA, 64 nt, Homo Sapiens; identical to SEQ ID NO: 91758

SEQ ID NO: 455383 - RNA, 64 nt, Homo Sapiens; identical to SEQ ID NO: 91759

SEQ ID NO: 455384 - RNA, 64 nt, Homo Sapiens; identical to SEQ ID NO: 91760

SEQ ID NO: 455385 - RNA, 64 nt, Homo Sapiens; identical to SEQ ID NO: 91761

SEQ ID NO: 455386 - RNA, 64 nt, Homo Sapiens; identical to SEQ ID NO: 91762

SEQ ID NO: 455387 - RNA, 64 nt, Homo Sapiens; identical to SEQ ID NO: 91763

SEQ ID NO: 455388 - RNA, 64 nt, Homo Sapiens; identical to SEQ ID NO: 91764

SEQ ID NO: 455389 - RNA, 64 nt, Homo Sapiens; identical to SEQ ID NO: 91765

SEQ ID NO: 455390 - RNA, 64 nt, Homo Sapiens; identical to SEQ ID NO: 91766

SEQ ID NO: 455391 - RNA, 64 nt, Homo Sapiens; identical to SEQ ID NO: 91767

SEQ ID NO: 455392 - RNA, 64 nt, Homo Sapiens; identical to SEQ ID NO: 91768

SEQ ID NO: 455393 - RNA, 64 nt, Homo Sapiens; identical to SEQ ID NO: 91769

SEQ ID NO: 455394 - RNA, 64 nt, Homo Sapiens; identical to SEQ ID NO: 91770

SEQ ID NO: 455395 - RNA, 64 nt, Homo Sapiens; identical to SEQ ID NO: 91771

SEQ ID NO: 455396 - RNA, 64 nt, Homo Sapiens; identical to SEQ ID NO: 91772

SEQ ID NO: 455397 - RNA, 64 nt, Homo Sapiens; identical to SEQ ID NO: 91773

SEQ ID NO: 455398 - RNA, 64 nt, Homo Sapiens; identical to SEQ ID NO: 91774

SEQ ID NO: 455399 - RNA, 64 nt, Homo Sapiens; identical to SEQ ID NO: 91775

SEQ ID NO: 455400 - RNA, 64 nt, Homo Sapiens; identical to SEQ ID NO: 91776

SEQ ID NO: 455401 - RNA, 64 nt, Homo Sapiens; identical to SEQ ID NO: 91777

SEQ ID NO: 455402 - RNA, 64 nt, Homo Sapiens; identical to SEQ ID NO: 91778

SEQ ID NO: 455403 - RNA, 64 nt, Homo Sapiens; identical to SEQ ID NO: 91779

SEQ ID NO: 455404 - RNA, 64 nt, Homo Sapiens; identical to SEQ ID NO: 91780

SEQ ID NO: 455405 - RNA, 64 nt, Homo Sapiens; identical to SEQ ID NO: 91781

SEQ ID NO: 455406 - RNA, 64 nt, Homo Sapiens; identical to SEQ ID NO: 91782

SEQ ID NO: 455407 - RNA, 64 nt, Homo Sapiens; identical to SEQ ID NO: 91783

SEQ ID NO: 455408 - RNA, 64 nt, Homo Sapiens; identical to SEQ ID NO: 91784

SEQ ID NO: 455409 - RNA, 64 nt, Homo Sapiens; identical to SEQ ID NO: 91785

SEQ ID NO: 455410 - RNA, 64 nt, Homo Sapiens; identical to SEQ ID NO: 91786

SEQ ID NO: 455411 - RNA, 64 nt, Homo Sapiens; identical to SEQ ID NO: 91787

SEQ ID NO: 455412 - RNA, 64 nt, Homo Sapiens; identical to SEQ ID NO: 91788

SEQ ID NO: 455413 - RNA, 64 nt, Homo Sapiens; identical to SEQ ID NO: 91789

SEQ ID NO: 455414 - RNA, 64 nt, Homo Sapiens; identical to SEQ ID NO: 91790

SEQ ID NO: 455415 - RNA, 64 nt, Homo Sapiens; identical to SEQ ID NO: 91791

SEQ ID NO: 455416 - RNA, 64 nt, Homo Sapiens; identical to SEQ ID NO: 91792

SEQ ID NO: 455417 - RNA, 64 nt, Homo Sapiens; identical to SEQ ID NO: 91793

SEQ ID NO: 455418 - RNA, 64 nt, Homo Sapiens; identical to SEQ ID NO: 91794

SEQ ID NO: 455419 - RNA, 64 nt, Homo Sapiens; identical to SEQ ID NO: 91795

SEQ ID NO: 455420 - RNA, 64 nt, Homo Sapiens; identical to SEQ ID NO: 91796

SEQ ID NO: 455421 - RNA, 64 nt, Homo Sapiens; identical to SEQ ID NO: 91797

SEQ ID NO: 455422 - RNA, 64 nt, Homo Sapiens; identical to SEQ ID NO: 91798

SEQ ID NO: 455423 - RNA, 64 nt, Homo Sapiens; identical to SEQ ID NO: 91799

SEQ ID NO: 455424 - RNA, 64 nt, Homo Sapiens; identical to SEQ ID NO: 91800

SEQ ID NO: 455425 - RNA, 54 nt, Homo Sapiens; identical to SEQ ID NO: 91801

SEQ ID NO: 455426 - RNA, 64 nt, Homo Sapiens; identical to SEQ ID NO: 158094

SEQ ID NO: 455427 - RNA, 64 nt, Homo Sapiens; identical to SEQ ID NO: 158095

SEQ ID NO: 455428 - RNA, 64 nt, Homo Sapiens; identical to SEQ ID NO: 158096

SEQ ID NO: 455429 - RNA, 64 nt, Homo Sapiens; identical to SEQ ID NO: 158097

SEQ ID NO: 455430 - RNA, 64 nt, Homo Sapiens; identical to SEQ ID NO: 158098

SEQ ID NO: 455431 - RNA, 64 nt, Homo Sapiens; identical to SEQ ID NO: 158099

SEQ ID NO: 455432 - RNA, 64 nt, Homo Sapiens; identical to SEQ ID NO: 158100

SEQ ID NO: 455433 - RNA, 64 nt, Homo Sapiens; identical to SEQ ID NO: 158101

SEQ ID NO: 455434 - RNA, 64 nt, Homo Sapiens; identical to SEQ ID NO: 158102

SEQ ID NO: 455435 - RNA, 64 nt, Homo Sapiens; identical to SEQ ID NO: 158103

SEQ ID NO: 455436 - RNA, 64 nt, Homo Sapiens; identical to SEQ ID NO: 158104

SEQ ID NO: 455437 - RNA, 64 nt, Homo Sapiens; identical to SEQ ID NO: 158105

SEQ ID NO: 455438 - RNA, 64 nt, Homo Sapiens; identical to SEQ ID NO: 158106

SEQ ID NO: 455439 - RNA, 64 nt, Homo Sapiens; identical to SEQ ID NO: 158107

SEQ ID NO: 455440 - RNA, 64 nt, Homo Sapiens; identical to SEQ ID NO: 158108

SEQ ID NO: 455441 - RNA, 64 nt, Homo Sapiens; identical to SEQ ID NO: 158109

SEQ ID NO: 455442 - RNA, 64 nt, Homo Sapiens; identical to SEQ ID NO: 158110

SEQ ID NO: 455443 - RNA, 64 nt, Homo Sapiens; identical to SEQ ID NO: 158111

SEQ ID NO: 455444 - RNA, 64 nt, Homo Sapiens; identical to SEQ ID NO: 158112

SEQ ID NO: 455445 - RNA, 64 nt, Homo Sapiens; identical to SEQ ID NO: 158113

SEQ ID NO: 455446 - RNA, 64 nt, Homo Sapiens; identical to SEQ ID NO: 158114

SEQ ID NO: 455447 - RNA, 64 nt, Homo Sapiens; identical to SEQ ID NO: 158115

SEQ ID NO: 455448 - RNA, 64 nt, Homo Sapiens; identical to SEQ ID NO: 158116

SEQ ID NO: 455449 - RNA, 64 nt, Homo Sapiens; identical to SEQ ID NO: 158117

SEQ ID NO: 455450 - RNA, 64 nt, Homo Sapiens; identical to SEQ ID NO: 158118

SEQ ID NO: 455451 - RNA, 64 nt, Homo Sapiens; identical to SEQ ID NO: 158119

SEQ ID NO: 455452 - RNA, 64 nt, Homo Sapiens; identical to SEQ ID NO: 158120

SEQ ID NO: 455453 - RNA, 64 nt, Homo Sapiens; identical to SEQ ID NO: 158121

SEQ ID NO: 455454 - RNA, 64 nt, Homo Sapiens; identical to SEQ ID NO: 158122

SEQ ID NO: 455455 - RNA, 64 nt, Homo Sapiens; identical to SEQ ID NO: 158123

SEQ ID NO: 455456 - RNA, 64 nt, Homo Sapiens; identical to SEQ ID NO: 158124

SEQ ID NO: 455457 - RNA, 64 nt, Homo Sapiens; identical to SEQ ID NO: 158125

SEQ ID NO: 455458 - RNA, 64 nt, Homo Sapiens; identical to SEQ ID NO: 158126

SEQ ID NO: 455459 - RNA, 64 nt, Homo Sapiens; identical to SEQ ID NO: 158127

SEQ ID NO: 455460 - RNA, 64 nt, Homo Sapiens; identical to SEQ ID NO: 158128

SEQ ID NO: 455461 - RNA, 64 nt, Homo Sapiens; identical to SEQ ID NO: 257525

SEQ ID NO: 455462 - RNA, 64 nt, Homo Sapiens; identical to SEQ ID NO: 257526

SEQ ID NO: 455463 - RNA, 64 nt, Homo Sapiens; identical to SEQ ID NO: 257527

SEQ ID NO: 455464 - RNA, 64 nt, Homo Sapiens; identical to SEQ ID NO: 257528

SEQ ID NO: 455465 - RNA, 64 nt, Homo Sapiens; identical to SEQ ID NO: 257529

SEQ ID NO: 455466 - RNA, 64 nt, Homo Sapiens; identical to SEQ ID NO: 257530

SEQ ID NO: 455467 - RNA, 64 nt, Homo Sapiens; identical to SEQ ID NO: 257531

SEQ ID NO: 455468 - RNA, 64 nt, Homo Sapiens; identical to SEQ ID NO: 257532

SEQ ID NO: 455469 - RNA, 64 nt, Homo Sapiens; identical to SEQ ID NO: 257533

SEQ ID NO: 455470 - RNA, 64 nt, Homo Sapiens; identical to SEQ ID NO: 257534

SEQ ID NO: 455471 - RNA, 64 nt, Homo Sapiens; identical to SEQ ID NO: 257535

SEQ ID NO: 455472 - RNA, 64 nt, Homo Sapiens; identical to SEQ ID NO: 257536

SEQ ID NO: 455473 - RNA, 64 nt, Homo Sapiens
ugacaagccagccaucagggcaaguguuuugaaucuuagcaaguguuuugaaucuuagcaacug

SEQ ID NO: 455474 - RNA, 64 nt, Homo Sapiens
gcaaguguuuugaaucuuagcaaguguuuugaaucuuagcaacugaacaugacauugcacacug

SEQ ID NO: 455475 - RNA, 64 nt, Homo Sapiens
uuuuuuuuuuugccgaaacaagcuuacacagcuucuuagcaauuaaaaaaaaaaaaaaaaaaaa

SEQ ID NO: 455476 - RNA, 64 nt, Homo Sapiens
acaaacacacaaaaaacugacaaaacuuguuuagcuuagcaaaacuuguuuuagcgaacucuag

SEQ ID NO: 455477 - RNA, 64 nt, Homo Sapiens
uuagcaauauauuauccaauuguuggcucucaaacuuagcaaaaguuagaaggcuccauuguuu

SEQ ID NO: 455478 - RNA, 64 nt, Homo Sapiens
uucuaaucacuauggacagagcaccucaagcaugcuuagcaauguccaacauuauuugaauuga

SEQ ID NO: 455479 - RNA, 64 nt, Homo Sapiens
cuaauguuuuauauucauauauuaggaaagugaacuuagcaagcuuuuuggaauuuaaggauca

SEQ ID NO: 455480 - RNA, 64 nt, Homo Sapiens
gccauaagagaugcucaaaaaagcauggucagggcuuagcaagaauccuuuuccagugcaaaua

SEQ ID NO: 455481 - RNA, 64 nt, Homo Sapiens
caucggucucugaggugacaguuucugguuuugccuuagcaaugcaaagccucagagaaagggu

SEQ ID NO: 455482 - RNA, 64 nt, Homo Sapiens
aauuguaagucuccuccuuagacuggacuggaaucuuagcaaacgcacccacauuuuuuugaaa

SEQ ID NO: 455483 - RNA, 64 nt, Homo Sapiens
uccaugcuuuuuaaagacagagauaauaucuucucuauucuauucuacuuccuccauuucacca

SEQ ID NO: 455484 - RNA, 64 nt, Homo Sapiens
gcuuuuuaaagacagagauaauaucuucucuauucuauucuacuuccuccauuucaccauuuau

SEQ ID NO: 455485 - RNA, 64 nt, Homo Sapiens
acuuuuaaauauuguaagaggauaucuaguuucucuauucuaccaucaaagaagcuuuugagua

SEQ ID NO: 455486 - RNA, 64 nt, Homo Sapiens
gaagcuuuugaguaccaccuguuaaugagcuuuccuauucuaaauuguuuugggucacagaguu

SEQ ID NO: 455487 - RNA, 61 nt, Homo Sapiens
aaaagaagaccuggguggaaagcgguuuggaugaaaagauuucaggcaaagacuugcagga

SEQ ID NO: 455488 - RNA, 61 nt, Homo Sapiens
aaagacggguguuuuauuuggucuaauacccugaaaagaagugaugacuuguugcuuuuca

SEQ ID NO: 455489 - RNA, 61 nt, Homo Sapiens
cuaacauuauuuacaguagagugguuugagaugaaaagaacaguaaguagacaagaauaaa

SEQ ID NO: 455490 - RNA, 61 nt, Homo Sapiens
uuuuuugugugugaauuaucauuuaaccaugugaaaagaauggagcaagagaaagaagaua

SEQ ID NO: 455491 - RNA, 61 nt, Homo Sapiens
uuuucuuuuuaucuuauuuuuacucguccguugaaaagauaaucaaggccuacauuuuagc

SEQ ID NO: 455492 - RNA, 61 nt, Homo Sapiens
aaagacucuuuuagggcauuuuucugacucaugaaaagagcacagaaaaggauguuuggca

SEQ ID NO: 455493 - RNA, 61 nt, Homo Sapiens
accugcagaaugggagaaaauaucaagaaggugaaaagauauuuugugauugaaaagaccc

SEQ ID NO: 455494 - RNA, 61 nt, Homo Sapiens
cuaucaagaaggugaaaagagcuuuugugauugaaaagaccggacuuaaucaagauuugaa

SEQ ID NO: 455495 - RNA, 61 nt, Homo Sapiens
aggaaaaugagaaaucaccuagagagagagaugaaaagaguacuccaucucaaaaaaaaaa

SEQ ID NO: 455496 - RNA, 61 nt, Homo Sapiens
auuuauauuggacuaaucaguaaagggauugugaaaagagcaaaaaaagaaaagaaaaaga

SEQ ID NO: 455497 - RNA, 61 nt, Homo Sapiens
ccgugccuucaguuaauaaagauuuguauugugaaaagauuuuuucuuuuuuuuuugggac

SEQ ID NO: 455498 - RNA, 61 nt, Homo Sapiens
gauuacaggcgcgagccacggcgcccagccuugaaaagauguuuuuagaaccagaagaaac

SEQ ID NO: 455499 - RNA, 61 nt, Homo Sapiens
agguacccuaaggcugagggaauaauaaagaugaaaagagauuaagcuaugauaggagaau

SEQ ID NO: 455500 - RNA, 61 nt, Homo Sapiens
aaucacagaagagagaaugcaaagguagauaugaaaagaaaccaagucuuacauagaaaaa

SEQ ID NO: 455501 - RNA, 61 nt, Homo Sapiens
uuuaaccuaauauaucaaggaaugagauaaaugaaaagauaguuagagaaaagauggauuu

SEQ ID NO: 455502 - RNA, 61 nt, Homo Sapiens
aauauauaacucaauuuucagcggagaauuuugaaaagaggcaaaaacaagugcuuguuua

SEQ ID NO: 455503 - RNA, 61 nt, Homo Sapiens
ugaguacccucugaaaaagggaauuugcuggugaaaagaggcuggaucuuguggaagacug

SEQ ID NO: 455504 - RNA, 61 nt, Homo Sapiens
ugaauuacuguaucuuuuacuuuuuuuuuuuugaaaagauaaacuuguaaauagagugauu

SEQ ID NO: 455505 - RNA, 61 nt, Homo Sapiens
gauauauuguuguuagaaauauauaagaaugugaaaagauuucauuagauucucugauucu

SEQ ID NO: 455506 - RNA, 61 nt, Homo Sapiens
agguucccuauguugcccagauuuuauuuuuugaaaagacauauaccgccacacccagcua

SEQ ID NO: 455507 - RNA, 61 nt, Homo Sapiens
gacauugaaacauuuguauuaaguugucaaaugaaaagaauugacaaaugaaaagaauaac

SEQ ID NO: 455508 - RNA, 61 nt, Homo Sapiens
aacaaguugucaaaugaaaauauaugacaaaugaaaagaauaguuaugagaaaucuuugcu

SEQ ID NO: 455509 - RNA, 61 nt, Homo Sapiens
ugaguugguugauugggguuugauuugcuuuugaaaagauuuuuauuuuuagaggcagggc

SEQ ID NO: 455510 - RNA, 61 nt, Homo Sapiens
auauauuuccucauaaacauuugaguuuuguugaaaagauggaguuuacaaagauaccauu

SEQ ID NO: 455511 - RNA, 61 nt, Homo Sapiens
uuuuuaguccuaggccaguagugcuuuggguugaaaagaaggccuuuguggauuuggguuu

SEQ ID NO: 455512 - RNA, 61 nt, Homo Sapiens
ggaaggguuugcagaggagaucucagagcacugaaaagaaauugaggcuuuucuauauacu

SEQ ID NO: 455513 - RNA, 61 nt, Homo Sapiens
auagaguuaaaacaauauuuaguaagagauuugaaaagacgaaagaacuguaaccgaaaga

SEQ ID NO: 455514 - RNA, 61 nt, Homo Sapiens
auaauucuacuuuguuuaaugcacaggccuuugaaaagacucaaacuuuuuguguuaucug

SEQ ID NO: 455515 - RNA, 61 nt, Homo Sapiens
ugcuaauguaaucauuuaucaaaauaacaucugaaaagaaauaguuucaaaugaguuuaaa

SEQ ID NO: 455516 - RNA, 61 nt, Homo Sapiens
aaagucuaugcuuaggccagaaccauaugauugaaaagaaguuguaauauacaguuuuugu

SEQ ID NO: 455517 - RNA, 61 nt, Homo Sapiens
uaauaauauccaggucaacauuuccuguuucugaaaagaaaagacacagauguucgguuuu

SEQ ID NO: 455518 - RNA, 61 nt, Homo Sapiens
gcagagaauauaacaugaaacuuuagagaacugaaaagagaggauaacaaagauaucuuuu

SEQ ID NO: 455519 - RNA, 61 nt, Homo Sapiens
cguaguaaauuaaauagaaguuuauugguacugaaaagagaaaauacagcagacgaacaua

SEQ ID NO: 455520 - RNA, 61 nt, Homo Sapiens
uuuaguaugcuuugaaaaaagaacauuuguaugaaaagacaauguucuuuugcaaggcaua

SEQ ID NO: 455521 - RNA, 61 nt, Homo Sapiens
auacuuuuuacuuuuauuuauauugugcuuuugaaaagaguauguacaguauaaagaggaa

SEQ ID NO: 455522 - RNA, 61 nt, Homo Sapiens
cuuaguaccaaauacacucauagcaaauauaugaaaagaccuccacuuuacuuaagaaaac

SEQ ID NO: 455523 - RNA, 61 nt, Homo Sapiens
acugacacaccagucugggucacuuuuucugugaaaagaacgauggagcuccguggguuga

SEQ ID NO: 455524 - RNA, 61 nt, Homo Sapiens
gugcaccugauuuggccaauaggaucaacagugaaaagacagaagaggcaauaccagcagu

SEQ ID NO: 455525 - RNA, 61 nt, Homo Sapiens
aaagaaaccuguuuguuuuucuuuugaacuaugaaaagacccuguuugugaauauauuuua

SEQ ID NO: 455526 - RNA, 61 nt, Homo Sapiens
uuaaaggcagagaaguaucugcaucuuuauuugaaaagacgucuuauuaacucuuagcucc

SEQ ID NO: 455527 - RNA, 61 nt, Homo Sapiens
caagaucugucacccacaacaccacauaucuugaaaagaugcuuuucauaauuuucacuau

SEQ ID NO: 455528 - RNA, 61 nt, Homo Sapiens
acuucucgggaaaggaucaucgccguugaaaugaaaagagagacagagagaaaaaaaaaaa

SEQ ID NO: 455529 - RNA, 61 nt, Homo Sapiens
ucacauuggaugacaccauguucuuccucuuugaaaagaaaaggggaaugugucccacuag

SEQ ID NO: 455530 - RNA, 61 nt, Homo Sapiens
aacuagaaauagcacucuugguuucuuuugaugaaaagagugagcuggucaaugcaacauu

SEQ ID NO: 455531 - RNA, 61 nt, Homo Sapiens
gugccgagcagggauauaaccugcaguuaagugaaaagaaaauccagccucccccuccaaa

SEQ ID NO: 455532 - RNA, 61 nt, Homo Sapiens
aaugauaaugcuuccaaacuaaagugagagcugaaaagagagaaaauaacugaaaagauua

SEQ ID NO: 455533 - RNA, 61 nt, Homo Sapiens
aaaagugagagcugaaaagaaggaaaauaacugaaaagauuuugguggcuaaguuuuacua

SEQ ID NO: 455534 - RNA, 61 nt, Homo Sapiens
cuuacauuuuaaauguuauucuaauguaaaaugaaaagaggagauucaaaugcuuuuauga

SEQ ID NO: 455535 - RNA, 61 nt, Homo Sapiens
augucauuuccuaauuuugauacaugccuaaugaaaagaagaacacauaguguaaaauaau

SEQ ID NO: 455536 - RNA, 61 nt, Homo Sapiens
auaaaacaaaauggaauguguuuuauuuucaugaaaagacaguuaccaguuaggggaagac

SEQ ID NO: 455537 - RNA, 61 nt, Homo Sapiens
ucacuuccuugaaaauuuuacaauggaauacugaaaagaaaacacauucacccuaaggauc

SEQ ID NO: 455538 - RNA, 61 nt, Homo Sapiens
gaaaggaaaagaaaaaggagacaaagauaagugaaaagagacugcauuugguuuuaugaau

SEQ ID NO: 455539 - RNA, 61 nt, Homo Sapiens
auuuuuauuuuuccuuugguauuugcuacagugaaaagaaguuuggaaaguagauacauaa

SEQ ID NO: 455540 - RNA, 61 nt, Homo Sapiens
uaggcauuaccucagggaaaagccuugacagugaaaagaaacuacuuaaucgcuaauagcu

SEQ ID NO: 455541 - RNA, 61 nt, Homo Sapiens
gaauugaagucguuuuguuucgaggcacauuugaaaagaugaacuuuuuuucuugcagcac

SEQ ID NO: 455542 - RNA, 61 nt, Homo Sapiens
aaggaacaaagguugagagaaucuugccuuuugaaaagaugaagacuacagaaggaaagag

SEQ ID NO: 455543 - RNA, 61 nt, Homo Sapiens
aguucaagaaguucuggagaaaagaaaaugaugaaaagaguccucuaagaaagaaaugaag

SEQ ID NO: 455544 - RNA, 61 nt, Homo Sapiens
aaaaauaaagauuuauuuaauguauuacuuuugaaaagauguuaauuuuugacaacaagca

SEQ ID NO: 455545 - RNA, 61 nt, Homo Sapiens
ucguucccagcagcaucaagagaaaauauaaugaaaagauuguuuuguaccaacaggaauu

SEQ ID NO: 455546 - RNA, 61 nt, Homo Sapiens
acacacacauacacauauauuaugcauguggugaaaagaauuggcuagauaggggauuuuu

SEQ ID NO: 455547 - RNA, 61 nt, Homo Sapiens
acuuuugggugucuguauccuaagaaguuucugaaaagaucuaaagccuuuuuaucccaua

SEQ ID NO: 455548 - RNA, 61 nt, Homo Sapiens
gauugggaauuuaaaaacgagcuauguuaaaugaaaagaucuuguugaaaauauaauguau

SEQ ID NO: 455549 - RNA, 61 nt, Homo Sapiens
guggggucuuggauaucaccuucuauguuuuugaaaagaagagacugaagugugcagguuc

SEQ ID NO: 455550 - RNA, 61 nt, Homo Sapiens
uagcuugagaguaaugucaccugugauuauuugaaaagaauuguuagauuaaagcugcacc

SEQ ID NO: 455551 - RNA, 61 nt, Homo Sapiens
gugaagauuuuuuacauugcaagaugcuacuugaaaagacuauugucccccagaaaagauu

SEQ ID NO: 455552 - RNA, 61 nt, Homo Sapiens
aguacuuuagcuucuuucuguccuuacuguuugaaaagauaauagauaacauggcuuuuac

SEQ ID NO: 455553 - RNA, 61 nt, Homo Sapiens
ccgaaugugcagauuccacauaaacucagauugaaaagagacacaccugacuuaacaucuc

SEQ ID NO: 455554 - RNA, 61 nt, Homo Sapiens
caacccaguucuguuugacuauguagcaucuugaaaagaaaaauuauaauaaagccccaaa

SEQ ID NO: 455555 - RNA, 61 nt, Homo Sapiens
ccaugugucccccaguacuuauaaaagggagugaaaagaccgagcuguaaggcaugugccu

SEQ ID NO: 455556 - RNA, 61 nt, Homo Sapiens
agucaccaggguuacucagauuuugauaaggugaaaagaauugcauuguuuuuagcucagg

SEQ ID NO: 455557 - RNA, 61 nt, Homo Sapiens
caucacacaaucaccuugcuuaacucaacugugaaaagacacauaacugguggggcacauc

SEQ ID NO: 455558 - RNA, 61 nt, Homo Sapiens
gcacaaggcagagcugggaugaaaacagggcugaaaagacucagggccaauuauuggcuga

SEQ ID NO: 455559 - RNA, 61 nt, Homo Sapiens
gaaagaaggugauuuguauuugucuccccgcugaaaagaacaggauucaaguccagaguuu

SEQ ID NO: 455560 - RNA, 61 nt, Homo Sapiens
ucuaccauuaaaaucuugaaagcgaaauacuugaaaagaggugaccauaaagaucacacca

SEQ ID NO: 455561 - RNA, 61 nt, Homo Sapiens
auaagcagguuauuuuuauuuuuuuacuguuugaaaagaaauaaguagugucauucauaug

SEQ ID NO: 455562 - RNA, 61 nt, Homo Sapiens
caagacucucagguauagaaagagcaaaaugugaaaagacauuuuucuuccuauucagaaa

SEQ ID NO: 455563 - RNA, 61 nt, Homo Sapiens
gucuccaguuucugaaugaauaacaacucagugaaaagauggcuaagggaagaggaaggaa

SEQ ID NO: 455564 - RNA, 61 nt, Homo Sapiens
guuuugaucauaugcauguauaccccaaacaugaaaagauucuuuuacuauguguaagaaa

SEQ ID NO: 455565 - RNA, 61 nt, Homo Sapiens
ucuauugggaguccgaggcaagcugugaacaugaaaagacacaaugucuaugcuucucgau

SEQ ID NO: 455566 - RNA, 61 nt, Homo Sapiens
aaugcaacuuguauauuuugucguguguguuugaaaagaaguggaaauugaaaaacgaaaa

SEQ ID NO: 455567 - RNA, 61 nt, Homo Sapiens
aaaaguaaaaaguguucuguaguuuuuguuuugaaaagagcgugggcaaacccuucuacaa

SEQ ID NO: 455568 - RNA, 61 nt, Homo Sapiens
gcauagcuuaaaagaugaaacaaagcgccacugaaaagaugaggccuguacauacuucucc

SEQ ID NO: 455569 - RNA, 61 nt, Homo Sapiens
cagguguuaauauaauacuagaaaauaagugugaaaagaauacugcaauaaguggguuuua

SEQ ID NO: 455570 - RNA, 61 nt, Homo Sapiens
ccugaggcaaacacucucucgugacugccucugaaaagagccacgugacagugacaacaca

SEQ ID NO: 455571 - RNA, 64 nt, Homo Sapiens; identical to SEQ ID NO: 173467

SEQ ID NO: 455572 - RNA, 64 nt, Homo Sapiens; identical to SEQ ID NO: 173468

SEQ ID NO: 455573 - RNA, 64 nt, Homo Sapiens; identical to SEQ ID NO: 173469

SEQ ID NO: 455574 - RNA, 64 nt, Homo Sapiens; identical to SEQ ID NO: 173470

SEQ ID NO: 455575 - RNA, 64 nt, Homo Sapiens; identical to SEQ ID NO: 173471

SEQ ID NO: 455576 - RNA, 64 nt, Homo Sapiens; identical to SEQ ID NO: 173472

SEQ ID NO: 455577 - RNA, 64 nt, Homo Sapiens; identical to SEQ ID NO: 173473

SEQ ID NO: 455578 - RNA, 64 nt, Homo Sapiens; identical to SEQ ID NO: 173474

SEQ ID NO: 455579 - RNA, 64 nt, Homo Sapiens; identical to SEQ ID NO: 173475

SEQ ID NO: 455580 - RNA, 64 nt, Homo Sapiens; identical to SEQ ID NO: 173476

SEQ ID NO: 455581 - RNA, 64 nt, Homo Sapiens; identical to SEQ ID NO: 173477

SEQ ID NO: 455582 - RNA, 64 nt, Homo Sapiens; identical to SEQ ID NO: 173478

SEQ ID NO: 455583 - RNA, 64 nt, Homo Sapiens; identical to SEQ ID NO: 173479

SEQ ID NO: 455584 - RNA, 64 nt, Homo Sapiens; identical to SEQ ID NO: 173480

SEQ ID NO: 455585 - RNA, 64 nt, Homo Sapiens; identical to SEQ ID NO: 173481

SEQ ID NO: 455586 - RNA, 64 nt, Homo Sapiens; identical to SEQ ID NO: 173482

SEQ ID NO: 455587 - RNA, 64 nt, Homo Sapiens; identical to SEQ ID NO: 173483

SEQ ID NO: 455588 - RNA, 64 nt, Homo Sapiens; identical to SEQ ID NO: 173484

SEQ ID NO: 455589 - RNA, 64 nt, Homo Sapiens; identical to SEQ ID NO: 173485

SEQ ID NO: 455590 - RNA, 64 nt, Homo Sapiens; identical to SEQ ID NO: 173486

SEQ ID NO: 455591 - RNA, 64 nt, Homo Sapiens; identical to SEQ ID NO: 173487

SEQ ID NO: 455592 - RNA, 64 nt, Homo Sapiens; identical to SEQ ID NO: 173488

SEQ ID NO: 455593 - RNA, 64 nt, Homo Sapiens
aaaaugccaaacauguuggcaucaauuuuauacagggauauaaaaaaguauauguggauaaauu

SEQ ID NO: 455594 - RNA, 64 nt, Homo Sapiens
aaaguauauguggauaaauuuuuuguaaucuuuagggauauaaaaaaguguauguggauaaauu

SEQ ID NO: 455595 - RNA, 64 nt, Homo Sapiens
auagauuaacuguagaauucuuccuguacgauuggggauauaaugggcuucacuaaccuucccu

SEQ ID NO: 455596 - RNA, 64 nt, Homo Sapiens
ggaggucauccaacugacuuuaucaaguggaauugggauauauuugauauacuucugccuaaca

SEQ ID NO: 455597 - RNA, 64 nt, Homo Sapiens
aacaaauggaaaaagaagaugucccuaaccuacacccauagauuaccaagguuucaguguacua

SEQ ID NO: 455598 - RNA, 64 nt, Homo Sapiens
aaguuaaaacaaaacauggaugucugggucccgccccauagagaaugacuuaauuggcaugggg

SEQ ID NO: 455599 - RNA, 64 nt, Homo Sapiens; identical to SEQ ID NO: 153609

SEQ ID NO: 455600 - RNA, 64 nt, Homo Sapiens; identical to SEQ ID NO: 153610

SEQ ID NO: 455601 - RNA, 64 nt, Homo Sapiens; identical to SEQ ID NO: 153611

SEQ ID NO: 455602 - RNA, 64 nt, Homo Sapiens; identical to SEQ ID NO: 153612

SEQ ID NO: 455603 - RNA, 64 nt, Homo Sapiens; identical to SEQ ID NO: 153613

SEQ ID NO: 455604 - RNA, 64 nt, Homo Sapiens; identical to SEQ ID NO: 153614

SEQ ID NO: 455605 - RNA, 64 nt, Homo Sapiens; identical to SEQ ID NO: 153615

SEQ ID NO: 455606 - RNA, 64 nt, Homo Sapiens; identical to SEQ ID NO: 153616

SEQ ID NO: 455607 - RNA, 64 nt, Homo Sapiens; identical to SEQ ID NO: 153617

SEQ ID NO: 455608 - RNA, 64 nt, Homo Sapiens; identical to SEQ ID NO: 153618

SEQ ID NO: 455609 - RNA, 64 nt, Homo Sapiens; identical to SEQ ID NO: 153619

SEQ ID NO: 455610 - RNA, 64 nt, Homo Sapiens; identical to SEQ ID NO: 153620

SEQ ID NO: 455611 - RNA, 64 nt, Homo Sapiens; identical to SEQ ID NO: 153621

SEQ ID NO: 455612 - RNA, 64 nt, Homo Sapiens; identical to SEQ ID NO: 153622

SEQ ID NO: 455613 - RNA, 64 nt, Homo Sapiens; identical to SEQ ID NO: 153623

SEQ ID NO: 455614 - RNA, 64 nt, Homo Sapiens; identical to SEQ ID NO: 153624

SEQ ID NO: 455615 - RNA, 64 nt, Homo Sapiens; identical to SEQ ID NO: 153625

SEQ ID NO: 455616 - RNA, 64 nt, Homo Sapiens; identical to SEQ ID NO: 153626

SEQ ID NO: 455617 - RNA, 64 nt, Homo Sapiens; identical to SEQ ID NO: 153627

SEQ ID NO: 455618 - RNA, 64 nt, Homo Sapiens
aacacggcccuccugggaaccuccuuaccuggaguaaccggacaccuuagacggaggugccuga

SEQ ID NO: 455619 - RNA, 64 nt, Homo Sapiens
gagcuuuaugucuuuuauucauucuaauucuuauuaaccggaauauguaggaccauuucaauac

SEQ ID NO: 455620 - RNA, 64 nt, Homo Sapiens
ucggaaaccguccuguguacgguacugauggacuuaaccggagugauaacacaaguaaaacugu

SEQ ID NO: 455621 - RNA, 64 nt, Homo Sapiens
agggcgcagggugggggguaguuuugaaugcacuuaaccggagguaggaguguuaggggcagaa

SEQ ID NO: 455622 - RNA, 64 nt, Homo Sapiens
caaggccaggcuggcagagucccccaugucuguguaaccggaguggagguggagugaaaguuca

SEQ ID NO: 455623 - RNA, 64 nt, Homo Sapiens
aaucgggauuccauuuguguaaaaacuagggugguaaccggaaaaaaauauugucaguauuuca

SEQ ID NO: 455624 - RNA, 64 nt, Homo Sapiens
gcggacaccuggcccccgaguugccagcuuaaaguaaccggaugggguccacgggacgauggcu

SEQ ID NO: 455625 - RNA, 64 nt, Homo Sapiens
aggaauaaauagaaccuguugugcaaccacgguuuaaccggagauuuugaggcuaggguguguu

SEQ ID NO: 455626 - RNA, 64 nt, Homo Sapiens
auaucacuguguuugaaucgagggggaggggugguaaccggaaauaaagaccuccgaucuuccg

SEQ ID NO: 455627 - RNA, 64 nt, Homo Sapiens
aauugcagaacuaaacucauuuauaaagcuaaaauaaccggauauauacauagcaugacauuuc

SEQ ID NO: 455628 - RNA, 64 nt, Homo Sapiens
uauagagaaaauaaaauuuuuuccuuuuuuuuuuuaaccggaaagugcauuugcuuggguguaa

SEQ ID NO: 455629 - RNA, 64 nt, Homo Sapiens
acuaacauguaguauuugugaguuuagcaacuaauaaccggagacugcccaguggcucuuaaac

SEQ ID NO: 455630 - RNA, 64 nt, Homo Sapiens
gugaaagcuucauguauuuuuuaccuuuuuccuuuaaccggauucuuuaaccaguuauuuacag

SEQ ID NO: 455631 - RNA, 64 nt, Homo Sapiens
uuguguguguguguguguguguuuuuaaucacuguaaccggaugcauuuuuuuaaggcaaaauu

SEQ ID NO: 455632 - RNA, 64 nt, Homo Sapiens
uggcaccccagcucacugggagucucaggagggauaaccggauuucugcucuuuccccugucac

SEQ ID NO: 455633 - RNA, 64 nt, Homo Sapiens
ucagaagugccucacuguucucgugaccuggaguuaaccggaacagcgucuucauucauuucug

SEQ ID NO: 455634 - RNA, 64 nt, Homo Sapiens
caaacugcccgugacuuuuucugaauggacuucauaaccggaagacuuaaccgguggccucauc

SEQ ID NO: 455635 - RNA, 64 nt, Homo Sapiens
uuuauauuaaaaggggccucaccauauugguauauaaccggaauuauaguguaaaugcuaauua

SEQ ID NO: 455636 - RNA, 64 nt, Homo Sapiens
acuccucuaaccgguaccucugaauggggcuggauaaccggagaccccaugggaggucccugaa

SEQ ID NO: 455637 - RNA, 64 nt, Homo Sapiens
auaaagcugaaaaucgcauggcgcucagacauuuuaaccggaacugauguauaaucacaaaucu

SEQ ID NO: 455638 - RNA, 64 nt, Homo Sapiens
accaucaccaccaccauggacaacaagccuuggguaaccggaccaggccaagggucuacaauuc

SEQ ID NO: 455639 - RNA, 64 nt, Homo Sapiens
gggcuagcugcaccucacauuucuuggacauauaccguuggacaugucuaucuucuggaaacua

SEQ ID NO: 455640 - RNA, 64 nt, Homo Sapiens
ccgccacuuccagcgaacacacacagguguccugccguuggaccuucaccuccuagagauaaac

SEQ ID NO: 455641 - RNA, 64 nt, Homo Sapiens
ggggcuccuccaugacuagucucaauaugggguuccguuggauuaagccuuaucucagccuuuc

SEQ ID NO: 455642 - RNA, 64 nt, Homo Sapiens
cacccagacaucugcuuccauguuugguuuucuuccguuggaacacacaugugagacccagucc

SEQ ID NO: 455643 - RNA, 64 nt, Homo Sapiens
uuuugaaguccaacaaauuuaaaaguggcaaaucccguuggaggaaaaauggagguaguuccaa

SEQ ID NO: 455644 - RNA, 64 nt, Homo Sapiens
gucuuagaugauaucuguaaccaguuucugaaucccguuggauaaaacuguauugugauaucua

SEQ ID NO: 455645 - RNA, 64 nt, Homo Sapiens
cccuguguuccagaggaccuaggaucaagacaacccguuggagccacucagggugggggacagc

SEQ ID NO: 455646 - RNA, 64 nt, Homo Sapiens
ugagcuguguagcacuuguuucuuuccccgugucccguuggaucgggcuaggugcacuacagcc

SEQ ID NO: 455647 - RNA, 64 nt, Homo Sapiens
uagccagauggccauuauuuagucucaugcucuaccguuggaacgauguauuuuguauuuuaag

SEQ ID NO: 455648 - RNA, 64 nt, Homo Sapiens
ccaucgcuacagggcaccuacuggguguagguagccguuggagggcauccuccgaaucccaggg

SEQ ID NO: 455649 - RNA, 64 nt, Homo Sapiens
agugugaccggcgcuaggaaaugacccgagaaccccguuggaagcgcagcagcgggagcuaggg

SEQ ID NO: 455650 - RNA, 64 nt, Homo Sapiens
cuauauccugggacccuguaaagguccaugacauccguuggaacuuugaaaaguuccugguggg

SEQ ID NO: 455651 - RNA, 64 nt, Homo Sapiens
gaacauuuaaaauuaaauaauauaccuaccucuuccguuggaaaugauuuuucauauguggaaa

SEQ ID NO: 455652 - RNA, 64 nt, Homo Sapiens
ccagcugccuguuuucuuuugaggucauaccccaccguuggagcuggaagcccuggccugggag

SEQ ID NO: 455653 - RNA, 64 nt, Homo Sapiens
agcugauucacaaagugcugcugcagagcaagugccguuggaccgugauggacccaggaggucu

SEQ ID NO: 455654 - RNA, 64 nt, Homo Sapiens
gcagauauuucccggacccacccacccaggugccccguuggaaagcugaaguucuuggaaggcu

SEQ ID NO: 455655 - RNA, 64 nt, Homo Sapiens
uuccuagugggaaugaugggguaacaaacaagccccguuggaaccuuuuauucacucuugagcu

SEQ ID NO: 455656 - RNA, 64 nt, Homo Sapiens
acagagggcuauggcuguggagaagguucuuggcccguuggacucacacagacccuguacccuc

SEQ ID NO: 455657 - RNA, 64 nt, Homo Sapiens
ucuggaugcuugucuauuucgcccuuugguggggccguuggacucuuccuccagggacucuggg

SEQ ID NO: 455658 - RNA, 64 nt, Homo Sapiens
guaacaccuacaccauuaucuuggaaagaaacaaccguuggaaacauaaccauuacagggagcu

SEQ ID NO: 455659 - RNA, 64 nt, Homo Sapiens
cgaccccccuuuucacgucccuucugccucugccccguuggaugcccugacugggggcagggga

SEQ ID NO: 455660 - RNA, 64 nt, Homo Sapiens
agacccuccugugggcaggguggccucaaaccccccguuggaucgggaaccaggcugagcugag

SEQ ID NO: 455661 - RNA, 64 nt, Homo Sapiens
cucucccuuuccccaggcagcucgccuggccacaccguuggagugaacccucacugcccucaag

SEQ ID NO: 455662 - RNA, 64 nt, Homo Sapiens
cagcacagugaggcauuuagguaucucucggugaccguuggauuccuggaagcaguagcuguuc

SEQ ID NO: 455663 - RNA, 64 nt, Homo Sapiens
cuucuuuguagagcccaccgcuaccucccucuccccguuggauguccauuccauuccccaggug

SEQ ID NO: 455664 - RNA, 64 nt, Homo Sapiens
ccgguggagaagccccaccucagggccugcccacccguuggaggccagcccccugucgccuguc

SEQ ID NO: 455665 - RNA, 64 nt, Homo Sapiens
cgcugaagauggcaaugaaagacucucccuccagccguuggaauuggggccugugugcuuccca

SEQ ID NO: 455666 - RNA, 63 nt, Homo Sapiens
auucgcugcuggugaauugauucgaccugacugccguuggaccguaggcccuggacugcagag

SEQ ID NO: 455667 - RNA, 64 nt, Homo Sapiens
acugagugcccggggcacggucgacuccggggccccguuggaagccugaacccuagaacugucu

SEQ ID NO: 455668 - RNA, 64 nt, Homo Sapiens
ccaagaaacaaagccuacaugccgcuuacagcccccguuggaugguugcucaguacaacagucu

SEQ ID NO: 455669 - RNA, 64 nt, Homo Sapiens
agucuuaaacuggggcuucacacucaacaaauacccguuggaaguuguagguucuucacucacu

SEQ ID NO: 455670 - RNA, 64 nt, Homo Sapiens
uugccccucacacuggcccacaggagugggaugcccguuggacuagcugggaaagcccaggccg

SEQ ID NO: 455671 - RNA, 64 nt, Homo Sapiens
ggcaggcugaggcuguggagggccucccucuggcccguuggagguuccaggcccugcucuccac

SEQ ID NO: 455672 - RNA, 64 nt, Homo Sapiens
agccugggggaguggggaaggcuugggcauggccccguuggagguugauuugcuguuuuguuuc

SEQ ID NO: 455673 - RNA, 64 nt, Homo Sapiens
aaguuaaugagguuuuuaaaauaagguuuucuaguuuugagagugugcacuucacacaggggaa

SEQ ID NO: 455674 - RNA, 64 nt, Homo Sapiens
uccugguaaggauuuggggcauaguuuuuuguuuuuuugagacggaguuucgcucuuguugccc

SEQ ID NO: 455675 - RNA, 64 nt, Homo Sapiens
uucuuagaaucuaacguuacucaguuacuaauucuuuugagaacuccuaagagaccaauuugua

SEQ ID NO: 455676 - RNA, 64 nt, Homo Sapiens
augacaaccagacauuuccaguugguuuuguaaguuuugagaaucuagauacuggguuuuauuu

SEQ ID NO: 455677 - RNA, 64 nt, Homo Sapiens
aguuccauccaacuuucugaaauuucauuuuuuuuuuugagauggagucucucucugucaccca

SEQ ID NO: 455678 - RNA, 64 nt, Homo Sapiens
aacuagugcucuuccuaaaguuccuuuaauguccuuuugagauuuugagccauggaacuuacuu

SEQ ID NO: 455679 - RNA, 64 nt, Homo Sapiens
gaguuucacucuuguugcccuuuuuuuuuuucuuuuuugagaugccaccacgcccggccuuuuu

SEQ ID NO: 455680 - RNA, 64 nt, Homo Sapiens
gaguuuugcucugucgcgcauuuauuuuuuuuuauuuugagacguaacacagauuuuuuuauuu

SEQ ID NO: 455681 - RNA, 64 nt, Homo Sapiens
aaagaugaccauaaccacugaaaacaaaacaacauuuugagaacaaagaacauaaagguaaaac

SEQ ID NO: 455682 - RNA, 64 nt, Homo Sapiens
guaaagaacuuuuucuuuucaugaaaguagacaguuuugagaacgguguggacugaaugggauc

SEQ ID NO: 455683 - RNA, 64 nt, Homo Sapiens
augaaguguggaaugugucauagggcacuuuuuauuuugagagcaaaaaacuuagaguuaguuu

SEQ ID NO: 455684 - RNA, 64 nt, Homo Sapiens
gagucuugcuuugucacccaucaguguaauuuuuuuuugagacaaauacuuaccauaaagucuu

SEQ ID NO: 455685 - RNA, 64 nt, Homo Sapiens
aagucucacugcacucaggcuuuuuauuuuuguuuuuugagaugcaauucucuguuuuguuuug

SEQ ID NO: 455686 - RNA, 64 nt, Homo Sapiens
uuuaaguuuuguuuuaauguuucaugauuaucuguuuugagaguuauaauuuuauaaacacaaa

SEQ ID NO: 455687 - RNA, 64 nt, Homo Sapiens
uuuauaaccaaauacauuucaaauacaauuagguuuuugagauuuaaauagaauaauagcuuug

SEQ ID NO: 455688 - RNA, 64 nt, Homo Sapiens
uaaaaguaggaaacagguauucuucuccaaaauauuuugagauaacagucaagaccauuaaugg

SEQ ID NO: 455689 - RNA, 64 nt, Homo Sapiens
agggucaggucauggguaugcuugccagguuggguuuugagauuaagcacuaccuuccccagag

SEQ ID NO: 455690 - RNA, 64 nt, Homo Sapiens
aucaccaagugcaguuucaucaguacaaguagguuuuugagacacacagauggccugagauaag

SEQ ID NO: 455691 - RNA, 64 nt, Homo Sapiens
aagucucacugugucacccauuuucuuuucuuuuuuuugagacaccaccgcguccggccucuuu

SEQ ID NO: 455692 - RNA, 64 nt, Homo Sapiens
gagucucucacugucgcccauuuuucuuuuuuuuuuuugagacgggaagagugaagcguuuuuc

SEQ ID NO: 455693 - RNA, 64 nt, Homo Sapiens
uaggcuauaaaacaaaaaaauaaucacacaacaauuuugagaagguagauucccccguugucac

SEQ ID NO: 455694 - RNA, 64 nt, Homo Sapiens
cagauauagcaaaggauuagugcaaaaugcacuuuuuugagaugauaucauaaauugauaauuu

SEQ ID NO: 455695 - RNA, 64 nt, Homo Sapiens
gccagauuuucacauuuuuaaaauguucuagucauuuugagaaaucauauaucuuacacaguuc

SEQ ID NO: 455696 - RNA, 64 nt, Homo Sapiens
ugccaccucuggcauuuucuuucuuuuuuuuucuuuuugagacggaguuucgcuuuuguccccc

SEQ ID NO: 455697 - RNA, 64 nt, Homo Sapiens
uuuuuccuaaguaacuguaauaggaaaaaguuuauuuugagaguuucuucuucauaaaucuaca

SEQ ID NO: 455698 - RNA, 64 nt, Homo Sapiens
auagaagaugcaugauuucuggguuuuuuuuuuuuuuugagacagaguuucgcucuuguugccc

SEQ ID NO: 455699 - RNA, 64 nt, Homo Sapiens
uagcauucuguuuuuuugauccuaugucauaauuuuuugagaaaauguuugauacugcaagauc

SEQ ID NO: 455700 - RNA, 64 nt, Homo Sapiens
gagcaaaaaguagaagugauaaaugcaaguuauguuuugagauugcuuacaccgugacaagaug

SEQ ID NO: 455701 - RNA, 64 nt, Homo Sapiens
aauuuguucauaauggcucauguauuauuauuauuuuugagauggaguuuugcucuuaaugaua

SEQ ID NO: 455702 - RNA, 64 nt, Homo Sapiens
caggggcuuugaccacgaccuuugaagagcuucauuuugagaucaagccccacgaugacugcac

SEQ ID NO: 455703 - RNA, 64 nt, Homo Sapiens
ggugcuauuuuguuuguuuuguuuuguuuuguuuuuuugagacagaaucucgcucugucgccca

SEQ ID NO: 455704 - RNA, 64 nt, Homo Sapiens
agugguucccacuaaguauaagaauagcuucaaauuuugagaccugcgaauguucuccucuuaa

SEQ ID NO: 455705 - RNA, 64 nt, Homo Sapiens
gagucuugcucugucacccaauuuauuuauuuauuuuugagauggucuuuuuuuuaauuuauuu

SEQ ID NO: 455706 - RNA, 64 nt, Homo Sapiens
uuuucuuucuuucuuucuuuucuuuuuuuuuuuuuuuugagacggagucucacucuuguugccc

SEQ ID NO: 455707 - RNA, 64 nt, Homo Sapiens
aaugaagaacaaaaaaaaagauugauuuuuuuuuuuuugagacaggaucucacucugucaucca

SEQ ID NO: 455708 - RNA, 64 nt, Homo Sapiens
auaggaaaccaguuauuccuucuaccuuuaaaaauuuugagaacuugccaaccagggauuaaag

SEQ ID NO: 455709 - RNA, 64 nt, Homo Sapiens
cugccaccugaauaaaaugaaaaaaaaaguguuuuuuugagacagagucuugcucuguugccca

SEQ ID NO: 455710 - RNA, 64 nt, Homo Sapiens
uuagcccaagacaccaugacaaaauagcccagccuuuugagaguaauuugggaaaagaagcugu

SEQ ID NO: 455711 - RNA, 64 nt, Homo Sapiens
uuuuuuuuuuaagaagaaagaaaaugcaagcuaguuuugagaaaggaaggccaaauugggucgg

SEQ ID NO: 455712 - RNA, 64 nt, Homo Sapiens
guaguaaaggaaaaccaacccucuggaaaauacauuuugagaaucucaaacaucucacauauau

SEQ ID NO: 455713 - RNA, 64 nt, Homo Sapiens
uuucuuuuucuaacggcaaggaagauaugugcccuuuugagaauucaagauggcacugacacgg

SEQ ID NO: 455714 - RNA, 64 nt, Homo Sapiens
caaagucaagagucuuaaccuuguacucagggaauuuugagauaacaagucccuugggcaccuu

SEQ ID NO: 455715 - RNA, 64 nt, Homo Sapiens
aggggugggaaggaagagcgucccuuccuucuccuuuugagaaaaccacagaacuaugacucuc

SEQ ID NO: 455716 - RNA, 64 nt, Homo Sapiens
ugcuagucugucauuucuggagugauacuuuuuuuuuugagacggagucugcucugucgcucgc

SEQ ID NO: 455717 - RNA, 64 nt, Homo Sapiens
uuuguuuuguuuugcuuuguuuuuguuguuguuguuuugagacagggucucacuguguccccca

SEQ ID NO: 455718 - RNA, 64 nt, Homo Sapiens
ggagcuucucugaugugauauccacuuuuuuuuuuuuugagauggagucucacucugucaccca

SEQ ID NO: 455719 - RNA, 64 nt, Homo Sapiens
uugugaucugcccgccuccauuuuuguuguuauuuuuugagaaagauagauaugagguuuagag

SEQ ID NO: 455720 - RNA, 64 nt, Homo Sapiens
gagucucacucuguugcccaauaccuuuuuuuuuuuuugagacaagcacaggucuagagaaaug

SEQ ID NO: 455721 - RNA, 64 nt, Homo Sapiens
gagucuugcucugucgccgaguuuuguuuguuuguuuugagacaaugaguagugggguuuuuug

SEQ ID NO: 455722 - RNA, 64 nt, Homo Sapiens
guaagauuagaauaucaugaugauacagaacuacuuuugagaugauacauuguuuuagaucccc

SEQ ID NO: 455723 - RNA, 64 nt, Homo Sapiens
gggucucacucuugccuaggacauuguuuuuuguuuuugagacaugagaaagauuuugagauau

SEQ ID NO: 455724 - RNA, 64 nt, Homo Sapiens
uacauuguuuuuuguuuuuguguucugagaaagauuuugagauaaaaagaaauaauuggcacca

SEQ ID NO: 455725 - RNA, 64 nt, Homo Sapiens
gagucucuggugcccaggcuuuugccaugauucuuuuugagacacugugccuuuacucugcauc

SEQ ID NO: 455726 - RNA, 64 nt, Homo Sapiens
cauacacuacauuuacaaaaugucuauuguuaaauuuugagauucaguuugguauuuuaaaaau

SEQ ID NO: 455727 - RNA, 64 nt, Homo Sapiens
guauuuuuagagcugaauuuguagauaugugauuuuuugagacuuacuugucuuaguauuauau

SEQ ID NO: 455728 - RNA, 64 nt, Homo Sapiens
gaguuucacucuugucaccuuguuuguuuuguuuuuuugagaugauuuacuuguuuuguuuuug

SEQ ID NO: 455729 - RNA, 64 nt, Homo Sapiens
uucuccuaccucuuccaacccuccauuagcucaauuuugagauaauggaaaauugacuggaaau

SEQ ID NO: 455730 - RNA, 64 nt, Homo Sapiens
uggguacugcuuucauaaaacaguuuuuucaguauuuugagaauugccauauuaauuuuuauaa

SEQ ID NO: 455731 - RNA, 64 nt, Homo Sapiens
cauuuucuuggcauguuaaaucaagcuuaaaaaguuuugagaaaauuuuacugcgcuguguugc

SEQ ID NO: 455732 - RNA, 64 nt, Homo Sapiens
cauuauggugauacacauaugugaauucaguacauuuugagacaguauucuaccauucaguaau

SEQ ID NO: 455733 - RNA, 64 nt, Homo Sapiens
gagucuuguucugucgccaguaauuaauuuauuuuuuugagacauggcuuuucuaauuuuuaau

SEQ ID NO: 455734 - RNA, 64 nt, Homo Sapiens
agaggcuauuuugauguuuuucuccaugaaguucuuuugagaggauacuuguguuuuugauaca

SEQ ID NO: 455735 - RNA, 64 nt, Homo Sapiens
gagucuccugaccuaaucuuuauuauuuuuuuuuuuuugagacgauuauuauuauuauuauuau

SEQ ID NO: 455736 - RNA, 64 nt, Homo Sapiens
uccuuuauucuuaaaaagcuaacugcacuaagccuuuugagacaucugaaguuauuaaagcuaa

SEQ ID NO: 455737 - RNA, 64 nt, Homo Sapiens
aacuuagauguaacuuagcacuuuuuuuuuuuuuuuuugagauggagucucacucugucaccag

SEQ ID NO: 455738 - RNA, 64 nt, Homo Sapiens
gcgcugccacacccagguaauuuauuuauuuuuuuuuugagacagagucucgcacuguugccca

SEQ ID NO: 455739 - RNA, 64 nt, Homo Sapiens
agguacauggacuauaucgcacaacaggugcuaguuuugagaaggcccaacaggaguuugcaac

SEQ ID NO: 455740 - RNA, 64 nt, Homo Sapiens
auacuugaaucccuaaaugcaccugucuuucacuuuuugagacagacugaauauaucuaaaauu

SEQ ID NO: 455741 - RNA, 64 nt, Homo Sapiens
aaaauaucuaaaauaauguucauggugaaucuuauuuugagaaauacauguuaaaaaaggaaca

SEQ ID NO: 455742 - RNA, 64 nt, Homo Sapiens
cgagccaccacaccuggccaaaaaaauuuauauuuuuugagacaaggucucacucugucaccca

SEQ ID NO: 455743 - RNA, 64 nt, Homo Sapiens
gccuggcuggauaugaaauuuuuuuuuuuuuuuuuuuugagacaggguuucgcucuuguugcca

SEQ ID NO: 455744 - RNA, 64 nt, Homo Sapiens
uuucuuuucuuuucuuucuuuuuuuuuuuuuccuuuuugagacagggucuuacucuugucaccc

SEQ ID NO: 455745 - RNA, 64 nt, Homo Sapiens
caaugugcccauccaaaguuuuauuuauuuauuuuuuugagauggagucucguaaaguuaccuu

SEQ ID NO: 455746 - RNA, 64 nt, Homo Sapiens
gagucuuacucuuuugccagauuuugugggguuuuuuugagaugugaaaaaggaaguaauauaa

SEQ ID NO: 455747 - RNA, 64 nt, Homo Sapiens
ggaaaugacccaaaggaaagccuuaagcaaaguuuuuugagaagagcucuuuagcuccaauuuc

SEQ ID NO: 455748 - RNA, 64 nt, Homo Sapiens
gagucucacucugucacacaucuuuuuuuuuuuuuuuugagauguuuucuuccuuuuucuuuuu

SEQ ID NO: 455749 - RNA, 64 nt, Homo Sapiens
guaugugucucuaaguaaguuagaauauuacaucuuuugagaauuauaguaaaaccuugggaua

SEQ ID NO: 455750 - RNA, 64 nt, Homo Sapiens
aagucucgcucuguugcccauuuguguuuuguuuuuuugagaugugcuuguuugucgguuuugu

SEQ ID NO: 455751 - RNA, 64 nt, Homo Sapiens
gaguuucugucuuguugcccuuuuuuuuuuuuuuuuuugagacgaauuauauggaucucuuuuu

SEQ ID NO: 455752 - RNA, 64 nt, Homo Sapiens
ugcuuaaguauaccuaucacuuacauuuuugugguuuugagaaaguacagcaguagacuggggc

SEQ ID NO: 455753 - RNA, 64 nt, Homo Sapiens
caccauuuuguaaguuauguuuuacaugccccguuuuugagacugaucucgaugcagguggauc

SEQ ID NO: 455754 - RNA, 64 nt, Homo Sapiens
guucucugauuucugguggcuuuuagacacuaauuuuugagaacuacuuuuuuuuuuuuaccaa

SEQ ID NO: 455755 - RNA, 64 nt, Homo Sapiens
cagguguugcugaugcuggugauuggguaccacauuuugagaaccauggggcauuggcaaucaa

SEQ ID NO: 455756 - RNA, 64 nt, Homo Sapiens
augauagaagguuuuuuuuuuuuuuuuuuuuuuuuuuugagacggagucccacucuugucgccc

SEQ ID NO: 455757 - RNA, 64 nt, Homo Sapiens
uuguguuauugauuauauacaaaggagacuuuuuuuuugagauaacacucaaauaguauucucu

SEQ ID NO: 455758 - RNA, 64 nt, Homo Sapiens
agguaauaagcuucacuuuuuguguucuaauuguuuuugagauauaaagacccugaaaaagccc

SEQ ID NO: 455759 - RNA, 64 nt, Homo Sapiens
aagaaauuuucuuaccaggacucccugaaagccuuuuugagauuucuucuuauccaucaccaug

SEQ ID NO: 455760 - RNA, 64 nt, Homo Sapiens
ugaugcaaaaaguaucuguuacaaaacacauugguuuugagaggcugacugacaguucaucccc

SEQ ID NO: 455761 - RNA, 64 nt, Homo Sapiens
gugccucacucugucacccauuuuuuuuuuuuuuuuuugagacaccuaguucaguaucuuuuuu

SEQ ID NO: 455762 - RNA, 64 nt, Homo Sapiens
uauuuacauaguagcauguacacuuaguacaaguuuuugagauucuuuugugucuggcuucuuu

SEQ ID NO: 455763 - RNA, 64 nt, Homo Sapiens
gcucuaugagcucuaaguaaugaucaguaguugauuuugagaaaaguuuuuaauugggcuguua

SEQ ID NO: 455764 - RNA, 64 nt, Homo Sapiens
gaauuuuucucuccuuaauaguuuuuuuguuuuguuuugagagaacucacucaguuguguguag

SEQ ID NO: 455765 - RNA, 64 nt, Homo Sapiens
gagucucgcucugucgcccauuuuuuuuuuuuuuuuuugagacggaaugaagaaggcaaaaaac

SEQ ID NO: 455766 - RNA, 64 nt, Homo Sapiens
gagucucacucuuccgcccaucuuuuuuuuuuuuuuuugagacgcuuauauaagggauaauuuu

SEQ ID NO: 455767 - RNA, 64 nt, Homo Sapiens
gaguuucacucugucgcccaauaauuuuuuuuuuuuuugagaugauauacauacacacauacau

SEQ ID NO: 455768 - RNA, 64 nt, Homo Sapiens
uauauuuucacagucuuuucuaugccuuguucucuuuugagauaguuuuacugagccuucugac

SEQ ID NO: 455769 - RNA, 64 nt, Homo Sapiens
aacuuaacauuuugcacagaauauaucaaauauauuuugagaaaaaaaguacggcaugaguucu

SEQ ID NO: 455770 - RNA, 64 nt, Homo Sapiens
ucucacaaaaaaucuuauuucagaauggaaauauuuuugagaaaaguagcugaguauacugguu

SEQ ID NO: 455771 - RNA, 64 nt, Homo Sapiens
acuuuaauaguguuacuuggauagcuuauaugaauuuugagaauuuuauaugaauuuugagaaa

SEQ ID NO: 455772 - RNA, 64 nt, Homo Sapiens
auagcuuauaugaauuuugagaauuuuauaugaauuuugagaaagcaaguucaaaagaacucug

SEQ ID NO: 455773 - RNA, 64 nt, Homo Sapiens
uauagauaauguucaaugaccucaagacauauauuuuugagaaauuaucauuuuaaaaaauuug

SEQ ID NO: 455774 - RNA, 64 nt, Homo Sapiens
guagagcuauaucauugucuguuaauguauuauauuuugagauuuuuuuugaucuaagguuuua

SEQ ID NO: 455775 - RNA, 64 nt, Homo Sapiens
aaguucaaaaaccaucccuuaaaggugauuguuuuuuugagacagagucuugcucugucaccca

SEQ ID NO: 455776 - RNA, 64 nt, Homo Sapiens
auuucacucuuguugcccaguuuuauuuuuauuuuuuugagauaaaaaugugauucuguaacuu

SEQ ID NO: 455777 - RNA, 64 nt, Homo Sapiens
uggucacgcugugucgccaagcguuuaguuuguuuuuugagacauuccaucuuggcuaguugug

SEQ ID NO: 455778 - RNA, 64 nt, Homo Sapiens
gaaucucacucuguugcccauguuuuuguuuuguuuuugagaccuuagaaacaaauuuuuuucu

SEQ ID NO: 455779 - RNA, 64 nt, Homo Sapiens
acacuaucaaaucagucuuguguguagggcuuuuuuuugagaauuuuaacugggagugauauga

SEQ ID NO: 455780 - RNA, 64 nt, Homo Sapiens
gagucucgcucugucgcccauuuuuuuuuuuuuuuuuugagacgaaauaaaccuuugcuuuuuu

SEQ ID NO: 455781 - RNA, 64 nt, Homo Sapiens
uugcucaugaaccaucugcaucaagaagcccauguuuugagauuagagcaucuaugugccuuca

SEQ ID NO: 455782 - RNA, 64 nt, Homo Sapiens
aaugaauugcaauaaccagcuuuucaugaaaguauuuugagaacggcuuuuucucaggucaggc

SEQ ID NO: 455783 - RNA, 64 nt, Homo Sapiens
gaaucucacuccaucguccauuuuuuuuuuuuuuuuuugagacucgccaggcaguuguauuuuu

SEQ ID NO: 455784 - RNA, 64 nt, Homo Sapiens
uggaaacuuacaggacuuaaauaucagugaaauauuuugagaucuuugaauaauuccuuuagag

SEQ ID NO: 455785 - RNA, 64 nt, Homo Sapiens
auuaauauauaugaguccuuuguaauuuauuuuuuuuugagacaggaucucacuuuuaccgccc

SEQ ID NO: 455786 - RNA, 64 nt, Homo Sapiens
uguacugacaucacauguuauacuaaugacagguuuuugagaaucacuugcuagcaacucauac

SEQ ID NO: 455787 - RNA, 64 nt, Homo Sapiens
uaggccagguauccucacaaggugaauugaugguuuuugagaagucagcugaaaauuugguugg

SEQ ID NO: 455788 - RNA, 64 nt, Homo Sapiens
ccugccugggcucugcccuuggaaucaguuaauguuuugagaaauugauucuccuuugguaggu

SEQ ID NO: 455789 - RNA, 64 nt, Homo Sapiens
uagacucuguaaaaauaaucuccauagggugaaauuuugagaccguagaccaaaaagaaccaaa

SEQ ID NO: 455790 - RNA, 64 nt, Homo Sapiens
caaaagaaaaaaaauagacuuuuucaacucagcuuuuugagaccugaaaaaauuauuauguaaa

SEQ ID NO: 455791 - RNA, 64 nt, Homo Sapiens
uucuaagacuacuaugaacaguuuucuuuuaaaauuuugagauuaagaaugccaggaauauugu

SEQ ID NO: 455792 - RNA, 64 nt, Homo Sapiens
ggagguagauucagcaccuaacaauccuguaugcuuuugagaucacguuuagugcuauguccua

SEQ ID NO: 455793 - RNA, 64 nt, Homo Sapiens
gauugauugauugauagaaagaaaguugcuuuucuuuugagaauuaaaaacuuuggcuugauuu

SEQ ID NO: 455794 - RNA, 64 nt, Homo Sapiens
cauuguccccagacagggaucugggcccucagacuuuugagaauaugaagaggaggguugaggc

SEQ ID NO: 455795 - RNA, 64 nt, Homo Sapiens
aaagugccaggaccagcuggguucacugauguguuuuugagauacuuaagguagaaaugauacc

SEQ ID NO: 455796 - RNA, 64 nt, Homo Sapiens
uggucuccguuaaguauagggcuuuuugacagcuuuuugagaccucuuaagaaaaaauaaaaag

SEQ ID NO: 455797 - RNA, 64 nt, Homo Sapiens
ccauuuucaaaaaccaucauguuuuguagauacauuuugagaaaaaccaucauguuuugaggau

SEQ ID NO: 455798 - RNA, 64 nt, Homo Sapiens
auaaaauguuucagguauuuuuguuucauuuuguuuuugagauagggucuuuguugcucaggcu

SEQ ID NO: 455799 - RNA, 64 nt, Homo Sapiens
ugcggguuggagaaaauacaauuuuuuuuuuuuuuuuugagacagucucgcucugucccccagg

SEQ ID NO: 455800 - RNA, 64 nt, Homo Sapiens
acaacagaaaauuuggacagacuucaauuugccauuuugagauuugaccugugguagcaucugg

SEQ ID NO: 455801 - RNA, 64 nt, Homo Sapiens
uugauuagucuuuaaaguaggcuuuuuuuuuuuuuuuugagaauacuggaccaucauuaaaugu

SEQ ID NO: 455802 - RNA, 64 nt, Homo Sapiens
gagucuugcucugucgcccauuuguuuguuuguuuuuugagaugauuuuuuguuuguuuguuug

SEQ ID NO: 455803 - RNA, 64 nt, Homo Sapiens
gaguuucccucuugucacccuuuuuauuuuaauuuuuugagacgccuucuuuuucuuuuuuuuu

SEQ ID NO: 455804 - RNA, 64 nt, Homo Sapiens
agucucgcucugucgcccagaauuuuuuuuuuuuuuuugagaggaugcaccaccacacccagcu

SEQ ID NO: 455805 - RNA, 64 nt, Homo Sapiens
gagucuuguucuguugccagcuuuuuuuuuuuuuuuuugagacgucuugccuaaugcauauucu

SEQ ID NO: 455806 - RNA, 64 nt, Homo Sapiens
aaugucuacuuuuccuguuucuguuuccugacuuuuuugagagaguaagcauugguacaguguc

SEQ ID NO: 455807 - RNA, 64 nt, Homo Sapiens
gagucuugcucuguugcccaugguuucuuucuuuuuuugagauggaguuucuguauaacauaac

SEQ ID NO: 455808 - RNA, 64 nt, Homo Sapiens
gaguuucacucuuguugcccauuuuuuuuuuuuuuuuugagacagguaaucgccaaauaguucc

SEQ ID NO: 455809 - RNA, 64 nt, Homo Sapiens
gucacuggaucaagaaugcaaaaaucuuuuccuguuuugagauaccaaauggucaacuuacuua

SEQ ID NO: 455810 - RNA, 64 nt, Homo Sapiens
ucuucagagaucauaagaacgggacugugacugcuuuugagagcucuuagaggaccagccuccu

SEQ ID NO: 455811 - RNA, 64 nt, Homo Sapiens
aaagugacucuuuacuguagcagugaaaaguaucuuuugagauuuaaaauccugucauuuagaa

SEQ ID NO: 455812 - RNA, 64 nt, Homo Sapiens
caauaauggggaaaauauuuaucuaugacaugaguuuugagaaaaaaccaucaucuguaaaacc

SEQ ID NO: 455813 - RNA, 64 nt, Homo Sapiens
gagucucacucugucccccauuuuuuuuuuuuuuuuuugagacacccagguucaagcgauuccu

SEQ ID NO: 455814 - RNA, 64 nt, Homo Sapiens
gagucucacucugucacccauuaaucuuuuauuuuuuugagacaguuccuacccuuuuuuuuuu

SEQ ID NO: 455815 - RNA, 64 nt, Homo Sapiens
ccucauccaguuucuuuagucccaagccuucuccuuuugagacuuaugcccaucccaucuucac

SEQ ID NO: 455816 - RNA, 64 nt, Homo Sapiens
gaaucuuacucugucaccggcuggcuuuuuuuuuuuuugagauguuaggccuaacuccaaagcc

SEQ ID NO: 455817 - RNA, 64 nt, Homo Sapiens
aaaggccaaaugauagcgggggcuaaguuggugcuuuugagaaccaaguaaaacaaaaccacug

SEQ ID NO: 455818 - RNA, 64 nt, Homo Sapiens
cccauaggaguuagaaguuaggguuuaggcaucauuuugagaaugcugacacuuuuucagggcu

SEQ ID NO: 455819 - RNA, 64 nt, Homo Sapiens
gagggaugggggaaaguaaaagauguuuuuuuuuuuuugagacucgcuuugucacccaggcugg

SEQ ID NO: 455820 - RNA, 64 nt, Homo Sapiens
uaucuugguguaguuuuggcuuuuuuguuuguuuuuuugagacagcaucucacacugucgccca

SEQ ID NO: 455821 - RNA, 64 nt, Homo Sapiens
ccagaaaaauguauggaugaauuuuuuuuuuuuuuuuugagacaaagucucacugugucaugca

SEQ ID NO: 455822 - RNA, 64 nt, Homo Sapiens
ggccauguuuagcacugguugccagggauucucuuuuugagagagggaaagcaaaaugaaugga

SEQ ID NO: 455823 - RNA, 64 nt, Homo Sapiens
gcaaaucguauaccuuauuagccagaaaaggcauuuuugagaaaggugugagccacugugucug

SEQ ID NO: 455824 - RNA, 64 nt, Homo Sapiens
gggucuggcuguguugcccuuuuuuuuuuuuuuuuuuugagacgaaaggcuguuuuuuguuuuu

SEQ ID NO: 455825 - RNA, 64 nt, Homo Sapiens
gaguuucgcucuuguugcccuuuuuuuuuuuuuuuuuugagacaauaucucuaauagaaucuuu

SEQ ID NO: 455826 - RNA, 64 nt, Homo Sapiens
gggucucacuuuguuacccauuauuuauuuauuuuuuugagauacaagcuugaguuuuuauuuu

SEQ ID NO: 455827 - RNA, 64 nt, Homo Sapiens
cagugguuggggcauuuuuauuuuagucuuucuguuuugagaaguaugauaaacuguauguagu

SEQ ID NO: 455828 - RNA, 64 nt, Homo Sapiens
gaguuuugcucuuguuacccugacccucuuuuuuuuuugagacgaaaaccacaaagcuacaaac

SEQ ID NO: 455829 - RNA, 64 nt, Homo Sapiens
aagucucgcgguugucacccugcaaacacuuuuuuuuugagaugaauuugacaaauggugcugu

SEQ ID NO: 455830 - RNA, 64 nt, Homo Sapiens
uggggacagagucucacuaucuaaauguuuuuauuuuugagaaguucuucacuguugagaacac

SEQ ID NO: 455831 - RNA, 64 nt, Homo Sapiens
uguauguguauauauaaaaguaaaaauaacuauguuuugagauauauuuauauaacuuaaaaag

SEQ ID NO: 455832 - RNA, 64 nt, Homo Sapiens
caggaauuacuguaacaaaaacuuuuuguauuauuuuugagauggcuggucuaaacuuauuuuc

SEQ ID NO: 455833 - RNA, 64 nt, Homo Sapiens
augcaguaaagaucacuuuuuuuuuuuuuuuuuuuuuugagauggagucuugcucugucgccca

SEQ ID NO: 455834 - RNA, 64 nt, Homo Sapiens
agagauggugauuuguuuaguuucaucuuagauuuuuugagaacucaccagcuuuuauuaccca

SEQ ID NO: 455835 - RNA, 64 nt, Homo Sapiens
gaaguacaggcaaacuugauguuugaaagauaaguuuugagaaaugucauuguauuuuggagua

SEQ ID NO: 455836 - RNA, 64 nt, Homo Sapiens
cugcuugcaaaguguuggugauuuuacugaaaacuuuugagaucuucauuuuacaggcagaccu

SEQ ID NO: 455837 - RNA, 64 nt, Homo Sapiens
gucaagacucuuucuuaaggacagaauacugcuauuuugagagacuuguguugcuaagugcuaa

SEQ ID NO: 455838 - RNA, 64 nt, Homo Sapiens
uuuauuucaguugcuauauccuaugaagacauucuuuugagauugaaggaacaggcauuuuaca

SEQ ID NO: 455839 - RNA, 64 nt, Homo Sapiens
aagaguuaucccacagaaaacucuuuaaaauuuauuuugagaagaacccucauggucaaaguuu

SEQ ID NO: 455840 - RNA, 64 nt, Homo Sapiens
ucauuuuauaaucauuauuuguguagaaacuauuuuuugagaaacuuauguagcacuuaacacu

SEQ ID NO: 455841 - RNA, 64 nt, Homo Sapiens
acaauauauugauugcacuauauaaaugaguaaauuuugagaggaacaaugugggaauguauaa

SEQ ID NO: 455842 - RNA, 64 nt, Homo Sapiens
uuccuaugaaacaaaaaccuugagaucucuuuuuuuuugagacagagucucgcuguugucagcc

SEQ ID NO: 455843 - RNA, 64 nt, Homo Sapiens
cacaggaauaguuaaaugcauuuguuuguuuguuuuuugagacagaguuucacucuuguugccc

SEQ ID NO: 455844 - RNA, 64 nt, Homo Sapiens
acgcccagccaucaaugcauuuuuuuuauuuuuuuuuugagacagaguuucgcacuucuugccc

SEQ ID NO: 455845 - RNA, 64 nt, Homo Sapiens
ucuauauggucagcuucaucuuccuuuuuuuuuuuuuugagauggaguuucgcucuuguugccc

SEQ ID NO: 455846 - RNA, 64 nt, Homo Sapiens
uuaggguagaaauuuauuuagcaaaugugaauucuuuugagaaaguaugaaguuuugcagaaau

SEQ ID NO: 455847 - RNA, 64 nt, Homo Sapiens
aaaagagaggauguccgugcuuaauucuagauacuuuugagacaacaccuucagaaaacacaua

SEQ ID NO: 455848 - RNA, 64 nt, Homo Sapiens
guguuugggccucucuugcugucauuaugauguauuuugagaugauuagucaagagucaagguu

SEQ ID NO: 455849 - RNA, 64 nt, Homo Sapiens
aaugguuaagcccucuucuuuacucuuaauuuuuuuuugagacagagucacccaggcuggagug

SEQ ID NO: 455850 - RNA, 64 nt, Homo Sapiens
cugauggguguuuuuuuuuguuuuguuuuuuguuuuuugagauggaguuuugcucuuguugccc

SEQ ID NO: 455851 - RNA, 64 nt, Homo Sapiens
gagucucgcucuguugcccaugcuuuuuuuuuuuuuuugagauguguuagauguuagcacaucu

SEQ ID NO: 455852 - RNA, 64 nt, Homo Sapiens
gucuugggucucaaacacauucuuuuucagcauuuuuugagaaauauauauaugcacacacacc

SEQ ID NO: 455853 - RNA, 64 nt, Homo Sapiens
cccaguccaaauuuuuuuuuuuuuuuuuuuuuuuuuuugagacagagucuugcucugucaccca

SEQ ID NO: 455854 - RNA, 64 nt, Homo Sapiens
cuuagugucuugaaguuuugcacaaaauucuuuuuuuugagauggagucucacucugucaccca

SEQ ID NO: 455855 - RNA, 64 nt, Homo Sapiens
uuuuguugguuuguuuguuugguuuuguguuuuuuuuugagauggggucuugcucugucgccca

SEQ ID NO: 455856 - RNA, 64 nt, Homo Sapiens
ccgcucuaaaaaugaaauuguuaggugaaaguguuuuugagaauuuuuauauauauuacucacu

SEQ ID NO: 455857 - RNA, 64 nt, Homo Sapiens
uuuuucauauucauuggccaugcuauauucauucuuuugagaauugcucauucauauuuuuucu

SEQ ID NO: 455858 - RNA, 64 nt, Homo Sapiens
ccaucaccagaauuaauuuuauuauucuuauuauuuuugagacagagucuuacucuguugccag

SEQ ID NO: 455859 - RNA, 64 nt, Homo Sapiens
gaaccaccgcgcccagccuuuuuguuuuuuuuuuuuuugagacagagucuuccucugucuccua

SEQ ID NO: 455860 - RNA, 64 nt, Homo Sapiens
ucuacguuucccaaguuuuagugucggacccuacuuuugagaaacaaaaaguaacuaaaaaauu

SEQ ID NO: 455861 - RNA, 64 nt, Homo Sapiens
ccggagucucgcucuaucgcaaauuuuuuuuuuuuuuugagacuuguuuauuuuagacccuucu

SEQ ID NO: 455862 - RNA, 64 nt, Homo Sapiens
gagucucacucuguuacccauuguuuuguucuuuuuuugagacgacguagguuuuuuguuuguu

SEQ ID NO: 455863 - RNA, 64 nt, Homo Sapiens
cuuugcuccaguccuauggcaaaaaaauguuuucuuuugagacccugaugaacaaaacuuuuuu

SEQ ID NO: 455864 - RNA, 64 nt, Homo Sapiens
caucuuggugggggcaccuuuuuaaacauuuuuuuuuugagagagagccuuguucugucaccua

SEQ ID NO: 455865 - RNA, 64 nt, Homo Sapiens
ccaccacaccuggcuaacuuuuuuuuuuuuuuuuuuuugagauggcaucuugcucugucgccca

SEQ ID NO: 455866 - RNA, 64 nt, Homo Sapiens
aaguuuugcucuugucacccuuuuuuuuuuuuuuuuuugagacacugugcccggccuaugauuc

SEQ ID NO: 455867 - RNA, 64 nt, Homo Sapiens
aaaucuugcucuguggcccauuuuuuuuuuuuuuuuuugagaccccuggauuaaugaacuauga

SEQ ID NO: 455868 - RNA, 64 nt, Homo Sapiens
uuagauuccugagagaugucucuggaagggaaaguuuugagaacuaauggcuauuuuugaggac

SEQ ID NO: 455869 - RNA, 64 nt, Homo Sapiens
ucuuuguucuuguuugcugcuauuuucuguccuauuuugagaaauauaaauacauagaaauggu

SEQ ID NO: 455870 - RNA, 64 nt, Homo Sapiens
aggaaaagucaacaucuucucucuuuuuuuuuuuuuuugagacagggucucacuauguugccca

SEQ ID NO: 455871 - RNA, 64 nt, Homo Sapiens
acuccuccuugccugcuuuucuuuuuuuuucuuuuuuugagacggcgcaccuaucacccaggcu

SEQ ID NO: 455872 - RNA, 64 nt, Homo Sapiens
gagucucacucuggcgccuguuuuuucuuuuucuuuuugagacaauccagcuaaaggagagcgu

SEQ ID NO: 455873 - RNA, 64 nt, Homo Sapiens
aggucucacugucacccagguguuuuguuuuuguuuuugagacgguaggggagcaugguuuuuu

SEQ ID NO: 455874 - RNA, 64 nt, Homo Sapiens
aggcauuuuauaaaaugcauuaugccaugguugcuuuugagauagauuguagucuggguagcau

SEQ ID NO: 455875 - RNA, 64 nt, Homo Sapiens
uuccgaucaaagaaaaguaauucuuucuuuuuuuuuuugagacagagucuugcuuuguugccca

SEQ ID NO: 455876 - RNA, 64 nt, Homo Sapiens
guucucuuuuucuagcuuccacaucagcuuccuuuuuugagaacauauagaagaagaaggcuaa

SEQ ID NO: 455877 - RNA, 64 nt, Homo Sapiens
uaauuauuuuuuaaaaaaaauuuuuaaaaagguuuuuugagacagauucuugcucugucaccca

SEQ ID NO: 455878 - RNA, 64 nt, Homo Sapiens
guuugguuauguuuuguccuuuuaaaacauuuucuuuugagaugggggucuugcucuguugccc

SEQ ID NO: 455879 - RNA, 64 nt, Homo Sapiens
aacaauaguacuguugagauaaaaguugagcacauuuugagacuucuuccaaauuggucccuag

SEQ ID NO: 455880 - RNA, 64 nt, Homo Sapiens
uuuguaguaugacuccugucacucaguacaauuauuuugagauucauuuauguuauuguaugua

SEQ ID NO: 455881 - RNA, 64 nt, Homo Sapiens
gguguuagauguuacggugcuacauuuaauuucuuuuugagaaaaacccucugcuauugaugac

SEQ ID NO: 455882 - RNA, 64 nt, Homo Sapiens
gggucucacucuguugcccauguuuuuguuuuuguuuugagacaggccccacccauguuauuuu

SEQ ID NO: 455883 - RNA, 64 nt, Homo Sapiens
cugaauuuugcaaagggccaucaguuggauauccuuuugagaaagucaugacaggaaacuugca

SEQ ID NO: 455884 - RNA, 64 nt, Homo Sapiens
gagucucucucugucccccaucuuuuuuucuuuuuuuugagacagaagauugauuauuuccuca

SEQ ID NO: 455885 - RNA, 64 nt, Homo Sapiens
aagacuuugacaggggugccuaauuuuuuuuuuuuuuugagauggagucucgcucuguugccca

SEQ ID NO: 455886 - RNA, 64 nt, Homo Sapiens
uuuuccuucgguuguuugccuucuuauuguuggauuuugagaguucuauguacaaguccuuugu

SEQ ID NO: 455887 - RNA, 64 nt, Homo Sapiens
uuuaaguuauuauuauuauuauuauuuuuuuuuuuuuugagauggagucucgcucugucgccca

SEQ ID NO: 455888 - RNA, 64 nt, Homo Sapiens
ugagccacugcgccuggcuaaguuauuauuauuuuuuugagacagucuccuggugucacccagg

SEQ ID NO: 455889 - RNA, 64 nt, Homo Sapiens
gaggucacuccuugcagaacaucagaaaauucauuuuugagauaacuguucccaaugcagugag

SEQ ID NO: 455890 - RNA, 64 nt, Homo Sapiens
gugagccaguuuucccagccuguuuauuauuauuuuuugagauggaguguugcucuugcugccc

SEQ ID NO: 455891 - RNA, 64 nt, Homo Sapiens
guaccucauauaaguggauucuacaguauuuaucuuuugagacuggcuuauuucacuuaggaua

SEQ ID NO: 455892 - RNA, 64 nt, Homo Sapiens
ucauauaggauuucuauuuuuuuuuuuuguuuguuuuugagacagagucuugcucugucaccca

SEQ ID NO: 455893 - RNA, 64 nt, Homo Sapiens
ccugagucacgugauagauuaaaguacaacucuuuuuugagacagagucucacucugucaccca

SEQ ID NO: 455894 - RNA, 64 nt, Homo Sapiens
uugagucagugguuuauguuuugcauuuuuuuuguuuugagacaaagucucgcucugucuccca

SEQ ID NO: 455895 - RNA, 64 nt, Homo Sapiens
uccagacuauuuugugccuaacugcaaggcugacuuuugagacugccucuuccacgaugccuuu

SEQ ID NO: 455896 - RNA, 64 nt, Homo Sapiens
uucuuuuucuuuuucuuuucuuuucuuuuuuuuuuuuugagauggagucucgcucugucgccca

SEQ ID NO: 455897 - RNA, 64 nt, Homo Sapiens
aacuggucugacuaaaauuuuuaucaggagacgguuuugagaucccauugucauugauaacauc

SEQ ID NO: 455898 - RNA, 64 nt, Homo Sapiens
gaguuuugcucuuguugcccuuuuuuuuuuuuuuuuuugagaugaaacacaggauuuuuuuuuu

SEQ ID NO: 455899 - RNA, 64 nt, Homo Sapiens
gagucucacucugucgcccaccuuuuuuuuuuuuuuuugagacgcgugcccagcuagacgucuu

SEQ ID NO: 455900 - RNA, 64 nt, Homo Sapiens
gaguuucacucuuguugucccuuuuuuuuuuuuuuuuugagacaugaaauguggggacauagau

SEQ ID NO: 455901 - RNA, 64 nt, Homo Sapiens
cagucucgcucugucaccaauuuguuuguuguuuuuuugagacacugccuggcugguuauuuug

SEQ ID NO: 455902 - RNA, 64 nt, Homo Sapiens
gauucucacuguugccaggcuuuuuuuuuuuuuuuuuugagauguggaaugcuuuuagguuuuu

SEQ ID NO: 455903 - RNA, 64 nt, Homo Sapiens
gaguccuugcccaggcuggauucuuuuuuuuuuuuuuugagacgccaccacacccggcccccag

SEQ ID NO: 455904 - RNA, 64 nt, Homo Sapiens
gagucucacucuuguugcccuuuuuuuuuuuuuuuuuugagacacgagaaaguugguuguuuuu

SEQ ID NO: 455905 - RNA, 64 nt, Homo Sapiens
uagucuugcucugucacccauuauuuuauuuuauuuuugagagguguagguuaaauuuuuguuu

SEQ ID NO: 455906 - RNA, 64 nt, Homo Sapiens
agccugaccaacacugagaaaccugaggucgggauuuugagaccgaggccauggcagguggauc

SEQ ID NO: 455907 - RNA, 64 nt, Homo Sapiens
gggugucacuuugucccccaccaauguauaauuuuuuugagacacuaugaaagaugcuagagca

SEQ ID NO: 455908 - RNA, 64 nt, Homo Sapiens
auguguuucaugcucaauucaucagaaaauucauuuuugagaaauguauaugauguuacagaac

SEQ ID NO: 455909 - RNA, 64 nt, Homo Sapiens
gaguuuuguucuuguugcccugauuuuuuuuuuuuuuugagacgcugacagagaacgcuacuaa

SEQ ID NO: 455910 - RNA, 64 nt, Homo Sapiens
uuguuuacuugauuucuuucuuugaagcaaaucuuuuugagaauaccuaaacaguguucucuua

SEQ ID NO: 455911 - RNA, 64 nt, Homo Sapiens
guacuuuuuaaagagauaguuuucuauuuuucuuuuuugagauagccuguuuuuugauucuuau

SEQ ID NO: 455912 - RNA, 64 nt, Homo Sapiens
acuguucccaaugcagugagaucagaaaauucauuuuugagauagaggucacuccuugcagaac

SEQ ID NO: 455913 - RNA, 64 nt, Homo Sapiens
gaauuuugcucuuguugcccucuuguuuauuuguuuuugagacauaucaauuuuuaaaaccuuu

SEQ ID NO: 455914 - RNA, 64 nt, Homo Sapiens
gggucucacacugucacccauuuucuuuuuucuuuuuugagacacucuuaagagcacaguuuuc

SEQ ID NO: 455915 - RNA, 64 nt, Homo Sapiens
gaguuucacgcuuauugcccacuuuuuuuuuuuuuuuugagacguaaacagacucgcuuuuuaa

SEQ ID NO: 455916 - RNA, 64 nt, Homo Sapiens
gagucucgcucugcugcccauuuuuuuuuuuuuuuuuugagauguggcaagaaugaaauacucu

SEQ ID NO: 455917 - RNA, 64 nt, Homo Sapiens
auacauauuuucacuacgauacuuaguuguggccuuuugagaguugagcuuuaacagccauggc

SEQ ID NO: 455918 - RNA, 64 nt, Homo Sapiens
ugucauguuucccuguauuugauaaaacacauaauuuugagaaaaauaaaguuuuaaauguauc

SEQ ID NO: 455919 - RNA, 64 nt, Homo Sapiens
uuuuuuguuuuguuuuguuuguuuuguuuuguuuuuuugagacggugucucgcugcaucaccca

SEQ ID NO: 455920 - RNA, 64 nt, Homo Sapiens
gcugugacuguggcccugucuggagguuccuagguuuugagauuuagagcaaugcauucuggag

SEQ ID NO: 455921 - RNA, 64 nt, Homo Sapiens
gagagcagagguggucucuggcaauuccaucugguuuugagaaacuuagcagcucacagagcac

SEQ ID NO: 455922 - RNA, 64 nt, Homo Sapiens
uuuuuuuuuuuuucuguuucuguuucuguuuuuuuuuugagauggagucucgcucugucgccca

SEQ ID NO: 455923 - RNA, 64 nt, Homo Sapiens
aucuccccagcauaaccuaauauuuuuuuuuuuuuuuugagacggaauuucgcucugucaccca

SEQ ID NO: 455924 - RNA, 64 nt, Homo Sapiens
aguugaaauggguauguaaguugaaaaccagaaguuuugagaaacauccuuuguuaacuuucau

SEQ ID NO: 455925 - RNA, 64 nt, Homo Sapiens
uaugaaaauauuuaaguaaaaacaaaaugaugcauuuugagaagaacaaagugugcacucagcg

SEQ ID NO: 455926 - RNA, 64 nt, Homo Sapiens
auaucuacuuuauacaaauacuuuauauggcuauuuuugagaaaacccucacauuuuaauguuu

SEQ ID NO: 455927 - RNA, 64 nt, Homo Sapiens
ucuugggcuauuuguuugacaguagcaugauguuuuuugagaccaucaggggugguuacauaga

SEQ ID NO: 455928 - RNA, 64 nt, Homo Sapiens
uuauuuuauuuuacuuuauuauuuauuuguuuauuuuugagauggaguuucgcuguugucaccc

SEQ ID NO: 455929 - RNA, 64 nt, Homo Sapiens
acauugcaaauuuauuuuauuuauuuaauuuucuuuuugagauggagucuugcuugucacccag

SEQ ID NO: 455930 - RNA, 64 nt, Homo Sapiens
aauuuagucugcugaucaaaagcauugucuuaauuuuugagaacugguuuuagcauuuacaaac

SEQ ID NO: 455931 - RNA, 64 nt, Homo Sapiens
gaguuucgcucuguuguccagguuuuuuuuuuuuuuuugagaugucagauagguugaucuuugg

SEQ ID NO: 455932 - RNA, 64 nt, Homo Sapiens
gagucuugcuccuguugugcuuuguuuuuuguuuuuuugagaugguggguuuuuguuuuuguuu

SEQ ID NO: 455933 - RNA, 64 nt, Homo Sapiens
gagucuugcuccuguugugccucgcuuuuuuuuuuuuugagaugacuuaaaaauugggaauaag

SEQ ID NO: 455934 - RNA, 64 nt, Homo Sapiens
ugugcauguuacuuaauguauugcuuaacgauguuuuugagaucuguuuagcaauuuguuuucu

SEQ ID NO: 455935 - RNA, 64 nt, Homo Sapiens
uuagauuguuaaagauagucugaauucauucuccuuuugagaagucuaauuacccaaauaugca

SEQ ID NO: 455936 - RNA, 64 nt, Homo Sapiens
auaaacacaccuguuuuguuaaagauggcaaagcuuuugagaaucauauuaaagucauauuggg

SEQ ID NO: 455937 - RNA, 64 nt, Homo Sapiens
cuuuucugccuucuaucacuuauggcaauucuguuuuugagacaucauuaauguugaguccuaa

SEQ ID NO: 455938 - RNA, 65 nt, Homo Sapiens; identical to SEQ ID NO: 65698

SEQ ID NO: 455939 - RNA, 65 nt, Homo Sapiens; identical to SEQ ID NO: 65699

SEQ ID NO: 455940 - RNA, 65 nt, Homo Sapiens; identical to SEQ ID NO: 65706

SEQ ID NO: 455941 - RNA, 65 nt, Homo Sapiens; identical to SEQ ID NO: 65707

SEQ ID NO: 455942 - RNA, 65 nt, Homo Sapiens; identical to SEQ ID NO: 65720

SEQ ID NO: 455943 - RNA, 65 nt, Homo Sapiens; identical to SEQ ID NO: 65721

SEQ ID NO: 455944 - RNA, 65 nt, Homo Sapiens; identical to SEQ ID NO: 65744

SEQ ID NO: 455945 - RNA, 65 nt, Homo Sapiens; identical to SEQ ID NO: 65745

SEQ ID NO: 455946 - RNA, 65 nt, Homo Sapiens; identical to SEQ ID NO: 65788

SEQ ID NO: 455947 - RNA, 65 nt, Homo Sapiens; identical to SEQ ID NO: 65789

SEQ ID NO: 455948 - RNA, 65 nt, Homo Sapiens; identical to SEQ ID NO: 65808

SEQ ID NO: 455949 - RNA, 65 nt, Homo Sapiens; identical to SEQ ID NO: 65809

SEQ ID NO: 455950 - RNA, 65 nt, Homo Sapiens; identical to SEQ ID NO: 65810

SEQ ID NO: 455951 - RNA, 65 nt, Homo Sapiens; identical to SEQ ID NO: 65811

SEQ ID NO: 455952 - RNA, 65 nt, Homo Sapiens; identical to SEQ ID NO: 65827

SEQ ID NO: 455953 - RNA, 65 nt, Homo Sapiens; identical to SEQ ID NO: 65828

SEQ ID NO: 455954 - RNA, 65 nt, Homo Sapiens; identical to SEQ ID NO: 65831

SEQ ID NO: 455955 - RNA, 56 nt, Homo Sapiens; identical to SEQ ID NO: 61369

SEQ ID NO: 455956 - RNA, 65 nt, Homo Sapiens; identical to SEQ ID NO: 65853

SEQ ID NO: 455957 - RNA, 65 nt, Homo Sapiens; identical to SEQ ID NO: 65854

SEQ ID NO: 455958 - RNA, 65 nt, Homo Sapiens; identical to SEQ ID NO: 65891

SEQ ID NO: 455959 - RNA, 65 nt, Homo Sapiens; identical to SEQ ID NO: 65892

SEQ ID NO: 455960 - RNA, 65 nt, Homo Sapiens; identical to SEQ ID NO: 65896

SEQ ID NO: 455961 - RNA, 65 nt, Homo Sapiens; identical to SEQ ID NO: 65897

SEQ ID NO: 455962 - RNA, 64 nt, Homo Sapiens
auagcugcccaucuccugugauugcacaaccaagcacuuugacauuugcaccuuaggagaggca

SEQ ID NO: 455963 - RNA, 64 nt, Homo Sapiens
uguuuuuugguuuuuuuuaaugacaaugaagugacacuuugacauuuccuaccuuuugaggacu

SEQ ID NO: 455964 - RNA, 64 nt, Homo Sapiens
uguucaauuagcuuuggggaagaaaugccaaauccacuuugaggaugagucuuacgacacagau

SEQ ID NO: 455965 - RNA, 64 nt, Homo Sapiens
uaaguuuauugcuuuaaaauggcaguguuucucccacuuugauaugcuaacauuuaguaagcac

SEQ ID NO: 455966 - RNA, 64 nt, Homo Sapiens
aauugcauccucugggaucuucugagguggacagcacuuugaauguagcauuucacuggaacag

SEQ ID NO: 455967 - RNA, 64 nt, Homo Sapiens
acuguuuugguggcauccaaagacgaucucagagcacuuugaaccucucuguugaguuuucuuu

SEQ ID NO: 455968 - RNA, 64 nt, Homo Sapiens
gauaacacugucuaagcacccccaagccacuauccacuuugaauccugcuccauacauugggug

SEQ ID NO: 455969 - RNA, 64 nt, Homo Sapiens
uguugugaggauuaaaugagauggcaugugaaagcacuuugaaaauuguaaagcgcuauguaaa

SEQ ID NO: 455970 - RNA, 64 nt, Homo Sapiens
uagguuugcugagaaggcuucauuaaauuaaucucacuuugaauaucuccugagagauggacaa

SEQ ID NO: 455971 - RNA, 64 nt, Homo Sapiens
aagcgggauccguuuuuuggaauuugguugaagucacuuugauuucuuuaaaaaacaucuuuuc

SEQ ID NO: 455972 - RNA, 64 nt, Homo Sapiens
agugacuuugcugcuacauauuuacuaaauugaccacuuugauucuugcuuguuugucucaguu

SEQ ID NO: 455973 - RNA, 64 nt, Homo Sapiens
gaaguaauugcggaggcuccuucagcugccucagcacuuugauuuuggacagggacaagguagg

SEQ ID NO: 455974 - RNA, 64 nt, Homo Sapiens
aauuguuuacuuuaugauguuuacauacacguuucacuuugaaaaaaaaugcaaaucgacuuuu

SEQ ID NO: 455975 - RNA, 64 nt, Homo Sapiens
aagucuggccuugugugcauuggagcuuccaaggcacuuugaaaucauuccaguauauuuggga

SEQ ID NO: 455976 - RNA, 64 nt, Homo Sapiens
cuuccuuguacaccuaccuucagauuucugcuuacacuuugauuucagagcuuuauuccccagu

SEQ ID NO: 455977 - RNA, 64 nt, Homo Sapiens
ugacaucuucaguaugagggggacaguuugacuucacuuugagggugugaugucuguagcuaug

SEQ ID NO: 455978 - RNA, 64 nt, Homo Sapiens
cugggccucggaguuugccccguaaagcgaauugcacuuugauguucagaaacccacuuuguuc

SEQ ID NO: 455979 - RNA, 64 nt, Homo Sapiens
ucugauaacauuauuauguugccuucuuguuucucacuuugauauuuaaaagauguucaauaca

SEQ ID NO: 455980 - RNA, 64 nt, Homo Sapiens
ccaggucaugcugcuguugcuggacugaggaccacacuuugagaaccugugcucuaagugaaua

SEQ ID NO: 455981 - RNA, 64 nt, Homo Sapiens
gaauguuuacuuuucuauuuggcauagcuaacuacacuuugauacuaacuccaguuuuacuauu

SEQ ID NO: 455982 - RNA, 64 nt, Homo Sapiens
uaugagugccaaaaaucugucuugaaggcagcuacacuuugaaguggucuuugaauacuuuuaa

SEQ ID NO: 455983 - RNA, 64 nt, Homo Sapiens
guaagucacuuuauaaguuggcagaagugaaugacacuuugagaguagucuuucaaucugaaga

SEQ ID NO: 455984 - RNA, 64 nt, Homo Sapiens
gcucaggucacccgggccucugacccaggccugucacuuugagaggggcaaaacugagaggggc

SEQ ID NO: 455985 - RNA, 64 nt, Homo Sapiens
uccgccaguagugugauuguuuuucaauuuuucccacuuugaaaacuuacaccuaaaggccugu

SEQ ID NO: 455986 - RNA, 64 nt, Homo Sapiens
acaaccuucucaggacaagcccacugucuuaagccacuuugacccugggagacacaggacugug

SEQ ID NO: 455987 - RNA, 64 nt, Homo Sapiens
ggccaaggcaguaggacugaaccuguaaucucagcacuuugagaaaaaaaaaagaguggcugac

SEQ ID NO: 455988 - RNA, 64 nt, Homo Sapiens
uuuauuacuagcuugcuaccaugaaaagagaaagcacuuugaaaaacaguuauuggcaaaaagc

SEQ ID NO: 455989 - RNA, 64 nt, Homo Sapiens
ugcuaaaaguggcauuuuucaaaagaaguuuuuccacuuugaauaguugggauaauuuuuauau

SEQ ID NO: 455990 - RNA, 64 nt, Homo Sapiens
auauaaagaacaaaauaaagguacuauuucuuuucacuuugaaaaacaaaaagaaauugacuca

SEQ ID NO: 455991 - RNA, 64 nt, Homo Sapiens
ccauuaagaggcaagccugguccaaagcaaaacucacuuugaccuacauuccuguuugaauuuu

SEQ ID NO: 455992 - RNA, 64 nt, Homo Sapiens
ccuucuguuggugucauguugcaauuucacgacacacuuugaucagaaaaaggaaugaagacuc

SEQ ID NO: 455993 - RNA, 64 nt, Homo Sapiens
ggccgaggugagacgggaagaccuguaaucccagcacuuugagaggcugggcaugguggcucac

SEQ ID NO: 455994 - RNA, 64 nt, Homo Sapiens
uuauagcucccaaaugaugaaguugcauucuggccacuuugaccuuugcacaguguaacagcgc

SEQ ID NO: 455995 - RNA, 64 nt, Homo Sapiens
cccaggcuggagugcaguaguugaaacagggucucacuuugacauuuuguuuuguuuuuguuuu

SEQ ID NO: 455996 - RNA, 64 nt, Homo Sapiens
agguugguaaauguuuuuagaaaggugguauuuucacuuugaugauguguaccauagagggggg

SEQ ID NO: 455997 - RNA, 64 nt, Homo Sapiens
ucccaaagugcugggauuacucaggugauccacccacuuugacccugaucucaaacuucugacc

SEQ ID NO: 455998 - RNA, 64 nt, Homo Sapiens
uguaacgaaugguacuacaaacaucagcauuagucacuuugaaaccauuagcauucugguuuug

SEQ ID NO: 455999 - RNA, 64 nt, Homo Sapiens
aucaaguacuucaaaacgcauuaugcagcaucuacacuuugaaaugagcuuuguuaauaaacua

SEQ ID NO: 456000 - RNA, 64 nt, Homo Sapiens
aaggcugccuucuuguagauaugcgagugcuaaccacuuugagcacucuuggaaaucuuuacac

SEQ ID NO: 456001 - RNA, 64 nt, Homo Sapiens
cuuugaaauuccuauuucuccaguuuccgucguucacuuugagauuuuucuaauuuguagauuu

SEQ ID NO: 456002 - RNA, 64 nt, Homo Sapiens
uauugaauauuuuaagcugauacacaaaauacagcacuuugacaugacgggguucaggacaccc

SEQ ID NO: 456003 - RNA, 64 nt, Homo Sapiens
auuuucuaagggcacaagugaauacugcuacugucacuuugaaguaaccaagaggcugcaguca

SEQ ID NO: 456004 - RNA, 64 nt, Homo Sapiens
ccaaauucucauuauuuucaucuuucuaggacuucacuuugauacuccaccccacacucccacc

SEQ ID NO: 456005 - RNA, 64 nt, Homo Sapiens
gaguuaauccauaaaauugcuuuuucaugugcuucacuuugauaauauugugacuuuaggccca

SEQ ID NO: 456006 - RNA, 64 nt, Homo Sapiens
auauaaacaguuauguccccuuugguuaugcaaacacuuugauauucaucuuuauuauuguacu

SEQ ID NO: 456007 - RNA, 64 nt, Homo Sapiens
acaaagauauuucagagagccugucaucuuuuuccacuuugacuguuuauuaacuugagcuuca

SEQ ID NO: 456008 - RNA, 64 nt, Homo Sapiens
ucaaaauguauauauuuagugcugcaucuuauagcacuuugaaauaccucauguuuaugaaaau

SEQ ID NO: 456009 - RNA, 64 nt, Homo Sapiens
acuuuuauuuuacacauaagggaaaaaauaagaccacuuugagcaguugccuggaaggcugggc

SEQ ID NO: 456010 - RNA, 64 nt, Homo Sapiens
gugauucacugugcuucgagccaacucuaacaggcacuuugagauguguuccuccugcuguagu

SEQ ID NO: 456011 - RNA, 64 nt, Homo Sapiens
aaaaccuggacucagggagcaaccacaggcucuccacuuugaaacuuuaguuugaauuuuaaaa

SEQ ID NO: 456012 - RNA, 64 nt, Homo Sapiens
cagauucaagggaaauaccagcuuccacuugagucacuuugaaauaguuaauucaacagcacca

SEQ ID NO: 456013 - RNA, 64 nt, Homo Sapiens
ccaaauguuaauacauuuacuuuagcauugaagccacuuugaaaccugagauaaaugaauguga

SEQ ID NO: 456014 - RNA, 64 nt, Homo Sapiens
uggaagaacuuuuaacagaagccucaaugaugaucacuuugaauugcuugugauuucaaaaaua

SEQ ID NO: 456015 - RNA, 64 nt, Homo Sapiens
aauaaaaaucccagaaggacaggaggauucucaacacuuugaauuuuuuuaacuucauuuuucu

SEQ ID NO: 456016 - RNA, 64 nt, Homo Sapiens
gaaaacugaagauuucaucaguuggaaacaguagcacuuugaaaacuuuuuaggccagcuuuaa

SEQ ID NO: 456017 - RNA, 64 nt, Homo Sapiens
cgaagccuggcuuauucacaagacaacgaagcuccacuuugaggcucugaugaacauuccagug

SEQ ID NO: 456018 - RNA, 64 nt, Homo Sapiens
uccuggaguucugucuggucacuaucagaaggaacacuuugagggaaacccuggugcagccagc

SEQ ID NO: 456019 - RNA, 64 nt, Homo Sapiens
aacucacaguccacuagcuucacuccuuuaaauucacuuugaaacaggccucaucccacuucca

SEQ ID NO: 456020 - RNA, 64 nt, Homo Sapiens
caugcuuuccuagaaugucaaguagauauuuuuacacuuugaguuuuaaagcaauuacuaucag

SEQ ID NO: 456021 - RNA, 64 nt, Homo Sapiens
ggcugggcgcgguggcucacgccuguaaucccagcacuuugagagaccgaggcgggcggaucac

SEQ ID NO: 456022 - RNA, 64 nt, Homo Sapiens
uuuaaucaaucagaauuagagcaugggaggucaucacuuugaccuaaauuauuuacugcaaaaa

SEQ ID NO: 456023 - RNA, 64 nt, Homo Sapiens
gcuggaaaugaauuauucuuuaccaguuuugaaacacuuugaaauauccuaagguaacuuggaa

SEQ ID NO: 456024 - RNA, 64 nt, Homo Sapiens
caagugucugguuucacuuucacagugcggcugccacuuugaagagacccuugguaaaccccug

SEQ ID NO: 456025 - RNA, 64 nt, Homo Sapiens
cuauuuuucuguauuccaagguuuugcuaaaauacacuuugaaaugcuaauuucauuauaaauu

SEQ ID NO: 456026 - RNA, 64 nt, Homo Sapiens
ggaaaucuuguuucaauguuuagauguaaguuuacacuuugaaaaugcauuguguguguaguaa

SEQ ID NO: 456027 - RNA, 64 nt, Homo Sapiens
acccucgggugcuauggguggagccagaaugagccacuuugaccguuggauucauuucuuggaa

SEQ ID NO: 456028 - RNA, 64 nt, Homo Sapiens
gccccuaccuguuguaccacacuaucaggugagacacuuugacacauucacccuucaucaguga

SEQ ID NO: 456029 - RNA, 64 nt, Homo Sapiens
ugaaguaucuguccuuuggcgcuuggcugcagugcacuuugaaacugccccaggggcuugccug

SEQ ID NO: 456030 - RNA, 64 nt, Homo Sapiens
gcugaaaguguaaggaagcugauuuuuggaaucccacuuugagugcugcauguuuuguaguuac

SEQ ID NO: 456031 - RNA, 64 nt, Homo Sapiens
uuagaccuuuugaagucuguauuuaaauauauuucacuuugacucauuagauguaacuaaucau

SEQ ID NO: 456032 - RNA, 64 nt, Homo Sapiens
ccagaaguacuuaagaaguucauaagaauuugcucacuuugauguagauauuuuaccauauagu

SEQ ID NO: 456033 - RNA, 64 nt, Homo Sapiens
uaauuuuuaaauguuuuaauuauucauggaucuccacuuugauuuuuuuuuuuuuguuauaauc

SEQ ID NO: 456034 - RNA, 64 nt, Homo Sapiens
uuuuuuuaugucuaaaauuguggaaauaacugagcacuuugaauuuauaauauacauaacuccc

SEQ ID NO: 456035 - RNA, 64 nt, Homo Sapiens
uccucaagggcagagaacugcagggaguaagugacacuuugaacugugggaauuagugagacau

SEQ ID NO: 456036 - RNA, 64 nt, Homo Sapiens
guuauuuucuguuuacuacaaccucaugcaauaucacuuugaaauucacaaaaccuugucaaag

SEQ ID NO: 456037 - RNA, 64 nt, Homo Sapiens
cucacuuaauucaacgauuuauagauugaauuagcacuuugacugauggggaggaaaaaacccc

SEQ ID NO: 456038 - RNA, 64 nt, Homo Sapiens
gauuuuaagaggauggauaaggcuucaugauccucacuuugauuuuaugaagcuuuaucaacuu

SEQ ID NO: 456039 - RNA, 64 nt, Homo Sapiens
uuuugguaguuccacacuaugacaauuucuuaagcacuuugacaucuuuauuuucuucacaugc

SEQ ID NO: 456040 - RNA, 64 nt, Homo Sapiens
guaauuggucaugugaugcaagccagcuuacuagcacuuugagaaugagucuccuguugagcug

SEQ ID NO: 456041 - RNA, 64 nt, Homo Sapiens
aauugcuguaucguucagucucuuguggcaauagcacuuugaagaaaauagagaauuuaauaua

SEQ ID NO: 456042 - RNA, 64 nt, Homo Sapiens
ccauuccacaaaguuggaccaucacuugugcacccacuuugacuaugaguauaccaccacauug

SEQ ID NO: 456043 - RNA, 64 nt, Homo Sapiens
auucacaauuccauuuugauuagcaggacuuuuccacuuugaagauaaauagcaacuuuaucaa

SEQ ID NO: 456044 - RNA, 64 nt, Homo Sapiens
cagcacuuuucccucaugcuguccuauaggacuccacuuugaagguugugccuacguugcaggg

SEQ ID NO: 456045 - RNA, 64 nt, Homo Sapiens
uuuuggaguauuucaucagcugaaaagugauucucacuuugaguuuucuuccuauauuuguaua

SEQ ID NO: 456046 - RNA, 64 nt, Homo Sapiens
uucuuuuggaaacuggacaggccauugccaccugcacuuugaagaagugagcaaagacguggcc

SEQ ID NO: 456047 - RNA, 64 nt, Homo Sapiens
ggccgggcuugguggcucaugccuguaaucccagcacuuugagaggccgaagcgaguggaucac

SEQ ID NO: 456048 - RNA, 64 nt, Homo Sapiens
ccaccccacucuaccuccuuagcuuucccugugccacuuugacucagaggcugggagcauagca

SEQ ID NO: 456049 - RNA, 64 nt, Homo Sapiens
cacauauauacaagccaaauggauuucuuacuugcacuuugacuggcuaccagauaaucacagu

SEQ ID NO: 456050 - RNA, 64 nt, Homo Sapiens
ccauuguuccuuauaucguuaaaucuuugugacacacuuugacaaaaauguagaaccuauaaca

SEQ ID NO: 456051 - RNA, 64 nt, Homo Sapiens
uucacauuuucaguguuuguaauauuuaucuuuucacuuugauaaaccagaaauguuucuaaau

SEQ ID NO: 456052 - RNA, 64 nt, Homo Sapiens
accuugguucuccuuacugaaguccucuugcuuucacuuugaucugguuuuugaagucucuuaa

SEQ ID NO: 456053 - RNA, 64 nt, Homo Sapiens
ggcaggauugucacaccguuuuaggacucugugccacuuugagagacuguucccaggaggccca

SEQ ID NO: 456054 - RNA, 64 nt, Homo Sapiens
uaaaaaauaggcuauacuacaauugcacuuccagcacuuugagaacgaguugaauaccaagaau

SEQ ID NO: 456055 - RNA, 64 nt, Homo Sapiens
gcccaccuuagacuucuuuuggggccuucgaccucacuuugagaaauaccuucuucagguuauu

SEQ ID NO: 456056 - RNA, 64 nt, Homo Sapiens
aaguauucugacugagugauugguugaccuaaaccacuuugaauguuucuauuuuaugaaauga

SEQ ID NO: 456057 - RNA, 64 nt, Homo Sapiens
ggccaaggcagguggaucacgccuguaaucccagcacuuugagaggccgggcgcaguggcucau

SEQ ID NO: 456058 - RNA, 64 nt, Homo Sapiens
uauuuuaacuaaagccuuuaauaaauguguacuacacuuugaaaaaagaaaauaacaaaugaaa

SEQ ID NO: 456059 - RNA, 64 nt, Homo Sapiens
ccuaaaugugauacugguuuugcugaagaauuaacacuuugacuugcuuucuaguugucaggaa

SEQ ID NO: 456060 - RNA, 64 nt, Homo Sapiens
gauggauugaaacuguuccuugggcacuggaagucacuuugauagccugaagacuuaaguuuug

SEQ ID NO: 456061 - RNA, 64 nt, Homo Sapiens
uauuuucucuaauaguuuauuugccacuggccgccacuuugacuagauuuguguauuguacuua

SEQ ID NO: 456062 - RNA, 64 nt, Homo Sapiens
aguguucuaauuggauaaaucuaaaucccuccuucacuuugagcucauuucuagggaagaaauu

SEQ ID NO: 456063 - RNA, 64 nt, Homo Sapiens
auuuacuuggcucauuuagucagugucuuuucagcacuuugagcccgguuguacaaucucugau

SEQ ID NO: 456064 - RNA, 64 nt, Homo Sapiens
auauuagauacaugcuaaauuuuuuuucugauagcacuuugagguauacuuagcaagaaaauuu

SEQ ID NO: 456065 - RNA, 64 nt, Homo Sapiens
accccccuaaauagcuggacuuaugaucaguugacacuuugaguuugacauuuuaaaagccugg

SEQ ID NO: 456066 - RNA, 64 nt, Homo Sapiens
uggggggauauggggauucaggcaauuguuuacacacuuugaauaacugcaaaggauuuacggu

SEQ ID NO: 456067 - RNA, 64 nt, Homo Sapiens
auucaucucccccucaaaucauagccuaacagaacacuuugaaagcucuuuuauuuaauauuuu

SEQ ID NO: 456068 - RNA, 64 nt, Homo Sapiens
ccauggugaaggcuucuuuccccacugcaggacccacuuugagaaggaccgaggaggaggauuu

SEQ ID NO: 456069 - RNA, 64 nt, Homo Sapiens
uucaguacaguacaucauuccuccucacuaggagcacuuugauguaaaccagaauagcuuuaaa

SEQ ID NO: 456070 - RNA, 64 nt, Homo Sapiens
ggccaggugugguggcucaugccuguaaucccagcacuuugagaggccgaggugggcagaucac

SEQ ID NO: 456071 - RNA, 64 nt, Homo Sapiens
aauucuauaggauucaauacuuaguuugcaaaagcacuuugaaauuauggcacagugaguuguu

SEQ ID NO: 456072 - RNA, 64 nt, Homo Sapiens
cauauuguuuccugugcuggagcaaaagucauuacacuuugaaguauuauauuguucuuauccu

SEQ ID NO: 456073 - RNA, 64 nt, Homo Sapiens
gaaugugcacuagcucuuuuuaaauuccaugcuacacuuugaggacugucaucauguucucguu

SEQ ID NO: 456074 - RNA, 64 nt, Homo Sapiens
gcuuuaagagauuagccugaugcacuugugaaaacacuuugagccugagaacaaucccuccccu

SEQ ID NO: 456075 - RNA, 64 nt, Homo Sapiens
aaccuuguauauuaaauuacuguaacauauuuugcacuuugagaaugaagccuaagaaacuauc

SEQ ID NO: 456076 - RNA, 64 nt, Homo Sapiens
uuacaagagaggagcuuuaaaaaaauacacaaaacacuuugauuauuccaggucaaaauuugug

SEQ ID NO: 456077 - RNA, 64 nt, Homo Sapiens
ucaguacaacuucagcaauuuuuguucacauaaccacuuugauggauaguggauaacaaauaua

SEQ ID NO: 456078 - RNA, 64 nt, Homo Sapiens
ugugcacauaagaaaaccaacauucugucagggucacuuugaauccugcauucaaguguaacag

SEQ ID NO: 456079 - RNA, 64 nt, Homo Sapiens
ggccaaggcaggggaauugcaucuguaauccuaacacuuugacaugacagccguggugguucau

SEQ ID NO: 456080 - RNA, 64 nt, Homo Sapiens
ggccgagauaggcggauugcgccuguaauccuagcacuuugagaggccagguguaguggcucau

SEQ ID NO: 456081 - RNA, 64 nt, Homo Sapiens
agugugaggaaaaccuaugucuuccuggauuccucacuuugaaguuuuuccaguaguuagcuuu

SEQ ID NO: 456082 - RNA, 64 nt, Homo Sapiens
gaaguauucaaucaaguuuuacauaaaaaagaagcacuuugauuauucaguaugauuuauccuc

SEQ ID NO: 456083 - RNA, 64 nt, Homo Sapiens
ggccaagguggguagaucaugccuguaaucccagcacuuugagaggccaggcacaguggcucau

SEQ ID NO: 456084 - RNA, 64 nt, Homo Sapiens
cccauucaucacacagcauagaaguaaagaacgucacuuugaaacaaaggguguuagcagaugc

SEQ ID NO: 456085 - RNA, 64 nt, Homo Sapiens
uauugaaacgggucaauuuauagcuguauacuaccacuuugaauaccccaauugucaaggguag

SEQ ID NO: 456086 - RNA, 64 nt, Homo Sapiens
aggaugauaggaaauaaauguucccaauacauaccacuuugaauucuucccugggggcagauau

SEQ ID NO: 456087 - RNA, 64 nt, Homo Sapiens
aaaggucaguggggauuguugauuauacccagagcacuuugaaccaaacacucaugcuuuaaug

SEQ ID NO: 456088 - RNA, 64 nt, Homo Sapiens
ucuugcuucuuuuuuauuacagcuagcgcaccugcacuuugaauugaauggauguggaaaugaa

SEQ ID NO: 456089 - RNA, 64 nt, Homo Sapiens
gauaacauuuuauuaugaugaggauuuuagagagcacuuugaaauagcauuuagauaauguaac

SEQ ID NO: 456090 - RNA, 64 nt, Homo Sapiens
guaauaaauacacagcaugcuaauaugaaagccacacuuugaagagucaacuuacggugcacag

SEQ ID NO: 456091 - RNA, 64 nt, Homo Sapiens
uuuauuacauuccagcagcuuacucccguggccgcacuuugaaugucaccaccuugaguuucuc

SEQ ID NO: 456092 - RNA, 64 nt, Homo Sapiens
caagcaccccagucacuaggaugcagauggaccacacuuugagaaacaccacccauuucuacuu

SEQ ID NO: 456093 - RNA, 64 nt, Homo Sapiens
aagugaaguugcuucuucuacuucagucuucucucacuuugauuugcuaguuguuaucaauuaa

SEQ ID NO: 456094 - RNA, 64 nt, Homo Sapiens
aaguuaucaacuuuagcuaguaucuucaaacuuucacuuugaaaaaugagaauuuuauauucua

SEQ ID NO: 456095 - RNA, 64 nt, Homo Sapiens
uuggacaaauaguuguuaccaaaauauucaaaaccacuuugaguuuacauacuaguuaccuuaa

SEQ ID NO: 456096 - RNA, 64 nt, Homo Sapiens
gaugauaauuggugcucccuucauccaacuggaucacuuugagauucaguuuuacaucauuuua

SEQ ID NO: 456097 - RNA, 64 nt, Homo Sapiens
uaggaaaaacuaaguugucacccaauaucuuagacacuuugagagcaaagggggugcuguaaau

SEQ ID NO: 456098 - RNA, 64 nt, Homo Sapiens
ucucucucucucuuuucuaagaaacaauuaugugcacuuugauacacaaccuucucuaaccaac

SEQ ID NO: 456099 - RNA, 64 nt, Homo Sapiens
accucuuugaaugcugaaaggucuucccucagcucacuuugaguuuuuaaaugacauuguuuuu

SEQ ID NO: 456100 - RNA, 64 nt, Homo Sapiens
cguccccagaggaggacuugaaugaggaaaccaacacuuugagaaaccaaaguccuuuuuccca

SEQ ID NO: 456101 - RNA, 64 nt, Homo Sapiens
ggaugaaacaggcccuugaguugggagccugcuucacuuugacuuucccacuguugcuggagac

SEQ ID NO: 456102 - RNA, 64 nt, Homo Sapiens
ugcuaauagaaaauaaugcaguaggcagagugcucacuuugaaucucaaccaaacaggaguucc

SEQ ID NO: 456103 - RNA, 64 nt, Homo Sapiens
aaucuauuuuacgauuguaguucguaucuguuuucacuuugagauuauuucauuaaauauuuca

SEQ ID NO: 456104 - RNA, 64 nt, Homo Sapiens
caaauacaauucacagcacaugugaaacgucccacacuuugaagcuacuugaccauucucaccc

SEQ ID NO: 456105 - RNA, 64 nt, Homo Sapiens
auguauagauuacauaggaacaugagaaaucacucacuuugauucuaaagaacaauuugcuaaa

SEQ ID NO: 456106 - RNA, 64 nt, Homo Sapiens
acuuaagaaucccuuaucauugaaagagcuccuacacuuugaaacuacaccaagaguguaucug

SEQ ID NO: 456107 - RNA, 64 nt, Homo Sapiens
ugacagcauucgauuuuuuuuacuuuucaugccucacuuugacacgauggagccacauuaauaa

SEQ ID NO: 456108 - RNA, 64 nt, Homo Sapiens
auacccauguuuugcaugcaauugaugacugucucacuuugacuuuuuucuggugcuuuuuugg

SEQ ID NO: 456109 - RNA, 64 nt, Homo Sapiens
auaaacuuuuuucuucagaaacagaaacacaaaacacuuugaucgggucucaucauucccauac

SEQ ID NO: 456110 - RNA, 64 nt, Homo Sapiens
acuuucaggccagcuuuaauguuggaaacaguagcacuuugaaagaaaacugaagaucucauca

SEQ ID NO: 456111 - RNA, 64 nt, Homo Sapiens
ggaggcgggaacgcgggcccgcgcgcggacuuugcacuuugaauccagaggaagaugaauuuuu

SEQ ID NO: 456112 - RNA, 64 nt, Homo Sapiens
aaaaacaaaagccgcuaugaccggcguugccucucacuuugaaagaaagacuccguaaucuuaa

SEQ ID NO: 456113 - RNA, 64 nt, Homo Sapiens
cccuauaacauuccuucucugccucucuauggcccacuuugaccacuaacaacaucagaauuau

SEQ ID NO: 456114 - RNA, 64 nt, Homo Sapiens
uuguuaaucugucugauuuugucugaauuauaaacacuuugagguaccaaacauaaccaaucug

SEQ ID NO: 456115 - RNA, 64 nt, Homo Sapiens
ugaauucuuuuucauuugagaaguaaacagauggcacuuugaaggggccucaccgagugggggc

SEQ ID NO: 456116 - RNA, 64 nt, Homo Sapiens
uuccucauccaccccaucccuccccaguucauugcacuuugauuagcagcggaacaaggaguca

SEQ ID NO: 456117 - RNA, 64 nt, Homo Sapiens
aaaacucaucacacaagaagagaaacaguaaccucacuuugaaaauuagcuccacucaagacua

SEQ ID NO: 456118 - RNA, 64 nt, Homo Sapiens
uacccccaacaaaucuucuaagugcauuuuugaucacuuugauaacuucuuaggugauuugccu

SEQ ID NO: 456119 - RNA, 64 nt, Homo Sapiens
auauuuccagaguuguccagcagaaagaaaguggcacuuugaagagaacuagggaaguacauau

SEQ ID NO: 456120 - RNA, 64 nt, Homo Sapiens
acccucuuuuccuguaauuuauugcagaauacaccacuuugacuuggacagcuuucugcccccu

SEQ ID NO: 456121 - RNA, 64 nt, Homo Sapiens
agucccugcuaaaacauuccauuguuaaaauuugcacuuugaagguaagcuuucuaggccugac

SEQ ID NO: 456122 - RNA, 64 nt, Homo Sapiens
uguguauauuagauaauuguguugugaugcuacucacuuugauugcaaugaugauguccaaggu

SEQ ID NO: 456123 - RNA, 64 nt, Homo Sapiens
gcgaaaaacauggacaauuccuauucauucuuagcacuuugacaugucuuggggaaaagcuuac

SEQ ID NO: 456124 - RNA, 64 nt, Homo Sapiens
ucugagaaucaguucaaggccgggaggcacuuuucacuuugauggaccaccaaguacuaccuga

SEQ ID NO: 456125 - RNA, 64 nt, Homo Sapiens
ggcugaggcgggcggaucaccgccuguaauccaacacuuugagaaggccaggcgccguggcuca

SEQ ID NO: 456126 - RNA, 64 nt, Homo Sapiens
agagcaaagcacaagcuugcuaagcagaggagcccacuuugagggggagagauuaagcgcucau

SEQ ID NO: 456127 - RNA, 64 nt, Homo Sapiens
gaaagcagaaagagugaaaaaaacaugagcaaaccacuuugacuguuucaguucugauuucagc

SEQ ID NO: 456128 - RNA, 64 nt, Homo Sapiens
aauuacagauauauuugauaaacauacacuauagcacuuugacuaguauagaacuguugauuuc

SEQ ID NO: 456129 - RNA, 64 nt, Homo Sapiens
cgcuucaaggauauacugcauuuccuuaccauaccacuuugacauugugagauaaaacucuccu

SEQ ID NO: 456130 - RNA, 64 nt, Homo Sapiens
uaagucuaucugguauuaaaccaagccucucuggcacuuugaguuccuacacuugagaugauuu

SEQ ID NO: 456131 - RNA, 64 nt, Homo Sapiens
cuuuucauaucauuucuuaaaaacuaguuagauucacuuugacaccuucauuuaaaaagguuua

SEQ ID NO: 456132 - RNA, 64 nt, Homo Sapiens
gaaacucaugcuucaguuuaugcaccuaaauccucacuuugacaccauuugcaugaaauucaca

SEQ ID NO: 456133 - RNA, 64 nt, Homo Sapiens
ugcuguuaucaccacccccugaguacuuuguaaccacuuugauacuggaugcuacuugaagagg

SEQ ID NO: 456134 - RNA, 64 nt, Homo Sapiens
caaaaacuuguauauuaacaauaaauaaaguaagcacuuugaagcccucuugaucuucucuuuu

SEQ ID NO: 456135 - RNA, 64 nt, Homo Sapiens
guuaguuuugggccagcacgaaguguuugaaagucacuuugaaagauaaucauggguuagaagg

SEQ ID NO: 456136 - RNA, 64 nt, Homo Sapiens
auugcuuauuugaaaacaguuagcaugaaagucccacuuugauuuuuugacugagugagacuuc

SEQ ID NO: 456137 - RNA, 64 nt, Homo Sapiens
aaaugacagugaacaaagccugcuuuuaaugacucacuuugaucuuacuuugugugcaacuacc

SEQ ID NO: 456138 - RNA, 64 nt, Homo Sapiens
aucuuuguaguucaugauauuaacucaucuauagcacuuugaguaaaauguauuacaucaauau

SEQ ID NO: 456139 - RNA, 64 nt, Homo Sapiens
ggcugggcgcgguggcucacaccuguaaucccagcacuuugagaggaugagguaggcggaucac

SEQ ID NO: 456140 - RNA, 64 nt, Homo Sapiens
aaauauuguaaagcagggucucaacuuuuaaauacacuuugaacuucuucucugaauuauuaaa

SEQ ID NO: 456141 - RNA, 64 nt, Homo Sapiens
uaggaaguauuaaaacugugaagcuuucucagugcacuuugaaccuggaaaacaaucccaacag

SEQ ID NO: 456142 - RNA, 64 nt, Homo Sapiens
uucuuaaacuuuuuuuuuuuuucaguuuuuuuuccacuuugaaucagaaauauaaucugcagua

SEQ ID NO: 456143 - RNA, 64 nt, Homo Sapiens
cucagaaaccacugucauuaguuuacaaaguuagcacuuugaaguaaaacuaaaugaggaagga

SEQ ID NO: 456144 - RNA, 64 nt, Homo Sapiens
uuuaaaucauuccauuagccauauauagcaaacucacuuugacauuuuggaaauaacauugugc

SEQ ID NO: 456145 - RNA, 64 nt, Homo Sapiens
auuccaaccacuagaauacccuagucacuauucccacuuugagcauuaaccccuuugaaaagaa

SEQ ID NO: 456146 - RNA, 64 nt, Homo Sapiens
aggaacaacauaguuaauuuuuuucuaaccuugccacuuugagggaaggaaggguugggggaag

SEQ ID NO: 456147 - RNA, 64 nt, Homo Sapiens
guucagacuguauaguaaggagaaagucugguugcacuuugaagagcuugaagauuugaaagau

SEQ ID NO: 456148 - RNA, 64 nt, Homo Sapiens
gcugucgucuuggcagcacuugucacguuggcagcacuuugagagcaagucugaguggacccac

SEQ ID NO: 456149 - RNA, 64 nt, Homo Sapiens
gaaagauaguugcaaccucaccucccucacucaacacuuugaauacuuauuguuuggcagguca

SEQ ID NO: 456150 - RNA, 64 nt, Homo Sapiens
ggccgaggagggaggacugcugaguggcucccagcacuuugagaggcgugguggcucacaccug

SEQ ID NO: 456151 - RNA, 64 nt, Homo Sapiens
uacuuaaagaaauucagagcauuucuccagaaaacacuuugagauauaaugauguaguaaaaag

SEQ ID NO: 456152 - RNA, 64 nt, Homo Sapiens
cagaaauauaaucugcaguauucaguuuuuuuuccacuuugaauguucuuaaacuuuuuuuuuu

SEQ ID NO: 456153 - RNA, 64 nt, Homo Sapiens
ggcugaggugguaggaucacgccuguaaucccagcacuuugagaggccgggcacaguggcucac

SEQ ID NO: 456154 - RNA, 64 nt, Homo Sapiens
gagcagaggcagaguauuugcaugacuucauuugcacuuugacacuuauuuuaaacccugucuc

SEQ ID NO: 456155 - RNA, 64 nt, Homo Sapiens
aaaaucagcaucaaaacauuauggcuugcaguaccacuuugauauuggaauuuguuccaacuua

SEQ ID NO: 456156 - RNA, 64 nt, Homo Sapiens
ccguggggugaggaguuggcgccccgcuggauugcacuuugagcacagaggcccccagcccugu

SEQ ID NO: 456157 - RNA, 64 nt, Homo Sapiens
cauggguuuacuuauaauggcaauuuauaacuuacacuuugaacagcagauuuugauuuuguuu

SEQ ID NO: 456158 - RNA, 64 nt, Homo Sapiens
uccucaagugaaaaacaggaguaauguuucguugcacuuugaaagaucugcuucaaggcauaac

SEQ ID NO: 456159 - RNA, 64 nt, Homo Sapiens
uuucaaugccgucauuuucaguuagaugauuuugcacuuugagauuaaaaugccaugucuauuu

SEQ ID NO: 456160 - RNA, 64 nt, Homo Sapiens
uaugguaaaaacauauaaaauuuaccaucuuaaucacuuugaguguacaguucaucaguguuaa

SEQ ID NO: 456161 - RNA, 55 nt, Homo Sapiens
cagcaaaaucugaaagcuaacaccccacuuugacccucgaccacaccugaaaaug

SEQ ID NO: 456162 - RNA, 64 nt, Homo Sapiens
ucuucagcagaaaaucuuuguggaacacauuccacacuuugaaaucuucguggaacaaaagaua

SEQ ID NO: 456163 - RNA, 64 nt, Homo Sapiens
gcucacaccuuaaucucaggccccuauauagucacacuuugauuuaagaaaaauggagcucuug

SEQ ID NO: 456164 - RNA, 64 nt, Homo Sapiens
ggcugaggcgggaagaucacaccgguaaucccagcacuuugagaggucggaugcaggggcucac

SEQ ID NO: 456165 - RNA, 64 nt, Homo Sapiens
uuuggggaucuggugggcagacugaguuuuguuucacuuugacaaaaacagucaucuagaauuc

SEQ ID NO: 456166 - RNA, 64 nt, Homo Sapiens
uuucuuuuuccucccuuagaagaacuaauaguaucacuuugauuuccgcaaguggcacaacuuc

SEQ ID NO: 456167 - RNA, 64 nt, Homo Sapiens
ggcugaggcagguggauugcgccuguaaucccagcacuuugauaggccacaugcgguggcucau

SEQ ID NO: 456168 - RNA, 64 nt, Homo Sapiens
guuacaaaaucuguagaccuuuuuuaaugcaggacacuuugagucguaggaaauagacacgugc

SEQ ID NO: 456169 - RNA, 64 nt, Homo Sapiens
acauuuaugauugucccucuuuaauucucugcaacacuuugaggcuucccccaaagccggauuc

SEQ ID NO: 456170 - RNA, 64 nt, Homo Sapiens
uacuagaaaauugugcuggaaauauguaaaauuacacuuugaacaaucacucaaauuguucucu

SEQ ID NO: 456171 - RNA, 60 nt, Homo Sapiens
gcgcacagcugcucugugaccagcgcucggcacuuugacauggaacuggaguaccuguaa

SEQ ID NO: 456172 - RNA, 64 nt, Homo Sapiens
cauauaguugaaguacaaauaacacaccugaugucacuuugagcccacccuucuugcugucccc

SEQ ID NO: 456173 - RNA, 64 nt, Homo Sapiens
auucagucuuugaacuuuaaacugagaaaaugagcacuuugaucuccuagcagaagauaguccu

SEQ ID NO: 456174 - RNA, 64 nt, Homo Sapiens
ccauggaggauugccugugagaaauaaguccuuccacuuugaccguggacuacugagcccugaa

SEQ ID NO: 456175 - RNA, 64 nt, Homo Sapiens
aagauuguggcaguuuuugcuuuggauacuuagacacuuugagcaugcagcucauuugcuacca

SEQ ID NO: 456176 - RNA, 64 nt, Homo Sapiens
ucuauaaaaaauaaaauaaugucuauaaaagaaacacuuugaagcagauucacacuguuccagu

SEQ ID NO: 456177 - RNA, 64 nt, Homo Sapiens
uacauuguuuuggaaauucaaauuucuuguaaaccacuuugagauaucucuacaacauuuaaug

SEQ ID NO: 456178 - RNA, 64 nt, Homo Sapiens
caacuaaaaaggcuucaaacuugaguggcugucacacuuugagggcagacuguuaggagcagua

SEQ ID NO: 456179 - RNA, 64 nt, Homo Sapiens
guuaaaaaugaaccacauuccaaacagaucuugccacuuugauuccuguuuuuacagugaucac

SEQ ID NO: 456180 - RNA, 64 nt, Homo Sapiens
uggguucauuuuuuguuuuguauaaguuuaaccacacuuugauuugguugaaaaaucuuucuca

SEQ ID NO: 456181 - RNA, 64 nt, Homo Sapiens
guaaauaucccagagaacaaucacuauucuuaagcacuuugaaaauauuucuauguaaauuauu

SEQ ID NO: 456182 - RNA, 64 nt, Homo Sapiens
uuauuucuaagaaacgccacugaggaacaggauccacuuugaacaguccgcuaaagcuaucaaa

SEQ ID NO: 456183 - RNA, 64 nt, Homo Sapiens
agccagauccugggguggggucuuuagguuuucucacuuugacaacccccgaauguuuuuauag

SEQ ID NO: 456184 - RNA, 64 nt, Homo Sapiens
caggcauuaucuauaccuggggccagauuuucugcacuuugaaauguugccuuugccuaaugua

SEQ ID NO: 456185 - RNA, 64 nt, Homo Sapiens
uuccuuaauguuccaugguauuuucaacggaauacacuuugaaagguaaaaacaauucaaaagu

SEQ ID NO: 456186 - RNA, 64 nt, Homo Sapiens
cuguccaggaaaugagcagagauucacaagacagcacuuugauucuauguugaguuuguuucua

SEQ ID NO: 456187 - RNA, 64 nt, Homo Sapiens
cauuugcagugacuuuuaaggcaguacuguuuagcacuuugauauuaaaauuuugcuuauguuu

SEQ ID NO: 456188 - RNA, 64 nt, Homo Sapiens
gauggcugaugcaucgacuugcauucccacuuaacacuuugauuagcaugaacuugccaaucaa

SEQ ID NO: 456189 - RNA, 64 nt, Homo Sapiens
cuagagggccauuggagcuugcagcucagacccccacuuugaguuuuauuuauuuaaauaguag

SEQ ID NO: 456190 - RNA, 64 nt, Homo Sapiens
cagggauggggucagugguuccaccuucacaggccacuuugaaggguggauucuuugaggcccc

SEQ ID NO: 456191 - RNA, 64 nt, Homo Sapiens
gauacaugcaaaacauauaguuuguuaaggauuucacuuugaaggccuaauauauacuguuaaa

SEQ ID NO: 456192 - RNA, 64 nt, Homo Sapiens
uaguuuuaaauauguuuaaagaauuuuuaaaagccacuuugauuuuugaauuugguguuuucua

SEQ ID NO: 456193 - RNA, 64 nt, Homo Sapiens
ccuccuugggguugauaggauccucuuccagccucacuuugaguuacuuucauacucuucuaag

SEQ ID NO: 456194 - RNA, 64 nt, Homo Sapiens
uugagacauuaauuuguaccauguaauacugaaccacuuugauauuuccaaagagccauguguc

SEQ ID NO: 456195 - RNA, 64 nt, Homo Sapiens
uuuuugcugggggaggggugaaauuuuuugugagcacuuugagaugccuuguaagauuguugua

SEQ ID NO: 456196 - RNA, 64 nt, Homo Sapiens
uguauaaaacuuucuguguuuaagugauuuaaugcacuuugacugaagaguggaauaaauauuc

SEQ ID NO: 456197 - RNA, 64 nt, Homo Sapiens
acuauauccgcuucuguuuuugccacaucagaagcacuuugaccugucuccaucuucuauagug

SEQ ID NO: 456198 - RNA, 64 nt, Homo Sapiens
ccuucauggguuuuugaacauuaaaccaccaugucacuuugaguuugaucauuuagguuuuuuu

SEQ ID NO: 456199 - RNA, 64 nt, Homo Sapiens
caaauauuucauuuugugcgugugaaagggaaaacacuuugacggaucguuuuugucagaugac

SEQ ID NO: 456200 - RNA, 64 nt, Homo Sapiens
cuuuucugcagcuucgcuuuuuugcaaaugcauucacuuugacaccauauaauggaacagaagc

SEQ ID NO: 456201 - RNA, 64 nt, Homo Sapiens
aauaccuaagggaguguaacagucucuggaggaccacuuugagccuuuggaaguuaagguuucc

SEQ ID NO: 456202 - RNA, 64 nt, Homo Sapiens
auuacauuucuuuaaaccuguuuuacuacuauggcacuuugauaaaauggucaggaaccaacuu

SEQ ID NO: 456203 - RNA, 64 nt, Homo Sapiens
aaauuagaagacauuuauacucuuuuuucauggacacuuugaaauguguuucuguauaaagccu

SEQ ID NO: 456204 - RNA, 64 nt, Homo Sapiens
gugccuuuagccuuuucauguuucugucucaaaacacuuugacaaagcucaccaacuuuaaaau

SEQ ID NO: 456205 - RNA, 64 nt, Homo Sapiens
ucuugguuuuauuuuguuccauguuuaaaucauucacuuugauuugagugggaaaagccugaag

SEQ ID NO: 456206 - RNA, 64 nt, Homo Sapiens
auguuauuuucuucuaagugaaauuucuagccugcacuuugaugucauguguucccuuugucuu

SEQ ID NO: 456207 - RNA, 64 nt, Homo Sapiens
gauccucaccagggugaaugacagaguugccaggcacuuugagucucagucugaugacccacac

SEQ ID NO: 456208 - RNA, 64 nt, Homo Sapiens
acauuuauuuauuuaguugaagauucacugaucccacuuugaaauacaucuuuuuaccuaagca

SEQ ID NO: 456209 - RNA, 64 nt, Homo Sapiens
acaaaaaagaaaucuuauuucauugcauggaaaacacuuugaagguucaacacagcaagugcuu

SEQ ID NO: 456210 - RNA, 64 nt, Homo Sapiens
ugggcaauggcuugagcccaacuuguaaucccagcacuuugagggguugggugugguggcucac

SEQ ID NO: 456211 - RNA, 64 nt, Homo Sapiens
cacaccuuugucugcuugguaugguacugauuugcacuuugauugcagaauugcagaguguaga

SEQ ID NO: 456212 - RNA, 64 nt, Homo Sapiens
uuugggaaaacucuuuaucucuuucccucuuuuucacuuugagcuugggcucuaagcuagauau

SEQ ID NO: 456213 - RNA, 64 nt, Homo Sapiens
aauguaaaccagugaaaaguuugguucagaauggcacuuugaauccucuauaaaugaaagggug

SEQ ID NO: 456214 - RNA, 64 nt, Homo Sapiens
cuacucacugguuggaagaaaaacucacccaucacacuuugagagaaacaaagaagacuaugua

SEQ ID NO: 456215 - RNA, 64 nt, Homo Sapiens
auugguguucaagacuauaucuaauuccucugaucacuuugagaaacaaacuuuuauuaaaugu

SEQ ID NO: 456216 - RNA, 64 nt, Homo Sapiens
ccccauaccuacuauuuuuuuauaucccgauuugcacuuugagaauacaucuaaggucaucuuu

SEQ ID NO: 456217 - RNA, 64 nt, Homo Sapiens
gccaugcaaucugggaagcacaggaauaaguagacacuuugaaaauggauuugaauguucucau

SEQ ID NO: 456218 - RNA, 64 nt, Homo Sapiens
gacuguaauugguuucuuagaccaccuaagaugccacuuugaauucucuaagacccuggagaau

SEQ ID NO: 456219 - RNA, 64 nt, Homo Sapiens
augagaaaagucccaggcuaauggcagaaauuugcacuuugaacauguguguuuuuguguugug

SEQ ID NO: 456220 - RNA, 64 nt, Homo Sapiens
uugguuccugcuccauggucgggccucugacagccacuuugaauaaaccagacaccgcacaugu

SEQ ID NO: 456221 - RNA, 64 nt, Homo Sapiens
aaggaaacgcagggagacugugugccuggguguccacuuugaucacaugugaguguccacuuuu

SEQ ID NO: 456222 - RNA, 64 nt, Homo Sapiens
gauaaagauaguugaugguuuauuuuaaaagaugcacuuugaguugcaauauguuauuuuuaua

SEQ ID NO: 456223 - RNA, 64 nt, Homo Sapiens
aggagugcuauucaguguuucuuuuccugauaaacacuuugaauauuuuuuuuguguuuuuguu

SEQ ID NO: 456224 - RNA, 64 nt, Homo Sapiens
aggggguaggaggggaagaagcugcucuuguuagcacuuugauguuggacaguacaaaaacaaa

SEQ ID NO: 456225 - RNA, 64 nt, Homo Sapiens
ucaaacuaugcacugugaaguuuugcccauauugcacuuugauuucgagagcaccaccuucucu

SEQ ID NO: 456226 - RNA, 64 nt, Homo Sapiens
aagaaaagccaaauucuuuuuuacuauggccagucacuuugacauacaugggaagauguugugc

SEQ ID NO: 456227 - RNA, 64 nt, Homo Sapiens
caccaaucuggauugagcggcagacccugaaggacacuuugagauuuuaccaucuccagcucag

SEQ ID NO: 456228 - RNA, 64 nt, Homo Sapiens
ggcugcggcggguggaucacgccuguaaucccagcacuuugagaggcugggugcgguggcucau

SEQ ID NO: 456229 - RNA, 64 nt, Homo Sapiens
aauuaauuuuaauuaacuuauuuguuuuuugaagcacuuugagacaaaaaggagucagauuuaa

SEQ ID NO: 456230 - RNA, 64 nt, Homo Sapiens
ugaaggacaagaagacgcauagcaggugagcauccacuuugacauugagcucugcaaagaucag

SEQ ID NO: 456231 - RNA, 64 nt, Homo Sapiens
cuugaccacagggaccaagaagugggucuuuuggcacuuugaaccaacagucucagguucgauc

SEQ ID NO: 456232 - RNA, 64 nt, Homo Sapiens
cuugaaugugucacuuuacucccuguuuguaguucacuuugacuuaacacacccacugagaaaa

SEQ ID NO: 456233 - RNA, 64 nt, Homo Sapiens
ggcugaggcagggcagauuggccuguaaucccagcacuuugagaggcccgaugcaguggcucau

SEQ ID NO: 456234 - RNA, 64 nt, Homo Sapiens
cugaggccauggcaggacagaucugcagggaacccacuuugagggaugaagagggaaagcugac

SEQ ID NO: 456235 - RNA, 64 nt, Homo Sapiens
uucuacauguaauuaccuucaccacauucccauucacuuugauuucuucuuuuauguucacacc

SEQ ID NO: 456236 - RNA, 64 nt, Homo Sapiens
auagaaaaaccacuuuuuaaacuuguuucuuuagcacuuugaagccugaaguuucuuuuugaau

SEQ ID NO: 456237 - RNA, 64 nt, Homo Sapiens
agaauucuuuuucucacuauuuucuaaaaugggucacuuugaaaauacagagaacaucagaaau

SEQ ID NO: 456238 - RNA, 64 nt, Homo Sapiens
uuuaaaguacucuguccauaaucauagacucugacacuuugauuauuuucacaugaaacuacaa

SEQ ID NO: 456239 - RNA, 64 nt, Homo Sapiens
cuguggucccuggagggugggucuccaccacagccacuuugaguucacccuacccaggcggugg

SEQ ID NO: 456240 - RNA, 64 nt, Homo Sapiens
uuuagcauuguuauaaaccauuccauucgaaaagcacuuugaaaaauuguucccgagcgauaga

SEQ ID NO: 456241 - RNA, 64 nt, Homo Sapiens
cuucauaaugauccugucuucaucauaucauauucacuuugagaaucgguuugacuuugcuuuc

SEQ ID NO: 456242 - RNA, 64 nt, Homo Sapiens
auaagaggugaugacauggauauacaacagaaaacacuuugaguugaaaguaaacacaagcugg

SEQ ID NO: 456243 - RNA, 64 nt, Homo Sapiens
cuaaaguggagcacuuacaccaggcucuaagauucacuuugagguggaacuuaaaaccagugua

SEQ ID NO: 456244 - RNA, 64 nt, Homo Sapiens
auuuggcagaugcaguuaagguuccuaaacaacucacuuugagacuguugaaagggccugaccu

SEQ ID NO: 456245 - RNA, 64 nt, Homo Sapiens
aguccuccucaggagaaggggaagggaaggaggccacuuugagagggcugaagggagggccuug

SEQ ID NO: 456246 - RNA, 64 nt, Homo Sapiens
aaaauguuuauaugauaaugucuguaaacagcaucacuuugauuacaauagauguaguguugua

SEQ ID NO: 456247 - RNA, 64 nt, Homo Sapiens
auaaauauugcaaguggaugaguuggaaauuaugcacuuugaaaaacauucacuuuguuuaagc

SEQ ID NO: 456248 - RNA, 64 nt, Homo Sapiens
agguucgaauucaaacccagccagguuaugccaacacuuugagggaugcagcucccaaaaugua

SEQ ID NO: 456249 - RNA, 64 nt, Homo Sapiens
cacgguuccuucauaaaacuauaauaauauccgacacuuugauagaaaaaaauucaaagcugug

SEQ ID NO: 456250 - RNA, 64 nt, Homo Sapiens
ggagggaagaggauuuuuauaagagaaauuucugcacuuugaaacuguccucuaagagaauaag

SEQ ID NO: 456251 - RNA, 64 nt, Homo Sapiens
uuuccuccugaaguguucuguuggcaauaaaaugcacuuugacuguuuguugucacugaugccc

SEQ ID NO: 456252 - RNA, 64 nt, Homo Sapiens
aaaaauacccaauucuaagugguugacagauguucacuuugaagugugaaguuuuaaaaauacg

SEQ ID NO: 456253 - RNA, 64 nt, Homo Sapiens
accauacuuguccugaaguauggucccuggaucacacuuugagacguggacuuccucagagggu

SEQ ID NO: 456254 - RNA, 64 nt, Homo Sapiens
ccauugggucauugaauauaucacuuuccucuuccacuuugauauaguuaucaaucucuaguug

SEQ ID NO: 456255 - RNA, 64 nt, Homo Sapiens
aauauauaaggaauuguugaacaugcaacaaaagcacuuugaaacauguauagcagaaaaugaa

SEQ ID NO: 456256 - RNA, 64 nt, Homo Sapiens
ucacuggcuguaauuuuuuuuugaauaaaggucccacuuugaaggcacagauuucaccucuguc

SEQ ID NO: 456257 - RNA, 64 nt, Homo Sapiens
gaaaacugccauuuuguauugaagcaaauauuuucacuuugaaaaggcacugaggaguaucaaa

SEQ ID NO: 456258 - RNA, 64 nt, Homo Sapiens
gagauaaauaaucaaaacugaucucaaaucaaaucacuuugauggagccugagauugugugauu

SEQ ID NO: 456259 - RNA, 64 nt, Homo Sapiens
gaccccucccacuccuggccagcuacuucuccugcacuuugaaaggcgccuggagcaagugcuc

SEQ ID NO: 456260 - RNA, 64 nt, Homo Sapiens
gaaaagaauguccacauacauuuaucucugauggcacuuugaggagcaaguuaaauuuuuguca

SEQ ID NO: 456261 - RNA, 64 nt, Homo Sapiens
cuuaacauuaucagucaacuucggcuuucuuuuucacuuugacuagcacuguugaauaugggua

SEQ ID NO: 456262 - RNA, 64 nt, Homo Sapiens
uuugaauaggaaguuguaguucucuugaaacaagcacuuugaaaguaguaggugagaaaugugu

SEQ ID NO: 456263 - RNA, 64 nt, Homo Sapiens
augaguuacuccuugucaucaauagacuuacuugcacuuugaaguugccuuuuuugugguugua

SEQ ID NO: 456264 - RNA, 64 nt, Homo Sapiens
acauuuaugaugcagcagauucuguuuugggaaacacuuugagguuuuccaauuaauuaucaag

SEQ ID NO: 456265 - RNA, 64 nt, Homo Sapiens
ucaggaguuugagaccagcccaaggcaggcagaucacuuugaggauuccagcacuuugggaggc

SEQ ID NO: 456266 - RNA, 64 nt, Homo Sapiens
cgguuaaagcucauagcuguucucacuugucuuccacuuugaaccgaaauuuuuaugagauauc

SEQ ID NO: 456267 - RNA, 64 nt, Homo Sapiens
cuggucuugaaauuccuaguuaaugcauaacuuucacuuugacuuucucaaaaugcuugccuca

SEQ ID NO: 456268 - RNA, 64 nt, Homo Sapiens
ggcugagcucgguggcucaugccuguaaucccaacacuuugagaagcugaggugggaggagugc

SEQ ID NO: 456269 - RNA, 64 nt, Homo Sapiens
gaagugagggaagaaugaguagucaggaacuggucacuuugaaugugggagggaagauauucac

SEQ ID NO: 456270 - RNA, 64 nt, Homo Sapiens
uccuggcccagugcuuuuucuuacuuuguagcuacacuuugaaguaagauucaaacuguuaucc

SEQ ID NO: 456271 - RNA, 64 nt, Homo Sapiens
gguuccuuuuaaguggacucaggagcauugcagucacuuugacaaacaagagacugcuugacaa

SEQ ID NO: 456272 - RNA, 64 nt, Homo Sapiens
auaaaaaguuacuaaugcuguuaaaugcuuuuaucacuuugagauuuauacuguaaaguauaug

SEQ ID NO: 456273 - RNA, 64 nt, Homo Sapiens
cccuauaccuagcacugugacaccaccccuaaaucacuuugagccugggaaauaagcccccuca

SEQ ID NO: 456274 - RNA, 64 nt, Homo Sapiens
ucgucggcauuuucguuuagaccuuuaauucuagcacuuugaauucgagcaggucagcgucuuc

SEQ ID NO: 456275 - RNA, 64 nt, Homo Sapiens
cuaaaugucagcuguugucacacaguagcuccaacacuuugagcauuuuuaagggaguggccuc

SEQ ID NO: 456276 - RNA, 64 nt, Homo Sapiens
aagagaggaacaagcagaagaugccugcagguaucacuuugauccuaugugggagcgacugaaa

SEQ ID NO: 456277 - RNA, 64 nt, Homo Sapiens
auauuucuauugcaaaagucuauccgauuugaugcacuuugaauauugagauauuuugcacgga

SEQ ID NO: 456278 - RNA, 64 nt, Homo Sapiens
uccucagccgcugguauuuucuaaggggucucuucacuuugaugagugacaugaacaccguguc

SEQ ID NO: 456279 - RNA, 64 nt, Homo Sapiens
cuauuuggguuaugauggggagucccaucucugccacuuugauguugaugcuugcuuuaacuuu

SEQ ID NO: 456280 - RNA, 64 nt, Homo Sapiens
auggaagggauggaaacagguugcacugauaaugcacuuugaagcugagauccagcccuacuuc

SEQ ID NO: 456281 - RNA, 64 nt, Homo Sapiens
agggaggcacagggcuugggggcugcaggaugcccacuuugaggccuucggccuggcucagcug

SEQ ID NO: 456282 - RNA, 64 nt, Homo Sapiens
uaaauagguuuucuauugggaaaugaauuacaugcacuuugaaggcguuuaugagcuaccgggu

SEQ ID NO: 456283 - RNA, 64 nt, Homo Sapiens
cauaggaauugacuucuuuuccuugaauggaaaacacuuugaaauaauaauaaacauuguuaua

SEQ ID NO: 456284 - RNA, 64 nt, Homo Sapiens
ucuaauccuuaggaguuguuuuaaaagacauaaucacuuugaacuuccaugaaaccugucuucc

SEQ ID NO: 456285 - RNA, 64 nt, Homo Sapiens
ucugaggacgcaacaagccugguucccuagagcucacuuugacccucaauauguucauaauuuc

SEQ ID NO: 456286 - RNA, 64 nt, Homo Sapiens
gacuuuuuuauuuuauguuaauguuuucaguucucacuuugaggcacauuuacaucaaugcuuu

SEQ ID NO: 456287 - RNA, 64 nt, Homo Sapiens
gcugugucugccaaacacauuuacccuuuggccccacuuugaagggcaagaaauggcgucugcu

SEQ ID NO: 456288 - RNA, 64 nt, Homo Sapiens
ccucuuuaaaaacucacuuacguuuguccuuuuucacuuugaaaaguuggaaggaucugcugag

SEQ ID NO: 456289 - RNA, 64 nt, Homo Sapiens
agguuuguuuuuguuuuuccacuuaucuugaguucacuuugauguuaaaucuauugcuacuuca

SEQ ID NO: 456290 - RNA, 64 nt, Homo Sapiens
ggggcaagcaugauauguuguuagaacaggagcccacuuugaagguauaacagguuccugccag

SEQ ID NO: 456291 - RNA, 64 nt, Homo Sapiens
uuugcucaaaguauagaaacagcccaccugugcccacuuugaccauuggugaggauagauauaa

SEQ ID NO: 456292 - RNA, 64 nt, Homo Sapiens
cgauccugugguacuugaauauccaaaaacccugcacuuugaacaaucagcuguugcuaucugg

SEQ ID NO: 456293 - RNA, 64 nt, Homo Sapiens
caaccaugaacccaccucacggaagcuuuuuuugcacuuugaacagaagucauugcaguugggg

SEQ ID NO: 456294 - RNA, 64 nt, Homo Sapiens
uaauaauaaacauuguuauaccuugaauggaaaacacuuugaaacauaggaauugacuucuuuu

SEQ ID NO: 456295 - RNA, 64 nt, Homo Sapiens
uucaugggaugguccuaacaagaaaaaaaccuggcacuuugauuuuucuccagucaaagcucac

SEQ ID NO: 456296 - RNA, 64 nt, Homo Sapiens
ggccugaggucggcggacuggccuguaaucccagcacuuugagaggccgggucugguggcucau

SEQ ID NO: 456297 - RNA, 64 nt, Homo Sapiens
ugagcaaaugguuuaauuuucauuauaacgugaucacuuugacucuguuacaaauggaacauuu

SEQ ID NO: 456298 - RNA, 64 nt, Homo Sapiens
ggauggagaugcauuuacaaccggaugcuguucacacuuugacuccuaacuuucaaugagggaa

SEQ ID NO: 456299 - RNA, 64 nt, Homo Sapiens
caagcaggaggcucugccuacccauagggcuagacacuuugaggccccucccuccauggaggga

SEQ ID NO: 456300 - RNA, 64 nt, Homo Sapiens
uuuucauuuuuugaaguugauaaacuauugccuacacuuugaaagcaagauauucauucauuca

SEQ ID NO: 456301 - RNA, 64 nt, Homo Sapiens
uccaaggccuccccuauguacauuucagugagcucacuuugauuuuuaaucccaccacaagcac

SEQ ID NO: 456302 - RNA, 64 nt, Homo Sapiens
aggaagcagacccuucacaagcaaaaucagccagcacuuugaucacggacuucccagccucuag

SEQ ID NO: 456303 - RNA, 64 nt, Homo Sapiens
caccguuucuugaaacaaagaugguuguauuccucacuuugauguuguuuugcaagauguuugu

SEQ ID NO: 456304 - RNA, 64 nt, Homo Sapiens
cuugcagcccaccugccacccaggacgggcccugcacuuugaauaggcuuuccauuuuguuuug

SEQ ID NO: 456305 - RNA, 64 nt, Homo Sapiens
uugaauaggcuuuccauuuuguuuuggagguucucacuuugaaccuucuuguuuacagauuuuu

SEQ ID NO: 456306 - RNA, 64 nt, Homo Sapiens
uauuaaauauacugaguugcccguuuugaaaaugcacuuugaauaaucucaaaaagauguacaa

SEQ ID NO: 456307 - RNA, 64 nt, Homo Sapiens
cucucuucucucgucugagcccccaggccuuuuccacuuugagggaggugcuucgaagaauguu

SEQ ID NO: 456308 - RNA, 64 nt, Homo Sapiens
agcagguucuacccucucugcuaagggccuagcacacuuugaugagguuccuggacgugagacc

SEQ ID NO: 456309 - RNA, 64 nt, Homo Sapiens
aagguugggcuggugcucacagcuguaaucccagcacuuugagguuggcugggaguucaagacc

SEQ ID NO: 456310 - RNA, 64 nt, Homo Sapiens
augaaucuggagucugcuuaauccccuuucccaacacuuugaagugauaauguacaggucacag

SEQ ID NO: 456311 - RNA, 64 nt, Homo Sapiens
cugcuggaaaauuuuaucaguguauauacauguacacuuugaucauuagaucucuaauaaaguc

SEQ ID NO: 456312 - RNA, 64 nt, Homo Sapiens
auaacccgccugucugccccaaaugagcugcugccacuuugacuguaucuauuuuuggcuaaau

SEQ ID NO: 456313 - RNA, 64 nt, Homo Sapiens
ugggcaaaucuuacuuggcagacgcaaacacuuucacuuugagccugaggauuccggauaccaa

SEQ ID NO: 456314 - RNA, 64 nt, Homo Sapiens
uaaugagcacucuacagaugaagaaagcugggagcacuuugaacuugaaaaucauuucucuuag

SEQ ID NO: 456315 - RNA, 64 nt, Homo Sapiens
ccgggcugggcucuacuaccuguacugucaggugcacuuugaugaggggaaggcugucuaccug

SEQ ID NO: 456316 - RNA, 64 nt, Homo Sapiens
uuccaaauaaauuacucauccuuaaaguuuacuccacuuugacaaaagauacgcccuucucccu

SEQ ID NO: 456317 - RNA, 64 nt, Homo Sapiens
gugaugacuuagggcuucccaucuguguacaucccacuuugaaucuugaucgugacaagaaaua

SEQ ID NO: 456318 - RNA, 64 nt, Homo Sapiens
guuucuccguccucuccuaucacccccaaacacucacuuugaaugcugcaugaaucucgugggg

SEQ ID NO: 456319 - RNA, 64 nt, Homo Sapiens
ccucagaucagacagagguaaguguauuguuucucacuuugauuagggcuuuuuguuacuguuu

SEQ ID NO: 456320 - RNA, 64 nt, Homo Sapiens
gcugcagauaggcauggucucagguaugaacagacacuuugaaacgacuuuaggucuuucuuuu

SEQ ID NO: 456321 - RNA, 64 nt, Homo Sapiens
cguccaccuacaaaucaggaacagaaagucuguccacuuugaaaauaccuuuccaggcagcucc

SEQ ID NO: 456322 - RNA, 64 nt, Homo Sapiens
ggacccacccuuggaaagcuuggucuggggggaccacuuugaucccaaguguuucuugagcauc

SEQ ID NO: 456323 - RNA, 64 nt, Homo Sapiens
cccaggcuggagugcagugguuaagacagagucucacuuugacaauaugauuuuuuuguuguug

SEQ ID NO: 456324 - RNA, 64 nt, Homo Sapiens
gggucucuaccuccccaucagccucagaccauggcacuuugaggcugcuuggccaauuaguuca

SEQ ID NO: 456325 - RNA, 64 nt, Homo Sapiens
cacuccucaaaaaaagaacucuagugcagguggacacuuugaacugcaaaaacaccaauggggu

SEQ ID NO: 456326 - RNA, 64 nt, Homo Sapiens
ucuccacugaaauuuccuugacaaugcaacauuucacuuugauugagucucacuucuaaaugaa

SEQ ID NO: 456327 - RNA, 64 nt, Homo Sapiens
gauauuguaauuuucaaaugccuguaaacuguaucacuuugacuuuccagauaguuucauuuca

SEQ ID NO: 456328 - RNA, 64 nt, Homo Sapiens
ccuccucgguuuauggagggaccagcacugucagcacuuugagcagaaggagaaaugacuggaa

SEQ ID NO: 456329 - RNA, 64 nt, Homo Sapiens
ggguaggaggagggagaaacaacugcugugaacucacuuugagguaggaauuuauuuuuucuuu

SEQ ID NO: 456330 - RNA, 64 nt, Homo Sapiens
ggaaguugucauccguaaaaauuucuaaaaaagccacuuugaauuuucuugcuucuccuuuuua

SEQ ID NO: 456331 - RNA, 64 nt, Homo Sapiens
gcugaaggacccuacgcucgguggccuggcaccucacuuugagaagagugagcacacuggcuuu

SEQ ID NO: 456332 - RNA, 64 nt, Homo Sapiens
aauuacuuuugaacuguaaucuuucagauuacaccacuuugaaaacaaguuuuaacaguagggu

SEQ ID NO: 456333 - RNA, 64 nt, Homo Sapiens
uuaucuugcccuuuucauucuaccaacagaucugcacuuugaagucaaugguaaauuacuccag

SEQ ID NO: 456334 - RNA, 64 nt, Homo Sapiens
cugaacccauuuuccuccccugucccagccuucccacuuugacagacacuuuuaacuguguucc

SEQ ID NO: 456335 - RNA, 64 nt, Homo Sapiens
aaauggauagcuucuguguuuaauugaauccuuacacuuugagaccacaaacuaaaucauaaaa

SEQ ID NO: 456336 - RNA, 64 nt, Homo Sapiens
ggcagaugaaagucuagagauaaaacagggaugucacuuugagguagaggucgguaauuuaaca

SEQ ID NO: 456337 - RNA, 64 nt, Homo Sapiens
uggagaauuggugcuaguugguguuuuccucacacacuuugauuuuaaagaggauugcacgagu

SEQ ID NO: 456338 - RNA, 64 nt, Homo Sapiens
cacucuccauccccuuucccuuccacuuuggguucacuuugaauuuucuccguuuuuuggggca

SEQ ID NO: 456339 - RNA, 64 nt, Homo Sapiens
gcacaggaccucuguaagcugcuuguguauuguccacuuugacgaucagucauucgguccguug

SEQ ID NO: 456340 - RNA, 64 nt, Homo Sapiens
ggccauuugguuccugggagaauaggcagccccacacuuugaagaauacagaccccaguaucua

SEQ ID NO: 456341 - RNA, 64 nt, Homo Sapiens
aucuccauggugaugcagucucuggguugucauucacuuugagagcccgaggggugggagggag

SEQ ID NO: 456342 - RNA, 64 nt, Homo Sapiens
ggucgggugcgguggcucaugccuauaauccuagcacuuugagaggccaaggugggcugaucac

SEQ ID NO: 456343 - RNA, 64 nt, Homo Sapiens
uagggggacccugaauuugcccauccaccugggucacuuugagaguugugcaggggggcuggga

SEQ ID NO: 456344 - RNA, 64 nt, Homo Sapiens
ggugguccuguccaggcuccugcagcgccccccucacuuugacacuggacuaggaugcagccuc

SEQ ID NO: 456345 - RNA, 64 nt, Homo Sapiens
ggcccggagcgguggcucacaccuguaaucccagcacuuugagaggccaaggagggaggaucgc

SEQ ID NO: 456346 - RNA, 64 nt, Homo Sapiens
cauuuuuuaucuuucaucuuaccuguaauccuagcacuuugagaccacuaaggcagguggauca

SEQ ID NO: 456347 - RNA, 64 nt, Homo Sapiens
auauauuguacagaaguaaaaauaaucauguauucacuuugaacuccucaaagccuuuuuuauu

SEQ ID NO: 456348 - RNA, 64 nt, Homo Sapiens
auucucuucaguacaaguuuugaucguucagccacacuuugaggcucaugaucucuuuaucaga

SEQ ID NO: 456349 - RNA, 64 nt, Homo Sapiens
auucucuucaguacaaguuuugauuguucagccacacuuugaggcucaugaucucuuuaucaaa

SEQ ID NO: 456350 - RNA, 64 nt, Homo Sapiens
cugggaacuggguauaccucguguguguaacaaacacuuugaccacacacaggcauggaugcau

SEQ ID NO: 456351 - RNA, 64 nt, Homo Sapiens
uggugaauuucgugguaugugcuauugaauuggacacuuugaaaacacugugagugcacuaaau

SEQ ID NO: 456352 - RNA, 64 nt, Homo Sapiens
ggccaaggcgggcggaucaccccugucaucccagcacuuugagaggccaggugcagugucucac

SEQ ID NO: 456353 - RNA, 64 nt, Homo Sapiens
cccauuugggaugagcccucguuaguaaaaauggcacuuugauugucuuugaguuuuagagucu

SEQ ID NO: 456354 - RNA, 64 nt, Homo Sapiens
caucgugucuaugguucauugaguuugaagaugacacuuugagguuauacuuucaauucagagc

SEQ ID NO: 456355 - RNA, 64 nt, Homo Sapiens
ggccaagacugguaggucacgccugcaaugccagcacuuugagaggcugggcacuguggcucac

SEQ ID NO: 456356 - RNA, 64 nt, Homo Sapiens
ggcaaagacagguaggucacgccuguaauuccagcacuuugagacacugggggccauggcucau

SEQ ID NO: 456357 - RNA, 64 nt, Homo Sapiens
aauguuuguagauuugaagggcacauguuuuuaucacuuugaucauggcuuguaucucuuauuu

SEQ ID NO: 456358 - RNA, 64 nt, Homo Sapiens
ggccaagacagguaggucacaccuguaaucccagcacuuugagaggccaggcguggugucucac

SEQ ID NO: 456359 - RNA, 64 nt, Homo Sapiens
aaaaagaaaucuuuuguaaaucauucuacuuuugcacuuugaaagaaaggcguuaaucauaaag

SEQ ID NO: 456360 - RNA, 64 nt, Homo Sapiens
auuuuuuuaaauuugaaauauacuuuaccugauccacuuugauuguauacuauauucuuuguua

SEQ ID NO: 456361 - RNA, 64 nt, Homo Sapiens
agcuuuucaaacaagaaugucccuuuuccuaagucacuuugaggugucucaaucugaucugagu

SEQ ID NO: 456362 - RNA, 64 nt, Homo Sapiens
agauggggacaaggacuaagagucagaauguugacacuuugaugaaauggaguagagaaaugca

SEQ ID NO: 456363 - RNA, 64 nt, Homo Sapiens
guuaguagugaaauucauucuucaauaaauaaaacacuuugaaacuccggaggaccacaucuuu

SEQ ID NO: 456364 - RNA, 64 nt, Homo Sapiens
cuacauuuuuaauuuauuaaacuugcugugaaaacacuuugauuuucuaagaggaagguacuuu

SEQ ID NO: 456365 - RNA, 64 nt, Homo Sapiens
aaguuuagauugcuccauuauuaacugauuaaugcacuuugaaguucucuggaauuaauuauuu

SEQ ID NO: 456366 - RNA, 64 nt, Homo Sapiens
ugugauagccccagccaggucacaccuggccucacacuuugagcugagacuugaaaacgaugcu

SEQ ID NO: 456367 - RNA, 64 nt, Homo Sapiens
ucucaccccucauccuuuuacuuuuugccccuuccacuuugaguaccaaauccacaagccauuu

SEQ ID NO: 456368 - RNA, 64 nt, Homo Sapiens
aucaucaccacaccgugagcagaucugaaaggcacacuuugauuuuuuuaaggauaagaaccac

SEQ ID NO: 456369 - RNA, 64 nt, Homo Sapiens
gaucccaucuggaaaucauaauaaagacauaugccacuuugacaaaccugacuaguccuuacua

SEQ ID NO: 456370 - RNA, 64 nt, Homo Sapiens
uguagaauugucaacacgagagaucacaguggagcacuuugaaagaccgucgguugugugcacg

SEQ ID NO: 456371 - RNA, 64 nt, Homo Sapiens
uuaugggcccagcuuuggggggccagucccgaugcacuuugagggguguuggagaggggacucc

SEQ ID NO: 456372 - RNA, 64 nt, Homo Sapiens
cuacccccugccgagagaagugugacaaccaaagcacuuugacagaaccuaggugucugggucu

SEQ ID NO: 456373 - RNA, 64 nt, Homo Sapiens
ugcuuccuaacagcucuguucacccuccaaucugcacuuugauugccuccccacugcucugccc

SEQ ID NO: 456374 - RNA, 64 nt, Homo Sapiens
cuugcuaguagguccuuugaagacaguugcccaacacuuugacaucuuucuggagccugcaaga

SEQ ID NO: 456375 - RNA, 64 nt, Homo Sapiens
uaauccuuuggcugugggcucucccacccugccccacuuugauuauucaaucccaucccccuuc

SEQ ID NO: 456376 - RNA, 64 nt, Homo Sapiens
ccuuugcggucaugucuguggcuuaaaguggggucacuuugauaaggaaaggucuuuuuucacu

SEQ ID NO: 456377 - RNA, 64 nt, Homo Sapiens
agguaagaguguguguguguguguguguguguaacacuuugacaauacuaaacucucauaagca

SEQ ID NO: 456378 - RNA, 64 nt, Homo Sapiens
cauucagugcauuguuuacauauucaaaguggugcacuuugaaggaagcacaugugcaccuuuc

SEQ ID NO: 456379 - RNA, 64 nt, Homo Sapiens
ugaucaacccacucuuguuauggguggucucugucacuuugaaugccaggcuggcuucucgucu

SEQ ID NO: 456380 - RNA, 64 nt, Homo Sapiens
auagaugucuguaaccaauaauguagcaguucugcacuuugacacaagguguaacuagaccauu

SEQ ID NO: 456381 - RNA, 63 nt, Homo Sapiens
ugaaagcugauagucgcguccugaauugcuccugcacuuugaccauuuccuggugucugcugu

SEQ ID NO: 456382 - RNA, 64 nt, Homo Sapiens
cagguuugaacuugacaauuagcagugacaaguucacuuugaaucuacgguuguguuguuuucu

SEQ ID NO: 456383 - RNA, 64 nt, Homo Sapiens
ucguacugucuuucaccuuuaaucuaagucaguccacuuugacugggaaaauucuauacaacuc

SEQ ID NO: 456384 - RNA, 64 nt, Homo Sapiens
aaugaggccuguacaaggcuucucaauaaauuaucacuuugagauuugacguagaaauuuuuuu

SEQ ID NO: 456385 - RNA, 64 nt, Homo Sapiens
uacuggcugaauaucagugcuguuuguaauuuuucacuuugagaaccaacauuaauuccauaug

SEQ ID NO: 456386 - RNA, 64 nt, Homo Sapiens
cgugcaguggcccugccacagcccucccucggcacacuuugacccuuuguaggauuggaauuag

SEQ ID NO: 456387 - RNA, 62 nt, Homo Sapiens
ucaucaguguuuuaaacagaauaaagauuccaaacacuuugaauagagaaccaagaguuauu

SEQ ID NO: 456388 - RNA, 64 nt, Homo Sapiens
ucuucccacucgguagacaggcuggccucucccucacuuugagacuuuggcaacuccugggcca

SEQ ID NO: 456389 - RNA, 64 nt, Homo Sapiens
aggaacucgccugacccugcugccaccuccugugcacuuugagcaaugcccccugggaucaccc

SEQ ID NO: 456390 - RNA, 64 nt, Homo Sapiens
cuucauagcaaucuuugcccugaauuuaggcagucacuuugagauccaucagccuaaaacaaag

SEQ ID NO: 456391 - RNA, 64 nt, Homo Sapiens
ucagcccaggguccucgcucacucccucacuccccacuuugaagccaucucuguucugcaggug

SEQ ID NO: 456392 - RNA, 62 nt, Homo Sapiens
ucccuuagccuuuguucuagaaaauaaacuugugcacuuugaccucuguccccgagauguca

SEQ ID NO: 456393 - RNA, 64 nt, Homo Sapiens
ccuuugagccguuuggagggcgucuuggcuuauccacuuugacucccugguccugucuccagcc

SEQ ID NO: 456394 - RNA, 64 nt, Homo Sapiens
ucccccacccccuccaggucuuacuaaaacgcuccacuuugagcuuuuuguuaacgagcguguc

SEQ ID NO: 456395 - RNA, 64 nt, Homo Sapiens
cacuuugcaggacuuauucuagguagcagugggucacuuugaucggucacaccaucugggccug

SEQ ID NO: 456396 - RNA, 64 nt, Homo Sapiens
ugcuuguaaauacacagugaaauugucuuuauaucacuuugacagaggagaagauugagggagg

SEQ ID NO: 456397 - RNA, 64 nt, Homo Sapiens
uaauuugcuuaauucugagccauuaauccugcuacacuuugaaugauacauuaauucagacuaa

SEQ ID NO: 456398 - RNA, 64 nt, Homo Sapiens
agaugagcauuguccaccacuaaaaugccucugccacuuugaauucugugcuaauuuuguggcc

SEQ ID NO: 456399 - RNA, 64 nt, Homo Sapiens
gcgcaaugggcuggauuauaaugagcuggccaugcacuuugaccgccuugugcgaaaacaccac

SEQ ID NO: 456400 - RNA, 64 nt, Homo Sapiens
ggguuucuacuucuuucaaggacucaggaaauuucacuuugaacugaggccaagugagcuguua

SEQ ID NO: 456401 - RNA, 64 nt, Homo Sapiens
aagaggcugccuggggcugggccagcccgcugugcacuuugaccccaguuccuugccagcacgg

SEQ ID NO: 456402 - RNA, 64 nt, Homo Sapiens
caaugcacaaggggaaauuuggcuugcaauucaucacuuugaaaagguuagucauuaaauuaau

SEQ ID NO: 456403 - RNA, 64 nt, Homo Sapiens
gcauuaaaggugccaugaaagguagacucugaaccacuuugaucccucugaaguaggugacuga

SEQ ID NO: 456404 - RNA, 64 nt, Homo Sapiens
agagccaguagugaauccccucauuuugugcauucacuuugaagaaaaagguuucucaaagaug

SEQ ID NO: 456405 - RNA, 64 nt, Homo Sapiens
aucacuccuuugcacuccacuccccucguucugucacuuugaacgaagucugagugaggcuagu

SEQ ID NO: 456406 - RNA, 64 nt, Homo Sapiens
caucgaugagagagaaucacaaucagaauggaagcacuuugaguaucugaagagugagagcauu

SEQ ID NO: 456407 - RNA, 64 nt, Homo Sapiens
gagcuuuuagcaagguuguguuuauugguguuuucacuuugaaagacaaacaagaaaaaaagcu

SEQ ID NO: 456408 - RNA, 64 nt, Homo Sapiens
acuuguguaugggcuuguacgaguaguuguccaucacuuugaggucccagguuuuuuacuuucu

SEQ ID NO: 456409 - RNA, 64 nt, Homo Sapiens
guguuguuccagauuuaacauuacuuaccauuuucacuuugaauuuuugguuauacauuuuaaa

SEQ ID NO: 456410 - RNA, 64 nt, Homo Sapiens
aaaugaucguucauacuuugauuuuaaaaggcaacacuuugacauuggagguuucauguuagcc

SEQ ID NO: 456411 - RNA, 64 nt, Homo Sapiens
gauauauuaguucugacuuacauuuauucugcuacacuuugaaauaauuugcuuaguucugagc

SEQ ID NO: 456412 - RNA, 64 nt, Homo Sapiens
uaauuucauacaaagcucuguaaaaggagcuccacacuuugacuuaaggagaaaaaaaaaugag

SEQ ID NO: 456413 - RNA, 64 nt, Homo Sapiens
ucagacuucacaguuuucuauacgauuucaaggucacuuugaagccugauauuauguuauuagc

SEQ ID NO: 456414 - RNA, 64 nt, Homo Sapiens
accaaagacgcuuggcagaacauguccggagcaacacuuugaaaggugccgccaggugacccua

SEQ ID NO: 456415 - RNA, 64 nt, Homo Sapiens
aauaauagaaccugggcuaccaaauugucaaauucacuuugaauaaguuacagauucagcuuuu

SEQ ID NO: 456416 - RNA, 64 nt, Homo Sapiens
gcuaggggucauguaugcuucuuuuuuucuaauucacuuugauuaacauuuguuauuuucucac

SEQ ID NO: 456417 - RNA, 64 nt, Homo Sapiens
aaaagaacacugagaacuaggagacuguugaugccacuuugaagcuuggaagauaggccuggaa

SEQ ID NO: 456418 - RNA, 66 nt, Homo Sapiens
aaauagcugcccaucuccugugauugcacaaccaagcacuuugacauuugcaccuuaggagaggca

SEQ ID NO: 456419 - RNA, 66 nt, Homo Sapiens
uuuguuuuuugguuuuuuuuaaugacaaugaagugacacuuugacauuuccuaccuuuugaggacu

SEQ ID NO: 456420 - RNA, 66 nt, Homo Sapiens
uuuguucaauuagcuuuggggaagaaaugccaaauccacuuugaggaugagucuuacgacacagau

SEQ ID NO: 456421 - RNA, 66 nt, Homo Sapiens
uuuaaguuuauugcuuuaaaauggcaguguuucucccacuuugauaugcuaacauuuaguaagcac

SEQ ID NO: 456422 - RNA, 66 nt, Homo Sapiens
agaauugcauccucugggaucuucugagguggacagcacuuugaauguagcauuucacuggaacag

SEQ ID NO: 456423 - RNA, 66 nt, Homo Sapiens
ggacuguuuugguggcauccaaagacgaucucagagcacuuugaaccucucuguugaguuuucuuu

SEQ ID NO: 456424 - RNA, 66 nt, Homo Sapiens
gcgauaacacugucuaagcacccccaagccacuauccacuuugaauccugcuccauacauugggug

SEQ ID NO: 456425 - RNA, 66 nt, Homo Sapiens
gcuguugugaggauuaaaugagauggcaugugaaagcacuuugaaaauuguaaagcgcuauguaaa

SEQ ID NO: 456426 - RNA, 66 nt, Homo Sapiens
ucuagguuugcugagaaggcuucauuaaauuaaucucacuuugaauaucuccugagagauggacaa

SEQ ID NO: 456427 - RNA, 66 nt, Homo Sapiens
guaagcgggauccguuuuuuggaauuugguugaagucacuuugauuucuuuaaaaaacaucuuuuc

SEQ ID NO: 456428 - RNA, 66 nt, Homo Sapiens
ccagugacuuugcugcuacauauuuacuaaauugaccacuuugauucuugcuuguuugucucaguu

SEQ ID NO: 456429 - RNA, 66 nt, Homo Sapiens
cagaaguaauugcggaggcuccuucagcugccucagcacuuugauuuuggacagggacaagguagg

SEQ ID NO: 456430 - RNA, 66 nt, Homo Sapiens
uaaauuguuuacuuuaugauguuuacauacacguuucacuuugaaaaaaaaugcaaaucgacuuuu

SEQ ID NO: 456431 - RNA, 66 nt, Homo Sapiens
ugaagucuggccuugugugcauuggagcuuccaaggcacuuugaaaucauuccaguauauuuggga

SEQ ID NO: 456432 - RNA, 66 nt, Homo Sapiens
uccuuccuuguacaccuaccuucagauuucugcuuacacuuugauuucagagcuuuauuccccagu

SEQ ID NO: 456433 - RNA, 66 nt, Homo Sapiens
caugacaucuucaguaugagggggacaguuugacuucacuuugagggugugaugucuguagcuaug

SEQ ID NO: 456434 - RNA, 66 nt, Homo Sapiens
ggcugggccucggaguuugccccguaaagcgaauugcacuuugauguucagaaacccacuuuguuc

SEQ ID NO: 456435 - RNA, 66 nt, Homo Sapiens
uuucugauaacauuauuauguugccuucuuguuucucacuuugauauuuaaaagauguucaauaca

SEQ ID NO: 456436 - RNA, 66 nt, Homo Sapiens
ccccaggucaugcugcuguugcuggacugaggaccacacuuugagaaccugugcucuaagugaaua

SEQ ID NO: 456437 - RNA, 66 nt, Homo Sapiens
gagaauguuuacuuuucuauuuggcauagcuaacuacacuuugauacuaacuccaguuuuacuauu

SEQ ID NO: 456438 - RNA, 66 nt, Homo Sapiens
guuaugagugccaaaaaucugucuugaaggcagcuacacuuugaaguggucuuugaauacuuuuaa

SEQ ID NO: 456439 - RNA, 66 nt, Homo Sapiens
aaguaagucacuuuauaaguuggcagaagugaaugacacuuugagaguagucuuucaaucugaaga

SEQ ID NO: 456440 - RNA, 66 nt, Homo Sapiens
cagcucaggucacccgggccucugacccaggccugucacuuugagaggggcaaaacugagaggggc

SEQ ID NO: 456441 - RNA, 66 nt, Homo Sapiens
aauccgccaguagugugauuguuuuucaauuuuucccacuuugaaaacuuacaccuaaaggccugu

SEQ ID NO: 456442 - RNA, 66 nt, Homo Sapiens
acacaaccuucucaggacaagcccacugucuuaagccacuuugacccugggagacacaggacugug

SEQ ID NO: 456443 - RNA, 66 nt, Homo Sapiens
ggccaaggcaguaggacugaacaccuguaaucucagcacuuugagaaaaaaaaaaaagaguggcug

SEQ ID NO: 456444 - RNA, 66 nt, Homo Sapiens
uuuauuacuagcuugcuaccgcaugaaaagagaaagcacuuugaaaguaacaguuauuggcaaaaa

SEQ ID NO: 456445 - RNA, 66 nt, Homo Sapiens
ugcuaaaaguggcauuuuucauaaaagaaguuuuuccacuuugaauggaguugggauaauuuuuau

SEQ ID NO: 456446 - RNA, 66 nt, Homo Sapiens
auauaaagaacaaaauaaagcaguacuauuucuuuucacuuugaaaaaaacaaaaagaaauugacu

SEQ ID NO: 456447 - RNA, 66 nt, Homo Sapiens
ccauuaagaggcaagccugguuuccaaagcaaaacucacuuugaccuuuacauuccuguuugaauu

SEQ ID NO: 456448 - RNA, 66 nt, Homo Sapiens
ccuucuguuggugucauguuucgcaauuucacgacacacuuugauccaagaaaaaggaaugaagac

SEQ ID NO: 456449 - RNA, 66 nt, Homo Sapiens
ggccgaggugagacgggaagacaccuguaaucccagcacuuugagauaggcugggcaugguggcuc

SEQ ID NO: 456450 - RNA, 66 nt, Homo Sapiens
uuauagcucccaaaugaugagcaguugcauucuggccacuuugaccauuuugcacaguguaacagc

SEQ ID NO: 456451 - RNA, 66 nt, Homo Sapiens
cccaggcuggagugcaguaguuuugaaacagggucucacuuugacacauuuuguuuuguuuuuguu

SEQ ID NO: 456452 - RNA, 66 nt, Homo Sapiens
agguugguaaauguuuuuagggaaaggugguauuuucacuuugaugccauguguaccauagagggg

SEQ ID NO: 456453 - RNA, 66 nt, Homo Sapiens
ucccaaagugcugggauuacccucaggugauccacccacuuugaccggcugaucucaaacuucuga

SEQ ID NO: 456454 - RNA, 66 nt, Homo Sapiens
uguaacgaaugguacuacaaugacaucagcauuagucacuuugaaauaccauuagcauucugguuu

SEQ ID NO: 456455 - RNA, 66 nt, Homo Sapiens
aucaaguacuucaaaacgcauauuaugcagcaucuacacuuugaaauuugagcuuuguuaauaaac

SEQ ID NO: 456456 - RNA, 66 nt, Homo Sapiens
aaggcugccuucuuguagauacaugcgagugcuaaccacuuugagcgaacucuuggaaaucuuuac

SEQ ID NO: 456457 - RNA, 66 nt, Homo Sapiens
cuuugaaauuccuauuucucuucaguuuccgucguucacuuugagaccuuuuucuaauuuguagau

SEQ ID NO: 456458 - RNA, 66 nt, Homo Sapiens
uauugaauauuuuaagcugaccuacacaaaauacagcacuuugacaagugacgggguucaggacac

SEQ ID NO: 456459 - RNA, 66 nt, Homo Sapiens
auuuucuaagggcacaagugcaaauacugcuacugucacuuugaagaauaaccaagaggcugcagu

SEQ ID NO: 456460 - RNA, 66 nt, Homo Sapiens
ccaaauucucauuauuuucaccucuuucuaggacuucacuuugauauccuccaccccacacuccca

SEQ ID NO: 456461 - RNA, 66 nt, Homo Sapiens
gaguuaauccauaaaauugccauuuuucaugugcuucacuuugauaauauauugugacuuuaggcc

SEQ ID NO: 456462 - RNA, 66 nt, Homo Sapiens
auauaaacaguuaugucccccuuuugguuaugcaaacacuuugauauuuucaucuuuauuauugua

SEQ ID NO: 456463 - RNA, 66 nt, Homo Sapiens
acaaagauauuucagagagccacugucaucuuuuuccacuuugacucaguuuauuaacuugagcuu

SEQ ID NO: 456464 - RNA, 66 nt, Homo Sapiens
cuucaaaauguauauauuuagugcugcaucuuauagcacuuugaaauaccucauguuuaugaaaau

SEQ ID NO: 456465 - RNA, 66 nt, Homo Sapiens
guacuuuuauuuuacacauaagggaaaaaauaagaccacuuugagcaguugccuggaaggcugggc

SEQ ID NO: 456466 - RNA, 66 nt, Homo Sapiens
aagugauucacugugcuucgagccaacucuaacaggcacuuugagauguguuccuccugcuguagu

SEQ ID NO: 456467 - RNA, 66 nt, Homo Sapiens
auaaaaccuggacucagggagcaaccacaggcucuccacuuugaaacuuuaguuugaauuuuaaaa

SEQ ID NO: 456468 - RNA, 66 nt, Homo Sapiens
cucagauucaagggaaauaccagcuuccacuugagucacuuugaaauaguuaauucaacagcacca

SEQ ID NO: 456469 - RNA, 66 nt, Homo Sapiens
uuccaaauguuaauacauuuacuuuagcauugaagccacuuugaaaccugagauaaaugaauguga

SEQ ID NO: 456470 - RNA, 66 nt, Homo Sapiens
uuuggaagaacuuuuaacagaagccucaaugaugaucacuuugaauugcuugugauuucaaaaaua

SEQ ID NO: 456471 - RNA, 66 nt, Homo Sapiens
aaaauaaaaaucccagaaggacaggaggauucucaacacuuugaauuuuuuuaacuucauuuuucu

SEQ ID NO: 456472 - RNA, 66 nt, Homo Sapiens
cagaaaacugaagauuucaucaguuggaaacaguagcacuuugaaaacuuuuuaggccagcuuuaa

SEQ ID NO: 456473 - RNA, 66 nt, Homo Sapiens
cacgaagccuggcuuauucacaagacaacgaagcuccacuuugaggcucugaugaacauuccagug

SEQ ID NO: 456474 - RNA, 66 nt, Homo Sapiens
aauccuggaguucugucuggucacuaucagaaggaacacuuugagggaaacccuggugcagccagc

SEQ ID NO: 456475 - RNA, 66 nt, Homo Sapiens
ccaacucacaguccacuagcuucacuccuuuaaauucacuuugaaacaggccucaucccacuucca

SEQ ID NO: 456476 - RNA, 66 nt, Homo Sapiens
gccaugcuuuccuagaaugucaaguagauauuuuuacacuuugaguuuuaaagcaauuacuaucag

SEQ ID NO: 456477 - RNA, 66 nt, Homo Sapiens
cuggcugggcgcgguggcucacgccuguaaucccagcacuuugagagaccgaggcgggcggaucac

SEQ ID NO: 456478 - RNA, 66 nt, Homo Sapiens
gguuuaaucaaucagaauuagagcaugggaggucaucacuuugaccuaaauuauuuacugcaaaaa

SEQ ID NO: 456479 - RNA, 66 nt, Homo Sapiens
aggcuggaaaugaauuauucuuuaccaguuuugaaacacuuugaaauauccuaagguaacuuggaa

SEQ ID NO: 456480 - RNA, 66 nt, Homo Sapiens
uucaagugucugguuucacuuucacagugcggcugccacuuugaagagacccuugguaaaccccug

SEQ ID NO: 456481 - RNA, 66 nt, Homo Sapiens
cuauuuuucuguauuccaaguuguuuugcuaaaauacacuuugaaaaaugcuaauuucauuauaaa

SEQ ID NO: 456482 - RNA, 66 nt, Homo Sapiens
ggaaaucuuguuucaauguuaauagauguaaguuuacacuuugaaaauaugcauuguguguguagu

SEQ ID NO: 456483 - RNA, 66 nt, Homo Sapiens
acccucgggugcuaugggugaagagccagaaugagccacuuugacccaguuggauucauuucuugg

SEQ ID NO: 456484 - RNA, 66 nt, Homo Sapiens
gccccuaccuguuguaccacgaacuaucaggugagacacuuugacacacauucacccuucaucagu

SEQ ID NO: 456485 - RNA, 66 nt, Homo Sapiens
ugaaguaucuguccuuuggcuggcuuggcugcagugcacuuugaaauucugccccaggggcuugcc

SEQ ID NO: 456486 - RNA, 66 nt, Homo Sapiens
gcugaaaguguaaggaagcuacgauuuuuggaaucccacuuugaguuagcugcauguuuuguaguu

SEQ ID NO: 456487 - RNA, 66 nt, Homo Sapiens
uuagaccuuuugaagucuguauauuuaaauauauuucacuuugacuugcauuagauguaacuaauc

SEQ ID NO: 456488 - RNA, 66 nt, Homo Sapiens
ccagaaguacuuaagaaguugucauaagaauuugcucacuuugaugauuagauauuuuaccauaua

SEQ ID NO: 456489 - RNA, 66 nt, Homo Sapiens
uaauuuuuaaauguuuuaauucuauucauggaucuccacuuugauuguuuuuuuuuuuuguuauaa

SEQ ID NO: 456490 - RNA, 66 nt, Homo Sapiens
uuuuuuuaugucuaaaauugccuggaaauaacugagcacuuugaaugcuuauaauauacauaacuc

SEQ ID NO: 456491 - RNA, 66 nt, Homo Sapiens
uccucaagggcagagaacugaucagggaguaagugacacuuugaacuaugugggaauuagugagac

SEQ ID NO: 456492 - RNA, 66 nt, Homo Sapiens
guuauuuucuguuuacuacaagaccucaugcaauaucacuuugaaacuuucacaaaaccuugucaa

SEQ ID NO: 456493 - RNA, 66 nt, Homo Sapiens
cucacuuaauucaacgauuuccauagauugaauuagcacuuugacuaugauggggaggaaaaaacc

SEQ ID NO: 456494 - RNA, 66 nt, Homo Sapiens
gauuuuaagaggauggauaauuggcuucaugauccucacuuugauuuuuuaugaagcuuuaucaac

SEQ ID NO: 456495 - RNA, 66 nt, Homo Sapiens
uuuugguaguuccacacuaugcgacaauuucuuaagcacuuugacauuucuuuauuuucuucacau

SEQ ID NO: 456496 - RNA, 66 nt, Homo Sapiens
caguaauuggucaugugaugcaagccagcuuacuagcacuuugagaaugagucuccuguugagcug

SEQ ID NO: 456497 - RNA, 66 nt, Homo Sapiens
uaaauugcuguaucguucagucucuuguggcaauagcacuuugaagaaaauagagaauuuaauaua

SEQ ID NO: 456498 - RNA, 66 nt, Homo Sapiens
uaccauuccacaaaguuggaccaucacuugugcacccacuuugacuaugaguauaccaccacauug

SEQ ID NO: 456499 - RNA, 66 nt, Homo Sapiens
uaauucacaauuccauuuugauuagcaggacuuuuccacuuugaagauaaauagcaacuuuaucaa

SEQ ID NO: 456500 - RNA, 66 nt, Homo Sapiens
ggcagcacuuuucccucaugcuguccuauaggacuccacuuugaagguugugccuacguugcaggg

SEQ ID NO: 456501 - RNA, 66 nt, Homo Sapiens
uauuuuggaguauuucaucagcugaaaagugauucucacuuugaguuuucuuccuauauuuguaua

SEQ ID NO: 456502 - RNA, 66 nt, Homo Sapiens
gcuucuuuuggaaacuggacaggccauugccaccugcacuuugaagaagugagcaaagacguggcc

SEQ ID NO: 456503 - RNA, 66 nt, Homo Sapiens
uaggccgggcuugguggcucaugccuguaaucccagcacuuugagaggccgaagcgaguggaucac

SEQ ID NO: 456504 - RNA, 66 nt, Homo Sapiens
ggccaccccacucuaccuccuuagcuuucccugugccacuuugacucagaggcugggagcauagca

SEQ ID NO: 456505 - RNA, 66 nt, Homo Sapiens
cucacauauauacaagccaaauggauuucuuacuugcacuuugacuggcuaccagauaaucacagu

SEQ ID NO: 456506 - RNA, 66 nt, Homo Sapiens
uaccauuguuccuuauaucguuaaaucuuugugacacacuuugacaaaaauguagaaccuauaaca

SEQ ID NO: 456507 - RNA, 66 nt, Homo Sapiens
uuuucacauuuucaguguuuguaauauuuaucuuuucacuuugauaaaccagaaauguuucuaaau

SEQ ID NO: 456508 - RNA, 66 nt, Homo Sapiens
uuaccuugguucuccuuacugaaguccucuugcuuucacuuugaucugguuuuugaagucucuuaa

SEQ ID NO: 456509 - RNA, 66 nt, Homo Sapiens
gcggcaggauugucacaccguuuuaggacucugugccacuuugagagacuguucccaggaggccca

SEQ ID NO: 456510 - RNA, 66 nt, Homo Sapiens
ucuaaaaaauaggcuauacuacaauugcacuuccagcacuuugagaacgaguugaauaccaagaau

SEQ ID NO: 456511 - RNA, 66 nt, Homo Sapiens
gagcccaccuuagacuucuuuuggggccuucgaccucacuuugagaaauaccuucuucagguuauu

SEQ ID NO: 456512 - RNA, 66 nt, Homo Sapiens
ucaaguauucugacugagugauugguugaccuaaaccacuuugaauguuucuauuuuaugaaauga

SEQ ID NO: 456513 - RNA, 66 nt, Homo Sapiens
ggccaaggcagguggaucacaugccuguaaucccagcacuuugagacaggccgggcgcaguggcuc

SEQ ID NO: 456514 - RNA, 66 nt, Homo Sapiens
uauuuuaacuaaagccuuuaaaauaaauguguacuacacuuugaaaugaaagaaaauaacaaauga

SEQ ID NO: 456515 - RNA, 66 nt, Homo Sapiens
ccuaaaugugauacugguuuaaugcugaagaauuaacacuuugacuugugcuuucuaguugucagg

SEQ ID NO: 456516 - RNA, 66 nt, Homo Sapiens
gauggauugaaacuguuccuugugggcacuggaagucacuuugauacugccugaagacuuaaguuu

SEQ ID NO: 456517 - RNA, 66 nt, Homo Sapiens
uauuuucucuaauaguuuauuauugccacuggccgccacuuugacuccagauuuguguauuguacu

SEQ ID NO: 456518 - RNA, 66 nt, Homo Sapiens
aguguucuaauuggauaaauuucuaaaucccuccuucacuuugagcacucauuucuagggaagaaa

SEQ ID NO: 456519 - RNA, 66 nt, Homo Sapiens
auuuacuuggcucauuuaguaucagugucuuuucagcacuuugagcugccgguuguacaaucucug

SEQ ID NO: 456520 - RNA, 66 nt, Homo Sapiens
auauuagauacaugcuaaauuuuuuuuuucugauagcacuuugagguguauacuuagcaagaaaau

SEQ ID NO: 456521 - RNA, 66 nt, Homo Sapiens
accccccuaaauagcuggacgguuaugaucaguugacacuuugaguucuugacauuuuaaaagccu

SEQ ID NO: 456522 - RNA, 66 nt, Homo Sapiens
gguggggggauauggggauucaggcaauuguuuacacacuuugaauaacugcaaaggauuuacggu

SEQ ID NO: 456523 - RNA, 66 nt, Homo Sapiens
ccauucaucucccccucaaaucauagccuaacagaacacuuugaaagcucuuuuauuuaauauuuu

SEQ ID NO: 456524 - RNA, 66 nt, Homo Sapiens
caccauggugaaggcuucuuuccccacugcaggacccacuuugagaaggaccgaggaggaggauuu

SEQ ID NO: 456525 - RNA, 66 nt, Homo Sapiens
uuuucaguacaguacaucauuccuccucacuaggagcacuuugauguaaaccagaauagcuuuaaa

SEQ ID NO: 456526 - RNA, 66 nt, Homo Sapiens
caggccaggugugguggcucaugccuguaaucccagcacuuugagaggccgaggugggcagaucac

SEQ ID NO: 456527 - RNA, 66 nt, Homo Sapiens
uaaauucuauaggauucaauacuuaguuugcaaaagcacuuugaaauuauggcacagugaguuguu

SEQ ID NO: 456528 - RNA, 66 nt, Homo Sapiens
gucauauuguuuccugugcuggagcaaaagucauuacacuuugaaguauuauauuguucuuauccu

SEQ ID NO: 456529 - RNA, 66 nt, Homo Sapiens
aggaaugugcacuagcucuuuuuaaauuccaugcuacacuuugaggacugucaucauguucucguu

SEQ ID NO: 456530 - RNA, 66 nt, Homo Sapiens
gcuuuaagagauuagccugacuugcacuugugaaaacacuuugagcggcugagaacaaucccuccc

SEQ ID NO: 456531 - RNA, 66 nt, Homo Sapiens
aaccuuguauauuaaauuacucuguaacauauuuugcacuuugagaaaaugaagccuaagaaacua

SEQ ID NO: 456532 - RNA, 66 nt, Homo Sapiens
uuacaagagaggagcuuuaaugaaaaauacacaaaacacuuugauuauauuccaggucaaaauuug

SEQ ID NO: 456533 - RNA, 66 nt, Homo Sapiens
ucaguacaacuucagcaauuuauuuguucacauaaccacuuugaugcugauaguggauaacaaaua

SEQ ID NO: 456534 - RNA, 66 nt, Homo Sapiens
ugugcacauaagaaaaccaaagcauucugucagggucacuuugaauacccugcauucaaguguaac

SEQ ID NO: 456535 - RNA, 66 nt, Homo Sapiens
ggccaaggcaggggaauugcauaucuguaauccuaacacuuugacauaugacagccguggugguuc

SEQ ID NO: 456536 - RNA, 66 nt, Homo Sapiens
ggccgagauaggcggauugcaugccuguaauccuagcacuuugagagaggccagguguaguggcuc

SEQ ID NO: 456537 - RNA, 66 nt, Homo Sapiens
agugugaggaaaaccuauguuucuuccuggauuccucacuuugaaguguuuuuccaguaguuagcu

SEQ ID NO: 456538 - RNA, 66 nt, Homo Sapiens
gaaguauucaaucaaguuuuucacauaaaaaagaagcacuuugauuuaauucaguaugauuuaucc

SEQ ID NO: 456539 - RNA, 66 nt, Homo Sapiens
ggccaagguggguagaucauaugccuguaaucccagcacuuugagauuggccaggcacaguggcuc

SEQ ID NO: 456540 - RNA, 66 nt, Homo Sapiens
cccauucaucacacagcauagcgaaguaaagaacgucacuuugaaauacaaaggguguuagcagau

SEQ ID NO: 456541 - RNA, 66 nt, Homo Sapiens
uauugaaacgggucaauuuaaguagcuguauacuaccacuuugaauuaaccccaauugucaagggu

SEQ ID NO: 456542 - RNA, 66 nt, Homo Sapiens
aggaugauaggaaauaaaugauuucccaauacauaccacuuugaauucucuucccugggggcagau

SEQ ID NO: 456543 - RNA, 66 nt, Homo Sapiens
aaaggucaguggggauuguuuggauuauacccagagcacuuugaacaacaaacacucaugcuuuaa

SEQ ID NO: 456544 - RNA, 66 nt, Homo Sapiens
ucuugcuucuuuuuuauuacaaagcuagcgcaccugcacuuugaauccugaauggauguggaaaug

SEQ ID NO: 456545 - RNA, 66 nt, Homo Sapiens
gauaacauuuuauuaugaugacaggauuuuagagagcacuuugaaaauuagcauuuagauaaugua

SEQ ID NO: 456546 - RNA, 66 nt, Homo Sapiens
guaauaaauacacagcaugcaguaauaugaaagccacacuuugaagacagucaacuuacggugcac

SEQ ID NO: 456547 - RNA, 66 nt, Homo Sapiens
acuuuauuacauuccagcagcuuacucccguggccgcacuuugaaugucaccaccuugaguuucuc

SEQ ID NO: 456548 - RNA, 66 nt, Homo Sapiens
aacaagcaccccagucacuaggaugcagauggaccacacuuugagaaacaccacccauuucuacuu

SEQ ID NO: 456549 - RNA, 66 nt, Homo Sapiens
caaagugaaguugcuucuucuacuucagucuucucucacuuugauuugcuaguuguuaucaauuaa

SEQ ID NO: 456550 - RNA, 66 nt, Homo Sapiens
uuaaguuaucaacuuuagcuaguaucuucaaacuuucacuuugaaaaaugagaauuuuauauucua

SEQ ID NO: 456551 - RNA, 66 nt, Homo Sapiens
uuuuggacaaauaguuguuaccaaaauauucaaaaccacuuugaguuuacauacuaguuaccuuaa

SEQ ID NO: 456552 - RNA, 66 nt, Homo Sapiens
ucgaugauaauuggugcucccuucauccaacuggaucacuuugagauucaguuuuacaucauuuua

SEQ ID NO: 456553 - RNA, 66 nt, Homo Sapiens
uauaggaaaaacuaaguugucacccaauaucuuagacacuuugagagcaaagggggugcuguaaau

SEQ ID NO: 456554 - RNA, 66 nt, Homo Sapiens
ucucucucucucucuuuucuaagaaacaauuaugugcacuuugauacacaaccuucucuaaccaac

SEQ ID NO: 456555 - RNA, 66 nt, Homo Sapiens
aaaccucuuugaaugcugaaaggucuucccucagcucacuuugaguuuuuaaaugacauuguuuuu

SEQ ID NO: 456556 - RNA, 66 nt, Homo Sapiens
cucguccccagaggaggacuugaaugaggaaaccaacacuuugagaaaccaaaguccuuuuuccca

SEQ ID NO: 456557 - RNA, 66 nt, Homo Sapiens
auggaugaaacaggcccuugaguugggagccugcuucacuuugacuuucccacuguugcuggagac

SEQ ID NO: 456558 - RNA, 66 nt, Homo Sapiens
ugcuaauagaaaauaaugcaccguaggcagagugcucacuuugaaucacucaaccaaacaggaguu

SEQ ID NO: 456559 - RNA, 66 nt, Homo Sapiens
aaucuauuuuacgauuguagcauucguaucuguuuucacuuugagaauuuauuucauuaaauauuu

SEQ ID NO: 456560 - RNA, 66 nt, Homo Sapiens
caaauacaauucacagcacaccugugaaacgucccacacuuugaagcacuacuugaccauucucac

SEQ ID NO: 456561 - RNA, 66 nt, Homo Sapiens
auguauagauuacauaggaaaacaugagaaaucacucacuuugauuaccuaaagaacaauuugcua

SEQ ID NO: 456562 - RNA, 66 nt, Homo Sapiens
acuuaagaaucccuuaucauugugaaagagcuccuacacuuugaaacccuacaccaagaguguauc

SEQ ID NO: 456563 - RNA, 66 nt, Homo Sapiens
ugacagcauucgauuuuuuuaauacuuuucaugccucacuuugacaaucgauggagccacauuaau

SEQ ID NO: 456564 - RNA, 66 nt, Homo Sapiens
auacccauguuuugcaugcaggauugaugacugucucacuuugacuuuuuuuucuggugcuuuuuu

SEQ ID NO: 456565 - RNA, 66 nt, Homo Sapiens
auaaacuuuuuucuucagaaacacagaaacacaaaacacuuugaucaugggucucaucauucccau

SEQ ID NO: 456566 - RNA, 66 nt, Homo Sapiens
acuuucaggccagcuuuaaucaguuggaaacaguagcacuuugaaacagaaaacugaagaucucau

SEQ ID NO: 456567 - RNA, 66 nt, Homo Sapiens
ggggaggcgggaacgcgggcccgcgcgcggacuuugcacuuugaauccagaggaagaugaauuuuu

SEQ ID NO: 456568 - RNA, 66 nt, Homo Sapiens
caaaaaacaaaagccgcuaugaccggcguugccucucacuuugaaagaaagacuccguaaucuuaa

SEQ ID NO: 456569 - RNA, 66 nt, Homo Sapiens
uucccuauaacauuccuucucugccucucuauggcccacuuugaccacuaacaacaucagaauuau

SEQ ID NO: 456570 - RNA, 66 nt, Homo Sapiens
aauuguuaaucugucugauuuugucugaauuauaaacacuuugagguaccaaacauaaccaaucug

SEQ ID NO: 456571 - RNA, 66 nt, Homo Sapiens
ccugaauucuuuuucauuugagaaguaaacagauggcacuuugaaggggccucaccgagugggggc

SEQ ID NO: 456572 - RNA, 66 nt, Homo Sapiens
ccuuccucauccaccccaucccuccccaguucauugcacuuugauuagcagcggaacaaggaguca

SEQ ID NO: 456573 - RNA, 66 nt, Homo Sapiens
aaaaaacucaucacacaagaagagaaacaguaaccucacuuugaaaauuagcuccacucaagacua

SEQ ID NO: 456574 - RNA, 66 nt, Homo Sapiens
gguacccccaacaaaucuucuaagugcauuuuugaucacuuugauaacuucuuaggugauuugccu

SEQ ID NO: 456575 - RNA, 66 nt, Homo Sapiens
auauauuuccagaguuguccagcagaaagaaaguggcacuuugaagagaacuagggaaguacauau

SEQ ID NO: 456576 - RNA, 66 nt, Homo Sapiens
acacccucuuuuccuguaauuuauugcagaauacaccacuuugacuuggacagcuuucugcccccu

SEQ ID NO: 456577 - RNA, 66 nt, Homo Sapiens
uaagucccugcuaaaacauuccauuguuaaaauuugcacuuugaagguaagcuuucuaggccugac

SEQ ID NO: 456578 - RNA, 66 nt, Homo Sapiens
cauguguauauuagauaauuguguugugaugcuacucacuuugauugcaaugaugauguccaaggu

SEQ ID NO: 456579 - RNA, 66 nt, Homo Sapiens
aagcgaaaaacauggacaauuccuauucauucuuagcacuuugacaugucuuggggaaaagcuuac

SEQ ID NO: 456580 - RNA, 66 nt, Homo Sapiens
ucugagaaucaguucaaggcgacgggaggcacuuuucacuuugaugaugaccaccaaguacuaccu

SEQ ID NO: 456581 - RNA, 66 nt, Homo Sapiens
ggcugaggcgggcggaucaccacgccuguaauccaacacuuugagauuaggccaggcgccguggcu

SEQ ID NO: 456582 - RNA, 66 nt, Homo Sapiens
agagcaaagcacaagcuugcauuaagcagaggagcccacuuugagguggggagagauuaagcgcuc

SEQ ID NO: 456583 - RNA, 66 nt, Homo Sapiens
gaaagcagaaagagugaaaagcaaacaugagcaaaccacuuugacuuuguuucaguucugauuuca

SEQ ID NO: 456584 - RNA, 66 nt, Homo Sapiens
aauuacagauauauuugauaucaacauacacuauagcacuuugacuugaguauagaacuguugauu

SEQ ID NO: 456585 - RNA, 66 nt, Homo Sapiens
cgcuucaaggauauacugcacuuuuccuuaccauaccacuuugacacuuugugagauaaaacucuc

SEQ ID NO: 456586 - RNA, 66 nt, Homo Sapiens
uaagucuaucugguauuaaauuccaagccucucuggcacuuugaguuguccuacacuugagaugau

SEQ ID NO: 456587 - RNA, 66 nt, Homo Sapiens
cuuuucauaucauuucuuaauaaaacuaguuagauucacuuugacaaaccuucauuuaaaaagguu

SEQ ID NO: 456588 - RNA, 66 nt, Homo Sapiens
gaaacucaugcuucaguuuacaugcaccuaaauccucacuuugacaggccauuugcaugaaauuca

SEQ ID NO: 456589 - RNA, 66 nt, Homo Sapiens
ugcuguuaucaccacccccugggaguacuuuguaaccacuuugauacacuggaugcuacuugaaga

SEQ ID NO: 456590 - RNA, 66 nt, Homo Sapiens
caaaaacuuguauauuaacauuauaaauaaaguaagcacuuugaagaacccucuugaucuucucuu

SEQ ID NO: 456591 - RNA, 66 nt, Homo Sapiens
guuaguuuugggccagcacgggaaguguuugaaagucacuuugaaaaggauaaucauggguuagaa

SEQ ID NO: 456592 - RNA, 66 nt, Homo Sapiens
auugcuuauuugaaaacaguucuagcaugaaagucccacuuugauugauuuugacugagugagacu

SEQ ID NO: 456593 - RNA, 66 nt, Homo Sapiens
aaaugacagugaacaaagccccugcuuuuaaugacucacuuugaucguuuacuuugugugcaacua

SEQ ID NO: 456594 - RNA, 66 nt, Homo Sapiens
aucuuuguaguucaugauauauuaacucaucuauagcacuuugaguugaaaauguauuacaucaau

SEQ ID NO: 456595 - RNA, 66 nt, Homo Sapiens
aaggcugggcgcgguggcucacaccuguaaucccagcacuuugagaggaugagguaggcggaucac

SEQ ID NO: 456596 - RNA, 66 nt, Homo Sapiens
uaaaauauuguaaagcagggucucaacuuuuaaauacacuuugaacuucuucucugaauuauuaaa

SEQ ID NO: 456597 - RNA, 66 nt, Homo Sapiens
ucuaggaaguauuaaaacugugaagcuuucucagugcacuuugaaccuggaaaacaaucccaacag

SEQ ID NO: 456598 - RNA, 66 nt, Homo Sapiens
aguucuuaaacuuuuuuuuuuuuucaguuuuuuuuccacuuugaaucagaaauauaaucugcagua

SEQ ID NO: 456599 - RNA, 66 nt, Homo Sapiens
cccucagaaaccacugucauuaguuuacaaaguuagcacuuugaaguaaaacuaaaugaggaagga

SEQ ID NO: 456600 - RNA, 66 nt, Homo Sapiens
cuuuuaaaucauuccauuagccauauauagcaaacucacuuugacauuuuggaaauaacauugugc

SEQ ID NO: 456601 - RNA, 66 nt, Homo Sapiens
uuauuccaaccacuagaauacccuagucacuauucccacuuugagcauuaaccccuuugaaaagaa

SEQ ID NO: 456602 - RNA, 66 nt, Homo Sapiens
ggaggaacaacauaguuaauuuuuuucuaaccuugccacuuugagggaaggaaggguugggggaag

SEQ ID NO: 456603 - RNA, 66 nt, Homo Sapiens
uuguucagacuguauaguaaggagaaagucugguugcacuuugaagagcuugaagauuugaaagau

SEQ ID NO: 456604 - RNA, 66 nt, Homo Sapiens
cagcugucgucuuggcagcacuugucacguuggcagcacuuugagagcaagucugaguggacccac

SEQ ID NO: 456605 - RNA, 66 nt, Homo Sapiens
gagaaagauaguugcaaccucaccucccucacucaacacuuugaauacuuauuguuuggcagguca

SEQ ID NO: 456606 - RNA, 66 nt, Homo Sapiens
ggccgaggagggaggacugcugugaguggcucccagcacuuugagaugggcgugguggcucacacc

SEQ ID NO: 456607 - RNA, 66 nt, Homo Sapiens
uacuuaaagaaauucagagcagauuucuccagaaaacacuuugagaaguauaaugauguaguaaaa

SEQ ID NO: 456608 - RNA, 66 nt, Homo Sapiens
cagaaauauaaucugcaguauuuucaguuuuuuuuccacuuugaaugaguucuuaaacuuuuuuuu

SEQ ID NO: 456609 - RNA, 66 nt, Homo Sapiens
ggcugaggugguaggaucacacgccuguaaucccagcacuuugagaguggccgggcacaguggcuc

SEQ ID NO: 456610 - RNA, 66 nt, Homo Sapiens
gagcagaggcagaguauuuguccaugacuucauuugcacuuugacagucuuauuuuaaacccuguc

SEQ ID NO: 456611 - RNA, 66 nt, Homo Sapiens
aaaaucagcaucaaaacauuuaauggcuugcaguaccacuuugauaauuuggaauuuguuccaacu

SEQ ID NO: 456612 - RNA, 66 nt, Homo Sapiens
ccguggggugaggaguuggcgugccccgcuggauugcacuuugagcucacagaggcccccagcccu

SEQ ID NO: 456613 - RNA, 66 nt, Homo Sapiens
cauggguuuacuuauaaugguucaauuuauaacuuacacuuugaaccuagcagauuuugauuuugu

SEQ ID NO: 456614 - RNA, 66 nt, Homo Sapiens
ucuccucaagugaaaaacaggaguaauguuucguugcacuuugaaagaucugcuucaaggcauaac

SEQ ID NO: 456615 - RNA, 66 nt, Homo Sapiens
uuuuucaaugccgucauuuucaguuagaugauuuugcacuuugagauuaaaaugccaugucuauuu

SEQ ID NO: 456616 - RNA, 66 nt, Homo Sapiens
auuaugguaaaaacauauaaaauuuaccaucuuaaucacuuugaguguacaguucaucaguguuaa

SEQ ID NO: 456617 - RNA, 55 nt, Homo Sapiens; identical to SEQ ID NO: 456161

SEQ ID NO: 456618 - RNA, 66 nt, Homo Sapiens
gcucuucagcagaaaaucuuuguggaacacauuccacacuuugaaaucuucguggaacaaaagaua

SEQ ID NO: 456619 - RNA, 66 nt, Homo Sapiens
aggcucacaccuuaaucucaggccccuauauagucacacuuugauuuaagaaaaauggagcucuug

SEQ ID NO: 456620 - RNA, 66 nt, Homo Sapiens
ggcugaggcgggaagaucacacaccgguaaucccagcacuuugagaugggucggaugcaggggcuc

SEQ ID NO: 456621 - RNA, 66 nt, Homo Sapiens
uuuggggaucuggugggcagucacugaguuuuguuucacuuugacaguaaaacagucaucuagaau

SEQ ID NO: 456622 - RNA, 66 nt, Homo Sapiens
uuucuuuuuccucccuuagaucagaacuaauaguaucacuuugauuucuccgcaaguggcacaacu

SEQ ID NO: 456623 - RNA, 66 nt, Homo Sapiens
ggcugaggcagguggauugcaugccuguaaucccagcacuuugauauaggccacaugcgguggcuc

SEQ ID NO: 456624 - RNA, 66 nt, Homo Sapiens
guuacaaaaucuguagaccugcuuuuuaaugcaggacacuuugagucacguaggaaauagacacgu

SEQ ID NO: 456625 - RNA, 66 nt, Homo Sapiens
acauuuaugauugucccucuucuuaauucucugcaacacuuugagguucuucccccaaagccggau

SEQ ID NO: 456626 - RNA, 66 nt, Homo Sapiens
uacuagaaaauugugcuggacuaauauguaaaauuacacuuugaacuaaaucacucaaauuguucu

SEQ ID NO: 456627 - RNA, 60 nt, Homo Sapiens; identical to SEQ ID NO: 456171

SEQ ID NO: 456628 - RNA, 66 nt, Homo Sapiens
cauauaguugaaguacaaauccaacacaccugaugucacuuugagcccccacccuucuugcugucc

SEQ ID NO: 456629 - RNA, 66 nt, Homo Sapiens
auucagucuuugaacuuuaacuacugagaaaaugagcacuuugaucccuccuagcagaagauaguc

SEQ ID NO: 456630 - RNA, 66 nt, Homo Sapiens
ccauggaggauugccugugaaagaaauaaguccuuccacuuugaccauguggacuacugagcccug

SEQ ID NO: 456631 - RNA, 66 nt, Homo Sapiens
aagauuguggcaguuuuugccauuuggauacuuagacacuuugagcuaaugcagcucauuugcuac

SEQ ID NO: 456632 - RNA, 66 nt, Homo Sapiens
ucuauaaaaaauaaaauaaugugucuauaaaagaaacacuuugaagaccagauucacacuguucca

SEQ ID NO: 456633 - RNA, 66 nt, Homo Sapiens
uacauuguuuuggaaauucaugaauuucuuguaaaccacuuugagaucuaucucuacaacauuuaa

SEQ ID NO: 456634 - RNA, 66 nt, Homo Sapiens
caacuaaaaaggcuucaaacuauugaguggcugucacacuuugaggaagcagacuguuaggagcag

SEQ ID NO: 456635 - RNA, 66 nt, Homo Sapiens
guuaaaaaugaaccacauucaccaaacagaucuugccacuuugauuuuccuguuuuuacagugauc

SEQ ID NO: 456636 - RNA, 66 nt, Homo Sapiens
uggguucauuuuuuguuuugcauauaaguuuaaccacacuuugauuucugguugaaaaaucuuucu

SEQ ID NO: 456637 - RNA, 66 nt, Homo Sapiens
cuguaaauaucccagagaacaaucacuauucuuaagcacuuugaaaauauuucuauguaaauuauu

SEQ ID NO: 456638 - RNA, 66 nt, Homo Sapiens
ccuuauuucuaagaaacgccacugaggaacaggauccacuuugaacaguccgcuaaagcuaucaaa

SEQ ID NO: 456639 - RNA, 66 nt, Homo Sapiens
ucagccagauccugggguggggucuuuagguuuucucacuuugacaacccccgaauguuuuuauag

SEQ ID NO: 456640 - RNA, 66 nt, Homo Sapiens
cacaggcauuaucuauaccuggggccagauuuucugcacuuugaaauguugccuuugccuaaugua

SEQ ID NO: 456641 - RNA, 66 nt, Homo Sapiens
auuuccuuaauguuccaugguauuuucaacggaauacacuuugaaagguaaaaacaauucaaaagu

SEQ ID NO: 456642 - RNA, 66 nt, Homo Sapiens
agcuguccaggaaaugagcagagauucacaagacagcacuuugauucuauguugaguuuguuucua

SEQ ID NO: 456643 - RNA, 66 nt, Homo Sapiens
uucauuugcagugacuuuuaaggcaguacuguuuagcacuuugauauuaaaauuuugcuuauguuu

SEQ ID NO: 456644 - RNA, 66 nt, Homo Sapiens
uggauggcugaugcaucgacuugcauucccacuuaacacuuugauuagcaugaacuugccaaucaa

SEQ ID NO: 456645 - RNA, 66 nt, Homo Sapiens
uccuagagggccauuggagcuugcagcucagacccccacuuugaguuuuauuuauuuaaauaguag

SEQ ID NO: 456646 - RNA, 66 nt, Homo Sapiens
ugcagggauggggucagugguuccaccuucacaggccacuuugaaggguggauucuuugaggcccc

SEQ ID NO: 456647 - RNA, 66 nt, Homo Sapiens
gauacaugcaaaacauauagaauuuguuaaggauuucacuuugaagcagccuaauauauacuguua

SEQ ID NO: 456648 - RNA, 66 nt, Homo Sapiens
uaguuuuaaauauguuuaaauagaauuuuuaaaagccacuuugauuuuuuugaauuugguguuuuc

SEQ ID NO: 456649 - RNA, 66 nt, Homo Sapiens
ccuccuugggguugauaggaaguccucuuccagccucacuuugaguaguacuuucauacucuucua

SEQ ID NO: 456650 - RNA, 66 nt, Homo Sapiens
uugagacauuaauuuguaccucauguaauacugaaccacuuugauaauuuuccaaagagccaugug

SEQ ID NO: 456651 - RNA, 66 nt, Homo Sapiens
uuuuugcugggggagggguguaaaauuuuuugugagcacuuugagaugugccuuguaagauuguug

SEQ ID NO: 456652 - RNA, 66 nt, Homo Sapiens
uguauaaaacuuucuguguuucuaagugauuuaaugcacuuugacuaggaagaguggaauaaauau

SEQ ID NO: 456653 - RNA, 66 nt, Homo Sapiens
acuauauccgcuucuguuuuugugccacaucagaagcacuuugaccccugucuccaucuucuauag

SEQ ID NO: 456654 - RNA, 66 nt, Homo Sapiens
ccuucauggguuuuugaacauuuuaaaccaccaugucacuuugaguuguugaucauuuagguuuuu

SEQ ID NO: 456655 - RNA, 66 nt, Homo Sapiens
uucaaauauuucauuuugugcgugugaaagggaaaacacuuugacggaucguuuuugucagaugac

SEQ ID NO: 456656 - RNA, 66 nt, Homo Sapiens
uucuuuucugcagcuucgcuuuuuugcaaaugcauucacuuugacaccauauaauggaacagaagc

SEQ ID NO: 456657 - RNA, 66 nt, Homo Sapiens
uaaauaccuaagggaguguaacagucucuggaggaccacuuugagccuuuggaaguuaagguuucc

SEQ ID NO: 456658 - RNA, 66 nt, Homo Sapiens
aaauuacauuucuuuaaaccuguuuuacuacuauggcacuuugauaaaauggucaggaaccaacuu

SEQ ID NO: 456659 - RNA, 66 nt, Homo Sapiens
ucaaauuagaagacauuuauacucuuuuuucauggacacuuugaaauguguuucuguauaaagccu

SEQ ID NO: 456660 - RNA, 66 nt, Homo Sapiens
cugugccuuuagccuuuucauguuucugucucaaaacacuuugacaaagcucaccaacuuuaaaau

SEQ ID NO: 456661 - RNA, 66 nt, Homo Sapiens
ugucuugguuuuauuuuguuccauguuuaaaucauucacuuugauuugagugggaaaagccugaag

SEQ ID NO: 456662 - RNA, 66 nt, Homo Sapiens
uaauguuauuuucuucuaagugaaauuucuagccugcacuuugaugucauguguucccuuugucuu

SEQ ID NO: 456663 - RNA, 66 nt, Homo Sapiens
cagauccucaccagggugaaugacagaguugccaggcacuuugagucucagucugaugacccacac

SEQ ID NO: 456664 - RNA, 66 nt, Homo Sapiens
guacauuuauuuauuuaguugaagauucacugaucccacuuugaaauacaucuuuuuaccuaagca

SEQ ID NO: 456665 - RNA, 66 nt, Homo Sapiens
acaaaaaagaaaucuuauuuuucauugcauggaaaacacuuugaagcaguucaacacagcaagugc

SEQ ID NO: 456666 - RNA, 66 nt, Homo Sapiens
ugggcaauggcuugagcccaacacuuguaaucccagcacuuugaggcugguugggugugguggcuc

SEQ ID NO: 456667 - RNA, 66 nt, Homo Sapiens
cacaccuuugucugcuuggugaaugguacugauuugcacuuugauuaugcagaauugcagagugua

SEQ ID NO: 456668 - RNA, 66 nt, Homo Sapiens
uuugggaaaacucuuuaucuaucuuucccucuuuuucacuuugagcgguugggcucuaagcuagau

SEQ ID NO: 456669 - RNA, 66 nt, Homo Sapiens
aauguaaaccagugaaaaguuguugguucagaauggcacuuugaauuuccucuauaaaugaaaggg

SEQ ID NO: 456670 - RNA, 66 nt, Homo Sapiens
cuacucacugguuggaagaauaaaacucacccaucacacuuugagaucgaaacaaagaagacuaug

SEQ ID NO: 456671 - RNA, 66 nt, Homo Sapiens
auauugguguucaagacuauaucuaauuccucugaucacuuugagaaacaaacuuuuauuaaaugu

SEQ ID NO: 456672 - RNA, 66 nt, Homo Sapiens
ucccccauaccuacuauuuuuuuauaucccgauuugcacuuugagaauacaucuaaggucaucuuu

SEQ ID NO: 456673 - RNA, 66 nt, Homo Sapiens
gagccaugcaaucugggaagcacaggaauaaguagacacuuugaaaauggauuugaauguucucau

SEQ ID NO: 456674 - RNA, 66 nt, Homo Sapiens
gagacuguaauugguuucuuagaccaccuaagaugccacuuugaauucucuaagacccuggagaau

SEQ ID NO: 456675 - RNA, 66 nt, Homo Sapiens
cgaugagaaaagucccaggcuaauggcagaaauuugcacuuugaacauguguguuuuuguguugug

SEQ ID NO: 456676 - RNA, 66 nt, Homo Sapiens
auuugguuccugcuccauggucgggccucugacagccacuuugaauaaaccagacaccgcacaugu

SEQ ID NO: 456677 - RNA, 66 nt, Homo Sapiens
gaaaggaaacgcagggagacugugugccuggguguccacuuugaucacaugugaguguccacuuuu

SEQ ID NO: 456678 - RNA, 66 nt, Homo Sapiens
uugauaaagauaguugaugguuuauuuuaaaagaugcacuuugaguugcaauauguuauuuuuaua

SEQ ID NO: 456679 - RNA, 66 nt, Homo Sapiens
cuaggagugcuauucaguguuucuuuuccugauaaacacuuugaauauuuuuuuuguguuuuuguu

SEQ ID NO: 456680 - RNA, 66 nt, Homo Sapiens
aggggguaggaggggaagaaaagcugcucuuguuagcacuuugauguguuggacaguacaaaaaca

SEQ ID NO: 456681 - RNA, 66 nt, Homo Sapiens
ucaaacuaugcacugugaagcuuuuugcccauauugcacuuugauuuaucgagagcaccaccuucu

SEQ ID NO: 456682 - RNA, 66 nt, Homo Sapiens
aagaaaagccaaauucuuuugcuuacuauggccagucacuuugacaucuacaugggaagauguugu

SEQ ID NO: 456683 - RNA, 66 nt, Homo Sapiens
caccaaucuggauugagcggagcagacccugaaggacacuuugagagcuuuuaccaucuccagcuc

SEQ ID NO: 456684 - RNA, 66 nt, Homo Sapiens
ggcugcggcggguggaucacaugccuguaaucccagcacuuugagaugggcugggugcgguggcuc

SEQ ID NO: 456685 - RNA, 66 nt, Homo Sapiens
aauuaauuuuaauuaacuuaaauuuguuuuuugaagcacuuugagaaacaaaaaggagucagauuu

SEQ ID NO: 456686 - RNA, 66 nt, Homo Sapiens
ugaaggacaagaagacgcauagagcaggugagcauccacuuugacaucuugagcucugcaaagauc

SEQ ID NO: 456687 - RNA, 66 nt, Homo Sapiens
cuugaccacagggaccaagaucagugggucuuuuggcacuuugaaccucaacagucucagguucga

SEQ ID NO: 456688 - RNA, 66 nt, Homo Sapiens
cuugaaugugucacuuuacuaacccuguuuguaguucacuuugacucuuaacacacccacugagaa

SEQ ID NO: 456689 - RNA, 66 nt, Homo Sapiens
ggcugaggcagggcagauugaugccuguaaucccagcacuuugagacuggcccgaugcaguggcuc

SEQ ID NO: 456690 - RNA, 66 nt, Homo Sapiens
cugaggccauggcaggacagacaucugcagggaacccacuuugaggcagaugaagagggaaagcug

SEQ ID NO: 456691 - RNA, 66 nt, Homo Sapiens
uucuacauguaauuaccuucccaccacauucccauucacuuugauuuuucuucuuuuauguucaca

SEQ ID NO: 456692 - RNA, 66 nt, Homo Sapiens
auagaaaaaccacuuuuuaaauacuuguuucuuuagcacuuugaaggaccugaaguuucuuuuuga

SEQ ID NO: 456693 - RNA, 66 nt, Homo Sapiens
agaauucuuuuucucacuauauuuucuaaaaugggucacuuugaaacaauacagagaacaucagaa

SEQ ID NO: 456694 - RNA, 66 nt, Homo Sapiens
uuuaaaguacucuguccauaaaaucauagacucugacacuuugauuguauuuucacaugaaacuac

SEQ ID NO: 456695 - RNA, 66 nt, Homo Sapiens
cuguggucccuggagggugggggucuccaccacagccacuuugagucaucacccuacccaggcggu

SEQ ID NO: 456696 - RNA, 66 nt, Homo Sapiens
aguuuagcauuguuauaaaccauuccauucgaaaagcacuuugaaaaauuguucccgagcgauaga

SEQ ID NO: 456697 - RNA, 66 nt, Homo Sapiens
agcuucauaaugauccugucuucaucauaucauauucacuuugagaaucgguuugacuuugcuuuc

SEQ ID NO: 456698 - RNA, 66 nt, Homo Sapiens
aaauaagaggugaugacauggauauacaacagaaaacacuuugaguugaaaguaaacacaagcugg

SEQ ID NO: 456699 - RNA, 66 nt, Homo Sapiens
cucuaaaguggagcacuuacaccaggcucuaagauucacuuugagguggaacuuaaaaccagugua

SEQ ID NO: 456700 - RNA, 66 nt, Homo Sapiens
gaauuuggcagaugcaguuaagguuccuaaacaacucacuuugagacuguugaaagggccugaccu

SEQ ID NO: 456701 - RNA, 66 nt, Homo Sapiens
ccaguccuccucaggagaaggggaagggaaggaggccacuuugagagggcugaagggagggccuug

SEQ ID NO: 456702 - RNA, 66 nt, Homo Sapiens
uaaaaauguuuauaugauaaugucuguaaacagcaucacuuugauuacaauagauguaguguugua

SEQ ID NO: 456703 - RNA, 66 nt, Homo Sapiens
ggauaaauauugcaaguggaugaguuggaaauuaugcacuuugaaaaacauucacuuuguuuaagc

SEQ ID NO: 456704 - RNA, 66 nt, Homo Sapiens
uaagguucgaauucaaacccagccagguuaugccaacacuuugagggaugcagcucccaaaaugua

SEQ ID NO: 456705 - RNA, 66 nt, Homo Sapiens
uucacgguuccuucauaaaacuauaauaauauccgacacuuugauagaaaaaaauucaaagcugug

SEQ ID NO: 456706 - RNA, 66 nt, Homo Sapiens
auggagggaagaggauuuuuauaagagaaauuucugcacuuugaaacuguccucuaagagaauaag

SEQ ID NO: 456707 - RNA, 66 nt, Homo Sapiens
cauuuccuccugaaguguucuguuggcaauaaaaugcacuuugacuguuuguugucacugaugccc

SEQ ID NO: 456708 - RNA, 66 nt, Homo Sapiens
ccaaaaauacccaauucuaagugguugacagauguucacuuugaagugugaaguuuuaaaaauacg

SEQ ID NO: 456709 - RNA, 66 nt, Homo Sapiens
accauacuuguccugaaguaguuggucccuggaucacacuuugagacucguggacuuccucagagg

SEQ ID NO: 456710 - RNA, 66 nt, Homo Sapiens
ccauugggucauugaauauaugucacuuuccucuuccacuuugauauauaguuaucaaucucuagu

SEQ ID NO: 456711 - RNA, 66 nt, Homo Sapiens
aauauauaaggaauuguugaaaacaugcaacaaaagcacuuugaaagccauguauagcagaaaaug

SEQ ID NO: 456712 - RNA, 66 nt, Homo Sapiens
ucacuggcuguaauuuuuuuucuugaauaaaggucccacuuugaagcagcacagauuucaccucug

SEQ ID NO: 456713 - RNA, 66 nt, Homo Sapiens
gaaaacugccauuuuguauuaagaagcaaauauuuucacuuugaaacaaggcacugaggaguauca

SEQ ID NO: 456714 - RNA, 66 nt, Homo Sapiens
gagauaaauaaucaaaacuguuaucucaaaucaaaucacuuugaugccgagccugagauuguguga

SEQ ID NO: 456715 - RNA, 66 nt, Homo Sapiens
gaccccucccacuccuggccucagcuacuucuccugcacuuugaaacaggcgccuggagcaagugc

SEQ ID NO: 456716 - RNA, 66 nt, Homo Sapiens
gaaaagaauguccacauacacauuuaucucugauggcacuuugagggcagcaaguuaaauuuuugu

SEQ ID NO: 456717 - RNA, 66 nt, Homo Sapiens
cuuaacauuaucagucaacuuaucggcuuucuuuuucacuuugacuaaagcacuguugaauauggg

SEQ ID NO: 456718 - RNA, 66 nt, Homo Sapiens
uuugaauaggaaguuguaguguucucuugaaacaagcacuuugaaaagguaguaggugagaaaugu

SEQ ID NO: 456719 - RNA, 66 nt, Homo Sapiens
augaguuacuccuugucaucuaaauagacuuacuugcacuuugaagcauugccuuuuuugugguug

SEQ ID NO: 456720 - RNA, 66 nt, Homo Sapiens
acauuuaugaugcagcagauagucuguuuugggaaacacuuugaggcauuuuccaauuaauuauca

SEQ ID NO: 456721 - RNA, 66 nt, Homo Sapiens
ucaggaguuugagaccagccgccaaggcaggcagaucacuuugagguaauuccagcacuuugggag

SEQ ID NO: 456722 - RNA, 66 nt, Homo Sapiens
cgguuaaagcucauagcuguucucucacuugucuuccacuuugaacgccgaaauuuuuaugagaua

SEQ ID NO: 456723 - RNA, 66 nt, Homo Sapiens
cuggucuugaaauuccuagucauaaugcauaacuuucacuuugacuccuucucaaaaugcuugccu

SEQ ID NO: 456724 - RNA, 66 nt, Homo Sapiens
uuggcugagcucgguggcucaugccuguaaucccaacacuuugagaagcugaggugggaggagugc

SEQ ID NO: 456725 - RNA, 66 nt, Homo Sapiens
uugaagugagggaagaaugaguagucaggaacuggucacuuugaaugugggagggaagauauucac

SEQ ID NO: 456726 - RNA, 66 nt, Homo Sapiens
acuccuggcccagugcuuuuucuuacuuuguagcuacacuuugaaguaagauucaaacuguuaucc

SEQ ID NO: 456727 - RNA, 66 nt, Homo Sapiens
gguuccuuuuaaguggacucaaaggagcauugcagucacuuugacaaaaacaagagacugcuugac

SEQ ID NO: 456728 - RNA, 66 nt, Homo Sapiens
auaaaaaguuacuaaugcuguguuaaaugcuuuuaucacuuugagauguuuauacuguaaaguaua

SEQ ID NO: 456729 - RNA, 64 nt, Homo Sapiens; identical to SEQ ID NO: 456273

SEQ ID NO: 456730 - RNA, 66 nt, Homo Sapiens
caucgucggcauuuucguuuagaccuuuaauucuagcacuuugaauucgagcaggucagcgucuuc

SEQ ID NO: 456731 - RNA, 66 nt, Homo Sapiens
uccuaaaugucagcuguugucacacaguagcuccaacacuuugagcauuuuuaagggaguggccuc

SEQ ID NO: 456732 - RNA, 66 nt, Homo Sapiens
aaaagagaggaacaagcagaagaugccugcagguaucacuuugauccuaugugggagcgacugaaa

SEQ ID NO: 456733 - RNA, 66 nt, Homo Sapiens
uaauauuucuauugcaaaagucuauccgauuugaugcacuuugaauauugagauauuuugcacgga

SEQ ID NO: 456734 - RNA, 66 nt, Homo Sapiens
aauccucagccgcugguauuuucuaaggggucucuucacuuugaugagugacaugaacaccguguc

SEQ ID NO: 456735 - RNA, 66 nt, Homo Sapiens
cuauuuggguuaugaugggguuagucccaucucugccacuuugaugcuuugaugcuugcuuuaacu

SEQ ID NO: 456736 - RNA, 66 nt, Homo Sapiens
auggaagggauggaaacaggucuugcacugauaaugcacuuugaagcccugagauccagcccuacu

SEQ ID NO: 456737 - RNA, 66 nt, Homo Sapiens
agggaggcacagggcuugggugggcugcaggaugcccacuuugaggguccuucggccuggcucagc

SEQ ID NO: 456738 - RNA, 66 nt, Homo Sapiens
uaaauagguuuucuauugggguaaaugaauuacaugcacuuugaaggagcguuuaugagcuaccgg

SEQ ID NO: 456739 - RNA, 66 nt, Homo Sapiens
gacauaggaauugacuucuuuuccuugaauggaaaacacuuugaaauaauaauaaacauuguuaua

SEQ ID NO: 456740 - RNA, 66 nt, Homo Sapiens
ucucuaauccuuaggaguuguuuuaaaagacauaaucacuuugaacuuccaugaaaccugucuucc

SEQ ID NO: 456741 - RNA, 66 nt, Homo Sapiens
cuucugaggacgcaacaagccugguucccuagagcucacuuugacccucaauauguucauaauuuc

SEQ ID NO: 456742 - RNA, 66 nt, Homo Sapiens
uugacuuuuuuauuuuauguuaauguuuucaguucucacuuugaggcacauuuacaucaaugcuuu

SEQ ID NO: 456743 - RNA, 66 nt, Homo Sapiens
cagcugugucugccaaacacauuuacccuuuggccccacuuugaagggcaagaaauggcgucugcu

SEQ ID NO: 456744 - RNA, 66 nt, Homo Sapiens
caccucuuuaaaaacucacuuacguuuguccuuuuucacuuugaaaaguuggaaggaucugcugag

SEQ ID NO: 456745 - RNA, 66 nt, Homo Sapiens
uuagguuuguuuuuguuuuuccacuuaucuugaguucacuuugauguuaaaucuauugcuacuuca

SEQ ID NO: 456746 - RNA, 66 nt, Homo Sapiens
gaggggcaagcaugauauguuguuagaacaggagcccacuuugaagguauaacagguuccugccag

SEQ ID NO: 456747 - RNA, 66 nt, Homo Sapiens
aauuugcucaaaguauagaaacagcccaccugugcccacuuugaccauuggugaggauagauauaa

SEQ ID NO: 456748 - RNA, 66 nt, Homo Sapiens
uccgauccugugguacuugaauauccaaaaacccugcacuuugaacaaucagcuguugcuaucugg

SEQ ID NO: 456749 - RNA, 66 nt, Homo Sapiens
aacaaccaugaacccaccucacggaagcuuuuuuugcacuuugaacagaagucauugcaguugggg

SEQ ID NO: 456750 - RNA, 66 nt, Homo Sapiens
uaauaauaaacauuguuauauuccuugaauggaaaacacuuugaaagacauaggaauugacuucuu

SEQ ID NO: 456751 - RNA, 66 nt, Homo Sapiens
uucaugggaugguccuaacaacagaaaaaaaccuggcacuuugauugauuucuccagucaaagcuc

SEQ ID NO: 456752 - RNA, 66 nt, Homo Sapiens
ggccugaggucggcggacugaugccuguaaucccagcacuuugagacaggccgggucugguggcuc

SEQ ID NO: 456753 - RNA, 66 nt, Homo Sapiens
ugagcaaaugguuuaauuuuuucauuauaacgugaucacuuugacuagcuguuacaaauggaacau

SEQ ID NO: 456754 - RNA, 66 nt, Homo Sapiens
ggauggagaugcauuuacaaaaccggaugcuguucacacuuugacuggccuaacuuucaaugaggg

SEQ ID NO: 456755 - RNA, 66 nt, Homo Sapiens
caagcaggaggcucugccuagacccauagggcuagacacuuugaggagccccucccuccauggagg

SEQ ID NO: 456756 - RNA, 66 nt, Homo Sapiens
uuuucauuuuuugaaguugacauaaacuauugccuacacuuugaaaaggcaagauauucauucauu

SEQ ID NO: 456757 - RNA, 66 nt, Homo Sapiens
ucuccaaggccuccccuauguacauuucagugagcucacuuugauuuuuaaucccaccacaagcac

SEQ ID NO: 456758 - RNA, 66 nt, Homo Sapiens
ugaggaagcagacccuucacaagcaaaaucagccagcacuuugaucacggacuucccagccucuag

SEQ ID NO: 456759 - RNA, 66 nt, Homo Sapiens
gacaccguuucuugaaacaaagaugguuguauuccucacuuugauguuguuuugcaagauguuugu

SEQ ID NO: 456760 - RNA, 66 nt, Homo Sapiens
gacuugcagcccaccugccacccaggacgggcccugcacuuugaauaggcuuuccauuuuguuuug

SEQ ID NO: 456761 - RNA, 66 nt, Homo Sapiens
cuuugaauaggcuuuccauuuuguuuuggagguucucacuuugaaccuucuuguuuacagauuuuu

SEQ ID NO: 456762 - RNA, 66 nt, Homo Sapiens
uauauuaaauauacugaguugcccguuuugaaaaugcacuuugaauaaucucaaaaagauguacaa

SEQ ID NO: 456763 - RNA, 66 nt, Homo Sapiens
uucucucuucucucgucugagcccccaggccuuuuccacuuugagggaggugcuucgaagaauguu

SEQ ID NO: 456764 - RNA, 66 nt, Homo Sapiens
cgagcagguucuacccucucugcuaagggccuagcacacuuugaugagguuccuggacgugagacc

SEQ ID NO: 456765 - RNA, 66 nt, Homo Sapiens
gcaagguugggcuggugcucacagcuguaaucccagcacuuugagguuggcugggaguucaagacc

SEQ ID NO: 456766 - RNA, 66 nt, Homo Sapiens
augaaucuggagucugcuuaagauccccuuucccaacacuuugaaguaugauaauguacaggucac

SEQ ID NO: 456767 - RNA, 66 nt, Homo Sapiens
cugcuggaaaauuuuaucagucuguauauacauguacacuuugaucgcauuagaucucuaauaaag

SEQ ID NO: 456768 - RNA, 66 nt, Homo Sapiens
auaacccgccugucugccccauaaaugagcugcugccacuuugacuaaguaucuauuuuuggcuaa

SEQ ID NO: 456769 - RNA, 66 nt, Homo Sapiens
ugggcaaaucuuacuuggcaaagacgcaaacacuuucacuuugagcggcugaggauuccggauacc

SEQ ID NO: 456770 - RNA, 66 nt, Homo Sapiens
uguaaugagcacucuacagaugaagaaagcugggagcacuuugaacuugaaaaucauuucucuuag

SEQ ID NO: 456771 - RNA, 66 nt, Homo Sapiens
acccgggcugggcucuacuaccuguacugucaggugcacuuugaugaggggaaggcugucuaccug

SEQ ID NO: 456772 - RNA, 66 nt, Homo Sapiens
uuuuccaaauaaauuacucauccuuaaaguuuacuccacuuugacaaaagauacgcccuucucccu

SEQ ID NO: 456773 - RNA, 66 nt, Homo Sapiens
uggugaugacuuagggcuucccaucuguguacaucccacuuugaaucuugaucgugacaagaaaua

SEQ ID NO: 456774 - RNA, 66 nt, Homo Sapiens
cuguuucuccguccucuccuaucacccccaaacacucacuuugaaugcugcaugaaucucgugggg

SEQ ID NO: 456775 - RNA, 66 nt, Homo Sapiens
gaccucagaucagacagagguaaguguauuguuucucacuuugauuagggcuuuuuguuacuguuu

SEQ ID NO: 456776 - RNA, 66 nt, Homo Sapiens
uagcugcagauaggcauggucucagguaugaacagacacuuugaaacgacuuuaggucuuucuuuu

SEQ ID NO: 456777 - RNA, 66 nt, Homo Sapiens
cucguccaccuacaaaucaggaacagaaagucuguccacuuugaaaauaccuuuccaggcagcucc

SEQ ID NO: 456778 - RNA, 66 nt, Homo Sapiens
ggacccacccuuggaaagcuucuggucuggggggaccacuuugaucccccaaguguuucuugagca

SEQ ID NO: 456779 - RNA, 66 nt, Homo Sapiens
cccaggcuggagugcagugguguuaagacagagucucacuuugacaaaauaugauuuuuuuguugu

SEQ ID NO: 456780 - RNA, 66 nt, Homo Sapiens
gggucucuaccuccccaucacagccucagaccauggcacuuugaggaucugcuuggccaauuaguu

SEQ ID NO: 456781 - RNA, 66 nt, Homo Sapiens
cacuccucaaaaaaagaacugucuagugcagguggacacuuugaacccugcaaaaacaccaauggg

SEQ ID NO: 456782 - RNA, 66 nt, Homo Sapiens
ucuccacugaaauuuccuugaaacaaugcaacauuucacuuugauugagagucucacuucuaaaug

SEQ ID NO: 456783 - RNA, 66 nt, Homo Sapiens
gauauuguaauuuucaaaugcaccuguaaacuguaucacuuugacuaguuccagauaguuucauuu

SEQ ID NO: 456784 - RNA, 66 nt, Homo Sapiens
ccuccucgguuuauggagggaaaccagcacugucagcacuuugagcggagaaggagaaaugacugg

SEQ ID NO: 456785 - RNA, 66 nt, Homo Sapiens
ggguaggaggagggagaaacuuaacugcugugaacucacuuugagguguaggaauuuauuuuuucu

SEQ ID NO: 456786 - RNA, 66 nt, Homo Sapiens
ggaaguugucauccguaaaauaauuucuaaaaaagccacuuugaauaguuucuugcuucuccuuuu

SEQ ID NO: 456787 - RNA, 66 nt, Homo Sapiens
cugcugaaggacccuacgcucgguggccuggcaccucacuuugagaagagugagcacacuggcuuu

SEQ ID NO: 456788 - RNA, 66 nt, Homo Sapiens
ggaauuacuuuugaacuguaaucuuucagauuacaccacuuugaaaacaaguuuuaacaguagggu

SEQ ID NO: 456789 - RNA, 66 nt, Homo Sapiens
cuuuaucuugcccuuuucauucuaccaacagaucugcacuuugaagucaaugguaaauuacuccag

SEQ ID NO: 456790 - RNA, 66 nt, Homo Sapiens
cccugaacccauuuuccuccccugucccagccuucccacuuugacagacacuuuuaacuguguucc

SEQ ID NO: 456791 - RNA, 66 nt, Homo Sapiens
aaauggauagcuucuguguuaauaauugaauccuuacacuuugagagaccacaaacuaaaucauaa

SEQ ID NO: 456792 - RNA, 66 nt, Homo Sapiens
ggcagaugaaagucuagagacauaaaacagggaugucacuuugaggcuuagaggucgguaauuuaa

SEQ ID NO: 456793 - RNA, 66 nt, Homo Sapiens
uggagaauuggugcuaguugguguguuuuccucacacacuuugauuuguuaaagaggauugcacga

SEQ ID NO: 456794 - RNA, 66 nt, Homo Sapiens
uccacucuccauccccuuucccuuccacuuuggguucacuuugaauuuucuccguuuuuuggggca

SEQ ID NO: 456795 - RNA, 66 nt, Homo Sapiens
gagcacaggaccucuguaagcugcuuguguauuguccacuuugacgaucagucauucgguccguug

SEQ ID NO: 456796 - RNA, 66 nt, Homo Sapiens
gaggccauuugguuccugggagaauaggcagccccacacuuugaagaauacagaccccaguaucua

SEQ ID NO: 456797 - RNA, 66 nt, Homo Sapiens
ccaucuccauggugaugcagucucuggguugucauucacuuugagagcccgaggggugggagggag

SEQ ID NO: 456798 - RNA, 66 nt, Homo Sapiens
agggucgggugcgguggcucaugccuauaauccuagcacuuugagaggccaaggugggcugaucac

SEQ ID NO: 456799 - RNA, 66 nt, Homo Sapiens
aguagggggacccugaauuugcccauccaccugggucacuuugagaguugugcaggggggcuggga

SEQ ID NO: 456800 - RNA, 66 nt, Homo Sapiens
uaggugguccuguccaggcuccugcagcgccccccucacuuugacacuggacuaggaugcagccuc

SEQ ID NO: 456801 - RNA, 66 nt, Homo Sapiens
agggcccggagcgguggcucacaccuguaaucccagcacuuugagaggccaaggagggaggaucgc

SEQ ID NO: 456802 - RNA, 66 nt, Homo Sapiens
accauuuuuuaucuuucaucuuaccuguaauccuagcacuuugagaccacuaaggcagguggauca

SEQ ID NO: 456803 - RNA, 66 nt, Homo Sapiens
aaauauauuguacagaaguaaaaauaaucauguauucacuuugaacuccucaaagccuuuuuuauu

SEQ ID NO: 456804 - RNA, 66 nt, Homo Sapiens
auucucuucaguacaaguuugaugaucguucagccacacuuugaggcacucaugaucucuuuauca

SEQ ID NO: 456805 - RNA, 66 nt, Homo Sapiens
auucucuucaguacaaguuuaaugauuguucagccacacuuugaggcacucaugaucucuuuauca

SEQ ID NO: 456806 - RNA, 66 nt, Homo Sapiens
cugggaacuggguauaccucauguguguguaacaaacacuuugaccucacacacaggcauggaugc

SEQ ID NO: 456807 - RNA, 66 nt, Homo Sapiens
uggugaauuucgugguauguaugcuauugaauuggacacuuugaaacgacacugugagugcacuaa

SEQ ID NO: 456808 - RNA, 66 nt, Homo Sapiens
ggccaaggcgggcggaucacaccccugucaucccagcacuuugagaaaggccaggugcagugucuc

SEQ ID NO: 456809 - RNA, 66 nt, Homo Sapiens
cccauuugggaugagcccuccuguuaguaaaaauggcacuuugauuaagucuuugaguuuuagagu

SEQ ID NO: 456810 - RNA, 66 nt, Homo Sapiens
caucgugucuaugguucauugcgaguuugaagaugacacuuugagggauuauacuuucaauucaga

SEQ ID NO: 456811 - RNA, 66 nt, Homo Sapiens
ggccaagacugguaggucacacgccugcaaugccagcacuuugagaugggcugggcacuguggcuc

SEQ ID NO: 456812 - RNA, 66 nt, Homo Sapiens
ggcaaagacagguaggucacaugccuguaauuccagcacuuugagaugcacugggggccauggcuc

SEQ ID NO: 456813 - RNA, 66 nt, Homo Sapiens
aauguuuguagauuugaagguugcacauguuuuuaucacuuugaucauauggcuuguaucucuuau

SEQ ID NO: 456814 - RNA, 66 nt, Homo Sapiens
ggccaagacagguaggucacacaccuguaaucccagcacuuugagaugggccaggcguggugucuc

SEQ ID NO: 456815 - RNA, 66 nt, Homo Sapiens
ugaaaaagaaaucuuuuguaaaucauucuacuuuugcacuuugaaagaaaggcguuaaucauaaag

SEQ ID NO: 456816 - RNA, 66 nt, Homo Sapiens
ucauuuuuuuaaauuugaaauauacuuuaccugauccacuuugauuguauacuauauucuuuguua

SEQ ID NO: 456817 - RNA, 66 nt, Homo Sapiens
cuagcuuuucaaacaagaaugucccuuuuccuaagucacuuugaggugucucaaucugaucugagu

SEQ ID NO: 456818 - RNA, 66 nt, Homo Sapiens
aaagauggggacaaggacuaagagucagaauguugacacuuugaugaaauggaguagagaaaugca

SEQ ID NO: 456819 - RNA, 66 nt, Homo Sapiens
agguuaguagugaaauucauucuucaauaaauaaaacacuuugaaacuccggaggaccacaucuuu

SEQ ID NO: 456820 - RNA, 66 nt, Homo Sapiens
cucuacauuuuuaauuuauuaaacuugcugugaaaacacuuugauuuucuaagaggaagguacuuu

SEQ ID NO: 456821 - RNA, 66 nt, Homo Sapiens
uuaaguuuagauugcuccauuauuaacugauuaaugcacuuugaaguucucuggaauuaauuauuu

SEQ ID NO: 456822 - RNA, 66 nt, Homo Sapiens
ggugugauagccccagccaggucacaccuggccucacacuuugagcugagacuugaaaacgaugcu

SEQ ID NO: 456823 - RNA, 66 nt, Homo Sapiens
ugucucaccccucauccuuuuacuuuuugccccuuccacuuugaguaccaaauccacaagccauuu

SEQ ID NO: 456824 - RNA, 66 nt, Homo Sapiens
uaaucaucaccacaccgugagcagaucugaaaggcacacuuugauuuuuuuaaggauaagaaccac

SEQ ID NO: 456825 - RNA, 66 nt, Homo Sapiens
cagaucccaucuggaaaucauaauaaagacauaugccacuuugacaaaccugacuaguccuuacua

SEQ ID NO: 456826 - RNA, 66 nt, Homo Sapiens
cauguagaauugucaacacgagagaucacaguggagcacuuugaaagaccgucgguugugugcacg

SEQ ID NO: 456827 - RNA, 66 nt, Homo Sapiens
uguuaugggcccagcuuuggggggccagucccgaugcacuuugagggguguuggagaggggacucc

SEQ ID NO: 456828 - RNA, 66 nt, Homo Sapiens
cuacccccugccgagagaagcuugugacaaccaaagcacuuugacagggaaccuaggugucugggu

SEQ ID NO: 456829 - RNA, 66 nt, Homo Sapiens
ugcuuccuaacagcucuguucccacccuccaaucugcacuuugauucugccuccccacugcucugc

SEQ ID NO: 456830 - RNA, 66 nt, Homo Sapiens
cuugcuaguagguccuuugagaagacaguugcccaacacuuugacaguucuuucuggagccugcaa

SEQ ID NO: 456831 - RNA, 66 nt, Homo Sapiens
uaauccuuuggcugugggcuuccucccacccugccccacuuugauuauauucaaucccaucccccu

SEQ ID NO: 456832 - RNA, 66 nt, Homo Sapiens
ccuuugcggucaugucugugcugcuuaaaguggggucacuuugauaaaaggaaaggucuuuuuuca

SEQ ID NO: 456833 - RNA, 66 nt, Homo Sapiens
acagguaagaguguguguguguguguguguguguaacacuuugacaauacuaaacucucauaagca

SEQ ID NO: 456834 - RNA, 66 nt, Homo Sapiens
aucauucagugcauuguuuacauauucaaaguggugcacuuugaaggaagcacaugugcaccuuuc

SEQ ID NO: 456835 - RNA, 66 nt, Homo Sapiens
agugaucaacccacucuuguuauggguggucucugucacuuugaaugccaggcuggcuucucgucu

SEQ ID NO: 456836 - RNA, 66 nt, Homo Sapiens
acauagaugucuguaaccaauaauguagcaguucugcacuuugacacaagguguaacuagaccauu

SEQ ID NO: 456837 - RNA, 65 nt, Homo Sapiens
ccugaaagcugauagucgcguccugaauugcuccugcacuuugaccauuuccuggugucugcugu

SEQ ID NO: 456838 - RNA, 66 nt, Homo Sapiens
cagguuugaacuugacaauucuagcagugacaaguucacuuugaaucacuacgguuguguuguuuu

SEQ ID NO: 456839 - RNA, 66 nt, Homo Sapiens
ucguacugucuuucaccuuuucaaucuaagucaguccacuuugacuaagggaaaauucuauacaac

SEQ ID NO: 456840 - RNA, 66 nt, Homo Sapiens
aaugaggccuguacaaggcuuuucucaauaaauuaucacuuugagacuuuugacguagaaauuuuu

SEQ ID NO: 456841 - RNA, 66 nt, Homo Sapiens
uauacuggcugaauaucagugcuguuuguaauuuuucacuuugagaaccaacauuaauuccauaug

SEQ ID NO: 456842 - RNA, 66 nt, Homo Sapiens
uccgugcaguggcccugccacagcccucccucggcacacuuugacccuuuguaggauuggaauuag

SEQ ID NO: 456843 - RNA, 64 nt, Homo Sapiens
ugucaucaguguuuuaaacagaauaaagauuccaaacacuuugaauagagaaccaagaguuauu

SEQ ID NO: 456844 - RNA, 66 nt, Homo Sapiens
caucuucccacucgguagacaggcuggccucucccucacuuugagacuuuggcaacuccugggcca

SEQ ID NO: 456845 - RNA, 66 nt, Homo Sapiens
acaggaacucgccugacccugcugccaccuccugugcacuuugagcaaugcccccugggaucaccc

SEQ ID NO: 456846 - RNA, 66 nt, Homo Sapiens
uacuucauagcaaucuuugcccugaauuuaggcagucacuuugagauccaucagccuaaaacaaag

SEQ ID NO: 456847 - RNA, 66 nt, Homo Sapiens
ucucagcccaggguccucgcucacucccucacuccccacuuugaagccaucucuguucugcaggug

SEQ ID NO: 456848 - RNA, 64 nt, Homo Sapiens
cuucccuuagccuuuguucuagaaaauaaacuugugcacuuugaccucuguccccgagauguca

SEQ ID NO: 456849 - RNA, 66 nt, Homo Sapiens
ccuuugagccguuuggagggcccgucuuggcuuauccacuuugacuaccccugguccugucuccag

SEQ ID NO: 456850 - RNA, 66 nt, Homo Sapiens
ucccccacccccuccaggucucuuacuaaaacgcuccacuuugagcaguuuuuguuaacgagcgug

SEQ ID NO: 456851 - RNA, 66 nt, Homo Sapiens
cacuuugcaggacuuauucuugagguagcagugggucacuuugauccaggucacaccaucugggcc

SEQ ID NO: 456852 - RNA, 66 nt, Homo Sapiens
ugugcuuguaaauacacagugaaauugucuuuauaucacuuugacagaggagaagauugagggagg

SEQ ID NO: 456853 - RNA, 66 nt, Homo Sapiens
auuaauuugcuuaauucugagccauuaauccugcuacacuuugaaugauacauuaauucagacuaa

SEQ ID NO: 456854 - RNA, 66 nt, Homo Sapiens
aaagaugagcauuguccaccacuaaaaugccucugccacuuugaauucugugcuaauuuuguggcc

SEQ ID NO: 456855 - RNA, 66 nt, Homo Sapiens
augcgcaaugggcuggauuauaaugagcuggccaugcacuuugaccgccuugugcgaaaacaccac

SEQ ID NO: 456856 - RNA, 66 nt, Homo Sapiens
uuggguuucuacuucuuucaaggacucaggaaauuucacuuugaacugaggccaagugagcuguua

SEQ ID NO: 456857 - RNA, 66 nt, Homo Sapiens
ggaagaggcugccuggggcugggccagcccgcugugcacuuugaccccaguuccuugccagcacgg

SEQ ID NO: 456858 - RNA, 66 nt, Homo Sapiens
uucaaugcacaaggggaaauuuggcuugcaauucaucacuuugaaaagguuagucauuaaauuaau

SEQ ID NO: 456859 - RNA, 66 nt, Homo Sapiens
gggcauuaaaggugccaugaaagguagacucugaaccacuuugaucccucugaaguaggugacuga

SEQ ID NO: 456860 - RNA, 66 nt, Homo Sapiens
aaagagccaguagugaauccccucauuuugugcauucacuuugaagaaaaagguuucucaaagaug

SEQ ID NO: 456861 - RNA, 66 nt, Homo Sapiens
ggaucacuccuuugcacuccacuccccucguucugucacuuugaacgaagucugagugaggcuagu

SEQ ID NO: 456862 - RNA, 66 nt, Homo Sapiens
cucaucgaugagagagaaucacaaucagaauggaagcacuuugaguaucugaagagugagagcauu

SEQ ID NO: 456863 - RNA, 66 nt, Homo Sapiens
gagcuuuuagcaagguugugcuuuuauugguguuuucacuuugaaacagacaaacaagaaaaaaag

SEQ ID NO: 456864 - RNA, 66 nt, Homo Sapiens
acuuguguaugggcuuguaccugaguaguuguccaucacuuugagggaucccagguuuuuuacuuu

SEQ ID NO: 456865 - RNA, 66 nt, Homo Sapiens
guguuguuccagauuuaacaaauuacuuaccauuuucacuuugaaucauuuugguuauacauuuua

SEQ ID NO: 456866 - RNA, 66 nt, Homo Sapiens
aaaugaucguucauacuuugccauuuuaaaaggcaacacuuugacauauuggagguuucauguuag

SEQ ID NO: 456867 - RNA, 66 nt, Homo Sapiens
gauauauuaguucugacuuagccauuuauucugcuacacuuugaaaauuaauuugcuuaguucuga

SEQ ID NO: 456868 - RNA, 66 nt, Homo Sapiens
uaauuucauacaaagcucugaguaaaaggagcuccacacuuugacuuuuaaggagaaaaaaaaaug

SEQ ID NO: 456869 - RNA, 66 nt, Homo Sapiens
ucagacuucacaguuuucuagcuacgauuucaaggucacuuugaagauccugauauuauguuauua

SEQ ID NO: 456870 - RNA, 66 nt, Homo Sapiens
accaaagacgcuuggcagaauacauguccggagcaacacuuugaaaacggugccgccaggugaccc

SEQ ID NO: 456871 - RNA, 66 nt, Homo Sapiens
aauaauagaaccugggcuacuucaaauugucaaauucacuuugaauuaaaguuacagauucagcuu

SEQ ID NO: 456872 - RNA, 66 nt, Homo Sapiens
gcuaggggucauguaugcuuaccuuuuuuucuaauucacuuugauuaaaacauuuguuauuuucuc

SEQ ID NO: 456873 - RNA, 66 nt, Homo Sapiens
aaaagaacacugagaacuagaagagacuguugaugccacuuugaagaccuuggaagauaggccugg

SEQ ID NO: 456874 - RNA, 65 nt, Homo Sapiens; identical to SEQ ID NO: 192258

SEQ ID NO: 456875 - RNA, 65 nt, Homo Sapiens; identical to SEQ ID NO: 192259

SEQ ID NO: 456876 - RNA, 65 nt, Homo Sapiens; identical to SEQ ID NO: 192260

SEQ ID NO: 456877 - RNA, 65 nt, Homo Sapiens; identical to SEQ ID NO: 192261

SEQ ID NO: 456878 - RNA, 65 nt, Homo Sapiens; identical to SEQ ID NO: 192262

SEQ ID NO: 456879 - RNA, 65 nt, Homo Sapiens; identical to SEQ ID NO: 192263

SEQ ID NO: 456880 - RNA, 65 nt, Homo Sapiens; identical to SEQ ID NO: 192264

SEQ ID NO: 456881 - RNA, 65 nt, Homo Sapiens; identical to SEQ ID NO: 192265

SEQ ID NO: 456882 - RNA, 65 nt, Homo Sapiens; identical to SEQ ID NO: 192266

SEQ ID NO: 456883 - RNA, 65 nt, Homo Sapiens; identical to SEQ ID NO: 192267

SEQ ID NO: 456884 - RNA, 65 nt, Homo Sapiens; identical to SEQ ID NO: 192268

SEQ ID NO: 456885 - RNA, 65 nt, Homo Sapiens; identical to SEQ ID NO: 192269

SEQ ID NO: 456886 - RNA, 65 nt, Homo Sapiens; identical to SEQ ID NO: 192270

SEQ ID NO: 456887 - RNA, 65 nt, Homo Sapiens; identical to SEQ ID NO: 192271

SEQ ID NO: 456888 - RNA, 65 nt, Homo Sapiens; identical to SEQ ID NO: 192272

SEQ ID NO: 456889 - RNA, 65 nt, Homo Sapiens; identical to SEQ ID NO: 192273

SEQ ID NO: 456890 - RNA, 65 nt, Homo Sapiens; identical to SEQ ID NO: 192274

SEQ ID NO: 456891 - RNA, 65 nt, Homo Sapiens; identical to SEQ ID NO: 192275

SEQ ID NO: 456892 - RNA, 65 nt, Homo Sapiens; identical to SEQ ID NO: 192276

SEQ ID NO: 456893 - RNA, 65 nt, Homo Sapiens; identical to SEQ ID NO: 192277

SEQ ID NO: 456894 - RNA, 65 nt, Homo Sapiens; identical to SEQ ID NO: 192278

SEQ ID NO: 456895 - RNA, 65 nt, Homo Sapiens; identical to SEQ ID NO: 192279

SEQ ID NO: 456896 - RNA, 65 nt, Homo Sapiens; identical to SEQ ID NO: 192280

SEQ ID NO: 456897 - RNA, 65 nt, Homo Sapiens; identical to SEQ ID NO: 192281

SEQ ID NO: 456898 - RNA, 65 nt, Homo Sapiens; identical to SEQ ID NO: 192282

SEQ ID NO: 456899 - RNA, 65 nt, Homo Sapiens; identical to SEQ ID NO: 192283

SEQ ID NO: 456900 - RNA, 65 nt, Homo Sapiens; identical to SEQ ID NO: 192284

SEQ ID NO: 456901 - RNA, 65 nt, Homo Sapiens; identical to SEQ ID NO: 192285

SEQ ID NO: 456902 - RNA, 65 nt, Homo Sapiens; identical to SEQ ID NO: 192286

SEQ ID NO: 456903 - RNA, 65 nt, Homo Sapiens; identical to SEQ ID NO: 192287

SEQ ID NO: 456904 - RNA, 65 nt, Homo Sapiens; identical to SEQ ID NO: 192288

SEQ ID NO: 456905 - RNA, 65 nt, Homo Sapiens; identical to SEQ ID NO: 192289

SEQ ID NO: 456906 - RNA, 65 nt, Homo Sapiens; identical to SEQ ID NO: 192290

SEQ ID NO: 456907 - RNA, 65 nt, Homo Sapiens; identical to SEQ ID NO: 192291

SEQ ID NO: 456908 - RNA, 65 nt, Homo Sapiens; identical to SEQ ID NO: 192292

SEQ ID NO: 456909 - RNA, 65 nt, Homo Sapiens; identical to SEQ ID NO: 192293

SEQ ID NO: 456910 - RNA, 65 nt, Homo Sapiens; identical to SEQ ID NO: 192294

SEQ ID NO: 456911 - RNA, 65 nt, Homo Sapiens; identical to SEQ ID NO: 192295

SEQ ID NO: 456912 - RNA, 65 nt, Homo Sapiens; identical to SEQ ID NO: 192296

SEQ ID NO: 456913 - RNA, 65 nt, Homo Sapiens; identical to SEQ ID NO: 192297

SEQ ID NO: 456914 - RNA, 65 nt, Homo Sapiens; identical to SEQ ID NO: 192298

SEQ ID NO: 456915 - RNA, 65 nt, Homo Sapiens; identical to SEQ ID NO: 192299

SEQ ID NO: 456916 - RNA, 65 nt, Homo Sapiens; identical to SEQ ID NO: 192300

SEQ ID NO: 456917 - RNA, 65 nt, Homo Sapiens; identical to SEQ ID NO: 192301

SEQ ID NO: 456918 - RNA, 65 nt, Homo Sapiens; identical to SEQ ID NO: 192302

SEQ ID NO: 456919 - RNA, 65 nt, Homo Sapiens; identical to SEQ ID NO: 192303

SEQ ID NO: 456920 - RNA, 65 nt, Homo Sapiens; identical to SEQ ID NO: 192304

SEQ ID NO: 456921 - RNA, 65 nt, Homo Sapiens; identical to SEQ ID NO: 192305

SEQ ID NO: 456922 - RNA, 65 nt, Homo Sapiens; identical to SEQ ID NO: 192306

SEQ ID NO: 456923 - RNA, 65 nt, Homo Sapiens; identical to SEQ ID NO: 192307

SEQ ID NO: 456924 - RNA, 65 nt, Homo Sapiens; identical to SEQ ID NO: 192308

SEQ ID NO: 456925 - RNA, 65 nt, Homo Sapiens; identical to SEQ ID NO: 192309

SEQ ID NO: 456926 - RNA, 65 nt, Homo Sapiens; identical to SEQ ID NO: 192310

SEQ ID NO: 456927 - RNA, 65 nt, Homo Sapiens; identical to SEQ ID NO: 192311

SEQ ID NO: 456928 - RNA, 65 nt, Homo Sapiens; identical to SEQ ID NO: 192312

SEQ ID NO: 456929 - RNA, 65 nt, Homo Sapiens; identical to SEQ ID NO: 192313

SEQ ID NO: 456930 - RNA, 65 nt, Homo Sapiens; identical to SEQ ID NO: 192314

SEQ ID NO: 456931 - RNA, 65 nt, Homo Sapiens; identical to SEQ ID NO: 192315

SEQ ID NO: 456932 - RNA, 65 nt, Homo Sapiens; identical to SEQ ID NO: 192316

SEQ ID NO: 456933 - RNA, 65 nt, Homo Sapiens; identical to SEQ ID NO: 192317

SEQ ID NO: 456934 - RNA, 65 nt, Homo Sapiens; identical to SEQ ID NO: 192318

SEQ ID NO: 456935 - RNA, 65 nt, Homo Sapiens; identical to SEQ ID NO: 192319

SEQ ID NO: 456936 - RNA, 65 nt, Homo Sapiens; identical to SEQ ID NO: 192320

SEQ ID NO: 456937 - RNA, 65 nt, Homo Sapiens; identical to SEQ ID NO: 192321

SEQ ID NO: 456938 - RNA, 65 nt, Homo Sapiens; identical to SEQ ID NO: 192322

SEQ ID NO: 456939 - RNA, 65 nt, Homo Sapiens; identical to SEQ ID NO: 192323

SEQ ID NO: 456940 - RNA, 65 nt, Homo Sapiens; identical to SEQ ID NO: 192324

SEQ ID NO: 456941 - RNA, 65 nt, Homo Sapiens; identical to SEQ ID NO: 192325

SEQ ID NO: 456942 - RNA, 65 nt, Homo Sapiens; identical to SEQ ID NO: 192326

SEQ ID NO: 456943 - RNA, 65 nt, Homo Sapiens; identical to SEQ ID NO: 192327

SEQ ID NO: 456944 - RNA, 65 nt, Homo Sapiens; identical to SEQ ID NO: 192328

SEQ ID NO: 456945 - RNA, 65 nt, Homo Sapiens; identical to SEQ ID NO: 192329

SEQ ID NO: 456946 - RNA, 65 nt, Homo Sapiens; identical to SEQ ID NO: 192330

SEQ ID NO: 456947 - RNA, 65 nt, Homo Sapiens; identical to SEQ ID NO: 192331

SEQ ID NO: 456948 - RNA, 65 nt, Homo Sapiens; identical to SEQ ID NO: 192332

SEQ ID NO: 456949 - RNA, 65 nt, Homo Sapiens; identical to SEQ ID NO: 192333

SEQ ID NO: 456950 - RNA, 65 nt, Homo Sapiens; identical to SEQ ID NO: 192334

SEQ ID NO: 456951 - RNA, 65 nt, Homo Sapiens; identical to SEQ ID NO: 192335

SEQ ID NO: 456952 - RNA, 65 nt, Homo Sapiens; identical to SEQ ID NO: 192336

SEQ ID NO: 456953 - RNA, 65 nt, Homo Sapiens; identical to SEQ ID NO: 192337

SEQ ID NO: 456954 - RNA, 65 nt, Homo Sapiens; identical to SEQ ID NO: 192338

SEQ ID NO: 456955 - RNA, 65 nt, Homo Sapiens; identical to SEQ ID NO: 192339

SEQ ID NO: 456956 - RNA, 65 nt, Homo Sapiens; identical to SEQ ID NO: 192340

SEQ ID NO: 456957 - RNA, 65 nt, Homo Sapiens; identical to SEQ ID NO: 192341

SEQ ID NO: 456958 - RNA, 65 nt, Homo Sapiens; identical to SEQ ID NO: 192342

SEQ ID NO: 456959 - RNA, 65 nt, Homo Sapiens; identical to SEQ ID NO: 192343

SEQ ID NO: 456960 - RNA, 65 nt, Homo Sapiens; identical to SEQ ID NO: 192344

SEQ ID NO: 456961 - RNA, 65 nt, Homo Sapiens; identical to SEQ ID NO: 192345

SEQ ID NO: 456962 - RNA, 65 nt, Homo Sapiens; identical to SEQ ID NO: 192346

SEQ ID NO: 456963 - RNA, 65 nt, Homo Sapiens; identical to SEQ ID NO: 192347

SEQ ID NO: 456964 - RNA, 65 nt, Homo Sapiens; identical to SEQ ID NO: 192348

SEQ ID NO: 456965 - RNA, 65 nt, Homo Sapiens; identical to SEQ ID NO: 192349

SEQ ID NO: 456966 - RNA, 65 nt, Homo Sapiens; identical to SEQ ID NO: 192350

SEQ ID NO: 456967 - RNA, 65 nt, Homo Sapiens; identical to SEQ ID NO: 192351

SEQ ID NO: 456968 - RNA, 65 nt, Homo Sapiens; identical to SEQ ID NO: 192352

SEQ ID NO: 456969 - RNA, 65 nt, Homo Sapiens; identical to SEQ ID NO: 192353

SEQ ID NO: 456970 - RNA, 65 nt, Homo Sapiens; identical to SEQ ID NO: 192354

SEQ ID NO: 456971 - RNA, 65 nt, Homo Sapiens; identical to SEQ ID NO: 192355

SEQ ID NO: 456972 - RNA, 65 nt, Homo Sapiens; identical to SEQ ID NO: 192356

SEQ ID NO: 456973 - RNA, 65 nt, Homo Sapiens; identical to SEQ ID NO: 192357

SEQ ID NO: 456974 - RNA, 65 nt, Homo Sapiens; identical to SEQ ID NO: 192358

SEQ ID NO: 456975 - RNA, 65 nt, Homo Sapiens; identical to SEQ ID NO: 192359

SEQ ID NO: 456976 - RNA, 65 nt, Homo Sapiens; identical to SEQ ID NO: 192360

SEQ ID NO: 456977 - RNA, 65 nt, Homo Sapiens; identical to SEQ ID NO: 192361

SEQ ID NO: 456978 - RNA, 65 nt, Homo Sapiens; identical to SEQ ID NO: 192362

SEQ ID NO: 456979 - RNA, 65 nt, Homo Sapiens; identical to SEQ ID NO: 192363

SEQ ID NO: 456980 - RNA, 65 nt, Homo Sapiens; identical to SEQ ID NO: 192364

SEQ ID NO: 456981 - RNA, 65 nt, Homo Sapiens; identical to SEQ ID NO: 192365

SEQ ID NO: 456982 - RNA, 65 nt, Homo Sapiens; identical to SEQ ID NO: 192366

SEQ ID NO: 456983 - RNA, 65 nt, Homo Sapiens; identical to SEQ ID NO: 192367

SEQ ID NO: 456984 - RNA, 65 nt, Homo Sapiens; identical to SEQ ID NO: 192368

SEQ ID NO: 456985 - RNA, 65 nt, Homo Sapiens; identical to SEQ ID NO: 192369

SEQ ID NO: 456986 - RNA, 65 nt, Homo Sapiens; identical to SEQ ID NO: 192370

SEQ ID NO: 456987 - RNA, 65 nt, Homo Sapiens; identical to SEQ ID NO: 192371

SEQ ID NO: 456988 - RNA, 65 nt, Homo Sapiens; identical to SEQ ID NO: 192372

SEQ ID NO: 456989 - RNA, 65 nt, Homo Sapiens; identical to SEQ ID NO: 192373

SEQ ID NO: 456990 - RNA, 65 nt, Homo Sapiens; identical to SEQ ID NO: 192374

SEQ ID NO: 456991 - RNA, 65 nt, Homo Sapiens; identical to SEQ ID NO: 192375

SEQ ID NO: 456992 - RNA, 65 nt, Homo Sapiens; identical to SEQ ID NO: 192376

SEQ ID NO: 456993 - RNA, 65 nt, Homo Sapiens; identical to SEQ ID NO: 192377

SEQ ID NO: 456994 - RNA, 65 nt, Homo Sapiens; identical to SEQ ID NO: 192378

SEQ ID NO: 456995 - RNA, 65 nt, Homo Sapiens; identical to SEQ ID NO: 192379

SEQ ID NO: 456996 - RNA, 65 nt, Homo Sapiens; identical to SEQ ID NO: 192380

SEQ ID NO: 456997 - RNA, 65 nt, Homo Sapiens; identical to SEQ ID NO: 192381

SEQ ID NO: 456998 - RNA, 65 nt, Homo Sapiens; identical to SEQ ID NO: 192382

SEQ ID NO: 456999 - RNA, 65 nt, Homo Sapiens; identical to SEQ ID NO: 192383

SEQ ID NO: 457000 - RNA, 65 nt, Homo Sapiens; identical to SEQ ID NO: 192384

SEQ ID NO: 457001 - RNA, 65 nt, Homo Sapiens; identical to SEQ ID NO: 192385

SEQ ID NO: 457002 - RNA, 65 nt, Homo Sapiens; identical to SEQ ID NO: 192386

SEQ ID NO: 457003 - RNA, 65 nt, Homo Sapiens; identical to SEQ ID NO: 192387

SEQ ID NO: 457004 - RNA, 65 nt, Homo Sapiens; identical to SEQ ID NO: 192388

SEQ ID NO: 457005 - RNA, 65 nt, Homo Sapiens; identical to SEQ ID NO: 192389

SEQ ID NO: 457006 - RNA, 65 nt, Homo Sapiens; identical to SEQ ID NO: 192390

SEQ ID NO: 457007 - RNA, 65 nt, Homo Sapiens; identical to SEQ ID NO: 192391

SEQ ID NO: 457008 - RNA, 65 nt, Homo Sapiens; identical to SEQ ID NO: 192392

SEQ ID NO: 457009 - RNA, 65 nt, Homo Sapiens; identical to SEQ ID NO: 192393

SEQ ID NO: 457010 - RNA, 65 nt, Homo Sapiens; identical to SEQ ID NO: 192394

SEQ ID NO: 457011 - RNA, 65 nt, Homo Sapiens; identical to SEQ ID NO: 192395

SEQ ID NO: 457012 - RNA, 65 nt, Homo Sapiens; identical to SEQ ID NO: 192396

SEQ ID NO: 457013 - RNA, 65 nt, Homo Sapiens; identical to SEQ ID NO: 192397

SEQ ID NO: 457014 - RNA, 65 nt, Homo Sapiens; identical to SEQ ID NO: 192398

SEQ ID NO: 457015 - RNA, 65 nt, Homo Sapiens; identical to SEQ ID NO: 192399

SEQ ID NO: 457016 - RNA, 65 nt, Homo Sapiens; identical to SEQ ID NO: 192400

SEQ ID NO: 457017 - RNA, 65 nt, Homo Sapiens; identical to SEQ ID NO: 192401

SEQ ID NO: 457018 - RNA, 65 nt, Homo Sapiens; identical to SEQ ID NO: 192402

SEQ ID NO: 457019 - RNA, 65 nt, Homo Sapiens; identical to SEQ ID NO: 192403

SEQ ID NO: 457020 - RNA, 65 nt, Homo Sapiens; identical to SEQ ID NO: 192404

SEQ ID NO: 457021 - RNA, 65 nt, Homo Sapiens; identical to SEQ ID NO: 192405

SEQ ID NO: 457022 - RNA, 65 nt, Homo Sapiens; identical to SEQ ID NO: 192406

SEQ ID NO: 457023 - RNA, 65 nt, Homo Sapiens; identical to SEQ ID NO: 192407

SEQ ID NO: 457024 - RNA, 65 nt, Homo Sapiens; identical to SEQ ID NO: 192408

SEQ ID NO: 457025 - RNA, 65 nt, Homo Sapiens; identical to SEQ ID NO: 192409

SEQ ID NO: 457026 - RNA, 65 nt, Homo Sapiens; identical to SEQ ID NO: 192410

SEQ ID NO: 457027 - RNA, 65 nt, Homo Sapiens; identical to SEQ ID NO: 192411

SEQ ID NO: 457028 - RNA, 65 nt, Homo Sapiens; identical to SEQ ID NO: 192412

SEQ ID NO: 457029 - RNA, 65 nt, Homo Sapiens; identical to SEQ ID NO: 192413

SEQ ID NO: 457030 - RNA, 65 nt, Homo Sapiens; identical to SEQ ID NO: 192414

SEQ ID NO: 457031 - RNA, 65 nt, Homo Sapiens; identical to SEQ ID NO: 192415

SEQ ID NO: 457032 - RNA, 65 nt, Homo Sapiens; identical to SEQ ID NO: 192416

SEQ ID NO: 457033 - RNA, 65 nt, Homo Sapiens; identical to SEQ ID NO: 192417

SEQ ID NO: 457034 - RNA, 65 nt, Homo Sapiens; identical to SEQ ID NO: 192418

SEQ ID NO: 457035 - RNA, 65 nt, Homo Sapiens; identical to SEQ ID NO: 192419

SEQ ID NO: 457036 - RNA, 65 nt, Homo Sapiens; identical to SEQ ID NO: 192420

SEQ ID NO: 457037 - RNA, 65 nt, Homo Sapiens; identical to SEQ ID NO: 192421

SEQ ID NO: 457038 - RNA, 65 nt, Homo Sapiens; identical to SEQ ID NO: 192422

SEQ ID NO: 457039 - RNA, 65 nt, Homo Sapiens; identical to SEQ ID NO: 192423

SEQ ID NO: 457040 - RNA, 65 nt, Homo Sapiens; identical to SEQ ID NO: 192424

SEQ ID NO: 457041 - RNA, 65 nt, Homo Sapiens; identical to SEQ ID NO: 192425

SEQ ID NO: 457042 - RNA, 65 nt, Homo Sapiens; identical to SEQ ID NO: 192426

SEQ ID NO: 457043 - RNA, 65 nt, Homo Sapiens; identical to SEQ ID NO: 192427

SEQ ID NO: 457044 - RNA, 65 nt, Homo Sapiens; identical to SEQ ID NO: 192428

SEQ ID NO: 457045 - RNA, 65 nt, Homo Sapiens; identical to SEQ ID NO: 192429

SEQ ID NO: 457046 - RNA, 65 nt, Homo Sapiens; identical to SEQ ID NO: 192430

SEQ ID NO: 457047 - RNA, 65 nt, Homo Sapiens; identical to SEQ ID NO: 192431

SEQ ID NO: 457048 - RNA, 65 nt, Homo Sapiens; identical to SEQ ID NO: 192432

SEQ ID NO: 457049 - RNA, 65 nt, Homo Sapiens; identical to SEQ ID NO: 192433

SEQ ID NO: 457050 - RNA, 65 nt, Homo Sapiens; identical to SEQ ID NO: 192434

SEQ ID NO: 457051 - RNA, 65 nt, Homo Sapiens; identical to SEQ ID NO: 192435

SEQ ID NO: 457052 - RNA, 65 nt, Homo Sapiens; identical to SEQ ID NO: 192436

SEQ ID NO: 457053 - RNA, 65 nt, Homo Sapiens; identical to SEQ ID NO: 192437

SEQ ID NO: 457054 - RNA, 65 nt, Homo Sapiens; identical to SEQ ID NO: 192438

SEQ ID NO: 457055 - RNA, 65 nt, Homo Sapiens; identical to SEQ ID NO: 192439

SEQ ID NO: 457056 - RNA, 65 nt, Homo Sapiens; identical to SEQ ID NO: 192440

SEQ ID NO: 457057 - RNA, 65 nt, Homo Sapiens; identical to SEQ ID NO: 192441

SEQ ID NO: 457058 - RNA, 65 nt, Homo Sapiens; identical to SEQ ID NO: 192442

SEQ ID NO: 457059 - RNA, 65 nt, Homo Sapiens; identical to SEQ ID NO: 192443

SEQ ID NO: 457060 - RNA, 65 nt, Homo Sapiens; identical to SEQ ID NO: 192444

SEQ ID NO: 457061 - RNA, 65 nt, Homo Sapiens; identical to SEQ ID NO: 192445

SEQ ID NO: 457062 - RNA, 65 nt, Homo Sapiens; identical to SEQ ID NO: 192446

SEQ ID NO: 457063 - RNA, 65 nt, Homo Sapiens; identical to SEQ ID NO: 192447

SEQ ID NO: 457064 - RNA, 65 nt, Homo Sapiens; identical to SEQ ID NO: 192448

SEQ ID NO: 457065 - RNA, 65 nt, Homo Sapiens; identical to SEQ ID NO: 192449

SEQ ID NO: 457066 - RNA, 65 nt, Homo Sapiens; identical to SEQ ID NO: 192450

SEQ ID NO: 457067 - RNA, 65 nt, Homo Sapiens; identical to SEQ ID NO: 192451

SEQ ID NO: 457068 - RNA, 65 nt, Homo Sapiens; identical to SEQ ID NO: 192452

SEQ ID NO: 457069 - RNA, 65 nt, Homo Sapiens; identical to SEQ ID NO: 192453

SEQ ID NO: 457070 - RNA, 65 nt, Homo Sapiens; identical to SEQ ID NO: 192454

SEQ ID NO: 457071 - RNA, 65 nt, Homo Sapiens; identical to SEQ ID NO: 192455

SEQ ID NO: 457072 - RNA, 65 nt, Homo Sapiens; identical to SEQ ID NO: 192456

SEQ ID NO: 457073 - RNA, 65 nt, Homo Sapiens; identical to SEQ ID NO: 192457

SEQ ID NO: 457074 - RNA, 65 nt, Homo Sapiens; identical to SEQ ID NO: 192458

SEQ ID NO: 457075 - RNA, 65 nt, Homo Sapiens; identical to SEQ ID NO: 192459

SEQ ID NO: 457076 - RNA, 65 nt, Homo Sapiens; identical to SEQ ID NO: 192460

SEQ ID NO: 457077 - RNA, 65 nt, Homo Sapiens; identical to SEQ ID NO: 192461

SEQ ID NO: 457078 - RNA, 65 nt, Homo Sapiens; identical to SEQ ID NO: 192462

SEQ ID NO: 457079 - RNA, 65 nt, Homo Sapiens; identical to SEQ ID NO: 192463

SEQ ID NO: 457080 - RNA, 51 nt, Homo Sapiens; identical to SEQ ID NO: 192464

SEQ ID NO: 457081 - RNA, 65 nt, Homo Sapiens; identical to SEQ ID NO: 192465

SEQ ID NO: 457082 - RNA, 65 nt, Homo Sapiens; identical to SEQ ID NO: 192466

SEQ ID NO: 457083 - RNA, 65 nt, Homo Sapiens; identical to SEQ ID NO: 192467

SEQ ID NO: 457084 - RNA, 65 nt, Homo Sapiens; identical to SEQ ID NO: 192468

SEQ ID NO: 457085 - RNA, 65 nt, Homo Sapiens; identical to SEQ ID NO: 192469

SEQ ID NO: 457086 - RNA, 65 nt, Homo Sapiens; identical to SEQ ID NO: 192470

SEQ ID NO: 457087 - RNA, 65 nt, Homo Sapiens; identical to SEQ ID NO: 192471

SEQ ID NO: 457088 - RNA, 65 nt, Homo Sapiens; identical to SEQ ID NO: 192472

SEQ ID NO: 457089 - RNA, 65 nt, Homo Sapiens; identical to SEQ ID NO: 192473

SEQ ID NO: 457090 - RNA, 65 nt, Homo Sapiens; identical to SEQ ID NO: 192474

SEQ ID NO: 457091 - RNA, 65 nt, Homo Sapiens; identical to SEQ ID NO: 192475

SEQ ID NO: 457092 - RNA, 65 nt, Homo Sapiens; identical to SEQ ID NO: 192476

SEQ ID NO: 457093 - RNA, 65 nt, Homo Sapiens; identical to SEQ ID NO: 192477

SEQ ID NO: 457094 - RNA, 65 nt, Homo Sapiens; identical to SEQ ID NO: 192478

SEQ ID NO: 457095 - RNA, 65 nt, Homo Sapiens; identical to SEQ ID NO: 192479

SEQ ID NO: 457096 - RNA, 65 nt, Homo Sapiens; identical to SEQ ID NO: 192480

SEQ ID NO: 457097 - RNA, 65 nt, Homo Sapiens; identical to SEQ ID NO: 192481

SEQ ID NO: 457098 - RNA, 65 nt, Homo Sapiens; identical to SEQ ID NO: 192482

SEQ ID NO: 457099 - RNA, 65 nt, Homo Sapiens; identical to SEQ ID NO: 192483

SEQ ID NO: 457100 - RNA, 65 nt, Homo Sapiens; identical to SEQ ID NO: 192484

SEQ ID NO: 457101 - RNA, 65 nt, Homo Sapiens; identical to SEQ ID NO: 192485

SEQ ID NO: 457102 - RNA, 65 nt, Homo Sapiens; identical to SEQ ID NO: 192486

SEQ ID NO: 457103 - RNA, 65 nt, Homo Sapiens; identical to SEQ ID NO: 192487

SEQ ID NO: 457104 - RNA, 65 nt, Homo Sapiens; identical to SEQ ID NO: 192488

SEQ ID NO: 457105 - RNA, 65 nt, Homo Sapiens; identical to SEQ ID NO: 192489

SEQ ID NO: 457106 - RNA, 65 nt, Homo Sapiens; identical to SEQ ID NO: 192490

SEQ ID NO: 457107 - RNA, 65 nt, Homo Sapiens; identical to SEQ ID NO: 192491

SEQ ID NO: 457108 - RNA, 65 nt, Homo Sapiens; identical to SEQ ID NO: 192492

SEQ ID NO: 457109 - RNA, 65 nt, Homo Sapiens; identical to SEQ ID NO: 192493

SEQ ID NO: 457110 - RNA, 65 nt, Homo Sapiens; identical to SEQ ID NO: 192494

SEQ ID NO: 457111 - RNA, 65 nt, Homo Sapiens; identical to SEQ ID NO: 192495

SEQ ID NO: 457112 - RNA, 65 nt, Homo Sapiens; identical to SEQ ID NO: 192496

SEQ ID NO: 457113 - RNA, 65 nt, Homo Sapiens; identical to SEQ ID NO: 192497

SEQ ID NO: 457114 - RNA, 65 nt, Homo Sapiens; identical to SEQ ID NO: 192498

SEQ ID NO: 457115 - RNA, 65 nt, Homo Sapiens; identical to SEQ ID NO: 192499

SEQ ID NO: 457116 - RNA, 65 nt, Homo Sapiens; identical to SEQ ID NO: 192500

SEQ ID NO: 457117 - RNA, 65 nt, Homo Sapiens; identical to SEQ ID NO: 192501

SEQ ID NO: 457118 - RNA, 65 nt, Homo Sapiens; identical to SEQ ID NO: 192502

SEQ ID NO: 457119 - RNA, 65 nt, Homo Sapiens; identical to SEQ ID NO: 192503

SEQ ID NO: 457120 - RNA, 65 nt, Homo Sapiens; identical to SEQ ID NO: 192504

SEQ ID NO: 457121 - RNA, 65 nt, Homo Sapiens; identical to SEQ ID NO: 192505

SEQ ID NO: 457122 - RNA, 65 nt, Homo Sapiens; identical to SEQ ID NO: 192506

SEQ ID NO: 457123 - RNA, 65 nt, Homo Sapiens; identical to SEQ ID NO: 192507

SEQ ID NO: 457124 - RNA, 65 nt, Homo Sapiens; identical to SEQ ID NO: 192508

SEQ ID NO: 457125 - RNA, 65 nt, Homo Sapiens; identical to SEQ ID NO: 192509

SEQ ID NO: 457126 - RNA, 65 nt, Homo Sapiens; identical to SEQ ID NO: 192510

SEQ ID NO: 457127 - RNA, 65 nt, Homo Sapiens; identical to SEQ ID NO: 192511

SEQ ID NO: 457128 - RNA, 65 nt, Homo Sapiens; identical to SEQ ID NO: 192512

SEQ ID NO: 457129 - RNA, 65 nt, Homo Sapiens; identical to SEQ ID NO: 192513

SEQ ID NO: 457130 - RNA, 65 nt, Homo Sapiens; identical to SEQ ID NO: 192514

SEQ ID NO: 457131 - RNA, 65 nt, Homo Sapiens; identical to SEQ ID NO: 192515

SEQ ID NO: 457132 - RNA, 65 nt, Homo Sapiens; identical to SEQ ID NO: 192516

SEQ ID NO: 457133 - RNA, 65 nt, Homo Sapiens; identical to SEQ ID NO: 192517

SEQ ID NO: 457134 - RNA, 65 nt, Homo Sapiens; identical to SEQ ID NO: 192518

SEQ ID NO: 457135 - RNA, 65 nt, Homo Sapiens; identical to SEQ ID NO: 192519

SEQ ID NO: 457136 - RNA, 65 nt, Homo Sapiens; identical to SEQ ID NO: 192520

SEQ ID NO: 457137 - RNA, 65 nt, Homo Sapiens; identical to SEQ ID NO: 192521

SEQ ID NO: 457138 - RNA, 65 nt, Homo Sapiens; identical to SEQ ID NO: 192522

SEQ ID NO: 457139 - RNA, 65 nt, Homo Sapiens; identical to SEQ ID NO: 192523

SEQ ID NO: 457140 - RNA, 65 nt, Homo Sapiens; identical to SEQ ID NO: 192524

SEQ ID NO: 457141 - RNA, 65 nt, Homo Sapiens; identical to SEQ ID NO: 192525

SEQ ID NO: 457142 - RNA, 65 nt, Homo Sapiens; identical to SEQ ID NO: 192526

SEQ ID NO: 457143 - RNA, 65 nt, Homo Sapiens; identical to SEQ ID NO: 192527

SEQ ID NO: 457144 - RNA, 65 nt, Homo Sapiens; identical to SEQ ID NO: 192528

SEQ ID NO: 457145 - RNA, 65 nt, Homo Sapiens; identical to SEQ ID NO: 192529

SEQ ID NO: 457146 - RNA, 65 nt, Homo Sapiens; identical to SEQ ID NO: 192530

SEQ ID NO: 457147 - RNA, 65 nt, Homo Sapiens; identical to SEQ ID NO: 192531

SEQ ID NO: 457148 - RNA, 53 nt, Homo Sapiens; identical to SEQ ID NO: 192532

SEQ ID NO: 457149 - RNA, 65 nt, Homo Sapiens; identical to SEQ ID NO: 192533

SEQ ID NO: 457150 - RNA, 65 nt, Homo Sapiens; identical to SEQ ID NO: 192534

SEQ ID NO: 457151 - RNA, 65 nt, Homo Sapiens; identical to SEQ ID NO: 192535

SEQ ID NO: 457152 - RNA, 65 nt, Homo Sapiens; identical to SEQ ID NO: 192536

SEQ ID NO: 457153 - RNA, 65 nt, Homo Sapiens; identical to SEQ ID NO: 192537

SEQ ID NO: 457154 - RNA, 65 nt, Homo Sapiens; identical to SEQ ID NO: 192538

SEQ ID NO: 457155 - RNA, 65 nt, Homo Sapiens; identical to SEQ ID NO: 192539

SEQ ID NO: 457156 - RNA, 65 nt, Homo Sapiens; identical to SEQ ID NO: 192540

SEQ ID NO: 457157 - RNA, 65 nt, Homo Sapiens; identical to SEQ ID NO: 192541

SEQ ID NO: 457158 - RNA, 65 nt, Homo Sapiens; identical to SEQ ID NO: 192542

SEQ ID NO: 457159 - RNA, 65 nt, Homo Sapiens; identical to SEQ ID NO: 192543

SEQ ID NO: 457160 - RNA, 65 nt, Homo Sapiens; identical to SEQ ID NO: 192544

SEQ ID NO: 457161 - RNA, 65 nt, Homo Sapiens; identical to SEQ ID NO: 192545

SEQ ID NO: 457162 - RNA, 65 nt, Homo Sapiens; identical to SEQ ID NO: 192546

SEQ ID NO: 457163 - RNA, 65 nt, Homo Sapiens; identical to SEQ ID NO: 192547

SEQ ID NO: 457164 - RNA, 65 nt, Homo Sapiens; identical to SEQ ID NO: 192548

SEQ ID NO: 457165 - RNA, 65 nt, Homo Sapiens; identical to SEQ ID NO: 192549

SEQ ID NO: 457166 - RNA, 65 nt, Homo Sapiens; identical to SEQ ID NO: 192550

SEQ ID NO: 457167 - RNA, 65 nt, Homo Sapiens; identical to SEQ ID NO: 192551

SEQ ID NO: 457168 - RNA, 65 nt, Homo Sapiens; identical to SEQ ID NO: 192552

SEQ ID NO: 457169 - RNA, 65 nt, Homo Sapiens; identical to SEQ ID NO: 192553

SEQ ID NO: 457170 - RNA, 65 nt, Homo Sapiens; identical to SEQ ID NO: 192554

SEQ ID NO: 457171 - RNA, 65 nt, Homo Sapiens; identical to SEQ ID NO: 192555

SEQ ID NO: 457172 - RNA, 65 nt, Homo Sapiens; identical to SEQ ID NO: 192556

SEQ ID NO: 457173 - RNA, 65 nt, Homo Sapiens; identical to SEQ ID NO: 192557

SEQ ID NO: 457174 - RNA, 65 nt, Homo Sapiens; identical to SEQ ID NO: 192558

SEQ ID NO: 457175 - RNA, 65 nt, Homo Sapiens; identical to SEQ ID NO: 192559

SEQ ID NO: 457176 - RNA, 65 nt, Homo Sapiens; identical to SEQ ID NO: 192560

SEQ ID NO: 457177 - RNA, 65 nt, Homo Sapiens; identical to SEQ ID NO: 192561

SEQ ID NO: 457178 - RNA, 65 nt, Homo Sapiens; identical to SEQ ID NO: 192562

SEQ ID NO: 457179 - RNA, 65 nt, Homo Sapiens; identical to SEQ ID NO: 192563

SEQ ID NO: 457180 - RNA, 65 nt, Homo Sapiens; identical to SEQ ID NO: 192564

SEQ ID NO: 457181 - RNA, 65 nt, Homo Sapiens; identical to SEQ ID NO: 192565

SEQ ID NO: 457182 - RNA, 65 nt, Homo Sapiens; identical to SEQ ID NO: 192566

SEQ ID NO: 457183 - RNA, 65 nt, Homo Sapiens; identical to SEQ ID NO: 192567

SEQ ID NO: 457184 - RNA, 65 nt, Homo Sapiens; identical to SEQ ID NO: 192568

SEQ ID NO: 457185 - RNA, 65 nt, Homo Sapiens; identical to SEQ ID NO: 192569

SEQ ID NO: 457186 - RNA, 65 nt, Homo Sapiens; identical to SEQ ID NO: 192570

SEQ ID NO: 457187 - RNA, 65 nt, Homo Sapiens; identical to SEQ ID NO: 192571

SEQ ID NO: 457188 - RNA, 65 nt, Homo Sapiens; identical to SEQ ID NO: 192572

SEQ ID NO: 457189 - RNA, 65 nt, Homo Sapiens; identical to SEQ ID NO: 192573

SEQ ID NO: 457190 - RNA, 65 nt, Homo Sapiens; identical to SEQ ID NO: 192574

SEQ ID NO: 457191 - RNA, 65 nt, Homo Sapiens; identical to SEQ ID NO: 192575

SEQ ID NO: 457192 - RNA, 65 nt, Homo Sapiens; identical to SEQ ID NO: 192576

SEQ ID NO: 457193 - RNA, 65 nt, Homo Sapiens; identical to SEQ ID NO: 192577

SEQ ID NO: 457194 - RNA, 65 nt, Homo Sapiens; identical to SEQ ID NO: 192578

SEQ ID NO: 457195 - RNA, 65 nt, Homo Sapiens; identical to SEQ ID NO: 192579

SEQ ID NO: 457196 - RNA, 65 nt, Homo Sapiens; identical to SEQ ID NO: 192580

SEQ ID NO: 457197 - RNA, 65 nt, Homo Sapiens; identical to SEQ ID NO: 192581

SEQ ID NO: 457198 - RNA, 65 nt, Homo Sapiens; identical to SEQ ID NO: 192582

SEQ ID NO: 457199 - RNA, 65 nt, Homo Sapiens; identical to SEQ ID NO: 192583

SEQ ID NO: 457200 - RNA, 65 nt, Homo Sapiens; identical to SEQ ID NO: 192584

SEQ ID NO: 457201 - RNA, 65 nt, Homo Sapiens; identical to SEQ ID NO: 192585

SEQ ID NO: 457202 - RNA, 65 nt, Homo Sapiens; identical to SEQ ID NO: 192586

SEQ ID NO: 457203 - RNA, 65 nt, Homo Sapiens; identical to SEQ ID NO: 192587

SEQ ID NO: 457204 - RNA, 65 nt, Homo Sapiens; identical to SEQ ID NO: 192588

SEQ ID NO: 457205 - RNA, 65 nt, Homo Sapiens; identical to SEQ ID NO: 192589

SEQ ID NO: 457206 - RNA, 65 nt, Homo Sapiens; identical to SEQ ID NO: 192590

SEQ ID NO: 457207 - RNA, 65 nt, Homo Sapiens; identical to SEQ ID NO: 192591

SEQ ID NO: 457208 - RNA, 65 nt, Homo Sapiens; identical to SEQ ID NO: 192592

SEQ ID NO: 457209 - RNA, 65 nt, Homo Sapiens; identical to SEQ ID NO: 192593

SEQ ID NO: 457210 - RNA, 65 nt, Homo Sapiens; identical to SEQ ID NO: 192594

SEQ ID NO: 457211 - RNA, 65 nt, Homo Sapiens; identical to SEQ ID NO: 192595

SEQ ID NO: 457212 - RNA, 65 nt, Homo Sapiens; identical to SEQ ID NO: 192596

SEQ ID NO: 457213 - RNA, 65 nt, Homo Sapiens; identical to SEQ ID NO: 192597

SEQ ID NO: 457214 - RNA, 65 nt, Homo Sapiens; identical to SEQ ID NO: 192598

SEQ ID NO: 457215 - RNA, 65 nt, Homo Sapiens; identical to SEQ ID NO: 192599

SEQ ID NO: 457216 - RNA, 65 nt, Homo Sapiens; identical to SEQ ID NO: 192600

SEQ ID NO: 457217 - RNA, 65 nt, Homo Sapiens; identical to SEQ ID NO: 192601

SEQ ID NO: 457218 - RNA, 65 nt, Homo Sapiens; identical to SEQ ID NO: 192602

SEQ ID NO: 457219 - RNA, 65 nt, Homo Sapiens; identical to SEQ ID NO: 192603

SEQ ID NO: 457220 - RNA, 65 nt, Homo Sapiens; identical to SEQ ID NO: 192604

SEQ ID NO: 457221 - RNA, 65 nt, Homo Sapiens; identical to SEQ ID NO: 192605

SEQ ID NO: 457222 - RNA, 65 nt, Homo Sapiens; identical to SEQ ID NO: 192606

SEQ ID NO: 457223 - RNA, 65 nt, Homo Sapiens; identical to SEQ ID NO: 192607

SEQ ID NO: 457224 - RNA, 65 nt, Homo Sapiens; identical to SEQ ID NO: 192608

SEQ ID NO: 457225 - RNA, 65 nt, Homo Sapiens; identical to SEQ ID NO: 192609

SEQ ID NO: 457226 - RNA, 65 nt, Homo Sapiens; identical to SEQ ID NO: 192610

SEQ ID NO: 457227 - RNA, 65 nt, Homo Sapiens; identical to SEQ ID NO: 192611

SEQ ID NO: 457228 - RNA, 65 nt, Homo Sapiens; identical to SEQ ID NO: 192612

SEQ ID NO: 457229 - RNA, 65 nt, Homo Sapiens; identical to SEQ ID NO: 192613

SEQ ID NO: 457230 - RNA, 65 nt, Homo Sapiens; identical to SEQ ID NO: 192614

SEQ ID NO: 457231 - RNA, 65 nt, Homo Sapiens; identical to SEQ ID NO: 192615

SEQ ID NO: 457232 - RNA, 65 nt, Homo Sapiens; identical to SEQ ID NO: 192616

SEQ ID NO: 457233 - RNA, 65 nt, Homo Sapiens; identical to SEQ ID NO: 192617

SEQ ID NO: 457234 - RNA, 65 nt, Homo Sapiens; identical to SEQ ID NO: 192618

SEQ ID NO: 457235 - RNA, 65 nt, Homo Sapiens; identical to SEQ ID NO: 192619

SEQ ID NO: 457236 - RNA, 65 nt, Homo Sapiens; identical to SEQ ID NO: 192620

SEQ ID NO: 457237 - RNA, 65 nt, Homo Sapiens; identical to SEQ ID NO: 192621

SEQ ID NO: 457238 - RNA, 65 nt, Homo Sapiens; identical to SEQ ID NO: 192622

SEQ ID NO: 457239 - RNA, 65 nt, Homo Sapiens; identical to SEQ ID NO: 192623

SEQ ID NO: 457240 - RNA, 65 nt, Homo Sapiens; identical to SEQ ID NO: 192624

SEQ ID NO: 457241 - RNA, 65 nt, Homo Sapiens; identical to SEQ ID NO: 192625

SEQ ID NO: 457242 - RNA, 65 nt, Homo Sapiens; identical to SEQ ID NO: 192626

SEQ ID NO: 457243 - RNA, 65 nt, Homo Sapiens; identical to SEQ ID NO: 192627

SEQ ID NO: 457244 - RNA, 65 nt, Homo Sapiens; identical to SEQ ID NO: 192628

SEQ ID NO: 457245 - RNA, 65 nt, Homo Sapiens; identical to SEQ ID NO: 192629

SEQ ID NO: 457246 - RNA, 65 nt, Homo Sapiens; identical to SEQ ID NO: 192630

SEQ ID NO: 457247 - RNA, 65 nt, Homo Sapiens; identical to SEQ ID NO: 192631

SEQ ID NO: 457248 - RNA, 65 nt, Homo Sapiens; identical to SEQ ID NO: 192632

SEQ ID NO: 457249 - RNA, 65 nt, Homo Sapiens; identical to SEQ ID NO: 192633

SEQ ID NO: 457250 - RNA, 65 nt, Homo Sapiens; identical to SEQ ID NO: 192634

SEQ ID NO: 457251 - RNA, 65 nt, Homo Sapiens; identical to SEQ ID NO: 192635

SEQ ID NO: 457252 - RNA, 65 nt, Homo Sapiens; identical to SEQ ID NO: 192636

SEQ ID NO: 457253 - RNA, 65 nt, Homo Sapiens; identical to SEQ ID NO: 192637

SEQ ID NO: 457254 - RNA, 65 nt, Homo Sapiens; identical to SEQ ID NO: 192638

SEQ ID NO: 457255 - RNA, 65 nt, Homo Sapiens; identical to SEQ ID NO: 192639

SEQ ID NO: 457256 - RNA, 65 nt, Homo Sapiens; identical to SEQ ID NO: 192640

SEQ ID NO: 457257 - RNA, 65 nt, Homo Sapiens; identical to SEQ ID NO: 192641

SEQ ID NO: 457258 - RNA, 65 nt, Homo Sapiens; identical to SEQ ID NO: 192642

SEQ ID NO: 457259 - RNA, 65 nt, Homo Sapiens; identical to SEQ ID NO: 192643

SEQ ID NO: 457260 - RNA, 65 nt, Homo Sapiens; identical to SEQ ID NO: 192644

SEQ ID NO: 457261 - RNA, 65 nt, Homo Sapiens; identical to SEQ ID NO: 192645

SEQ ID NO: 457262 - RNA, 65 nt, Homo Sapiens; identical to SEQ ID NO: 192646

SEQ ID NO: 457263 - RNA, 65 nt, Homo Sapiens; identical to SEQ ID NO: 192647

SEQ ID NO: 457264 - RNA, 65 nt, Homo Sapiens; identical to SEQ ID NO: 192648

SEQ ID NO: 457265 - RNA, 65 nt, Homo Sapiens; identical to SEQ ID NO: 192649

SEQ ID NO: 457266 - RNA, 51 nt, Homo Sapiens; identical to SEQ ID NO: 192650

SEQ ID NO: 457267 - RNA, 65 nt, Homo Sapiens; identical to SEQ ID NO: 192651

SEQ ID NO: 457268 - RNA, 65 nt, Homo Sapiens; identical to SEQ ID NO: 192652

SEQ ID NO: 457269 - RNA, 65 nt, Homo Sapiens; identical to SEQ ID NO: 192653

SEQ ID NO: 457270 - RNA, 65 nt, Homo Sapiens; identical to SEQ ID NO: 192654

SEQ ID NO: 457271 - RNA, 65 nt, Homo Sapiens; identical to SEQ ID NO: 192655

SEQ ID NO: 457272 - RNA, 65 nt, Homo Sapiens; identical to SEQ ID NO: 192656

SEQ ID NO: 457273 - RNA, 65 nt, Homo Sapiens; identical to SEQ ID NO: 192657

SEQ ID NO: 457274 - RNA, 65 nt, Homo Sapiens; identical to SEQ ID NO: 192658

SEQ ID NO: 457275 - RNA, 65 nt, Homo Sapiens; identical to SEQ ID NO: 192659

SEQ ID NO: 457276 - RNA, 65 nt, Homo Sapiens; identical to SEQ ID NO: 192660

SEQ ID NO: 457277 - RNA, 65 nt, Homo Sapiens; identical to SEQ ID NO: 192661

SEQ ID NO: 457278 - RNA, 65 nt, Homo Sapiens; identical to SEQ ID NO: 192662

SEQ ID NO: 457279 - RNA, 65 nt, Homo Sapiens; identical to SEQ ID NO: 192663

SEQ ID NO: 457280 - RNA, 65 nt, Homo Sapiens; identical to SEQ ID NO: 192664

SEQ ID NO: 457281 - RNA, 65 nt, Homo Sapiens; identical to SEQ ID NO: 192665

SEQ ID NO: 457282 - RNA, 65 nt, Homo Sapiens; identical to SEQ ID NO: 192666

SEQ ID NO: 457283 - RNA, 65 nt, Homo Sapiens; identical to SEQ ID NO: 192667

SEQ ID NO: 457284 - RNA, 65 nt, Homo Sapiens; identical to SEQ ID NO: 192668

SEQ ID NO: 457285 - RNA, 65 nt, Homo Sapiens; identical to SEQ ID NO: 192669

SEQ ID NO: 457286 - RNA, 65 nt, Homo Sapiens; identical to SEQ ID NO: 192670

SEQ ID NO: 457287 - RNA, 65 nt, Homo Sapiens; identical to SEQ ID NO: 192671

SEQ ID NO: 457288 - RNA, 65 nt, Homo Sapiens; identical to SEQ ID NO: 192672

SEQ ID NO: 457289 - RNA, 65 nt, Homo Sapiens; identical to SEQ ID NO: 192673

SEQ ID NO: 457290 - RNA, 65 nt, Homo Sapiens; identical to SEQ ID NO: 192674

SEQ ID NO: 457291 - RNA, 65 nt, Homo Sapiens; identical to SEQ ID NO: 192675

SEQ ID NO: 457292 - RNA, 65 nt, Homo Sapiens; identical to SEQ ID NO: 192676

SEQ ID NO: 457293 - RNA, 65 nt, Homo Sapiens; identical to SEQ ID NO: 192677

SEQ ID NO: 457294 - RNA, 65 nt, Homo Sapiens; identical to SEQ ID NO: 192678

SEQ ID NO: 457295 - RNA, 65 nt, Homo Sapiens; identical to SEQ ID NO: 192679

SEQ ID NO: 457296 - RNA, 65 nt, Homo Sapiens; identical to SEQ ID NO: 192680

SEQ ID NO: 457297 - RNA, 64 nt, Homo Sapiens; identical to SEQ ID NO: 455962

SEQ ID NO: 457298 - RNA, 64 nt, Homo Sapiens; identical to SEQ ID NO: 455963

SEQ ID NO: 457299 - RNA, 64 nt, Homo Sapiens; identical to SEQ ID NO: 455964

SEQ ID NO: 457300 - RNA, 64 nt, Homo Sapiens; identical to SEQ ID NO: 455965

SEQ ID NO: 457301 - RNA, 64 nt, Homo Sapiens; identical to SEQ ID NO: 455966

SEQ ID NO: 457302 - RNA, 64 nt, Homo Sapiens; identical to SEQ ID NO: 455967

SEQ ID NO: 457303 - RNA, 64 nt, Homo Sapiens; identical to SEQ ID NO: 455968

SEQ ID NO: 457304 - RNA, 64 nt, Homo Sapiens; identical to SEQ ID NO: 455969

SEQ ID NO: 457305 - RNA, 64 nt, Homo Sapiens; identical to SEQ ID NO: 455970

SEQ ID NO: 457306 - RNA, 64 nt, Homo Sapiens; identical to SEQ ID NO: 455971

SEQ ID NO: 457307 - RNA, 64 nt, Homo Sapiens; identical to SEQ ID NO: 455972

SEQ ID NO: 457308 - RNA, 64 nt, Homo Sapiens; identical to SEQ ID NO: 455973

SEQ ID NO: 457309 - RNA, 64 nt, Homo Sapiens; identical to SEQ ID NO: 455974

SEQ ID NO: 457310 - RNA, 64 nt, Homo Sapiens; identical to SEQ ID NO: 455975

SEQ ID NO: 457311 - RNA, 64 nt, Homo Sapiens; identical to SEQ ID NO: 455976

SEQ ID NO: 457312 - RNA, 64 nt, Homo Sapiens; identical to SEQ ID NO: 455977

SEQ ID NO: 457313 - RNA, 64 nt, Homo Sapiens; identical to SEQ ID NO: 455978

SEQ ID NO: 457314 - RNA, 64 nt, Homo Sapiens; identical to SEQ ID NO: 455979

SEQ ID NO: 457315 - RNA, 64 nt, Homo Sapiens; identical to SEQ ID NO: 455980

SEQ ID NO: 457316 - RNA, 64 nt, Homo Sapiens; identical to SEQ ID NO: 455981

SEQ ID NO: 457317 - RNA, 64 nt, Homo Sapiens; identical to SEQ ID NO: 455982

SEQ ID NO: 457318 - RNA, 64 nt, Homo Sapiens; identical to SEQ ID NO: 455983

SEQ ID NO: 457319 - RNA, 64 nt, Homo Sapiens; identical to SEQ ID NO: 455984

SEQ ID NO: 457320 - RNA, 64 nt, Homo Sapiens; identical to SEQ ID NO: 455985

SEQ ID NO: 457321 - RNA, 64 nt, Homo Sapiens; identical to SEQ ID NO: 455986

SEQ ID NO: 457322 - RNA, 64 nt, Homo Sapiens; identical to SEQ ID NO: 455987

SEQ ID NO: 457323 - RNA, 64 nt, Homo Sapiens; identical to SEQ ID NO: 455988

SEQ ID NO: 457324 - RNA, 64 nt, Homo Sapiens; identical to SEQ ID NO: 455989

SEQ ID NO: 457325 - RNA, 64 nt, Homo Sapiens; identical to SEQ ID NO: 455990

SEQ ID NO: 457326 - RNA, 64 nt, Homo Sapiens; identical to SEQ ID NO: 455991

SEQ ID NO: 457327 - RNA, 64 nt, Homo Sapiens; identical to SEQ ID NO: 455992

SEQ ID NO: 457328 - RNA, 64 nt, Homo Sapiens; identical to SEQ ID NO: 455993

SEQ ID NO: 457329 - RNA, 64 nt, Homo Sapiens; identical to SEQ ID NO: 455994

SEQ ID NO: 457330 - RNA, 64 nt, Homo Sapiens; identical to SEQ ID NO: 455995

SEQ ID NO: 457331 - RNA, 64 nt, Homo Sapiens; identical to SEQ ID NO: 455996

SEQ ID NO: 457332 - RNA, 64 nt, Homo Sapiens; identical to SEQ ID NO: 455997

SEQ ID NO: 457333 - RNA, 64 nt, Homo Sapiens; identical to SEQ ID NO: 455998

SEQ ID NO: 457334 - RNA, 64 nt, Homo Sapiens; identical to SEQ ID NO: 455999

SEQ ID NO: 457335 - RNA, 64 nt, Homo Sapiens; identical to SEQ ID NO: 456000

SEQ ID NO: 457336 - RNA, 64 nt, Homo Sapiens; identical to SEQ ID NO: 456001

SEQ ID NO: 457337 - RNA, 64 nt, Homo Sapiens; identical to SEQ ID NO: 456002

SEQ ID NO: 457338 - RNA, 64 nt, Homo Sapiens; identical to SEQ ID NO: 456003

SEQ ID NO: 457339 - RNA, 64 nt, Homo Sapiens; identical to SEQ ID NO: 456004

SEQ ID NO: 457340 - RNA, 64 nt, Homo Sapiens; identical to SEQ ID NO: 456005

SEQ ID NO: 457341 - RNA, 64 nt, Homo Sapiens; identical to SEQ ID NO: 456006

SEQ ID NO: 457342 - RNA, 64 nt, Homo Sapiens; identical to SEQ ID NO: 456007

SEQ ID NO: 457343 - RNA, 64 nt, Homo Sapiens; identical to SEQ ID NO: 456008

SEQ ID NO: 457344 - RNA, 64 nt, Homo Sapiens; identical to SEQ ID NO: 456009

SEQ ID NO: 457345 - RNA, 64 nt, Homo Sapiens; identical to SEQ ID NO: 456010

SEQ ID NO: 457346 - RNA, 64 nt, Homo Sapiens; identical to SEQ ID NO: 456011

SEQ ID NO: 457347 - RNA, 64 nt, Homo Sapiens; identical to SEQ ID NO: 456012

SEQ ID NO: 457348 - RNA, 64 nt, Homo Sapiens; identical to SEQ ID NO: 456013

SEQ ID NO: 457349 - RNA, 64 nt, Homo Sapiens; identical to SEQ ID NO: 456014

SEQ ID NO: 457350 - RNA, 64 nt, Homo Sapiens; identical to SEQ ID NO: 456015

SEQ ID NO: 457351 - RNA, 64 nt, Homo Sapiens; identical to SEQ ID NO: 456016

SEQ ID NO: 457352 - RNA, 64 nt, Homo Sapiens; identical to SEQ ID NO: 456017

SEQ ID NO: 457353 - RNA, 64 nt, Homo Sapiens; identical to SEQ ID NO: 456018

SEQ ID NO: 457354 - RNA, 64 nt, Homo Sapiens; identical to SEQ ID NO: 456019

SEQ ID NO: 457355 - RNA, 64 nt, Homo Sapiens; identical to SEQ ID NO: 456020

SEQ ID NO: 457356 - RNA, 64 nt, Homo Sapiens; identical to SEQ ID NO: 456021

SEQ ID NO: 457357 - RNA, 64 nt, Homo Sapiens; identical to SEQ ID NO: 456022

SEQ ID NO: 457358 - RNA, 64 nt, Homo Sapiens; identical to SEQ ID NO: 456023

SEQ ID NO: 457359 - RNA, 64 nt, Homo Sapiens; identical to SEQ ID NO: 456024

SEQ ID NO: 457360 - RNA, 64 nt, Homo Sapiens; identical to SEQ ID NO: 456025

SEQ ID NO: 457361 - RNA, 64 nt, Homo Sapiens; identical to SEQ ID NO: 456026

SEQ ID NO: 457362 - RNA, 64 nt, Homo Sapiens; identical to SEQ ID NO: 456027

SEQ ID NO: 457363 - RNA, 64 nt, Homo Sapiens; identical to SEQ ID NO: 456028

SEQ ID NO: 457364 - RNA, 64 nt, Homo Sapiens; identical to SEQ ID NO: 456029

SEQ ID NO: 457365 - RNA, 64 nt, Homo Sapiens; identical to SEQ ID NO: 456030

SEQ ID NO: 457366 - RNA, 64 nt, Homo Sapiens; identical to SEQ ID NO: 456031

SEQ ID NO: 457367 - RNA, 64 nt, Homo Sapiens; identical to SEQ ID NO: 456032

SEQ ID NO: 457368 - RNA, 64 nt, Homo Sapiens; identical to SEQ ID NO: 456033

SEQ ID NO: 457369 - RNA, 64 nt, Homo Sapiens; identical to SEQ ID NO: 456034

SEQ ID NO: 457370 - RNA, 64 nt, Homo Sapiens; identical to SEQ ID NO: 456035

SEQ ID NO: 457371 - RNA, 64 nt, Homo Sapiens; identical to SEQ ID NO: 456036

SEQ ID NO: 457372 - RNA, 64 nt, Homo Sapiens; identical to SEQ ID NO: 456037

SEQ ID NO: 457373 - RNA, 64 nt, Homo Sapiens; identical to SEQ ID NO: 456038

SEQ ID NO: 457374 - RNA, 64 nt, Homo Sapiens; identical to SEQ ID NO: 456039

SEQ ID NO: 457375 - RNA, 64 nt, Homo Sapiens; identical to SEQ ID NO: 456040

SEQ ID NO: 457376 - RNA, 64 nt, Homo Sapiens; identical to SEQ ID NO: 456041

SEQ ID NO: 457377 - RNA, 64 nt, Homo Sapiens; identical to SEQ ID NO: 456042

SEQ ID NO: 457378 - RNA, 64 nt, Homo Sapiens; identical to SEQ ID NO: 456043

SEQ ID NO: 457379 - RNA, 64 nt, Homo Sapiens; identical to SEQ ID NO: 456044

SEQ ID NO: 457380 - RNA, 64 nt, Homo Sapiens; identical to SEQ ID NO: 456045

SEQ ID NO: 457381 - RNA, 64 nt, Homo Sapiens; identical to SEQ ID NO: 456046

SEQ ID NO: 457382 - RNA, 64 nt, Homo Sapiens; identical to SEQ ID NO: 456047

SEQ ID NO: 457383 - RNA, 64 nt, Homo Sapiens; identical to SEQ ID NO: 456048

SEQ ID NO: 457384 - RNA, 64 nt, Homo Sapiens; identical to SEQ ID NO: 456049

SEQ ID NO: 457385 - RNA, 64 nt, Homo Sapiens; identical to SEQ ID NO: 456050

SEQ ID NO: 457386 - RNA, 64 nt, Homo Sapiens; identical to SEQ ID NO: 456051

SEQ ID NO: 457387 - RNA, 64 nt, Homo Sapiens; identical to SEQ ID NO: 456052

SEQ ID NO: 457388 - RNA, 64 nt, Homo Sapiens; identical to SEQ ID NO: 456053

SEQ ID NO: 457389 - RNA, 64 nt, Homo Sapiens; identical to SEQ ID NO: 456054

SEQ ID NO: 457390 - RNA, 64 nt, Homo Sapiens; identical to SEQ ID NO: 456055

SEQ ID NO: 457391 - RNA, 64 nt, Homo Sapiens; identical to SEQ ID NO: 456056

SEQ ID NO: 457392 - RNA, 64 nt, Homo Sapiens; identical to SEQ ID NO: 456057

SEQ ID NO: 457393 - RNA, 64 nt, Homo Sapiens; identical to SEQ ID NO: 456058

SEQ ID NO: 457394 - RNA, 64 nt, Homo Sapiens; identical to SEQ ID NO: 456059

SEQ ID NO: 457395 - RNA, 64 nt, Homo Sapiens; identical to SEQ ID NO: 456060

SEQ ID NO: 457396 - RNA, 64 nt, Homo Sapiens; identical to SEQ ID NO: 456061

SEQ ID NO: 457397 - RNA, 64 nt, Homo Sapiens; identical to SEQ ID NO: 456062

SEQ ID NO: 457398 - RNA, 64 nt, Homo Sapiens; identical to SEQ ID NO: 456063

SEQ ID NO: 457399 - RNA, 64 nt, Homo Sapiens; identical to SEQ ID NO: 456064

SEQ ID NO: 457400 - RNA, 64 nt, Homo Sapiens; identical to SEQ ID NO: 456065

SEQ ID NO: 457401 - RNA, 64 nt, Homo Sapiens; identical to SEQ ID NO: 456066

SEQ ID NO: 457402 - RNA, 64 nt, Homo Sapiens; identical to SEQ ID NO: 456067

SEQ ID NO: 457403 - RNA, 64 nt, Homo Sapiens; identical to SEQ ID NO: 456068

SEQ ID NO: 457404 - RNA, 64 nt, Homo Sapiens; identical to SEQ ID NO: 456069

SEQ ID NO: 457405 - RNA, 64 nt, Homo Sapiens; identical to SEQ ID NO: 456070

SEQ ID NO: 457406 - RNA, 64 nt, Homo Sapiens; identical to SEQ ID NO: 456071

SEQ ID NO: 457407 - RNA, 64 nt, Homo Sapiens; identical to SEQ ID NO: 456072

SEQ ID NO: 457408 - RNA, 64 nt, Homo Sapiens; identical to SEQ ID NO: 456073

SEQ ID NO: 457409 - RNA, 64 nt, Homo Sapiens; identical to SEQ ID NO: 456074

SEQ ID NO: 457410 - RNA, 64 nt, Homo Sapiens; identical to SEQ ID NO: 456075

SEQ ID NO: 457411 - RNA, 64 nt, Homo Sapiens; identical to SEQ ID NO: 456076

SEQ ID NO: 457412 - RNA, 64 nt, Homo Sapiens; identical to SEQ ID NO: 456077

SEQ ID NO: 457413 - RNA, 64 nt, Homo Sapiens; identical to SEQ ID NO: 456078

SEQ ID NO: 457414 - RNA, 64 nt, Homo Sapiens; identical to SEQ ID NO: 456079

SEQ ID NO: 457415 - RNA, 64 nt, Homo Sapiens; identical to SEQ ID NO: 456080

SEQ ID NO: 457416 - RNA, 64 nt, Homo Sapiens; identical to SEQ ID NO: 456081

SEQ ID NO: 457417 - RNA, 64 nt, Homo Sapiens; identical to SEQ ID NO: 456082

SEQ ID NO: 457418 - RNA, 64 nt, Homo Sapiens; identical to SEQ ID NO: 456083

SEQ ID NO: 457419 - RNA, 64 nt, Homo Sapiens; identical to SEQ ID NO: 456084

SEQ ID NO: 457420 - RNA, 64 nt, Homo Sapiens; identical to SEQ ID NO: 456085

SEQ ID NO: 457421 - RNA, 64 nt, Homo Sapiens; identical to SEQ ID NO: 456086

SEQ ID NO: 457422 - RNA, 64 nt, Homo Sapiens; identical to SEQ ID NO: 456087

SEQ ID NO: 457423 - RNA, 64 nt, Homo Sapiens; identical to SEQ ID NO: 456088

SEQ ID NO: 457424 - RNA, 64 nt, Homo Sapiens; identical to SEQ ID NO: 456089

SEQ ID NO: 457425 - RNA, 64 nt, Homo Sapiens; identical to SEQ ID NO: 456090

SEQ ID NO: 457426 - RNA, 64 nt, Homo Sapiens; identical to SEQ ID NO: 456091

SEQ ID NO: 457427 - RNA, 64 nt, Homo Sapiens; identical to SEQ ID NO: 456092

SEQ ID NO: 457428 - RNA, 64 nt, Homo Sapiens; identical to SEQ ID NO: 456093

SEQ ID NO: 457429 - RNA, 64 nt, Homo Sapiens; identical to SEQ ID NO: 456094

SEQ ID NO: 457430 - RNA, 64 nt, Homo Sapiens; identical to SEQ ID NO: 456095

SEQ ID NO: 457431 - RNA, 64 nt, Homo Sapiens; identical to SEQ ID NO: 456096

SEQ ID NO: 457432 - RNA, 64 nt, Homo Sapiens; identical to SEQ ID NO: 456097

SEQ ID NO: 457433 - RNA, 64 nt, Homo Sapiens; identical to SEQ ID NO: 456098

SEQ ID NO: 457434 - RNA, 64 nt, Homo Sapiens; identical to SEQ ID NO: 456099

SEQ ID NO: 457435 - RNA, 64 nt, Homo Sapiens; identical to SEQ ID NO: 456100

SEQ ID NO: 457436 - RNA, 64 nt, Homo Sapiens; identical to SEQ ID NO: 456101

SEQ ID NO: 457437 - RNA, 64 nt, Homo Sapiens; identical to SEQ ID NO: 456102

SEQ ID NO: 457438 - RNA, 64 nt, Homo Sapiens; identical to SEQ ID NO: 456103

SEQ ID NO: 457439 - RNA, 64 nt, Homo Sapiens; identical to SEQ ID NO: 456104

SEQ ID NO: 457440 - RNA, 64 nt, Homo Sapiens; identical to SEQ ID NO: 456105

SEQ ID NO: 457441 - RNA, 64 nt, Homo Sapiens; identical to SEQ ID NO: 456106

SEQ ID NO: 457442 - RNA, 64 nt, Homo Sapiens; identical to SEQ ID NO: 456107

SEQ ID NO: 457443 - RNA, 64 nt, Homo Sapiens; identical to SEQ ID NO: 456108

SEQ ID NO: 457444 - RNA, 64 nt, Homo Sapiens; identical to SEQ ID NO: 456109

SEQ ID NO: 457445 - RNA, 64 nt, Homo Sapiens; identical to SEQ ID NO: 456110

SEQ ID NO: 457446 - RNA, 64 nt, Homo Sapiens; identical to SEQ ID NO: 456111

SEQ ID NO: 457447 - RNA, 64 nt, Homo Sapiens; identical to SEQ ID NO: 456112

SEQ ID NO: 457448 - RNA, 64 nt, Homo Sapiens; identical to SEQ ID NO: 456113

SEQ ID NO: 457449 - RNA, 64 nt, Homo Sapiens; identical to SEQ ID NO: 456114

SEQ ID NO: 457450 - RNA, 64 nt, Homo Sapiens; identical to SEQ ID NO: 456115

SEQ ID NO: 457451 - RNA, 64 nt, Homo Sapiens; identical to SEQ ID NO: 456116

SEQ ID NO: 457452 - RNA, 64 nt, Homo Sapiens; identical to SEQ ID NO: 456117

SEQ ID NO: 457453 - RNA, 64 nt, Homo Sapiens; identical to SEQ ID NO: 456118

SEQ ID NO: 457454 - RNA, 64 nt, Homo Sapiens; identical to SEQ ID NO: 456119

SEQ ID NO: 457455 - RNA, 64 nt, Homo Sapiens; identical to SEQ ID NO: 456120

SEQ ID NO: 457456 - RNA, 64 nt, Homo Sapiens; identical to SEQ ID NO: 456121

SEQ ID NO: 457457 - RNA, 64 nt, Homo Sapiens; identical to SEQ ID NO: 456122

SEQ ID NO: 457458 - RNA, 64 nt, Homo Sapiens; identical to SEQ ID NO: 456123

SEQ ID NO: 457459 - RNA, 64 nt, Homo Sapiens; identical to SEQ ID NO: 456124

SEQ ID NO: 457460 - RNA, 64 nt, Homo Sapiens; identical to SEQ ID NO: 456125

SEQ ID NO: 457461 - RNA, 64 nt, Homo Sapiens; identical to SEQ ID NO: 456126

SEQ ID NO: 457462 - RNA, 64 nt, Homo Sapiens; identical to SEQ ID NO: 456127

SEQ ID NO: 457463 - RNA, 64 nt, Homo Sapiens; identical to SEQ ID NO: 456128

SEQ ID NO: 457464 - RNA, 64 nt, Homo Sapiens; identical to SEQ ID NO: 456129

SEQ ID NO: 457465 - RNA, 64 nt, Homo Sapiens; identical to SEQ ID NO: 456130

SEQ ID NO: 457466 - RNA, 64 nt, Homo Sapiens; identical to SEQ ID NO: 456131

SEQ ID NO: 457467 - RNA, 64 nt, Homo Sapiens; identical to SEQ ID NO: 456132

SEQ ID NO: 457468 - RNA, 64 nt, Homo Sapiens; identical to SEQ ID NO: 456133

SEQ ID NO: 457469 - RNA, 64 nt, Homo Sapiens; identical to SEQ ID NO: 456134

SEQ ID NO: 457470 - RNA, 64 nt, Homo Sapiens; identical to SEQ ID NO: 456135

SEQ ID NO: 457471 - RNA, 64 nt, Homo Sapiens; identical to SEQ ID NO: 456136

SEQ ID NO: 457472 - RNA, 64 nt, Homo Sapiens; identical to SEQ ID NO: 456137

SEQ ID NO: 457473 - RNA, 64 nt, Homo Sapiens; identical to SEQ ID NO: 456138

SEQ ID NO: 457474 - RNA, 64 nt, Homo Sapiens; identical to SEQ ID NO: 456139

SEQ ID NO: 457475 - RNA, 64 nt, Homo Sapiens; identical to SEQ ID NO: 456140

SEQ ID NO: 457476 - RNA, 64 nt, Homo Sapiens; identical to SEQ ID NO: 456141

SEQ ID NO: 457477 - RNA, 64 nt, Homo Sapiens; identical to SEQ ID NO: 456142

SEQ ID NO: 457478 - RNA, 64 nt, Homo Sapiens; identical to SEQ ID NO: 456143

SEQ ID NO: 457479 - RNA, 64 nt, Homo Sapiens; identical to SEQ ID NO: 456144

SEQ ID NO: 457480 - RNA, 64 nt, Homo Sapiens; identical to SEQ ID NO: 456145

SEQ ID NO: 457481 - RNA, 64 nt, Homo Sapiens; identical to SEQ ID NO: 456146

SEQ ID NO: 457482 - RNA, 64 nt, Homo Sapiens; identical to SEQ ID NO: 456147

SEQ ID NO: 457483 - RNA, 64 nt, Homo Sapiens; identical to SEQ ID NO: 456148

SEQ ID NO: 457484 - RNA, 64 nt, Homo Sapiens; identical to SEQ ID NO: 456149

SEQ ID NO: 457485 - RNA, 64 nt, Homo Sapiens; identical to SEQ ID NO: 456150

SEQ ID NO: 457486 - RNA, 64 nt, Homo Sapiens; identical to SEQ ID NO: 456151

SEQ ID NO: 457487 - RNA, 64 nt, Homo Sapiens; identical to SEQ ID NO: 456152

SEQ ID NO: 457488 - RNA, 64 nt, Homo Sapiens; identical to SEQ ID NO: 456153

SEQ ID NO: 457489 - RNA, 64 nt, Homo Sapiens; identical to SEQ ID NO: 456154

SEQ ID NO: 457490 - RNA, 64 nt, Homo Sapiens; identical to SEQ ID NO: 456155

SEQ ID NO: 457491 - RNA, 64 nt, Homo Sapiens; identical to SEQ ID NO: 456156

SEQ ID NO: 457492 - RNA, 64 nt, Homo Sapiens; identical to SEQ ID NO: 456157

SEQ ID NO: 457493 - RNA, 64 nt, Homo Sapiens; identical to SEQ ID NO: 456158

SEQ ID NO: 457494 - RNA, 64 nt, Homo Sapiens; identical to SEQ ID NO: 456159

SEQ ID NO: 457495 - RNA, 64 nt, Homo Sapiens; identical to SEQ ID NO: 456160

SEQ ID NO: 457496 - RNA, 55 nt, Homo Sapiens; identical to SEQ ID NO: 456161

SEQ ID NO: 457497 - RNA, 64 nt, Homo Sapiens; identical to SEQ ID NO: 456162

SEQ ID NO: 457498 - RNA, 64 nt, Homo Sapiens; identical to SEQ ID NO: 456163

SEQ ID NO: 457499 - RNA, 64 nt, Homo Sapiens; identical to SEQ ID NO: 456164

SEQ ID NO: 457500 - RNA, 64 nt, Homo Sapiens; identical to SEQ ID NO: 456165

SEQ ID NO: 457501 - RNA, 64 nt, Homo Sapiens; identical to SEQ ID NO: 456166

SEQ ID NO: 457502 - RNA, 64 nt, Homo Sapiens; identical to SEQ ID NO: 456167

SEQ ID NO: 457503 - RNA, 64 nt, Homo Sapiens; identical to SEQ ID NO: 456168

SEQ ID NO: 457504 - RNA, 64 nt, Homo Sapiens; identical to SEQ ID NO: 456169

SEQ ID NO: 457505 - RNA, 64 nt, Homo Sapiens; identical to SEQ ID NO: 456170

SEQ ID NO: 457506 - RNA, 60 nt, Homo Sapiens; identical to SEQ ID NO: 456171

SEQ ID NO: 457507 - RNA, 64 nt, Homo Sapiens; identical to SEQ ID NO: 456172

SEQ ID NO: 457508 - RNA, 64 nt, Homo Sapiens; identical to SEQ ID NO: 456173

SEQ ID NO: 457509 - RNA, 64 nt, Homo Sapiens; identical to SEQ ID NO: 456174

SEQ ID NO: 457510 - RNA, 64 nt, Homo Sapiens; identical to SEQ ID NO: 456175

SEQ ID NO: 457511 - RNA, 64 nt, Homo Sapiens; identical to SEQ ID NO: 456176

SEQ ID NO: 457512 - RNA, 64 nt, Homo Sapiens; identical to SEQ ID NO: 456177

SEQ ID NO: 457513 - RNA, 64 nt, Homo Sapiens; identical to SEQ ID NO: 456178

SEQ ID NO: 457514 - RNA, 64 nt, Homo Sapiens; identical to SEQ ID NO: 456179

SEQ ID NO: 457515 - RNA, 64 nt, Homo Sapiens; identical to SEQ ID NO: 456180

SEQ ID NO: 457516 - RNA, 64 nt, Homo Sapiens; identical to SEQ ID NO: 456181

SEQ ID NO: 457517 - RNA, 64 nt, Homo Sapiens; identical to SEQ ID NO: 456182

SEQ ID NO: 457518 - RNA, 64 nt, Homo Sapiens; identical to SEQ ID NO: 456183

SEQ ID NO: 457519 - RNA, 64 nt, Homo Sapiens; identical to SEQ ID NO: 456184

SEQ ID NO: 457520 - RNA, 64 nt, Homo Sapiens; identical to SEQ ID NO: 456185

SEQ ID NO: 457521 - RNA, 64 nt, Homo Sapiens; identical to SEQ ID NO: 456186

SEQ ID NO: 457522 - RNA, 64 nt, Homo Sapiens; identical to SEQ ID NO: 456187

SEQ ID NO: 457523 - RNA, 64 nt, Homo Sapiens; identical to SEQ ID NO: 456188

SEQ ID NO: 457524 - RNA, 64 nt, Homo Sapiens; identical to SEQ ID NO: 456189

SEQ ID NO: 457525 - RNA, 64 nt, Homo Sapiens; identical to SEQ ID NO: 456190

SEQ ID NO: 457526 - RNA, 64 nt, Homo Sapiens; identical to SEQ ID NO: 456191

SEQ ID NO: 457527 - RNA, 64 nt, Homo Sapiens; identical to SEQ ID NO: 456192

SEQ ID NO: 457528 - RNA, 64 nt, Homo Sapiens; identical to SEQ ID NO: 456193

SEQ ID NO: 457529 - RNA, 64 nt, Homo Sapiens; identical to SEQ ID NO: 456194

SEQ ID NO: 457530 - RNA, 64 nt, Homo Sapiens; identical to SEQ ID NO: 456195

SEQ ID NO: 457531 - RNA, 64 nt, Homo Sapiens; identical to SEQ ID NO: 456196

SEQ ID NO: 457532 - RNA, 64 nt, Homo Sapiens; identical to SEQ ID NO: 456197

SEQ ID NO: 457533 - RNA, 64 nt, Homo Sapiens; identical to SEQ ID NO: 456198

SEQ ID NO: 457534 - RNA, 64 nt, Homo Sapiens; identical to SEQ ID NO: 456199

SEQ ID NO: 457535 - RNA, 64 nt, Homo Sapiens; identical to SEQ ID NO: 456200

SEQ ID NO: 457536 - RNA, 64 nt, Homo Sapiens; identical to SEQ ID NO: 456201

SEQ ID NO: 457537 - RNA, 64 nt, Homo Sapiens; identical to SEQ ID NO: 456202

SEQ ID NO: 457538 - RNA, 64 nt, Homo Sapiens; identical to SEQ ID NO: 456203

SEQ ID NO: 457539 - RNA, 64 nt, Homo Sapiens; identical to SEQ ID NO: 456204

SEQ ID NO: 457540 - RNA, 64 nt, Homo Sapiens; identical to SEQ ID NO: 456205

SEQ ID NO: 457541 - RNA, 64 nt, Homo Sapiens; identical to SEQ ID NO: 456206

SEQ ID NO: 457542 - RNA, 64 nt, Homo Sapiens; identical to SEQ ID NO: 456207

SEQ ID NO: 457543 - RNA, 64 nt, Homo Sapiens; identical to SEQ ID NO: 456208

SEQ ID NO: 457544 - RNA, 64 nt, Homo Sapiens; identical to SEQ ID NO: 456209

SEQ ID NO: 457545 - RNA, 64 nt, Homo Sapiens; identical to SEQ ID NO: 456210

SEQ ID NO: 457546 - RNA, 64 nt, Homo Sapiens; identical to SEQ ID NO: 456211

SEQ ID NO: 457547 - RNA, 64 nt, Homo Sapiens; identical to SEQ ID NO: 456212

SEQ ID NO: 457548 - RNA, 64 nt, Homo Sapiens; identical to SEQ ID NO: 456213

SEQ ID NO: 457549 - RNA, 64 nt, Homo Sapiens; identical to SEQ ID NO: 456214

SEQ ID NO: 457550 - RNA, 64 nt, Homo Sapiens; identical to SEQ ID NO: 456215

SEQ ID NO: 457551 - RNA, 64 nt, Homo Sapiens; identical to SEQ ID NO: 456216

SEQ ID NO: 457552 - RNA, 64 nt, Homo Sapiens; identical to SEQ ID NO: 456217

SEQ ID NO: 457553 - RNA, 64 nt, Homo Sapiens; identical to SEQ ID NO: 456218

SEQ ID NO: 457554 - RNA, 64 nt, Homo Sapiens; identical to SEQ ID NO: 456219

SEQ ID NO: 457555 - RNA, 64 nt, Homo Sapiens; identical to SEQ ID NO: 456220

SEQ ID NO: 457556 - RNA, 64 nt, Homo Sapiens; identical to SEQ ID NO: 456221

SEQ ID NO: 457557 - RNA, 64 nt, Homo Sapiens; identical to SEQ ID NO: 456222

SEQ ID NO: 457558 - RNA, 64 nt, Homo Sapiens; identical to SEQ ID NO: 456223

SEQ ID NO: 457559 - RNA, 64 nt, Homo Sapiens; identical to SEQ ID NO: 456224

SEQ ID NO: 457560 - RNA, 64 nt, Homo Sapiens; identical to SEQ ID NO: 456225

SEQ ID NO: 457561 - RNA, 64 nt, Homo Sapiens; identical to SEQ ID NO: 456226

SEQ ID NO: 457562 - RNA, 64 nt, Homo Sapiens; identical to SEQ ID NO: 456227

SEQ ID NO: 457563 - RNA, 64 nt, Homo Sapiens; identical to SEQ ID NO: 456228

SEQ ID NO: 457564 - RNA, 64 nt, Homo Sapiens; identical to SEQ ID NO: 456229

SEQ ID NO: 457565 - RNA, 64 nt, Homo Sapiens; identical to SEQ ID NO: 456230

SEQ ID NO: 457566 - RNA, 64 nt, Homo Sapiens; identical to SEQ ID NO: 456231

SEQ ID NO: 457567 - RNA, 64 nt, Homo Sapiens; identical to SEQ ID NO: 456232

SEQ ID NO: 457568 - RNA, 64 nt, Homo Sapiens; identical to SEQ ID NO: 456233

SEQ ID NO: 457569 - RNA, 64 nt, Homo Sapiens; identical to SEQ ID NO: 456234

SEQ ID NO: 457570 - RNA, 64 nt, Homo Sapiens; identical to SEQ ID NO: 456235

SEQ ID NO: 457571 - RNA, 64 nt, Homo Sapiens; identical to SEQ ID NO: 456236

SEQ ID NO: 457572 - RNA, 64 nt, Homo Sapiens; identical to SEQ ID NO: 456237

SEQ ID NO: 457573 - RNA, 64 nt, Homo Sapiens; identical to SEQ ID NO: 456238

SEQ ID NO: 457574 - RNA, 64 nt, Homo Sapiens; identical to SEQ ID NO: 456239

SEQ ID NO: 457575 - RNA, 64 nt, Homo Sapiens; identical to SEQ ID NO: 456240

SEQ ID NO: 457576 - RNA, 64 nt, Homo Sapiens; identical to SEQ ID NO: 456241

SEQ ID NO: 457577 - RNA, 64 nt, Homo Sapiens; identical to SEQ ID NO: 456242

SEQ ID NO: 457578 - RNA, 64 nt, Homo Sapiens; identical to SEQ ID NO: 456243

SEQ ID NO: 457579 - RNA, 64 nt, Homo Sapiens; identical to SEQ ID NO: 456244

SEQ ID NO: 457580 - RNA, 64 nt, Homo Sapiens; identical to SEQ ID NO: 456245

SEQ ID NO: 457581 - RNA, 64 nt, Homo Sapiens; identical to SEQ ID NO: 456246

SEQ ID NO: 457582 - RNA, 64 nt, Homo Sapiens; identical to SEQ ID NO: 456247

SEQ ID NO: 457583 - RNA, 64 nt, Homo Sapiens; identical to SEQ ID NO: 456248

SEQ ID NO: 457584 - RNA, 64 nt, Homo Sapiens; identical to SEQ ID NO: 456249

SEQ ID NO: 457585 - RNA, 64 nt, Homo Sapiens; identical to SEQ ID NO: 456250

SEQ ID NO: 457586 - RNA, 64 nt, Homo Sapiens; identical to SEQ ID NO: 456251

SEQ ID NO: 457587 - RNA, 64 nt, Homo Sapiens; identical to SEQ ID NO: 456252

SEQ ID NO: 457588 - RNA, 64 nt, Homo Sapiens; identical to SEQ ID NO: 456253

SEQ ID NO: 457589 - RNA, 64 nt, Homo Sapiens; identical to SEQ ID NO: 456254

SEQ ID NO: 457590 - RNA, 64 nt, Homo Sapiens; identical to SEQ ID NO: 456255

SEQ ID NO: 457591 - RNA, 64 nt, Homo Sapiens; identical to SEQ ID NO: 456256

SEQ ID NO: 457592 - RNA, 64 nt, Homo Sapiens; identical to SEQ ID NO: 456257

SEQ ID NO: 457593 - RNA, 64 nt, Homo Sapiens; identical to SEQ ID NO: 456258

SEQ ID NO: 457594 - RNA, 64 nt, Homo Sapiens; identical to SEQ ID NO: 456259

SEQ ID NO: 457595 - RNA, 64 nt, Homo Sapiens; identical to SEQ ID NO: 456260

SEQ ID NO: 457596 - RNA, 64 nt, Homo Sapiens; identical to SEQ ID NO: 456261

SEQ ID NO: 457597 - RNA, 64 nt, Homo Sapiens; identical to SEQ ID NO: 456262

SEQ ID NO: 457598 - RNA, 64 nt, Homo Sapiens; identical to SEQ ID NO: 456263

SEQ ID NO: 457599 - RNA, 64 nt, Homo Sapiens; identical to SEQ ID NO: 456264

SEQ ID NO: 457600 - RNA, 64 nt, Homo Sapiens; identical to SEQ ID NO: 456265

SEQ ID NO: 457601 - RNA, 64 nt, Homo Sapiens; identical to SEQ ID NO: 456266

SEQ ID NO: 457602 - RNA, 64 nt, Homo Sapiens; identical to SEQ ID NO: 456267

SEQ ID NO: 457603 - RNA, 64 nt, Homo Sapiens; identical to SEQ ID NO: 456268

SEQ ID NO: 457604 - RNA, 64 nt, Homo Sapiens; identical to SEQ ID NO: 456269

SEQ ID NO: 457605 - RNA, 64 nt, Homo Sapiens; identical to SEQ ID NO: 456270

SEQ ID NO: 457606 - RNA, 64 nt, Homo Sapiens; identical to SEQ ID NO: 456271

SEQ ID NO: 457607 - RNA, 64 nt, Homo Sapiens; identical to SEQ ID NO: 456272

SEQ ID NO: 457608 - RNA, 64 nt, Homo Sapiens; identical to SEQ ID NO: 456273

SEQ ID NO: 457609 - RNA, 64 nt, Homo Sapiens; identical to SEQ ID NO: 456274

SEQ ID NO: 457610 - RNA, 64 nt, Homo Sapiens; identical to SEQ ID NO: 456275

SEQ ID NO: 457611 - RNA, 64 nt, Homo Sapiens; identical to SEQ ID NO: 456276

SEQ ID NO: 457612 - RNA, 64 nt, Homo Sapiens; identical to SEQ ID NO: 456277

SEQ ID NO: 457613 - RNA, 64 nt, Homo Sapiens; identical to SEQ ID NO: 456278

SEQ ID NO: 457614 - RNA, 64 nt, Homo Sapiens; identical to SEQ ID NO: 456279

SEQ ID NO: 457615 - RNA, 64 nt, Homo Sapiens; identical to SEQ ID NO: 456280

SEQ ID NO: 457616 - RNA, 64 nt, Homo Sapiens; identical to SEQ ID NO: 456281

SEQ ID NO: 457617 - RNA, 64 nt, Homo Sapiens; identical to SEQ ID NO: 456282

SEQ ID NO: 457618 - RNA, 64 nt, Homo Sapiens; identical to SEQ ID NO: 456283

SEQ ID NO: 457619 - RNA, 64 nt, Homo Sapiens; identical to SEQ ID NO: 456284

SEQ ID NO: 457620 - RNA, 64 nt, Homo Sapiens; identical to SEQ ID NO: 456285

SEQ ID NO: 457621 - RNA, 64 nt, Homo Sapiens; identical to SEQ ID NO: 456286

SEQ ID NO: 457622 - RNA, 64 nt, Homo Sapiens; identical to SEQ ID NO: 456287

SEQ ID NO: 457623 - RNA, 64 nt, Homo Sapiens; identical to SEQ ID NO: 456288

SEQ ID NO: 457624 - RNA, 64 nt, Homo Sapiens; identical to SEQ ID NO: 456289

SEQ ID NO: 457625 - RNA, 64 nt, Homo Sapiens; identical to SEQ ID NO: 456290

SEQ ID NO: 457626 - RNA, 64 nt, Homo Sapiens; identical to SEQ ID NO: 456291

SEQ ID NO: 457627 - RNA, 64 nt, Homo Sapiens; identical to SEQ ID NO: 456292

SEQ ID NO: 457628 - RNA, 64 nt, Homo Sapiens; identical to SEQ ID NO: 456293

SEQ ID NO: 457629 - RNA, 64 nt, Homo Sapiens; identical to SEQ ID NO: 456294

SEQ ID NO: 457630 - RNA, 64 nt, Homo Sapiens; identical to SEQ ID NO: 456295

SEQ ID NO: 457631 - RNA, 64 nt, Homo Sapiens; identical to SEQ ID NO: 456296

SEQ ID NO: 457632 - RNA, 64 nt, Homo Sapiens; identical to SEQ ID NO: 456297

SEQ ID NO: 457633 - RNA, 64 nt, Homo Sapiens; identical to SEQ ID NO: 456298

SEQ ID NO: 457634 - RNA, 64 nt, Homo Sapiens; identical to SEQ ID NO: 456299

SEQ ID NO: 457635 - RNA, 64 nt, Homo Sapiens; identical to SEQ ID NO: 456300

SEQ ID NO: 457636 - RNA, 64 nt, Homo Sapiens; identical to SEQ ID NO: 456301

SEQ ID NO: 457637 - RNA, 64 nt, Homo Sapiens; identical to SEQ ID NO: 456302

SEQ ID NO: 457638 - RNA, 64 nt, Homo Sapiens; identical to SEQ ID NO: 456303

SEQ ID NO: 457639 - RNA, 64 nt, Homo Sapiens; identical to SEQ ID NO: 456304

SEQ ID NO: 457640 - RNA, 64 nt, Homo Sapiens; identical to SEQ ID NO: 456305

SEQ ID NO: 457641 - RNA, 64 nt, Homo Sapiens; identical to SEQ ID NO: 456306

SEQ ID NO: 457642 - RNA, 64 nt, Homo Sapiens; identical to SEQ ID NO: 456307

SEQ ID NO: 457643 - RNA, 64 nt, Homo Sapiens; identical to SEQ ID NO: 456308

SEQ ID NO: 457644 - RNA, 64 nt, Homo Sapiens; identical to SEQ ID NO: 456309

SEQ ID NO: 457645 - RNA, 64 nt, Homo Sapiens; identical to SEQ ID NO: 456310

SEQ ID NO: 457646 - RNA, 64 nt, Homo Sapiens; identical to SEQ ID NO: 456311

SEQ ID NO: 457647 - RNA, 64 nt, Homo Sapiens; identical to SEQ ID NO: 456312

SEQ ID NO: 457648 - RNA, 64 nt, Homo Sapiens; identical to SEQ ID NO: 456313

SEQ ID NO: 457649 - RNA, 64 nt, Homo Sapiens; identical to SEQ ID NO: 456314

SEQ ID NO: 457650 - RNA, 64 nt, Homo Sapiens; identical to SEQ ID NO: 456315

SEQ ID NO: 457651 - RNA, 64 nt, Homo Sapiens; identical to SEQ ID NO: 456316

SEQ ID NO: 457652 - RNA, 64 nt, Homo Sapiens; identical to SEQ ID NO: 456317

SEQ ID NO: 457653 - RNA, 64 nt, Homo Sapiens; identical to SEQ ID NO: 456318

SEQ ID NO: 457654 - RNA, 64 nt, Homo Sapiens; identical to SEQ ID NO: 456319

SEQ ID NO: 457655 - RNA, 64 nt, Homo Sapiens; identical to SEQ ID NO: 456320

SEQ ID NO: 457656 - RNA, 64 nt, Homo Sapiens; identical to SEQ ID NO: 456321

SEQ ID NO: 457657 - RNA, 64 nt, Homo Sapiens; identical to SEQ ID NO: 456322

SEQ ID NO: 457658 - RNA, 64 nt, Homo Sapiens; identical to SEQ ID NO: 456323

SEQ ID NO: 457659 - RNA, 64 nt, Homo Sapiens; identical to SEQ ID NO: 456324

SEQ ID NO: 457660 - RNA, 64 nt, Homo Sapiens; identical to SEQ ID NO: 456325

SEQ ID NO: 457661 - RNA, 64 nt, Homo Sapiens; identical to SEQ ID NO: 456326

SEQ ID NO: 457662 - RNA, 64 nt, Homo Sapiens; identical to SEQ ID NO: 456327

SEQ ID NO: 457663 - RNA, 64 nt, Homo Sapiens; identical to SEQ ID NO: 456328

SEQ ID NO: 457664 - RNA, 64 nt, Homo Sapiens; identical to SEQ ID NO: 456329

SEQ ID NO: 457665 - RNA, 64 nt, Homo Sapiens; identical to SEQ ID NO: 456330

SEQ ID NO: 457666 - RNA, 64 nt, Homo Sapiens; identical to SEQ ID NO: 456331

SEQ ID NO: 457667 - RNA, 64 nt, Homo Sapiens; identical to SEQ ID NO: 456332

SEQ ID NO: 457668 - RNA, 64 nt, Homo Sapiens; identical to SEQ ID NO: 456333

SEQ ID NO: 457669 - RNA, 64 nt, Homo Sapiens; identical to SEQ ID NO: 456334

SEQ ID NO: 457670 - RNA, 64 nt, Homo Sapiens; identical to SEQ ID NO: 456335

SEQ ID NO: 457671 - RNA, 64 nt, Homo Sapiens; identical to SEQ ID NO: 456336

SEQ ID NO: 457672 - RNA, 64 nt, Homo Sapiens; identical to SEQ ID NO: 456337

SEQ ID NO: 457673 - RNA, 64 nt, Homo Sapiens; identical to SEQ ID NO: 456338

SEQ ID NO: 457674 - RNA, 64 nt, Homo Sapiens; identical to SEQ ID NO: 456339

SEQ ID NO: 457675 - RNA, 64 nt, Homo Sapiens; identical to SEQ ID NO: 456340

SEQ ID NO: 457676 - RNA, 64 nt, Homo Sapiens; identical to SEQ ID NO: 456341

SEQ ID NO: 457677 - RNA, 64 nt, Homo Sapiens; identical to SEQ ID NO: 456342

SEQ ID NO: 457678 - RNA, 64 nt, Homo Sapiens; identical to SEQ ID NO: 456343

SEQ ID NO: 457679 - RNA, 64 nt, Homo Sapiens; identical to SEQ ID NO: 456344

SEQ ID NO: 457680 - RNA, 64 nt, Homo Sapiens; identical to SEQ ID NO: 456345

SEQ ID NO: 457681 - RNA, 64 nt, Homo Sapiens; identical to SEQ ID NO: 456346

SEQ ID NO: 457682 - RNA, 64 nt, Homo Sapiens; identical to SEQ ID NO: 456347

SEQ ID NO: 457683 - RNA, 64 nt, Homo Sapiens; identical to SEQ ID NO: 456348

SEQ ID NO: 457684 - RNA, 64 nt, Homo Sapiens; identical to SEQ ID NO: 456349

SEQ ID NO: 457685 - RNA, 64 nt, Homo Sapiens; identical to SEQ ID NO: 456350

SEQ ID NO: 457686 - RNA, 64 nt, Homo Sapiens; identical to SEQ ID NO: 456351

SEQ ID NO: 457687 - RNA, 64 nt, Homo Sapiens; identical to SEQ ID NO: 456352

SEQ ID NO: 457688 - RNA, 64 nt, Homo Sapiens; identical to SEQ ID NO: 456353

SEQ ID NO: 457689 - RNA, 64 nt, Homo Sapiens; identical to SEQ ID NO: 456354

SEQ ID NO: 457690 - RNA, 64 nt, Homo Sapiens; identical to SEQ ID NO: 456355

SEQ ID NO: 457691 - RNA, 64 nt, Homo Sapiens; identical to SEQ ID NO: 456356

SEQ ID NO: 457692 - RNA, 64 nt, Homo Sapiens; identical to SEQ ID NO: 456357

SEQ ID NO: 457693 - RNA, 64 nt, Homo Sapiens; identical to SEQ ID NO: 456358

SEQ ID NO: 457694 - RNA, 64 nt, Homo Sapiens; identical to SEQ ID NO: 456359

SEQ ID NO: 457695 - RNA, 64 nt, Homo Sapiens; identical to SEQ ID NO: 456360

SEQ ID NO: 457696 - RNA, 64 nt, Homo Sapiens; identical to SEQ ID NO: 456361

SEQ ID NO: 457697 - RNA, 64 nt, Homo Sapiens; identical to SEQ ID NO: 456362

SEQ ID NO: 457698 - RNA, 64 nt, Homo Sapiens; identical to SEQ ID NO: 456363

SEQ ID NO: 457699 - RNA, 64 nt, Homo Sapiens; identical to SEQ ID NO: 456364

SEQ ID NO: 457700 - RNA, 64 nt, Homo Sapiens; identical to SEQ ID NO: 456365

SEQ ID NO: 457701 - RNA, 64 nt, Homo Sapiens; identical to SEQ ID NO: 456366

SEQ ID NO: 457702 - RNA, 64 nt, Homo Sapiens; identical to SEQ ID NO: 456367

SEQ ID NO: 457703 - RNA, 64 nt, Homo Sapiens; identical to SEQ ID NO: 456368

SEQ ID NO: 457704 - RNA, 64 nt, Homo Sapiens; identical to SEQ ID NO: 456369

SEQ ID NO: 457705 - RNA, 64 nt, Homo Sapiens; identical to SEQ ID NO: 456370

SEQ ID NO: 457706 - RNA, 64 nt, Homo Sapiens; identical to SEQ ID NO: 456371

SEQ ID NO: 457707 - RNA, 64 nt, Homo Sapiens; identical to SEQ ID NO: 456372

SEQ ID NO: 457708 - RNA, 64 nt, Homo Sapiens; identical to SEQ ID NO: 456373

SEQ ID NO: 457709 - RNA, 64 nt, Homo Sapiens; identical to SEQ ID NO: 456374

SEQ ID NO: 457710 - RNA, 64 nt, Homo Sapiens; identical to SEQ ID NO: 456375

SEQ ID NO: 457711 - RNA, 64 nt, Homo Sapiens; identical to SEQ ID NO: 456376

SEQ ID NO: 457712 - RNA, 64 nt, Homo Sapiens; identical to SEQ ID NO: 456377

SEQ ID NO: 457713 - RNA, 64 nt, Homo Sapiens; identical to SEQ ID NO: 456378

SEQ ID NO: 457714 - RNA, 64 nt, Homo Sapiens; identical to SEQ ID NO: 456379

SEQ ID NO: 457715 - RNA, 64 nt, Homo Sapiens; identical to SEQ ID NO: 456380

SEQ ID NO: 457716 - RNA, 63 nt, Homo Sapiens; identical to SEQ ID NO: 456381

SEQ ID NO: 457717 - RNA, 64 nt, Homo Sapiens; identical to SEQ ID NO: 456382

SEQ ID NO: 457718 - RNA, 64 nt, Homo Sapiens; identical to SEQ ID NO: 456383

SEQ ID NO: 457719 - RNA, 64 nt, Homo Sapiens; identical to SEQ ID NO: 456384

SEQ ID NO: 457720 - RNA, 64 nt, Homo Sapiens; identical to SEQ ID NO: 456385

SEQ ID NO: 457721 - RNA, 64 nt, Homo Sapiens; identical to SEQ ID NO: 456386

SEQ ID NO: 457722 - RNA, 62 nt, Homo Sapiens; identical to SEQ ID NO: 456387

SEQ ID NO: 457723 - RNA, 64 nt, Homo Sapiens; identical to SEQ ID NO: 456388

SEQ ID NO: 457724 - RNA, 64 nt, Homo Sapiens; identical to SEQ ID NO: 456389

SEQ ID NO: 457725 - RNA, 64 nt, Homo Sapiens; identical to SEQ ID NO: 456390

SEQ ID NO: 457726 - RNA, 64 nt, Homo Sapiens; identical to SEQ ID NO: 456391

SEQ ID NO: 457727 - RNA, 62 nt, Homo Sapiens; identical to SEQ ID NO: 456392

SEQ ID NO: 457728 - RNA, 64 nt, Homo Sapiens; identical to SEQ ID NO: 456393

SEQ ID NO: 457729 - RNA, 64 nt, Homo Sapiens; identical to SEQ ID NO: 456394

SEQ ID NO: 457730 - RNA, 64 nt, Homo Sapiens; identical to SEQ ID NO: 456395

SEQ ID NO: 457731 - RNA, 64 nt, Homo Sapiens; identical to SEQ ID NO: 456396

SEQ ID NO: 457732 - RNA, 64 nt, Homo Sapiens; identical to SEQ ID NO: 456397

SEQ ID NO: 457733 - RNA, 64 nt, Homo Sapiens; identical to SEQ ID NO: 456398

SEQ ID NO: 457734 - RNA, 64 nt, Homo Sapiens; identical to SEQ ID NO: 456399

SEQ ID NO: 457735 - RNA, 64 nt, Homo Sapiens; identical to SEQ ID NO: 456400

SEQ ID NO: 457736 - RNA, 64 nt, Homo Sapiens; identical to SEQ ID NO: 456401

SEQ ID NO: 457737 - RNA, 64 nt, Homo Sapiens; identical to SEQ ID NO: 456402

SEQ ID NO: 457738 - RNA, 64 nt, Homo Sapiens; identical to SEQ ID NO: 456403

SEQ ID NO: 457739 - RNA, 64 nt, Homo Sapiens; identical to SEQ ID NO: 456404

SEQ ID NO: 457740 - RNA, 64 nt, Homo Sapiens; identical to SEQ ID NO: 456405

SEQ ID NO: 457741 - RNA, 64 nt, Homo Sapiens; identical to SEQ ID NO: 456406

SEQ ID NO: 457742 - RNA, 64 nt, Homo Sapiens; identical to SEQ ID NO: 456407

SEQ ID NO: 457743 - RNA, 64 nt, Homo Sapiens; identical to SEQ ID NO: 456408

SEQ ID NO: 457744 - RNA, 64 nt, Homo Sapiens; identical to SEQ ID NO: 456409

SEQ ID NO: 457745 - RNA, 64 nt, Homo Sapiens; identical to SEQ ID NO: 456410

SEQ ID NO: 457746 - RNA, 64 nt, Homo Sapiens; identical to SEQ ID NO: 456411

SEQ ID NO: 457747 - RNA, 64 nt, Homo Sapiens; identical to SEQ ID NO: 456412

SEQ ID NO: 457748 - RNA, 64 nt, Homo Sapiens; identical to SEQ ID NO: 456413

SEQ ID NO: 457749 - RNA, 64 nt, Homo Sapiens; identical to SEQ ID NO: 456414

SEQ ID NO: 457750 - RNA, 64 nt, Homo Sapiens; identical to SEQ ID NO: 456415

SEQ ID NO: 457751 - RNA, 64 nt, Homo Sapiens; identical to SEQ ID NO: 456416

SEQ ID NO: 457752 - RNA, 64 nt, Homo Sapiens; identical to SEQ ID NO: 456417

SEQ ID NO: 457753 - RNA, 64 nt, Homo Sapiens; identical to SEQ ID NO: 307734

SEQ ID NO: 457754 - RNA, 64 nt, Homo Sapiens; identical to SEQ ID NO: 307735

SEQ ID NO: 457755 - RNA, 64 nt, Homo Sapiens; identical to SEQ ID NO: 307736

SEQ ID NO: 457756 - RNA, 64 nt, Homo Sapiens; identical to SEQ ID NO: 307737

SEQ ID NO: 457757 - RNA, 64 nt, Homo Sapiens; identical to SEQ ID NO: 307738

SEQ ID NO: 457758 - RNA, 64 nt, Homo Sapiens; identical to SEQ ID NO: 307739

SEQ ID NO: 457759 - RNA, 64 nt, Homo Sapiens; identical to SEQ ID NO: 307740

SEQ ID NO: 457760 - RNA, 64 nt, Homo Sapiens; identical to SEQ ID NO: 307741

SEQ ID NO: 457761 - RNA, 59 nt, Homo Sapiens; identical to SEQ ID NO: 307742

SEQ ID NO: 457762 - RNA, 64 nt, Homo Sapiens; identical to SEQ ID NO: 307743

SEQ ID NO: 457763 - RNA, 64 nt, Homo Sapiens; identical to SEQ ID NO: 307744

SEQ ID NO: 457764 - RNA, 64 nt, Homo Sapiens; identical to SEQ ID NO: 307745

SEQ ID NO: 457765 - RNA, 64 nt, Homo Sapiens; identical to SEQ ID NO: 307746

SEQ ID NO: 457766 - RNA, 64 nt, Homo Sapiens; identical to SEQ ID NO: 307747

SEQ ID NO: 457767 - RNA, 64 nt, Homo Sapiens; identical to SEQ ID NO: 307748

SEQ ID NO: 457768 - RNA, 64 nt, Homo Sapiens; identical to SEQ ID NO: 307749

SEQ ID NO: 457769 - RNA, 64 nt, Homo Sapiens; identical to SEQ ID NO: 307750

SEQ ID NO: 457770 - RNA, 64 nt, Homo Sapiens; identical to SEQ ID NO: 307751

SEQ ID NO: 457771 - RNA, 64 nt, Homo Sapiens; identical to SEQ ID NO: 307752

SEQ ID NO: 457772 - RNA, 64 nt, Homo Sapiens; identical to SEQ ID NO: 307753

SEQ ID NO: 457773 - RNA, 64 nt, Homo Sapiens; identical to SEQ ID NO: 307754

SEQ ID NO: 457774 - RNA, 64 nt, Homo Sapiens; identical to SEQ ID NO: 307755

SEQ ID NO: 457775 - RNA, 64 nt, Homo Sapiens; identical to SEQ ID NO: 307756

SEQ ID NO: 457776 - RNA, 64 nt, Homo Sapiens; identical to SEQ ID NO: 307757

SEQ ID NO: 457777 - RNA, 64 nt, Homo Sapiens; identical to SEQ ID NO: 307758

SEQ ID NO: 457778 - RNA, 64 nt, Homo Sapiens; identical to SEQ ID NO: 307759

SEQ ID NO: 457779 - RNA, 64 nt, Homo Sapiens; identical to SEQ ID NO: 307760

SEQ ID NO: 457780 - RNA, 64 nt, Homo Sapiens; identical to SEQ ID NO: 307761

SEQ ID NO: 457781 - RNA, 64 nt, Homo Sapiens; identical to SEQ ID NO: 307762

SEQ ID NO: 457782 - RNA, 64 nt, Homo Sapiens; identical to SEQ ID NO: 307763

SEQ ID NO: 457783 - RNA, 64 nt, Homo Sapiens; identical to SEQ ID NO: 307764

SEQ ID NO: 457784 - RNA, 64 nt, Homo Sapiens; identical to SEQ ID NO: 307765

SEQ ID NO: 457785 - RNA, 64 nt, Homo Sapiens; identical to SEQ ID NO: 307766

SEQ ID NO: 457786 - RNA, 64 nt, Homo Sapiens; identical to SEQ ID NO: 307767

SEQ ID NO: 457787 - RNA, 64 nt, Homo Sapiens; identical to SEQ ID NO: 307768

SEQ ID NO: 457788 - RNA, 64 nt, Homo Sapiens; identical to SEQ ID NO: 307769

SEQ ID NO: 457789 - RNA, 64 nt, Homo Sapiens; identical to SEQ ID NO: 307770

SEQ ID NO: 457790 - RNA, 64 nt, Homo Sapiens; identical to SEQ ID NO: 307771

SEQ ID NO: 457791 - RNA, 64 nt, Homo Sapiens; identical to SEQ ID NO: 307772

SEQ ID NO: 457792 - RNA, 64 nt, Homo Sapiens; identical to SEQ ID NO: 307773

SEQ ID NO: 457793 - RNA, 64 nt, Homo Sapiens; identical to SEQ ID NO: 307774

SEQ ID NO: 457794 - RNA, 64 nt, Homo Sapiens; identical to SEQ ID NO: 307775

SEQ ID NO: 457795 - RNA, 64 nt, Homo Sapiens; identical to SEQ ID NO: 307776

SEQ ID NO: 457796 - RNA, 64 nt, Homo Sapiens; identical to SEQ ID NO: 307777

SEQ ID NO: 457797 - RNA, 64 nt, Homo Sapiens; identical to SEQ ID NO: 307778

SEQ ID NO: 457798 - RNA, 64 nt, Homo Sapiens; identical to SEQ ID NO: 307779

SEQ ID NO: 457799 - RNA, 64 nt, Homo Sapiens; identical to SEQ ID NO: 307780

SEQ ID NO: 457800 - RNA, 64 nt, Homo Sapiens; identical to SEQ ID NO: 307781

SEQ ID NO: 457801 - RNA, 64 nt, Homo Sapiens; identical to SEQ ID NO: 307782

SEQ ID NO: 457802 - RNA, 64 nt, Homo Sapiens; identical to SEQ ID NO: 307783

SEQ ID NO: 457803 - RNA, 64 nt, Homo Sapiens; identical to SEQ ID NO: 307784

SEQ ID NO: 457804 - RNA, 64 nt, Homo Sapiens; identical to SEQ ID NO: 307785

SEQ ID NO: 457805 - RNA, 64 nt, Homo Sapiens; identical to SEQ ID NO: 307786

SEQ ID NO: 457806 - RNA, 64 nt, Homo Sapiens; identical to SEQ ID NO: 307787

SEQ ID NO: 457807 - RNA, 64 nt, Homo Sapiens; identical to SEQ ID NO: 307788

SEQ ID NO: 457808 - RNA, 64 nt, Homo Sapiens; identical to SEQ ID NO: 307789

SEQ ID NO: 457809 - RNA, 64 nt, Homo Sapiens; identical to SEQ ID NO: 307790

SEQ ID NO: 457810 - RNA, 64 nt, Homo Sapiens; identical to SEQ ID NO: 307791

SEQ ID NO: 457811 - RNA, 64 nt, Homo Sapiens; identical to SEQ ID NO: 307792

SEQ ID NO: 457812 - RNA, 64 nt, Homo Sapiens; identical to SEQ ID NO: 307793

SEQ ID NO: 457813 - RNA, 64 nt, Homo Sapiens; identical to SEQ ID NO: 307794

SEQ ID NO: 457814 - RNA, 64 nt, Homo Sapiens; identical to SEQ ID NO: 307795

SEQ ID NO: 457815 - RNA, 64 nt, Homo Sapiens; identical to SEQ ID NO: 307796

SEQ ID NO: 457816 - RNA, 62 nt, Homo Sapiens; identical to SEQ ID NO: 307797

SEQ ID NO: 457817 - RNA, 64 nt, Homo Sapiens; identical to SEQ ID NO: 307798

SEQ ID NO: 457818 - RNA, 64 nt, Homo Sapiens; identical to SEQ ID NO: 307799

SEQ ID NO: 457819 - RNA, 64 nt, Homo Sapiens; identical to SEQ ID NO: 307800

SEQ ID NO: 457820 - RNA, 64 nt, Homo Sapiens; identical to SEQ ID NO: 307801

SEQ ID NO: 457821 - RNA, 64 nt, Homo Sapiens; identical to SEQ ID NO: 307802

SEQ ID NO: 457822 - RNA, 64 nt, Homo Sapiens; identical to SEQ ID NO: 307803

SEQ ID NO: 457823 - RNA, 64 nt, Homo Sapiens; identical to SEQ ID NO: 307804

SEQ ID NO: 457824 - RNA, 64 nt, Homo Sapiens; identical to SEQ ID NO: 307805

SEQ ID NO: 457825 - RNA, 64 nt, Homo Sapiens; identical to SEQ ID NO: 307806

SEQ ID NO: 457826 - RNA, 64 nt, Homo Sapiens; identical to SEQ ID NO: 307807

SEQ ID NO: 457827 - RNA, 64 nt, Homo Sapiens; identical to SEQ ID NO: 307808

SEQ ID NO: 457828 - RNA, 64 nt, Homo Sapiens; identical to SEQ ID NO: 307809

SEQ ID NO: 457829 - RNA, 64 nt, Homo Sapiens
caagugggcacguggaggaagggucugaaggaaggcuccggagcacaggcccugguguuccugu

SEQ ID NO: 457830 - RNA, 64 nt, Homo Sapiens
ccgcuccccucuccuccgccacccccgccguggggcuccggaggggacccagcuccucugagcc

SEQ ID NO: 457831 - RNA, 64 nt, Homo Sapiens
cuuccuucagacccuuccucacaccagggccugugcuccggagcgguccagcguccucacagga

SEQ ID NO: 457832 - RNA, 64 nt, Homo Sapiens
gaggcagaggggagacugugcauuggcagggagugcuccggagggaucauuuuagagagugggu

SEQ ID NO: 457833 - RNA, 64 nt, Homo Sapiens
cucgucugccaccaucaccagcuccagcagccuggcuccggacugggagcucagacuuagcugg

SEQ ID NO: 457834 - RNA, 64 nt, Homo Sapiens
ccucgcuguggcucccccgcacuccgccuugcaggcuccggaacuggggugagcugagcccggg

SEQ ID NO: 457835 - RNA, 64 nt, Homo Sapiens
gagggggcggggcgggggaggggagguaggacccgcuccggaaggcgcuguuugaagcuugucg

SEQ ID NO: 457836 - RNA, 64 nt, Homo Sapiens
gcuggcucuguaacccagugcaccucccuccccagcuccggaggggguccuccucgcuccuccu

SEQ ID NO: 457837 - RNA, 64 nt, Homo Sapiens
uggguuugaaucugaaugcuauacuggauacucugcuccggaaagaugagcuuuuuauucuacu

SEQ ID NO: 457838 - RNA, 64 nt, Homo Sapiens
gugaagauucaguauugauacuucuagaaucggagcuccggagugcccucacaagagcaucagc

SEQ ID NO: 457839 - RNA, 64 nt, Homo Sapiens
ggcggccggggccgagggggugcgggcgcugggggcuccggauacagccucugcugcgccgccu

SEQ ID NO: 457840 - RNA, 64 nt, Homo Sapiens
uaggugucccccacccccaaagaccugccugugugcuccggagaugaauaugagcucauuagua

SEQ ID NO: 457841 - RNA, 64 nt, Homo Sapiens
ucaguacuuccuaccacugcugcaugaguauaaugcuccggaauuaucagaaagcauaaugcag

SEQ ID NO: 457842 - RNA, 64 nt, Homo Sapiens
ggcgcugacagcuguaggcuauucccgcgcuccggcuccggaccuugggcugaggcagcgagug

SEQ ID NO: 457843 - RNA, 64 nt, Homo Sapiens
uuguuaaggaaugcuagcagggcauggcacgugagcuccggaauagaugucuucaucacuucuu

SEQ ID NO: 457844 - RNA, 64 nt, Homo Sapiens
ucccggccgcgcugcgcgccgcgcuccucggacggcuccggacgcugcugccgugggccugaga

SEQ ID NO: 457845 - RNA, 64 nt, Homo Sapiens
ggcgagaggguguacgucaaggcggccuggugcagcuccggagggguacacgagcgugggguuc

SEQ ID NO: 457846 - RNA, 64 nt, Homo Sapiens
aaggagaaacauugcaguggacuaugggaggaaagcuccggaaggugccaggaguacaugugag

SEQ ID NO: 457847 - RNA, 64 nt, Homo Sapiens
aggaccuucguccuggucaggcuucugguuuggagcuccggacccaccgccccgauuccuuuuu

SEQ ID NO: 457848 - RNA, 64 nt, Homo Sapiens
caccuuaaauuauuagaccccggggcagucaggugcuccggacacccgaaggcaauaaaacagg

SEQ ID NO: 457849 - RNA, 64 nt, Homo Sapiens
aguugguuuccauaggaaagcagcuggcgccaucgcuccggauuggagagccaugugaaggagg

SEQ ID NO: 457850 - RNA, 64 nt, Homo Sapiens
cccugcaggugaauaaacaccgcagagcaaaugagcuccggagucggggagggggauaggaaga

SEQ ID NO: 457851 - RNA, 64 nt, Homo Sapiens
guguugcuaacagaaguggccuguaagcuccugugcuccggagggaagcauuuccugguaggcu

SEQ ID NO: 457852 - RNA, 64 nt, Homo Sapiens
ccccaaagccagagaaagccagauggcaccagcugcuccggaugugccugcccacauuggggga

SEQ ID NO: 457853 - RNA, 64 nt, Homo Sapiens
cacuuugggaggcggaggcaggcggguugcuugagcuccggagcuugagaccagccugagcaac

SEQ ID NO: 457854 - RNA, 64 nt, Homo Sapiens
cggaugaagaaguacuucugugucucacccaagugcuccggagagugacagguagguacucacc

SEQ ID NO: 457855 - RNA, 64 nt, Homo Sapiens
aucaagaucuuaagugaagcgaagaugaauuauagcuccggagaugugggugguauuggagaaa

SEQ ID NO: 457856 - RNA, 64 nt, Homo Sapiens
uaucuguucuguugaccuguagugacaccugggugcuccggaggaguggagggcuguugacugc

SEQ ID NO: 457857 - RNA, 64 nt, Homo Sapiens
ucauaccuaguggcuguguacggaugucaggaaugcuccggaauaguguggguggcggcuccgg

SEQ ID NO: 457858 - RNA, 64 nt, Homo Sapiens
ccgggcagcagccuaccggccacguggaacacuggcuccggaguuauucucugucaaaucuacu

SEQ ID NO: 457859 - RNA, 64 nt, Homo Sapiens
cccagccccaaggcuuugacgcugcuguggcaaagcuccggagccuauggcccccggcucaagu

SEQ ID NO: 457860 - RNA, 64 nt, Homo Sapiens
uagaagacaggucgccggaggagccucaggcggggcuccggagaagccugacugugccaucuug

SEQ ID NO: 457861 - RNA, 64 nt, Homo Sapiens
gguggagguuucucuucuaagaagggacuaacgugcuccggaagagguugagcagugagagagg

SEQ ID NO: 457862 - RNA, 64 nt, Homo Sapiens
ugccugcucuaugcccugagggauugacugagaugcuccggagcgaggccaugccaugguccug

SEQ ID NO: 457863 - RNA, 64 nt, Homo Sapiens
gcaccccagcagcauccagacgcuguucacacccgcuccggagacgccugcucauguugaagug

SEQ ID NO: 457864 - RNA, 64 nt, Homo Sapiens
cagacacaggccaggccuggacaggcagcgcauggcuccggaagggccaugcauucaucccagc

SEQ ID NO: 457865 - RNA, 64 nt, Homo Sapiens
uauuugccaaagacgacagggugggcuggggugcgcuccggaggaacccccggcacugaugggc

SEQ ID NO: 457866 - RNA, 64 nt, Homo Sapiens
augcuggauggaacaggaaagcugguggccccuggcuccggagaaacgcuccucucaauccugg

SEQ ID NO: 457867 - RNA, 64 nt, Homo Sapiens
cuucuaggaaauuccucuguugcccuggcagacugcuccggacucauuucccaguagucugccu

SEQ ID NO: 457868 - RNA, 64 nt, Homo Sapiens
gaggccagcuaagccacucgcaaagcaggaagaagcuccggaugagucugagccugaagagccc

SEQ ID NO: 457869 - RNA, 64 nt, Homo Sapiens
uaagccauuuaaggguggacgccaagaggaaguggcuccggauucaaaucaguggcaauuccau

SEQ ID NO: 457870 - RNA, 64 nt, Homo Sapiens
ggagcaggcugccgaguggagggugccaucgagggcuccggaucccuuauccuacuuagcagug

SEQ ID NO: 457871 - RNA, 64 nt, Homo Sapiens
gagcccucggcuccccagacuuugccgaggggcugcuccggaccccguugugagccggccuccu

SEQ ID NO: 457872 - RNA, 64 nt, Homo Sapiens
ugcucuguuugugguccuagguugguucauucuggcuccggaugucgaucccccucccuuggau

SEQ ID NO: 457873 - RNA, 64 nt, Homo Sapiens
ggacccacccugccaacaucaaguuguuccuucugcuccggagaccccuggggugcggcccugg

SEQ ID NO: 457874 - RNA, 64 nt, Homo Sapiens
aaagcuguuagaggcccaggggacacgaagucuagcuccggacaaaaccauuuaccaacugaaa

SEQ ID NO: 457875 - RNA, 64 nt, Homo Sapiens
aggcuccucccucuaaggggcgccaugggaacaggcuccggagggagccggcgucugaaaggcc

SEQ ID NO: 457876 - RNA, 64 nt, Homo Sapiens
ggcccgcgggcuccaccucagguuuucacuuuucgcuccggagcgagaacgaaacgacaaaaac

SEQ ID NO: 457877 - RNA, 64 nt, Homo Sapiens
ugauuggcuuccccgagggccagcagggcugggggcuccggagagcagcaggaagcacucccag

SEQ ID NO: 457878 - RNA, 64 nt, Homo Sapiens
ccuccacgcagcggccggagcagccgccucucccgcuccggauccgcccgagccccgcuccucg

SEQ ID NO: 457879 - RNA, 64 nt, Homo Sapiens
gaaagagaacgggccaagacagggacggucaucugcuccggaaggaggcgccacugaaccgaga

SEQ ID NO: 457880 - RNA, 64 nt, Homo Sapiens
cugagucaauguugggaggaggaguucuccaggagcuccggaccaccccaaguccucugcuugg

SEQ ID NO: 457881 - RNA, 64 nt, Homo Sapiens
cugagcuccccuucccuucugacuccucccuccagcuccggaaccuuuaccccaggccuuccug

SEQ ID NO: 457882 - RNA, 64 nt, Homo Sapiens
guggcucuggcagcaggcggcuucaggacugcaggcuccggagagccugccccugcugaggcgu

SEQ ID NO: 457883 - RNA, 64 nt, Homo Sapiens
guacauggagucugagggcggcgacggcuaccuggcuccggagaauggguauuugauggaggcu

SEQ ID NO: 457884 - RNA, 64 nt, Homo Sapiens
ugcagcuaaaggccaccaagugaagcugcccagggcuccggaggucuuccgaaggcaccagagg

SEQ ID NO: 457885 - RNA, 64 nt, Homo Sapiens
gcgccuaguuccugcgcgacagaccaugcccugcgcuccggacugcccguccccaucuuaauaa

SEQ ID NO: 457886 - RNA, 64 nt, Homo Sapiens
ccuccucguggccggaggacccgcccccuccuuugcuccggaaucucuccucccucgcccggcc

SEQ ID NO: 457887 - RNA, 64 nt, Homo Sapiens
ccugccacccgggcccgagcgcgcccggcccgcggcuccggagcccucgccgcgccccccgccg

SEQ ID NO: 457888 - RNA, 64 nt, Homo Sapiens
acacuggcccccugcggcggaggugcggcccaaggcuccggacccguacagcaagggacucccc

SEQ ID NO: 457889 - RNA, 64 nt, Homo Sapiens
gacacagucaggggccgggcugcaguccucggcagcuccggaaggggacaagccaggcccucuc

SEQ ID NO: 457890 - RNA, 64 nt, Homo Sapiens; identical to SEQ ID NO: 301795

SEQ ID NO: 457891 - RNA, 64 nt, Homo Sapiens; identical to SEQ ID NO: 301796

SEQ ID NO: 457892 - RNA, 64 nt, Homo Sapiens; identical to SEQ ID NO: 301797

SEQ ID NO: 457893 - RNA, 64 nt, Homo Sapiens; identical to SEQ ID NO: 301798

SEQ ID NO: 457894 - RNA, 64 nt, Homo Sapiens; identical to SEQ ID NO: 301799

SEQ ID NO: 457895 - RNA, 64 nt, Homo Sapiens; identical to SEQ ID NO: 301800

SEQ ID NO: 457896 - RNA, 64 nt, Homo Sapiens; identical to SEQ ID NO: 301801

SEQ ID NO: 457897 - RNA, 64 nt, Homo Sapiens; identical to SEQ ID NO: 301802

SEQ ID NO: 457898 - RNA, 64 nt, Homo Sapiens; identical to SEQ ID NO: 301803

SEQ ID NO: 457899 - RNA, 63 nt, Homo Sapiens; identical to SEQ ID NO: 98265

SEQ ID NO: 457900 - RNA, 63 nt, Homo Sapiens; identical to SEQ ID NO: 342995

SEQ ID NO: 457901 - RNA, 63 nt, Homo Sapiens; identical to SEQ ID NO: 342996

SEQ ID NO: 457902 - RNA, 63 nt, Homo Sapiens; identical to SEQ ID NO: 342997

SEQ ID NO: 457903 - RNA, 63 nt, Homo Sapiens; identical to SEQ ID NO: 342998

SEQ ID NO: 457904 - RNA, 63 nt, Homo Sapiens; identical to SEQ ID NO: 342999

SEQ ID NO: 457905 - RNA, 63 nt, Homo Sapiens; identical to SEQ ID NO: 343000

SEQ ID NO: 457906 - RNA, 63 nt, Homo Sapiens; identical to SEQ ID NO: 343001

SEQ ID NO: 457907 - RNA, 63 nt, Homo Sapiens; identical to SEQ ID NO: 343002

SEQ ID NO: 457908 - RNA, 63 nt, Homo Sapiens; identical to SEQ ID NO: 343003

SEQ ID NO: 457909 - RNA, 63 nt, Homo Sapiens; identical to SEQ ID NO: 343004

SEQ ID NO: 457910 - RNA, 63 nt, Homo Sapiens; identical to SEQ ID NO: 343005

SEQ ID NO: 457911 - RNA, 63 nt, Homo Sapiens; identical to SEQ ID NO: 343006

SEQ ID NO: 457912 - RNA, 63 nt, Homo Sapiens; identical to SEQ ID NO: 343007

SEQ ID NO: 457913 - RNA, 63 nt, Homo Sapiens; identical to SEQ ID NO: 343008

SEQ ID NO: 457914 - RNA, 63 nt, Homo Sapiens; identical to SEQ ID NO: 343009

SEQ ID NO: 457915 - RNA, 63 nt, Homo Sapiens; identical to SEQ ID NO: 343010

SEQ ID NO: 457916 - RNA, 63 nt, Homo Sapiens; identical to SEQ ID NO: 343011

SEQ ID NO: 457917 - RNA, 63 nt, Homo Sapiens; identical to SEQ ID NO: 343012

SEQ ID NO: 457918 - RNA, 63 nt, Homo Sapiens; identical to SEQ ID NO: 343013

SEQ ID NO: 457919 - RNA, 63 nt, Homo Sapiens; identical to SEQ ID NO: 343014

SEQ ID NO: 457920 - RNA, 63 nt, Homo Sapiens; identical to SEQ ID NO: 343015

SEQ ID NO: 457921 - RNA, 63 nt, Homo Sapiens; identical to SEQ ID NO: 343016

SEQ ID NO: 457922 - RNA, 63 nt, Homo Sapiens; identical to SEQ ID NO: 343017

SEQ ID NO: 457923 - RNA, 63 nt, Homo Sapiens; identical to SEQ ID NO: 343018

SEQ ID NO: 457924 - RNA, 63 nt, Homo Sapiens; identical to SEQ ID NO: 343019

SEQ ID NO: 457925 - RNA, 63 nt, Homo Sapiens; identical to SEQ ID NO: 343020

SEQ ID NO: 457926 - RNA, 63 nt, Homo Sapiens; identical to SEQ ID NO: 343021

SEQ ID NO: 457927 - RNA, 63 nt, Homo Sapiens; identical to SEQ ID NO: 343022

SEQ ID NO: 457928 - RNA, 63 nt, Homo Sapiens; identical to SEQ ID NO: 343023

SEQ ID NO: 457929 - RNA, 63 nt, Homo Sapiens; identical to SEQ ID NO: 343024

SEQ ID NO: 457930 - RNA, 63 nt, Homo Sapiens; identical to SEQ ID NO: 343025

SEQ ID NO: 457931 - RNA, 63 nt, Homo Sapiens; identical to SEQ ID NO: 343026

SEQ ID NO: 457932 - RNA, 63 nt, Homo Sapiens; identical to SEQ ID NO: 343027

SEQ ID NO: 457933 - RNA, 63 nt, Homo Sapiens; identical to SEQ ID NO: 343028

SEQ ID NO: 457934 - RNA, 63 nt, Homo Sapiens; identical to SEQ ID NO: 343029

SEQ ID NO: 457935 - RNA, 63 nt, Homo Sapiens; identical to SEQ ID NO: 343030

SEQ ID NO: 457936 - RNA, 63 nt, Homo Sapiens; identical to SEQ ID NO: 343031

SEQ ID NO: 457937 - RNA, 64 nt, Homo Sapiens
uuguuuuugagauggagucucuacuaaaaauacaaaaaauuagccaggcauggugccgcauaac

SEQ ID NO: 457938 - RNA, 64 nt, Homo Sapiens
aauauggugaaaccccaucucuacuaagaauacaaaaaauuagcugagcaugguggugggcucc

SEQ ID NO: 457939 - RNA, 64 nt, Homo Sapiens
agaguucuuugcuuucauuaacuuggauucauuuaaaaauuaaucuucccuguuaggcugauuu

SEQ ID NO: 457940 - RNA, 64 nt, Homo Sapiens
cuuaaaaaugauguuaacccaagaaguagacaucaaaaauuaaaaaaaaaaaaaggaauguguu

SEQ ID NO: 457941 - RNA, 64 nt, Homo Sapiens
guuuguuaaauuaaccuucaguaacugcaguaccaaaaauuacacucaacugaugaaaaaaacg

SEQ ID NO: 457942 - RNA, 64 nt, Homo Sapiens
uauaugugucauauguauguacauguauaugucuaaaaauuacuuuacacaugugccuacauag

SEQ ID NO: 457943 - RNA, 64 nt, Homo Sapiens
gggcaacauagaaaccugugucuacaaaaaauuuaaaaauuagccaaguauggugacaggcacc

SEQ ID NO: 457944 - RNA, 64 nt, Homo Sapiens
caacauggugacaccccgucucuacuaaaaauacaaaaauuacccaggcauaguggcacacgcc

SEQ ID NO: 457945 - RNA, 64 nt, Homo Sapiens
ucucaaaaaaacaaaacaaacaaacaaaaauacaaaaaauuagccgggcgugguggcaccugcc

SEQ ID NO: 457946 - RNA, 64 nt, Homo Sapiens
uacaugacgaaacuccaucucuaucaaaaauacaaaaaauuaacuagguguggugcugcacgcc

SEQ ID NO: 457947 - RNA, 64 nt, Homo Sapiens
cucugggcuggguaacagagugagauccugucucaaaaauuaauuaauuaauuaauuaaaauaa

SEQ ID NO: 457948 - RNA, 64 nt, Homo Sapiens
ugaauccuuauagaauuugucuuuuaauagacagaaaaauuaaugaaacuuuuuaaaauagaaa

SEQ ID NO: 457949 - RNA, 64 nt, Homo Sapiens
uagacagaaaaauuaaugaaacuuuuuaaaauagaaaaauuacucuucuuuaaugcuaaguauu

SEQ ID NO: 457950 - RNA, 64 nt, Homo Sapiens
aacccucauauuuuaaugguguuacagcauuugcaaaaauuauucugcuaaguauuuacaacuc

SEQ ID NO: 457951 - RNA, 64 nt, Homo Sapiens
caagaagucuuuacauuauauuuauaacucauauaaaaauuauauuuagaauuuuuaaacaugu

SEQ ID NO: 457952 - RNA, 64 nt, Homo Sapiens
uagucaaauacacguuuagauuaaaacuaguuuaaaaaauuauaaaugaaucuaaucaaaaugu

SEQ ID NO: 457953 - RNA, 64 nt, Homo Sapiens
acauggugaaacccccgucucuacuaaaauacaaaaaaauuagccaggcauaguggcgcgcgcc

SEQ ID NO: 457954 - RNA, 64 nt, Homo Sapiens
uugaagaauuucucgcaaacucacaacccucaugaaaaauuaauccucaguuccacgagacugc

SEQ ID NO: 457955 - RNA, 64 nt, Homo Sapiens
ccuggccaacaugacccaucuuuacuaaaaauacaaaaauuagccaggcgugguggugugcccc

SEQ ID NO: 457956 - RNA, 64 nt, Homo Sapiens
uuguaaacccugucucucauauuuguaaaacuacaaaaauuagcuuggcaugguggugugcgcc

SEQ ID NO: 457957 - RNA, 64 nt, Homo Sapiens
cagccaugguggcgggcgccacuaaaaauacaaaaaaaauuagccauggugaaacccugucucu

SEQ ID NO: 457958 - RNA, 64 nt, Homo Sapiens
caggcguggucgugggcaccuaaaaaaaauacaaaaaaauuagccggugaaaccccgucucuac

SEQ ID NO: 457959 - RNA, 64 nt, Homo Sapiens
cuggcaugguggugggaggcucuacuaaaaauacaaaaauuagccaacauggcgaaaccccauc

SEQ ID NO: 457960 - RNA, 64 nt, Homo Sapiens
ccgauuuuguggugguaauggguguugggcccugaaaaauuaguaaaaaaaaauuagcagaauu

SEQ ID NO: 457961 - RNA, 64 nt, Homo Sapiens
agaauugguguugggcccugagauugagccaaaaaaaaauuagcgcggagguugugaugagcca

SEQ ID NO: 457962 - RNA, 64 nt, Homo Sapiens
caggcaugguggcaggugccucuacuaaaaauacaaaaauuagccaacaugacgaaacccgguc

SEQ ID NO: 457963 - RNA, 64 nt, Homo Sapiens
uuaaauuugccagcagggaagagaaaacugauuaaaaaauuaguaagugaacuugauucaaccu

SEQ ID NO: 457964 - RNA, 64 nt, Homo Sapiens
caggcaugguggugcaugccuuuacaaaaaauacaaaaauuagccaauguggcaaaaccgcgug

SEQ ID NO: 457965 - RNA, 64 nt, Homo Sapiens
uggguguggugaugcaugcccaaaaacauuuuuaaaaaauuagcacagggagacccccucucua

SEQ ID NO: 457966 - RNA, 64 nt, Homo Sapiens
augaccaggcacaguggcucaauacaggcauuuaaaaaauuaaaguugcucagccucugagggc

SEQ ID NO: 457967 - RNA, 64 nt, Homo Sapiens
agcaaaggcuacuucagauguauuucuuaucucuaaaaauuaucgggcuaauugaugagcaucu

SEQ ID NO: 457968 - RNA, 64 nt, Homo Sapiens
cuugcuucuucaucaggucugcuuugacugccggaaaaauuaaucaugagcuauacagcugcau

SEQ ID NO: 457969 - RNA, 64 nt, Homo Sapiens
uuuauuauaccauuaugugcaaaauauuuucaugaaaaauuacuuuuauaauguagcuucuuuc

SEQ ID NO: 457970 - RNA, 64 nt, Homo Sapiens
aaaaaaaugcaagcugucagacggugaggaaaaaaaaaauuaaacagccacagguauguggaau

SEQ ID NO: 457971 - RNA, 64 nt, Homo Sapiens
auaggccagcuacaucuaguuuuuaaauuguuguaaaaauuauuuucuuuguuuuuguuuuauu

SEQ ID NO: 457972 - RNA, 64 nt, Homo Sapiens
agccacagucuaauaugucucacugcuucugucuaaaaauuacaggcuaaugcuuccagaugug

SEQ ID NO: 457973 - RNA, 64 nt, Homo Sapiens
uucaucucagcuuucuuagauauuuaauucuuuuaaaaauuauaaaggacuaugauugauaaag

SEQ ID NO: 457974 - RNA, 64 nt, Homo Sapiens
ugcuauggcaggauaagaaaaaugaagaaagucaaaaaauuauuaguuagcuccauaaaguaca

SEQ ID NO: 457975 - RNA, 64 nt, Homo Sapiens
uuuaauuuuaaugcuguuucaacauuuuaucauuaaaaauuacccaagaaaauguauccaagga

SEQ ID NO: 457976 - RNA, 64 nt, Homo Sapiens
uuuuuuguggcaauuaguguaguugucuuaugugaaaaauuaacuuaauuggauguucacugcc

SEQ ID NO: 457977 - RNA, 64 nt, Homo Sapiens
ugggccugguggcacacgccuuuguaaaaauacaaaaaauuaccugaaaccccaucucuacagu

SEQ ID NO: 457978 - RNA, 64 nt, Homo Sapiens
cggguguggugguggguaccucuacuaaaaauacaaaaauuagccaacauggugaaaccuggcc

SEQ ID NO: 457979 - RNA, 64 nt, Homo Sapiens
ucaugaaauauaguuuguacaaaaauuauuuuacaaaaauuacuuacugugucuguagcuaaag

SEQ ID NO: 457980 - RNA, 64 nt, Homo Sapiens
uuacaaaaauuacuucaugagucuguagcuaaagaaaaauuauuauacauggcuacuuuacugu

SEQ ID NO: 457981 - RNA, 64 nt, Homo Sapiens
aagaauacaaauauuccagcaauaaaugaaguaaaaaaauuaaacacauauuagaaacucuucu

SEQ ID NO: 457982 - RNA, 64 nt, Homo Sapiens
gugauuacagguagaggccucaaauugucuuuagaaaaauuaaugacauuuaucuucaaaacac

SEQ ID NO: 457983 - RNA, 64 nt, Homo Sapiens
auaaauccaggaggcaaacugguuuuuuucaauuaaaaauuacucaaaugagcagaauaaauga

SEQ ID NO: 457984 - RNA, 64 nt, Homo Sapiens
ugaaaaaaaaaauauuguuugcugauguaacuauaaaaauuaguuuucuguauaauuagcccag

SEQ ID NO: 457985 - RNA, 64 nt, Homo Sapiens
uggauaucuugaaauauacauaauucaaggauugaaaaauuaaccacauuuguugacuuaaauu

SEQ ID NO: 457986 - RNA, 64 nt, Homo Sapiens
ugugucauauuauauucuuucugcugcuccucuuaaaaauuaaaaucacaauggacacagaaug

SEQ ID NO: 457987 - RNA, 64 nt, Homo Sapiens
aagguuuuaugaaguugacaaugaaagcaauuuuaaaaauuauuuuuauaauaauccaaacucu

SEQ ID NO: 457988 - RNA, 64 nt, Homo Sapiens
ugggcgugguggcgggcacccuacuaaaaauaagaaaaauuagcaacauacugaaaccccgucu

SEQ ID NO: 457989 - RNA, 64 nt, Homo Sapiens
caggcgugauggcacgugucucuacuaaaaguacaaaaauuagccagcauggcaaaaccccguc

SEQ ID NO: 457990 - RNA, 64 nt, Homo Sapiens
uuuauuuaggaguuugaauuaugauagguaaaucaaaaauuacugauagauaaucugguaauaa

SEQ ID NO: 457991 - RNA, 64 nt, Homo Sapiens
gaauggaaaauaauauuuugaauggaagguaaagaaaaauuacauugcagagaaaccuguaagu

SEQ ID NO: 457992 - RNA, 64 nt, Homo Sapiens
acacaggaccugugggagggacuaucagagaugcaaaaauuacuucaagaugaguuuauuguuu

SEQ ID NO: 457993 - RNA, 64 nt, Homo Sapiens
aaauuaaaaaaacauuuuuuucuugguagucuuuaaaaauuaggggauugaaaggauccaggau

SEQ ID NO: 457994 - RNA, 64 nt, Homo Sapiens
ugacaaauuuuaccuuaaaaccaaaaugaaacacaaaaauuaauccuuaauaaugauagcaagu

SEQ ID NO: 457995 - RNA, 64 nt, Homo Sapiens
aucugugugaaagccuuuuucuucuuugauuuaaaaaaauuaacuauacaguuaaugguuuaga

SEQ ID NO: 457996 - RNA, 64 nt, Homo Sapiens
guaaaugcaaccaauuuaacauguaguguuauuaaaaaauuacaaaggccuagaccagccuggg

SEQ ID NO: 457997 - RNA, 64 nt, Homo Sapiens
caacauggugaaacccugucuuuacuaaaaauacaaaaauuagccaggcaugguggcgugugcc

SEQ ID NO: 457998 - RNA, 64 nt, Homo Sapiens
acuucaucucuacaaaaaaagcaacaacgacaaaaaaaauuagccaagcauaguggcacacccc

SEQ ID NO: 457999 - RNA, 64 nt, Homo Sapiens
ucugggcaacauggggaaaccccagcucuacaaaaaaaauuagccuggugugguggcacaugcc

SEQ ID NO: 458000 - RNA, 64 nt, Homo Sapiens
uugaggcauaacuaucaaucacaaaaguauauucaaaaauuauauuuugaacaacucgaaucac

SEQ ID NO: 458001 - RNA, 64 nt, Homo Sapiens
agaccacaagcaggcucaacauaacauaagcuagaaaaauuagaugacugaauuucuauggcau

SEQ ID NO: 458002 - RNA, 64 nt, Homo Sapiens
auuaauuuguaagaguaagcaccuuuagaauauuaaaaauuaauucuuuaucacauguugucau

SEQ ID NO: 458003 - RNA, 64 nt, Homo Sapiens
uccuggugguaaauuaaauaguuuuuuucaucagaaaaauuauuuuuuagccauuuuuuuucuu

SEQ ID NO: 458004 - RNA, 64 nt, Homo Sapiens
uuccauugagucaaaucccauuuuauauauacauaaaaauuaaguucugagugaguucuagcua

SEQ ID NO: 458005 - RNA, 64 nt, Homo Sapiens
gucucauuuugauaaucauuugcuuccaguguuuaaaaauuaaaaaaagaauggggagaagguu

SEQ ID NO: 458006 - RNA, 64 nt, Homo Sapiens
augagacuugccagucaaaugcuauuugguuuaaaaaaauuauugcaaucucaaguuaauggaa

SEQ ID NO: 458007 - RNA, 64 nt, Homo Sapiens
gcaguuccuuucauaauaucucagcaccagaaacaaaaauuaagauuaucaaagcauuuugaau

SEQ ID NO: 458008 - RNA, 64 nt, Homo Sapiens
cucagaaccauucacauuuaauucaauucuuggaaaaaauuaaagcuuuuugcccacaauuugc

SEQ ID NO: 458009 - RNA, 64 nt, Homo Sapiens
cugaacauugggcgguuuucuuaauuugaaguauaaaaauuauaaagaguaauuccaaagguau

SEQ ID NO: 458010 - RNA, 64 nt, Homo Sapiens
aguuugccguaucauccaggaaaaccugagggaaaaaaauuauagcaauuaacugggcauugua

SEQ ID NO: 458011 - RNA, 64 nt, Homo Sapiens
cacuccuguccagucuauuuauuauucaaauaggaaaaauuacuuuacagguuguuuuacugua

SEQ ID NO: 458012 - RNA, 64 nt, Homo Sapiens
uuuuaauauugggaaaauuaugauaaaaugcuuuaaaaauuaauaugccagauuaaaauaacug

SEQ ID NO: 458013 - RNA, 64 nt, Homo Sapiens
uggugaaaccccgucucuauuaaaaauauuuuuuaaaaauuaacugagcgugguggugggcgcc

SEQ ID NO: 458014 - RNA, 64 nt, Homo Sapiens
cuaugcauuuaucauagaaagucuuuauaccuucaaaaauuauaaauauaaauccuuagaaauu

SEQ ID NO: 458015 - RNA, 64 nt, Homo Sapiens
ucuacacugacaggauuuacuuugagaauuacaaaaaaauuauuaagcguauacuauuuucuuc

SEQ ID NO: 458016 - RNA, 64 nt, Homo Sapiens
auaggaauaauuugagaugaaauacuuccaacauaaaaauuauauauuuagauguccaaacaag

SEQ ID NO: 458017 - RNA, 64 nt, Homo Sapiens
cuucccagccgaagggauaacaucuugguaggguaaaaauuauccacugcaguggcauugucau

SEQ ID NO: 458018 - RNA, 64 nt, Homo Sapiens
cgggcgugguggcgcaugccucuacuaaaagugcaaaaauuagcuaacacggugaaaccccguc

SEQ ID NO: 458019 - RNA, 64 nt, Homo Sapiens
uaguuuuguuuuuacaauucuuauacaucuuagaaaaaauuacauauuauuaaaaguaagucau

SEQ ID NO: 458020 - RNA, 64 nt, Homo Sapiens
uucaggggguacaugugcagaaccacuuuaaaaaaaaaauuagguucuucccuaauccccuggc

SEQ ID NO: 458021 - RNA, 64 nt, Homo Sapiens
uuaaauaauuauuuuuuuaaucagaguguaguuaaaaaauuauuuauuacucuugauuucaucu

SEQ ID NO: 458022 - RNA, 64 nt, Homo Sapiens
accacuuauuugaaaacaaauuuucuauaagaagaaaaauuaagauaauaaacugauuuaaacu

SEQ ID NO: 458023 - RNA, 64 nt, Homo Sapiens
gguuuagauauauuuauaauuaccugaaagcugcaaaaauuaauauaaaugaagugcuggacuu

SEQ ID NO: 458024 - RNA, 64 nt, Homo Sapiens
ugggcaucauggcacacaccaaauacauauauacaaaaauuagcaacaucaucucuacauaaaa

SEQ ID NO: 458025 - RNA, 64 nt, Homo Sapiens
gaauuuuguuuguuauuguugaaaauucugucucaaaaauuaaaaggugacugaccacaaagaa

SEQ ID NO: 458026 - RNA, 64 nt, Homo Sapiens
auuucugaaaaccaaugcgagcaucugauuuuuaaaaaauuaaaaaacauacaacuuccaaaag

SEQ ID NO: 458027 - RNA, 64 nt, Homo Sapiens
uauguauuauuggauaaggaccuggacuguuaauaaaaauuaauaaacaagaugcuaaacaaau

SEQ ID NO: 458028 - RNA, 64 nt, Homo Sapiens
aaccacugauguucaagauuuuguucuguaaguaaaaaauuacucaaugaaauuucagaaguuu

SEQ ID NO: 458029 - RNA, 64 nt, Homo Sapiens
cagguguggagguacaugccucuacuaaaaauacaaaaauuagccaacauggugaaacccuguc

SEQ ID NO: 458030 - RNA, 64 nt, Homo Sapiens
caggcgugguggcacgugcccuacuaaaaauacaaaaaauuagcaacauggugaaaccccgucu

SEQ ID NO: 458031 - RNA, 64 nt, Homo Sapiens
uguuuacuugcuauggucugaauacuuugauucuaaaaauuauuccaugaacuggucuucuauu

SEQ ID NO: 458032 - RNA, 64 nt, Homo Sapiens
gggaaagauuuaaagugcagugagaggcacuguuaaaaauuauucuuuuacgugucuuugcauu

SEQ ID NO: 458033 - RNA, 64 nt, Homo Sapiens
cgggcaugguggcaggugccucucaaacaaacaaaaaaauuagcggcgacagagcgagacuucg

SEQ ID NO: 458034 - RNA, 64 nt, Homo Sapiens
cgggagugguggugcgugccucuauuaaaaauacaaaaauuagccaacaaggugaaaccccacc

SEQ ID NO: 458035 - RNA, 64 nt, Homo Sapiens
ccggguacaguggcucaugcucuacuaaaaauacaaaaauuaggcaauaugaugaaaccccauc

SEQ ID NO: 458036 - RNA, 64 nt, Homo Sapiens
ugucuguguuauacuguauaucuguauuauuaaaaaaaauuaugauauuuauaauuacuaugug

SEQ ID NO: 458037 - RNA, 64 nt, Homo Sapiens
ugggcagcguggugugugcccuacuaaaaaauuaaaaaauuagccaacacagugacaccugacu

SEQ ID NO: 458038 - RNA, 64 nt, Homo Sapiens
aaauuagcugggcagcguggaccugacucuacuaaaaaauuaaaagccugggcaacacagugac

SEQ ID NO: 458039 - RNA, 64 nt, Homo Sapiens
uuuccucuguuuuuuauuuuaucuaauagucuauaaaaauuaugacucuauuauuucuuucuaa

SEQ ID NO: 458040 - RNA, 64 nt, Homo Sapiens
gagaaaaacaacaaaguacauaacaacuaagaacaaaaauuaacaguauuaccuccuuaauuuu

SEQ ID NO: 458041 - RNA, 64 nt, Homo Sapiens
agagaaaugaaauauuuuugaaugguugcacguuaaaaauuaaaagaaggaaugggggcagaau

SEQ ID NO: 458042 - RNA, 64 nt, Homo Sapiens
caauauggagaaaccuugucucuacuaaaaacacaaaaauuaucugggcaugguggggcaugcc

SEQ ID NO: 458043 - RNA, 64 nt, Homo Sapiens
aauaacuuaaaaaaugcuuuacuacuaaaauguaaaaaauuaaugugcucaccucggcagcaca

SEQ ID NO: 458044 - RNA, 64 nt, Homo Sapiens
aaauuaaugugcucaccucggcagcacauauacuaaaaauuaauaagacccagcuugaaaauug

SEQ ID NO: 458045 - RNA, 64 nt, Homo Sapiens
aaugaaaaauguaaaaguaccuagaaauucacaaaaaaauuaauaccucuguggagaaaacuuc

SEQ ID NO: 458046 - RNA, 64 nt, Homo Sapiens
aaauccugccucuacuaaaaauacaaaaaaaaaaaaaaauuagcugggcaugguggcacacacc

SEQ ID NO: 458047 - RNA, 64 nt, Homo Sapiens
gcaacauggcaaaacccugugucuacaaaaaauaaaaaauuagcugggcaugacggccagagcc

SEQ ID NO: 458048 - RNA, 64 nt, Homo Sapiens
acauauaccaaaaauauaugaggcaaauuuuagcaaaaauuaaaauucuuaagaaaacuucacu

SEQ ID NO: 458049 - RNA, 64 nt, Homo Sapiens
aaaugaaauagagaauagaaaagcaauacagaaaaaaaauuaugaaaucaaaagcugguucuuu

SEQ ID NO: 458050 - RNA, 64 nt, Homo Sapiens
aaagucaagauuuuauuaccaaacuuauagaaauaaaaauuauuagaaagaaauacuaugaaca

SEQ ID NO: 458051 - RNA, 64 nt, Homo Sapiens
ugaaucaauuauuacaucuguuuuacuaugaaaaaaaaauuaauacuacuagcuuccagacaau

SEQ ID NO: 458052 - RNA, 64 nt, Homo Sapiens
caacauggugaaauccugucucuacuaaaaauacaaaaauuagcugggcaugguggcacauacc

SEQ ID NO: 458053 - RNA, 64 nt, Homo Sapiens
aauaauauaauaaccagugaauuuucaggaauuuaaaaauuagcuuuuuuccacuuaaaggaga

SEQ ID NO: 458054 - RNA, 64 nt, Homo Sapiens
uauuaauuuuaaaacauucagaacuuguugaaagaaaaauuauaucugaaucaagauucauguu

SEQ ID NO: 458055 - RNA, 64 nt, Homo Sapiens
cgggcguggugggcacccgucuauuaaaaaugcaaaaaauuagcaacauagugaaacccugucu

SEQ ID NO: 458056 - RNA, 64 nt, Homo Sapiens
caggugugguggcaugugcccacaaaaaaauucaaaaaauuagcucaugacgaaaccccaucuc

SEQ ID NO: 458057 - RNA, 64 nt, Homo Sapiens
ugggcaugguggcaguugcccuacuaaaaauacaaaaaauuagcagcauggcgaaaccccaucu

SEQ ID NO: 458058 - RNA, 64 nt, Homo Sapiens
ugggcauuguggggcacaccacaaaaaauuucugaaaaauuacccauagggagacccuaucccu

SEQ ID NO: 458059 - RNA, 64 nt, Homo Sapiens
aauuugaggauuuaacuugaauuuaaauugggcuaaaaauuaaaaaaaccagagguuauauaca

SEQ ID NO: 458060 - RNA, 64 nt, Homo Sapiens
gucaccucuacugaaccuuguuguaguugcagaaaaaaauuaaacuuaaacaucuaagacucag

SEQ ID NO: 458061 - RNA, 64 nt, Homo Sapiens
cgggcgugauggcacaugccucuacuaaaaauacaaaaauuagccaacaugaugaagcccuguc

SEQ ID NO: 458062 - RNA, 64 nt, Homo Sapiens
auguacuauuuuaaaauaauuaucuaugucucauaaaaauuagaucuaccuuuuuauaaauaca

SEQ ID NO: 458063 - RNA, 64 nt, Homo Sapiens
caggagcacaaagucagggaaauacuucaguuggaaaaauuaaaaucccuguuuucauaaagcu

SEQ ID NO: 458064 - RNA, 64 nt, Homo Sapiens
ugauuauaaaauaugugcuauuaucuucuuugagaaaaauuaaucauucaggucuucugcuaca

SEQ ID NO: 458065 - RNA, 64 nt, Homo Sapiens
gccuuuagcuucuugaagauuuagaaguuauauaaaaaauuaauuuaaaagcaaaccaaaagag

SEQ ID NO: 458066 - RNA, 64 nt, Homo Sapiens
cucagugcugguuuacggaacaacucuuacuuuuaaaaauuacuuguucccccaaauuguugag

SEQ ID NO: 458067 - RNA, 64 nt, Homo Sapiens
guuuuauuauaaauaauauucaauuaugaaacaaaaaaauuaugauguuuuucaaaaugcaagu

SEQ ID NO: 458068 - RNA, 64 nt, Homo Sapiens
caacauggugaauccccgucucuauuaaaaauacaaaaauuagcugggugugguggcgugugcc

SEQ ID NO: 458069 - RNA, 64 nt, Homo Sapiens
aggaguuucuauaggugucuucagaguucugaagaaaaauuacuggacacagcuucagcuauac

SEQ ID NO: 458070 - RNA, 64 nt, Homo Sapiens
acagaaguuauuuccaaguuuguguauauauuauaaaaauuacauauauaaaacuaaggcuuuu

SEQ ID NO: 458071 - RNA, 64 nt, Homo Sapiens
caacauggugaaaccccaucucuacuaaaaauacaaaaauuagccggacgcaguggcacgcgcc

SEQ ID NO: 458072 - RNA, 64 nt, Homo Sapiens
cuuuuuguuucguuuuguuucuucuucugcauuuaaaaauuaaaagauugguuugaggauguga

SEQ ID NO: 458073 - RNA, 64 nt, Homo Sapiens
uuaaagaaguuucuuauuuaaacaucucagacgcaaaaauuacauuaaauuuuuguauauuuca

SEQ ID NO: 458074 - RNA, 64 nt, Homo Sapiens
caacaugaugaaaccuugucuuuacuaaaaauacaaaaauuagcugggcaugguggcaggcgcc

SEQ ID NO: 458075 - RNA, 64 nt, Homo Sapiens
cagcaugguaaaacccugucuccacuaaaaauacaaaaauuagccaggcaugguggcgggcacc

SEQ ID NO: 458076 - RNA, 64 nt, Homo Sapiens
caacauggugaaacccugucucuacuaaaaauacaaaaauuagcuggguguggugguguguacc

SEQ ID NO: 458077 - RNA, 64 nt, Homo Sapiens
ccagccugggcgacagagcaagaccaccaucuccaaaaauuauauauauaaaaauaauuaauau

SEQ ID NO: 458078 - RNA, 64 nt, Homo Sapiens
uuauuaucagauaucagcauauuauuaaacauuuaaaaauuagugcauuuuuaaacauuuaaaa

SEQ ID NO: 458079 - RNA, 64 nt, Homo Sapiens
aaacauuuaaaaauuaguuuauuuuuaaacauuuaaaaauuauuagaaauuaguuuuaucuggc

SEQ ID NO: 458080 - RNA, 64 nt, Homo Sapiens
ggauguaacuaaugcuucaguagaugcauagacaaaaaauuaugucacaguccggaagagauga

SEQ ID NO: 458081 - RNA, 64 nt, Homo Sapiens
uuaaaagaacucagcauucaauguuuuuuuucagaaaaauuauuccugagugaaaaagugaacu

SEQ ID NO: 458082 - RNA, 64 nt, Homo Sapiens
aauagaacuaucauaugauccauggacuuucuucaaaaauuacaagcagccauguggagaacaa

SEQ ID NO: 458083 - RNA, 64 nt, Homo Sapiens
ugggcgugguggcacaugccaaauuuuaaaaaguaaaaauuagcgagacucugucucuacaaaa

SEQ ID NO: 458084 - RNA, 64 nt, Homo Sapiens
uauaugguugaaauguaaaaacccugucucauggaaaaauuaauccaagaagauuauguguccu

SEQ ID NO: 458085 - RNA, 64 nt, Homo Sapiens
cucccaaaucauucuacugaaaguggccgaaaaaaaaaauuauguuucauuuggaggaaaucac

SEQ ID NO: 458086 - RNA, 64 nt, Homo Sapiens
auuugaaguaauuuauuuacauguccacccuuuuaaaaauuauuguuucugcaauauuuuucuu

SEQ ID NO: 458087 - RNA, 64 nt, Homo Sapiens
aacuaguccauccaagaaccaggucugcaaaaacaaaaauuauaaagacuuacauuuucugcac

SEQ ID NO: 458088 - RNA, 64 nt, Homo Sapiens
acacauuccuuggaacagagucuuuuaucugggcaaaaauuaaaagugugugcaaagcuuauuu

SEQ ID NO: 458089 - RNA, 64 nt, Homo Sapiens
gugaauuguuuuuguacaguguggaaaagcuuaaaaaaauuacucaaaaagucauuuuucugga

SEQ ID NO: 458090 - RNA, 64 nt, Homo Sapiens
uuaaauuuaucuuugaaauaauucuggguuccuuaaaaauuauuaagcaguguucuaaauaaaa

SEQ ID NO: 458091 - RNA, 64 nt, Homo Sapiens
aguauuuugcauuagugauuaaauacaacauuuaaaaaauuaaguauuaauauuuaaaaacgag

SEQ ID NO: 458092 - RNA, 64 nt, Homo Sapiens
uugucuaauuaugaugaauuugucucaaaaguggaaaaauuauaaaguauugauuuauauauuu

SEQ ID NO: 458093 - RNA, 64 nt, Homo Sapiens
gaucauuuuuccauaugacacugguuccgauuuuaaaaauuauuuuuaaauaaccgauuauuga

SEQ ID NO: 458094 - RNA, 64 nt, Homo Sapiens
aaaacggugaaaccccgucucuacuaaaaauacaaaaaauuagccgggcguaguggcgggcgcc

SEQ ID NO: 458095 - RNA, 64 nt, Homo Sapiens
auacuaaaaauauaggcucuugggauuggagaggaaaaauuagaggugauuuucagauuucuug

SEQ ID NO: 458096 - RNA, 64 nt, Homo Sapiens
aaauucuucugaccgaaaccaauguggguguuagaaaaauuaccauauagcuuaauauguuuau

SEQ ID NO: 458097 - RNA, 64 nt, Homo Sapiens
cccucucaguuaagaaaugcuuagauuaaaaaaaaaaaauuacguaggauuaauacagaaauuu

SEQ ID NO: 458098 - RNA, 64 nt, Homo Sapiens
aaaccccaucucaacuaaaaauacaaaaaauacaaaaaauuagccgggcgcgguggcucacacc

SEQ ID NO: 458099 - RNA, 64 nt, Homo Sapiens
caacauggugaaacccugucucuauuaaaaauacaaaaauuagcugggcgugguggcgcaugcc

SEQ ID NO: 458100 - RNA, 64 nt, Homo Sapiens
uuauuaaauuuauuugaaaaugcaucacaugaugaaaaauuauaguagcuuauaagagggcaua

SEQ ID NO: 458101 - RNA, 64 nt, Homo Sapiens
caauauggugaaacccugucucuacaaaaaauacaaaaauuagcugggcaugguggugcgugcc

SEQ ID NO: 458102 - RNA, 64 nt, Homo Sapiens
cuuauggcaugaucucuggaacaaauuuguaggaaaaaauuacuccaauugaaugacugaugua

SEQ ID NO: 458103 - RNA, 64 nt, Homo Sapiens
aacacugugaaaccccgucucuacuaaaaauacaaaaaauuagcggggcaugguggcacgcgcc

SEQ ID NO: 458104 - RNA, 64 nt, Homo Sapiens
gcagggaaguuuccuugagccuaaaauaaaaagaaaaaauuaaaaagaaucaguuuuuuuaauu

SEQ ID NO: 458105 - RNA, 64 nt, Homo Sapiens
ugggggugguagcacauaccucuacuaaaaacauaaaaauuagccaacauggcaaaacccuguc

SEQ ID NO: 458106 - RNA, 64 nt, Homo Sapiens
uugcauagcugcuuugcaguauauaugaguacugaaaaauuaagggcuuuuccuccauuaauac

SEQ ID NO: 458107 - RNA, 64 nt, Homo Sapiens
gacacgguucacuaaauugaguuuuuuccuuuaaaaaaauuauauucuaaguuuuggaaagcag

SEQ ID NO: 458108 - RNA, 64 nt, Homo Sapiens
ucuuacuguugauauauguagcagugauguaaugaaaaauuacaacacaaagcuaaauauucua

SEQ ID NO: 458109 - RNA, 64 nt, Homo Sapiens
uaaggaaaaaaacagaaaauaaguauuacugauaaaaaauuaucuguuaacagugagguugaua

SEQ ID NO: 458110 - RNA, 64 nt, Homo Sapiens
gcaguaguagaaguuuuguagguuaaauguuuucaaaaauuauaugucuuaccucuugcuagug

SEQ ID NO: 458111 - RNA, 64 nt, Homo Sapiens
guuuauacuucuacuuauggcauuccacaagaagaaaaauuauuuaagaaaggaaauuuaaaaa

SEQ ID NO: 458112 - RNA, 64 nt, Homo Sapiens
ucuuuauaacucugaucuuuagauccuuugaaauaaaaauuaugcugagaucuagcugaugcuu

SEQ ID NO: 458113 - RNA, 64 nt, Homo Sapiens
gaucacucuuggcugauuucauucugguuaaauaaaaaauuagauauuuauuauauugguaaaa

SEQ ID NO: 458114 - RNA, 64 nt, Homo Sapiens
agcauguaacaaagaaugcuguuaaaacauuuugaaaaauuauuaaauuaauggcauuuuaaag

SEQ ID NO: 458115 - RNA, 64 nt, Homo Sapiens
ggcauuuuaaagguuaaaacauaucuacagagagaaaaauuaauuuuuuugccacugcaaacau

SEQ ID NO: 458116 - RNA, 64 nt, Homo Sapiens
aggcugcagaggcaagaggaaauaaaaauuaaaaaaaaauuauugauccccaacucuacaaaaa

SEQ ID NO: 458117 - RNA, 64 nt, Homo Sapiens
aaaaaauuauuaggcugcagcucuacaaaaaaauaaaaauuaaauagcaaggcaagauccccaa

SEQ ID NO: 458118 - RNA, 64 nt, Homo Sapiens
caacauggugaaacccugucucuacuaaaaauacaaaaauuagccgggcauggugguaggggcc

SEQ ID NO: 458119 - RNA, 64 nt, Homo Sapiens
guaagccaagaucaugcugugccucaaggaaaaaaaaaauuaauguuuacugauauuuguugaa

SEQ ID NO: 458120 - RNA, 64 nt, Homo Sapiens
acuuaaaauugauuacauugagccuauucagaaaaaaaauuauauagguucugaugaaagcuuc

SEQ ID NO: 458121 - RNA, 64 nt, Homo Sapiens
uguggcauaaauuuggagaaaauaauaugacuagaaaaauuaguguuauauugggugugagaaa

SEQ ID NO: 458122 - RNA, 64 nt, Homo Sapiens
agagagaagauauuuuaaaaagaaauaccuuuuuaaaaauuauuuuauuauuuuuuaauagaga

SEQ ID NO: 458123 - RNA, 64 nt, Homo Sapiens
aaagccugaauguacuauguuuaaaagacaaaccaaaaauuaacccaaacuugcauuauuuguc

SEQ ID NO: 458124 - RNA, 64 nt, Homo Sapiens
gccaacauggcaaaaccaucucuacuaaaaauagaaaaauuagccaggcacguuccaggcaccu

SEQ ID NO: 458125 - RNA, 64 nt, Homo Sapiens
uauggugaaaccccaucucuacuaaaauuacaaaaaaaauuauccaggcgugguggugcacgcc

SEQ ID NO: 458126 - RNA, 64 nt, Homo Sapiens
ggcaaaacaccgucucuacaaaaaaaaaaaaaaaaaaaauuagccaaguacaguggggcacacc

SEQ ID NO: 458127 - RNA, 64 nt, Homo Sapiens
agccuggacaacauagcaagaccucaucucuucuaaaaauuaaaaaaaaaaaaaauaggcaugg

SEQ ID NO: 458128 - RNA, 64 nt, Homo Sapiens
uguauucuuacaguuaauguuuauaacuauaguaaaaaauuaauauauauccuauuacauaaau

SEQ ID NO: 458129 - RNA, 64 nt, Homo Sapiens
aaucuucagaguauaaagacauccauucagaaacaaaaauuagcacuaaauuuuuuauaaaaua

SEQ ID NO: 458130 - RNA, 64 nt, Homo Sapiens
uuguuuaacuuccuucuguuuuaagauuguaauuaaaaauuacuauuuuguuauauggaauggu

SEQ ID NO: 458131 - RNA, 64 nt, Homo Sapiens
aaaccauuuuaugaguuuucuguuagcuugcuuuaaaaauuauuacuguaagaaauaguuuuau

SEQ ID NO: 458132 - RNA, 64 nt, Homo Sapiens
uuuaaaaauuauuacuguaagaaauaguuuuauaaaaaauuauauuuuuauucaguaauuuaau

SEQ ID NO: 458133 - RNA, 64 nt, Homo Sapiens
caguuccacaccaagaaugaacugcauuuccuuuaaaaauuauuuuaaaacaccuuuauugaaa

SEQ ID NO: 458134 - RNA, 64 nt, Homo Sapiens
cuaauaucacagggcuugugcauucagauuuuuaaaaaauuaggauagauaaggaaacaacuua

SEQ ID NO: 458135 - RNA, 64 nt, Homo Sapiens
aacauggugaaaccccaucucuacuaaaaauacaaaaaauuagcugggcaugcacuuguaauuc

SEQ ID NO: 458136 - RNA, 64 nt, Homo Sapiens
cacucuuugcaggcacucuucaaauuuuuauuuuaaaaauuauaaugcaaacaucuggccauca

SEQ ID NO: 458137 - RNA, 64 nt, Homo Sapiens
uugccuacagaaagguuguaccaucuuuuuaaacaaaaauuauuuuaaaaugggggaaaaaaag

SEQ ID NO: 458138 - RNA, 64 nt, Homo Sapiens
aaaagacagaaggccugacugugucagcaagaagaaaaauuaaccuucggccagucuuaaacgg

SEQ ID NO: 458139 - RNA, 64 nt, Homo Sapiens
cagguguaauggugugcaccucuacaaaaaauuuaaaaauuauccaacauagcgagacugcauc

SEQ ID NO: 458140 - RNA, 64 nt, Homo Sapiens
cgggcgugguggugggcacuuacuaaaauaguacaaaaauuagcacaugguuaaaccccgucuc

SEQ ID NO: 458141 - RNA, 64 nt, Homo Sapiens
aaguaaauuuuugcuuuucagauggaaaaauaaaaaaaauuaaaauguucucuuugccauuuua

SEQ ID NO: 458142 - RNA, 64 nt, Homo Sapiens
gcccuguggacuccuuuaaugagaccucugguggaaaaauuauuugcuuuucagaauguagagu

SEQ ID NO: 458143 - RNA, 64 nt, Homo Sapiens
aaaaugaacccaagucuguuaauguuuucuauuuaaaaauuacacuucuucaagagaugccuaa

SEQ ID NO: 458144 - RNA, 64 nt, Homo Sapiens
uuuggaauuacuuguuuucucugaaaacuuuuguaaaaauuaaagccauaauuugucaauaaag

SEQ ID NO: 458145 - RNA, 64 nt, Homo Sapiens
uaaauguuguguccgucuuuuuuaugguuuauuaaaaaauuaaauuucauuugaauauuuaaau

SEQ ID NO: 458146 - RNA, 64 nt, Homo Sapiens
caaaugcugaagugagauucauguuuuucuuauaaaaaauuauaagaucccauaauaaaaauga

SEQ ID NO: 458147 - RNA, 64 nt, Homo Sapiens
uuccaaguaccucuauuuucccauuuaaaauuuaaaaaauuaugaauacuauuaaccuauauaa

SEQ ID NO: 458148 - RNA, 64 nt, Homo Sapiens
uggguauggugguaagugccucugcaaaaaauacaaaaauuagccaacauagugaaacacuguc

SEQ ID NO: 458149 - RNA, 64 nt, Homo Sapiens
caguuacaguaaagacuuuggaaaacuaacauuuaaaaauuaauucucaaguagaaaaguuuuu

SEQ ID NO: 458150 - RNA, 64 nt, Homo Sapiens
guuuuuucaauguuuauauuaacuuuagaacaaaaaaaauuagaaagacaauaaauugugaguc

SEQ ID NO: 458151 - RNA, 64 nt, Homo Sapiens
uuaagggcucucacauuuuaguuguaccaucuauaaaaauuacuaucagaaugaugcucuuaua

SEQ ID NO: 458152 - RNA, 64 nt, Homo Sapiens
gagacucucaacauacuguugucauauuuacucuaaaaauuaaaguucuaaagcuauccauugu

SEQ ID NO: 458153 - RNA, 64 nt, Homo Sapiens
acagagcugaucuucuugggucgauggaaauucuaaaaauuaauacuguugcucaaucuaaucu

SEQ ID NO: 458154 - RNA, 64 nt, Homo Sapiens
uucucauugaauuuuagugcauuucauccacuuuaaaaauuaucuaauguuacaugcaccuuca

SEQ ID NO: 458155 - RNA, 64 nt, Homo Sapiens
gcauauugcuauaauaaaacuugaguugucacuuaaaaauuauacauacuuuuaaaacaagugc

SEQ ID NO: 458156 - RNA, 64 nt, Homo Sapiens
acauggcgaaaccucgccucuacuaaaaauacaaaaaaauuagcugcgcgugguggugcacgcc

SEQ ID NO: 458157 - RNA, 64 nt, Homo Sapiens
gcaacagagacucugucucaaaaaaaaaaaaaaaaaaaauuaaccucaaccaaacgccuauuuu

SEQ ID NO: 458158 - RNA, 64 nt, Homo Sapiens
cauagcaaaaccccaucucuauuaaaaauuuuacaaaaauuagcugcgugugguggcaggcccc

SEQ ID NO: 458159 - RNA, 64 nt, Homo Sapiens
auguauaauuacauucaaauuauauuuuuucuugaaaaauuaguuuuugaaaagcaaaugaugu

SEQ ID NO: 458160 - RNA, 64 nt, Homo Sapiens
guauauuuacauucagaguacacuuuucuuuggaaaaaauuacagguuuuuugaaaagugaaua

SEQ ID NO: 458161 - RNA, 64 nt, Homo Sapiens
uuauggacuacaggguuauuuuuauggucauaauaaaaauuacaaaaguaugaauaaaauacau

SEQ ID NO: 458162 - RNA, 64 nt, Homo Sapiens
ugcaauuuucuacagaauugaauaccuguuaaagaaaaauuacagaauaaacuugugacugguc

SEQ ID NO: 458163 - RNA, 64 nt, Homo Sapiens
ccaacauggugaaaccuugucuacuaaaaauacaaaaaauuagcugggcauggcggcaugcgcc

SEQ ID NO: 458164 - RNA, 64 nt, Homo Sapiens
guucuauugcauaguacaugaaucuauugucacuaaaaauuagguuacuaaucuuaauuuuuuu

SEQ ID NO: 458165 - RNA, 64 nt, Homo Sapiens
gacagagcaagacuccgucucaaagaaacaaacaaaaaauuaaaagggauagaauauaaugaaa

SEQ ID NO: 458166 - RNA, 64 nt, Homo Sapiens
caacaugaugaaacccugucucuacuaaauauacaaaaauuaguuggguguuauggugcaugcc

SEQ ID NO: 458167 - RNA, 64 nt, Homo Sapiens
ugaaaucuucaagaacaccuuuacucuauaacucaaaaauuaguugaaaaauaauuacuucuca

SEQ ID NO: 458168 - RNA, 64 nt, Homo Sapiens
cugggcaacacagugagacuccaucucuuaaaaaaaaaauuagcuggguauagugguaugugcc

SEQ ID NO: 458169 - RNA, 64 nt, Homo Sapiens
uuucagaucaguaucuucuagauuccagacagaaaaaaauuacacuucagaaaagacaucaaag

SEQ ID NO: 458170 - RNA, 64 nt, Homo Sapiens
aacaaggugaaaccccgucucuacuaaaaauacaaaaaauuagccaggcgcgguggcgggggcc

SEQ ID NO: 458171 - RNA, 64 nt, Homo Sapiens
acugucauacugucauaggaugagagaguucuucaaaaauuauguuuucccaagaucaguugcu

SEQ ID NO: 458172 - RNA, 64 nt, Homo Sapiens
agccugggcaaaacccugucucuacuaaaaauauaaaaauuagccaggcaugauggcacaugcu

SEQ ID NO: 458173 - RNA, 64 nt, Homo Sapiens
agacuuuugacagugagacugucaaaaaaaaaaaaaaaauuaauagauaaaacaggccacuaga

SEQ ID NO: 458174 - RNA, 64 nt, Homo Sapiens
caacauggcaaaaccccgucucuaugaaaaauauaaaaauuagcugggcaugguggcaggcacc

SEQ ID NO: 458175 - RNA, 64 nt, Homo Sapiens
ugagaaagaagagaagaagaacaagacccuaugaaaaaauuaguuggcucgugaucaagagcuu

SEQ ID NO: 458176 - RNA, 64 nt, Homo Sapiens
cggguaccgugcaugugcagaaauaaaaacacuuaaaaauuaucgagacccccaucucuacaaa

SEQ ID NO: 458177 - RNA, 64 nt, Homo Sapiens
cagaagagcacccugaaaaauuacacuuaauaaaaaaaauuaaauauaaaaaucauuggcacag

SEQ ID NO: 458178 - RNA, 64 nt, Homo Sapiens
gcauauuuguuacguaaagucuugaaaguuguaaaaaaauuaaacaguacagcuauaauaguau

SEQ ID NO: 458179 - RNA, 64 nt, Homo Sapiens
cuugaaacaagugagcuuuuuuuuuuucaucaauaaaaauuaucaucuuuucauaucugcaaga

SEQ ID NO: 458180 - RNA, 64 nt, Homo Sapiens
uuuucauaucugcaagauuuugucauaggaauaaaaaaauuaucaaaaucguaaaaacagaaaa

SEQ ID NO: 458181 - RNA, 64 nt, Homo Sapiens
uaaauaaacucccgugacuucuccaucuggggaaaaaaauuaaauccagccugggcgacagagu

SEQ ID NO: 458182 - RNA, 64 nt, Homo Sapiens
ugggugugguggcgggcaccuuuacuaaaaauauaaaaauuagccaacauggggaaacccuguc

SEQ ID NO: 458183 - RNA, 64 nt, Homo Sapiens
cgggcaugguggcaggcgccucuacuaaaaauacaaaaauuagccaacauggugaaaccccguc

SEQ ID NO: 458184 - RNA, 64 nt, Homo Sapiens
ugaaugauccugucucuaaauuuaaaaacaaacaaaaaauuaucacagagcgagacuccaucuc

SEQ ID NO: 458185 - RNA, 64 nt, Homo Sapiens
aauggggcaaacagucuaguucucaaaaaaaaaaaaaaauuacagcaacaagagcaaaacuccg

SEQ ID NO: 458186 - RNA, 64 nt, Homo Sapiens
cgagcguagugacgggugcccuacuaaaaauaccaaaaauuagcacauggugaaacccccaucu

SEQ ID NO: 458187 - RNA, 64 nt, Homo Sapiens
caugcucucauauauauuuuuggaaaaaugugaaaaaaauuauuuucuccaaauaaaaauuaga

SEQ ID NO: 458188 - RNA, 64 nt, Homo Sapiens
uggaaaaaugugaaaaaaauuauuuucuccaaauaaaaauuagagaauaauuucauacugaaau

SEQ ID NO: 458189 - RNA, 64 nt, Homo Sapiens
cgggcgcgguggcgggcgcccuacuaaaaauacaaaaaauuagcaacaaggugaaaccccgucu

SEQ ID NO: 458190 - RNA, 64 nt, Homo Sapiens
aauggauggaucuucucugaaaugcccaggcuuuaaaaauuaaaauucagaaucuguugugaga

SEQ ID NO: 458191 - RNA, 64 nt, Homo Sapiens
uucucacacauuucuuuuuuccucuugugguaaaaaaaauuauacuguaaaagauuuuugcuuc

SEQ ID NO: 458192 - RNA, 64 nt, Homo Sapiens
uucaacaaggcauauagucuucucaaaaaaaaaaaaaaauuacuggugacacagcaagacucca

SEQ ID NO: 458193 - RNA, 64 nt, Homo Sapiens
ugggugugguggcgggcgcccucuacaaaaauacaaaaauuagcccaacauggugaaacccugu

SEQ ID NO: 458194 - RNA, 64 nt, Homo Sapiens
cauaaaacagugggcaauagauuucuaaggcuuuaaaaauuauugugacagauaaagauguaug

SEQ ID NO: 458195 - RNA, 64 nt, Homo Sapiens
gcacaaacauucuggcauuccagugcuuaugaagaaaaauuaaagcuuuugacucauuucuagg

SEQ ID NO: 458196 - RNA, 64 nt, Homo Sapiens
ugggcaugguggugcgugccucuauuaaaauacaaaaaauuagccaacacggugaaaccccauc

SEQ ID NO: 458197 - RNA, 64 nt, Homo Sapiens
ucaagauggauuaaagacuucuuaugccauauacaaaaauuaacgauugaaaauggacgccuuc

SEQ ID NO: 458198 - RNA, 64 nt, Homo Sapiens
guugcguacauggcaaauccugcaaauauagauuaaaaauuaaauuagcccauugaaauccuuu

SEQ ID NO: 458199 - RNA, 64 nt, Homo Sapiens
uugucaguguuuccuucuauaaacuguucuuuggaaaaauuaaguuauacauaaaauucauauu

SEQ ID NO: 458200 - RNA, 64 nt, Homo Sapiens
gcccacugugcucaauuugaagcagaauucagugaaaaauuauuuuuccacauugaaacacuuu

SEQ ID NO: 458201 - RNA, 64 nt, Homo Sapiens
uagcauagcaagacccugucucuacaaaaaaaacaaaaauuagcugggcaugguggcaugcaca

SEQ ID NO: 458202 - RNA, 64 nt, Homo Sapiens
uuucucuuaaaauuauuuagccuccauuauuacaaaaaauuauaaaaauaaguuuucagucagu

SEQ ID NO: 458203 - RNA, 64 nt, Homo Sapiens
uauuuguuuguauguuuauucaguauacuuacauaaaaauuauuucgccaucagccaaaacuca

SEQ ID NO: 458204 - RNA, 64 nt, Homo Sapiens
aggagccccaccccccgucucuacaaaaaaauuuaaaaauuaacugggcaugguggcugaggug

SEQ ID NO: 458205 - RNA, 64 nt, Homo Sapiens
ccaacuuuuuuagagacagccugucucuuaaaaaaaaaauuaauuugguagugagagcuugugu

SEQ ID NO: 458206 - RNA, 64 nt, Homo Sapiens
caacauggcgaaacccuaucucuacaaaaaauacaaaaauuagccagacaugguggcacaugcc

SEQ ID NO: 458207 - RNA, 64 nt, Homo Sapiens
auuuuuuguacucauucauuccuguuaagcugccaaaaauuaaagugcaauauuguauauuuuu

SEQ ID NO: 458208 - RNA, 64 nt, Homo Sapiens
gacuuuaacugcaguuccaaagcuucucuaacccaaaaauuacaguaccaaaugauugacucag

SEQ ID NO: 458209 - RNA, 64 nt, Homo Sapiens
uguauacuugaaacuguuuaaguacaaguugaacaaaaauuaugaaaagguauauuugcuucuc

SEQ ID NO: 458210 - RNA, 64 nt, Homo Sapiens
cacauuuuaauuuagcaaauugauuuaccuaggaaaaaauuaucaccuucaaagauaggcauag

SEQ ID NO: 458211 - RNA, 64 nt, Homo Sapiens
augcuuaagcuuuuaacagcauuuuaaccgcucuaaaaauuaccagaguaagaaaaagcuaggu

SEQ ID NO: 458212 - RNA, 64 nt, Homo Sapiens
ucuauaaugcuuauuaugguaaaauaaaauuggaaaaaauuaaaacugaccuauaagaguguua

SEQ ID NO: 458213 - RNA, 64 nt, Homo Sapiens
uuuauguccauaaaauacaaauauauuguucauaaaaaauuaguaucccuuuuguuugguugcu

SEQ ID NO: 458214 - RNA, 64 nt, Homo Sapiens
uagacuugugaguugaaugacaaagcaguugaacaaaaauuauggcauuuaagaauuuaacaug

SEQ ID NO: 458215 - RNA, 64 nt, Homo Sapiens
ugccuuagguggagaacuuaaucucucaaggcugaaaaauuaauuuuuucuagaacuacuaauu

SEQ ID NO: 458216 - RNA, 64 nt, Homo Sapiens
uuggcaugguggugcgugccucuacuaaaaauacaaaaauuagccaacauggcgaaaccccauc

SEQ ID NO: 458217 - RNA, 64 nt, Homo Sapiens
ucuucacuuuuaacacaagucaaggcuucacauaaaaaauuauuugcacuugacugaguuggga

SEQ ID NO: 458218 - RNA, 64 nt, Homo Sapiens
ggagguuguucacuuccagaagaacggcagcuugaaaaauuaaacagcagcgaugcagaaggca

SEQ ID NO: 458219 - RNA, 64 nt, Homo Sapiens
aaagaaaaaaguuuuaguuguguaaaagaaaaggaaaaauuaguaauauuaaugauuauucucu

SEQ ID NO: 458220 - RNA, 64 nt, Homo Sapiens
aauuauuggagaaaaugccaauagcagaaauuguaaaaauuaugauuuuaauguuuguuccaaa

SEQ ID NO: 458221 - RNA, 64 nt, Homo Sapiens
accguuuuuguucuaucuugaauuaccacuuuuaaaaaauuauauuuauauacugcuaguuaac

SEQ ID NO: 458222 - RNA, 64 nt, Homo Sapiens
accguggccagccaccaaauaauaacuugaaaaaaaaaauuaaaaaaaauaugucugcuauaga

SEQ ID NO: 458223 - RNA, 64 nt, Homo Sapiens
cauuuugcauuuuacauuuacaguuugcauauuuaaaaauuaauugauuauugagaaaauguag

SEQ ID NO: 458224 - RNA, 64 nt, Homo Sapiens
aguguguuuacaacuguuuuuugcagauaaagaaaaaaauuaagaaucuuuuaaaaauauuauc

SEQ ID NO: 458225 - RNA, 64 nt, Homo Sapiens
auuauaaaucaccaauauaaacauaaugacugaaaaaaauuauuuauuuuggucuagccacuaa

SEQ ID NO: 458226 - RNA, 64 nt, Homo Sapiens
auuuugcaguuaucugagaccagaaauuaucuagaaaaauuauucccaaaaaccauuuggcugg

SEQ ID NO: 458227 - RNA, 64 nt, Homo Sapiens
cuuacuuguaacagcguaauuguuacacaugcuaaaaaauuaguaacuuuuuuagcaugugguc

SEQ ID NO: 458228 - RNA, 64 nt, Homo Sapiens
ugaggagaaauccuuuuuccuacauagucuacucaaaaauuacauuaauauuuugcuuuuuugc

SEQ ID NO: 458229 - RNA, 64 nt, Homo Sapiens
ccaacauggugaaacccuucucuacugaaaauacaaaaauuagccaggugugguggcgcauacc

SEQ ID NO: 458230 - RNA, 64 nt, Homo Sapiens
uaauauggugaaaccucgucucuacuaaaaauacaaaaauuagcugggcaugguggugcgugcc

SEQ ID NO: 458231 - RNA, 64 nt, Homo Sapiens
uauguuauuagcaagguuaagacaucuuuuuuaaaaaaauuauagcuucuaccaagagaaacac

SEQ ID NO: 458232 - RNA, 64 nt, Homo Sapiens
ucugaacuuggcaaaauuggaaauuaaaauuuuuaaaaauuacaaauauacaaaguuauuuauc

SEQ ID NO: 458233 - RNA, 64 nt, Homo Sapiens
ugacgaaaccccaucucuacugaaaauagaaaaaaaaaauuagccaggcuugcaccuguaaucc

SEQ ID NO: 458234 - RNA, 64 nt, Homo Sapiens
guguuaaaaaaaaaaagugcaacuaucaaaacuaaaaaauuauagaguaauauugccguucugc

SEQ ID NO: 458235 - RNA, 64 nt, Homo Sapiens
auugaccucuguugcauuuauucuaaagccccccaaaaauuaucuagccguuucgaauaucaac

SEQ ID NO: 458236 - RNA, 64 nt, Homo Sapiens
caacaugacgaaacuccgucucuauuuaaaauacaaaaauuagcugggcaugguggugcaugcc

SEQ ID NO: 458237 - RNA, 64 nt, Homo Sapiens
caacauggcgaaaccccaucucuacuaaaaauauaaaaauuaguugcgugugguggcacauccc

SEQ ID NO: 458238 - RNA, 64 nt, Homo Sapiens
caacauggggaaaccccgucucuacuaaaaauacaaaaauuagccgggcaugguggugggcgcc

SEQ ID NO: 458239 - RNA, 64 nt, Homo Sapiens
acaacauagugagauccuaucucuauaaaaaaucaaaaauuagccaggcaugguggugcauacc

SEQ ID NO: 458240 - RNA, 64 nt, Homo Sapiens
caauguggugaaaccccaucucuacuaaaaauacaaaaauuagcugggcgugguggugcaugcc

SEQ ID NO: 458241 - RNA, 64 nt, Homo Sapiens
uccauuuucgaagccaccuguaucaaugccauguaaaaauuaauguuguauugaaauaguaacu

SEQ ID NO: 458242 - RNA, 64 nt, Homo Sapiens
ccuugaaauagauaugaaacuauacugggucaugaaaaauuaucuuuaaauuugcuaguugcau

SEQ ID NO: 458243 - RNA, 64 nt, Homo Sapiens
ccagugcacaauggugugagccaaggaaaaaaauaaaaauuauuauguagcacuugacuuuuug

SEQ ID NO: 458244 - RNA, 64 nt, Homo Sapiens
uauauauucuccuuuuaaugagggaaauuggaaaaaaaauuauaccucuucucuggguguaaga

SEQ ID NO: 458245 - RNA, 64 nt, Homo Sapiens
uuucuagaaacaccauucuggacacagguggucuaaaaauuacuaccaacacccccaagugacu

SEQ ID NO: 458246 - RNA, 64 nt, Homo Sapiens
ucauuaguaucauaaacgucggggugggguauuuaaaaauuaacgagcagagcaccucccacug

SEQ ID NO: 458247 - RNA, 64 nt, Homo Sapiens
aaaaaaguuaugggauuaaagucucaaaaaaaaaaaaaauuauggggcgacagagugagacucu

SEQ ID NO: 458248 - RNA, 64 nt, Homo Sapiens
caggcaugguggcacgugccucuacuaaaaauacaaaaauuagccaacauggugaaacuguguc

SEQ ID NO: 458249 - RNA, 64 nt, Homo Sapiens
aguuaugggauuaaaaaaagccacuaaauuaaaaaaaaauuaaacacugucaucuaaaagcugg

SEQ ID NO: 458250 - RNA, 64 nt, Homo Sapiens
augauaaagaaauuuaagguauaaaauuaaauguaaaaauuaauuucagcuucauuucguauuu

SEQ ID NO: 458251 - RNA, 64 nt, Homo Sapiens
caucauggugaaacccugucucuacugaaaauacaaaaauuagccgggcgugguggcacacgcc

SEQ ID NO: 458252 - RNA, 64 nt, Homo Sapiens
caacaugaugaaacccugucucuacuaaaaauacaaaaauuagccgggcaugguggugcacauc

SEQ ID NO: 458253 - RNA, 64 nt, Homo Sapiens
ggcaacauggcacaauugucucuacaaaaaauacaaaaauuagccaggcaugguggcaugcacc

SEQ ID NO: 458254 - RNA, 64 nt, Homo Sapiens
cgacauggugaaacucagucucuauugaaaauacaaaaauuagcucagugugguggcacacacu

SEQ ID NO: 458255 - RNA, 64 nt, Homo Sapiens
cauggugaaaccuugucucuacuaaaacuacaaaaaaaauuagccaggcgugguggcgggcgcc

SEQ ID NO: 458256 - RNA, 64 nt, Homo Sapiens
uauuagcaucaaccaucuugauaaucaccaagggaaaaauuaaaaauaccuagacugcaauaaa

SEQ ID NO: 458257 - RNA, 64 nt, Homo Sapiens
cuuggugacuaaggugacuuuguauauucaucuuaaaaauuauguucuuuagacacugcuaccu

SEQ ID NO: 458258 - RNA, 64 nt, Homo Sapiens
uuucuuuaaauaggaacaaccucuuuuaaaagagaaaaauuauuucagugauuugucaaaacga

SEQ ID NO: 458259 - RNA, 64 nt, Homo Sapiens
gguagccaaaugaaaaagaaugaaagggaaagugaaaaauuaaggggacaaaagaugggaugug

SEQ ID NO: 458260 - RNA, 64 nt, Homo Sapiens
cucaaaguguuucuuaagggugaguuggcaugcaaaaaauuacauugauuacaguguguuuugg

SEQ ID NO: 458261 - RNA, 64 nt, Homo Sapiens
aucaggccuuggagcagucacugcuuuauuccgcaaaaauuauuugguaggaaauuuuugggag

SEQ ID NO: 458262 - RNA, 64 nt, Homo Sapiens
acuuuucuuguaaauaugucacaucugaguucaaaaaaauuacuuugaauaccuuaauauuugc

SEQ ID NO: 458263 - RNA, 64 nt, Homo Sapiens
ugggcgugguggugcgugccucuacuaaaaauacaaaaauuagccaacauggugaaaccucguc

SEQ ID NO: 458264 - RNA, 64 nt, Homo Sapiens
uuuuacuuuagaaaaauaucgagcuuucauuuuuaaaaauuauaaaaacauaaguaacaaaguu

SEQ ID NO: 458265 - RNA, 64 nt, Homo Sapiens
uuucauuaaaaagaaauuuggguaucuugcccuuaaaaauuaguagacguuuuucuucugcugu

SEQ ID NO: 458266 - RNA, 64 nt, Homo Sapiens
gugugggagcugcacguuuaggaggaaagaagaaaaaaauuaauugugugcagauaccaaaaga

SEQ ID NO: 458267 - RNA, 64 nt, Homo Sapiens
aggggccaagaggaagacauuaaauaaaaacauaaaaaauuaagaugcugccaaagauuaaaaa

SEQ ID NO: 458268 - RNA, 64 nt, Homo Sapiens
uagaggugaacacaauuauuuaauacgugugcauaaaaauuaaagucaaaaggaagcuuguuug

SEQ ID NO: 458269 - RNA, 64 nt, Homo Sapiens
cgggcgucgcagcaugcgccucuacuaaaauacaaaaaauuagccaacacggugaaaccccguc

SEQ ID NO: 458270 - RNA, 64 nt, Homo Sapiens
uuagaacacauuguauugguauuuaacucaauagaaaaauuauuuauaggaucuacagaugaau

SEQ ID NO: 458271 - RNA, 64 nt, Homo Sapiens
uaaauuauuauaaccuuucaacucugucucaaaaaaaaauuaaaagccugggugacagagugag

SEQ ID NO: 458272 - RNA, 64 nt, Homo Sapiens
auaaauuuaaauacaaaaaaacucugccucaaaaaaaaauuaaaagccugggcaacagagcaag

SEQ ID NO: 458273 - RNA, 64 nt, Homo Sapiens
ugggcaugguggcaggugcuucuacuaaacaugcaaaaauuacccaacauggugaaaccccauc

SEQ ID NO: 458274 - RNA, 64 nt, Homo Sapiens
cauauuuacauauuuuucauuuuuuugcuaagaaaaaaauuaaacauuguuauuuuuagaaaga

SEQ ID NO: 458275 - RNA, 64 nt, Homo Sapiens
uuuuaaaacacagagguguuagaggguccuucaaaaaaauuauuuguuaauguuauauuaaaag

SEQ ID NO: 458276 - RNA, 64 nt, Homo Sapiens
ucccaaguaaauauaucaguuaaaaacaaaaaguaaaaauuaguaucagucaaaauaauaaaac

SEQ ID NO: 458277 - RNA, 64 nt, Homo Sapiens
ugcuuuaagaaauggagaagaacauuuuuuucauaaaaauuaaaacauacauuuugaaauuaug

SEQ ID NO: 458278 - RNA, 64 nt, Homo Sapiens
ccuggugaaacccugucucuacuaaaaauacaaaaaaaauuagcugagcgugguggcgggcgcc

SEQ ID NO: 458279 - RNA, 64 nt, Homo Sapiens
uauacugaguaguagaaagaagcuaauuugaaauaaaaauuauuuguauaauuaagaaagcaga

SEQ ID NO: 458280 - RNA, 64 nt, Homo Sapiens
auuacauauuagggauuguaagaaaacuuuaauuaaaaauuaaagacuauauauaauuaaacua

SEQ ID NO: 458281 - RNA, 64 nt, Homo Sapiens
aacaaggugaaacccugucucuacuaaaaauacaaaaaauuagccaggcaugguggugcgcacc

SEQ ID NO: 458282 - RNA, 64 nt, Homo Sapiens
guuuugcccuuaagaagucaugauuaacuuaugaaaaaauuauuuggggacaggagugugauac

SEQ ID NO: 458283 - RNA, 64 nt, Homo Sapiens
aaaguaguggaaggaaauugucuacgugucuuggaaaaauuaguuaggaauuuggauggguaaa

SEQ ID NO: 458284 - RNA, 64 nt, Homo Sapiens
auuuuuuuuuuuuuuuaagaaaaaccuauagaugaaaaauuacuaaugaaacuguguguacgug

SEQ ID NO: 458285 - RNA, 64 nt, Homo Sapiens
uguucuccuuagaugugagagaaagagaaaucagaaaaauuaauucucuugggggaagggcuug

SEQ ID NO: 458286 - RNA, 64 nt, Homo Sapiens
aaaauaagaaagcccuaaaauacuauuggagagaaaaaauuaacuagguugcuacuuuauuugc

SEQ ID NO: 458287 - RNA, 64 nt, Homo Sapiens
cauaagacaugcacacuaauacacauacacaccaaaaaauuacacauuuuaaaacugcuaagcu

SEQ ID NO: 458288 - RNA, 64 nt, Homo Sapiens
augugaaagcuggagccgaagagucaaagagcuaaaaaauuaagucuagaacauucuaugagga

SEQ ID NO: 458289 - RNA, 64 nt, Homo Sapiens
gcaacugaacaaaaaaaugcacuagaaagugaauaaaaauuaaguuugcaauaucgaucagaug

SEQ ID NO: 458290 - RNA, 64 nt, Homo Sapiens
uauuuguauauauacauaacgauuauauugagacaaaaauuaucgauuuauguuguauagauua

SEQ ID NO: 458291 - RNA, 64 nt, Homo Sapiens
cacaguguuagucaaccuuuaugacuaaaaauugaaaaauuaaaccaaauguccgaugugugcu

SEQ ID NO: 458292 - RNA, 64 nt, Homo Sapiens
agcauaaaaacucagguaucuuuuuucaaagaacaaaaauuauauuuacuaugauuuagggcuu

SEQ ID NO: 458293 - RNA, 64 nt, Homo Sapiens
agauauacagaugacuuuuuggaauaaaaauuuuaaaaauuaagaucuuuuuuuuauuuuuaag

SEQ ID NO: 458294 - RNA, 64 nt, Homo Sapiens
cgggugugguggugggcaccucuacuaaaaauacaaaaauuagccaauauggugaaacccuguc

SEQ ID NO: 458295 - RNA, 64 nt, Homo Sapiens
gaauaaaaauacuucuauuaaaauuaaaauguaaaaaaauuaaauuaaguucugaaaauugaaa

SEQ ID NO: 458296 - RNA, 64 nt, Homo Sapiens
auguaaaaaaauuaaagaauguucugaaaauugaaaaaauuaaagcaauaguucaaaaaauuaa

SEQ ID NO: 458297 - RNA, 64 nt, Homo Sapiens
uucugaaaauugaaaaaauuuuagcaauaguucaaaaaauuaagaaaauccuugcuuuuaagug

SEQ ID NO: 458298 - RNA, 64 nt, Homo Sapiens
ugaauguggucucucuuucucaauauauuguaauaaaaauuauggcaaaauagagcaauuauaa

SEQ ID NO: 458299 - RNA, 64 nt, Homo Sapiens
uaaccaugauggaugaaucuaaauaaaggccagaaaaaauuaaugaaauccagcgagauauuag

SEQ ID NO: 458300 - RNA, 64 nt, Homo Sapiens
aaauauauuuuuuaauaaacuaugcagcagguguaaaaauuaauuaguguuaauagucuugugc

SEQ ID NO: 458301 - RNA, 64 nt, Homo Sapiens
augugauggccacuucuaauuucacacuuagggaaaaaauuaaacuuuuaauaagacggucaac

SEQ ID NO: 458302 - RNA, 64 nt, Homo Sapiens
uucucugugaccugauuucagaagagacugauccaaaaauuauaacggcagggaaccuagugca

SEQ ID NO: 458303 - RNA, 64 nt, Homo Sapiens
ucugcuagccaauauuaaaagagaccugcaauaaaaaaauuacccugaucugauagaaagcaag

SEQ ID NO: 458304 - RNA, 64 nt, Homo Sapiens
ucgaauccauccgcuuguaggggaaaaaaaggaaaaaaauuaaccagagagggucuguaaucuc

SEQ ID NO: 458305 - RNA, 64 nt, Homo Sapiens
aguaacaucucagaaauuucauccagaggaacaaaaaaauuaaaaauagaacauagcaaagcaa

SEQ ID NO: 458306 - RNA, 64 nt, Homo Sapiens
auaacuuacuauauguuucaguugcucucugaacaaaaauuaucuucaauuuaauauguggaau

SEQ ID NO: 458307 - RNA, 64 nt, Homo Sapiens
aacauggugaaacaccgucucuacuaaaaauacaaaaaauuaggugugguggugcgugccugua

SEQ ID NO: 458308 - RNA, 64 nt, Homo Sapiens
uauuccuacuuucagaagaaaaauauaauacggaaaaaauuauagauuuacuuguagcuuauua

SEQ ID NO: 458309 - RNA, 64 nt, Homo Sapiens
aaguugugcuguuuucuaaguaaaauaaaaaauaaaaaauuagcaauuuaugauagccaguguu

SEQ ID NO: 458310 - RNA, 64 nt, Homo Sapiens
aguuuuaucuggguacaaauauuaaaauauacuuaaaaauuaaucaguuuucucugcauaagua

SEQ ID NO: 458311 - RNA, 64 nt, Homo Sapiens
uuuaaauauuaacucaaaagacaaacucuuuuuuaaaaauuacuugcuuuuguuucuuaagaaa

SEQ ID NO: 458312 - RNA, 64 nt, Homo Sapiens
aggcaauggaaacuauuauaagaaaaaaauggaaaaaaauuacaauuauauuuuuucuauaaaa

SEQ ID NO: 458313 - RNA, 64 nt, Homo Sapiens
caggcaugguggcacaugcccuacaaaaaaauuaaaaaauuagcaacaugacaagaccccaucu

SEQ ID NO: 458314 - RNA, 64 nt, Homo Sapiens
aaauuagccaggcaugguggccccaucucuacaaaaaaauuaaaacaugggcaacaugacaaga

SEQ ID NO: 458315 - RNA, 64 nt, Homo Sapiens
aacugauucuucugcagagcaauagauacauuaaaaaaauuaaaaugaucaacuuauuccauua

SEQ ID NO: 458316 - RNA, 64 nt, Homo Sapiens
gggggggugguggcagggccaaaaaaaaauagacaaaaauuagcgaaaccccgucucuacuaaa

SEQ ID NO: 458317 - RNA, 64 nt, Homo Sapiens
cgggcgugguggcgggugcccuacuaaaaauacaaaaaauuagcaacaccgugaaaccccgucu

SEQ ID NO: 458318 - RNA, 64 nt, Homo Sapiens
cgggcgugguggcaggcacccuaaaaaaaaauacaaaaauuagcacggugaaaccccaucucua

SEQ ID NO: 458319 - RNA, 64 nt, Homo Sapiens
cgggcgugguggugcaugccacuaaaaaaaaaaaaaaaauuagucauggugaaaccccaucucu

SEQ ID NO: 458320 - RNA, 64 nt, Homo Sapiens
uauuagaaugugagaaauuuaaaauuuaaaaaauaaaaauuaaacaucauaccuagcagguaau

SEQ ID NO: 458321 - RNA, 64 nt, Homo Sapiens
aggguagacacaguugagagggggaagaaagaaaaaaaauuaaaucgguuaacuguaaaguuag

SEQ ID NO: 458322 - RNA, 64 nt, Homo Sapiens
cagcugugguggcgggcgcccuacuaaaaauacaaaaaauuagcaacauggugaaaccucgucu

SEQ ID NO: 458323 - RNA, 64 nt, Homo Sapiens
ugaggggaggccgggugcgggagaaauggguuuuaaaaauuaagccaguugugaagcuggagaa

SEQ ID NO: 458324 - RNA, 64 nt, Homo Sapiens
ugcugguaaugagagcuuaaaaaaccagccucuaaaaaauuaggauuucuuucacuuaaguugg

SEQ ID NO: 458325 - RNA, 64 nt, Homo Sapiens
cuuauugcuagacuguaaguaagcauucuguuuuaaaaauuaggugauuguacagggagaaauu

SEQ ID NO: 458326 - RNA, 64 nt, Homo Sapiens
ccaaggugauaaaacccgucucuacuaauacaaaaaaaauuagcuggguauguuggugcaggcu

SEQ ID NO: 458327 - RNA, 64 nt, Homo Sapiens
caacauggcgaaaccccaucucuacuaaaaauacaaaaauuagccgggcgugguggcuuacgcc

SEQ ID NO: 458328 - RNA, 64 nt, Homo Sapiens
ugaaaacuuaaauuguaaaacauguugaaauuuuaaaaauuaauguuaauauggaaaugcauuu

SEQ ID NO: 458329 - RNA, 64 nt, Homo Sapiens
gcacaagagaauuagagcuucagugagaauuuagaaaaauuauacuaaagugagaugcauuuuu

SEQ ID NO: 458330 - RNA, 64 nt, Homo Sapiens
ccccccaccaacccccuucuacugccuacuuuaaaaaaauuaauaguuuucuauggaacugauc

SEQ ID NO: 458331 - RNA, 64 nt, Homo Sapiens
uuaauaguuuucuauggaacugaucuaagauuagaaaaauuaauuuucuuuaauuucauuauga

SEQ ID NO: 458332 - RNA, 64 nt, Homo Sapiens
ucauaauugugccaaguuguuucaugcaguccucaaaaauuagauguaauugagcuuuguguaa

SEQ ID NO: 458333 - RNA, 64 nt, Homo Sapiens
gauaauuauauguauuuuuaaaaacugugagaggaaaaauuagucauaacccuuuuggguuauc

SEQ ID NO: 458334 - RNA, 64 nt, Homo Sapiens
uucaaguaaucugacagcauuaaauauugcauuuaaaaauuauacuguagcaaauacauuuaaa

SEQ ID NO: 458335 - RNA, 64 nt, Homo Sapiens
ugcauuuaaaaauuauacuguagcaaauacauuuaaaaauuaaucacaacguuaagaugaaauu

SEQ ID NO: 458336 - RNA, 64 nt, Homo Sapiens
ugauccuuguggcacacaacuacaaaaaaaaucaaaaaauuaucaagugagaccucccugucuc

SEQ ID NO: 458337 - RNA, 64 nt, Homo Sapiens
uuuaaaacuuacuaugguauuauaauggccucuuaaaaauuaucauagugaaaauuuuauugaa

SEQ ID NO: 458338 - RNA, 64 nt, Homo Sapiens
caagucuaguggaaccaacgaauaugagauuggaaaaaauuagacaccuaucuggaaaaaaaaa

SEQ ID NO: 458339 - RNA, 64 nt, Homo Sapiens
cuuuuauuaauuuguugcuaaaaacuauuuguauaaaaauuaaguaagaauucaaauuuguaau

SEQ ID NO: 458340 - RNA, 64 nt, Homo Sapiens
uguugccaaaaccaaacccauucacuucuaaaccaaaaauuaugugaaacauccguuuucauug

SEQ ID NO: 458341 - RNA, 64 nt, Homo Sapiens
uauauauauauauuaguaauguccaaaaauagucaaaaauuaaauuuccuguggaauaaagaug

SEQ ID NO: 458342 - RNA, 64 nt, Homo Sapiens
uugaaacaaaaugucccaacuuguuaacauaaccaaaaauuaaaauccucuuuagagguaauuu

SEQ ID NO: 458343 - RNA, 64 nt, Homo Sapiens
gugauaggauauucauuaguccauuucuuuuagaaaaaauuagguauuugucacuuuaaaaaau

SEQ ID NO: 458344 - RNA, 64 nt, Homo Sapiens
aaauugcaauacguaguucuagaauaaaaguacaaaaaauuagaauaagaauucuuuaacauuu

SEQ ID NO: 458345 - RNA, 64 nt, Homo Sapiens
aacacagugaaaccccgucucuaauaaaaauacgaaaaauuagccaggcgugguggcgggcgcc

SEQ ID NO: 458346 - RNA, 64 nt, Homo Sapiens
acaaucauuaauggaucauacacaauagguuuuuaaaaauuaauaacuuuuaguaauuacuuuu

SEQ ID NO: 458347 - RNA, 64 nt, Homo Sapiens
ccaacacggugaaaccccaucucucuaaaaauacaaaaauuagcugggcgugguggcacacgcc

SEQ ID NO: 458348 - RNA, 64 nt, Homo Sapiens
acuuaguuacuacugaagauaauuuuugaaauguaaaaauuagauuuaaauaguauauuuuaaa

SEQ ID NO: 458349 - RNA, 64 nt, Homo Sapiens
gaucacugauuucaaagacuugguguauaguguuaaaaauuaaagcuuaaaaggugguuagaaa

SEQ ID NO: 458350 - RNA, 64 nt, Homo Sapiens
cggguaugauggugugugccuacaaaaaauacaaaaaaauuagcacauggugaagccccaucuc

SEQ ID NO: 458351 - RNA, 64 nt, Homo Sapiens
cuaucauuuuaagagccaauuuuuauugaaugagaaaaauuaguuuuuguuauuagaaauuuuc

SEQ ID NO: 458352 - RNA, 64 nt, Homo Sapiens
cuacuuaaaggcacaacuaacaaaacaaaacaaaaaaaauuagcgacagagagagacuccaucu

SEQ ID NO: 458353 - RNA, 64 nt, Homo Sapiens
cagacgugguggcaugcgcccuacuaaaaaaaagaaaaauuagcaaaauggugaaacccugucu

SEQ ID NO: 458354 - RNA, 64 nt, Homo Sapiens
cugguaaggccgggugcaguaaacgcauguuuuuaaaaauuagcagguaaauccugguaauuaa

SEQ ID NO: 458355 - RNA, 64 nt, Homo Sapiens
aaauuuaaaauggaaauaaccaagcaacuguuagaaaaauuagacaguauucccaacucacagg

SEQ ID NO: 458356 - RNA, 64 nt, Homo Sapiens
auuguaugaaauuaagaguuuauguaucaguuuuaaaaauuagagaaaauuuuaugacaucuau

SEQ ID NO: 458357 - RNA, 64 nt, Homo Sapiens
aaaauucugauaauagugcauggucauuuuacggaaaaauuagauuaagcuauauguuuagaaa

SEQ ID NO: 458358 - RNA, 64 nt, Homo Sapiens
uuagggacugauauugguaaaauucuucauucagaaaaauuaucaacaaacaaacaaaaaaaac

SEQ ID NO: 458359 - RNA, 64 nt, Homo Sapiens
uagacuuuaaaaaguuagaauuuauucuguaacuaaaaauuauuugaaaaaauuaugccucugg

SEQ ID NO: 458360 - RNA, 64 nt, Homo Sapiens
guuagaauuuauucuguaacuaaaaauuauuugaaaaaauuaugccucugguuuaauuauuggu

SEQ ID NO: 458361 - RNA, 64 nt, Homo Sapiens
guuugauuauugugagucaaaacucuaagugguuaaaaauuaguaugaauuuuuuagcuucuua

SEQ ID NO: 458362 - RNA, 64 nt, Homo Sapiens
caacauggugaaaccccgucucuacuagaaauacaaaaauuagcugggugugggggcgugcgcc

SEQ ID NO: 458363 - RNA, 64 nt, Homo Sapiens
aauacccacuuuauagauaauuacagggauggugaaaaauuaguaaauagcuucacaaaagagg

SEQ ID NO: 458364 - RNA, 64 nt, Homo Sapiens
uagcaaaucaguauauuuucuguauuuaauuauaaaaaauuaacuuaguuuuuaaaauuuauuu

SEQ ID NO: 458365 - RNA, 64 nt, Homo Sapiens
uuguauuuuggaggugcuugaucuaucuacaaagaaaaauuaauuaggaauuacuuuauuauaa

SEQ ID NO: 458366 - RNA, 64 nt, Homo Sapiens
cuuuucuucuauagucugugguauaguuaagguaaaaaauuaagucguuauugauaaccagucu

SEQ ID NO: 458367 - RNA, 64 nt, Homo Sapiens
cuucagaaaugaaaaucagaaaugaagaacuaacaaaaauuaguauggaccagguccucuauaa

SEQ ID NO: 458368 - RNA, 64 nt, Homo Sapiens
uucauauguauugcauugcaucucaaaaaaaaaaaaaaauuauaggugacaaagcgagacuccg

SEQ ID NO: 458369 - RNA, 64 nt, Homo Sapiens
cgggcgugguggcgggcgccuacuaaaaaauacaaaaaauuagcccacggugaaacccugucuc

SEQ ID NO: 458370 - RNA, 64 nt, Homo Sapiens
cagguguagggguaggcaccguacaaaaaauacaaaaaauuagcaacauggcaaaacgcagucu

SEQ ID NO: 458371 - RNA, 64 nt, Homo Sapiens
ccagagagacagaguccuccgaaccagccuggccaaaaauuacaucacaggcugaggggguuca

SEQ ID NO: 458372 - RNA, 64 nt, Homo Sapiens
ugggcaugguggcaugcuccucuacaaaaaauacaaaaauuagccaacauggugaaaccccguc

SEQ ID NO: 458373 - RNA, 64 nt, Homo Sapiens
gaugaaacagccaccaccauuggugacuugggggaaaaauuaguuagauagccaugugacgucc

SEQ ID NO: 458374 - RNA, 64 nt, Homo Sapiens
caggcaugguggcaagcgccuacuaaaaauacaaaaaaauuagcacacgguaaaacccugucuc

SEQ ID NO: 458375 - RNA, 64 nt, Homo Sapiens
ggccgggcgcaguggcucacucuccacaaaauuuaaaaauuagcggccaacacaguaaacccug

SEQ ID NO: 458376 - RNA, 64 nt, Homo Sapiens
aaaauugcaaguuaagaaauagguaagaguacugaaaaauuaauuuuucuuaguaguauauaaa

SEQ ID NO: 458377 - RNA, 64 nt, Homo Sapiens
acguacuuaagccaggagaaauuuuuuucugugaaaaaauuaaauuuuuauuugccugaaauau

SEQ ID NO: 458378 - RNA, 64 nt, Homo Sapiens
agccuggacaacuaagugagacuccaucucuacaaaaaauuaaaaaauuagccagguguggagg

SEQ ID NO: 458379 - RNA, 64 nt, Homo Sapiens
caacuaagugagacuccaucucuacaaaaaauuaaaaaauuagccagguguggaggggcaugcc

SEQ ID NO: 458380 - RNA, 64 nt, Homo Sapiens
ugacauguugggcugcaugauaaaaguuaauuauaaaaauuaaaagauuuuuuuuuuugagaug

SEQ ID NO: 458381 - RNA, 64 nt, Homo Sapiens
cugggauuauaggcguaagccaccaugccuggccaaaaauuaaaagauuuuaugaaacgaaaug

SEQ ID NO: 458382 - RNA, 64 nt, Homo Sapiens
cugggcaacauagcgagaccucgucucuacaaaaaaaaauuaaaaagggggcuuugggaggcca

SEQ ID NO: 458383 - RNA, 64 nt, Homo Sapiens
caacauggugaaaccccgucucuacuaaaauacaaaaaauuagcugggcaugguggcgcacacc

SEQ ID NO: 458384 - RNA, 64 nt, Homo Sapiens
caacuuggugaaaucccaucucuacuaaaaauacaaaaauuagcugggugcaguggcgcaugcu

SEQ ID NO: 458385 - RNA, 64 nt, Homo Sapiens
agcucgacuuuaaaaagcuccaaaugcagcuuuaaaaaauuaaucugggccagaauuucaaacg

SEQ ID NO: 458386 - RNA, 64 nt, Homo Sapiens
gauguacaguuauggauugaaaguuuacaggaaaaaaaauuaggccguuccuucaaagcaaaug

SEQ ID NO: 458387 - RNA, 64 nt, Homo Sapiens
ugggcgugguggcgugcaccucuauuaaaaauacaaaaauuagcaaacauggugaaaccccguc

SEQ ID NO: 458388 - RNA, 64 nt, Homo Sapiens
cagguguaguggugugcaccucuacuaaaaauagaaaaauuagccaauauggugaaaccccauc

SEQ ID NO: 458389 - RNA, 64 nt, Homo Sapiens
uggacguguagucccagcuacuuuacaaaaauacaaaaauuagcgcaacauagugaggccccau

SEQ ID NO: 458390 - RNA, 64 nt, Homo Sapiens
cgggcaugguggaaugugccucuccuaaaaauacaaaaauuagccaguauggugaaacccuguc

SEQ ID NO: 458391 - RNA, 64 nt, Homo Sapiens
auauucagacuauucuuaaaauauuuauuuuaaaaaaaauuauaaguugggauuuugcaguugg

SEQ ID NO: 458392 - RNA, 64 nt, Homo Sapiens
uggaaaacagugggaagugguaguuaauuccguuaaaaauuacuuguauuaggcuguguauuga

SEQ ID NO: 458393 - RNA, 64 nt, Homo Sapiens
acacggugaaaccccaucucuacuaaaaauacaaaaaaauuagucggacaugguggcaggcacc

SEQ ID NO: 458394 - RNA, 64 nt, Homo Sapiens
caacauggugaaaccccaucucuacuaaaaauacaaaaauuagcuaggcgggguagugcaugcc

SEQ ID NO: 458395 - RNA, 64 nt, Homo Sapiens
caacauggugaaaccccgucucuacuaaagauaaaaaaauuagcugaguguguuggugggugcc

SEQ ID NO: 458396 - RNA, 64 nt, Homo Sapiens
cacggugaaaccucgucuccacuaaaaauaccaaaaaaauuagcugggcaugguggcacacacc

SEQ ID NO: 458397 - RNA, 64 nt, Homo Sapiens
aauaacucuuugcaaauaggagacuccaucucaaaaaaauuauaccagcuugggugacagagca

SEQ ID NO: 458398 - RNA, 64 nt, Homo Sapiens
cagaugugguggugcacacccugcuaaaaauacaaaaaauuagcaacauggugaaaccccgucu

SEQ ID NO: 458399 - RNA, 64 nt, Homo Sapiens
gaugguuauuucuguuuuagaaggauggucuccaaaaaauuaauugaacuuuugagagagauga

SEQ ID NO: 458400 - RNA, 64 nt, Homo Sapiens
agaucuuuugcuagcuauuguucauggaucuggcaaaaauuaagcagugagaugaaacuucccc

SEQ ID NO: 458401 - RNA, 64 nt, Homo Sapiens
cgggcgugguggcccacgccaaaaaaaaaaauacaaaaauuagcuccgucucaaaaaaaaaaaa

SEQ ID NO: 458402 - RNA, 64 nt, Homo Sapiens
cgggcgugguagcgggcgcccuacuaaaaauacaaaaaauuagcaacaugaugaaaccccaucu

SEQ ID NO: 458403 - RNA, 64 nt, Homo Sapiens
agccaggugcaguggcucaccuuuauuuaaaaagaaaaauuagcaaguuaauccuuuuuaaaaa

SEQ ID NO: 458404 - RNA, 64 nt, Homo Sapiens
uacuaaaaguuuauugguaguauuuuagugaguuaaaaauuacaccaaauuaaacuagacuuac

SEQ ID NO: 458405 - RNA, 64 nt, Homo Sapiens
aggacagaagcagaccacucugugcaccaaccuaaaaaauuacagagaagagaaaauuaucuuu

SEQ ID NO: 458406 - RNA, 64 nt, Homo Sapiens
ccacauggugaaacccugucucuacuaaagauauaaaaauuagcuggaugugguggugcacacc

SEQ ID NO: 458407 - RNA, 64 nt, Homo Sapiens
cacagaauguuuuugguaauauuaauuuccacuaaaaaauuaaaugucuuuuaagaaacauucu

SEQ ID NO: 458408 - RNA, 64 nt, Homo Sapiens
ugucuuuuaagaaacauucuuuuccacuuguuaaaaaaauuaaauauauuuuaaagcacuuuaa

SEQ ID NO: 458409 - RNA, 64 nt, Homo Sapiens
acauccuugagauucuuacacaucuaacaacaaaaaaaauuaucuacaucagucauuguuacau

SEQ ID NO: 458410 - RNA, 64 nt, Homo Sapiens
ggucucugugaaacuccgucucuacuaaaaauacaaaaauuagcuggacguguuggcgggcauc

SEQ ID NO: 458411 - RNA, 64 nt, Homo Sapiens
gguguuuagcuggcucgaugauguuaacaguauuaaaaauuaaaccccauaaaccaacuaagcc

SEQ ID NO: 458412 - RNA, 64 nt, Homo Sapiens
cagcauggugaaacccuguaucuacaaaaaauacaaaaauuagccaggcaugguggugggugcc

SEQ ID NO: 458413 - RNA, 64 nt, Homo Sapiens
uaucuauaaagugaauguucacaaauuuuaaacaaaaaauuaaauaaaauaucuugauauuuuc

SEQ ID NO: 458414 - RNA, 64 nt, Homo Sapiens
uguguugcaguuuugcauguugugcaaauuguuuaaaaauuagaauaugugauauaaauuaaug

SEQ ID NO: 458415 - RNA, 64 nt, Homo Sapiens
ugggcaugauggcgagugucucuacuaaaaauacaaaaauuagccaacauggugaaaugccguc

SEQ ID NO: 458416 - RNA, 64 nt, Homo Sapiens
aaugauagaaucuuuacucaaauuuacguuauuaaaaaauuacacaucauucuuaucaauguaa

SEQ ID NO: 458417 - RNA, 64 nt, Homo Sapiens
caacauggugaaaccucaucucuacuaaaaauacaaaaauuagccaggcgugguggcaggugcc

SEQ ID NO: 458418 - RNA, 64 nt, Homo Sapiens
gaacauggcgaaaccccgucucuaauaaaaauacaaaaauuagccgggcaugguggugcaugcc

SEQ ID NO: 458419 - RNA, 64 nt, Homo Sapiens
aaucccccagcccagcccagccccaccgaaaagcaaaaauuacacgucgucagccacucagccc

SEQ ID NO: 458420 - RNA, 64 nt, Homo Sapiens
accaacacaagaucaaaaaggaaaaggacgagagaaaaauuauuuuuaagauaauuaaacauaa

SEQ ID NO: 458421 - RNA, 64 nt, Homo Sapiens
caacaugguaaaaccccaucucuaccaaaaauacaaaaauuagcugggcuugguggcuggcgcc

SEQ ID NO: 458422 - RNA, 64 nt, Homo Sapiens
uaacauggugaaauccuaucucuaccaaaaauacaaaaauuagccaggcgugguggugggcacc

SEQ ID NO: 458423 - RNA, 64 nt, Homo Sapiens
aaugaaaugaagugagaagggaaguuuagagaaaaaaaauuaaaaagaaacaaagucuccaaga

SEQ ID NO: 458424 - RNA, 64 nt, Homo Sapiens
gaaguaaagcacuccucagcaaauguaaaggaacaaaaauuauaacaaacugucucucagacca

SEQ ID NO: 458425 - RNA, 64 nt, Homo Sapiens
aacucaaggaaauagagacacaaaaaaaccuucaaaaaauuaauguauccaggagcugguuuuu

SEQ ID NO: 458426 - RNA, 64 nt, Homo Sapiens
agcugaaacuggaucccuuccuuacaccuuauacaaaaauuaauucaagauggauuaaagacuu

SEQ ID NO: 458427 - RNA, 64 nt, Homo Sapiens
caacauggugaaacccugucucuacuaaaaauacaaaaauuaucugggugugguggcacgugcc

SEQ ID NO: 458428 - RNA, 64 nt, Homo Sapiens
uuauuuaccacaguguuauuuuuaucgucauaauaaaaauuauauacgaguauaaaugaaauuc

SEQ ID NO: 458429 - RNA, 64 nt, Homo Sapiens
uucugaguauagaaaauaaaacuaaaguugguagaaaaauuauuuguauauaauguuaagagga

SEQ ID NO: 458430 - RNA, 64 nt, Homo Sapiens
aauaacuauauucggauuauacuuuguuucuugaaaaaauuacagauuuuuugaaaagcaaaug

SEQ ID NO: 458431 - RNA, 64 nt, Homo Sapiens
gcaacacggggagacccugucucuacaagaaauuaaaaauuagccaggcauaguuggcacgugc

SEQ ID NO: 458432 - RNA, 64 nt, Homo Sapiens
aacugaauaagcauuuagcuuuuuaaaucauuuuaaaaauuaagucuaauuuugaagcuuuuuu

SEQ ID NO: 458433 - RNA, 64 nt, Homo Sapiens
caccauagaucuggagaucuucgccaguaacaagaaaaauuaaguuguaaauauuggaaaggaa

SEQ ID NO: 458434 - RNA, 64 nt, Homo Sapiens
uaggauauuuacuguggcuugauuuguaguagccaaaaauuagaaacaacugagaaagcccauc

SEQ ID NO: 458435 - RNA, 64 nt, Homo Sapiens
aacacggugaaaccccgacucuacuaaaaauacaaaaaauuagccgggugugguggcacacacc

SEQ ID NO: 458436 - RNA, 64 nt, Homo Sapiens
caacauagcaaaagcccuuaucugcaaaaaauucaaaaauuagccaggugugguggugcgugcc

SEQ ID NO: 458437 - RNA, 64 nt, Homo Sapiens
aacaccuguaugcacacaaacuagaaaaccuagaaaaaauuaauaaauuccuugaaagauauaa

SEQ ID NO: 458438 - RNA, 64 nt, Homo Sapiens
uucaaaaaaguuucaggauacaaaaucuguguacaaaaauuaguugcauuucuauacaccagua

SEQ ID NO: 458439 - RNA, 64 nt, Homo Sapiens
gggagcuucuaaugaggacaaacaaaaaauagagaaaaauuaauaaagucaaaauguuuauucu

SEQ ID NO: 458440 - RNA, 64 nt, Homo Sapiens
uaacagaaaauguagaugagauagaugaaauacgaaaaauuacaguuuacuuaaugaacauaag

SEQ ID NO: 458441 - RNA, 64 nt, Homo Sapiens
aucaauguaauucaguauuuuaacaaaaggaaugaaaaauuaucaucucaauagacaaagcuuu

SEQ ID NO: 458442 - RNA, 64 nt, Homo Sapiens
agccauaugguaaauuuuuauuuguuaaauuuuuaaaaauuacuuagcucaaaaugucaguggu

SEQ ID NO: 458443 - RNA, 64 nt, Homo Sapiens
gccaacauggcaaaacccugucuacuaaaaauacaaaaauuagccaggcaugguggcgugugcc

SEQ ID NO: 458444 - RNA, 64 nt, Homo Sapiens
uaacauggcaaaauccugucuuuacaaaaaauacaaaaauuagccuagcaugguggcgcauacc

SEQ ID NO: 458445 - RNA, 64 nt, Homo Sapiens
auauggugaaacccugucucuacuaaaaauacaaaaaaauuagcuaggcaugguggcgggcucc

SEQ ID NO: 458446 - RNA, 64 nt, Homo Sapiens
auuaaaauuaaaaacaaauacaagacugucucaaaaaaauuaaacucuagccugggcgacagag

SEQ ID NO: 458447 - RNA, 64 nt, Homo Sapiens
caggcgugguggugggcacccuacuaaaaauauaaaaaauuagcaacauggugaaacccugucu

SEQ ID NO: 458448 - RNA, 64 nt, Homo Sapiens
caagcauggugaugauauagccaaaaaaaaaauuaaaaauuagcagagugagaaccaucucuac

SEQ ID NO: 458449 - RNA, 64 nt, Homo Sapiens
aauuagccaagcauggugauucucuacccaaaaaaaaaauuaaagggcaacagagugagaacca

SEQ ID NO: 458450 - RNA, 64 nt, Homo Sapiens
acguuauuuuacuauuuguauuuuguuaaaauuaaaaaauuaguuuauaguaagaacauuuaag

SEQ ID NO: 458451 - RNA, 64 nt, Homo Sapiens
ugggcguggcggcacgugccucuacuaaaaauacaaaaauuagccaacaugguaaaacccuguc

SEQ ID NO: 458452 - RNA, 64 nt, Homo Sapiens
uucuuaaaguguggcaaacauucuuuguuaaaaaaaaaauuagaagauuaaaucagaauaguug

SEQ ID NO: 458453 - RNA, 64 nt, Homo Sapiens
uuuuuugaaaagugaguaaugcuuaacuuuuugaaaaaauuagaaguuauugcauucaaaguau

SEQ ID NO: 458454 - RNA, 64 nt, Homo Sapiens
gugaagaaaaaugaugaacacagaaauauuuuuaaaaaauuagaaaauuaagucuauauauuaa

SEQ ID NO: 458455 - RNA, 64 nt, Homo Sapiens
ugacucuucauauggaaaaaaucauggauuacuuaaaaauuaauuaucccagauugguggggaa

SEQ ID NO: 458456 - RNA, 64 nt, Homo Sapiens
caggcguggucacaugcgccuccacuaaaaauacaaaaauuagccaucauggugaaaccucauc

SEQ ID NO: 458457 - RNA, 64 nt, Homo Sapiens
ugccuccuaaugugcuacagaaaagcaagagaguaaaaauuacgcucaucaucucaacuucaca

SEQ ID NO: 458458 - RNA, 64 nt, Homo Sapiens
aauaaaaauaagaaauaaaaacagauuuuagagcaaaaauuaguaauaagaaauagcuacagug

SEQ ID NO: 458459 - RNA, 64 nt, Homo Sapiens
cgggcaugguggugcacgccucuacuaaaaauacaaaaauuagccaacaugaugaaacccuauc

SEQ ID NO: 458460 - RNA, 64 nt, Homo Sapiens
caggcgcauuggcucaugucauacaaaaaccaaaaaaaauuagcaaaccccaucucuacuaaaa

SEQ ID NO: 458461 - RNA, 64 nt, Homo Sapiens
cgggugcgguggcgggcaccuacuaaaaauacaaaaaaauuagcacacggugaaaccccgucuc

SEQ ID NO: 458462 - RNA, 64 nt, Homo Sapiens
ugagugugguggcacaugccucuacaaaaaauacaaaaauuagccaacauggugagaccccauc

SEQ ID NO: 458463 - RNA, 64 nt, Homo Sapiens
aagccaaagagaaaagucaaugugaaaggaaaauaaaaauuacucauuauggcugucacaagcu

SEQ ID NO: 458464 - RNA, 64 nt, Homo Sapiens
caggcgugguugugggcgcccuacuaaaaauacaaaaaauuagcaacacggugaaaccccaucu

SEQ ID NO: 458465 - RNA, 64 nt, Homo Sapiens
cgggcaugguagcaggugccaaaaaaaaauuacaaaaaauuagcagaaaccccgucucuacuaa

SEQ ID NO: 458466 - RNA, 64 nt, Homo Sapiens
aaaaauuagccgggcaugguucucuacuaaaaaaaaaaauuacagcuaacguggagaaaccccg

SEQ ID NO: 458467 - RNA, 64 nt, Homo Sapiens
acuuauaugaauuugauuuauauuuugcaagaucaaaaauuagauguuaaguaucagauuuuaa

SEQ ID NO: 458468 - RNA, 64 nt, Homo Sapiens
uaaguaucagauuuuaagcuuguuuuaauggucaaaaaauuaggacagaaauaauauggacauu

SEQ ID NO: 458469 - RNA, 64 nt, Homo Sapiens
caauauugaaauuaaacuuccaacuucucuaauaaaaaauuaaaacacgcauaacacucgucaa

SEQ ID NO: 458470 - RNA, 64 nt, Homo Sapiens
uagacuacauaucuuuuggcacuaacaucucaugaaaaauuaugguuaauaaaauaucaccaca

SEQ ID NO: 458471 - RNA, 64 nt, Homo Sapiens
aggagccaaccucccccuuugcagggcugcauuuaaaaauuagguuugggacaguucuuguacc

SEQ ID NO: 458472 - RNA, 64 nt, Homo Sapiens
caaaaucccaucucuacaaaacaucaaaaaaaaaaaaaauuagucgggcaugguggugcacacc

SEQ ID NO: 458473 - RNA, 64 nt, Homo Sapiens
ggauuuuuacaaguugguaaacacagccauuauaaaaaauuaaaugauuuaaauuuauaauuaa

SEQ ID NO: 458474 - RNA, 64 nt, Homo Sapiens
uaaauuuauaauuaaguaaauuacauuaaaacaaaaaaauuauacucaaaauucauuacuuaau

SEQ ID NO: 458475 - RNA, 64 nt, Homo Sapiens
acauacccuuuaucucuguaaaauuuauacacacaaaaauuaacaaaagauucuguaagaauua

SEQ ID NO: 458476 - RNA, 64 nt, Homo Sapiens
auuuuuuuaaaacucucaggacugaacagaagagaaaaauuauuaauuagcugcuacuguaugu

SEQ ID NO: 458477 - RNA, 64 nt, Homo Sapiens
guguaaguauugugaaaacccuuuucuuccagggaaaaauuauuggaaauuccuuaacugagcu

SEQ ID NO: 458478 - RNA, 64 nt, Homo Sapiens
ugcagguggaauauuucaugcaggggauucccugaaaaauuaccaacucgaacuuuucauaacu

SEQ ID NO: 458479 - RNA, 64 nt, Homo Sapiens
auaggcugauuuucuuuuuuuucagucauaaaaaaaaaauuauaugcuuguggauuuauaguag

SEQ ID NO: 458480 - RNA, 64 nt, Homo Sapiens
gagaggcauuuaauucuaauaaaccagcuguuauaaaaauuauaaaaugaucucuguuuuuccu

SEQ ID NO: 458481 - RNA, 64 nt, Homo Sapiens
gguuuguuuugguuuguuauggcuuccuuuuuuaaaaaauuacccuguagugccaguuuauuau

SEQ ID NO: 458482 - RNA, 64 nt, Homo Sapiens
uauaaacauaugaaggcauaaagauauacagaagaaaaauuauuaaacaacucauuuuaagauu

SEQ ID NO: 458483 - RNA, 64 nt, Homo Sapiens
aaaaaauaaacaaaauaaacugcucacuuauuugaaaaauuaaggaaggauuucaggcauggcu

SEQ ID NO: 458484 - RNA, 64 nt, Homo Sapiens
caacaaggcgaaacccugucucuaccaaaaauacaaaaauuagccaggcaggguggcaugugcc

SEQ ID NO: 458485 - RNA, 64 nt, Homo Sapiens
caacguggugaaaccccaucucuacuaaaaauacaaaaauuagccgggugugguggcgcgcgcc

SEQ ID NO: 458486 - RNA, 64 nt, Homo Sapiens
ggacuuaaaguacuuauucauauaccuuguaacuaaaaauuagaacagcucccuagaauuguga

SEQ ID NO: 458487 - RNA, 64 nt, Homo Sapiens
aaacuuuaguuguacauuuaagucuuuucauaaaaaaaauuaauauuuaugaauaacaaucuga

SEQ ID NO: 458488 - RNA, 64 nt, Homo Sapiens
uccugaucaccuuuuuuugugcuucauauuauucaaaaauuauaauuuuccuuaauagaggaau

SEQ ID NO: 458489 - RNA, 64 nt, Homo Sapiens
cgggcgugguggcgggcgccccacuaaaaauacaaaaaauuagccuaacagugaaacccugucu

SEQ ID NO: 458490 - RNA, 64 nt, Homo Sapiens
ugggcgugguggugcacgcccugcuaaaauuacaaaaaauuagcaauacagugaaaccccaugu

SEQ ID NO: 458491 - RNA, 64 nt, Homo Sapiens
uucaauuuaaaguugauuucuuaaugaugacuucaaaaauuaauaaaaagaaaagaaaaaaaug

SEQ ID NO: 458492 - RNA, 64 nt, Homo Sapiens
cacggugaaaccccgucuuuacuaaaaauacaaaaaaaauuagcugggcgugguggcggaugcc

SEQ ID NO: 458493 - RNA, 64 nt, Homo Sapiens
acacuagagacaccuuguaguauuuugggagcaaaaaaauuauuuucucuuaacaagacuuuuu

SEQ ID NO: 458494 - RNA, 64 nt, Homo Sapiens
auuuuuuucguuauuuuuacaucuaacaaaguaaaaaaauuaaaaagaggguaagaaacgauuc

SEQ ID NO: 458495 - RNA, 64 nt, Homo Sapiens
caacauggugaaacccugucucuacuaaaaauacaaaaauuagccgggugugguggcacaugcc

SEQ ID NO: 458496 - RNA, 64 nt, Homo Sapiens
aaaagugaaaguuaggguuaggacauccuuuuuuaaaaauuacaaauuuaguccguuuugguuu

SEQ ID NO: 458497 - RNA, 64 nt, Homo Sapiens
caacauagcaagacccugucuguacacaaaauuuaaaaauuaguucaucgggguggcacacauc

SEQ ID NO: 458498 - RNA, 64 nt, Homo Sapiens
aauauagugaaacuccugucccuacaaaaaauacaaaaauuagccgggugugguagugcaugcc

SEQ ID NO: 458499 - RNA, 64 nt, Homo Sapiens
ucuagacucgaaugcuuucauacaagugauuuucaaaaauuagucaauaaaaauugaugucagu

SEQ ID NO: 458500 - RNA, 64 nt, Homo Sapiens
guuuauuaaaguacaaccauuuuuuuugguaaaaaaaaauuacugaaguagaaacaaaauacaa

SEQ ID NO: 458501 - RNA, 64 nt, Homo Sapiens
uuggaaagcagguuucaagggcagguucccacuuaaaaauuaaaggugccuuuauuuccacugu

SEQ ID NO: 458502 - RNA, 64 nt, Homo Sapiens
auaucugcuauuuuuaaaagaugcgaaauuagaaaaaaauuauaucaacuuuggccaaauacaa

SEQ ID NO: 458503 - RNA, 64 nt, Homo Sapiens
aaacggguaacaugguaaaucuauagaaaauuuaaaaaauuaaaacccugucucuaaagaaaaa

SEQ ID NO: 458504 - RNA, 64 nt, Homo Sapiens
guauaaaguauuuuaaguuaagguacuacaaauuaaaaauuaaauuugaugcauuauaacuuaa

SEQ ID NO: 458505 - RNA, 64 nt, Homo Sapiens
caagugugguggugugcaccucuacaaaaaauuuaaaaauuagccaguauagugagaucuuuuc

SEQ ID NO: 458506 - RNA, 64 nt, Homo Sapiens
uaacuugauaauucuucaucuaccuuaaaaagaaaaaaauuacacauagucauucuugauguua

SEQ ID NO: 458507 - RNA, 64 nt, Homo Sapiens
uggcacuuucugccuccuugcucuaaaugucacaaaaaauuauacuuccuuaaaguaaauguaa

SEQ ID NO: 458508 - RNA, 64 nt, Homo Sapiens
auugguucuggcaaguuuggccagacugacuucaaaaaauuaauguguauccagggacauuuua

SEQ ID NO: 458509 - RNA, 64 nt, Homo Sapiens
caacauggugaaaccccaucuguacuaaacauaaaaaaauuagccuggcauggugguguacgcc

SEQ ID NO: 458510 - RNA, 64 nt, Homo Sapiens
caacauggugaaaccccaccucuacaaaaaauacaaaaauuagccgggcgugguggcaggcacc

SEQ ID NO: 458511 - RNA, 64 nt, Homo Sapiens
guggaagacagugagacuccgucucaaaaaaaugaaaaauuagccaggcagguuggcgggggcc

SEQ ID NO: 458512 - RNA, 64 nt, Homo Sapiens
accuguguuuuaacuaauauugugucaguguauuaaaaauuagcuuuuacauaugauaucuaca

SEQ ID NO: 458513 - RNA, 64 nt, Homo Sapiens
aaucugcucagaaaaauguaugugcacaaauaaaaaaaauuaauggcaauuguuuagugauugu

SEQ ID NO: 458514 - RNA, 64 nt, Homo Sapiens
uuauccaugagcaccaggcuuugcucacuuaaaaaaaaauuaagccacauuaaggagugagucu

SEQ ID NO: 458515 - RNA, 64 nt, Homo Sapiens
auuaaggagugagucuucuuuuuuacaauaauguaaaaauuaaacuguuuacauuuuuuuaaag

SEQ ID NO: 458516 - RNA, 64 nt, Homo Sapiens
acuguuuacauuuuuuuaaagcauuguaguuuuuaaaaauuaagcuguuuuguuuuguguuguu

SEQ ID NO: 458517 - RNA, 64 nt, Homo Sapiens
uuacuacagaggaaaguuugagaguaaaacuguaaaaaauuauauuuuuguuguacuuucuaag

SEQ ID NO: 458518 - RNA, 64 nt, Homo Sapiens
cggcuaaaacauugcaaauuuaaaugagaguuuuaaaaauuaaauaaugacugcccuguuucug

SEQ ID NO: 458519 - RNA, 64 nt, Homo Sapiens
aagacucugaacacccaagguuggugucacauauaaaaauuaagcugaugacuuugcagugacu

SEQ ID NO: 458520 - RNA, 64 nt, Homo Sapiens
ucaauucagcacccccaaauuuaauucuguggggaaaaauuauugagccaguugucaguguucu

SEQ ID NO: 458521 - RNA, 64 nt, Homo Sapiens
ugugguggcgggcaccuguacucuacuaaaauacaaaaauuaggcaacauggcaaaacccccau

SEQ ID NO: 458522 - RNA, 64 nt, Homo Sapiens
aauaaaaccauaaaugaaacgaacauucuacuuuaaaaauuauuuaaaucauaguaauaauauu

SEQ ID NO: 458523 - RNA, 64 nt, Homo Sapiens
cgggcaugguggcacgugagucuacaaaauacaaaaaaauuagcaaacguggugagaccucauc

SEQ ID NO: 458524 - RNA, 64 nt, Homo Sapiens
aaaaaaaaaucugccacuuagauucaaaaaaauuaaaaauuaaauuuugugaugcagcuaccau

SEQ ID NO: 458525 - RNA, 64 nt, Homo Sapiens
aauuaaaaaaaaaaaaucugcuaccaugauucaaaaaaauuaaauuggagcuuuugugaugcag

SEQ ID NO: 458526 - RNA, 64 nt, Homo Sapiens
ugagcaugguggugugcaccucuacaaaaaguuaaaaaauuaucaaacauagugagacccuuuc

SEQ ID NO: 458527 - RNA, 64 nt, Homo Sapiens
ggcaugagccacugcacccguucugaaaaaacaaaaaaauuauacuaccauguugccucccauc

SEQ ID NO: 458528 - RNA, 64 nt, Homo Sapiens
ugaccauauuuacucuuucuuuggaaguguuucaaaaaauuauauagcaugcugcuuuuuguac

SEQ ID NO: 458529 - RNA, 64 nt, Homo Sapiens
augcugcuuuuuguacuuggcuuucuuugcacuuaaaaauuagcaaagucuauuuuauuaugag

SEQ ID NO: 458530 - RNA, 64 nt, Homo Sapiens
ugggcguaguggcgcgugccucuacuaaaaauacaaaaauuagccaacauggugaaaccccauc

SEQ ID NO: 458531 - RNA, 64 nt, Homo Sapiens
cgggcgugguggugcgugcccucuacuaaaauacaaaaauuagcccaacauagcaaaaccucau

SEQ ID NO: 458532 - RNA, 64 nt, Homo Sapiens
ccccaugggcuugccagguacuccguauucuucuaaaaauuauaauuacuguuaacagauuuuc

SEQ ID NO: 458533 - RNA, 64 nt, Homo Sapiens
auaauuuugucaaccaauacccuuagcccccccaaaaaauuacacuaaccuugugauccgcccu

SEQ ID NO: 458534 - RNA, 64 nt, Homo Sapiens
uagauugauucuccccaaaucuuuaaaaauguuuaaaaauuauuaucugcagcuggauacucuu

SEQ ID NO: 458535 - RNA, 64 nt, Homo Sapiens; identical to SEQ ID NO: 458512

SEQ ID NO: 458536 - RNA, 64 nt, Homo Sapiens
aaucugcucagaaaaauguaugugcacaaauaaaaaaaauuaauggcaauuguuuagugacugu

SEQ ID NO: 458537 - RNA, 64 nt, Homo Sapiens
gaaacccugucuguauggaauuuacacaaauuauaaaaauuagucgggugucauugugcauacc

SEQ ID NO: 458538 - RNA, 64 nt, Homo Sapiens
aucauaguaauaauauuauugaacauucuacuuuaaaaauuauuaauaaaaccauaaaugaaac

SEQ ID NO: 458539 - RNA, 64 nt, Homo Sapiens
aacaugaugaaacccuugucucuauuaaaaacacaaaaauuagccagaugugguggcacaugcc

SEQ ID NO: 458540 - RNA, 62 nt, Homo Sapiens
uccuuccuuccuaaucucuaauccccugaagccuaacacaguuccuaauguguuuugccuua

SEQ ID NO: 458541 - RNA, 62 nt, Homo Sapiens
cugugguuuacuccugucuaaaccccugaagccuaacacaguuccuggcacacaacaggugu

SEQ ID NO: 458542 - RNA, 62 nt, Homo Sapiens
gccuuguuggagggggccaggcucuagaacgucuaacacaguggagaaccgaaacccccccc

SEQ ID NO: 458543 - RNA, 62 nt, Homo Sapiens
ccucccccagucucucuucucaaucccccuuucuaacacacacacacacacacacacacaca

SEQ ID NO: 458544 - RNA, 64 nt, Homo Sapiens
aucacauguuguaaauuuuccuaaagaaauacuuauguacuacuauagcacuuuucaauucucu

SEQ ID NO: 458545 - RNA, 64 nt, Homo Sapiens
aaauucauuguauguuagaaaaauguuuaaaaucauguacuaauacauuaaaagaguacaauaa

SEQ ID NO: 458546 - RNA, 64 nt, Homo Sapiens
ucuuuuagaccaguuuucuaauaagcuuuguaaaauguacuauccaaauuagaagcggauuugg

SEQ ID NO: 458547 - RNA, 64 nt, Homo Sapiens
ggguggaggcugggcugaggauuaccauaaugaaauguacuaaaucuucauuuagguaugcaau

SEQ ID NO: 458548 - RNA, 64 nt, Homo Sapiens
cuuaaacagaaauaaauauuuggaaugaaggggaauguacuagaacacccuuuuugccacgggu

SEQ ID NO: 458549 - RNA, 64 nt, Homo Sapiens
cuaccucuuuuguuuuguuuuguuuuugcccuuuauguacuacauucuuauuuucuaacuuuua

SEQ ID NO: 458550 - RNA, 64 nt, Homo Sapiens
guuuuauacggccugccuauaacguugaaaauccauguacuacauaauaauucagaagggcucu

SEQ ID NO: 458551 - RNA, 64 nt, Homo Sapiens
ggagagguagagugaaaaucccagccauggaugaauguacuaauuugaaagccaaguguuaagu

SEQ ID NO: 458552 - RNA, 64 nt, Homo Sapiens
aucaguuuuuuguuuuacaaugucauauacugccauguacuaguuuuaguuuucucuuagaaca

SEQ ID NO: 458553 - RNA, 64 nt, Homo Sapiens
aauuuguucaaguuuuggguauguuuaaucuguuauguacuaguguucuguuuguuauuguuuu

SEQ ID NO: 458554 - RNA, 64 nt, Homo Sapiens
uuuucaaaaauaaaacauuuuauguacuauguggauguacuaccuuuugaaaauguggguguac

SEQ ID NO: 458555 - RNA, 64 nt, Homo Sapiens
uggauguacuaccuuuucaaaauguggguguacuauguacuaugauccuuucauagcuuuugaa

SEQ ID NO: 458556 - RNA, 64 nt, Homo Sapiens; identical to SEQ ID NO: 79909

SEQ ID NO: 458557 - RNA, 64 nt, Homo Sapiens; identical to SEQ ID NO: 79910

SEQ ID NO: 458558 - RNA, 64 nt, Homo Sapiens; identical to SEQ ID NO: 79911

SEQ ID NO: 458559 - RNA, 64 nt, Homo Sapiens; identical to SEQ ID NO: 79912

SEQ ID NO: 458560 - RNA, 64 nt, Homo Sapiens; identical to SEQ ID NO: 79913

SEQ ID NO: 458561 - RNA, 64 nt, Homo Sapiens; identical to SEQ ID NO: 79914

SEQ ID NO: 458562 - RNA, 64 nt, Homo Sapiens; identical to SEQ ID NO: 79915

SEQ ID NO: 458563 - RNA, 64 nt, Homo Sapiens; identical to SEQ ID NO: 79916

SEQ ID NO: 458564 - RNA, 64 nt, Homo Sapiens; identical to SEQ ID NO: 79917

SEQ ID NO: 458565 - RNA, 64 nt, Homo Sapiens; identical to SEQ ID NO: 79918

SEQ ID NO: 458566 - RNA, 64 nt, Homo Sapiens
aucugcaccaguacacaggcaggcauuaucauucuucaccuacuuuuuaaauaguggcaacuug

SEQ ID NO: 458567 - RNA, 64 nt, Homo Sapiens
uugagaaauauuuuucuuucaaauucugguuccuuucaccuauguaaccgcaucccucaggcau

SEQ ID NO: 458568 - RNA, 64 nt, Homo Sapiens
uuuauuaaaacuuguguggcacuuuaacauugcuuucaccuauauuuuguguacuuuguuacuu

SEQ ID NO: 458569 - RNA, 64 nt, Homo Sapiens
aaggcagggccuuuccaguccucacaaccuguccuucaccuagucccuccugacccagggaugg

SEQ ID NO: 458570 - RNA, 64 nt, Homo Sapiens
ugacacaaaaaaaguugaaggccuuauucuacauuucaccuacuuuguaagugagagagacaag

SEQ ID NO: 458571 - RNA, 64 nt, Homo Sapiens
ugucgcugagccaggaaggcccgccagugccuucuucaccuacgcucucagaagcgcuaccggg

SEQ ID NO: 458572 - RNA, 64 nt, Homo Sapiens
aaugggaacccugcuucccacuggucucuccgccuucaccuagcgagccccacccaaggggacc

SEQ ID NO: 458573 - RNA, 64 nt, Homo Sapiens
acacucuguuaaaaacacauuuuaauauguuuaauucaccuaucaacagaugcuauagaacucu

SEQ ID NO: 458574 - RNA, 64 nt, Homo Sapiens
uauuuauuauucaaaaguguucagugcuuccacauucaccuaugugcuuggcucuuuaaacaca

SEQ ID NO: 458575 - RNA, 64 nt, Homo Sapiens
ugacucagcccucgauagucguacagguuggcccuucaccuaguccaaaauaagacuuagaacu

SEQ ID NO: 458576 - RNA, 64 nt, Homo Sapiens
aaauugucaagcuagcaaaacucacuucauguuuuucaccuauauuugugguuuaguuuauuua

SEQ ID NO: 458577 - RNA, 64 nt, Homo Sapiens
aucauagggccucauuuuguaaauuuuuuuaaaauucaccuagaaagaauuguuccuuggggaa

SEQ ID NO: 458578 - RNA, 64 nt, Homo Sapiens
agacggggaaaauaauaccaugaaccucagagucuucaccuauagcgauaucacuuuaacuuuc

SEQ ID NO: 458579 - RNA, 64 nt, Homo Sapiens
caccccuagaucugaguuuuagauucuacucuacuucaccuaacucaggggcaauuuggcacuc

SEQ ID NO: 458580 - RNA, 64 nt, Homo Sapiens
uuucucugagaaauagagacccucucuuuuacuuuucaccuaagcaugaaggaaagagauuuug

SEQ ID NO: 458581 - RNA, 64 nt, Homo Sapiens
cugcacaguuccugcagcuuugcagaauccaggguucaccuaaggagaaaacuccacuggggcu

SEQ ID NO: 458582 - RNA, 64 nt, Homo Sapiens
auauuguuaacuauuuguuacagcaauaccccacuucaccuacagucuucuagagccuuugauc

SEQ ID NO: 458583 - RNA, 64 nt, Homo Sapiens
ugauugaaacucacugcaaaaucaccacgacucuuucaccuacugagaugauugaccgagguuu

SEQ ID NO: 458584 - RNA, 64 nt, Homo Sapiens
auuauacacauuauuggaccauaaggacauuuguuucaccuagauuuuaagauuauggagacug

SEQ ID NO: 458585 - RNA, 64 nt, Homo Sapiens
cugccuccuagaauauagacugucuguauuauuauucaccuauaauuagucauuaugaugcuuu

SEQ ID NO: 458586 - RNA, 64 nt, Homo Sapiens
ucuuugcacuuacacacacucuuccuguucugccuucaccuaugccgggauaagcagagaucuc

SEQ ID NO: 458587 - RNA, 64 nt, Homo Sapiens
gaaagcugugugacugccugagagaaccuguuucuucaccuaaaaaaugggacuuuuugucuca

SEQ ID NO: 458588 - RNA, 64 nt, Homo Sapiens
uuauuaaguuuccaaauuuaauuugaauuccaaauucaccuagcaauaaaaucuaauuuuuaaa

SEQ ID NO: 458589 - RNA, 64 nt, Homo Sapiens
cucucugcguccuauuucauuagugaagacauaguucaccuaaaauggcauccugcucugaauc

SEQ ID NO: 458590 - RNA, 64 nt, Homo Sapiens
uuuggaaacucucuuuuggauugacuccucagacuucaccuaacuuuaguucuagaaucaccug

SEQ ID NO: 458591 - RNA, 64 nt, Homo Sapiens
cuuuuuuagauuuacuacuauuugaaaaugaggauucaccuagaucauguuuucaauaugcagu

SEQ ID NO: 458592 - RNA, 64 nt, Homo Sapiens
uggaagacugcuguguuugugaaaauuauuauacuucaccuaaacaacuauuuuuugacccucu

SEQ ID NO: 458593 - RNA, 64 nt, Homo Sapiens
ugaggugugugcagcaguuggagacggacuccuguucaccuagguguuaaaaaagaacugcaaa

SEQ ID NO: 458594 - RNA, 64 nt, Homo Sapiens
gaaagacuucuuggugguuugaauaguuuauccauucaccuauuuaauacuccauugucuagau

SEQ ID NO: 458595 - RNA, 64 nt, Homo Sapiens
ucaaaaauuuggaauucuguuguaacugcagcaguucaccuauuaguuuuccuaaauguauacc

SEQ ID NO: 458596 - RNA, 64 nt, Homo Sapiens
agauucugauuugccacugauugauucauaaagauucaccuaagaucaugcuuugaaaaaucac

SEQ ID NO: 458597 - RNA, 64 nt, Homo Sapiens
cuuugaaaauaaaguaguauauaaauuaacaagauucaccuaaccaagaauucuuauuucuaua

SEQ ID NO: 458598 - RNA, 64 nt, Homo Sapiens
gagugaagacacuuggcagacuugagccagacacuucaccuaguaguuccugaaacugugagca

SEQ ID NO: 458599 - RNA, 64 nt, Homo Sapiens
cuucaggcccuuacacaaaagccaugaagagauguucaccuacccgguauuuuaaauguucugu

SEQ ID NO: 458600 - RNA, 64 nt, Homo Sapiens
uuuuguuacucugagagcuguucacuucucugaauucaccuagagugguuggaccaucagaugu

SEQ ID NO: 458601 - RNA, 64 nt, Homo Sapiens
ggccagcucuaugcaaagggaaaagcauguugcauucaccuaggccaagaaacaguguuguagg

SEQ ID NO: 458602 - RNA, 64 nt, Homo Sapiens
uguacaguauauuacucuugacaguuugaauuucuucaccuaaagauaauucucugaaaguacu

SEQ ID NO: 458603 - RNA, 64 nt, Homo Sapiens
agcauauugcucuuauaacucuguuaaacaguucuucaccuaacugcaaaaacauaauauauuu

SEQ ID NO: 458604 - RNA, 64 nt, Homo Sapiens
caugaguuauuauugaaaccauaaauagcaaacuuucaccuauucaguguuuuucuaagacuaa

SEQ ID NO: 458605 - RNA, 64 nt, Homo Sapiens
ucagcaaaacaaacuuucaaacagagauuacccuuucaccuaccgaugcagucaccuggaaaga

SEQ ID NO: 458606 - RNA, 64 nt, Homo Sapiens
gggaugccaauauuucuguuagaagagaaaauacuucaccuauuggauauuauauguuucuggg

SEQ ID NO: 458607 - RNA, 64 nt, Homo Sapiens
guggagaaggaucacuuuacagcagagcuuauuuuucaccuaagcaugaggcaagggaaggaaa

SEQ ID NO: 458608 - RNA, 64 nt, Homo Sapiens
guagagaaaauaaauguuauauacccuauaaucuuucaccuaauuaguauuuaauuauauggau

SEQ ID NO: 458609 - RNA, 64 nt, Homo Sapiens
aaaauugaucuuaauaacucucccuucauaucuuuucaccuauuuccaguccuuaucauaguug

SEQ ID NO: 458610 - RNA, 64 nt, Homo Sapiens
gcccggccuuuuuaacuuuaaacauguuuuagaauucaccuaaagaucaaaauaucauggauug

SEQ ID NO: 458611 - RNA, 64 nt, Homo Sapiens
uuuauaauaaacguucuugcgcacacuuacuuuauucaccuauuucauccagccggaaguuaaa

SEQ ID NO: 458612 - RNA, 64 nt, Homo Sapiens
uaaaggcagcaguuugggacuuuguugaaauuuauucaccuagacuggcacauuuauuucuucu

SEQ ID NO: 458613 - RNA, 64 nt, Homo Sapiens
ggaaaagcccacccgaaucuaguggauagcuguuuucaccuaaacugaguuauaaggccacagg

SEQ ID NO: 458614 - RNA, 64 nt, Homo Sapiens
caagcaucaccuuccuaaucccuggcuccaugcuuucaccuacauguucggagcucuucugugc

SEQ ID NO: 458615 - RNA, 64 nt, Homo Sapiens
acauccugcuacacucauccgcaggucaccuuaguucaccuacccugagugaacacccccagcu

SEQ ID NO: 458616 - RNA, 64 nt, Homo Sapiens
uguaagugauaugucagaagagcuucuuacugauuucaccuaaaaugagaaggaaguccuguuu

SEQ ID NO: 458617 - RNA, 64 nt, Homo Sapiens
ugguuuuccauguaauauuuugaauuauagcaucuucaccuagaagaucucaauugucuuaguc

SEQ ID NO: 458618 - RNA, 64 nt, Homo Sapiens
ugggcaguauguaguuauuuauuacaaaauuauauucaccuaaaugccaaccaucuacaaaaac

SEQ ID NO: 458619 - RNA, 64 nt, Homo Sapiens
acugaccaucagcucugaacuguggcuuuuuuuguucaccuaugaugccauguaccaaauucag

SEQ ID NO: 458620 - RNA, 64 nt, Homo Sapiens
acagaauuuacuuuaaaugucacguaaaaacaaauucaccuaagauagucuugcuuauuuuguu

SEQ ID NO: 458621 - RNA, 64 nt, Homo Sapiens
caauugaccuaugacaaacugugaaccugcagauuucaccuauuuugauuuacuauaagagcug

SEQ ID NO: 458622 - RNA, 64 nt, Homo Sapiens
auuuuaaaauguucauguucuguucuauauuuucuucaccuacucuccaaauauuguaaugcaa

SEQ ID NO: 458623 - RNA, 64 nt, Homo Sapiens
uguguguacaacacuggugacuccaggaaccauuuucaccuauuaccaguguucccuggggacu

SEQ ID NO: 458624 - RNA, 64 nt, Homo Sapiens
ggucgagaugcaauaacacuucguaagcaacgaguucaccuaaguaaggcucagauccuaguuu

SEQ ID NO: 458625 - RNA, 64 nt, Homo Sapiens
cagacgaaacuccagaacaggaaaagccagaggguucaccuaguguaggguacccugcguccuc

SEQ ID NO: 458626 - RNA, 64 nt, Homo Sapiens
ucauaugaguugaugugauauuuuuacuuuuggguucaccuagaccauaauuuauaaucauuau

SEQ ID NO: 458627 - RNA, 64 nt, Homo Sapiens
gacaugaccaggauuuuccucuaauuuggccaccuucaccuacuucucaccacagacgucuuug

SEQ ID NO: 458628 - RNA, 64 nt, Homo Sapiens
aucucucgguaaaaagcagaguaccuuaguacccuucaccuaacucuuuaauacuaagagaugg

SEQ ID NO: 458629 - RNA, 62 nt, Homo Sapiens
cacuaaauaugggcauuuuauauaagcaguauauuucaccuacaaggcuaauaucaauaguu

SEQ ID NO: 458630 - RNA, 64 nt, Homo Sapiens
gaccuuuucuuuuguuugaagauuuguuacuugauucaccuacuacuuaggcuaaguuaauuug

SEQ ID NO: 458631 - RNA, 64 nt, Homo Sapiens
aaaccucaugcuuuuaggcauaucuauguugaauuucaccuagggaauguucuguucuuaguua

SEQ ID NO: 458632 - RNA, 64 nt, Homo Sapiens
aucuugauuagauccaaagucaaagcaaccauacuucaccuagagaagacaguauuggcaauca

SEQ ID NO: 458633 - RNA, 64 nt, Homo Sapiens
uguucagucauucugguuuuuucagcuguuccuuuucaccuaacaguccauuuccccuuccuau

SEQ ID NO: 458634 - RNA, 64 nt, Homo Sapiens
aguuuccuagcucugucacauuugugggaucuuuuucaccuaagaguaaauaugauuuaggggu

SEQ ID NO: 458635 - RNA, 64 nt, Homo Sapiens
caugcuguguuuccuuucuucuauggauugggguuucaccuaauucaaccugcuggcgggcugu

SEQ ID NO: 458636 - RNA, 64 nt, Homo Sapiens
uuuuauacugaaauguagauauacaaaaugccaauucaccuaauguuuugcaggccaccuagaa

SEQ ID NO: 458637 - RNA, 56 nt, Homo Sapiens
cuacagcaggagaaaguugaagguucuucaccuaccaacgaggggagagagcugug

SEQ ID NO: 458638 - RNA, 64 nt, Homo Sapiens
acaaaugaaaaaggcaauugaaaaucccagcuauuucaccuagauggaauagccacccugagca

SEQ ID NO: 458639 - RNA, 64 nt, Homo Sapiens
uccauaugauauucaacauuuuacaacugcaguauucaccuaaaguagaaauaaucuguuacuu

SEQ ID NO: 458640 - RNA, 64 nt, Homo Sapiens
ggcugacuguacaaaugacuccuggaaaaaacucuucaccuagucuagaauagggagguggaga

SEQ ID NO: 458641 - RNA, 64 nt, Homo Sapiens
uccuuccugucaaggcaggcccguguauuuauuuuucaccuaucgcuugcugcaggcggcccag

SEQ ID NO: 458642 - RNA, 64 nt, Homo Sapiens
uaaaaauugaaagcaagugguuuuguaagauguuuucaccuaaauaccuuucuaaaauaugaaa

SEQ ID NO: 458643 - RNA, 64 nt, Homo Sapiens
aauagaaucucagcauugugauaguugaaaauuauucaccuaagccccaggugacuuacuaaaa

SEQ ID NO: 458644 - RNA, 64 nt, Homo Sapiens
auccuauuuuaaaucucagaagucuuugcaauaguucaccuauaggauuugggcaacauucugc

SEQ ID NO: 458645 - RNA, 64 nt, Homo Sapiens
aagaggcggccgccuccuuguugcagauuucaucuucaccuaccguguauugugcuuagaaagg

SEQ ID NO: 458646 - RNA, 64 nt, Homo Sapiens
uuuuuuucccaauugagaaaguuagguaauuuuuuucaccuagacuauguaaacuacuucucuu

SEQ ID NO: 458647 - RNA, 64 nt, Homo Sapiens
uuuccggacccuuuuccuuaaucccagucugauauucaccuaagacuccaaagccugcguucuc

SEQ ID NO: 458648 - RNA, 64 nt, Homo Sapiens
cuuauuuugaagaaaauccuagacaucaaaucauuucaccuauaaaaaugucaucauauauaau

SEQ ID NO: 458649 - RNA, 64 nt, Homo Sapiens
cuugaucaccacaacucaauuauuucggcaucuuuucaccuaugcugugauuuguuuuuuuuuu

SEQ ID NO: 458650 - RNA, 64 nt, Homo Sapiens
cauagggggaaaaacucucauguucauugccuuuuucaccuaagcuuaaagaacgagagcaucu

SEQ ID NO: 458651 - RNA, 64 nt, Homo Sapiens
gugaguacuuuccuugugcagccuuuuguggaaauucaccuagauguggacccacauacuuacu

SEQ ID NO: 458652 - RNA, 64 nt, Homo Sapiens
cuaaggaugcuaaaccuuagaaaauaaaaauaaauucaccuagucaauuucaaaaaaauaaaau

SEQ ID NO: 458653 - RNA, 55 nt, Homo Sapiens
aaauuucaccugcaaaccuuaccuuuucaccuacaaacagacuggugaaaaguaa

SEQ ID NO: 458654 - RNA, 64 nt, Homo Sapiens
aauucgcugaaaaaggaacuaccuauccuuacauuucaccuacuaaugucucuucuaacaucuu

SEQ ID NO: 458655 - RNA, 64 nt, Homo Sapiens
ugggaaaacuuuaauauccguaccugaaggcugauucaccuaaaaauguguuaacugaaagaaa

SEQ ID NO: 458656 - RNA, 64 nt, Homo Sapiens
ugaccuguguguguguguguggggggguggggccuucaccuaagaccucugcagcagaccugga

SEQ ID NO: 458657 - RNA, 64 nt, Homo Sapiens
caccuagucacaggguggaucuggaccucaguccuucaccuaguagguuuaagauagcuccuuu

SEQ ID NO: 458658 - RNA, 64 nt, Homo Sapiens
gaagucuaagcauaacagcuuuugagacucugaguucaccuagagacauuuguaacauuuccuc

SEQ ID NO: 458659 - RNA, 64 nt, Homo Sapiens
ucauuauuuugcuuuauuaaacucuuucuguugauucaccuaacugucacuguuaacacuuuuc

SEQ ID NO: 458660 - RNA, 62 nt, Homo Sapiens
ucugugcucuacagucuccuauuguguuaaacucuucaccuaauuauuuaagcauaaaauaa

SEQ ID NO: 458661 - RNA, 64 nt, Homo Sapiens
aaaauaaaauaaaaauguugcuauuguguucuacuucaccuaaaucugauauuuuugagccauu

SEQ ID NO: 458662 - RNA, 64 nt, Homo Sapiens
uacccugacacaagaaguucccucucgaacaguauucaccuaguaauacuuggaccucagccaa

SEQ ID NO: 458663 - RNA, 63 nt, Homo Sapiens
uaugcccaccaagcucuugaauuuucucauuucuucaccuacaacccuuugucuugacuuauc

SEQ ID NO: 458664 - RNA, 64 nt, Homo Sapiens
gaaaacagccacuccuauucugagucuugguuucuucaccuagaaagugaggguuuggacuaga

SEQ ID NO: 458665 - RNA, 64 nt, Homo Sapiens
cccuguaguuugaaagugaaguaaagauuuagaauucaccuaaguccaaaggaaaacacguggu

SEQ ID NO: 458666 - RNA, 64 nt, Homo Sapiens
aaagaaaagaucacauuuguauauucaacaaucuuucaccuauuucauaagucauuuuuucacc

SEQ ID NO: 458667 - RNA, 64 nt, Homo Sapiens
aaguuaauaauccuauauaauaauugcuuuggcuuucaccuaaaauucugggcaucacaauuuc

SEQ ID NO: 458668 - RNA, 64 nt, Homo Sapiens
gcugcccccuccccccaggugggucccccugcuuuucaccuaucuacuccugagcuuccccaac

SEQ ID NO: 458669 - RNA, 64 nt, Homo Sapiens
aaauuuaaaaccaaaaacuauucuguuguuuuucuucaccuacuagccuuaguuuuuaaccaag

SEQ ID NO: 458670 - RNA, 64 nt, Homo Sapiens
agcaucgagggcgaggggaauaugaaaguuggucuucaccuaauuaccuguuugguuuggauuu

SEQ ID NO: 458671 - RNA, 64 nt, Homo Sapiens
auucaugucucuacccacuaugcacagauuaaacuucaccuacaaacuccuuaauaugaucugu

SEQ ID NO: 458672 - RNA, 64 nt, Homo Sapiens
aacaccuccacgugcucagccccaggacaugauuuucaccuacuccuggagaagcuggguuaua

SEQ ID NO: 458673 - RNA, 64 nt, Homo Sapiens
ucauaggggagguugugagggaugguaauaauacuucaccuaccgguuuccccaucuguaaaau

SEQ ID NO: 458674 - RNA, 64 nt, Homo Sapiens
ucucugugaauugaaauguugaagcuaauaauucuucaccuaagacaauaugggcacuuuaaau

SEQ ID NO: 458675 - RNA, 64 nt, Homo Sapiens
auccucuuuuagcugcaugucuaggucaguuguuuucaccuaaugggacuucuuugggcagaug

SEQ ID NO: 458676 - RNA, 64 nt, Homo Sapiens
gugaaacaauguguuuuaaaauugaugaaauucguucaccuacauuugagaauuauaaaauuaa

SEQ ID NO: 458677 - RNA, 64 nt, Homo Sapiens
agcacuuaacuaugagccaggcaucauacuaaacuucaccuacauuaucucacuuaguccuuua

SEQ ID NO: 458678 - RNA, 64 nt, Homo Sapiens
ggguccaagggcagagccugugcccuucagcccuuucaccuaacaggcccauauucgggccuuu

SEQ ID NO: 458679 - RNA, 64 nt, Homo Sapiens
gagagaggugagcaaccaagggaagcuccucugauucaccuagaaccuguucucugccgucuuu

SEQ ID NO: 458680 - RNA, 64 nt, Homo Sapiens
cagcauucuuucugauuucugucaccacucagacuucaccuauugcagacaggacagugagguu

SEQ ID NO: 458681 - RNA, 64 nt, Homo Sapiens
uugucccaagcuucccugccgcuaccuguauuauuucaccuagcugucaacauuuuugauucua

SEQ ID NO: 458682 - RNA, 64 nt, Homo Sapiens
guaugaccaaauaaagguuaacauugagacacucuucaccuauuaguaaaauuuaguguucaaa

SEQ ID NO: 458683 - RNA, 64 nt, Homo Sapiens
guuuucaguuucacuuccuuaacuacuaugaaauuucaccuaauugccaguguugaguaaacuc

SEQ ID NO: 458684 - RNA, 64 nt, Homo Sapiens
auauuguacccacauauauuacaucaucauuaauuucaccuauuguuuuuuaaagcauuaauga

SEQ ID NO: 458685 - RNA, 64 nt, Homo Sapiens
aauaaauuaauuugcucucaucguauuguguauauucaccuaaugcccauuguguauugauauu

SEQ ID NO: 458686 - RNA, 64 nt, Homo Sapiens
ggaaccaaguuuaguauagucugauuacauuccauucaccuaacuuuagacauucguuuagaca

SEQ ID NO: 458687 - RNA, 64 nt, Homo Sapiens
uuucuuccuaaaaaaaguucuuucuuuuauuauuuucaccuauuggcugcugcauuuuacgaag

SEQ ID NO: 458688 - RNA, 64 nt, Homo Sapiens
ucuagauuauuuuuuuccuccacaguccuuuuuuuucaccuaacgcaccuaaaucuugaaacua

SEQ ID NO: 458689 - RNA, 64 nt, Homo Sapiens
agcacgacuuacauagcucaaagacauguuuaaauucaccuacuaauguaaauauuccuuauuu

SEQ ID NO: 458690 - RNA, 64 nt, Homo Sapiens
uggaaaaaaaaaaauaugagacacugagcaaguuuucaccuaucccguggcaacuguggaaggc

SEQ ID NO: 458691 - RNA, 64 nt, Homo Sapiens
aauguuguagcauaauucugguguacuuauaauguucaccuaaaagcuauuauuaacaacuuuu

SEQ ID NO: 458692 - RNA, 64 nt, Homo Sapiens
uuacacuagguguucucuuauuugccaucuuuaauucaccuaacguguugaggauguaaucucc

SEQ ID NO: 458693 - RNA, 64 nt, Homo Sapiens
uaagccucaucugauggaagagaggaauaaauaauucaccuauauguguuugagguugugacag

SEQ ID NO: 458694 - RNA, 64 nt, Homo Sapiens
agcauuccauuuuguccuguuaaaaccuuuuguuuucaccuaaacccuuucugcuuaguuguau

SEQ ID NO: 458695 - RNA, 64 nt, Homo Sapiens
gcuagaucucuuaaaaccaauugcuugaaacuaguucaccuaaacugauuugauacuagucagu

SEQ ID NO: 458696 - RNA, 64 nt, Homo Sapiens
auuucugaauauauuuugcauucggaacagucauuucaccuacuuuuaaugauacuucugaugu

SEQ ID NO: 458697 - RNA, 64 nt, Homo Sapiens
cuuguucucuauuuagauuaccucuggcuacacauucaccuaccacuugacauaggauauuuuc

SEQ ID NO: 458698 - RNA, 64 nt, Homo Sapiens
aaagcugugcuguuaaugccuguugcaugcauauuucaccuaccucuuacuauacuuuucauaa

SEQ ID NO: 458699 - RNA, 64 nt, Homo Sapiens
ggcugauugugcaggcccaggcuuccuguuccaguucaccuaaaucggccgccuuggggguucc

SEQ ID NO: 458700 - RNA, 64 nt, Homo Sapiens
uuguuguguucucaauaugauggcuauuugaaacuucaccuacuuuucauuagauugguuguac

SEQ ID NO: 458701 - RNA, 64 nt, Homo Sapiens
agugcuggugacuggauagcaguuuuaaguggcguucaccuagucaacacgaccgcguguguug

SEQ ID NO: 458702 - RNA, 64 nt, Homo Sapiens
aagauuuuucuucuuuccuuaaaaauauuuuuuuuucaccuaggucuaaauagcuaacuaacug

SEQ ID NO: 458703 - RNA, 64 nt, Homo Sapiens
gucuuauagagccuuugauccagcaauaccccacuucaccuacaauaauuguugacgcuauuug

SEQ ID NO: 458704 - RNA, 64 nt, Homo Sapiens
caaagacccuaaacaaaaaguuaaguuucuuucuuucaccuauuuguacaacuccaaguuacag

SEQ ID NO: 458705 - RNA, 64 nt, Homo Sapiens
ucauuuuuauauucauuuauucaucauucauucauucaccuaacuuucauuaaauagcugcacc

SEQ ID NO: 458706 - RNA, 64 nt, Homo Sapiens
cucacuaagccagaggccaaagugcccccucccguucaccuaccacccaaguccucaugcccuc

SEQ ID NO: 458707 - RNA, 64 nt, Homo Sapiens
gggccacugcaggagaugagaccagccuucuguguucaccuaacgauuuauacuguguaucugu

SEQ ID NO: 458708 - RNA, 64 nt, Homo Sapiens
cccacccccucaaucugucggggagccccugcccuucaccuagcucccuuggccaggagcgagc

SEQ ID NO: 458709 - RNA, 64 nt, Homo Sapiens
cuggccacaggggcucaccugggccccauggcuuuucaccuaaguggguccugcccccuccccc

SEQ ID NO: 458710 - RNA, 64 nt, Homo Sapiens
cagguaguggaggcucagacaaguuauuuagccauucaccuagagaguaaguguugaagccaga

SEQ ID NO: 458711 - RNA, 64 nt, Homo Sapiens
ugaagaccuccugguaggauucagcacaaaggccuucaccuacgaaacauugcaaccaaaaagg

SEQ ID NO: 458712 - RNA, 64 nt, Homo Sapiens
ugucaacuccacaagaugaaagaacaauaagucauucaccuagagagaaacucaguuaauauaa

SEQ ID NO: 458713 - RNA, 64 nt, Homo Sapiens
cuaccuacaagaucccgcguccucagagugcugcuucaccuacacucagggggaccuuaccacc

SEQ ID NO: 458714 - RNA, 64 nt, Homo Sapiens
ucaguaccuacaacuaauguuagaagcuuuagcauucaccuaucugagauugaaaaagucaaca

SEQ ID NO: 458715 - RNA, 64 nt, Homo Sapiens
ggucaaggcccggagcuggaccagcucccccuccuucaccuaguguaccccaucccaagcauag

SEQ ID NO: 458716 - RNA, 64 nt, Homo Sapiens
gaaaauucugaaauuguaaaugucuauuuuaauauucaccuaugaaagaaucugugaauauaug

SEQ ID NO: 458717 - RNA, 64 nt, Homo Sapiens
uuuuuucugauuuaugaggguuugaaagaaagaauucaccuaaaagauuccauuuccaguuuua

SEQ ID NO: 458718 - RNA, 64 nt, Homo Sapiens
gccaagaaaaauaauacucuuaaauacuuagauguucaccuaaaguugauauuauuugguaugg

SEQ ID NO: 458719 - RNA, 64 nt, Homo Sapiens
cugauuuuaaaggcagagaaguucucaaaguuaauucaccuauguuauuuuguguacaaguugu

SEQ ID NO: 458720 - RNA, 64 nt, Homo Sapiens
uggaguguuuggggugccugccauugccucugccuucaccuaagucugugcccauuguuucagg

SEQ ID NO: 458721 - RNA, 64 nt, Homo Sapiens
auaaugcugaucuagagauaauguuuuaguuugcuucaccuaaacguuguaguggaaccucuac

SEQ ID NO: 458722 - RNA, 64 nt, Homo Sapiens
ccauuuuagcaucuacuuguaugaugaccugaaguucaccuaucuuacaguuccuucaauaacc

SEQ ID NO: 458723 - RNA, 64 nt, Homo Sapiens
gguguucugguaaacugauuccauuuagaaaauguucaccuagagaugcaauuagucugucacu

SEQ ID NO: 458724 - RNA, 64 nt, Homo Sapiens
auuuggugugcuuuccuccgauugaucccaacccuucaccuauuuuacguauaccugcccuuuc

SEQ ID NO: 458725 - RNA, 64 nt, Homo Sapiens
uuauuaacuuacggauuuauuauauaaauauauauucaccuagcaacauaucucugccgucucu

SEQ ID NO: 458726 - RNA, 64 nt, Homo Sapiens
gagugcaguggugcaaucucgccucacugcaaccuucaccuaccgaguucaagugauuuuccug

SEQ ID NO: 458727 - RNA, 64 nt, Homo Sapiens
acccucaggccugaggugugugccacucagagacuucaccuaacuagagacaggcaaacugcaa

SEQ ID NO: 458728 - RNA, 64 nt, Homo Sapiens
acagcaucagauaucaagaguuuguaggucuggauucaccuaagauucaagggaguguugcuuc

SEQ ID NO: 458729 - RNA, 64 nt, Homo Sapiens
uggguccucacuuuccugggcaccugccuggggauucaccuaccacggucaccuguugcagcuu

SEQ ID NO: 458730 - RNA, 64 nt, Homo Sapiens
gccaaucuugcaugagauuuguuucguaauacaauucaccuauaaaucuagaagaacuuggaug

SEQ ID NO: 458731 - RNA, 64 nt, Homo Sapiens
gugugccugaggacaccuggaccugcgcacacccuucaccuaccgcacaugggggcuuccaugc

SEQ ID NO: 458732 - RNA, 64 nt, Homo Sapiens
acucuaauuuuaccuucuuuaguuguuucuaauguucaccuagauuaccuacuacagacauuga

SEQ ID NO: 458733 - RNA, 64 nt, Homo Sapiens
gcgaccacccaccucauccuaucuuuggccccuuuucaccuacuucuguggcuuucauuugagu

SEQ ID NO: 458734 - RNA, 64 nt, Homo Sapiens
agauauauuugcacuguuuuuaguaguuuauccauucaccuaugaguaguauacauauuugaug

SEQ ID NO: 458735 - RNA, 64 nt, Homo Sapiens
acuugacccuuaccaaaccaaagguuagaaaaccuucaccuaggcuggcugagggcauggggua

SEQ ID NO: 458736 - RNA, 64 nt, Homo Sapiens
agggaaucauuuuguguucauuuuuguuuucuguuucaccuaaaccagcauaggauugauaggg

SEQ ID NO: 458737 - RNA, 64 nt, Homo Sapiens
cauguauuuuuauuaaauauaacaaugucugaguuucaccuaagauguuuuugugccauaugcu

SEQ ID NO: 458738 - RNA, 64 nt, Homo Sapiens
cccauuccuguguuaccaccuuccucccgauuuguucaccuauuuugugcuuuaaaucucaaua

SEQ ID NO: 458739 - RNA, 64 nt, Homo Sapiens
cuuauuuauuuuauauuuuuaaaagaagacaguauucaccuauguauuuugcauaacgauuaua

SEQ ID NO: 458740 - RNA, 64 nt, Homo Sapiens
guuaacaggagggcuggggucccugccaccaguuuucaccuagccagucuugagucuucuccgu

SEQ ID NO: 458741 - RNA, 64 nt, Homo Sapiens
ucugcuuucuguuagcuuaggcagacauugggccuucaccuacaaguuuuuccuuaccccugug

SEQ ID NO: 458742 - RNA, 64 nt, Homo Sapiens
aaacagggaaauugaauaacccaugaccuguagguucaccuauagcuucuugcugcucagcaga

SEQ ID NO: 458743 - RNA, 64 nt, Homo Sapiens
gaucaugggcaagaagccugaccccaagugugucuucaccuaugugcagucgcucuacaaccac

SEQ ID NO: 458744 - RNA, 64 nt, Homo Sapiens
aagaugauaaucuacuuaauuuuagaacaccuuuuucaccuaacuaaaauaauguuuaaagagu

SEQ ID NO: 458745 - RNA, 64 nt, Homo Sapiens
cuuuauaaggcaaaaagaucuguauuuacacuccuucaccuagggauguguuuguugcccuccu

SEQ ID NO: 458746 - RNA, 64 nt, Homo Sapiens
gaugcuuugaaagagcccuaaacauugggaaccauucaccuaauuuggagacauuucucacugg

SEQ ID NO: 458747 - RNA, 64 nt, Homo Sapiens
gagguagagcacucacgccccaagagaaauccaguucaccuacacacacuucucaaaagugaca

SEQ ID NO: 458748 - RNA, 64 nt, Homo Sapiens
uuaacauuaugucuuugcagacacaagugaaauuuucaccuacaaauuuugucuaucagaauaa

SEQ ID NO: 458749 - RNA, 64 nt, Homo Sapiens
ccuuucaugguuauaacacauuuaaaaaacacuuuucaccuacugcuacuuucuauccaaauaa

SEQ ID NO: 458750 - RNA, 64 nt, Homo Sapiens
uaacaaaccugcacauccugcaccauggcacacguucaccuaugggguugaggugcagcaaaac

SEQ ID NO: 458751 - RNA, 64 nt, Homo Sapiens
aauuuacuuagccucucugucuuuuuagcugugugagcaugaaugguuguuaucacacucacuu

SEQ ID NO: 458752 - RNA, 64 nt, Homo Sapiens
uguccucagaagagcagggcauugugaguucucagagcaugaacccugaggugucccacauacu

SEQ ID NO: 458753 - RNA, 64 nt, Homo Sapiens
uaauuucagcauuucuuugugauuuauaaguacugagcaugaaguacuugucugccccucauuu

SEQ ID NO: 458754 - RNA, 64 nt, Homo Sapiens
aucuuuuagggcacaauagaaaccauggggcguggagcaugaguugugaauggcagggaucauu

SEQ ID NO: 458755 - RNA, 64 nt, Homo Sapiens
gucaaaacuggaauuuucuaauugcauucucauugagcaugaaaugaacaauauugugaaaaug

SEQ ID NO: 458756 - RNA, 64 nt, Homo Sapiens
cuuaacaugaacuugauguaucaugagucugucugagcaugauaaauuauuuuauucuagccug

SEQ ID NO: 458757 - RNA, 64 nt, Homo Sapiens
agagcuggacucgcucaucucaggaggcccuugggagcaugaggcaccgcugccacuguggcuc

SEQ ID NO: 458758 - RNA, 64 nt, Homo Sapiens
cuggaggcugugugcgggcaagcuuggccugcuggagcaugauguacugaauugccugucccug

SEQ ID NO: 458759 - RNA, 57 nt, Homo Sapiens
aucagaagaaaaucagcuagcuguauuccuaaacaaauuguuuccuaaacaaaugug

SEQ ID NO: 458760 - RNA, 64 nt, Homo Sapiens
aaaucagcuagcuguauuccuaaacaaauuguuuccuaaacaaaugugaaaaugugaacagugc

SEQ ID NO: 458761 - RNA, 64 nt, Homo Sapiens
acuagaauaauggcaaauacuucuaauuuuuuucccuaaacauuuuuaaaagugaaauauggga

SEQ ID NO: 458762 - RNA, 64 nt, Homo Sapiens
uccaugcugccauaucccuucauuguaaaaaguaccuaaacauucgugaaaugauuuuuuuuag

SEQ ID NO: 458763 - RNA, 64 nt, Homo Sapiens
uccauuaggcuccaccuucccuucacccucaugaccuaaacauccauuaauccauucaugaggg

SEQ ID NO: 458764 - RNA, 64 nt, Homo Sapiens
uucuaguuauauucucauuugucaauuuuugucuccuaaacauccuuuucccuuuauucaagcu

SEQ ID NO: 458765 - RNA, 64 nt, Homo Sapiens
uuaauuccagauauuauuuaauagucauuagccaccuaaacauuaaauuauguggucaaauaau

SEQ ID NO: 458766 - RNA, 64 nt, Homo Sapiens
ccaucccacagauccucagggugagaaacccuggccuaaacaauguguugggaaagaagaaagg

SEQ ID NO: 458767 - RNA, 64 nt, Homo Sapiens
guaauuuagaaaucauuuugcaaucccuuaauauccuaaacaucauucauuuuuguuguuguug

SEQ ID NO: 458768 - RNA, 64 nt, Homo Sapiens
gcugggauuacagguguaagccaccgugcccagcccuaaacaucauucuugagagcauugggau

SEQ ID NO: 458769 - RNA, 64 nt, Homo Sapiens
cgcccuguuucugucaaauaccuagugaaaaaggccuaaacaauuguaaugauauuauuuauug

SEQ ID NO: 458770 - RNA, 64 nt, Homo Sapiens
uagucuaaaaccauuuuucuuucuuuuuuuucccccuaaacaaccucuuaaagggguaagaagu

SEQ ID NO: 458771 - RNA, 64 nt, Homo Sapiens
gguagugcuucaccuugagaugcuuugaaagagcccuaaacauugggaaccauucaccuaauuu

SEQ ID NO: 458772 - RNA, 64 nt, Homo Sapiens
acccccuuaugauccuucacauucauuuuaugucccuaaacaucacaauguaaauaucauuuuu

SEQ ID NO: 458773 - RNA, 64 nt, Homo Sapiens
ucuauagccagcgaugggcauaaauccugcuuagccuaaacauaauuccuucgcaacagaaguc

SEQ ID NO: 458774 - RNA, 64 nt, Homo Sapiens
uagcgugcgguuucccaucagagggccaucgcugccuaaacauuuccuguugggauuaacaguu

SEQ ID NO: 458775 - RNA, 64 nt, Homo Sapiens
cagcuacuuauggauucaucuuucuuaaguaugaauucuagauauuuauucaugccuguguguu

SEQ ID NO: 458776 - RNA, 64 nt, Homo Sapiens
ugguuuuuguuaaaucuacugggcacuauuuugaauucuagagauauagaaccaacggaaauau

SEQ ID NO: 458777 - RNA, 64 nt, Homo Sapiens
uaaaacaacaaaauuaauaaugaaauggaggggaauucuagaauuauaugcuaaaugcauauuu

SEQ ID NO: 458778 - RNA, 64 nt, Homo Sapiens
uggcaagcaguucaucaccaggacacuagcuaugauucuagaagucaaaaggugucuauagaac

SEQ ID NO: 458779 - RNA, 64 nt, Homo Sapiens
ugcuuuguaauaacaccuggugaaaaaguuagauauucuagacuuguuuuaguaauggaaacuc

SEQ ID NO: 458780 - RNA, 64 nt, Homo Sapiens
aagcaagguauuuuuucaccucagauucuaauauauucuagauuuguuucuguuuuauagauuu

SEQ ID NO: 458781 - RNA, 64 nt, Homo Sapiens
agucaaaacuuguguucucaugagccuaaggaccauucuagauuuauuacguguuuuuugugug

SEQ ID NO: 458782 - RNA, 64 nt, Homo Sapiens
uuccugaaaccauacauuucaagugaaauaaguaauucuagauaggacaauuuaaauuggauaa

SEQ ID NO: 458783 - RNA, 64 nt, Homo Sapiens
uuccagcugacuuugguauacuuguggccaagaaauucuagauucaauuuaagaucucucuuaa

SEQ ID NO: 458784 - RNA, 64 nt, Homo Sapiens
uuuuguuucuugcaacaacaagcacaugggaaagauucuagacuuuucuugcaagaguaauuua

SEQ ID NO: 458785 - RNA, 64 nt, Homo Sapiens
uuauaguguugccugucugucagaucuuugccaaauucuagauaccauucuguaucuuauauaa

SEQ ID NO: 458786 - RNA, 64 nt, Homo Sapiens
uacaaaaggcuuaaaaagaauuauuaaaauuauuauucuagacuuaauaaauugaucugcuuau

SEQ ID NO: 458787 - RNA, 64 nt, Homo Sapiens
ccaaauuuuacagccaggacuacagaagugcaucauucuagaauguguagaccugaguagcuua

SEQ ID NO: 458788 - RNA, 64 nt, Homo Sapiens
aggaauguaagaacacccauauuggcuacuggaaauucuagaagucagucagguuuuaauuuau

SEQ ID NO: 458789 - RNA, 64 nt, Homo Sapiens
auaguucagaaacacuuuuuaucugcaaggcacuauucuagauccagaagaugcaauguugaac

SEQ ID NO: 458790 - RNA, 64 nt, Homo Sapiens
aacaaauccuagagucuuugaaauuucuaagggcauucuagaccucuguugggauaugguauua

SEQ ID NO: 458791 - RNA, 64 nt, Homo Sapiens
auauaucagguugaaucacauucaacagagauauauucuagaauacuuuuuuagaagaggcuaa

SEQ ID NO: 458792 - RNA, 64 nt, Homo Sapiens
gcagggcguagaaaagagaggauguccgugcuuaauucuagauacuuuugagacaacaccuuca

SEQ ID NO: 458793 - RNA, 64 nt, Homo Sapiens
uaggcuaacaaugaaaaguacuaauauuguuuaaauucuagaugaaagcaauuagagaccauac

SEQ ID NO: 458794 - RNA, 64 nt, Homo Sapiens
ugggguaucucuguccauacgaaauaugggauggauucuagaaaauuuuuguuaacuaaaaagu

SEQ ID NO: 458795 - RNA, 64 nt, Homo Sapiens
cuuacucuaagaucuuagauucucugugucuaagauucuagaucagaugcuccaagauucuaga

SEQ ID NO: 458796 - RNA, 64 nt, Homo Sapiens
ucugugucuaagauucuagaucagaugcuccaagauucuagaugauuaaauaagauucuaacgg

SEQ ID NO: 458797 - RNA, 64 nt, Homo Sapiens
auccacuggguggguuguuuuuuuuuaaagugccauucuagaauguccaaagggaaucaggauu

SEQ ID NO: 458798 - RNA, 64 nt, Homo Sapiens
guagacugaucacagagucaaggaagcaguggcaauucuagauaucugagauuuugcugguucc

SEQ ID NO: 458799 - RNA, 64 nt, Homo Sapiens
uccaguuugcccaauggaguugagaaucucaaugauucuagaugacuucuugugguucuguaau

SEQ ID NO: 458800 - RNA, 64 nt, Homo Sapiens
gagacuuguucuagagaggaguguuucuggagugauucuagaggcauucaccaaguccccuucu

SEQ ID NO: 458801 - RNA, 64 nt, Homo Sapiens
uagcaaaacaucuuuuccugggaacugucugaauauucuagaacgagagaagggggacguuucu

SEQ ID NO: 458802 - RNA, 64 nt, Homo Sapiens
ucucccaacauuuuuuuuucggaauccuccccacauucuagaauuaguacuuucugaacauucu

SEQ ID NO: 458803 - RNA, 64 nt, Homo Sapiens
uuucccagccucguagcccauugcuaaccuaaauauucuagaacuuggaccuauuuuaagaagc

SEQ ID NO: 458804 - RNA, 64 nt, Homo Sapiens; identical to SEQ ID NO: 73323

SEQ ID NO: 458805 - RNA, 64 nt, Homo Sapiens; identical to SEQ ID NO: 73324

SEQ ID NO: 458806 - RNA, 64 nt, Homo Sapiens; identical to SEQ ID NO: 73325

SEQ ID NO: 458807 - RNA, 64 nt, Homo Sapiens; identical to SEQ ID NO: 73326

SEQ ID NO: 458808 - RNA, 64 nt, Homo Sapiens; identical to SEQ ID NO: 73327

SEQ ID NO: 458809 - RNA, 64 nt, Homo Sapiens; identical to SEQ ID NO: 73328

SEQ ID NO: 458810 - RNA, 64 nt, Homo Sapiens; identical to SEQ ID NO: 73329

SEQ ID NO: 458811 - RNA, 64 nt, Homo Sapiens; identical to SEQ ID NO: 73330

SEQ ID NO: 458812 - RNA, 64 nt, Homo Sapiens; identical to SEQ ID NO: 73331

SEQ ID NO: 458813 - RNA, 64 nt, Homo Sapiens; identical to SEQ ID NO: 73332

SEQ ID NO: 458814 - RNA, 64 nt, Homo Sapiens; identical to SEQ ID NO: 73333

SEQ ID NO: 458815 - RNA, 64 nt, Homo Sapiens; identical to SEQ ID NO: 73334

SEQ ID NO: 458816 - RNA, 64 nt, Homo Sapiens; identical to SEQ ID NO: 73335

SEQ ID NO: 458817 - RNA, 64 nt, Homo Sapiens; identical to SEQ ID NO: 73336

SEQ ID NO: 458818 - RNA, 64 nt, Homo Sapiens; identical to SEQ ID NO: 73337

SEQ ID NO: 458819 - RNA, 64 nt, Homo Sapiens; identical to SEQ ID NO: 73338

SEQ ID NO: 458820 - RNA, 64 nt, Homo Sapiens; identical to SEQ ID NO: 73339

SEQ ID NO: 458821 - RNA, 64 nt, Homo Sapiens; identical to SEQ ID NO: 73340

SEQ ID NO: 458822 - RNA, 64 nt, Homo Sapiens; identical to SEQ ID NO: 73341

SEQ ID NO: 458823 - RNA, 64 nt, Homo Sapiens; identical to SEQ ID NO: 73342

SEQ ID NO: 458824 - RNA, 64 nt, Homo Sapiens; identical to SEQ ID NO: 73343

SEQ ID NO: 458825 - RNA, 64 nt, Homo Sapiens; identical to SEQ ID NO: 73344

SEQ ID NO: 458826 - RNA, 64 nt, Homo Sapiens
augucccauuucagacagaguaaccauuaacaaaaaagaagagaaaaaguuaaagucguuauau

SEQ ID NO: 458827 - RNA, 64 nt, Homo Sapiens
uuaaaugaauuuaaaaugagccaaaggacccugaaaagaagacauguugauuucccacuccuag

SEQ ID NO: 458828 - RNA, 64 nt, Homo Sapiens
acucuugcaggagccuguccccucaucacaggcuaaagaagagcaguagacagcccuggacacu

SEQ ID NO: 458829 - RNA, 64 nt, Homo Sapiens
agaccuggggacaggucgauugcuggaccagggcaaagaagaagcccugccaucugugcccugu

SEQ ID NO: 458830 - RNA, 64 nt, Homo Sapiens
acauucuuugccugaguuuugucugcuguugcaaaaagaagaaagugccuuuguuuuuacuagu

SEQ ID NO: 458831 - RNA, 64 nt, Homo Sapiens
gggaagaaaagaaggggaagaagaucaaagaagaaaagaagaaggggaagaaaagaaggggaag

SEQ ID NO: 458832 - RNA, 64 nt, Homo Sapiens
agaagaaggggaagaaaagaaggggaagaagaucaaagaagaaaaggggaaggggaagaaaaga

SEQ ID NO: 458833 - RNA, 64 nt, Homo Sapiens
cagcaacaggaggaggaggaccaugcagccgaagaaagaagaggagagcagggcauaugcugac

SEQ ID NO: 458834 - RNA, 64 nt, Homo Sapiens
uggcaccaugaagaggagaaaggaaagggaagaaaaagaagaggagcaaaccaaucagucccuc

SEQ ID NO: 458835 - RNA, 64 nt, Homo Sapiens
gcuagcauuaaugaaugcuuagcuacuaguagggaaagaagaaaacauggucaguagguggcag

SEQ ID NO: 458836 - RNA, 64 nt, Homo Sapiens
cugcauuuucacauugaaaaauuugguggcagaaaaagaagauaauguauaugguauauuauac

SEQ ID NO: 458837 - RNA, 64 nt, Homo Sapiens
gcuaugaguucagaucuaucaaaaguauauuaaaaaagaagauaacaaauucacugagaauucc

SEQ ID NO: 458838 - RNA, 64 nt, Homo Sapiens
aaacuaugccaguuuuauauauuuugucaagaggaaagaagauaaggacguuuaaaguauauau

SEQ ID NO: 458839 - RNA, 64 nt, Homo Sapiens
auaacuguuaauucucagccaucuuugaagcuugaaagaagagucuuugguauuuuguaaacgu

SEQ ID NO: 458840 - RNA, 64 nt, Homo Sapiens
uuuuaaaacuuuuuuuuaacuaauaauagcuuugaaagaagaggcuuaauuugggggugguaac

SEQ ID NO: 458841 - RNA, 64 nt, Homo Sapiens
acauuucuuuuuuguaaugugacgauauguggacaaagaagaagaugcagguuuaagaaguuaa

SEQ ID NO: 458842 - RNA, 64 nt, Homo Sapiens
agacaagcugagaagcuuacuuuuuggggaaguaaaagaagauggaaauggauguuucauuugu

SEQ ID NO: 458843 - RNA, 64 nt, Homo Sapiens
uuccagaguuucacaggcauuuuuggauccuucaaaagaagagaaggagacaaaugcugauugg

SEQ ID NO: 458844 - RNA, 64 nt, Homo Sapiens
aaagugggugaaggacaugaacagacacuucucaaaagaagacauuuaugcagccaaaaaacac

SEQ ID NO: 458845 - RNA, 64 nt, Homo Sapiens
gcaaagaggagaaugaagauccagaaaggaaaauaaagaagaagggcuucggcgccaugcugag

SEQ ID NO: 458846 - RNA, 64 nt, Homo Sapiens
agaagaagggcuucggcgccaugcugagauuuggaaagaagaaagaggauaaggguggaaaggc

SEQ ID NO: 458847 - RNA, 64 nt, Homo Sapiens
ugguggccugagagaagaagagcuggagaaaaugaaagaagagcgugaaaggugagcagaagug

SEQ ID NO: 458848 - RNA, 64 nt, Homo Sapiens
aucuccccagaaggcauccaugcuuagggcccuuaaagaagaaaggaacucagcccuguugcaa

SEQ ID NO: 458849 - RNA, 64 nt, Homo Sapiens
acuauauauauauaucuuauuuauugcaagagguaaagaagaaagucuauuuuuucuauaaguu

SEQ ID NO: 458850 - RNA, 64 nt, Homo Sapiens
cauagacuggaggagguaauccauggagagagaaaaagaagagggcucaggacaaggcccugag

SEQ ID NO: 458851 - RNA, 64 nt, Homo Sapiens
ccuaaaaguuugggcagagggaaccaggcacguuaaagaagacagaaagcggacuaugcagagu

SEQ ID NO: 458852 - RNA, 64 nt, Homo Sapiens
aaaaggaaaaagaaaccacaaauuggggaaaaaaaaagaagaaaaaccuguuuccgugugcaaa

SEQ ID NO: 458853 - RNA, 64 nt, Homo Sapiens
augacugugcuuguucguaacagaugcaaacaagaaagaagaacugggaagucuuugucccuag

SEQ ID NO: 458854 - RNA, 64 nt, Homo Sapiens
aaagauuugaauuuuuuguucccauggaagaaguaaagaagaggucacuagauguugcagugaa

SEQ ID NO: 458855 - RNA, 64 nt, Homo Sapiens
auuugugauuauuuagguacugauugacuuaucaaaagaagaucugauuaagggcuuuucacaa

SEQ ID NO: 458856 - RNA, 64 nt, Homo Sapiens
uuugagguagaccaggauuucuaaucaaaagggaaaagaagauguugaagaauacaguuaggca

SEQ ID NO: 458857 - RNA, 64 nt, Homo Sapiens
gagcucucaaacuaaaagacauuuguuauuuuggaaagaagaaagacucuauucucaaaguuuc

SEQ ID NO: 458858 - RNA, 64 nt, Homo Sapiens
uaauagaagcuuccuccaucaauuggcagaaccuaaagaagauuuuaaggggcaaaaguaauua

SEQ ID NO: 458859 - RNA, 64 nt, Homo Sapiens
uuuuucuaaaaaaagaaaaaaaagaaaaaaaggaaaagaagaacaaagaaacaugacugucuca

SEQ ID NO: 458860 - RNA, 64 nt, Homo Sapiens
gguacuuuucuuguauuuuuuaccauaucacuguaaagaagaggggaaacccagccagcuacuu

SEQ ID NO: 458861 - RNA, 64 nt, Homo Sapiens
aaaacauuccaucuuucauuuaauaucaauaucaaaagaagaagacaaacaucuaucuuucuca

SEQ ID NO: 458862 - RNA, 64 nt, Homo Sapiens
accauucuuuguaaacaguuggauggauuaugauaaagaagaugcuaccaaugaaauagaaaac

SEQ ID NO: 458863 - RNA, 64 nt, Homo Sapiens
gcaaagaugcugugguggaugagguuggaguucgaaagaagaagcaagcgcuggccuggccuug

SEQ ID NO: 458864 - RNA, 64 nt, Homo Sapiens
ugcaaauggcuacuaagcacauagacauuucuccaaagaagauaaaaaugggcuaacgguuuga

SEQ ID NO: 458865 - RNA, 64 nt, Homo Sapiens
uaaaacuauuugcagaugacguauccagauaggaaaagaagaagggaaagaaaaagaaauaaau

SEQ ID NO: 458866 - RNA, 64 nt, Homo Sapiens
uuugucugggacccccaaaggacaaguuauaaagaaagaagauccacccuuuaaaucuuaggau

SEQ ID NO: 458867 - RNA, 64 nt, Homo Sapiens
aggaaggugugcaggaagaacuuccugagugucuaaagaagaugaggagugcucagcccaucaa

SEQ ID NO: 458868 - RNA, 64 nt, Homo Sapiens
caguugcuagaagcuaaauuucaccuuugcuggaaaagaagaucuuguuccucagaaggagcca

SEQ ID NO: 458869 - RNA, 64 nt, Homo Sapiens
ucccuguggaaauguccaauacuuggaaaaggaaaaagaagaugucgagcugaagacaauuuua

SEQ ID NO: 458870 - RNA, 64 nt, Homo Sapiens
aaaccaagcuuaggguauuuacucuaaaagaagaaaagaagaaacuguuggucaaaaucugcaa

SEQ ID NO: 458871 - RNA, 64 nt, Homo Sapiens
agaagaaaaaaccaagcuuaaucugcaaacucuaaaagaagaaaaaccaugucuguuggucaaa

SEQ ID NO: 458872 - RNA, 64 nt, Homo Sapiens
auuuuaauggccacaucuaaucucauuucacaugaaagaagaaguauauuuuagaaauuuguua

SEQ ID NO: 458873 - RNA, 64 nt, Homo Sapiens
gcccuugcaguaauucuacuggugaaaaacaugcaaagaagaggaagucacagaaacaugucuc

SEQ ID NO: 458874 - RNA, 64 nt, Homo Sapiens
caucucaaaaaaaaaaaaaaaaaaaaaaaaaaaaaaagaagaagaaacccugagccauuaaugu

SEQ ID NO: 458875 - RNA, 64 nt, Homo Sapiens
uuuuucaugcuuauuuuauucuuugucacagaugaaagaagaauaggacuaauuggggcuaaga

SEQ ID NO: 458876 - RNA, 64 nt, Homo Sapiens
uucaaaauaauagucccauagagaaaucaccaacaaagaagaugaaauuacauuaucaacauga

SEQ ID NO: 458877 - RNA, 64 nt, Homo Sapiens
uucuaggggcuacuguuuauuuguugaauacauuaaagaagaguugaacaaaggucagugggga

SEQ ID NO: 458878 - RNA, 64 nt, Homo Sapiens
acuaaaucuuuuauaggauuuauuuaaaauagcaaaagaagaaguuucaucauuuuuuacuucc

SEQ ID NO: 458879 - RNA, 64 nt, Homo Sapiens
gagcauugggauaucuccugaaaagguuuaugaaaaagaagaaucucaucucagugaagaauac

SEQ ID NO: 458880 - RNA, 64 nt, Homo Sapiens
uuccuguuucuggaauuccuuguuagggaacuuuaaagaagaaaagaaaaacuugaauuguguu

SEQ ID NO: 458881 - RNA, 64 nt, Homo Sapiens
cucuucccuuucaccuccaauucccgugaucccaaaagaagaggaagacuccaggagggguaua

SEQ ID NO: 458882 - RNA, 64 nt, Homo Sapiens
aacuguacaagcccauuucagguauuuaggguucaaagaagacacaagaaugaauucaguuaaa

SEQ ID NO: 458883 - RNA, 64 nt, Homo Sapiens
uggcauggggaauauauaugcaggcaauuugaggaaagaagaaauugauuucuuauuucuuggg

SEQ ID NO: 458884 - RNA, 64 nt, Homo Sapiens
ggcagcaccucccauuggcaaggauuuuaacagcaaagaagagauuucccucccuaucaacaag

SEQ ID NO: 458885 - RNA, 64 nt, Homo Sapiens
cuuggagucuucuauaccuuaccaggguaccuuuaaagaagaccggaggaauuguuaacugagu

SEQ ID NO: 458886 - RNA, 64 nt, Homo Sapiens
gcuguaggauucaagcugucuuugcacuagcucuaaagaagauuuucuucugguuuuagagaac

SEQ ID NO: 458887 - RNA, 64 nt, Homo Sapiens
cuccaccagcacaucacuaugcaucuguuccaggaaagaagaaaagcgagcgaggaagacggaa

SEQ ID NO: 458888 - RNA, 64 nt, Homo Sapiens
gguacuguguuguaccuuuauuucuguauuucuaaaagaagaaaguucuuuccuagcaggguuu

SEQ ID NO: 458889 - RNA, 64 nt, Homo Sapiens
uuuccauccccaaggcaaacaaggaaaggaaaggaaagaagaaaaggugccuuaguccuuuguu

SEQ ID NO: 458890 - RNA, 64 nt, Homo Sapiens
gucaggcuugguggcucaugcaggaaauaaagcaaaagaagaggccugcuucauguggaggaaa

SEQ ID NO: 458891 - RNA, 64 nt, Homo Sapiens
accugggccagggccuacgucaagcagcugagccaaagaagaucgaggacuagaggcuggaggc

SEQ ID NO: 458892 - RNA, 64 nt, Homo Sapiens
aacccagauagauauguaaagguuaccuuuaauaaaagaagacaucuguucuugcucucaagga

SEQ ID NO: 458893 - RNA, 64 nt, Homo Sapiens
cuugugaaguuuccccagcauucuuuauugacuuaaagaagauuuugugcaggacugauagcuc

SEQ ID NO: 458894 - RNA, 64 nt, Homo Sapiens
aaacuucagcugaagauuuuauauaggacuuuaaaaagaagagaagagaaagaagaaacaaugc

SEQ ID NO: 458895 - RNA, 64 nt, Homo Sapiens
gauuuuauauaggacuuuaaaaagaagagaagagaaagaagaaacaaugcauuuccaggcaacc

SEQ ID NO: 458896 - RNA, 64 nt, Homo Sapiens
aauuucauuauguaaacgcugaaauuuauaaugaaaagaagauguaaggagaaauagaaaagaa

SEQ ID NO: 458897 - RNA, 64 nt, Homo Sapiens
uuuauaaugaaaagaagauguaaggagaaauagaaaagaagaaauaaugcccuaacucucuuau

SEQ ID NO: 458898 - RNA, 64 nt, Homo Sapiens
augugagugguaaguauaucucaguuuaaaugguaaagaagaaauguaguuuacauuuguauuu

SEQ ID NO: 458899 - RNA, 64 nt, Homo Sapiens
augugcacacgcccugccugguccgccauguuccaaagaagaugauuuaaugguagaacggaua

SEQ ID NO: 458900 - RNA, 64 nt, Homo Sapiens
gcucucugacugcuuuggauacagcuuugucuccaaagaagauaggaaagugugaagacccaaa

SEQ ID NO: 458901 - RNA, 64 nt, Homo Sapiens
agauucuucuuaaaaguuucaaagaagaggagaaaaagaagaaaguaaaauuucaggauuaacu

SEQ ID NO: 458902 - RNA, 64 nt, Homo Sapiens
agaaaaagaagaaaagauucuuucaggauuaacuaaagaagaggacgcucaaugcccaguaaaa

SEQ ID NO: 458903 - RNA, 64 nt, Homo Sapiens
auaaccuuaaucucuuguauuacuaagaauaaauaaagaagaaagccauuagacugaauuuaac

SEQ ID NO: 458904 - RNA, 64 nt, Homo Sapiens
gucuaugcuuaggccagucaaaccauaugauugaaaagaagaaauuguaauauacaguuuuugu

SEQ ID NO: 458905 - RNA, 64 nt, Homo Sapiens
agcugaacuuacuugccucaaaaggaguuaggagaaagaagagcgcuauuuuuccauaggaaga

SEQ ID NO: 458906 - RNA, 64 nt, Homo Sapiens
cuaauugucacaccuggaagggcaagccaguaauaaagaagacaagugucagggacccuaugga

SEQ ID NO: 458907 - RNA, 64 nt, Homo Sapiens
ccaagacauuaaaguagcauggcugcccaggagaaaagaagacauucuaauuccagucauuuug

SEQ ID NO: 458908 - RNA, 64 nt, Homo Sapiens
augucauuuaagggaguuacaucuuuauucugcuaaagaagaggaucauugauuucuguacagu

SEQ ID NO: 458909 - RNA, 64 nt, Homo Sapiens
uacuuugcuuuggagaaaucuuuaaaaagaagagaaagaagauauucacaaucucauaggaguu

SEQ ID NO: 458910 - RNA, 64 nt, Homo Sapiens
aagaagauauacuuugcuuuauaggaguuuuuaaaaagaagagauugaacauuuucacaaucuc

SEQ ID NO: 458911 - RNA, 64 nt, Homo Sapiens
cuugcuggggccauaauaugcuucaggguguguaaaagaagaaaucucuuuguggcuuucaugg

SEQ ID NO: 458912 - RNA, 64 nt, Homo Sapiens
gaacccuaacuuagggcuugggcaggggaaagagaaagaagaugagagauuauacuucaugagu

SEQ ID NO: 458913 - RNA, 64 nt, Homo Sapiens
cauggauagucagacugaacuuuuucuuucucccaaagaagauuaaacauuauacauugggcca

SEQ ID NO: 458914 - RNA, 64 nt, Homo Sapiens
aaaauuaaugugugggagcuaccaaaagaggaggaaagaagaaacaccacauuugugugcagau

SEQ ID NO: 458915 - RNA, 64 nt, Homo Sapiens
cuugcguuugaaacuacaacuugauaaccccuagaaagaagaggacaugaaaggaugcuggcua

SEQ ID NO: 458916 - RNA, 64 nt, Homo Sapiens
uugcauuuaaauugcaauccagcacacgugugagaaagaagaggcacuagucuaaaaggcugca

SEQ ID NO: 458917 - RNA, 64 nt, Homo Sapiens
aacguguaagaaugguuugcaaggaaagaagaauaaagaagagagaggaaagaaaaaagaaaag

SEQ ID NO: 458918 - RNA, 64 nt, Homo Sapiens
aaagaagagaaacguguaagaaaagaaaagaaggaaagaagaaugaaagagcaagaggaaagaa

SEQ ID NO: 458919 - RNA, 64 nt, Homo Sapiens
auuuuuaaagaaugggagugguccuggggcuaagaaagaagauaaggagaaucaaagauugauu

SEQ ID NO: 458920 - RNA, 64 nt, Homo Sapiens
caagcaucaauuaauuauaauuuaaaagauguagaaagaagaaucacuaguguccaauuucauu

SEQ ID NO: 458921 - RNA, 64 nt, Homo Sapiens
agggcugcuuuguguggccaaaauaguuaaaccaaaagaagaaugcucagugaucaaagucuuc

SEQ ID NO: 458922 - RNA, 64 nt, Homo Sapiens
gagucagcuggugaugugcuggauuuagcagcuaaaagaagaauacauggaaaaacaacuuaga

SEQ ID NO: 458923 - RNA, 64 nt, Homo Sapiens
aaauagcauugaaacuaaccgcaauaugaccgacaaagaagacaccuuaggggugaguccuauu

SEQ ID NO: 458924 - RNA, 64 nt, Homo Sapiens
uugcauggagcaggacucuaaauuaaucaucuauaaagaagaacuuacugugaaacuggcacug

SEQ ID NO: 458925 - RNA, 64 nt, Homo Sapiens
aagccauuauaccaccauccuuguagacucagaaaaagaagauccaauaaaauacaaugauuac

SEQ ID NO: 458926 - RNA, 64 nt, Homo Sapiens
ggcuuccccucugucaaaucuaguuuccuauggaaaagaagauggcagauacaggagagacgac

SEQ ID NO: 458927 - RNA, 64 nt, Homo Sapiens
aacuuugcaucucaguaugaaaguagauaggaagaaagaagacaguuugccccuuuauaaaucc

SEQ ID NO: 458928 - RNA, 64 nt, Homo Sapiens
ugagaauguauccccaaaaggcaguucccacauuaaagaagaccuguaauggcaguuauauuuu

SEQ ID NO: 458929 - RNA, 64 nt, Homo Sapiens
agauaauacccauuuguucuuaauuaauuauaggaaagaagaaaacagguccauaauuucauuu

SEQ ID NO: 458930 - RNA, 64 nt, Homo Sapiens
uggaugaagugaacccaugcgaguauucugaaaaaaagaagauaugaaauaagacaggaauaaa

SEQ ID NO: 458931 - RNA, 64 nt, Homo Sapiens
agcaaucucgcaguacauguugauggaaaaagaaaaagaagaaacauuccagccccuauguuau

SEQ ID NO: 458932 - RNA, 64 nt, Homo Sapiens
cucagcacuguuucagcccgagagaguaucauuaaaagaagacgucaccaggaugucacauguc

SEQ ID NO: 458933 - RNA, 64 nt, Homo Sapiens
gcuccccucacugauggacaaggaggucugugccaaagaagaauccaauaagcacauauugagc

SEQ ID NO: 458934 - RNA, 64 nt, Homo Sapiens
gccucaguaaguaucuggaggaagaaaacaggugaaagaagaaguaaaaaccauuuaguauuag

SEQ ID NO: 458935 - RNA, 64 nt, Homo Sapiens
auucuaaaauauaaucaaccaguagaaauuuaagaaagaagauguaaaaaaaaaaaauauuaac

SEQ ID NO: 458936 - RNA, 64 nt, Homo Sapiens
cgaaaaagaaagcccaaggcgaaaaagaagauaaaaagaagaaaagaaaacaccaaaaaauuuu

SEQ ID NO: 458937 - RNA, 64 nt, Homo Sapiens
aaaagaagaaacgaaaaagacaaaaaauuuugaaaaagaagauaauguuccacugagaaaacac

SEQ ID NO: 458938 - RNA, 64 nt, Homo Sapiens
cucgugagucccuggccuuuccuuuuguaauaagaaagaagagagagaacuugaugcaaagucc

SEQ ID NO: 458939 - RNA, 64 nt, Homo Sapiens
agauaggacucuaaaccuagucaucuuggaauaaaaagaagagcugguuuguuuuagagcaggg

SEQ ID NO: 458940 - RNA, 64 nt, Homo Sapiens
aacacuugaaaaguguguuuauauauaaaaguuuaaagaagaguagaaaaagaagagccuuaac

SEQ ID NO: 458941 - RNA, 64 nt, Homo Sapiens
cuuaacauauauaaaaguuuuauauugaaaagaaaaagaagagcuuuuaaaauucuaaguagag

SEQ ID NO: 458942 - RNA, 64 nt, Homo Sapiens
guccaggugggacugggauaguucaccuggaacuaaagaagagcagcugcauguuaguuauuac

SEQ ID NO: 458943 - RNA, 64 nt, Homo Sapiens
gucccuugacuugaaguaauauauucugacucugaaagaagacacuugcagugugcucuacuga

SEQ ID NO: 458944 - RNA, 64 nt, Homo Sapiens
ggcaaacgugagccagggccagcggagaaacacuaaagaagacucggugguucagagccugggu

SEQ ID NO: 458945 - RNA, 64 nt, Homo Sapiens
cgccuccuaguugccaggcacuggagggcgcaucaaagaagaguccuacccaggagggagagcg

SEQ ID NO: 458946 - RNA, 64 nt, Homo Sapiens
uguuauuuuuuuaaaggaaacaaacagacaacaaaaagaagaaaaaaaaaaagaaccuccuugg

SEQ ID NO: 458947 - RNA, 64 nt, Homo Sapiens
auaaaaauaaaaaaaauaaaaaaggaaaaaaaaaaaagaagaaacaagacaugccaccuuuccc

SEQ ID NO: 458948 - RNA, 64 nt, Homo Sapiens
caaguucugugcugucccguuuugggcaacagacaaagaagaaucagacucaaagaacagguuc

SEQ ID NO: 458949 - RNA, 64 nt, Homo Sapiens
gcacuaaaaacucaacuagcacaaugguguuccaaaagaagaaauuuaguaacuauuaugaaau

SEQ ID NO: 458950 - RNA, 64 nt, Homo Sapiens
aggcagagaauugucagagcccuuaagcaagcacaaagaagaugccaccuagcgccuucccacu

SEQ ID NO: 458951 - RNA, 64 nt, Homo Sapiens
ccauucccaggacagaggccugucaggcugcuggaaagaagacuucguccugagagcuucugug

SEQ ID NO: 458952 - RNA, 64 nt, Homo Sapiens
cucugucaccucagccaaguuccaacucauuaaaaaagaagaauggcaccauguuuucuuugag

SEQ ID NO: 458953 - RNA, 64 nt, Homo Sapiens
gaaggaaauuuuaucaauuaacaaaaacagaacaaaagaagagacaaaaaaaaaaacacacaaa

SEQ ID NO: 458954 - RNA, 64 nt, Homo Sapiens
agauuuuugcagaauuucuccagaagggaaaaggaaagaagaaagaaaggacauugaguuuuaa

SEQ ID NO: 458955 - RNA, 64 nt, Homo Sapiens
uaauuuuacauuuccccuuuagaaggggauaggaaaagaagagggggcucaggaugggaaagga

SEQ ID NO: 458956 - RNA, 64 nt, Homo Sapiens
cagacagaguguggguuuguagugagcccuguggaaagaagagagaggacaacugugaacucac

SEQ ID NO: 458957 - RNA, 64 nt, Homo Sapiens
cuccuccaccacuuacuuuucugcaaauguauucaaagaagaacaggucuugcuacauugcccu

SEQ ID NO: 458958 - RNA, 64 nt, Homo Sapiens
uacagaaaaugaaaaagaaaguggaguaauagggaaagaagagugagaaggccagauggaguau

SEQ ID NO: 458959 - RNA, 64 nt, Homo Sapiens
caaaagaaagcaucaugaugaaagaagaaaacgaaaagaagaaauugcugaaauugaaaaagaa

SEQ ID NO: 458960 - RNA, 64 nt, Homo Sapiens
acgaaaagaagaaacaaaagaaauugaaaaagaaaaagaagaaaaauugagaaguauguugcug

SEQ ID NO: 458961 - RNA, 64 nt, Homo Sapiens
gcucagcuggggguguggacagguagggguggggaaagaagaggcucugcguucugggggcuuu

SEQ ID NO: 458962 - RNA, 64 nt, Homo Sapiens
uuauccuuucuaauuuuuacugaacugaaagcacaaagaagacuacacagaaaaucuggaaaca

SEQ ID NO: 458963 - RNA, 64 nt, Homo Sapiens
cugucuuuuucauuuguagaaacuggagacguguaaagaagauaaauaauuguguaauuaaacu

SEQ ID NO: 458964 - RNA, 64 nt, Homo Sapiens
cuauguuacaugaaugcuucugccucuuuaagacaaagaagaaugucacccaaaauugucauuu

SEQ ID NO: 458965 - RNA, 64 nt, Homo Sapiens
cugaacuuucuacuggauuggagaaaaggaacagaaagaagauugguuauagaaaggcuacaag

SEQ ID NO: 458966 - RNA, 64 nt, Homo Sapiens
caaggccuccaaaauuugucaaacagugguauccaaagaagaaugcaguuguuagaggaaccua

SEQ ID NO: 458967 - RNA, 64 nt, Homo Sapiens
uccaucauguagcuugugacucuaugcaacauuaaaagaagagacucacuagccaaacugaaac

SEQ ID NO: 458968 - RNA, 64 nt, Homo Sapiens
aaaauuucauuagcaugaauauuuugaucaugacaaagaagauuaagauuguccuacaauuugg

SEQ ID NO: 458969 - RNA, 64 nt, Homo Sapiens
uguagugccuuaacaagcaauuaaucauuuaaccaaagaagauguuuucaagugauuuaaauag

SEQ ID NO: 458970 - RNA, 64 nt, Homo Sapiens
gcaacuuguauauuuuguauucguguguguuugaaaagaagaauuggaaauugaaaaacgaaaa

SEQ ID NO: 458971 - RNA, 64 nt, Homo Sapiens
caacaacaaaaaagccuaaauugaaauuuaauugaaagaagaaaggaaagcuauuuaaaaaaac

SEQ ID NO: 458972 - RNA, 64 nt, Homo Sapiens
guaagcacaggaaagagaaaauguacccuccgagaaagaagaacaaaaaagaaaaaaagccaug

SEQ ID NO: 458973 - RNA, 64 nt, Homo Sapiens
uaugacucuuuccaagaugacaguuaccucauucaaagaagacauuucacaagcaauggaaaag

SEQ ID NO: 458974 - RNA, 64 nt, Homo Sapiens
auauuggaaaucagcugcugacaaacagcaaaucaaagaagauaccgcucagcagaggaggcuu

SEQ ID NO: 458975 - RNA, 64 nt, Homo Sapiens
gauauaaaggaucuuguagucccagaggaucuggaaagaagaaaaaugccauacaggcucuuca

SEQ ID NO: 458976 - RNA, 64 nt, Homo Sapiens
gaagaguugcuuccuauuucaggacccugccaaaaaagaagaaagcuugccuuugguggggcua

SEQ ID NO: 458977 - RNA, 64 nt, Homo Sapiens
gccacaacaugacagucuugugacaucuuaaggaaaagaagaguuccuguuaaaugaauagcuu

SEQ ID NO: 458978 - RNA, 64 nt, Homo Sapiens
auuacagggcugcuauuuucauaauguacaugaacaaugucacagaacuuuuuuaauuuuuuug

SEQ ID NO: 458979 - RNA, 64 nt, Homo Sapiens
agcacucuuauuguaauauguacuagucugugaacaaugucaaauaaaagagaacgaacaggua

SEQ ID NO: 458980 - RNA, 64 nt, Homo Sapiens
cacucauucccucaaaauauuuauugagcaccaacaaugucacaagcacugugcuaaacacugu

SEQ ID NO: 458981 - RNA, 64 nt, Homo Sapiens
aacacuaaaauguuuuaaguuuucuuauugcuaacaaugucacagugaacauuuauauauucau

SEQ ID NO: 458982 - RNA, 64 nt, Homo Sapiens
uugaaaguaacaccuuuuccaaggacaauggcaacaaugucaaugucaacacugagucuaauuu

SEQ ID NO: 458983 - RNA, 64 nt, Homo Sapiens
guaacaccuuuuccaaggacaauggcaacaaugucaaugucaacacugagucuaauuuugacca

SEQ ID NO: 458984 - RNA, 64 nt, Homo Sapiens
ggcugcuggcugauaagggugaggagucuugccucaaugucauuucguaaucuuuuuugcuggu

SEQ ID NO: 458985 - RNA, 64 nt, Homo Sapiens
ugaacacaaauucaggaugaaacuaauaauuaggcaaugucaagacaaaaaguggguaagcuga

SEQ ID NO: 458986 - RNA, 64 nt, Homo Sapiens
uagaaauuaaccaggaagauguuuccaccaagccugcugugagucaauugagggaguguuuggg

SEQ ID NO: 458987 - RNA, 64 nt, Homo Sapiens
cggcuggggugggcagggaagggaagccgggggcugcugugagggaucuuggagcuucccugua

SEQ ID NO: 458988 - RNA, 64 nt, Homo Sapiens
aacaacaacaaaaaauaaauucccaucaacaaaaugcugugaacaaauacgacaguguuccaaa

SEQ ID NO: 458989 - RNA, 64 nt, Homo Sapiens
gagaaguuugccccaauuaacuggccguggcagaugcugugauuugaacacugcucgcuacaag

SEQ ID NO: 458990 - RNA, 64 nt, Homo Sapiens
ugagggaaucugaaauguuuacugcuuauugaugugcugugauaaaaagucagucuauguacau

SEQ ID NO: 458991 - RNA, 64 nt, Homo Sapiens
cauuuugucucuagcuucuaagggaaacugugcuugcugugaucauagcguuccuuauucuuug

SEQ ID NO: 458992 - RNA, 64 nt, Homo Sapiens
ccccacagaucaaucucugcagaugacagggaggugcugugagaagugcaccaggcagcuuucu

SEQ ID NO: 458993 - RNA, 64 nt, Homo Sapiens
uggaaccugggcuguggcucucugucguuuguggugcugugauggugucuacuguuagaauagc

SEQ ID NO: 458994 - RNA, 64 nt, Homo Sapiens
ucaccacucuuuccugaugcccgccucccuccuuugcugugacaaaugugcauguucuuagcca

SEQ ID NO: 458995 - RNA, 64 nt, Homo Sapiens
auuuucugccaaagaccauguaaaguauuuuuugugcugugaacuuaauauuugguauuucuuu

SEQ ID NO: 458996 - RNA, 64 nt, Homo Sapiens
auaggccagagccauuguucccacccucccaaaaugcugugauucucaaacucccgaucucaag

SEQ ID NO: 458997 - RNA, 64 nt, Homo Sapiens
gaguguccuuucccaucugugacuggagcaaagcugcugugagauucgcaguguugggcuuggu

SEQ ID NO: 458998 - RNA, 64 nt, Homo Sapiens
caacuacuccacguguuuuuccauccaaucacacugcugugauucagggaucuuucuucuaaga

SEQ ID NO: 458999 - RNA, 64 nt, Homo Sapiens
uuuuuucagugagcguggugacugcagagguuagugcugugaaaagcugggcuaaauauucuuu

SEQ ID NO: 459000 - RNA, 64 nt, Homo Sapiens
acucugaaaaggccugggagcagaauggcuggccugcugugagcaggagaggagauucuaagaa

SEQ ID NO: 459001 - RNA, 64 nt, Homo Sapiens
aauuaccuuugcuccucuccugugauucccaccaugcugugacccucagcugucucccuuugcu

SEQ ID NO: 459002 - RNA, 64 nt, Homo Sapiens
ccuuagccuccugagcaucugggacuacagccauugcugugaauuacgugagggaaagauauug

SEQ ID NO: 459003 - RNA, 64 nt, Homo Sapiens
ccugcauucugcgagucugugcucauuaacaaugugcugugaccaugugacucagcaauccugc

SEQ ID NO: 459004 - RNA, 64 nt, Homo Sapiens
caugucccacuuuuuuaaccacuccgcacaucagugcugugaaggcaaccucaccauguauuuu

SEQ ID NO: 459005 - RNA, 64 nt, Homo Sapiens
auaaugucauacaaaaaauguauuuguuuuuuugugcugugagaauugauguuuguagauuaau

SEQ ID NO: 459006 - RNA, 64 nt, Homo Sapiens
aaucuaaaaucaaccaggcuuccaagcaugauuuugcugugacaguucugccaggccucgagca

SEQ ID NO: 459007 - RNA, 64 nt, Homo Sapiens
auucuaagaucaaccagguugagcaugaugauuuugcugugacacugccaggccccaagcaucu

SEQ ID NO: 459008 - RNA, 64 nt, Homo Sapiens
cuucuguuguacuuuaauuauuguuuugccuuguugcugugaccucccuaagacacugaagaua

SEQ ID NO: 459009 - RNA, 64 nt, Homo Sapiens
uaaaaagucaucuguucauuaggagaacucaaguugcugugacuuuucucauccaaaagacuca

SEQ ID NO: 459010 - RNA, 64 nt, Homo Sapiens
caaggauccucaccacccaaaggguggugggcacugcugugaccaccccagcugcagagucagu

SEQ ID NO: 459011 - RNA, 64 nt, Homo Sapiens
agcuuuaggcaccaucuguucccaucgcgccugcugcugugacccguuuuggaaaacuggugug

SEQ ID NO: 459012 - RNA, 64 nt, Homo Sapiens
uugaugcuggccagggaagcgauucgacucuggaugcugugagcuggagggucuugucugcugu

SEQ ID NO: 459013 - RNA, 64 nt, Homo Sapiens
cgacucuggaugcugugagcuggagggucuugucugcugugauucuuccccggguugguggcca

SEQ ID NO: 459014 - RNA, 64 nt, Homo Sapiens
ccgccccaccuugcagcuaaaugugauccugccuugcugugaaauuucuguaccuucaaccugg

SEQ ID NO: 459015 - RNA, 64 nt, Homo Sapiens
ugcacuccccacccugcucccuucccagagggauugcugugaaauuuuuuugguggcaaauaaa

SEQ ID NO: 459016 - RNA, 64 nt, Homo Sapiens
uaaaguaugucauuuaugcuuuuaaugucagugcugcugugaacacacauuuuguguagacaau

SEQ ID NO: 459017 - RNA, 64 nt, Homo Sapiens
cuguuuuaaguccauaccuuggcuuucgcagaaaugcugugauuacauagauggagaguuugag

SEQ ID NO: 459018 - RNA, 64 nt, Homo Sapiens
ugaaaucuuucccacaucucacaguuaugaaaaaugcugugacuuaaaugaccauuguuuauaa

SEQ ID NO: 459019 - RNA, 64 nt, Homo Sapiens
auucauguacagguuuuuauugcccuaauaaagcugcugugaacaagaguuguuuucaguuuuu

SEQ ID NO: 459020 - RNA, 64 nt, Homo Sapiens
uauuaaagaguuagccauauagauacuaaacagaugcugugauugcucuuagcauucaaacugc

SEQ ID NO: 459021 - RNA, 64 nt, Homo Sapiens
auuccgagcuguucccugggaagggggcuuccaaugcugugagacuggccuugcagagcucaag

SEQ ID NO: 459022 - RNA, 64 nt, Homo Sapiens
cuuugugcaaccagggcccacggcgccccuccugugcugugacgugugugucguggcuggcccc

SEQ ID NO: 459023 - RNA, 64 nt, Homo Sapiens
gcgccuaccgcccuggccgugucugucuggugugugcugugaaccccugcacccaaccccacau

SEQ ID NO: 459024 - RNA, 64 nt, Homo Sapiens
uccugcagacgucugguggcagcgucuacuccauugcugugacaaaucaccacauugucugugg

SEQ ID NO: 459025 - RNA, 64 nt, Homo Sapiens
uguggccuugagguuggugugcacaggcacuggcugcugugagugggggggcauggggcaguuu

SEQ ID NO: 459026 - RNA, 64 nt, Homo Sapiens
ggcagggugccugaccugugugccggcugcucacugcugugaccagcagccgagcccuuggccc

SEQ ID NO: 459027 - RNA, 64 nt, Homo Sapiens
accggugccucggucacucugggggcaguuuagaugcugugaaauuaaaccuguucuaagugua

SEQ ID NO: 459028 - RNA, 64 nt, Homo Sapiens
cccaagguuuugauggaguuuacacacugggagaugcugugagcagaacuuagaugugaaaauc

SEQ ID NO: 459029 - RNA, 64 nt, Homo Sapiens
aaccuuaaggguguguggauuaauaccgucagagugcugugaaacgucauuugcaaaacacaca

SEQ ID NO: 459030 - RNA, 64 nt, Homo Sapiens
caacucucuaguuacuugauuaaaaagcuaauauugcugugauugaaaagaaguacagauuuuu

SEQ ID NO: 459031 - RNA, 64 nt, Homo Sapiens
acaggcuuaagccacagcgcuuggcuucccaaagugcugugauugaccucaugcucugcccagc

SEQ ID NO: 459032 - RNA, 64 nt, Homo Sapiens
auagaaaucuuggucagggcggugguguguucugugcugugacuuauacacuuucccacguuga

SEQ ID NO: 459033 - RNA, 64 nt, Homo Sapiens
ugaaugaaggagaggcuccucgccaagucuguguugcugugaaagccuguguauuguuuaagcu

SEQ ID NO: 459034 - RNA, 64 nt, Homo Sapiens
guuuugacagagcacuuuauuccagcugaaaaccugcugugagaaaaaguagccaucuccuugu

SEQ ID NO: 459035 - RNA, 64 nt, Homo Sapiens
aguccucuuggacacagguugcgcuucagaauuuugcugugaacgcaggacauuccuucuauga

SEQ ID NO: 459036 - RNA, 64 nt, Homo Sapiens
ggauuaauacagaaauuuaaucaugucugauuaauugcucuauuaaaauaaggggcauuuaaag

SEQ ID NO: 459037 - RNA, 64 nt, Homo Sapiens
uuguguugucuuagcuuuaaaacagucacaguucuugcucuaucauagaugaacaaauacuuuc

SEQ ID NO: 459038 - RNA, 64 nt, Homo Sapiens
ucauuuugccucuugggaaauuagcagauagucuuugcucuaaaugauaucugaguaaauagac

SEQ ID NO: 459039 - RNA, 64 nt, Homo Sapiens
augcuuucucuauagaaccacuaacauauggcuauugcucuaugauuuuuuuuuuuacauuagg

SEQ ID NO: 459040 - RNA, 64 nt, Homo Sapiens
guuuacauuaaaauccuuuaagccaaaaggaagcuugcucuauggauuuaaaugcaaacuucau

SEQ ID NO: 459041 - RNA, 64 nt, Homo Sapiens
gggacaacagggguuaaaaauaaacugauuuaauuugcucuauaguccuaaagagaauuauauc

SEQ ID NO: 459042 - RNA, 64 nt, Homo Sapiens
uaguuuuuuaacaugguagucuaaacuucaaggcuugcucuaucuccuagagcaauuuagagcu

SEQ ID NO: 459043 - RNA, 64 nt, Homo Sapiens
cucucggcguuccagcauccugucaauuucccuuuugcucuagaggaugcauguuuauuugagg

SEQ ID NO: 459044 - RNA, 64 nt, Homo Sapiens
ucauucuagugcccgguguguuggcaucaucuuuuugcucuagcccuuccucuccaaaauaaaa

SEQ ID NO: 459045 - RNA, 64 nt, Homo Sapiens; identical to SEQ ID NO: 368876

SEQ ID NO: 459046 - RNA, 64 nt, Homo Sapiens; identical to SEQ ID NO: 368877

SEQ ID NO: 459047 - RNA, 64 nt, Homo Sapiens; identical to SEQ ID NO: 368878

SEQ ID NO: 459048 - RNA, 64 nt, Homo Sapiens; identical to SEQ ID NO: 368879

SEQ ID NO: 459049 - RNA, 64 nt, Homo Sapiens; identical to SEQ ID NO: 368880

SEQ ID NO: 459050 - RNA, 64 nt, Homo Sapiens; identical to SEQ ID NO: 368881

SEQ ID NO: 459051 - RNA, 64 nt, Homo Sapiens; identical to SEQ ID NO: 368882

SEQ ID NO: 459052 - RNA, 64 nt, Homo Sapiens; identical to SEQ ID NO: 368883

SEQ ID NO: 459053 - RNA, 64 nt, Homo Sapiens; identical to SEQ ID NO: 368884

SEQ ID NO: 459054 - RNA, 64 nt, Homo Sapiens; identical to SEQ ID NO: 368885

SEQ ID NO: 459055 - RNA, 64 nt, Homo Sapiens; identical to SEQ ID NO: 368886

SEQ ID NO: 459056 - RNA, 64 nt, Homo Sapiens; identical to SEQ ID NO: 368887

SEQ ID NO: 459057 - RNA, 64 nt, Homo Sapiens; identical to SEQ ID NO: 368888

SEQ ID NO: 459058 - RNA, 64 nt, Homo Sapiens; identical to SEQ ID NO: 368889

SEQ ID NO: 459059 - RNA, 64 nt, Homo Sapiens; identical to SEQ ID NO: 368890

SEQ ID NO: 459060 - RNA, 51 nt, Homo Sapiens; identical to SEQ ID NO: 368891

SEQ ID NO: 459061 - RNA, 64 nt, Homo Sapiens; identical to SEQ ID NO: 368892

SEQ ID NO: 459062 - RNA, 64 nt, Homo Sapiens; identical to SEQ ID NO: 368893

SEQ ID NO: 459063 - RNA, 64 nt, Homo Sapiens; identical to SEQ ID NO: 368894

SEQ ID NO: 459064 - RNA, 64 nt, Homo Sapiens; identical to SEQ ID NO: 368895

SEQ ID NO: 459065 - RNA, 64 nt, Homo Sapiens; identical to SEQ ID NO: 368896

SEQ ID NO: 459066 - RNA, 64 nt, Homo Sapiens; identical to SEQ ID NO: 368897

SEQ ID NO: 459067 - RNA, 64 nt, Homo Sapiens; identical to SEQ ID NO: 368898

SEQ ID NO: 459068 - RNA, 64 nt, Homo Sapiens; identical to SEQ ID NO: 368899

SEQ ID NO: 459069 - RNA, 64 nt, Homo Sapiens; identical to SEQ ID NO: 368900

SEQ ID NO: 459070 - RNA, 64 nt, Homo Sapiens; identical to SEQ ID NO: 368901

SEQ ID NO: 459071 - RNA, 64 nt, Homo Sapiens; identical to SEQ ID NO: 104428

SEQ ID NO: 459072 - RNA, 64 nt, Homo Sapiens; identical to SEQ ID NO: 104429

SEQ ID NO: 459073 - RNA, 64 nt, Homo Sapiens; identical to SEQ ID NO: 104430

SEQ ID NO: 459074 - RNA, 64 nt, Homo Sapiens; identical to SEQ ID NO: 104431

SEQ ID NO: 459075 - RNA, 64 nt, Homo Sapiens; identical to SEQ ID NO: 104432

SEQ ID NO: 459076 - RNA, 64 nt, Homo Sapiens; identical to SEQ ID NO: 104433

SEQ ID NO: 459077 - RNA, 64 nt, Homo Sapiens; identical to SEQ ID NO: 104434

SEQ ID NO: 459078 - RNA, 64 nt, Homo Sapiens; identical to SEQ ID NO: 104435

SEQ ID NO: 459079 - RNA, 64 nt, Homo Sapiens; identical to SEQ ID NO: 104436

SEQ ID NO: 459080 - RNA, 64 nt, Homo Sapiens; identical to SEQ ID NO: 104437

SEQ ID NO: 459081 - RNA, 64 nt, Homo Sapiens; identical to SEQ ID NO: 104438

SEQ ID NO: 459082 - RNA, 64 nt, Homo Sapiens; identical to SEQ ID NO: 104439

SEQ ID NO: 459083 - RNA, 64 nt, Homo Sapiens; identical to SEQ ID NO: 104440

SEQ ID NO: 459084 - RNA, 64 nt, Homo Sapiens; identical to SEQ ID NO: 104441

SEQ ID NO: 459085 - RNA, 64 nt, Homo Sapiens; identical to SEQ ID NO: 104442

SEQ ID NO: 459086 - RNA, 64 nt, Homo Sapiens; identical to SEQ ID NO: 104443

SEQ ID NO: 459087 - RNA, 64 nt, Homo Sapiens; identical to SEQ ID NO: 104444

SEQ ID NO: 459088 - RNA, 64 nt, Homo Sapiens; identical to SEQ ID NO: 104445

SEQ ID NO: 459089 - RNA, 64 nt, Homo Sapiens; identical to SEQ ID NO: 104446

SEQ ID NO: 459090 - RNA, 64 nt, Homo Sapiens; identical to SEQ ID NO: 104447

SEQ ID NO: 459091 - RNA, 64 nt, Homo Sapiens; identical to SEQ ID NO: 104448

SEQ ID NO: 459092 - RNA, 64 nt, Homo Sapiens; identical to SEQ ID NO: 104449

SEQ ID NO: 459093 - RNA, 64 nt, Homo Sapiens; identical to SEQ ID NO: 104450

SEQ ID NO: 459094 - RNA, 64 nt, Homo Sapiens; identical to SEQ ID NO: 104451

SEQ ID NO: 459095 - RNA, 64 nt, Homo Sapiens; identical to SEQ ID NO: 189185

SEQ ID NO: 459096 - RNA, 64 nt, Homo Sapiens; identical to SEQ ID NO: 189186

SEQ ID NO: 459097 - RNA, 64 nt, Homo Sapiens; identical to SEQ ID NO: 189187

SEQ ID NO: 459098 - RNA, 64 nt, Homo Sapiens; identical to SEQ ID NO: 189188

SEQ ID NO: 459099 - RNA, 64 nt, Homo Sapiens; identical to SEQ ID NO: 189189

SEQ ID NO: 459100 - RNA, 64 nt, Homo Sapiens; identical to SEQ ID NO: 189190

SEQ ID NO: 459101 - RNA, 64 nt, Homo Sapiens; identical to SEQ ID NO: 189191

SEQ ID NO: 459102 - RNA, 64 nt, Homo Sapiens; identical to SEQ ID NO: 189192

SEQ ID NO: 459103 - RNA, 64 nt, Homo Sapiens; identical to SEQ ID NO: 189193

SEQ ID NO: 459104 - RNA, 64 nt, Homo Sapiens; identical to SEQ ID NO: 189194

SEQ ID NO: 459105 - RNA, 64 nt, Homo Sapiens; identical to SEQ ID NO: 189195

SEQ ID NO: 459106 - RNA, 64 nt, Homo Sapiens; identical to SEQ ID NO: 189196

SEQ ID NO: 459107 - RNA, 64 nt, Homo Sapiens; identical to SEQ ID NO: 189197

SEQ ID NO: 459108 - RNA, 64 nt, Homo Sapiens; identical to SEQ ID NO: 189198

SEQ ID NO: 459109 - RNA, 64 nt, Homo Sapiens; identical to SEQ ID NO: 189199

SEQ ID NO: 459110 - RNA, 64 nt, Homo Sapiens; identical to SEQ ID NO: 189200

SEQ ID NO: 459111 - RNA, 64 nt, Homo Sapiens; identical to SEQ ID NO: 189201

SEQ ID NO: 459112 - RNA, 64 nt, Homo Sapiens; identical to SEQ ID NO: 189202

SEQ ID NO: 459113 - RNA, 64 nt, Homo Sapiens; identical to SEQ ID NO: 189203

SEQ ID NO: 459114 - RNA, 64 nt, Homo Sapiens; identical to SEQ ID NO: 189204

SEQ ID NO: 459115 - RNA, 64 nt, Homo Sapiens; identical to SEQ ID NO: 189205

SEQ ID NO: 459116 - RNA, 64 nt, Homo Sapiens; identical to SEQ ID NO: 189206

SEQ ID NO: 459117 - RNA, 64 nt, Homo Sapiens; identical to SEQ ID NO: 189207

SEQ ID NO: 459118 - RNA, 64 nt, Homo Sapiens; identical to SEQ ID NO: 189208

SEQ ID NO: 459119 - RNA, 64 nt, Homo Sapiens; identical to SEQ ID NO: 189209

SEQ ID NO: 459120 - RNA, 64 nt, Homo Sapiens; identical to SEQ ID NO: 189210

SEQ ID NO: 459121 - RNA, 64 nt, Homo Sapiens; identical to SEQ ID NO: 189211

SEQ ID NO: 459122 - RNA, 64 nt, Homo Sapiens; identical to SEQ ID NO: 189212

SEQ ID NO: 459123 - RNA, 64 nt, Homo Sapiens; identical to SEQ ID NO: 189213

SEQ ID NO: 459124 - RNA, 50 nt, Homo Sapiens; identical to SEQ ID NO: 189214

SEQ ID NO: 459125 - RNA, 64 nt, Homo Sapiens; identical to SEQ ID NO: 189215

SEQ ID NO: 459126 - RNA, 64 nt, Homo Sapiens; identical to SEQ ID NO: 189216

SEQ ID NO: 459127 - RNA, 64 nt, Homo Sapiens; identical to SEQ ID NO: 189217

SEQ ID NO: 459128 - RNA, 64 nt, Homo Sapiens; identical to SEQ ID NO: 189218

SEQ ID NO: 459129 - RNA, 64 nt, Homo Sapiens; identical to SEQ ID NO: 189219

SEQ ID NO: 459130 - RNA, 64 nt, Homo Sapiens; identical to SEQ ID NO: 189220

SEQ ID NO: 459131 - RNA, 64 nt, Homo Sapiens; identical to SEQ ID NO: 189221

SEQ ID NO: 459132 - RNA, 64 nt, Homo Sapiens; identical to SEQ ID NO: 189222

SEQ ID NO: 459133 - RNA, 64 nt, Homo Sapiens; identical to SEQ ID NO: 189223

SEQ ID NO: 459134 - RNA, 64 nt, Homo Sapiens; identical to SEQ ID NO: 189224

SEQ ID NO: 459135 - RNA, 64 nt, Homo Sapiens; identical to SEQ ID NO: 189225

SEQ ID NO: 459136 - RNA, 64 nt, Homo Sapiens; identical to SEQ ID NO: 189226

SEQ ID NO: 459137 - RNA, 64 nt, Homo Sapiens; identical to SEQ ID NO: 189227

SEQ ID NO: 459138 - RNA, 64 nt, Homo Sapiens; identical to SEQ ID NO: 189228

SEQ ID NO: 459139 - RNA, 64 nt, Homo Sapiens; identical to SEQ ID NO: 189229

SEQ ID NO: 459140 - RNA, 64 nt, Homo Sapiens; identical to SEQ ID NO: 189230

SEQ ID NO: 459141 - RNA, 64 nt, Homo Sapiens; identical to SEQ ID NO: 189231

SEQ ID NO: 459142 - RNA, 64 nt, Homo Sapiens; identical to SEQ ID NO: 189232

SEQ ID NO: 459143 - RNA, 64 nt, Homo Sapiens; identical to SEQ ID NO: 189233

SEQ ID NO: 459144 - RNA, 64 nt, Homo Sapiens; identical to SEQ ID NO: 189234

SEQ ID NO: 459145 - RNA, 64 nt, Homo Sapiens; identical to SEQ ID NO: 189235

SEQ ID NO: 459146 - RNA, 64 nt, Homo Sapiens; identical to SEQ ID NO: 189236

SEQ ID NO: 459147 - RNA, 64 nt, Homo Sapiens; identical to SEQ ID NO: 189237

SEQ ID NO: 459148 - RNA, 64 nt, Homo Sapiens; identical to SEQ ID NO: 189238

SEQ ID NO: 459149 - RNA, 64 nt, Homo Sapiens; identical to SEQ ID NO: 189239

SEQ ID NO: 459150 - RNA, 64 nt, Homo Sapiens; identical to SEQ ID NO: 189240

SEQ ID NO: 459151 - RNA, 64 nt, Homo Sapiens; identical to SEQ ID NO: 189241

SEQ ID NO: 459152 - RNA, 64 nt, Homo Sapiens; identical to SEQ ID NO: 189242

SEQ ID NO: 459153 - RNA, 64 nt, Homo Sapiens; identical to SEQ ID NO: 189243

SEQ ID NO: 459154 - RNA, 64 nt, Homo Sapiens; identical to SEQ ID NO: 189244

SEQ ID NO: 459155 - RNA, 64 nt, Homo Sapiens; identical to SEQ ID NO: 189245

SEQ ID NO: 459156 - RNA, 64 nt, Homo Sapiens; identical to SEQ ID NO: 189246

SEQ ID NO: 459157 - RNA, 64 nt, Homo Sapiens; identical to SEQ ID NO: 189247

SEQ ID NO: 459158 - RNA, 64 nt, Homo Sapiens; identical to SEQ ID NO: 189248

SEQ ID NO: 459159 - RNA, 64 nt, Homo Sapiens; identical to SEQ ID NO: 189249

SEQ ID NO: 459160 - RNA, 64 nt, Homo Sapiens; identical to SEQ ID NO: 189250

SEQ ID NO: 459161 - RNA, 64 nt, Homo Sapiens; identical to SEQ ID NO: 189251

SEQ ID NO: 459162 - RNA, 64 nt, Homo Sapiens; identical to SEQ ID NO: 189252

SEQ ID NO: 459163 - RNA, 64 nt, Homo Sapiens; identical to SEQ ID NO: 189253

SEQ ID NO: 459164 - RNA, 64 nt, Homo Sapiens; identical to SEQ ID NO: 189254

SEQ ID NO: 459165 - RNA, 64 nt, Homo Sapiens; identical to SEQ ID NO: 189255

SEQ ID NO: 459166 - RNA, 64 nt, Homo Sapiens; identical to SEQ ID NO: 189256

SEQ ID NO: 459167 - RNA, 64 nt, Homo Sapiens; identical to SEQ ID NO: 189257

SEQ ID NO: 459168 - RNA, 64 nt, Homo Sapiens; identical to SEQ ID NO: 189258

SEQ ID NO: 459169 - RNA, 64 nt, Homo Sapiens; identical to SEQ ID NO: 181919

SEQ ID NO: 459170 - RNA, 64 nt, Homo Sapiens; identical to SEQ ID NO: 181920

SEQ ID NO: 459171 - RNA, 64 nt, Homo Sapiens; identical to SEQ ID NO: 181921

SEQ ID NO: 459172 - RNA, 64 nt, Homo Sapiens; identical to SEQ ID NO: 181922

SEQ ID NO: 459173 - RNA, 64 nt, Homo Sapiens; identical to SEQ ID NO: 181923

SEQ ID NO: 459174 - RNA, 64 nt, Homo Sapiens; identical to SEQ ID NO: 181924

SEQ ID NO: 459175 - RNA, 64 nt, Homo Sapiens; identical to SEQ ID NO: 181925

SEQ ID NO: 459176 - RNA, 64 nt, Homo Sapiens; identical to SEQ ID NO: 181926

SEQ ID NO: 459177 - RNA, 64 nt, Homo Sapiens; identical to SEQ ID NO: 181927

SEQ ID NO: 459178 - RNA, 64 nt, Homo Sapiens; identical to SEQ ID NO: 181928

SEQ ID NO: 459179 - RNA, 64 nt, Homo Sapiens; identical to SEQ ID NO: 181929

SEQ ID NO: 459180 - RNA, 64 nt, Homo Sapiens; identical to SEQ ID NO: 181930

SEQ ID NO: 459181 - RNA, 64 nt, Homo Sapiens; identical to SEQ ID NO: 181931

SEQ ID NO: 459182 - RNA, 64 nt, Homo Sapiens; identical to SEQ ID NO: 181932

SEQ ID NO: 459183 - RNA, 64 nt, Homo Sapiens; identical to SEQ ID NO: 181933

SEQ ID NO: 459184 - RNA, 64 nt, Homo Sapiens; identical to SEQ ID NO: 181934

SEQ ID NO: 459185 - RNA, 64 nt, Homo Sapiens; identical to SEQ ID NO: 181935

SEQ ID NO: 459186 - RNA, 64 nt, Homo Sapiens; identical to SEQ ID NO: 181936

SEQ ID NO: 459187 - RNA, 64 nt, Homo Sapiens; identical to SEQ ID NO: 181937

SEQ ID NO: 459188 - RNA, 64 nt, Homo Sapiens; identical to SEQ ID NO: 181938

SEQ ID NO: 459189 - RNA, 64 nt, Homo Sapiens; identical to SEQ ID NO: 181939

SEQ ID NO: 459190 - RNA, 64 nt, Homo Sapiens; identical to SEQ ID NO: 181940

SEQ ID NO: 459191 - RNA, 64 nt, Homo Sapiens; identical to SEQ ID NO: 181941

SEQ ID NO: 459192 - RNA, 64 nt, Homo Sapiens; identical to SEQ ID NO: 181942

SEQ ID NO: 459193 - RNA, 64 nt, Homo Sapiens; identical to SEQ ID NO: 181943

SEQ ID NO: 459194 - RNA, 64 nt, Homo Sapiens; identical to SEQ ID NO: 181944

SEQ ID NO: 459195 - RNA, 64 nt, Homo Sapiens; identical to SEQ ID NO: 181945

SEQ ID NO: 459196 - RNA, 64 nt, Homo Sapiens; identical to SEQ ID NO: 181946

SEQ ID NO: 459197 - RNA, 64 nt, Homo Sapiens; identical to SEQ ID NO: 181947

SEQ ID NO: 459198 - RNA, 64 nt, Homo Sapiens; identical to SEQ ID NO: 181948

SEQ ID NO: 459199 - RNA, 64 nt, Homo Sapiens; identical to SEQ ID NO: 181949

SEQ ID NO: 459200 - RNA, 64 nt, Homo Sapiens; identical to SEQ ID NO: 181950

SEQ ID NO: 459201 - RNA, 64 nt, Homo Sapiens; identical to SEQ ID NO: 181951

SEQ ID NO: 459202 - RNA, 64 nt, Homo Sapiens; identical to SEQ ID NO: 181952

SEQ ID NO: 459203 - RNA, 64 nt, Homo Sapiens; identical to SEQ ID NO: 97841

SEQ ID NO: 459204 - RNA, 64 nt, Homo Sapiens; identical to SEQ ID NO: 97842

SEQ ID NO: 459205 - RNA, 64 nt, Homo Sapiens; identical to SEQ ID NO: 97843

SEQ ID NO: 459206 - RNA, 64 nt, Homo Sapiens; identical to SEQ ID NO: 97844

SEQ ID NO: 459207 - RNA, 64 nt, Homo Sapiens; identical to SEQ ID NO: 97845

SEQ ID NO: 459208 - RNA, 64 nt, Homo Sapiens; identical to SEQ ID NO: 97846

SEQ ID NO: 459209 - RNA, 64 nt, Homo Sapiens; identical to SEQ ID NO: 97847

SEQ ID NO: 459210 - RNA, 64 nt, Homo Sapiens; identical to SEQ ID NO: 97848

SEQ ID NO: 459211 - RNA, 64 nt, Homo Sapiens; identical to SEQ ID NO: 115592

SEQ ID NO: 459212 - RNA, 64 nt, Homo Sapiens; identical to SEQ ID NO: 115593

SEQ ID NO: 459213 - RNA, 64 nt, Homo Sapiens; identical to SEQ ID NO: 115594

SEQ ID NO: 459214 - RNA, 64 nt, Homo Sapiens; identical to SEQ ID NO: 115595

SEQ ID NO: 459215 - RNA, 64 nt, Homo Sapiens; identical to SEQ ID NO: 115596

SEQ ID NO: 459216 - RNA, 64 nt, Homo Sapiens; identical to SEQ ID NO: 115597

SEQ ID NO: 459217 - RNA, 64 nt, Homo Sapiens; identical to SEQ ID NO: 115598

SEQ ID NO: 459218 - RNA, 64 nt, Homo Sapiens; identical to SEQ ID NO: 115599

SEQ ID NO: 459219 - RNA, 64 nt, Homo Sapiens; identical to SEQ ID NO: 115600

SEQ ID NO: 459220 - RNA, 64 nt, Homo Sapiens; identical to SEQ ID NO: 115601

SEQ ID NO: 459221 - RNA, 64 nt, Homo Sapiens; identical to SEQ ID NO: 115602

SEQ ID NO: 459222 - RNA, 64 nt, Homo Sapiens; identical to SEQ ID NO: 115603

SEQ ID NO: 459223 - RNA, 64 nt, Homo Sapiens; identical to SEQ ID NO: 115604

SEQ ID NO: 459224 - RNA, 64 nt, Homo Sapiens; identical to SEQ ID NO: 115605

SEQ ID NO: 459225 - RNA, 64 nt, Homo Sapiens; identical to SEQ ID NO: 115606

SEQ ID NO: 459226 - RNA, 64 nt, Homo Sapiens; identical to SEQ ID NO: 115607

SEQ ID NO: 459227 - RNA, 64 nt, Homo Sapiens; identical to SEQ ID NO: 115608

SEQ ID NO: 459228 - RNA, 64 nt, Homo Sapiens; identical to SEQ ID NO: 115609

SEQ ID NO: 459229 - RNA, 64 nt, Homo Sapiens; identical to SEQ ID NO: 115610

SEQ ID NO: 459230 - RNA, 64 nt, Homo Sapiens; identical to SEQ ID NO: 115611

SEQ ID NO: 459231 - RNA, 64 nt, Homo Sapiens; identical to SEQ ID NO: 115612

SEQ ID NO: 459232 - RNA, 64 nt, Homo Sapiens; identical to SEQ ID NO: 115613

SEQ ID NO: 459233 - RNA, 64 nt, Homo Sapiens; identical to SEQ ID NO: 115614

SEQ ID NO: 459234 - RNA, 64 nt, Homo Sapiens; identical to SEQ ID NO: 115615

SEQ ID NO: 459235 - RNA, 52 nt, Homo Sapiens; identical to SEQ ID NO: 115616

SEQ ID NO: 459236 - RNA, 64 nt, Homo Sapiens; identical to SEQ ID NO: 115617

SEQ ID NO: 459237 - RNA, 64 nt, Homo Sapiens; identical to SEQ ID NO: 115618

SEQ ID NO: 459238 - RNA, 64 nt, Homo Sapiens; identical to SEQ ID NO: 115619

SEQ ID NO: 459239 - RNA, 64 nt, Homo Sapiens; identical to SEQ ID NO: 115620

SEQ ID NO: 459240 - RNA, 64 nt, Homo Sapiens; identical to SEQ ID NO: 115621

SEQ ID NO: 459241 - RNA, 64 nt, Homo Sapiens; identical to SEQ ID NO: 115622

SEQ ID NO: 459242 - RNA, 64 nt, Homo Sapiens; identical to SEQ ID NO: 115623

SEQ ID NO: 459243 - RNA, 64 nt, Homo Sapiens; identical to SEQ ID NO: 115624

SEQ ID NO: 459244 - RNA, 64 nt, Homo Sapiens; identical to SEQ ID NO: 115625

SEQ ID NO: 459245 - RNA, 64 nt, Homo Sapiens; identical to SEQ ID NO: 115626

SEQ ID NO: 459246 - RNA, 64 nt, Homo Sapiens; identical to SEQ ID NO: 115627

SEQ ID NO: 459247 - RNA, 64 nt, Homo Sapiens; identical to SEQ ID NO: 115628

SEQ ID NO: 459248 - RNA, 64 nt, Homo Sapiens; identical to SEQ ID NO: 115629

SEQ ID NO: 459249 - RNA, 64 nt, Homo Sapiens; identical to SEQ ID NO: 115630

SEQ ID NO: 459250 - RNA, 64 nt, Homo Sapiens; identical to SEQ ID NO: 115631

SEQ ID NO: 459251 - RNA, 64 nt, Homo Sapiens; identical to SEQ ID NO: 115632

SEQ ID NO: 459252 - RNA, 64 nt, Homo Sapiens; identical to SEQ ID NO: 115633

SEQ ID NO: 459253 - RNA, 64 nt, Homo Sapiens; identical to SEQ ID NO: 115634

SEQ ID NO: 459254 - RNA, 64 nt, Homo Sapiens; identical to SEQ ID NO: 115635

SEQ ID NO: 459255 - RNA, 64 nt, Homo Sapiens; identical to SEQ ID NO: 115636

SEQ ID NO: 459256 - RNA, 64 nt, Homo Sapiens; identical to SEQ ID NO: 115637

SEQ ID NO: 459257 - RNA, 64 nt, Homo Sapiens; identical to SEQ ID NO: 115636

SEQ ID NO: 459258 - RNA, 64 nt, Homo Sapiens; identical to SEQ ID NO: 115639

SEQ ID NO: 459259 - RNA, 64 nt, Homo Sapiens; identical to SEQ ID NO: 115640

SEQ ID NO: 459260 - RNA, 64 nt, Homo Sapiens; identical to SEQ ID NO: 115641

SEQ ID NO: 459261 - RNA, 64 nt, Homo Sapiens; identical to SEQ ID NO: 115642

SEQ ID NO: 459262 - RNA, 64 nt, Homo Sapiens; identical to SEQ ID NO: 115643

SEQ ID NO: 459263 - RNA, 64 nt, Homo Sapiens; identical to SEQ ID NO: 115644

SEQ ID NO: 459264 - RNA, 64 nt, Homo Sapiens; identical to SEQ ID NO: 115645

SEQ ID NO: 459265 - RNA, 64 nt, Homo Sapiens; identical to SEQ ID NO: 115646

SEQ ID NO: 459266 - RNA, 64 nt, Homo Sapiens; identical to SEQ ID NO: 115647

SEQ ID NO: 459267 - RNA, 64 nt, Homo Sapiens; identical to SEQ ID NO: 115648

SEQ ID NO: 459268 - RNA, 64 nt, Homo Sapiens; identical to SEQ ID NO: 115649

SEQ ID NO: 459269 - RNA, 64 nt, Homo Sapiens; identical to SEQ ID NO: 115650

SEQ ID NO: 459270 - RNA, 64 nt, Homo Sapiens; identical to SEQ ID NO: 115651

SEQ ID NO: 459271 - RNA, 64 nt, Homo Sapiens; identical to SEQ ID NO: 115652

SEQ ID NO: 459272 - RNA, 64 nt, Homo Sapiens; identical to SEQ ID NO: 115653

SEQ ID NO: 459273 - RNA, 64 nt, Homo Sapiens; identical to SEQ ID NO: 115654

SEQ ID NO: 459274 - RNA, 64 nt, Homo Sapiens; identical to SEQ ID NO: 115655

SEQ ID NO: 459275 - RNA, 64 nt, Homo Sapiens; identical to SEQ ID NO: 115656

SEQ ID NO: 459276 - RNA, 64 nt, Homo Sapiens; identical to SEQ ID NO: 115657

SEQ ID NO: 459277 - RNA, 64 nt, Homo Sapiens; identical to SEQ ID NO: 115658

SEQ ID NO: 459278 - RNA, 64 nt, Homo Sapiens; identical to SEQ ID NO: 115659

SEQ ID NO: 459279 - RNA, 64 nt, Homo Sapiens; identical to SEQ ID NO: 70830

SEQ ID NO: 459280 - RNA, 64 nt, Homo Sapiens; identical to SEQ ID NO: 70831

SEQ ID NO: 459281 - RNA, 64 nt, Homo Sapiens; identical to SEQ ID NO: 70832

SEQ ID NO: 459282 - RNA, 64 nt, Homo Sapiens; identical to SEQ ID NO: 70833

SEQ ID NO: 459283 - RNA, 64 nt, Homo Sapiens; identical to SEQ ID NO: 70834

SEQ ID NO: 459284 - RNA, 64 nt, Homo Sapiens; identical to SEQ ID NO: 70835

SEQ ID NO: 459285 - RNA, 64 nt, Homo Sapiens; identical to SEQ ID NO: 294959

SEQ ID NO: 459286 - RNA, 64 nt, Homo Sapiens; identical to SEQ ID NO: 294960

SEQ ID NO: 459287 - RNA, 64 nt, Homo Sapiens; identical to SEQ ID NO: 294961

SEQ ID NO: 459288 - RNA, 64 nt, Homo Sapiens; identical to SEQ ID NO: 294962

SEQ ID NO: 459289 - RNA, 64 nt, Homo Sapiens; identical to SEQ ID NO: 294963

SEQ ID NO: 459290 - RNA, 64 nt, Homo Sapiens; identical to SEQ ID NO: 294964

SEQ ID NO: 459291 - RNA, 64 nt, Homo Sapiens; identical to SEQ ID NO: 294965

SEQ ID NO: 459292 - RNA, 64 nt, Homo Sapiens; identical to SEQ ID NO: 294966

SEQ ID NO: 459293 - RNA, 64 nt, Homo Sapiens; identical to SEQ ID NO: 294967

SEQ ID NO: 459294 - RNA, 64 nt, Homo Sapiens; identical to SEQ ID NO: 294968

SEQ ID NO: 459295 - RNA, 64 nt, Homo Sapiens; identical to SEQ ID NO: 294969

SEQ ID NO: 459296 - RNA, 64 nt, Homo Sapiens; identical to SEQ ID NO: 294970

SEQ ID NO: 459297 - RNA, 64 nt, Homo Sapiens; identical to SEQ ID NO: 294971

SEQ ID NO: 459298 - RNA, 64 nt, Homo Sapiens; identical to SEQ ID NO: 294972

SEQ ID NO: 459299 - RNA, 64 nt, Homo Sapiens; identical to SEQ ID NO: 294973

SEQ ID NO: 459300 - RNA, 64 nt, Homo Sapiens; identical to SEQ ID NO: 294974

SEQ ID NO: 459301 - RNA, 64 nt, Homo Sapiens; identical to SEQ ID NO: 294975

SEQ ID NO: 459302 - RNA, 64 nt, Homo Sapiens; identical to SEQ ID NO: 294976

SEQ ID NO: 459303 - RNA, 64 nt, Homo Sapiens; identical to SEQ ID NO: 294977

SEQ ID NO: 459304 - RNA, 64 nt, Homo Sapiens; identical to SEQ ID NO: 294978

SEQ ID NO: 459305 - RNA, 64 nt, Homo Sapiens; identical to SEQ ID NO: 294979

SEQ ID NO: 459306 - RNA, 64 nt, Homo Sapiens; identical to SEQ ID NO: 294980

SEQ ID NO: 459307 - RNA, 64 nt, Homo Sapiens; identical to SEQ ID NO: 294981

SEQ ID NO: 459308 - RNA, 64 nt, Homo Sapiens; identical to SEQ ID NO: 294982

SEQ ID NO: 459309 - RNA, 64 nt, Homo Sapiens; identical to SEQ ID NO: 294983

SEQ ID NO: 459310 - RNA, 64 nt, Homo Sapiens; identical to SEQ ID NO: 294984

SEQ ID NO: 459311 - RNA, 64 nt, Homo Sapiens; identical to SEQ ID NO: 294985

SEQ ID NO: 459312 - RNA, 64 nt, Homo Sapiens; identical to SEQ ID NO: 294986

SEQ ID NO: 459313 - RNA, 64 nt, Homo Sapiens; identical to SEQ ID NO: 294987

SEQ ID NO: 459314 - RNA, 64 nt, Homo Sapiens; identical to SEQ ID NO: 294988

SEQ ID NO: 459315 - RNA, 64 nt, Homo Sapiens; identical to SEQ ID NO: 294989

SEQ ID NO: 459316 - RNA, 64 nt, Homo Sapiens
gguagguggauccagggaaaagcaguggggacggaaggcaaagagaccacucaacccccaccug

SEQ ID NO: 459317 - RNA, 64 nt, Homo Sapiens
gguucuuuucagcagagucuaguaguuucucuguaaggcaaaauaaucuaaaaagacuaaccug

SEQ ID NO: 459318 - RNA, 64 nt, Homo Sapiens
ugcaugagacacagccuucugccccauucuggaaaaggcaaagcccacaaaacuaaaaggccug

SEQ ID NO: 459319 - RNA, 64 nt, Homo Sapiens
gacaagacauccaggcagggaggcuggguuugaaaaggcaaaaaauucaguugagugaggcuga

SEQ ID NO: 459320 - RNA, 64 nt, Homo Sapiens
uaggaaaauacuugaaaugcaugucucaagcugcaaggcaaacuccauuccucauauuaaacua

SEQ ID NO: 459321 - RNA, 64 nt, Homo Sapiens
uacuuuguugauucucaguuacuguaggcaucaaaaggcaaaaaucaaaaaaaaaaaaaacaaa

SEQ ID NO: 459322 - RNA, 64 nt, Homo Sapiens
uuuuauggaugagcauaaaccuagucuuaguuuaaaggcaaacuaaaguugaggggaaauaauu

SEQ ID NO: 459323 - RNA, 64 nt, Homo Sapiens
aacacugucuacccuaaauaauuuuuauaugcucaaggcaaagcagggaauagaggcaauuagc

SEQ ID NO: 459324 - RNA, 64 nt, Homo Sapiens
aagauauaggaccaaaacaguaauaaaguggauaaaggcaaauuaaaucaguugacaauuagaa

SEQ ID NO: 459325 - RNA, 64 nt, Homo Sapiens
cgccuucugagaucaaaagggggguggaggaaaaaaggcaaaggaaacuaccaaaaaaaaagug

SEQ ID NO: 459326 - RNA, 64 nt, Homo Sapiens
uuauuuccccgucccuuaaaaagacaaaaaaaauaaggcaaaaggaaagcaacuaagacacugg

SEQ ID NO: 459327 - RNA, 64 nt, Homo Sapiens
cuuggacagcuuucugcccccucuuucacuaaggaaggcaaaugaagugaaaaaaaaaaaugcc

SEQ ID NO: 459328 - RNA, 64 nt, Homo Sapiens
auucccaccaucacuuaacguuuguaggcuuuuaaaggcaaaucuagcaucuuuccccuuuuaa

SEQ ID NO: 459329 - RNA, 64 nt, Homo Sapiens
gagcaaggagaacguuuaaucagaaacuuaguugaaggcaaagaucuggcaugccaaaaacuaa

SEQ ID NO: 459330 - RNA, 64 nt, Homo Sapiens
gggggaccaggucuucuugcugaccucgucuacaaaggcaaaggaaggcaaaggaagcugucuc

SEQ ID NO: 459331 - RNA, 64 nt, Homo Sapiens
gucuucuugcugaccucgucuacaaaggcaaaggaaggcaaaggaagcugucucggguguuucu

SEQ ID NO: 459332 - RNA, 64 nt, Homo Sapiens
guugaagauacuacggugugucuucauauaguaaaaggcaaaguucacuuuucaacuuccauau

SEQ ID NO: 459333 - RNA, 64 nt, Homo Sapiens
cuguuacaaauuuuuggcaucaaguuucuauuaaaaggcaaauguccuggauucacagugggaa

SEQ ID NO: 459334 - RNA, 64 nt, Homo Sapiens
cuuccaucacaacaagaaaugaguuuccaguugaaaggcaaaaauguuaaaauaugcuugacua

SEQ ID NO: 459335 - RNA, 64 nt, Homo Sapiens
ccccccaguuaugccuuccauccauuugggaaagaaggcaaagugaaggguacugaaaacacca

SEQ ID NO: 459336 - RNA, 64 nt, Homo Sapiens
acggauugaucugaucaaucccuucaaggagcugaaggcaaaauguguaaaaccccuaaaucag

SEQ ID NO: 459337 - RNA, 64 nt, Homo Sapiens
ugacuuaacauggaagcuauuucucucuuacuuaaaggcaaacugguuuuacagcucuggugug

SEQ ID NO: 459338 - RNA, 64 nt, Homo Sapiens
ucaagggaagaaauguaaaauaaugacaugcuaaaaggcaaauuucaguaagaagugauuaaaa

SEQ ID NO: 459339 - RNA, 64 nt, Homo Sapiens
aacuuugauaugguacagucauggccuaaaacacaaggcaaaacuucuuuauagcaaugcaaga

SEQ ID NO: 459340 - RNA, 64 nt, Homo Sapiens
ggaaacacgcgccagcggcaaggugccgaugcagaaggcaaauuguccuuguacaucugcauua

SEQ ID NO: 459341 - RNA, 64 nt, Homo Sapiens
guauuugaaacguaauuguuaaacagcaucaugaaaggcaaaaaacccguggcuccuaaggaaa

SEQ ID NO: 459342 - RNA, 64 nt, Homo Sapiens
guuguaugauuagaaauuacggucacuaccucacaaggcaaagucagaccuuuggcaauggggu

SEQ ID NO: 459343 - RNA, 64 nt, Homo Sapiens
gugacuugugucuauugaaagucugcuuacuuggaaggcaaagaacuuugaagaugaaucugga

SEQ ID NO: 459344 - RNA, 64 nt, Homo Sapiens
uugaaguuguuuaucaacuuccuuuucucacaaaaaggcaaauagugguaaauacugugaaaua

SEQ ID NO: 459345 - RNA, 64 nt, Homo Sapiens
aaagaaccacucauugucuuuuugugacccugagaaggcaaaagcuccagucauuguaguauug

SEQ ID NO: 459346 - RNA, 64 nt, Homo Sapiens
aucacuucaccucuggugccucuuuguauauuuuaaggcaaauauuuuuuucaaaguaggcaau

SEQ ID NO: 459347 - RNA, 64 nt, Homo Sapiens
cucaggguuugaagggagacucgcagaagugaggaaggcaaauaucaagauucuguuccccucu

SEQ ID NO: 459348 - RNA, 64 nt, Homo Sapiens
cagagcaaaacucugucucaaaaaaaaaaaaaaaaaggcaaaauuaaagaauuucaagucccua

SEQ ID NO: 459349 - RNA, 64 nt, Homo Sapiens
cugaccucuacaguucauauuugcagugacauaaaaggcaaagaggagcuggcauggugguaca

SEQ ID NO: 459350 - RNA, 64 nt, Homo Sapiens
aauggcuacuuuuuucuaugucccaaucugagaaaaggcaaaaguaauaugaaagaaaaaugga

SEQ ID NO: 459351 - RNA, 64 nt, Homo Sapiens
auuuggacaaucugcaaaauaaucuuggagucaaaaggcaaaucuuucaggaucagaucaauac

SEQ ID NO: 459352 - RNA, 64 nt, Homo Sapiens
uguaaaggagucaaaacuacaucuugaaauuaagaaggcaaaaauuuugaaggcaaaauugcaa

SEQ ID NO: 459353 - RNA, 64 nt, Homo Sapiens
ugcaaaucuugaaauuaagaaaagaucuguuuugaaggcaaaauuacuuuuuacaauuaaaaaa

SEQ ID NO: 459354 - RNA, 64 nt, Homo Sapiens; identical to SEQ ID NO: 82704

SEQ ID NO: 459355 - RNA, 64 nt, Homo Sapiens; identical to SEQ ID NO: 82705

SEQ ID NO: 459356 - RNA, 64 nt, Homo Sapiens; identical to SEQ ID NO: 82706

SEQ ID NO: 459357 - RNA, 64 nt, Homo Sapiens; identical to SEQ ID NO: 82707

SEQ ID NO: 459358 - RNA, 64 nt, Homo Sapiens; identical to SEQ ID NO: 82708

SEQ ID NO: 459359 - RNA, 64 nt, Homo Sapiens; identical to SEQ ID NO: 82709

SEQ ID NO: 459360 - RNA, 64 nt, Homo Sapiens; identical to SEQ ID NO: 82710

SEQ ID NO: 459361 - RNA, 64 nt, Homo Sapiens; identical to SEQ ID NO: 82711

SEQ ID NO: 459362 - RNA, 64 nt, Homo Sapiens; identical to SEQ ID NO: 82712

SEQ ID NO: 459363 - RNA, 64 nt, Homo Sapiens; identical to SEQ ID NO: 82713

SEQ ID NO: 459364 - RNA, 64 nt, Homo Sapiens; identical to SEQ ID NO: 82714

SEQ ID NO: 459365 - RNA, 64 nt, Homo Sapiens; identical to SEQ ID NO: 82715

SEQ ID NO: 459366 - RNA, 64 nt, Homo Sapiens; identical to SEQ ID NO: 82716

SEQ ID NO: 459367 - RNA, 64 nt, Homo Sapiens; identical to SEQ ID NO: 82717

SEQ ID NO: 459368 - RNA, 64 nt, Homo Sapiens; identical to SEQ ID NO: 82718

SEQ ID NO: 459369 - RNA, 64 nt, Homo Sapiens; identical to SEQ ID NO: 82719

SEQ ID NO: 459370 - RNA, 64 nt, Homo Sapiens; identical to SEQ ID NO: 82720

SEQ ID NO: 459371 - RNA, 64 nt, Homo Sapiens; identical to SEQ ID NO: 82721

SEQ ID NO: 459372 - RNA, 64 nt, Homo Sapiens; identical to SEQ ID NO: 82722

SEQ ID NO: 459373 - RNA, 64 nt, Homo Sapiens; identical to SEQ ID NO: 82723

SEQ ID NO: 459374 - RNA, 64 nt, Homo Sapiens; identical to SEQ ID NO: 82724

SEQ ID NO: 459375 - RNA, 64 nt, Homo Sapiens; identical to SEQ ID NO: 82725

SEQ ID NO: 459376 - RNA, 64 nt, Homo Sapiens; identical to SEQ ID NO: 82726

SEQ ID NO: 459377 - RNA, 64 nt, Homo Sapiens; identical to SEQ ID NO: 82727

SEQ ID NO: 459378 - RNA, 64 nt, Homo Sapiens; identical to SEQ ID NO: 82728

SEQ ID NO: 459379 - RNA, 64 nt, Homo Sapiens; identical to SEQ ID NO: 82729

SEQ ID NO: 459380 - RNA, 64 nt, Homo Sapiens; identical to SEQ ID NO: 82730

SEQ ID NO: 459381 - RNA, 64 nt, Homo Sapiens; identical to SEQ ID NO: 82731

SEQ ID NO: 459382 - RNA, 64 nt, Homo Sapiens; identical to SEQ ID NO: 82732

SEQ ID NO: 459383 - RNA, 64 nt, Homo Sapiens; identical to SEQ ID NO: 82733

SEQ ID NO: 459384 - RNA, 64 nt, Homo Sapiens; identical to SEQ ID NO: 82734

SEQ ID NO: 459385 - RNA, 64 nt, Homo Sapiens; identical to SEQ ID NO: 82735

SEQ ID NO: 459386 - RNA, 64 nt, Homo Sapiens; identical to SEQ ID NO: 82736

SEQ ID NO: 459387 - RNA, 64 nt, Homo Sapiens; identical to SEQ ID NO: 82737

SEQ ID NO: 459388 - RNA, 64 nt, Homo Sapiens; identical to SEQ ID NO: 82738

SEQ ID NO: 459389 - RNA, 64 nt, Homo Sapiens; identical to SEQ ID NO: 82739

SEQ ID NO: 459390 - RNA, 64 nt, Homo Sapiens; identical to SEQ ID NO: 82740

SEQ ID NO: 459391 - RNA, 64 nt, Homo Sapiens; identical to SEQ ID NO: 82741

SEQ ID NO: 459392 - RNA, 64 nt, Homo Sapiens; identical to SEQ ID NO: 82742

SEQ ID NO: 459393 - RNA, 64 nt, Homo Sapiens; identical to SEQ ID NO: 82743

SEQ ID NO: 459394 - RNA, 64 nt, Homo Sapiens; identical to SEQ ID NO: 82744

SEQ ID NO: 459395 - RNA, 64 nt, Homo Sapiens; identical to SEQ ID NO: 82745

SEQ ID NO: 459396 - RNA, 64 nt, Homo Sapiens; identical to SEQ ID NO: 82746

SEQ ID NO: 459397 - RNA, 64 nt, Homo Sapiens; identical to SEQ ID NO: 82747

SEQ ID NO: 459398 - RNA, 64 nt, Homo Sapiens; identical to SEQ ID NO: 82748

SEQ ID NO: 459399 - RNA, 64 nt, Homo Sapiens; identical to SEQ ID NO: 82749

SEQ ID NO: 459400 - RNA, 64 nt, Homo Sapiens; identical to SEQ ID NO: 82750

SEQ ID NO: 459401 - RNA, 64 nt, Homo Sapiens; identical to SEQ ID NO: 82751

SEQ ID NO: 459402 - RNA, 64 nt, Homo Sapiens; identical to SEQ ID NO: 82752

SEQ ID NO: 459403 - RNA, 64 nt, Homo Sapiens; identical to SEQ ID NO: 82753

SEQ ID NO: 459404 - RNA, 64 nt, Homo Sapiens; identical to SEQ ID NO: 82754

SEQ ID NO: 459405 - RNA, 64 nt, Homo Sapiens; identical to SEQ ID NO: 82755

SEQ ID NO: 459406 - RNA, 64 nt, Homo Sapiens; identical to SEQ ID NO: 82756

SEQ ID NO: 459407 - RNA, 64 nt, Homo Sapiens; identical to SEQ ID NO: 82757

SEQ ID NO: 459408 - RNA, 64 nt, Homo Sapiens; identical to SEQ ID NO: 82758

SEQ ID NO: 459409 - RNA, 64 nt, Homo Sapiens; identical to SEQ ID NO: 82759

SEQ ID NO: 459410 - RNA, 64 nt, Homo Sapiens; identical to SEQ ID NO: 82760

SEQ ID NO: 459411 - RNA, 64 nt, Homo Sapiens; identical to SEQ ID NO: 82761

SEQ ID NO: 459412 - RNA, 64 nt, Homo Sapiens; identical to SEQ ID NO: 82762

SEQ ID NO: 459413 - RNA, 64 nt, Homo Sapiens; identical to SEQ ID NO: 82763

SEQ ID NO: 459414 - RNA, 64 nt, Homo Sapiens; identical to SEQ ID NO: 82764

SEQ ID NO: 459415 - RNA, 64 nt, Homo Sapiens; identical to SEQ ID NO: 82765

SEQ ID NO: 459416 - RNA, 64 nt, Homo Sapiens; identical to SEQ ID NO: 82766

SEQ ID NO: 459417 - RNA, 64 nt, Homo Sapiens; identical to SEQ ID NO: 82767

SEQ ID NO: 459418 - RNA, 64 nt, Homo Sapiens; identical to SEQ ID NO: 82768

SEQ ID NO: 459419 - RNA, 64 nt, Homo Sapiens; identical to SEQ ID NO: 82769

SEQ ID NO: 459420 - RNA, 64 nt, Homo Sapiens; identical to SEQ ID NO: 82770

SEQ ID NO: 459421 - RNA, 64 nt, Homo Sapiens; identical to SEQ ID NO: 82771

SEQ ID NO: 459422 - RNA, 64 nt, Homo Sapiens; identical to SEQ ID NO: 82772

SEQ ID NO: 459423 - RNA, 64 nt, Homo Sapiens; identical to SEQ ID NO: 82773

SEQ ID NO: 459424 - RNA, 64 nt, Homo Sapiens; identical to SEQ ID NO: 82774

SEQ ID NO: 459425 - RNA, 64 nt, Homo Sapiens; identical to SEQ ID NO: 82775

SEQ ID NO: 459426 - RNA, 64 nt, Homo Sapiens; identical to SEQ ID NO: 82776

SEQ ID NO: 459427 - RNA, 64 nt, Homo Sapiens; identical to SEQ ID NO: 82777

SEQ ID NO: 459428 - RNA, 64 nt, Homo Sapiens; identical to SEQ ID NO: 82778

SEQ ID NO: 459429 - RNA, 64 nt, Homo Sapiens; identical to SEQ ID NO: 82779

SEQ ID NO: 459430 - RNA, 64 nt, Homo Sapiens; identical to SEQ ID NO: 82780

SEQ ID NO: 459431 - RNA, 64 nt, Homo Sapiens; identical to SEQ ID NO: 82781

SEQ ID NO: 459432 - RNA, 64 nt, Homo Sapiens; identical to SEQ ID NO: 82782

SEQ ID NO: 459433 - RNA, 64 nt, Homo Sapiens; identical to SEQ ID NO: 82783

SEQ ID NO: 459434 - RNA, 64 nt, Homo Sapiens; identical to SEQ ID NO: 82784

SEQ ID NO: 459435 - RNA, 64 nt, Homo Sapiens; identical to SEQ ID NO: 82785

SEQ ID NO: 459436 - RNA, 64 nt, Homo Sapiens; identical to SEQ ID NO: 82786

SEQ ID NO: 459437 - RNA, 64 nt, Homo Sapiens; identical to SEQ ID NO: 82787

SEQ ID NO: 459438 - RNA, 64 nt, Homo Sapiens; identical to SEQ ID NO: 82788

SEQ ID NO: 459439 - RNA, 64 nt, Homo Sapiens; identical to SEQ ID NO: 82789

SEQ ID NO: 459440 - RNA, 64 nt, Homo Sapiens; identical to SEQ ID NO: 82790

SEQ ID NO: 459441 - RNA, 64 nt, Homo Sapiens; identical to SEQ ID NO: 107827

SEQ ID NO: 459442 - RNA, 64 nt, Homo Sapiens; identical to SEQ ID NO: 107828

SEQ ID NO: 459443 - RNA, 64 nt, Homo Sapiens; identical to SEQ ID NO: 107829

SEQ ID NO: 459444 - RNA, 64 nt, Homo Sapiens; identical to SEQ ID NO: 107830

SEQ ID NO: 459445 - RNA, 64 nt, Homo Sapiens; identical to SEQ ID NO: 107831

SEQ ID NO: 459446 - RNA, 64 nt, Homo Sapiens; identical to SEQ ID NO: 107832

SEQ ID NO: 459447 - RNA, 64 nt, Homo Sapiens; identical to SEQ ID NO: 107833

SEQ ID NO: 459448 - RNA, 64 nt, Homo Sapiens; identical to SEQ ID NO: 107834

SEQ ID NO: 459449 - RNA, 64 nt, Homo Sapiens; identical to SEQ ID NO: 107835

SEQ ID NO: 459450 - RNA, 64 nt, Homo Sapiens; identical to SEQ ID NO: 107836

SEQ ID NO: 459451 - RNA, 64 nt, Homo Sapiens; identical to SEQ ID NO: 107837

SEQ ID NO: 459452 - RNA, 64 nt, Homo Sapiens; identical to SEQ ID NO: 107838

SEQ ID NO: 459453 - RNA, 64 nt, Homo Sapiens; identical to SEQ ID NO: 107839

SEQ ID NO: 459454 - RNA, 64 nt, Homo Sapiens; identical to SEQ ID NO: 107840

SEQ ID NO: 459455 - RNA, 64 nt, Homo Sapiens
uuacgaauccugaaaauuaugcuagcaugauuuuuuuauauauagaaguuuaaaaauaaaccag

SEQ ID NO: 459456 - RNA, 64 nt, Homo Sapiens
uuuuuagugcuaaauucuuguuaaauaauguaguuuuauauagcugauagaccaaccuauaucc

SEQ ID NO: 459457 - RNA, 64 nt, Homo Sapiens
aacaucaaaauguauccaagccauuuaaaaaauauuuauauauacauaguagcaaauaguuuua

SEQ ID NO: 459458 - RNA, 64 nt, Homo Sapiens
uaucgcauuuuuuauuacaaaugaauauuucauguuuauauaagcuguaaucaaaaaggacuag

SEQ ID NO: 459459 - RNA, 64 nt, Homo Sapiens
agugagaugcacacuuauauauauacuguauauauuuauauauuuauauauauauuucauauau

SEQ ID NO: 459460 - RNA, 64 nt, Homo Sapiens
gcacacuuauauauauacuguauauauuuauauauuuauauauauauuucauauauauauauaa

SEQ ID NO: 459461 - RNA, 64 nt, Homo Sapiens
ugcuugguugauggccaugcaucuucagucagaauuuauauauaaauguaugcacccauuuuuu

SEQ ID NO: 459462 - RNA, 64 nt, Homo Sapiens
ugcuauugaugcauaacauacugcuauuggucuuuuuauauaaauauauauauauauauacaua

SEQ ID NO: 459463 - RNA, 64 nt, Homo Sapiens
ucaucucucuccagacucuagguauauuuccaacuuuauauaucacaguauuuaaaaagacaug

SEQ ID NO: 459464 - RNA, 64 nt, Homo Sapiens
ugaaauuugaaaaccaccaaaaaucaagggaacuuuuauauauucaauuccuuuucugguguaa

SEQ ID NO: 459465 - RNA, 51 nt, Homo Sapiens
cucaagaacuuuggaaauaauuuuauauauauauaaauaauauauauauau

SEQ ID NO: 459466 - RNA, 64 nt, Homo Sapiens
augaagaacguaaaugcacuguuuuuauuuuuauuuuauauaauuuaaauugacuuucccacug

SEQ ID NO: 459467 - RNA, 64 nt, Homo Sapiens
uguauguguuuuuaaaauauccacuuuugaucuauuuauauauacucuuuuauauauucuuuuu

SEQ ID NO: 459468 - RNA, 64 nt, Homo Sapiens
cuuuuuccacuuuugaucuaaaauguugcacucuuuuauauauuugaaauaauucucagcugcc

SEQ ID NO: 459469 - RNA, 64 nt, Homo Sapiens
gcaauauuuuguagugaaaaugugucucuguugcuuuauauaauagucuuuuucaggguuuuuu

SEQ ID NO: 459470 - RNA, 64 nt, Homo Sapiens
aagauguuuguucuugaaagguuucuaaacauauuuuauauauucaaauuucccacuucucccu

SEQ ID NO: 459471 - RNA, 64 nt, Homo Sapiens
caaaaacaucuauuugugacaggcgaagugccccuuuauauaucuaauaucugauuacuuuugc

SEQ ID NO: 459472 - RNA, 64 nt, Homo Sapiens
agccauuuagauaugcaguguuuuaauuacacauuuuauauaugacauaguguguauguuuggg

SEQ ID NO: 459473 - RNA, 64 nt, Homo Sapiens
uuugacuuuuuaaaaguucauucaggcuaauauuuuuauauauugguguuugaaaauuugccau

SEQ ID NO: 459474 - RNA, 64 nt, Homo Sapiens
cugccucuucaauuuggaaacaagcucuguuaccuuuauauacaaacauuucuguaaauuauca

SEQ ID NO: 459475 - RNA, 64 nt, Homo Sapiens
acacacuaaaauuauauuuuugguugguugauuguuuauauaaaaggaccaguagaauuuaaau

SEQ ID NO: 459476 - RNA, 64 nt, Homo Sapiens
uaaauauggcuuauuaaugguaagacuucauacauuuauauauggcaauuuuucuauuuuauau

SEQ ID NO: 459477 - RNA, 64 nt, Homo Sapiens
uuauuguaaauuuuuauguauuggaagaaaauaauuuauauaaauggauuauuaaauaucuagu

SEQ ID NO: 459478 - RNA, 64 nt, Homo Sapiens
uuuuaaaugcccuuucugcaguuggaagguuuucuuuauauacuauucccaccauggggagcga

SEQ ID NO: 459479 - RNA, 64 nt, Homo Sapiens
uuuugacacaagccuacugaaugcuguguauauauuuauauauaaauauaucuauuugagugaa

SEQ ID NO: 459480 - RNA, 64 nt, Homo Sapiens
aauuaucuuauuuaauuuuugcaauuauucuaauuuuauauauagagaaagugaccuauuuuuu

SEQ ID NO: 459481 - RNA, 64 nt, Homo Sapiens
uguacuaguugaugaaggaguuuuuuuuaaccuguuuauauaauuuugcagcagaagccaaauu

SEQ ID NO: 459482 - RNA, 64 nt, Homo Sapiens
auguauauaagacagguagugccugauuuacuacuuuauauaaaauaguaccuccuucaguuac

SEQ ID NO: 459483 - RNA, 64 nt, Homo Sapiens
auaauagcauagauuuuccuucaaaaaaugaacauuuauauaucuacaaaaauauggagaagag

SEQ ID NO: 459484 - RNA, 64 nt, Homo Sapiens
acauugguaagaaauauugauacugauauugauuuuuauauagguauuuauuucagaauugaua

SEQ ID NO: 459485 - RNA, 64 nt, Homo Sapiens
gauagaagacuguacaauuuuuauuucacacaguuuuauauauaaacauaaaacauccuuacuu

SEQ ID NO: 459486 - RNA, 64 nt, Homo Sapiens
gauauauguagcuuucuauauacauauguaaauauuuauauauaaacaagaaaguaucuauaua

SEQ ID NO: 459487 - RNA, 64 nt, Homo Sapiens
cuacaguuguccugauuucuuuucuaagacaguuuuuauauaguaugauaaaguuguaaauaau

SEQ ID NO: 459488 - RNA, 64 nt, Homo Sapiens
aaaaugauuccucuuggcaagccucugcuuacuuuuuauauagcggcaugagccaccgcgccug

SEQ ID NO: 459489 - RNA, 64 nt, Homo Sapiens
aucuguggcugcuuugaaaugcuauacucaucuguuuauauauuauaaagcuuuauuggaacua

SEQ ID NO: 459490 - RNA, 64 nt, Homo Sapiens
cuguaagcuaagaaugguuugccugcugccuguuuuuauauacccagcaugugggccaaaucca

SEQ ID NO: 459491 - RNA, 64 nt, Homo Sapiens
uggcgagaaccuaaguuucacuccucucucaguuuuuauauagacacugcauacaaucugaggc

SEQ ID NO: 459492 - RNA, 64 nt, Homo Sapiens
auuauaucaguccucuuucaaguucaaagccaaguuuauauacacauugguuuaccugugaaau

SEQ ID NO: 459493 - RNA, 64 nt, Homo Sapiens
ucacuuuuugucauguaaaaaaaguugaggacaauuuauauaacaaccauuuuuuuccuaugug

SEQ ID NO: 459494 - RNA, 64 nt, Homo Sapiens
ugguaauucauuaaaauugcgugacagcuauuuuuuuauauacacauacaaaccugugugccaa

SEQ ID NO: 459495 - RNA, 64 nt, Homo Sapiens
agaagcauaauaaaguucacaauaaggauaauacuuuauauaauguauaaaguauauauaauau

SEQ ID NO: 459496 - RNA, 64 nt, Homo Sapiens
auucugauugguaaaauuaaagaggaaauuaaucuuuauauauuauuucuugcagaaacauuca

SEQ ID NO: 459497 - RNA, 64 nt, Homo Sapiens
cggaaacaaaggcuuaaugaauuuauggcagguuuuuauauaauaacaaauaaauuaaaggaaa

SEQ ID NO: 459498 - RNA, 64 nt, Homo Sapiens
gcccuugauuuuaaaaauguguccauuguugcauuuuauauauauguaaguaaucauuuuggga

SEQ ID NO: 459499 - RNA, 64 nt, Homo Sapiens
uacccauuugcuaaaaauaaauauaaguugucucuuuauauaaaucccucaaaaugcagagaaa

SEQ ID NO: 459500 - RNA, 64 nt, Homo Sapiens
gugcuuguauuuugauugugauguuuccauugcuuuuauauaguauuuuuaggagguuuuuaga

SEQ ID NO: 459501 - RNA, 64 nt, Homo Sapiens
aucugauaccuugauguaauaauuuuauuguucauuuauauaaaguuuaaauaaauaaaaauug

SEQ ID NO: 459502 - RNA, 64 nt, Homo Sapiens
uuuaguuccacaugaaauaacuuuuuagucaucuuuuauauacucuuuuuaaagucuaacaaau

SEQ ID NO: 459503 - RNA, 64 nt, Homo Sapiens
caggaaaauacauuugacacaagagagaauacauuuuauauaaauaauaaaacggcuauauuug

SEQ ID NO: 459504 - RNA, 64 nt, Homo Sapiens
aaauaaugguuuccauuuuauugugauuaauuaauuuauauauguucuuagccauggagagcau

SEQ ID NO: 459505 - RNA, 64 nt, Homo Sapiens
cuagggagauucaaauacaguguacaccguucauuuuauauagagccauuuuuccaacagaugc

SEQ ID NO: 459506 - RNA, 64 nt, Homo Sapiens
cuugaauaaaagguuuauuuaugaauucccagauuuuauauacucacccucuguggauauggau

SEQ ID NO: 459507 - RNA, 64 nt, Homo Sapiens
auugucauaugucauaguuugaguuaaaauuuucuuuauauaauaaaauuauauuugucucuua

SEQ ID NO: 459508 - RNA, 64 nt, Homo Sapiens
ccaugcuuguuuucucauucuuuuaauguuaaaguuuauauauuuuauuacaaaauaaaacauu

SEQ ID NO: 459509 - RNA, 64 nt, Homo Sapiens
agucucuuaucaggaaauagagaugauguggauauuuauauauuacauauauaaccaccagacu

SEQ ID NO: 459510 - RNA, 64 nt, Homo Sapiens
uuuauauauuacauauauaaccaccagacuccauuuuauauauuagcauuuuccuugcuuaugg

SEQ ID NO: 459511 - RNA, 64 nt, Homo Sapiens
auagaauugcagucauuuggugcucugcuaaccauuuauauaaaacuuaaaaacaagagaaaag

SEQ ID NO: 459512 - RNA, 64 nt, Homo Sapiens
gaugugaauagguuauaugcaagcacuaugcccuuuuauauaagugacuugaacaucugugccc

SEQ ID NO: 459513 - RNA, 64 nt, Homo Sapiens
ucuucauuuaauuccucauagaaucccagucaccuuuauauaucauauuauuggaagagauuca

SEQ ID NO: 459514 - RNA, 64 nt, Homo Sapiens
auuuuuauucacucuucauagaaucacaauuaccuuuauauaucauauguuauuggaagagauu

SEQ ID NO: 459515 - RNA, 64 nt, Homo Sapiens
auauauauuauauauuuagcuuauauauuauauauuuauauauacuugguaaaaacguauguau

SEQ ID NO: 459516 - RNA, 64 nt, Homo Sapiens
auauauuuauauauaauauauaaaaacguauguauuuauauauuaaaaauaaaacauuucuugg

SEQ ID NO: 459517 - RNA, 64 nt, Homo Sapiens
aauguauucuuuuaguuuuuuuccugacugcuaguuuauauagagaagcuagaaaacaggcaaa

SEQ ID NO: 459518 - RNA, 64 nt, Homo Sapiens
aauauaaaaauuuguuaaaguguauauucuuauauuuauauauauauuaguuaugugcaagcuu

SEQ ID NO: 459519 - RNA, 64 nt, Homo Sapiens
accuuauuugaucuucacaacuucaaaauguauuuuuauauauucauguagaccgcuuuauagg

SEQ ID NO: 459520 - RNA, 64 nt, Homo Sapiens
uuuauguggcacacaauccuauaaaugugauuuuuuuauauaaguuaaagagacaaauaguagg

SEQ ID NO: 459521 - RNA, 64 nt, Homo Sapiens
gacauagauccucugauauacaauuagagauauuuuuauauagaccccaagcauucugugcaua

SEQ ID NO: 459522 - RNA, 64 nt, Homo Sapiens
uuugguuuaccuggggauccaauugauguauauguuuauauacuggguucuuguuuuauauacc

SEQ ID NO: 459523 - RNA, 64 nt, Homo Sapiens
aauugauguauauguuuauauacuggguucuuguuuuauauaccuggcuuuuacuuuauuaaua

SEQ ID NO: 459524 - RNA, 64 nt, Homo Sapiens
uaguagaagugauaaauuguguuauauaugauaauuuauauaaaaccacuaauuguuccguuaa

SEQ ID NO: 459525 - RNA, 64 nt, Homo Sapiens
acucuuuagcaauauauaacacaguauaugcuuuuuuauauauucaauguuagcccaagucuga

SEQ ID NO: 459526 - RNA, 64 nt, Homo Sapiens
gacguaaaaauucaaauuauuuuaaaaggcaaaauuuauauacauaugugcuuuuuuucuauau

SEQ ID NO: 459527 - RNA, 64 nt, Homo Sapiens
auuucugcauuuuacuugcauuaaaagaaaccucuuuauauacuacaguuguuccuaucucucc

SEQ ID NO: 459528 - RNA, 64 nt, Homo Sapiens
guaccuguuguauguccuaaacuuauuagaaaauuuuauauacuuuuuuacauguuggggggca

SEQ ID NO: 459529 - RNA, 64 nt, Homo Sapiens
guauauuagaauuuuccuagaagaagagagcuuuuuuauauacacuagucuucccugggaaacu

SEQ ID NO: 459530 - RNA, 64 nt, Homo Sapiens
guuuuauuaacuuucuccuacagaaaauuaauacuuuauauaguaugcuaagaacuauaaggua

SEQ ID NO: 459531 - RNA, 64 nt, Homo Sapiens
agguacauauuuuaaaagaaaggagucaggagcuuuuauauauaaaauaauuuugguccuuaaa

SEQ ID NO: 459532 - RNA, 64 nt, Homo Sapiens
caguuuuauaaggugauacugggcugcauuguauuuuauauacuuaaagauucuuagcuaucaa

SEQ ID NO: 459533 - RNA, 64 nt, Homo Sapiens
cuguaaucaggauaacacaauccacaagcauuguuuuauauacagcuuucuccuagguuaauuu

SEQ ID NO: 459534 - RNA, 64 nt, Homo Sapiens
aauaaaacaugaacugcccaccuguaaagccaauuuuauauacuauuuuuuugccauaaugcuu

SEQ ID NO: 459535 - RNA, 64 nt, Homo Sapiens
cuuauaaugaaaagauauuuuaguugcagaaggcuuuauauauguucgauaaagugauauguaa

SEQ ID NO: 459536 - RNA, 64 nt, Homo Sapiens
uuagugcuucucaguguucucaguguaaauucuauuuauauacagcauauucacauacuacuuu

SEQ ID NO: 459537 - RNA, 64 nt, Homo Sapiens
uauacagcauauucacauacuacuuuccuuauauuuuauauaguucuaugacuguugaaacauc

SEQ ID NO: 459538 - RNA, 64 nt, Homo Sapiens
uaccaaaauuuaguaggcauguuuuucuaauaaauuuauauauuuguaaagaaaacaacagaaa

SEQ ID NO: 459539 - RNA, 64 nt, Homo Sapiens
aaaucuauacuuggcauccaacucaugaguggauuuuauauaggauggaacaggaagguauguc

SEQ ID NO: 459540 - RNA, 64 nt, Homo Sapiens
auauagguguaacaguuucccaguuaacuuugaauuuauauauuuagauuuaaaggauuaaaaa

SEQ ID NO: 459541 - RNA, 64 nt, Homo Sapiens
auuugcauaaaauuauuuuucauaacaguccuuuuuuauauauugguguaaacauaauauucuu

SEQ ID NO: 459542 - RNA, 64 nt, Homo Sapiens
uuuuuuuuuuggauggcucaaaauauggugcugcuuuauauaaaccuuacauuuauauagugca

SEQ ID NO: 459543 - RNA, 64 nt, Homo Sapiens
ucaaaauauggugcugcuuuauauaaaccuuacauuuauauagugcaccuaugagcaguugccu

SEQ ID NO: 459544 - RNA, 64 nt, Homo Sapiens
uugguuuaauuuauucaguuucauuaggacuauuuuuauauauuuauccucuucauuuucuccu

SEQ ID NO: 459545 - RNA, 64 nt, Homo Sapiens
uacuguauaaagaccucaaucuauccagaguauuuuuauauaauguuggaugaguuaggauuug

SEQ ID NO: 459546 - RNA, 64 nt, Homo Sapiens
uaaagagagucugagaaaugcaauugcuauucuuuuuauauacuuuuucagauuuuuuauaugc

SEQ ID NO: 459547 - RNA, 64 nt, Homo Sapiens
augcuucuuuacuacuuacaucauaaugcacaauuuuauauacugauuuuuucaaucaauguau

SEQ ID NO: 459548 - RNA, 64 nt, Homo Sapiens
uauuaaaaagguacuucucuuuaaauaacuauaauuuauauaucuaaaguuauuguuuucuaag

SEQ ID NO: 459549 - RNA, 64 nt, Homo Sapiens
uauaugcacguaucuauaugugugugaauauuuguuuauauacauauauacacguauguauaga

SEQ ID NO: 459550 - RNA, 64 nt, Homo Sapiens
gaagaugaagcucaauaauuguucacauuguucuuuuauauauauuuauauauauauauaaaaa

SEQ ID NO: 459551 - RNA, 64 nt, Homo Sapiens
cucaauaauuguucacauuguucuuuuauauauauuuauauauauauauaaaaauugggucuua

SEQ ID NO: 459552 - RNA, 64 nt, Homo Sapiens
aaccuuaaugggcuguuacagaaacuaguucguguuuauauacuauuuccuuugauguccuaua

SEQ ID NO: 459553 - RNA, 64 nt, Homo Sapiens
agauuuuuuccuguuuuaucugaaacauacuggauuuauauauguauaagcgccucaaugggga

SEQ ID NO: 459554 - RNA, 64 nt, Homo Sapiens
acguauacggcaccuucuugauggaauguauauuuuuauauaagagggagaggauauaagauua

SEQ ID NO: 459555 - RNA, 64 nt, Homo Sapiens
aacuauuuaauaaaaaugaaccuugacauuucuuuuuauauauaguuuauaugaauguagaaca

SEQ ID NO: 459556 - RNA, 64 nt, Homo Sapiens
uaaaagauacucuaggaugaggcacaaaccuguguuuauauauucugugcuugccuucugaagu

SEQ ID NO: 459557 - RNA, 64 nt, Homo Sapiens
auuuugcuugauuauuugcuauuguaagucauauuuuauauagcgcuaauuuuuuucaaaggug

SEQ ID NO: 459558 - RNA, 64 nt, Homo Sapiens
gagacauugugaaguuaaagugugaguaaacaaguuuauauagaagaaauuugauuuuagggau

SEQ ID NO: 459559 - RNA, 64 nt, Homo Sapiens
uuucaccuuuacuuucaaagcuugaauuuuucccuuuauauaaugacauaaugcuauuuaaagg

SEQ ID NO: 459560 - RNA, 64 nt, Homo Sapiens
auugaaacacuuucaaacucucuagauucauacauuuauauagcguaugcauauuuuuuucucc

SEQ ID NO: 459561 - RNA, 64 nt, Homo Sapiens
cuagaguacuguuaaugccccuuucccacagucuuuuauauaauuaaauauaugucaauacaca

SEQ ID NO: 459562 - RNA, 64 nt, Homo Sapiens
agugcuaaauaaauagaucuacauuuuguacauauuuauauaaaauuuaccuuuaaguauuuac

SEQ ID NO: 459563 - RNA, 64 nt, Homo Sapiens
acaugcaaccaauguauaucugaguuugaagauguuuauauaggguauuuuuuccaacugcccc

SEQ ID NO: 459564 - RNA, 64 nt, Homo Sapiens
auaacuauggucagggaauuuauaauauuauauuuuuauauacugaacugccauagaugcugga

SEQ ID NO: 459565 - RNA, 64 nt, Homo Sapiens
uauuuucaaaauauugauaagggaaguuauuacuuuuauauaguauucaacuuuuuucagguaa

SEQ ID NO: 459566 - RNA, 64 nt, Homo Sapiens
acuugagucugcuguaauugcuaaccuccagguuuuuauauauggaaaaaugugacuagacaug

SEQ ID NO: 459567 - RNA, 64 nt, Homo Sapiens
ccauaaaaauacaaaguaacaucgacaaguauauuuuauauauugucuuugcacaaauguacca

SEQ ID NO: 459568 - RNA, 64 nt, Homo Sapiens
gccauacaaaaacuuaacauuauguuuaaagauauuuauauauuuuugaacuguauucagguaa

SEQ ID NO: 459569 - RNA, 64 nt, Homo Sapiens
uuuccuguuuaacaacaagacuaaacaauuugcauuuauauaauaaggaaauccaaaaccuauu

SEQ ID NO: 459570 - RNA, 64 nt, Homo Sapiens
ugucaaaacuccucaaauaguauauugacaagaguuuauauauuuauauauugacaagaguuua

SEQ ID NO: 459571 - RNA, 64 nt, Homo Sapiens
gacaagaguuuauauauuuguauauugacaagaguuuauauauuuggggugguggaauacucua

SEQ ID NO: 459572 - RNA, 64 nt, Homo Sapiens
guggcaccucgguacccagcggguagggcgauaauuuauauauuuuccacagucagggaaggac

SEQ ID NO: 459573 - RNA, 64 nt, Homo Sapiens
uugagaaagaauucuuaugaauuguuaugcgaauuuuauauauuuaaagagggagaucuggggc

SEQ ID NO: 459574 - RNA, 64 nt, Homo Sapiens
gcuuuuuauauuuguacauuucuuaugagcuuuguuuauauacccauuaccuggauguuuuugu

SEQ ID NO: 459575 - RNA, 64 nt, Homo Sapiens
uuuaaaguuuccuuuacccugcccuuguugaacauuuauauaaucuaaccuggacaucaagcug

SEQ ID NO: 459576 - RNA, 64 nt, Homo Sapiens
uguaaacuuuuaaggacuugagauaacuaauuuguuuauauacaaaaauuaauguuacuguguu

SEQ ID NO: 459577 - RNA, 64 nt, Homo Sapiens
uaauguuacuguguuacuuaacccauguuuucucuuuauauaaucacuuaucgcuuacaaauga

SEQ ID NO: 459578 - RNA, 64 nt, Homo Sapiens
cauaucaucaaauguuuuuuucuuaugcgggucuuuuauauauuagggauccugagauacccga

SEQ ID NO: 459579 - RNA, 64 nt, Homo Sapiens
aaauguaauuuaacuugcauaguuauaggaucucuuuauauaauuugcuuuguuuuucguauca

SEQ ID NO: 459580 - RNA, 64 nt, Homo Sapiens
cauuguguguguguguaauacugaagaaaaaaaauuuauauauauuccuggaauaauugucuac

SEQ ID NO: 459581 - RNA, 64 nt, Homo Sapiens
aucugaaaugugauuuguuaaagcauauuuagauuuuauauacugcaaaaucuggaaaauguga

SEQ ID NO: 459582 - RNA, 64 nt, Homo Sapiens
ugcaaaaaauuuauaucuguccaucuuauacacuuuuauauagcauguuuaaaauggcaaaagc

SEQ ID NO: 459583 - RNA, 64 nt, Homo Sapiens
uauauauauauuuuuauuuuuggaauauauauauuuuauauauauuauauauauaaaauacaua

SEQ ID NO: 459584 - RNA, 64 nt, Homo Sapiens
uaauauauauggaauauauaauauuauauauauuuuuauauauaauaauauauauggaauaugu

SEQ ID NO: 459585 - RNA, 64 nt, Homo Sapiens
gagacuguuaaggaaaaaaauuuuaaaccccugauuuauauagauaucuucaugccauuacagc

SEQ ID NO: 459586 - RNA, 64 nt, Homo Sapiens
uuccauuagaagcaauuggcacaucuuucuauacuuuauauacuuuucuccaguaauacauguu

SEQ ID NO: 459587 - RNA, 64 nt, Homo Sapiens
ggauacaagcugggaacuucuaaacacuucauucuuuauauauggacagcuuuauuuuaaaugu

SEQ ID NO: 459588 - RNA, 64 nt, Homo Sapiens
uauuugcaaaucacccacuccuuuacaaccauacuuuauauauguacauacauucauacuguag

SEQ ID NO: 459589 - RNA, 64 nt, Homo Sapiens
gacaaugaauuuaaucgggcccuugguggaaacauuuauauauuuaaugcagaugcauaguguu

SEQ ID NO: 459590 - RNA, 64 nt, Homo Sapiens
gcauggcugaagcauaaaagggagagagaauuucuuuauauacacaaacauacaugaauaugca

SEQ ID NO: 459591 - RNA, 64 nt, Homo Sapiens
gaaaaguuugcucugcauuuguuuuuauguacaguuuauauacaccaaaaauguauagugccuu

SEQ ID NO: 459592 - RNA, 64 nt, Homo Sapiens
caccauauaagucaaauaugaaaauauauauauauuuauauaaauuugauaguuuguggauucu

SEQ ID NO: 459593 - RNA, 64 nt, Homo Sapiens
aauuuacucagucuuauaaauuaaaaaugugcauuuuauauaaagaugcauuuuauauaaaaau

SEQ ID NO: 459594 - RNA, 64 nt, Homo Sapiens
aaauuaaaaaugugcauuuuauauaaagaugcauuuuauauaaaaaugcacaccuuuaaucucu

SEQ ID NO: 459595 - RNA, 64 nt, Homo Sapiens
gggaagacaccuggguuuuuaauucagaacccuauuuauauacuguuaaaauuugagguacugu

SEQ ID NO: 459596 - RNA, 64 nt, Homo Sapiens
uauuuauauacuguuaaaauuugagguacuguaguuuauauaaaagucggauguuaagauauua

SEQ ID NO: 459597 - RNA, 64 nt, Homo Sapiens
uaaacauauuguguguuuacuaacacacuuaauguuuauauaccuaauauuuauuaugccauau

SEQ ID NO: 459598 - RNA, 64 nt, Homo Sapiens
agcaguaaacuugccaaauauauguacauauauauuuauauauuuuaaaaauaaacauuuuuua

SEQ ID NO: 459599 - RNA, 64 nt, Homo Sapiens
ccaucaagcaccaucaaccagucagccauuauuauuuauauauguauuaccaaaagcagucuau

SEQ ID NO: 459600 - RNA, 64 nt, Homo Sapiens
uacucuuuggagcucugagaugacaucuuguuguuuuauauagauguaucuuuuaaaaauaguu

SEQ ID NO: 459601 - RNA, 64 nt, Homo Sapiens
guuacagcaggccagaaacagcauaaauguuauauuuauauacagucuguuacuauuugauaau

SEQ ID NO: 459602 - RNA, 64 nt, Homo Sapiens
accacuguagauauugacaaugauuaggaaguauuuuauauauauucuuucuaaauuugauaau

SEQ ID NO: 459603 - RNA, 64 nt, Homo Sapiens
auuucaauauuacuaucugcaaaguaaugucaauuuuauauacuugucucuuccuuugucucaa

SEQ ID NO: 459604 - RNA, 64 nt, Homo Sapiens
ucacugggacauugccaaauugugguuucacuuauuuauauaacugcucuaaaaugagaaagcc

SEQ ID NO: 459605 - RNA, 64 nt, Homo Sapiens
uaaauauauauguauauauauccucuuuauauauuuuauauauauugggguggcacuucucaau

SEQ ID NO: 459606 - RNA, 64 nt, Homo Sapiens
uuauauauauaaauauauaucuucucaauuccucuuuauauauugcuuuuucuuugggguggca

SEQ ID NO: 459607 - RNA, 64 nt, Homo Sapiens
auuuuuaauaauuugugcauacccugaagguaauuuuauauaauuauauauaccuuguucacau

SEQ ID NO: 459608 - RNA, 64 nt, Homo Sapiens
ccuuguucacauacccugaaaaauucauuuauauuuuauauauagagauccaagucuaaacaca

SEQ ID NO: 459609 - RNA, 64 nt, Homo Sapiens
uagauggauauagcaguacuguucucccgguggcuuuauauaugagacugcaccaaguggacua

SEQ ID NO: 459610 - RNA, 64 nt, Homo Sapiens
guagccugauuucauauuguuugcuggagaguuuuuuauauacugcugaugcuggcacaucauu

SEQ ID NO: 459611 - RNA, 64 nt, Homo Sapiens
ccccauuggaaaagcaaaacaugaaagaaaacuguuuauauagacggcugaggauucugucaca

SEQ ID NO: 459612 - RNA, 64 nt, Homo Sapiens
ucuuauucuugcaccuuuuuuucuugguaguaauuuuauauagcagguugagaaagcuacucua

SEQ ID NO: 459613 - RNA, 64 nt, Homo Sapiens
cuuuguuauuuuuacaguuuucaguacaaaaguguuuauauagaaacaauaaaguugacauuug

SEQ ID NO: 459614 - RNA, 64 nt, Homo Sapiens
uuugcuuucuuaugguucaauguacacaaacuguuuuauauagaaaaugauuucaaauaucaua

SEQ ID NO: 459615 - RNA, 64 nt, Homo Sapiens
uuuagacuuuguguccauccccaagaucucucauuuuauauauauauauauauauauauauaua

SEQ ID NO: 459616 - RNA, 64 nt, Homo Sapiens
uuccagauuucgauguuucuuaagucuaggugaauuuauauauauauuuuuuugcuuuucauuu

SEQ ID NO: 459617 - RNA, 64 nt, Homo Sapiens
cagugcuuuuguuucacacuugauuuguaaaaauuuuauauauauguauuuaaaaugugccauu

SEQ ID NO: 459618 - RNA, 64 nt, Homo Sapiens
augcagaugauaaaacuaauuuugaacuuuuuaauuuauauaaauuauuuuauaucacuuacuu

SEQ ID NO: 459619 - RNA, 64 nt, Homo Sapiens
uuuuaagcuccuccuuuucuuugaaauacaauaauuuauauagaaauguguagcagcaaauuau

SEQ ID NO: 459620 - RNA, 64 nt, Homo Sapiens
uacaaauagaugaugguaugauucuauuauauauuuuauauaaaauccauccaaauuaaguuuu

SEQ ID NO: 459621 - RNA, 64 nt, Homo Sapiens
uggaagcugcagaucuuugcuaggacgcaauaaauuuauauacuuuuugagggguucuucuggg

SEQ ID NO: 459622 - RNA, 64 nt, Homo Sapiens
acuauuuuuccacacuaaagguuuaauauuaagcuuuauauaauaaauauguauuuuucauaau

SEQ ID NO: 459623 - RNA, 64 nt, Homo Sapiens
uuaaagguaacagauauuauagaauguuuaaaauuuuauauaauuguauaauuuauuaaucugg

SEQ ID NO: 459624 - RNA, 64 nt, Homo Sapiens
uuaaaaaguaaaaauaacuagaaaauguauauuauuuauauaacucuucccauuuuccuauauu

SEQ ID NO: 459625 - RNA, 64 nt, Homo Sapiens
aauuagcaccugagcuaaggugaaugcacauagauuuauauauauuuguaagucaaaauugaaa

SEQ ID NO: 459626 - RNA, 64 nt, Homo Sapiens
gcaaacaauuugaaagaauaugcagugagcuucuuuuauauauacuuuuuuccuucaagcauuu

SEQ ID NO: 459627 - RNA, 64 nt, Homo Sapiens
cacaacggaaauauauuuucguaccuuaauuaguuuuauauaguacucagagccauggaggcaa

SEQ ID NO: 459628 - RNA, 64 nt, Homo Sapiens
uucuucauaaaucuauuaaauauauuuauauauguuuauauauggucuuccuugaugaugcauc

SEQ ID NO: 459629 - RNA, 64 nt, Homo Sapiens
uuuauauauguucuucauaaaugaugcaucuauauuuauauauguguguccuaagucuuccuug

SEQ ID NO: 459630 - RNA, 64 nt, Homo Sapiens
guauuuuuauaaugacugguguucugacuuugaauuuauauaaauauaggcuuggauguuuuua

SEQ ID NO: 459631 - RNA, 64 nt, Homo Sapiens
uguuguugauaaggaacauuguacuuucugaaaauuuauauaacuggacucucugacaaagugg

SEQ ID NO: 459632 - RNA, 64 nt, Homo Sapiens
uguacuggcuguaaaugaugguaaugauaauuaguuuauauaagucuuuugcagaauguaaaag

SEQ ID NO: 459633 - RNA, 64 nt, Homo Sapiens
gugguugaacaggaugcaaucacaaauguuauaauuuauauaguguuuguguguacauauuuuc

SEQ ID NO: 459634 - RNA, 64 nt, Homo Sapiens
caaagcuuagcaguuuguuaucauugaacugcacuuuauauaacugaaugauugggaugauaca

SEQ ID NO: 459635 - RNA, 64 nt, Homo Sapiens
cacaaaguaugcauugaagaaagagaauguagaguuuauauaaaaaaacaaaacgaaaaccuuu

SEQ ID NO: 459636 - RNA, 64 nt, Homo Sapiens
auuuaaaauacaaauguuaauuguuaaaaagaaauuuauauaaauuucgugugcuuuuuuaaac

SEQ ID NO: 459637 - RNA, 64 nt, Homo Sapiens
auuguguguuuugaaaaugauguaaaauaccaauuuuauauagacuccaucuuuacuguauaua

SEQ ID NO: 459638 - RNA, 64 nt, Homo Sapiens
uuacuuaaaauuaaauggacuuuaaaaugagaacuuuauauauauacaucccuacuaauauaau

SEQ ID NO: 459639 - RNA, 64 nt, Homo Sapiens
uuuguaauauaacaugggcauugcaaccuauauauuuauauaacuaaucauuauuuuaaaagcu

SEQ ID NO: 459640 - RNA, 64 nt, Homo Sapiens
uauguauacucauauagauaauauauguauauguuuuauauaugggacaaauauuguuuccuau

SEQ ID NO: 459641 - RNA, 64 nt, Homo Sapiens
uuaaaaguguccaucaacagugugucagauggucuuuauauauuuuuucuguaugaaggaauag

SEQ ID NO: 459642 - RNA, 64 nt, Homo Sapiens
aauaaauucagucaucuucuuaucagguugcuuauuuauauaauuuguuuauuuuauuaaaaau

SEQ ID NO: 459643 - RNA, 64 nt, Homo Sapiens
ggaaacacuaugauaggauuguuuuuuucccaguuuuauauagaaccaaaaggacuuaauucuu

SEQ ID NO: 459644 - RNA, 64 nt, Homo Sapiens
ggaaacacugucuaugauaguguuuuuucccaguuuuauauagacaccaaaaggacuuacuucu

SEQ ID NO: 459645 - RNA, 64 nt, Homo Sapiens
aagcuuauuaaauauauuuuguuaaguguuugauuuuauauaacacugaagaaauguugacaau

SEQ ID NO: 459646 - RNA, 64 nt, Homo Sapiens
auguauguuugucuccccucuauugugauaaauauuuauauauguaaaauaggauuuggaaccu

SEQ ID NO: 459647 - RNA, 64 nt, Homo Sapiens
gguuaagaaaugucaguuuauaaagugggguuuauuuauauaguuugaaaugucacauuaguag

SEQ ID NO: 459648 - RNA, 64 nt, Homo Sapiens
uuccaauuuacagaaaaguugaacacuuuuuauuuuuauauaauaauacuaaauaaaauuuggg

SEQ ID NO: 459649 - RNA, 64 nt, Homo Sapiens
guugcuuuuguaaaggagaacuuaagccaaacauuuuauauaaaggcauaauagcaaugacagu

SEQ ID NO: 459650 - RNA, 64 nt, Homo Sapiens
cuagauaaaauuccucuguuguuuugagagguuuuuuauauaucuuuguucuuuuuacuauuga

SEQ ID NO: 459651 - RNA, 64 nt, Homo Sapiens
uaggggguauaaguacagauucuuuuaaaaauguuuuauauauugaauaguuucuuccuuuuuu

SEQ ID NO: 459652 - RNA, 64 nt, Homo Sapiens
ugucuaauguucugaugggaacguaacacuuauuuuuauauaaaaagagacugaguaaacaaac

SEQ ID NO: 459653 - RNA, 64 nt, Homo Sapiens
gcagguuuuuaaacgucauuuauguaucauucuuuuuauauaucacacuuaagcuuguguuagc

SEQ ID NO: 459654 - RNA, 64 nt, Homo Sapiens
cuguaggcagcaguuuuaagucuuauuuuuacuguuuauauauuugaaugcugcuacaacagau

SEQ ID NO: 459655 - RNA, 64 nt, Homo Sapiens
augaaauuguuaggugaaaguguuuuugagaauuuuuauauauauuacucacugcagagaucau

SEQ ID NO: 459656 - RNA, 64 nt, Homo Sapiens
uuuacaccuaucuuuaaaaggaauuuaaauuuuguuuauauacauuaacuaaaucaguacaagu

SEQ ID NO: 459657 - RNA, 64 nt, Homo Sapiens
cccagauaucaucuaccuagauuuaauauaaaguuuuauauauuauauggaaauauauauuaua

SEQ ID NO: 459658 - RNA, 64 nt, Homo Sapiens
uuuucuuucucuuccuccuuccucuuccuuacuuuuuauauauauauauaaagaaaaugauaca

SEQ ID NO: 459659 - RNA, 64 nt, Homo Sapiens
acaauaauggcguuuuccuuuauauccuuacucuuuuauauaacuauauggaagcauagguguc

SEQ ID NO: 459660 - RNA, 64 nt, Homo Sapiens
cuuuuuaaauguagaaacuuugcaauucauguaauuuauauaaaauuuugauuuuuaugaaagu

SEQ ID NO: 459661 - RNA, 64 nt, Homo Sapiens
ucuucuuaacccagucuuaggcugguauucccuuuuuauauauaucuauauuacuuuucaccuc

SEQ ID NO: 459662 - RNA, 64 nt, Homo Sapiens
guacugagugaguacauuggcauaaauauagaaauuuauauauauacauauauauaaacuauuc

SEQ ID NO: 459663 - RNA, 64 nt, Homo Sapiens
agaugcugcuucauuuacccaggaggucauauucuuuauauauauuuuuuguugcaaagugucu

SEQ ID NO: 459664 - RNA, 64 nt, Homo Sapiens
acucuauauauuauucgaauuuuuaaauuauuuguuuauauauaaaagaaaagcucaauuggcu

SEQ ID NO: 459665 - RNA, 64 nt, Homo Sapiens
ccaaguggccacuggcaucgcagcuuccugucuguuuauauauugaaaguugcuuuuauugcac

SEQ ID NO: 459666 - RNA, 64 nt, Homo Sapiens
uucuguaauguaggcacuuuuauuuucauugugauuuauauauaagguaauguaggguuauauu

SEQ ID NO: 459667 - RNA, 64 nt, Homo Sapiens
gagauuucuucuaacauuucuauuuuauuucuauuuuauauauucuuuagccagaauagccuag

SEQ ID NO: 459668 - RNA, 64 nt, Homo Sapiens
auagugguuuuauuuuguuaaaaaauaaugugguuuuauauagcuguaucaagauuaugagguu

SEQ ID NO: 459669 - RNA, 64 nt, Homo Sapiens
agagaauaaaaacuuuuuugaaaguuuucuugguuuuauauaucaacuaugcauauuauguauu

SEQ ID NO: 459670 - RNA, 64 nt, Homo Sapiens
guguuuugcuugaauaaaauugauacaauuaaauuuuauauaauuaauuuuaaaaauuccuauu

SEQ ID NO: 459671 - RNA, 64 nt, Homo Sapiens
uaguaauuuuaaaaauuccuaucuuccagcaacguuuauauauuuucauccucacuuuauguug

SEQ ID NO: 459672 - RNA, 64 nt, Homo Sapiens
ccccugaggucaagagaggauggggcuauucacuuuuauauauuuauauaaaauuaguagugag

SEQ ID NO: 459673 - RNA, 64 nt, Homo Sapiens
gucaagagaggauggggcuauucacuuuuauauauuuauauaaaauuaguagugagauguaaca

SEQ ID NO: 459674 - RNA, 64 nt, Homo Sapiens
cccacuguauauuaauugagguuacagaaaguucuuuauauaaaacuuauuuaaauuuuucaua

SEQ ID NO: 459675 - RNA, 64 nt, Homo Sapiens
uuuauguucucguuuuucuacagauauaaguaaauuuauauauaaaaauaccaaaaagaggcug

SEQ ID NO: 459676 - RNA, 64 nt, Homo Sapiens
uauacauucuguacaguaguauucuaucuauagauuuauauauguauauacucaaauguauaua

SEQ ID NO: 459677 - RNA, 64 nt, Homo Sapiens
acccaaacacugauguuuacuuugaaucagaacuuuuauauaaauuuuuucuuuuuuucccuca

SEQ ID NO: 459678 - RNA, 64 nt, Homo Sapiens
uauauauacacacacacauauacgugcagauuaauuuauauauauucuccuuuuaguguuuaua

SEQ ID NO: 459679 - RNA, 64 nt, Homo Sapiens
ugcagauuaauuuauauauauucuccuuuuaguguuuauauacgagagaacagacacuuggaau

SEQ ID NO: 459680 - RNA, 64 nt, Homo Sapiens
auugaaagaaaauuaacuccuuaauugcuauuguuuuauauagguacuuucagaaaugaaguuu

SEQ ID NO: 459681 - RNA, 64 nt, Homo Sapiens
ugcagauuacgccuuuuuguacgccuggggacuuuuuauauauuuccuuaagugacacaggagg

SEQ ID NO: 459682 - RNA, 64 nt, Homo Sapiens
uuucuuccccuucauuuacauauuagaaagcuaauuuauauauucacauuuguaauuucagauu

SEQ ID NO: 459683 - RNA, 64 nt, Homo Sapiens
uucuucauaaaucuauuacauauguuuauauauguuuauauauguguuccuugaaguauuuauu

SEQ ID NO: 459684 - RNA, 64 nt, Homo Sapiens
uuuauauauguucuucauaaaguauuuauuuauguuuauauaugcuauccuaaauguuccuuga

SEQ ID NO: 459685 - RNA, 64 nt, Homo Sapiens
aggaaaucuauuuuaugucggcguauguaaguuauuuauauacauugagaauuuacuuuaugga

SEQ ID NO: 459686 - RNA, 64 nt, Homo Sapiens
gugcaucaacucuguuggauauuggacuugaguauuuauauauucaagugccuaaguuuuuaau

SEQ ID NO: 459687 - RNA, 64 nt, Homo Sapiens
uauauauaaauugagcuugcuauuuuuauauacguuuauauaaaauuugcauuugggugguuuu

SEQ ID NO: 459688 - RNA, 64 nt, Homo Sapiens
uuuauauaaauauauauaaagggugguuuuuauuuuuauauacgcaaaaugcguauuugcauuu

SEQ ID NO: 459689 - RNA, 64 nt, Homo Sapiens
aucucaguguccccugaacucuuuauuugccuaauuuauauauauauauaugagauauauaaau

SEQ ID NO: 459690 - RNA, 64 nt, Homo Sapiens
gggucuuucuuucuacuccaggacugguuuuguuuuuauauauauaaaaaaaaaaagugaaaac

SEQ ID NO: 459691 - RNA, 64 nt, Homo Sapiens
auagucauaaaauaguauguuaauauguuuuuacuuuauauauuuauauauuaaaauauauuua

SEQ ID NO: 459692 - RNA, 64 nt, Homo Sapiens
aaaauaguauguuaauauguuuuuacuuuauauauuuauauauuaaaauauauuuaauauguuu

SEQ ID NO: 459693 - RNA, 64 nt, Homo Sapiens
agcagacaucugaucauuuuauccauaaauauucuuuauauaucucugaaagcuaugggaugau

SEQ ID NO: 459694 - RNA, 64 nt, Homo Sapiens
ccauuccaacuaggcuuuggcuaaaucugacaauuuuauauauagcuuaaaacaaagaauauac

SEQ ID NO: 459695 - RNA, 64 nt, Homo Sapiens
uauuuuuuccuuucaaaucauuuuuauauaauguuuuauauauacauuucuuccuggaacucac

SEQ ID NO: 459696 - RNA, 64 nt, Homo Sapiens
guuuuauauauauauuuuuuccuggaacucacuuuuuauauaauaaaaaagaaaaacauuucuu

SEQ ID NO: 459697 - RNA, 64 nt, Homo Sapiens; identical to SEQ ID NO: 387427

SEQ ID NO: 459698 - RNA, 64 nt, Homo Sapiens; identical to SEQ ID NO: 387428

SEQ ID NO: 459699 - RNA, 64 nt, Homo Sapiens; identical to SEQ ID NO: 387429

SEQ ID NO: 459700 - RNA, 64 nt, Homo Sapiens; identical to SEQ ID NO: 387430

SEQ ID NO: 459701 - RNA, 64 nt, Homo Sapiens; identical to SEQ ID NO: 387431

SEQ ID NO: 459702 - RNA, 64 nt, Homo Sapiens; identical to SEQ ID NO: 387432

SEQ ID NO: 459703 - RNA, 64 nt, Homo Sapiens; identical to SEQ ID NO: 387433

SEQ ID NO: 459704 - RNA, 64 nt, Homo Sapiens; identical to SEQ ID NO: 387434

SEQ ID NO: 459705 - RNA, 64 nt, Homo Sapiens; identical to SEQ ID NO: 387435

SEQ ID NO: 459706 - RNA, 64 nt, Homo Sapiens; identical to SEQ ID NO: 387436

SEQ ID NO: 459707 - RNA, 64 nt, Homo Sapiens; identical to SEQ ID NO: 387437

SEQ ID NO: 459708 - RNA, 64 nt, Homo Sapiens; identical to SEQ ID NO: 387438

SEQ ID NO: 459709 - RNA, 64 nt, Homo Sapiens; identical to SEQ ID NO: 387439

SEQ ID NO: 459710 - RNA, 64 nt, Homo Sapiens; identical to SEQ ID NO: 387440

SEQ ID NO: 459711 - RNA, 64 nt, Homo Sapiens; identical to SEQ ID NO: 387441

SEQ ID NO: 459712 - RNA, 64 nt, Homo Sapiens; identical to SEQ ID NO: 387442

SEQ ID NO: 459713 - RNA, 64 nt, Homo Sapiens; identical to SEQ ID NO: 387443

SEQ ID NO: 459714 - RNA, 64 nt, Homo Sapiens; identical to SEQ ID NO: 387444

SEQ ID NO: 459715 - RNA, 64 nt, Homo Sapiens; identical to SEQ ID NO: 387445

SEQ ID NO: 459716 - RNA, 64 nt, Homo Sapiens; identical to SEQ ID NO: 387446

SEQ ID NO: 459717 - RNA, 64 nt, Homo Sapiens; identical to SEQ ID NO: 387447

SEQ ID NO: 459718 - RNA, 64 nt, Homo Sapiens; identical to SEQ ID NO: 387448

SEQ ID NO: 459719 - RNA, 64 nt, Homo Sapiens; identical to SEQ ID NO: 387449

SEQ ID NO: 459720 - RNA, 64 nt, Homo Sapiens; identical to SEQ ID NO: 387450

SEQ ID NO: 459721 - RNA, 64 nt, Homo Sapiens; identical to SEQ ID NO: 387451

SEQ ID NO: 459722 - RNA, 64 nt, Homo Sapiens; identical to SEQ ID NO: 387452

SEQ ID NO: 459723 - RNA, 64 nt, Homo Sapiens; identical to SEQ ID NO: 387453

SEQ ID NO: 459724 - RNA, 64 nt, Homo Sapiens; identical to SEQ ID NO: 387454

SEQ ID NO: 459725 - RNA, 64 nt, Homo Sapiens; identical to SEQ ID NO: 387455

SEQ ID NO: 459726 - RNA, 64 nt, Homo Sapiens; identical to SEQ ID NO: 387456

SEQ ID NO: 459727 - RNA, 64 nt, Homo Sapiens; identical to SEQ ID NO: 387457

SEQ ID NO: 459728 - RNA, 64 nt, Homo Sapiens; identical to SEQ ID NO: 387458

SEQ ID NO: 459729 - RNA, 64 nt, Homo Sapiens; identical to SEQ ID NO: 387459

SEQ ID NO: 459730 - RNA, 64 nt, Homo Sapiens; identical to SEQ ID NO: 387460

SEQ ID NO: 459731 - RNA, 64 nt, Homo Sapiens; identical to SEQ ID NO: 387461

SEQ ID NO: 459732 - RNA, 64 nt, Homo Sapiens; identical to SEQ ID NO: 387462

SEQ ID NO: 459733 - RNA, 64 nt, Homo Sapiens; identical to SEQ ID NO: 387463

SEQ ID NO: 459734 - RNA, 64 nt, Homo Sapiens; identical to SEQ ID NO: 387464

SEQ ID NO: 459735 - RNA, 64 nt, Homo Sapiens; identical to SEQ ID NO: 387465

SEQ ID NO: 459736 - RNA, 64 nt, Homo Sapiens; identical to SEQ ID NO: 387466

SEQ ID NO: 459737 - RNA, 64 nt, Homo Sapiens; identical to SEQ ID NO: 387467

SEQ ID NO: 459738 - RNA, 64 nt, Homo Sapiens; identical to SEQ ID NO: 387468

SEQ ID NO: 459739 - RNA, 64 nt, Homo Sapiens; identical to SEQ ID NO: 387469

SEQ ID NO: 459740 - RNA, 64 nt, Homo Sapiens; identical to SEQ ID NO: 387470

SEQ ID NO: 459741 - RNA, 64 nt, Homo Sapiens; identical to SEQ ID NO: 387471

SEQ ID NO: 459742 - RNA, 64 nt, Homo Sapiens; identical to SEQ ID NO: 387472

SEQ ID NO: 459743 - RNA, 64 nt, Homo Sapiens; identical to SEQ ID NO: 387473

SEQ ID NO: 459744 - RNA, 64 nt, Homo Sapiens; identical to SEQ ID NO: 387474

SEQ ID NO: 459745 - RNA, 64 nt, Homo Sapiens; identical to SEQ ID NO: 387475

SEQ ID NO: 459746 - RNA, 64 nt, Homo Sapiens; identical to SEQ ID NO: 387476

SEQ ID NO: 459747 - RNA, 64 nt, Homo Sapiens; identical to SEQ ID NO: 387477

SEQ ID NO: 459748 - RNA, 64 nt, Homo Sapiens; identical to SEQ ID NO: 387478

SEQ ID NO: 459749 - RNA, 64 nt, Homo Sapiens; identical to SEQ ID NO: 387479

SEQ ID NO: 459750 - RNA, 64 nt, Homo Sapiens; identical to SEQ ID NO: 387480

SEQ ID NO: 459751 - RNA, 64 nt, Homo Sapiens; identical to SEQ ID NO: 387481

SEQ ID NO: 459752 - RNA, 64 nt, Homo Sapiens; identical to SEQ ID NO: 387482

SEQ ID NO: 459753 - RNA, 64 nt, Homo Sapiens; identical to SEQ ID NO: 387483

SEQ ID NO: 459754 - RNA, 64 nt, Homo Sapiens; identical to SEQ ID NO: 387484

SEQ ID NO: 459755 - RNA, 64 nt, Homo Sapiens; identical to SEQ ID NO: 387485

SEQ ID NO: 459756 - RNA, 64 nt, Homo Sapiens; identical to SEQ ID NO: 387486

SEQ ID NO: 459757 - RNA, 64 nt, Homo Sapiens; identical to SEQ ID NO: 387487

SEQ ID NO: 459758 - RNA, 64 nt, Homo Sapiens; identical to SEQ ID NO: 387488

SEQ ID NO: 459759 - RNA, 64 nt, Homo Sapiens; identical to SEQ ID NO: 387487

SEQ ID NO: 459760 - RNA, 64 nt, Homo Sapiens; identical to SEQ ID NO: 387488

SEQ ID NO: 459761 - RNA, 64 nt, Homo Sapiens; identical to SEQ ID NO: 72274

SEQ ID NO: 459762 - RNA, 64 nt, Homo Sapiens; identical to SEQ ID NO: 72275

SEQ ID NO: 459763 - RNA, 64 nt, Homo Sapiens; identical to SEQ ID NO: 72276

SEQ ID NO: 459764 - RNA, 64 nt, Homo Sapiens; identical to SEQ ID NO: 72277

SEQ ID NO: 459765 - RNA, 64 nt, Homo Sapiens; identical to SEQ ID NO: 72278

SEQ ID NO: 459766 - RNA, 64 nt, Homo Sapiens; identical to SEQ ID NO: 72279

SEQ ID NO: 459767 - RNA, 64 nt, Homo Sapiens; identical to SEQ ID NO: 72280

SEQ ID NO: 459768 - RNA, 64 nt, Homo Sapiens; identical to SEQ ID NO: 72281

SEQ ID NO: 459769 - RNA, 64 nt, Homo Sapiens; identical to SEQ ID NO: 72282

SEQ ID NO: 459770 - RNA, 64 nt, Homo Sapiens; identical to SEQ ID NO: 72283

SEQ ID NO: 459771 - RNA, 64 nt, Homo Sapiens; identical to SEQ ID NO: 72284

SEQ ID NO: 459772 - RNA, 64 nt, Homo Sapiens; identical to SEQ ID NO: 72285

SEQ ID NO: 459773 - RNA, 64 nt, Homo Sapiens; identical to SEQ ID NO: 72286

SEQ ID NO: 459774 - RNA, 64 nt, Homo Sapiens; identical to SEQ ID NO: 72287

SEQ ID NO: 459775 - RNA, 64 nt, Homo Sapiens; identical to SEQ ID NO: 72288

SEQ ID NO: 459776 - RNA, 64 nt, Homo Sapiens; identical to SEQ ID NO: 72289

SEQ ID NO: 459777 - RNA, 64 nt, Homo Sapiens; identical to SEQ ID NO: 72290

SEQ ID NO: 459778 - RNA, 64 nt, Homo Sapiens; identical to SEQ ID NO: 72291

SEQ ID NO: 459779 - RNA, 64 nt, Homo Sapiens; identical to SEQ ID NO: 72292

SEQ ID NO: 459780 - RNA, 64 nt, Homo Sapiens; identical to SEQ ID NO: 72293

SEQ ID NO: 459781 - RNA, 64 nt, Homo Sapiens; identical to SEQ ID NO: 72294

SEQ ID NO: 459782 - RNA, 64 nt, Homo Sapiens; identical to SEQ ID NO: 72295

SEQ ID NO: 459783 - RNA, 64 nt, Homo Sapiens; identical to SEQ ID NO: 72296

SEQ ID NO: 459784 - RNA, 64 nt, Homo Sapiens; identical to SEQ ID NO: 72297

SEQ ID NO: 459785 - RNA, 64 nt, Homo Sapiens; identical to SEQ ID NO: 72298

SEQ ID NO: 459786 - RNA, 64 nt, Homo Sapiens; identical to SEQ ID NO: 72299

SEQ ID NO: 459787 - RNA, 64 nt, Homo Sapiens; identical to SEQ ID NO: 72300

SEQ ID NO: 459788 - RNA, 64 nt, Homo Sapiens; identical to SEQ ID NO: 72301

SEQ ID NO: 459789 - RNA, 64 nt, Homo Sapiens; identical to SEQ ID NO: 72302

SEQ ID NO: 459790 - RNA, 64 nt, Homo Sapiens; identical to SEQ ID NO: 72303

SEQ ID NO: 459791 - RNA, 64 nt, Homo Sapiens; identical to SEQ ID NO: 72304

SEQ ID NO: 459792 - RNA, 64 nt, Homo Sapiens; identical to SEQ ID NO: 72305

SEQ ID NO: 459793 - RNA, 64 nt, Homo Sapiens; identical to SEQ ID NO: 72306

SEQ ID NO: 459794 - RNA, 64 nt, Homo Sapiens; identical to SEQ ID NO: 72307

SEQ ID NO: 459795 - RNA, 64 nt, Homo Sapiens; identical to SEQ ID NO: 72308

SEQ ID NO: 459796 - RNA, 64 nt, Homo Sapiens; identical to SEQ ID NO: 72309

SEQ ID NO: 459797 - RNA, 64 nt, Homo Sapiens; identical to SEQ ID NO: 72310

SEQ ID NO: 459798 - RNA, 64 nt, Homo Sapiens; identical to SEQ ID NO: 72311

SEQ ID NO: 459799 - RNA, 64 nt, Homo Sapiens; identical to SEQ ID NO: 72312

SEQ ID NO: 459800 - RNA, 64 nt, Homo Sapiens; identical to SEQ ID NO: 72313

SEQ ID NO: 459801 - RNA, 64 nt, Homo Sapiens; identical to SEQ ID NO: 72314

SEQ ID NO: 459802 - RNA, 64 nt, Homo Sapiens; identical to SEQ ID NO: 72315

SEQ ID NO: 459803 - RNA, 64 nt, Homo Sapiens; identical to SEQ ID NO: 72316

SEQ ID NO: 459804 - RNA, 64 nt, Homo Sapiens; identical to SEQ ID NO: 72317

SEQ ID NO: 459805 - RNA, 64 nt, Homo Sapiens; identical to SEQ ID NO: 72318

SEQ ID NO: 459806 - RNA, 64 nt, Homo Sapiens; identical to SEQ ID NO: 72319

SEQ ID NO: 459807 - RNA, 64 nt, Homo Sapiens; identical to SEQ ID NO: 72320

SEQ ID NO: 459808 - RNA, 64 nt, Homo Sapiens; identical to SEQ ID NO: 72321

SEQ ID NO: 459809 - RNA, 64 nt, Homo Sapiens; identical to SEQ ID NO: 72322

SEQ ID NO: 459810 - RNA, 64 nt, Homo Sapiens; identical to SEQ ID NO: 72323

SEQ ID NO: 459811 - RNA, 64 nt, Homo Sapiens; identical to SEQ ID NO: 72324

SEQ ID NO: 459812 - RNA, 64 nt, Homo Sapiens; identical to SEQ ID NO: 72325

SEQ ID NO: 459813 - RNA, 64 nt, Homo Sapiens; identical to SEQ ID NO: 72326

SEQ ID NO: 459814 - RNA, 64 nt, Homo Sapiens; identical to SEQ ID NO: 72327

SEQ ID NO: 459815 - RNA, 64 nt, Homo Sapiens; identical to SEQ ID NO: 72328

SEQ ID NO: 459816 - RNA, 64 nt, Homo Sapiens; identical to SEQ ID NO: 72329

SEQ ID NO: 459817 - RNA, 64 nt, Homo Sapiens; identical to SEQ ID NO: 72330

SEQ ID NO: 459818 - RNA, 64 nt, Homo Sapiens; identical to SEQ ID NO: 72331

SEQ ID NO: 459819 - RNA, 64 nt, Homo Sapiens; identical to SEQ ID NO: 72332

SEQ ID NO: 459820 - RNA, 64 nt, Homo Sapiens; identical to SEQ ID NO: 72333

SEQ ID NO: 459821 - RNA, 64 nt, Homo Sapiens; identical to SEQ ID NO: 72334

SEQ ID NO: 459822 - RNA, 64 nt, Homo Sapiens; identical to SEQ ID NO: 72335

SEQ ID NO: 459823 - RNA, 64 nt, Homo Sapiens; identical to SEQ ID NO: 72336

SEQ ID NO: 459824 - RNA, 64 nt, Homo Sapiens; identical to SEQ ID NO: 72337

SEQ ID NO: 459825 - RNA, 64 nt, Homo Sapiens; identical to SEQ ID NO: 72338

SEQ ID NO: 459826 - RNA, 64 nt, Homo Sapiens; identical to SEQ ID NO: 72339

SEQ ID NO: 459827 - RNA, 64 nt, Homo Sapiens; identical to SEQ ID NO: 72340

SEQ ID NO: 459828 - RNA, 64 nt, Homo Sapiens; identical to SEQ ID NO: 72341

SEQ ID NO: 459829 - RNA, 64 nt, Homo Sapiens; identical to SEQ ID NO: 72342

SEQ ID NO: 459830 - RNA, 64 nt, Homo Sapiens; identical to SEQ ID NO: 72343

SEQ ID NO: 459831 - RNA, 64 nt, Homo Sapiens; identical to SEQ ID NO: 72344

SEQ ID NO: 459832 - RNA, 64 nt, Homo Sapiens; identical to SEQ ID NO: 72345

SEQ ID NO: 459833 - RNA, 64 nt, Homo Sapiens; identical to SEQ ID NO: 72346

SEQ ID NO: 459834 - RNA, 64 nt, Homo Sapiens; identical to SEQ ID NO: 72347

SEQ ID NO: 459835 - RNA, 64 nt, Homo Sapiens; identical to SEQ ID NO: 72348

SEQ ID NO: 459836 - RNA, 64 nt, Homo Sapiens; identical to SEQ ID NO: 72349

SEQ ID NO: 459837 - RNA, 64 nt, Homo Sapiens; identical to SEQ ID NO: 72350

SEQ ID NO: 459838 - RNA, 64 nt, Homo Sapiens; identical to SEQ ID NO: 72351

SEQ ID NO: 459839 - RNA, 64 nt, Homo Sapiens; identical to SEQ ID NO: 72352

SEQ ID NO: 459840 - RNA, 64 nt, Homo Sapiens; identical to SEQ ID NO: 72353

SEQ ID NO: 459841 - RNA, 64 nt, Homo Sapiens; identical to SEQ ID NO: 72354

SEQ ID NO: 459842 - RNA, 64 nt, Homo Sapiens; identical to SEQ ID NO: 72355

SEQ ID NO: 459843 - RNA, 64 nt, Homo Sapiens; identical to SEQ ID NO: 72356

SEQ ID NO: 459844 - RNA, 64 nt, Homo Sapiens; identical to SEQ ID NO: 72357

SEQ ID NO: 459845 - RNA, 64 nt, Homo Sapiens; identical to SEQ ID NO: 72358

SEQ ID NO: 459846 - RNA, 64 nt, Homo Sapiens; identical to SEQ ID NO: 72359

SEQ ID NO: 459847 - RNA, 64 nt, Homo Sapiens; identical to SEQ ID NO: 72360

SEQ ID NO: 459848 - RNA, 64 nt, Homo Sapiens; identical to SEQ ID NO: 72361

SEQ ID NO: 459849 - RNA, 64 nt, Homo Sapiens; identical to SEQ ID NO: 72362

SEQ ID NO: 459850 - RNA, 64 nt, Homo Sapiens; identical to SEQ ID NO: 72363

SEQ ID NO: 459851 - RNA, 64 nt, Homo Sapiens; identical to SEQ ID NO: 72364

SEQ ID NO: 459852 - RNA, 64 nt, Homo Sapiens; identical to SEQ ID NO: 72365

SEQ ID NO: 459853 - RNA, 64 nt, Homo Sapiens; identical to SEQ ID NO: 72366

SEQ ID NO: 459854 - RNA, 64 nt, Homo Sapiens; identical to SEQ ID NO: 72367

SEQ ID NO: 459855 - RNA, 64 nt, Homo Sapiens; identical to SEQ ID NO: 72368

SEQ ID NO: 459856 - RNA, 64 nt, Homo Sapiens; identical to SEQ ID NO: 72369

SEQ ID NO: 459857 - RNA, 64 nt, Homo Sapiens; identical to SEQ ID NO: 72370

SEQ ID NO: 459858 - RNA, 64 nt, Homo Sapiens; identical to SEQ ID NO: 72371

SEQ ID NO: 459859 - RNA, 64 nt, Homo Sapiens; identical to SEQ ID NO: 72372

SEQ ID NO: 459860 - RNA, 64 nt, Homo Sapiens; identical to SEQ ID NO: 72373

SEQ ID NO: 459861 - RNA, 64 nt, Homo Sapiens; identical to SEQ ID NO: 72374

SEQ ID NO: 459862 - RNA, 64 nt, Homo Sapiens; identical to SEQ ID NO: 72375

SEQ ID NO: 459863 - RNA, 64 nt, Homo Sapiens; identical to SEQ ID NO: 72376

SEQ ID NO: 459864 - RNA, 64 nt, Homo Sapiens; identical to SEQ ID NO: 72377

SEQ ID NO: 459865 - RNA, 64 nt, Homo Sapiens; identical to SEQ ID NO: 72378

SEQ ID NO: 459866 - RNA, 64 nt, Homo Sapiens; identical to SEQ ID NO: 72379

SEQ ID NO: 459867 - RNA, 64 nt, Homo Sapiens; identical to SEQ ID NO: 72380

SEQ ID NO: 459868 - RNA, 64 nt, Homo Sapiens; identical to SEQ ID NO: 72381

SEQ ID NO: 459869 - RNA, 64 nt, Homo Sapiens; identical to SEQ ID NO: 72382

SEQ ID NO: 459870 - RNA, 64 nt, Homo Sapiens; identical to SEQ ID NO: 72383

SEQ ID NO: 459871 - RNA, 64 nt, Homo Sapiens; identical to SEQ ID NO: 72384

SEQ ID NO: 459872 - RNA, 64 nt, Homo Sapiens; identical to SEQ ID NO: 72385

SEQ ID NO: 459873 - RNA, 64 nt, Homo Sapiens; identical to SEQ ID NO: 72386

SEQ ID NO: 459874 - RNA, 64 nt, Homo Sapiens; identical to SEQ ID NO: 72387

SEQ ID NO: 459875 - RNA, 64 nt, Homo Sapiens; identical to SEQ ID NO: 72388

SEQ ID NO: 459876 - RNA, 64 nt, Homo Sapiens; identical to SEQ ID NO: 72389

SEQ ID NO: 459877 - RNA, 64 nt, Homo Sapiens; identical to SEQ ID NO: 72390

SEQ ID NO: 459878 - RNA, 64 nt, Homo Sapiens; identical to SEQ ID NO: 72391

SEQ ID NO: 459879 - RNA, 64 nt, Homo Sapiens; identical to SEQ ID NO: 72392

SEQ ID NO: 459880 - RNA, 64 nt, Homo Sapiens; identical to SEQ ID NO: 72393

SEQ ID NO: 459881 - RNA, 64 nt, Homo Sapiens; identical to SEQ ID NO: 72394

SEQ ID NO: 459882 - RNA, 64 nt, Homo Sapiens; identical to SEQ ID NO: 72395

SEQ ID NO: 459883 - RNA, 64 nt, Homo Sapiens; identical to SEQ ID NO: 72396

SEQ ID NO: 459884 - RNA, 64 nt, Homo Sapiens; identical to SEQ ID NO: 72397

SEQ ID NO: 459885 - RNA, 64 nt, Homo Sapiens; identical to SEQ ID NO: 72398

SEQ ID NO: 459886 - RNA, 64 nt, Homo Sapiens; identical to SEQ ID NO: 72399

SEQ ID NO: 459887 - RNA, 64 nt, Homo Sapiens; identical to SEQ ID NO: 72400

SEQ ID NO: 459888 - RNA, 64 nt, Homo Sapiens; identical to SEQ ID NO: 72401

SEQ ID NO: 459889 - RNA, 64 nt, Homo Sapiens; identical to SEQ ID NO: 72402

SEQ ID NO: 459890 - RNA, 64 nt, Homo Sapiens; identical to SEQ ID NO: 72403

SEQ ID NO: 459891 - RNA, 64 nt, Homo Sapiens; identical to SEQ ID NO: 72404

SEQ ID NO: 459892 - RNA, 64 nt, Homo Sapiens; identical to SEQ ID NO: 72405

SEQ ID NO: 459893 - RNA, 64 nt, Homo Sapiens; identical to SEQ ID NO: 72406

SEQ ID NO: 459894 - RNA, 64 nt, Homo Sapiens; identical to SEQ ID NO: 72407

SEQ ID NO: 459895 - RNA, 64 nt, Homo Sapiens; identical to SEQ ID NO: 72408

SEQ ID NO: 459896 - RNA, 64 nt, Homo Sapiens; identical to SEQ ID NO: 72409

SEQ ID NO: 459897 - RNA, 64 nt, Homo Sapiens; identical to SEQ ID NO: 72410

SEQ ID NO: 459898 - RNA, 64 nt, Homo Sapiens; identical to SEQ ID NO: 72411

SEQ ID NO: 459899 - RNA, 64 nt, Homo Sapiens; identical to SEQ ID NO: 72412

SEQ ID NO: 459900 - RNA, 64 nt, Homo Sapiens; identical to SEQ ID NO: 72413

SEQ ID NO: 459901 - RNA, 64 nt, Homo Sapiens; identical to SEQ ID NO: 72414

SEQ ID NO: 459902 - RNA, 64 nt, Homo Sapiens; identical to SEQ ID NO: 72415

SEQ ID NO: 459903 - RNA, 64 nt, Homo Sapiens; identical to SEQ ID NO: 72416

SEQ ID NO: 459904 - RNA, 64 nt, Homo Sapiens; identical to SEQ ID NO: 72417

SEQ ID NO: 459905 - RNA, 64 nt, Homo Sapiens; identical to SEQ ID NO: 72418

SEQ ID NO: 459906 - RNA, 64 nt, Homo Sapiens; identical to SEQ ID NO: 72419

SEQ ID NO: 459907 - RNA, 64 nt, Homo Sapiens; identical to SEQ ID NO: 72420

SEQ ID NO: 459908 - RNA, 64 nt, Homo Sapiens; identical to SEQ ID NO: 72421

SEQ ID NO: 459909 - RNA, 64 nt, Homo Sapiens; identical to SEQ ID NO: 72422

SEQ ID NO: 459910 - RNA, 64 nt, Homo Sapiens; identical to SEQ ID NO: 72423

SEQ ID NO: 459911 - RNA, 64 nt, Homo Sapiens; identical to SEQ ID NO: 72424

SEQ ID NO: 459912 - RNA, 64 nt, Homo Sapiens; identical to SEQ ID NO: 72425

SEQ ID NO: 459913 - RNA, 64 nt, Homo Sapiens; identical to SEQ ID NO: 72426

SEQ ID NO: 459914 - RNA, 64 nt, Homo Sapiens; identical to SEQ ID NO: 72427

SEQ ID NO: 459915 - RNA, 64 nt, Homo Sapiens; identical to SEQ ID NO: 72428

SEQ ID NO: 459916 - RNA, 64 nt, Homo Sapiens; identical to SEQ ID NO: 72429

SEQ ID NO: 459917 - RNA, 64 nt, Homo Sapiens; identical to SEQ ID NO: 72430

SEQ ID NO: 459918 - RNA, 64 nt, Homo Sapiens; identical to SEQ ID NO: 72431

SEQ ID NO: 459919 - RNA, 64 nt, Homo Sapiens; identical to SEQ ID NO: 72432

SEQ ID NO: 459920 - RNA, 64 nt, Homo Sapiens; identical to SEQ ID NO: 72433

SEQ ID NO: 459921 - RNA, 64 nt, Homo Sapiens; identical to SEQ ID NO: 72434

SEQ ID NO: 459922 - RNA, 64 nt, Homo Sapiens
guauuuuggacaaaugcucuaccuuuuguaauauuugauuuagaaggccuauucuuuucaguug

SEQ ID NO: 459923 - RNA, 64 nt, Homo Sapiens
auuagcaugucauuuguacauagacuagacaggguugauuuauuuaguagaguugcuugaagau

SEQ ID NO: 459924 - RNA, 64 nt, Homo Sapiens
uauuucucuggcaaugauuuuucaucauucacccuugauuuaauuacagauaacuuuucaaaaa

SEQ ID NO: 459925 - RNA, 64 nt, Homo Sapiens
aaugaagaaaaugaauauaugucgaaaauaaagguugauuuagaaauggaaauaggaaaaauua

SEQ ID NO: 459926 - RNA, 64 nt, Homo Sapiens
cagaauuccuagacugaaagcacgguucacuaaauugauuuaguuccuuuaaaaaaauuauaga

SEQ ID NO: 459927 - RNA, 64 nt, Homo Sapiens
gguuucgugucaauucucuauaaugaaagaggccuugauuuaaauuuuuuuuguuuuguuuugg

SEQ ID NO: 459928 - RNA, 64 nt, Homo Sapiens
caaaucauucuugguaaauguaaaucaaacaugauugauuuaaaacuucauggaauuuguagaa

SEQ ID NO: 459929 - RNA, 64 nt, Homo Sapiens
aggagcaaaaauaaaaccaaaguguuaguaaauuuugauuuauuagauauuuuagaaaaauaau

SEQ ID NO: 459930 - RNA, 64 nt, Homo Sapiens
augcucuauuacuaauaacuuauuuuuaagccaguugauuuaggcuuuugugagagacuaaacu

SEQ ID NO: 459931 - RNA, 64 nt, Homo Sapiens
guggucacagggcccaauuccucguugccagcaguugauuuacauaaccagugacacuccccuu

SEQ ID NO: 459932 - RNA, 64 nt, Homo Sapiens
auaauuaguuaaaauauauuuggauacaauacucuugauuuaugaucuaauauucuggcugcuu

SEQ ID NO: 459933 - RNA, 64 nt, Homo Sapiens
gaagggcacuaauguuucccaguguacuacaacauugauuuacuuggccacugggguuaaauuu

SEQ ID NO: 459934 - RNA, 64 nt, Homo Sapiens
uuuucucuggcccucuaccuugcuuccugggaguuugauuuaggauugcuguugaaggcuuccu

SEQ ID NO: 459935 - RNA, 64 nt, Homo Sapiens
ucucacugguaaggugacuugguggcguucccacuugauuuagccauuuucuuccauugugaga

SEQ ID NO: 459936 - RNA, 64 nt, Homo Sapiens
ucuagcaaauauaaugcuaguccuagauuacuuauugauuuaaaaacaaaaaaaagauuacuua

SEQ ID NO: 459937 - RNA, 64 nt, Homo Sapiens
auugauuuaaaaacaaaaaaaagauuacuuaauuuugauuuaaaaacaaaaaaucguaaaauac

SEQ ID NO: 459938 - RNA, 64 nt, Homo Sapiens
auauuggaucuugcucuguuugcacaaggccccguugauuuaaauccagaucgagcgcaguuca

SEQ ID NO: 459939 - RNA, 64 nt, Homo Sapiens
gaauuugaaaaagauaauuagccuugcugcuguuuugauuuauggaggaaaaaaaugugguuug

SEQ ID NO: 459940 - RNA, 64 nt, Homo Sapiens
uuccccugcaugugagaagcuuuaggccuucucuuugauuuauuuuaguccaaguuccaguucu

SEQ ID NO: 459941 - RNA, 64 nt, Homo Sapiens
ugcuucucacuaagaguccagagggagugaaugauugauuuaccccuccuaggccugcagacau

SEQ ID NO: 459942 - RNA, 64 nt, Homo Sapiens
ggacaagauacuaagcuucuacuugauuaccaguuugauuuauugucauuaucucccuuucucc

SEQ ID NO: 459943 - RNA, 64 nt, Homo Sapiens
agccuuccaacaccauuuaaagagaaagaauauguugauuuaaaagcauaauaaauuuuauauu

SEQ ID NO: 459944 - RNA, 64 nt, Homo Sapiens
agcaucuaaccuuuuacuuuugcauaggaaauacuugauuuaauuacagguccagggaugagcu

SEQ ID NO: 459945 - RNA, 64 nt, Homo Sapiens
aggcauuuuaccuuccagugcaaauccugcuccuuugauuuaaugggguguacuggggccaggg

SEQ ID NO: 459946 - RNA, 64 nt, Homo Sapiens
uaaugcugacacguacucuuugugaaaugcauuauugauuuaaaagugauguuucugcaauaau

SEQ ID NO: 459947 - RNA, 64 nt, Homo Sapiens
ucuuagacuacuuuagcaauaguaguuugcaguauugauuuauauccaaaauaggaagaagugg

SEQ ID NO: 459948 - RNA, 64 nt, Homo Sapiens
uagccaaaguacagguguauauaguucagggcacuugauuuagauuuggaggggcugggguggg

SEQ ID NO: 459949 - RNA, 64 nt, Homo Sapiens
guagcauugccuuaaaucuuauccaguuagaacauugauuuauuuacaugauguucagauuuuc

SEQ ID NO: 459950 - RNA, 64 nt, Homo Sapiens; identical to SEQ ID NO: 59936

SEQ ID NO: 459951 - RNA, 64 nt, Homo Sapiens; identical to SEQ ID NO: 59937

SEQ ID NO: 459952 - RNA, 64 nt, Homo Sapiens; identical to SEQ ID NO: 59938

SEQ ID NO: 459953 - RNA, 64 nt, Homo Sapiens; identical to SEQ ID NO: 59939

SEQ ID NO: 459954 - RNA, 64 nt, Homo Sapiens; identical to SEQ ID NO: 59940

SEQ ID NO: 459955 - RNA, 64 nt, Homo Sapiens; identical to SEQ ID NO: 59941

SEQ ID NO: 459956 - RNA, 64 nt, Homo Sapiens; identical to SEQ ID NO: 59942

SEQ ID NO: 459957 - RNA, 64 nt, Homo Sapiens; identical to SEQ ID NO: 59943

SEQ ID NO: 459958 - RNA, 64 nt, Homo Sapiens; identical to SEQ ID NO: 59944

SEQ ID NO: 459959 - RNA, 64 nt, Homo Sapiens; identical to SEQ ID NO: 59945

SEQ ID NO: 459960 - RNA, 64 nt, Homo Sapiens; identical to SEQ ID NO: 59946

SEQ ID NO: 459961 - RNA, 64 nt, Homo Sapiens; identical to SEQ ID NO: 59947

SEQ ID NO: 459962 - RNA, 64 nt, Homo Sapiens; identical to SEQ ID NO: 59948

SEQ ID NO: 459963 - RNA, 64 nt, Homo Sapiens; identical to SEQ ID NO: 59949

SEQ ID NO: 459964 - RNA, 64 nt, Homo Sapiens; identical to SEQ ID NO: 59950

SEQ ID NO: 459965 - RNA, 64 nt, Homo Sapiens; identical to SEQ ID NO: 59951

SEQ ID NO: 459966 - RNA, 64 nt, Homo Sapiens; identical to SEQ ID NO: 59952

SEQ ID NO: 459967 - RNA, 64 nt, Homo Sapiens; identical to SEQ ID NO: 59953

SEQ ID NO: 459968 - RNA, 64 nt, Homo Sapiens; identical to SEQ ID NO: 59954

SEQ ID NO: 459969 - RNA, 64 nt, Homo Sapiens; identical to SEQ ID NO: 59955

SEQ ID NO: 459970 - RNA, 64 nt, Homo Sapiens; identical to SEQ ID NO: 71880

SEQ ID NO: 459971 - RNA, 64 nt, Homo Sapiens; identical to SEQ ID NO: 71881

SEQ ID NO: 459972 - RNA, 64 nt, Homo Sapiens; identical to SEQ ID NO: 71882

SEQ ID NO: 459973 - RNA, 64 nt, Homo Sapiens; identical to SEQ ID NO: 71883

SEQ ID NO: 459974 - RNA, 64 nt, Homo Sapiens; identical to SEQ ID NO: 71884

SEQ ID NO: 459975 - RNA, 64 nt, Homo Sapiens; identical to SEQ ID NO: 71885

SEQ ID NO: 459976 - RNA, 64 nt, Homo Sapiens; identical to SEQ ID NO: 71886

SEQ ID NO: 459977 - RNA, 64 nt, Homo Sapiens; identical to SEQ ID NO: 71887

SEQ ID NO: 459978 - RNA, 64 nt, Homo Sapiens; identical to SEQ ID NO: 71888

SEQ ID NO: 459979 - RNA, 64 nt, Homo Sapiens; identical to SEQ ID NO: 71889

SEQ ID NO: 459980 - RNA, 64 nt, Homo Sapiens; identical to SEQ ID NO: 71890

SEQ ID NO: 459981 - RNA, 64 nt, Homo Sapiens; identical to SEQ ID NO: 71891

SEQ ID NO: 459982 - RNA, 64 nt, Homo Sapiens; identical to SEQ ID NO: 71892

SEQ ID NO: 459983 - RNA, 64 nt, Homo Sapiens; identical to SEQ ID NO: 71893

SEQ ID NO: 459984 - RNA, 64 nt, Homo Sapiens; identical to SEQ ID NO: 71894

SEQ ID NO: 459985 - RNA, 64 nt, Homo Sapiens; identical to SEQ ID NO: 71895

SEQ ID NO: 459986 - RNA, 64 nt, Homo Sapiens; identical to SEQ ID NO: 71896

SEQ ID NO: 459987 - RNA, 64 nt, Homo Sapiens; identical to SEQ ID NO: 71897

SEQ ID NO: 459988 - RNA, 64 nt, Homo Sapiens; identical to SEQ ID NO: 71898

SEQ ID NO: 459989 - RNA, 64 nt, Homo Sapiens; identical to SEQ ID NO: 71899

SEQ ID NO: 459990 - RNA, 64 nt, Homo Sapiens; identical to SEQ ID NO: 71900

SEQ ID NO: 459991 - RNA, 65 nt, Homo Sapiens; identical to SEQ ID NO: 242081

SEQ ID NO: 459992 - RNA, 65 nt, Homo Sapiens; identical to SEQ ID NO: 242082

SEQ ID NO: 459993 - RNA, 65 nt, Homo Sapiens; identical to SEQ ID NO: 242083

SEQ ID NO: 459994 - RNA, 65 nt, Homo Sapiens; identical to SEQ ID NO: 242084

SEQ ID NO: 459995 - RNA, 65 nt, Homo Sapiens; identical to SEQ ID NO: 242085

SEQ ID NO: 459996 - RNA, 65 nt, Homo Sapiens; identical to SEQ ID NO: 242086

SEQ ID NO: 459997 - RNA, 65 nt, Homo Sapiens; identical to SEQ ID NO: 242087

SEQ ID NO: 459998 - RNA, 65 nt, Homo Sapiens; identical to SEQ ID NO: 242088

SEQ ID NO: 459999 - RNA, 65 nt, Homo Sapiens; identical to SEQ ID NO: 242089

SEQ ID NO: 460000 - RNA, 65 nt, Homo Sapiens; identical to SEQ ID NO: 242090

SEQ ID NO: 460001 - RNA, 65 nt, Homo Sapiens; identical to SEQ ID NO: 242091

SEQ ID NO: 460002 - RNA, 65 nt, Homo Sapiens; identical to SEQ ID NO: 242092

SEQ ID NO: 460003 - RNA, 65 nt, Homo Sapiens; identical to SEQ ID NO: 242093

SEQ ID NO: 460004 - RNA, 65 nt, Homo Sapiens; identical to SEQ ID NO: 242094

SEQ ID NO: 460005 - RNA, 65 nt, Homo Sapiens; identical to SEQ ID NO: 242095

SEQ ID NO: 460006 - RNA, 65 nt, Homo Sapiens; identical to SEQ ID NO: 242096

SEQ ID NO: 460007 - RNA, 65 nt, Homo Sapiens; identical to SEQ ID NO: 242097

SEQ ID NO: 460008 - RNA, 65 nt, Homo Sapiens; identical to SEQ ID NO: 242098

SEQ ID NO: 460009 - RNA, 65 nt, Homo Sapiens; identical to SEQ ID NO: 242099

SEQ ID NO: 460010 - RNA, 65 nt, Homo Sapiens; identical to SEQ ID NO: 242100

SEQ ID NO: 460011 - RNA, 65 nt, Homo Sapiens; identical to SEQ ID NO: 242101

SEQ ID NO: 460012 - RNA, 65 nt, Homo Sapiens; identical to SEQ ID NO: 242102

SEQ ID NO: 460013 - RNA, 65 nt, Homo Sapiens; identical to SEQ ID NO: 242103

SEQ ID NO: 460014 - RNA, 65 nt, Homo Sapiens; identical to SEQ ID NO: 242104

SEQ ID NO: 460015 - RNA, 65 nt, Homo Sapiens; identical to SEQ ID NO: 242105

SEQ ID NO: 460016 - RNA, 65 nt, Homo Sapiens; identical to SEQ ID NO: 242106

SEQ ID NO: 460017 - RNA, 65 nt, Homo Sapiens; identical to SEQ ID NO: 242107

SEQ ID NO: 460018 - RNA, 65 nt, Homo Sapiens; identical to SEQ ID NO: 242108

SEQ ID NO: 460019 - RNA, 65 nt, Homo Sapiens; identical to SEQ ID NO: 242109

SEQ ID NO: 460020 - RNA, 65 nt, Homo Sapiens; identical to SEQ ID NO: 242110

SEQ ID NO: 460021 - RNA, 65 nt, Homo Sapiens; identical to SEQ ID NO: 242111

SEQ ID NO: 460022 - RNA, 65 nt, Homo Sapiens; identical to SEQ ID NO: 242112

SEQ ID NO: 460023 - RNA, 65 nt, Homo Sapiens; identical to SEQ ID NO: 242113

SEQ ID NO: 460024 - RNA, 65 nt, Homo Sapiens; identical to SEQ ID NO: 242114

SEQ ID NO: 460025 - RNA, 65 nt, Homo Sapiens; identical to SEQ ID NO: 242115

SEQ ID NO: 460026 - RNA, 65 nt, Homo Sapiens; identical to SEQ ID NO: 242116

SEQ ID NO: 460027 - RNA, 65 nt, Homo Sapiens; identical to SEQ ID NO: 242117

SEQ ID NO: 460028 - RNA, 65 nt, Homo Sapiens; identical to SEQ ID NO: 242118

SEQ ID NO: 460029 - RNA, 65 nt, Homo Sapiens; identical to SEQ ID NO: 242119

SEQ ID NO: 460030 - RNA, 65 nt, Homo Sapiens; identical to SEQ ID NO: 242120

SEQ ID NO: 460031 - RNA, 65 nt, Homo Sapiens; identical to SEQ ID NO: 242121

SEQ ID NO: 460032 - RNA, 65 nt, Homo Sapiens; identical to SEQ ID NO: 242122

SEQ ID NO: 460033 - RNA, 65 nt, Homo Sapiens; identical to SEQ ID NO: 242123

SEQ ID NO: 460034 - RNA, 65 nt, Homo Sapiens; identical to SEQ ID NO: 242124

SEQ ID NO: 460035 - RNA, 65 nt, Homo Sapiens; identical to SEQ ID NO: 242125

SEQ ID NO: 460036 - RNA, 65 nt, Homo Sapiens; identical to SEQ ID NO: 242126

SEQ ID NO: 460037 - RNA, 65 nt, Homo Sapiens; identical to SEQ ID NO: 242127

SEQ ID NO: 460038 - RNA, 65 nt, Homo Sapiens; identical to SEQ ID NO: 242128

SEQ ID NO: 460039 - RNA, 65 nt, Homo Sapiens; identical to SEQ ID NO: 242129

SEQ ID NO: 460040 - RNA, 65 nt, Homo Sapiens; identical to SEQ ID NO: 242130

SEQ ID NO: 460041 - RNA, 65 nt, Homo Sapiens; identical to SEQ ID NO: 242131

SEQ ID NO: 460042 - RNA, 65 nt, Homo Sapiens; identical to SEQ ID NO: 242132

SEQ ID NO: 460043 - RNA, 65 nt, Homo Sapiens; identical to SEQ ID NO: 242133

SEQ ID NO: 460044 - RNA, 65 nt, Homo Sapiens; identical to SEQ ID NO: 242134

SEQ ID NO: 460045 - RNA, 65 nt, Homo Sapiens; identical to SEQ ID NO: 242135

SEQ ID NO: 460046 - RNA, 65 nt, Homo Sapiens; identical to SEQ ID NO: 242136

SEQ ID NO: 460047 - RNA, 65 nt, Homo Sapiens; identical to SEQ ID NO: 242137

SEQ ID NO: 460048 - RNA, 65 nt, Homo Sapiens; identical to SEQ ID NO: 242138

SEQ ID NO: 460049 - RNA, 65 nt, Homo Sapiens; identical to SEQ ID NO: 242139

SEQ ID NO: 460050 - RNA, 65 nt, Homo Sapiens; identical to SEQ ID NO: 242140

SEQ ID NO: 460051 - RNA, 65 nt, Homo Sapiens; identical to SEQ ID NO: 242141

SEQ ID NO: 460052 - RNA, 62 nt, Homo Sapiens; identical to SEQ ID NO: 242142

SEQ ID NO: 460053 - RNA, 65 nt, Homo Sapiens; identical to SEQ ID NO: 242143

SEQ ID NO: 460054 - RNA, 65 nt, Homo Sapiens; identical to SEQ ID NO: 242144

SEQ ID NO: 460055 - RNA, 65 nt, Homo Sapiens; identical to SEQ ID NO: 242145

SEQ ID NO: 460056 - RNA, 65 nt, Homo Sapiens; identical to SEQ ID NO: 242146

SEQ ID NO: 460057 - RNA, 65 nt, Homo Sapiens; identical to SEQ ID NO: 242147

SEQ ID NO: 460058 - RNA, 65 nt, Homo Sapiens; identical to SEQ ID NO: 242148

SEQ ID NO: 460059 - RNA, 65 nt, Homo Sapiens; identical to SEQ ID NO: 242149

SEQ ID NO: 460060 - RNA, 65 nt, Homo Sapiens; identical to SEQ ID NO: 242150

SEQ ID NO: 460061 - RNA, 65 nt, Homo Sapiens; identical to SEQ ID NO: 242151

SEQ ID NO: 460062 - RNA, 65 nt, Homo Sapiens; identical to SEQ ID NO: 242152

SEQ ID NO: 460063 - RNA, 65 nt, Homo Sapiens; identical to SEQ ID NO: 242153

SEQ ID NO: 460064 - RNA, 65 nt, Homo Sapiens; identical to SEQ ID NO: 242154

SEQ ID NO: 460065 - RNA, 65 nt, Homo Sapiens; identical to SEQ ID NO: 242155

SEQ ID NO: 460066 - RNA, 65 nt, Homo Sapiens; identical to SEQ ID NO: 242156

SEQ ID NO: 460067 - RNA, 65 nt, Homo Sapiens; identical to SEQ ID NO: 242157

SEQ ID NO: 460068 - RNA, 65 nt, Homo Sapiens; identical to SEQ ID NO: 242158

SEQ ID NO: 460069 - RNA, 65 nt, Homo Sapiens; identical to SEQ ID NO: 242159

SEQ ID NO: 460070 - RNA, 65 nt, Homo Sapiens; identical to SEQ ID NO: 242160

SEQ ID NO: 460071 - RNA, 65 nt, Homo Sapiens; identical to SEQ ID NO: 242161

SEQ ID NO: 460072 - RNA, 65 nt, Homo Sapiens; identical to SEQ ID NO: 242162

SEQ ID NO: 460073 - RNA, 65 nt, Homo Sapiens; identical to SEQ ID NO: 242163

SEQ ID NO: 460074 - RNA, 65 nt, Homo Sapiens; identical to SEQ ID NO: 242164

SEQ ID NO: 460075 - RNA, 65 nt, Homo Sapiens; identical to SEQ ID NO: 242165

SEQ ID NO: 460076 - RNA, 65 nt, Homo Sapiens; identical to SEQ ID NO: 242166

SEQ ID NO: 460077 - RNA, 65 nt, Homo Sapiens; identical to SEQ ID NO: 242167

SEQ ID NO: 460078 - RNA, 65 nt, Homo Sapiens; identical to SEQ ID NO: 242168

SEQ ID NO: 460079 - RNA, 60 nt, Homo Sapiens; identical to SEQ ID NO: 242169

SEQ ID NO: 460080 - RNA, 65 nt, Homo Sapiens; identical to SEQ ID NO: 242170

SEQ ID NO: 460081 - RNA, 65 nt, Homo Sapiens; identical to SEQ ID NO: 242171

SEQ ID NO: 460082 - RNA, 65 nt, Homo Sapiens; identical to SEQ ID NO: 242172

SEQ ID NO: 460083 - RNA, 65 nt, Homo Sapiens; identical to SEQ ID NO: 242173

SEQ ID NO: 460084 - RNA, 65 nt, Homo Sapiens; identical to SEQ ID NO: 242174

SEQ ID NO: 460085 - RNA, 65 nt, Homo Sapiens; identical to SEQ ID NO: 242175

SEQ ID NO: 460086 - RNA, 65 nt, Homo Sapiens; identical to SEQ ID NO: 242176

SEQ ID NO: 460087 - RNA, 65 nt, Homo Sapiens; identical to SEQ ID NO: 242177

SEQ ID NO: 460088 - RNA, 65 nt, Homo Sapiens; identical to SEQ ID NO: 242178

SEQ ID NO: 460089 - RNA, 65 nt, Homo Sapiens; identical to SEQ ID NO: 242179

SEQ ID NO: 460090 - RNA, 65 nt, Homo Sapiens; identical to SEQ ID NO: 242180

SEQ ID NO: 460091 - RNA, 65 nt, Homo Sapiens; identical to SEQ ID NO: 242181

SEQ ID NO: 460092 - RNA, 65 nt, Homo Sapiens; identical to SEQ ID NO: 242182

SEQ ID NO: 460093 - RNA, 65 nt, Homo Sapiens; identical to SEQ ID NO: 242183

SEQ ID NO: 460094 - RNA, 65 nt, Homo Sapiens; identical to SEQ ID NO: 242184

SEQ ID NO: 460095 - RNA, 65 nt, Homo Sapiens; identical to SEQ ID NO: 242185

SEQ ID NO: 460096 - RNA, 65 nt, Homo Sapiens; identical to SEQ ID NO: 242186

SEQ ID NO: 460097 - RNA, 65 nt, Homo Sapiens; identical to SEQ ID NO: 242187

SEQ ID NO: 460098 - RNA, 65 nt, Homo Sapiens; identical to SEQ ID NO: 242188

SEQ ID NO: 460099 - RNA, 65 nt, Homo Sapiens; identical to SEQ ID NO: 242189

SEQ ID NO: 460100 - RNA, 65 nt, Homo Sapiens; identical to SEQ ID NO: 242190

SEQ ID NO: 460101 - RNA, 65 nt, Homo Sapiens; identical to SEQ ID NO: 242191

SEQ ID NO: 460102 - RNA, 65 nt, Homo Sapiens; identical to SEQ ID NO: 242192

SEQ ID NO: 460103 - RNA, 65 nt, Homo Sapiens; identical to SEQ ID NO: 242193

SEQ ID NO: 460104 - RNA, 65 nt, Homo Sapiens; identical to SEQ ID NO: 242194

SEQ ID NO: 460105 - RNA, 65 nt, Homo Sapiens; identical to SEQ ID NO: 242195

SEQ ID NO: 460106 - RNA, 65 nt, Homo Sapiens; identical to SEQ ID NO: 242196

SEQ ID NO: 460107 - RNA, 65 nt, Homo Sapiens; identical to SEQ ID NO: 242197

SEQ ID NO: 460108 - RNA, 65 nt, Homo Sapiens; identical to SEQ ID NO: 242198

SEQ ID NO: 460109 - RNA, 65 nt, Homo Sapiens; identical to SEQ ID NO: 242199

SEQ ID NO: 460110 - RNA, 65 nt, Homo Sapiens; identical to SEQ ID NO: 242200

SEQ ID NO: 460111 - RNA, 65 nt, Homo Sapiens; identical to SEQ ID NO: 242201

SEQ ID NO: 460112 - RNA, 65 nt, Homo Sapiens; identical to SEQ ID NO: 242202

SEQ ID NO: 460113 - RNA, 65 nt, Homo Sapiens; identical to SEQ ID NO: 242203

SEQ ID NO: 460114 - RNA, 65 nt, Homo Sapiens; identical to SEQ ID NO: 242204

SEQ ID NO: 460115 - RNA, 65 nt, Homo Sapiens; identical to SEQ ID NO: 242205

SEQ ID NO: 460116 - RNA, 65 nt, Homo Sapiens; identical to SEQ ID NO: 242206

SEQ ID NO: 460117 - RNA, 65 nt, Homo Sapiens; identical to SEQ ID NO: 242207

SEQ ID NO: 460118 - RNA, 65 nt, Homo Sapiens; identical to SEQ ID NO: 242208

SEQ ID NO: 460119 - RNA, 65 nt, Homo Sapiens; identical to SEQ ID NO: 242209

SEQ ID NO: 460120 - RNA, 65 nt, Homo Sapiens; identical to SEQ ID NO: 242210

SEQ ID NO: 460121 - RNA, 65 nt, Homo Sapiens; identical to SEQ ID NO: 242211

SEQ ID NO: 460122 - RNA, 65 nt, Homo Sapiens; identical to SEQ ID NO: 242212

SEQ ID NO: 460123 - RNA, 65 nt, Homo Sapiens; identical to SEQ ID NO: 242213

SEQ ID NO: 460124 - RNA, 65 nt, Homo Sapiens; identical to SEQ ID NO: 242214

SEQ ID NO: 460125 - RNA, 65 nt, Homo Sapiens; identical to SEQ ID NO: 242215

SEQ ID NO: 460126 - RNA, 65 nt, Homo Sapiens; identical to SEQ ID NO: 242216

SEQ ID NO: 460127 - RNA, 65 nt, Homo Sapiens; identical to SEQ ID NO: 242217

SEQ ID NO: 460128 - RNA, 50 nt, Homo Sapiens; identical to SEQ ID NO: 242218

SEQ ID NO: 460129 - RNA, 65 nt, Homo Sapiens; identical to SEQ ID NO: 242219

SEQ ID NO: 460130 - RNA, 65 nt, Homo Sapiens; identical to SEQ ID NO: 242220

SEQ ID NO: 460131 - RNA, 65 nt, Homo Sapiens; identical to SEQ ID NO: 242221

SEQ ID NO: 460132 - RNA, 65 nt, Homo Sapiens; identical to SEQ ID NO: 242222

SEQ ID NO: 460133 - RNA, 65 nt, Homo Sapiens; identical to SEQ ID NO: 242223

SEQ ID NO: 460134 - RNA, 65 nt, Homo Sapiens; identical to SEQ ID NO: 242224

SEQ ID NO: 460135 - RNA, 65 nt, Homo Sapiens; identical to SEQ ID NO: 242225

SEQ ID NO: 460136 - RNA, 65 nt, Homo Sapiens; identical to SEQ ID NO: 242226

SEQ ID NO: 460137 - RNA, 65 nt, Homo Sapiens; identical to SEQ ID NO: 242227

SEQ ID NO: 460138 - RNA, 65 nt, Homo Sapiens; identical to SEQ ID NO: 242228

SEQ ID NO: 460139 - RNA, 65 nt, Homo Sapiens; identical to SEQ ID NO: 242229

SEQ ID NO: 460140 - RNA, 65 nt, Homo Sapiens; identical to SEQ ID NO: 242230

SEQ ID NO: 460141 - RNA, 65 nt, Homo Sapiens; identical to SEQ ID NO: 242231

SEQ ID NO: 460142 - RNA, 65 nt, Homo Sapiens; identical to SEQ ID NO: 242232

SEQ ID NO: 460143 - RNA, 65 nt, Homo Sapiens; identical to SEQ ID NO: 242233

SEQ ID NO: 460144 - RNA, 65 nt, Homo Sapiens; identical to SEQ ID NO: 242234

SEQ ID NO: 460145 - RNA, 65 nt, Homo Sapiens; identical to SEQ ID NO: 242235

SEQ ID NO: 460146 - RNA, 65 nt, Homo Sapiens; identical to SEQ ID NO: 242236

SEQ ID NO: 460147 - RNA, 65 nt, Homo Sapiens; identical to SEQ ID NO: 242237

SEQ ID NO: 460148 - RNA, 65 nt, Homo Sapiens; identical to SEQ ID NO: 242238

SEQ ID NO: 460149 - RNA, 65 nt, Homo Sapiens; identical to SEQ ID NO: 242239

SEQ ID NO: 460150 - RNA, 65 nt, Homo Sapiens; identical to SEQ ID NO: 242240

SEQ ID NO: 460151 - RNA, 65 nt, Homo Sapiens; identical to SEQ ID NO: 242241

SEQ ID NO: 460152 - RNA, 65 nt, Homo Sapiens; identical to SEQ ID NO: 242242

SEQ ID NO: 460153 - RNA, 65 nt, Homo Sapiens; identical to SEQ ID NO: 242243

SEQ ID NO: 460154 - RNA, 65 nt, Homo Sapiens; identical to SEQ ID NO: 242244

SEQ ID NO: 460155 - RNA, 65 nt, Homo Sapiens; identical to SEQ ID NO: 242245

SEQ ID NO: 460156 - RNA, 65 nt, Homo Sapiens; identical to SEQ ID NO: 242246

SEQ ID NO: 460157 - RNA, 65 nt, Homo Sapiens; identical to SEQ ID NO: 242247

SEQ ID NO: 460158 - RNA, 65 nt, Homo Sapiens; identical to SEQ ID NO: 242248

SEQ ID NO: 460159 - RNA, 65 nt, Homo Sapiens; identical to SEQ ID NO: 242249

SEQ ID NO: 460160 - RNA, 65 nt, Homo Sapiens; identical to SEQ ID NO: 242250

SEQ ID NO: 460161 - RNA, 65 nt, Homo Sapiens; identical to SEQ ID NO: 242251

SEQ ID NO: 460162 - RNA, 65 nt, Homo Sapiens; identical to SEQ ID NO: 242252

SEQ ID NO: 460163 - RNA, 65 nt, Homo Sapiens; identical to SEQ ID NO: 242253

SEQ ID NO: 460164 - RNA, 65 nt, Homo Sapiens; identical to SEQ ID NO: 242254

SEQ ID NO: 460165 - RNA, 65 nt, Homo Sapiens; identical to SEQ ID NO: 242255

SEQ ID NO: 460166 - RNA, 65 nt, Homo Sapiens; identical to SEQ ID NO: 242256

SEQ ID NO: 460167 - RNA, 65 nt, Homo Sapiens; identical to SEQ ID NO: 242257

SEQ ID NO: 460168 - RNA, 65 nt, Homo Sapiens; identical to SEQ ID NO: 242258

SEQ ID NO: 460169 - RNA, 65 nt, Homo Sapiens; identical to SEQ ID NO: 242259

SEQ ID NO: 460170 - RNA, 65 nt, Homo Sapiens; identical to SEQ ID NO: 242260

SEQ ID NO: 460171 - RNA, 65 nt, Homo Sapiens; identical to SEQ ID NO: 242261

SEQ ID NO: 460172 - RNA, 65 nt, Homo Sapiens; identical to SEQ ID NO: 242262

SEQ ID NO: 460173 - RNA, 65 nt, Homo Sapiens; identical to SEQ ID NO: 242263

SEQ ID NO: 460174 - RNA, 65 nt, Homo Sapiens; identical to SEQ ID NO: 242264

SEQ ID NO: 460175 - RNA, 65 nt, Homo Sapiens; identical to SEQ ID NO: 242261

SEQ ID NO: 460176 - RNA, 65 nt, Homo Sapiens; identical to SEQ ID NO: 242266

SEQ ID NO: 460177 - RNA, 65 nt, Homo Sapiens; identical to SEQ ID NO: 242267

SEQ ID NO: 460178 - RNA, 65 nt, Homo Sapiens; identical to SEQ ID NO: 242268

SEQ ID NO: 460179 - RNA, 65 nt, Homo Sapiens; identical to SEQ ID NO: 242269

SEQ ID NO: 460180 - RNA, 65 nt, Homo Sapiens; identical to SEQ ID NO: 242270

SEQ ID NO: 460181 - RNA, 65 nt, Homo Sapiens; identical to SEQ ID NO: 242271

SEQ ID NO: 460182 - RNA, 65 nt, Homo Sapiens; identical to SEQ ID NO: 242272

SEQ ID NO: 460183 - RNA, 65 nt, Homo Sapiens; identical to SEQ ID NO: 242273

SEQ ID NO: 460184 - RNA, 65 nt, Homo Sapiens; identical to SEQ ID NO: 242274

SEQ ID NO: 460185 - RNA, 65 nt, Homo Sapiens; identical to SEQ ID NO: 242275

SEQ ID NO: 460186 - RNA, 65 nt, Homo Sapiens; identical to SEQ ID NO: 242276

SEQ ID NO: 460187 - RNA, 65 nt, Homo Sapiens; identical to SEQ ID NO: 242277

SEQ ID NO: 460188 - RNA, 65 nt, Homo Sapiens; identical to SEQ ID NO: 242278

SEQ ID NO: 460189 - RNA, 65 nt, Homo Sapiens; identical to SEQ ID NO: 242279

SEQ ID NO: 460190 - RNA, 65 nt, Homo Sapiens; identical to SEQ ID NO: 242280

SEQ ID NO: 460191 - RNA, 65 nt, Homo Sapiens; identical to SEQ ID NO: 242281

SEQ ID NO: 460192 - RNA, 65 nt, Homo Sapiens; identical to SEQ ID NO: 242282

SEQ ID NO: 460193 - RNA, 65 nt, Homo Sapiens; identical to SEQ ID NO: 242283

SEQ ID NO: 460194 - RNA, 65 nt, Homo Sapiens; identical to SEQ ID NO: 242284

SEQ ID NO: 460195 - RNA, 65 nt, Homo Sapiens; identical to SEQ ID NO: 242285

SEQ ID NO: 460196 - RNA, 65 nt, Homo Sapiens; identical to SEQ ID NO: 242286

SEQ ID NO: 460197 - RNA, 65 nt, Homo Sapiens; identical to SEQ ID NO: 242287

SEQ ID NO: 460198 - RNA, 65 nt, Homo Sapiens; identical to SEQ ID NO: 242288

SEQ ID NO: 460199 - RNA, 65 nt, Homo Sapiens; identical to SEQ ID NO: 242289

SEQ ID NO: 460200 - RNA, 65 nt, Homo Sapiens; identical to SEQ ID NO: 242290

SEQ ID NO: 460201 - RNA, 65 nt, Homo Sapiens; identical to SEQ ID NO: 242291

SEQ ID NO: 460202 - RNA, 65 nt, Homo Sapiens; identical to SEQ ID NO: 242292

SEQ ID NO: 460203 - RNA, 65 nt, Homo Sapiens; identical to SEQ ID NO: 242293

SEQ ID NO: 460204 - RNA, 65 nt, Homo Sapiens; identical to SEQ ID NO: 242294

SEQ ID NO: 460205 - RNA, 65 nt, Homo Sapiens; identical to SEQ ID NO: 242295

SEQ ID NO: 460206 - RNA, 65 nt, Homo Sapiens; identical to SEQ ID NO: 242296

SEQ ID NO: 460207 - RNA, 65 nt, Homo Sapiens; identical to SEQ ID NO: 242297

SEQ ID NO: 460208 - RNA, 65 nt, Homo Sapiens; identical to SEQ ID NO: 242298

SEQ ID NO: 460209 - RNA, 65 nt, Homo Sapiens; identical to SEQ ID NO: 242299

SEQ ID NO: 460210 - RNA, 65 nt, Homo Sapiens; identical to SEQ ID NO: 242300

SEQ ID NO: 460211 - RNA, 65 nt, Homo Sapiens; identical to SEQ ID NO: 242301

SEQ ID NO: 460212 - RNA, 65 nt, Homo Sapiens; identical to SEQ ID NO: 242302

SEQ ID NO: 460213 - RNA, 65 nt, Homo Sapiens; identical to SEQ ID NO: 242303

SEQ ID NO: 460214 - RNA, 65 nt, Homo Sapiens; identical to SEQ ID NO: 242304

SEQ ID NO: 460215 - RNA, 65 nt, Homo Sapiens; identical to SEQ ID NO: 242305

SEQ ID NO: 460216 - RNA, 65 nt, Homo Sapiens; identical to SEQ ID NO: 242306

SEQ ID NO: 460217 - RNA, 65 nt, Homo Sapiens; identical to SEQ ID NO: 242307

SEQ ID NO: 460218 - RNA, 60 nt, Homo Sapiens; identical to SEQ ID NO: 37632

SEQ ID NO: 460219 - RNA, 60 nt, Homo Sapiens; identical to SEQ ID NO: 37633

SEQ ID NO: 460220 - RNA, 60 nt, Homo Sapiens; identical to SEQ ID NO: 37634

SEQ ID NO: 460221 - RNA, 60 nt, Homo Sapiens; identical to SEQ ID NO: 37635

SEQ ID NO: 460222 - RNA, 60 nt, Homo Sapiens; identical to SEQ ID NO: 37636

SEQ ID NO: 460223 - RNA, 60 nt, Homo Sapiens; identical to SEQ ID NO: 37637

SEQ ID NO: 460224 - RNA, 60 nt, Homo Sapiens; identical to SEQ ID NO: 37638

SEQ ID NO: 460225 - RNA, 60 nt, Homo Sapiens; identical to SEQ ID NO: 37639

SEQ ID NO: 460226 - RNA, 60 nt, Homo Sapiens; identical to SEQ ID NO: 37640

SEQ ID NO: 460227 - RNA, 60 nt, Homo Sapiens; identical to SEQ ID NO: 37641

SEQ ID NO: 460228 - RNA, 60 nt, Homo Sapiens; identical to SEQ ID NO: 37642

SEQ ID NO: 460229 - RNA, 60 nt, Homo Sapiens; identical to SEQ ID NO: 37643

SEQ ID NO: 460230 - RNA, 60 nt, Homo Sapiens; identical to SEQ ID NO: 37644

SEQ ID NO: 460231 - RNA, 60 nt, Homo Sapiens; identical to SEQ ID NO: 37645

SEQ ID NO: 460232 - RNA, 60 nt, Homo Sapiens; identical to SEQ ID NO: 37646

SEQ ID NO: 460233 - RNA, 60 nt, Homo Sapiens; identical to SEQ ID NO: 37647

SEQ ID NO: 460234 - RNA, 60 nt, Homo Sapiens; identical to SEQ ID NO: 37648

SEQ ID NO: 460235 - RNA, 60 nt, Homo Sapiens; identical to SEQ ID NO: 37649

SEQ ID NO: 460236 - RNA, 60 nt, Homo Sapiens; identical to SEQ ID NO: 37650

SEQ ID NO: 460237 - RNA, 60 nt, Homo Sapiens; identical to SEQ ID NO: 37651

SEQ ID NO: 460238 - RNA, 60 nt, Homo Sapiens; identical to SEQ ID NO: 37652

SEQ ID NO: 460239 - RNA, 60 nt, Homo Sapiens; identical to SEQ ID NO: 37653

SEQ ID NO: 460240 - RNA, 60 nt, Homo Sapiens; identical to SEQ ID NO: 37654

SEQ ID NO: 460241 - RNA, 60 nt, Homo Sapiens; identical to SEQ ID NO: 37655

SEQ ID NO: 460242 - RNA, 60 nt, Homo Sapiens; identical to SEQ ID NO: 37656

SEQ ID NO: 460243 - RNA, 60 nt, Homo Sapiens; identical to SEQ ID NO: 37657

SEQ ID NO: 460244 - RNA, 60 nt, Homo Sapiens; identical to SEQ ID NO: 37658

SEQ ID NO: 460245 - RNA, 60 nt, Homo Sapiens; identical to SEQ ID NO: 37659

SEQ ID NO: 460246 - RNA, 60 nt, Homo Sapiens; identical to SEQ ID NO: 37660

SEQ ID NO: 460247 - RNA, 60 nt, Homo Sapiens; identical to SEQ ID NO: 37661

SEQ ID NO: 460248 - RNA, 60 nt, Homo Sapiens; identical to SEQ ID NO: 37662

SEQ ID NO: 460249 - RNA, 60 nt, Homo Sapiens; identical to SEQ ID NO: 37663

SEQ ID NO: 460250 - RNA, 60 nt, Homo Sapiens; identical to SEQ ID NO: 37664

SEQ ID NO: 460251 - RNA, 60 nt, Homo Sapiens; identical to SEQ ID NO: 37665

SEQ ID NO: 460252 - RNA, 60 nt, Homo Sapiens; identical to SEQ ID NO: 37666

SEQ ID NO: 460253 - RNA, 60 nt, Homo Sapiens; identical to SEQ ID NO: 37667

SEQ ID NO: 460254 - RNA, 60 nt, Homo Sapiens; identical to SEQ ID NO: 37668

SEQ ID NO: 460255 - RNA, 60 nt, Homo Sapiens; identical to SEQ ID NO: 37669

SEQ ID NO: 460256 - RNA, 60 nt, Homo Sapiens; identical to SEQ ID NO: 37670

SEQ ID NO: 460257 - RNA, 60 nt, Homo Sapiens; identical to SEQ ID NO: 37671

SEQ ID NO: 460258 - RNA, 60 nt, Homo Sapiens; identical to SEQ ID NO: 37672

SEQ ID NO: 460259 - RNA, 50 nt, Homo Sapiens; identical to SEQ ID NO: 37673

SEQ ID NO: 460260 - RNA, 60 nt, Homo Sapiens; identical to SEQ ID NO: 37674

SEQ ID NO: 460261 - RNA, 60 nt, Homo Sapiens; identical to SEQ ID NO: 37675

SEQ ID NO: 460262 - RNA, 60 nt, Homo Sapiens; identical to SEQ ID NO: 37676

SEQ ID NO: 460263 - RNA, 60 nt, Homo Sapiens; identical to SEQ ID NO: 37677

SEQ ID NO: 460264 - RNA, 60 nt, Homo Sapiens; identical to SEQ ID NO: 37678

SEQ ID NO: 460265 - RNA, 60 nt, Homo Sapiens; identical to SEQ ID NO: 37679

SEQ ID NO: 460266 - RNA, 60 nt, Homo Sapiens; identical to SEQ ID NO: 37680

SEQ ID NO: 460267 - RNA, 60 nt, Homo Sapiens; identical to SEQ ID NO: 37681

SEQ ID NO: 460268 - RNA, 60 nt, Homo Sapiens; identical to SEQ ID NO: 37682

SEQ ID NO: 460269 - RNA, 60 nt, Homo Sapiens; identical to SEQ ID NO: 37683

SEQ ID NO: 460270 - RNA, 60 nt, Homo Sapiens; identical to SEQ ID NO: 37684

SEQ ID NO: 460271 - RNA, 60 nt, Homo Sapiens; identical to SEQ ID NO: 37685

SEQ ID NO: 460272 - RNA, 60 nt, Homo Sapiens; identical to SEQ ID NO: 37686

SEQ ID NO: 460273 - RNA, 60 nt, Homo Sapiens; identical to SEQ ID NO: 37687

SEQ ID NO: 460274 - RNA, 60 nt, Homo Sapiens; identical to SEQ ID NO: 37688

SEQ ID NO: 460275 - RNA, 60 nt, Homo Sapiens; identical to SEQ ID NO: 37689

SEQ ID NO: 460276 - RNA, 60 nt, Homo Sapiens; identical to SEQ ID NO: 37690

SEQ ID NO: 460277 - RNA, 60 nt, Homo Sapiens; identical to SEQ ID NO: 37691

SEQ ID NO: 460278 - RNA, 60 nt, Homo Sapiens; identical to SEQ ID NO: 37692

SEQ ID NO: 460279 - RNA, 60 nt, Homo Sapiens; identical to SEQ ID NO: 37693

SEQ ID NO: 460280 - RNA, 60 nt, Homo Sapiens; identical to SEQ ID NO: 37694

SEQ ID NO: 460281 - RNA, 60 nt, Homo Sapiens; identical to SEQ ID NO: 37695

SEQ ID NO: 460282 - RNA, 60 nt, Homo Sapiens; identical to SEQ ID NO: 37696

SEQ ID NO: 460283 - RNA, 60 nt, Homo Sapiens; identical to SEQ ID NO: 37697

SEQ ID NO: 460284 - RNA, 60 nt, Homo Sapiens; identical to SEQ ID NO: 37698

SEQ ID NO: 460285 - RNA, 60 nt, Homo Sapiens; identical to SEQ ID NO: 37699

SEQ ID NO: 460286 - RNA, 60 nt, Homo Sapiens; identical to SEQ ID NO: 37700

SEQ ID NO: 460287 - RNA, 60 nt, Homo Sapiens; identical to SEQ ID NO: 37701

SEQ ID NO: 460288 - RNA, 60 nt, Homo Sapiens; identical to SEQ ID NO: 37702

SEQ ID NO: 460289 - RNA, 60 nt, Homo Sapiens; identical to SEQ ID NO: 37703

SEQ ID NO: 460290 - RNA, 60 nt, Homo Sapiens; identical to SEQ ID NO: 37704

SEQ ID NO: 460291 - RNA, 60 nt, Homo Sapiens; identical to SEQ ID NO: 37705

SEQ ID NO: 460292 - RNA, 60 nt, Homo Sapiens; identical to SEQ ID NO: 37706

SEQ ID NO: 460293 - RNA, 60 nt, Homo Sapiens; identical to SEQ ID NO: 37707

SEQ ID NO: 460294 - RNA, 60 nt, Homo Sapiens; identical to SEQ ID NO: 37708

SEQ ID NO: 460295 - RNA, 60 nt, Homo Sapiens; identical to SEQ ID NO: 37709

SEQ ID NO: 460296 - RNA, 60 nt, Homo Sapiens; identical to SEQ ID NO: 37710

SEQ ID NO: 460297 - RNA, 60 nt, Homo Sapiens; identical to SEQ ID NO: 37711

SEQ ID NO: 460298 - RNA, 60 nt, Homo Sapiens; identical to SEQ ID NO: 37712

SEQ ID NO: 460299 - RNA, 60 nt, Homo Sapiens; identical to SEQ ID NO: 37713

SEQ ID NO: 460300 - RNA, 60 nt, Homo Sapiens; identical to SEQ ID NO: 37714

SEQ ID NO: 460301 - RNA, 60 nt, Homo Sapiens; identical to SEQ ID NO: 37715

SEQ ID NO: 460302 - RNA, 60 nt, Homo Sapiens; identical to SEQ ID NO: 37716

SEQ ID NO: 460303 - RNA, 60 nt, Homo Sapiens; identical to SEQ ID NO: 37717

SEQ ID NO: 460304 - RNA, 60 nt, Homo Sapiens; identical to SEQ ID NO: 37718

SEQ ID NO: 460305 - RNA, 60 nt, Homo Sapiens; identical to SEQ ID NO: 37719

SEQ ID NO: 460306 - RNA, 60 nt, Homo Sapiens; identical to SEQ ID NO: 37720

SEQ ID NO: 460307 - RNA, 60 nt, Homo Sapiens; identical to SEQ ID NO: 37721

SEQ ID NO: 460308 - RNA, 60 nt, Homo Sapiens; identical to SEQ ID NO: 37722

SEQ ID NO: 460309 - RNA, 60 nt, Homo Sapiens; identical to SEQ ID NO: 37723

SEQ ID NO: 460310 - RNA, 60 nt, Homo Sapiens; identical to SEQ ID NO: 37724

SEQ ID NO: 460311 - RNA, 60 nt, Homo Sapiens; identical to SEQ ID NO: 37725

SEQ ID NO: 460312 - RNA, 60 nt, Homo Sapiens; identical to SEQ ID NO: 37726

SEQ ID NO: 460313 - RNA, 60 nt, Homo Sapiens; identical to SEQ ID NO: 37727

SEQ ID NO: 460314 - RNA, 60 nt, Homo Sapiens; identical to SEQ ID NO: 37728

SEQ ID NO: 460315 - RNA, 60 nt, Homo Sapiens; identical to SEQ ID NO: 37729

SEQ ID NO: 460316 - RNA, 60 nt, Homo Sapiens; identical to SEQ ID NO: 37730

SEQ ID NO: 460317 - RNA, 60 nt, Homo Sapiens; identical to SEQ ID NO: 37731

SEQ ID NO: 460318 - RNA, 60 nt, Homo Sapiens; identical to SEQ ID NO: 37732

SEQ ID NO: 460319 - RNA, 60 nt, Homo Sapiens; identical to SEQ ID NO: 37733

SEQ ID NO: 460320 - RNA, 60 nt, Homo Sapiens; identical to SEQ ID NO: 37734

SEQ ID NO: 460321 - RNA, 60 nt, Homo Sapiens; identical to SEQ ID NO: 37735

SEQ ID NO: 460322 - RNA, 60 nt, Homo Sapiens; identical to SEQ ID NO: 37736

SEQ ID NO: 460323 - RNA, 60 nt, Homo Sapiens; identical to SEQ ID NO: 37737

SEQ ID NO: 460324 - RNA, 60 nt, Homo Sapiens; identical to SEQ ID NO: 37738

SEQ ID NO: 460325 - RNA, 60 nt, Homo Sapiens; identical to SEQ ID NO: 37739

SEQ ID NO: 460326 - RNA, 60 nt, Homo Sapiens; identical to SEQ ID NO: 37740

SEQ ID NO: 460327 - RNA, 60 nt, Homo Sapiens; identical to SEQ ID NO: 37741

SEQ ID NO: 460328 - RNA, 60 nt, Homo Sapiens; identical to SEQ ID NO: 37742

SEQ ID NO: 460329 - RNA, 60 nt, Homo Sapiens; identical to SEQ ID NO: 37743

SEQ ID NO: 460330 - RNA, 60 nt, Homo Sapiens; identical to SEQ ID NO: 37744

SEQ ID NO: 460331 - RNA, 60 nt, Homo Sapiens; identical to SEQ ID NO: 37745

SEQ ID NO: 460332 - RNA, 60 nt, Homo Sapiens; identical to SEQ ID NO: 37746

SEQ ID NO: 460333 - RNA, 60 nt, Homo Sapiens; identical to SEQ ID NO: 37747

SEQ ID NO: 460334 - RNA, 60 nt, Homo Sapiens; identical to SEQ ID NO: 37748

SEQ ID NO: 460335 - RNA, 60 nt, Homo Sapiens; identical to SEQ ID NO: 37749

SEQ ID NO: 460336 - RNA, 60 nt, Homo Sapiens; identical to SEQ ID NO: 37750

SEQ ID NO: 460337 - RNA, 60 nt, Homo Sapiens; identical to SEQ ID NO: 37751

SEQ ID NO: 460338 - RNA, 60 nt, Homo Sapiens; identical to SEQ ID NO: 37752

SEQ ID NO: 460339 - RNA, 51 nt, Homo Sapiens; identical to SEQ ID NO: 37753

SEQ ID NO: 460340 - RNA, 60 nt, Homo Sapiens; identical to SEQ ID NO: 37754

SEQ ID NO: 460341 - RNA, 60 nt, Homo Sapiens; identical to SEQ ID NO: 37755

SEQ ID NO: 460342 - RNA, 60 nt, Homo Sapiens; identical to SEQ ID NO: 37756

SEQ ID NO: 460343 - RNA, 60 nt, Homo Sapiens; identical to SEQ ID NO: 37757

SEQ ID NO: 460344 - RNA, 60 nt, Homo Sapiens; identical to SEQ ID NO: 37758

SEQ ID NO: 460345 - RNA, 60 nt, Homo Sapiens; identical to SEQ ID NO: 37759

SEQ ID NO: 460346 - RNA, 60 nt, Homo Sapiens; identical to SEQ ID NO: 37760

SEQ ID NO: 460347 - RNA, 60 nt, Homo Sapiens; identical to SEQ ID NO: 37761

SEQ ID NO: 460348 - RNA, 60 nt, Homo Sapiens; identical to SEQ ID NO: 37762

SEQ ID NO: 460349 - RNA, 60 nt, Homo Sapiens; identical to SEQ ID NO: 37763

SEQ ID NO: 460350 - RNA, 60 nt, Homo Sapiens; identical to SEQ ID NO: 37764

SEQ ID NO: 460351 - RNA, 60 nt, Homo Sapiens; identical to SEQ ID NO: 37765

SEQ ID NO: 460352 - RNA, 54 nt, Homo Sapiens; identical to SEQ ID NO: 37766

SEQ ID NO: 460353 - RNA, 60 nt, Homo Sapiens; identical to SEQ ID NO: 37767

SEQ ID NO: 460354 - RNA, 60 nt, Homo Sapiens; identical to SEQ ID NO: 37768

SEQ ID NO: 460355 - RNA, 60 nt, Homo Sapiens; identical to SEQ ID NO: 37769

SEQ ID NO: 460356 - RNA, 60 nt, Homo Sapiens; identical to SEQ ID NO: 37770

SEQ ID NO: 460357 - RNA, 60 nt, Homo Sapiens; identical to SEQ ID NO: 37771

SEQ ID NO: 460358 - RNA, 60 nt, Homo Sapiens; identical to SEQ ID NO: 37772

SEQ ID NO: 460359 - RNA, 60 nt, Homo Sapiens; identical to SEQ ID NO: 37773

SEQ ID NO: 460360 - RNA, 60 nt, Homo Sapiens; identical to SEQ ID NO: 37774

SEQ ID NO: 460361 - RNA, 60 nt, Homo Sapiens; identical to SEQ ID NO: 37775

SEQ ID NO: 460362 - RNA, 60 nt, Homo Sapiens; identical to SEQ ID NO: 37776

SEQ ID NO: 460363 - RNA, 60 nt, Homo Sapiens; identical to SEQ ID NO: 37777

SEQ ID NO: 460364 - RNA, 60 nt, Homo Sapiens; identical to SEQ ID NO: 37778

SEQ ID NO: 460365 - RNA, 60 nt, Homo Sapiens; identical to SEQ ID NO: 37779

SEQ ID NO: 460366 - RNA, 60 nt, Homo Sapiens; identical to SEQ ID NO: 37780

SEQ ID NO: 460367 - RNA, 60 nt, Homo Sapiens; identical to SEQ ID NO: 37781

SEQ ID NO: 460368 - RNA, 60 nt, Homo Sapiens; identical to SEQ ID NO: 37782

SEQ ID NO: 460369 - RNA, 60 nt, Homo Sapiens; identical to SEQ ID NO: 37783

SEQ ID NO: 460370 - RNA, 60 nt, Homo Sapiens; identical to SEQ ID NO: 37784

SEQ ID NO: 460371 - RNA, 60 nt, Homo Sapiens; identical to SEQ ID NO: 37785

SEQ ID NO: 460372 - RNA, 60 nt, Homo Sapiens; identical to SEQ ID NO: 37786

SEQ ID NO: 460373 - RNA, 60 nt, Homo Sapiens; identical to SEQ ID NO: 37787

SEQ ID NO: 460374 - RNA, 60 nt, Homo Sapiens; identical to SEQ ID NO: 37788

SEQ ID NO: 460375 - RNA, 60 nt, Homo Sapiens; identical to SEQ ID NO: 37789

SEQ ID NO: 460376 - RNA, 60 nt, Homo Sapiens; identical to SEQ ID NO: 37790

SEQ ID NO: 460377 - RNA, 60 nt, Homo Sapiens; identical to SEQ ID NO: 37791

SEQ ID NO: 460378 - RNA, 60 nt, Homo Sapiens; identical to SEQ ID NO: 37792

SEQ ID NO: 460379 - RNA, 60 nt, Homo Sapiens; identical to SEQ ID NO: 37793

SEQ ID NO: 460380 - RNA, 60 nt, Homo Sapiens; identical to SEQ ID NO: 37794

SEQ ID NO: 460381 - RNA, 60 nt, Homo Sapiens; identical to SEQ ID NO: 37795

SEQ ID NO: 460382 - RNA, 60 nt, Homo Sapiens; identical to SEQ ID NO: 37796

SEQ ID NO: 460383 - RNA, 60 nt, Homo Sapiens; identical to SEQ ID NO: 37797

SEQ ID NO: 460384 - RNA, 60 nt, Homo Sapiens; identical to SEQ ID NO: 37798

SEQ ID NO: 460385 - RNA, 60 nt, Homo Sapiens; identical to SEQ ID NO: 37799

SEQ ID NO: 460386 - RNA, 60 nt, Homo Sapiens; identical to SEQ ID NO: 37800

SEQ ID NO: 460387 - RNA, 60 nt, Homo Sapiens; identical to SEQ ID NO: 37801

SEQ ID NO: 460388 - RNA, 60 nt, Homo Sapiens; identical to SEQ ID NO: 37802

SEQ ID NO: 460389 - RNA, 60 nt, Homo Sapiens; identical to SEQ ID NO: 37803

SEQ ID NO: 460390 - RNA, 60 nt, Homo Sapiens; identical to SEQ ID NO: 37804

SEQ ID NO: 460391 - RNA, 60 nt, Homo Sapiens; identical to SEQ ID NO: 37805

SEQ ID NO: 460392 - RNA, 60 nt, Homo Sapiens; identical to SEQ ID NO: 37806

SEQ ID NO: 460393 - RNA, 60 nt, Homo Sapiens; identical to SEQ ID NO: 37807

SEQ ID NO: 460394 - RNA, 60 nt, Homo Sapiens; identical to SEQ ID NO: 37808

SEQ ID NO: 460395 - RNA, 60 nt, Homo Sapiens; identical to SEQ ID NO: 37809

SEQ ID NO: 460396 - RNA, 60 nt, Homo Sapiens; identical to SEQ ID NO: 37810

SEQ ID NO: 460397 - RNA, 60 nt, Homo Sapiens; identical to SEQ ID NO: 37811

SEQ ID NO: 460398 - RNA, 60 nt, Homo Sapiens; identical to SEQ ID NO: 37812

SEQ ID NO: 460399 - RNA, 60 nt, Homo Sapiens; identical to SEQ ID NO: 37813

SEQ ID NO: 460400 - RNA, 60 nt, Homo Sapiens; identical to SEQ ID NO: 37814

SEQ ID NO: 460401 - RNA, 60 nt, Homo Sapiens; identical to SEQ ID NO: 37815

SEQ ID NO: 460402 - RNA, 60 nt, Homo Sapiens; identical to SEQ ID NO: 37816

SEQ ID NO: 460403 - RNA, 60 nt, Homo Sapiens; identical to SEQ ID NO: 37817

SEQ ID NO: 460404 - RNA, 60 nt, Homo Sapiens; identical to SEQ ID NO: 37818

SEQ ID NO: 460405 - RNA, 60 nt, Homo Sapiens; identical to SEQ ID NO: 37819

SEQ ID NO: 460406 - RNA, 60 nt, Homo Sapiens; identical to SEQ ID NO: 37820

SEQ ID NO: 460407 - RNA, 60 nt, Homo Sapiens; identical to SEQ ID NO: 37821

SEQ ID NO: 460408 - RNA, 60 nt, Homo Sapiens; identical to SEQ ID NO: 37822

SEQ ID NO: 460409 - RNA, 60 nt, Homo Sapiens; identical to SEQ ID NO: 37823

SEQ ID NO: 460410 - RNA, 60 nt, Homo Sapiens; identical to SEQ ID NO: 37824

SEQ ID NO: 460411 - RNA, 60 nt, Homo Sapiens; identical to SEQ ID NO: 37825

SEQ ID NO: 460412 - RNA, 60 nt, Homo Sapiens; identical to SEQ ID NO: 37826

SEQ ID NO: 460413 - RNA, 60 nt, Homo Sapiens; identical to SEQ ID NO: 37827

SEQ ID NO: 460414 - RNA, 60 nt, Homo Sapiens; identical to SEQ ID NO: 37828

SEQ ID NO: 460415 - RNA, 60 nt, Homo Sapiens; identical to SEQ ID NO: 37829

SEQ ID NO: 460416 - RNA, 60 nt, Homo Sapiens; identical to SEQ ID NO: 37830

SEQ ID NO: 460417 - RNA, 60 nt, Homo Sapiens; identical to SEQ ID NO: 37831

SEQ ID NO: 460418 - RNA, 60 nt, Homo Sapiens; identical to SEQ ID NO: 37832

SEQ ID NO: 460419 - RNA, 60 nt, Homo Sapiens; identical to SEQ ID NO: 37833

SEQ ID NO: 460420 - RNA, 60 nt, Homo Sapiens; identical to SEQ ID NO: 37834

SEQ ID NO: 460421 - RNA, 60 nt, Homo Sapiens; identical to SEQ ID NO: 37835

SEQ ID NO: 460422 - RNA, 60 nt, Homo Sapiens; identical to SEQ ID NO: 37836

SEQ ID NO: 460423 - RNA, 60 nt, Homo Sapiens; identical to SEQ ID NO: 37837

SEQ ID NO: 460424 - RNA, 60 nt, Homo Sapiens; identical to SEQ ID NO: 37838

SEQ ID NO: 460425 - RNA, 60 nt, Homo Sapiens; identical to SEQ ID NO: 37839

SEQ ID NO: 460426 - RNA, 60 nt, Homo Sapiens; identical to SEQ ID NO: 37840

SEQ ID NO: 460427 - RNA, 60 nt, Homo Sapiens; identical to SEQ ID NO: 37841

SEQ ID NO: 460428 - RNA, 60 nt, Homo Sapiens; identical to SEQ ID NO: 37842

SEQ ID NO: 460429 - RNA, 60 nt, Homo Sapiens; identical to SEQ ID NO: 37843

SEQ ID NO: 460430 - RNA, 60 nt, Homo Sapiens; identical to SEQ ID NO: 37844

SEQ ID NO: 460431 - RNA, 60 nt, Homo Sapiens; identical to SEQ ID NO: 37845

SEQ ID NO: 460432 - RNA, 60 nt, Homo Sapiens; identical to SEQ ID NO: 37846

SEQ ID NO: 460433 - RNA, 60 nt, Homo Sapiens; identical to SEQ ID NO: 37847

SEQ ID NO: 460434 - RNA, 60 nt, Homo Sapiens; identical to SEQ ID NO: 37848

SEQ ID NO: 460435 - RNA, 60 nt, Homo Sapiens; identical to SEQ ID NO: 37849

SEQ ID NO: 460436 - RNA, 60 nt, Homo Sapiens; identical to SEQ ID NO: 37850

SEQ ID NO: 460437 - RNA, 60 nt, Homo Sapiens; identical to SEQ ID NO: 37851

SEQ ID NO: 460438 - RNA, 60 nt, Homo Sapiens; identical to SEQ ID NO: 37852

SEQ ID NO: 460439 - RNA, 60 nt, Homo Sapiens; identical to SEQ ID NO: 37853

SEQ ID NO: 460440 - RNA, 60 nt, Homo Sapiens; identical to SEQ ID NO: 37854

SEQ ID NO: 460441 - RNA, 60 nt, Homo Sapiens; identical to SEQ ID NO: 37855

SEQ ID NO: 460442 - RNA, 60 nt, Homo Sapiens; identical to SEQ ID NO: 37856

SEQ ID NO: 460443 - RNA, 60 nt, Homo Sapiens; identical to SEQ ID NO: 37857

SEQ ID NO: 460444 - RNA, 60 nt, Homo Sapiens; identical to SEQ ID NO: 37858

SEQ ID NO: 460445 - RNA, 60 nt, Homo Sapiens; identical to SEQ ID NO: 37859

SEQ ID NO: 460446 - RNA, 60 nt, Homo Sapiens; identical to SEQ ID NO: 37860

SEQ ID NO: 460447 - RNA, 60 nt, Homo Sapiens; identical to SEQ ID NO: 37861

SEQ ID NO: 460448 - RNA, 60 nt, Homo Sapiens; identical to SEQ ID NO: 37862

SEQ ID NO: 460449 - RNA, 60 nt, Homo Sapiens; identical to SEQ ID NO: 37863

SEQ ID NO: 460450 - RNA, 60 nt, Homo Sapiens; identical to SEQ ID NO: 37864

SEQ ID NO: 460451 - RNA, 60 nt, Homo Sapiens; identical to SEQ ID NO: 37865

SEQ ID NO: 460452 - RNA, 60 nt, Homo Sapiens; identical to SEQ ID NO: 37866

SEQ ID NO: 460453 - RNA, 60 nt, Homo Sapiens; identical to SEQ ID NO: 37867

SEQ ID NO: 460454 - RNA, 60 nt, Homo Sapiens; identical to SEQ ID NO: 37868

SEQ ID NO: 460455 - RNA, 60 nt, Homo Sapiens; identical to SEQ ID NO: 37869

SEQ ID NO: 460456 - RNA, 60 nt, Homo Sapiens; identical to SEQ ID NO: 37870

SEQ ID NO: 460457 - RNA, 60 nt, Homo Sapiens; identical to SEQ ID NO: 37871

SEQ ID NO: 460458 - RNA, 60 nt, Homo Sapiens; identical to SEQ ID NO: 37872

SEQ ID NO: 460459 - RNA, 60 nt, Homo Sapiens; identical to SEQ ID NO: 37873

SEQ ID NO: 460460 - RNA, 60 nt, Homo Sapiens; identical to SEQ ID NO: 37874

SEQ ID NO: 460461 - RNA, 60 nt, Homo Sapiens; identical to SEQ ID NO: 37875

SEQ ID NO: 460462 - RNA, 60 nt, Homo Sapiens; identical to SEQ ID NO: 37876

SEQ ID NO: 460463 - RNA, 60 nt, Homo Sapiens; identical to SEQ ID NO: 37877

SEQ ID NO: 460464 - RNA, 60 nt, Homo Sapiens; identical to SEQ ID NO: 37878

SEQ ID NO: 460465 - RNA, 60 nt, Homo Sapiens; identical to SEQ ID NO: 37879

SEQ ID NO: 460466 - RNA, 60 nt, Homo Sapiens; identical to SEQ ID NO: 37880

SEQ ID NO: 460467 - RNA, 60 nt, Homo Sapiens; identical to SEQ ID NO: 37881

SEQ ID NO: 460468 - RNA, 60 nt, Homo Sapiens; identical to SEQ ID NO: 37882

SEQ ID NO: 460469 - RNA, 60 nt, Homo Sapiens; identical to SEQ ID NO: 37883

SEQ ID NO: 460470 - RNA, 60 nt, Homo Sapiens; identical to SEQ ID NO: 37884

SEQ ID NO: 460471 - RNA, 60 nt, Homo Sapiens; identical to SEQ ID NO: 37885

SEQ ID NO: 460472 - RNA, 60 nt, Homo Sapiens; identical to SEQ ID NO: 37886

SEQ ID NO: 460473 - RNA, 60 nt, Homo Sapiens; identical to SEQ ID NO: 37887

SEQ ID NO: 460474 - RNA, 60 nt, Homo Sapiens; identical to SEQ ID NO: 37888

SEQ ID NO: 460475 - RNA, 60 nt, Homo Sapiens; identical to SEQ ID NO: 37889

SEQ ID NO: 460476 - RNA, 60 nt, Homo Sapiens; identical to SEQ ID NO: 37890

SEQ ID NO: 460477 - RNA, 60 nt, Homo Sapiens; identical to SEQ ID NO: 37891

SEQ ID NO: 460478 - RNA, 60 nt, Homo Sapiens; identical to SEQ ID NO: 37892

SEQ ID NO: 460479 - RNA, 60 nt, Homo Sapiens; identical to SEQ ID NO: 37893

SEQ ID NO: 460480 - RNA, 60 nt, Homo Sapiens; identical to SEQ ID NO: 37894

SEQ ID NO: 460481 - RNA, 60 nt, Homo Sapiens; identical to SEQ ID NO: 37895

SEQ ID NO: 460482 - RNA, 60 nt, Homo Sapiens; identical to SEQ ID NO: 37896

SEQ ID NO: 460483 - RNA, 60 nt, Homo Sapiens; identical to SEQ ID NO: 37897

SEQ ID NO: 460484 - RNA, 60 nt, Homo Sapiens; identical to SEQ ID NO: 37898

SEQ ID NO: 460485 - RNA, 60 nt, Homo Sapiens; identical to SEQ ID NO: 37899

SEQ ID NO: 460486 - RNA, 60 nt, Homo Sapiens; identical to SEQ ID NO: 37900

SEQ ID NO: 460487 - RNA, 60 nt, Homo Sapiens; identical to SEQ ID NO: 37901

SEQ ID NO: 460488 - RNA, 60 nt, Homo Sapiens; identical to SEQ ID NO: 37902

SEQ ID NO: 460489 - RNA, 60 nt, Homo Sapiens; identical to SEQ ID NO: 37903

SEQ ID NO: 460490 - RNA, 60 nt, Homo Sapiens; identical to SEQ ID NO: 37904

SEQ ID NO: 460491 - RNA, 60 nt, Homo Sapiens; identical to SEQ ID NO: 37905

SEQ ID NO: 460492 - RNA, 60 nt, Homo Sapiens; identical to SEQ ID NO: 37906

SEQ ID NO: 460493 - RNA, 60 nt, Homo Sapiens; identical to SEQ ID NO: 37907

SEQ ID NO: 460494 - RNA, 60 nt, Homo Sapiens; identical to SEQ ID NO: 37908

SEQ ID NO: 460495 - RNA, 60 nt, Homo Sapiens; identical to SEQ ID NO: 37909

SEQ ID NO: 460496 - RNA, 60 nt, Homo Sapiens; identical to SEQ ID NO: 37910

SEQ ID NO: 460497 - RNA, 60 nt, Homo Sapiens; identical to SEQ ID NO: 37911

SEQ ID NO: 460498 - RNA, 60 nt, Homo Sapiens; identical to SEQ ID NO: 37912

SEQ ID NO: 460499 - RNA, 60 nt, Homo Sapiens; identical to SEQ ID NO: 37913

SEQ ID NO: 460500 - RNA, 60 nt, Homo Sapiens; identical to SEQ ID NO: 37914

SEQ ID NO: 460501 - RNA, 60 nt, Homo Sapiens; identical to SEQ ID NO: 37915

SEQ ID NO: 460502 - RNA, 60 nt, Homo Sapiens; identical to SEQ ID NO: 37916

SEQ ID NO: 460503 - RNA, 60 nt, Homo Sapiens; identical to SEQ ID NO: 37917

SEQ ID NO: 460504 - RNA, 60 nt, Homo Sapiens; identical to SEQ ID NO: 37918

SEQ ID NO: 460505 - RNA, 60 nt, Homo Sapiens; identical to SEQ ID NO: 37919

SEQ ID NO: 460506 - RNA, 60 nt, Homo Sapiens; identical to SEQ ID NO: 37920

SEQ ID NO: 460507 - RNA, 60 nt, Homo Sapiens; identical to SEQ ID NO: 37921

SEQ ID NO: 460508 - RNA, 60 nt, Homo Sapiens; identical to SEQ ID NO: 37922

SEQ ID NO: 460509 - RNA, 60 nt, Homo Sapiens; identical to SEQ ID NO: 37923

SEQ ID NO: 460510 - RNA, 60 nt, Homo Sapiens; identical to SEQ ID NO: 37924

SEQ ID NO: 460511 - RNA, 60 nt, Homo Sapiens; identical to SEQ ID NO: 37925

SEQ ID NO: 460512 - RNA, 60 nt, Homo Sapiens; identical to SEQ ID NO: 37926

SEQ ID NO: 460513 - RNA, 60 nt, Homo Sapiens; identical to SEQ ID NO: 37927

SEQ ID NO: 460514 - RNA, 60 nt, Homo Sapiens; identical to SEQ ID NO: 37928

SEQ ID NO: 460515 - RNA, 60 nt, Homo Sapiens; identical to SEQ ID NO: 37929

SEQ ID NO: 460516 - RNA, 60 nt, Homo Sapiens; identical to SEQ ID NO: 37930

SEQ ID NO: 460517 - RNA, 60 nt, Homo Sapiens; identical to SEQ ID NO: 37931

SEQ ID NO: 460518 - RNA, 60 nt, Homo Sapiens; identical to SEQ ID NO: 37932

SEQ ID NO: 460519 - RNA, 60 nt, Homo Sapiens; identical to SEQ ID NO: 37933

SEQ ID NO: 460520 - RNA, 60 nt, Homo Sapiens; identical to SEQ ID NO: 37934

SEQ ID NO: 460521 - RNA, 60 nt, Homo Sapiens; identical to SEQ ID NO: 37935

SEQ ID NO: 460522 - RNA, 60 nt, Homo Sapiens; identical to SEQ ID NO: 37936

SEQ ID NO: 460523 - RNA, 60 nt, Homo Sapiens; identical to SEQ ID NO: 37937

SEQ ID NO: 460524 - RNA, 60 nt, Homo Sapiens; identical to SEQ ID NO: 37938

SEQ ID NO: 460525 - RNA, 60 nt, Homo Sapiens; identical to SEQ ID NO: 37939

SEQ ID NO: 460526 - RNA, 60 nt, Homo Sapiens; identical to SEQ ID NO: 37940

SEQ ID NO: 460527 - RNA, 60 nt, Homo Sapiens; identical to SEQ ID NO: 37941

SEQ ID NO: 460528 - RNA, 60 nt, Homo Sapiens; identical to SEQ ID NO: 37942

SEQ ID NO: 460529 - RNA, 60 nt, Homo Sapiens; identical to SEQ ID NO: 37943

SEQ ID NO: 460530 - RNA, 60 nt, Homo Sapiens; identical to SEQ ID NO: 37944

SEQ ID NO: 460531 - RNA, 60 nt, Homo Sapiens; identical to SEQ ID NO: 37945

SEQ ID NO: 460532 - RNA, 60 nt, Homo Sapiens; identical to SEQ ID NO: 37946

SEQ ID NO: 460533 - RNA, 60 nt, Homo Sapiens; identical to SEQ ID NO: 37947

SEQ ID NO: 460534 - RNA, 60 nt, Homo Sapiens; identical to SEQ ID NO: 37948

SEQ ID NO: 460535 - RNA, 60 nt, Homo Sapiens; identical to SEQ ID NO: 37949

SEQ ID NO: 460536 - RNA, 60 nt, Homo Sapiens; identical to SEQ ID NO: 37950

SEQ ID NO: 460537 - RNA, 60 nt, Homo Sapiens; identical to SEQ ID NO: 37951

SEQ ID NO: 460538 - RNA, 60 nt, Homo Sapiens; identical to SEQ ID NO: 37952

SEQ ID NO: 460539 - RNA, 60 nt, Homo Sapiens; identical to SEQ ID NO: 37953

SEQ ID NO: 460540 - RNA, 60 nt, Homo Sapiens; identical to SEQ ID NO: 37954

SEQ ID NO: 460541 - RNA, 60 nt, Homo Sapiens; identical to SEQ ID NO: 37955

SEQ ID NO: 460542 - RNA, 60 nt, Homo Sapiens; identical to SEQ ID NO: 37956

SEQ ID NO: 460543 - RNA, 60 nt, Homo Sapiens; identical to SEQ ID NO: 37957

SEQ ID NO: 460544 - RNA, 60 nt, Homo Sapiens; identical to SEQ ID NO: 37958

SEQ ID NO: 460545 - RNA, 60 nt, Homo Sapiens; identical to SEQ ID NO: 37959

SEQ ID NO: 460546 - RNA, 60 nt, Homo Sapiens; identical to SEQ ID NO: 37960

SEQ ID NO: 460547 - RNA, 54 nt, Homo Sapiens; identical to SEQ ID NO: 37961

SEQ ID NO: 460548 - RNA, 60 nt, Homo Sapiens; identical to SEQ ID NO: 37962

SEQ ID NO: 460549 - RNA, 60 nt, Homo Sapiens; identical to SEQ ID NO: 37963

SEQ ID NO: 460550 - RNA, 60 nt, Homo Sapiens; identical to SEQ ID NO: 37964

SEQ ID NO: 460551 - RNA, 60 nt, Homo Sapiens; identical to SEQ ID NO: 37965

SEQ ID NO: 460552 - RNA, 60 nt, Homo Sapiens; identical to SEQ ID NO: 37966

SEQ ID NO: 460553 - RNA, 60 nt, Homo Sapiens; identical to SEQ ID NO: 37967

SEQ ID NO: 460554 - RNA, 60 nt, Homo Sapiens; identical to SEQ ID NO: 37968

SEQ ID NO: 460555 - RNA, 60 nt, Homo Sapiens; identical to SEQ ID NO: 37969

SEQ ID NO: 460556 - RNA, 60 nt, Homo Sapiens; identical to SEQ ID NO: 37970

SEQ ID NO: 460557 - RNA, 60 nt, Homo Sapiens; identical to SEQ ID NO: 37971

SEQ ID NO: 460558 - RNA, 60 nt, Homo Sapiens; identical to SEQ ID NO: 37972

SEQ ID NO: 460559 - RNA, 60 nt, Homo Sapiens; identical to SEQ ID NO: 37973

SEQ ID NO: 460560 - RNA, 60 nt, Homo Sapiens; identical to SEQ ID NO: 37974

SEQ ID NO: 460561 - RNA, 60 nt, Homo Sapiens; identical to SEQ ID NO: 37975

SEQ ID NO: 460562 - RNA, 60 nt, Homo Sapiens; identical to SEQ ID NO: 37976

SEQ ID NO: 460563 - RNA, 60 nt, Homo Sapiens; identical to SEQ ID NO: 37977

SEQ ID NO: 460564 - RNA, 60 nt, Homo Sapiens; identical to SEQ ID NO: 37978

SEQ ID NO: 460565 - RNA, 60 nt, Homo Sapiens; identical to SEQ ID NO: 37979

SEQ ID NO: 460566 - RNA, 60 nt, Homo Sapiens; identical to SEQ ID NO: 37980

SEQ ID NO: 460567 - RNA, 60 nt, Homo Sapiens; identical to SEQ ID NO: 37981

SEQ ID NO: 460568 - RNA, 60 nt, Homo Sapiens; identical to SEQ ID NO: 37982

SEQ ID NO: 460569 - RNA, 60 nt, Homo Sapiens; identical to SEQ ID NO: 37983

SEQ ID NO: 460570 - RNA, 60 nt, Homo Sapiens; identical to SEQ ID NO: 37984

SEQ ID NO: 460571 - RNA, 60 nt, Homo Sapiens; identical to SEQ ID NO: 37985

SEQ ID NO: 460572 - RNA, 60 nt, Homo Sapiens; identical to SEQ ID NO: 37986

SEQ ID NO: 460573 - RNA, 60 nt, Homo Sapiens; identical to SEQ ID NO: 37987

SEQ ID NO: 460574 - RNA, 60 nt, Homo Sapiens; identical to SEQ ID NO: 37988

SEQ ID NO: 460575 - RNA, 60 nt, Homo Sapiens; identical to SEQ ID NO: 37989

SEQ ID NO: 460576 - RNA, 60 nt, Homo Sapiens; identical to SEQ ID NO: 37990

SEQ ID NO: 460577 - RNA, 60 nt, Homo Sapiens; identical to SEQ ID NO: 37991

SEQ ID NO: 460578 - RNA, 60 nt, Homo Sapiens; identical to SEQ ID NO: 37992

SEQ ID NO: 460579 - RNA, 60 nt, Homo Sapiens; identical to SEQ ID NO: 37993

SEQ ID NO: 460580 - RNA, 60 nt, Homo Sapiens; identical to SEQ ID NO: 37994

SEQ ID NO: 460581 - RNA, 52 nt, Homo Sapiens; identical to SEQ ID NO: 37995

SEQ ID NO: 460582 - RNA, 60 nt, Homo Sapiens; identical to SEQ ID NO: 37996

SEQ ID NO: 460583 - RNA, 60 nt, Homo Sapiens; identical to SEQ ID NO: 37997

SEQ ID NO: 460584 - RNA, 60 nt, Homo Sapiens; identical to SEQ ID NO: 37998

SEQ ID NO: 460585 - RNA, 60 nt, Homo Sapiens; identical to SEQ ID NO: 37999

SEQ ID NO: 460586 - RNA, 60 nt, Homo Sapiens; identical to SEQ ID NO: 38000

SEQ ID NO: 460587 - RNA, 60 nt, Homo Sapiens; identical to SEQ ID NO: 38001

SEQ ID NO: 460588 - RNA, 60 nt, Homo Sapiens; identical to SEQ ID NO: 38002

SEQ ID NO: 460589 - RNA, 60 nt, Homo Sapiens; identical to SEQ ID NO: 38003

SEQ ID NO: 460590 - RNA, 60 nt, Homo Sapiens; identical to SEQ ID NO: 38004

SEQ ID NO: 460591 - RNA, 60 nt, Homo Sapiens; identical to SEQ ID NO: 38005

SEQ ID NO: 460592 - RNA, 60 nt, Homo Sapiens; identical to SEQ ID NO: 38006

SEQ ID NO: 460593 - RNA, 60 nt, Homo Sapiens; identical to SEQ ID NO: 38007

SEQ ID NO: 460594 - RNA, 60 nt, Homo Sapiens; identical to SEQ ID NO: 38008

SEQ ID NO: 460595 - RNA, 60 nt, Homo Sapiens; identical to SEQ ID NO: 38009

SEQ ID NO: 460596 - RNA, 60 nt, Homo Sapiens; identical to SEQ ID NO: 38010

SEQ ID NO: 460597 - RNA, 60 nt, Homo Sapiens; identical to SEQ ID NO: 38011

SEQ ID NO: 460598 - RNA, 60 nt, Homo Sapiens; identical to SEQ ID NO: 38012

SEQ ID NO: 460599 - RNA, 60 nt, Homo Sapiens; identical to SEQ ID NO: 38013

SEQ ID NO: 460600 - RNA, 60 nt, Homo Sapiens; identical to SEQ ID NO: 38014

SEQ ID NO: 460601 - RNA, 60 nt, Homo Sapiens; identical to SEQ ID NO: 38015

SEQ ID NO: 460602 - RNA, 60 nt, Homo Sapiens; identical to SEQ ID NO: 38016

SEQ ID NO: 460603 - RNA, 60 nt, Homo Sapiens; identical to SEQ ID NO: 38017

SEQ ID NO: 460604 - RNA, 60 nt, Homo Sapiens; identical to SEQ ID NO: 38018

SEQ ID NO: 460605 - RNA, 60 nt, Homo Sapiens; identical to SEQ ID NO: 38019

SEQ ID NO: 460606 - RNA, 60 nt, Homo Sapiens; identical to SEQ ID NO: 38020

SEQ ID NO: 460607 - RNA, 60 nt, Homo Sapiens; identical to SEQ ID NO: 38021

SEQ ID NO: 460608 - RNA, 60 nt, Homo Sapiens; identical to SEQ ID NO: 38022

SEQ ID NO: 460609 - RNA, 60 nt, Homo Sapiens; identical to SEQ ID NO: 38023

SEQ ID NO: 460610 - RNA, 60 nt, Homo Sapiens; identical to SEQ ID NO: 38024

SEQ ID NO: 460611 - RNA, 60 nt, Homo Sapiens; identical to SEQ ID NO: 38025

SEQ ID NO: 460612 - RNA, 60 nt, Homo Sapiens; identical to SEQ ID NO: 38026

SEQ ID NO: 460613 - RNA, 60 nt, Homo Sapiens; identical to SEQ ID NO: 38027

SEQ ID NO: 460614 - RNA, 60 nt, Homo Sapiens; identical to SEQ ID NO: 38028

SEQ ID NO: 460615 - RNA, 60 nt, Homo Sapiens; identical to SEQ ID NO: 38029

SEQ ID NO: 460616 - RNA, 60 nt, Homo Sapiens; identical to SEQ ID NO: 38030

SEQ ID NO: 460617 - RNA, 60 nt, Homo Sapiens; identical to SEQ ID NO: 38031

SEQ ID NO: 460618 - RNA, 60 nt, Homo Sapiens; identical to SEQ ID NO: 38032

SEQ ID NO: 460619 - RNA, 60 nt, Homo Sapiens; identical to SEQ ID NO: 38033

SEQ ID NO: 460620 - RNA, 60 nt, Homo Sapiens; identical to SEQ ID NO: 38034

SEQ ID NO: 460621 - RNA, 60 nt, Homo Sapiens; identical to SEQ ID NO: 38035

SEQ ID NO: 460622 - RNA, 60 nt, Homo Sapiens; identical to SEQ ID NO: 38036

SEQ ID NO: 460623 - RNA, 60 nt, Homo Sapiens; identical to SEQ ID NO: 38037

SEQ ID NO: 460624 - RNA, 60 nt, Homo Sapiens; identical to SEQ ID NO: 38038

SEQ ID NO: 460625 - RNA, 60 nt, Homo Sapiens; identical to SEQ ID NO: 38039

SEQ ID NO: 460626 - RNA, 60 nt, Homo Sapiens; identical to SEQ ID NO: 38040

SEQ ID NO: 460627 - RNA, 60 nt, Homo Sapiens; identical to SEQ ID NO: 38041

SEQ ID NO: 460628 - RNA, 60 nt, Homo Sapiens; identical to SEQ ID NO: 38042

SEQ ID NO: 460629 - RNA, 60 nt, Homo Sapiens; identical to SEQ ID NO: 38043

SEQ ID NO: 460630 - RNA, 60 nt, Homo Sapiens; identical to SEQ ID NO: 38044

SEQ ID NO: 460631 - RNA, 60 nt, Homo Sapiens; identical to SEQ ID NO: 38045

SEQ ID NO: 460632 - RNA, 60 nt, Homo Sapiens; identical to SEQ ID NO: 38046

SEQ ID NO: 460633 - RNA, 60 nt, Homo Sapiens; identical to SEQ ID NO: 38047

SEQ ID NO: 460634 - RNA, 60 nt, Homo Sapiens; identical to SEQ ID NO: 38048

SEQ ID NO: 460635 - RNA, 60 nt, Homo Sapiens; identical to SEQ ID NO: 38049

SEQ ID NO: 460636 - RNA, 60 nt, Homo Sapiens; identical to SEQ ID NO: 38050

SEQ ID NO: 460637 - RNA, 60 nt, Homo Sapiens; identical to SEQ ID NO: 38051

SEQ ID NO: 460638 - RNA, 60 nt, Homo Sapiens; identical to SEQ ID NO: 38052

SEQ ID NO: 460639 - RNA, 60 nt, Homo Sapiens; identical to SEQ ID NO: 38053

SEQ ID NO: 460640 - RNA, 60 nt, Homo Sapiens; identical to SEQ ID NO: 38054

SEQ ID NO: 460641 - RNA, 60 nt, Homo Sapiens; identical to SEQ ID NO: 38055

SEQ ID NO: 460642 - RNA, 60 nt, Homo Sapiens; identical to SEQ ID NO: 38056

SEQ ID NO: 460643 - RNA, 60 nt, Homo Sapiens; identical to SEQ ID NO: 38057

SEQ ID NO: 460644 - RNA, 60 nt, Homo Sapiens; identical to SEQ ID NO: 38058

SEQ ID NO: 460645 - RNA, 60 nt, Homo Sapiens; identical to SEQ ID NO: 38059

SEQ ID NO: 460646 - RNA, 60 nt, Homo Sapiens; identical to SEQ ID NO: 38060

SEQ ID NO: 460647 - RNA, 60 nt, Homo Sapiens; identical to SEQ ID NO: 38061

SEQ ID NO: 460648 - RNA, 60 nt, Homo Sapiens; identical to SEQ ID NO: 38062

SEQ ID NO: 460649 - RNA, 60 nt, Homo Sapiens; identical to SEQ ID NO: 38063

SEQ ID NO: 460650 - RNA, 60 nt, Homo Sapiens; identical to SEQ ID NO: 38064

SEQ ID NO: 460651 - RNA, 60 nt, Homo Sapiens; identical to SEQ ID NO: 38065

SEQ ID NO: 460652 - RNA, 60 nt, Homo Sapiens; identical to SEQ ID NO: 38066

SEQ ID NO: 460653 - RNA, 60 nt, Homo Sapiens; identical to SEQ ID NO: 38067

SEQ ID NO: 460654 - RNA, 60 nt, Homo Sapiens; identical to SEQ ID NO: 38068

SEQ ID NO: 460655 - RNA, 60 nt, Homo Sapiens; identical to SEQ ID NO: 38069

SEQ ID NO: 460656 - RNA, 60 nt, Homo Sapiens; identical to SEQ ID NO: 38070

SEQ ID NO: 460657 - RNA, 60 nt, Homo Sapiens; identical to SEQ ID NO: 38071

SEQ ID NO: 460658 - RNA, 60 nt, Homo Sapiens; identical to SEQ ID NO: 38072

SEQ ID NO: 460659 - RNA, 60 nt, Homo Sapiens; identical to SEQ ID NO: 38073

SEQ ID NO: 460660 - RNA, 60 nt, Homo Sapiens; identical to SEQ ID NO: 38074

SEQ ID NO: 460661 - RNA, 60 nt, Homo Sapiens; identical to SEQ ID NO: 38075

SEQ ID NO: 460662 - RNA, 60 nt, Homo Sapiens; identical to SEQ ID NO: 38076

SEQ ID NO: 460663 - RNA, 60 nt, Homo Sapiens; identical to SEQ ID NO: 38077

SEQ ID NO: 460664 - RNA, 60 nt, Homo Sapiens; identical to SEQ ID NO: 38078

SEQ ID NO: 460665 - RNA, 60 nt, Homo Sapiens; identical to SEQ ID NO: 38079

SEQ ID NO: 460666 - RNA, 60 nt, Homo Sapiens; identical to SEQ ID NO: 38080

SEQ ID NO: 460667 - RNA, 60 nt, Homo Sapiens; identical to SEQ ID NO: 38081

SEQ ID NO: 460668 - RNA, 60 nt, Homo Sapiens; identical to SEQ ID NO: 38082

SEQ ID NO: 460669 - RNA, 60 nt, Homo Sapiens; identical to SEQ ID NO: 38083

SEQ ID NO: 460670 - RNA, 60 nt, Homo Sapiens; identical to SEQ ID NO: 38084

SEQ ID NO: 460671 - RNA, 60 nt, Homo Sapiens; identical to SEQ ID NO: 38085

SEQ ID NO: 460672 - RNA, 60 nt, Homo Sapiens; identical to SEQ ID NO: 38086

SEQ ID NO: 460673 - RNA, 60 nt, Homo Sapiens; identical to SEQ ID NO: 38087

SEQ ID NO: 460674 - RNA, 60 nt, Homo Sapiens; identical to SEQ ID NO: 38088

SEQ ID NO: 460675 - RNA, 60 nt, Homo Sapiens; identical to SEQ ID NO: 38089

SEQ ID NO: 460676 - RNA, 60 nt, Homo Sapiens; identical to SEQ ID NO: 38090

SEQ ID NO: 460677 - RNA, 60 nt, Homo Sapiens; identical to SEQ ID NO: 38091

SEQ ID NO: 460678 - RNA, 60 nt, Homo Sapiens; identical to SEQ ID NO: 38092

SEQ ID NO: 460679 - RNA, 60 nt, Homo Sapiens; identical to SEQ ID NO: 38093

SEQ ID NO: 460680 - RNA, 60 nt, Homo Sapiens; identical to SEQ ID NO: 38094

SEQ ID NO: 460681 - RNA, 60 nt, Homo Sapiens; identical to SEQ ID NO: 38095

SEQ ID NO: 460682 - RNA, 60 nt, Homo Sapiens; identical to SEQ ID NO: 38096

SEQ ID NO: 460683 - RNA, 60 nt, Homo Sapiens; identical to SEQ ID NO: 38097

SEQ ID NO: 460684 - RNA, 60 nt, Homo Sapiens; identical to SEQ ID NO: 38098

SEQ ID NO: 460685 - RNA, 60 nt, Homo Sapiens; identical to SEQ ID NO: 38099

SEQ ID NO: 460686 - RNA, 60 nt, Homo Sapiens; identical to SEQ ID NO: 38100

SEQ ID NO: 460687 - RNA, 60 nt, Homo Sapiens; identical to SEQ ID NO: 38101

SEQ ID NO: 460688 - RNA, 60 nt, Homo Sapiens; identical to SEQ ID NO: 38102

SEQ ID NO: 460689 - RNA, 60 nt, Homo Sapiens; identical to SEQ ID NO: 38103

SEQ ID NO: 460690 - RNA, 60 nt, Homo Sapiens; identical to SEQ ID NO: 38104

SEQ ID NO: 460691 - RNA, 60 nt, Homo Sapiens; identical to SEQ ID NO: 38105

SEQ ID NO: 460692 - RNA, 60 nt, Homo Sapiens; identical to SEQ ID NO: 38106

SEQ ID NO: 460693 - RNA, 60 nt, Homo Sapiens; identical to SEQ ID NO: 38107

SEQ ID NO: 460694 - RNA, 60 nt, Homo Sapiens; identical to SEQ ID NO: 38108

SEQ ID NO: 460695 - RNA, 60 nt, Homo Sapiens; identical to SEQ ID NO: 38109

SEQ ID NO: 460696 - RNA, 60 nt, Homo Sapiens; identical to SEQ ID NO: 38110

SEQ ID NO: 460697 - RNA, 60 nt, Homo Sapiens; identical to SEQ ID NO: 38111

SEQ ID NO: 460698 - RNA, 60 nt, Homo Sapiens; identical to SEQ ID NO: 38112

SEQ ID NO: 460699 - RNA, 60 nt, Homo Sapiens; identical to SEQ ID NO: 38113

SEQ ID NO: 460700 - RNA, 60 nt, Homo Sapiens; identical to SEQ ID NO: 38114

SEQ ID NO: 460701 - RNA, 60 nt, Homo Sapiens; identical to SEQ ID NO: 38115

SEQ ID NO: 460702 - RNA, 60 nt, Homo Sapiens; identical to SEQ ID NO: 38116

SEQ ID NO: 460703 - RNA, 60 nt, Homo Sapiens; identical to SEQ ID NO: 38117

SEQ ID NO: 460704 - RNA, 60 nt, Homo Sapiens; identical to SEQ ID NO: 38118

SEQ ID NO: 460705 - RNA, 60 nt, Homo Sapiens; identical to SEQ ID NO: 38119

SEQ ID NO: 460706 - RNA, 60 nt, Homo Sapiens; identical to SEQ ID NO: 38120

SEQ ID NO: 460707 - RNA, 60 nt, Homo Sapiens; identical to SEQ ID NO: 38121

SEQ ID NO: 460708 - RNA, 60 nt, Homo Sapiens; identical to SEQ ID NO: 38122

SEQ ID NO: 460709 - RNA, 60 nt, Homo Sapiens; identical to SEQ ID NO: 38123

SEQ ID NO: 460710 - RNA, 60 nt, Homo Sapiens; identical to SEQ ID NO: 38124

SEQ ID NO: 460711 - RNA, 60 nt, Homo Sapiens; identical to SEQ ID NO: 38125

SEQ ID NO: 460712 - RNA, 60 nt, Homo Sapiens; identical to SEQ ID NO: 38126

SEQ ID NO: 460713 - RNA, 60 nt, Homo Sapiens; identical to SEQ ID NO: 38127

SEQ ID NO: 460714 - RNA, 60 nt, Homo Sapiens; identical to SEQ ID NO: 38128

SEQ ID NO: 460715 - RNA, 60 nt, Homo Sapiens; identical to SEQ ID NO: 38129

SEQ ID NO: 460716 - RNA, 60 nt, Homo Sapiens; identical to SEQ ID NO: 38130

SEQ ID NO: 460717 - RNA, 60 nt, Homo Sapiens; identical to SEQ ID NO: 38131

SEQ ID NO: 460718 - RNA, 60 nt, Homo Sapiens; identical to SEQ ID NO: 38132

SEQ ID NO: 460719 - RNA, 60 nt, Homo Sapiens; identical to SEQ ID NO: 38133

SEQ ID NO: 460720 - RNA, 60 nt, Homo Sapiens; identical to SEQ ID NO: 38134

SEQ ID NO: 460721 - RNA, 60 nt, Homo Sapiens; identical to SEQ ID NO: 38135

SEQ ID NO: 460722 - RNA, 60 nt, Homo Sapiens; identical to SEQ ID NO: 38136

SEQ ID NO: 460723 - RNA, 60 nt, Homo Sapiens; identical to SEQ ID NO: 38137

SEQ ID NO: 460724 - RNA, 60 nt, Homo Sapiens; identical to SEQ ID NO: 38138

SEQ ID NO: 460725 - RNA, 60 nt, Homo Sapiens; identical to SEQ ID NO: 38139

SEQ ID NO: 460726 - RNA, 64 nt, Homo Sapiens
gcuuuccucacuguucucucccuugaaucucauuuguaggaaucaagagauuccuauacauggg

SEQ ID NO: 460727 - RNA, 64 nt, Homo Sapiens
aggucaugaucaggagacuugaauuguuacuggauguaggaauuguuucacugcucuuaacuug

SEQ ID NO: 460728 - RNA, 64 nt, Homo Sapiens
uguaagguguuaauguguguguaugugcuuugguuguaggaaaacuugaaaauuccaaaauccu

SEQ ID NO: 460729 - RNA, 64 nt, Homo Sapiens
guauuaacaaacacugcaauuuauagauuacauuuguaggaaguuaugcuuuuuucugguuuuu

SEQ ID NO: 460730 - RNA, 64 nt, Homo Sapiens
aaccaggcuuauggcaugaucucuggaacaaauuuguaggaaaaaauuacuccaauugaaugac

SEQ ID NO: 460731 - RNA, 64 nt, Homo Sapiens
ucuucagcacuugagcugcauagauuguagugaauguaggaaguaauuuauucuagguaaaauu

SEQ ID NO: 460732 - RNA, 64 nt, Homo Sapiens
ucuuuagccuuaucugucauaauaauguaaugaauguaggaaaaucagcaaauuccuaugagag

SEQ ID NO: 460733 - RNA, 64 nt, Homo Sapiens
ucugaaauuuugaaucaucuagaacugaaccaggagcauuaaguaaaagaagcauuaacuuagu

SEQ ID NO: 460734 - RNA, 64 nt, Homo Sapiens
uaguagaacugaaccaggagugggaaaaaaaagaagcauuaacuagacugagagaguuacaugu

SEQ ID NO: 460735 - RNA, 64 nt, Homo Sapiens
aaggcuguguccaccuucugagcuggcacaaauaagcauuaaccgggacaauaaaguuguuuaa

SEQ ID NO: 460736 - RNA, 64 nt, Homo Sapiens
uauauacauguagagacaaguaucuguuccuucuagcauuaacaaaauuuuaaaaggaaaaaug

SEQ ID NO: 460737 - RNA, 64 nt, Homo Sapiens
uuuucuucugguuuuagagaacuaauuuuguuuuagcauuaaacuguugaacuuuuuuuuguac

SEQ ID NO: 460738 - RNA, 64 nt, Homo Sapiens
ucucaccgcuucuuguuugacaccuucacaagucagcauuaaucuuucuuuuaaaacuuguuuc

SEQ ID NO: 460739 - RNA, 64 nt, Homo Sapiens
uauuuuacuuauucuauucaaggcauagggccaaagcauuaaguauaauuuaaucccauacauu

SEQ ID NO: 460740 - RNA, 64 nt, Homo Sapiens
guuaucugggaaguaucagguucugggaggcaacagcauuaagugauaagaaaaggagacauuc

SEQ ID NO: 460741 - RNA, 64 nt, Homo Sapiens
uuuguuuuauaguuaugcuuguuaggauagcacaagcauuaacuugcugaagaaugugucugug

SEQ ID NO: 460742 - RNA, 64 nt, Homo Sapiens
acuaaucaauuguuuugccucaguugaaaaacagagcauuaaagguuggaugaaguccuuagua

SEQ ID NO: 460743 - RNA, 64 nt, Homo Sapiens
uaguauuauuuuuaauugcuuaaauuacguagucagcauuaagaacauuucaagcucugggaua

SEQ ID NO: 460744 - RNA, 64 nt, Homo Sapiens
uuucuuuuggggagagacugccuaggcagaauaaagcauuaaaaguaccaggcagugaauaagc

SEQ ID NO: 460745 - RNA, 64 nt, Homo Sapiens
ugccuaaccuucauggugagacucuggguuuuacagcauuaaccuccucacuuuggagaugaac

SEQ ID NO: 460746 - RNA, 64 nt, Homo Sapiens
cuuugaacugaauguauuuuauguugagcuaagaagcauuaaguauucucgggguuuggacuua

SEQ ID NO: 460747 - RNA, 64 nt, Homo Sapiens
gucuugucaagcgaaaggccaaauauuaacauuuagcauuaacuaucccaaacuuuuaagugcu

SEQ ID NO: 460748 - RNA, 64 nt, Homo Sapiens
guggccaaaggaggcagcggggaggccuauguggagcauuaacuuggggcucacccaucccaua

SEQ ID NO: 460749 - RNA, 64 nt, Homo Sapiens
uuugcagucuuaaaauuacauuauuaaggggcauagcauuaauuaauaagccuggagaguucug

SEQ ID NO: 460750 - RNA, 64 nt, Homo Sapiens
aacaucaucauuaauuucacuuaauguuuuuuaaagcauuaaugaaacaagauacuuaauauuu

SEQ ID NO: 460751 - RNA, 64 nt, Homo Sapiens
gacauuaaacuguuuauguuuaacauugaguuuaagcauuaauugaccugaguuugaguugacu

SEQ ID NO: 460752 - RNA, 64 nt, Homo Sapiens
gacauuacaguuaaaugagcauagcaagccaucaagcauuaauuuuguuucaaaugccauuagu

SEQ ID NO: 460753 - RNA, 64 nt, Homo Sapiens
gccauuaaacuguuuauguuuaacauugauuucaagcauuaauuuugaccugaguuuguugauu

SEQ ID NO: 460754 - RNA, 64 nt, Homo Sapiens
gacauuagagucaaaucagcauagcaaaccaucaagcauuaauuuuguuucaaaugcagugagu

SEQ ID NO: 460755 - RNA, 64 nt, Homo Sapiens; identical to SEQ ID NO: 323157

SEQ ID NO: 460756 - RNA, 64 nt, Homo Sapiens; identical to SEQ ID NO: 323158

SEQ ID NO: 460757 - RNA, 64 nt, Homo Sapiens; identical to SEQ ID NO: 323159

SEQ ID NO: 460758 - RNA, 64 nt, Homo Sapiens; identical to SEQ ID NO: 323160

SEQ ID NO: 460759 - RNA, 64 nt, Homo Sapiens; identical to SEQ ID NO: 323161

SEQ ID NO: 460760 - RNA, 64 nt, Homo Sapiens; identical to SEQ ID NO: 323162

SEQ ID NO: 460761 - RNA, 64 nt, Homo Sapiens; identical to SEQ ID NO: 323163

SEQ ID NO: 460762 - RNA, 64 nt, Homo Sapiens; identical to SEQ ID NO: 323164

SEQ ID NO: 460763 - RNA, 64 nt, Homo Sapiens; identical to SEQ ID NO: 323165

SEQ ID NO: 460764 - RNA, 64 nt, Homo Sapiens; identical to SEQ ID NO: 323166

SEQ ID NO: 460765 - RNA, 64 nt, Homo Sapiens; identical to SEQ ID NO: 323167

SEQ ID NO: 460766 - RNA, 64 nt, Homo Sapiens; identical to SEQ ID NO: 323168

SEQ ID NO: 460767 - RNA, 64 nt, Homo Sapiens; identical to SEQ ID NO: 323169

SEQ ID NO: 460768 - RNA, 64 nt, Homo Sapiens; identical to SEQ ID NO: 323170

SEQ ID NO: 460769 - RNA, 64 nt, Homo Sapiens; identical to SEQ ID NO: 323171

SEQ ID NO: 460770 - RNA, 64 nt, Homo Sapiens; identical to SEQ ID NO: 323172

SEQ ID NO: 460771 - RNA, 64 nt, Homo Sapiens; identical to SEQ ID NO: 323173

SEQ ID NO: 460772 - RNA, 64 nt, Homo Sapiens; identical to SEQ ID NO: 323174

SEQ ID NO: 460773 - RNA, 64 nt, Homo Sapiens; identical to SEQ ID NO: 323175

SEQ ID NO: 460774 - RNA, 64 nt, Homo Sapiens; identical to SEQ ID NO: 323176

SEQ ID NO: 460775 - RNA, 64 nt, Homo Sapiens; identical to SEQ ID NO: 323177

SEQ ID NO: 460776 - RNA, 64 nt, Homo Sapiens; identical to SEQ ID NO: 323178

SEQ ID NO: 460777 - RNA, 64 nt, Homo Sapiens; identical to SEQ ID NO: 323179

SEQ ID NO: 460778 - RNA, 64 nt, Homo Sapiens; identical to SEQ ID NO: 323180

SEQ ID NO: 460779 - RNA, 64 nt, Homo Sapiens; identical to SEQ ID NO: 323181

SEQ ID NO: 460780 - RNA, 64 nt, Homo Sapiens; identical to SEQ ID NO: 323182

SEQ ID NO: 460781 - RNA, 64 nt, Homo Sapiens; identical to SEQ ID NO: 323183

SEQ ID NO: 460782 - RNA, 64 nt, Homo Sapiens; identical to SEQ ID NO: 323184

SEQ ID NO: 460783 - RNA, 64 nt, Homo Sapiens; identical to SEQ ID NO: 323185

SEQ ID NO: 460784 - RNA, 64 nt, Homo Sapiens; identical to SEQ ID NO: 323186

SEQ ID NO: 460785 - RNA, 64 nt, Homo Sapiens; identical to SEQ ID NO: 323187

SEQ ID NO: 460786 - RNA, 64 nt, Homo Sapiens; identical to SEQ ID NO: 323188

SEQ ID NO: 460787 - RNA, 64 nt, Homo Sapiens; identical to SEQ ID NO: 323189

SEQ ID NO: 460788 - RNA, 64 nt, Homo Sapiens; identical to SEQ ID NO: 323190

SEQ ID NO: 460789 - RNA, 64 nt, Homo Sapiens; identical to SEQ ID NO: 323191

SEQ ID NO: 460790 - RNA, 64 nt, Homo Sapiens; identical to SEQ ID NO: 323192

SEQ ID NO: 460791 - RNA, 64 nt, Homo Sapiens; identical to SEQ ID NO: 323193

SEQ ID NO: 460792 - RNA, 64 nt, Homo Sapiens; identical to SEQ ID NO: 323194

SEQ ID NO: 460793 - RNA, 64 nt, Homo Sapiens; identical to SEQ ID NO: 323195

SEQ ID NO: 460794 - RNA, 64 nt, Homo Sapiens; identical to SEQ ID NO: 323196

SEQ ID NO: 460795 - RNA, 64 nt, Homo Sapiens; identical to SEQ ID NO: 323197

SEQ ID NO: 460796 - RNA, 64 nt, Homo Sapiens; identical to SEQ ID NO: 323198

SEQ ID NO: 460797 - RNA, 64 nt, Homo Sapiens; identical to SEQ ID NO: 323199

SEQ ID NO: 460798 - RNA, 64 nt, Homo Sapiens; identical to SEQ ID NO: 323200

SEQ ID NO: 460799 - RNA, 64 nt, Homo Sapiens; identical to SEQ ID NO: 323201

SEQ ID NO: 460800 - RNA, 64 nt, Homo Sapiens; identical to SEQ ID NO: 323202

SEQ ID NO: 460801 - RNA, 64 nt, Homo Sapiens; identical to SEQ ID NO: 323203

SEQ ID NO: 460802 - RNA, 64 nt, Homo Sapiens; identical to SEQ ID NO: 323204

SEQ ID NO: 460803 - RNA, 64 nt, Homo Sapiens; identical to SEQ ID NO: 323205

SEQ ID NO: 460804 - RNA, 64 nt, Homo Sapiens; identical to SEQ ID NO: 323206

SEQ ID NO: 460805 - RNA, 64 nt, Homo Sapiens; identical to SEQ ID NO: 323207

SEQ ID NO: 460806 - RNA, 64 nt, Homo Sapiens; identical to SEQ ID NO: 323208

SEQ ID NO: 460807 - RNA, 64 nt, Homo Sapiens; identical to SEQ ID NO: 323209

SEQ ID NO: 460808 - RNA, 64 nt, Homo Sapiens; identical to SEQ ID NO: 323210

SEQ ID NO: 460809 - RNA, 64 nt, Homo Sapiens; identical to SEQ ID NO: 323211

SEQ ID NO: 460810 - RNA, 64 nt, Homo Sapiens; identical to SEQ ID NO: 323212

SEQ ID NO: 460811 - RNA, 64 nt, Homo Sapiens; identical to SEQ ID NO: 323213

SEQ ID NO: 460812 - RNA, 64 nt, Homo Sapiens; identical to SEQ ID NO: 323214

SEQ ID NO: 460813 - RNA, 64 nt, Homo Sapiens; identical to SEQ ID NO: 323215

SEQ ID NO: 460814 - RNA, 64 nt, Homo Sapiens; identical to SEQ ID NO: 323216

SEQ ID NO: 460815 - RNA, 64 nt, Homo Sapiens; identical to SEQ ID NO: 323217

SEQ ID NO: 460816 - RNA, 64 nt, Homo Sapiens; identical to SEQ ID NO: 323218

SEQ ID NO: 460817 - RNA, 64 nt, Homo Sapiens; identical to SEQ ID NO: 323219

SEQ ID NO: 460818 - RNA, 64 nt, Homo Sapiens; identical to SEQ ID NO: 323220

SEQ ID NO: 460819 - RNA, 64 nt, Homo Sapiens; identical to SEQ ID NO: 323221

SEQ ID NO: 460820 - RNA, 64 nt, Homo Sapiens; identical to SEQ ID NO: 323222

SEQ ID NO: 460821 - RNA, 64 nt, Homo Sapiens; identical to SEQ ID NO: 323223

SEQ ID NO: 460822 - RNA, 64 nt, Homo Sapiens; identical to SEQ ID NO: 323224

SEQ ID NO: 460823 - RNA, 64 nt, Homo Sapiens; identical to SEQ ID NO: 323225

SEQ ID NO: 460824 - RNA, 64 nt, Homo Sapiens; identical to SEQ ID NO: 323226

SEQ ID NO: 460825 - RNA, 64 nt, Homo Sapiens; identical to SEQ ID NO: 323227

SEQ ID NO: 460826 - RNA, 64 nt, Homo Sapiens; identical to SEQ ID NO: 323228

SEQ ID NO: 460827 - RNA, 64 nt, Homo Sapiens; identical to SEQ ID NO: 323229

SEQ ID NO: 460828 - RNA, 64 nt, Homo Sapiens; identical to SEQ ID NO: 323230

SEQ ID NO: 460829 - RNA, 64 nt, Homo Sapiens; identical to SEQ ID NO: 323231

SEQ ID NO: 460830 - RNA, 64 nt, Homo Sapiens; identical to SEQ ID NO: 323232

SEQ ID NO: 460831 - RNA, 64 nt, Homo Sapiens; identical to SEQ ID NO: 323233

SEQ ID NO: 460832 - RNA, 64 nt, Homo Sapiens; identical to SEQ ID NO: 323234

SEQ ID NO: 460833 - RNA, 64 nt, Homo Sapiens; identical to SEQ ID NO: 323235

SEQ ID NO: 460834 - RNA, 64 nt, Homo Sapiens; identical to SEQ ID NO: 323236

SEQ ID NO: 460835 - RNA, 64 nt, Homo Sapiens; identical to SEQ ID NO: 323237

SEQ ID NO: 460836 - RNA, 64 nt, Homo Sapiens; identical to SEQ ID NO: 323238

SEQ ID NO: 460837 - RNA, 64 nt, Homo Sapiens; identical to SEQ ID NO: 323239

SEQ ID NO: 460838 - RNA, 64 nt, Homo Sapiens; identical to SEQ ID NO: 323240

SEQ ID NO: 460839 - RNA, 64 nt, Homo Sapiens; identical to SEQ ID NO: 323241

SEQ ID NO: 460840 - RNA, 64 nt, Homo Sapiens; identical to SEQ ID NO: 323242

SEQ ID NO: 460841 - RNA, 64 nt, Homo Sapiens; identical to SEQ ID NO: 323243

SEQ ID NO: 460842 - RNA, 64 nt, Homo Sapiens; identical to SEQ ID NO: 323244

SEQ ID NO: 460843 - RNA, 64 nt, Homo Sapiens; identical to SEQ ID NO: 323245

SEQ ID NO: 460844 - RNA, 64 nt, Homo Sapiens; identical to SEQ ID NO: 323246

SEQ ID NO: 460845 - RNA, 64 nt, Homo Sapiens; identical to SEQ ID NO: 323247

SEQ ID NO: 460846 - RNA, 64 nt, Homo Sapiens; identical to SEQ ID NO: 323248

SEQ ID NO: 460847 - RNA, 64 nt, Homo Sapiens; identical to SEQ ID NO: 323249

SEQ ID NO: 460848 - RNA, 64 nt, Homo Sapiens; identical to SEQ ID NO: 323250

SEQ ID NO: 460849 - RNA, 64 nt, Homo Sapiens; identical to SEQ ID NO: 323251

SEQ ID NO: 460850 - RNA, 64 nt, Homo Sapiens; identical to SEQ ID NO: 323252

SEQ ID NO: 460851 - RNA, 64 nt, Homo Sapiens; identical to SEQ ID NO: 323253

SEQ ID NO: 460852 - RNA, 64 nt, Homo Sapiens; identical to SEQ ID NO: 323254

SEQ ID NO: 460853 - RNA, 64 nt, Homo Sapiens; identical to SEQ ID NO: 323255

SEQ ID NO: 460854 - RNA, 64 nt, Homo Sapiens; identical to SEQ ID NO: 323256

SEQ ID NO: 460855 - RNA, 64 nt, Homo Sapiens; identical to SEQ ID NO: 323257

SEQ ID NO: 460856 - RNA, 64 nt, Homo Sapiens; identical to SEQ ID NO: 323258

SEQ ID NO: 460857 - RNA, 64 nt, Homo Sapiens; identical to SEQ ID NO: 323259

SEQ ID NO: 460858 - RNA, 64 nt, Homo Sapiens; identical to SEQ ID NO: 323260

SEQ ID NO: 460859 - RNA, 64 nt, Homo Sapiens; identical to SEQ ID NO: 323261

SEQ ID NO: 460860 - RNA, 64 nt, Homo Sapiens; identical to SEQ ID NO: 323262

SEQ ID NO: 460861 - RNA, 64 nt, Homo Sapiens; identical to SEQ ID NO: 323263

SEQ ID NO: 460862 - RNA, 64 nt, Homo Sapiens; identical to SEQ ID NO: 323264

SEQ ID NO: 460863 - RNA, 64 nt, Homo Sapiens; identical to SEQ ID NO: 323265

SEQ ID NO: 460864 - RNA, 64 nt, Homo Sapiens; identical to SEQ ID NO: 323266

SEQ ID NO: 460865 - RNA, 64 nt, Homo Sapiens; identical to SEQ ID NO: 323267

SEQ ID NO: 460866 - RNA, 64 nt, Homo Sapiens; identical to SEQ ID NO: 323268

SEQ ID NO: 460867 - RNA, 64 nt, Homo Sapiens; identical to SEQ ID NO: 323269

SEQ ID NO: 460868 - RNA, 64 nt, Homo Sapiens; identical to SEQ ID NO: 323270

SEQ ID NO: 460869 - RNA, 64 nt, Homo Sapiens; identical to SEQ ID NO: 323271

SEQ ID NO: 460870 - RNA, 64 nt, Homo Sapiens; identical to SEQ ID NO: 323272

SEQ ID NO: 460871 - RNA, 64 nt, Homo Sapiens; identical to SEQ ID NO: 323273

SEQ ID NO: 460872 - RNA, 64 nt, Homo Sapiens; identical to SEQ ID NO: 323274

SEQ ID NO: 460873 - RNA, 64 nt, Homo Sapiens; identical to SEQ ID NO: 323275

SEQ ID NO: 460874 - RNA, 64 nt, Homo Sapiens; identical to SEQ ID NO: 323276

SEQ ID NO: 460875 - RNA, 64 nt, Homo Sapiens; identical to SEQ ID NO: 323277

SEQ ID NO: 460876 - RNA, 64 nt, Homo Sapiens; identical to SEQ ID NO: 323278

SEQ ID NO: 460877 - RNA, 64 nt, Homo Sapiens; identical to SEQ ID NO: 323279

SEQ ID NO: 460878 - RNA, 64 nt, Homo Sapiens; identical to SEQ ID NO: 323280

SEQ ID NO: 460879 - RNA, 64 nt, Homo Sapiens; identical to SEQ ID NO: 323281

SEQ ID NO: 460880 - RNA, 64 nt, Homo Sapiens; identical to SEQ ID NO: 323282

SEQ ID NO: 460881 - RNA, 64 nt, Homo Sapiens; identical to SEQ ID NO: 323283

SEQ ID NO: 460882 - RNA, 64 nt, Homo Sapiens; identical to SEQ ID NO: 323284

SEQ ID NO: 460883 - RNA, 64 nt, Homo Sapiens; identical to SEQ ID NO: 323285

SEQ ID NO: 460884 - RNA, 64 nt, Homo Sapiens; identical to SEQ ID NO: 323286

SEQ ID NO: 460885 - RNA, 64 nt, Homo Sapiens; identical to SEQ ID NO: 323287

SEQ ID NO: 460886 - RNA, 64 nt, Homo Sapiens; identical to SEQ ID NO: 323288

SEQ ID NO: 460887 - RNA, 64 nt, Homo Sapiens; identical to SEQ ID NO: 323289

SEQ ID NO: 460888 - RNA, 64 nt, Homo Sapiens; identical to SEQ ID NO: 323290

SEQ ID NO: 460889 - RNA, 64 nt, Homo Sapiens; identical to SEQ ID NO: 323291

SEQ ID NO: 460890 - RNA, 64 nt, Homo Sapiens; identical to SEQ ID NO: 323292

SEQ ID NO: 460891 - RNA, 64 nt, Homo Sapiens; identical to SEQ ID NO: 323293

SEQ ID NO: 460892 - RNA, 64 nt, Homo Sapiens; identical to SEQ ID NO: 323294

SEQ ID NO: 460893 - RNA, 64 nt, Homo Sapiens; identical to SEQ ID NO: 323295

SEQ ID NO: 460894 - RNA, 64 nt, Homo Sapiens; identical to SEQ ID NO: 323296

SEQ ID NO: 460895 - RNA, 64 nt, Homo Sapiens; identical to SEQ ID NO: 323297

SEQ ID NO: 460896 - RNA, 64 nt, Homo Sapiens; identical to SEQ ID NO: 323298

SEQ ID NO: 460897 - RNA, 64 nt, Homo Sapiens; identical to SEQ ID NO: 323299

SEQ ID NO: 460898 - RNA, 64 nt, Homo Sapiens; identical to SEQ ID NO: 323300

SEQ ID NO: 460899 - RNA, 64 nt, Homo Sapiens; identical to SEQ ID NO: 323301

SEQ ID NO: 460900 - RNA, 64 nt, Homo Sapiens; identical to SEQ ID NO: 323302

SEQ ID NO: 460901 - RNA, 64 nt, Homo Sapiens; identical to SEQ ID NO: 323303

SEQ ID NO: 460902 - RNA, 64 nt, Homo Sapiens; identical to SEQ ID NO: 323304

SEQ ID NO: 460903 - RNA, 64 nt, Homo Sapiens; identical to SEQ ID NO: 323305

SEQ ID NO: 460904 - RNA, 64 nt, Homo Sapiens; identical to SEQ ID NO: 323306

SEQ ID NO: 460905 - RNA, 64 nt, Homo Sapiens; identical to SEQ ID NO: 323307

SEQ ID NO: 460906 - RNA, 64 nt, Homo Sapiens; identical to SEQ ID NO: 323308

SEQ ID NO: 460907 - RNA, 64 nt, Homo Sapiens; identical to SEQ ID NO: 323309

SEQ ID NO: 460908 - RNA, 64 nt, Homo Sapiens; identical to SEQ ID NO: 323310

SEQ ID NO: 460909 - RNA, 64 nt, Homo Sapiens; identical to SEQ ID NO: 323311

SEQ ID NO: 460910 - RNA, 64 nt, Homo Sapiens; identical to SEQ ID NO: 323312

SEQ ID NO: 460911 - RNA, 64 nt, Homo Sapiens; identical to SEQ ID NO: 323313

SEQ ID NO: 460912 - RNA, 64 nt, Homo Sapiens; identical to SEQ ID NO: 323314

SEQ ID NO: 460913 - RNA, 64 nt, Homo Sapiens; identical to SEQ ID NO: 323315

SEQ ID NO: 460914 - RNA, 64 nt, Homo Sapiens; identical to SEQ ID NO: 323316

SEQ ID NO: 460915 - RNA, 64 nt, Homo Sapiens; identical to SEQ ID NO: 323317

SEQ ID NO: 460916 - RNA, 64 nt, Homo Sapiens; identical to SEQ ID NO: 323318

SEQ ID NO: 460917 - RNA, 64 nt, Homo Sapiens; identical to SEQ ID NO: 323319

SEQ ID NO: 460918 - RNA, 64 nt, Homo Sapiens; identical to SEQ ID NO: 323320

SEQ ID NO: 460919 - RNA, 64 nt, Homo Sapiens; identical to SEQ ID NO: 323321

SEQ ID NO: 460920 - RNA, 64 nt, Homo Sapiens; identical to SEQ ID NO: 323322

SEQ ID NO: 460921 - RNA, 64 nt, Homo Sapiens; identical to SEQ ID NO: 323323

SEQ ID NO: 460922 - RNA, 64 nt, Homo Sapiens; identical to SEQ ID NO: 323324

SEQ ID NO: 460923 - RNA, 64 nt, Homo Sapiens; identical to SEQ ID NO: 323325

SEQ ID NO: 460924 - RNA, 64 nt, Homo Sapiens; identical to SEQ ID NO: 323326

SEQ ID NO: 460925 - RNA, 64 nt, Homo Sapiens; identical to SEQ ID NO: 323327

SEQ ID NO: 460926 - RNA, 64 nt, Homo Sapiens; identical to SEQ ID NO: 323328

SEQ ID NO: 460927 - RNA, 64 nt, Homo Sapiens; identical to SEQ ID NO: 323329

SEQ ID NO: 460928 - RNA, 64 nt, Homo Sapiens; identical to SEQ ID NO: 323330

SEQ ID NO: 460929 - RNA, 64 nt, Homo Sapiens; identical to SEQ ID NO: 323331

SEQ ID NO: 460930 - RNA, 64 nt, Homo Sapiens; identical to SEQ ID NO: 323332

SEQ ID NO: 460931 - RNA, 64 nt, Homo Sapiens; identical to SEQ ID NO: 323333

SEQ ID NO: 460932 - RNA, 64 nt, Homo Sapiens; identical to SEQ ID NO: 323334

SEQ ID NO: 460933 - RNA, 64 nt, Homo Sapiens; identical to SEQ ID NO: 323335

SEQ ID NO: 460934 - RNA, 64 nt, Homo Sapiens; identical to SEQ ID NO: 323336

SEQ ID NO: 460935 - RNA, 64 nt, Homo Sapiens; identical to SEQ ID NO: 323337

SEQ ID NO: 460936 - RNA, 64 nt, Homo Sapiens; identical to SEQ ID NO: 323338

SEQ ID NO: 460937 - RNA, 64 nt, Homo Sapiens; identical to SEQ ID NO: 323339

SEQ ID NO: 460938 - RNA, 64 nt, Homo Sapiens; identical to SEQ ID NO: 323340

SEQ ID NO: 460939 - RNA, 64 nt, Homo Sapiens; identical to SEQ ID NO: 323341

SEQ ID NO: 460940 - RNA, 64 nt, Homo Sapiens; identical to SEQ ID NO: 323342

SEQ ID NO: 460941 - RNA, 64 nt, Homo Sapiens; identical to SEQ ID NO: 323343

SEQ ID NO: 460942 - RNA, 64 nt, Homo Sapiens; identical to SEQ ID NO: 323344

SEQ ID NO: 460943 - RNA, 64 nt, Homo Sapiens; identical to SEQ ID NO: 323345

SEQ ID NO: 460944 - RNA, 64 nt, Homo Sapiens; identical to SEQ ID NO: 323346

SEQ ID NO: 460945 - RNA, 64 nt, Homo Sapiens; identical to SEQ ID NO: 323347

SEQ ID NO: 460946 - RNA, 64 nt, Homo Sapiens; identical to SEQ ID NO: 323348

SEQ ID NO: 460947 - RNA, 64 nt, Homo Sapiens; identical to SEQ ID NO: 323349

SEQ ID NO: 460948 - RNA, 64 nt, Homo Sapiens; identical to SEQ ID NO: 323350

SEQ ID NO: 460949 - RNA, 64 nt, Homo Sapiens; identical to SEQ ID NO: 323351

SEQ ID NO: 460950 - RNA, 64 nt, Homo Sapiens; identical to SEQ ID NO: 323352

SEQ ID NO: 460951 - RNA, 64 nt, Homo Sapiens; identical to SEQ ID NO: 323353

SEQ ID NO: 460952 - RNA, 64 nt, Homo Sapiens; identical to SEQ ID NO: 323354

SEQ ID NO: 460953 - RNA, 64 nt, Homo Sapiens; identical to SEQ ID NO: 323355

SEQ ID NO: 460954 - RNA, 64 nt, Homo Sapiens; identical to SEQ ID NO: 323356

SEQ ID NO: 460955 - RNA, 64 nt, Homo Sapiens; identical to SEQ ID NO: 323357

SEQ ID NO: 460956 - RNA, 64 nt, Homo Sapiens; identical to SEQ ID NO: 323358

SEQ ID NO: 460957 - RNA, 64 nt, Homo Sapiens; identical to SEQ ID NO: 323359

SEQ ID NO: 460958 - RNA, 64 nt, Homo Sapiens; identical to SEQ ID NO: 323360

SEQ ID NO: 460959 - RNA, 64 nt, Homo Sapiens; identical to SEQ ID NO: 323361

SEQ ID NO: 460960 - RNA, 64 nt, Homo Sapiens; identical to SEQ ID NO: 323362

SEQ ID NO: 460961 - RNA, 64 nt, Homo Sapiens; identical to SEQ ID NO: 323363

SEQ ID NO: 460962 - RNA, 64 nt, Homo Sapiens; identical to SEQ ID NO: 323364

SEQ ID NO: 460963 - RNA, 64 nt, Homo Sapiens; identical to SEQ ID NO: 323365

SEQ ID NO: 460964 - RNA, 64 nt, Homo Sapiens; identical to SEQ ID NO: 323366

SEQ ID NO: 460965 - RNA, 64 nt, Homo Sapiens; identical to SEQ ID NO: 323367

SEQ ID NO: 460966 - RNA, 64 nt, Homo Sapiens; identical to SEQ ID NO: 323368

SEQ ID NO: 460967 - RNA, 64 nt, Homo Sapiens; identical to SEQ ID NO: 323369

SEQ ID NO: 460968 - RNA, 64 nt, Homo Sapiens
uauguaaaaguuguuuuuguggagucaguggauauauuucuaaugaagugcuagacuauccaau

SEQ ID NO: 460969 - RNA, 64 nt, Homo Sapiens
ugaaaauucuuaacuaaacuauacauguaauauguauuucuagaagagaauaaaaacccaaguc

SEQ ID NO: 460970 - RNA, 64 nt, Homo Sapiens
uagcuuacauuuucaaaauggaaauugucggucauauuucuagaacuuuaaagaaaaaagaaug

SEQ ID NO: 460971 - RNA, 64 nt, Homo Sapiens
gauauuguguugcacuagaaaacuaagugguucauauuucuaaugaggaagauuaaugaaagaa

SEQ ID NO: 460972 - RNA, 64 nt, Homo Sapiens
uaugagaauguuuacaauuuuacaccaauuaaaauauuucuacagaucaguuagcaaaacuuaa

SEQ ID NO: 460973 - RNA, 64 nt, Homo Sapiens
agaaauauguacauaguucuuuuguuuaaacaaguauuucuaaauacuaaaaaguggagggaga

SEQ ID NO: 460974 - RNA, 64 nt, Homo Sapiens
caguucuaagaacugccuccccuggucauuauuuuauuucuauccuaccucaguuuacaaucua

SEQ ID NO: 460975 - RNA, 64 nt, Homo Sapiens
uuaaguucuaccuaggauauugugguagccuuuuuauuucuacaaaugacuuggauugaaaaua

SEQ ID NO: 460976 - RNA, 64 nt, Homo Sapiens
acaaaaaaaugcaaacuguaaugaaacuacauuguauuucuaagugugaaaacgacaggcugcc

SEQ ID NO: 460977 - RNA, 64 nt, Homo Sapiens
cacuuuauaaaagggaauagagaagagaugggacuauuucuauauuuaaaugcugcuggcuauu

SEQ ID NO: 460978 - RNA, 64 nt, Homo Sapiens
uacuuuacaccuuugacaaaaaagggagagcuauuauuucuaaauuucuuucacugguuauauu

SEQ ID NO: 460979 - RNA, 64 nt, Homo Sapiens
auacgaacuauagugccuggaaaaauaugagacauauuucuaaccauuauuuaaaaacacaugg

SEQ ID NO: 460980 - RNA, 64 nt, Homo Sapiens
ugccguguguugcuuguuauuuuuuaauuaaaguuauuucuauauuauaaucuucuauguaagu

SEQ ID NO: 460981 - RNA, 64 nt, Homo Sapiens
uaauuuggucauucuuugccuucuggcugauuucuauuucuagcauuagcaagaaauuaguuaa

SEQ ID NO: 460982 - RNA, 64 nt, Homo Sapiens
uuagcaagaaauuaguuaauaaaaaagaugauuguauuucuagaguauaaaauuugaaaaaaaa

SEQ ID NO: 460983 - RNA, 64 nt, Homo Sapiens
uuuuccaauauuaauaccuuauguuguccuuaaauauuucuaaaagcgccuuuauuucagcauu

SEQ ID NO: 460984 - RNA, 64 nt, Homo Sapiens
aagguaucaguauuucagaauccugcgacgauuuuauuucuaaauucauguacuguauguccau

SEQ ID NO: 460985 - RNA, 64 nt, Homo Sapiens
caauaaguuuuuucuuuuuuacauuauuucuaaauauuucuauugccuuugucuccuaacugaa

SEQ ID NO: 460986 - RNA, 64 nt, Homo Sapiens
uauuucuauucaauaaguuuccuaacugaaacauuauuucuaaaaucuauuuaagccuuugucu

SEQ ID NO: 460987 - RNA, 64 nt, Homo Sapiens
agucugcugcuauauagugggggaagcgugcacuuauuucuaaacauggguuuuuaacuucaag

SEQ ID NO: 460988 - RNA, 64 nt, Homo Sapiens
uuuugcuaacaaaaggagagacuuuuuucaugcauauuucuauuuuguuuuuuuggguuuuauu

SEQ ID NO: 460989 - RNA, 64 nt, Homo Sapiens
ugcuccaacauugcaaagacacauuaucagucccuauuucuagagggauuacuuugaauugagc

SEQ ID NO: 460990 - RNA, 64 nt, Homo Sapiens
auggauaaugugaccgggucuuaugcaaauuuucuauuucuaaaacuacuacuaugauauacaa

SEQ ID NO: 460991 - RNA, 64 nt, Homo Sapiens
ccauguaagguacuguguuguaccuuuauuucuguauuucuaaaagaagaaaguucuuuccuag

SEQ ID NO: 460992 - RNA, 64 nt, Homo Sapiens
augucuuugcauucagaccaauauuucagguggauauuucuaaguauuacuagaaaauacguuu

SEQ ID NO: 460993 - RNA, 64 nt, Homo Sapiens
uaacccccaaaaaagauucgguugucaagggauauauuucuaucccugccagcacagugcugga

SEQ ID NO: 460994 - RNA, 64 nt, Homo Sapiens
ggaaaacguguugcaagucaaccagucacuaggauauuucuacccaugcaacggaagaaaaacc

SEQ ID NO: 460995 - RNA, 64 nt, Homo Sapiens
guuuaacauaaaauaguuugauggcuuucuacaguauuucuauuauuuuagguuuuccuuuauc

SEQ ID NO: 460996 - RNA, 64 nt, Homo Sapiens
augucaagacuagccaaaggacucuacauaaaauuauuucuacacauauucuuccagguuuugc

SEQ ID NO: 460997 - RNA, 64 nt, Homo Sapiens
caguagcuugaaauugauuagcaugcuaguguuguauuucuauacucuauugauacaauauugu

SEQ ID NO: 460998 - RNA, 64 nt, Homo Sapiens
uuacagccauauguaacaucauugcaguuuacaguauuucuacaguugacaguauuaacacuaa

SEQ ID NO: 460999 - RNA, 64 nt, Homo Sapiens
uauauuuuauaaaguuuuguaaaaucccaaacaauauuucuauuuuuguaaaacaauuguaugu

SEQ ID NO: 461000 - RNA, 64 nt, Homo Sapiens
auuuugcaaucuauggaaauagaguagcaauugcuauuucuaaauugugaacuuuaagucaauc

SEQ ID NO: 461001 - RNA, 64 nt, Homo Sapiens
ugcaaauaguuucaaaugagauucaaaauaguucuauuucuaucuauuucauauugagaucagc

SEQ ID NO: 461002 - RNA, 64 nt, Homo Sapiens
uauuaggaggaaugugcuuuaauauuucuaagcuuauuucuaacaccauagaacugucccacaa

SEQ ID NO: 461003 - RNA, 64 nt, Homo Sapiens
cuuauuucuaacuauuaggaacugucccacaaaauauuucuaaguuauuuuagacaaccauaga

SEQ ID NO: 461004 - RNA, 64 nt, Homo Sapiens
uuagcaaggucuguuuuuaauaccauauacuuuauauuucuauacauuuauauuucuaauaaua

SEQ ID NO: 461005 - RNA, 64 nt, Homo Sapiens
uuaauaccauauacuuuauauuucuauacauuuauauuucuaauaauacaguuaucacugauau

SEQ ID NO: 461006 - RNA, 64 nt, Homo Sapiens
guuuuguuucuguuuccuaaauacuccuaaauaauauuucuaaucagccauuaugcuggggcau

SEQ ID NO: 461007 - RNA, 64 nt, Homo Sapiens
aauuugagccaaaaaaaaaauacgcaggcuuuccuauuucuacaacugauuguacuuaugcauu

SEQ ID NO: 461008 - RNA, 64 nt, Homo Sapiens
uugauuaucauuaaaauuaucauuaaaauugccuuauuucuauggacucagaggaaugauguuu

SEQ ID NO: 461009 - RNA, 64 nt, Homo Sapiens
gauaaacaugaaagcucuguccaaaugaaaaagguauuucuaacaacaaccacaauaacaauaa

SEQ ID NO: 461010 - RNA, 64 nt, Homo Sapiens
agguccuuccaucucugggaguuuuuucaacccauauuucuagaaauuacagcugccaguuuau

SEQ ID NO: 461011 - RNA, 64 nt, Homo Sapiens
cuuugaaaugcaaauaauguuuaucucagaagacuauuucuaggauuaacugagagauuaaagg

SEQ ID NO: 461012 - RNA, 64 nt, Homo Sapiens
uuggguuucauuugggauuugcaauguaaauacguauuucuaguuuucauauaaaguaguucuu

SEQ ID NO: 461013 - RNA, 64 nt, Homo Sapiens
uuaucuagaaaucuuuuaacaccuuuuuagugguuauuucuaaaaucacugucaacaauaaauc

SEQ ID NO: 461014 - RNA, 64 nt, Homo Sapiens
ucuggcuggcuacaguguagaucaguauuaggaauauuucuaaagauccugcuuuuuuguuuca

SEQ ID NO: 461015 - RNA, 64 nt, Homo Sapiens
auauacuguucuugguuuuauuguuccacuugaauauuucuacuguaaaaaaaagacagugguu

SEQ ID NO: 461016 - RNA, 64 nt, Homo Sapiens
guuguguuauucuuagcaguuuuugcuaaaaaauuauuucuagauagggaaauuuugaaguagu

SEQ ID NO: 461017 - RNA, 64 nt, Homo Sapiens
guaaucucucaauauucauacugauuuucugguuuauuucuacuaacuucauacuguuuauaaa

SEQ ID NO: 461018 - RNA, 64 nt, Homo Sapiens
ucuuuuggauuuuuuuuaauauuuuugaagcugguauuucuauugccuuacuuuuuggauaaau

SEQ ID NO: 461019 - RNA, 64 nt, Homo Sapiens
ccucaggacggaucugauauuaaaaauacuccccuauuucuaacucccauccaagaacuuggcc

SEQ ID NO: 461020 - RNA, 64 nt, Homo Sapiens
uaugccuugaagaacuaaaugauccacaaagcaguauuucuaaauuccuucuucaaacauuaaa

SEQ ID NO: 461021 - RNA, 64 nt, Homo Sapiens
caacuaacucacagaaaaacaaguguguuaccuauauuucuagcuuuugggaaaaaacuuugga

SEQ ID NO: 461022 - RNA, 64 nt, Homo Sapiens
uaaauaaaauauugaagaaacuucauuuuuuaaguauuucuauaaaacuuaaguaauggugcua

SEQ ID NO: 461023 - RNA, 64 nt, Homo Sapiens
uuaauacauuuguuuaccaccacucuaguuuuaguauuucuauuuuacaaaaauucuguugcac

SEQ ID NO: 461024 - RNA, 64 nt, Homo Sapiens
aaacguuucugcacuggcuuuaugcagaccuuuuuauuucuauuguggcuccgagccucggcuc

SEQ ID NO: 461025 - RNA, 64 nt, Homo Sapiens
acuacuuaaugaaaaaguguucagggccucaccguauuucuacuccucgcucaccaggccaguc

SEQ ID NO: 461026 - RNA, 64 nt, Homo Sapiens
gaaaaaaacuuuuaaauuauuauuuuuauacauuuauuucuaauaaugccuauaauaacauauu

SEQ ID NO: 461027 - RNA, 64 nt, Homo Sapiens
gagaauuaaaacuucagauugaauguuuauacauuauuucuaccauggcugcuaugguuucaga

SEQ ID NO: 461028 - RNA, 64 nt, Homo Sapiens
uauuagugaaauuugaauuggcuugugggagaauuauuucuauauucuugaugcugaccuuuuu

SEQ ID NO: 461029 - RNA, 64 nt, Homo Sapiens
aaugguuuaauuucuuuguauauuugagagaaaauauuucuauuuuuuacaaaagaauauuaca

SEQ ID NO: 461030 - RNA, 64 nt, Homo Sapiens
uuuuguuuugucugacaguaugagcuuguaucaguauuucuagcaaaauagauuuucuugacuc

SEQ ID NO: 461031 - RNA, 64 nt, Homo Sapiens
ccuuuaguucuuuuucauguccaguugggccaacuauuucuagcacaucucuauuguaauguuu

SEQ ID NO: 461032 - RNA, 64 nt, Homo Sapiens
agccaaagccuccuccagccgccaugcuccuggcccacugcaucguuucaucuuccaacucaaa

SEQ ID NO: 461033 - RNA, 64 nt, Homo Sapiens
ugggaggucaaggcugcagugagccgagauugcaccacugcacuccagccugggugacagagca

SEQ ID NO: 461034 - RNA, 64 nt, Homo Sapiens
ggggaggcggagguugcagugaggcgagauugugccacugcacuccagcuugggcgacagagug

SEQ ID NO: 461035 - RNA, 64 nt, Homo Sapiens
cuggaggcagaaguugcagugagccgagaucgcaccacugcacuccagccuaggagacaaaacg

SEQ ID NO: 461036 - RNA, 64 nt, Homo Sapiens
ccagccugggcaacagagcggagcugagauugcgccacugcacuugggaggcagagcuugcagu

SEQ ID NO: 461037 - RNA, 64 nt, Homo Sapiens
ccagccugggcgacaagagugagcuaagaucgcgccacugcacuccaggagguggagguugcgu

SEQ ID NO: 461038 - RNA, 64 nt, Homo Sapiens
ccggccugggugacagcauggagccaagauugugccacugcacacaggaggucaaggcugcagu

SEQ ID NO: 461039 - RNA, 64 nt, Homo Sapiens
ccacucugggcaacagaaugaagcuacgaucaugccacugcacucaggaauuugagguuguagu

SEQ ID NO: 461040 - RNA, 64 nt, Homo Sapiens
ccaaucugggugacugagcagagcuguguucuugccacugcacucaggaauuugaagcugcagu

SEQ ID NO: 461041 - RNA, 64 nt, Homo Sapiens
ccagccuggcuacagggcgagagccgagaucacgccacugcacuugggaggcagagguugcagu

SEQ ID NO: 461042 - RNA, 64 nt, Homo Sapiens
cgggaggcggagguugcagugagccaagaucgcaccacugcacuccagccuggcaacagagcga

SEQ ID NO: 461043 - RNA, 64 nt, Homo Sapiens
cuggagauggagguugcagugagcagagaucgcaccacugcacuccagccugggcaagagugag

SEQ ID NO: 461044 - RNA, 64 nt, Homo Sapiens
uaggagagggagguugcagugagccgugauugcaccacugcacuccagccugggcaacagagca

SEQ ID NO: 461045 - RNA, 64 nt, Homo Sapiens
cugggaagcugaggcugcaguagccaugacugcaccacugcauuccagccugguugacagagug

SEQ ID NO: 461046 - RNA, 64 nt, Homo Sapiens
ggggagacggagguugcagugagccgaguuugggccacugcacucuagccuggcaacagagcaa

SEQ ID NO: 461047 - RNA, 64 nt, Homo Sapiens
gacuuccucuccagccuucucucucuggucaggcccacugcagagaugguggugagcacaucug

SEQ ID NO: 461048 - RNA, 64 nt, Homo Sapiens
cucugaaucaguuuuuuaaagaguaaguaagcagccacugcaagaaauuucugaaagauagcca

SEQ ID NO: 461049 - RNA, 64 nt, Homo Sapiens
cuuguggauuuuccacacagcuuccaauccaagcccacugcagccuaagaagaaaagccacuuu

SEQ ID NO: 461050 - RNA, 64 nt, Homo Sapiens
ugggagguggagguugcagugagcugaggucgcaccacugcacuccagccuggacaacagagca

SEQ ID NO: 461051 - RNA, 64 nt, Homo Sapiens
acagaggucgaggcugcagugagcugugacugugccacugcacuccagcuugagcaacacagug

SEQ ID NO: 461052 - RNA, 64 nt, Homo Sapiens
ucuuauagacagagggcacagcuaagcacagcugccacugcaggagacaggccccaugucagga

SEQ ID NO: 461053 - RNA, 64 nt, Homo Sapiens
ucuuggucccugugaugucaagcccauugcucucccacugcagaacauggccucuagauuaaug

SEQ ID NO: 461054 - RNA, 64 nt, Homo Sapiens
ucaacuugcauccaacuccaggauagugggcaccccacugcaauccugucuuucugagcacacu

SEQ ID NO: 461055 - RNA, 64 nt, Homo Sapiens
ccccaagugugaacaaaagaugcucuucuguggaccacugcaugagcuuuuauacuaccgaccu

SEQ ID NO: 461056 - RNA, 64 nt, Homo Sapiens
cgggagggagagguugcagugagccaagaucguaccacugcacuccagccugggugacagagug

SEQ ID NO: 461057 - RNA, 64 nt, Homo Sapiens
caggagacggaaguugcagugagcugagaucacaccacugcacuccagccuggugacagagcaa

SEQ ID NO: 461058 - RNA, 64 nt, Homo Sapiens
agucuucuguuuuguuuuucauuguuugacguuuccacugcaugccuugacuucccccaccucc

SEQ ID NO: 461059 - RNA, 64 nt, Homo Sapiens
ugacuucccccaccuccuccucaaacaagagacuccacugcauguuccaagacaguauggggug

SEQ ID NO: 461060 - RNA, 64 nt, Homo Sapiens
uaggaggcagagguugcagugagccgagauugcgccacugcaccccagccuggacaacagagug

SEQ ID NO: 461061 - RNA, 64 nt, Homo Sapiens
gccaccagguaugaaaaggagccugguggggagaccacugcacccaaaacaaauccuuucuucu

SEQ ID NO: 461062 - RNA, 64 nt, Homo Sapiens
uaaagcagggaggaaaccucugcagcucauucugccacugcaaagcugguguagccaugcuggu

SEQ ID NO: 461063 - RNA, 64 nt, Homo Sapiens
cuccuucacaccccuuccaaaagucagucacagaccacugcaacaugccuucccugcuggauca

SEQ ID NO: 461064 - RNA, 64 nt, Homo Sapiens
uguucuguagcuagacuggugcaggcucguuguaccacugcaaccgacugacguuacuguaguu

SEQ ID NO: 461065 - RNA, 64 nt, Homo Sapiens
ccacuguuuuugguagcaauuauaugguuacuauccacugcaguccucaguuguugggguaaau

SEQ ID NO: 461066 - RNA, 64 nt, Homo Sapiens
ccagccugggugacagagccgggccgagaucgagccacugcacgagggagucagagguugcauu

SEQ ID NO: 461067 - RNA, 64 nt, Homo Sapiens
uggccugacauucuuuaugaauuacaggcgugagccacugcacccggccucccaaagugcuggg

SEQ ID NO: 461068 - RNA, 64 nt, Homo Sapiens
cuagccugggcaacagaguggagcuaugauuucaccacugcauucaggaguuugaaguugcaau

SEQ ID NO: 461069 - RNA, 64 nt, Homo Sapiens
ucagccugggugacagagcagagccaagauuaugccacugcacuugggaggcagagguugcagu

SEQ ID NO: 461070 - RNA, 64 nt, Homo Sapiens
gauucuucuaaaaaguauguaucugacuuucuguccacugcaugggaucccuagggacuaccua

SEQ ID NO: 461071 - RNA, 64 nt, Homo Sapiens
ccaaccugggcgacagagccgagccaagauuguaccacugcauucgggagguggagguugcaau

SEQ ID NO: 461072 - RNA, 64 nt, Homo Sapiens
ggcagaacguccaagaaugggagggucuccuuccccacugcagaaaauauucaccauaauccag

SEQ ID NO: 461073 - RNA, 64 nt, Homo Sapiens
auauaaauacugaaaaugugauguuuaaagacuuccacugcaauuuaaucaccaguaagauuug

SEQ ID NO: 461074 - RNA, 64 nt, Homo Sapiens
caggaguucaagucugcagugagcuaugauugcaccacugcacuccagccugggugauagagca

SEQ ID NO: 461075 - RNA, 64 nt, Homo Sapiens
cgcugagagaccccacuccccugcugagaucgcgccacugcacuccagccugggcgacagagca

SEQ ID NO: 461076 - RNA, 64 nt, Homo Sapiens
cuggaggcggagguugccgugagccaagaucgcaccacugcacuccagccugggcgacaaagug

SEQ ID NO: 461077 - RNA, 64 nt, Homo Sapiens
caggaggcggagguugcagugagcagagaucgugccacugcacuccagccuggguggacagagc

SEQ ID NO: 461078 - RNA, 64 nt, Homo Sapiens
cgggagguggagauugcaguaagccgagaucgugccacugcacuccagccugggugauagagca

SEQ ID NO: 461079 - RNA, 64 nt, Homo Sapiens
ccagccugagcaacaaaagcgagccaagauugugccacugcacuugggaggcagagguugcagu

SEQ ID NO: 461080 - RNA, 64 nt, Homo Sapiens
gaguguugagggcaccucucccaaaacccgugcgccacugcaguccaagaugcuguccccccau

SEQ ID NO: 461081 - RNA, 64 nt, Homo Sapiens
acagcagauuugaggcuuuuauacuauuuacaucccacugcagaucuuaucuugccuuauugcu

SEQ ID NO: 461082 - RNA, 64 nt, Homo Sapiens
ccagccugggcgacagaguggagccaagaucgcgccacugcacuagguaggcagagguugcagu

SEQ ID NO: 461083 - RNA, 64 nt, Homo Sapiens
ccagccugggucacagaguggagccaagaucgcaccacugcacucgggggacagagguuguagu

SEQ ID NO: 461084 - RNA, 64 nt, Homo Sapiens
ccagccugagugacagagcgugagccaugauuucccacugcacuccaggaguuugaggcugcaa

SEQ ID NO: 461085 - RNA, 64 nt, Homo Sapiens
uagagaacagcggugggggauccagcuggaccccccacugcaaaguugccgcauuuauuccacc

SEQ ID NO: 461086 - RNA, 64 nt, Homo Sapiens
ccagccugggcaacagaguggagccaagaucgcaccacugcacucaggaggcggagguugcagu

SEQ ID NO: 461087 - RNA, 64 nt, Homo Sapiens
acaagugccucccgagccuagauccuggcucggaccacugcaagggccgaggcagggccagacc

SEQ ID NO: 461088 - RNA, 64 nt, Homo Sapiens
cauuugcugacagaggacggggcacccgggcuccccacugcagucggccuugccuccuccuccu

SEQ ID NO: 461089 - RNA, 64 nt, Homo Sapiens
uggcccuaccccagccuccucagaacaggggugaccacugcaggggagacugccccuaaccugu

SEQ ID NO: 461090 - RNA, 64 nt, Homo Sapiens
cccuaaccugugucuuuguguccccagaagacacccacugcagacccccagcccagccugcucu

SEQ ID NO: 461091 - RNA, 64 nt, Homo Sapiens
ucaacuguuacacagagaugaccagaggauggggccacugcagugcaguucaagaggcucuggu

SEQ ID NO: 461092 - RNA, 64 nt, Homo Sapiens
cgggagguggagguugcagugagccaagaucgcgccacugcacuccagccuggaugacagagca

SEQ ID NO: 461093 - RNA, 64 nt, Homo Sapiens
agggaggucgaggcugcagugagccacgaucacaccacugcacuccagccuaggugacagagug

SEQ ID NO: 461094 - RNA, 64 nt, Homo Sapiens
ugccauucaccacugcguccuguugaaucucaugccacugcaagucccagcugagucccaucga

SEQ ID NO: 461095 - RNA, 64 nt, Homo Sapiens
ucucucaugcccacaggcacagcacccacugugaccacugcaguugugcccaugggcaccccag

SEQ ID NO: 461096 - RNA, 64 nt, Homo Sapiens
ccagccugggugacagagugcaagaucacaggagccacugcacuagguggagguugcagugagc

SEQ ID NO: 461097 - RNA, 64 nt, Homo Sapiens
ccagccugggcaacagagcagagcugagaucaugccacugcacuugggagauggagguugcagu

SEQ ID NO: 461098 - RNA, 61 nt, Homo Sapiens
gcaagagggggaaguggugaccagacacugcccacugcagugccaagacggcagcaggacu

SEQ ID NO: 461099 - RNA, 64 nt, Homo Sapiens
gcagcaggacuggggcugauagcccaccccgcccccacugcagcucccacaaagcacucuaagg

SEQ ID NO: 461100 - RNA, 64 nt, Homo Sapiens
cugggagguugaggcugcagugagcuguguuucgccacugcacaccagccugggugacagugug

SEQ ID NO: 461101 - RNA, 64 nt, Homo Sapiens
caggagguagagguugcagugagcugagauugcaccacugcaccagccuggcaacagagcaaga

SEQ ID NO: 461102 - RNA, 64 nt, Homo Sapiens
ugggaggcagagguugcagugaucaggaauugugccacugcacuccaaccugagugacagagca

SEQ ID NO: 461103 - RNA, 64 nt, Homo Sapiens
cggccagcccuguugucuuuauuccaggcgugagccacugcacccggccucccaaagugcuggg

SEQ ID NO: 461104 - RNA, 64 nt, Homo Sapiens
aaggccugagugcaagcaccgcuuugcagaagccccacugcaugccuaucugguaggcugcccu

SEQ ID NO: 461105 - RNA, 64 nt, Homo Sapiens
uggugcugcuuuggcugacugguucucuucauucccacugcacucugagucaguuuuuuaucug

SEQ ID NO: 461106 - RNA, 64 nt, Homo Sapiens
cuacuccuaccuggucaaccuuuuccuaguauacccacugcaucuguuagugggaagagcuggg

SEQ ID NO: 461107 - RNA, 64 nt, Homo Sapiens
gagagacgggcuggcuaacccuccuaauuaagggccacugcaaacaccccccaucugucucuuc

SEQ ID NO: 461108 - RNA, 64 nt, Homo Sapiens
ucagccugggugacauagagagauagugauagugccacugcaaugcagagguugcagugaacug

SEQ ID NO: 461109 - RNA, 64 nt, Homo Sapiens
cggaaggcggagcuugcaguuagccgagaucaugccacugcacuccagccuacaugacaaugug

SEQ ID NO: 461110 - RNA, 64 nt, Homo Sapiens
ugggaggcggagguugcagugagcugagcucauaccacugcacuccagccugaacagagugaga

SEQ ID NO: 461111 - RNA, 64 nt, Homo Sapiens
ccagccugcggacagaccaagagcuaagaucacgccacugcacuugggaggcggagguugcagu

SEQ ID NO: 461112 - RNA, 64 nt, Homo Sapiens
agaaacccccacccggcaagacuguugcaccaagccacugcaagagggaaauccuauucacauc

SEQ ID NO: 461113 - RNA, 64 nt, Homo Sapiens
gcuuccuucccuccuucacugcggcaccagccucccacugcacaaggcuugcagaggcauccca

SEQ ID NO: 461114 - RNA, 64 nt, Homo Sapiens
aggagggacuuaagcuagacaaccccagggcacuccacugcagcuaaggcggcuggaccccagg

SEQ ID NO: 461115 - RNA, 64 nt, Homo Sapiens
ccagccuggacgacagagcggagccaagaucacgccacugcauucgggaggcagagcuugcagu

SEQ ID NO: 461116 - RNA, 64 nt, Homo Sapiens
ggcgaaagccagugcuuuggaaguauugcuuccgccacugcagacucaagaaauccuuacaggu

SEQ ID NO: 461117 - RNA, 64 nt, Homo Sapiens
ccagccugggugacagaacagagccaagaucgcgccacugcacuugggaggcagagguugcagu

SEQ ID NO: 461118 - RNA, 64 nt, Homo Sapiens
ucagccuggaugaugagagugagccgagauugcaccacugcaguugggaggcggaaguugcagu

SEQ ID NO: 461119 - RNA, 64 nt, Homo Sapiens
uggcccacauuuuuuaaagaaugacaggugcgagccacugcacccagccucccaaagugcuugg

SEQ ID NO: 461120 - RNA, 64 nt, Homo Sapiens
ccagccuggcgacagagagagagcugagaucacaccacugcacucgggaggcaaagguugcagu

SEQ ID NO: 461121 - RNA, 64 nt, Homo Sapiens
ucagccugggugacagaaaggagccaagaucgugccacugcacucaugaggcccagguuacagu

SEQ ID NO: 461122 - RNA, 64 nt, Homo Sapiens
ugagccugggcgacacagcggagccgagaucacgccacugcacucaggaggcagagcuugcagu

SEQ ID NO: 461123 - RNA, 64 nt, Homo Sapiens
cagccucccaaagugcugggauuacaagcgugagccacugcaccgggccacagagaaaguacuu

SEQ ID NO: 461124 - RNA, 64 nt, Homo Sapiens
agggaggcagagguugcagugagccgagaucacgccacugcacuauagccuaggugacagagug

SEQ ID NO: 461125 - RNA, 64 nt, Homo Sapiens
caggaggcggagauugcagugagccaagguuccaccacugcacuccagccuggcgacagagcaa

SEQ ID NO: 461126 - RNA, 64 nt, Homo Sapiens
cgggagguggaggcugcagugaacagagacagugccacugcacaucagccugagugacagagag

SEQ ID NO: 461127 - RNA, 64 nt, Homo Sapiens
ccagccugggugacagagccgagccgagaucgcgccacugcacucgggaggaagagcuugcagu

SEQ ID NO: 461128 - RNA, 64 nt, Homo Sapiens
ccagcccaggugacaguguggagccgagaucgcuccacugcacucaggaggcggagguugcagu

SEQ ID NO: 461129 - RNA, 64 nt, Homo Sapiens
uguuuaaaaauaaauuuuuagagcuaugaucaucccacugcauucaggaguucaaggcugcaga

SEQ ID NO: 461130 - RNA, 64 nt, Homo Sapiens
ccagccugggugacagagcggagcucagauagugccacugcacuugggaggcagagguugcagu

SEQ ID NO: 461131 - RNA, 64 nt, Homo Sapiens
caaauuccaauguguacuucagcugcuguccuggccacugcauuuaccuauaaggugguuuaua

SEQ ID NO: 461132 - RNA, 64 nt, Homo Sapiens
cugcacuccauccugggcgagagccaaaauugcaccacugcacaugagaggcggagguugcagu

SEQ ID NO: 461133 - RNA, 64 nt, Homo Sapiens
ccagccugggcgacagagcgugaguggagaugcgccacugcacucugggaggcagagcuugcag

SEQ ID NO: 461134 - RNA, 64 nt, Homo Sapiens
gucuuuuuaaacuggaaacagacucaaaguagugccacugcaguuucuggaauuaacacucugu

SEQ ID NO: 461135 - RNA, 64 nt, Homo Sapiens
ugagaggcagagguuacagugagccaagaucgugccacugcauuccagccugggcgacagagca

SEQ ID NO: 461136 - RNA, 64 nt, Homo Sapiens
caggaggcagagguugcagugauccaagaucaugccacugcacuccagccugggcaacaagagc

SEQ ID NO: 461137 - RNA, 64 nt, Homo Sapiens
cgggaagcggagcuugcagugagccgagauugcgccacugcaguccgcagucuggccugggcga

SEQ ID NO: 461138 - RNA, 64 nt, Homo Sapiens
caggagguggagguugcagugagccaugaucgagccacugcacuccagccugggcaacagauga

SEQ ID NO: 461139 - RNA, 64 nt, Homo Sapiens
ugggagguugugguugcagugagcuaugauuguaccacugcacuccagccugggcaacagagca

SEQ ID NO: 461140 - RNA, 64 nt, Homo Sapiens
ugggaggcggagguugcggucagcugagauggugccacugcacuccagccugggcgaaagagcg

SEQ ID NO: 461141 - RNA, 64 nt, Homo Sapiens
cccugccucauggcuuuagugagccaugauugugccacugcacuccagcuuggugacagaguga

SEQ ID NO: 461142 - RNA, 64 nt, Homo Sapiens
uaaguggcagagguugcagugagcugagaucgcaccacugcacucuagcuugggcaacagagca

SEQ ID NO: 461143 - RNA, 64 nt, Homo Sapiens
cgggagguggagauugcagugagcccagaucgcaccacugcacuccagucuggcaacagagcaa

SEQ ID NO: 461144 - RNA, 64 nt, Homo Sapiens
ucugaccuguacucuugaauacaaguuucugauaccacugcacugucugagaauuuccaaaacu

SEQ ID NO: 461145 - RNA, 64 nt, Homo Sapiens
cgggaggcggagcuugcagugagccgagaucgcgccacugcacuccagccugggcgacagagug

SEQ ID NO: 461146 - RNA, 64 nt, Homo Sapiens
agggagauugaggcugcagugagcuguguucacaccacugcacuccagucugggcaacagugca

SEQ ID NO: 461147 - RNA, 64 nt, Homo Sapiens
ugggaggcagagguugcagugagcugagaucucaccacugcacuccagccugggcaacagagcg

SEQ ID NO: 461148 - RNA, 64 nt, Homo Sapiens
cggccccccaaagugcugggguuacaggugugagccacugcacccggccacaagauguaauuuu

SEQ ID NO: 461149 - RNA, 64 nt, Homo Sapiens
ccagccugggugacagugaggagcugacaccacgccacugcacuugggagguggagguugcugu

SEQ ID NO: 461150 - RNA, 64 nt, Homo Sapiens
ccagccugggugacagaauggaacuaugauggugccacugcauugcccaguucaaggcugcagu

SEQ ID NO: 461151 - RNA, 64 nt, Homo Sapiens
ccagccuggguaacagagcagaguugagaucgcgccacugcacucaggaggcggaguuuguggu

SEQ ID NO: 461152 - RNA, 64 nt, Homo Sapiens
ccagccugggugacagaguggagcugagaucgugccacugcacucaagaggcagaguuugcagu

SEQ ID NO: 461153 - RNA, 64 nt, Homo Sapiens
ccagccugggugacagagcggagccaugaucauaccacugcacugcccagguugaggcuauagu

SEQ ID NO: 461154 - RNA, 64 nt, Homo Sapiens
ccagccugggcaacacagcggaaccaagaucaugccacugcacucgggaggcagaggcugcagu

SEQ ID NO: 461155 - RNA, 64 nt, Homo Sapiens
ccagccugggcagcagagcagagccgagauugcgccacugcacuugggaggcggagcuugcagu

SEQ ID NO: 461156 - RNA, 64 nt, Homo Sapiens
ccagccugggcaacagaggggagccaugauugcaccacugcacuugagagguagaggcugcauu

SEQ ID NO: 461157 - RNA, 64 nt, Homo Sapiens
ccagccugggccacagacccgagccgagauggcgccacugcacucaggagguggagguugcagu

SEQ ID NO: 461158 - RNA, 64 nt, Homo Sapiens
cggcucaccacuaguuuuuaauuacaggcgugagccacugcacccagccucccaaagugcuggg

SEQ ID NO: 461159 - RNA, 64 nt, Homo Sapiens
gguauuguucucacagucuuuuggugguugauggccacugcaaaccuggcaccaucagaucucu

SEQ ID NO: 461160 - RNA, 64 nt, Homo Sapiens
ugggagguggagguugcagugagccgagauggugccacugcauuccagccugggcaacagagcg

SEQ ID NO: 461161 - RNA, 64 nt, Homo Sapiens
cccuucacccucuguguccugguccuucugagggccacugcagaugacucuccuuugaaaugag

SEQ ID NO: 461162 - RNA, 64 nt, Homo Sapiens
gcucagaaagugccccuugaugagggaaaaugucccacugcacugcgaauuucucaguuccauu

SEQ ID NO: 461163 - RNA, 64 nt, Homo Sapiens
uggccuccaaaagugcugggauuacaggcaugagccacugcacucggcuguaccgugauuauua

SEQ ID NO: 461164 - RNA, 64 nt, Homo Sapiens
ugggaggcagagguuucagugagcugaaauugugccacugcacuccagccugagugacagagug

SEQ ID NO: 461165 - RNA, 64 nt, Homo Sapiens
caggagguggagguugcagugagccgagaucacgccacugcacuccagccuggugacagcguga

SEQ ID NO: 461166 - RNA, 64 nt, Homo Sapiens
guuccagagcccaggguugagcauccugaaggagccacugcagccgucacuguccccagagccu

SEQ ID NO: 461167 - RNA, 64 nt, Homo Sapiens
ccagccugggcaacagaguggagcugagaucacgccacugcacucaggaggcggagcuugcagu

SEQ ID NO: 461168 - RNA, 64 nt, Homo Sapiens
ccagccugggcaacagagcggagcugaagucccgccacugcacucgggaggcagagguagcagu

SEQ ID NO: 461169 - RNA, 64 nt, Homo Sapiens
agggaguuggagguugcagugagcuaagacugcaccacugcacuccagccuggugacagaacga

SEQ ID NO: 461170 - RNA, 64 nt, Homo Sapiens
caggaggucgaggcugcagugagcugugaucucaccacugcauuccagccugggugacagaguu

SEQ ID NO: 461171 - RNA, 64 nt, Homo Sapiens
ccagccugggccacagagcaaagccgagaucgugccacugcacucgggaggcagaggcugcagu

SEQ ID NO: 461172 - RNA, 64 nt, Homo Sapiens
ccagccugggugacagaguggauccgagaucacaccacugcauuggggagguccaggccgcagu

SEQ ID NO: 461173 - RNA, 64 nt, Homo Sapiens
ccagucugggugacagcaaggagcuaugaucaugccacugcacucaggaguuugagucugcagu

SEQ ID NO: 461174 - RNA, 64 nt, Homo Sapiens
cggccgguggaaagcauuuuauuauaggcaugagccacugcaccuggccucccaaagugcuggg

SEQ ID NO: 461175 - RNA, 63 nt, Homo Sapiens
uauuaguuucucuccacucuacgagugccugaacugcaugauuucaaacaugccauaaggaaa

SEQ ID NO: 461176 - RNA, 63 nt, Homo Sapiens
aucuaggagagaauucauaagccuuguuccuuucugcaugagacaagugugguaauauggcaa

SEQ ID NO: 461177 - RNA, 63 nt, Homo Sapiens
cacagaccgucucagacacgcacagugggccugcugcaugauucacacccagucccugccaca

SEQ ID NO: 461178 - RNA, 63 nt, Homo Sapiens; identical to SEQ ID NO: 461177

SEQ ID NO: 461179 - RNA, 63 nt, Homo Sapiens
ucagcucaccgcaaccucugggcuggagugcagcugcaugauuaguuucauucuuguuaccca

SEQ ID NO: 461180 - RNA, 63 nt, Homo Sapiens
uuagccauggguccuuucugaagugugacuccccugcaugauguucgucuaugaaaaguugcc

SEQ ID NO: 461181 - RNA, 63 nt, Homo Sapiens
ucauagacuuugauuuuauuuauaagccacuugcugcaugacccuccaaguagaccuguggcu

SEQ ID NO: 461182 - RNA, 63 nt, Homo Sapiens
uacucaaacacuuuuggaccaggauuugagucucugcaugacauauacuugauuaaaagguua

SEQ ID NO: 461183 - RNA, 64 nt, Homo Sapiens; identical to SEQ ID NO: 85324

SEQ ID NO: 461184 - RNA, 64 nt, Homo Sapiens; identical to SEQ ID NO: 85325

SEQ ID NO: 461185 - RNA, 64 nt, Homo Sapiens; identical to SEQ ID NO: 85326

SEQ ID NO: 461186 - RNA, 64 nt, Homo Sapiens; identical to SEQ ID NO: 85327

SEQ ID NO: 461187 - RNA, 64 nt, Homo Sapiens; identical to SEQ ID NO: 85328

SEQ ID NO: 461188 - RNA, 64 nt, Homo Sapiens; identical to SEQ ID NO: 85329

SEQ ID NO: 461189 - RNA, 64 nt, Homo Sapiens; identical to SEQ ID NO: 85330

SEQ ID NO: 461190 - RNA, 64 nt, Homo Sapiens; identical to SEQ ID NO: 85331

SEQ ID NO: 461191 - RNA, 64 nt, Homo Sapiens; identical to SEQ ID NO: 85332

SEQ ID NO: 461192 - RNA, 64 nt, Homo Sapiens; identical to SEQ ID NO: 85333

SEQ ID NO: 461193 - RNA, 64 nt, Homo Sapiens; identical to SEQ ID NO: 85334

SEQ ID NO: 461194 - RNA, 64 nt, Homo Sapiens; identical to SEQ ID NO: 85335

SEQ ID NO: 461195 - RNA, 64 nt, Homo Sapiens; identical to SEQ ID NO: 85336

SEQ ID NO: 461196 - RNA, 64 nt, Homo Sapiens; identical to SEQ ID NO: 85337

SEQ ID NO: 461197 - RNA, 64 nt, Homo Sapiens; identical to SEQ ID NO: 85338

SEQ ID NO: 461198 - RNA, 64 nt, Homo Sapiens; identical to SEQ ID NO: 85339

SEQ ID NO: 461199 - RNA, 64 nt, Homo Sapiens; identical to SEQ ID NO: 85340

SEQ ID NO: 461200 - RNA, 64 nt, Homo Sapiens; identical to SEQ ID NO: 85341

SEQ ID NO: 461201 - RNA, 64 nt, Homo Sapiens; identical to SEQ ID NO: 85342

SEQ ID NO: 461202 - RNA, 64 nt, Homo Sapiens; identical to SEQ ID NO: 85343

SEQ ID NO: 461203 - RNA, 64 nt, Homo Sapiens; identical to SEQ ID NO: 85344

SEQ ID NO: 461204 - RNA, 64 nt, Homo Sapiens; identical to SEQ ID NO: 85345

SEQ ID NO: 461205 - RNA, 64 nt, Homo Sapiens; identical to SEQ ID NO: 85346

SEQ ID NO: 461206 - RNA, 64 nt, Homo Sapiens; identical to SEQ ID NO: 85347

SEQ ID NO: 461207 - RNA, 64 nt, Homo Sapiens; identical to SEQ ID NO: 85348

SEQ ID NO: 461208 - RNA, 64 nt, Homo Sapiens; identical to SEQ ID NO: 85349

SEQ ID NO: 461209 - RNA, 64 nt, Homo Sapiens; identical to SEQ ID NO: 85350

SEQ ID NO: 461210 - RNA, 64 nt, Homo Sapiens; identical to SEQ ID NO: 85351

SEQ ID NO: 461211 - RNA, 64 nt, Homo Sapiens; identical to SEQ ID NO: 85352

SEQ ID NO: 461212 - RNA, 64 nt, Homo Sapiens; identical to SEQ ID NO: 85353

SEQ ID NO: 461213 - RNA, 64 nt, Homo Sapiens; identical to SEQ ID NO: 85354

SEQ ID NO: 461214 - RNA, 64 nt, Homo Sapiens; identical to SEQ ID NO: 85355

SEQ ID NO: 461215 - RNA, 64 nt, Homo Sapiens; identical to SEQ ID NO: 85356

SEQ ID NO: 461216 - RNA, 64 nt, Homo Sapiens; identical to SEQ ID NO: 85357

SEQ ID NO: 461217 - RNA, 64 nt, Homo Sapiens; identical to SEQ ID NO: 85358

SEQ ID NO: 461218 - RNA, 64 nt, Homo Sapiens; identical to SEQ ID NO: 85359

SEQ ID NO: 461219 - RNA, 64 nt, Homo Sapiens; identical to SEQ ID NO: 85360

SEQ ID NO: 461220 - RNA, 64 nt, Homo Sapiens; identical to SEQ ID NO: 85361

SEQ ID NO: 461221 - RNA, 64 nt, Homo Sapiens; identical to SEQ ID NO: 85362

SEQ ID NO: 461222 - RNA, 64 nt, Homo Sapiens; identical to SEQ ID NO: 85363

SEQ ID NO: 461223 - RNA, 64 nt, Homo Sapiens; identical to SEQ ID NO: 85364

SEQ ID NO: 461224 - RNA, 64 nt, Homo Sapiens; identical to SEQ ID NO: 85365

SEQ ID NO: 461225 - RNA, 64 nt, Homo Sapiens; identical to SEQ ID NO: 85366

SEQ ID NO: 461226 - RNA, 64 nt, Homo Sapiens; identical to SEQ ID NO: 85367

SEQ ID NO: 461227 - RNA, 64 nt, Homo Sapiens; identical to SEQ ID NO: 85368

SEQ ID NO: 461228 - RNA, 64 nt, Homo Sapiens; identical to SEQ ID NO: 85369

SEQ ID NO: 461229 - RNA, 64 nt, Homo Sapiens; identical to SEQ ID NO: 290548

SEQ ID NO: 461230 - RNA, 64 nt, Homo Sapiens; identical to SEQ ID NO: 290549

SEQ ID NO: 461231 - RNA, 64 nt, Homo Sapiens; identical to SEQ ID NO: 290550

SEQ ID NO: 461232 - RNA, 64 nt, Homo Sapiens; identical to SEQ ID NO: 290551

SEQ ID NO: 461233 - RNA, 64 nt, Homo Sapiens; identical to SEQ ID NO: 290552

SEQ ID NO: 461234 - RNA, 64 nt, Homo Sapiens; identical to SEQ ID NO: 290553

SEQ ID NO: 461235 - RNA, 57 nt, Homo Sapiens; identical to SEQ ID NO: 50453

SEQ ID NO: 461236 - RNA, 64 nt, Homo Sapiens; identical to SEQ ID NO: 290555

SEQ ID NO: 461237 - RNA, 64 nt, Homo Sapiens; identical to SEQ ID NO: 290556

SEQ ID NO: 461238 - RNA, 64 nt, Homo Sapiens; identical to SEQ ID NO: 290557

SEQ ID NO: 461239 - RNA, 64 nt, Homo Sapiens; identical to SEQ ID NO: 290558

SEQ ID NO: 461240 - RNA, 64 nt, Homo Sapiens; identical to SEQ ID NO: 290559

SEQ ID NO: 461241 - RNA, 64 nt, Homo Sapiens; identical to SEQ ID NO: 290560

SEQ ID NO: 461242 - RNA, 64 nt, Homo Sapiens; identical to SEQ ID NO: 290561

SEQ ID NO: 461243 - RNA, 64 nt, Homo Sapiens; identical to SEQ ID NO: 290562

SEQ ID NO: 461244 - RNA, 64 nt, Homo Sapiens; identical to SEQ ID NO: 290563

SEQ ID NO: 461245 - RNA, 64 nt, Homo Sapiens; identical to SEQ ID NO: 290564

SEQ ID NO: 461246 - RNA, 64 nt, Homo Sapiens; identical to SEQ ID NO: 290565

SEQ ID NO: 461247 - RNA, 64 nt, Homo Sapiens; identical to SEQ ID NO: 290566

SEQ ID NO: 461248 - RNA, 64 nt, Homo Sapiens; identical to SEQ ID NO: 290567

SEQ ID NO: 461249 - RNA, 64 nt, Homo Sapiens; identical to SEQ ID NO: 290568

SEQ ID NO: 461250 - RNA, 64 nt, Homo Sapiens; identical to SEQ ID NO: 290569

SEQ ID NO: 461251 - RNA, 64 nt, Homo Sapiens; identical to SEQ ID NO: 290570

SEQ ID NO: 461252 - RNA, 64 nt, Homo Sapiens; identical to SEQ ID NO: 290571

SEQ ID NO: 461253 - RNA, 64 nt, Homo Sapiens; identical to SEQ ID NO: 290572

SEQ ID NO: 461254 - RNA, 64 nt, Homo Sapiens; identical to SEQ ID NO: 290573

SEQ ID NO: 461255 - RNA, 64 nt, Homo Sapiens; identical to SEQ ID NO: 290574

SEQ ID NO: 461256 - RNA, 64 nt, Homo Sapiens; identical to SEQ ID NO: 290575

SEQ ID NO: 461257 - RNA, 64 nt, Homo Sapiens; identical to SEQ ID NO: 290576

SEQ ID NO: 461258 - RNA, 64 nt, Homo Sapiens; identical to SEQ ID NO: 290577

SEQ ID NO: 461259 - RNA, 64 nt, Homo Sapiens; identical to SEQ ID NO: 290578

SEQ ID NO: 461260 - RNA, 64 nt, Homo Sapiens; identical to SEQ ID NO: 290579

SEQ ID NO: 461261 - RNA, 64 nt, Homo Sapiens; identical to SEQ ID NO: 290580

SEQ ID NO: 461262 - RNA, 64 nt, Homo Sapiens; identical to SEQ ID NO: 290581

SEQ ID NO: 461263 - RNA, 64 nt, Homo Sapiens; identical to SEQ ID NO: 290582

SEQ ID NO: 461264 - RNA, 64 nt, Homo Sapiens; identical to SEQ ID NO: 290583

SEQ ID NO: 461265 - RNA, 64 nt, Homo Sapiens; identical to SEQ ID NO: 290584

SEQ ID NO: 461266 - RNA, 64 nt, Homo Sapiens; identical to SEQ ID NO: 290585

SEQ ID NO: 461267 - RNA, 64 nt, Homo Sapiens; identical to SEQ ID NO: 290586

SEQ ID NO: 461268 - RNA, 64 nt, Homo Sapiens; identical to SEQ ID NO: 290587

SEQ ID NO: 461269 - RNA, 64 nt, Homo Sapiens; identical to SEQ ID NO: 290588

SEQ ID NO: 461270 - RNA, 64 nt, Homo Sapiens; identical to SEQ ID NO: 290589

SEQ ID NO: 461271 - RNA, 64 nt, Homo Sapiens; identical to SEQ ID NO: 290590

SEQ ID NO: 461272 - RNA, 64 nt, Homo Sapiens; identical to SEQ ID NO: 290591

SEQ ID NO: 461273 - RNA, 64 nt, Homo Sapiens; identical to SEQ ID NO: 290592

SEQ ID NO: 461274 - RNA, 64 nt, Homo Sapiens; identical to SEQ ID NO: 290593

SEQ ID NO: 461275 - RNA, 64 nt, Homo Sapiens; identical to SEQ ID NO: 290594

SEQ ID NO: 461276 - RNA, 64 nt, Homo Sapiens; identical to SEQ ID NO: 290595

SEQ ID NO: 461277 - RNA, 64 nt, Homo Sapiens; identical to SEQ ID NO: 290596

SEQ ID NO: 461278 - RNA, 64 nt, Homo Sapiens; identical to SEQ ID NO: 290597

SEQ ID NO: 461279 - RNA, 64 nt, Homo Sapiens; identical to SEQ ID NO: 290598

SEQ ID NO: 461280 - RNA, 64 nt, Homo Sapiens; identical to SEQ ID NO: 290599

SEQ ID NO: 461281 - RNA, 64 nt, Homo Sapiens; identical to SEQ ID NO: 290600

SEQ ID NO: 461282 - RNA, 64 nt, Homo Sapiens; identical to SEQ ID NO: 290601

SEQ ID NO: 461283 - RNA, 64 nt, Homo Sapiens; identical to SEQ ID NO: 290602

SEQ ID NO: 461284 - RNA, 64 nt, Homo Sapiens; identical to SEQ ID NO: 290603

SEQ ID NO: 461285 - RNA, 64 nt, Homo Sapiens; identical to SEQ ID NO: 290604

SEQ ID NO: 461286 - RNA, 64 nt, Homo Sapiens; identical to SEQ ID NO: 290605

SEQ ID NO: 461287 - RNA, 64 nt, Homo Sapiens; identical to SEQ ID NO: 290606

SEQ ID NO: 461288 - RNA, 64 nt, Homo Sapiens; identical to SEQ ID NO: 290607

SEQ ID NO: 461289 - RNA, 64 nt, Homo Sapiens; identical to SEQ ID NO: 290608

SEQ ID NO: 461290 - RNA, 64 nt, Homo Sapiens; identical to SEQ ID NO: 290609

SEQ ID NO: 461291 - RNA, 64 nt, Homo Sapiens; identical to SEQ ID NO: 290610

SEQ ID NO: 461292 - RNA, 64 nt, Homo Sapiens; identical to SEQ ID NO: 290611

SEQ ID NO: 461293 - RNA, 64 nt, Homo Sapiens; identical to SEQ ID NO: 290612

SEQ ID NO: 461294 - RNA, 64 nt, Homo Sapiens; identical to SEQ ID NO: 290613

SEQ ID NO: 461295 - RNA, 64 nt, Homo Sapiens; identical to SEQ ID NO: 290614

SEQ ID NO: 461296 - RNA, 64 nt, Homo Sapiens; identical to SEQ ID NO: 290615

SEQ ID NO: 461297 - RNA, 64 nt, Homo Sapiens; identical to SEQ ID NO: 290616

SEQ ID NO: 461298 - RNA, 64 nt, Homo Sapiens; identical to SEQ ID NO: 290617

SEQ ID NO: 461299 - RNA, 64 nt, Homo Sapiens; identical to SEQ ID NO: 290618

SEQ ID NO: 461300 - RNA, 64 nt, Homo Sapiens; identical to SEQ ID NO: 290619

SEQ ID NO: 461301 - RNA, 64 nt, Homo Sapiens; identical to SEQ ID NO: 290620

SEQ ID NO: 461302 - RNA, 64 nt, Homo Sapiens; identical to SEQ ID NO: 290621

SEQ ID NO: 461303 - RNA, 64 nt, Homo Sapiens; identical to SEQ ID NO: 290622

SEQ ID NO: 461304 - RNA, 64 nt, Homo Sapiens; identical to SEQ ID NO: 290623

SEQ ID NO: 461305 - RNA, 64 nt, Homo Sapiens; identical to SEQ ID NO: 290624

SEQ ID NO: 461306 - RNA, 64 nt, Homo Sapiens; identical to SEQ ID NO: 290625

SEQ ID NO: 461307 - RNA, 64 nt, Homo Sapiens; identical to SEQ ID NO: 290626

SEQ ID NO: 461308 - RNA, 64 nt, Homo Sapiens; identical to SEQ ID NO: 290627

SEQ ID NO: 461309 - RNA, 64 nt, Homo Sapiens; identical to SEQ ID NO: 290628

SEQ ID NO: 461310 - RNA, 64 nt, Homo Sapiens; identical to SEQ ID NO: 290629

SEQ ID NO: 461311 - RNA, 64 nt, Homo Sapiens; identical to SEQ ID NO: 290630

SEQ ID NO: 461312 - RNA, 64 nt, Homo Sapiens; identical to SEQ ID NO: 290631

SEQ ID NO: 461313 - RNA, 64 nt, Homo Sapiens; identical to SEQ ID NO: 290632

SEQ ID NO: 461314 - RNA, 64 nt, Homo Sapiens; identical to SEQ ID NO: 290633

SEQ ID NO: 461315 - RNA, 64 nt, Homo Sapiens; identical to SEQ ID NO: 290634

SEQ ID NO: 461316 - RNA, 64 nt, Homo Sapiens; identical to SEQ ID NO: 290635

SEQ ID NO: 461317 - RNA, 64 nt, Homo Sapiens; identical to SEQ ID NO: 290636

SEQ ID NO: 461318 - RNA, 64 nt, Homo Sapiens
ugcagcagcacacccugcaggcggaguuuucagaggaugcaauuuuggaucccgaauuuugaug

SEQ ID NO: 461319 - RNA, 64 nt, Homo Sapiens
uaaaaaucacuguaauacuucauuguguuguacuggaugcaaagcuagaaaauauugcaauaaa

SEQ ID NO: 461320 - RNA, 64 nt, Homo Sapiens
uaugccaaauaucaagaugugaaggacuaauucaggaugcaaaaacguuauugggggguuguaa

SEQ ID NO: 461321 - RNA, 64 nt, Homo Sapiens
gggggguuguaaauaucaacuauucaacaguuuaggaugcaauuacgaguguaaacugugugcc

SEQ ID NO: 461322 - RNA, 64 nt, Homo Sapiens
cuuauccaccaugaucaagugggcuucaucccugggaugcaaggcugguucaacauacgcaaau

SEQ ID NO: 461323 - RNA, 64 nt, Homo Sapiens
agaacuacaaaccacugcuuaacgaaauaaaagaggaugcaaagaaauggaagagcauuccaug

SEQ ID NO: 461324 - RNA, 64 nt, Homo Sapiens; identical to SEQ ID NO: 286186

SEQ ID NO: 461325 - RNA, 64 nt, Homo Sapiens; identical to SEQ ID NO: 286187

SEQ ID NO: 461326 - RNA, 64 nt, Homo Sapiens; identical to SEQ ID NO: 286188

SEQ ID NO: 461327 - RNA, 64 nt, Homo Sapiens; identical to SEQ ID NO: 286189

SEQ ID NO: 461328 - RNA, 64 nt, Homo Sapiens; identical to SEQ ID NO: 286190

SEQ ID NO: 461329 - RNA, 64 nt, Homo Sapiens; identical to SEQ ID NO: 286191

SEQ ID NO: 461330 - RNA, 64 nt, Homo Sapiens; identical to SEQ ID NO: 286192

SEQ ID NO: 461331 - RNA, 64 nt, Homo Sapiens; identical to SEQ ID NO: 286193

SEQ ID NO: 461332 - RNA, 64 nt, Homo Sapiens; identical to SEQ ID NO: 286194

SEQ ID NO: 461333 - RNA, 64 nt, Homo Sapiens; identical to SEQ ID NO: 286195

SEQ ID NO: 461334 - RNA, 64 nt, Homo Sapiens; identical to SEQ ID NO: 286196

SEQ ID NO: 461335 - RNA, 64 nt, Homo Sapiens; identical to SEQ ID NO: 286197

SEQ ID NO: 461336 - RNA, 64 nt, Homo Sapiens; identical to SEQ ID NO: 286198

SEQ ID NO: 461337 - RNA, 64 nt, Homo Sapiens; identical to SEQ ID NO: 286199

SEQ ID NO: 461338 - RNA, 64 nt, Homo Sapiens; identical to SEQ ID NO: 286200

SEQ ID NO: 461339 - RNA, 64 nt, Homo Sapiens; identical to SEQ ID NO: 286201

SEQ ID NO: 461340 - RNA, 64 nt, Homo Sapiens; identical to SEQ ID NO: 286202

SEQ ID NO: 461341 - RNA, 64 nt, Homo Sapiens; identical to SEQ ID NO: 286203

SEQ ID NO: 461342 - RNA, 64 nt, Homo Sapiens; identical to SEQ ID NO: 286204

SEQ ID NO: 461343 - RNA, 64 nt, Homo Sapiens; identical to SEQ ID NO: 286205

SEQ ID NO: 461344 - RNA, 64 nt, Homo Sapiens; identical to SEQ ID NO: 286206

SEQ ID NO: 461345 - RNA, 64 nt, Homo Sapiens; identical to SEQ ID NO: 286207

SEQ ID NO: 461346 - RNA, 64 nt, Homo Sapiens; identical to SEQ ID NO: 286208

SEQ ID NO: 461347 - RNA, 64 nt, Homo Sapiens; identical to SEQ ID NO: 286209

SEQ ID NO: 461348 - RNA, 64 nt, Homo Sapiens; identical to SEQ ID NO: 286210

SEQ ID NO: 461349 - RNA, 64 nt, Homo Sapiens
cauuuacaucacagcucaaagguaugacagcauaccauuaaauagaucugaaaauguguguggu

SEQ ID NO: 461350 - RNA, 64 nt, Homo Sapiens
uaauaaacuuacucuuauacaguugcgguuuuucccauuaaaaguauuagguuggugcaaaacu

SEQ ID NO: 461351 - RNA, 64 nt, Homo Sapiens
agaaaaaucacguagaaagcaucugucaggagugccauuaaaggugcucugagcuuguuuccuc

SEQ ID NO: 461352 - RNA, 64 nt, Homo Sapiens
gaaaccugaaggccauccuccagugcuggcuuggccauuaaaugcaggcaggaggacaucuugg

SEQ ID NO: 461353 - RNA, 64 nt, Homo Sapiens
auuaccgagaggggacucaaaguguaagacucugccauuaaaacccaucugaagaaacuuccca

SEQ ID NO: 461354 - RNA, 64 nt, Homo Sapiens
cuaccacauguguuucugucuuuauccuagugggccauuaaaaauaucucaauuuaguuuguua

SEQ ID NO: 461355 - RNA, 64 nt, Homo Sapiens
uguuugccuuuuacuuugcucuuuagcaaaauaaccauuaaaguuuuaccacccagaguuuuau

SEQ ID NO: 461356 - RNA, 64 nt, Homo Sapiens
guaauucccacuccucccagaauggaaacuguacccauuaaacaauaggcuucucagcuuguaa

SEQ ID NO: 461357 - RNA, 64 nt, Homo Sapiens
aguucuuuuguuaagaaauaccuccugccccgccccauuaaaacucaguguuuucuacaauacu

SEQ ID NO: 461358 - RNA, 64 nt, Homo Sapiens
uagcauuaucuucaucaugggaaugcuggauaagccauuaaacuccuggaccugggaggacuuc

SEQ ID NO: 461359 - RNA, 62 nt, Homo Sapiens
caucagggugaccacauuaagcccaguauuccaguuggcaccagaagauauggacuuggaau

SEQ ID NO: 461360 - RNA, 62 nt, Homo Sapiens
acguggauguaguuuggcucaggugucccugcaguuggcaaggagucaguacucagucccug

SEQ ID NO: 461361 - RNA, 62 nt, Homo Sapiens
aacagccuucuagcacacuuaccaaaaaaggaaguuggcaaauaauguggaaguuaacccuu

SEQ ID NO: 461362 - RNA, 62 nt, Homo Sapiens
gguucugguacuaaaaauugggacuucaugcaaguuggcagucauuuuuaaaaugugaagau

SEQ ID NO: 461363 - RNA, 62 nt, Homo Sapiens
aacagacuuccggggaauuuucacuuuuuacaaguuggcaaaaaacaaggaagucagcucuu

SEQ ID NO: 461364 - RNA, 62 nt, Homo Sapiens
gcaggugcaggccaacccuucagcccuuccacaguuggcacugcaacuguggggccugcaca

SEQ ID NO: 461365 - RNA, 62 nt, Homo Sapiens
uguuaaguccuuggcuugccgauuuguguuuuaguuggcaguuuuuauuuugugaagugaag

SEQ ID NO: 461366 - RNA, 62 nt, Homo Sapiens
acucuugacucuugccugccccacauuacuagaguuggcauggguagguguuugaacagagg

SEQ ID NO: 461367 - RNA, 64 nt, Homo Sapiens; identical to SEQ ID NO: 124720

SEQ ID NO: 461368 - RNA, 64 nt, Homo Sapiens; identical to SEQ ID NO: 124721

SEQ ID NO: 461369 - RNA, 64 nt, Homo Sapiens; identical to SEQ ID NO: 124722

SEQ ID NO: 461370 - RNA, 64 nt, Homo Sapiens; identical to SEQ ID NO: 124723

SEQ ID NO: 461371 - RNA, 64 nt, Homo Sapiens; identical to SEQ ID NO: 124724

SEQ ID NO: 461372 - RNA, 64 nt, Homo Sapiens; identical to SEQ ID NO: 124725

SEQ ID NO: 461373 - RNA, 64 nt, Homo Sapiens; identical to SEQ ID NO: 323157

SEQ ID NO: 461374 - RNA, 64 nt, Homo Sapiens; identical to SEQ ID NO: 323158

SEQ ID NO: 461375 - RNA, 64 nt, Homo Sapiens; identical to SEQ ID NO: 323159

SEQ ID NO: 461376 - RNA, 64 nt, Homo Sapiens; identical to SEQ ID NO: 323160

SEQ ID NO: 461377 - RNA, 64 nt, Homo Sapiens; identical to SEQ ID NO: 323161

SEQ ID NO: 461378 - RNA, 64 nt, Homo Sapiens; identical to SEQ ID NO: 323162

SEQ ID NO: 461379 - RNA, 64 nt, Homo Sapiens; identical to SEQ ID NO: 323163

SEQ ID NO: 461380 - RNA, 64 nt, Homo Sapiens; identical to SEQ ID NO: 323164

SEQ ID NO: 461381 - RNA, 64 nt, Homo Sapiens; identical to SEQ ID NO: 323165

SEQ ID NO: 461382 - RNA, 64 nt, Homo Sapiens; identical to SEQ ID NO: 323166

SEQ ID NO: 461383 - RNA, 64 nt, Homo Sapiens; identical to SEQ ID NO: 323167

SEQ ID NO: 461384 - RNA, 64 nt, Homo Sapiens; identical to SEQ ID NO: 323168

SEQ ID NO: 461385 - RNA, 64 nt, Homo Sapiens; identical to SEQ ID NO: 323169

SEQ ID NO: 461386 - RNA, 64 nt, Homo Sapiens; identical to SEQ ID NO: 323170

SEQ ID NO: 461387 - RNA, 64 nt, Homo Sapiens; identical to SEQ ID NO: 323171

SEQ ID NO: 461388 - RNA, 64 nt, Homo Sapiens; identical to SEQ ID NO: 323172

SEQ ID NO: 461389 - RNA, 64 nt, Homo Sapiens; identical to SEQ ID NO: 323173

SEQ ID NO: 461390 - RNA, 64 nt, Homo Sapiens; identical to SEQ ID NO: 323174

SEQ ID NO: 461391 - RNA, 64 nt, Homo Sapiens; identical to SEQ ID NO: 323175

SEQ ID NO: 461392 - RNA, 64 nt, Homo Sapiens; identical to SEQ ID NO: 323176

SEQ ID NO: 461393 - RNA, 64 nt, Homo Sapiens; identical to SEQ ID NO: 323177

SEQ ID NO: 461394 - RNA, 64 nt, Homo Sapiens; identical to SEQ ID NO: 323178

SEQ ID NO: 461395 - RNA, 64 nt, Homo Sapiens; identical to SEQ ID NO: 323179

SEQ ID NO: 461396 - RNA, 64 nt, Homo Sapiens; identical to SEQ ID NO: 323180

SEQ ID NO: 461397 - RNA, 64 nt, Homo Sapiens; identical to SEQ ID NO: 323181

SEQ ID NO: 461398 - RNA, 64 nt, Homo Sapiens; identical to SEQ ID NO: 323182

SEQ ID NO: 461399 - RNA, 64 nt, Homo Sapiens; identical to SEQ ID NO: 323183

SEQ ID NO: 461400 - RNA, 64 nt, Homo Sapiens; identical to SEQ ID NO: 323184

SEQ ID NO: 461401 - RNA, 64 nt, Homo Sapiens; identical to SEQ ID NO: 323185

SEQ ID NO: 461402 - RNA, 64 nt, Homo Sapiens; identical to SEQ ID NO: 323186

SEQ ID NO: 461403 - RNA, 64 nt, Homo Sapiens; identical to SEQ ID NO: 323187

SEQ ID NO: 461404 - RNA, 64 nt, Homo Sapiens; identical to SEQ ID NO: 323188

SEQ ID NO: 461405 - RNA, 64 nt, Homo Sapiens; identical to SEQ ID NO: 323189

SEQ ID NO: 461406 - RNA, 64 nt, Homo Sapiens; identical to SEQ ID NO: 323190

SEQ ID NO: 461407 - RNA, 64 nt, Homo Sapiens; identical to SEQ ID NO: 323191

SEQ ID NO: 461408 - RNA, 64 nt, Homo Sapiens; identical to SEQ ID NO: 323192

SEQ ID NO: 461409 - RNA, 64 nt, Homo Sapiens; identical to SEQ ID NO: 323193

SEQ ID NO: 461410 - RNA, 64 nt, Homo Sapiens; identical to SEQ ID NO: 323194

SEQ ID NO: 461411 - RNA, 64 nt, Homo Sapiens; identical to SEQ ID NO: 323195

SEQ ID NO: 461412 - RNA, 64 nt, Homo Sapiens; identical to SEQ ID NO: 323196

SEQ ID NO: 461413 - RNA, 64 nt, Homo Sapiens; identical to SEQ ID NO: 323197

SEQ ID NO: 461414 - RNA, 64 nt, Homo Sapiens; identical to SEQ ID NO: 323198

SEQ ID NO: 461415 - RNA, 64 nt, Homo Sapiens; identical to SEQ ID NO: 323199

SEQ ID NO: 461416 - RNA, 64 nt, Homo Sapiens; identical to SEQ ID NO: 323200

SEQ ID NO: 461417 - RNA, 64 nt, Homo Sapiens; identical to SEQ ID NO: 323201

SEQ ID NO: 461418 - RNA, 64 nt, Homo Sapiens; identical to SEQ ID NO: 323202

SEQ ID NO: 461419 - RNA, 64 nt, Homo Sapiens; identical to SEQ ID NO: 323203

SEQ ID NO: 461420 - RNA, 64 nt, Homo Sapiens; identical to SEQ ID NO: 323204

SEQ ID NO: 461421 - RNA, 64 nt, Homo Sapiens; identical to SEQ ID NO: 323205

SEQ ID NO: 461422 - RNA, 64 nt, Homo Sapiens; identical to SEQ ID NO: 323206

SEQ ID NO: 461423 - RNA, 64 nt, Homo Sapiens; identical to SEQ ID NO: 323207

SEQ ID NO: 461424 - RNA, 64 nt, Homo Sapiens; identical to SEQ ID NO: 323208

SEQ ID NO: 461425 - RNA, 64 nt, Homo Sapiens; identical to SEQ ID NO: 323209

SEQ ID NO: 461426 - RNA, 64 nt, Homo Sapiens; identical to SEQ ID NO: 323210

SEQ ID NO: 461427 - RNA, 64 nt, Homo Sapiens; identical to SEQ ID NO: 323211

SEQ ID NO: 461428 - RNA, 64 nt, Homo Sapiens; identical to SEQ ID NO: 323212

SEQ ID NO: 461429 - RNA, 64 nt, Homo Sapiens; identical to SEQ ID NO: 323213

SEQ ID NO: 461430 - RNA, 64 nt, Homo Sapiens; identical to SEQ ID NO: 323214

SEQ ID NO: 461431 - RNA, 64 nt, Homo Sapiens; identical to SEQ ID NO: 323215

SEQ ID NO: 461432 - RNA, 64 nt, Homo Sapiens; identical to SEQ ID NO: 323216

SEQ ID NO: 461433 - RNA, 64 nt, Homo Sapiens; identical to SEQ ID NO: 323217

SEQ ID NO: 461434 - RNA, 64 nt, Homo Sapiens; identical to SEQ ID NO: 323218

SEQ ID NO: 461435 - RNA, 64 nt, Homo Sapiens; identical to SEQ ID NO: 323219

SEQ ID NO: 461436 - RNA, 64 nt, Homo Sapiens; identical to SEQ ID NO: 323220

SEQ ID NO: 461437 - RNA, 64 nt, Homo Sapiens; identical to SEQ ID NO: 323221

SEQ ID NO: 461438 - RNA, 64 nt, Homo Sapiens; identical to SEQ ID NO: 323222

SEQ ID NO: 461439 - RNA, 64 nt, Homo Sapiens; identical to SEQ ID NO: 323223

SEQ ID NO: 461440 - RNA, 64 nt, Homo Sapiens; identical to SEQ ID NO: 323224

SEQ ID NO: 461441 - RNA, 64 nt, Homo Sapiens; identical to SEQ ID NO: 323225

SEQ ID NO: 461442 - RNA, 64 nt, Homo Sapiens; identical to SEQ ID NO: 323226

SEQ ID NO: 461443 - RNA, 64 nt, Homo Sapiens; identical to SEQ ID NO: 323227

SEQ ID NO: 461444 - RNA, 64 nt, Homo Sapiens; identical to SEQ ID NO: 323228

SEQ ID NO: 461445 - RNA, 64 nt, Homo Sapiens; identical to SEQ ID NO: 323229

SEQ ID NO: 461446 - RNA, 64 nt, Homo Sapiens; identical to SEQ ID NO: 323230

SEQ ID NO: 461447 - RNA, 64 nt, Homo Sapiens; identical to SEQ ID NO: 323231

SEQ ID NO: 461448 - RNA, 64 nt, Homo Sapiens; identical to SEQ ID NO: 323232

SEQ ID NO: 461449 - RNA, 64 nt, Homo Sapiens; identical to SEQ ID NO: 323233

SEQ ID NO: 461450 - RNA, 64 nt, Homo Sapiens; identical to SEQ ID NO: 323234

SEQ ID NO: 461451 - RNA, 64 nt, Homo Sapiens; identical to SEQ ID NO: 323235

SEQ ID NO: 461452 - RNA, 64 nt, Homo Sapiens; identical to SEQ ID NO: 323236

SEQ ID NO: 461453 - RNA, 64 nt, Homo Sapiens; identical to SEQ ID NO: 323237

SEQ ID NO: 461454 - RNA, 64 nt, Homo Sapiens; identical to SEQ ID NO: 323238

SEQ ID NO: 461455 - RNA, 64 nt, Homo Sapiens; identical to SEQ ID NO: 323239

SEQ ID NO: 461456 - RNA, 64 nt, Homo Sapiens; identical to SEQ ID NO: 323240

SEQ ID NO: 461457 - RNA, 64 nt, Homo Sapiens; identical to SEQ ID NO: 323241

SEQ ID NO: 461458 - RNA, 64 nt, Homo Sapiens; identical to SEQ ID NO: 323242

SEQ ID NO: 461459 - RNA, 64 nt, Homo Sapiens; identical to SEQ ID NO: 323243

SEQ ID NO: 461460 - RNA, 64 nt, Homo Sapiens; identical to SEQ ID NO: 323244

SEQ ID NO: 461461 - RNA, 64 nt, Homo Sapiens; identical to SEQ ID NO: 323245

SEQ ID NO: 461462 - RNA, 64 nt, Homo Sapiens; identical to SEQ ID NO: 323246

SEQ ID NO: 461463 - RNA, 64 nt, Homo Sapiens; identical to SEQ ID NO: 323247

SEQ ID NO: 461464 - RNA, 64 nt, Homo Sapiens; identical to SEQ ID NO: 323248

SEQ ID NO: 461465 - RNA, 64 nt, Homo Sapiens; identical to SEQ ID NO: 323249

SEQ ID NO: 461466 - RNA, 64 nt, Homo Sapiens; identical to SEQ ID NO: 323250

SEQ ID NO: 461467 - RNA, 64 nt, Homo Sapiens; identical to SEQ ID NO: 323251

SEQ ID NO: 461468 - RNA, 64 nt, Homo Sapiens; identical to SEQ ID NO: 323252

SEQ ID NO: 461469 - RNA, 64 nt, Homo Sapiens; identical to SEQ ID NO: 323253

SEQ ID NO: 461470 - RNA, 64 nt, Homo Sapiens; identical to SEQ ID NO: 323254

SEQ ID NO: 461471 - RNA, 64 nt, Homo Sapiens; identical to SEQ ID NO: 323255

SEQ ID NO: 461472 - RNA, 64 nt, Homo Sapiens; identical to SEQ ID NO: 323256

SEQ ID NO: 461473 - RNA, 64 nt, Homo Sapiens; identical to SEQ ID NO: 323257

SEQ ID NO: 461474 - RNA, 64 nt, Homo Sapiens; identical to SEQ ID NO: 323258

SEQ ID NO: 461475 - RNA, 64 nt, Homo Sapiens; identical to SEQ ID NO: 323259

SEQ ID NO: 461476 - RNA, 64 nt, Homo Sapiens; identical to SEQ ID NO: 323260

SEQ ID NO: 461477 - RNA, 64 nt, Homo Sapiens; identical to SEQ ID NO: 323261

SEQ ID NO: 461478 - RNA, 64 nt, Homo Sapiens; identical to SEQ ID NO: 323262

SEQ ID NO: 461479 - RNA, 64 nt, Homo Sapiens; identical to SEQ ID NO: 323263

SEQ ID NO: 461480 - RNA, 64 nt, Homo Sapiens; identical to SEQ ID NO: 323264

SEQ ID NO: 461481 - RNA, 64 nt, Homo Sapiens; identical to SEQ ID NO: 323265

SEQ ID NO: 461482 - RNA, 64 nt, Homo Sapiens; identical to SEQ ID NO: 323266

SEQ ID NO: 461483 - RNA, 64 nt, Homo Sapiens; identical to SEQ ID NO: 323267

SEQ ID NO: 461484 - RNA, 64 nt, Homo Sapiens; identical to SEQ ID NO: 323268

SEQ ID NO: 461485 - RNA, 64 nt, Homo Sapiens; identical to SEQ ID NO: 323269

SEQ ID NO: 461486 - RNA, 64 nt, Homo Sapiens; identical to SEQ ID NO: 323270

SEQ ID NO: 461487 - RNA, 64 nt, Homo Sapiens; identical to SEQ ID NO: 323271

SEQ ID NO: 461488 - RNA, 64 nt, Homo Sapiens; identical to SEQ ID NO: 323272

SEQ ID NO: 461489 - RNA, 64 nt, Homo Sapiens; identical to SEQ ID NO: 323273

SEQ ID NO: 461490 - RNA, 64 nt, Homo Sapiens; identical to SEQ ID NO: 323274

SEQ ID NO: 461491 - RNA, 64 nt, Homo Sapiens; identical to SEQ ID NO: 323275

SEQ ID NO: 461492 - RNA, 64 nt, Homo Sapiens; identical to SEQ ID NO: 323276

SEQ ID NO: 461493 - RNA, 64 nt, Homo Sapiens; identical to SEQ ID NO: 323277

SEQ ID NO: 461494 - RNA, 64 nt, Homo Sapiens; identical to SEQ ID NO: 323278

SEQ ID NO: 461495 - RNA, 64 nt, Homo Sapiens; identical to SEQ ID NO: 323279

SEQ ID NO: 461496 - RNA, 64 nt, Homo Sapiens; identical to SEQ ID NO: 323280

SEQ ID NO: 461497 - RNA, 64 nt, Homo Sapiens; identical to SEQ ID NO: 323281

SEQ ID NO: 461498 - RNA, 64 nt, Homo Sapiens; identical to SEQ ID NO: 323282

SEQ ID NO: 461499 - RNA, 64 nt, Homo Sapiens; identical to SEQ ID NO: 323283

SEQ ID NO: 461500 - RNA, 64 nt, Homo Sapiens; identical to SEQ ID NO: 323284

SEQ ID NO: 461501 - RNA, 64 nt, Homo Sapiens; identical to SEQ ID NO: 323285

SEQ ID NO: 461502 - RNA, 64 nt, Homo Sapiens; identical to SEQ ID NO: 323286

SEQ ID NO: 461503 - RNA, 64 nt, Homo Sapiens; identical to SEQ ID NO: 323287

SEQ ID NO: 461504 - RNA, 64 nt, Homo Sapiens; identical to SEQ ID NO: 323288

SEQ ID NO: 461505 - RNA, 64 nt, Homo Sapiens; identical to SEQ ID NO: 323289

SEQ ID NO: 461506 - RNA, 64 nt, Homo Sapiens; identical to SEQ ID NO: 323290

SEQ ID NO: 461507 - RNA, 64 nt, Homo Sapiens; identical to SEQ ID NO: 323291

SEQ ID NO: 461508 - RNA, 64 nt, Homo Sapiens; identical to SEQ ID NO: 323292

SEQ ID NO: 461509 - RNA, 64 nt, Homo Sapiens; identical to SEQ ID NO: 323293

SEQ ID NO: 461510 - RNA, 64 nt, Homo Sapiens; identical to SEQ ID NO: 323294

SEQ ID NO: 461511 - RNA, 64 nt, Homo Sapiens; identical to SEQ ID NO: 323295

SEQ ID NO: 461512 - RNA, 64 nt, Homo Sapiens; identical to SEQ ID NO: 323296

SEQ ID NO: 461513 - RNA, 64 nt, Homo Sapiens; identical to SEQ ID NO: 323297

SEQ ID NO: 461514 - RNA, 64 nt, Homo Sapiens; identical to SEQ ID NO: 323298

SEQ ID NO: 461515 - RNA, 64 nt, Homo Sapiens; identical to SEQ ID NO: 323299

SEQ ID NO: 461516 - RNA, 64 nt, Homo Sapiens; identical to SEQ ID NO: 323300

SEQ ID NO: 461517 - RNA, 64 nt, Homo Sapiens; identical to SEQ ID NO: 323301

SEQ ID NO: 461518 - RNA, 64 nt, Homo Sapiens; identical to SEQ ID NO: 323302

SEQ ID NO: 461519 - RNA, 64 nt, Homo Sapiens; identical to SEQ ID NO: 323303

SEQ ID NO: 461520 - RNA, 64 nt, Homo Sapiens; identical to SEQ ID NO: 323304

SEQ ID NO: 461521 - RNA, 64 nt, Homo Sapiens; identical to SEQ ID NO: 323305

SEQ ID NO: 461522 - RNA, 64 nt, Homo Sapiens; identical to SEQ ID NO: 323306

SEQ ID NO: 461523 - RNA, 64 nt, Homo Sapiens; identical to SEQ ID NO: 323307

SEQ ID NO: 461524 - RNA, 64 nt, Homo Sapiens; identical to SEQ ID NO: 323308

SEQ ID NO: 461525 - RNA, 64 nt, Homo Sapiens; identical to SEQ ID NO: 323309

SEQ ID NO: 461526 - RNA, 64 nt, Homo Sapiens; identical to SEQ ID NO: 323310

SEQ ID NO: 461527 - RNA, 64 nt, Homo Sapiens; identical to SEQ ID NO: 323311

SEQ ID NO: 461528 - RNA, 64 nt, Homo Sapiens; identical to SEQ ID NO: 323312

SEQ ID NO: 461529 - RNA, 64 nt, Homo Sapiens; identical to SEQ ID NO: 323313

SEQ ID NO: 461530 - RNA, 64 nt, Homo Sapiens; identical to SEQ ID NO: 323314

SEQ ID NO: 461531 - RNA, 64 nt, Homo Sapiens; identical to SEQ ID NO: 323315

SEQ ID NO: 461532 - RNA, 64 nt, Homo Sapiens; identical to SEQ ID NO: 323316

SEQ ID NO: 461533 - RNA, 64 nt, Homo Sapiens; identical to SEQ ID NO: 323317

SEQ ID NO: 461534 - RNA, 64 nt, Homo Sapiens; identical to SEQ ID NO: 323318

SEQ ID NO: 461535 - RNA, 64 nt, Homo Sapiens; identical to SEQ ID NO: 323319

SEQ ID NO: 461536 - RNA, 64 nt, Homo Sapiens; identical to SEQ ID NO: 323320

SEQ ID NO: 461537 - RNA, 64 nt, Homo Sapiens; identical to SEQ ID NO: 323321

SEQ ID NO: 461538 - RNA, 64 nt, Homo Sapiens; identical to SEQ ID NO: 323322

SEQ ID NO: 461539 - RNA, 64 nt, Homo Sapiens; identical to SEQ ID NO: 323323

SEQ ID NO: 461540 - RNA, 64 nt, Homo Sapiens; identical to SEQ ID NO: 323324

SEQ ID NO: 461541 - RNA, 64 nt, Homo Sapiens; identical to SEQ ID NO: 323325

SEQ ID NO: 461542 - RNA, 64 nt, Homo Sapiens; identical to SEQ ID NO: 323326

SEQ ID NO: 461543 - RNA, 64 nt, Homo Sapiens; identical to SEQ ID NO: 323327

SEQ ID NO: 461544 - RNA, 64 nt, Homo Sapiens; identical to SEQ ID NO: 323328

SEQ ID NO: 461545 - RNA, 64 nt, Homo Sapiens; identical to SEQ ID NO: 323329

SEQ ID NO: 461546 - RNA, 64 nt, Homo Sapiens; identical to SEQ ID NO: 323330

SEQ ID NO: 461547 - RNA, 64 nt, Homo Sapiens; identical to SEQ ID NO: 323331

SEQ ID NO: 461548 - RNA, 64 nt, Homo Sapiens; identical to SEQ ID NO: 323332

SEQ ID NO: 461549 - RNA, 64 nt, Homo Sapiens; identical to SEQ ID NO: 323333

SEQ ID NO: 461550 - RNA, 64 nt, Homo Sapiens; identical to SEQ ID NO: 323334

SEQ ID NO: 461551 - RNA, 64 nt, Homo Sapiens; identical to SEQ ID NO: 323335

SEQ ID NO: 461552 - RNA, 64 nt, Homo Sapiens; identical to SEQ ID NO: 323336

SEQ ID NO: 461553 - RNA, 64 nt, Homo Sapiens; identical to SEQ ID NO: 323337

SEQ ID NO: 461554 - RNA, 64 nt, Homo Sapiens; identical to SEQ ID NO: 323338

SEQ ID NO: 461555 - RNA, 64 nt, Homo Sapiens; identical to SEQ ID NO: 323339

SEQ ID NO: 461556 - RNA, 64 nt, Homo Sapiens; identical to SEQ ID NO: 323340

SEQ ID NO: 461557 - RNA, 64 nt, Homo Sapiens; identical to SEQ ID NO: 323341

SEQ ID NO: 461558 - RNA, 64 nt, Homo Sapiens; identical to SEQ ID NO: 323342

SEQ ID NO: 461559 - RNA, 64 nt, Homo Sapiens; identical to SEQ ID NO: 323343

SEQ ID NO: 461560 - RNA, 64 nt, Homo Sapiens; identical to SEQ ID NO: 323344

SEQ ID NO: 461561 - RNA, 64 nt, Homo Sapiens; identical to SEQ ID NO: 323345

SEQ ID NO: 461562 - RNA, 64 nt, Homo Sapiens; identical to SEQ ID NO: 323346

SEQ ID NO: 461563 - RNA, 64 nt, Homo Sapiens; identical to SEQ ID NO: 323347

SEQ ID NO: 461564 - RNA, 64 nt, Homo Sapiens; identical to SEQ ID NO: 323348

SEQ ID NO: 461565 - RNA, 64 nt, Homo Sapiens; identical to SEQ ID NO: 323349

SEQ ID NO: 461566 - RNA, 64 nt, Homo Sapiens; identical to SEQ ID NO: 323350

SEQ ID NO: 461567 - RNA, 64 nt, Homo Sapiens; identical to SEQ ID NO: 323351

SEQ ID NO: 461568 - RNA, 64 nt, Homo Sapiens; identical to SEQ ID NO: 323352

SEQ ID NO: 461569 - RNA, 64 nt, Homo Sapiens; identical to SEQ ID NO: 323353

SEQ ID NO: 461570 - RNA, 64 nt, Homo Sapiens; identical to SEQ ID NO: 323354

SEQ ID NO: 461571 - RNA, 64 nt, Homo Sapiens; identical to SEQ ID NO: 323355

SEQ ID NO: 461572 - RNA, 64 nt, Homo Sapiens; identical to SEQ ID NO: 323356

SEQ ID NO: 461573 - RNA, 64 nt, Homo Sapiens; identical to SEQ ID NO: 323357

SEQ ID NO: 461574 - RNA, 64 nt, Homo Sapiens; identical to SEQ ID NO: 323358

SEQ ID NO: 461575 - RNA, 64 nt, Homo Sapiens; identical to SEQ ID NO: 323359

SEQ ID NO: 461576 - RNA, 64 nt, Homo Sapiens; identical to SEQ ID NO: 323360

SEQ ID NO: 461577 - RNA, 64 nt, Homo Sapiens; identical to SEQ ID NO: 323361

SEQ ID NO: 461578 - RNA, 64 nt, Homo Sapiens; identical to SEQ ID NO: 323362

SEQ ID NO: 461579 - RNA, 64 nt, Homo Sapiens; identical to SEQ ID NO: 323363

SEQ ID NO: 461580 - RNA, 64 nt, Homo Sapiens; identical to SEQ ID NO: 323364

SEQ ID NO: 461581 - RNA, 64 nt, Homo Sapiens; identical to SEQ ID NO: 323365

SEQ ID NO: 461582 - RNA, 64 nt, Homo Sapiens; identical to SEQ ID NO: 323366

SEQ ID NO: 461583 - RNA, 64 nt, Homo Sapiens; identical to SEQ ID NO: 323367

SEQ ID NO: 461584 - RNA, 64 nt, Homo Sapiens; identical to SEQ ID NO: 323368

SEQ ID NO: 461585 - RNA, 64 nt, Homo Sapiens; identical to SEQ ID NO: 323369

SEQ ID NO: 461586 - RNA, 64 nt, Homo Sapiens; identical to SEQ ID NO: 108616

SEQ ID NO: 461587 - RNA, 64 nt, Homo Sapiens; identical to SEQ ID NO: 108617

SEQ ID NO: 461588 - RNA, 64 nt, Homo Sapiens; identical to SEQ ID NO: 108618

SEQ ID NO: 461589 - RNA, 64 nt, Homo Sapiens; identical to SEQ ID NO: 108619

SEQ ID NO: 461590 - RNA, 64 nt, Homo Sapiens; identical to SEQ ID NO: 108620

SEQ ID NO: 461591 - RNA, 64 nt, Homo Sapiens; identical to SEQ ID NO: 108621

SEQ ID NO: 461592 - RNA, 64 nt, Homo Sapiens; identical to SEQ ID NO: 108622

SEQ ID NO: 461593 - RNA, 64 nt, Homo Sapiens; identical to SEQ ID NO: 108623

SEQ ID NO: 461594 - RNA, 61 nt, Homo Sapiens; identical to SEQ ID NO: 108624

SEQ ID NO: 461595 - RNA, 64 nt, Homo Sapiens; identical to SEQ ID NO: 108625

SEQ ID NO: 461596 - RNA, 64 nt, Homo Sapiens; identical to SEQ ID NO: 108626

SEQ ID NO: 461597 - RNA, 64 nt, Homo Sapiens; identical to SEQ ID NO: 108627

SEQ ID NO: 461598 - RNA, 64 nt, Homo Sapiens; identical to SEQ ID NO: 108628

SEQ ID NO: 461599 - RNA, 64 nt, Homo Sapiens; identical to SEQ ID NO: 108629

SEQ ID NO: 461600 - RNA, 64 nt, Homo Sapiens; identical to SEQ ID NO: 108630

SEQ ID NO: 461601 - RNA, 64 nt, Homo Sapiens; identical to SEQ ID NO: 108631

SEQ ID NO: 461602 - RNA, 64 nt, Homo Sapiens; identical to SEQ ID NO: 108632

SEQ ID NO: 461603 - RNA, 64 nt, Homo Sapiens; identical to SEQ ID NO: 108633

SEQ ID NO: 461604 - RNA, 64 nt, Homo Sapiens; identical to SEQ ID NO: 108634

SEQ ID NO: 461605 - RNA, 64 nt, Homo Sapiens; identical to SEQ ID NO: 108635

SEQ ID NO: 461606 - RNA, 64 nt, Homo Sapiens; identical to SEQ ID NO: 108636

SEQ ID NO: 461607 - RNA, 64 nt, Homo Sapiens; identical to SEQ ID NO: 108637

SEQ ID NO: 461608 - RNA, 64 nt, Homo Sapiens; identical to SEQ ID NO: 108638

SEQ ID NO: 461609 - RNA, 64 nt, Homo Sapiens; identical to SEQ ID NO: 108639

SEQ ID NO: 461610 - RNA, 64 nt, Homo Sapiens; identical to SEQ ID NO: 108640

SEQ ID NO: 461611 - RNA, 64 nt, Homo Sapiens; identical to SEQ ID NO: 108641

SEQ ID NO: 461612 - RNA, 64 nt, Homo Sapiens; identical to SEQ ID NO: 108642

SEQ ID NO: 461613 - RNA, 64 nt, Homo Sapiens; identical to SEQ ID NO: 108643

SEQ ID NO: 461614 - RNA, 64 nt, Homo Sapiens; identical to SEQ ID NO: 108644

SEQ ID NO: 461615 - RNA, 64 nt, Homo Sapiens; identical to SEQ ID NO: 108645

SEQ ID NO: 461616 - RNA, 64 nt, Homo Sapiens; identical to SEQ ID NO: 108646

SEQ ID NO: 461617 - RNA, 64 nt, Homo Sapiens; identical to SEQ ID NO: 108647

SEQ ID NO: 461618 - RNA, 64 nt, Homo Sapiens; identical to SEQ ID NO: 108648

SEQ ID NO: 461619 - RNA, 64 nt, Homo Sapiens; identical to SEQ ID NO: 108649

SEQ ID NO: 461620 - RNA, 64 nt, Homo Sapiens; identical to SEQ ID NO: 108650

SEQ ID NO: 461621 - RNA, 64 nt, Homo Sapiens; identical to SEQ ID NO: 108651

SEQ ID NO: 461622 - RNA, 64 nt, Homo Sapiens; identical to SEQ ID NO: 108652

SEQ ID NO: 461623 - RNA, 64 nt, Homo Sapiens; identical to SEQ ID NO: 108653

SEQ ID NO: 461624 - RNA, 64 nt, Homo Sapiens; identical to SEQ ID NO: 108654

SEQ ID NO: 461625 - RNA, 64 nt, Homo Sapiens; identical to SEQ ID NO: 108655

SEQ ID NO: 461626 - RNA, 64 nt, Homo Sapiens; identical to SEQ ID NO: 108656

SEQ ID NO: 461627 - RNA, 64 nt, Homo Sapiens; identical to SEQ ID NO: 108657

SEQ ID NO: 461628 - RNA, 64 nt, Homo Sapiens; identical to SEQ ID NO: 108658

SEQ ID NO: 461629 - RNA, 64 nt, Homo Sapiens; identical to SEQ ID NO: 108659

SEQ ID NO: 461630 - RNA, 64 nt, Homo Sapiens; identical to SEQ ID NO: 108660

SEQ ID NO: 461631 - RNA, 64 nt, Homo Sapiens; identical to SEQ ID NO: 108661

SEQ ID NO: 461632 - RNA, 64 nt, Homo Sapiens; identical to SEQ ID NO: 108662

SEQ ID NO: 461633 - RNA, 64 nt, Homo Sapiens; identical to SEQ ID NO: 108663

SEQ ID NO: 461634 - RNA, 64 nt, Homo Sapiens; identical to SEQ ID NO: 108664

SEQ ID NO: 461635 - RNA, 64 nt, Homo Sapiens; identical to SEQ ID NO: 108665

SEQ ID NO: 461636 - RNA, 64 nt, Homo Sapiens; identical to SEQ ID NO: 108666

SEQ ID NO: 461637 - RNA, 64 nt, Homo Sapiens; identical to SEQ ID NO: 108667

SEQ ID NO: 461638 - RNA, 64 nt, Homo Sapiens; identical to SEQ ID NO: 108668

SEQ ID NO: 461639 - RNA, 64 nt, Homo Sapiens; identical to SEQ ID NO: 108669

SEQ ID NO: 461640 - RNA, 64 nt, Homo Sapiens; identical to SEQ ID NO: 108670

SEQ ID NO: 461641 - RNA, 64 nt, Homo Sapiens; identical to SEQ ID NO: 108671

SEQ ID NO: 461642 - RNA, 64 nt, Homo Sapiens; identical to SEQ ID NO: 108672

SEQ ID NO: 461643 - RNA, 64 nt, Homo Sapiens; identical to SEQ ID NO: 108673

SEQ ID NO: 461644 - RNA, 64 nt, Homo Sapiens; identical to SEQ ID NO: 108674

SEQ ID NO: 461645 - RNA, 64 nt, Homo Sapiens; identical to SEQ ID NO: 108675

SEQ ID NO: 461646 - RNA, 64 nt, Homo Sapiens; identical to SEQ ID NO: 108676

SEQ ID NO: 461647 - RNA, 64 nt, Homo Sapiens; identical to SEQ ID NO: 108677

SEQ ID NO: 461648 - RNA, 64 nt, Homo Sapiens; identical to SEQ ID NO: 108678

SEQ ID NO: 461649 - RNA, 64 nt, Homo Sapiens; identical to SEQ ID NO: 108679

SEQ ID NO: 461650 - RNA, 64 nt, Homo Sapiens; identical to SEQ ID NO: 108680

SEQ ID NO: 461651 - RNA, 64 nt, Homo Sapiens; identical to SEQ ID NO: 108681

SEQ ID NO: 461652 - RNA, 64 nt, Homo Sapiens; identical to SEQ ID NO: 108682

SEQ ID NO: 461653 - RNA, 64 nt, Homo Sapiens; identical to SEQ ID NO: 108683

SEQ ID NO: 461654 - RNA, 64 nt, Homo Sapiens; identical to SEQ ID NO: 108684

SEQ ID NO: 461655 - RNA, 64 nt, Homo Sapiens; identical to SEQ ID NO: 108685

SEQ ID NO: 461656 - RNA, 64 nt, Homo Sapiens; identical to SEQ ID NO: 108686

SEQ ID NO: 461657 - RNA, 64 nt, Homo Sapiens; identical to SEQ ID NO: 108687

SEQ ID NO: 461658 - RNA, 64 nt, Homo Sapiens; identical to SEQ ID NO: 108688

SEQ ID NO: 461659 - RNA, 64 nt, Homo Sapiens; identical to SEQ ID NO: 108689

SEQ ID NO: 461660 - RNA, 64 nt, Homo Sapiens; identical to SEQ ID NO: 108690

SEQ ID NO: 461661 - RNA, 64 nt, Homo Sapiens; identical to SEQ ID NO: 108691

SEQ ID NO: 461662 - RNA, 64 nt, Homo Sapiens; identical to SEQ ID NO: 108692

SEQ ID NO: 461663 - RNA, 64 nt, Homo Sapiens; identical to SEQ ID NO: 108693

SEQ ID NO: 461664 - RNA, 64 nt, Homo Sapiens; identical to SEQ ID NO: 108694

SEQ ID NO: 461665 - RNA, 64 nt, Homo Sapiens; identical to SEQ ID NO: 108695

SEQ ID NO: 461666 - RNA, 64 nt, Homo Sapiens; identical to SEQ ID NO: 108696

SEQ ID NO: 461667 - RNA, 64 nt, Homo Sapiens; identical to SEQ ID NO: 108697

SEQ ID NO: 461668 - RNA, 64 nt, Homo Sapiens; identical to SEQ ID NO: 108698

SEQ ID NO: 461669 - RNA, 64 nt, Homo Sapiens; identical to SEQ ID NO: 108699

SEQ ID NO: 461670 - RNA, 64 nt, Homo Sapiens; identical to SEQ ID NO: 108700

SEQ ID NO: 461671 - RNA, 64 nt, Homo Sapiens; identical to SEQ ID NO: 108701

SEQ ID NO: 461672 - RNA, 64 nt, Homo Sapiens; identical to SEQ ID NO: 108702

SEQ ID NO: 461673 - RNA, 64 nt, Homo Sapiens; identical to SEQ ID NO: 108703

SEQ ID NO: 461674 - RNA, 64 nt, Homo Sapiens; identical to SEQ ID NO: 108704

SEQ ID NO: 461675 - RNA, 64 nt, Homo Sapiens; identical to SEQ ID NO: 108705

SEQ ID NO: 461676 - RNA, 64 nt, Homo Sapiens; identical to SEQ ID NO: 108706

SEQ ID NO: 461677 - RNA, 64 nt, Homo Sapiens; identical to SEQ ID NO: 108707

SEQ ID NO: 461678 - RNA, 64 nt, Homo Sapiens; identical to SEQ ID NO: 108708

SEQ ID NO: 461679 - RNA, 64 nt, Homo Sapiens; identical to SEQ ID NO: 108709

SEQ ID NO: 461680 - RNA, 64 nt, Homo Sapiens; identical to SEQ ID NO: 108710

SEQ ID NO: 461681 - RNA, 64 nt, Homo Sapiens; identical to SEQ ID NO: 108711

SEQ ID NO: 461682 - RNA, 64 nt, Homo Sapiens; identical to SEQ ID NO: 108712

SEQ ID NO: 461683 - RNA, 64 nt, Homo Sapiens; identical to SEQ ID NO: 108713

SEQ ID NO: 461684 - RNA, 64 nt, Homo Sapiens; identical to SEQ ID NO: 108714

SEQ ID NO: 461685 - RNA, 64 nt, Homo Sapiens; identical to SEQ ID NO: 108715

SEQ ID NO: 461686 - RNA, 64 nt, Homo Sapiens; identical to SEQ ID NO: 108716

SEQ ID NO: 461687 - RNA, 64 nt, Homo Sapiens; identical to SEQ ID NO: 108717

SEQ ID NO: 461688 - RNA, 64 nt, Homo Sapiens; identical to SEQ ID NO: 108718

SEQ ID NO: 461689 - RNA, 64 nt, Homo Sapiens; identical to SEQ ID NO: 108719

SEQ ID NO: 461690 - RNA, 64 nt, Homo Sapiens; identical to SEQ ID NO: 108720

SEQ ID NO: 461691 - RNA, 64 nt, Homo Sapiens; identical to SEQ ID NO: 108721

SEQ ID NO: 461692 - RNA, 64 nt, Homo Sapiens; identical to SEQ ID NO: 108722

SEQ ID NO: 461693 - RNA, 64 nt, Homo Sapiens; identical to SEQ ID NO: 108723

SEQ ID NO: 461694 - RNA, 64 nt, Homo Sapiens; identical to SEQ ID NO: 108724

SEQ ID NO: 461695 - RNA, 64 nt, Homo Sapiens; identical to SEQ ID NO: 108725

SEQ ID NO: 461696 - RNA, 64 nt, Homo Sapiens; identical to SEQ ID NO: 108726

SEQ ID NO: 461697 - RNA, 64 nt, Homo Sapiens; identical to SEQ ID NO: 108727

SEQ ID NO: 461698 - RNA, 64 nt, Homo Sapiens; identical to SEQ ID NO: 108728

SEQ ID NO: 461699 - RNA, 64 nt, Homo Sapiens; identical to SEQ ID NO: 108729

SEQ ID NO: 461700 - RNA, 64 nt, Homo Sapiens; identical to SEQ ID NO: 108730

SEQ ID NO: 461701 - RNA, 64 nt, Homo Sapiens; identical to SEQ ID NO: 108731

SEQ ID NO: 461702 - RNA, 64 nt, Homo Sapiens; identical to SEQ ID NO: 108732

SEQ ID NO: 461703 - RNA, 64 nt, Homo Sapiens; identical to SEQ ID NO: 108733

SEQ ID NO: 461704 - RNA, 64 nt, Homo Sapiens; identical to SEQ ID NO: 108734

SEQ ID NO: 461705 - RNA, 64 nt, Homo Sapiens; identical to SEQ ID NO: 108735

SEQ ID NO: 461706 - RNA, 64 nt, Homo Sapiens; identical to SEQ ID NO: 108736

SEQ ID NO: 461707 - RNA, 64 nt, Homo Sapiens; identical to SEQ ID NO: 108737

SEQ ID NO: 461708 - RNA, 64 nt, Homo Sapiens; identical to SEQ ID NO: 108738

SEQ ID NO: 461709 - RNA, 64 nt, Homo Sapiens; identical to SEQ ID NO: 108739

SEQ ID NO: 461710 - RNA, 64 nt, Homo Sapiens; identical to SEQ ID NO: 108740

SEQ ID NO: 461711 - RNA, 64 nt, Homo Sapiens; identical to SEQ ID NO: 108741

SEQ ID NO: 461712 - RNA, 64 nt, Homo Sapiens; identical to SEQ ID NO: 108742

SEQ ID NO: 461713 - RNA, 64 nt, Homo Sapiens; identical to SEQ ID NO: 108743

SEQ ID NO: 461714 - RNA, 64 nt, Homo Sapiens; identical to SEQ ID NO: 108744

SEQ ID NO: 461715 - RNA, 64 nt, Homo Sapiens; identical to SEQ ID NO: 108745

SEQ ID NO: 461716 - RNA, 64 nt, Homo Sapiens; identical to SEQ ID NO: 108746

SEQ ID NO: 461717 - RNA, 64 nt, Homo Sapiens; identical to SEQ ID NO: 108747

SEQ ID NO: 461718 - RNA, 64 nt, Homo Sapiens; identical to SEQ ID NO: 108748

SEQ ID NO: 461719 - RNA, 64 nt, Homo Sapiens; identical to SEQ ID NO: 108749

SEQ ID NO: 461720 - RNA, 64 nt, Homo Sapiens; identical to SEQ ID NO: 108750

SEQ ID NO: 461721 - RNA, 64 nt, Homo Sapiens; identical to SEQ ID NO: 108751

SEQ ID NO: 461722 - RNA, 64 nt, Homo Sapiens; identical to SEQ ID NO: 108752

SEQ ID NO: 461723 - RNA, 64 nt, Homo Sapiens; identical to SEQ ID NO: 108753

SEQ ID NO: 461724 - RNA, 64 nt, Homo Sapiens; identical to SEQ ID NO: 108754

SEQ ID NO: 461725 - RNA, 64 nt, Homo Sapiens; identical to SEQ ID NO: 108755

SEQ ID NO: 461726 - RNA, 64 nt, Homo Sapiens; identical to SEQ ID NO: 108756

SEQ ID NO: 461727 - RNA, 64 nt, Homo Sapiens; identical to SEQ ID NO: 108757

SEQ ID NO: 461728 - RNA, 64 nt, Homo Sapiens; identical to SEQ ID NO: 108758

SEQ ID NO: 461729 - RNA, 64 nt, Homo Sapiens; identical to SEQ ID NO: 108759

SEQ ID NO: 461730 - RNA, 64 nt, Homo Sapiens; identical to SEQ ID NO: 108760

SEQ ID NO: 461731 - RNA, 64 nt, Homo Sapiens; identical to SEQ ID NO: 108761

SEQ ID NO: 461732 - RNA, 64 nt, Homo Sapiens; identical to SEQ ID NO: 108762

SEQ ID NO: 461733 - RNA, 64 nt, Homo Sapiens; identical to SEQ ID NO: 108763

SEQ ID NO: 461734 - RNA, 64 nt, Homo Sapiens; identical to SEQ ID NO: 108764

SEQ ID NO: 461735 - RNA, 64 nt, Homo Sapiens; identical to SEQ ID NO: 108765

SEQ ID NO: 461736 - RNA, 64 nt, Homo Sapiens; identical to SEQ ID NO: 243136

SEQ ID NO: 461737 - RNA, 64 nt, Homo Sapiens; identical to SEQ ID NO: 243137

SEQ ID NO: 461738 - RNA, 64 nt, Homo Sapiens; identical to SEQ ID NO: 243138

SEQ ID NO: 461739 - RNA, 64 nt, Homo Sapiens; identical to SEQ ID NO: 243139

SEQ ID NO: 461740 - RNA, 64 nt, Homo Sapiens; identical to SEQ ID NO: 243140

SEQ ID NO: 461741 - RNA, 64 nt, Homo Sapiens; identical to SEQ ID NO: 243141

SEQ ID NO: 461742 - RNA, 64 nt, Homo Sapiens; identical to SEQ ID NO: 108616

SEQ ID NO: 461743 - RNA, 64 nt, Homo Sapiens; identical to SEQ ID NO: 108617

SEQ ID NO: 461744 - RNA, 64 nt, Homo Sapiens; identical to SEQ ID NO: 108618

SEQ ID NO: 461745 - RNA, 64 nt, Homo Sapiens; identical to SEQ ID NO: 108619

SEQ ID NO: 461746 - RNA, 64 nt, Homo Sapiens; identical to SEQ ID NO: 108620

SEQ ID NO: 461747 - RNA, 64 nt, Homo Sapiens; identical to SEQ ID NO: 108621

SEQ ID NO: 461748 - RNA, 64 nt, Homo Sapiens; identical to SEQ ID NO: 108622

SEQ ID NO: 461749 - RNA, 64 nt, Homo Sapiens; identical to SEQ ID NO: 108623

SEQ ID NO: 461750 - RNA, 61 nt, Homo Sapiens; identical to SEQ ID NO: 108624

SEQ ID NO: 461751 - RNA, 64 nt, Homo Sapiens; identical to SEQ ID NO: 108625

SEQ ID NO: 461752 - RNA, 64 nt, Homo Sapiens; identical to SEQ ID NO: 108626

SEQ ID NO: 461753 - RNA, 64 nt, Homo Sapiens; identical to SEQ ID NO: 108627

SEQ ID NO: 461754 - RNA, 64 nt, Homo Sapiens; identical to SEQ ID NO: 108628

SEQ ID NO: 461755 - RNA, 64 nt, Homo Sapiens; identical to SEQ ID NO: 108629

SEQ ID NO: 461756 - RNA, 64 nt, Homo Sapiens; identical to SEQ ID NO: 108630

SEQ ID NO: 461757 - RNA, 64 nt, Homo Sapiens; identical to SEQ ID NO: 108631

SEQ ID NO: 461758 - RNA, 64 nt, Homo Sapiens; identical to SEQ ID NO: 108632

SEQ ID NO: 461759 - RNA, 64 nt, Homo Sapiens; identical to SEQ ID NO: 108633

SEQ ID NO: 461760 - RNA, 64 nt, Homo Sapiens; identical to SEQ ID NO: 108634

SEQ ID NO: 461761 - RNA, 64 nt, Homo Sapiens; identical to SEQ ID NO: 108635

SEQ ID NO: 461762 - RNA, 64 nt, Homo Sapiens; identical to SEQ ID NO: 108636

SEQ ID NO: 461763 - RNA, 64 nt, Homo Sapiens; identical to SEQ ID NO: 108637

SEQ ID NO: 461764 - RNA, 64 nt, Homo Sapiens; identical to SEQ ID NO: 108638

SEQ ID NO: 461765 - RNA, 64 nt, Homo Sapiens; identical to SEQ ID NO: 108639

SEQ ID NO: 461766 - RNA, 64 nt, Homo Sapiens; identical to SEQ ID NO: 108640

SEQ ID NO: 461767 - RNA, 64 nt, Homo Sapiens; identical to SEQ ID NO: 108641

SEQ ID NO: 461768 - RNA, 64 nt, Homo Sapiens; identical to SEQ ID NO: 108642

SEQ ID NO: 461769 - RNA, 64 nt, Homo Sapiens; identical to SEQ ID NO: 108643

SEQ ID NO: 461770 - RNA, 64 nt, Homo Sapiens; identical to SEQ ID NO: 108644

SEQ ID NO: 461771 - RNA, 64 nt, Homo Sapiens; identical to SEQ ID NO: 108645

SEQ ID NO: 461772 - RNA, 64 nt, Homo Sapiens; identical to SEQ ID NO: 108646

SEQ ID NO: 461773 - RNA, 64 nt, Homo Sapiens; identical to SEQ ID NO: 108647

SEQ ID NO: 461774 - RNA, 64 nt, Homo Sapiens; identical to SEQ ID NO: 108648

SEQ ID NO: 461775 - RNA, 64 nt, Homo Sapiens; identical to SEQ ID NO: 108649

SEQ ID NO: 461776 - RNA, 64 nt, Homo Sapiens; identical to SEQ ID NO: 108650

SEQ ID NO: 461777 - RNA, 64 nt, Homo Sapiens; identical to SEQ ID NO: 108651

SEQ ID NO: 461778 - RNA, 64 nt, Homo Sapiens; identical to SEQ ID NO: 108652

SEQ ID NO: 461779 - RNA, 64 nt, Homo Sapiens; identical to SEQ ID NO: 108653

SEQ ID NO: 461780 - RNA, 64 nt, Homo Sapiens; identical to SEQ ID NO: 108654

SEQ ID NO: 461781 - RNA, 64 nt, Homo Sapiens; identical to SEQ ID NO: 108655

SEQ ID NO: 461782 - RNA, 64 nt, Homo Sapiens; identical to SEQ ID NO: 108656

SEQ ID NO: 461783 - RNA, 64 nt, Homo Sapiens; identical to SEQ ID NO: 108657

SEQ ID NO: 461784 - RNA, 64 nt, Homo Sapiens; identical to SEQ ID NO: 108658

SEQ ID NO: 461785 - RNA, 64 nt, Homo Sapiens; identical to SEQ ID NO: 108659

SEQ ID NO: 461786 - RNA, 64 nt, Homo Sapiens; identical to SEQ ID NO: 108660

SEQ ID NO: 461787 - RNA, 64 nt, Homo Sapiens; identical to SEQ ID NO: 108661

SEQ ID NO: 461788 - RNA, 64 nt, Homo Sapiens; identical to SEQ ID NO: 108662

SEQ ID NO: 461789 - RNA, 64 nt, Homo Sapiens; identical to SEQ ID NO: 108663

SEQ ID NO: 461790 - RNA, 64 nt, Homo Sapiens; identical to SEQ ID NO: 108664

SEQ ID NO: 461791 - RNA, 64 nt, Homo Sapiens; identical to SEQ ID NO: 108665

SEQ ID NO: 461792 - RNA, 64 nt, Homo Sapiens; identical to SEQ ID NO: 108666

SEQ ID NO: 461793 - RNA, 64 nt, Homo Sapiens; identical to SEQ ID NO: 108667

SEQ ID NO: 461794 - RNA, 64 nt, Homo Sapiens; identical to SEQ ID NO: 108668

SEQ ID NO: 461795 - RNA, 64 nt, Homo Sapiens; identical to SEQ ID NO: 108669

SEQ ID NO: 461796 - RNA, 64 nt, Homo Sapiens; identical to SEQ ID NO: 108670

SEQ ID NO: 461797 - RNA, 64 nt, Homo Sapiens; identical to SEQ ID NO: 108671

SEQ ID NO: 461798 - RNA, 64 nt, Homo Sapiens; identical to SEQ ID NO: 108672

SEQ ID NO: 461799 - RNA, 64 nt, Homo Sapiens; identical to SEQ ID NO: 108673

SEQ ID NO: 461800 - RNA, 64 nt, Homo Sapiens; identical to SEQ ID NO: 108674

SEQ ID NO: 461801 - RNA, 64 nt, Homo Sapiens; identical to SEQ ID NO: 108675

SEQ ID NO: 461802 - RNA, 64 nt, Homo Sapiens; identical to SEQ ID NO: 108676

SEQ ID NO: 461803 - RNA, 64 nt, Homo Sapiens; identical to SEQ ID NO: 108677

SEQ ID NO: 461804 - RNA, 64 nt, Homo Sapiens; identical to SEQ ID NO: 108678

SEQ ID NO: 461805 - RNA, 64 nt, Homo Sapiens; identical to SEQ ID NO: 108679

SEQ ID NO: 461806 - RNA, 64 nt, Homo Sapiens; identical to SEQ ID NO: 108680

SEQ ID NO: 461807 - RNA, 64 nt, Homo Sapiens; identical to SEQ ID NO: 108681

SEQ ID NO: 461808 - RNA, 64 nt, Homo Sapiens; identical to SEQ ID NO: 108682

SEQ ID NO: 461809 - RNA, 64 nt, Homo Sapiens; identical to SEQ ID NO: 108683

SEQ ID NO: 461810 - RNA, 64 nt, Homo Sapiens; identical to SEQ ID NO: 108684

SEQ ID NO: 461811 - RNA, 64 nt, Homo Sapiens; identical to SEQ ID NO: 108685

SEQ ID NO: 461812 - RNA, 64 nt, Homo Sapiens; identical to SEQ ID NO: 108686

SEQ ID NO: 461813 - RNA, 64 nt, Homo Sapiens; identical to SEQ ID NO: 108687

SEQ ID NO: 461814 - RNA, 64 nt, Homo Sapiens; identical to SEQ ID NO: 108688

SEQ ID NO: 461815 - RNA, 64 nt, Homo Sapiens; identical to SEQ ID NO: 108689

SEQ ID NO: 461816 - RNA, 64 nt, Homo Sapiens; identical to SEQ ID NO: 108690

SEQ ID NO: 461817 - RNA, 64 nt, Homo Sapiens; identical to SEQ ID NO: 108691

SEQ ID NO: 461818 - RNA, 64 nt, Homo Sapiens; identical to SEQ ID NO: 108692

SEQ ID NO: 461819 - RNA, 64 nt, Homo Sapiens; identical to SEQ ID NO: 108693

SEQ ID NO: 461820 - RNA, 64 nt, Homo Sapiens; identical to SEQ ID NO: 108694

SEQ ID NO: 461821 - RNA, 64 nt, Homo Sapiens; identical to SEQ ID NO: 108695

SEQ ID NO: 461822 - RNA, 64 nt, Homo Sapiens; identical to SEQ ID NO: 108696

SEQ ID NO: 461823 - RNA, 64 nt, Homo Sapiens; identical to SEQ ID NO: 108697

SEQ ID NO: 461824 - RNA, 64 nt, Homo Sapiens; identical to SEQ ID NO: 108698

SEQ ID NO: 461825 - RNA, 64 nt, Homo Sapiens; identical to SEQ ID NO: 108699

SEQ ID NO: 461826 - RNA, 64 nt, Homo Sapiens; identical to SEQ ID NO: 108700

SEQ ID NO: 461827 - RNA, 64 nt, Homo Sapiens; identical to SEQ ID NO: 108701

SEQ ID NO: 461828 - RNA, 64 nt, Homo Sapiens; identical to SEQ ID NO: 108702

SEQ ID NO: 461829 - RNA, 64 nt, Homo Sapiens; identical to SEQ ID NO: 108703

SEQ ID NO: 461830 - RNA, 64 nt, Homo Sapiens; identical to SEQ ID NO: 108704

SEQ ID NO: 461831 - RNA, 64 nt, Homo Sapiens; identical to SEQ ID NO: 108705

SEQ ID NO: 461832 - RNA, 64 nt, Homo Sapiens; identical to SEQ ID NO: 108706

SEQ ID NO: 461833 - RNA, 64 nt, Homo Sapiens; identical to SEQ ID NO: 108707

SEQ ID NO: 461834 - RNA, 64 nt, Homo Sapiens; identical to SEQ ID NO: 108708

SEQ ID NO: 461835 - RNA, 64 nt, Homo Sapiens; identical to SEQ ID NO: 108709

SEQ ID NO: 461836 - RNA, 64 nt, Homo Sapiens; identical to SEQ ID NO: 108710

SEQ ID NO: 461837 - RNA, 64 nt, Homo Sapiens; identical to SEQ ID NO: 108711

SEQ ID NO: 461838 - RNA, 64 nt, Homo Sapiens; identical to SEQ ID NO: 108712

SEQ ID NO: 461839 - RNA, 64 nt, Homo Sapiens; identical to SEQ ID NO: 108713

SEQ ID NO: 461840 - RNA, 64 nt, Homo Sapiens; identical to SEQ ID NO: 108714

SEQ ID NO: 461841 - RNA, 64 nt, Homo Sapiens; identical to SEQ ID NO: 108715

SEQ ID NO: 461842 - RNA, 64 nt, Homo Sapiens; identical to SEQ ID NO: 108716

SEQ ID NO: 461843 - RNA, 64 nt, Homo Sapiens; identical to SEQ ID NO: 108717

SEQ ID NO: 461844 - RNA, 64 nt, Homo Sapiens; identical to SEQ ID NO: 108718

SEQ ID NO: 461845 - RNA, 64 nt, Homo Sapiens; identical to SEQ ID NO: 108719

SEQ ID NO: 461846 - RNA, 64 nt, Homo Sapiens; identical to SEQ ID NO: 108720

SEQ ID NO: 461847 - RNA, 64 nt, Homo Sapiens; identical to SEQ ID NO: 108721

SEQ ID NO: 461848 - RNA, 64 nt, Homo Sapiens; identical to SEQ ID NO: 108722

SEQ ID NO: 461849 - RNA, 64 nt, Homo Sapiens; identical to SEQ ID NO: 108723

SEQ ID NO: 461850 - RNA, 64 nt, Homo Sapiens; identical to SEQ ID NO: 108724

SEQ ID NO: 461851 - RNA, 64 nt, Homo Sapiens; identical to SEQ ID NO: 108725

SEQ ID NO: 461852 - RNA, 64 nt, Homo Sapiens; identical to SEQ ID NO: 108726

SEQ ID NO: 461853 - RNA, 64 nt, Homo Sapiens; identical to SEQ ID NO: 108727

SEQ ID NO: 461854 - RNA, 64 nt, Homo Sapiens; identical to SEQ ID NO: 108728

SEQ ID NO: 461855 - RNA, 64 nt, Homo Sapiens; identical to SEQ ID NO: 108729

SEQ ID NO: 461856 - RNA, 64 nt, Homo Sapiens; identical to SEQ ID NO: 108730

SEQ ID NO: 461857 - RNA, 64 nt, Homo Sapiens; identical to SEQ ID NO: 108731

SEQ ID NO: 461858 - RNA, 64 nt, Homo Sapiens; identical to SEQ ID NO: 108732

SEQ ID NO: 461859 - RNA, 64 nt, Homo Sapiens; identical to SEQ ID NO: 108733

SEQ ID NO: 461860 - RNA, 64 nt, Homo Sapiens; identical to SEQ ID NO: 108734

SEQ ID NO: 461861 - RNA, 64 nt, Homo Sapiens; identical to SEQ ID NO: 108735

SEQ ID NO: 461862 - RNA, 64 nt, Homo Sapiens; identical to SEQ ID NO: 108736

SEQ ID NO: 461863 - RNA, 64 nt, Homo Sapiens; identical to SEQ ID NO: 108737

SEQ ID NO: 461864 - RNA, 64 nt, Homo Sapiens; identical to SEQ ID NO: 108738

SEQ ID NO: 461865 - RNA, 64 nt, Homo Sapiens; identical to SEQ ID NO: 108739

SEQ ID NO: 461866 - RNA, 64 nt, Homo Sapiens; identical to SEQ ID NO: 108740

SEQ ID NO: 461867 - RNA, 64 nt, Homo Sapiens; identical to SEQ ID NO: 108741

SEQ ID NO: 461868 - RNA, 64 nt, Homo Sapiens; identical to SEQ ID NO: 108742

SEQ ID NO: 461869 - RNA, 64 nt, Homo Sapiens; identical to SEQ ID NO: 108743

SEQ ID NO: 461870 - RNA, 64 nt, Homo Sapiens; identical to SEQ ID NO: 108744

SEQ ID NO: 461871 - RNA, 64 nt, Homo Sapiens; identical to SEQ ID NO: 108745

SEQ ID NO: 461872 - RNA, 64 nt, Homo Sapiens; identical to SEQ ID NO: 108746

SEQ ID NO: 461873 - RNA, 64 nt, Homo Sapiens; identical to SEQ ID NO: 108747

SEQ ID NO: 461874 - RNA, 64 nt, Homo Sapiens; identical to SEQ ID NO: 108748

SEQ ID NO: 461875 - RNA, 64 nt, Homo Sapiens; identical to SEQ ID NO: 108749

SEQ ID NO: 461876 - RNA, 64 nt, Homo Sapiens; identical to SEQ ID NO: 108750

SEQ ID NO: 461877 - RNA, 64 nt, Homo Sapiens; identical to SEQ ID NO: 108751

SEQ ID NO: 461878 - RNA, 64 nt, Homo Sapiens; identical to SEQ ID NO: 108752

SEQ ID NO: 461879 - RNA, 64 nt, Homo Sapiens; identical to SEQ ID NO: 108753

SEQ ID NO: 461880 - RNA, 64 nt, Homo Sapiens; identical to SEQ ID NO: 108754

SEQ ID NO: 461881 - RNA, 64 nt, Homo Sapiens; identical to SEQ ID NO: 108755

SEQ ID NO: 461882 - RNA, 64 nt, Homo Sapiens; identical to SEQ ID NO: 108756

SEQ ID NO: 461883 - RNA, 64 nt, Homo Sapiens; identical to SEQ ID NO: 108757

SEQ ID NO: 461884 - RNA, 64 nt, Homo Sapiens; identical to SEQ ID NO: 108758

SEQ ID NO: 461885 - RNA, 64 nt, Homo Sapiens; identical to SEQ ID NO: 108759

SEQ ID NO: 461886 - RNA, 64 nt, Homo Sapiens; identical to SEQ ID NO: 108760

SEQ ID NO: 461887 - RNA, 64 nt, Homo Sapiens; identical to SEQ ID NO: 108761

SEQ ID NO: 461888 - RNA, 64 nt, Homo Sapiens; identical to SEQ ID NO: 108762

SEQ ID NO: 461889 - RNA, 64 nt, Homo Sapiens; identical to SEQ ID NO: 108763

SEQ ID NO: 461890 - RNA, 64 nt, Homo Sapiens; identical to SEQ ID NO: 108764

SEQ ID NO: 461891 - RNA, 64 nt, Homo Sapiens; identical to SEQ ID NO: 108765

SEQ ID NO: 461892 - RNA, 64 nt, Homo Sapiens; identical to SEQ ID NO: 243136

SEQ ID NO: 461893 - RNA, 64 nt, Homo Sapiens; identical to SEQ ID NO: 243137

SEQ ID NO: 461894 - RNA, 64 nt, Homo Sapiens; identical to SEQ ID NO: 243138

SEQ ID NO: 461895 - RNA, 64 nt, Homo Sapiens; identical to SEQ ID NO: 243139

SEQ ID NO: 461896 - RNA, 64 nt, Homo Sapiens; identical to SEQ ID NO: 243140

SEQ ID NO: 461897 - RNA, 64 nt, Homo Sapiens; identical to SEQ ID NO: 243141

SEQ ID NO: 461898 - RNA, 64 nt, Homo Sapiens; identical to SEQ ID NO: 108616

SEQ ID NO: 461899 - RNA, 64 nt, Homo Sapiens; identical to SEQ ID NO: 108617

SEQ ID NO: 461900 - RNA, 64 nt, Homo Sapiens; identical to SEQ ID NO: 108618

SEQ ID NO: 461901 - RNA, 64 nt, Homo Sapiens; identical to SEQ ID NO: 108619

SEQ ID NO: 461902 - RNA, 64 nt, Homo Sapiens; identical to SEQ ID NO: 108620

SEQ ID NO: 461903 - RNA, 64 nt, Homo Sapiens; identical to SEQ ID NO: 108621

SEQ ID NO: 461904 - RNA, 64 nt, Homo Sapiens; identical to SEQ ID NO: 108622

SEQ ID NO: 461905 - RNA, 64 nt, Homo Sapiens; identical to SEQ ID NO: 108623

SEQ ID NO: 461906 - RNA, 61 nt, Homo Sapiens; identical to SEQ ID NO: 108624

SEQ ID NO: 461907 - RNA, 64 nt, Homo Sapiens; identical to SEQ ID NO: 108625

SEQ ID NO: 461908 - RNA, 64 nt, Homo Sapiens; identical to SEQ ID NO: 108626

SEQ ID NO: 461909 - RNA, 64 nt, Homo Sapiens; identical to SEQ ID NO: 108627

SEQ ID NO: 461910 - RNA, 64 nt, Homo Sapiens; identical to SEQ ID NO: 108628

SEQ ID NO: 461911 - RNA, 64 nt, Homo Sapiens; identical to SEQ ID NO: 108629

SEQ ID NO: 461912 - RNA, 64 nt, Homo Sapiens; identical to SEQ ID NO: 108630

SEQ ID NO: 461913 - RNA, 64 nt, Homo Sapiens; identical to SEQ ID NO: 108631

SEQ ID NO: 461914 - RNA, 64 nt, Homo Sapiens; identical to SEQ ID NO: 108632

SEQ ID NO: 461915 - RNA, 64 nt, Homo Sapiens; identical to SEQ ID NO: 108633

SEQ ID NO: 461916 - RNA, 64 nt, Homo Sapiens; identical to SEQ ID NO: 108634

SEQ ID NO: 461917 - RNA, 64 nt, Homo Sapiens; identical to SEQ ID NO: 108635

SEQ ID NO: 461918 - RNA, 64 nt, Homo Sapiens; identical to SEQ ID NO: 108636

SEQ ID NO: 461919 - RNA, 64 nt, Homo Sapiens; identical to SEQ ID NO: 108637

SEQ ID NO: 461920 - RNA, 64 nt, Homo Sapiens; identical to SEQ ID NO: 108638

SEQ ID NO: 461921 - RNA, 64 nt, Homo Sapiens; identical to SEQ ID NO: 108639

SEQ ID NO: 461922 - RNA, 64 nt, Homo Sapiens; identical to SEQ ID NO: 108640

SEQ ID NO: 461923 - RNA, 64 nt, Homo Sapiens; identical to SEQ ID NO: 108641

SEQ ID NO: 461924 - RNA, 64 nt, Homo Sapiens; identical to SEQ ID NO: 108642

SEQ ID NO: 461925 - RNA, 64 nt, Homo Sapiens; identical to SEQ ID NO: 108643

SEQ ID NO: 461926 - RNA, 64 nt, Homo Sapiens; identical to SEQ ID NO: 108644

SEQ ID NO: 461927 - RNA, 64 nt, Homo Sapiens; identical to SEQ ID NO: 108645

SEQ ID NO: 461928 - RNA, 64 nt, Homo Sapiens; identical to SEQ ID NO: 108646

SEQ ID NO: 461929 - RNA, 64 nt, Homo Sapiens; identical to SEQ ID NO: 108647

SEQ ID NO: 461930 - RNA, 64 nt, Homo Sapiens; identical to SEQ ID NO: 108648

SEQ ID NO: 461931 - RNA, 64 nt, Homo Sapiens; identical to SEQ ID NO: 108649

SEQ ID NO: 461932 - RNA, 64 nt, Homo Sapiens; identical to SEQ ID NO: 108650

SEQ ID NO: 461933 - RNA, 64 nt, Homo Sapiens; identical to SEQ ID NO: 108651

SEQ ID NO: 461934 - RNA, 64 nt, Homo Sapiens; identical to SEQ ID NO: 108652

SEQ ID NO: 461935 - RNA, 64 nt, Homo Sapiens; identical to SEQ ID NO: 108653

SEQ ID NO: 461936 - RNA, 64 nt, Homo Sapiens; identical to SEQ ID NO: 108654

SEQ ID NO: 461937 - RNA, 64 nt, Homo Sapiens; identical to SEQ ID NO: 108655

SEQ ID NO: 461938 - RNA, 64 nt, Homo Sapiens; identical to SEQ ID NO: 108656

SEQ ID NO: 461939 - RNA, 64 nt, Homo Sapiens; identical to SEQ ID NO: 108657

SEQ ID NO: 461940 - RNA, 64 nt, Homo Sapiens; identical to SEQ ID NO: 108658

SEQ ID NO: 461941 - RNA, 64 nt, Homo Sapiens; identical to SEQ ID NO: 108659

SEQ ID NO: 461942 - RNA, 64 nt, Homo Sapiens; identical to SEQ ID NO: 108660

SEQ ID NO: 461943 - RNA, 64 nt, Homo Sapiens; identical to SEQ ID NO: 108661

SEQ ID NO: 461944 - RNA, 64 nt, Homo Sapiens; identical to SEQ ID NO: 108662

SEQ ID NO: 461945 - RNA, 64 nt, Homo Sapiens; identical to SEQ ID NO: 108663

SEQ ID NO: 461946 - RNA, 64 nt, Homo Sapiens; identical to SEQ ID NO: 108664

SEQ ID NO: 461947 - RNA, 64 nt, Homo Sapiens; identical to SEQ ID NO: 108665

SEQ ID NO: 461948 - RNA, 64 nt, Homo Sapiens; identical to SEQ ID NO: 108666

SEQ ID NO: 461949 - RNA, 64 nt, Homo Sapiens; identical to SEQ ID NO: 108667

SEQ ID NO: 461950 - RNA, 64 nt, Homo Sapiens; identical to SEQ ID NO: 108668

SEQ ID NO: 461951 - RNA, 64 nt, Homo Sapiens; identical to SEQ ID NO: 108669

SEQ ID NO: 461952 - RNA, 64 nt, Homo Sapiens; identical to SEQ ID NO: 108670

SEQ ID NO: 461953 - RNA, 64 nt, Homo Sapiens; identical to SEQ ID NO: 108671

SEQ ID NO: 461954 - RNA, 64 nt, Homo Sapiens; identical to SEQ ID NO: 108672

SEQ ID NO: 461955 - RNA, 64 nt, Homo Sapiens; identical to SEQ ID NO: 108673

SEQ ID NO: 461956 - RNA, 64 nt, Homo Sapiens; identical to SEQ ID NO: 108674

SEQ ID NO: 461957 - RNA, 64 nt, Homo Sapiens; identical to SEQ ID NO: 108675

SEQ ID NO: 461958 - RNA, 64 nt, Homo Sapiens; identical to SEQ ID NO: 108676

SEQ ID NO: 461959 - RNA, 64 nt, Homo Sapiens; identical to SEQ ID NO: 108677

SEQ ID NO: 461960 - RNA, 64 nt, Homo Sapiens; identical to SEQ ID NO: 108678

SEQ ID NO: 461961 - RNA, 64 nt, Homo Sapiens; identical to SEQ ID NO: 108679

SEQ ID NO: 461962 - RNA, 64 nt, Homo Sapiens; identical to SEQ ID NO: 108680

SEQ ID NO: 461963 - RNA, 64 nt, Homo Sapiens; identical to SEQ ID NO: 108681

SEQ ID NO: 461964 - RNA, 64 nt, Homo Sapiens; identical to SEQ ID NO: 108682

SEQ ID NO: 461965 - RNA, 64 nt, Homo Sapiens; identical to SEQ ID NO: 108683

SEQ ID NO: 461966 - RNA, 64 nt, Homo Sapiens; identical to SEQ ID NO: 108684

SEQ ID NO: 461967 - RNA, 64 nt, Homo Sapiens; identical to SEQ ID NO: 108685

SEQ ID NO: 461968 - RNA, 64 nt, Homo Sapiens; identical to SEQ ID NO: 108686

SEQ ID NO: 461969 - RNA, 64 nt, Homo Sapiens; identical to SEQ ID NO: 108687

SEQ ID NO: 461970 - RNA, 64 nt, Homo Sapiens; identical to SEQ ID NO: 108688

SEQ ID NO: 461971 - RNA, 64 nt, Homo Sapiens; identical to SEQ ID NO: 108689

SEQ ID NO: 461972 - RNA, 64 nt, Homo Sapiens; identical to SEQ ID NO: 108690

SEQ ID NO: 461973 - RNA, 64 nt, Homo Sapiens; identical to SEQ ID NO: 108691

SEQ ID NO: 461974 - RNA, 64 nt, Homo Sapiens; identical to SEQ ID NO: 108692

SEQ ID NO: 461975 - RNA, 64 nt, Homo Sapiens; identical to SEQ ID NO: 108693

SEQ ID NO: 461976 - RNA, 64 nt, Homo Sapiens; identical to SEQ ID NO: 108694

SEQ ID NO: 461977 - RNA, 64 nt, Homo Sapiens; identical to SEQ ID NO: 108695

SEQ ID NO: 461978 - RNA, 64 nt, Homo Sapiens; identical to SEQ ID NO: 108696

SEQ ID NO: 461979 - RNA, 64 nt, Homo Sapiens; identical to SEQ ID NO: 108697

SEQ ID NO: 461980 - RNA, 64 nt, Homo Sapiens; identical to SEQ ID NO: 108698

SEQ ID NO: 461981 - RNA, 64 nt, Homo Sapiens; identical to SEQ ID NO: 108699

SEQ ID NO: 461982 - RNA, 64 nt, Homo Sapiens; identical to SEQ ID NO: 108700

SEQ ID NO: 461983 - RNA, 64 nt, Homo Sapiens; identical to SEQ ID NO: 108701

SEQ ID NO: 461984 - RNA, 64 nt, Homo Sapiens; identical to SEQ ID NO: 108702

SEQ ID NO: 461985 - RNA, 64 nt, Homo Sapiens; identical to SEQ ID NO: 108703

SEQ ID NO: 461986 - RNA, 64 nt, Homo Sapiens; identical to SEQ ID NO: 108704

SEQ ID NO: 461987 - RNA, 64 nt, Homo Sapiens; identical to SEQ ID NO: 108705

SEQ ID NO: 461988 - RNA, 64 nt, Homo Sapiens; identical to SEQ ID NO: 108706

SEQ ID NO: 461989 - RNA, 64 nt, Homo Sapiens; identical to SEQ ID NO: 108707

SEQ ID NO: 461990 - RNA, 64 nt, Homo Sapiens; identical to SEQ ID NO: 108708

SEQ ID NO: 461991 - RNA, 64 nt, Homo Sapiens; identical to SEQ ID NO: 108709

SEQ ID NO: 461992 - RNA, 64 nt, Homo Sapiens; identical to SEQ ID NO: 108710

SEQ ID NO: 461993 - RNA, 64 nt, Homo Sapiens; identical to SEQ ID NO: 108711

SEQ ID NO: 461994 - RNA, 64 nt, Homo Sapiens; identical to SEQ ID NO: 108712

SEQ ID NO: 461995 - RNA, 64 nt, Homo Sapiens; identical to SEQ ID NO: 108713

SEQ ID NO: 461996 - RNA, 64 nt, Homo Sapiens; identical to SEQ ID NO: 108714

SEQ ID NO: 461997 - RNA, 64 nt, Homo Sapiens; identical to SEQ ID NO: 108715

SEQ ID NO: 461998 - RNA, 64 nt, Homo Sapiens; identical to SEQ ID NO: 108716

SEQ ID NO: 461999 - RNA, 64 nt, Homo Sapiens; identical to SEQ ID NO: 108717

SEQ ID NO: 462000 - RNA, 64 nt, Homo Sapiens; identical to SEQ ID NO: 108718

SEQ ID NO: 462001 - RNA, 64 nt, Homo Sapiens; identical to SEQ ID NO: 108719

SEQ ID NO: 462002 - RNA, 64 nt, Homo Sapiens; identical to SEQ ID NO: 108720

SEQ ID NO: 462003 - RNA, 64 nt, Homo Sapiens; identical to SEQ ID NO: 108721

SEQ ID NO: 462004 - RNA, 64 nt, Homo Sapiens; identical to SEQ ID NO: 108722

SEQ ID NO: 462005 - RNA, 64 nt, Homo Sapiens; identical to SEQ ID NO: 108723

SEQ ID NO: 462006 - RNA, 64 nt, Homo Sapiens; identical to SEQ ID NO: 108724

SEQ ID NO: 462007 - RNA, 64 nt, Homo Sapiens; identical to SEQ ID NO: 108725

SEQ ID NO: 462008 - RNA, 64 nt, Homo Sapiens; identical to SEQ ID NO: 108726

SEQ ID NO: 462009 - RNA, 64 nt, Homo Sapiens; identical to SEQ ID NO: 108727

SEQ ID NO: 462010 - RNA, 64 nt, Homo Sapiens; identical to SEQ ID NO: 108728

SEQ ID NO: 462011 - RNA, 64 nt, Homo Sapiens; identical to SEQ ID NO: 108729

SEQ ID NO: 462012 - RNA, 64 nt, Homo Sapiens; identical to SEQ ID NO: 108730

SEQ ID NO: 462013 - RNA, 64 nt, Homo Sapiens; identical to SEQ ID NO: 108731

SEQ ID NO: 462014 - RNA, 64 nt, Homo Sapiens; identical to SEQ ID NO: 108732

SEQ ID NO: 462015 - RNA, 64 nt, Homo Sapiens; identical to SEQ ID NO: 108733

SEQ ID NO: 462016 - RNA, 64 nt, Homo Sapiens; identical to SEQ ID NO: 108734

SEQ ID NO: 462017 - RNA, 64 nt, Homo Sapiens; identical to SEQ ID NO: 108735

SEQ ID NO: 462018 - RNA, 64 nt, Homo Sapiens; identical to SEQ ID NO: 108736

SEQ ID NO: 462019 - RNA, 64 nt, Homo Sapiens; identical to SEQ ID NO: 108737

SEQ ID NO: 462020 - RNA, 64 nt, Homo Sapiens; identical to SEQ ID NO: 108738

SEQ ID NO: 462021 - RNA, 64 nt, Homo Sapiens; identical to SEQ ID NO: 108739

SEQ ID NO: 462022 - RNA, 64 nt, Homo Sapiens; identical to SEQ ID NO: 108740

SEQ ID NO: 462023 - RNA, 64 nt, Homo Sapiens; identical to SEQ ID NO: 108741

SEQ ID NO: 462024 - RNA, 64 nt, Homo Sapiens; identical to SEQ ID NO: 108742

SEQ ID NO: 462025 - RNA, 64 nt, Homo Sapiens; identical to SEQ ID NO: 108743

SEQ ID NO: 462026 - RNA, 64 nt, Homo Sapiens; identical to SEQ ID NO: 108744

SEQ ID NO: 462027 - RNA, 64 nt, Homo Sapiens; identical to SEQ ID NO: 108745

SEQ ID NO: 462028 - RNA, 64 nt, Homo Sapiens; identical to SEQ ID NO: 108746

SEQ ID NO: 462029 - RNA, 64 nt, Homo Sapiens; identical to SEQ ID NO: 108747

SEQ ID NO: 462030 - RNA, 64 nt, Homo Sapiens; identical to SEQ ID NO: 108748

SEQ ID NO: 462031 - RNA, 64 nt, Homo Sapiens; identical to SEQ ID NO: 108749

SEQ ID NO: 462032 - RNA, 64 nt, Homo Sapiens; identical to SEQ ID NO: 108750

SEQ ID NO: 462033 - RNA, 64 nt, Homo Sapiens; identical to SEQ ID NO: 108751

SEQ ID NO: 462034 - RNA, 64 nt, Homo Sapiens; identical to SEQ ID NO: 108752

SEQ ID NO: 462035 - RNA, 64 nt, Homo Sapiens; identical to SEQ ID NO: 108753

SEQ ID NO: 462036 - RNA, 64 nt, Homo Sapiens; identical to SEQ ID NO: 108754

SEQ ID NO: 462037 - RNA, 64 nt, Homo Sapiens; identical to SEQ ID NO: 108755

SEQ ID NO: 462038 - RNA, 64 nt, Homo Sapiens; identical to SEQ ID NO: 108756

SEQ ID NO: 462039 - RNA, 64 nt, Homo Sapiens; identical to SEQ ID NO: 108757

SEQ ID NO: 462040 - RNA, 64 nt, Homo Sapiens; identical to SEQ ID NO: 108758

SEQ ID NO: 462041 - RNA, 64 nt, Homo Sapiens; identical to SEQ ID NO: 108759

SEQ ID NO: 462042 - RNA, 64 nt, Homo Sapiens; identical to SEQ ID NO: 108760

SEQ ID NO: 462043 - RNA, 64 nt, Homo Sapiens; identical to SEQ ID NO: 108761

SEQ ID NO: 462044 - RNA, 64 nt, Homo Sapiens; identical to SEQ ID NO: 108762

SEQ ID NO: 462045 - RNA, 64 nt, Homo Sapiens; identical to SEQ ID NO: 108763

SEQ ID NO: 462046 - RNA, 64 nt, Homo Sapiens; identical to SEQ ID NO: 108764

SEQ ID NO: 462047 - RNA, 64 nt, Homo Sapiens; identical to SEQ ID NO: 108765

SEQ ID NO: 462048 - RNA, 64 nt, Homo Sapiens; identical to SEQ ID NO: 243136

SEQ ID NO: 462049 - RNA, 64 nt, Homo Sapiens; identical to SEQ ID NO: 243137

SEQ ID NO: 462050 - RNA, 64 nt, Homo Sapiens; identical to SEQ ID NO: 243138

SEQ ID NO: 462051 - RNA, 64 nt, Homo Sapiens; identical to SEQ ID NO: 243139

SEQ ID NO: 462052 - RNA, 64 nt, Homo Sapiens; identical to SEQ ID NO: 243140

SEQ ID NO: 462053 - RNA, 64 nt, Homo Sapiens; identical to SEQ ID NO: 243141

SEQ ID NO: 462054 - RNA, 64 nt, Homo Sapiens; identical to SEQ ID NO: 108616

SEQ ID NO: 462055 - RNA, 64 nt, Homo Sapiens; identical to SEQ ID NO: 108617

SEQ ID NO: 462056 - RNA, 64 nt, Homo Sapiens; identical to SEQ ID NO: 108618

SEQ ID NO: 462057 - RNA, 64 nt, Homo Sapiens; identical to SEQ ID NO: 108619

SEQ ID NO: 462058 - RNA, 64 nt, Homo Sapiens; identical to SEQ ID NO: 108620

SEQ ID NO: 462059 - RNA, 64 nt, Homo Sapiens; identical to SEQ ID NO: 108621

SEQ ID NO: 462060 - RNA, 64 nt, Homo Sapiens; identical to SEQ ID NO: 108622

SEQ ID NO: 462061 - RNA, 64 nt, Homo Sapiens; identical to SEQ ID NO: 108623

SEQ ID NO: 462062 - RNA, 61 nt, Homo Sapiens; identical to SEQ ID NO: 108624

SEQ ID NO: 462063 - RNA, 64 nt, Homo Sapiens; identical to SEQ ID NO: 108625

SEQ ID NO: 462064 - RNA, 64 nt, Homo Sapiens; identical to SEQ ID NO: 108626

SEQ ID NO: 462065 - RNA, 64 nt, Homo Sapiens; identical to SEQ ID NO: 108627

SEQ ID NO: 462066 - RNA, 64 nt, Homo Sapiens; identical to SEQ ID NO: 108628

SEQ ID NO: 462067 - RNA, 64 nt, Homo Sapiens; identical to SEQ ID NO: 108629

SEQ ID NO: 462068 - RNA, 64 nt, Homo Sapiens; identical to SEQ ID NO: 108630

SEQ ID NO: 462069 - RNA, 64 nt, Homo Sapiens; identical to SEQ ID NO: 108631

SEQ ID NO: 462070 - RNA, 64 nt, Homo Sapiens; identical to SEQ ID NO: 108632

SEQ ID NO: 462071 - RNA, 64 nt, Homo Sapiens; identical to SEQ ID NO: 108633

SEQ ID NO: 462072 - RNA, 64 nt, Homo Sapiens; identical to SEQ ID NO: 108634

SEQ ID NO: 462073 - RNA, 64 nt, Homo Sapiens; identical to SEQ ID NO: 108635

SEQ ID NO: 462074 - RNA, 64 nt, Homo Sapiens; identical to SEQ ID NO: 108636

SEQ ID NO: 462075 - RNA, 64 nt, Homo Sapiens; identical to SEQ ID NO: 108637

SEQ ID NO: 462076 - RNA, 64 nt, Homo Sapiens; identical to SEQ ID NO: 108638

SEQ ID NO: 462077 - RNA, 64 nt, Homo Sapiens; identical to SEQ ID NO: 108639

SEQ ID NO: 462078 - RNA, 64 nt, Homo Sapiens; identical to SEQ ID NO: 108640

SEQ ID NO: 462079 - RNA, 64 nt, Homo Sapiens; identical to SEQ ID NO: 108641

SEQ ID NO: 462080 - RNA, 64 nt, Homo Sapiens; identical to SEQ ID NO: 108642

SEQ ID NO: 462081 - RNA, 64 nt, Homo Sapiens; identical to SEQ ID NO: 108643

SEQ ID NO: 462082 - RNA, 64 nt, Homo Sapiens; identical to SEQ ID NO: 108644

SEQ ID NO: 462083 - RNA, 64 nt, Homo Sapiens; identical to SEQ ID NO: 108645

SEQ ID NO: 462084 - RNA, 64 nt, Homo Sapiens; identical to SEQ ID NO: 108646

SEQ ID NO: 462085 - RNA, 64 nt, Homo Sapiens; identical to SEQ ID NO: 108647

SEQ ID NO: 462086 - RNA, 64 nt, Homo Sapiens; identical to SEQ ID NO: 108648

SEQ ID NO: 462087 - RNA, 64 nt, Homo Sapiens; identical to SEQ ID NO: 108649

SEQ ID NO: 462088 - RNA, 64 nt, Homo Sapiens; identical to SEQ ID NO: 108650

SEQ ID NO: 462089 - RNA, 64 nt, Homo Sapiens; identical to SEQ ID NO: 108651

SEQ ID NO: 462090 - RNA, 64 nt, Homo Sapiens; identical to SEQ ID NO: 108652

SEQ ID NO: 462091 - RNA, 64 nt, Homo Sapiens; identical to SEQ ID NO: 108653

SEQ ID NO: 462092 - RNA, 64 nt, Homo Sapiens; identical to SEQ ID NO: 108654

SEQ ID NO: 462093 - RNA, 64 nt, Homo Sapiens; identical to SEQ ID NO: 108655

SEQ ID NO: 462094 - RNA, 64 nt, Homo Sapiens; identical to SEQ ID NO: 108656

SEQ ID NO: 462095 - RNA, 64 nt, Homo Sapiens; identical to SEQ ID NO: 108657

SEQ ID NO: 462096 - RNA, 64 nt, Homo Sapiens; identical to SEQ ID NO: 108658

SEQ ID NO: 462097 - RNA, 64 nt, Homo Sapiens; identical to SEQ ID NO: 108659

SEQ ID NO: 462098 - RNA, 64 nt, Homo Sapiens; identical to SEQ ID NO: 108660

SEQ ID NO: 462099 - RNA, 64 nt, Homo Sapiens; identical to SEQ ID NO: 108661

SEQ ID NO: 462100 - RNA, 64 nt, Homo Sapiens; identical to SEQ ID NO: 108662

SEQ ID NO: 462101 - RNA, 64 nt, Homo Sapiens; identical to SEQ ID NO: 108663

SEQ ID NO: 462102 - RNA, 64 nt, Homo Sapiens; identical to SEQ ID NO: 108664

SEQ ID NO: 462103 - RNA, 64 nt, Homo Sapiens; identical to SEQ ID NO: 108665

SEQ ID NO: 462104 - RNA, 64 nt, Homo Sapiens; identical to SEQ ID NO: 108666

SEQ ID NO: 462105 - RNA, 64 nt, Homo Sapiens; identical to SEQ ID NO: 108667

SEQ ID NO: 462106 - RNA, 64 nt, Homo Sapiens; identical to SEQ ID NO: 108668

SEQ ID NO: 462107 - RNA, 64 nt, Homo Sapiens; identical to SEQ ID NO: 108669

SEQ ID NO: 462108 - RNA, 64 nt, Homo Sapiens; identical to SEQ ID NO: 108670

SEQ ID NO: 462109 - RNA, 64 nt, Homo Sapiens; identical to SEQ ID NO: 108671

SEQ ID NO: 462110 - RNA, 64 nt, Homo Sapiens; identical to SEQ ID NO: 108672

SEQ ID NO: 462111 - RNA, 64 nt, Homo Sapiens; identical to SEQ ID NO: 108673

SEQ ID NO: 462112 - RNA, 64 nt, Homo Sapiens; identical to SEQ ID NO: 108674

SEQ ID NO: 462113 - RNA, 64 nt, Homo Sapiens; identical to SEQ ID NO: 108675

SEQ ID NO: 462114 - RNA, 64 nt, Homo Sapiens; identical to SEQ ID NO: 108676

SEQ ID NO: 462115 - RNA, 64 nt, Homo Sapiens; identical to SEQ ID NO: 108677

SEQ ID NO: 462116 - RNA, 64 nt, Homo Sapiens; identical to SEQ ID NO: 108678

SEQ ID NO: 462117 - RNA, 64 nt, Homo Sapiens; identical to SEQ ID NO: 108679

SEQ ID NO: 462118 - RNA, 64 nt, Homo Sapiens; identical to SEQ ID NO: 108680

SEQ ID NO: 462119 - RNA, 64 nt, Homo Sapiens; identical to SEQ ID NO: 108681

SEQ ID NO: 462120 - RNA, 64 nt, Homo Sapiens; identical to SEQ ID NO: 108682

SEQ ID NO: 462121 - RNA, 64 nt, Homo Sapiens; identical to SEQ ID NO: 108683

SEQ ID NO: 462122 - RNA, 64 nt, Homo Sapiens; identical to SEQ ID NO: 108684

SEQ ID NO: 462123 - RNA, 64 nt, Homo Sapiens; identical to SEQ ID NO: 108685

SEQ ID NO: 462124 - RNA, 64 nt, Homo Sapiens; identical to SEQ ID NO: 108686

SEQ ID NO: 462125 - RNA, 64 nt, Homo Sapiens; identical to SEQ ID NO: 108687

SEQ ID NO: 462126 - RNA, 64 nt, Homo Sapiens; identical to SEQ ID NO: 108688

SEQ ID NO: 462127 - RNA, 64 nt, Homo Sapiens; identical to SEQ ID NO: 108689

SEQ ID NO: 462128 - RNA, 64 nt, Homo Sapiens; identical to SEQ ID NO: 108690

SEQ ID NO: 462129 - RNA, 64 nt, Homo Sapiens; identical to SEQ ID NO: 108691

SEQ ID NO: 462130 - RNA, 64 nt, Homo Sapiens; identical to SEQ ID NO: 108692

SEQ ID NO: 462131 - RNA, 64 nt, Homo Sapiens; identical to SEQ ID NO: 108693

SEQ ID NO: 462132 - RNA, 64 nt, Homo Sapiens; identical to SEQ ID NO: 108694

SEQ ID NO: 462133 - RNA, 64 nt, Homo Sapiens; identical to SEQ ID NO: 108695

SEQ ID NO: 462134 - RNA, 64 nt, Homo Sapiens; identical to SEQ ID NO: 108696

SEQ ID NO: 462135 - RNA, 64 nt, Homo Sapiens; identical to SEQ ID NO: 108697

SEQ ID NO: 462136 - RNA, 64 nt, Homo Sapiens; identical to SEQ ID NO: 108698

SEQ ID NO: 462137 - RNA, 64 nt, Homo Sapiens; identical to SEQ ID NO: 108699

SEQ ID NO: 462138 - RNA, 64 nt, Homo Sapiens; identical to SEQ ID NO: 108700

SEQ ID NO: 462139 - RNA, 64 nt, Homo Sapiens; identical to SEQ ID NO: 108701

SEQ ID NO: 462140 - RNA, 64 nt, Homo Sapiens; identical to SEQ ID NO: 108702

SEQ ID NO: 462141 - RNA, 64 nt, Homo Sapiens; identical to SEQ ID NO: 108703

SEQ ID NO: 462142 - RNA, 64 nt, Homo Sapiens; identical to SEQ ID NO: 108704

SEQ ID NO: 462143 - RNA, 64 nt, Homo Sapiens; identical to SEQ ID NO: 108705

SEQ ID NO: 462144 - RNA, 64 nt, Homo Sapiens; identical to SEQ ID NO: 108706

SEQ ID NO: 462145 - RNA, 64 nt, Homo Sapiens; identical to SEQ ID NO: 108707

SEQ ID NO: 462146 - RNA, 64 nt, Homo Sapiens; identical to SEQ ID NO: 108708

SEQ ID NO: 462147 - RNA, 64 nt, Homo Sapiens; identical to SEQ ID NO: 108709

SEQ ID NO: 462148 - RNA, 64 nt, Homo Sapiens; identical to SEQ ID NO: 108710

SEQ ID NO: 462149 - RNA, 64 nt, Homo Sapiens; identical to SEQ ID NO: 108711

SEQ ID NO: 462150 - RNA, 64 nt, Homo Sapiens; identical to SEQ ID NO: 108712

SEQ ID NO: 462151 - RNA, 64 nt, Homo Sapiens; identical to SEQ ID NO: 108713

SEQ ID NO: 462152 - RNA, 64 nt, Homo Sapiens; identical to SEQ ID NO: 108714

SEQ ID NO: 462153 - RNA, 64 nt, Homo Sapiens; identical to SEQ ID NO: 108715

SEQ ID NO: 462154 - RNA, 64 nt, Homo Sapiens; identical to SEQ ID NO: 108716

SEQ ID NO: 462155 - RNA, 64 nt, Homo Sapiens; identical to SEQ ID NO: 108717

SEQ ID NO: 462156 - RNA, 64 nt, Homo Sapiens; identical to SEQ ID NO: 108718

SEQ ID NO: 462157 - RNA, 64 nt, Homo Sapiens; identical to SEQ ID NO: 108719

SEQ ID NO: 462158 - RNA, 64 nt, Homo Sapiens; identical to SEQ ID NO: 108720

SEQ ID NO: 462159 - RNA, 64 nt, Homo Sapiens; identical to SEQ ID NO: 108721

SEQ ID NO: 462160 - RNA, 64 nt, Homo Sapiens; identical to SEQ ID NO: 108722

SEQ ID NO: 462161 - RNA, 64 nt, Homo Sapiens; identical to SEQ ID NO: 108723

SEQ ID NO: 462162 - RNA, 64 nt, Homo Sapiens; identical to SEQ ID NO: 108724

SEQ ID NO: 462163 - RNA, 64 nt, Homo Sapiens; identical to SEQ ID NO: 108725

SEQ ID NO: 462164 - RNA, 64 nt, Homo Sapiens; identical to SEQ ID NO: 108726

SEQ ID NO: 462165 - RNA, 64 nt, Homo Sapiens; identical to SEQ ID NO: 108727

SEQ ID NO: 462166 - RNA, 64 nt, Homo Sapiens; identical to SEQ ID NO: 108728

SEQ ID NO: 462167 - RNA, 64 nt, Homo Sapiens; identical to SEQ ID NO: 108729

SEQ ID NO: 462168 - RNA, 64 nt, Homo Sapiens; identical to SEQ ID NO: 108730

SEQ ID NO: 462169 - RNA, 64 nt, Homo Sapiens; identical to SEQ ID NO: 108731

SEQ ID NO: 462170 - RNA, 64 nt, Homo Sapiens; identical to SEQ ID NO: 108732

SEQ ID NO: 462171 - RNA, 64 nt, Homo Sapiens; identical to SEQ ID NO: 108733

SEQ ID NO: 462172 - RNA, 64 nt, Homo Sapiens; identical to SEQ ID NO: 108734

SEQ ID NO: 462173 - RNA, 64 nt, Homo Sapiens; identical to SEQ ID NO: 108735

SEQ ID NO: 462174 - RNA, 64 nt, Homo Sapiens; identical to SEQ ID NO: 108736

SEQ ID NO: 462175 - RNA, 64 nt, Homo Sapiens; identical to SEQ ID NO: 108737

SEQ ID NO: 462176 - RNA, 64 nt, Homo Sapiens; identical to SEQ ID NO: 108738

SEQ ID NO: 462177 - RNA, 64 nt, Homo Sapiens; identical to SEQ ID NO: 108739

SEQ ID NO: 462178 - RNA, 64 nt, Homo Sapiens; identical to SEQ ID NO: 108740

SEQ ID NO: 462179 - RNA, 64 nt, Homo Sapiens; identical to SEQ ID NO: 108741

SEQ ID NO: 462180 - RNA, 64 nt, Homo Sapiens; identical to SEQ ID NO: 108742

SEQ ID NO: 462181 - RNA, 64 nt, Homo Sapiens; identical to SEQ ID NO: 108743

SEQ ID NO: 462182 - RNA, 64 nt, Homo Sapiens; identical to SEQ ID NO: 108744

SEQ ID NO: 462183 - RNA, 64 nt, Homo Sapiens; identical to SEQ ID NO: 108745

SEQ ID NO: 462184 - RNA, 64 nt, Homo Sapiens; identical to SEQ ID NO: 108746

SEQ ID NO: 462185 - RNA, 64 nt, Homo Sapiens; identical to SEQ ID NO: 108747

SEQ ID NO: 462186 - RNA, 64 nt, Homo Sapiens; identical to SEQ ID NO: 108748

SEQ ID NO: 462187 - RNA, 64 nt, Homo Sapiens; identical to SEQ ID NO: 108749

SEQ ID NO: 462188 - RNA, 64 nt, Homo Sapiens; identical to SEQ ID NO: 108750

SEQ ID NO: 462189 - RNA, 64 nt, Homo Sapiens; identical to SEQ ID NO: 108751

SEQ ID NO: 462190 - RNA, 64 nt, Homo Sapiens; identical to SEQ ID NO: 108752

SEQ ID NO: 462191 - RNA, 64 nt, Homo Sapiens; identical to SEQ ID NO: 108753

SEQ ID NO: 462192 - RNA, 64 nt, Homo Sapiens; identical to SEQ ID NO: 108754

SEQ ID NO: 462193 - RNA, 64 nt, Homo Sapiens; identical to SEQ ID NO: 108755

SEQ ID NO: 462194 - RNA, 64 nt, Homo Sapiens; identical to SEQ ID NO: 108756

SEQ ID NO: 462195 - RNA, 64 nt, Homo Sapiens; identical to SEQ ID NO: 108757

SEQ ID NO: 462196 - RNA, 64 nt, Homo Sapiens; identical to SEQ ID NO: 108758

SEQ ID NO: 462197 - RNA, 64 nt, Homo Sapiens; identical to SEQ ID NO: 108759

SEQ ID NO: 462198 - RNA, 64 nt, Homo Sapiens; identical to SEQ ID NO: 108760

SEQ ID NO: 462199 - RNA, 64 nt, Homo Sapiens; identical to SEQ ID NO: 108761

SEQ ID NO: 462200 - RNA, 64 nt, Homo Sapiens; identical to SEQ ID NO: 108762

SEQ ID NO: 462201 - RNA, 64 nt, Homo Sapiens; identical to SEQ ID NO: 108763

SEQ ID NO: 462202 - RNA, 64 nt, Homo Sapiens; identical to SEQ ID NO: 108764

SEQ ID NO: 462203 - RNA, 64 nt, Homo Sapiens; identical to SEQ ID NO: 108765

SEQ ID NO: 462204 - RNA, 64 nt, Homo Sapiens; identical to SEQ ID NO: 243136

SEQ ID NO: 462205 - RNA, 64 nt, Homo Sapiens; identical to SEQ ID NO: 243137

SEQ ID NO: 462206 - RNA, 64 nt, Homo Sapiens; identical to SEQ ID NO: 243138

SEQ ID NO: 462207 - RNA, 64 nt, Homo Sapiens; identical to SEQ ID NO: 243139

SEQ ID NO: 462208 - RNA, 64 nt, Homo Sapiens; identical to SEQ ID NO: 243140

SEQ ID NO: 462209 - RNA, 64 nt, Homo Sapiens; identical to SEQ ID NO: 243141

SEQ ID NO: 462210 - RNA, 64 nt, Homo Sapiens; identical to SEQ ID NO: 108616

SEQ ID NO: 462211 - RNA, 64 nt, Homo Sapiens; identical to SEQ ID NO: 108617

SEQ ID NO: 462212 - RNA, 64 nt, Homo Sapiens; identical to SEQ ID NO: 108618

SEQ ID NO: 462213 - RNA, 64 nt, Homo Sapiens; identical to SEQ ID NO: 108619

SEQ ID NO: 462214 - RNA, 64 nt, Homo Sapiens; identical to SEQ ID NO: 108620

SEQ ID NO: 462215 - RNA, 64 nt, Homo Sapiens; identical to SEQ ID NO: 108621

SEQ ID NO: 462216 - RNA, 64 nt, Homo Sapiens; identical to SEQ ID NO: 108622

SEQ ID NO: 462217 - RNA, 64 nt, Homo Sapiens; identical to SEQ ID NO: 108623

SEQ ID NO: 462218 - RNA, 61 nt, Homo Sapiens; identical to SEQ ID NO: 108624

SEQ ID NO: 462219 - RNA, 64 nt, Homo Sapiens; identical to SEQ ID NO: 108625

SEQ ID NO: 462220 - RNA, 64 nt, Homo Sapiens; identical to SEQ ID NO: 108626

SEQ ID NO: 462221 - RNA, 64 nt, Homo Sapiens; identical to SEQ ID NO: 108627

SEQ ID NO: 462222 - RNA, 64 nt, Homo Sapiens; identical to SEQ ID NO: 108628

SEQ ID NO: 462223 - RNA, 64 nt, Homo Sapiens; identical to SEQ ID NO: 108629

SEQ ID NO: 462224 - RNA, 64 nt, Homo Sapiens; identical to SEQ ID NO: 108630

SEQ ID NO: 462225 - RNA, 64 nt, Homo Sapiens; identical to SEQ ID NO: 108631

SEQ ID NO: 462226 - RNA, 64 nt, Homo Sapiens; identical to SEQ ID NO: 108632

SEQ ID NO: 462227 - RNA, 64 nt, Homo Sapiens; identical to SEQ ID NO: 108633

SEQ ID NO: 462228 - RNA, 64 nt, Homo Sapiens; identical to SEQ ID NO: 108634

SEQ ID NO: 462229 - RNA, 64 nt, Homo Sapiens; identical to SEQ ID NO: 108635

SEQ ID NO: 462230 - RNA, 64 nt, Homo Sapiens; identical to SEQ ID NO: 108636

SEQ ID NO: 462231 - RNA, 64 nt, Homo Sapiens; identical to SEQ ID NO: 108637

SEQ ID NO: 462232 - RNA, 64 nt, Homo Sapiens; identical to SEQ ID NO: 108638

SEQ ID NO: 462233 - RNA, 64 nt, Homo Sapiens; identical to SEQ ID NO: 108639

SEQ ID NO: 462234 - RNA, 64 nt, Homo Sapiens; identical to SEQ ID NO: 108640

SEQ ID NO: 462235 - RNA, 64 nt, Homo Sapiens; identical to SEQ ID NO: 108641

SEQ ID NO: 462236 - RNA, 64 nt, Homo Sapiens; identical to SEQ ID NO: 108642

SEQ ID NO: 462237 - RNA, 64 nt, Homo Sapiens; identical to SEQ ID NO: 108643

SEQ ID NO: 462238 - RNA, 64 nt, Homo Sapiens; identical to SEQ ID NO: 108644

SEQ ID NO: 462239 - RNA, 64 nt, Homo Sapiens; identical to SEQ ID NO: 108645

SEQ ID NO: 462240 - RNA, 64 nt, Homo Sapiens; identical to SEQ ID NO: 108646

SEQ ID NO: 462241 - RNA, 64 nt, Homo Sapiens; identical to SEQ ID NO: 108647

SEQ ID NO: 462242 - RNA, 64 nt, Homo Sapiens; identical to SEQ ID NO: 108648

SEQ ID NO: 462243 - RNA, 64 nt, Homo Sapiens; identical to SEQ ID NO: 108649

SEQ ID NO: 462244 - RNA, 64 nt, Homo Sapiens; identical to SEQ ID NO: 108650

SEQ ID NO: 462245 - RNA, 64 nt, Homo Sapiens; identical to SEQ ID NO: 108651

SEQ ID NO: 462246 - RNA, 64 nt, Homo Sapiens; identical to SEQ ID NO: 108652

SEQ ID NO: 462247 - RNA, 64 nt, Homo Sapiens; identical to SEQ ID NO: 108653

SEQ ID NO: 462248 - RNA, 64 nt, Homo Sapiens; identical to SEQ ID NO: 108654

SEQ ID NO: 462249 - RNA, 64 nt, Homo Sapiens; identical to SEQ ID NO: 108655

SEQ ID NO: 462250 - RNA, 64 nt, Homo Sapiens; identical to SEQ ID NO: 108656

SEQ ID NO: 462251 - RNA, 64 nt, Homo Sapiens; identical to SEQ ID NO: 108657

SEQ ID NO: 462252 - RNA, 64 nt, Homo Sapiens; identical to SEQ ID NO: 108658

SEQ ID NO: 462253 - RNA, 64 nt, Homo Sapiens; identical to SEQ ID NO: 108659

SEQ ID NO: 462254 - RNA, 64 nt, Homo Sapiens; identical to SEQ ID NO: 108660

SEQ ID NO: 462255 - RNA, 64 nt, Homo Sapiens; identical to SEQ ID NO: 108661

SEQ ID NO: 462256 - RNA, 64 nt, Homo Sapiens; identical to SEQ ID NO: 108662

SEQ ID NO: 462257 - RNA, 64 nt, Homo Sapiens; identical to SEQ ID NO: 108663

SEQ ID NO: 462258 - RNA, 64 nt, Homo Sapiens; identical to SEQ ID NO: 108664

SEQ ID NO: 462259 - RNA, 64 nt, Homo Sapiens; identical to SEQ ID NO: 108665

SEQ ID NO: 462260 - RNA, 64 nt, Homo Sapiens; identical to SEQ ID NO: 108666

SEQ ID NO: 462261 - RNA, 64 nt, Homo Sapiens; identical to SEQ ID NO: 108667

SEQ ID NO: 462262 - RNA, 64 nt, Homo Sapiens; identical to SEQ ID NO: 108668

SEQ ID NO: 462263 - RNA, 64 nt, Homo Sapiens; identical to SEQ ID NO: 108669

SEQ ID NO: 462264 - RNA, 64 nt, Homo Sapiens; identical to SEQ ID NO: 108670

SEQ ID NO: 462265 - RNA, 64 nt, Homo Sapiens; identical to SEQ ID NO: 108671

SEQ ID NO: 462266 - RNA, 64 nt, Homo Sapiens; identical to SEQ ID NO: 108672

SEQ ID NO: 462267 - RNA, 64 nt, Homo Sapiens; identical to SEQ ID NO: 108673

SEQ ID NO: 462268 - RNA, 64 nt, Homo Sapiens; identical to SEQ ID NO: 108674

SEQ ID NO: 462269 - RNA, 64 nt, Homo Sapiens; identical to SEQ ID NO: 108675

SEQ ID NO: 462270 - RNA, 64 nt, Homo Sapiens; identical to SEQ ID NO: 108676

SEQ ID NO: 462271 - RNA, 64 nt, Homo Sapiens; identical to SEQ ID NO: 108677

SEQ ID NO: 462272 - RNA, 64 nt, Homo Sapiens; identical to SEQ ID NO: 108678

SEQ ID NO: 462273 - RNA, 64 nt, Homo Sapiens; identical to SEQ ID NO: 108679

SEQ ID NO: 462274 - RNA, 64 nt, Homo Sapiens; identical to SEQ ID NO: 108680

SEQ ID NO: 462275 - RNA, 64 nt, Homo Sapiens; identical to SEQ ID NO: 108681

SEQ ID NO: 462276 - RNA, 64 nt, Homo Sapiens; identical to SEQ ID NO: 108682

SEQ ID NO: 462277 - RNA, 64 nt, Homo Sapiens; identical to SEQ ID NO: 108683

SEQ ID NO: 462278 - RNA, 64 nt, Homo Sapiens; identical to SEQ ID NO: 108684

SEQ ID NO: 462279 - RNA, 64 nt, Homo Sapiens; identical to SEQ ID NO: 108685

SEQ ID NO: 462280 - RNA, 64 nt, Homo Sapiens; identical to SEQ ID NO: 108686

SEQ ID NO: 462281 - RNA, 64 nt, Homo Sapiens; identical to SEQ ID NO: 108687

SEQ ID NO: 462282 - RNA, 64 nt, Homo Sapiens; identical to SEQ ID NO: 108688

SEQ ID NO: 462283 - RNA, 64 nt, Homo Sapiens; identical to SEQ ID NO: 108689

SEQ ID NO: 462284 - RNA, 64 nt, Homo Sapiens; identical to SEQ ID NO: 108690

SEQ ID NO: 462285 - RNA, 64 nt, Homo Sapiens; identical to SEQ ID NO: 108691

SEQ ID NO: 462286 - RNA, 64 nt, Homo Sapiens; identical to SEQ ID NO: 108692

SEQ ID NO: 462287 - RNA, 64 nt, Homo Sapiens; identical to SEQ ID NO: 108693

SEQ ID NO: 462288 - RNA, 64 nt, Homo Sapiens; identical to SEQ ID NO: 108694

SEQ ID NO: 462289 - RNA, 64 nt, Homo Sapiens; identical to SEQ ID NO: 108695

SEQ ID NO: 462290 - RNA, 64 nt, Homo Sapiens; identical to SEQ ID NO: 108696

SEQ ID NO: 462291 - RNA, 64 nt, Homo Sapiens; identical to SEQ ID NO: 108697

SEQ ID NO: 462292 - RNA, 64 nt, Homo Sapiens; identical to SEQ ID NO: 108698

SEQ ID NO: 462293 - RNA, 64 nt, Homo Sapiens; identical to SEQ ID NO: 108699

SEQ ID NO: 462294 - RNA, 64 nt, Homo Sapiens; identical to SEQ ID NO: 108700

SEQ ID NO: 462295 - RNA, 64 nt, Homo Sapiens; identical to SEQ ID NO: 108701

SEQ ID NO: 462296 - RNA, 64 nt, Homo Sapiens; identical to SEQ ID NO: 108702

SEQ ID NO: 462297 - RNA, 64 nt, Homo Sapiens; identical to SEQ ID NO: 108703

SEQ ID NO: 462298 - RNA, 64 nt, Homo Sapiens; identical to SEQ ID NO: 108704

SEQ ID NO: 462299 - RNA, 64 nt, Homo Sapiens; identical to SEQ ID NO: 108705

SEQ ID NO: 462300 - RNA, 64 nt, Homo Sapiens; identical to SEQ ID NO: 108706

SEQ ID NO: 462301 - RNA, 64 nt, Homo Sapiens; identical to SEQ ID NO: 108707

SEQ ID NO: 462302 - RNA, 64 nt, Homo Sapiens; identical to SEQ ID NO: 108708

SEQ ID NO: 462303 - RNA, 64 nt, Homo Sapiens; identical to SEQ ID NO: 108709

SEQ ID NO: 462304 - RNA, 64 nt, Homo Sapiens; identical to SEQ ID NO: 108710

SEQ ID NO: 462305 - RNA, 64 nt, Homo Sapiens; identical to SEQ ID NO: 108711

SEQ ID NO: 462306 - RNA, 64 nt, Homo Sapiens; identical to SEQ ID NO: 108712

SEQ ID NO: 462307 - RNA, 64 nt, Homo Sapiens; identical to SEQ ID NO: 108713

SEQ ID NO: 462308 - RNA, 64 nt, Homo Sapiens; identical to SEQ ID NO: 108714

SEQ ID NO: 462309 - RNA, 64 nt, Homo Sapiens; identical to SEQ ID NO: 108715

SEQ ID NO: 462310 - RNA, 64 nt, Homo Sapiens; identical to SEQ ID NO: 108716

SEQ ID NO: 462311 - RNA, 64 nt, Homo Sapiens; identical to SEQ ID NO: 108717

SEQ ID NO: 462312 - RNA, 64 nt, Homo Sapiens; identical to SEQ ID NO: 108718

SEQ ID NO: 462313 - RNA, 64 nt, Homo Sapiens; identical to SEQ ID NO: 108719

SEQ ID NO: 462314 - RNA, 64 nt, Homo Sapiens; identical to SEQ ID NO: 108720

SEQ ID NO: 462315 - RNA, 64 nt, Homo Sapiens; identical to SEQ ID NO: 108721

SEQ ID NO: 462316 - RNA, 64 nt, Homo Sapiens; identical to SEQ ID NO: 108722

SEQ ID NO: 462317 - RNA, 64 nt, Homo Sapiens; identical to SEQ ID NO: 108723

SEQ ID NO: 462318 - RNA, 64 nt, Homo Sapiens; identical to SEQ ID NO: 108724

SEQ ID NO: 462319 - RNA, 64 nt, Homo Sapiens; identical to SEQ ID NO: 108725

SEQ ID NO: 462320 - RNA, 64 nt, Homo Sapiens; identical to SEQ ID NO: 108726

SEQ ID NO: 462321 - RNA, 64 nt, Homo Sapiens; identical to SEQ ID NO: 108727

SEQ ID NO: 462322 - RNA, 64 nt, Homo Sapiens; identical to SEQ ID NO: 108728

SEQ ID NO: 462323 - RNA, 64 nt, Homo Sapiens; identical to SEQ ID NO: 108729

SEQ ID NO: 462324 - RNA, 64 nt, Homo Sapiens; identical to SEQ ID NO: 108730

SEQ ID NO: 462325 - RNA, 64 nt, Homo Sapiens; identical to SEQ ID NO: 108731

SEQ ID NO: 462326 - RNA, 64 nt, Homo Sapiens; identical to SEQ ID NO: 108732

SEQ ID NO: 462327 - RNA, 64 nt, Homo Sapiens; identical to SEQ ID NO: 108733

SEQ ID NO: 462328 - RNA, 64 nt, Homo Sapiens; identical to SEQ ID NO: 108734

SEQ ID NO: 462329 - RNA, 64 nt, Homo Sapiens; identical to SEQ ID NO: 108735

SEQ ID NO: 462330 - RNA, 64 nt, Homo Sapiens; identical to SEQ ID NO: 108736

SEQ ID NO: 462331 - RNA, 64 nt, Homo Sapiens; identical to SEQ ID NO: 108737

SEQ ID NO: 462332 - RNA, 64 nt, Homo Sapiens; identical to SEQ ID NO: 108738

SEQ ID NO: 462333 - RNA, 64 nt, Homo Sapiens; identical to SEQ ID NO: 108739

SEQ ID NO: 462334 - RNA, 64 nt, Homo Sapiens; identical to SEQ ID NO: 108740

SEQ ID NO: 462335 - RNA, 64 nt, Homo Sapiens; identical to SEQ ID NO: 108741

SEQ ID NO: 462336 - RNA, 64 nt, Homo Sapiens; identical to SEQ ID NO: 108742

SEQ ID NO: 462337 - RNA, 64 nt, Homo Sapiens; identical to SEQ ID NO: 108743

SEQ ID NO: 462338 - RNA, 64 nt, Homo Sapiens; identical to SEQ ID NO: 108744

SEQ ID NO: 462339 - RNA, 64 nt, Homo Sapiens; identical to SEQ ID NO: 108745

SEQ ID NO: 462340 - RNA, 64 nt, Homo Sapiens; identical to SEQ ID NO: 108746

SEQ ID NO: 462341 - RNA, 64 nt, Homo Sapiens; identical to SEQ ID NO: 108747

SEQ ID NO: 462342 - RNA, 64 nt, Homo Sapiens; identical to SEQ ID NO: 108748

SEQ ID NO: 462343 - RNA, 64 nt, Homo Sapiens; identical to SEQ ID NO: 108749

SEQ ID NO: 462344 - RNA, 64 nt, Homo Sapiens; identical to SEQ ID NO: 108750

SEQ ID NO: 462345 - RNA, 64 nt, Homo Sapiens; identical to SEQ ID NO: 108751

SEQ ID NO: 462346 - RNA, 64 nt, Homo Sapiens; identical to SEQ ID NO: 108752

SEQ ID NO: 462347 - RNA, 64 nt, Homo Sapiens; identical to SEQ ID NO: 108753

SEQ ID NO: 462348 - RNA, 64 nt, Homo Sapiens; identical to SEQ ID NO: 108754

SEQ ID NO: 462349 - RNA, 64 nt, Homo Sapiens; identical to SEQ ID NO: 108755

SEQ ID NO: 462350 - RNA, 64 nt, Homo Sapiens; identical to SEQ ID NO: 108756

SEQ ID NO: 462351 - RNA, 64 nt, Homo Sapiens; identical to SEQ ID NO: 108757

SEQ ID NO: 462352 - RNA, 64 nt, Homo Sapiens; identical to SEQ ID NO: 108758

SEQ ID NO: 462353 - RNA, 64 nt, Homo Sapiens; identical to SEQ ID NO: 108759

SEQ ID NO: 462354 - RNA, 64 nt, Homo Sapiens; identical to SEQ ID NO: 108760

SEQ ID NO: 462355 - RNA, 64 nt, Homo Sapiens; identical to SEQ ID NO: 108761

SEQ ID NO: 462356 - RNA, 64 nt, Homo Sapiens; identical to SEQ ID NO: 108762

SEQ ID NO: 462357 - RNA, 64 nt, Homo Sapiens; identical to SEQ ID NO: 108763

SEQ ID NO: 462358 - RNA, 64 nt, Homo Sapiens; identical to SEQ ID NO: 108764

SEQ ID NO: 462359 - RNA, 64 nt, Homo Sapiens; identical to SEQ ID NO: 108765

SEQ ID NO: 462360 - RNA, 64 nt, Homo Sapiens; identical to SEQ ID NO: 243136

SEQ ID NO: 462361 - RNA, 64 nt, Homo Sapiens; identical to SEQ ID NO: 243137

SEQ ID NO: 462362 - RNA, 64 nt, Homo Sapiens; identical to SEQ ID NO: 243138

SEQ ID NO: 462363 - RNA, 64 nt, Homo Sapiens; identical to SEQ ID NO: 243139

SEQ ID NO: 462364 - RNA, 64 nt, Homo Sapiens; identical to SEQ ID NO: 243140

SEQ ID NO: 462365 - RNA, 64 nt, Homo Sapiens; identical to SEQ ID NO: 243141

SEQ ID NO: 462366 - RNA, 64 nt, Homo Sapiens; identical to SEQ ID NO: 454757

SEQ ID NO: 462367 - RNA, 64 nt, Homo Sapiens; identical to SEQ ID NO: 454758

SEQ ID NO: 462368 - RNA, 64 nt, Homo Sapiens; identical to SEQ ID NO: 454759

SEQ ID NO: 462369 - RNA, 64 nt, Homo Sapiens; identical to SEQ ID NO: 454760

SEQ ID NO: 462370 - RNA, 64 nt, Homo Sapiens; identical to SEQ ID NO: 454761

SEQ ID NO: 462371 - RNA, 64 nt, Homo Sapiens; identical to SEQ ID NO: 454762

SEQ ID NO: 462372 - RNA, 64 nt, Homo Sapiens; identical to SEQ ID NO: 454763

SEQ ID NO: 462373 - RNA, 64 nt, Homo Sapiens; identical to SEQ ID NO: 454764

SEQ ID NO: 462374 - RNA, 58 nt, Homo Sapiens; identical to SEQ ID NO: 454765

SEQ ID NO: 462375 - RNA, 64 nt, Homo Sapiens; identical to SEQ ID NO: 454766

SEQ ID NO: 462376 - RNA, 64 nt, Homo Sapiens; identical to SEQ ID NO: 454767

SEQ ID NO: 462377 - RNA, 64 nt, Homo Sapiens; identical to SEQ ID NO: 454768

SEQ ID NO: 462378 - RNA, 64 nt, Homo Sapiens; identical to SEQ ID NO: 454769

SEQ ID NO: 462379 - RNA, 64 nt, Homo Sapiens; identical to SEQ ID NO: 454770

SEQ ID NO: 462380 - RNA, 64 nt, Homo Sapiens; identical to SEQ ID NO: 454771

SEQ ID NO: 462381 - RNA, 64 nt, Homo Sapiens; identical to SEQ ID NO: 454772

SEQ ID NO: 462382 - RNA, 64 nt, Homo Sapiens; identical to SEQ ID NO: 454773

SEQ ID NO: 462383 - RNA, 64 nt, Homo Sapiens; identical to SEQ ID NO: 454774

SEQ ID NO: 462384 - RNA, 64 nt, Homo Sapiens; identical to SEQ ID NO: 454775

SEQ ID NO: 462385 - RNA, 64 nt, Homo Sapiens; identical to SEQ ID NO: 454776

SEQ ID NO: 462386 - RNA, 64 nt, Homo Sapiens; identical to SEQ ID NO: 454777

SEQ ID NO: 462387 - RNA, 64 nt, Homo Sapiens; identical to SEQ ID NO: 454778

SEQ ID NO: 462388 - RNA, 64 nt, Homo Sapiens; identical to SEQ ID NO: 454779

SEQ ID NO: 462389 - RNA, 64 nt, Homo Sapiens; identical to SEQ ID NO: 454780

SEQ ID NO: 462390 - RNA, 64 nt, Homo Sapiens; identical to SEQ ID NO: 454781

SEQ ID NO: 462391 - RNA, 64 nt, Homo Sapiens; identical to SEQ ID NO: 454782

SEQ ID NO: 462392 - RNA, 64 nt, Homo Sapiens; identical to SEQ ID NO: 454783

SEQ ID NO: 462393 - RNA, 64 nt, Homo Sapiens; identical to SEQ ID NO: 454784

SEQ ID NO: 462394 - RNA, 64 nt, Homo Sapiens; identical to SEQ ID NO: 454785

SEQ ID NO: 462395 - RNA, 64 nt, Homo Sapiens; identical to SEQ ID NO: 454786

SEQ ID NO: 462396 - RNA, 64 nt, Homo Sapiens; identical to SEQ ID NO: 454787

SEQ ID NO: 462397 - RNA, 64 nt, Homo Sapiens; identical to SEQ ID NO: 454788

SEQ ID NO: 462398 - RNA, 64 nt, Homo Sapiens; identical to SEQ ID NO: 454789

SEQ ID NO: 462399 - RNA, 64 nt, Homo Sapiens; identical to SEQ ID NO: 454790

SEQ ID NO: 462400 - RNA, 64 nt, Homo Sapiens; identical to SEQ ID NO: 454791

SEQ ID NO: 462401 - RNA, 64 nt, Homo Sapiens; identical to SEQ ID NO: 454792

SEQ ID NO: 462402 - RNA, 64 nt, Homo Sapiens; identical to SEQ ID NO: 454793

SEQ ID NO: 462403 - RNA, 64 nt, Homo Sapiens; identical to SEQ ID NO: 454794

SEQ ID NO: 462404 - RNA, 64 nt, Homo Sapiens; identical to SEQ ID NO: 454795

SEQ ID NO: 462405 - RNA, 64 nt, Homo Sapiens; identical to SEQ ID NO: 454796

SEQ ID NO: 462406 - RNA, 64 nt, Homo Sapiens; identical to SEQ ID NO: 454797

SEQ ID NO: 462407 - RNA, 64 nt, Homo Sapiens; identical to SEQ ID NO: 454798

SEQ ID NO: 462408 - RNA, 64 nt, Homo Sapiens; identical to SEQ ID NO: 454799

SEQ ID NO: 462409 - RNA, 64 nt, Homo Sapiens; identical to SEQ ID NO: 454800

SEQ ID NO: 462410 - RNA, 64 nt, Homo Sapiens; identical to SEQ ID NO: 454801

SEQ ID NO: 462411 - RNA, 64 nt, Homo Sapiens; identical to SEQ ID NO: 454802

SEQ ID NO: 462412 - RNA, 64 nt, Homo Sapiens; identical to SEQ ID NO: 454803

SEQ ID NO: 462413 - RNA, 64 nt, Homo Sapiens; identical to SEQ ID NO: 454804

SEQ ID NO: 462414 - RNA, 64 nt, Homo Sapiens; identical to SEQ ID NO: 454805

SEQ ID NO: 462415 - RNA, 64 nt, Homo Sapiens; identical to SEQ ID NO: 454806

SEQ ID NO: 462416 - RNA, 64 nt, Homo Sapiens; identical to SEQ ID NO: 454807

SEQ ID NO: 462417 - RNA, 64 nt, Homo Sapiens; identical to SEQ ID NO: 454808

SEQ ID NO: 462418 - RNA, 64 nt, Homo Sapiens; identical to SEQ ID NO: 454809

SEQ ID NO: 462419 - RNA, 64 nt, Homo Sapiens; identical to SEQ ID NO: 454810

SEQ ID NO: 462420 - RNA, 64 nt, Homo Sapiens; identical to SEQ ID NO: 454811

SEQ ID NO: 462421 - RNA, 64 nt, Homo Sapiens; identical to SEQ ID NO: 454812

SEQ ID NO: 462422 - RNA, 64 nt, Homo Sapiens; identical to SEQ ID NO: 454813

SEQ ID NO: 462423 - RNA, 64 nt, Homo Sapiens; identical to SEQ ID NO: 454814

SEQ ID NO: 462424 - RNA, 64 nt, Homo Sapiens; identical to SEQ ID NO: 454815

SEQ ID NO: 462425 - RNA, 64 nt, Homo Sapiens; identical to SEQ ID NO: 454816

SEQ ID NO: 462426 - RNA, 64 nt, Homo Sapiens; identical to SEQ ID NO: 454817

SEQ ID NO: 462427 - RNA, 64 nt, Homo Sapiens; identical to SEQ ID NO: 454818

SEQ ID NO: 462428 - RNA, 64 nt, Homo Sapiens; identical to SEQ ID NO: 454819

SEQ ID NO: 462429 - RNA, 64 nt, Homo Sapiens; identical to SEQ ID NO: 454820

SEQ ID NO: 462430 - RNA, 64 nt, Homo Sapiens; identical to SEQ ID NO: 454821

SEQ ID NO: 462431 - RNA, 64 nt, Homo Sapiens; identical to SEQ ID NO: 454822

SEQ ID NO: 462432 - RNA, 64 nt, Homo Sapiens; identical to SEQ ID NO: 454823

SEQ ID NO: 462433 - RNA, 64 nt, Homo Sapiens; identical to SEQ ID NO: 454823

SEQ ID NO: 462434 - RNA, 64 nt, Homo Sapiens; identical to SEQ ID NO: 454825

SEQ ID NO: 462435 - RNA, 64 nt, Homo Sapiens; identical to SEQ ID NO: 454826

SEQ ID NO: 462436 - RNA, 64 nt, Homo Sapiens; identical to SEQ ID NO: 454827

SEQ ID NO: 462437 - RNA, 64 nt, Homo Sapiens; identical to SEQ ID NO: 454828

SEQ ID NO: 462438 - RNA, 64 nt, Homo Sapiens; identical to SEQ ID NO: 454829

SEQ ID NO: 462439 - RNA, 64 nt, Homo Sapiens; identical to SEQ ID NO: 454830

SEQ ID NO: 462440 - RNA, 64 nt, Homo Sapiens; identical to SEQ ID NO: 454831

SEQ ID NO: 462441 - RNA, 64 nt, Homo Sapiens; identical to SEQ ID NO: 454832

SEQ ID NO: 462442 - RNA, 64 nt, Homo Sapiens; identical to SEQ ID NO: 454833

SEQ ID NO: 462443 - RNA, 64 nt, Homo Sapiens; identical to SEQ ID NO: 454834

SEQ ID NO: 462444 - RNA, 64 nt, Homo Sapiens; identical to SEQ ID NO: 454835

SEQ ID NO: 462445 - RNA, 64 nt, Homo Sapiens; identical to SEQ ID NO: 454836

SEQ ID NO: 462446 - RNA, 64 nt, Homo Sapiens; identical to SEQ ID NO: 454837

SEQ ID NO: 462447 - RNA, 64 nt, Homo Sapiens; identical to SEQ ID NO: 454838

SEQ ID NO: 462448 - RNA, 64 nt, Homo Sapiens; identical to SEQ ID NO: 454839

SEQ ID NO: 462449 - RNA, 64 nt, Homo Sapiens; identical to SEQ ID NO: 454840

SEQ ID NO: 462450 - RNA, 64 nt, Homo Sapiens; identical to SEQ ID NO: 454841

SEQ ID NO: 462451 - RNA, 64 nt, Homo Sapiens; identical to SEQ ID NO: 454842

SEQ ID NO: 462452 - RNA, 64 nt, Homo Sapiens; identical to SEQ ID NO: 454843

SEQ ID NO: 462453 - RNA, 64 nt, Homo Sapiens; identical to SEQ ID NO: 454844

SEQ ID NO: 462454 - RNA, 64 nt, Homo Sapiens; identical to SEQ ID NO: 454845

SEQ ID NO: 462455 - RNA, 64 nt, Homo Sapiens; identical to SEQ ID NO: 454846

SEQ ID NO: 462456 - RNA, 64 nt, Homo Sapiens; identical to SEQ ID NO: 454847

SEQ ID NO: 462457 - RNA, 64 nt, Homo Sapiens; identical to SEQ ID NO: 454848

SEQ ID NO: 462458 - RNA, 64 nt, Homo Sapiens; identical to SEQ ID NO: 454849

SEQ ID NO: 462459 - RNA, 64 nt, Homo Sapiens; identical to SEQ ID NO: 454850

SEQ ID NO: 462460 - RNA, 64 nt, Homo Sapiens; identical to SEQ ID NO: 454851

SEQ ID NO: 462461 - RNA, 64 nt, Homo Sapiens; identical to SEQ ID NO: 454852

SEQ ID NO: 462462 - RNA, 64 nt, Homo Sapiens; identical to SEQ ID NO: 454853

SEQ ID NO: 462463 - RNA, 64 nt, Homo Sapiens; identical to SEQ ID NO: 454854

SEQ ID NO: 462464 - RNA, 64 nt, Homo Sapiens; identical to SEQ ID NO: 454855

SEQ ID NO: 462465 - RNA, 64 nt, Homo Sapiens; identical to SEQ ID NO: 454856

SEQ ID NO: 462466 - RNA, 64 nt, Homo Sapiens; identical to SEQ ID NO: 454857

SEQ ID NO: 462467 - RNA, 64 nt, Homo Sapiens; identical to SEQ ID NO: 454858

SEQ ID NO: 462468 - RNA, 64 nt, Homo Sapiens; identical to SEQ ID NO: 454859

SEQ ID NO: 462469 - RNA, 64 nt, Homo Sapiens; identical to SEQ ID NO: 454860

SEQ ID NO: 462470 - RNA, 64 nt, Homo Sapiens; identical to SEQ ID NO: 454861

SEQ ID NO: 462471 - RNA, 64 nt, Homo Sapiens; identical to SEQ ID NO: 454862

SEQ ID NO: 462472 - RNA, 64 nt, Homo Sapiens; identical to SEQ ID NO: 454863

SEQ ID NO: 462473 - RNA, 64 nt, Homo Sapiens; identical to SEQ ID NO: 454864

SEQ ID NO: 462474 - RNA, 64 nt, Homo Sapiens; identical to SEQ ID NO: 454865

SEQ ID NO: 462475 - RNA, 64 nt, Homo Sapiens; identical to SEQ ID NO: 454866

SEQ ID NO: 462476 - RNA, 64 nt, Homo Sapiens; identical to SEQ ID NO: 454867

SEQ ID NO: 462477 - RNA, 64 nt, Homo Sapiens; identical to SEQ ID NO: 454868

SEQ ID NO: 462478 - RNA, 64 nt, Homo Sapiens; identical to SEQ ID NO: 454869

SEQ ID NO: 462479 - RNA, 64 nt, Homo Sapiens; identical to SEQ ID NO: 454870

SEQ ID NO: 462480 - RNA, 64 nt, Homo Sapiens; identical to SEQ ID NO: 454871

SEQ ID NO: 462481 - RNA, 64 nt, Homo Sapiens; identical to SEQ ID NO: 454872

SEQ ID NO: 462482 - RNA, 64 nt, Homo Sapiens; identical to SEQ ID NO: 454873

SEQ ID NO: 462483 - RNA, 64 nt, Homo Sapiens; identical to SEQ ID NO: 454874

SEQ ID NO: 462484 - RNA, 64 nt, Homo Sapiens; identical to SEQ ID NO: 454875

SEQ ID NO: 462485 - RNA, 64 nt, Homo Sapiens; identical to SEQ ID NO: 454876

SEQ ID NO: 462486 - RNA, 64 nt, Homo Sapiens; identical to SEQ ID NO: 454877

SEQ ID NO: 462487 - RNA, 64 nt, Homo Sapiens; identical to SEQ ID NO: 454878

SEQ ID NO: 462488 - RNA, 64 nt, Homo Sapiens; identical to SEQ ID NO: 454879

SEQ ID NO: 462489 - RNA, 64 nt, Homo Sapiens; identical to SEQ ID NO: 454880

SEQ ID NO: 462490 - RNA, 64 nt, Homo Sapiens; identical to SEQ ID NO: 454881

SEQ ID NO: 462491 - RNA, 64 nt, Homo Sapiens; identical to SEQ ID NO: 454882

SEQ ID NO: 462492 - RNA, 64 nt, Homo Sapiens; identical to SEQ ID NO: 454883

SEQ ID NO: 462493 - RNA, 64 nt, Homo Sapiens; identical to SEQ ID NO: 454884

SEQ ID NO: 462494 - RNA, 64 nt, Homo Sapiens; identical to SEQ ID NO: 454885

SEQ ID NO: 462495 - RNA, 64 nt, Homo Sapiens; identical to SEQ ID NO: 454886

SEQ ID NO: 462496 - RNA, 64 nt, Homo Sapiens; identical to SEQ ID NO: 454887

SEQ ID NO: 462497 - RNA, 64 nt, Homo Sapiens; identical to SEQ ID NO: 454888

SEQ ID NO: 462498 - RNA, 64 nt, Homo Sapiens; identical to SEQ ID NO: 454889

SEQ ID NO: 462499 - RNA, 64 nt, Homo Sapiens; identical to SEQ ID NO: 454890

SEQ ID NO: 462500 - RNA, 64 nt, Homo Sapiens; identical to SEQ ID NO: 454891

SEQ ID NO: 462501 - RNA, 64 nt, Homo Sapiens; identical to SEQ ID NO: 454892

SEQ ID NO: 462502 - RNA, 64 nt, Homo Sapiens; identical to SEQ ID NO: 454893

SEQ ID NO: 462503 - RNA, 64 nt, Homo Sapiens; identical to SEQ ID NO: 454894

SEQ ID NO: 462504 - RNA, 64 nt, Homo Sapiens; identical to SEQ ID NO: 454895

SEQ ID NO: 462505 - RNA, 64 nt, Homo Sapiens; identical to SEQ ID NO: 454896

SEQ ID NO: 462506 - RNA, 64 nt, Homo Sapiens; identical to SEQ ID NO: 454897

SEQ ID NO: 462507 - RNA, 64 nt, Homo Sapiens; identical to SEQ ID NO: 454898

SEQ ID NO: 462508 - RNA, 64 nt, Homo Sapiens; identical to SEQ ID NO: 454899

SEQ ID NO: 462509 - RNA, 64 nt, Homo Sapiens; identical to SEQ ID NO: 454900

SEQ ID NO: 462510 - RNA, 63 nt, Homo Sapiens
uugcucccccuucauucugaugccucccuggggaacaaggauaaugacuuugcaucugcaccu

SEQ ID NO: 462511 - RNA, 63 nt, Homo Sapiens
ccccauccagcacccuucagcuguguguggacaaacaaggacagaaaaacccaguguccaagg

SEQ ID NO: 462512 - RNA, 63 nt, Homo Sapiens
gaggaagguucuguuuugaguauagccagagaaaacaaggauggagaaaaaucuaggacaggu

SEQ ID NO: 462513 - RNA, 63 nt, Homo Sapiens
gaggaagauucuguuuuggguauagccagagaaaacaaggauggagaaaaaucuaggacaggu

SEQ ID NO: 462514 - RNA, 63 nt, Homo Sapiens
agcugcccgcauacugagagacagcuucuuauaaacaaggagaguuuuugugugugcgagauc

SEQ ID NO: 462515 - RNA, 63 nt, Homo Sapiens
uuuucuuuuugacaauucuuggacuugagguaaaacaaggaggauuguggccggauuucagau

SEQ ID NO: 462516 - RNA, 63 nt, Homo Sapiens
gcauuccacacaggcacugccccaggacaacacaacaaggacagucacaacaaggacaacaag

SEQ ID NO: 462517 - RNA, 63 nt, Homo Sapiens
acugccccaggacaacacaacaaggacagucacaacaaggacaacaaggacacaacacaacac

SEQ ID NO: 462518 - RNA, 63 nt, Homo Sapiens
ggacaacacaacaaggacagucacaacaaggacaacaaggacacaacacaacacacaacaagg

SEQ ID NO: 462519 - RNA, 63 nt, Homo Sapiens
caacaaggacaacaaggacacaacacaacacacaacaaggacagucacaacaagccuagagcc

SEQ ID NO: 462520 - RNA, 63 nt, Homo Sapiens
uugugaucaauuuuacccugauuauuuuuugaaaacaaggauaaaaaacaagguauauacuuu

SEQ ID NO: 462521 - RNA, 63 nt, Homo Sapiens
agagaccaugacucuaucgagaaugaaugaagcaacaaggaagggccuacucauuauuuuaga

SEQ ID NO: 462522 - RNA, 63 nt, Homo Sapiens
uggagacuugguggucugagugcucuuguuucuaacaaggacuuaggcaaaaauaauuuauuu

SEQ ID NO: 462523 - RNA, 63 nt, Homo Sapiens
acuuuauguagagaaaaggauuguuuggagaacaacaaggacagggguuuccugcauggacag

SEQ ID NO: 462524 - RNA, 63 nt, Homo Sapiens
cucaaaaagaaaugagaggguguuuuaagaauuaacaaggaguagagaugggccuuagaaaug

SEQ ID NO: 462525 - RNA, 63 nt, Homo Sapiens
ucaagaacugccuguggaccuggcuuccuggucaacaaggaccggguugcugucagccccagu

SEQ ID NO: 462526 - RNA, 63 nt, Homo Sapiens
guaggcacaaaguaaaaaauggaaccaucuacuaacaaggauccuuuaaaacugccaagggag

SEQ ID NO: 462527 - RNA, 63 nt, Homo Sapiens
auauacacacacacauauauauauauaaaguguaacaaggaacacuaaaacaguguugauucu

SEQ ID NO: 462528 - RNA, 63 nt, Homo Sapiens
guguggugaccauugaggaagaagauggacagaaacaaggaugcacguggagagcuucuucca

SEQ ID NO: 462529 - RNA, 63 nt, Homo Sapiens
gcugcaucaccaaggaggugccuguaugaccuuaacaaggacgaggcuuaauugggccuucaa

SEQ ID NO: 462530 - RNA, 63 nt, Homo Sapiens
uucuggcugcugaaaccacuuugggccaggaagaacaaggaugaagagguuccugucauuucu

SEQ ID NO: 462531 - RNA, 63 nt, Homo Sapiens
ugucuuugcuuauagcauuuuucucuaaccuauaacaaggagacauuacauuuuacuuuagaa

SEQ ID NO: 462532 - RNA, 63 nt, Homo Sapiens
acacuguuguacuuccgugggcccuccuuccagaacaaggacaacaaggacaagguugaaggg

SEQ ID NO: 462533 - RNA, 63 nt, Homo Sapiens
uacuuccgugggcccuccuuccagaacaaggacaacaaggacaagguugaagggucuucucau

SEQ ID NO: 462534 - RNA, 64 nt, Homo Sapiens; identical to SEQ ID NO: 163262

SEQ ID NO: 462535 - RNA, 64 nt, Homo Sapiens; identical to SEQ ID NO: 163263

SEQ ID NO: 462536 - RNA, 64 nt, Homo Sapiens; identical to SEQ ID NO: 163264

SEQ ID NO: 462537 - RNA, 64 nt, Homo Sapiens; identical to SEQ ID NO: 163265

SEQ ID NO: 462538 - RNA, 64 nt, Homo Sapiens; identical to SEQ ID NO: 163266

SEQ ID NO: 462539 - RNA, 64 nt, Homo Sapiens; identical to SEQ ID NO: 163267

SEQ ID NO: 462540 - RNA, 64 nt, Homo Sapiens; identical to SEQ ID NO: 163268

SEQ ID NO: 462541 - RNA, 64 nt, Homo Sapiens; identical to SEQ ID NO: 163269

SEQ ID NO: 462542 - RNA, 61 nt, Homo Sapiens
uuuugcuuacaguuuuaaauucugaacaauucucucuuauauguguauugcuaaucauuaa

SEQ ID NO: 462543 - RNA, 61 nt, Homo Sapiens
uguuuaguauuaugucuuauuggugcauuuacucucuuaucauuauguaauguccuucuuu

SEQ ID NO: 462544 - RNA, 61 nt, Homo Sapiens
cugcgggccaggcacugcccuuuucaggaagcucucuuaaaauacccauugccccagaccu

SEQ ID NO: 462545 - RNA, 61 nt, Homo Sapiens
uggaaggaugggauggguuccagagguauuccucucuuaaaugcaagugccuagauuaggu

SEQ ID NO: 462546 - RNA, 61 nt, Homo Sapiens
cugucccuuuguagucagcuacucccaauagcucucuuaugcgguacagaacaguuccuuc

SEQ ID NO: 462547 - RNA, 61 nt, Homo Sapiens
uauucuugauucuagugacaaaauaguguuccucucuuauaucucaguaguaucccuagag

SEQ ID NO: 462548 - RNA, 61 nt, Homo Sapiens
auuggaggauuugccauugucugucuuuuuucucucuuagaucuuucucucuccuaucucu

SEQ ID NO: 462549 - RNA, 61 nt, Homo Sapiens
guucuuucauauggaauguagcuacaauauucucucuuauuucuugacccuuuuguauaaa

SEQ ID NO: 462550 - RNA, 61 nt, Homo Sapiens
acugcugacuugguuaugcacaaaaucaucucucucuuagguaacuaaucucauuuaacuc

SEQ ID NO: 462551 - RNA, 61 nt, Homo Sapiens
gucuguuuuuagacuucaugucaguaucucccucucuuaaauaauagguaaucaaggcaau

SEQ ID NO: 462552 - RNA, 61 nt, Homo Sapiens
augaacaaagcaaaggauacagagguauguucucucuuagaagcuaacuucccugagacug

SEQ ID NO: 462553 - RNA, 61 nt, Homo Sapiens
augaaagauguauaauguagagaacugacuucucucuuaaaaaguacagagagccugugcu

SEQ ID NO: 462554 - RNA, 64 nt, Homo Sapiens
cauauauauuaaauauauccacaaagcagaugggcaaaaagauuuucaugcuaaucuucaaagg

SEQ ID NO: 462555 - RNA, 64 nt, Homo Sapiens
acaugauuuugauuaugcuacaugauauauguuucaaaaagaauuagcauagaaauccuggucu

SEQ ID NO: 462556 - RNA, 64 nt, Homo Sapiens
gaugugacauaucugcagucccagcacagugggacaaaaagaauuuagaccccaaaaguguccu

SEQ ID NO: 462557 - RNA, 64 nt, Homo Sapiens
cagaaaggccuuaaugaccucauaggcacucuuccaaaaagacaacagaacuggaaugagaggc

SEQ ID NO: 462558 - RNA, 55 nt, Homo Sapiens
caacaucaacaaauaaauaagaaagcaaaaagaucugggauauguguuggaaaac

SEQ ID NO: 462559 - RNA, 64 nt, Homo Sapiens
ucaucaucucuguuauacaccuguaucaugaaagcaaaaagaaguaaacaucaggagucagcuc

SEQ ID NO: 462560 - RNA, 64 nt, Homo Sapiens
ucucagguuuguuuugugaagcuuuuuuccaaaacaaaaagauguuugacucuauaagcaaauu

SEQ ID NO: 462561 - RNA, 64 nt, Homo Sapiens
ucaauaguugaauuagugaguaaagucaguugcucaaaaagaaauuacuuuuaaggauaaauca

SEQ ID NO: 462562 - RNA, 64 nt, Homo Sapiens
aagagaacugacugaacuugggaaauaauuugaacaaaaagauaaaucuucacagauaugaaua

SEQ ID NO: 462563 - RNA, 64 nt, Homo Sapiens
agcaaaacaaacaaagcaauauuaaaggaagagccaaaaagacccagaaauaaaaugacagaua

SEQ ID NO: 462564 - RNA, 64 nt, Homo Sapiens
acuauugggaaaccauggugauugaaaaguccuccaaaaagagacuaaagcaguuuacucauca

SEQ ID NO: 462565 - RNA, 64 nt, Homo Sapiens
cagcagcaguaucuuguucuuauauuucaaaagacaaaaagaaggcagagccuacaaaacauug

SEQ ID NO: 462566 - RNA, 64 nt, Homo Sapiens
aaaucagcuuauauuuuuuauuauguaaaaccaacaaaaagaaccucagguugucuaaguguuu

SEQ ID NO: 462567 - RNA, 64 nt, Homo Sapiens
aacauaucucagguugucuauuuuuuuuaaucaucaaaaagaacauugcgcccggccuuaaaug

SEQ ID NO: 462568 - RNA, 64 nt, Homo Sapiens
ugauaaauauuugaaaccaugauuuuguccccaacaaaaagaaaguuucaaauagcuaaaagga

SEQ ID NO: 462569 - RNA, 64 nt, Homo Sapiens
aaaaauaugacagccgugguaaggugacuauuuucaaaaagacagauaucaucucauccuaauu

SEQ ID NO: 462570 - RNA, 64 nt, Homo Sapiens
acacacugcagcagagcuuguagcuggacagagucaaaaagaagaaaauacgguuucaggcuuu

SEQ ID NO: 462571 - RNA, 64 nt, Homo Sapiens
cagugaugccuuauuugaaacugggcuuaaacugcaaaaagaaugaaguuggauuuaggaagcu

SEQ ID NO: 462572 - RNA, 64 nt, Homo Sapiens
caaauaccacuaugaauaagccuacaccuguuuacaaaaagaauagaucaaggucacagcacug

SEQ ID NO: 462573 - RNA, 64 nt, Homo Sapiens
cgcuagaucaaggucacagcggacaaaguuaauucaaaaagagguaauuccaggaaagcacaga

SEQ ID NO: 462574 - RNA, 64 nt, Homo Sapiens
cuaguuaugggaguuaaguuauggcauucuacaacaaaaagaagccaaucccgacaguagcaga

SEQ ID NO: 462575 - RNA, 64 nt, Homo Sapiens
ucggagaaaagugccgcgaaaaaaaaaaaaaaagcaaaaagacgcaaaaagacaaaaaaaaaaa

SEQ ID NO: 462576 - RNA, 64 nt, Homo Sapiens
aaaaaaaaaaaaaaaaaaaacccacucugcccuccaaaaagacauuguguuugcuuuuccggac

SEQ ID NO: 462577 - RNA, 64 nt, Homo Sapiens
uuaagauucaagagagaggaaagugucuggaaggcaaaaagaucggaugacacagaaacaccgu

SEQ ID NO: 462578 - RNA, 64 nt, Homo Sapiens
auuucuaucugauuugcuuucaacggaauagacccaaaaagauaaagcaaaauguuuaaagaca

SEQ ID NO: 462579 - RNA, 64 nt, Homo Sapiens
aaucaguaaucuaccugguggauuuguuuuuaaccaaaaagaugaauuaucaaugauuuguaau

SEQ ID NO: 462580 - RNA, 64 nt, Homo Sapiens
ugccauuuguaaaauaaaauagagcagaaaaacacaaaaagagaacacugguucagacauucag

SEQ ID NO: 462581 - RNA, 64 nt, Homo Sapiens
cgggauauacccacaggaaaagaauucauuuuaucaaaaagacaccugcaccaauauguucauu

SEQ ID NO: 462582 - RNA, 64 nt, Homo Sapiens
gagagaacucugcacuaugaacccaaacccagcucaaaaagauaaaaucuagucauuuaagaua

SEQ ID NO: 462583 - RNA, 64 nt, Homo Sapiens
uaaaacauuucuguaaacuuuacaagguaauuuucaaaaagaaaugauagaaaagucacauuuc

SEQ ID NO: 462584 - RNA, 64 nt, Homo Sapiens
uugcucucagauuuuccugaauguggagagcuuccaaaaagagaguaaagaaaagaucgcagga

SEQ ID NO: 462585 - RNA, 64 nt, Homo Sapiens
agauuuacucaaguagcauugggcccaaagaaggcaaaaagauaucaggcauaggcagccuaua

SEQ ID NO: 462586 - RNA, 64 nt, Homo Sapiens
uugccuaaugugcaccuguguccaccaauagugccaaaaagauagugggacaagcaggcuuguu

SEQ ID NO: 462587 - RNA, 64 nt, Homo Sapiens
gacaucaguuuaaaggcacaacucagcauaguagcaaaaagaacacauagucaguaauaauaaa

SEQ ID NO: 462588 - RNA, 64 nt, Homo Sapiens
accuuucuuuuguuuuuuacuuuguaaguaaaaacaaaaagaaauacaaagauauucucuaugu

SEQ ID NO: 462589 - RNA, 64 nt, Homo Sapiens
uuuuuaaagucccaccuuucaauguuuaauaaaacaaaaagagaaauccuuaaucuaaaagcua

SEQ ID NO: 462590 - RNA, 64 nt, Homo Sapiens
ccauuagguaccuagcagaugugcacaauauaaacaaaaagauaucuggccuaccuuacuacua

SEQ ID NO: 462591 - RNA, 64 nt, Homo Sapiens
auaccucuuaggaaccaaagaaugccucuacaagcaaaaagauaguugaaaauaguuaagaucc

SEQ ID NO: 462592 - RNA, 64 nt, Homo Sapiens
guaauauggcaagagcccaacucuacuaaaaauacaaaaagaaaagaaaacagccaagcuuggu

SEQ ID NO: 462593 - RNA, 64 nt, Homo Sapiens
ucucuuuacacuuuuuguuauuuauaugaauuuucaaaaagauguaauaacauggaagguuugu

SEQ ID NO: 462594 - RNA, 64 nt, Homo Sapiens
agugcucaagcagcaaaaucaaauggaauuacuccaaaaagacauuauguaacuugauggaaga

SEQ ID NO: 462595 - RNA, 64 nt, Homo Sapiens
ggaguguuugaaguuugcagaugagaagguuugacaaaaagacagagagauguagagacaguga

SEQ ID NO: 462596 - RNA, 64 nt, Homo Sapiens
gagagauguagagacagugauagagacagaggaacaaaaagagcagcagugagaaggcaaagag

SEQ ID NO: 462597 - RNA, 64 nt, Homo Sapiens
uuggauguuuuccagcauuuagccaaauuccauacaaaaagaauuuugagcacuggguucuuuu

SEQ ID NO: 462598 - RNA, 64 nt, Homo Sapiens
agccauaagaaaaccagguaaaggaaacaacuagcaaaaagaauuagaaaaagaaaaaagugaa

SEQ ID NO: 462599 - RNA, 64 nt, Homo Sapiens
agaaaaagcacagcucucacuggccaguagcugccaaaaagaacacccaucguauaaggaaauc

SEQ ID NO: 462600 - RNA, 64 nt, Homo Sapiens
ccgcucucucauguggggauguuugugcugcagacaaaaagaacaaaaaaaaauuuuuaaauac

SEQ ID NO: 462601 - RNA, 64 nt, Homo Sapiens
agcaaucaggcaagagaaagaaauaaaaggcaaccaaaaagaaaggaagucgaaguaucucugu

SEQ ID NO: 462602 - RNA, 64 nt, Homo Sapiens
caaaucaagaaugcaauccuauucacaauugccacaaaaagaauaaaauaccuaggaauacagc

SEQ ID NO: 462603 - RNA, 64 nt, Homo Sapiens
aaaaaagagcccaaaaagccaaagcaauccuaagcaaaaagaacaaagcuggaggcaucgcauu

SEQ ID NO: 462604 - RNA, 64 nt, Homo Sapiens
cuugaauccggugcaugccuucugacaacuggaacaaaaagaaccauuggggucuaguuuggaa

SEQ ID NO: 462605 - RNA, 51 nt, Homo Sapiens
aaccacaggcccuuccccuuucaaaaagaaagacaguguuacagcaauuaa

SEQ ID NO: 462606 - RNA, 64 nt, Homo Sapiens
gaucaaaucuguacaguuucguuuaaaaacaaaacaaaaagauuugguguguuuagagauuuua

SEQ ID NO: 462607 - RNA, 64 nt, Homo Sapiens
uucgaucuucucacucuuacaaaagaaaaauguacaaaaagauugaaaggccaaaaaaaagagg

SEQ ID NO: 462608 - RNA, 64 nt, Homo Sapiens
uauuuugguguuuuuguguuuucucuuuauaaggcaaaaagaucuguauuuacacuccuucacc

SEQ ID NO: 462609 - RNA, 64 nt, Homo Sapiens
gguuugucaucuccgcaaggccagaaagugaucacaaaaagaggcagaugauagacacuggggu

SEQ ID NO: 462610 - RNA, 64 nt, Homo Sapiens
aauuaaucacuaaugaauuaugcgaaagcaacauauuugauaaccguugcaguaaaucaugagu

SEQ ID NO: 462611 - RNA, 64 nt, Homo Sapiens
uuuuaggauuugggaaaauaaacuguaaauguuuauuugauagguaaauauaguuuuauuguca

SEQ ID NO: 462612 - RNA, 64 nt, Homo Sapiens
ggccacaucccaguguuuaucugcuaacucuaagauuugauaaguaagaucaacucuuccuauc

SEQ ID NO: 462613 - RNA, 64 nt, Homo Sapiens
aaugaacgcccucaagacuggaagauacaauuuuauuugauaucggcugagaaaugauucauuu

SEQ ID NO: 462614 - RNA, 64 nt, Homo Sapiens
uaaguuccagcagaugccacauaagggguuugccauuugauaccccuggggaacauuucuguaa

SEQ ID NO: 462615 - RNA, 64 nt, Homo Sapiens
uguauacuuuaguaugacgcugauacauaacuaaauuugauacuuauauuuucguaugaaaaug

SEQ ID NO: 462616 - RNA, 64 nt, Homo Sapiens
uuucuauggagcugauuuaaaguauuccauuuagauuugauagauaugcuuaagcaaucuauaa

SEQ ID NO: 462617 - RNA, 64 nt, Homo Sapiens
ccacagaauaggauaaaauauuuguaaaucauauauuugauaaaagucuuguaaccagauacau

SEQ ID NO: 462618 - RNA, 64 nt, Homo Sapiens
guaaagcuguaucgauuugcuauugaaauauaguauuugauacaggagccauguguacgaauug

SEQ ID NO: 462619 - RNA, 64 nt, Homo Sapiens
uauauagugcauauaauaaauccaauuaaacauuauuugauacauauuuaacuuuuuuggcugu

SEQ ID NO: 462620 - RNA, 64 nt, Homo Sapiens
auuguuucauuuauaauuugugguccauaauuugauuugauaugagguuaaauuuucuauacuu

SEQ ID NO: 462621 - RNA, 64 nt, Homo Sapiens
uggaaccagagguuauauacucuagcccauccaaauuugauaaauagaggagacuaauucucuu

SEQ ID NO: 462622 - RNA, 64 nt, Homo Sapiens
cugcaagaaaagaagucaaucagcagaggagagcauuugauaacuaagaggaagacuugcaaag

SEQ ID NO: 462623 - RNA, 64 nt, Homo Sapiens
gagugauuugaaauacuauauggcaaaguuuuauauuugauauucuuuaaguuaguugcucaca

SEQ ID NO: 462624 - RNA, 64 nt, Homo Sapiens
caagggaaguuuugugauaggagagaaauaaaagauuugauauuuuuugagaugacacucaagc

SEQ ID NO: 462625 - RNA, 64 nt, Homo Sapiens
aagugaccacaguauacaaaguaauaagcaggaaauuugauauggguuaaauuaugcauuuugu

SEQ ID NO: 462626 - RNA, 64 nt, Homo Sapiens
aacugauuuccaaauauguucaacauuuacuucuauuugauaucugcucaagaagucauagaag

SEQ ID NO: 462627 - RNA, 64 nt, Homo Sapiens
aaaucaucaacuuccacugguuaggugcuuugaaauuugauaacgagaugaagugggguuucca

SEQ ID NO: 462628 - RNA, 64 nt, Homo Sapiens
aauguuaugcauuuaguauguauaaauguuaauuauuugauacgguccuuauuuguuaauugua

SEQ ID NO: 462629 - RNA, 64 nt, Homo Sapiens
uugcacugaagacagacccuccuucaauugccaaauuugauaugaaaauauauauuugauauac

SEQ ID NO: 462630 - RNA, 64 nt, Homo Sapiens
cccuucaauugccaaauuugagcaaaaaauauauauuugauauaaguuuguuccacauuuugaa

SEQ ID NO: 462631 - RNA, 64 nt, Homo Sapiens
ugggaguuuguaugcagaaaguuaaauaguauuuauuugauaaauaagggaauauggacaaauu

SEQ ID NO: 462632 - RNA, 64 nt, Homo Sapiens
gucaccguuuuugcauguaguaauaaacugcaucauuugauagacauguacaaaucaaucacua

SEQ ID NO: 462633 - RNA, 64 nt, Homo Sapiens
cuaauuggaaauuacagauugauguggccuagauauuugauauuuuuguuaagccuuggcucug

SEQ ID NO: 462634 - RNA, 64 nt, Homo Sapiens
agagauacacaaaaaaccaaaaaaggaauaccccauuugauaucaacuagaaaauccuuuugac

SEQ ID NO: 462635 - RNA, 64 nt, Homo Sapiens
aaugacuacaaaaaaagguagaauggugccaauaauuugauacucugccccucuccuuaaaacu

SEQ ID NO: 462636 - RNA, 64 nt, Homo Sapiens
ucuaggaaaagaaagaugggguaguugagacaggauuugauaaggaguuuuucuauuacucuau

SEQ ID NO: 462637 - RNA, 64 nt, Homo Sapiens
gauuagaaagaaacauggacaacucuguccauaaauuugauaacuuagcuaaaauggaccaauu

SEQ ID NO: 462638 - RNA, 64 nt, Homo Sapiens
uauuagcaaaucaggaaugcaaggcuuguucaacauuugauauucaguguaauccauugcaugc

SEQ ID NO: 462639 - RNA, 64 nt, Homo Sapiens
gaacuacuacaaaaaacccuggagaacuuacucaauuugauaaacucaacacagaaggaauaca

SEQ ID NO: 462640 - RNA, 64 nt, Homo Sapiens
cagugcaauccauugcaugcaagccuuguucaacauuugauauuuguuagcaaaucaggaaugc

SEQ ID NO: 462641 - RNA, 64 nt, Homo Sapiens
uuagcuaaaauggaucaauuaacucuguccauaaauuugauaacgauuagaaagaaauauggac

SEQ ID NO: 462642 - RNA, 64 nt, Homo Sapiens
gcauaaauguuauauuuauaaauagucuguuacuauuugauaauacauauauaugaaugcuugu

SEQ ID NO: 462643 - RNA, 64 nt, Homo Sapiens
ugauuaggaaguauuuuauaauuauucuuucuaaauuugauaaugaaauuucaaaguauguuuc

SEQ ID NO: 462644 - RNA, 64 nt, Homo Sapiens
caucaaaggaauaaaaagcuuagccaauaaaucuauuugauagcucuuuugcacuucuaacaug

SEQ ID NO: 462645 - RNA, 64 nt, Homo Sapiens
auccauaucuaauaauggauaaauuaggugggauauuugauaggugaaacaucgacguaacugg

SEQ ID NO: 462646 - RNA, 64 nt, Homo Sapiens
uauuuauuuuagacuaauuguugaaaugcugcagauuugauaaaggugaaucugcuaaauccuu

SEQ ID NO: 462647 - RNA, 64 nt, Homo Sapiens
agucaguuugcuugaaacuaggagcaaaacacugauuugauacuagaguuggggggaacuggag

SEQ ID NO: 462648 - RNA, 64 nt, Homo Sapiens
uauagaauuggcuugggcuuguguagccccagucauuugauaaagauguuguuaaacuguguca

SEQ ID NO: 462649 - RNA, 64 nt, Homo Sapiens
ggagcuucuuaggucuugccacaaaaaucugcaaauuugauaauucuccugaauucacaaucau

SEQ ID NO: 462650 - RNA, 64 nt, Homo Sapiens
ggaaugcaauuugacuuggcauaauugugaguuaauuugauaaagaucuccaguuguauccucu

SEQ ID NO: 462651 - RNA, 64 nt, Homo Sapiens
uuuaaguaauuucaugcacacaggagaaaaugcaauuugauaaucaguuuccacuacauucgga

SEQ ID NO: 462652 - RNA, 64 nt, Homo Sapiens
ugguauuaagccuuucccaacuugugaauauagaauuugauaauacacuuuuguguauuagcaa

SEQ ID NO: 462653 - RNA, 64 nt, Homo Sapiens
uacuuuguaaauugaauuuuuuaaagaaauaggcauuugauaaccagcuuggcaaguaacucua

SEQ ID NO: 462654 - RNA, 64 nt, Homo Sapiens
aauacuugucuuuucuaccuuuuaauauuaacucauuugauaauucauaugaaaaauuugcuaa

SEQ ID NO: 462655 - RNA, 64 nt, Homo Sapiens
uguuguuuauaauuaagagugaaacauuauauagauuugauaaagugaaguaaauauuuuaaag

SEQ ID NO: 462656 - RNA, 64 nt, Homo Sapiens; identical to SEQ ID NO: 291173

SEQ ID NO: 462657 - RNA, 64 nt, Homo Sapiens; identical to SEQ ID NO: 291174

SEQ ID NO: 462658 - RNA, 64 nt, Homo Sapiens; identical to SEQ ID NO: 291175

SEQ ID NO: 462659 - RNA, 64 nt, Homo Sapiens; identical to SEQ ID NO: 291176

SEQ ID NO: 462660 - RNA, 64 nt, Homo Sapiens; identical to SEQ ID NO: 291177

SEQ ID NO: 462661 - RNA, 64 nt, Homo Sapiens; identical to SEQ ID NO: 291178

SEQ ID NO: 462662 - RNA, 64 nt, Homo Sapiens; identical to SEQ ID NO: 291179

SEQ ID NO: 462663 - RNA, 64 nt, Homo Sapiens; identical to SEQ ID NO: 291180

SEQ ID NO: 462664 - RNA, 64 nt, Homo Sapiens; identical to SEQ ID NO: 291181

SEQ ID NO: 462665 - RNA, 64 nt, Homo Sapiens; identical to SEQ ID NO: 291182

SEQ ID NO: 462666 - RNA, 64 nt, Homo Sapiens; identical to SEQ ID NO: 291183

SEQ ID NO: 462667 - RNA, 64 nt, Homo Sapiens; identical to SEQ ID NO: 291184

SEQ ID NO: 462668 - RNA, 64 nt, Homo Sapiens; identical to SEQ ID NO: 291185

SEQ ID NO: 462669 - RNA, 64 nt, Homo Sapiens; identical to SEQ ID NO: 291186

SEQ ID NO: 462670 - RNA, 64 nt, Homo Sapiens; identical to SEQ ID NO: 291187

SEQ ID NO: 462671 - RNA, 64 nt, Homo Sapiens; identical to SEQ ID NO: 291188

SEQ ID NO: 462672 - RNA, 64 nt, Homo Sapiens; identical to SEQ ID NO: 291189

SEQ ID NO: 462673 - RNA, 64 nt, Homo Sapiens; identical to SEQ ID NO: 291190

SEQ ID NO: 462674 - RNA, 64 nt, Homo Sapiens; identical to SEQ ID NO: 291191

SEQ ID NO: 462675 - RNA, 64 nt, Homo Sapiens; identical to SEQ ID NO: 291192

SEQ ID NO: 462676 - RNA, 64 nt, Homo Sapiens; identical to SEQ ID NO: 291193

SEQ ID NO: 462677 - RNA, 64 nt, Homo Sapiens; identical to SEQ ID NO: 291194

SEQ ID NO: 462678 - RNA, 64 nt, Homo Sapiens; identical to SEQ ID NO: 291195

SEQ ID NO: 462679 - RNA, 64 nt, Homo Sapiens; identical to SEQ ID NO: 291196

SEQ ID NO: 462680 - RNA, 64 nt, Homo Sapiens; identical to SEQ ID NO: 291197

SEQ ID NO: 462681 - RNA, 64 nt, Homo Sapiens; identical to SEQ ID NO: 291198

SEQ ID NO: 462682 - RNA, 64 nt, Homo Sapiens; identical to SEQ ID NO: 291199

SEQ ID NO: 462683 - RNA, 64 nt, Homo Sapiens; identical to SEQ ID NO: 291200

SEQ ID NO: 462684 - RNA, 64 nt, Homo Sapiens; identical to SEQ ID NO: 291201

SEQ ID NO: 462685 - RNA, 64 nt, Homo Sapiens; identical to SEQ ID NO: 291202

SEQ ID NO: 462686 - RNA, 64 nt, Homo Sapiens; identical to SEQ ID NO: 291203

SEQ ID NO: 462687 - RNA, 64 nt, Homo Sapiens; identical to SEQ ID NO: 291204

SEQ ID NO: 462688 - RNA, 64 nt, Homo Sapiens; identical to SEQ ID NO: 291205

SEQ ID NO: 462689 - RNA, 64 nt, Homo Sapiens; identical to SEQ ID NO: 291206

SEQ ID NO: 462690 - RNA, 61 nt, Homo Sapiens; identical to SEQ ID NO: 316476

SEQ ID NO: 462691 - RNA, 61 nt, Homo Sapiens; identical to SEQ ID NO: 316477

SEQ ID NO: 462692 - RNA, 61 nt, Homo Sapiens; identical to SEQ ID NO: 316567

SEQ ID NO: 462693 - RNA, 61 nt, Homo Sapiens; identical to SEQ ID NO: 316568

SEQ ID NO: 462694 - RNA, 61 nt, Homo Sapiens; identical to SEQ ID NO: 316585

SEQ ID NO: 462695 - RNA, 61 nt, Homo Sapiens; identical to SEQ ID NO: 316586

SEQ ID NO: 462696 - RNA, 61 nt, Homo Sapiens; identical to SEQ ID NO: 316623

SEQ ID NO: 462697 - RNA, 61 nt, Homo Sapiens; identical to SEQ ID NO: 316624

SEQ ID NO: 462698 - RNA, 61 nt, Homo Sapiens; identical to SEQ ID NO: 316679

SEQ ID NO: 462699 - RNA, 61 nt, Homo Sapiens; identical to SEQ ID NO: 316680

SEQ ID NO: 462700 - RNA, 61 nt, Homo Sapiens; identical to SEQ ID NO: 316734

SEQ ID NO: 462701 - RNA, 61 nt, Homo Sapiens; identical to SEQ ID NO: 316735

SEQ ID NO: 462702 - RNA, 61 nt, Homo Sapiens; identical to SEQ ID NO: 316748

SEQ ID NO: 462703 - RNA, 61 nt, Homo Sapiens; identical to SEQ ID NO: 316749

SEQ ID NO: 462704 - RNA, 61 nt, Homo Sapiens; identical to SEQ ID NO: 316751

SEQ ID NO: 462705 - RNA, 61 nt, Homo Sapiens; identical to SEQ ID NO: 316752

SEQ ID NO: 462706 - RNA, 61 nt, Homo Sapiens; identical to SEQ ID NO: 316776

SEQ ID NO: 462707 - RNA, 61 nt, Homo Sapiens; identical to SEQ ID NO: 316777

SEQ ID NO: 462708 - RNA, 61 nt, Homo Sapiens; identical to SEQ ID NO: 316788

SEQ ID NO: 462709 - RNA, 61 nt, Homo Sapiens; identical to SEQ ID NO: 316789

SEQ ID NO: 462710 - RNA, 61 nt, Homo Sapiens; identical to SEQ ID NO: 316796

SEQ ID NO: 462711 - RNA, 61 nt, Homo Sapiens; identical to SEQ ID NO: 316797

SEQ ID NO: 462712 - RNA, 61 nt, Homo Sapiens; identical to SEQ ID NO: 316804

SEQ ID NO: 462713 - RNA, 61 nt, Homo Sapiens; identical to SEQ ID NO: 316805

SEQ ID NO: 462714 - RNA, 61 nt, Homo Sapiens; identical to SEQ ID NO: 316842

SEQ ID NO: 462715 - RNA, 61 nt, Homo Sapiens; identical to SEQ ID NO: 316843

SEQ ID NO: 462716 - RNA, 61 nt, Homo Sapiens; identical to SEQ ID NO: 316851

SEQ ID NO: 462717 - RNA, 61 nt, Homo Sapiens; identical to SEQ ID NO: 316852

SEQ ID NO: 462718 - RNA, 61 nt, Homo Sapiens; identical to SEQ ID NO: 316866

SEQ ID NO: 462719 - RNA, 61 nt, Homo Sapiens; identical to SEQ ID NO: 316867

SEQ ID NO: 462720 - RNA, 64 nt, Homo Sapiens; identical to SEQ ID NO: 336218

SEQ ID NO: 462721 - RNA, 64 nt, Homo Sapiens; identical to SEQ ID NO: 336219

SEQ ID NO: 462722 - RNA, 64 nt, Homo Sapiens; identical to SEQ ID NO: 336220

SEQ ID NO: 462723 - RNA, 64 nt, Homo Sapiens; identical to SEQ ID NO: 336221

SEQ ID NO: 462724 - RNA, 64 nt, Homo Sapiens; identical to SEQ ID NO: 336222

SEQ ID NO: 462725 - RNA, 64 nt, Homo Sapiens; identical to SEQ ID NO: 336223

SEQ ID NO: 462726 - RNA, 64 nt, Homo Sapiens; identical to SEQ ID NO: 336224

SEQ ID NO: 462727 - RNA, 64 nt, Homo Sapiens; identical to SEQ ID NO: 336225

SEQ ID NO: 462728 - RNA, 64 nt, Homo Sapiens; identical to SEQ ID NO: 336226

SEQ ID NO: 462729 - RNA, 64 nt, Homo Sapiens; identical to SEQ ID NO: 336227

SEQ ID NO: 462730 - RNA, 64 nt, Homo Sapiens; identical to SEQ ID NO: 336228

SEQ ID NO: 462731 - RNA, 64 nt, Homo Sapiens; identical to SEQ ID NO: 336229

SEQ ID NO: 462732 - RNA, 64 nt, Homo Sapiens; identical to SEQ ID NO: 336230

SEQ ID NO: 462733 - RNA, 64 nt, Homo Sapiens; identical to SEQ ID NO: 336231

SEQ ID NO: 462734 - RNA, 64 nt, Homo Sapiens; identical to SEQ ID NO: 336232

SEQ ID NO: 462735 - RNA, 64 nt, Homo Sapiens; identical to SEQ ID NO: 336233

SEQ ID NO: 462736 - RNA, 64 nt, Homo Sapiens; identical to SEQ ID NO: 336234

SEQ ID NO: 462737 - RNA, 64 nt, Homo Sapiens; identical to SEQ ID NO: 336235

SEQ ID NO: 462738 - RNA, 64 nt, Homo Sapiens; identical to SEQ ID NO: 336236

SEQ ID NO: 462739 - RNA, 64 nt, Homo Sapiens; identical to SEQ ID NO: 336237

SEQ ID NO: 462740 - RNA, 64 nt, Homo Sapiens; identical to SEQ ID NO: 336238

SEQ ID NO: 462741 - RNA, 64 nt, Homo Sapiens; identical to SEQ ID NO: 336239

SEQ ID NO: 462742 - RNA, 64 nt, Homo Sapiens; identical to SEQ ID NO: 336240

SEQ ID NO: 462743 - RNA, 64 nt, Homo Sapiens; identical to SEQ ID NO: 336241

SEQ ID NO: 462744 - RNA, 64 nt, Homo Sapiens; identical to SEQ ID NO: 336242

SEQ ID NO: 462745 - RNA, 64 nt, Homo Sapiens; identical to SEQ ID NO: 336243

SEQ ID NO: 462746 - RNA, 64 nt, Homo Sapiens; identical to SEQ ID NO: 336244

SEQ ID NO: 462747 - RNA, 64 nt, Homo Sapiens; identical to SEQ ID NO: 336245

SEQ ID NO: 462748 - RNA, 64 nt, Homo Sapiens; identical to SEQ ID NO: 336246

SEQ ID NO: 462749 - RNA, 64 nt, Homo Sapiens; identical to SEQ ID NO: 336247

SEQ ID NO: 462750 - RNA, 64 nt, Homo Sapiens; identical to SEQ ID NO: 336248

SEQ ID NO: 462751 - RNA, 64 nt, Homo Sapiens; identical to SEQ ID NO: 336249

SEQ ID NO: 462752 - RNA, 64 nt, Homo Sapiens; identical to SEQ ID NO: 336250

SEQ ID NO: 462753 - RNA, 64 nt, Homo Sapiens; identical to SEQ ID NO: 336251

SEQ ID NO: 462754 - RNA, 64 nt, Homo Sapiens; identical to SEQ ID NO: 336252

SEQ ID NO: 462755 - RNA, 64 nt, Homo Sapiens; identical to SEQ ID NO: 336253

SEQ ID NO: 462756 - RNA, 64 nt, Homo Sapiens; identical to SEQ ID NO: 336254

SEQ ID NO: 462757 - RNA, 64 nt, Homo Sapiens; identical to SEQ ID NO: 336255

SEQ ID NO: 462758 - RNA, 64 nt, Homo Sapiens; identical to SEQ ID NO: 336256

SEQ ID NO: 462759 - RNA, 64 nt, Homo Sapiens; identical to SEQ ID NO: 336257

SEQ ID NO: 462760 - RNA, 64 nt, Homo Sapiens; identical to SEQ ID NO: 336258

SEQ ID NO: 462761 - RNA, 64 nt, Homo Sapiens; identical to SEQ ID NO: 336259

SEQ ID NO: 462762 - RNA, 64 nt, Homo Sapiens; identical to SEQ ID NO: 336260

SEQ ID NO: 462763 - RNA, 64 nt, Homo Sapiens; identical to SEQ ID NO: 336261

SEQ ID NO: 462764 - RNA, 64 nt, Homo Sapiens; identical to SEQ ID NO: 336262

SEQ ID NO: 462765 - RNA, 64 nt, Homo Sapiens; identical to SEQ ID NO: 336263

SEQ ID NO: 462766 - RNA, 64 nt, Homo Sapiens; identical to SEQ ID NO: 336264

SEQ ID NO: 462767 - RNA, 64 nt, Homo Sapiens; identical to SEQ ID NO: 336265

SEQ ID NO: 462768 - RNA, 64 nt, Homo Sapiens; identical to SEQ ID NO: 336266

SEQ ID NO: 462769 - RNA, 64 nt, Homo Sapiens; identical to SEQ ID NO: 336267

SEQ ID NO: 462770 - RNA, 64 nt, Homo Sapiens; identical to SEQ ID NO: 336268

SEQ ID NO: 462771 - RNA, 64 nt, Homo Sapiens; identical to SEQ ID NO: 336269

SEQ ID NO: 462772 - RNA, 64 nt, Homo Sapiens; identical to SEQ ID NO: 336270

SEQ ID NO: 462773 - RNA, 64 nt, Homo Sapiens; identical to SEQ ID NO: 336271

SEQ ID NO: 462774 - RNA, 64 nt, Homo Sapiens; identical to SEQ ID NO: 336272

SEQ ID NO: 462775 - RNA, 64 nt, Homo Sapiens; identical to SEQ ID NO: 336273

SEQ ID NO: 462776 - RNA, 64 nt, Homo Sapiens; identical to SEQ ID NO: 336274

SEQ ID NO: 462777 - RNA, 64 nt, Homo Sapiens; identical to SEQ ID NO: 336275

SEQ ID NO: 462778 - RNA, 64 nt, Homo Sapiens; identical to SEQ ID NO: 336276

SEQ ID NO: 462779 - RNA, 64 nt, Homo Sapiens; identical to SEQ ID NO: 336277

SEQ ID NO: 462780 - RNA, 64 nt, Homo Sapiens; identical to SEQ ID NO: 336278

SEQ ID NO: 462781 - RNA, 64 nt, Homo Sapiens; identical to SEQ ID NO: 336279

SEQ ID NO: 462782 - RNA, 64 nt, Homo Sapiens; identical to SEQ ID NO: 336280

SEQ ID NO: 462783 - RNA, 64 nt, Homo Sapiens; identical to SEQ ID NO: 336281

SEQ ID NO: 462784 - RNA, 64 nt, Homo Sapiens; identical to SEQ ID NO: 336282

SEQ ID NO: 462785 - RNA, 64 nt, Homo Sapiens; identical to SEQ ID NO: 336283

SEQ ID NO: 462786 - RNA, 64 nt, Homo Sapiens; identical to SEQ ID NO: 336284

SEQ ID NO: 462787 - RNA, 64 nt, Homo Sapiens; identical to SEQ ID NO: 336285

SEQ ID NO: 462788 - RNA, 64 nt, Homo Sapiens; identical to SEQ ID NO: 336286

SEQ ID NO: 462789 - RNA, 64 nt, Homo Sapiens; identical to SEQ ID NO: 336287

SEQ ID NO: 462790 - RNA, 64 nt, Homo Sapiens; identical to SEQ ID NO: 336288

SEQ ID NO: 462791 - RNA, 64 nt, Homo Sapiens; identical to SEQ ID NO: 336289

SEQ ID NO: 462792 - RNA, 64 nt, Homo Sapiens; identical to SEQ ID NO: 336290

SEQ ID NO: 462793 - RNA, 64 nt, Homo Sapiens; identical to SEQ ID NO: 336291

SEQ ID NO: 462794 - RNA, 64 nt, Homo Sapiens; identical to SEQ ID NO: 336292

SEQ ID NO: 462795 - RNA, 64 nt, Homo Sapiens; identical to SEQ ID NO: 336293

SEQ ID NO: 462796 - RNA, 64 nt, Homo Sapiens; identical to SEQ ID NO: 336294

SEQ ID NO: 462797 - RNA, 64 nt, Homo Sapiens; identical to SEQ ID NO: 336295

SEQ ID NO: 462798 - RNA, 64 nt, Homo Sapiens; identical to SEQ ID NO: 336296

SEQ ID NO: 462799 - RNA, 64 nt, Homo Sapiens; identical to SEQ ID NO: 336297

SEQ ID NO: 462800 - RNA, 64 nt, Homo Sapiens; identical to SEQ ID NO: 336298

SEQ ID NO: 462801 - RNA, 64 nt, Homo Sapiens; identical to SEQ ID NO: 336299

SEQ ID NO: 462802 - RNA, 64 nt, Homo Sapiens; identical to SEQ ID NO: 336300

SEQ ID NO: 462803 - RNA, 64 nt, Homo Sapiens; identical to SEQ ID NO: 336301

SEQ ID NO: 462804 - RNA, 64 nt, Homo Sapiens; identical to SEQ ID NO: 336302

SEQ ID NO: 462805 - RNA, 64 nt, Homo Sapiens; identical to SEQ ID NO: 336303

SEQ ID NO: 462806 - RNA, 64 nt, Homo Sapiens; identical to SEQ ID NO: 336304

SEQ ID NO: 462807 - RNA, 64 nt, Homo Sapiens; identical to SEQ ID NO: 336305

SEQ ID NO: 462808 - RNA, 64 nt, Homo Sapiens; identical to SEQ ID NO: 336306

SEQ ID NO: 462809 - RNA, 64 nt, Homo Sapiens; identical to SEQ ID NO: 336307

SEQ ID NO: 462810 - RNA, 64 nt, Homo Sapiens; identical to SEQ ID NO: 336308

SEQ ID NO: 462811 - RNA, 64 nt, Homo Sapiens; identical to SEQ ID NO: 336309

SEQ ID NO: 462812 - RNA, 63 nt, Homo Sapiens; identical to SEQ ID NO: 336310

SEQ ID NO: 462813 - RNA, 64 nt, Homo Sapiens; identical to SEQ ID NO: 336311

SEQ ID NO: 462814 - RNA, 64 nt, Homo Sapiens; identical to SEQ ID NO: 336312

SEQ ID NO: 462815 - RNA, 64 nt, Homo Sapiens; identical to SEQ ID NO: 336313

SEQ ID NO: 462816 - RNA, 64 nt, Homo Sapiens
ucuuguuauugcuccaguacauaggaauuguguaaaguguuaacagcagcuguauuuguuuaaa

SEQ ID NO: 462817 - RNA, 64 nt, Homo Sapiens
uaauguaagaauacuuuaaaucucuaagcuucugaaguguuagagguagagauggucuaguaaa

SEQ ID NO: 462818 - RNA, 64 nt, Homo Sapiens
uugagcuuggggugggagaucugugaaaagagccaaguguuacauaaaacuuaguaaugagaaa

SEQ ID NO: 462819 - RNA, 64 nt, Homo Sapiens
uagggaaauuggcaaaaagacccucccacacagaaaguguuagagucauagcccaugucuugug

SEQ ID NO: 462820 - RNA, 64 nt, Homo Sapiens
augugucaucaguauaauaaacuucuucaauacaaaguguuaauugcccugugauuuuuaugau

SEQ ID NO: 462821 - RNA, 64 nt, Homo Sapiens
agcugggauuacaaaagcauugccuccuggauucaaguguuagugcucagcuuacuguaaccuc

SEQ ID NO: 462822 - RNA, 64 nt, Homo Sapiens
uaguguuaaagauuaagcauaguaacugacucuuaaguguuaaauaauguagaaguaaaaaaau

SEQ ID NO: 462823 - RNA, 64 nt, Homo Sapiens
agauaaugcaguugguggaaaugauaaacguuuuaaguguuaacauccuuugaaugcguuggau

SEQ ID NO: 462824 - RNA, 64 nt, Homo Sapiens
uagagccacacacaacuuuugaacuuuuaauuauaaguguuauggcuaaaguuauuuacugaaa

SEQ ID NO: 462825 - RNA, 64 nt, Homo Sapiens
guuuucugggaauuuuguaacaaguuacacgcacaaguguuagaaacuuuggcauaacucaauu

SEQ ID NO: 462826 - RNA, 64 nt, Homo Sapiens
acuacacaacugccuuccugacagguucugagauaaguguuauguuuguagauagagugaaaua

SEQ ID NO: 462827 - RNA, 64 nt, Homo Sapiens
accuuauuuuacagaagugaaagugagguaucagaaguguuaagugacaugccugaggcacccc

SEQ ID NO: 462828 - RNA, 64 nt, Homo Sapiens
agcaaagcacuuggaaucuccguuuuaaagcuucaaguguuaaaaaugcuacaauaguuuuuua

SEQ ID NO: 462829 - RNA, 64 nt, Homo Sapiens
aagcguaagauugaggcaugaaguucagaaaaaaaaguguuacaacacacagggaaguuuuuuc

SEQ ID NO: 462830 - RNA, 64 nt, Homo Sapiens
auaaauauuuguagauaauacuguaguucuauucaaguguuacacuaucagugccaagggcuuc

SEQ ID NO: 462831 - RNA, 64 nt, Homo Sapiens
uuauuaaaaugaccaccauuucuuaauuauuaagaaguguuaccuuuuguuccauaaauguuuu

SEQ ID NO: 462832 - RNA, 64 nt, Homo Sapiens
uacauaggaaauaaaauggaugccaucuguccucaaguguuaucagaccguaaauucacauaua

SEQ ID NO: 462833 - RNA, 64 nt, Homo Sapiens
aguggggaacagaaguauauuuugauuucaacuaaaguguuauuuuugcuguauauguguggug

SEQ ID NO: 462834 - RNA, 64 nt, Homo Sapiens
uuacuauuuuguuuacaagauucaucuguuuuugaaguguuacccauucuugguggauaaauug

SEQ ID NO: 462835 - RNA, 64 nt, Homo Sapiens; identical to SEQ ID NO: 169116

SEQ ID NO: 462836 - RNA, 64 nt, Homo Sapiens; identical to SEQ ID NO: 169117

SEQ ID NO: 462837 - RNA, 64 nt, Homo Sapiens; identical to SEQ ID NO: 169118

SEQ ID NO: 462838 - RNA, 64 nt, Homo Sapiens; identical to SEQ ID NO: 169119

SEQ ID NO: 462839 - RNA, 64 nt, Homo Sapiens; identical to SEQ ID NO: 169120

SEQ ID NO: 462840 - RNA, 64 nt, Homo Sapiens; identical to SEQ ID NO: 169121

SEQ ID NO: 462841 - RNA, 64 nt, Homo Sapiens; identical to SEQ ID NO: 169122

SEQ ID NO: 462842 - RNA, 64 nt, Homo Sapiens; identical to SEQ ID NO: 169123

SEQ ID NO: 462843 - RNA, 64 nt, Homo Sapiens; identical to SEQ ID NO: 169124

SEQ ID NO: 462844 - RNA, 64 nt, Homo Sapiens; identical to SEQ ID NO: 169125

SEQ ID NO: 462845 - RNA, 64 nt, Homo Sapiens; identical to SEQ ID NO: 169126

SEQ ID NO: 462846 - RNA, 64 nt, Homo Sapiens; identical to SEQ ID NO: 169127

SEQ ID NO: 462847 - RNA, 64 nt, Homo Sapiens; identical to SEQ ID NO: 169128

SEQ ID NO: 462848 - RNA, 64 nt, Homo Sapiens; identical to SEQ ID NO: 169129

SEQ ID NO: 462849 - RNA, 64 nt, Homo Sapiens; identical to SEQ ID NO: 169130

SEQ ID NO: 462850 - RNA, 64 nt, Homo Sapiens; identical to SEQ ID NO: 169131

SEQ ID NO: 462851 - RNA, 64 nt, Homo Sapiens; identical to SEQ ID NO: 169132

SEQ ID NO: 462852 - RNA, 64 nt, Homo Sapiens; identical to SEQ ID NO: 169133

SEQ ID NO: 462853 - RNA, 64 nt, Homo Sapiens; identical to SEQ ID NO: 169134

SEQ ID NO: 462854 - RNA, 64 nt, Homo Sapiens; identical to SEQ ID NO: 169135

SEQ ID NO: 462855 - RNA, 64 nt, Homo Sapiens; identical to SEQ ID NO: 169136

SEQ ID NO: 462856 - RNA, 64 nt, Homo Sapiens; identical to SEQ ID NO: 169137

SEQ ID NO: 462857 - RNA, 64 nt, Homo Sapiens; identical to SEQ ID NO: 169138

SEQ ID NO: 462858 - RNA, 64 nt, Homo Sapiens; identical to SEQ ID NO: 169139

SEQ ID NO: 462859 - RNA, 64 nt, Homo Sapiens; identical to SEQ ID NO: 169140

SEQ ID NO: 462860 - RNA, 64 nt, Homo Sapiens; identical to SEQ ID NO: 169141

SEQ ID NO: 462861 - RNA, 64 nt, Homo Sapiens; identical to SEQ ID NO: 169142

SEQ ID NO: 462862 - RNA, 64 nt, Homo Sapiens; identical to SEQ ID NO: 169143

SEQ ID NO: 462863 - RNA, 64 nt, Homo Sapiens; identical to SEQ ID NO: 169144

SEQ ID NO: 462864 - RNA, 64 nt, Homo Sapiens; identical to SEQ ID NO: 169145

SEQ ID NO: 462865 - RNA, 64 nt, Homo Sapiens; identical to SEQ ID NO: 169146

SEQ ID NO: 462866 - RNA, 64 nt, Homo Sapiens; identical to SEQ ID NO: 169147

SEQ ID NO: 462867 - RNA, 64 nt, Homo Sapiens; identical to SEQ ID NO: 169148

SEQ ID NO: 462868 - RNA, 64 nt, Homo Sapiens; identical to SEQ ID NO: 169149

SEQ ID NO: 462869 - RNA, 64 nt, Homo Sapiens; identical to SEQ ID NO: 169150

SEQ ID NO: 462870 - RNA, 64 nt, Homo Sapiens; identical to SEQ ID NO: 169151

SEQ ID NO: 462871 - RNA, 64 nt, Homo Sapiens; identical to SEQ ID NO: 169152

SEQ ID NO: 462872 - RNA, 64 nt, Homo Sapiens; identical to SEQ ID NO: 169153

SEQ ID NO: 462873 - RNA, 64 nt, Homo Sapiens; identical to SEQ ID NO: 169154

SEQ ID NO: 462874 - RNA, 64 nt, Homo Sapiens; identical to SEQ ID NO: 169155

SEQ ID NO: 462875 - RNA, 64 nt, Homo Sapiens; identical to SEQ ID NO: 169156

SEQ ID NO: 462876 - RNA, 64 nt, Homo Sapiens
ucuuauuaagacuuauauaauaagugcauguaggaauugcaaaaaauauuuuaaaaauuuauua

SEQ ID NO: 462877 - RNA, 64 nt, Homo Sapiens
aaugaacugauacuuguuggaauguaugugaacuaauugcaauuauauuagagcauauuacugu

SEQ ID NO: 462878 - RNA, 64 nt, Homo Sapiens
aaauuaaaaacacaguuaaauugcuuuucaauauaauugcaaacuaauaaguaauuaucauugg

SEQ ID NO: 462879 - RNA, 64 nt, Homo Sapiens
guuucuuauccuaagauucaaagaguacacugauaauugcaacuguagccuuuaagaaggaauu

SEQ ID NO: 462880 - RNA, 64 nt, Homo Sapiens
aguuaacuuuucaucauguauauaguaauuuagaaauugcaaaucugucacauguuucuguuuc

SEQ ID NO: 462881 - RNA, 64 nt, Homo Sapiens
cccagcauaaauggguuagcuuuuucacacaaaaaauugcaaccaagucauugccaaggucuga

SEQ ID NO: 462882 - RNA, 64 nt, Homo Sapiens
uuucuuuuuuauuaccagguccauuuugccugacaauugcaaaucagagcauacaaaauaaaac

SEQ ID NO: 462883 - RNA, 64 nt, Homo Sapiens
gaacugaaauaaaaaauuauggauacguguuuugaauugcaaacuauuccucaggaauuccaau

SEQ ID NO: 462884 - RNA, 64 nt, Homo Sapiens
aaauuacuaugaaguauauugaaaacaggugcuuaauugcaauaaacaaaacugagauaauuua

SEQ ID NO: 462885 - RNA, 64 nt, Homo Sapiens
cacuuccuauuccugcauuucaaguuuugcacaaaauugcaaguugcccacaagaaagaggaca

SEQ ID NO: 462886 - RNA, 64 nt, Homo Sapiens
ggccacauaccuagaucucccaagaaaugugcucaauugcaauguagagauagagaaacagacc

SEQ ID NO: 462887 - RNA, 64 nt, Homo Sapiens
ugucacaggugugaugaaggcacaaucaaauauaaauugcaagaaggaauacauuagauaauga

SEQ ID NO: 462888 - RNA, 64 nt, Homo Sapiens
uguaauauaucaaagucaggaauugauugccagaaauugcaagaaauuuugucuauugucuuag

SEQ ID NO: 462889 - RNA, 64 nt, Homo Sapiens
ugaggauaaauaauaaaacuucagucaucagguaaauugcaagcuaagucaacaaaaugcaaua

SEQ ID NO: 462890 - RNA, 64 nt, Homo Sapiens
cuagacaaaaguuucacaaccuggaauaucugagaauugcaaaauaaugggaucuauuuuugca

SEQ ID NO: 462891 - RNA, 64 nt, Homo Sapiens
augcaaaagccaagaaaguauuuuuuuuuuuuuuaauugcaacaaacaauacugggcagccuuu

SEQ ID NO: 462892 - RNA, 64 nt, Homo Sapiens
ccaaaaauagcauacaccuaauguuggguuagggaauugcaauuucuacuuucauagagucaua

SEQ ID NO: 462893 - RNA, 64 nt, Homo Sapiens
uuuugcuugucauuucuuaauauaacucaacaagaauugcaacauuuguguaccaagcaauaag

SEQ ID NO: 462894 - RNA, 64 nt, Homo Sapiens
aagggaagggaaaaaugcuugucuggacaaacacaauugcaaaucaauaucucuuugaaugacu

SEQ ID NO: 462895 - RNA, 64 nt, Homo Sapiens
gcuauaaucacaagagcaauuccuuugucuucuaaauugcaauauaagaguuuuaaauacugaa

SEQ ID NO: 462896 - RNA, 64 nt, Homo Sapiens
augcugcaaauuaaaaaccucaaagaagggaaauaauugcaacaaaugggaauugauguugaau

SEQ ID NO: 462897 - RNA, 64 nt, Homo Sapiens
agaggagugcgcccuucagcagcauguauacaaaaauugcaacgauacagagauuagcauggcc

SEQ ID NO: 462898 - RNA, 64 nt, Homo Sapiens
aaaccacuuucuaauuuuuugaggaauccauguaaauugcaaauauacuaaaccucacaaagua

SEQ ID NO: 462899 - RNA, 64 nt, Homo Sapiens
cauuucaauuauacuaaaccguaauguuccugaaaauugcaauacaccuaauaucaauuuguag

SEQ ID NO: 462900 - RNA, 64 nt, Homo Sapiens
guuucauggauuuuucaucuucuaccguaugugaaauugcaaguguuugaagauuuauaaguac

SEQ ID NO: 462901 - RNA, 64 nt, Homo Sapiens
aggugccacucaguuuuagccaugucuucacugaaauugcaaaaguacuuuuagggagcaggag

SEQ ID NO: 462902 - RNA, 64 nt, Homo Sapiens
aggcaagaggccauauauagggcuacaucuuguuaauugcaauuguccaggaagguuuugggca

SEQ ID NO: 462903 - RNA, 64 nt, Homo Sapiens
cugcagcaguucugaaaugaugcuaugggaaaaaaauugcaaaauauguauuuuuaaaguucau

SEQ ID NO: 462904 - RNA, 64 nt, Homo Sapiens
ugaaaugaggccuacucuaaagaauucuugaaaaacuuacaagucaagccuagccugauaaucc

SEQ ID NO: 462905 - RNA, 64 nt, Homo Sapiens
agggaauaguauagacaauaaggaaggaaauaguacuuacaaaugacuccuaagggacugugag

SEQ ID NO: 462906 - RNA, 64 nt, Homo Sapiens
cucugcaagcuucuugcugaucagaguuccuccuacuuacaacccagggugugaacauguucuc

SEQ ID NO: 462907 - RNA, 64 nt, Homo Sapiens
gaggaagacaagcauuuuuaaaaaauaaauuuaaacuuacaaacuuuguuugucacaaguggug

SEQ ID NO: 462908 - RNA, 64 nt, Homo Sapiens
cacuccuuuuucccuuaaacauuuguacuuuuucacuuacaaagugucaagagaaaggccaaag

SEQ ID NO: 462909 - RNA, 64 nt, Homo Sapiens
acuugcagcaguaguuuguuuacagagaaaauggacuuacaaaaaguagugagcaguuuguaug

SEQ ID NO: 462910 - RNA, 64 nt, Homo Sapiens
acaagguuuccauuuuuccauuucuauuaggacuacuuacaagggagcauaugaguaagucaca

SEQ ID NO: 462911 - RNA, 64 nt, Homo Sapiens
auuuguuuacuaugaaauuuauggggaaauuaucacuuacaaguaacauuaucuuauuuggaaa

SEQ ID NO: 462912 - RNA, 64 nt, Homo Sapiens
uaaaaggaaaggaaggaaggaaaaagcagcuuucacuuacaaaguuucguguaaaaauaucuuu

SEQ ID NO: 462913 - RNA, 64 nt, Homo Sapiens
aaaaaaacuuuaaugaaagguggaaaauaauuuaacuuacaaugugaaaauacaaugugaaaug

SEQ ID NO: 462914 - RNA, 64 nt, Homo Sapiens
ucuuccccccccgccccugcagaggaaugaaacuacuuacaacauuuaauuccuuucauaauau

SEQ ID NO: 462915 - RNA, 64 nt, Homo Sapiens
auuugucucguaaaccuggucugcagaaagucaaacuuacaaaaacuguugugacaaauguuau

SEQ ID NO: 462916 - RNA, 64 nt, Homo Sapiens; identical to SEQ ID NO: 284290

SEQ ID NO: 462917 - RNA, 64 nt, Homo Sapiens; identical to SEQ ID NO: 284291

SEQ ID NO: 462918 - RNA, 64 nt, Homo Sapiens; identical to SEQ ID NO: 284292

SEQ ID NO: 462919 - RNA, 64 nt, Homo Sapiens; identical to SEQ ID NO: 284293

SEQ ID NO: 462920 - RNA, 64 nt, Homo Sapiens; identical to SEQ ID NO: 284294

SEQ ID NO: 462921 - RNA, 64 nt, Homo Sapiens; identical to SEQ ID NO: 284295

SEQ ID NO: 462922 - RNA, 64 nt, Homo Sapiens; identical to SEQ ID NO: 284296

SEQ ID NO: 462923 - RNA, 64 nt, Homo Sapiens; identical to SEQ ID NO: 284297

SEQ ID NO: 462924 - RNA, 64 nt, Homo Sapiens; identical to SEQ ID NO: 284298

SEQ ID NO: 462925 - RNA, 64 nt, Homo Sapiens; identical to SEQ ID NO: 284299

SEQ ID NO: 462926 - RNA, 64 nt, Homo Sapiens; identical to SEQ ID NO: 284300

SEQ ID NO: 462927 - RNA, 64 nt, Homo Sapiens; identical to SEQ ID NO: 284301

SEQ ID NO: 462928 - RNA, 64 nt, Homo Sapiens; identical to SEQ ID NO: 284302

SEQ ID NO: 462929 - RNA, 64 nt, Homo Sapiens; identical to SEQ ID NO: 284303

SEQ ID NO: 462930 - RNA, 64 nt, Homo Sapiens; identical to SEQ ID NO: 284304

SEQ ID NO: 462931 - RNA, 64 nt, Homo Sapiens; identical to SEQ ID NO: 284305

SEQ ID NO: 462932 - RNA, 64 nt, Homo Sapiens; identical to SEQ ID NO: 284306

SEQ ID NO: 462933 - RNA, 64 nt, Homo Sapiens; identical to SEQ ID NO: 284307

SEQ ID NO: 462934 - RNA, 64 nt, Homo Sapiens; identical to SEQ ID NO: 284308

SEQ ID NO: 462935 - RNA, 64 nt, Homo Sapiens; identical to SEQ ID NO: 284309

SEQ ID NO: 462936 - RNA, 64 nt, Homo Sapiens; identical to SEQ ID NO: 284310

SEQ ID NO: 462937 - RNA, 64 nt, Homo Sapiens; identical to SEQ ID NO: 284311

SEQ ID NO: 462938 - RNA, 64 nt, Homo Sapiens; identical to SEQ ID NO: 284312

SEQ ID NO: 462939 - RNA, 64 nt, Homo Sapiens; identical to SEQ ID NO: 284313

SEQ ID NO: 462940 - RNA, 64 nt, Homo Sapiens; identical to SEQ ID NO: 284314

SEQ ID NO: 462941 - RNA, 64 nt, Homo Sapiens; identical to SEQ ID NO: 284315

SEQ ID NO: 462942 - RNA, 64 nt, Homo Sapiens; identical to SEQ ID NO: 284316

SEQ ID NO: 462943 - RNA, 64 nt, Homo Sapiens; identical to SEQ ID NO: 284317

SEQ ID NO: 462944 - RNA, 64 nt, Homo Sapiens; identical to SEQ ID NO: 284318

SEQ ID NO: 462945 - RNA, 64 nt, Homo Sapiens; identical to SEQ ID NO: 284319

SEQ ID NO: 462946 - RNA, 64 nt, Homo Sapiens; identical to SEQ ID NO: 284320

SEQ ID NO: 462947 - RNA, 64 nt, Homo Sapiens; identical to SEQ ID NO: 284321

SEQ ID NO: 462948 - RNA, 64 nt, Homo Sapiens; identical to SEQ ID NO: 284322

SEQ ID NO: 462949 - RNA, 64 nt, Homo Sapiens; identical to SEQ ID NO: 284323

SEQ ID NO: 462950 - RNA, 64 nt, Homo Sapiens; identical to SEQ ID NO: 284324

SEQ ID NO: 462951 - RNA, 64 nt, Homo Sapiens; identical to SEQ ID NO: 284325

SEQ ID NO: 462952 - RNA, 64 nt, Homo Sapiens; identical to SEQ ID NO: 284326

SEQ ID NO: 462953 - RNA, 64 nt, Homo Sapiens; identical to SEQ ID NO: 284327

SEQ ID NO: 462954 - RNA, 64 nt, Homo Sapiens; identical to SEQ ID NO: 284328

SEQ ID NO: 462955 - RNA, 64 nt, Homo Sapiens; identical to SEQ ID NO: 284329

SEQ ID NO: 462956 - RNA, 64 nt, Homo Sapiens; identical to SEQ ID NO: 284330

SEQ ID NO: 462957 - RNA, 64 nt, Homo Sapiens; identical to SEQ ID NO: 284331

SEQ ID NO: 462958 - RNA, 64 nt, Homo Sapiens; identical to SEQ ID NO: 284332

SEQ ID NO: 462959 - RNA, 64 nt, Homo Sapiens; identical to SEQ ID NO: 284333

SEQ ID NO: 462960 - RNA, 50 nt, Homo Sapiens; identical to SEQ ID NO: 284334

SEQ ID NO: 462961 - RNA, 64 nt, Homo Sapiens; identical to SEQ ID NO: 284335

SEQ ID NO: 462962 - RNA, 64 nt, Homo Sapiens; identical to SEQ ID NO: 284336

SEQ ID NO: 462963 - RNA, 64 nt, Homo Sapiens; identical to SEQ ID NO: 284337

SEQ ID NO: 462964 - RNA, 64 nt, Homo Sapiens; identical to SEQ ID NO: 284338

SEQ ID NO: 462965 - RNA, 64 nt, Homo Sapiens; identical to SEQ ID NO: 284339

SEQ ID NO: 462966 - RNA, 64 nt, Homo Sapiens; identical to SEQ ID NO: 284340

SEQ ID NO: 462967 - RNA, 64 nt, Homo Sapiens; identical to SEQ ID NO: 284341

SEQ ID NO: 462968 - RNA, 64 nt, Homo Sapiens; identical to SEQ ID NO: 284342

SEQ ID NO: 462969 - RNA, 64 nt, Homo Sapiens; identical to SEQ ID NO: 284343

SEQ ID NO: 462970 - RNA, 64 nt, Homo Sapiens; identical to SEQ ID NO: 284344

SEQ ID NO: 462971 - RNA, 64 nt, Homo Sapiens; identical to SEQ ID NO: 284345

SEQ ID NO: 462972 - RNA, 64 nt, Homo Sapiens; identical to SEQ ID NO: 284346

SEQ ID NO: 462973 - RNA, 64 nt, Homo Sapiens; identical to SEQ ID NO: 284347

SEQ ID NO: 462974 - RNA, 64 nt, Homo Sapiens; identical to SEQ ID NO: 284348

SEQ ID NO: 462975 - RNA, 64 nt, Homo Sapiens; identical to SEQ ID NO: 284349

SEQ ID NO: 462976 - RNA, 64 nt, Homo Sapiens; identical to SEQ ID NO: 284350

SEQ ID NO: 462977 - RNA, 64 nt, Homo Sapiens; identical to SEQ ID NO: 284351

SEQ ID NO: 462978 - RNA, 64 nt, Homo Sapiens; identical to SEQ ID NO: 284352

SEQ ID NO: 462979 - RNA, 64 nt, Homo Sapiens; identical to SEQ ID NO: 284353

SEQ ID NO: 462980 - RNA, 64 nt, Homo Sapiens
aacugagaaccuagucucguauauucugaguaaauggaaucaguccugggaauagagagugucc

SEQ ID NO: 462981 - RNA, 64 nt, Homo Sapiens
ugaaucauuugucuaagagguacauucuuccagauggaaucaauaacuuuuuuuuuuccagguu

SEQ ID NO: 462982 - RNA, 64 nt, Homo Sapiens
cauuugcccuguggauuccagcauuugccauuccuggaaucaaggaauccugagucugggcaau

SEQ ID NO: 462983 - RNA, 64 nt, Homo Sapiens
uuuuaguuuguuuuacaaauuuuuccugcaaaaguggaaucacuguauuuucauuuuaauuuau

SEQ ID NO: 462984 - RNA, 64 nt, Homo Sapiens
caucccuuacuggucucaaccaaaauauuccuguuggaaucaugaugauaaucauagcagcacu

SEQ ID NO: 462985 - RNA, 64 nt, Homo Sapiens
uguacugcuuaugguuguaggauucagggguuaauggaaucacagaaaugauauucugcaagaa

SEQ ID NO: 462986 - RNA, 64 nt, Homo Sapiens
uuaaucagaaaaagacauacaguagacagugugguggaaucagucucuagacuagacugauuga

SEQ ID NO: 462987 - RNA, 64 nt, Homo Sapiens
uccauaggagguaauuuccauacaacagugacauuggaaucauuuucauuaaaugucauauucu

SEQ ID NO: 462988 - RNA, 64 nt, Homo Sapiens
guuuagaacacacacacuuaugaacacauugaguuggaaucacucagggucaaaguguuuucuc

SEQ ID NO: 462989 - RNA, 64 nt, Homo Sapiens
ucaggacugccauuggacuaccuugguuccuaacuggaaucagcaaccaaagaagaaaguccac

SEQ ID NO: 462990 - RNA, 64 nt, Homo Sapiens
uucuguuuaucaagccauaauuuggaaucagaauuggaaucacaaugaucugggagagucucac

SEQ ID NO: 462991 - RNA, 64 nt, Homo Sapiens
auuggaaucacauucuguuuggagagucucacuuuggaaucagagagaagacauggaugaucug

SEQ ID NO: 462992 - RNA, 64 nt, Homo Sapiens
aaccaagccaugcuggugggaguggucugaauucuggaaucacaguaacugugugagauuguga

SEQ ID NO: 462993 - RNA, 64 nt, Homo Sapiens
uuggcgcugcuucucauucaaauuucaacaauacuggaaucauuaggcgcuuucagggcacugu

SEQ ID NO: 462994 - RNA, 64 nt, Homo Sapiens
uauuuuuuccaggggugagauuaaaacccaaucuuggaaucaaaaaauuauucaugauacacug

SEQ ID NO: 462995 - RNA, 64 nt, Homo Sapiens; identical to SEQ ID NO: 133159

SEQ ID NO: 462996 - RNA, 64 nt, Homo Sapiens; identical to SEQ ID NO: 133160

SEQ ID NO: 462997 - RNA, 64 nt, Homo Sapiens; identical to SEQ ID NO: 133161

SEQ ID NO: 462998 - RNA, 64 nt, Homo Sapiens; identical to SEQ ID NO: 133162

SEQ ID NO: 462999 - RNA, 64 nt, Homo Sapiens; identical to SEQ ID NO: 133163

SEQ ID NO: 463000 - RNA, 64 nt, Homo Sapiens; identical to SEQ ID NO: 133164

SEQ ID NO: 463001 - RNA, 64 nt, Homo Sapiens; identical to SEQ ID NO: 133165

SEQ ID NO: 463002 - RNA, 64 nt, Homo Sapiens; identical to SEQ ID NO: 133166

SEQ ID NO: 463003 - RNA, 64 nt, Homo Sapiens; identical to SEQ ID NO: 133167

SEQ ID NO: 463004 - RNA, 64 nt, Homo Sapiens; identical to SEQ ID NO: 133168

SEQ ID NO: 463005 - RNA, 64 nt, Homo Sapiens; identical to SEQ ID NO: 133169

SEQ ID NO: 463006 - RNA, 64 nt, Homo Sapiens; identical to SEQ ID NO: 133170

SEQ ID NO: 463007 - RNA, 64 nt, Homo Sapiens; identical to SEQ ID NO: 133171

SEQ ID NO: 463008 - RNA, 64 nt, Homo Sapiens; identical to SEQ ID NO: 133172

SEQ ID NO: 463009 - RNA, 64 nt, Homo Sapiens; identical to SEQ ID NO: 133173

SEQ ID NO: 463010 - RNA, 64 nt, Homo Sapiens; identical to SEQ ID NO: 133174

SEQ ID NO: 463011 - RNA, 64 nt, Homo Sapiens; identical to SEQ ID NO: 133175

SEQ ID NO: 463012 - RNA, 64 nt, Homo Sapiens; identical to SEQ ID NO: 133176

SEQ ID NO: 463013 - RNA, 64 nt, Homo Sapiens; identical to SEQ ID NO: 133177

SEQ ID NO: 463014 - RNA, 64 nt, Homo Sapiens; identical to SEQ ID NO: 133178

SEQ ID NO: 463015 - RNA, 64 nt, Homo Sapiens; identical to SEQ ID NO: 133179

SEQ ID NO: 463016 - RNA, 64 nt, Homo Sapiens; identical to SEQ ID NO: 133180

SEQ ID NO: 463017 - RNA, 64 nt, Homo Sapiens; identical to SEQ ID NO: 133181

SEQ ID NO: 463018 - RNA, 64 nt, Homo Sapiens; identical to SEQ ID NO: 133182

SEQ ID NO: 463019 - RNA, 64 nt, Homo Sapiens; identical to SEQ ID NO: 133183

SEQ ID NO: 463020 - RNA, 64 nt, Homo Sapiens; identical to SEQ ID NO: 133184

SEQ ID NO: 463021 - RNA, 64 nt, Homo Sapiens; identical to SEQ ID NO: 133185

SEQ ID NO: 463022 - RNA, 64 nt, Homo Sapiens; identical to SEQ ID NO: 133186

SEQ ID NO: 463023 - RNA, 64 nt, Homo Sapiens; identical to SEQ ID NO: 133187

SEQ ID NO: 463024 - RNA, 64 nt, Homo Sapiens; identical to SEQ ID NO: 133188

SEQ ID NO: 463025 - RNA, 64 nt, Homo Sapiens; identical to SEQ ID NO: 133189

SEQ ID NO: 463026 - RNA, 64 nt, Homo Sapiens; identical to SEQ ID NO: 133190

SEQ ID NO: 463027 - RNA, 64 nt, Homo Sapiens; identical to SEQ ID NO: 133191

SEQ ID NO: 463028 - RNA, 64 nt, Homo Sapiens; identical to SEQ ID NO: 133192

SEQ ID NO: 463029 - RNA, 64 nt, Homo Sapiens; identical to SEQ ID NO: 133193

SEQ ID NO: 463030 - RNA, 64 nt, Homo Sapiens; identical to SEQ ID NO: 133194

SEQ ID NO: 463031 - RNA, 64 nt, Homo Sapiens; identical to SEQ ID NO: 133195

SEQ ID NO: 463032 - RNA, 64 nt, Homo Sapiens; identical to SEQ ID NO: 133196

SEQ ID NO: 463033 - RNA, 64 nt, Homo Sapiens; identical to SEQ ID NO: 133197

SEQ ID NO: 463034 - RNA, 64 nt, Homo Sapiens; identical to SEQ ID NO: 133198

SEQ ID NO: 463035 - RNA, 64 nt, Homo Sapiens; identical to SEQ ID NO: 133199

SEQ ID NO: 463036 - RNA, 64 nt, Homo Sapiens; identical to SEQ ID NO: 133200

SEQ ID NO: 463037 - RNA, 64 nt, Homo Sapiens; identical to SEQ ID NO: 133201

SEQ ID NO: 463038 - RNA, 64 nt, Homo Sapiens; identical to SEQ ID NO: 133202

SEQ ID NO: 463039 - RNA, 64 nt, Homo Sapiens; identical to SEQ ID NO: 133203

SEQ ID NO: 463040 - RNA, 64 nt, Homo Sapiens
uuacugucgguuuauugggguauuaaaugcauucucagcuuacaauauuuuugacuuacaauug

SEQ ID NO: 463041 - RNA, 64 nt, Homo Sapiens
auuuuguauccugagacuuugcugaaguugcuuaucagcuuaaggagauuuugggcugagacaa

SEQ ID NO: 463042 - RNA, 64 nt, Homo Sapiens
cccgggcugaaaaccucaauuuccuuuuuuugauucagcuuauauacacuauuggauuuuuuau

SEQ ID NO: 463043 - RNA, 64 nt, Homo Sapiens
gaaagagaauaaauuuuagaaugauaggaagcucucagcuuagguucauaacauagauacugac

SEQ ID NO: 463044 - RNA, 64 nt, Homo Sapiens; identical to SEQ ID NO: 133159

SEQ ID NO: 463045 - RNA, 64 nt, Homo Sapiens; identical to SEQ ID NO: 133160

SEQ ID NO: 463046 - RNA, 64 nt, Homo Sapiens; identical to SEQ ID NO: 133161

SEQ ID NO: 463047 - RNA, 64 nt, Homo Sapiens; identical to SEQ ID NO: 133162

SEQ ID NO: 463048 - RNA, 64 nt, Homo Sapiens; identical to SEQ ID NO: 133163

SEQ ID NO: 463049 - RNA, 64 nt, Homo Sapiens; identical to SEQ ID NO: 133164

SEQ ID NO: 463050 - RNA, 64 nt, Homo Sapiens; identical to SEQ ID NO: 133165

SEQ ID NO: 463051 - RNA, 64 nt, Homo Sapiens; identical to SEQ ID NO: 133166

SEQ ID NO: 463052 - RNA, 64 nt, Homo Sapiens; identical to SEQ ID NO: 133167

SEQ ID NO: 463053 - RNA, 64 nt, Homo Sapiens; identical to SEQ ID NO: 133168

SEQ ID NO: 463054 - RNA, 64 nt, Homo Sapiens; identical to SEQ ID NO: 133169

SEQ ID NO: 463055 - RNA, 64 nt, Homo Sapiens; identical to SEQ ID NO: 133170

SEQ ID NO: 463056 - RNA, 64 nt, Homo Sapiens; identical to SEQ ID NO: 133171

SEQ ID NO: 463057 - RNA, 64 nt, Homo Sapiens; identical to SEQ ID NO: 133172

SEQ ID NO: 463058 - RNA, 64 nt, Homo Sapiens; identical to SEQ ID NO: 133173

SEQ ID NO: 463059 - RNA, 64 nt, Homo Sapiens; identical to SEQ ID NO: 133174

SEQ ID NO: 463060 - RNA, 64 nt, Homo Sapiens; identical to SEQ ID NO: 133175

SEQ ID NO: 463061 - RNA, 64 nt, Homo Sapiens; identical to SEQ ID NO: 133176

SEQ ID NO: 463062 - RNA, 64 nt, Homo Sapiens; identical to SEQ ID NO: 133177

SEQ ID NO: 463063 - RNA, 64 nt, Homo Sapiens; identical to SEQ ID NO: 133178

SEQ ID NO: 463064 - RNA, 64 nt, Homo Sapiens; identical to SEQ ID NO: 133179

SEQ ID NO: 463065 - RNA, 64 nt, Homo Sapiens; identical to SEQ ID NO: 133180

SEQ ID NO: 463066 - RNA, 64 nt, Homo Sapiens; identical to SEQ ID NO: 133181

SEQ ID NO: 463067 - RNA, 64 nt, Homo Sapiens; identical to SEQ ID NO: 133182

SEQ ID NO: 463068 - RNA, 64 nt, Homo Sapiens; identical to SEQ ID NO: 133183

SEQ ID NO: 463069 - RNA, 64 nt, Homo Sapiens; identical to SEQ ID NO: 133184

SEQ ID NO: 463070 - RNA, 64 nt, Homo Sapiens; identical to SEQ ID NO: 133185

SEQ ID NO: 463071 - RNA, 64 nt, Homo Sapiens; identical to SEQ ID NO: 133186

SEQ ID NO: 463072 - RNA, 64 nt, Homo Sapiens; identical to SEQ ID NO: 133187

SEQ ID NO: 463073 - RNA, 64 nt, Homo Sapiens; identical to SEQ ID NO: 133188

SEQ ID NO: 463074 - RNA, 64 nt, Homo Sapiens; identical to SEQ ID NO: 133189

SEQ ID NO: 463075 - RNA, 64 nt, Homo Sapiens; identical to SEQ ID NO: 133190

SEQ ID NO: 463076 - RNA, 64 nt, Homo Sapiens; identical to SEQ ID NO: 133191

SEQ ID NO: 463077 - RNA, 64 nt, Homo Sapiens; identical to SEQ ID NO: 133192

SEQ ID NO: 463078 - RNA, 64 nt, Homo Sapiens; identical to SEQ ID NO: 133193

SEQ ID NO: 463079 - RNA, 64 nt, Homo Sapiens; identical to SEQ ID NO: 133194

SEQ ID NO: 463080 - RNA, 64 nt, Homo Sapiens; identical to SEQ ID NO: 133195

SEQ ID NO: 463081 - RNA, 64 nt, Homo Sapiens; identical to SEQ ID NO: 133196

SEQ ID NO: 463082 - RNA, 64 nt, Homo Sapiens; identical to SEQ ID NO: 133197

SEQ ID NO: 463083 - RNA, 64 nt, Homo Sapiens; identical to SEQ ID NO: 133198

SEQ ID NO: 463084 - RNA, 64 nt, Homo Sapiens; identical to SEQ ID NO: 133199

SEQ ID NO: 463085 - RNA, 64 nt, Homo Sapiens; identical to SEQ ID NO: 133200

SEQ ID NO: 463086 - RNA, 64 nt, Homo Sapiens; identical to SEQ ID NO: 133201

SEQ ID NO: 463087 - RNA, 64 nt, Homo Sapiens; identical to SEQ ID NO: 133202

SEQ ID NO: 463088 - RNA, 64 nt, Homo Sapiens; identical to SEQ ID NO: 133203

SEQ ID NO: 463089 - RNA, 64 nt, Homo Sapiens; identical to SEQ ID NO: 110824

SEQ ID NO: 463090 - RNA, 64 nt, Homo Sapiens; identical to SEQ ID NO: 110825

SEQ ID NO: 463091 - RNA, 64 nt, Homo Sapiens; identical to SEQ ID NO: 110826

SEQ ID NO: 463092 - RNA, 64 nt, Homo Sapiens; identical to SEQ ID NO: 110827

SEQ ID NO: 463093 - RNA, 64 nt, Homo Sapiens; identical to SEQ ID NO: 110828

SEQ ID NO: 463094 - RNA, 64 nt, Homo Sapiens; identical to SEQ ID NO: 110829

SEQ ID NO: 463095 - RNA, 64 nt, Homo Sapiens; identical to SEQ ID NO: 110830

SEQ ID NO: 463096 - RNA, 64 nt, Homo Sapiens; identical to SEQ ID NO: 110831

SEQ ID NO: 463097 - RNA, 64 nt, Homo Sapiens; identical to SEQ ID NO: 110832

SEQ ID NO: 463098 - RNA, 64 nt, Homo Sapiens; identical to SEQ ID NO: 110833

SEQ ID NO: 463099 - RNA, 64 nt, Homo Sapiens
auuggaaauacauaugcccaguuuggaauuacuuauuaaggagaacaaaccccacauuauucca

SEQ ID NO: 463100 - RNA, 64 nt, Homo Sapiens
uuauaaacucaaauuggcacgcacaaagaauaaaauuaaggauuucucaaauugaaacuuuucu

SEQ ID NO: 463101 - RNA, 64 nt, Homo Sapiens
uaggaaacugaaacucugugauauaaauacauagauuaaggaaauuucuauauuguauguaugu

SEQ ID NO: 463102 - RNA, 64 nt, Homo Sapiens
aacuggaaaaaaugugucucgauuuaauauuuguauuaaggauuggguugcugguaguuaauug

SEQ ID NO: 463103 - RNA, 64 nt, Homo Sapiens
augaaaauaaucuggcaucacuuguuuguauuuuauuaaggaaaauauaagugaauuuugugcu

SEQ ID NO: 463104 - RNA, 64 nt, Homo Sapiens
cuuucggagucaaggaaagccuuucuauaagcaaauuaaggaagaaaagguaggauuauaagau

SEQ ID NO: 463105 - RNA, 64 nt, Homo Sapiens
uuguguuugaauauuguagguagaugcauuuguaauuaaggauaauaucguuuaacaacaugua

SEQ ID NO: 463106 - RNA, 64 nt, Homo Sapiens
aauagaaaagaagaaauuuagcccuaacucucuuauuaaggagacuuaaaaaaaucaauuuaau

SEQ ID NO: 463107 - RNA, 64 nt, Homo Sapiens
uaagacauuacagccuuagaaucuaaucaugccuauuaaggaugauuuggaaaauuugggagaa

SEQ ID NO: 463108 - RNA, 64 nt, Homo Sapiens
agcuuuaaaauaauuuuuuaguaauuauuacaaaauuaaggaaaaucucuauuaccguuaucuu

SEQ ID NO: 463109 - RNA, 64 nt, Homo Sapiens
gggaaaagaaaagaguaauaauuuuuuuuaaaacauuaaggaauuggaauucagaaagguuacc

SEQ ID NO: 463110 - RNA, 64 nt, Homo Sapiens
ccaggcaugcaacagauuuuucaacuguaguuuuauuaaggaaguuuuuugacacuggaaaugu

SEQ ID NO: 463111 - RNA, 64 nt, Homo Sapiens
gcgguguagguguugugagcgccugaucauagacauuaaggaaaccagugaaguagugacggaa

SEQ ID NO: 463112 - RNA, 64 nt, Homo Sapiens
uauuuuuccccacaauugucagagaauuccucucauuaaggaaaaaaccucacugagcauguuc

SEQ ID NO: 463113 - RNA, 64 nt, Homo Sapiens
aauuaccauaacaucuucaucugaagcugacacaauuaaggaugguguggcugcaaauuucccu

SEQ ID NO: 463114 - RNA, 64 nt, Homo Sapiens; identical to SEQ ID NO: 332815

SEQ ID NO: 463115 - RNA, 64 nt, Homo Sapiens; identical to SEQ ID NO: 332816

SEQ ID NO: 463116 - RNA, 64 nt, Homo Sapiens; identical to SEQ ID NO: 332817

SEQ ID NO: 463117 - RNA, 64 nt, Homo Sapiens; identical to SEQ ID NO: 332818

SEQ ID NO: 463118 - RNA, 64 nt, Homo Sapiens; identical to SEQ ID NO: 332819

SEQ ID NO: 463119 - RNA, 64 nt, Homo Sapiens; identical to SEQ ID NO: 332820

SEQ ID NO: 463120 - RNA, 64 nt, Homo Sapiens; identical to SEQ ID NO: 332821

SEQ ID NO: 463121 - RNA, 64 nt, Homo Sapiens; identical to SEQ ID NO: 332822

SEQ ID NO: 463122 - RNA, 64 nt, Homo Sapiens; identical to SEQ ID NO: 332823

SEQ ID NO: 463123 - RNA, 64 nt, Homo Sapiens; identical to SEQ ID NO: 332824

SEQ ID NO: 463124 - RNA, 64 nt, Homo Sapiens; identical to SEQ ID NO: 332825

SEQ ID NO: 463125 - RNA, 64 nt, Homo Sapiens; identical to SEQ ID NO: 332826

SEQ ID NO: 463126 - RNA, 64 nt, Homo Sapiens
cccgcgcacagcguaggcacccgguguacucuguaaacgggaggagguggggcgaggcagccag

SEQ ID NO: 463127 - RNA, 64 nt, Homo Sapiens
cuggcacagggacccucgauggagcgaagcccucaaacgggaugcuuucugguauucuaucggg

SEQ ID NO: 463128 - RNA, 64 nt, Homo Sapiens; identical to SEQ ID NO: 313172

SEQ ID NO: 463129 - RNA, 64 nt, Homo Sapiens; identical to SEQ ID NO: 313173

SEQ ID NO: 463130 - RNA, 64 nt, Homo Sapiens; identical to SEQ ID NO: 189516

SEQ ID NO: 463131 - RNA, 64 nt, Homo Sapiens; identical to SEQ ID NO: 189517

SEQ ID NO: 463132 - RNA, 64 nt, Homo Sapiens; identical to SEQ ID NO: 101929

SEQ ID NO: 463133 - RNA, 64 nt, Homo Sapiens; identical to SEQ ID NO: 101930

SEQ ID NO: 463134 - RNA, 64 nt, Homo Sapiens; identical to SEQ ID NO: 101931

SEQ ID NO: 463135 - RNA, 64 nt, Homo Sapiens; identical to SEQ ID NO: 101932

SEQ ID NO: 463136 - RNA, 64 nt, Homo Sapiens; identical to SEQ ID NO: 101933

SEQ ID NO: 463137 - RNA, 64 nt, Homo Sapiens; identical to SEQ ID NO: 101934

SEQ ID NO: 463138 - RNA, 64 nt, Homo Sapiens; identical to SEQ ID NO: 101935

SEQ ID NO: 463139 - RNA, 64 nt, Homo Sapiens; identical to SEQ ID NO: 101936

SEQ ID NO: 463140 - RNA, 64 nt, Homo Sapiens; identical to SEQ ID NO: 101937

SEQ ID NO: 463141 - RNA, 64 nt, Homo Sapiens; identical to SEQ ID NO: 101938

SEQ ID NO: 463142 - RNA, 64 nt, Homo Sapiens; identical to SEQ ID NO: 101939

SEQ ID NO: 463143 - RNA, 64 nt, Homo Sapiens; identical to SEQ ID NO: 101940

SEQ ID NO: 463144 - RNA, 64 nt, Homo Sapiens; identical to SEQ ID NO: 101941

SEQ ID NO: 463145 - RNA, 64 nt, Homo Sapiens; identical to SEQ ID NO: 101942

SEQ ID NO: 463146 - RNA, 64 nt, Homo Sapiens; identical to SEQ ID NO: 101943

SEQ ID NO: 463147 - RNA, 64 nt, Homo Sapiens; identical to SEQ ID NO: 101944

SEQ ID NO: 463148 - RNA, 64 nt, Homo Sapiens; identical to SEQ ID NO: 101945

SEQ ID NO: 463149 - RNA, 64 nt, Homo Sapiens; identical to SEQ ID NO: 101946

SEQ ID NO: 463150 - RNA, 64 nt, Homo Sapiens; identical to SEQ ID NO: 101947

SEQ ID NO: 463151 - RNA, 64 nt, Homo Sapiens; identical to SEQ ID NO: 92469

SEQ ID NO: 463152 - RNA, 64 nt, Homo Sapiens; identical to SEQ ID NO: 92470

SEQ ID NO: 463153 - RNA, 64 nt, Homo Sapiens; identical to SEQ ID NO: 92471

SEQ ID NO: 463154 - RNA, 64 nt, Homo Sapiens; identical to SEQ ID NO: 92472

SEQ ID NO: 463155 - RNA, 64 nt, Homo Sapiens; identical to SEQ ID NO: 92473

SEQ ID NO: 463156 - RNA, 64 nt, Homo Sapiens; identical to SEQ ID NO: 92474

SEQ ID NO: 463157 - RNA, 63 nt, Homo Sapiens; identical to SEQ ID NO: 92475

SEQ ID NO: 463158 - RNA, 64 nt, Homo Sapiens; identical to SEQ ID NO: 92476

SEQ ID NO: 463159 - RNA, 64 nt, Homo Sapiens; identical to SEQ ID NO: 92477

SEQ ID NO: 463160 - RNA, 64 nt, Homo Sapiens; identical to SEQ ID NO: 92478

SEQ ID NO: 463161 - RNA, 64 nt, Homo Sapiens; identical to SEQ ID NO: 92479

SEQ ID NO: 463162 - RNA, 64 nt, Homo Sapiens; identical to SEQ ID NO: 92480

SEQ ID NO: 463163 - RNA, 64 nt, Homo Sapiens; identical to SEQ ID NO: 92481

SEQ ID NO: 463164 - RNA, 64 nt, Homo Sapiens; identical to SEQ ID NO: 92482

SEQ ID NO: 463165 - RNA, 64 nt, Homo Sapiens; identical to SEQ ID NO: 92483

SEQ ID NO: 463166 - RNA, 64 nt, Homo Sapiens; identical to SEQ ID NO: 92484

SEQ ID NO: 463167 - RNA, 64 nt, Homo Sapiens; identical to SEQ ID NO: 92485

SEQ ID NO: 463168 - RNA, 64 nt, Homo Sapiens; identical to SEQ ID NO: 92486

SEQ ID NO: 463169 - RNA, 64 nt, Homo Sapiens; identical to SEQ ID NO: 92487

SEQ ID NO: 463170 - RNA, 64 nt, Homo Sapiens; identical to SEQ ID NO: 92488

SEQ ID NO: 463171 - RNA, 64 nt, Homo Sapiens; identical to SEQ ID NO: 92489

SEQ ID NO: 463172 - RNA, 64 nt, Homo Sapiens; identical to SEQ ID NO: 92490

SEQ ID NO: 463173 - RNA, 64 nt, Homo Sapiens; identical to SEQ ID NO: 92491

SEQ ID NO: 463174 - RNA, 64 nt, Homo Sapiens; identical to SEQ ID NO: 92492

SEQ ID NO: 463175 - RNA, 64 nt, Homo Sapiens; identical to SEQ ID NO: 92493

SEQ ID NO: 463176 - RNA, 64 nt, Homo Sapiens; identical to SEQ ID NO: 92494

SEQ ID NO: 463177 - RNA, 64 nt, Homo Sapiens; identical to SEQ ID NO: 92495

SEQ ID NO: 463178 - RNA, 64 nt, Homo Sapiens; identical to SEQ ID NO: 92496

SEQ ID NO: 463179 - RNA, 64 nt, Homo Sapiens; identical to SEQ ID NO: 92497

SEQ ID NO: 463180 - RNA, 64 nt, Homo Sapiens; identical to SEQ ID NO: 92498

SEQ ID NO: 463181 - RNA, 64 nt, Homo Sapiens; identical to SEQ ID NO: 92499

SEQ ID NO: 463182 - RNA, 64 nt, Homo Sapiens; identical to SEQ ID NO: 92500

SEQ ID NO: 463183 - RNA, 64 nt, Homo Sapiens; identical to SEQ ID NO: 92501

SEQ ID NO: 463184 - RNA, 64 nt, Homo Sapiens; identical to SEQ ID NO: 92502

SEQ ID NO: 463185 - RNA, 64 nt, Homo Sapiens; identical to SEQ ID NO: 92503

SEQ ID NO: 463186 - RNA, 64 nt, Homo Sapiens; identical to SEQ ID NO: 92504

SEQ ID NO: 463187 - RNA, 64 nt, Homo Sapiens; identical to SEQ ID NO: 92505

SEQ ID NO: 463188 - RNA, 64 nt, Homo Sapiens; identical to SEQ ID NO: 92506

SEQ ID NO: 463189 - RNA, 64 nt, Homo Sapiens; identical to SEQ ID NO: 92507

SEQ ID NO: 463190 - RNA, 64 nt, Homo Sapiens; identical to SEQ ID NO: 92508

SEQ ID NO: 463191 - RNA, 64 nt, Homo Sapiens; identical to SEQ ID NO: 92509

SEQ ID NO: 463192 - RNA, 64 nt, Homo Sapiens; identical to SEQ ID NO: 92510

SEQ ID NO: 463193 - RNA, 64 nt, Homo Sapiens; identical to SEQ ID NO: 92511

SEQ ID NO: 463194 - RNA, 64 nt, Homo Sapiens; identical to SEQ ID NO: 92512

SEQ ID NO: 463195 - RNA, 64 nt, Homo Sapiens; identical to SEQ ID NO: 92513

SEQ ID NO: 463196 - RNA, 64 nt, Homo Sapiens; identical to SEQ ID NO: 92514

SEQ ID NO: 463197 - RNA, 64 nt, Homo Sapiens; identical to SEQ ID NO: 92515

SEQ ID NO: 463198 - RNA, 64 nt, Homo Sapiens; identical to SEQ ID NO: 92516

SEQ ID NO: 463199 - RNA, 64 nt, Homo Sapiens; identical to SEQ ID NO: 92517

SEQ ID NO: 463200 - RNA, 64 nt, Homo Sapiens; identical to SEQ ID NO: 92518

SEQ ID NO: 463201 - RNA, 64 nt, Homo Sapiens
gaucacuggagcccaggaguuugaggcugcagcgagcuaugaucgcgccacuacacuccagccu

SEQ ID NO: 463202 - RNA, 64 nt, Homo Sapiens
ggcuauauugaaucucuguaugcacugagaacugagcuaugaagaggaucuuauuaaacugcug

SEQ ID NO: 463203 - RNA, 64 nt, Homo Sapiens
uuaaaaaaaaaaaaaaacuacucuugaucacauuagcuaugaggcgaggucaaauucagguauc

SEQ ID NO: 463204 - RNA, 64 nt, Homo Sapiens
cguucuccagacucuagauguuuagaugagguugagcuaugauaugugcuuguguguaugucua

SEQ ID NO: 463205 - RNA, 64 nt, Homo Sapiens
aaacuuguaaccugguugggacugauauugucauagcuaugauaaacuuuggauauuagcagaa

SEQ ID NO: 463206 - RNA, 64 nt, Homo Sapiens
gaucacuucagcccaggaguuuaaggcugcagugagcuaugaugaugccacuguacugcagcuu

SEQ ID NO: 463207 - RNA, 64 nt, Homo Sapiens
gaucacgugagcccaggaguuugaggcugcagcgagcuaugaucacaucacuguacuccagccu

SEQ ID NO: 463208 - RNA, 54 nt, Homo Sapiens
uucuucugauuuuuaugugaccauagcuaugauguaaagacaauacuguccuuc

SEQ ID NO: 463209 - RNA, 64 nt, Homo Sapiens
gugccacugcacuccagccuucaagucuggagugagcuaugacugauugcuugagcccagguau

SEQ ID NO: 463210 - RNA, 64 nt, Homo Sapiens
ggccccacuuucaagucacccuccuuggcucuggagcuaugaaacucugccuaauugucaaggc

SEQ ID NO: 463211 - RNA, 64 nt, Homo Sapiens
ccauuguccuuguaguuucuccuucuuaggaagcagcuaugaauacccaaggggccucuccaug

SEQ ID NO: 463212 - RNA, 64 nt, Homo Sapiens
cgagaaucagaauauuaauauuuccugccauaaaagcuaugacagguggggcauguccucaucc

SEQ ID NO: 463213 - RNA, 64 nt, Homo Sapiens
caaauguucccuuuccuggagccuuagucacuucagcuaugagcggcaccugaggccuaucugu

SEQ ID NO: 463214 - RNA, 64 nt, Homo Sapiens
gugaauaaagcagaauaaaauggcaucuaugcuuagcuaugaaaugccaagggcaggugaccac

SEQ ID NO: 463215 - RNA, 64 nt, Homo Sapiens
gcguccaggucagacggauggaagcccaaggaugagcuaugacaucucucucaggcagugaauc

SEQ ID NO: 463216 - RNA, 64 nt, Homo Sapiens
ugaucauugcuccuucucacuuuucccuuuucuuagcuaugagcuuuugcuuugguuauuguuu

SEQ ID NO: 463217 - RNA, 64 nt, Homo Sapiens
uuuauauauaaauauuauauuucaacuuauagcaagcuaugauuuacagaauccguccuuucau

SEQ ID NO: 463218 - RNA, 64 nt, Homo Sapiens
uuugauguacacuauaaaucauugcaaauaaauaagcuaugaacauuaguuuacgaaccacaaa

SEQ ID NO: 463219 - RNA, 64 nt, Homo Sapiens
agcugcaauccacccuggguuugaagcugcagugagcuaugaucgauggcuugagcccaagagu

SEQ ID NO: 463220 - RNA, 64 nt, Homo Sapiens
cuaggugguuucuaagcacauaaagugcuguugcagcuaugaugacuguagacucagaucccaa

SEQ ID NO: 463221 - RNA, 64 nt, Homo Sapiens
ccaucuggucuagggcuuuuaucuuguagaauucagcuaugaauguaccaguuauucuuucugc

SEQ ID NO: 463222 - RNA, 64 nt, Homo Sapiens
acacauaacaaaagaugcuuguauucaaccuuuuagcuaugauguuucuugcucuagaagagca

SEQ ID NO: 463223 - RNA, 64 nt, Homo Sapiens
ucagaucuaucuuauuggucuuaaaaaagaagauagcuaugagucugagaauuccaaaaguaua

SEQ ID NO: 463224 - RNA, 64 nt, Homo Sapiens
ccacugcuggcaguggguggaaguguggauuuauagcuaugaaaucuuagccucuugacgcugg

SEQ ID NO: 463225 - RNA, 64 nt, Homo Sapiens
uaaaaccugcaaagcuaaaauugaacuacuugggagcuaugauccacaaaaacaacuuauuauu

SEQ ID NO: 463226 - RNA, 64 nt, Homo Sapiens
uaaagauguuccccauggguuuugauugugucuaagcuaugaugaccuucauauaaucagcaua

SEQ ID NO: 463227 - RNA, 64 nt, Homo Sapiens
caguagagacaagcgggaaggauaauuagcugaaagcuaugaugauauaaauaaaaacagcucu

SEQ ID NO: 463228 - RNA, 64 nt, Homo Sapiens
ccccaacuuuccuggagcccgaggccucauccauagcuaugaucacuugcccucugaagcuuau

SEQ ID NO: 463229 - RNA, 64 nt, Homo Sapiens
uuacuugagucuuguacauacauacuuuuuuaugagcuaugaaauaaaacauuuuaaacugaau

SEQ ID NO: 463230 - RNA, 64 nt, Homo Sapiens
ggcccauuaguuuuggggauggggcacagggcauagcuaugacuuugcuuucugguuggagccu

SEQ ID NO: 463231 - RNA, 64 nt, Homo Sapiens
augcacugaugagucuaguuucauuauagcacgaagcuaugagaauaacuucagucacucccuu

SEQ ID NO: 463232 - RNA, 64 nt, Homo Sapiens
ugagcugaacuggguuguguuaacacauugguagagcuaugauuccuucccaguucuaagagau

SEQ ID NO: 463233 - RNA, 64 nt, Homo Sapiens
gaugucagauuuagauucuuccuggggauuacacagcuaugaauguauuugcuucuaaaaccuc

SEQ ID NO: 463234 - RNA, 64 nt, Homo Sapiens
ugguggcaauaaauaccagacacguacaaaauccagcuaugaauauagagggcuuaugauucag

SEQ ID NO: 463235 - RNA, 64 nt, Homo Sapiens
aaauggagcugaauuugauaaaaacccaaaauacagcuaugaagugcugggcaaguuuacuuuu

SEQ ID NO: 463236 - RNA, 64 nt, Homo Sapiens
aacuuaaguguggaaugcauuauaugggcaaagaagcuaugaagauacaugauacacuuuguac

SEQ ID NO: 463237 - RNA, 64 nt, Homo Sapiens
agagauuuagagccuagauggauugggaauagugagcuaugagagacaaguucagcauguugca

SEQ ID NO: 463238 - RNA, 64 nt, Homo Sapiens
ggcugagcgagucacauuaaccaggauuggcacuagcuaugaagacacaagaaaucuggcuugg

SEQ ID NO: 463239 - RNA, 64 nt, Homo Sapiens
gggaaggggucguaucacuuuggugagucauuggagcuaugaagucccuuggccuggguccucc

SEQ ID NO: 463240 - RNA, 64 nt, Homo Sapiens
aguauguucaugagguggagaguuccugagacuuagcuaugaucuuaccguuuaugauacuaac

SEQ ID NO: 463241 - RNA, 64 nt, Homo Sapiens
acaccacugcacuucagucuucgaggcuacagugagcuaugauucauugcuugagcuugggaga

SEQ ID NO: 463242 - RNA, 64 nt, Homo Sapiens
auauauagggugguccccaguugcuuacagccguagcuaugaauugccuuuuuaccuggaauuu

SEQ ID NO: 463243 - RNA, 64 nt, Homo Sapiens
cagguaggcucugcccugggccauuugcugguucagcuaugauugccuucaucuucccccaccc

SEQ ID NO: 463244 - RNA, 64 nt, Homo Sapiens
uuuauuccugguuggcuagaacugggugaccaacagcuaugaaacaaauuucagcuguuugaag

SEQ ID NO: 463245 - RNA, 64 nt, Homo Sapiens
cagcucuaguucauugugauauuuauaauuugaaagcuaugagaauagaugugugggugaagcc

SEQ ID NO: 463246 - RNA, 64 nt, Homo Sapiens
aaucgcuugagccccaggcuucgaggcugcagugagcuaugauuacgacacugcacuccagccu

SEQ ID NO: 463247 - RNA, 64 nt, Homo Sapiens
ccaacagacaggauugugugaauauggaauuagcagcuaugacuuucaagguguguagagaaau

SEQ ID NO: 463248 - RNA, 64 nt, Homo Sapiens
gcauauuuggcaagcaguucaucaccaggacacuagcuaugauucuagaagucaaaaggugucu

SEQ ID NO: 463249 - RNA, 64 nt, Homo Sapiens
guuacaacccaguauggugagugccaagacagagagcuaugaacacgauaucuaucugggaaca

SEQ ID NO: 463250 - RNA, 64 nt, Homo Sapiens
ugaagagccugagaguaaaaagauuaugcugcaaagcuaugauauaaacugcucuugcagucca

SEQ ID NO: 463251 - RNA, 64 nt, Homo Sapiens
guggugugaaaauguauggaugaauucugaccagagcuaugaaucugguugauggcggcucaca

SEQ ID NO: 463252 - RNA, 64 nt, Homo Sapiens
gauuuaacuuuuaaaauguuguuuaaaagugugaagcuaugaaaagccugauaaugugacuaca

SEQ ID NO: 463253 - RNA, 64 nt, Homo Sapiens
auuguuacucauauuuuaaucaguaagucauuuaagcuaugacagaguaggaauugagaaauua

SEQ ID NO: 463254 - RNA, 64 nt, Homo Sapiens
auuuaaaaacuguuuacagccucacauuccuugaagcuaugagcaauucauauaaacugugaua

SEQ ID NO: 463255 - RNA, 64 nt, Homo Sapiens
uacucuauauaguaucuauaagagauuugaaaucagcuaugaauugguacacauaagaaaaacu

SEQ ID NO: 463256 - RNA, 64 nt, Homo Sapiens
ugaccuccagggaaucagaaauauuaagaagcucagcuaugaaagaaaaagaauauauugccaa

SEQ ID NO: 463257 - RNA, 64 nt, Homo Sapiens
aauaauaauauaaaaccuuagucaaugauuuuuaagcuaugaaauuuaguuggaauuauucuau

SEQ ID NO: 463258 - RNA, 64 nt, Homo Sapiens
aauacaauggggggaaggaugucaaugauuuuuaagcuaugaaacuuuagcugaauuauucuau

SEQ ID NO: 463259 - RNA, 64 nt, Homo Sapiens
ggagaauaauaauaaagaugauaaauaauaauuaagcuaugauauuaaacagggaaaguuuaau

SEQ ID NO: 463260 - RNA, 64 nt, Homo Sapiens
uuuuaaauaaaauugaaaguuuguauauuuugcuagcuaugagcacuuuuuaguuuuaauuuuc

SEQ ID NO: 463261 - RNA, 64 nt, Homo Sapiens
guuaaguagaugagguaaccaucuuaacuaagguagcuaugaauuuaagauacuuauucgacuu

SEQ ID NO: 463262 - RNA, 64 nt, Homo Sapiens
uguggcaaucaggcuucguaccauuuuugcagauagcuaugacugagucuuucagaggcaggau

SEQ ID NO: 463263 - RNA, 64 nt, Homo Sapiens
uucuuuuuuuuuaacuggucagucauucacaauaagcuaugaggguaaauaaauauguguuaua

SEQ ID NO: 463264 - RNA, 64 nt, Homo Sapiens
agcauuauauaguggugcauuaguuuagaaagucagcuaugauuuugccuauaguucuaguuau

SEQ ID NO: 463265 - RNA, 64 nt, Homo Sapiens
gcccuugcacagcuggagaaauggcaucauuauaagcuaugaguugaaauguucugucaaaugu

SEQ ID NO: 463266 - RNA, 64 nt, Homo Sapiens
guucuauggauuccauaauguuacaauggauuuaagcuaugaagccucaaaacaucacgagaua

SEQ ID NO: 463267 - RNA, 64 nt, Homo Sapiens
aaaacuaugauccuuuauauguguguuuugggggagcuaugauaaguuuuauggcaaacgguug

SEQ ID NO: 463268 - RNA, 64 nt, Homo Sapiens
agauugaaauuccaguugcaagaugguuuccgugagcuaugauaaaaucugcagcacauugaua

SEQ ID NO: 463269 - RNA, 64 nt, Homo Sapiens
ggcaccuaaugcuucucaaggcagcgagguagguagcuaugauagaggugccuccgggaaggag

SEQ ID NO: 463270 - RNA, 64 nt, Homo Sapiens
ugagugauccaggguaugaccuagggaaugaacuagcuaugaaauacucaggguuaggaauccu

SEQ ID NO: 463271 - RNA, 64 nt, Homo Sapiens
gucuugauaguagaugcuucuucagcguaagaguagcuaugauauuccuuuuuaucuuuucagu

SEQ ID NO: 463272 - RNA, 64 nt, Homo Sapiens
aggaauauuuaaauuacugucauaauucaguuuaagcuaugaacugugugucccaguaggaggu

SEQ ID NO: 463273 - RNA, 64 nt, Homo Sapiens
ggauucuuccaucugauugugaugugaguugcacagcuaugaaggcuguacacugcacgaaugg

SEQ ID NO: 463274 - RNA, 64 nt, Homo Sapiens
gauagcuugagcccaggaguucgaggcugcagugagcuaugaucucaccacuacacuccagccu

SEQ ID NO: 463275 - RNA, 64 nt, Homo Sapiens
gccgcccucugggacugccccucagucccaggagagcuaugaggccucacugggggcagaacuu

SEQ ID NO: 463276 - RNA, 64 nt, Homo Sapiens
uucugcuuuacagugcugaauuccauauuuuagaagcuaugaaaguccuuuuaugaaaaaguua

SEQ ID NO: 463277 - RNA, 64 nt, Homo Sapiens
uuugcauuccugguuauauguaaugugauaaauuagcuaugaaugguaaaagaacaaaacugau

SEQ ID NO: 463278 - RNA, 64 nt, Homo Sapiens
gaaaaaaaugccaauugacacaaagcauuccaguagcuaugaccugccgcccugaccaggauag

SEQ ID NO: 463279 - RNA, 64 nt, Homo Sapiens
gucuauguuaaaguugcuuuccugcuguuaaauaagcuaugauauuaagauauucugacuugcu

SEQ ID NO: 463280 - RNA, 64 nt, Homo Sapiens
aguacugagaguaacaugacucaguagccacagaagcuaugauuuguaaaauauauaauugaau

SEQ ID NO: 463281 - RNA, 64 nt, Homo Sapiens
uuucugacugcuggauucuguaguaaggugacauagcuaugacauuuguuaaaaauaaacucug

SEQ ID NO: 463282 - RNA, 64 nt, Homo Sapiens
guguaugagcccauccuuuuuccuuuuugaaaagagcuaugaagcauccuuuaaauuauaagca

SEQ ID NO: 463283 - RNA, 64 nt, Homo Sapiens
ugucugcgaucacaucacggucuucggaggagcuagcuaugagaggguucacgagccauuuguc

SEQ ID NO: 463284 - RNA, 64 nt, Homo Sapiens
ucaccacugcauucuagccuuugaaguugcaaugagcuaugauuaauugcucaagcccaggagu

SEQ ID NO: 463285 - RNA, 64 nt, Homo Sapiens
aaguggaugggagugggaggaugagugguuuuugagcuaugagaggguuugacugugcuuacca

SEQ ID NO: 463286 - RNA, 64 nt, Homo Sapiens
uaaaacacgucccuuaacuguuuugcuugcagaaagcuaugaaacucauuuuguaucagagcaa

SEQ ID NO: 463287 - RNA, 64 nt, Homo Sapiens
agcuagagaaauucuuguuaaaugcucuuuucacagcuaugaagagagcucaccaggcaguacc

SEQ ID NO: 463288 - RNA, 64 nt, Homo Sapiens
uccuaggacugagaguacccgagggaugaaagagagcuaugaugauaaugguauuaacuuuuaa

SEQ ID NO: 463289 - RNA, 64 nt, Homo Sapiens
uuuguuaaaaauaaacucuguauuaaggugucauagcuaugacaggucugacugacaaauucug

SEQ ID NO: 463290 - RNA, 64 nt, Homo Sapiens
cuacuggauggcaccugagaugaucaacggccgcagcuaugaugagaagguggauguguucucc

SEQ ID NO: 463291 - RNA, 64 nt, Homo Sapiens
gaucgcuugaacccaggaguucaagucugcagugagcuaugauugcaccacugcacuccagccu

SEQ ID NO: 463292 - RNA, 64 nt, Homo Sapiens
gaucccuugagccgaggaguuugagucugcagugagcuaugaucgcaccacugcauuccagacc

SEQ ID NO: 463293 - RNA, 64 nt, Homo Sapiens
ugucaacacucuacuugcugaccacauuucccagagcuaugacgaugagaggaagacugcgcug

SEQ ID NO: 463294 - RNA, 64 nt, Homo Sapiens
cguauaaauaguaaaugaguacaucuugauuaaaagcuaugaauucagaauugcuuuuaaauau

SEQ ID NO: 463295 - RNA, 64 nt, Homo Sapiens
gcaggaucagucuaacuauauauuacacagggaaagcuaugacugaucuuccauaauuuuaugg

SEQ ID NO: 463296 - RNA, 64 nt, Homo Sapiens
ggagucaggagaaguuagugacaaaauaauaaggagcuaugacuuuugguuaacaucauugaug

SEQ ID NO: 463297 - RNA, 64 nt, Homo Sapiens
guccccgggagcacacgaaccugggcauugagcaagcuaugaggcacaaccaggaagaacaaau

SEQ ID NO: 463298 - RNA, 64 nt, Homo Sapiens
gaguccgcuugaugaauucuaaugcuuugcuuagagcuaugagaaauguuuguuuuaauaaaaa

SEQ ID NO: 463299 - RNA, 64 nt, Homo Sapiens
gaucccuugagccuaggagguugaggcugcagugagcuaugaucgcaucaguccacuccagccu

SEQ ID NO: 463300 - RNA, 64 nt, Homo Sapiens
aaagugagggcagaaguagcugugggaaaagaugagcuaugauaaugcugggaaggcagagauu

SEQ ID NO: 463301 - RNA, 64 nt, Homo Sapiens
aaucacuugagcccaggaguuugaggcugcagugagcuaugauugcaccacuguacuccugccu

SEQ ID NO: 463302 - RNA, 64 nt, Homo Sapiens
ucaauacauggacaaaaaguaaaucauugaccaaagcuaugaaauguuucacaaaguuuuccuc

SEQ ID NO: 463303 - RNA, 64 nt, Homo Sapiens
agggaaaaaagugcccaguuaacuacuuuaaugcagcuaugaaaaaauggugcaugucauugag

SEQ ID NO: 463304 - RNA, 64 nt, Homo Sapiens
ugaggguucaggccccuaaauucauucacugauuagcuaugacacucuuggauuaaaagguaac

SEQ ID NO: 463305 - RNA, 64 nt, Homo Sapiens
aaaacacaaaguguauaaauggggcucuguauauagcuaugaaguggggcccagccccaaacug

SEQ ID NO: 463306 - RNA, 64 nt, Homo Sapiens
gauguguccaugugaaauuuauugugaaacagggagcuaugagaggugauuuuagauuucuuug

SEQ ID NO: 463307 - RNA, 64 nt, Homo Sapiens
gauuacuugagcuugggaaaucaagguugcagugagcuaugauuguguggccacacuccauccu

SEQ ID NO: 463308 - RNA, 64 nt, Homo Sapiens
guggaggaaacuaaacauucccuugauggucucaagcuaugaucagaagacuuuaauuauauau

SEQ ID NO: 463309 - RNA, 64 nt, Homo Sapiens
aaagucaucuuugaaaugauaaucaagaaacagcagcuaugaagccuugaauuuugaaaaaaag

SEQ ID NO: 463310 - RNA, 64 nt, Homo Sapiens
uauucuggaaauuugauacggagagaacuuggugagcuaugaauuacucucagucuccuuuuua

SEQ ID NO: 463311 - RNA, 64 nt, Homo Sapiens
aguggcaccucccucucccugcugacaugaagagagcuaugauaugccacugcugccaacucau

SEQ ID NO: 463312 - RNA, 64 nt, Homo Sapiens
cccuuccccuucuccccugucccccuucaccugcagcuaugauggaggagcugccuuuuggagg

SEQ ID NO: 463313 - RNA, 64 nt, Homo Sapiens
uuuuaguauugaauuuuauauaauauugaauguuagcuaugaaaauacauuuuaauguugaaau

SEQ ID NO: 463314 - RNA, 64 nt, Homo Sapiens
auacaaaagguaaauccacuuaaacagagaugguagcuaugaguuaaggacccuaaaugaacga

SEQ ID NO: 463315 - RNA, 64 nt, Homo Sapiens
aggcuuccaggaguuuccauucacuuaaccccucagcuaugaaaagagugaucuuccuaaaacu

SEQ ID NO: 463316 - RNA, 64 nt, Homo Sapiens
ugguuuuggucccucuaaugacucaucucugaggagcuaugaacaaucccccauccucacaccc

SEQ ID NO: 463317 - RNA, 64 nt, Homo Sapiens
guuguguacauucuccuuugacauauuuuuacauagcuaugaucagcuuucucaaugaauacac

SEQ ID NO: 463318 - RNA, 64 nt, Homo Sapiens
uuuggggcccaaaauuucacagggacaacgguuuagcuaugaaagggaguagggggcauuccac

SEQ ID NO: 463319 - RNA, 64 nt, Homo Sapiens
guuugaccuuugaaauuugcaugugaccucaucuagcuaugaauucugggaagucaaugugaaa

SEQ ID NO: 463320 - RNA, 64 nt, Homo Sapiens
cuucaucuggcugccuuugcaguccuuuuacuacagcuaugaagaaacgcaacaagaaacucaa

SEQ ID NO: 463321 - RNA, 64 nt, Homo Sapiens
caagccacucucuuuuuaaacagcaacaauuuaaagcuaugaagucaccuggagaaaaggaacg

SEQ ID NO: 463322 - RNA, 64 nt, Homo Sapiens
cuaauagcucaugcaacucuuucaugaagagcuuagcuaugaccuuagaagacaaagccuguuu

SEQ ID NO: 463323 - RNA, 64 nt, Homo Sapiens
acaggcuaaccccacucuaugaaucaauagaagaagcuaugaccuuuugcugaaauaucaguua

SEQ ID NO: 463324 - RNA, 64 nt, Homo Sapiens
uaauuuucuuuugguggaucagcucucauaaaaaagcuaugauuugcucaaauaugcuguugac

SEQ ID NO: 463325 - RNA, 64 nt, Homo Sapiens
gaucccuugaggccaggaguucaagguuacagugagcuaugauagugccacugcacuccagccu

SEQ ID NO: 463326 - RNA, 64 nt, Homo Sapiens
gcagaagacagcuccuauaguuuuguauuuuggcagcuaugagauauuuucaugguaaugucaa

SEQ ID NO: 463327 - RNA, 64 nt, Homo Sapiens
ucucaguuacugagagaggccugugaacaguucuagcuaugaucaugaacauguguuuucuucu

SEQ ID NO: 463328 - RNA, 64 nt, Homo Sapiens
aaaccgaaaaagcaaaacuggggucugacuucacagcuaugacaaacgggguggcauucacuua

SEQ ID NO: 463329 - RNA, 64 nt, Homo Sapiens
uaguuauccauacucucaugaccuaaaacuugaaagcuaugaauaguuuugaaaaugaucacuu

SEQ ID NO: 463330 - RNA, 64 nt, Homo Sapiens
guccguaggcccauacuagagaaagucugauuguagcuaugauuaucacauucccauuugcuua

SEQ ID NO: 463331 - RNA, 64 nt, Homo Sapiens
cccccuugaggauuguggaaaaccaggaaaagggagcuaugauuuuuuuuuccaaaacaauuuc

SEQ ID NO: 463332 - RNA, 64 nt, Homo Sapiens
guaggaaugaacuugccagccuucaggcucguucagcuaugaccaucugugcggucaggguaca

SEQ ID NO: 463333 - RNA, 64 nt, Homo Sapiens
gaacaaaacgagcaugaauuaacucuucaauauaagcuaugaaguaauaguugguugugaauua

SEQ ID NO: 463334 - RNA, 64 nt, Homo Sapiens
guguguguuguguauggacugguggagggaagggagcuaugaguauuaguuugugugugugugu

SEQ ID NO: 463335 - RNA, 64 nt, Homo Sapiens
uugcucgcuggcccaccccuaggggcuggaggcaagcuaugaacuucccaaguguggacuccag

SEQ ID NO: 463336 - RNA, 64 nt, Homo Sapiens
uaauagaguuugcuuaaucaucuggaagauggucagcuaugaagauucaauuaagugggaauuu

SEQ ID NO: 463337 - RNA, 64 nt, Homo Sapiens
agaaaaaagcaccguugaggcagcauuugagcucagcuaugaucuagagacaggccacuggggu

SEQ ID NO: 463338 - RNA, 64 nt, Homo Sapiens
ucgccccuuccccaccccuuaccagauguuaagcagcuaugaaacauucucuguacuaguucug

SEQ ID NO: 463339 - RNA, 64 nt, Homo Sapiens
ggucgcuugagcccaggaguuugaggcugcagugagcuaugauugugccacuguacuccagccu

SEQ ID NO: 463340 - RNA, 64 nt, Homo Sapiens
cuugcucuagagguucaaaggcagcaaggcagugagcuaugagcccagcauggaugugucucag

SEQ ID NO: 463341 - RNA, 64 nt, Homo Sapiens
uaauaauaauuuuuugucauuugucuuuauguccagcuaugaauguagauuuugugucccgaca

SEQ ID NO: 463342 - RNA, 64 nt, Homo Sapiens
uagauguucagaagccgcuuccucuccacugaagagcuaugagauacgcacaauacuugcuguu

SEQ ID NO: 463343 - RNA, 64 nt, Homo Sapiens
gaucacuugagccugggaauucgaagcugcagugagcuaugauugugccacacacuccagccug

SEQ ID NO: 463344 - RNA, 64 nt, Homo Sapiens
guauuugaguagugagguuaauaaugcacauugaagcuaugauggugaaucuacugaaaucacu

SEQ ID NO: 463345 - RNA, 64 nt, Homo Sapiens
agagcuauuaucaucugugguugcgaaccuugguagcuaugaugauauuuuaaauauacuaugu

SEQ ID NO: 463346 - RNA, 64 nt, Homo Sapiens
auuaacaacuguuaaaggaaagcucuuggaguacagcuaugaaacuucuggaauauuuuuaugu

SEQ ID NO: 463347 - RNA, 64 nt, Homo Sapiens
acaccacugcacuccagccuucaaggcugcauugagcuaugauugauagcuuaagcccaggauu

SEQ ID NO: 463348 - RNA, 64 nt, Homo Sapiens
uaaauuuaaagcacagaagaaaugauuuccuucuagcuaugagaauagucaaauugagcuugcc

SEQ ID NO: 463349 - RNA, 64 nt, Homo Sapiens
uaguccaucgaucuacagggugaucucauuugaaagcuaugauggcauugucgcugaguugaca

SEQ ID NO: 463350 - RNA, 64 nt, Homo Sapiens
augucucagcacuccagcuuucauagcucacugcagcuaugaucgcuaucaucugcagcuauaa

SEQ ID NO: 463351 - RNA, 64 nt, Homo Sapiens
acaauuagagaaacagauucgccucauuuuccuaagcuaugagaauucaaacaaaccugcuucu

SEQ ID NO: 463352 - RNA, 64 nt, Homo Sapiens
aguaacuuuugugcauauauugaagugguuuuucagcuaugaauucuuuaggguagaaauuuau

SEQ ID NO: 463353 - RNA, 64 nt, Homo Sapiens
gaggugguuuggcaucuggggccaacuccauuacagcuaugagcucacugcugucagugacguu

SEQ ID NO: 463354 - RNA, 64 nt, Homo Sapiens
gaauugaaacugugcagucaguagagcugaacuuagcuaugaauuaauuuaaauuaauucuaaa

SEQ ID NO: 463355 - RNA, 64 nt, Homo Sapiens
caaauaguccucuaguuccaguuugcuuaauaaaagcuaugagacuguguggugguuauaucaa

SEQ ID NO: 463356 - RNA, 64 nt, Homo Sapiens
cagaauaccauauggccacccaaugcccuagaacagcuaugaaguugguuaguagauaucaccg

SEQ ID NO: 463357 - RNA, 64 nt, Homo Sapiens
ucucaguuucuuagaauccuauaauuuaagggaaagcuaugacuuuacaauguauguaugaugu

SEQ ID NO: 463358 - RNA, 64 nt, Homo Sapiens
uucacuuccugaaagccagggucgguucaugaaaagcuaugaaacagcaugcuaaaugugaaau

SEQ ID NO: 463359 - RNA, 64 nt, Homo Sapiens
caaggacauuuucugcagccccuuccucucagugagcuaugauuggagggcuuaggucuggagg

SEQ ID NO: 463360 - RNA, 55 nt, Homo Sapiens
agaaagaguacuucuucugauuggcagcuaugauuuaacauaaaauuaugauagu

SEQ ID NO: 463361 - RNA, 64 nt, Homo Sapiens
gggaauaaagagaaaagaaguggaucccggcagaagcuaugaaaccauuagugcucucucugcc

SEQ ID NO: 463362 - RNA, 64 nt, Homo Sapiens
cccggggauggugaggaacggggggguggcacugagcuaugaguccccuggagggcaugguguc

SEQ ID NO: 463363 - RNA, 64 nt, Homo Sapiens
cugagaagaucuucaagugguuugugcuucucugagcuaugaggagcuugcugucucggccuuc

SEQ ID NO: 463364 - RNA, 64 nt, Homo Sapiens
cugagaagaucuucaagugguuugugcuucucugagcuaugaggagcuugcugucuuggccuuc

SEQ ID NO: 463365 - RNA, 64 nt, Homo Sapiens
augccacucgcugcauucaauugagccugcagugagcuaugacggauugcuugaggcugagaga

SEQ ID NO: 463366 - RNA, 64 nt, Homo Sapiens
aaaaauuugaaaaagauaaauauguaccauugucagcuaugacuaauuucauaauccugggaua

SEQ ID NO: 463367 - RNA, 64 nt, Homo Sapiens
agggaauuuuggagaaacuagauggugaggacacagcuaugaucagcacauccuagaagcagcg

SEQ ID NO: 463368 - RNA, 64 nt, Homo Sapiens
caccccugaagccucuuuccagcucugcuucaggagcuaugagagucgggacucuccugcaccu

SEQ ID NO: 463369 - RNA, 64 nt, Homo Sapiens
gauaccuauuacggaugaguucuggaaaagacccagcuaugauucauaaaaacacuucuggaug

SEQ ID NO: 463370 - RNA, 64 nt, Homo Sapiens
cccucacccaccccaaagguauuuuugauaacagagcuaugacuugucugagccucacauccuu

SEQ ID NO: 463371 - RNA, 64 nt, Homo Sapiens
auaauuaugauaaugcuguuucucacaggagaauagcuaugagucaaaucuaaccugcuuaaau

SEQ ID NO: 463372 - RNA, 64 nt, Homo Sapiens
ucuagcaccguccgaauccccgcaggacccauggagcuaugaccacaccaggccauucaaaugg

SEQ ID NO: 463373 - RNA, 64 nt, Homo Sapiens
uuuucuuuucaaauugcuuuaguuuuucuuagggagcuaugagggggaaaaaucacuaacauga

SEQ ID NO: 463374 - RNA, 64 nt, Homo Sapiens
gauugcuugagccugggaguuugaggcugcagugagcuaugauugcaccacugcacuccaaccu

SEQ ID NO: 463375 - RNA, 64 nt, Homo Sapiens
uucugacugggauaaccuugauauccacaaacauagcuaugaaguguguuaugcugauuagcag

SEQ ID NO: 463376 - RNA, 64 nt, Homo Sapiens
aucccacugcauuuguuuaaucaaggcugcagagagcuaugaucgauugcuugagcucaggagu

SEQ ID NO: 463377 - RNA, 64 nt, Homo Sapiens
gugccucugugcuccauccuuugaggcugcagugagcuaugagggaucgccagagcccaggagu

SEQ ID NO: 463378 - RNA, 64 nt, Homo Sapiens
uuguuacaacuguucuuaucagagaaaaauauguagcuaugacuugucucaauaaacaaaaugu

SEQ ID NO: 463379 - RNA, 64 nt, Homo Sapiens
caucauuugagcccaggaguuugaggcugcagugagcuaugauuccaccauugcacuccagucu

SEQ ID NO: 463380 - RNA, 64 nt, Homo Sapiens
ugcuaucuaaaucucagagcuauaucgaagacuuagcuaugaaucacuuuugguuccuguguuu

SEQ ID NO: 463381 - RNA, 64 nt, Homo Sapiens
ccuguuauacugggacaaaccuuauaaauguuauagcuaugauuguuuuuaucagugaguauuu

SEQ ID NO: 463382 - RNA, 64 nt, Homo Sapiens
ucacugugggcgcugcguaccuaugcaagugccuagcuaugaagucccaggcguaaagggggau

SEQ ID NO: 463383 - RNA, 64 nt, Homo Sapiens
gaugguuugagcucaggcauuugaggcugucgugagcuaugauuaugccacugcuuuccagccu

SEQ ID NO: 463384 - RNA, 64 nt, Homo Sapiens
gaucacuugagccugggagguugugguugcagugagcuaugauuguaccacugcacuccagccu

SEQ ID NO: 463385 - RNA, 64 nt, Homo Sapiens
aaaauaaguaugaucauuauuauugaacucuaucagcuaugaagcuaaauuuuaaagucaacug

SEQ ID NO: 463386 - RNA, 64 nt, Homo Sapiens
cuuacagugaucauuauuuucauaaaagcuguaaagcuaugaaaaaugaauaaaauuacuaaaa

SEQ ID NO: 463387 - RNA, 64 nt, Homo Sapiens
cgccaagucauccucccaccucagccuccugaguagcuaugacuacagguaugugccaccacgu

SEQ ID NO: 463388 - RNA, 64 nt, Homo Sapiens
gauucuuguagaauuaacagcccucaacgugaugagcuaugauaacacuaugaauuaugugcag

SEQ ID NO: 463389 - RNA, 64 nt, Homo Sapiens
aauuaguugcauuucuauacaccaguaauguccaagcuaugaaccaaaucaagaauggaauccc

SEQ ID NO: 463390 - RNA, 64 nt, Homo Sapiens
gcaccacugcacuccagccuuugaggcuacagagagcuaugauugaucacuuaaggccaugagu

SEQ ID NO: 463391 - RNA, 64 nt, Homo Sapiens
acaccauugcacuucagccuucgaggcuacagugagcuaugaucgggaggcugagcccuggagg

SEQ ID NO: 463392 - RNA, 64 nt, Homo Sapiens
gcaucacugcacuccagccuuggaggcugaagagagcuaugacugaucgcuugagcccaggagu

SEQ ID NO: 463393 - RNA, 64 nt, Homo Sapiens
gugccacugcacuccagccuucgaggcugcagugagcuaugacuggcuggaggaucacuggagu

SEQ ID NO: 463394 - RNA, 64 nt, Homo Sapiens
gugcuacugcacuccagccugugaggcugcagugagcuaugaucaugguuugaacacagggaug

SEQ ID NO: 463395 - RNA, 64 nt, Homo Sapiens
ugguuauccacuucaugugguucaguaccacaagagcuaugagcgcccggccaaauacuugguu

SEQ ID NO: 463396 - RNA, 55 nt, Homo Sapiens
cagaguggcucgaauuuuaauagagagcuaugaacuuuauugacauuuugcaaau

SEQ ID NO: 463397 - RNA, 64 nt, Homo Sapiens
uuuaggaggcacucaggugucacggcuagacugcagcuaugagacagaucuggcuucaaaucca

SEQ ID NO: 463398 - RNA, 64 nt, Homo Sapiens
ggucagggugaaucagaugggggacugagcaaguagcuaugacugcagaucauguaaggaaggg

SEQ ID NO: 463399 - RNA, 64 nt, Homo Sapiens
uaacauagccaaaaugugagaagggaacaaguugagcuaugacugugaucugcugcagagcagu

SEQ ID NO: 463400 - RNA, 64 nt, Homo Sapiens
gcgccacuguacuccauccuuugagccuucagugagcuaugaucgauugcuugagcccaggagu

SEQ ID NO: 463401 - RNA, 64 nt, Homo Sapiens
aagagcaggcuuccugcuccccugcugugguaugagcuaugacccagcaugcccccgugaccug

SEQ ID NO: 463402 - RNA, 64 nt, Homo Sapiens
aguuacuucuccauuaauuuacccuuuauaauacagcuaugaaagaggcugucaaaugugugcc

SEQ ID NO: 463403 - RNA, 64 nt, Homo Sapiens
uucccucugcacacuguuguauauggacauuugcagcuaugaauaguuacugucuuguuucuua

SEQ ID NO: 463404 - RNA, 64 nt, Homo Sapiens
gccguacagagcagaggcuguccccgcccuccugagcuaugaaugcuuugcagaaacgcccuug

SEQ ID NO: 463405 - RNA, 64 nt, Homo Sapiens
gcuuugaacucuuaggccauuugaggcugcagugagcuaugauuguaucacugcacuccagccu

SEQ ID NO: 463406 - RNA, 64 nt, Homo Sapiens
augcuucauuucuuccacuucuccagaaaauggaagcuaugaagcaacauuucaaaugucucuc

SEQ ID NO: 463407 - RNA, 64 nt, Homo Sapiens
gauugcuugagcccaggaggucgaggcugcagugagcuaugaucacaccaccacacuccagccu

SEQ ID NO: 463408 - RNA, 64 nt, Homo Sapiens
gcuugcuugaggcaaggaguucaaggcuacagugagcuaugauugugccacuguacuccagacu

SEQ ID NO: 463409 - RNA, 64 nt, Homo Sapiens
aucucuggccaccacuccaccagaugggcagagcagcuaugaccgccacccagcccucccgcuc

SEQ ID NO: 463410 - RNA, 64 nt, Homo Sapiens
acagccuccucacugaucuccauacuccugccugagcuaugacauguugccaaguccaagcuac

SEQ ID NO: 463411 - RNA, 64 nt, Homo Sapiens
uuaggcaugcugucaaauccaacccuaaugguaaagcuaugauuagaaucgaguuacccaccag

SEQ ID NO: 463412 - RNA, 64 nt, Homo Sapiens
uugccauugcacuccagcuguugagguuguagggagcuaugaucgauugcuugagcccaggagu

SEQ ID NO: 463413 - RNA, 64 nt, Homo Sapiens
cgauggcugagaaaagcccggaggagaugcuccuagcuaugacuuccagcuuucaagugcucug

SEQ ID NO: 463414 - RNA, 64 nt, Homo Sapiens
guuauuacauuguguaacaaauauaagguuuacgagcuaugagaauuggugcuaucaccauuag

SEQ ID NO: 463415 - RNA, 64 nt, Homo Sapiens
uccuaguagucccccaucccuuccucccuuacccagcuaugauucaguugucucugcccucccu

SEQ ID NO: 463416 - RNA, 64 nt, Homo Sapiens
ucauucaguggacaaguuccuuguuuaacuacacagcuaugauggaaugauauauccaaguucc

SEQ ID NO: 463417 - RNA, 64 nt, Homo Sapiens
ugaccagcauggacucaggcaacugguaaugauaagcuaugagcuccagugcuuuugccaaaau

SEQ ID NO: 463418 - RNA, 64 nt, Homo Sapiens
aggccauuucugcaagcaauucauuguuucauagagcuaugaucgguaagauuucauuccgaau

SEQ ID NO: 463419 - RNA, 64 nt, Homo Sapiens
aucaguuauaaaaguauuagauguaauguuuauaagcuaugagauauuacuuuguguaacuuug

SEQ ID NO: 463420 - RNA, 64 nt, Homo Sapiens
augccacugcacuccagucuuugagucugcagugagcuaugaucgauugcuugaguccaggagu

SEQ ID NO: 463421 - RNA, 64 nt, Homo Sapiens
ggauuggcucccaucuuuugaugauugaagaaacagcuaugagaaaugaagagcuguugauggg

SEQ ID NO: 463422 - RNA, 64 nt, Homo Sapiens
uugacucuccuuucugggauagauccugagggccagcuaugagucgacccugagcucuucagcc

SEQ ID NO: 463423 - RNA, 64 nt, Homo Sapiens
gagaugacauaaccauauguagcacacaucccucagcuaugagaaagcucaagaagaacacaga

SEQ ID NO: 463424 - RNA, 64 nt, Homo Sapiens
ccgguuaaggaauguagacaauaucccguuucaaagcuaugaaaugugcuauuuauugaaaggg

SEQ ID NO: 463425 - RNA, 64 nt, Homo Sapiens; identical to SEQ ID NO: 60172

SEQ ID NO: 463426 - RNA, 64 nt, Homo Sapiens; identical to SEQ ID NO: 60173

SEQ ID NO: 463427 - RNA, 64 nt, Homo Sapiens; identical to SEQ ID NO: 60174

SEQ ID NO: 463428 - RNA, 64 nt, Homo Sapiens; identical to SEQ ID NO: 60175

SEQ ID NO: 463429 - RNA, 64 nt, Homo Sapiens; identical to SEQ ID NO: 60176

SEQ ID NO: 463430 - RNA, 64 nt, Homo Sapiens; identical to SEQ ID NO: 60177

SEQ ID NO: 463431 - RNA, 64 nt, Homo Sapiens; identical to SEQ ID NO: 60178

SEQ ID NO: 463432 - RNA, 64 nt, Homo Sapiens; identical to SEQ ID NO: 60179

SEQ ID NO: 463433 - RNA, 64 nt, Homo Sapiens; identical to SEQ ID NO: 60180

SEQ ID NO: 463434 - RNA, 64 nt, Homo Sapiens; identical to SEQ ID NO: 60181

SEQ ID NO: 463435 - RNA, 64 nt, Homo Sapiens; identical to SEQ ID NO: 60182

SEQ ID NO: 463436 - RNA, 64 nt, Homo Sapiens; identical to SEQ ID NO: 60183

SEQ ID NO: 463437 - RNA, 64 nt, Homo Sapiens; identical to SEQ ID NO: 60184

SEQ ID NO: 463438 - RNA, 64 nt, Homo Sapiens; identical to SEQ ID NO: 60185

SEQ ID NO: 463439 - RNA, 64 nt, Homo Sapiens; identical to SEQ ID NO: 60186

SEQ ID NO: 463440 - RNA, 64 nt, Homo Sapiens; identical to SEQ ID NO: 60187

SEQ ID NO: 463441 - RNA, 64 nt, Homo Sapiens; identical to SEQ ID NO: 60188

SEQ ID NO: 463442 - RNA, 64 nt, Homo Sapiens; identical to SEQ ID NO: 60189

SEQ ID NO: 463443 - RNA, 64 nt, Homo Sapiens; identical to SEQ ID NO: 60190

SEQ ID NO: 463444 - RNA, 64 nt, Homo Sapiens; identical to SEQ ID NO: 60191

SEQ ID NO: 463445 - RNA, 64 nt, Homo Sapiens; identical to SEQ ID NO: 60192

SEQ ID NO: 463446 - RNA, 64 nt, Homo Sapiens; identical to SEQ ID NO: 60193

SEQ ID NO: 463447 - RNA, 64 nt, Homo Sapiens; identical to SEQ ID NO: 60194

SEQ ID NO: 463448 - RNA, 64 nt, Homo Sapiens; identical to SEQ ID NO: 60195

SEQ ID NO: 463449 - RNA, 64 nt, Homo Sapiens; identical to SEQ ID NO: 60196

SEQ ID NO: 463450 - RNA, 64 nt, Homo Sapiens; identical to SEQ ID NO: 60197

SEQ ID NO: 463451 - RNA, 64 nt, Homo Sapiens; identical to SEQ ID NO: 60198

SEQ ID NO: 463452 - RNA, 64 nt, Homo Sapiens; identical to SEQ ID NO: 60199

SEQ ID NO: 463453 - RNA, 64 nt, Homo Sapiens; identical to SEQ ID NO: 60200

SEQ ID NO: 463454 - RNA, 64 nt, Homo Sapiens; identical to SEQ ID NO: 60201

SEQ ID NO: 463455 - RNA, 64 nt, Homo Sapiens; identical to SEQ ID NO: 60202

SEQ ID NO: 463456 - RNA, 64 nt, Homo Sapiens; identical to SEQ ID NO: 60203

SEQ ID NO: 463457 - RNA, 64 nt, Homo Sapiens; identical to SEQ ID NO: 60204

SEQ ID NO: 463458 - RNA, 64 nt, Homo Sapiens; identical to SEQ ID NO: 60205

SEQ ID NO: 463459 - RNA, 64 nt, Homo Sapiens; identical to SEQ ID NO: 60206

SEQ ID NO: 463460 - RNA, 64 nt, Homo Sapiens; identical to SEQ ID NO: 60207

SEQ ID NO: 463461 - RNA, 64 nt, Homo Sapiens; identical to SEQ ID NO: 60208

SEQ ID NO: 463462 - RNA, 64 nt, Homo Sapiens; identical to SEQ ID NO: 60209

SEQ ID NO: 463463 - RNA, 64 nt, Homo Sapiens
caccaaacuuuuugacaagguuauuuacaauacauaggguuacugacaaggcugaagguucuau

SEQ ID NO: 463464 - RNA, 64 nt, Homo Sapiens
uaccaaacuuuuugacaagguuauuuaccauacauaggguuacuaacuuuucugaagguucuau

SEQ ID NO: 463465 - RNA, 64 nt, Homo Sapiens
aagcgcgguaggguucguagguagggcuaguagguaggguuaguagguagggcuaguagguagg

SEQ ID NO: 463466 - RNA, 64 nt, Homo Sapiens
uucguagguaggguucguagguagggcugguagguaggguuaguagguagggcuaguagguagg

SEQ ID NO: 463467 - RNA, 64 nt, Homo Sapiens
cugguagguaggguuaguagguagggcuaguagguaggguuaguagguaggguucguagguagg

SEQ ID NO: 463468 - RNA, 64 nt, Homo Sapiens
uucguagguaggguucguagguagggcuaguagguaggguuaguagguaggguucguagguagg

SEQ ID NO: 463469 - RNA, 64 nt, Homo Sapiens
uucguagguaggguucguagguagggcuaguagguaggguuaguagguagggcuaguagguagg

SEQ ID NO: 463470 - RNA, 64 nt, Homo Sapiens
uuaguagguagggcuaguagguagggcuaguagguaggguuaguagguagggcuaguagguagg

SEQ ID NO: 463471 - RNA, 64 nt, Homo Sapiens
uuaguagguagggcuaguagguaggguucguagguaggguuaguagguagggcuaguagguagg

SEQ ID NO: 463472 - RNA, 64 nt, Homo Sapiens; identical to SEQ ID NO: 463469

SEQ ID NO: 463473 - RNA, 64 nt, Homo Sapiens
uucguagguaggguucguagguaggguucguagguaggguuaguagguaggguucguagguagg

SEQ ID NO: 463474 - RNA, 64 nt, Homo Sapiens
cuaguagguagggcuaguagguagggcuaguagguaggguuaguagguagggcuaguagguagg

SEQ ID NO: 463475 - RNA, 64 nt, Homo Sapiens
uucguagguaggguucguagguaggguucguagguaggguuaguagcgcgucugugcugcuucc

SEQ ID NO: 463476 - RNA, 64 nt, Homo Sapiens
gaccucagcgccuccugcaggcuaggacacuggugcacuacaccccaugccugggggccgagau

SEQ ID NO: 463477 - RNA, 64 nt, Homo Sapiens
caucccuacccuuggcaguguggcagugaccauggcacuacacggcugugacgagguggcaguc

SEQ ID NO: 463478 - RNA, 64 nt, Homo Sapiens
ggagaggaccagagugaucaaggguguaugaugugcacuacaauggugggcaaaacaggcuccu

SEQ ID NO: 463479 - RNA, 64 nt, Homo Sapiens
auuugguauuaaacuccaaaugagccauaggaaggcacuacaugaaauaaugcacugaguaugc

SEQ ID NO: 463480 - RNA, 64 nt, Homo Sapiens
aauguaauguugauuccucaagaaugaaaugaaggcacuacauugaaauauguuuuguauaaau

SEQ ID NO: 463481 - RNA, 64 nt, Homo Sapiens
cccaaauucugcaaaaaaauagaugaaggaggcugcacuacaaacucuucuccuuguccuaguc

SEQ ID NO: 463482 - RNA, 64 nt, Homo Sapiens
uugccuugcuguuuguccugagcuuaucuuagaagcacuacaccauguuuggggucuuuguggu

SEQ ID NO: 463483 - RNA, 64 nt, Homo Sapiens
cuggaugguguaugacuggagaauucagucccaugcacuacacucacccccuucgugccucaug

SEQ ID NO: 463484 - RNA, 64 nt, Homo Sapiens
aggcaacuguggcauugcuuuuaccaacagugaagcacuacaggccacaaugaauuguccuuaa

SEQ ID NO: 463485 - RNA, 64 nt, Homo Sapiens
aguguguuuuacucauuugaccugacucauuccagcacuacagacaucaauguacuuugaacua

SEQ ID NO: 463486 - RNA, 64 nt, Homo Sapiens
gaaguuugcuuuuucccugcccaagauacaaaaggcacuacauaaugaacggaugccucagugu

SEQ ID NO: 463487 - RNA, 64 nt, Homo Sapiens
agggaauuugcuccuguucuaaaaggcuagcucggcacuacacuaucagguuuuaggguccugc

SEQ ID NO: 463488 - RNA, 64 nt, Homo Sapiens
acacuuuguagaagaggagagacccuccugaacugcacuacaaguccuucacuuacaccugacu

SEQ ID NO: 463489 - RNA, 64 nt, Homo Sapiens
uaucuguaguuuuuuguuuuuguuuuuuuuuaaagcacuacaucuguuuucacuaauuguuaau

SEQ ID NO: 463490 - RNA, 64 nt, Homo Sapiens
guuaagacagauuuuugcuaguaauggaagaaaugcacuacaaauuaagcagguaacuuuuuuu

SEQ ID NO: 463491 - RNA, 64 nt, Homo Sapiens
aaaucuuuuuuugacacuugaaguauagacaguugcacuacaucccuuuuuucaaaggcaccac

SEQ ID NO: 463492 - RNA, 64 nt, Homo Sapiens
agauucuuaccgucuccacauacuguauguagcugcacuacaacaaacaaaauugccugaauug

SEQ ID NO: 463493 - RNA, 64 nt, Homo Sapiens
ccuuaucagacguuuuauaccucauacucaaugggcacuacaggugcagaauguaaacagcaga

SEQ ID NO: 463494 - RNA, 64 nt, Homo Sapiens
ucuguugugaggacuaccauuuuaugugucucuugcacuacacccuccucucaagagcugccau

SEQ ID NO: 463495 - RNA, 64 nt, Homo Sapiens
ugaauggccuuccacuucaggaacccuguggucugcacuacaugugcauuacucuuuggccugg

SEQ ID NO: 463496 - RNA, 64 nt, Homo Sapiens
acaauuuacaacaaugcugcuaugaaaaagaacugcacuacagugaccauuuguaugguauuuu

SEQ ID NO: 463497 - RNA, 64 nt, Homo Sapiens
gcaucaguauuaugauuccuaauuuaaugugcucgcacuacaauuauuauuguuauuccuuuuu

SEQ ID NO: 463498 - RNA, 64 nt, Homo Sapiens
gaucgcauagaucaaauaggagauuuguagaccagcacuacaaaaaagccuuugcaaucuugca

SEQ ID NO: 463499 - RNA, 64 nt, Homo Sapiens
uuaugaagcuguaaauaagcacuugaagacuccagcacuacauguacauuuuaacuggaaaucu

SEQ ID NO: 463500 - RNA, 64 nt, Homo Sapiens
ggcggagguuccagagagccaagaucgcaccacugcacuacagccugggcgacagaacgagacc

SEQ ID NO: 463501 - RNA, 64 nt, Homo Sapiens
ucauugaucuugcccccaaucuuugcugucucaggcacuacaugucuaauugcuaacaaaugcu

SEQ ID NO: 463502 - RNA, 64 nt, Homo Sapiens
gagugggaaggccugggauuucaguauuuuccuggcacuacaaaaaagcugcacccacuuacau

SEQ ID NO: 463503 - RNA, 64 nt, Homo Sapiens
ggcggaggcaccccgaagaaacccccaaccauuugcacuacaagccacacugguccauccugcc

SEQ ID NO: 463504 - RNA, 64 nt, Homo Sapiens
cucuuuccccgugucccguucagcagggcuaggugcacuacagcggcaaggcaagggucucccu

SEQ ID NO: 463505 - RNA, 64 nt, Homo Sapiens
auuggacuucauuaugcuuuccugucuacauuaugcacuacauagcauaauguuagauucuucu

SEQ ID NO: 463506 - RNA, 64 nt, Homo Sapiens
uuagacauucaggcuccacaauaaauuuuaaugagcacuacaaauuuagaauauauaaaaauau

SEQ ID NO: 463507 - RNA, 64 nt, Homo Sapiens
aaggagugaaaauagaguguaaaucuugccuuuggcacuacaaggugugugugugugugugugu

SEQ ID NO: 463508 - RNA, 64 nt, Homo Sapiens
uaucauauugaggauuaauucuuaucaaaagacagcacuacagaauacuugguuucuuuucuua

SEQ ID NO: 463509 - RNA, 64 nt, Homo Sapiens
acuaaccccuauugggguuugucaaguggaacaagcacuacacguucuagaaagaucacuaaug

SEQ ID NO: 463510 - RNA, 64 nt, Homo Sapiens
aguauaacugcauuucuaguauuucccacaaacugcacuacaucucuggagaacaccauuccug

SEQ ID NO: 463511 - RNA, 64 nt, Homo Sapiens
uccuuuauuucuggcucacagaggcagccacgaggcacuacaccaaguauuauauaaaagccau

SEQ ID NO: 463512 - RNA, 56 nt, Homo Sapiens
uagagaggaugaagcauuagcuugaagcacuacaggaggaaugcaccacggcagcu

SEQ ID NO: 463513 - RNA, 64 nt, Homo Sapiens
auuccuaaagccacuauuguguuuucucuaagaagcacuacaugccaccagaauugugcacuga

SEQ ID NO: 463514 - RNA, 64 nt, Homo Sapiens
cuuugggcugugagcauuuagaacgagccuggaagcacuacagagcaucccacaggaccacacg

SEQ ID NO: 463515 - RNA, 64 nt, Homo Sapiens
gaaauacacaaaaaaugaaaauuuuguugucacagcacuacaguugcucugguacacagauguc

SEQ ID NO: 463516 - RNA, 64 nt, Homo Sapiens
aacugacuuuauccucagacggauucuacuuuaagcacuacauauuuccauuccagaauaucug

SEQ ID NO: 463517 - RNA, 64 nt, Homo Sapiens
uaugauaaguauagacagcaagaagccauuauuugcacuacauaaggaaugcuuuauaaccauc

SEQ ID NO: 463518 - RNA, 64 nt, Homo Sapiens
aaacaaauuagagcaacacauacaauuuugaaaugcacuacaaugcacaaacuuuacacauuug

SEQ ID NO: 463519 - RNA, 64 nt, Homo Sapiens
auugcuguucugcugaaucacuucccgccccagggcacuacauagcugagaaacauuauuagca

SEQ ID NO: 463520 - RNA, 64 nt, Homo Sapiens
accucucugguaacuccuugaauaaaaaucaagggcacuacauaauuuguagacuuguagguaa

SEQ ID NO: 463521 - RNA, 64 nt, Homo Sapiens
ucucugagacauugucuggaaggcauaccccagagcacuacaaugagcuacauuaguuacauuc

SEQ ID NO: 463522 - RNA, 64 nt, Homo Sapiens
ugguuuauagagggccaagauuuguuuuaaauacgcacuacauguuauuguuuucaucuguugu

SEQ ID NO: 463523 - RNA, 64 nt, Homo Sapiens
acuucuguuuguucguucgucugauuugcuggaagcacuacaaggagcucuuuuuuccuuucug

SEQ ID NO: 463524 - RNA, 64 nt, Homo Sapiens
gaaauggcaggaugccaauauggaaaaaugauaggcacuacaauggcaacuuuaucaguaucaa

SEQ ID NO: 463525 - RNA, 64 nt, Homo Sapiens
guaguuaagaguggggucaccccuuuaacuccaagcacuacauuuuggcggcugccggccucug

SEQ ID NO: 463526 - RNA, 64 nt, Homo Sapiens
aagugaaagaauucaguguauccguuauuuuaaugcacuacaccacagaaauguuaaguugguc

SEQ ID NO: 463527 - RNA, 64 nt, Homo Sapiens
aaucccugacguuagggauacucugacagccacagcacuacaucuacagguaagucuacauccu

SEQ ID NO: 463528 - RNA, 64 nt, Homo Sapiens
aauaacuguauaaugaaaaacauuuccauggcaugcacuacagauuguaauucuacaaauuuca

SEQ ID NO: 463529 - RNA, 64 nt, Homo Sapiens
auugguuuccaauacugcacauuuauguguaggagcacuacaccuugugaugucacuugacccc

SEQ ID NO: 463530 - RNA, 64 nt, Homo Sapiens
gucuaaauuauguaggaagaaggagcacacugucgcacuacauuuugaaccacugaaguuauaa

SEQ ID NO: 463531 - RNA, 64 nt, Homo Sapiens
ggacaggggucaggcaacuaucccaaaggggagggcacuacacuuccuugagagaaaccgcugu

SEQ ID NO: 463532 - RNA, 64 nt, Homo Sapiens
agaagaaacaugcuaaauagacaccuuauucuuggcacuacaugugacuaaaggaagguaagau

SEQ ID NO: 463533 - RNA, 64 nt, Homo Sapiens
uaauugggggaaauaagcacuauuaacagauucagcacuacaaguauuuugaauguuguugcug

SEQ ID NO: 463534 - RNA, 64 nt, Homo Sapiens
aauaucauuugauagguauagaguauucuaaacagcacuacauuuuuuguaauucauauaguaa

SEQ ID NO: 463535 - RNA, 64 nt, Homo Sapiens
gggugagccgcccaugucugcagccaugcugcuggcacuacagaccacagcaugggaggaaaga

SEQ ID NO: 463536 - RNA, 64 nt, Homo Sapiens
ugauaucaggaaauaucuguuucuuuuaaaucucgcacuacaucaugugauguguugcucucca

SEQ ID NO: 463537 - RNA, 64 nt, Homo Sapiens
cuuuuuuaagugaugcagacaaaaaucuaguauagcacuacauuguaccuaaauuuucuuaaaa

SEQ ID NO: 463538 - RNA, 64 nt, Homo Sapiens
agagcugacuacugagaauucaugagggcugcaggcacuacaaauuuucugccuccaucccacc

SEQ ID NO: 463539 - RNA, 64 nt, Homo Sapiens
caaacuucagccaacaggggugucugcuucugcugcacuacacaggccaggaguggcauuccau

SEQ ID NO: 463540 - RNA, 64 nt, Homo Sapiens
aaagcaauugugaaaauguguuuacuucagaacggcacuacauaaaugugaaaaguuguugauc

SEQ ID NO: 463541 - RNA, 64 nt, Homo Sapiens
ugauccucccagcucucagccuccaaaguagcuggcacuacaaguguacacccccacacaaggc

SEQ ID NO: 463542 - RNA, 64 nt, Homo Sapiens
ucaaguccagagucaguuucgggcguguggcugagcacuacauggaaugcacagguguugguga

SEQ ID NO: 463543 - RNA, 64 nt, Homo Sapiens
uugagcuuuaucgaaagcuguuugccgaccaggagcacuacagauaaaauagagaauguugucu

SEQ ID NO: 463544 - RNA, 64 nt, Homo Sapiens
ugcuuaaauugcuauuuuggcaugugucauucuggcacuacauuuguucccugaguccgaggcu

SEQ ID NO: 463545 - RNA, 64 nt, Homo Sapiens
uccauuuucagacugagggggauuuacgaguuaggcacuacaucagauacuuguagcugucugu

SEQ ID NO: 463546 - RNA, 64 nt, Homo Sapiens
cauggucaaguucccaacugagcccagccagaaagcacuacaaugucuucccgaugagggaagg

SEQ ID NO: 463547 - RNA, 64 nt, Homo Sapiens
uuuagcggggagggggauaguccuuuaaaaaggugcacuacagugcugcugugcagcauggaau

SEQ ID NO: 463548 - RNA, 64 nt, Homo Sapiens
auuuuauuauguuuuuuaaaaugugagaacuucugcacuacaaaauucccuucacagagaagua

SEQ ID NO: 463549 - RNA, 64 nt, Homo Sapiens
caaagugaaaaagaaauuauauucagauaggacugcacuacauuauuugucacacauggaucug

SEQ ID NO: 463550 - RNA, 64 nt, Homo Sapiens
uucaaaggaaacauaugaauuuguuuugcguugugcacuacaucauuucucuccugaggaagaa

SEQ ID NO: 463551 - RNA, 64 nt, Homo Sapiens
aacgauaacauuuuaaggaccacauauauauuuugcacuacacauuaguuuguguacauauaua

SEQ ID NO: 463552 - RNA, 64 nt, Homo Sapiens
aggaaccuuuuggguuauuugcuaaauggcacaugcacuacaaggaaaaauacugaauagacuu

SEQ ID NO: 463553 - RNA, 64 nt, Homo Sapiens
ucagaccuuugaaaaucuggauaccaauaauucagcacuacaauuauaauaguguuuaccaaac

SEQ ID NO: 463554 - RNA, 64 nt, Homo Sapiens
gcuaaccagggugcuugcuuuggucacguucaacgcacuacagagcuacgacacagggaaaccu

SEQ ID NO: 463555 - RNA, 64 nt, Homo Sapiens
uagugugauaaugugcugcaaaaaauauccaacagcacuacacauaaguacagaguauucacaa

SEQ ID NO: 463556 - RNA, 64 nt, Homo Sapiens
uggcauuacccucugcagaacagugaaagguauugcacuacauuauggaaucaugcaaaaggaa

SEQ ID NO: 463557 - RNA, 64 nt, Homo Sapiens
auaggcuuuuguucuuaugaacgaaaaagagguagcacuacaaacacaauauucaaucaaaauu

SEQ ID NO: 463558 - RNA, 64 nt, Homo Sapiens
gcaucucagcuuccucagaucaguucuaucacuggcacuacagaauccuucucuuucuuaaggc

SEQ ID NO: 463559 - RNA, 64 nt, Homo Sapiens
uauuaggcacuacugauuuuuuaguuaaauugaugcacuacacuuuugauguuugaaguuacaa

SEQ ID NO: 463560 - RNA, 64 nt, Homo Sapiens
ucuggcugaucccaaucagauuccuucaccaucugcacuacauucucugcuuuauccccuucuc

SEQ ID NO: 463561 - RNA, 64 nt, Homo Sapiens
guuuaucuuuuucuuuuugaggucucagccucgggcacuacaaugacagaagugcuggcuagga

SEQ ID NO: 463562 - RNA, 64 nt, Homo Sapiens
uuaaauucagcauuagugcaacugacuaggaaaagcacuacauuauuuugccagggaacaguuc

SEQ ID NO: 463563 - RNA, 64 nt, Homo Sapiens
caugugccacuaugccugaacucaaguagcucuggcacuacagaugauccucccaccucagcuu

SEQ ID NO: 463564 - RNA, 64 nt, Homo Sapiens
gccugcucccccugagccagcaccugcgggagcugcacuacagcccuggccuccacccccaccc

SEQ ID NO: 463565 - RNA, 64 nt, Homo Sapiens
ccuauuugaaugacaaaggugccaguagugccaggcacuacacagagaggaaguggauuuguuc

SEQ ID NO: 463566 - RNA, 64 nt, Homo Sapiens
uggaacaaacucucccuucacuuguugcccuguagcacuacagaaacccugguucuugggcucc

SEQ ID NO: 463567 - RNA, 64 nt, Homo Sapiens
guuugcccguaucaucaugauugguacccugacugcacuacagugguuuaucuaugacuccgug

SEQ ID NO: 463568 - RNA, 64 nt, Homo Sapiens
cuuguggccucaagaaauuuagacgcccacgacagcacuacacagcaucuccaggugaugccca

SEQ ID NO: 463569 - RNA, 64 nt, Homo Sapiens
cuuuuaucuuuuuugcuccaauuaagaauacaaagcacuacauuugaucuaucaacaucacccc

SEQ ID NO: 463570 - RNA, 64 nt, Homo Sapiens
cacgcgccaccaugcccggccucccaaguagcuggcacuacagaggugauucuccugccucagc

SEQ ID NO: 463571 - RNA, 64 nt, Homo Sapiens
guaccuuuuuuuaucagaaaguuaccuccuaacagcacuacaaaauugguaguaaagguauuau

SEQ ID NO: 463572 - RNA, 64 nt, Homo Sapiens
cagcagagucccggugcccuguucugaaugugaagcacuacacccuaugcaaagcauccaggcg

SEQ ID NO: 463573 - RNA, 64 nt, Homo Sapiens
ggacauggcuaaagaccuuaaccaauagcaaauugcacuacagcugaacuuuucaucaucucau

SEQ ID NO: 463574 - RNA, 64 nt, Homo Sapiens
uuuguuugcaguccucuguuaguuuugcauaguugcacuacaagaagaauguaguugugcaaau

SEQ ID NO: 463575 - RNA, 64 nt, Homo Sapiens
ccugggagcgaaagcuggccuuuuuucuacgaaugcacuacauuaaagaugugcaaccuaugcg

SEQ ID NO: 463576 - RNA, 64 nt, Homo Sapiens
auuuucaagauuucaauaucaccuccccauuuuagcacuacagauuuucauucugaagcuugua

SEQ ID NO: 463577 - RNA, 64 nt, Homo Sapiens
guaugugaucgucaaugugacucccuugcagcaagcacuacaaucaaaacaacugguuauaugc

SEQ ID NO: 463578 - RNA, 64 nt, Homo Sapiens
uucguaacugcuguucccacaauauauccugcuggcacuacaccggagaacuuaccauccccca

SEQ ID NO: 463579 - RNA, 64 nt, Homo Sapiens
uaaccuucaucauguaaagcauggaugggcaauggcacuacauggaaugggcaugaauaugggc

SEQ ID NO: 463580 - RNA, 64 nt, Homo Sapiens
gguagcguguccauaguacuugguugcgacauuugcacuacauccacuuuaguuacuugaugag

SEQ ID NO: 463581 - RNA, 64 nt, Homo Sapiens
cuugguggcacagugagaacaugauuacaccacggcacuacaacguucaaggcugcaaugagcc

SEQ ID NO: 463582 - RNA, 64 nt, Homo Sapiens
agaauguacccugauguaaagauuuuuaaggauugcacuacagaugauuagcacuaaucucugg

SEQ ID NO: 463583 - RNA, 64 nt, Homo Sapiens
gggugguccaguaccuggcugagcugcugaagcugcacuacaugcaggaaucuccagggaccag

SEQ ID NO: 463584 - RNA, 64 nt, Homo Sapiens
cucccauccuuuccucucuccccguucaugcccugcacuacauagcacagccgggaugcuugga

SEQ ID NO: 463585 - RNA, 64 nt, Homo Sapiens
uaugaugcugcauggcagaggcagguauaacacagcacuacauauuggaaauuuuuuauuuuuc

SEQ ID NO: 463586 - RNA, 64 nt, Homo Sapiens
ucugggggagccaguuuuaagcccccugaagacagcacuacaaggguggcguguaaggaaugca

SEQ ID NO: 463587 - RNA, 64 nt, Homo Sapiens
gaauuuccagaggcaaauuugugagagaccaggagcacuacagagauuuaaaacuuuuuuggaa

SEQ ID NO: 463588 - RNA, 64 nt, Homo Sapiens
gcaguaacuucugggcugugguuguaaacugugagcacuacaaaauguuuuuccuuauugauac

SEQ ID NO: 463589 - RNA, 64 nt, Homo Sapiens
cauccauuuccauacaggaacaaaauaggaggcagcacuacagacccuacacacagcuuuacag

SEQ ID NO: 463590 - RNA, 64 nt, Homo Sapiens
acacacuauauauauauauaauaugcccacacaugcacuacauaaugugugugauguauacuau

SEQ ID NO: 463591 - RNA, 64 nt, Homo Sapiens
ucuuuauacaaauggaguagcaacuaguuuuguagcacuacauuuaauguaaugagauaccuuu

SEQ ID NO: 463592 - RNA, 64 nt, Homo Sapiens
aggaggaucugcgcacggugcacagcccaccagagcacuacagccuuuuauugaguggggcaag

SEQ ID NO: 463593 - RNA, 64 nt, Homo Sapiens
aaugcugacaagcacacccucucccauuauuugugcacuacagaucuccuccugaucagucacc

SEQ ID NO: 463594 - RNA, 54 nt, Homo Sapiens
ugcuuggccccacaggcugaccccgcacuacaucuacccaccagccaucgugca

SEQ ID NO: 463595 - RNA, 64 nt, Homo Sapiens
ugccauaaauguuugcauaaugacauagcuuuaagcacuacaugauuuuaaucugcucacauua

SEQ ID NO: 463596 - RNA, 64 nt, Homo Sapiens
ucaaagcauuagaaacauugaaauauuuauuugugcacuacaaucaaugaaaauauaaugaaau

SEQ ID NO: 463597 - RNA, 64 nt, Homo Sapiens
uagagagagagagagaagcggggagaauaagagugcacuacagcccaggcuuaugccaccccca

SEQ ID NO: 463598 - RNA, 64 nt, Homo Sapiens
guuaacugugcuuucuucuccuggcccugacagagcacuacagcaucaaaguaaaucuuugggg

SEQ ID NO: 463599 - RNA, 64 nt, Homo Sapiens
ccugggcacccagcugcaggccccugcccuacgugcacuacaggaaggggugaggagagcagcc

SEQ ID NO: 463600 - RNA, 64 nt, Homo Sapiens
agccacaccuuuuccaggaguucugaagcugacagcacuacaaaggagacgggggagcagcacg

SEQ ID NO: 463601 - RNA, 64 nt, Homo Sapiens
gggugcuggauucaaaucucuagggacucugguggcacuacacgggaccugggguaccuuuagu

SEQ ID NO: 463602 - RNA, 64 nt, Homo Sapiens
ugauccuucugugcuugcuuauggauguuacugagcacuacacauuuucuauuuuuaguacugu

SEQ ID NO: 463603 - RNA, 64 nt, Homo Sapiens
cagcccaguguagagauuggcacuucccuguccagcacuacaacuuaauugcucuaugccucag

SEQ ID NO: 463604 - RNA, 64 nt, Homo Sapiens
aguguguugucucuuuccuacaaguuaaccaguugcacuacauaaucucuggaaauuaauuuuc

SEQ ID NO: 463605 - RNA, 64 nt, Homo Sapiens
augagaucaggcccccccaggguccacccacagagcacuacagagccucugaaagaccauagca

SEQ ID NO: 463606 - RNA, 64 nt, Homo Sapiens
gauucugacaguguugugauaggcacuugugggugcacuacauaacugugaauucaaaacaaua

SEQ ID NO: 463607 - RNA, 64 nt, Homo Sapiens
auaccccucuacaacauacauaggaaaggauucagcacuacagccaagauucucagauccaggu

SEQ ID NO: 463608 - RNA, 64 nt, Homo Sapiens
aaaucaaaccauaaaugagguaagaacaguugaggcacuacacugcauuauacuaagacaccau

SEQ ID NO: 463609 - RNA, 64 nt, Homo Sapiens
uuuuggaauccuuuuggaaaauuucuuuucuuuugcacuacaaugugauuauuuauuuuuuuag

SEQ ID NO: 463610 - RNA, 64 nt, Homo Sapiens
cauuuagcuaaacggauuccuccauucaacaagagcacuacauuggcauuuccuaucaccuauu

SEQ ID NO: 463611 - RNA, 64 nt, Homo Sapiens
cugggguauaaucauguuguagguacuuaaaugcauuccgcaaaucaaaauaucuugauggaua

SEQ ID NO: 463612 - RNA, 64 nt, Homo Sapiens
aggagcaugcacagcggugcuauguccgugggcuauuccgcagcuugcagcaagcacagagugu

SEQ ID NO: 463613 - RNA, 64 nt, Homo Sapiens
cauugccccauggaaaugucgacccugugcggacauuccgcauacugccaugaagacggucucu

SEQ ID NO: 463614 - RNA, 64 nt, Homo Sapiens
gaaaaauacuuaagcucccuauguauccaugaaaauuccgcauugauuuugacauuccauacuu

SEQ ID NO: 463615 - RNA, 64 nt, Homo Sapiens
uuagauagaggucguuagcucgucagccggguugauuccgcagguguacggguuagauagaggu

SEQ ID NO: 463616 - RNA, 64 nt, Homo Sapiens
caaggaguaaccaggucgucgcuuuagauuauauauuccgcacugcaccuuuugcacauaacau

SEQ ID NO: 463617 - RNA, 64 nt, Homo Sapiens
gcuuucagucuuccaugugauguugggugguguuauuccgcaguuguaucccacugauaggagg

SEQ ID NO: 463618 - RNA, 64 nt, Homo Sapiens
gcugugacagacuucaccucgagauagugcagaaauuccgcaaggaauaacagacagcccagag

SEQ ID NO: 463619 - RNA, 64 nt, Homo Sapiens
gaaaguuucauuucaccaauuuauuaaacaauaaauuccgcacaguauacauguggcuucacau

SEQ ID NO: 463620 - RNA, 64 nt, Homo Sapiens
uuauucuggaugauucucugggaaaaccacacaaauuccgcaguuguuuuaauguacagaugug

SEQ ID NO: 463621 - RNA, 64 nt, Homo Sapiens
ucaaauuucucuccuuugguuauauaccuugcguauuccgcacauugauaaaguuucuuucuua

SEQ ID NO: 463622 - RNA, 64 nt, Homo Sapiens
gacucugggaucaaaggcuccacguauggaauucauuccgcaugcuccuuaugugaauuucaaa

SEQ ID NO: 463623 - RNA, 64 nt, Homo Sapiens
gagagaguggcuggggcauguucccuccuuggugauuccgcagugauugcucagggacucaucu

SEQ ID NO: 463624 - RNA, 64 nt, Homo Sapiens
cuaucgucuccacugacagccgccucuggguugaauuccgcagcagcagcaauuggguuggaaa

SEQ ID NO: 463625 - RNA, 64 nt, Homo Sapiens
cgccgcgucgccgauuagaggacgaggaggagagauuccgcacgcaaccgaaaggguccuucgg

SEQ ID NO: 463626 - RNA, 64 nt, Homo Sapiens
aagcuucaucaggccuuggagcagucacugcuuuauuccgcaaaaauuauuugguaggaaauuu

SEQ ID NO: 463627 - RNA, 64 nt, Homo Sapiens
ccaguucugauuguugagguauaaacugcuucccauuccgcagcgcagagccccacuuaacucc

SEQ ID NO: 463628 - RNA, 64 nt, Homo Sapiens
ucagacccuuucuucagcucggcuuucucuacugauuccgcagccaaggagucacugagaccaa

SEQ ID NO: 463629 - RNA, 64 nt, Homo Sapiens
gcccucgcuggcuuguuuuccgccaaaacccugcauuccgcagugcacacuccuguagcucugu

SEQ ID NO: 463630 - RNA, 64 nt, Homo Sapiens
ucuauaaugggugccucaaaauauguauugugccauuccgcaaauuuaaaagcuaauugaggac

SEQ ID NO: 463631 - RNA, 64 nt, Homo Sapiens
ccgggccccacagacaaaagcgcuuuuccuuggcauuccgcaucccuaccgacccaggguuccc

SEQ ID NO: 463632 - RNA, 64 nt, Homo Sapiens
ggacucccugcuuccaugcuuucuccuucaguccauuccgcaaacucuugugaucuuccaaaau

SEQ ID NO: 463633 - RNA, 64 nt, Homo Sapiens
ccaauagauuggagaaagccagagauuagcccucauuccgcaucugucaaccaggacagaaagc

SEQ ID NO: 463634 - RNA, 64 nt, Homo Sapiens
gaccagcagacagagccaggagaagcucagcugcauuccgcagcccccacccccaagguucucc

SEQ ID NO: 463635 - RNA, 64 nt, Homo Sapiens
gguaucucaggucugaaucuucaccaucuuucugauuccgcacccugccuacgccaggagaagu

SEQ ID NO: 463636 - RNA, 64 nt, Homo Sapiens
cuugcugaaguuguuuaccgaauguugaucuuguauuccgcaauagaaauacaauggauuuuua

SEQ ID NO: 463637 - RNA, 64 nt, Homo Sapiens
gccucugccugacagcauccucucuaugggccauauuccgcacugggcacaggccgucacccug

SEQ ID NO: 463638 - RNA, 64 nt, Homo Sapiens
ccuggcuggcccccuucccucugucuggggucgcauuccgcacaagccuuucaucaacaucuua

SEQ ID NO: 463639 - RNA, 64 nt, Homo Sapiens
auguuucccucuccuuccaagcaggaaauguuuaauuccgcaugaccaacauauacauuuuguu

SEQ ID NO: 463640 - RNA, 64 nt, Homo Sapiens
ggccuacuguaggaccauugcaacgagggaacuuauuccgcacguauucaugcuagcauuuuuc

SEQ ID NO: 463641 - RNA, 64 nt, Homo Sapiens
uaauucaugguauucaggaucucgucccugggcaauuccgcauuccuuguuucuugaagguuuc

SEQ ID NO: 463642 - RNA, 64 nt, Homo Sapiens
uccgcccacgcccccgacccuuugcucaauaaacauuccgcacuccauuuucaggcucuuccuu

SEQ ID NO: 463643 - RNA, 64 nt, Homo Sapiens
aauaaagccuucaaacucccggcugugcccucagauuccgcaccaucaaaguuggcgggggcuu

SEQ ID NO: 463644 - RNA, 64 nt, Homo Sapiens
gcugguuccugaguggcucuuaagaaacccagccauuccgcaugaggaagcauuucauguucaa

SEQ ID NO: 463645 - RNA, 64 nt, Homo Sapiens
ugaacuauaaaaagcaccggaucuuuuccaucuaauuccgcaaaaauugaucauuugcaaaguc

SEQ ID NO: 463646 - RNA, 64 nt, Homo Sapiens
accccaccucuaguauuuugggagauagggaaagugaaccgacuuccccuucccauaccccuca

SEQ ID NO: 463647 - RNA, 64 nt, Homo Sapiens
ggaggaggagaagcugagcaguuccuccugcauaugaaccgaggggcggggccucugggugcga

SEQ ID NO: 463648 - RNA, 64 nt, Homo Sapiens
ucaugccaccgcacuucagcggcagagguugcagugaaccgagaagaaucgcuugagacuggga

SEQ ID NO: 463649 - RNA, 64 nt, Homo Sapiens
ggcucaggaaaacgggaccggggaaaggccagugugaaccgagggggaccuccccugaggcuca

SEQ ID NO: 463650 - RNA, 64 nt, Homo Sapiens
uuauuugccuuuaccucauaugagucuuugaucuugaaccgauacuuuuggaucucauuguuga

SEQ ID NO: 463651 - RNA, 64 nt, Homo Sapiens
gaggaggacuuggagggucugggggcagcuguccugaaccgacugacccugaggaggccgcuua

SEQ ID NO: 463652 - RNA, 64 nt, Homo Sapiens
ugagaagagauaugccuguuguuacugcagaaccugaaccgaagauuccugauguugcacccau

SEQ ID NO: 463653 - RNA, 64 nt, Homo Sapiens
uucagaauugaaggagaaaaugcauuauguggacugaaccgacuuuucuaaagcucugaacaaa

SEQ ID NO: 463654 - RNA, 64 nt, Homo Sapiens
ucucagauaaaugcauuuuguggaauugauuuucugaaccgacccugcugucugcaaaccuucc

SEQ ID NO: 463655 - RNA, 64 nt, Homo Sapiens
agggaggggagaagggagcagaggccacgcagaaugaaccgaugggguauucaguugcuggcag

SEQ ID NO: 463656 - RNA, 64 nt, Homo Sapiens
cagcuacucaugagguugaggcaggagaauggcgugaaccgaggaggcggagcuugcagugagu

SEQ ID NO: 463657 - RNA, 64 nt, Homo Sapiens
cacaaguccucuagugcucuuguugguuugaagaugaaccgacuuuuuaguuuggguccuacug

SEQ ID NO: 463658 - RNA, 64 nt, Homo Sapiens
acgcaccaaaaacguggugugugcuggaguugucugaaccgauauuucuuuuuguuccuuggua

SEQ ID NO: 463659 - RNA, 64 nt, Homo Sapiens
caaagauuuuuuauugcugcauuucacacaacugugaaccgaauaaauagcuccuauuuggucu

SEQ ID NO: 463660 - RNA, 64 nt, Homo Sapiens
uugaccuugccagcugaccuucaaacccugcauuugaaccgaccaacauuaaguccagagagua

SEQ ID NO: 463661 - RNA, 64 nt, Homo Sapiens
cuguuuuaaguugcucaggagccugauggaaccaugaaccgagacucuucucuguuuccugcca

SEQ ID NO: 463662 - RNA, 64 nt, Homo Sapiens
ucacaccacugcauucccgcggcggagcuuacagugaaccgagaagaauggcgggaaccuggga

SEQ ID NO: 463663 - RNA, 64 nt, Homo Sapiens
aagaagaagggcaaguaggccuuggauaagaauuugaaccgaaagaauaauucaaaagcauauu

SEQ ID NO: 463664 - RNA, 64 nt, Homo Sapiens
agaauggugugaaccugggagguggagcuugcagugaaccgagaucgcuccacugcacuccagc

SEQ ID NO: 463665 - RNA, 53 nt, Homo Sapiens
ccaaaauggggaaaagcuaacucugaaccgaauguuuuggacuuaacuguugc

SEQ ID NO: 463666 - RNA, 64 nt, Homo Sapiens
uuuuuaguugagucaguaggggaagcaucauucaugaaccgaucagauuauuuuuauuggagga

SEQ ID NO: 463667 - RNA, 64 nt, Homo Sapiens
gaagcccuaaagaaugcaaccuagucagguuagcugaaccgacacucaaaacgcuacugaguca

SEQ ID NO: 463668 - RNA, 64 nt, Homo Sapiens
gaacccagaggaacccccacuucuuuggaccuccugaaccgagaauccucugggcugcuucguc

SEQ ID NO: 463669 - RNA, 64 nt, Homo Sapiens
agaaucacuugaaccugggagacagagguugcaaugaaccgagauagugccauugcacuccggc

SEQ ID NO: 463670 - RNA, 64 nt, Homo Sapiens
cccgccccuccucaucggggggcuccucccagauugaaccgaccgagaagaaaacugacccgca

SEQ ID NO: 463671 - RNA, 64 nt, Homo Sapiens
gcuaauauagucacuuauuaacugucucagcauuugaaccgaauaguuaaggcugagccagagc

SEQ ID NO: 463672 - RNA, 64 nt, Homo Sapiens
agggacggucaucugcuccguggggaggcgccacugaaccgagacggcgauccgcccccagcac

SEQ ID NO: 463673 - RNA, 64 nt, Homo Sapiens
gaacauccaagacaacagggagacgagaguggccugaaccgaaacaguuugagcaguauuuccg

SEQ ID NO: 463674 - RNA, 64 nt, Homo Sapiens
ccgucgccccugcacacgcacuuuuccccaggaaugaaccgagguuugugcgucucuucucucc

SEQ ID NO: 463675 - RNA, 64 nt, Homo Sapiens
gcgcacagccagccgcguggaucccacgcagcgcugaaccgaaccgaguaggaagccuuucucc

SEQ ID NO: 463676 - RNA, 64 nt, Homo Sapiens
augcuuaggguguccuccccacagagcagauacuugaaccgacucaauuccuguguaaagagca

SEQ ID NO: 463677 - RNA, 64 nt, Homo Sapiens
gaugcgcaugggcaaggccagcgcccggggcuucugaaccgagcgggguguuucauuuuuuugc

SEQ ID NO: 463678 - RNA, 64 nt, Homo Sapiens
cggcacugaacaaggaagccucggcagauguggcugaaccgagcuggagccaacagauguguca

SEQ ID NO: 463679 - RNA, 64 nt, Homo Sapiens
agguggagcuugccaugagcgcaggagaauggcaugaaccgaggcagcuacucaggaggcugag

SEQ ID NO: 463680 - RNA, 64 nt, Homo Sapiens
cugguugaggggccuugaggggacugugcucagcugaaccgaugcuguguucucuagggauuca

SEQ ID NO: 463681 - RNA, 64 nt, Homo Sapiens
cagugaggugauugcugcuguguggcggggacugugaaccgaggucucuucuucaagucccccu

SEQ ID NO: 463682 - RNA, 64 nt, Homo Sapiens
ccaguauuagcugaaugucaccaggugucaaaggugaaccgaguccccuggcuuccccaccucu

SEQ ID NO: 463683 - RNA, 64 nt, Homo Sapiens
auaacuguaggacuucuguuuccugguaacaagaugaaccgagagagugggcuggguucuguuu

SEQ ID NO: 463684 - RNA, 64 nt, Homo Sapiens
gaucucaggaguuggguccacuugaagugugcugugaaccgaggcaggccuucuagcaggaggu

SEQ ID NO: 463685 - RNA, 64 nt, Homo Sapiens
uggagaugccggggacccuucagcuauugcuuccugaaccgagggcaggaugaagauggugagg

SEQ ID NO: 463686 - RNA, 64 nt, Homo Sapiens
agaaauaaaguuucuguugaccuccgauuguuccugaaccgaugcccuuccucuuuccaucuac

SEQ ID NO: 463687 - RNA, 64 nt, Homo Sapiens
ggaggaauguuuucaaagauuucuacuguauguaugaaccgaauuuaagggcagccacaguggu

SEQ ID NO: 463688 - RNA, 64 nt, Homo Sapiens
agccaaucuuuccagcccucaagucagaaggauuugaaccgagcgaggagcaaggcuugccagc

SEQ ID NO: 463689 - RNA, 64 nt, Homo Sapiens; identical to SEQ ID NO: 111305

SEQ ID NO: 463690 - RNA, 64 nt, Homo Sapiens; identical to SEQ ID NO: 111306

SEQ ID NO: 463691 - RNA, 64 nt, Homo Sapiens; identical to SEQ ID NO: 111307

SEQ ID NO: 463692 - RNA, 64 nt, Homo Sapiens; identical to SEQ ID NO: 111308

SEQ ID NO: 463693 - RNA, 64 nt, Homo Sapiens; identical to SEQ ID NO: 111309

SEQ ID NO: 463694 - RNA, 64 nt, Homo Sapiens; identical to SEQ ID NO: 111310

SEQ ID NO: 463695 - RNA, 64 nt, Homo Sapiens; identical to SEQ ID NO: 111311

SEQ ID NO: 463696 - RNA, 64 nt, Homo Sapiens; identical to SEQ ID NO: 111312

SEQ ID NO: 463697 - RNA, 64 nt, Homo Sapiens; identical to SEQ ID NO: 111313

SEQ ID NO: 463698 - RNA, 64 nt, Homo Sapiens; identical to SEQ ID NO: 111314

SEQ ID NO: 463699 - RNA, 64 nt, Homo Sapiens; identical to SEQ ID NO: 111315

SEQ ID NO: 463700 - RNA, 64 nt, Homo Sapiens; identical to SEQ ID NO: 111316

SEQ ID NO: 463701 - RNA, 64 nt, Homo Sapiens; identical to SEQ ID NO: 111317

SEQ ID NO: 463702 - RNA, 64 nt, Homo Sapiens; identical to SEQ ID NO: 111318

SEQ ID NO: 463703 - RNA, 64 nt, Homo Sapiens; identical to SEQ ID NO: 111319

SEQ ID NO: 463704 - RNA, 64 nt, Homo Sapiens; identical to SEQ ID NO: 111320

SEQ ID NO: 463705 - RNA, 64 nt, Homo Sapiens; identical to SEQ ID NO: 111321

SEQ ID NO: 463706 - RNA, 64 nt, Homo Sapiens; identical to SEQ ID NO: 111322

SEQ ID NO: 463707 - RNA, 64 nt, Homo Sapiens; identical to SEQ ID NO: 111323

SEQ ID NO: 463708 - RNA, 64 nt, Homo Sapiens; identical to SEQ ID NO: 111324

SEQ ID NO: 463709 - RNA, 64 nt, Homo Sapiens; identical to SEQ ID NO: 111325

SEQ ID NO: 463710 - RNA, 64 nt, Homo Sapiens; identical to SEQ ID NO: 111326

SEQ ID NO: 463711 - RNA, 64 nt, Homo Sapiens; identical to SEQ ID NO: 111327

SEQ ID NO: 463712 - RNA, 64 nt, Homo Sapiens; identical to SEQ ID NO: 111328

SEQ ID NO: 463713 - RNA, 64 nt, Homo Sapiens; identical to SEQ ID NO: 111329

SEQ ID NO: 463714 - RNA, 64 nt, Homo Sapiens; identical to SEQ ID NO: 111330

SEQ ID NO: 463715 - RNA, 64 nt, Homo Sapiens; identical to SEQ ID NO: 111331

SEQ ID NO: 463716 - RNA, 64 nt, Homo Sapiens; identical to SEQ ID NO: 111332

SEQ ID NO: 463717 - RNA, 64 nt, Homo Sapiens; identical to SEQ ID NO: 111333

SEQ ID NO: 463718 - RNA, 64 nt, Homo Sapiens; identical to SEQ ID NO: 111334

SEQ ID NO: 463719 - RNA, 57 nt, Homo Sapiens; identical to SEQ ID NO: 111335

SEQ ID NO: 463720 - RNA, 64 nt, Homo Sapiens; identical to SEQ ID NO: 111336

SEQ ID NO: 463721 - RNA, 64 nt, Homo Sapiens; identical to SEQ ID NO: 111337

SEQ ID NO: 463722 - RNA, 64 nt, Homo Sapiens; identical to SEQ ID NO: 111338

SEQ ID NO: 463723 - RNA, 64 nt, Homo Sapiens; identical to SEQ ID NO: 111339

SEQ ID NO: 463724 - RNA, 64 nt, Homo Sapiens; identical to SEQ ID NO: 111340

SEQ ID NO: 463725 - RNA, 64 nt, Homo Sapiens; identical to SEQ ID NO: 111341

SEQ ID NO: 463726 - RNA, 64 nt, Homo Sapiens; identical to SEQ ID NO: 111342

SEQ ID NO: 463727 - RNA, 64 nt, Homo Sapiens; identical to SEQ ID NO: 111343

SEQ ID NO: 463728 - RNA, 64 nt, Homo Sapiens; identical to SEQ ID NO: 111344

SEQ ID NO: 463729 - RNA, 64 nt, Homo Sapiens; identical to SEQ ID NO: 111345

SEQ ID NO: 463730 - RNA, 64 nt, Homo Sapiens; identical to SEQ ID NO: 111346

SEQ ID NO: 463731 - RNA, 57 nt, Homo Sapiens; identical to SEQ ID NO: 111347

SEQ ID NO: 463732 - RNA, 64 nt, Homo Sapiens; identical to SEQ ID NO: 111348

SEQ ID NO: 463733 - RNA, 64 nt, Homo Sapiens; identical to SEQ ID NO: 111349

SEQ ID NO: 463734 - RNA, 64 nt, Homo Sapiens; identical to SEQ ID NO: 111350

SEQ ID NO: 463735 - RNA, 64 nt, Homo Sapiens
uuugcuuccuuugggagcucucucacauguggcucccccugaauuuacuugcccuucuauacuu

SEQ ID NO: 463736 - RNA, 64 nt, Homo Sapiens
cccccgaccggcuuagcugugccugcccaggggacccccugagcacccccagaacccucugggg

SEQ ID NO: 463737 - RNA, 64 nt, Homo Sapiens
ccuggagcaggccucaugauguggggggacucgacccccugacauggggcagcccauagcaggc

SEQ ID NO: 463738 - RNA, 64 nt, Homo Sapiens
cccauagcaggccuugugcaguggggggacucgacccccugacauggggcugccuggagcaggc

SEQ ID NO: 463739 - RNA, 64 nt, Homo Sapiens
guuccccuuggccugagcccgagugucucagaggcccccugaguggcacagagagcccaacccu

SEQ ID NO: 463740 - RNA, 64 nt, Homo Sapiens
accacuacuauacugaugguccgcggggcgaaggcccccugaggugugggaggacuagaaacag

SEQ ID NO: 463741 - RNA, 64 nt, Homo Sapiens; identical to SEQ ID NO: 394214

SEQ ID NO: 463742 - RNA, 64 nt, Homo Sapiens; identical to SEQ ID NO: 394215

SEQ ID NO: 463743 - RNA, 64 nt, Homo Sapiens; identical to SEQ ID NO: 394216

SEQ ID NO: 463744 - RNA, 64 nt, Homo Sapiens; identical to SEQ ID NO: 394217

SEQ ID NO: 463745 - RNA, 64 nt, Homo Sapiens; identical to SEQ ID NO: 394218

SEQ ID NO: 463746 - RNA, 64 nt, Homo Sapiens; identical to SEQ ID NO: 394219

SEQ ID NO: 463747 - RNA, 64 nt, Homo Sapiens; identical to SEQ ID NO: 394220

SEQ ID NO: 463748 - RNA, 64 nt, Homo Sapiens; identical to SEQ ID NO: 394221

SEQ ID NO: 463749 - RNA, 64 nt, Homo Sapiens; identical to SEQ ID NO: 394222

SEQ ID NO: 463750 - RNA, 64 nt, Homo Sapiens; identical to SEQ ID NO: 394223

SEQ ID NO: 463751 - RNA, 64 nt, Homo Sapiens; identical to SEQ ID NO: 394224

SEQ ID NO: 463752 - RNA, 64 nt, Homo Sapiens; identical to SEQ ID NO: 394225

SEQ ID NO: 463753 - RNA, 64 nt, Homo Sapiens; identical to SEQ ID NO: 394226

SEQ ID NO: 463754 - RNA, 64 nt, Homo Sapiens; identical to SEQ ID NO: 394227

SEQ ID NO: 463755 - RNA, 64 nt, Homo Sapiens; identical to SEQ ID NO: 394228

SEQ ID NO: 463756 - RNA, 64 nt, Homo Sapiens; identical to SEQ ID NO: 394229

SEQ ID NO: 463757 - RNA, 64 nt, Homo Sapiens; identical to SEQ ID NO: 394230

SEQ ID NO: 463758 - RNA, 64 nt, Homo Sapiens; identical to SEQ ID NO: 394231

SEQ ID NO: 463759 - RNA, 64 nt, Homo Sapiens; identical to SEQ ID NO: 394232

SEQ ID NO: 463760 - RNA, 64 nt, Homo Sapiens; identical to SEQ ID NO: 394233

SEQ ID NO: 463761 - RNA, 64 nt, Homo Sapiens; identical to SEQ ID NO: 394234

SEQ ID NO: 463762 - RNA, 64 nt, Homo Sapiens; identical to SEQ ID NO: 394235

SEQ ID NO: 463763 - RNA, 64 nt, Homo Sapiens; identical to SEQ ID NO: 394236

SEQ ID NO: 463764 - RNA, 64 nt, Homo Sapiens; identical to SEQ ID NO: 394237

SEQ ID NO: 463765 - RNA, 64 nt, Homo Sapiens; identical to SEQ ID NO: 394238

SEQ ID NO: 463766 - RNA, 64 nt, Homo Sapiens; identical to SEQ ID NO: 394239

SEQ ID NO: 463767 - RNA, 64 nt, Homo Sapiens; identical to SEQ ID NO: 394240

SEQ ID NO: 463768 - RNA, 64 nt, Homo Sapiens; identical to SEQ ID NO: 394241

SEQ ID NO: 463769 - RNA, 64 nt, Homo Sapiens; identical to SEQ ID NO: 394242

SEQ ID NO: 463770 - RNA, 64 nt, Homo Sapiens; identical to SEQ ID NO: 394243

SEQ ID NO: 463771 - RNA, 64 nt, Homo Sapiens; identical to SEQ ID NO: 394244

SEQ ID NO: 463772 - RNA, 64 nt, Homo Sapiens; identical to SEQ ID NO: 394245

SEQ ID NO: 463773 - RNA, 64 nt, Homo Sapiens; identical to SEQ ID NO: 394246

SEQ ID NO: 463774 - RNA, 64 nt, Homo Sapiens; identical to SEQ ID NO: 394247

SEQ ID NO: 463775 - RNA, 64 nt, Homo Sapiens; identical to SEQ ID NO: 394248

SEQ ID NO: 463776 - RNA, 64 nt, Homo Sapiens; identical to SEQ ID NO: 394249

SEQ ID NO: 463777 - RNA, 64 nt, Homo Sapiens; identical to SEQ ID NO: 394250

SEQ ID NO: 463778 - RNA, 64 nt, Homo Sapiens; identical to SEQ ID NO: 394251

SEQ ID NO: 463779 - RNA, 64 nt, Homo Sapiens; identical to SEQ ID NO: 394252

SEQ ID NO: 463780 - RNA, 64 nt, Homo Sapiens; identical to SEQ ID NO: 394253

SEQ ID NO: 463781 - RNA, 64 nt, Homo Sapiens; identical to SEQ ID NO: 394254

SEQ ID NO: 463782 - RNA, 64 nt, Homo Sapiens; identical to SEQ ID NO: 394255

SEQ ID NO: 463783 - RNA, 64 nt, Homo Sapiens; identical to SEQ ID NO: 394256

SEQ ID NO: 463784 - RNA, 64 nt, Homo Sapiens; identical to SEQ ID NO: 394257

SEQ ID NO: 463785 - RNA, 64 nt, Homo Sapiens; identical to SEQ ID NO: 394258

SEQ ID NO: 463786 - RNA, 64 nt, Homo Sapiens; identical to SEQ ID NO: 394259

SEQ ID NO: 463787 - RNA, 64 nt, Homo Sapiens; identical to SEQ ID NO: 190207

SEQ ID NO: 463788 - RNA, 64 nt, Homo Sapiens; identical to SEQ ID NO: 190208

SEQ ID NO: 463789 - RNA, 64 nt, Homo Sapiens; identical to SEQ ID NO: 190211

SEQ ID NO: 463790 - RNA, 64 nt, Homo Sapiens; identical to SEQ ID NO: 190212

SEQ ID NO: 463791 - RNA, 64 nt, Homo Sapiens; identical to SEQ ID NO: 190223

SEQ ID NO: 463792 - RNA, 64 nt, Homo Sapiens; identical to SEQ ID NO: 190224

SEQ ID NO: 463793 - RNA, 64 nt, Homo Sapiens; identical to SEQ ID NO: 190242

SEQ ID NO: 463794 - RNA, 64 nt, Homo Sapiens; identical to SEQ ID NO: 190243

SEQ ID NO: 463795 - RNA, 64 nt, Homo Sapiens; identical to SEQ ID NO: 190289

SEQ ID NO: 463796 - RNA, 64 nt, Homo Sapiens; identical to SEQ ID NO: 190290

SEQ ID NO: 463797 - RNA, 64 nt, Homo Sapiens; identical to SEQ ID NO: 190311

SEQ ID NO: 463798 - RNA, 64 nt, Homo Sapiens; identical to SEQ ID NO: 190312

SEQ ID NO: 463799 - RNA, 64 nt, Homo Sapiens; identical to SEQ ID NO: 190388

SEQ ID NO: 463800 - RNA, 64 nt, Homo Sapiens; identical to SEQ ID NO: 190389

SEQ ID NO: 463801 - RNA, 64 nt, Homo Sapiens; identical to SEQ ID NO: 332827

SEQ ID NO: 463802 - RNA, 64 nt, Homo Sapiens; identical to SEQ ID NO: 332828

SEQ ID NO: 463803 - RNA, 64 nt, Homo Sapiens; identical to SEQ ID NO: 332829

SEQ ID NO: 463804 - RNA, 64 nt, Homo Sapiens; identical to SEQ ID NO: 332830

SEQ ID NO: 463805 - RNA, 64 nt, Homo Sapiens; identical to SEQ ID NO: 332831

SEQ ID NO: 463806 - RNA, 64 nt, Homo Sapiens; identical to SEQ ID NO: 332832

SEQ ID NO: 463807 - RNA, 64 nt, Homo Sapiens
uuggugagaccuggagcugccuguuucuucccuaggggaucaccacggcucuagggcauucuag

SEQ ID NO: 463808 - RNA, 64 nt, Homo Sapiens
uaaacccagugagaggugagggggagugaugaaaggggaucagcuguauuugugugugugugug

SEQ ID NO: 463809 - RNA, 64 nt, Homo Sapiens
uaagaaaauaauguauugaguuacugucaaguagccaaguuaaugggaaugcuccaucuaccug

SEQ ID NO: 463810 - RNA, 64 nt, Homo Sapiens
agagcaaaguuaauuauaaaaauuagacauuuugccaaguuaguuuucuuaccacaauacccuc

SEQ ID NO: 463811 - RNA, 63 nt, Homo Sapiens
acaguuuggccuuuuuuuuguuaaaaauaaaguuccaaguuacuggaaaauuuucagaauacu

SEQ ID NO: 463812 - RNA, 64 nt, Homo Sapiens
uuuagaggcaagaacaugauuguuuuagaaacagccaaguuaauuacauagaaaauuaauacaa

SEQ ID NO: 463813 - RNA, 64 nt, Homo Sapiens
guaaauagaauccaagucaauugugacugcaauuccaaguuaguauuuaaaaauagagaaauug

SEQ ID NO: 463814 - RNA, 64 nt, Homo Sapiens
cuugauauaacuccuaguuauaauuuugaugcaaccaaguuauuuuuuauauauuuuguuauuu

SEQ ID NO: 463815 - RNA, 64 nt, Homo Sapiens; identical to SEQ ID NO: 195795

SEQ ID NO: 463816 - RNA, 64 nt, Homo Sapiens; identical to SEQ ID NO: 195796

SEQ ID NO: 463817 - RNA, 64 nt, Homo Sapiens; identical to SEQ ID NO: 195797

SEQ ID NO: 463818 - RNA, 64 nt, Homo Sapiens; identical to SEQ ID NO: 195798

SEQ ID NO: 463819 - RNA, 64 nt, Homo Sapiens; identical to SEQ ID NO: 195799

SEQ ID NO: 463820 - RNA, 64 nt, Homo Sapiens; identical to SEQ ID NO: 195800

SEQ ID NO: 463821 - RNA, 64 nt, Homo Sapiens; identical to SEQ ID NO: 195801

SEQ ID NO: 463822 - RNA, 64 nt, Homo Sapiens; identical to SEQ ID NO: 195802

SEQ ID NO: 463823 - RNA, 64 nt, Homo Sapiens; identical to SEQ ID NO: 195803

SEQ ID NO: 463824 - RNA, 64 nt, Homo Sapiens; identical to SEQ ID NO: 195804

SEQ ID NO: 463825 - RNA, 64 nt, Homo Sapiens; identical to SEQ ID NO: 195805

SEQ ID NO: 463826 - RNA, 64 nt, Homo Sapiens; identical to SEQ ID NO: 195806

SEQ ID NO: 463827 - RNA, 64 nt, Homo Sapiens; identical to SEQ ID NO: 195807

SEQ ID NO: 463828 - RNA, 64 nt, Homo Sapiens; identical to SEQ ID NO: 195808

SEQ ID NO: 463829 - RNA, 64 nt, Homo Sapiens; identical to SEQ ID NO: 195809

SEQ ID NO: 463830 - RNA, 64 nt, Homo Sapiens; identical to SEQ ID NO: 195810

SEQ ID NO: 463831 - RNA, 64 nt, Homo Sapiens; identical to SEQ ID NO: 195811

SEQ ID NO: 463832 - RNA, 64 nt, Homo Sapiens; identical to SEQ ID NO: 195812

SEQ ID NO: 463833 - RNA, 64 nt, Homo Sapiens; identical to SEQ ID NO: 195813

SEQ ID NO: 463834 - RNA, 64 nt, Homo Sapiens; identical to SEQ ID NO: 195814

SEQ ID NO: 463835 - RNA, 64 nt, Homo Sapiens; identical to SEQ ID NO: 195815

SEQ ID NO: 463836 - RNA, 64 nt, Homo Sapiens; identical to SEQ ID NO: 195816

SEQ ID NO: 463837 - RNA, 64 nt, Homo Sapiens; identical to SEQ ID NO: 195817

SEQ ID NO: 463838 - RNA, 64 nt, Homo Sapiens; identical to SEQ ID NO: 195818

SEQ ID NO: 463839 - RNA, 64 nt, Homo Sapiens; identical to SEQ ID NO: 195819

SEQ ID NO: 463840 - RNA, 64 nt, Homo Sapiens; identical to SEQ ID NO: 195820

SEQ ID NO: 463841 - RNA, 64 nt, Homo Sapiens; identical to SEQ ID NO: 195821

SEQ ID NO: 463842 - RNA, 64 nt, Homo Sapiens; identical to SEQ ID NO: 195822

SEQ ID NO: 463843 - RNA, 64 nt, Homo Sapiens; identical to SEQ ID NO: 195823

SEQ ID NO: 463844 - RNA, 64 nt, Homo Sapiens; identical to SEQ ID NO: 195824

SEQ ID NO: 463845 - RNA, 64 nt, Homo Sapiens; identical to SEQ ID NO: 195825

SEQ ID NO: 463846 - RNA, 64 nt, Homo Sapiens; identical to SEQ ID NO: 195826

SEQ ID NO: 463847 - RNA, 64 nt, Homo Sapiens; identical to SEQ ID NO: 195827

SEQ ID NO: 463848 - RNA, 64 nt, Homo Sapiens; identical to SEQ ID NO: 195828

SEQ ID NO: 463849 - RNA, 64 nt, Homo Sapiens; identical to SEQ ID NO: 195829

SEQ ID NO: 463850 - RNA, 64 nt, Homo Sapiens; identical to SEQ ID NO: 195830

SEQ ID NO: 463851 - RNA, 64 nt, Homo Sapiens; identical to SEQ ID NO: 195831

SEQ ID NO: 463852 - RNA, 64 nt, Homo Sapiens; identical to SEQ ID NO: 195832

SEQ ID NO: 463853 - RNA, 64 nt, Homo Sapiens; identical to SEQ ID NO: 195833

SEQ ID NO: 463854 - RNA, 64 nt, Homo Sapiens; identical to SEQ ID NO: 195834

SEQ ID NO: 463855 - RNA, 64 nt, Homo Sapiens; identical to SEQ ID NO: 195835

SEQ ID NO: 463856 - RNA, 64 nt, Homo Sapiens; identical to SEQ ID NO: 195836

SEQ ID NO: 463857 - RNA, 64 nt, Homo Sapiens
auagagccacuuacaguuuucaucuagguugucuugaaaggaggcuaaagcagguuuccccacu

SEQ ID NO: 463858 - RNA, 64 nt, Homo Sapiens
uagauuuuuuccaaaacccacugauguaggaaacugaaaggaaauuucugcaggaugcuuuuaa

SEQ ID NO: 463859 - RNA, 64 nt, Homo Sapiens
aaaaguagaagccugacuacgaauucagauuagcugaaaggaaaauaauuauauaaauauuaau

SEQ ID NO: 463860 - RNA, 64 nt, Homo Sapiens
aaauguuuuaauaguagagcggucagauuaugaaugaaaggauauugcuucugauuauugaaga

SEQ ID NO: 463861 - RNA, 64 nt, Homo Sapiens
gaaaagcagauggacuugaaaaaaucaguuuugaugaaaggagguaaccuaguuuguuacuuua

SEQ ID NO: 463862 - RNA, 64 nt, Homo Sapiens
acacuuguguuuaagcaccaagaguaguaagacgugaaaggaauagugauggacuccgauuugg

SEQ ID NO: 463863 - RNA, 64 nt, Homo Sapiens
cuccgcggcgcucacccuccucagucccaguuucugaaaggacucagcugagaaaggacaacug

SEQ ID NO: 463864 - RNA, 64 nt, Homo Sapiens
caacaauagaauuaccauauuguuuuuccugguuugaaaggaccagauggaaagaaacugggca

SEQ ID NO: 463865 - RNA, 64 nt, Homo Sapiens
gcaggcccauguuucagccucagcccacgccaggugaaaggaucagcaaugcucuguugccauc

SEQ ID NO: 463866 - RNA, 64 nt, Homo Sapiens
gcccggccccacacugccucuguggccuggacuuugaaaggaacccacugaacacuaauuauga

SEQ ID NO: 463867 - RNA, 64 nt, Homo Sapiens
cuuuacccuagaaggaagagagaaacuuguuaaaugaaaggacuuguuugugaacacugaugca

SEQ ID NO: 463868 - RNA, 64 nt, Homo Sapiens
uaauuguuuuauauuauaacaugcaguccaaacaugaaaggaaauuuauauccucuucuguuga

SEQ ID NO: 463869 - RNA, 64 nt, Homo Sapiens
uccaccagacugucuugagugcacuauuguaccuugaaaggauucuuuaaaaaaaaguaugcua

SEQ ID NO: 463870 - RNA, 64 nt, Homo Sapiens
ccauuaguguguauaacagacagauuuaaagaaaugaaaggauaccacacaaggaacuacauuc

SEQ ID NO: 463871 - RNA, 64 nt, Homo Sapiens
ggaucucaaauuuucaucugcacaaugaggcuguugaaaggaaaaaaagugagccucuaggaau

SEQ ID NO: 463872 - RNA, 64 nt, Homo Sapiens
ugaaauggcugcagauagaucccgcagucccuucugaaaggaacuguguagccagcagggaccu

SEQ ID NO: 463873 - RNA, 64 nt, Homo Sapiens
accucgaugauguaaauccacuuaaaagcaauggugaaaggauagcuggcuuggugugaacucg

SEQ ID NO: 463874 - RNA, 64 nt, Homo Sapiens
aggaauuggagcagcuuuucauguguuuccccuuugaaaggagaagcaggaagcuugagucaaa

SEQ ID NO: 463875 - RNA, 64 nt, Homo Sapiens
ugagaccucuuaagaaaaaauaaaaaguaaaaaaugaaaggaaucuuuuuuagaaauagagaug

SEQ ID NO: 463876 - RNA, 64 nt, Homo Sapiens
ucuuuuauuucuucuccuuguggacaguuguuaaugaaaggaguaaggauuucccuuuuuuugu

SEQ ID NO: 463877 - RNA, 64 nt, Homo Sapiens
ggaaggagugugcccagaccagcugggggagcauugaaaggacagcuuggggauggaauuuuuu

SEQ ID NO: 463878 - RNA, 64 nt, Homo Sapiens
uagacuauguuaacuaguuaaggauguuacauuuugaaaggauguauguuagauauauuauuug

SEQ ID NO: 463879 - RNA, 64 nt, Homo Sapiens
cuacaacuugauaaccccuagaaagaagaggacaugaaaggaugcuggcuauauauguuaauga

SEQ ID NO: 463880 - RNA, 64 nt, Homo Sapiens
acugaagcacgugagagacccucgcaaaaugaugugaaaggaccaguuucuugaaguccagugu

SEQ ID NO: 463881 - RNA, 64 nt, Homo Sapiens
ggcccaggagagaacacggggagguuuguuugugugaaaggaaaguaguccaggcugucccuga

SEQ ID NO: 463882 - RNA, 64 nt, Homo Sapiens
guaguuuucauaaaacucauucuaacaaaugaugugaaaggaaaugaucauggguguggcauuc

SEQ ID NO: 463883 - RNA, 64 nt, Homo Sapiens
aaaaagguugucucuugauuuuccuuugcuacuuugaaaggaaaagucagccaaucuuuuauug

SEQ ID NO: 463884 - RNA, 64 nt, Homo Sapiens
ugucuguaccugucugaagagugacauuaaacuuugaaaggacuucacugcuccuuuacgauau

SEQ ID NO: 463885 - RNA, 64 nt, Homo Sapiens
uuagauguagaaaauaaugaauuaaugagauuggugaaaggaaaucaugcaaaacauuugaaug

SEQ ID NO: 463886 - RNA, 64 nt, Homo Sapiens
aauauaucccugguaguuuuaauuuaaauuuaaaugaaaggaaaugguugcuuuguuggaaugg

SEQ ID NO: 463887 - RNA, 64 nt, Homo Sapiens
agguuugaaaagaaaaaaauuauacuuccugauuugaaaggaggaaccuuacuugcacuuuaug

SEQ ID NO: 463888 - RNA, 64 nt, Homo Sapiens
uacagcuguccuugaacaaguaucaauguguuuaugaaaggaagaucuaaaucagacaggaguu

SEQ ID NO: 463889 - RNA, 64 nt, Homo Sapiens
uuggaauggaacccuugcuauaguagugacaaagugaaaggaaauuuaggaggcauaggccauu

SEQ ID NO: 463890 - RNA, 53 nt, Homo Sapiens; identical to SEQ ID NO: 455350

SEQ ID NO: 463891 - RNA, 64 nt, Homo Sapiens
aagccuucaguccuuucuguuucuuucaacuacgugaaaggauucacaguggagaaagacccug

SEQ ID NO: 463892 - RNA, 64 nt, Homo Sapiens
aagccuuuguuuccuucacuuccuuucgauaucaugaaaggacucacacuggagagaaccccua

SEQ ID NO: 463893 - RNA, 64 nt, Homo Sapiens
aagcauuccauaauuucucuucuuugcaaauacaugaaaggaugcacagaggagagaagcucug

SEQ ID NO: 463894 - RNA, 64 nt, Homo Sapiens
aagccuuuauuucuuccacuucuuuucaauaucaugaaaggacucacaugggagagaaacccua

SEQ ID NO: 463895 - RNA, 64 nt, Homo Sapiens
aagccuucauuucuucuaguucccuucaauaucaugaaaggacucacacuggagagaagcccua

SEQ ID NO: 463896 - RNA, 64 nt, Homo Sapiens
aagucuucagaucugucaagaaccuuucaauuuaugaaaggacacacacuggagagaaacccua

SEQ ID NO: 463897 - RNA, 64 nt, Homo Sapiens
aagcauucaauuauuuuucuuccuugcauauacaugaaaggacucauacgagagagaauccgua

SEQ ID NO: 463898 - RNA, 64 nt, Homo Sapiens
aagcuuucacuucuuccaguucuuuucaauaucaugaaaggacucacacuggggagaaaccgua

SEQ ID NO: 463899 - RNA, 64 nt, Homo Sapiens
aagccuucaaucuuuccaguuccuuucaguaucaugaaaggacucacacuggagagaaacccua

SEQ ID NO: 463900 - RNA, 64 nt, Homo Sapiens
aagccuucagaucugccucacaccuucaaauucaugaaaggacacaaacacacauaagaauaca

SEQ ID NO: 463901 - RNA, 64 nt, Homo Sapiens
aagccuucaguaguuccaguuccuuuugguaccaugaaaggacucacacuggagagaaacccua

SEQ ID NO: 463902 - RNA, 64 nt, Homo Sapiens
aagccuucagaucugccaagaaccuucgaauucaugaaaggacacaaacacacguaagaaugca

SEQ ID NO: 463903 - RNA, 64 nt, Homo Sapiens
aagccuuuauuucuuucacuucuuuucgauaacaugaaaggacucacacuggagagaaacccua

SEQ ID NO: 463904 - RNA, 64 nt, Homo Sapiens
cacacugcaaagaaacaguaucugcccgaagacaugaaaggaugaagccuuuuauuguugcagu

SEQ ID NO: 463905 - RNA, 64 nt, Homo Sapiens
cauacuggagagaaacccuaucagcucaaagacaugaaaggacuaagcauuuagauacuacuac

SEQ ID NO: 463906 - RNA, 64 nt, Homo Sapiens
cacacuguacagaaacgcuaucugcucgagcacaugaaaggaauaacccuucauuuaccgccau

SEQ ID NO: 463907 - RNA, 64 nt, Homo Sapiens
cacacuggagagaagccguacacuuaaagcaacaugaaaggauuaagccuucagucauuuuggu

SEQ ID NO: 463908 - RNA, 64 nt, Homo Sapiens
cacacuagggagaaaaucuaggauuucaaagacaugaaaggacuaagccuuuguuuauuucauu

SEQ ID NO: 463909 - RNA, 64 nt, Homo Sapiens
gcccagccuuuuuucugcaugauccaggagcacauaccacaaacuaccacaauaaaaaagcugu

SEQ ID NO: 463910 - RNA, 64 nt, Homo Sapiens
uuuucugcaugauccaggagcacauaccacaaacuaccacaauaaaaaagcuguuuuugcuaau

SEQ ID NO: 463911 - RNA, 64 nt, Homo Sapiens
uuuaaaaaguuugaauagaauguuaugcauuuuuuaccacaauuuguuaagaggauagauuuca

SEQ ID NO: 463912 - RNA, 64 nt, Homo Sapiens
cgcauguaguuaacaauuuuaagaaaguuugcuguaccacaaugaagauacuauuuauaaguug

SEQ ID NO: 463913 - RNA, 64 nt, Homo Sapiens
aaagauuaugcuccccuuuuccugcuugguugaguaccacaauuaucuuucugcuguuuguugu

SEQ ID NO: 463914 - RNA, 64 nt, Homo Sapiens
ugauggcuagagcaagaccuccuuaaaggucaccuaccacaaaucagacauuuuguuauugaua

SEQ ID NO: 463915 - RNA, 64 nt, Homo Sapiens; identical to SEQ ID NO: 377221

SEQ ID NO: 463916 - RNA, 64 nt, Homo Sapiens; identical to SEQ ID NO: 377222

SEQ ID NO: 463917 - RNA, 64 nt, Homo Sapiens; identical to SEQ ID NO: 377223

SEQ ID NO: 463918 - RNA, 64 nt, Homo Sapiens; identical to SEQ ID NO: 377224

SEQ ID NO: 463919 - RNA, 64 nt, Homo Sapiens; identical to SEQ ID NO: 377225

SEQ ID NO: 463920 - RNA, 64 nt, Homo Sapiens; identical to SEQ ID NO: 377226

SEQ ID NO: 463921 - RNA, 64 nt, Homo Sapiens; identical to SEQ ID NO: 377227

SEQ ID NO: 463922 - RNA, 64 nt, Homo Sapiens; identical to SEQ ID NO: 377228

SEQ ID NO: 463923 - RNA, 64 nt, Homo Sapiens; identical to SEQ ID NO: 377229

SEQ ID NO: 463924 - RNA, 64 nt, Homo Sapiens; identical to SEQ ID NO: 377230

SEQ ID NO: 463925 - RNA, 64 nt, Homo Sapiens; identical to SEQ ID NO: 377231

SEQ ID NO: 463926 - RNA, 64 nt, Homo Sapiens; identical to SEQ ID NO: 377232

SEQ ID NO: 463927 - RNA, 64 nt, Homo Sapiens; identical to SEQ ID NO: 377233

SEQ ID NO: 463928 - RNA, 64 nt, Homo Sapiens; identical to SEQ ID NO: 377234

SEQ ID NO: 463929 - RNA, 64 nt, Homo Sapiens; identical to SEQ ID NO: 377235

SEQ ID NO: 463930 - RNA, 64 nt, Homo Sapiens; identical to SEQ ID NO: 377236

SEQ ID NO: 463931 - RNA, 64 nt, Homo Sapiens; identical to SEQ ID NO: 377237

SEQ ID NO: 463932 - RNA, 64 nt, Homo Sapiens; identical to SEQ ID NO: 377238

SEQ ID NO: 463933 - RNA, 64 nt, Homo Sapiens; identical to SEQ ID NO: 377239

SEQ ID NO: 463934 - RNA, 64 nt, Homo Sapiens; identical to SEQ ID NO: 377240

SEQ ID NO: 463935 - RNA, 64 nt, Homo Sapiens; identical to SEQ ID NO: 377241

SEQ ID NO: 463936 - RNA, 64 nt, Homo Sapiens; identical to SEQ ID NO: 377242

SEQ ID NO: 463937 - RNA, 64 nt, Homo Sapiens; identical to SEQ ID NO: 377243

SEQ ID NO: 463938 - RNA, 64 nt, Homo Sapiens; identical to SEQ ID NO: 377244

SEQ ID NO: 463939 - RNA, 64 nt, Homo Sapiens; identical to SEQ ID NO: 377245

SEQ ID NO: 463940 - RNA, 64 nt, Homo Sapiens; identical to SEQ ID NO: 377246

SEQ ID NO: 463941 - RNA, 64 nt, Homo Sapiens; identical to SEQ ID NO: 377247

SEQ ID NO: 463942 - RNA, 64 nt, Homo Sapiens; identical to SEQ ID NO: 377248

SEQ ID NO: 463943 - RNA, 64 nt, Homo Sapiens; identical to SEQ ID NO: 377249

SEQ ID NO: 463944 - RNA, 64 nt, Homo Sapiens; identical to SEQ ID NO: 377250

SEQ ID NO: 463945 - RNA, 64 nt, Homo Sapiens; identical to SEQ ID NO: 377251

SEQ ID NO: 463946 - RNA, 64 nt, Homo Sapiens; identical to SEQ ID NO: 377252

SEQ ID NO: 463947 - RNA, 64 nt, Homo Sapiens; identical to SEQ ID NO: 377253

SEQ ID NO: 463948 - RNA, 64 nt, Homo Sapiens; identical to SEQ ID NO: 377254

SEQ ID NO: 463949 - RNA, 64 nt, Homo Sapiens; identical to SEQ ID NO: 377255

SEQ ID NO: 463950 - RNA, 64 nt, Homo Sapiens; identical to SEQ ID NO: 377256

SEQ ID NO: 463951 - RNA, 64 nt, Homo Sapiens; identical to SEQ ID NO: 377257

SEQ ID NO: 463952 - RNA, 64 nt, Homo Sapiens; identical to SEQ ID NO: 377258

SEQ ID NO: 463953 - RNA, 64 nt, Homo Sapiens; identical to SEQ ID NO: 377259

SEQ ID NO: 463954 - RNA, 64 nt, Homo Sapiens; identical to SEQ ID NO: 377260

SEQ ID NO: 463955 - RNA, 64 nt, Homo Sapiens; identical to SEQ ID NO: 377261

SEQ ID NO: 463956 - RNA, 64 nt, Homo Sapiens; identical to SEQ ID NO: 377262

SEQ ID NO: 463957 - RNA, 64 nt, Homo Sapiens; identical to SEQ ID NO: 377263

SEQ ID NO: 463958 - RNA, 64 nt, Homo Sapiens; identical to SEQ ID NO: 377264

SEQ ID NO: 463959 - RNA, 64 nt, Homo Sapiens; identical to SEQ ID NO: 377265

SEQ ID NO: 463960 - RNA, 64 nt, Homo Sapiens; identical to SEQ ID NO: 377266

SEQ ID NO: 463961 - RNA, 64 nt, Homo Sapiens; identical to SEQ ID NO: 377267

SEQ ID NO: 463962 - RNA, 64 nt, Homo Sapiens; identical to SEQ ID NO: 377268

SEQ ID NO: 463963 - RNA, 64 nt, Homo Sapiens; identical to SEQ ID NO: 377269

SEQ ID NO: 463964 - RNA, 64 nt, Homo Sapiens; identical to SEQ ID NO: 377270

SEQ ID NO: 463965 - RNA, 64 nt, Homo Sapiens; identical to SEQ ID NO: 377271

SEQ ID NO: 463966 - RNA, 64 nt, Homo Sapiens; identical to SEQ ID NO: 377272

SEQ ID NO: 463967 - RNA, 64 nt, Homo Sapiens; identical to SEQ ID NO: 377273

SEQ ID NO: 463968 - RNA, 64 nt, Homo Sapiens; identical to SEQ ID NO: 377274

SEQ ID NO: 463969 - RNA, 64 nt, Homo Sapiens; identical to SEQ ID NO: 377275

SEQ ID NO: 463970 - RNA, 64 nt, Homo Sapiens; identical to SEQ ID NO: 377276

SEQ ID NO: 463971 - RNA, 64 nt, Homo Sapiens; identical to SEQ ID NO: 377277

SEQ ID NO: 463972 - RNA, 64 nt, Homo Sapiens; identical to SEQ ID NO: 377278

SEQ ID NO: 463973 - RNA, 64 nt, Homo Sapiens; identical to SEQ ID NO: 377279

SEQ ID NO: 463974 - RNA, 64 nt, Homo Sapiens; identical to SEQ ID NO: 377280

SEQ ID NO: 463975 - RNA, 64 nt, Homo Sapiens; identical to SEQ ID NO: 377281

SEQ ID NO: 463976 - RNA, 64 nt, Homo Sapiens; identical to SEQ ID NO: 377282

SEQ ID NO: 463977 - RNA, 64 nt, Homo Sapiens; identical to SEQ ID NO: 377283

SEQ ID NO: 463978 - RNA, 64 nt, Homo Sapiens; identical to SEQ ID NO: 377284

SEQ ID NO: 463979 - RNA, 64 nt, Homo Sapiens; identical to SEQ ID NO: 377285

SEQ ID NO: 463980 - RNA, 64 nt, Homo Sapiens; identical to SEQ ID NO: 377286

SEQ ID NO: 463981 - RNA, 64 nt, Homo Sapiens; identical to SEQ ID NO: 377287

SEQ ID NO: 463982 - RNA, 64 nt, Homo Sapiens; identical to SEQ ID NO: 377288

SEQ ID NO: 463983 - RNA, 64 nt, Homo Sapiens; identical to SEQ ID NO: 377289

SEQ ID NO: 463984 - RNA, 64 nt, Homo Sapiens; identical to SEQ ID NO: 377290

SEQ ID NO: 463985 - RNA, 64 nt, Homo Sapiens; identical to SEQ ID NO: 377291

SEQ ID NO: 463986 - RNA, 64 nt, Homo Sapiens; identical to SEQ ID NO: 377292

SEQ ID NO: 463987 - RNA, 64 nt, Homo Sapiens; identical to SEQ ID NO: 377293

SEQ ID NO: 463988 - RNA, 64 nt, Homo Sapiens; identical to SEQ ID NO: 377294

SEQ ID NO: 463989 - RNA, 64 nt, Homo Sapiens; identical to SEQ ID NO: 377295

SEQ ID NO: 463990 - RNA, 64 nt, Homo Sapiens; identical to SEQ ID NO: 377296

SEQ ID NO: 463991 - RNA, 64 nt, Homo Sapiens; identical to SEQ ID NO: 377297

SEQ ID NO: 463992 - RNA, 64 nt, Homo Sapiens; identical to SEQ ID NO: 377298

SEQ ID NO: 463993 - RNA, 64 nt, Homo Sapiens; identical to SEQ ID NO: 209365

SEQ ID NO: 463994 - RNA, 64 nt, Homo Sapiens; identical to SEQ ID NO: 209366

SEQ ID NO: 463995 - RNA, 64 nt, Homo Sapiens; identical to SEQ ID NO: 209367

SEQ ID NO: 463996 - RNA, 64 nt, Homo Sapiens; identical to SEQ ID NO: 209368

SEQ ID NO: 463997 - RNA, 64 nt, Homo Sapiens; identical to SEQ ID NO: 209369

SEQ ID NO: 463998 - RNA, 64 nt, Homo Sapiens; identical to SEQ ID NO: 209370

SEQ ID NO: 463999 - RNA, 64 nt, Homo Sapiens; identical to SEQ ID NO: 209371

SEQ ID NO: 464000 - RNA, 64 nt, Homo Sapiens; identical to SEQ ID NO: 209372

SEQ ID NO: 464001 - RNA, 64 nt, Homo Sapiens; identical to SEQ ID NO: 209373

SEQ ID NO: 464002 - RNA, 64 nt, Homo Sapiens; identical to SEQ ID NO: 209374

SEQ ID NO: 464003 - RNA, 64 nt, Homo Sapiens; identical to SEQ ID NO: 209375

SEQ ID NO: 464004 - RNA, 64 nt, Homo Sapiens; identical to SEQ ID NO: 209376

SEQ ID NO: 464005 - RNA, 64 nt, Homo Sapiens; identical to SEQ ID NO: 209377

SEQ ID NO: 464006 - RNA, 64 nt, Homo Sapiens; identical to SEQ ID NO: 209378

SEQ ID NO: 464007 - RNA, 64 nt, Homo Sapiens; identical to SEQ ID NO: 209379

SEQ ID NO: 464008 - RNA, 64 nt, Homo Sapiens; identical to SEQ ID NO: 209380

SEQ ID NO: 464009 - RNA, 64 nt, Homo Sapiens; identical to SEQ ID NO: 209381

SEQ ID NO: 464010 - RNA, 64 nt, Homo Sapiens; identical to SEQ ID NO: 209382

SEQ ID NO: 464011 - RNA, 64 nt, Homo Sapiens; identical to SEQ ID NO: 209383

SEQ ID NO: 464012 - RNA, 64 nt, Homo Sapiens; identical to SEQ ID NO: 313174

SEQ ID NO: 464013 - RNA, 64 nt, Homo Sapiens; identical to SEQ ID NO: 313175

SEQ ID NO: 464014 - RNA, 64 nt, Homo Sapiens; identical to SEQ ID NO: 313176

SEQ ID NO: 464015 - RNA, 64 nt, Homo Sapiens; identical to SEQ ID NO: 313177

SEQ ID NO: 464016 - RNA, 64 nt, Homo Sapiens; identical to SEQ ID NO: 313178

SEQ ID NO: 464017 - RNA, 64 nt, Homo Sapiens; identical to SEQ ID NO: 313179

SEQ ID NO: 464018 - RNA, 64 nt, Homo Sapiens; identical to SEQ ID NO: 313180

SEQ ID NO: 464019 - RNA, 64 nt, Homo Sapiens; identical to SEQ ID NO: 313181

SEQ ID NO: 464020 - RNA, 64 nt, Homo Sapiens; identical to SEQ ID NO: 313182

SEQ ID NO: 464021 - RNA, 64 nt, Homo Sapiens; identical to SEQ ID NO: 313183

SEQ ID NO: 464022 - RNA, 64 nt, Homo Sapiens; identical to SEQ ID NO: 313184

SEQ ID NO: 464023 - RNA, 64 nt, Homo Sapiens; identical to SEQ ID NO: 313185

SEQ ID NO: 464024 - RNA, 64 nt, Homo Sapiens; identical to SEQ ID NO: 313186

SEQ ID NO: 464025 - RNA, 64 nt, Homo Sapiens; identical to SEQ ID NO: 313187

SEQ ID NO: 464026 - RNA, 64 nt, Homo Sapiens
caagaauuaaaaucaugugcuguauuuuuaaaaucuagccaaauuaaauaguacaugagaaauu

SEQ ID NO: 464027 - RNA, 64 nt, Homo Sapiens
ucacaccuguaaucuucaggauuucaagaccagccuagccaacaugacgaaaccccaucucuac

SEQ ID NO: 464028 - RNA, 64 nt, Homo Sapiens
gaauacucuuuuugccuuguaucuucucagccuccuagccaaguccuauguaauauggaaaaca

SEQ ID NO: 464029 - RNA, 64 nt, Homo Sapiens
uaaucagcagcguaacuacccuaaaagcauaucacuagccaaagagggaaauaucuguucuucu

SEQ ID NO: 464030 - RNA, 64 nt, Homo Sapiens
ugcaacuggacaaccccagcacccuggcuguguacuagccaaaagcgaccuggagcagcucuug

SEQ ID NO: 464031 - RNA, 64 nt, Homo Sapiens
aaucucgucaucuggagguguauuugugaugagacuagccaaacugaaguuccuggaucuccca

SEQ ID NO: 464032 - RNA, 64 nt, Homo Sapiens
uaauucuaaaccugaaggcauccuugaaaucaugcuugaauauugcuuugauagcugcuaucau

SEQ ID NO: 464033 - RNA, 64 nt, Homo Sapiens
aaucuaguuaaauuucccauuuguauuuuauuuucuugaauacuuuuuucauaguuauuuguuu

SEQ ID NO: 464034 - RNA, 64 nt, Homo Sapiens
acauuuuucaaaacucaagugaaauuauguaauucuugaauaaacuguauuuuggaagauauuu

SEQ ID NO: 464035 - RNA, 64 nt, Homo Sapiens
aaacuuugccuguuguacaugcuaacgucaaauucuugaauacacacagcuauaaauugaggca

SEQ ID NO: 464036 - RNA, 64 nt, Homo Sapiens
caucucuaguaaauacuguuacaggauucaugaacuugaauaauucuacaguuugaaacucuga

SEQ ID NO: 464037 - RNA, 64 nt, Homo Sapiens
uaaauuuuaaaaaagcacuugguugaaaauuguacuugaauacauacaugcaugcugcuaaacu

SEQ ID NO: 464038 - RNA, 64 nt, Homo Sapiens
uuugacauucauuuugauucagucugucagaaagcuugaauauuuuucuugcuucauuagagua

SEQ ID NO: 464039 - RNA, 64 nt, Homo Sapiens
gaauaauuugaucaauguuauugaaaaauguauucuugaauaguauacauuuuaaagacaaaac

SEQ ID NO: 464040 - RNA, 64 nt, Homo Sapiens
aaauaaaaguagugauuaguugguugauugugaccuugaauacaagagcaaaagaacccucuuc

SEQ ID NO: 464041 - RNA, 64 nt, Homo Sapiens
caugcugcuuucauuuuuauuguuaugaaaaagccuugaauauguguuuuucagccauugaaaa

SEQ ID NO: 464042 - RNA, 64 nt, Homo Sapiens
uugauuuggucuaaauuugaauauauaugaguuacuugaauauaacaaaaaugaauuuuguuug

SEQ ID NO: 464043 - RNA, 64 nt, Homo Sapiens
uuugauagauuuauauuguaaccuuuuucuaguucuugaauaaauauagccugcuuucccuaga

SEQ ID NO: 464044 - RNA, 64 nt, Homo Sapiens
uucaagggcaauuuauucaucugauagugauugccuugaauaaauuuaccuggguguuccacag

SEQ ID NO: 464045 - RNA, 64 nt, Homo Sapiens
gaauauauaguuuacaaaauaugcuguguuauuacuugaauauagccucaguucuguauaggca

SEQ ID NO: 464046 - RNA, 64 nt, Homo Sapiens
ccauucaccaauuuuaauccuaccugcuugaauacuugaauaaaauuacuugguuucuuuuacu

SEQ ID NO: 464047 - RNA, 64 nt, Homo Sapiens
ugaauaaaccauucaccaaucuuuuacuuaccugcuugaauacucguuguguauuacuugguuu

SEQ ID NO: 464048 - RNA, 64 nt, Homo Sapiens
acaugggugaacuuacuugcauaccaaguugauacuugaauaaccaucugaaagugguacuuga

SEQ ID NO: 464049 - RNA, 64 nt, Homo Sapiens
auguucuagaaacauguaauccuaaauuuacccucuugaauauaaucccuggaugauauuuuuu

SEQ ID NO: 464050 - RNA, 64 nt, Homo Sapiens
gaggcaguaauuacaguggaaugaguacuggacaaggagucaaaaaacuugauuucagguccua

SEQ ID NO: 464051 - RNA, 64 nt, Homo Sapiens
guguauuuaauuccaucagguccaguacaguacuaggagucauaauacuuuauaaucaauuaaa

SEQ ID NO: 464052 - RNA, 64 nt, Homo Sapiens
uuuuuaaacguuuguaaaaaccucuuugaggaugaggagucaguaaaauuccacuccccaagug

SEQ ID NO: 464053 - RNA, 64 nt, Homo Sapiens
uuugguccauguaagugcuacccguugcugggggaggagucaugguuuauuuggaaaugucagu

SEQ ID NO: 464054 - RNA, 64 nt, Homo Sapiens
gucauucuaccccucgcuaaccguucacagugggaggagucaauucccugcagcugccuagacc

SEQ ID NO: 464055 - RNA, 64 nt, Homo Sapiens
uuggucgacaggcucucaaguucuguccccuccgaggagucauuccuccacuggauuccuuugu

SEQ ID NO: 464056 - RNA, 64 nt, Homo Sapiens
gcauggacugguaagaugaaggaagggugacaucaggagucaggcacagggaagggugaugcag

SEQ ID NO: 464057 - RNA, 61 nt, Homo Sapiens
ggaauuugcccaauggcugguuccaucagggaggagucagacacagaagaaaaagaauuag

SEQ ID NO: 464058 - RNA, 64 nt, Homo Sapiens
aaaaaaaaaaaaaaaaaaaagagagagcaagcuaaggagucaccggguggccagugggacucag

SEQ ID NO: 464059 - RNA, 64 nt, Homo Sapiens
aaaagcuuuugugaaagugaaagauacuaggcccaggagucaaguuacauucugccaggggcaa

SEQ ID NO: 464060 - RNA, 64 nt, Homo Sapiens
uccugagccacuucagaguuaagggcugccuuucaggagucaccgcuccaccaggagaucaagc

SEQ ID NO: 464061 - RNA, 64 nt, Homo Sapiens
augccaaagaaugaggcuggagccccucaauuccaggagucaacaaagcaugcaucuuagaaau

SEQ ID NO: 464062 - RNA, 64 nt, Homo Sapiens
uggcagaaaacaaaagugacgagaaaaaaaaaucaggagucagcucugacaaugaagaugauga

SEQ ID NO: 464063 - RNA, 64 nt, Homo Sapiens
gcugcugcccgggaaaagcuggcccaggcgucuaaggagucaaaagagaaacagcuucaagcag

SEQ ID NO: 464064 - RNA, 64 nt, Homo Sapiens
aaggaagugucguugcuguuagagccucacguggaggagucacuuaaacaccaguuuuuuacug

SEQ ID NO: 464065 - RNA, 64 nt, Homo Sapiens
acauucuugguccuggugcuuggguuaugauggcaggagucaagaagaagauuacuuucauucu

SEQ ID NO: 464066 - RNA, 64 nt, Homo Sapiens
cuaagaaacgccaggucugcgggcugugcccagcaggagucagggucacugugcccagcagggu

SEQ ID NO: 464067 - RNA, 64 nt, Homo Sapiens
agccagggacugugcagccuucacugcgcccggcaggagucaggaugcagcccgaaaccuccag

SEQ ID NO: 464068 - RNA, 64 nt, Homo Sapiens
uaauggaggucccagcccuguccuggcacagaagaggagucaagggaaccaccagucuaguccg

SEQ ID NO: 464069 - RNA, 64 nt, Homo Sapiens
ugaggcccugcaccuuccccaucaggcaaggaggaggagucagagaucaggccccaccccugua

SEQ ID NO: 464070 - RNA, 64 nt, Homo Sapiens; identical to SEQ ID NO: 115878

SEQ ID NO: 464071 - RNA, 64 nt, Homo Sapiens; identical to SEQ ID NO: 115879

SEQ ID NO: 464072 - RNA, 64 nt, Homo Sapiens; identical to SEQ ID NO: 115880

SEQ ID NO: 464073 - RNA, 64 nt, Homo Sapiens; identical to SEQ ID NO: 115881

SEQ ID NO: 464074 - RNA, 64 nt, Homo Sapiens; identical to SEQ ID NO: 115882

SEQ ID NO: 464075 - RNA, 64 nt, Homo Sapiens; identical to SEQ ID NO: 115883

SEQ ID NO: 464076 - RNA, 64 nt, Homo Sapiens; identical to SEQ ID NO: 115884

SEQ ID NO: 464077 - RNA, 64 nt, Homo Sapiens; identical to SEQ ID NO: 115885

SEQ ID NO: 464078 - RNA, 64 nt, Homo Sapiens; identical to SEQ ID NO: 115886

SEQ ID NO: 464079 - RNA, 64 nt, Homo Sapiens; identical to SEQ ID NO: 115887

SEQ ID NO: 464080 - RNA, 64 nt, Homo Sapiens; identical to SEQ ID NO: 115888

SEQ ID NO: 464081 - RNA, 64 nt, Homo Sapiens; identical to SEQ ID NO: 115889

SEQ ID NO: 464082 - RNA, 53 nt, Homo Sapiens; identical to SEQ ID NO: 115890

SEQ ID NO: 464083 - RNA, 64 nt, Homo Sapiens; identical to SEQ ID NO: 115891

SEQ ID NO: 464084 - RNA, 64 nt, Homo Sapiens; identical to SEQ ID NO: 115892

SEQ ID NO: 464085 - RNA, 64 nt, Homo Sapiens; identical to SEQ ID NO: 115893

SEQ ID NO: 464086 - RNA, 64 nt, Homo Sapiens; identical to SEQ ID NO: 115894

SEQ ID NO: 464087 - RNA, 64 nt, Homo Sapiens; identical to SEQ ID NO: 115895

SEQ ID NO: 464088 - RNA, 64 nt, Homo Sapiens; identical to SEQ ID NO: 115896

SEQ ID NO: 464089 - RNA, 64 nt, Homo Sapiens; identical to SEQ ID NO: 115897

SEQ ID NO: 464090 - RNA, 64 nt, Homo Sapiens; identical to SEQ ID NO: 115898

SEQ ID NO: 464091 - RNA, 64 nt, Homo Sapiens; identical to SEQ ID NO: 115899

SEQ ID NO: 464092 - RNA, 64 nt, Homo Sapiens; identical to SEQ ID NO: 115900

SEQ ID NO: 464093 - RNA, 64 nt, Homo Sapiens; identical to SEQ ID NO: 115901

SEQ ID NO: 464094 - RNA, 64 nt, Homo Sapiens; identical to SEQ ID NO: 115902

SEQ ID NO: 464095 - RNA, 64 nt, Homo Sapiens; identical to SEQ ID NO: 115903

SEQ ID NO: 464096 - RNA, 64 nt, Homo Sapiens; identical to SEQ ID NO: 115903

SEQ ID NO: 464097 - RNA, 64 nt, Homo Sapiens; identical to SEQ ID NO: 115905

SEQ ID NO: 464098 - RNA, 64 nt, Homo Sapiens; identical to SEQ ID NO: 115906

SEQ ID NO: 464099 - RNA, 64 nt, Homo Sapiens; identical to SEQ ID NO: 115907

SEQ ID NO: 464100 - RNA, 64 nt, Homo Sapiens; identical to SEQ ID NO: 115908

SEQ ID NO: 464101 - RNA, 64 nt, Homo Sapiens; identical to SEQ ID NO: 115909

SEQ ID NO: 464102 - RNA, 64 nt, Homo Sapiens; identical to SEQ ID NO: 115910

SEQ ID NO: 464103 - RNA, 64 nt, Homo Sapiens; identical to SEQ ID NO: 432964

SEQ ID NO: 464104 - RNA, 64 nt, Homo Sapiens; identical to SEQ ID NO: 432965

SEQ ID NO: 464105 - RNA, 64 nt, Homo Sapiens; identical to SEQ ID NO: 432966

SEQ ID NO: 464106 - RNA, 64 nt, Homo Sapiens; identical to SEQ ID NO: 432967

SEQ ID NO: 464107 - RNA, 64 nt, Homo Sapiens; identical to SEQ ID NO: 432968

SEQ ID NO: 464108 - RNA, 64 nt, Homo Sapiens; identical to SEQ ID NO: 301795

SEQ ID NO: 464109 - RNA, 64 nt, Homo Sapiens; identical to SEQ ID NO: 301796

SEQ ID NO: 464110 - RNA, 64 nt, Homo Sapiens; identical to SEQ ID NO: 301797

SEQ ID NO: 464111 - RNA, 64 nt, Homo Sapiens; identical to SEQ ID NO: 301798

SEQ ID NO: 464112 - RNA, 64 nt, Homo Sapiens; identical to SEQ ID NO: 301799

SEQ ID NO: 464113 - RNA, 64 nt, Homo Sapiens; identical to SEQ ID NO: 301800

SEQ ID NO: 464114 - RNA, 64 nt, Homo Sapiens; identical to SEQ ID NO: 301801

SEQ ID NO: 464115 - RNA, 64 nt, Homo Sapiens; identical to SEQ ID NO: 301802

SEQ ID NO: 464116 - RNA, 64 nt, Homo Sapiens; identical to SEQ ID NO: 301803

SEQ ID NO: 464117 - RNA, 64 nt, Homo Sapiens; identical to SEQ ID NO: 301804

SEQ ID NO: 464118 - RNA, 64 nt, Homo Sapiens; identical to SEQ ID NO: 301805

SEQ ID NO: 464119 - RNA, 55 nt, Homo Sapiens; identical to SEQ ID NO: 301806

SEQ ID NO: 464120 - RNA, 64 nt, Homo Sapiens; identical to SEQ ID NO: 301807

SEQ ID NO: 464121 - RNA, 64 nt, Homo Sapiens; identical to SEQ ID NO: 301808

SEQ ID NO: 464122 - RNA, 64 nt, Homo Sapiens; identical to SEQ ID NO: 301809

SEQ ID NO: 464123 - RNA, 64 nt, Homo Sapiens; identical to SEQ ID NO: 301810

SEQ ID NO: 464124 - RNA, 64 nt, Homo Sapiens; identical to SEQ ID NO: 301811

SEQ ID NO: 464125 - RNA, 64 nt, Homo Sapiens; identical to SEQ ID NO: 301812

SEQ ID NO: 464126 - RNA, 64 nt, Homo Sapiens; identical to SEQ ID NO: 301813

SEQ ID NO: 464127 - RNA, 64 nt, Homo Sapiens; identical to SEQ ID NO: 301814

SEQ ID NO: 464128 - RNA, 64 nt, Homo Sapiens; identical to SEQ ID NO: 301815

SEQ ID NO: 464129 - RNA, 64 nt, Homo Sapiens; identical to SEQ ID NO: 301816

SEQ ID NO: 464130 - RNA, 64 nt, Homo Sapiens; identical to SEQ ID NO: 301817

SEQ ID NO: 464131 - RNA, 64 nt, Homo Sapiens; identical to SEQ ID NO: 301818

SEQ ID NO: 464132 - RNA, 64 nt, Homo Sapiens; identical to SEQ ID NO: 301819

SEQ ID NO: 464133 - RNA, 64 nt, Homo Sapiens; identical to SEQ ID NO: 301820

SEQ ID NO: 464134 - RNA, 64 nt, Homo Sapiens; identical to SEQ ID NO: 301821

SEQ ID NO: 464135 - RNA, 64 nt, Homo Sapiens; identical to SEQ ID NO: 301822

SEQ ID NO: 464136 - RNA, 64 nt, Homo Sapiens; identical to SEQ ID NO: 301823

SEQ ID NO: 464137 - RNA, 64 nt, Homo Sapiens; identical to SEQ ID NO: 301824

SEQ ID NO: 464138 - RNA, 64 nt, Homo Sapiens; identical to SEQ ID NO: 301825

SEQ ID NO: 464139 - RNA, 64 nt, Homo Sapiens; identical to SEQ ID NO: 301826

SEQ ID NO: 464140 - RNA, 51 nt, Homo Sapiens; identical to SEQ ID NO: 301827

SEQ ID NO: 464141 - RNA, 64 nt, Homo Sapiens; identical to SEQ ID NO: 301828

SEQ ID NO: 464142 - RNA, 64 nt, Homo Sapiens; identical to SEQ ID NO: 301829

SEQ ID NO: 464143 - RNA, 64 nt, Homo Sapiens; identical to SEQ ID NO: 301830

SEQ ID NO: 464144 - RNA, 64 nt, Homo Sapiens; identical to SEQ ID NO: 301831

SEQ ID NO: 464145 - RNA, 64 nt, Homo Sapiens; identical to SEQ ID NO: 301832

SEQ ID NO: 464146 - RNA, 64 nt, Homo Sapiens; identical to SEQ ID NO: 301833

SEQ ID NO: 464147 - RNA, 64 nt, Homo Sapiens; identical to SEQ ID NO: 301834

SEQ ID NO: 464148 - RNA, 64 nt, Homo Sapiens; identical to SEQ ID NO: 301835

SEQ ID NO: 464149 - RNA, 64 nt, Homo Sapiens; identical to SEQ ID NO: 301836

SEQ ID NO: 464150 - RNA, 64 nt, Homo Sapiens; identical to SEQ ID NO: 301837

SEQ ID NO: 464151 - RNA, 64 nt, Homo Sapiens; identical to SEQ ID NO: 301838

SEQ ID NO: 464152 - RNA, 64 nt, Homo Sapiens; identical to SEQ ID NO: 301839

SEQ ID NO: 464153 - RNA, 64 nt, Homo Sapiens; identical to SEQ ID NO: 301840

SEQ ID NO: 464154 - RNA, 64 nt, Homo Sapiens; identical to SEQ ID NO: 301841

SEQ ID NO: 464155 - RNA, 64 nt, Homo Sapiens; identical to SEQ ID NO: 301842

SEQ ID NO: 464156 - RNA, 64 nt, Homo Sapiens; identical to SEQ ID NO: 301843

SEQ ID NO: 464157 - RNA, 64 nt, Homo Sapiens; identical to SEQ ID NO: 301844

SEQ ID NO: 464158 - RNA, 64 nt, Homo Sapiens; identical to SEQ ID NO: 301845

SEQ ID NO: 464159 - RNA, 64 nt, Homo Sapiens; identical to SEQ ID NO: 301846

SEQ ID NO: 464160 - RNA, 64 nt, Homo Sapiens; identical to SEQ ID NO: 301847

SEQ ID NO: 464161 - RNA, 64 nt, Homo Sapiens; identical to SEQ ID NO: 301848

SEQ ID NO: 464162 - RNA, 64 nt, Homo Sapiens; identical to SEQ ID NO: 301849

SEQ ID NO: 464163 - RNA, 64 nt, Homo Sapiens; identical to SEQ ID NO: 301850

SEQ ID NO: 464164 - RNA, 64 nt, Homo Sapiens; identical to SEQ ID NO: 301851

SEQ ID NO: 464165 - RNA, 64 nt, Homo Sapiens; identical to SEQ ID NO: 301852

SEQ ID NO: 464166 - RNA, 64 nt, Homo Sapiens; identical to SEQ ID NO: 301853

SEQ ID NO: 464167 - RNA, 64 nt, Homo Sapiens; identical to SEQ ID NO: 301854

SEQ ID NO: 464168 - RNA, 64 nt, Homo Sapiens; identical to SEQ ID NO: 301855

SEQ ID NO: 464169 - RNA, 64 nt, Homo Sapiens; identical to SEQ ID NO: 301856

SEQ ID NO: 464170 - RNA, 64 nt, Homo Sapiens; identical to SEQ ID NO: 301857

SEQ ID NO: 464171 - RNA, 64 nt, Homo Sapiens; identical to SEQ ID NO: 301858

SEQ ID NO: 464172 - RNA, 64 nt, Homo Sapiens; identical to SEQ ID NO: 301859

SEQ ID NO: 464173 - RNA, 64 nt, Homo Sapiens; identical to SEQ ID NO: 301860

SEQ ID NO: 464174 - RNA, 64 nt, Homo Sapiens; identical to SEQ ID NO: 301861

SEQ ID NO: 464175 - RNA, 64 nt, Homo Sapiens; identical to SEQ ID NO: 288178

SEQ ID NO: 464176 - RNA, 64 nt, Homo Sapiens; identical to SEQ ID NO: 288179

SEQ ID NO: 464177 - RNA, 64 nt, Homo Sapiens; identical to SEQ ID NO: 288180

SEQ ID NO: 464178 - RNA, 64 nt, Homo Sapiens; identical to SEQ ID NO: 288181

SEQ ID NO: 464179 - RNA, 64 nt, Homo Sapiens; identical to SEQ ID NO: 288182

SEQ ID NO: 464180 - RNA, 64 nt, Homo Sapiens; identical to SEQ ID NO: 288183

SEQ ID NO: 464181 - RNA, 64 nt, Homo Sapiens; identical to SEQ ID NO: 288184

SEQ ID NO: 464182 - RNA, 64 nt, Homo Sapiens; identical to SEQ ID NO: 288185

SEQ ID NO: 464183 - RNA, 64 nt, Homo Sapiens; identical to SEQ ID NO: 288186

SEQ ID NO: 464184 - RNA, 64 nt, Homo Sapiens; identical to SEQ ID NO: 288187

SEQ ID NO: 464185 - RNA, 64 nt, Homo Sapiens; identical to SEQ ID NO: 288188

SEQ ID NO: 464186 - RNA, 64 nt, Homo Sapiens; identical to SEQ ID NO: 288189

SEQ ID NO: 464187 - RNA, 64 nt, Homo Sapiens; identical to SEQ ID NO: 288190

SEQ ID NO: 464188 - RNA, 64 nt, Homo Sapiens; identical to SEQ ID NO: 288191

SEQ ID NO: 464189 - RNA, 64 nt, Homo Sapiens; identical to SEQ ID NO: 288192

SEQ ID NO: 464190 - RNA, 64 nt, Homo Sapiens; identical to SEQ ID NO: 288193

SEQ ID NO: 464191 - RNA, 64 nt, Homo Sapiens; identical to SEQ ID NO: 288194

SEQ ID NO: 464192 - RNA, 64 nt, Homo Sapiens; identical to SEQ ID NO: 288195

SEQ ID NO: 464193 - RNA, 64 nt, Homo Sapiens
uuuuaaaagcuucaaaaugaugggauaugaucauagauuuuagucuuacuaaucugaaucacau

SEQ ID NO: 464194 - RNA, 64 nt, Homo Sapiens
ucaagguauuguaaaugacaagauaccaaauacaagauuuuaaaagcaaccauggggagaaaaa

SEQ ID NO: 464195 - RNA, 64 nt, Homo Sapiens
caguaaaauguuagaaaucauacauaauuagcagagauuuuaguuuuaaagccacaaaguagau

SEQ ID NO: 464196 - RNA, 64 nt, Homo Sapiens
aacugggggauuucuuaauuuggaaauugcccucagauuuuauaucuauccugacaaaguucac

SEQ ID NO: 464197 - RNA, 64 nt, Homo Sapiens
ccaguuaaaagaugcagccucacugcuucaacgcagauuuuaauguuuacuuaaauauaaaccu

SEQ ID NO: 464198 - RNA, 64 nt, Homo Sapiens
uaaaucagaaauuuuuuauuaucuauguucuucuagauuuuaccuguaguucauacuucaguca

SEQ ID NO: 464199 - RNA, 64 nt, Homo Sapiens
gaacuugaaauuuuuaacacauccuucuuggugaagauuuuaauauauuacuuauaugcuucaa

SEQ ID NO: 464200 - RNA, 64 nt, Homo Sapiens
aagauuaauauuugauucucuaucucuuaacuguagauuuuauuggccuguuuuuuuuuucuaa

SEQ ID NO: 464201 - RNA, 64 nt, Homo Sapiens
uguauaauguuguuaaaguaagaaugacugacccagauuuuagagaaacguaugaaacagauga

SEQ ID NO: 464202 - RNA, 64 nt, Homo Sapiens
uccgagacaggagucuuucaccaauuauaugaaaagauuuuaacuuucuuagaucaaauuuaug

SEQ ID NO: 464203 - RNA, 64 nt, Homo Sapiens
uaucuuugcagguaucacagaaaaaagaaaaauuagauuuuacaagacuguagcaaaaaaaaaa

SEQ ID NO: 464204 - RNA, 64 nt, Homo Sapiens
gggcuacugcagauaaaaauucauucucuuaaagagauuuuaugaccucuacagagaccaaaac

SEQ ID NO: 464205 - RNA, 64 nt, Homo Sapiens
uuauuuguuucccuacuugaugcugauggcugcuagauuuuaaucauugucuuugcuguacucu

SEQ ID NO: 464206 - RNA, 64 nt, Homo Sapiens
uauccacaauagucagaaaacauuaauuacauacagauuuuaccuaauaguucaguagaauuac

SEQ ID NO: 464207 - RNA, 64 nt, Homo Sapiens
uauugaaugacacuucuacauuuugguucagaggagauuuuaaaguuuuacuuucaggcucuug

SEQ ID NO: 464208 - RNA, 64 nt, Homo Sapiens
auuacaucuugucccccuagucuuuuggggcuucagauuuuaugcuucagccuccucugacuuu

SEQ ID NO: 464209 - RNA, 64 nt, Homo Sapiens
gaaauuuguuguuaguuacgcauauuucuuaaccagauuuuaaauguuuacuuuucaauauuuu

SEQ ID NO: 464210 - RNA, 64 nt, Homo Sapiens
aaagcaagcauuuuuauuucugcugcgagacuggagauuuuauauguuuguauuauauuggggg

SEQ ID NO: 464211 - RNA, 64 nt, Homo Sapiens
gauuuaaugacaaaggaaauccuguagcagucaaagauuuuauuauauauauuguuaaaggaga

SEQ ID NO: 464212 - RNA, 64 nt, Homo Sapiens
caguauuuguuuuguuuuggcaauguuugcuuuuagauuuuauauaaauauaaauguuacaacu

SEQ ID NO: 464213 - RNA, 64 nt, Homo Sapiens
aaacuaucucaugccagugccuuauuacccaggaagauuuuaaaggaccucauuaauaauuugc

SEQ ID NO: 464214 - RNA, 64 nt, Homo Sapiens
aggaucagcugguucaguacugucuaucaaagguagauuuuacagagaacagaaaucggggaag

SEQ ID NO: 464215 - RNA, 64 nt, Homo Sapiens
aauucaauggauauacauuuuuuucugaagauuaagauuuuaauuauucaacuuaaaaaguaga

SEQ ID NO: 464216 - RNA, 64 nt, Homo Sapiens
augaaauacauacugauaauacauaccucaugaaagauuuuauucuuuauuguguuacagagca

SEQ ID NO: 464217 - RNA, 64 nt, Homo Sapiens
uaaacuuaagauccgacauuuuuuguauucuuuaagauuuuacaccuaaaaaaucucuccuauc

SEQ ID NO: 464218 - RNA, 64 nt, Homo Sapiens
gcucucuacaugaagaugacuuguuuuauauuucagauuuuauuuuaaaagccaugucuguuaa

SEQ ID NO: 464219 - RNA, 64 nt, Homo Sapiens
ccuuuuguuugaugaagaaauaaacuucagcugaagauuuuauauaggacuuuaaaaagaagag

SEQ ID NO: 464220 - RNA, 64 nt, Homo Sapiens
cuaugauuuagacuucaaggaauuccaaugaugaagauuuuaaggaaaguauuuuauauucaac

SEQ ID NO: 464221 - RNA, 64 nt, Homo Sapiens
augaugaaacugucauaaugguaaguuugugaauagauuuuagcaauacacuuuuuuccaaagu

SEQ ID NO: 464222 - RNA, 64 nt, Homo Sapiens
uauaucuuuauucaccuuuuauuuaacuuaacccagauuuuauucucauggugcauauaaauau

SEQ ID NO: 464223 - RNA, 64 nt, Homo Sapiens
uaaacaggaaauuagaagugaaaaaauugauugaagauuuuaaaaccuuaugauguacuuugua

SEQ ID NO: 464224 - RNA, 64 nt, Homo Sapiens
uugcaugcucuccuuuauuuacaaucauggagacagauuuuaauuuaaaaaccaggaaauuucu

SEQ ID NO: 464225 - RNA, 64 nt, Homo Sapiens
guuaaagacccuacaauaagcuucacuaaaugguagauuuuacucacugucucaagacugagca

SEQ ID NO: 464226 - RNA, 64 nt, Homo Sapiens
uaaacuauuaagaaucaacaaagacuuuguuuaaagauuuuauucagcaauugaaaugcuacaa

SEQ ID NO: 464227 - RNA, 64 nt, Homo Sapiens
ggccacauaggccagcuagucucaggauuggaagagauuuuaaauuauccagaguugugggaau

SEQ ID NO: 464228 - RNA, 64 nt, Homo Sapiens
auuuaggaguuucaauaauaaggauggguccuucagauuuuagcaugaucagaacuuagauaua

SEQ ID NO: 464229 - RNA, 64 nt, Homo Sapiens
gggggagaauucuagaaauaauuuguuuuuguagagauuuuaaauuugaaugguuuaacaaaag

SEQ ID NO: 464230 - RNA, 64 nt, Homo Sapiens
aaguauaaaaaauucucauauauaauaauugaaaagauuuuaacuuuacaugcuacuaaauuuu

SEQ ID NO: 464231 - RNA, 64 nt, Homo Sapiens
gucagauauuuagauguuugaguuacagcauuucagauuuuauugauggugcaguuaauguuga

SEQ ID NO: 464232 - RNA, 64 nt, Homo Sapiens
uuaugucaauugaucagguucagugcuuugggacagauuuuauaugguauagauuuucuuguuu

SEQ ID NO: 464233 - RNA, 64 nt, Homo Sapiens
guggugcuuuauuuauaucaaaucuuuuaggaagagauuuuacaauugcuaggugugacccagc

SEQ ID NO: 464234 - RNA, 64 nt, Homo Sapiens
uuuuaaucuaauuuuuuucugcacauuaaauuuuagauuuuauuuuguauuucuuuuuuagcca

SEQ ID NO: 464235 - RNA, 64 nt, Homo Sapiens
gacccaggguccuacagauagauauggugugcccagauuuuaaaaauaccuucaaaaauaaaaa

SEQ ID NO: 464236 - RNA, 64 nt, Homo Sapiens
augugccaaacuuuccaggguuuuguagucaccuagauuuuaagcugauagcauagugcuucag

SEQ ID NO: 464237 - RNA, 64 nt, Homo Sapiens
aacagguuacugugaagauuuugccacuaacucuagauuuuaccuuuuuguaaugcuguuuauc

SEQ ID NO: 464238 - RNA, 64 nt, Homo Sapiens
uuguaagcuaaauggucuugcauccagaaaggccagauuuuaccuaccaagaaaaaaagauauu

SEQ ID NO: 464239 - RNA, 64 nt, Homo Sapiens
uugacucacaguuugaagcauggagaaaaauaguagauuuuaauucagccguuucacuuuuugu

SEQ ID NO: 464240 - RNA, 64 nt, Homo Sapiens
auugauugguuacuuauuuacuaaaauaugcugcagauuuuauaaaaccuuagacauaucacac

SEQ ID NO: 464241 - RNA, 64 nt, Homo Sapiens
gauuguuauaucaaaucagaacaaacuucuccaaagauuuuauuauagcaacaacccagaacuu

SEQ ID NO: 464242 - RNA, 64 nt, Homo Sapiens
ggcagcuguuuuauugccauguagguguccaugcagauuuuauuuacaauaccauuaaccaaag

SEQ ID NO: 464243 - RNA, 64 nt, Homo Sapiens
agggccagaucaucccuggagugcaccucuacuaagauuuuaugaaaagaugacauguugggcu

SEQ ID NO: 464244 - RNA, 64 nt, Homo Sapiens
aggcguaagccaccaugccuggccaaaaauuaaaagauuuuaugaaacgaaauggcuucccauu

SEQ ID NO: 464245 - RNA, 64 nt, Homo Sapiens
uauagaugccuuucauuuuuacugccuguaauaaagauuuuauaguguuaguguauggaccaau

SEQ ID NO: 464246 - RNA, 64 nt, Homo Sapiens
ccaaauaaccauuuaacacugauuuucuuaacucagauuuuaagguauguagguugcuaaaaag

SEQ ID NO: 464247 - RNA, 64 nt, Homo Sapiens
caccaugccuggccaggacauauuugaaauggggagauuuuaaaaauucugaugauuagacuga

SEQ ID NO: 464248 - RNA, 64 nt, Homo Sapiens
uuggggguggggcgaggguuucuguaguagacucagauuuuacauggcccugagcugcccuugc

SEQ ID NO: 464249 - RNA, 64 nt, Homo Sapiens
auugugguuuuuuuccacugguagcuuccaagguagauuuuacugaccuuucuguucaagguga

SEQ ID NO: 464250 - RNA, 56 nt, Homo Sapiens
gcuuucaguaauagcucuaucuuugcagauuuuaugccuguuggggagcaggauga

SEQ ID NO: 464251 - RNA, 64 nt, Homo Sapiens
gggcaugugcccaggugagcuccuguguguguccagauuuuauauuccuaaucccaguaaggaa

SEQ ID NO: 464252 - RNA, 64 nt, Homo Sapiens
cauuuuucucauaguuaauuucaucucuccgguaagauuuuauugguguuucuuuuauaacuuu

SEQ ID NO: 464253 - RNA, 64 nt, Homo Sapiens
ugaguuauucuucaucaaaugacuuuuggaguagagauuuuauuuuuauagcaauagaugcaca

SEQ ID NO: 464254 - RNA, 64 nt, Homo Sapiens
gccuuccuuauggguaugcuguggcauaucccugagauuuuaauucgcauuuuccagugacuaa

SEQ ID NO: 464255 - RNA, 64 nt, Homo Sapiens
ucuuuuucuuuuuaacccuaaucuuucacuugaaagauuuuauuguauaaaaaguuucacaggu

SEQ ID NO: 464256 - RNA, 64 nt, Homo Sapiens
ugaguauuugguccaaaaaaaggaaaaauaaucaagauuuuagggcuuuuauuuuuucuuuugu

SEQ ID NO: 464257 - RNA, 64 nt, Homo Sapiens
gguaggauuaaguuguugaguaguuuuguaaucaagauuuuauguaacauuuguaaagggaaaa

SEQ ID NO: 464258 - RNA, 64 nt, Homo Sapiens
ugguauuauuuugugccccccacuuaauauggauagauuuuaaugggaaaauuauaauucagau

SEQ ID NO: 464259 - RNA, 64 nt, Homo Sapiens
gggcaccgcagugccagagaagaugcuugagguuagauuuuaaggaguggggaauugugaagcc

SEQ ID NO: 464260 - RNA, 64 nt, Homo Sapiens
cuuguccacguuguuucacaucugguuagggggcagauuuuaaaauguaguuuuguaauguuac

SEQ ID NO: 464261 - RNA, 64 nt, Homo Sapiens
cuucauuauaaaauauuguuuuauguauguaaauagauuuuaagaucaacaaaguuaauuguau

SEQ ID NO: 464262 - RNA, 64 nt, Homo Sapiens
cccuugacuuaacuuuuuaagugaauaaaaagaaagauuuuauagcuucugauuuagcaaugcu

SEQ ID NO: 464263 - RNA, 64 nt, Homo Sapiens
aguuguuugagaugcuaagcaggauaauaaauuuagauuuuaaaauguucccuguaaaagucag

SEQ ID NO: 464264 - RNA, 64 nt, Homo Sapiens
guaaaauguugaguuucgauugagccauguuuggagauuuuauuacuauucugaaggguagugu

SEQ ID NO: 464265 - RNA, 64 nt, Homo Sapiens
uuuccacugaaauuuguuauguuuaaggaaauuaagauuuuaagcuugaaauuauacaagcaga

SEQ ID NO: 464266 - RNA, 64 nt, Homo Sapiens
guaaagaaauauaauucauggaucaggcucauaaagauuuuauaauauuuuuaguuaaacaaga

SEQ ID NO: 464267 - RNA, 64 nt, Homo Sapiens
ccaagguauggccacaaggaagaauaguguacagagauuuuaauuaaugcaaguucugggaccu

SEQ ID NO: 464268 - RNA, 64 nt, Homo Sapiens
gucugagucugaaaugaaccuguucacuuagacuagauuuuauaguaacaaaaugugcuuuuaa

SEQ ID NO: 464269 - RNA, 64 nt, Homo Sapiens
cacuguaggaagguuuugaaaauuguuucguuauagauuuuaucuuaucuuuugguguugucuu

SEQ ID NO: 464270 - RNA, 64 nt, Homo Sapiens
gaucagcucaucuauaaggcugaccuucaugcagagauuuuauuucaccuuuaguuuugggaaa

SEQ ID NO: 464271 - RNA, 64 nt, Homo Sapiens
aaaaagaaauguagauucuugggccccaccaccccacgccuacugagccagaaucucugggggu

SEQ ID NO: 464272 - RNA, 64 nt, Homo Sapiens
uggaaagcaucaccucaggccaggugcaguggcucacgccuaugaucccagcacuuugggaggc

SEQ ID NO: 464273 - RNA, 64 nt, Homo Sapiens
cuaaaaauacaaaaauuagccaggcaugguggcacacgccuauagucccagcuacucaggaggc

SEQ ID NO: 464274 - RNA, 64 nt, Homo Sapiens
cccugcccuuccucagggccagcgcucugggagccacgccuauguggcacgggcccucccuccc

SEQ ID NO: 464275 - RNA, 64 nt, Homo Sapiens
aucccagaggcugaggcaggugggcgcaguggcucacgccuauaaagaaaagaaaacuggaggc

SEQ ID NO: 464276 - RNA, 64 nt, Homo Sapiens
cuuuuaaaaaggcaguaggcccggugugguggcucacgccuauaaucccagcacuuugggaggc

SEQ ID NO: 464277 - RNA, 64 nt, Homo Sapiens
agaaauguuaagaaauaggccaagugcgguggcucacgccuauaauccuaucacuuugggaggc

SEQ ID NO: 464278 - RNA, 64 nt, Homo Sapiens
gucucgcccgaucccaucggugcggccucgcccgcacgccuagaagacggggcggucgggugcc

SEQ ID NO: 464279 - RNA, 61 nt, Homo Sapiens
ucauagcuucacagccuugcgcccucaccuccacgccuaccgcaagguccacugugacuga

SEQ ID NO: 464280 - RNA, 64 nt, Homo Sapiens
aucccagcacuuugggaggccgggcgcggugacucacgccuauacuaagagaagacaagagggc

SEQ ID NO: 464281 - RNA, 64 nt, Homo Sapiens
aucccagcacuuugggaggccgggcacgguggcucacgccuauacaagaagaagcuugccaggc

SEQ ID NO: 464282 - RNA, 64 nt, Homo Sapiens
gaugagcacccucuuugugaaacagccgaagacacacgccuaggaaguagaggccuggugguuu

SEQ ID NO: 464283 - RNA, 64 nt, Homo Sapiens
uagcuaaagaaugccauggccgggugcaguggcucacgccuauaaucccagcacuuugggaggc

SEQ ID NO: 464284 - RNA, 64 nt, Homo Sapiens
uaagagugcuguguaaccccuuugcaaaacuuaucacgccuacuacugaggagauacugaacau

SEQ ID NO: 464285 - RNA, 64 nt, Homo Sapiens
cccaucugggcccccauuccgccugccacaugcccacgccuagugcuccuggacuggcccaccu

SEQ ID NO: 464286 - RNA, 64 nt, Homo Sapiens
gugcaauucaggagcccagcagugacacacuuaucacgccuaggcuccaguuugcaaaaauugc

SEQ ID NO: 464287 - RNA, 64 nt, Homo Sapiens
acacguuagccauuccuuacggcucuucacguuccacgccuagaugugaagugggacauagucu

SEQ ID NO: 464288 - RNA, 64 nt, Homo Sapiens
ugauuuuuguauuuuuuugucaggcgcgcaccaccacgccuagccuccuaaguagcugggagua

SEQ ID NO: 464289 - RNA, 64 nt, Homo Sapiens
auaaaguuaaccaagcaggccaggcacgguggcucacgccuauaaucccagcacuuagggaggc

SEQ ID NO: 464290 - RNA, 64 nt, Homo Sapiens
gugcuuugaagguuuccucuuuuccccgaccaaucacgccuacaggcccucucccugccccagc

SEQ ID NO: 464291 - RNA, 64 nt, Homo Sapiens
acagguaccuugcugucuugacaaauccuaaugucacgccuacagccccaacacaagcuccagu

SEQ ID NO: 464292 - RNA, 64 nt, Homo Sapiens
acagguggguacauuagaaguuccugggcauugccacgccuaccuauuugugaauugugcuggu

SEQ ID NO: 464293 - RNA, 64 nt, Homo Sapiens
agggccccaccucaccccuuggugucacccccaccacgccuaggcagcucugggcccugggauc

SEQ ID NO: 464294 - RNA, 55 nt, Homo Sapiens
ggugcuguucuucuggauaacuguucacgccuaagaaauuaaaagacagaacaaa

SEQ ID NO: 464295 - RNA, 64 nt, Homo Sapiens
aucccagcacuuugggaggccgggugcgguggcucacgccuauguauuuaaaaacccauggagc

SEQ ID NO: 464296 - RNA, 64 nt, Homo Sapiens
cugggcagggaugggacccagcuggacacagaagcacgccuaggccucacgcagaggccuuaaa

SEQ ID NO: 464297 - RNA, 64 nt, Homo Sapiens
cacaaacguggauuaucgcauaugcauccccacacacgccuaugcacacaagcacauacagaca

SEQ ID NO: 464298 - RNA, 64 nt, Homo Sapiens
uagucguuccagggcugggggaggugggagggaucacgccuauaggugugggcacaugaaacga

SEQ ID NO: 464299 - RNA, 64 nt, Homo Sapiens
ugcucacacgcgaguuuucacaguuauuucuauccacgccuaugaaucuuuggacggugagauc

SEQ ID NO: 464300 - RNA, 64 nt, Homo Sapiens
ugagacaagaauggccugcgggcuggucagaggucacgccuacucugucacggggcuggaugag

SEQ ID NO: 464301 - RNA, 56 nt, Homo Sapiens
cguacuccaaugagaugugaaccagccacgccuaccagguggcagagcuggggcca

SEQ ID NO: 464302 - RNA, 64 nt, Homo Sapiens
cacacuacagccuacaacucuugggcucaagcaucacgccuagcaguuucugguuccuuuaaca

SEQ ID NO: 464303 - RNA, 64 nt, Homo Sapiens
augugcuugggcagcuugagaaggcguucagcaccacgccuagcaggcagaccuugaagccuca

SEQ ID NO: 464304 - RNA, 64 nt, Homo Sapiens
auguauuuuaaauacuuacuauuuacuccuaaugcacgccuagauaagggcaucacaaauuaac

SEQ ID NO: 464305 - RNA, 64 nt, Homo Sapiens
aucccugcgcuuuggcagucugggagugguggcucacgccuauaaagagaacccacccagagac

SEQ ID NO: 464306 - RNA, 64 nt, Homo Sapiens
guuggguaggagcuuccaggccugggauuuacaccacgccuagcccagcagaggccuuaguccc

SEQ ID NO: 464307 - RNA, 64 nt, Homo Sapiens
guuuauuuuaaaacugaauccuuaaacuugcaaacacgccuacuguaagcaugcuuggaaugac

SEQ ID NO: 464308 - RNA, 64 nt, Homo Sapiens
aucccagcauuuugggaggcugugcacaguggcucacgccuauacuuaacaaguaguuauuggc

SEQ ID NO: 464309 - RNA, 64 nt, Homo Sapiens
aucccaacacuucgggaggccaguugcaguggcucacgccuauacaaucaaucacuguccuggc

SEQ ID NO: 464310 - RNA, 64 nt, Homo Sapiens
cuccugaguagcugagaccacaggcgugugccaccacgccuagcuaauuuuuuauaccaggguc

SEQ ID NO: 464311 - RNA, 64 nt, Homo Sapiens
uuuuacaaguaacucuaggcugggugugguggcucacgccuauaaucccagcacuuugggaggc

SEQ ID NO: 464312 - RNA, 64 nt, Homo Sapiens
uuagaugaggaaaugauccccaaguggugaaugacacgccuaaggucacagcuaguuugagcca

SEQ ID NO: 464313 - RNA, 64 nt, Homo Sapiens
aucccagcacuuugggaggccgggcacgguggcucacgccuauauagaagaaaacagcuguggu

SEQ ID NO: 464314 - RNA, 64 nt, Homo Sapiens
uucucucucugcuccuccuuggcaucccggaggccacgccuaucugcucucugcaaaaagaaug

SEQ ID NO: 464315 - RNA, 64 nt, Homo Sapiens
ccuguugacaagucccccgcgcagagcggcuccucacgccuaaugcagucuccagacuggaaac

SEQ ID NO: 464316 - RNA, 64 nt, Homo Sapiens
aaaagacuuggccuuagggccgagugcgguggcucacgccuauaaucccagcacuuugggaggc

SEQ ID NO: 464317 - RNA, 64 nt, Homo Sapiens
aaaagacgaaaagugacggccaggugcaguggcucacgccuauaaucucagcacucugggaggc

SEQ ID NO: 464318 - RNA, 64 nt, Homo Sapiens
gugcggggcagagccccgggagggcgcgucuguccacgccuaccggacgcgccgaggucgcgcu

SEQ ID NO: 464319 - RNA, 64 nt, Homo Sapiens
ggcaugcgaaauguucucaugaacuaccccacaacacgccuaaaacucaaaacacccaaaaaua

SEQ ID NO: 464320 - RNA, 64 nt, Homo Sapiens
acuucaaaaggauuucaggcugagugugguggcucacgccuauacacccagcacuuuggaaggc

SEQ ID NO: 464321 - RNA, 64 nt, Homo Sapiens
aucccagcacuuugggaggccaggcacaguggcucacgccuauaauuaaaccucugcuccuggc

SEQ ID NO: 464322 - RNA, 64 nt, Homo Sapiens
aucccagcacuuugggaggccgggugcggugacucacgccuauaucucaaaaaugaaaugcugc

SEQ ID NO: 464323 - RNA, 64 nt, Homo Sapiens
gucccagcuacucgggaggccgggcaugguggugcacgccuauacuaaaaauacaaaaauuagc

SEQ ID NO: 464324 - RNA, 64 nt, Homo Sapiens
cacccgaaacugccagugugcggugacaacggcacacgccuagacugagugugguuucgucgug

SEQ ID NO: 464325 - RNA, 64 nt, Homo Sapiens
cucacgcuccuuucugaucucaggcaugggccaccacgccuagccucccacagugcugggauua

SEQ ID NO: 464326 - RNA, 64 nt, Homo Sapiens
caucuacaaccaaguccugauggagcaagaggcccacgccuaggggaugcaagaacaacccguu

SEQ ID NO: 464327 - RNA, 64 nt, Homo Sapiens
aucccagcaguuugggaggcugggcgugguggcucacgccuauaauggaaaauuggaaauggac

SEQ ID NO: 464328 - RNA, 64 nt, Homo Sapiens
guggagcucugcuuuggcacugccccgcagaggccacgccuauuuauucuguuucuguuguuuu

SEQ ID NO: 464329 - RNA, 64 nt, Homo Sapiens; identical to SEQ ID NO: 443640

SEQ ID NO: 464330 - RNA, 64 nt, Homo Sapiens; identical to SEQ ID NO: 443641

SEQ ID NO: 464331 - RNA, 64 nt, Homo Sapiens; identical to SEQ ID NO: 443642

SEQ ID NO: 464332 - RNA, 64 nt, Homo Sapiens; identical to SEQ ID NO: 443643

SEQ ID NO: 464333 - RNA, 64 nt, Homo Sapiens; identical to SEQ ID NO: 443644

SEQ ID NO: 464334 - RNA, 64 nt, Homo Sapiens; identical to SEQ ID NO: 443645

SEQ ID NO: 464335 - RNA, 64 nt, Homo Sapiens; identical to SEQ ID NO: 443646

SEQ ID NO: 464336 - RNA, 64 nt, Homo Sapiens; identical to SEQ ID NO: 443647

SEQ ID NO: 464337 - RNA, 56 nt, Homo Sapiens; identical to SEQ ID NO: 443648

SEQ ID NO: 464338 - RNA, 64 nt, Homo Sapiens; identical to SEQ ID NO: 443649

SEQ ID NO: 464339 - RNA, 64 nt, Homo Sapiens; identical to SEQ ID NO: 443650

SEQ ID NO: 464340 - RNA, 64 nt, Homo Sapiens; identical to SEQ ID NO: 443651

SEQ ID NO: 464341 - RNA, 64 nt, Homo Sapiens; identical to SEQ ID NO: 443652

SEQ ID NO: 464342 - RNA, 64 nt, Homo Sapiens; identical to SEQ ID NO: 443653

SEQ ID NO: 464343 - RNA, 64 nt, Homo Sapiens; identical to SEQ ID NO: 443654

SEQ ID NO: 464344 - RNA, 64 nt, Homo Sapiens; identical to SEQ ID NO: 443655

SEQ ID NO: 464345 - RNA, 64 nt, Homo Sapiens; identical to SEQ ID NO: 443656

SEQ ID NO: 464346 - RNA, 64 nt, Homo Sapiens; identical to SEQ ID NO: 443657

SEQ ID NO: 464347 - RNA, 64 nt, Homo Sapiens; identical to SEQ ID NO: 443658

SEQ ID NO: 464348 - RNA, 64 nt, Homo Sapiens; identical to SEQ ID NO: 443659

SEQ ID NO: 464349 - RNA, 64 nt, Homo Sapiens; identical to SEQ ID NO: 443660

SEQ ID NO: 464350 - RNA, 64 nt, Homo Sapiens; identical to SEQ ID NO: 443661

SEQ ID NO: 464351 - RNA, 64 nt, Homo Sapiens; identical to SEQ ID NO: 443662

SEQ ID NO: 464352 - RNA, 64 nt, Homo Sapiens; identical to SEQ ID NO: 443663

SEQ ID NO: 464353 - RNA, 64 nt, Homo Sapiens; identical to SEQ ID NO: 443664

SEQ ID NO: 464354 - RNA, 64 nt, Homo Sapiens; identical to SEQ ID NO: 443665

SEQ ID NO: 464355 - RNA, 64 nt, Homo Sapiens; identical to SEQ ID NO: 443666

SEQ ID NO: 464356 - RNA, 64 nt, Homo Sapiens; identical to SEQ ID NO: 443667

SEQ ID NO: 464357 - RNA, 64 nt, Homo Sapiens; identical to SEQ ID NO: 443668

SEQ ID NO: 464358 - RNA, 64 nt, Homo Sapiens; identical to SEQ ID NO: 443669

SEQ ID NO: 464359 - RNA, 64 nt, Homo Sapiens; identical to SEQ ID NO: 443670

SEQ ID NO: 464360 - RNA, 64 nt, Homo Sapiens; identical to SEQ ID NO: 443671

SEQ ID NO: 464361 - RNA, 64 nt, Homo Sapiens; identical to SEQ ID NO: 443672

SEQ ID NO: 464362 - RNA, 64 nt, Homo Sapiens; identical to SEQ ID NO: 443673

SEQ ID NO: 464363 - RNA, 64 nt, Homo Sapiens; identical to SEQ ID NO: 443674

SEQ ID NO: 464364 - RNA, 64 nt, Homo Sapiens; identical to SEQ ID NO: 443675

SEQ ID NO: 464365 - RNA, 64 nt, Homo Sapiens; identical to SEQ ID NO: 443676

SEQ ID NO: 464366 - RNA, 64 nt, Homo Sapiens; identical to SEQ ID NO: 443677

SEQ ID NO: 464367 - RNA, 64 nt, Homo Sapiens; identical to SEQ ID NO: 443678

SEQ ID NO: 464368 - RNA, 64 nt, Homo Sapiens; identical to SEQ ID NO: 443679

SEQ ID NO: 464369 - RNA, 64 nt, Homo Sapiens; identical to SEQ ID NO: 443680

SEQ ID NO: 464370 - RNA, 64 nt, Homo Sapiens; identical to SEQ ID NO: 443681

SEQ ID NO: 464371 - RNA, 64 nt, Homo Sapiens; identical to SEQ ID NO: 443682

SEQ ID NO: 464372 - RNA, 64 nt, Homo Sapiens; identical to SEQ ID NO: 443683

SEQ ID NO: 464373 - RNA, 64 nt, Homo Sapiens; identical to SEQ ID NO: 443684

SEQ ID NO: 464374 - RNA, 64 nt, Homo Sapiens; identical to SEQ ID NO: 443685

SEQ ID NO: 464375 - RNA, 64 nt, Homo Sapiens; identical to SEQ ID NO: 443686

SEQ ID NO: 464376 - RNA, 64 nt, Homo Sapiens; identical to SEQ ID NO: 443687

SEQ ID NO: 464377 - RNA, 64 nt, Homo Sapiens; identical to SEQ ID NO: 443688

SEQ ID NO: 464378 - RNA, 64 nt, Homo Sapiens; identical to SEQ ID NO: 443689

SEQ ID NO: 464379 - RNA, 64 nt, Homo Sapiens; identical to SEQ ID NO: 443690

SEQ ID NO: 464380 - RNA, 64 nt, Homo Sapiens; identical to SEQ ID NO: 443691

SEQ ID NO: 464381 - RNA, 64 nt, Homo Sapiens; identical to SEQ ID NO: 443692

SEQ ID NO: 464382 - RNA, 64 nt, Homo Sapiens; identical to SEQ ID NO: 443693

SEQ ID NO: 464383 - RNA, 64 nt, Homo Sapiens; identical to SEQ ID NO: 443694

SEQ ID NO: 464384 - RNA, 64 nt, Homo Sapiens; identical to SEQ ID NO: 443695

SEQ ID NO: 464385 - RNA, 64 nt, Homo Sapiens; identical to SEQ ID NO: 443696

SEQ ID NO: 464386 - RNA, 64 nt, Homo Sapiens; identical to SEQ ID NO: 443697

SEQ ID NO: 464387 - RNA, 64 nt, Homo Sapiens; identical to SEQ ID NO: 443698

SEQ ID NO: 464388 - RNA, 64 nt, Homo Sapiens; identical to SEQ ID NO: 443699

SEQ ID NO: 464389 - RNA, 64 nt, Homo Sapiens; identical to SEQ ID NO: 443700

SEQ ID NO: 464390 - RNA, 64 nt, Homo Sapiens; identical to SEQ ID NO: 443701

SEQ ID NO: 464391 - RNA, 64 nt, Homo Sapiens; identical to SEQ ID NO: 443702

SEQ ID NO: 464392 - RNA, 64 nt, Homo Sapiens; identical to SEQ ID NO: 443703

SEQ ID NO: 464393 - RNA, 64 nt, Homo Sapiens; identical to SEQ ID NO: 443704

SEQ ID NO: 464394 - RNA, 64 nt, Homo Sapiens; identical to SEQ ID NO: 443705

SEQ ID NO: 464395 - RNA, 64 nt, Homo Sapiens; identical to SEQ ID NO: 443706

SEQ ID NO: 464396 - RNA, 64 nt, Homo Sapiens; identical to SEQ ID NO: 443707

SEQ ID NO: 464397 - RNA, 64 nt, Homo Sapiens; identical to SEQ ID NO: 443708

SEQ ID NO: 464398 - RNA, 64 nt, Homo Sapiens; identical to SEQ ID NO: 443709

SEQ ID NO: 464399 - RNA, 64 nt, Homo Sapiens; identical to SEQ ID NO: 443710

SEQ ID NO: 464400 - RNA, 64 nt, Homo Sapiens; identical to SEQ ID NO: 443711

SEQ ID NO: 464401 - RNA, 64 nt, Homo Sapiens; identical to SEQ ID NO: 443712

SEQ ID NO: 464402 - RNA, 64 nt, Homo Sapiens; identical to SEQ ID NO: 443713

SEQ ID NO: 464403 - RNA, 64 nt, Homo Sapiens; identical to SEQ ID NO: 443714

SEQ ID NO: 464404 - RNA, 64 nt, Homo Sapiens; identical to SEQ ID NO: 443715

SEQ ID NO: 464405 - RNA, 64 nt, Homo Sapiens; identical to SEQ ID NO: 443716

SEQ ID NO: 464406 - RNA, 64 nt, Homo Sapiens; identical to SEQ ID NO: 443717

SEQ ID NO: 464407 - RNA, 64 nt, Homo Sapiens; identical to SEQ ID NO: 443718

SEQ ID NO: 464408 - RNA, 64 nt, Homo Sapiens; identical to SEQ ID NO: 443719

SEQ ID NO: 464409 - RNA, 64 nt, Homo Sapiens; identical to SEQ ID NO: 443720

SEQ ID NO: 464410 - RNA, 64 nt, Homo Sapiens; identical to SEQ ID NO: 443721

SEQ ID NO: 464411 - RNA, 64 nt, Homo Sapiens; identical to SEQ ID NO: 443722

SEQ ID NO: 464412 - RNA, 64 nt, Homo Sapiens; identical to SEQ ID NO: 443723

SEQ ID NO: 464413 - RNA, 64 nt, Homo Sapiens; identical to SEQ ID NO: 443724

SEQ ID NO: 464414 - RNA, 64 nt, Homo Sapiens; identical to SEQ ID NO: 443725

SEQ ID NO: 464415 - RNA, 64 nt, Homo Sapiens; identical to SEQ ID NO: 443726

SEQ ID NO: 464416 - RNA, 64 nt, Homo Sapiens; identical to SEQ ID NO: 443727

SEQ ID NO: 464417 - RNA, 64 nt, Homo Sapiens; identical to SEQ ID NO: 443728

SEQ ID NO: 464418 - RNA, 64 nt, Homo Sapiens; identical to SEQ ID NO: 443729

SEQ ID NO: 464419 - RNA, 64 nt, Homo Sapiens; identical to SEQ ID NO: 443730

SEQ ID NO: 464420 - RNA, 64 nt, Homo Sapiens; identical to SEQ ID NO: 443731

SEQ ID NO: 464421 - RNA, 64 nt, Homo Sapiens; identical to SEQ ID NO: 443732

SEQ ID NO: 464422 - RNA, 64 nt, Homo Sapiens; identical to SEQ ID NO: 443733

SEQ ID NO: 464423 - RNA, 64 nt, Homo Sapiens; identical to SEQ ID NO: 443734

SEQ ID NO: 464424 - RNA, 64 nt, Homo Sapiens; identical to SEQ ID NO: 443735

SEQ ID NO: 464425 - RNA, 64 nt, Homo Sapiens; identical to SEQ ID NO: 443736

SEQ ID NO: 464426 - RNA, 64 nt, Homo Sapiens; identical to SEQ ID NO: 443737

SEQ ID NO: 464427 - RNA, 64 nt, Homo Sapiens; identical to SEQ ID NO: 443738

SEQ ID NO: 464428 - RNA, 64 nt, Homo Sapiens; identical to SEQ ID NO: 443739

SEQ ID NO: 464429 - RNA, 64 nt, Homo Sapiens; identical to SEQ ID NO: 69124

SEQ ID NO: 464430 - RNA, 64 nt, Homo Sapiens; identical to SEQ ID NO: 69125

SEQ ID NO: 464431 - RNA, 64 nt, Homo Sapiens; identical to SEQ ID NO: 69126

SEQ ID NO: 464432 - RNA, 64 nt, Homo Sapiens; identical to SEQ ID NO: 69127

SEQ ID NO: 464433 - RNA, 64 nt, Homo Sapiens; identical to SEQ ID NO: 69128

SEQ ID NO: 464434 - RNA, 64 nt, Homo Sapiens; identical to SEQ ID NO: 69129

SEQ ID NO: 464435 - RNA, 64 nt, Homo Sapiens
ccugcgguuucagcuuuucugggcgguguaaauugacucagaaaaagagggcaggucagggauu

SEQ ID NO: 464436 - RNA, 64 nt, Homo Sapiens
gggaagcauugggaaaccauuuguccucacuggagacucagaaggacaaaaccucauggcaauc

SEQ ID NO: 464437 - RNA, 64 nt, Homo Sapiens
uauuuacucuugcuggaucuccccacagaggagggacucagauuacuguggaguguguggacca

SEQ ID NO: 464438 - RNA, 64 nt, Homo Sapiens
gugugagcuacuggcccaagacugaggaaccugagacucagagaauuaucauccccauuuaaga

SEQ ID NO: 464439 - RNA, 64 nt, Homo Sapiens
gaaggucuuuccugauucuuccaagcuuugaggugacucagagcuaagaaugaaauaggagacc

SEQ ID NO: 464440 - RNA, 64 nt, Homo Sapiens
uacccaggaaagaaauggucugcuagagugauaagacucagaacaggaagccugcaugugacug

SEQ ID NO: 464441 - RNA, 64 nt, Homo Sapiens
uuuuaaaaaaaaaaauggaggaacaguugcccaagacucagaauacuguaaaguaguuacaaga

SEQ ID NO: 464442 - RNA, 64 nt, Homo Sapiens
uaugccaugugaugcuaccuauaucucgggaauggacucagaaguuauuuacagguacaacaga

SEQ ID NO: 464443 - RNA, 64 nt, Homo Sapiens
cuaacacaaagcucauguuaagaaaacaguugaggacucagaagucaguucgaaaaugcacuuu

SEQ ID NO: 464444 - RNA, 64 nt, Homo Sapiens
gagcaccucacgcugggggaaucaaucccugagggacucagaaucuucuccgugcaaccuggaa

SEQ ID NO: 464445 - RNA, 64 nt, Homo Sapiens
ugccagguuuaaacaucacuuguaccuuccacaagacucagaauccacagugucccauuuuccg

SEQ ID NO: 464446 - RNA, 64 nt, Homo Sapiens
gaccugguuaaacaaaccagaaucccucuacauggacucagagaaaagagauugagauguaagu

SEQ ID NO: 464447 - RNA, 64 nt, Homo Sapiens
cuguacauaugacauggcuucugaaacauaguuacauaguuaaaaucauggauuuuguuuauuc

SEQ ID NO: 464448 - RNA, 64 nt, Homo Sapiens
uaguuaaacuguacauaugaguuuauuccugaaacauaguuacaacuaaaauaucauggauuuu

SEQ ID NO: 464449 - RNA, 64 nt, Homo Sapiens
caagugaaaguuuagccaugguuuugugcggcaucauaguuaugucaauaaaguuuauuuaggu

SEQ ID NO: 464450 - RNA, 64 nt, Homo Sapiens
guuuauuuaggucauagaauauccuaaaguaucacauaguuaaauuuuucagucagugaagacc

SEQ ID NO: 464451 - RNA, 64 nt, Homo Sapiens
cacaaauggcaaaacuggaccuuuuguaucuugucauaguuauccuauuuauggcaaacacaug

SEQ ID NO: 464452 - RNA, 64 nt, Homo Sapiens
uuuuuauucacauuuacauuucuggauaaauuagcauaguuauuuuucaauaucugauuuguuc

SEQ ID NO: 464453 - RNA, 64 nt, Homo Sapiens; identical to SEQ ID NO: 113583

SEQ ID NO: 464454 - RNA, 64 nt, Homo Sapiens; identical to SEQ ID NO: 113584

SEQ ID NO: 464455 - RNA, 64 nt, Homo Sapiens; identical to SEQ ID NO: 113585

SEQ ID NO: 464456 - RNA, 64 nt, Homo Sapiens; identical to SEQ ID NO: 113586

SEQ ID NO: 464457 - RNA, 64 nt, Homo Sapiens; identical to SEQ ID NO: 113587

SEQ ID NO: 464458 - RNA, 64 nt, Homo Sapiens; identical to SEQ ID NO: 113588

SEQ ID NO: 464459 - RNA, 64 nt, Homo Sapiens; identical to SEQ ID NO: 113589

SEQ ID NO: 464460 - RNA, 64 nt, Homo Sapiens; identical to SEQ ID NO: 113590

SEQ ID NO: 464461 - RNA, 64 nt, Homo Sapiens; identical to SEQ ID NO: 113591

SEQ ID NO: 464462 - RNA, 64 nt, Homo Sapiens; identical to SEQ ID NO: 113592

SEQ ID NO: 464463 - RNA, 64 nt, Homo Sapiens; identical to SEQ ID NO: 113593

SEQ ID NO: 464464 - RNA, 64 nt, Homo Sapiens; identical to SEQ ID NO: 113594

SEQ ID NO: 464465 - RNA, 64 nt, Homo Sapiens; identical to SEQ ID NO: 113595

SEQ ID NO: 464466 - RNA, 64 nt, Homo Sapiens; identical to SEQ ID NO: 113596

SEQ ID NO: 464467 - RNA, 64 nt, Homo Sapiens; identical to SEQ ID NO: 113597

SEQ ID NO: 464468 - RNA, 64 nt, Homo Sapiens; identical to SEQ ID NO: 113598

SEQ ID NO: 464469 - RNA, 64 nt, Homo Sapiens; identical to SEQ ID NO: 113599

SEQ ID NO: 464470 - RNA, 64 nt, Homo Sapiens; identical to SEQ ID NO: 113600

SEQ ID NO: 464471 - RNA, 64 nt, Homo Sapiens; identical to SEQ ID NO: 113601

SEQ ID NO: 464472 - RNA, 64 nt, Homo Sapiens; identical to SEQ ID NO: 113602

SEQ ID NO: 464473 - RNA, 64 nt, Homo Sapiens; identical to SEQ ID NO: 113603

SEQ ID NO: 464474 - RNA, 64 nt, Homo Sapiens; identical to SEQ ID NO: 113604

SEQ ID NO: 464475 - RNA, 64 nt, Homo Sapiens; identical to SEQ ID NO: 113605

SEQ ID NO: 464476 - RNA, 64 nt, Homo Sapiens; identical to SEQ ID NO: 113606

SEQ ID NO: 464477 - RNA, 64 nt, Homo Sapiens; identical to SEQ ID NO: 113607

SEQ ID NO: 464478 - RNA, 64 nt, Homo Sapiens; identical to SEQ ID NO: 113608

SEQ ID NO: 464479 - RNA, 64 nt, Homo Sapiens; identical to SEQ ID NO: 113609

SEQ ID NO: 464480 - RNA, 64 nt, Homo Sapiens; identical to SEQ ID NO: 113610

SEQ ID NO: 464481 - RNA, 64 nt, Homo Sapiens; identical to SEQ ID NO: 113611

SEQ ID NO: 464482 - RNA, 64 nt, Homo Sapiens; identical to SEQ ID NO: 113612

SEQ ID NO: 464483 - RNA, 64 nt, Homo Sapiens; identical to SEQ ID NO: 113613

SEQ ID NO: 464484 - RNA, 64 nt, Homo Sapiens; identical to SEQ ID NO: 113614

SEQ ID NO: 464485 - RNA, 64 nt, Homo Sapiens; identical to SEQ ID NO: 113615

SEQ ID NO: 464486 - RNA, 64 nt, Homo Sapiens; identical to SEQ ID NO: 113616

SEQ ID NO: 464487 - RNA, 64 nt, Homo Sapiens; identical to SEQ ID NO: 113617

SEQ ID NO: 464488 - RNA, 64 nt, Homo Sapiens; identical to SEQ ID NO: 113618

SEQ ID NO: 464489 - RNA, 64 nt, Homo Sapiens; identical to SEQ ID NO: 113619

SEQ ID NO: 464490 - RNA, 64 nt, Homo Sapiens; identical to SEQ ID NO: 113620

SEQ ID NO: 464491 - RNA, 64 nt, Homo Sapiens; identical to SEQ ID NO: 113621

SEQ ID NO: 464492 - RNA, 64 nt, Homo Sapiens; identical to SEQ ID NO: 113622

SEQ ID NO: 464493 - RNA, 64 nt, Homo Sapiens; identical to SEQ ID NO: 113623

SEQ ID NO: 464494 - RNA, 64 nt, Homo Sapiens; identical to SEQ ID NO: 113624

SEQ ID NO: 464495 - RNA, 64 nt, Homo Sapiens; identical to SEQ ID NO: 113625

SEQ ID NO: 464496 - RNA, 64 nt, Homo Sapiens; identical to SEQ ID NO: 113626

SEQ ID NO: 464497 - RNA, 64 nt, Homo Sapiens; identical to SEQ ID NO: 113627

SEQ ID NO: 464498 - RNA, 64 nt, Homo Sapiens; identical to SEQ ID NO: 113628

SEQ ID NO: 464499 - RNA, 64 nt, Homo Sapiens; identical to SEQ ID NO: 113629

SEQ ID NO: 464500 - RNA, 64 nt, Homo Sapiens; identical to SEQ ID NO: 113630

SEQ ID NO: 464501 - RNA, 64 nt, Homo Sapiens; identical to SEQ ID NO: 113631

SEQ ID NO: 464502 - RNA, 64 nt, Homo Sapiens; identical to SEQ ID NO: 113632

SEQ ID NO: 464503 - RNA, 64 nt, Homo Sapiens; identical to SEQ ID NO: 113633

SEQ ID NO: 464504 - RNA, 64 nt, Homo Sapiens; identical to SEQ ID NO: 113634

SEQ ID NO: 464505 - RNA, 64 nt, Homo Sapiens; identical to SEQ ID NO: 113635

SEQ ID NO: 464506 - RNA, 64 nt, Homo Sapiens; identical to SEQ ID NO: 113636

SEQ ID NO: 464507 - RNA, 64 nt, Homo Sapiens; identical to SEQ ID NO: 113637

SEQ ID NO: 464508 - RNA, 64 nt, Homo Sapiens; identical to SEQ ID NO: 113638

SEQ ID NO: 464509 - RNA, 64 nt, Homo Sapiens; identical to SEQ ID NO: 457937

SEQ ID NO: 464510 - RNA, 64 nt, Homo Sapiens; identical to SEQ ID NO: 457938

SEQ ID NO: 464511 - RNA, 64 nt, Homo Sapiens; identical to SEQ ID NO: 457939

SEQ ID NO: 464512 - RNA, 64 nt, Homo Sapiens; identical to SEQ ID NO: 457940

SEQ ID NO: 464513 - RNA, 64 nt, Homo Sapiens; identical to SEQ ID NO: 457941

SEQ ID NO: 464514 - RNA, 64 nt, Homo Sapiens; identical to SEQ ID NO: 457942

SEQ ID NO: 464515 - RNA, 64 nt, Homo Sapiens; identical to SEQ ID NO: 457943

SEQ ID NO: 464516 - RNA, 64 nt, Homo Sapiens; identical to SEQ ID NO: 457944

SEQ ID NO: 464517 - RNA, 64 nt, Homo Sapiens; identical to SEQ ID NO: 457945

SEQ ID NO: 464518 - RNA, 64 nt, Homo Sapiens; identical to SEQ ID NO: 457946

SEQ ID NO: 464519 - RNA, 64 nt, Homo Sapiens; identical to SEQ ID NO: 457947

SEQ ID NO: 464520 - RNA, 64 nt, Homo Sapiens; identical to SEQ ID NO: 457948

SEQ ID NO: 464521 - RNA, 64 nt, Homo Sapiens; identical to SEQ ID NO: 457949

SEQ ID NO: 464522 - RNA, 64 nt, Homo Sapiens; identical to SEQ ID NO: 457950

SEQ ID NO: 464523 - RNA, 64 nt, Homo Sapiens; identical to SEQ ID NO: 457951

SEQ ID NO: 464524 - RNA, 64 nt, Homo Sapiens; identical to SEQ ID NO: 457952

SEQ ID NO: 464525 - RNA, 64 nt, Homo Sapiens; identical to SEQ ID NO: 457953

SEQ ID NO: 464526 - RNA, 64 nt, Homo Sapiens; identical to SEQ ID NO: 457954

SEQ ID NO: 464527 - RNA, 64 nt, Homo Sapiens; identical to SEQ ID NO: 457955

SEQ ID NO: 464528 - RNA, 64 nt, Homo Sapiens; identical to SEQ ID NO: 457956

SEQ ID NO: 464529 - RNA, 64 nt, Homo Sapiens; identical to SEQ ID NO: 457957

SEQ ID NO: 464530 - RNA, 64 nt, Homo Sapiens; identical to SEQ ID NO: 457958

SEQ ID NO: 464531 - RNA, 64 nt, Homo Sapiens; identical to SEQ ID NO: 457959

SEQ ID NO: 464532 - RNA, 64 nt, Homo Sapiens; identical to SEQ ID NO: 457960

SEQ ID NO: 464533 - RNA, 64 nt, Homo Sapiens; identical to SEQ ID NO: 457961

SEQ ID NO: 464534 - RNA, 64 nt, Homo Sapiens; identical to SEQ ID NO: 457962

SEQ ID NO: 464535 - RNA, 64 nt, Homo Sapiens; identical to SEQ ID NO: 457963

SEQ ID NO: 464536 - RNA, 64 nt, Homo Sapiens; identical to SEQ ID NO: 457964

SEQ ID NO: 464537 - RNA, 64 nt, Homo Sapiens; identical to SEQ ID NO: 457965

SEQ ID NO: 464538 - RNA, 64 nt, Homo Sapiens; identical to SEQ ID NO: 457966

SEQ ID NO: 464539 - RNA, 64 nt, Homo Sapiens; identical to SEQ ID NO: 457967

SEQ ID NO: 464540 - RNA, 64 nt, Homo Sapiens; identical to SEQ ID NO: 457968

SEQ ID NO: 464541 - RNA, 64 nt, Homo Sapiens; identical to SEQ ID NO: 457969

SEQ ID NO: 464542 - RNA, 64 nt, Homo Sapiens; identical to SEQ ID NO: 457970

SEQ ID NO: 464543 - RNA, 64 nt, Homo Sapiens; identical to SEQ ID NO: 457971

SEQ ID NO: 464544 - RNA, 64 nt, Homo Sapiens; identical to SEQ ID NO: 457972

SEQ ID NO: 464545 - RNA, 64 nt, Homo Sapiens; identical to SEQ ID NO: 457973

SEQ ID NO: 464546 - RNA, 64 nt, Homo Sapiens; identical to SEQ ID NO: 457974

SEQ ID NO: 464547 - RNA, 64 nt, Homo Sapiens; identical to SEQ ID NO: 457975

SEQ ID NO: 464548 - RNA, 64 nt, Homo Sapiens; identical to SEQ ID NO: 457976

SEQ ID NO: 464549 - RNA, 64 nt, Homo Sapiens; identical to SEQ ID NO: 457977

SEQ ID NO: 464550 - RNA, 64 nt, Homo Sapiens; identical to SEQ ID NO: 457978

SEQ ID NO: 464551 - RNA, 64 nt, Homo Sapiens; identical to SEQ ID NO: 457979

SEQ ID NO: 464552 - RNA, 64 nt, Homo Sapiens; identical to SEQ ID NO: 457980

SEQ ID NO: 464553 - RNA, 64 nt, Homo Sapiens; identical to SEQ ID NO: 457981

SEQ ID NO: 464554 - RNA, 64 nt, Homo Sapiens; identical to SEQ ID NO: 457982

SEQ ID NO: 464555 - RNA, 64 nt, Homo Sapiens; identical to SEQ ID NO: 457983

SEQ ID NO: 464556 - RNA, 64 nt, Homo Sapiens; identical to SEQ ID NO: 457984

SEQ ID NO: 464557 - RNA, 64 nt, Homo Sapiens; identical to SEQ ID NO: 457985

SEQ ID NO: 464558 - RNA, 64 nt, Homo Sapiens; identical to SEQ ID NO: 457986

SEQ ID NO: 464559 - RNA, 64 nt, Homo Sapiens; identical to SEQ ID NO: 457987

SEQ ID NO: 464560 - RNA, 64 nt, Homo Sapiens; identical to SEQ ID NO: 457988

SEQ ID NO: 464561 - RNA, 64 nt, Homo Sapiens; identical to SEQ ID NO: 457989

SEQ ID NO: 464562 - RNA, 64 nt, Homo Sapiens; identical to SEQ ID NO: 457990

SEQ ID NO: 464563 - RNA, 64 nt, Homo Sapiens; identical to SEQ ID NO: 457991

SEQ ID NO: 464564 - RNA, 64 nt, Homo Sapiens; identical to SEQ ID NO: 457992

SEQ ID NO: 464565 - RNA, 64 nt, Homo Sapiens; identical to SEQ ID NO: 457993

SEQ ID NO: 464566 - RNA, 64 nt, Homo Sapiens; identical to SEQ ID NO: 457994

SEQ ID NO: 464567 - RNA, 64 nt, Homo Sapiens; identical to SEQ ID NO: 457995

SEQ ID NO: 464568 - RNA, 64 nt, Homo Sapiens; identical to SEQ ID NO: 457996

SEQ ID NO: 464569 - RNA, 64 nt, Homo Sapiens; identical to SEQ ID NO: 457997

SEQ ID NO: 464570 - RNA, 64 nt, Homo Sapiens; identical to SEQ ID NO: 457998

SEQ ID NO: 464571 - RNA, 64 nt, Homo Sapiens; identical to SEQ ID NO: 457999

SEQ ID NO: 464572 - RNA, 64 nt, Homo Sapiens; identical to SEQ ID NO: 458000

SEQ ID NO: 464573 - RNA, 64 nt, Homo Sapiens; identical to SEQ ID NO: 458001

SEQ ID NO: 464574 - RNA, 64 nt, Homo Sapiens; identical to SEQ ID NO: 458002

SEQ ID NO: 464575 - RNA, 64 nt, Homo Sapiens; identical to SEQ ID NO: 458003

SEQ ID NO: 464576 - RNA, 64 nt, Homo Sapiens; identical to SEQ ID NO: 458004

SEQ ID NO: 464577 - RNA, 64 nt, Homo Sapiens; identical to SEQ ID NO: 458005

SEQ ID NO: 464578 - RNA, 64 nt, Homo Sapiens; identical to SEQ ID NO: 458006

SEQ ID NO: 464579 - RNA, 64 nt, Homo Sapiens; identical to SEQ ID NO: 458007

SEQ ID NO: 464580 - RNA, 64 nt, Homo Sapiens; identical to SEQ ID NO: 458008

SEQ ID NO: 464581 - RNA, 64 nt, Homo Sapiens; identical to SEQ ID NO: 458009

SEQ ID NO: 464582 - RNA, 64 nt, Homo Sapiens; identical to SEQ ID NO: 458010

SEQ ID NO: 464583 - RNA, 64 nt, Homo Sapiens; identical to SEQ ID NO: 458011

SEQ ID NO: 464584 - RNA, 64 nt, Homo Sapiens; identical to SEQ ID NO: 458012

SEQ ID NO: 464585 - RNA, 64 nt, Homo Sapiens; identical to SEQ ID NO: 458013

SEQ ID NO: 464586 - RNA, 64 nt, Homo Sapiens; identical to SEQ ID NO: 458014

SEQ ID NO: 464587 - RNA, 64 nt, Homo Sapiens; identical to SEQ ID NO: 458015

SEQ ID NO: 464588 - RNA, 64 nt, Homo Sapiens; identical to SEQ ID NO: 458016

SEQ ID NO: 464589 - RNA, 64 nt, Homo Sapiens; identical to SEQ ID NO: 458017

SEQ ID NO: 464590 - RNA, 64 nt, Homo Sapiens; identical to SEQ ID NO: 458018

SEQ ID NO: 464591 - RNA, 64 nt, Homo Sapiens; identical to SEQ ID NO: 458019

SEQ ID NO: 464592 - RNA, 64 nt, Homo Sapiens; identical to SEQ ID NO: 458020

SEQ ID NO: 464593 - RNA, 64 nt, Homo Sapiens; identical to SEQ ID NO: 458021

SEQ ID NO: 464594 - RNA, 64 nt, Homo Sapiens; identical to SEQ ID NO: 458022

SEQ ID NO: 464595 - RNA, 64 nt, Homo Sapiens; identical to SEQ ID NO: 458023

SEQ ID NO: 464596 - RNA, 64 nt, Homo Sapiens; identical to SEQ ID NO: 458024

SEQ ID NO: 464597 - RNA, 64 nt, Homo Sapiens; identical to SEQ ID NO: 458025

SEQ ID NO: 464598 - RNA, 64 nt, Homo Sapiens; identical to SEQ ID NO: 458026

SEQ ID NO: 464599 - RNA, 64 nt, Homo Sapiens; identical to SEQ ID NO: 458027

SEQ ID NO: 464600 - RNA, 64 nt, Homo Sapiens; identical to SEQ ID NO: 458028

SEQ ID NO: 464601 - RNA, 64 nt, Homo Sapiens; identical to SEQ ID NO: 458029

SEQ ID NO: 464602 - RNA, 64 nt, Homo Sapiens; identical to SEQ ID NO: 458030

SEQ ID NO: 464603 - RNA, 64 nt, Homo Sapiens; identical to SEQ ID NO: 458031

SEQ ID NO: 464604 - RNA, 64 nt, Homo Sapiens; identical to SEQ ID NO: 458032

SEQ ID NO: 464605 - RNA, 64 nt, Homo Sapiens; identical to SEQ ID NO: 458033

SEQ ID NO: 464606 - RNA, 64 nt, Homo Sapiens; identical to SEQ ID NO: 458034

SEQ ID NO: 464607 - RNA, 64 nt, Homo Sapiens; identical to SEQ ID NO: 458035

SEQ ID NO: 464608 - RNA, 64 nt, Homo Sapiens; identical to SEQ ID NO: 458036

SEQ ID NO: 464609 - RNA, 64 nt, Homo Sapiens; identical to SEQ ID NO: 458037

SEQ ID NO: 464610 - RNA, 64 nt, Homo Sapiens; identical to SEQ ID NO: 458038

SEQ ID NO: 464611 - RNA, 64 nt, Homo Sapiens; identical to SEQ ID NO: 458039

SEQ ID NO: 464612 - RNA, 64 nt, Homo Sapiens; identical to SEQ ID NO: 458040

SEQ ID NO: 464613 - RNA, 64 nt, Homo Sapiens; identical to SEQ ID NO: 458041

SEQ ID NO: 464614 - RNA, 64 nt, Homo Sapiens; identical to SEQ ID NO: 458042

SEQ ID NO: 464615 - RNA, 64 nt, Homo Sapiens; identical to SEQ ID NO: 458043

SEQ ID NO: 464616 - RNA, 64 nt, Homo Sapiens; identical to SEQ ID NO: 458044

SEQ ID NO: 464617 - RNA, 64 nt, Homo Sapiens; identical to SEQ ID NO: 458045

SEQ ID NO: 464618 - RNA, 64 nt, Homo Sapiens; identical to SEQ ID NO: 458046

SEQ ID NO: 464619 - RNA, 64 nt, Homo Sapiens; identical to SEQ ID NO: 458047

SEQ ID NO: 464620 - RNA, 64 nt, Homo Sapiens; identical to SEQ ID NO: 458048

SEQ ID NO: 464621 - RNA, 64 nt, Homo Sapiens; identical to SEQ ID NO: 458049

SEQ ID NO: 464622 - RNA, 64 nt, Homo Sapiens; identical to SEQ ID NO: 458050

SEQ ID NO: 464623 - RNA, 64 nt, Homo Sapiens; identical to SEQ ID NO: 458051

SEQ ID NO: 464624 - RNA, 64 nt, Homo Sapiens; identical to SEQ ID NO: 458052

SEQ ID NO: 464625 - RNA, 64 nt, Homo Sapiens; identical to SEQ ID NO: 458053

SEQ ID NO: 464626 - RNA, 64 nt, Homo Sapiens; identical to SEQ ID NO: 458054

SEQ ID NO: 464627 - RNA, 64 nt, Homo Sapiens; identical to SEQ ID NO: 458055

SEQ ID NO: 464628 - RNA, 64 nt, Homo Sapiens; identical to SEQ ID NO: 458056

SEQ ID NO: 464629 - RNA, 64 nt, Homo Sapiens; identical to SEQ ID NO: 458057

SEQ ID NO: 464630 - RNA, 64 nt, Homo Sapiens; identical to SEQ ID NO: 458058

SEQ ID NO: 464631 - RNA, 64 nt, Homo Sapiens; identical to SEQ ID NO: 458059

SEQ ID NO: 464632 - RNA, 64 nt, Homo Sapiens; identical to SEQ ID NO: 458060

SEQ ID NO: 464633 - RNA, 64 nt, Homo Sapiens; identical to SEQ ID NO: 458061

SEQ ID NO: 464634 - RNA, 64 nt, Homo Sapiens; identical to SEQ ID NO: 458062

SEQ ID NO: 464635 - RNA, 64 nt, Homo Sapiens; identical to SEQ ID NO: 458063

SEQ ID NO: 464636 - RNA, 64 nt, Homo Sapiens; identical to SEQ ID NO: 458064

SEQ ID NO: 464637 - RNA, 64 nt, Homo Sapiens; identical to SEQ ID NO: 458065

SEQ ID NO: 464638 - RNA, 64 nt, Homo Sapiens; identical to SEQ ID NO: 458066

SEQ ID NO: 464639 - RNA, 64 nt, Homo Sapiens; identical to SEQ ID NO: 458067

SEQ ID NO: 464640 - RNA, 64 nt, Homo Sapiens; identical to SEQ ID NO: 458068

SEQ ID NO: 464641 - RNA, 64 nt, Homo Sapiens; identical to SEQ ID NO: 458069

SEQ ID NO: 464642 - RNA, 64 nt, Homo Sapiens; identical to SEQ ID NO: 458070

SEQ ID NO: 464643 - RNA, 64 nt, Homo Sapiens; identical to SEQ ID NO: 458071

SEQ ID NO: 464644 - RNA, 64 nt, Homo Sapiens; identical to SEQ ID NO: 458072

SEQ ID NO: 464645 - RNA, 64 nt, Homo Sapiens; identical to SEQ ID NO: 458073

SEQ ID NO: 464646 - RNA, 64 nt, Homo Sapiens; identical to SEQ ID NO: 458074

SEQ ID NO: 464647 - RNA, 64 nt, Homo Sapiens; identical to SEQ ID NO: 458075

SEQ ID NO: 464648 - RNA, 64 nt, Homo Sapiens; identical to SEQ ID NO: 458076

SEQ ID NO: 464649 - RNA, 64 nt, Homo Sapiens; identical to SEQ ID NO: 458077

SEQ ID NO: 464650 - RNA, 64 nt, Homo Sapiens; identical to SEQ ID NO: 458078

SEQ ID NO: 464651 - RNA, 64 nt, Homo Sapiens; identical to SEQ ID NO: 458079

SEQ ID NO: 464652 - RNA, 64 nt, Homo Sapiens; identical to SEQ ID NO: 458080

SEQ ID NO: 464653 - RNA, 64 nt, Homo Sapiens; identical to SEQ ID NO: 458081

SEQ ID NO: 464654 - RNA, 64 nt, Homo Sapiens; identical to SEQ ID NO: 458082

SEQ ID NO: 464655 - RNA, 64 nt, Homo Sapiens; identical to SEQ ID NO: 458083

SEQ ID NO: 464656 - RNA, 64 nt, Homo Sapiens; identical to SEQ ID NO: 458084

SEQ ID NO: 464657 - RNA, 64 nt, Homo Sapiens; identical to SEQ ID NO: 458085

SEQ ID NO: 464658 - RNA, 64 nt, Homo Sapiens; identical to SEQ ID NO: 458086

SEQ ID NO: 464659 - RNA, 64 nt, Homo Sapiens; identical to SEQ ID NO: 458087

SEQ ID NO: 464660 - RNA, 64 nt, Homo Sapiens; identical to SEQ ID NO: 458088

SEQ ID NO: 464661 - RNA, 64 nt, Homo Sapiens; identical to SEQ ID NO: 458089

SEQ ID NO: 464662 - RNA, 64 nt, Homo Sapiens; identical to SEQ ID NO: 458090

SEQ ID NO: 464663 - RNA, 64 nt, Homo Sapiens; identical to SEQ ID NO: 458091

SEQ ID NO: 464664 - RNA, 64 nt, Homo Sapiens; identical to SEQ ID NO: 458092

SEQ ID NO: 464665 - RNA, 64 nt, Homo Sapiens; identical to SEQ ID NO: 458093

SEQ ID NO: 464666 - RNA, 64 nt, Homo Sapiens; identical to SEQ ID NO: 458094

SEQ ID NO: 464667 - RNA, 64 nt, Homo Sapiens; identical to SEQ ID NO: 458095

SEQ ID NO: 464668 - RNA, 64 nt, Homo Sapiens; identical to SEQ ID NO: 458096

SEQ ID NO: 464669 - RNA, 64 nt, Homo Sapiens; identical to SEQ ID NO: 458097

SEQ ID NO: 464670 - RNA, 64 nt, Homo Sapiens; identical to SEQ ID NO: 458098

SEQ ID NO: 464671 - RNA, 64 nt, Homo Sapiens; identical to SEQ ID NO: 458099

SEQ ID NO: 464672 - RNA, 64 nt, Homo Sapiens; identical to SEQ ID NO: 458100

SEQ ID NO: 464673 - RNA, 64 nt, Homo Sapiens; identical to SEQ ID NO: 458101

SEQ ID NO: 464674 - RNA, 64 nt, Homo Sapiens; identical to SEQ ID NO: 458102

SEQ ID NO: 464675 - RNA, 64 nt, Homo Sapiens; identical to SEQ ID NO: 458103

SEQ ID NO: 464676 - RNA, 64 nt, Homo Sapiens; identical to SEQ ID NO: 458104

SEQ ID NO: 464677 - RNA, 64 nt, Homo Sapiens; identical to SEQ ID NO: 458105

SEQ ID NO: 464678 - RNA, 64 nt, Homo Sapiens; identical to SEQ ID NO: 458106

SEQ ID NO: 464679 - RNA, 64 nt, Homo Sapiens; identical to SEQ ID NO: 458107

SEQ ID NO: 464680 - RNA, 64 nt, Homo Sapiens; identical to SEQ ID NO: 458108

SEQ ID NO: 464681 - RNA, 64 nt, Homo Sapiens; identical to SEQ ID NO: 458109

SEQ ID NO: 464682 - RNA, 64 nt, Homo Sapiens; identical to SEQ ID NO: 458110

SEQ ID NO: 464683 - RNA, 64 nt, Homo Sapiens; identical to SEQ ID NO: 458111

SEQ ID NO: 464684 - RNA, 64 nt, Homo Sapiens; identical to SEQ ID NO: 458112

SEQ ID NO: 464685 - RNA, 64 nt, Homo Sapiens; identical to SEQ ID NO: 458113

SEQ ID NO: 464686 - RNA, 64 nt, Homo Sapiens; identical to SEQ ID NO: 458114

SEQ ID NO: 464687 - RNA, 64 nt, Homo Sapiens; identical to SEQ ID NO: 458115

SEQ ID NO: 464688 - RNA, 64 nt, Homo Sapiens; identical to SEQ ID NO: 458116

SEQ ID NO: 464689 - RNA, 64 nt, Homo Sapiens; identical to SEQ ID NO: 458117

SEQ ID NO: 464690 - RNA, 64 nt, Homo Sapiens; identical to SEQ ID NO: 458118

SEQ ID NO: 464691 - RNA, 64 nt, Homo Sapiens; identical to SEQ ID NO: 458119

SEQ ID NO: 464692 - RNA, 64 nt, Homo Sapiens; identical to SEQ ID NO: 458120

SEQ ID NO: 464693 - RNA, 64 nt, Homo Sapiens; identical to SEQ ID NO: 458121

SEQ ID NO: 464694 - RNA, 64 nt, Homo Sapiens; identical to SEQ ID NO: 458122

SEQ ID NO: 464695 - RNA, 64 nt, Homo Sapiens; identical to SEQ ID NO: 458123

SEQ ID NO: 464696 - RNA, 64 nt, Homo Sapiens; identical to SEQ ID NO: 458124

SEQ ID NO: 464697 - RNA, 64 nt, Homo Sapiens; identical to SEQ ID NO: 458125

SEQ ID NO: 464698 - RNA, 64 nt, Homo Sapiens; identical to SEQ ID NO: 458126

SEQ ID NO: 464699 - RNA, 64 nt, Homo Sapiens; identical to SEQ ID NO: 458127

SEQ ID NO: 464700 - RNA, 64 nt, Homo Sapiens; identical to SEQ ID NO: 458128

SEQ ID NO: 464701 - RNA, 64 nt, Homo Sapiens; identical to SEQ ID NO: 458129

SEQ ID NO: 464702 - RNA, 64 nt, Homo Sapiens; identical to SEQ ID NO: 458130

SEQ ID NO: 464703 - RNA, 64 nt, Homo Sapiens; identical to SEQ ID NO: 458131

SEQ ID NO: 464704 - RNA, 64 nt, Homo Sapiens; identical to SEQ ID NO: 458132

SEQ ID NO: 464705 - RNA, 64 nt, Homo Sapiens; identical to SEQ ID NO: 458133

SEQ ID NO: 464706 - RNA, 64 nt, Homo Sapiens; identical to SEQ ID NO: 458134

SEQ ID NO: 464707 - RNA, 64 nt, Homo Sapiens; identical to SEQ ID NO: 458135

SEQ ID NO: 464708 - RNA, 64 nt, Homo Sapiens; identical to SEQ ID NO: 458136

SEQ ID NO: 464709 - RNA, 64 nt, Homo Sapiens; identical to SEQ ID NO: 458137

SEQ ID NO: 464710 - RNA, 64 nt, Homo Sapiens; identical to SEQ ID NO: 458138

SEQ ID NO: 464711 - RNA, 64 nt, Homo Sapiens; identical to SEQ ID NO: 458139

SEQ ID NO: 464712 - RNA, 64 nt, Homo Sapiens; identical to SEQ ID NO: 458140

SEQ ID NO: 464713 - RNA, 64 nt, Homo Sapiens; identical to SEQ ID NO: 458141

SEQ ID NO: 464714 - RNA, 64 nt, Homo Sapiens; identical to SEQ ID NO: 458142

SEQ ID NO: 464715 - RNA, 64 nt, Homo Sapiens; identical to SEQ ID NO: 458143

SEQ ID NO: 464716 - RNA, 64 nt, Homo Sapiens; identical to SEQ ID NO: 458144

SEQ ID NO: 464717 - RNA, 64 nt, Homo Sapiens; identical to SEQ ID NO: 458145

SEQ ID NO: 464718 - RNA, 64 nt, Homo Sapiens; identical to SEQ ID NO: 458146

SEQ ID NO: 464719 - RNA, 64 nt, Homo Sapiens; identical to SEQ ID NO: 458147

SEQ ID NO: 464720 - RNA, 64 nt, Homo Sapiens; identical to SEQ ID NO: 458148

SEQ ID NO: 464721 - RNA, 64 nt, Homo Sapiens; identical to SEQ ID NO: 458149

SEQ ID NO: 464722 - RNA, 64 nt, Homo Sapiens; identical to SEQ ID NO: 458150

SEQ ID NO: 464723 - RNA, 64 nt, Homo Sapiens; identical to SEQ ID NO: 458151

SEQ ID NO: 464724 - RNA, 64 nt, Homo Sapiens; identical to SEQ ID NO: 458152

SEQ ID NO: 464725 - RNA, 64 nt, Homo Sapiens; identical to SEQ ID NO: 458153

SEQ ID NO: 464726 - RNA, 64 nt, Homo Sapiens; identical to SEQ ID NO: 458154

SEQ ID NO: 464727 - RNA, 64 nt, Homo Sapiens; identical to SEQ ID NO: 458155

SEQ ID NO: 464728 - RNA, 64 nt, Homo Sapiens; identical to SEQ ID NO: 458156

SEQ ID NO: 464729 - RNA, 64 nt, Homo Sapiens; identical to SEQ ID NO: 458157

SEQ ID NO: 464730 - RNA, 64 nt, Homo Sapiens; identical to SEQ ID NO: 458158

SEQ ID NO: 464731 - RNA, 64 nt, Homo Sapiens; identical to SEQ ID NO: 458159

SEQ ID NO: 464732 - RNA, 64 nt, Homo Sapiens; identical to SEQ ID NO: 458160

SEQ ID NO: 464733 - RNA, 64 nt, Homo Sapiens; identical to SEQ ID NO: 458161

SEQ ID NO: 464734 - RNA, 64 nt, Homo Sapiens; identical to SEQ ID NO: 458162

SEQ ID NO: 464735 - RNA, 64 nt, Homo Sapiens; identical to SEQ ID NO: 458163

SEQ ID NO: 464736 - RNA, 64 nt, Homo Sapiens; identical to SEQ ID NO: 458164

SEQ ID NO: 464737 - RNA, 64 nt, Homo Sapiens; identical to SEQ ID NO: 458165

SEQ ID NO: 464738 - RNA, 64 nt, Homo Sapiens; identical to SEQ ID NO: 458166

SEQ ID NO: 464739 - RNA, 64 nt, Homo Sapiens; identical to SEQ ID NO: 458167

SEQ ID NO: 464740 - RNA, 64 nt, Homo Sapiens; identical to SEQ ID NO: 458168

SEQ ID NO: 464741 - RNA, 64 nt, Homo Sapiens; identical to SEQ ID NO: 458169

SEQ ID NO: 464742 - RNA, 64 nt, Homo Sapiens; identical to SEQ ID NO: 458170

SEQ ID NO: 464743 - RNA, 64 nt, Homo Sapiens; identical to SEQ ID NO: 458171

SEQ ID NO: 464744 - RNA, 64 nt, Homo Sapiens; identical to SEQ ID NO: 458172

SEQ ID NO: 464745 - RNA, 64 nt, Homo Sapiens; identical to SEQ ID NO: 458173

SEQ ID NO: 464746 - RNA, 64 nt, Homo Sapiens; identical to SEQ ID NO: 458174

SEQ ID NO: 464747 - RNA, 64 nt, Homo Sapiens; identical to SEQ ID NO: 458175

SEQ ID NO: 464748 - RNA, 64 nt, Homo Sapiens; identical to SEQ ID NO: 458176

SEQ ID NO: 464749 - RNA, 64 nt, Homo Sapiens; identical to SEQ ID NO: 458177

SEQ ID NO: 464750 - RNA, 64 nt, Homo Sapiens; identical to SEQ ID NO: 458178

SEQ ID NO: 464751 - RNA, 64 nt, Homo Sapiens; identical to SEQ ID NO: 458179

SEQ ID NO: 464752 - RNA, 64 nt, Homo Sapiens; identical to SEQ ID NO: 458180

SEQ ID NO: 464753 - RNA, 64 nt, Homo Sapiens; identical to SEQ ID NO: 458181

SEQ ID NO: 464754 - RNA, 64 nt, Homo Sapiens; identical to SEQ ID NO: 458182

SEQ ID NO: 464755 - RNA, 64 nt, Homo Sapiens; identical to SEQ ID NO: 458183

SEQ ID NO: 464756 - RNA, 64 nt, Homo Sapiens; identical to SEQ ID NO: 458184

SEQ ID NO: 464757 - RNA, 64 nt, Homo Sapiens; identical to SEQ ID NO: 458185

SEQ ID NO: 464758 - RNA, 64 nt, Homo Sapiens; identical to SEQ ID NO: 458186

SEQ ID NO: 464759 - RNA, 64 nt, Homo Sapiens; identical to SEQ ID NO: 458187

SEQ ID NO: 464760 - RNA, 64 nt, Homo Sapiens; identical to SEQ ID NO: 458188

SEQ ID NO: 464761 - RNA, 64 nt, Homo Sapiens; identical to SEQ ID NO: 458189

SEQ ID NO: 464762 - RNA, 64 nt, Homo Sapiens; identical to SEQ ID NO: 458190

SEQ ID NO: 464763 - RNA, 64 nt, Homo Sapiens; identical to SEQ ID NO: 458191

SEQ ID NO: 464764 - RNA, 64 nt, Homo Sapiens; identical to SEQ ID NO: 458192

SEQ ID NO: 464765 - RNA, 64 nt, Homo Sapiens; identical to SEQ ID NO: 458193

SEQ ID NO: 464766 - RNA, 64 nt, Homo Sapiens; identical to SEQ ID NO: 458194

SEQ ID NO: 464767 - RNA, 64 nt, Homo Sapiens; identical to SEQ ID NO: 458195

SEQ ID NO: 464768 - RNA, 64 nt, Homo Sapiens; identical to SEQ ID NO: 458196

SEQ ID NO: 464769 - RNA, 64 nt, Homo Sapiens; identical to SEQ ID NO: 458197

SEQ ID NO: 464770 - RNA, 64 nt, Homo Sapiens; identical to SEQ ID NO: 458198

SEQ ID NO: 464771 - RNA, 64 nt, Homo Sapiens; identical to SEQ ID NO: 458199

SEQ ID NO: 464772 - RNA, 64 nt, Homo Sapiens; identical to SEQ ID NO: 458200

SEQ ID NO: 464773 - RNA, 64 nt, Homo Sapiens; identical to SEQ ID NO: 458201

SEQ ID NO: 464774 - RNA, 64 nt, Homo Sapiens; identical to SEQ ID NO: 458202

SEQ ID NO: 464775 - RNA, 64 nt, Homo Sapiens; identical to SEQ ID NO: 458203

SEQ ID NO: 464776 - RNA, 64 nt, Homo Sapiens; identical to SEQ ID NO: 458204

SEQ ID NO: 464777 - RNA, 64 nt, Homo Sapiens; identical to SEQ ID NO: 458205

SEQ ID NO: 464778 - RNA, 64 nt, Homo Sapiens; identical to SEQ ID NO: 458206

SEQ ID NO: 464779 - RNA, 64 nt, Homo Sapiens; identical to SEQ ID NO: 458207

SEQ ID NO: 464780 - RNA, 64 nt, Homo Sapiens; identical to SEQ ID NO: 458208

SEQ ID NO: 464781 - RNA, 64 nt, Homo Sapiens; identical to SEQ ID NO: 458209

SEQ ID NO: 464782 - RNA, 64 nt, Homo Sapiens; identical to SEQ ID NO: 458210

SEQ ID NO: 464783 - RNA, 64 nt, Homo Sapiens; identical to SEQ ID NO: 458211

SEQ ID NO: 464784 - RNA, 64 nt, Homo Sapiens; identical to SEQ ID NO: 458212

SEQ ID NO: 464785 - RNA, 64 nt, Homo Sapiens; identical to SEQ ID NO: 458213

SEQ ID NO: 464786 - RNA, 64 nt, Homo Sapiens; identical to SEQ ID NO: 458214

SEQ ID NO: 464787 - RNA, 64 nt, Homo Sapiens; identical to SEQ ID NO: 458215

SEQ ID NO: 464788 - RNA, 64 nt, Homo Sapiens; identical to SEQ ID NO: 458216

SEQ ID NO: 464789 - RNA, 64 nt, Homo Sapiens; identical to SEQ ID NO: 458217

SEQ ID NO: 464790 - RNA, 64 nt, Homo Sapiens; identical to SEQ ID NO: 458218

SEQ ID NO: 464791 - RNA, 64 nt, Homo Sapiens; identical to SEQ ID NO: 458219

SEQ ID NO: 464792 - RNA, 64 nt, Homo Sapiens; identical to SEQ ID NO: 458220

SEQ ID NO: 464793 - RNA, 64 nt, Homo Sapiens; identical to SEQ ID NO: 458221

SEQ ID NO: 464794 - RNA, 64 nt, Homo Sapiens; identical to SEQ ID NO: 458222

SEQ ID NO: 464795 - RNA, 64 nt, Homo Sapiens; identical to SEQ ID NO: 458223

SEQ ID NO: 464796 - RNA, 64 nt, Homo Sapiens; identical to SEQ ID NO: 458224

SEQ ID NO: 464797 - RNA, 64 nt, Homo Sapiens; identical to SEQ ID NO: 458225

SEQ ID NO: 464798 - RNA, 64 nt, Homo Sapiens; identical to SEQ ID NO: 458226

SEQ ID NO: 464799 - RNA, 64 nt, Homo Sapiens; identical to SEQ ID NO: 458227

SEQ ID NO: 464800 - RNA, 64 nt, Homo Sapiens; identical to SEQ ID NO: 458228

SEQ ID NO: 464801 - RNA, 64 nt, Homo Sapiens; identical to SEQ ID NO: 458229

SEQ ID NO: 464802 - RNA, 64 nt, Homo Sapiens; identical to SEQ ID NO: 458230

SEQ ID NO: 464803 - RNA, 64 nt, Homo Sapiens; identical to SEQ ID NO: 458231

SEQ ID NO: 464804 - RNA, 64 nt, Homo Sapiens; identical to SEQ ID NO: 458232

SEQ ID NO: 464805 - RNA, 64 nt, Homo Sapiens; identical to SEQ ID NO: 458233

SEQ ID NO: 464806 - RNA, 64 nt, Homo Sapiens; identical to SEQ ID NO: 458234

SEQ ID NO: 464807 - RNA, 64 nt, Homo Sapiens; identical to SEQ ID NO: 458235

SEQ ID NO: 464808 - RNA, 64 nt, Homo Sapiens; identical to SEQ ID NO: 458236

SEQ ID NO: 464809 - RNA, 64 nt, Homo Sapiens; identical to SEQ ID NO: 458237

SEQ ID NO: 464810 - RNA, 64 nt, Homo Sapiens; identical to SEQ ID NO: 458238

SEQ ID NO: 464811 - RNA, 64 nt, Homo Sapiens; identical to SEQ ID NO: 458239

SEQ ID NO: 464812 - RNA, 64 nt, Homo Sapiens; identical to SEQ ID NO: 458240

SEQ ID NO: 464813 - RNA, 64 nt, Homo Sapiens; identical to SEQ ID NO: 458241

SEQ ID NO: 464814 - RNA, 64 nt, Homo Sapiens; identical to SEQ ID NO: 458242

SEQ ID NO: 464815 - RNA, 64 nt, Homo Sapiens; identical to SEQ ID NO: 458243

SEQ ID NO: 464816 - RNA, 64 nt, Homo Sapiens; identical to SEQ ID NO: 458244

SEQ ID NO: 464817 - RNA, 64 nt, Homo Sapiens; identical to SEQ ID NO: 458245

SEQ ID NO: 464818 - RNA, 64 nt, Homo Sapiens; identical to SEQ ID NO: 458246

SEQ ID NO: 464819 - RNA, 64 nt, Homo Sapiens; identical to SEQ ID NO: 458247

SEQ ID NO: 464820 - RNA, 64 nt, Homo Sapiens; identical to SEQ ID NO: 458248

SEQ ID NO: 464821 - RNA, 64 nt, Homo Sapiens; identical to SEQ ID NO: 458249

SEQ ID NO: 464822 - RNA, 64 nt, Homo Sapiens; identical to SEQ ID NO: 458250

SEQ ID NO: 464823 - RNA, 64 nt, Homo Sapiens; identical to SEQ ID NO: 458251

SEQ ID NO: 464824 - RNA, 64 nt, Homo Sapiens; identical to SEQ ID NO: 458252

SEQ ID NO: 464825 - RNA, 64 nt, Homo Sapiens; identical to SEQ ID NO: 458253

SEQ ID NO: 464826 - RNA, 64 nt, Homo Sapiens; identical to SEQ ID NO: 458254

SEQ ID NO: 464827 - RNA, 64 nt, Homo Sapiens; identical to SEQ ID NO: 458255

SEQ ID NO: 464828 - RNA, 64 nt, Homo Sapiens; identical to SEQ ID NO: 458256

SEQ ID NO: 464829 - RNA, 64 nt, Homo Sapiens; identical to SEQ ID NO: 458257

SEQ ID NO: 464830 - RNA, 64 nt, Homo Sapiens; identical to SEQ ID NO: 458258

SEQ ID NO: 464831 - RNA, 64 nt, Homo Sapiens; identical to SEQ ID NO: 458259

SEQ ID NO: 464832 - RNA, 64 nt, Homo Sapiens; identical to SEQ ID NO: 458260

SEQ ID NO: 464833 - RNA, 64 nt, Homo Sapiens; identical to SEQ ID NO: 458261

SEQ ID NO: 464834 - RNA, 64 nt, Homo Sapiens; identical to SEQ ID NO: 458262

SEQ ID NO: 464835 - RNA, 64 nt, Homo Sapiens; identical to SEQ ID NO: 458263

SEQ ID NO: 464836 - RNA, 64 nt, Homo Sapiens; identical to SEQ ID NO: 458264

SEQ ID NO: 464837 - RNA, 64 nt, Homo Sapiens; identical to SEQ ID NO: 458265

SEQ ID NO: 464838 - RNA, 64 nt, Homo Sapiens; identical to SEQ ID NO: 458266

SEQ ID NO: 464839 - RNA, 64 nt, Homo Sapiens; identical to SEQ ID NO: 458267

SEQ ID NO: 464840 - RNA, 64 nt, Homo Sapiens; identical to SEQ ID NO: 458268

SEQ ID NO: 464841 - RNA, 64 nt, Homo Sapiens; identical to SEQ ID NO: 458269

SEQ ID NO: 464842 - RNA, 64 nt, Homo Sapiens; identical to SEQ ID NO: 458270

SEQ ID NO: 464843 - RNA, 64 nt, Homo Sapiens; identical to SEQ ID NO: 458271

SEQ ID NO: 464844 - RNA, 64 nt, Homo Sapiens; identical to SEQ ID NO: 458272

SEQ ID NO: 464845 - RNA, 64 nt, Homo Sapiens; identical to SEQ ID NO: 458273

SEQ ID NO: 464846 - RNA, 64 nt, Homo Sapiens; identical to SEQ ID NO: 458274

SEQ ID NO: 464847 - RNA, 64 nt, Homo Sapiens; identical to SEQ ID NO: 458275

SEQ ID NO: 464848 - RNA, 64 nt, Homo Sapiens; identical to SEQ ID NO: 458276

SEQ ID NO: 464849 - RNA, 64 nt, Homo Sapiens; identical to SEQ ID NO: 458277

SEQ ID NO: 464850 - RNA, 64 nt, Homo Sapiens; identical to SEQ ID NO: 458278

SEQ ID NO: 464851 - RNA, 64 nt, Homo Sapiens; identical to SEQ ID NO: 458279

SEQ ID NO: 464852 - RNA, 64 nt, Homo Sapiens; identical to SEQ ID NO: 458280

SEQ ID NO: 464853 - RNA, 64 nt, Homo Sapiens; identical to SEQ ID NO: 458281

SEQ ID NO: 464854 - RNA, 64 nt, Homo Sapiens; identical to SEQ ID NO: 458282

SEQ ID NO: 464855 - RNA, 64 nt, Homo Sapiens; identical to SEQ ID NO: 458283

SEQ ID NO: 464856 - RNA, 64 nt, Homo Sapiens; identical to SEQ ID NO: 458284

SEQ ID NO: 464857 - RNA, 64 nt, Homo Sapiens; identical to SEQ ID NO: 458285

SEQ ID NO: 464858 - RNA, 64 nt, Homo Sapiens; identical to SEQ ID NO: 458286

SEQ ID NO: 464859 - RNA, 64 nt, Homo Sapiens; identical to SEQ ID NO: 458287

SEQ ID NO: 464860 - RNA, 64 nt, Homo Sapiens; identical to SEQ ID NO: 458288

SEQ ID NO: 464861 - RNA, 64 nt, Homo Sapiens; identical to SEQ ID NO: 458289

SEQ ID NO: 464862 - RNA, 64 nt, Homo Sapiens; identical to SEQ ID NO: 458290

SEQ ID NO: 464863 - RNA, 64 nt, Homo Sapiens; identical to SEQ ID NO: 458291

SEQ ID NO: 464864 - RNA, 64 nt, Homo Sapiens; identical to SEQ ID NO: 458292

SEQ ID NO: 464865 - RNA, 64 nt, Homo Sapiens; identical to SEQ ID NO: 458293

SEQ ID NO: 464866 - RNA, 64 nt, Homo Sapiens; identical to SEQ ID NO: 458294

SEQ ID NO: 464867 - RNA, 64 nt, Homo Sapiens; identical to SEQ ID NO: 458295

SEQ ID NO: 464868 - RNA, 64 nt, Homo Sapiens; identical to SEQ ID NO: 458296

SEQ ID NO: 464869 - RNA, 64 nt, Homo Sapiens; identical to SEQ ID NO: 458297

SEQ ID NO: 464870 - RNA, 64 nt, Homo Sapiens; identical to SEQ ID NO: 458298

SEQ ID NO: 464871 - RNA, 64 nt, Homo Sapiens; identical to SEQ ID NO: 458299

SEQ ID NO: 464872 - RNA, 64 nt, Homo Sapiens; identical to SEQ ID NO: 458300

SEQ ID NO: 464873 - RNA, 64 nt, Homo Sapiens; identical to SEQ ID NO: 458301

SEQ ID NO: 464874 - RNA, 64 nt, Homo Sapiens; identical to SEQ ID NO: 458302

SEQ ID NO: 464875 - RNA, 64 nt, Homo Sapiens; identical to SEQ ID NO: 458303

SEQ ID NO: 464876 - RNA, 64 nt, Homo Sapiens; identical to SEQ ID NO: 458304

SEQ ID NO: 464877 - RNA, 64 nt, Homo Sapiens; identical to SEQ ID NO: 458305

SEQ ID NO: 464878 - RNA, 64 nt, Homo Sapiens; identical to SEQ ID NO: 458306

SEQ ID NO: 464879 - RNA, 64 nt, Homo Sapiens; identical to SEQ ID NO: 458307

SEQ ID NO: 464880 - RNA, 64 nt, Homo Sapiens; identical to SEQ ID NO: 458308

SEQ ID NO: 464881 - RNA, 64 nt, Homo Sapiens; identical to SEQ ID NO: 458309

SEQ ID NO: 464882 - RNA, 64 nt, Homo Sapiens; identical to SEQ ID NO: 458310

SEQ ID NO: 464883 - RNA, 64 nt, Homo Sapiens; identical to SEQ ID NO: 458311

SEQ ID NO: 464884 - RNA, 64 nt, Homo Sapiens; identical to SEQ ID NO: 458312

SEQ ID NO: 464885 - RNA, 64 nt, Homo Sapiens; identical to SEQ ID NO: 458313

SEQ ID NO: 464886 - RNA, 64 nt, Homo Sapiens; identical to SEQ ID NO: 458314

SEQ ID NO: 464887 - RNA, 64 nt, Homo Sapiens; identical to SEQ ID NO: 458315

SEQ ID NO: 464888 - RNA, 64 nt, Homo Sapiens; identical to SEQ ID NO: 458316

SEQ ID NO: 464889 - RNA, 64 nt, Homo Sapiens; identical to SEQ ID NO: 458317

SEQ ID NO: 464890 - RNA, 64 nt, Homo Sapiens; identical to SEQ ID NO: 458318

SEQ ID NO: 464891 - RNA, 64 nt, Homo Sapiens; identical to SEQ ID NO: 458319

SEQ ID NO: 464892 - RNA, 64 nt, Homo Sapiens; identical to SEQ ID NO: 458320

SEQ ID NO: 464893 - RNA, 64 nt, Homo Sapiens; identical to SEQ ID NO: 458321

SEQ ID NO: 464894 - RNA, 64 nt, Homo Sapiens; identical to SEQ ID NO: 458322

SEQ ID NO: 464895 - RNA, 64 nt, Homo Sapiens; identical to SEQ ID NO: 458323

SEQ ID NO: 464896 - RNA, 64 nt, Homo Sapiens; identical to SEQ ID NO: 458324

SEQ ID NO: 464897 - RNA, 64 nt, Homo Sapiens; identical to SEQ ID NO: 458325

SEQ ID NO: 464898 - RNA, 64 nt, Homo Sapiens; identical to SEQ ID NO: 458326

SEQ ID NO: 464899 - RNA, 64 nt, Homo Sapiens; identical to SEQ ID NO: 458327

SEQ ID NO: 464900 - RNA, 64 nt, Homo Sapiens; identical to SEQ ID NO: 458328

SEQ ID NO: 464901 - RNA, 64 nt, Homo Sapiens; identical to SEQ ID NO: 458329

SEQ ID NO: 464902 - RNA, 64 nt, Homo Sapiens; identical to SEQ ID NO: 458330

SEQ ID NO: 464903 - RNA, 64 nt, Homo Sapiens; identical to SEQ ID NO: 458331

SEQ ID NO: 464904 - RNA, 64 nt, Homo Sapiens; identical to SEQ ID NO: 458332

SEQ ID NO: 464905 - RNA, 64 nt, Homo Sapiens; identical to SEQ ID NO: 458333

SEQ ID NO: 464906 - RNA, 64 nt, Homo Sapiens; identical to SEQ ID NO: 458334

SEQ ID NO: 464907 - RNA, 64 nt, Homo Sapiens; identical to SEQ ID NO: 458335

SEQ ID NO: 464908 - RNA, 64 nt, Homo Sapiens; identical to SEQ ID NO: 458336

SEQ ID NO: 464909 - RNA, 64 nt, Homo Sapiens; identical to SEQ ID NO: 458337

SEQ ID NO: 464910 - RNA, 64 nt, Homo Sapiens; identical to SEQ ID NO: 458338

SEQ ID NO: 464911 - RNA, 64 nt, Homo Sapiens; identical to SEQ ID NO: 458339

SEQ ID NO: 464912 - RNA, 64 nt, Homo Sapiens; identical to SEQ ID NO: 458340

SEQ ID NO: 464913 - RNA, 64 nt, Homo Sapiens; identical to SEQ ID NO: 458341

SEQ ID NO: 464914 - RNA, 64 nt, Homo Sapiens; identical to SEQ ID NO: 458342

SEQ ID NO: 464915 - RNA, 64 nt, Homo Sapiens; identical to SEQ ID NO: 458343

SEQ ID NO: 464916 - RNA, 64 nt, Homo Sapiens; identical to SEQ ID NO: 458344

SEQ ID NO: 464917 - RNA, 64 nt, Homo Sapiens; identical to SEQ ID NO: 458345

SEQ ID NO: 464918 - RNA, 64 nt, Homo Sapiens; identical to SEQ ID NO: 458346

SEQ ID NO: 464919 - RNA, 64 nt, Homo Sapiens; identical to SEQ ID NO: 458347

SEQ ID NO: 464920 - RNA, 64 nt, Homo Sapiens; identical to SEQ ID NO: 458348

SEQ ID NO: 464921 - RNA, 64 nt, Homo Sapiens; identical to SEQ ID NO: 458349

SEQ ID NO: 464922 - RNA, 64 nt, Homo Sapiens; identical to SEQ ID NO: 458350

SEQ ID NO: 464923 - RNA, 64 nt, Homo Sapiens; identical to SEQ ID NO: 458351

SEQ ID NO: 464924 - RNA, 64 nt, Homo Sapiens; identical to SEQ ID NO: 458352

SEQ ID NO: 464925 - RNA, 64 nt, Homo Sapiens; identical to SEQ ID NO: 458353

SEQ ID NO: 464926 - RNA, 64 nt, Homo Sapiens; identical to SEQ ID NO: 458354

SEQ ID NO: 464927 - RNA, 64 nt, Homo Sapiens; identical to SEQ ID NO: 458355

SEQ ID NO: 464928 - RNA, 64 nt, Homo Sapiens; identical to SEQ ID NO: 458356

SEQ ID NO: 464929 - RNA, 64 nt, Homo Sapiens; identical to SEQ ID NO: 458357

SEQ ID NO: 464930 - RNA, 64 nt, Homo Sapiens; identical to SEQ ID NO: 458358

SEQ ID NO: 464931 - RNA, 64 nt, Homo Sapiens; identical to SEQ ID NO: 458359

SEQ ID NO: 464932 - RNA, 64 nt, Homo Sapiens; identical to SEQ ID NO: 458360

SEQ ID NO: 464933 - RNA, 64 nt, Homo Sapiens; identical to SEQ ID NO: 458361

SEQ ID NO: 464934 - RNA, 64 nt, Homo Sapiens; identical to SEQ ID NO: 458362

SEQ ID NO: 464935 - RNA, 64 nt, Homo Sapiens; identical to SEQ ID NO: 458363

SEQ ID NO: 464936 - RNA, 64 nt, Homo Sapiens; identical to SEQ ID NO: 458364

SEQ ID NO: 464937 - RNA, 64 nt, Homo Sapiens; identical to SEQ ID NO: 458365

SEQ ID NO: 464938 - RNA, 64 nt, Homo Sapiens; identical to SEQ ID NO: 458366

SEQ ID NO: 464939 - RNA, 64 nt, Homo Sapiens; identical to SEQ ID NO: 458367

SEQ ID NO: 464940 - RNA, 64 nt, Homo Sapiens; identical to SEQ ID NO: 458368

SEQ ID NO: 464941 - RNA, 64 nt, Homo Sapiens; identical to SEQ ID NO: 458369

SEQ ID NO: 464942 - RNA, 64 nt, Homo Sapiens; identical to SEQ ID NO: 458370

SEQ ID NO: 464943 - RNA, 64 nt, Homo Sapiens; identical to SEQ ID NO: 458371

SEQ ID NO: 464944 - RNA, 64 nt, Homo Sapiens; identical to SEQ ID NO: 458372

SEQ ID NO: 464945 - RNA, 64 nt, Homo Sapiens; identical to SEQ ID NO: 458373

SEQ ID NO: 464946 - RNA, 64 nt, Homo Sapiens; identical to SEQ ID NO: 458374

SEQ ID NO: 464947 - RNA, 64 nt, Homo Sapiens; identical to SEQ ID NO: 458375

SEQ ID NO: 464948 - RNA, 64 nt, Homo Sapiens; identical to SEQ ID NO: 458376

SEQ ID NO: 464949 - RNA, 64 nt, Homo Sapiens; identical to SEQ ID NO: 458377

SEQ ID NO: 464950 - RNA, 64 nt, Homo Sapiens; identical to SEQ ID NO: 458378

SEQ ID NO: 464951 - RNA, 64 nt, Homo Sapiens; identical to SEQ ID NO: 458379

SEQ ID NO: 464952 - RNA, 64 nt, Homo Sapiens; identical to SEQ ID NO: 458380

SEQ ID NO: 464953 - RNA, 64 nt, Homo Sapiens; identical to SEQ ID NO: 458381

SEQ ID NO: 464954 - RNA, 64 nt, Homo Sapiens; identical to SEQ ID NO: 458382

SEQ ID NO: 464955 - RNA, 64 nt, Homo Sapiens; identical to SEQ ID NO: 458383

SEQ ID NO: 464956 - RNA, 64 nt, Homo Sapiens; identical to SEQ ID NO: 458384

SEQ ID NO: 464957 - RNA, 64 nt, Homo Sapiens; identical to SEQ ID NO: 458385

SEQ ID NO: 464958 - RNA, 64 nt, Homo Sapiens; identical to SEQ ID NO: 458386

SEQ ID NO: 464959 - RNA, 64 nt, Homo Sapiens; identical to SEQ ID NO: 458387

SEQ ID NO: 464960 - RNA, 64 nt, Homo Sapiens; identical to SEQ ID NO: 458388

SEQ ID NO: 464961 - RNA, 64 nt, Homo Sapiens; identical to SEQ ID NO: 458389

SEQ ID NO: 464962 - RNA, 64 nt, Homo Sapiens; identical to SEQ ID NO: 458390

SEQ ID NO: 464963 - RNA, 64 nt, Homo Sapiens; identical to SEQ ID NO: 458391

SEQ ID NO: 464964 - RNA, 64 nt, Homo Sapiens; identical to SEQ ID NO: 458392

SEQ ID NO: 464965 - RNA, 64 nt, Homo Sapiens; identical to SEQ ID NO: 458393

SEQ ID NO: 464966 - RNA, 64 nt, Homo Sapiens; identical to SEQ ID NO: 458394

SEQ ID NO: 464967 - RNA, 64 nt, Homo Sapiens; identical to SEQ ID NO: 458395

SEQ ID NO: 464968 - RNA, 64 nt, Homo Sapiens; identical to SEQ ID NO: 458396

SEQ ID NO: 464969 - RNA, 64 nt, Homo Sapiens; identical to SEQ ID NO: 458397

SEQ ID NO: 464970 - RNA, 64 nt, Homo Sapiens; identical to SEQ ID NO: 458398

SEQ ID NO: 464971 - RNA, 64 nt, Homo Sapiens; identical to SEQ ID NO: 458399

SEQ ID NO: 464972 - RNA, 64 nt, Homo Sapiens; identical to SEQ ID NO: 458400

SEQ ID NO: 464973 - RNA, 64 nt, Homo Sapiens; identical to SEQ ID NO: 458401

SEQ ID NO: 464974 - RNA, 64 nt, Homo Sapiens; identical to SEQ ID NO: 458402

SEQ ID NO: 464975 - RNA, 64 nt, Homo Sapiens; identical to SEQ ID NO: 458403

SEQ ID NO: 464976 - RNA, 64 nt, Homo Sapiens; identical to SEQ ID NO: 458404

SEQ ID NO: 464977 - RNA, 64 nt, Homo Sapiens; identical to SEQ ID NO: 458405

SEQ ID NO: 464978 - RNA, 64 nt, Homo Sapiens; identical to SEQ ID NO: 458406

SEQ ID NO: 464979 - RNA, 64 nt, Homo Sapiens; identical to SEQ ID NO: 458407

SEQ ID NO: 464980 - RNA, 64 nt, Homo Sapiens; identical to SEQ ID NO: 458408

SEQ ID NO: 464981 - RNA, 64 nt, Homo Sapiens; identical to SEQ ID NO: 458409

SEQ ID NO: 464982 - RNA, 64 nt, Homo Sapiens; identical to SEQ ID NO: 458410

SEQ ID NO: 464983 - RNA, 64 nt, Homo Sapiens; identical to SEQ ID NO: 458411

SEQ ID NO: 464984 - RNA, 64 nt, Homo Sapiens; identical to SEQ ID NO: 458412

SEQ ID NO: 464985 - RNA, 64 nt, Homo Sapiens; identical to SEQ ID NO: 458413

SEQ ID NO: 464986 - RNA, 64 nt, Homo Sapiens; identical to SEQ ID NO: 458414

SEQ ID NO: 464987 - RNA, 64 nt, Homo Sapiens; identical to SEQ ID NO: 458415

SEQ ID NO: 464988 - RNA, 64 nt, Homo Sapiens; identical to SEQ ID NO: 458416

SEQ ID NO: 464989 - RNA, 64 nt, Homo Sapiens; identical to SEQ ID NO: 458417

SEQ ID NO: 464990 - RNA, 64 nt, Homo Sapiens; identical to SEQ ID NO: 458418

SEQ ID NO: 464991 - RNA, 64 nt, Homo Sapiens; identical to SEQ ID NO: 458419

SEQ ID NO: 464992 - RNA, 64 nt, Homo Sapiens; identical to SEQ ID NO: 458420

SEQ ID NO: 464993 - RNA, 64 nt, Homo Sapiens; identical to SEQ ID NO: 458421

SEQ ID NO: 464994 - RNA, 64 nt, Homo Sapiens; identical to SEQ ID NO: 458422

SEQ ID NO: 464995 - RNA, 64 nt, Homo Sapiens; identical to SEQ ID NO: 458423

SEQ ID NO: 464996 - RNA, 64 nt, Homo Sapiens; identical to SEQ ID NO: 458424

SEQ ID NO: 464997 - RNA, 64 nt, Homo Sapiens; identical to SEQ ID NO: 458425

SEQ ID NO: 464998 - RNA, 64 nt, Homo Sapiens; identical to SEQ ID NO: 458426

SEQ ID NO: 464999 - RNA, 64 nt, Homo Sapiens; identical to SEQ ID NO: 458427

SEQ ID NO: 465000 - RNA, 64 nt, Homo Sapiens; identical to SEQ ID NO: 458428

SEQ ID NO: 465001 - RNA, 64 nt, Homo Sapiens; identical to SEQ ID NO: 458429

SEQ ID NO: 465002 - RNA, 64 nt, Homo Sapiens; identical to SEQ ID NO: 458430

SEQ ID NO: 465003 - RNA, 64 nt, Homo Sapiens; identical to SEQ ID NO: 458431

SEQ ID NO: 465004 - RNA, 64 nt, Homo Sapiens; identical to SEQ ID NO: 458432

SEQ ID NO: 465005 - RNA, 64 nt, Homo Sapiens; identical to SEQ ID NO: 458433

SEQ ID NO: 465006 - RNA, 64 nt, Homo Sapiens; identical to SEQ ID NO: 458434

SEQ ID NO: 465007 - RNA, 64 nt, Homo Sapiens; identical to SEQ ID NO: 458435

SEQ ID NO: 465008 - RNA, 64 nt, Homo Sapiens; identical to SEQ ID NO: 458436

SEQ ID NO: 465009 - RNA, 64 nt, Homo Sapiens; identical to SEQ ID NO: 458437

SEQ ID NO: 465010 - RNA, 64 nt, Homo Sapiens; identical to SEQ ID NO: 458438

SEQ ID NO: 465011 - RNA, 64 nt, Homo Sapiens; identical to SEQ ID NO: 458439

SEQ ID NO: 465012 - RNA, 64 nt, Homo Sapiens; identical to SEQ ID NO: 458440

SEQ ID NO: 465013 - RNA, 64 nt, Homo Sapiens; identical to SEQ ID NO: 458441

SEQ ID NO: 465014 - RNA, 64 nt, Homo Sapiens; identical to SEQ ID NO: 458442

SEQ ID NO: 465015 - RNA, 64 nt, Homo Sapiens; identical to SEQ ID NO: 458443

SEQ ID NO: 465016 - RNA, 64 nt, Homo Sapiens; identical to SEQ ID NO: 458444

SEQ ID NO: 465017 - RNA, 64 nt, Homo Sapiens; identical to SEQ ID NO: 458445

SEQ ID NO: 465018 - RNA, 64 nt, Homo Sapiens; identical to SEQ ID NO: 458446

SEQ ID NO: 465019 - RNA, 64 nt, Homo Sapiens; identical to SEQ ID NO: 458447

SEQ ID NO: 465020 - RNA, 64 nt, Homo Sapiens; identical to SEQ ID NO: 458448

SEQ ID NO: 465021 - RNA, 64 nt, Homo Sapiens; identical to SEQ ID NO: 458449

SEQ ID NO: 465022 - RNA, 64 nt, Homo Sapiens; identical to SEQ ID NO: 458450

SEQ ID NO: 465023 - RNA, 64 nt, Homo Sapiens; identical to SEQ ID NO: 458451

SEQ ID NO: 465024 - RNA, 64 nt, Homo Sapiens; identical to SEQ ID NO: 458452

SEQ ID NO: 465025 - RNA, 64 nt, Homo Sapiens; identical to SEQ ID NO: 458453

SEQ ID NO: 465026 - RNA, 64 nt, Homo Sapiens; identical to SEQ ID NO: 458454

SEQ ID NO: 465027 - RNA, 64 nt, Homo Sapiens; identical to SEQ ID NO: 458455

SEQ ID NO: 465028 - RNA, 64 nt, Homo Sapiens; identical to SEQ ID NO: 458456

SEQ ID NO: 465029 - RNA, 64 nt, Homo Sapiens; identical to SEQ ID NO: 458457

SEQ ID NO: 465030 - RNA, 64 nt, Homo Sapiens; identical to SEQ ID NO: 458458

SEQ ID NO: 465031 - RNA, 64 nt, Homo Sapiens; identical to SEQ ID NO: 458459

SEQ ID NO: 465032 - RNA, 64 nt, Homo Sapiens; identical to SEQ ID NO: 458460

SEQ ID NO: 465033 - RNA, 64 nt, Homo Sapiens; identical to SEQ ID NO: 458461

SEQ ID NO: 465034 - RNA, 64 nt, Homo Sapiens; identical to SEQ ID NO: 458462

SEQ ID NO: 465035 - RNA, 64 nt, Homo Sapiens; identical to SEQ ID NO: 458463

SEQ ID NO: 465036 - RNA, 64 nt, Homo Sapiens; identical to SEQ ID NO: 458464

SEQ ID NO: 465037 - RNA, 64 nt, Homo Sapiens; identical to SEQ ID NO: 458465

SEQ ID NO: 465038 - RNA, 64 nt, Homo Sapiens; identical to SEQ ID NO: 458466

SEQ ID NO: 465039 - RNA, 64 nt, Homo Sapiens; identical to SEQ ID NO: 458467

SEQ ID NO: 465040 - RNA, 64 nt, Homo Sapiens; identical to SEQ ID NO: 458468

SEQ ID NO: 465041 - RNA, 64 nt, Homo Sapiens; identical to SEQ ID NO: 458469

SEQ ID NO: 465042 - RNA, 64 nt, Homo Sapiens; identical to SEQ ID NO: 458470

SEQ ID NO: 465043 - RNA, 64 nt, Homo Sapiens; identical to SEQ ID NO: 458471

SEQ ID NO: 465044 - RNA, 64 nt, Homo Sapiens; identical to SEQ ID NO: 458472

SEQ ID NO: 465045 - RNA, 64 nt, Homo Sapiens; identical to SEQ ID NO: 458473

SEQ ID NO: 465046 - RNA, 64 nt, Homo Sapiens; identical to SEQ ID NO: 458474

SEQ ID NO: 465047 - RNA, 64 nt, Homo Sapiens; identical to SEQ ID NO: 458475

SEQ ID NO: 465048 - RNA, 64 nt, Homo Sapiens; identical to SEQ ID NO: 458476

SEQ ID NO: 465049 - RNA, 64 nt, Homo Sapiens; identical to SEQ ID NO: 458477

SEQ ID NO: 465050 - RNA, 64 nt, Homo Sapiens; identical to SEQ ID NO: 458478

SEQ ID NO: 465051 - RNA, 64 nt, Homo Sapiens; identical to SEQ ID NO: 458479

SEQ ID NO: 465052 - RNA, 64 nt, Homo Sapiens; identical to SEQ ID NO: 458480

SEQ ID NO: 465053 - RNA, 64 nt, Homo Sapiens; identical to SEQ ID NO: 458481

SEQ ID NO: 465054 - RNA, 64 nt, Homo Sapiens; identical to SEQ ID NO: 458482

SEQ ID NO: 465055 - RNA, 64 nt, Homo Sapiens; identical to SEQ ID NO: 458483

SEQ ID NO: 465056 - RNA, 64 nt, Homo Sapiens; identical to SEQ ID NO: 458484

SEQ ID NO: 465057 - RNA, 64 nt, Homo Sapiens; identical to SEQ ID NO: 458485

SEQ ID NO: 465058 - RNA, 64 nt, Homo Sapiens; identical to SEQ ID NO: 458486

SEQ ID NO: 465059 - RNA, 64 nt, Homo Sapiens; identical to SEQ ID NO: 458487

SEQ ID NO: 465060 - RNA, 64 nt, Homo Sapiens; identical to SEQ ID NO: 458488

SEQ ID NO: 465061 - RNA, 64 nt, Homo Sapiens; identical to SEQ ID NO: 458489

SEQ ID NO: 465062 - RNA, 64 nt, Homo Sapiens; identical to SEQ ID NO: 458490

SEQ ID NO: 465063 - RNA, 64 nt, Homo Sapiens; identical to SEQ ID NO: 458491

SEQ ID NO: 465064 - RNA, 64 nt, Homo Sapiens; identical to SEQ ID NO: 458492

SEQ ID NO: 465065 - RNA, 64 nt, Homo Sapiens; identical to SEQ ID NO: 458493

SEQ ID NO: 465066 - RNA, 64 nt, Homo Sapiens; identical to SEQ ID NO: 458494

SEQ ID NO: 465067 - RNA, 64 nt, Homo Sapiens; identical to SEQ ID NO: 458495

SEQ ID NO: 465068 - RNA, 64 nt, Homo Sapiens; identical to SEQ ID NO: 458496

SEQ ID NO: 465069 - RNA, 64 nt, Homo Sapiens; identical to SEQ ID NO: 458497

SEQ ID NO: 465070 - RNA, 64 nt, Homo Sapiens; identical to SEQ ID NO: 458498

SEQ ID NO: 465071 - RNA, 64 nt, Homo Sapiens; identical to SEQ ID NO: 458499

SEQ ID NO: 465072 - RNA, 64 nt, Homo Sapiens; identical to SEQ ID NO: 458500

SEQ ID NO: 465073 - RNA, 64 nt, Homo Sapiens; identical to SEQ ID NO: 458501

SEQ ID NO: 465074 - RNA, 64 nt, Homo Sapiens; identical to SEQ ID NO: 458502

SEQ ID NO: 465075 - RNA, 64 nt, Homo Sapiens; identical to SEQ ID NO: 458503

SEQ ID NO: 465076 - RNA, 64 nt, Homo Sapiens; identical to SEQ ID NO: 458504

SEQ ID NO: 465077 - RNA, 64 nt, Homo Sapiens; identical to SEQ ID NO: 458505

SEQ ID NO: 465078 - RNA, 64 nt, Homo Sapiens; identical to SEQ ID NO: 458506

SEQ ID NO: 465079 - RNA, 64 nt, Homo Sapiens; identical to SEQ ID NO: 458507

SEQ ID NO: 465080 - RNA, 64 nt, Homo Sapiens; identical to SEQ ID NO: 458508

SEQ ID NO: 465081 - RNA, 64 nt, Homo Sapiens; identical to SEQ ID NO: 458509

SEQ ID NO: 465082 - RNA, 64 nt, Homo Sapiens; identical to SEQ ID NO: 458510

SEQ ID NO: 465083 - RNA, 64 nt, Homo Sapiens; identical to SEQ ID NO: 458511

SEQ ID NO: 465084 - RNA, 64 nt, Homo Sapiens; identical to SEQ ID NO: 458512

SEQ ID NO: 465085 - RNA, 64 nt, Homo Sapiens; identical to SEQ ID NO: 458513

SEQ ID NO: 465086 - RNA, 64 nt, Homo Sapiens; identical to SEQ ID NO: 458514

SEQ ID NO: 465087 - RNA, 64 nt, Homo Sapiens; identical to SEQ ID NO: 458515

SEQ ID NO: 465088 - RNA, 64 nt, Homo Sapiens; identical to SEQ ID NO: 458516

SEQ ID NO: 465089 - RNA, 64 nt, Homo Sapiens; identical to SEQ ID NO: 458517

SEQ ID NO: 465090 - RNA, 64 nt, Homo Sapiens; identical to SEQ ID NO: 458518

SEQ ID NO: 465091 - RNA, 64 nt, Homo Sapiens; identical to SEQ ID NO: 458519

SEQ ID NO: 465092 - RNA, 64 nt, Homo Sapiens; identical to SEQ ID NO: 458520

SEQ ID NO: 465093 - RNA, 64 nt, Homo Sapiens; identical to SEQ ID NO: 458521

SEQ ID NO: 465094 - RNA, 64 nt, Homo Sapiens; identical to SEQ ID NO: 458522

SEQ ID NO: 465095 - RNA, 64 nt, Homo Sapiens; identical to SEQ ID NO: 458523

SEQ ID NO: 465096 - RNA, 64 nt, Homo Sapiens; identical to SEQ ID NO: 458524

SEQ ID NO: 465097 - RNA, 64 nt, Homo Sapiens; identical to SEQ ID NO: 458525

SEQ ID NO: 465098 - RNA, 64 nt, Homo Sapiens; identical to SEQ ID NO: 458526

SEQ ID NO: 465099 - RNA, 64 nt, Homo Sapiens; identical to SEQ ID NO: 458527

SEQ ID NO: 465100 - RNA, 64 nt, Homo Sapiens; identical to SEQ ID NO: 458528

SEQ ID NO: 465101 - RNA, 64 nt, Homo Sapiens; identical to SEQ ID NO: 458529

SEQ ID NO: 465102 - RNA, 64 nt, Homo Sapiens; identical to SEQ ID NO: 458530

SEQ ID NO: 465103 - RNA, 64 nt, Homo Sapiens; identical to SEQ ID NO: 458531

SEQ ID NO: 465104 - RNA, 64 nt, Homo Sapiens; identical to SEQ ID NO: 458532

SEQ ID NO: 465105 - RNA, 64 nt, Homo Sapiens; identical to SEQ ID NO: 458533

SEQ ID NO: 465106 - RNA, 64 nt, Homo Sapiens; identical to SEQ ID NO: 458534

SEQ ID NO: 465107 - RNA, 64 nt, Homo Sapiens; identical to SEQ ID NO: 458512

SEQ ID NO: 465108 - RNA, 64 nt, Homo Sapiens; identical to SEQ ID NO: 458536

SEQ ID NO: 465109 - RNA, 64 nt, Homo Sapiens; identical to SEQ ID NO: 458537

SEQ ID NO: 465110 - RNA, 64 nt, Homo Sapiens; identical to SEQ ID NO: 458538

SEQ ID NO: 465111 - RNA, 64 nt, Homo Sapiens; identical to SEQ ID NO: 458539

SEQ ID NO: 465112 - RNA, 64 nt, Homo Sapiens; identical to SEQ ID NO: 422910

SEQ ID NO: 465113 - RNA, 64 nt, Homo Sapiens; identical to SEQ ID NO: 422911

SEQ ID NO: 465114 - RNA, 64 nt, Homo Sapiens; identical to SEQ ID NO: 422917

SEQ ID NO: 465115 - RNA, 64 nt, Homo Sapiens; identical to SEQ ID NO: 422918

SEQ ID NO: 465116 - RNA, 64 nt, Homo Sapiens; identical to SEQ ID NO: 422923

SEQ ID NO: 465117 - RNA, 64 nt, Homo Sapiens; identical to SEQ ID NO: 422924

SEQ ID NO: 465118 - RNA, 64 nt, Homo Sapiens; identical to SEQ ID NO: 422947

SEQ ID NO: 465119 - RNA, 64 nt, Homo Sapiens; identical to SEQ ID NO: 422948

SEQ ID NO: 465120 - RNA, 64 nt, Homo Sapiens; identical to SEQ ID NO: 422952

SEQ ID NO: 465121 - RNA, 64 nt, Homo Sapiens; identical to SEQ ID NO: 422953

SEQ ID NO: 465122 - RNA, 64 nt, Homo Sapiens; identical to SEQ ID NO: 423007

SEQ ID NO: 465123 - RNA, 64 nt, Homo Sapiens; identical to SEQ ID NO: 423008

SEQ ID NO: 465124 - RNA, 64 nt, Homo Sapiens; identical to SEQ ID NO: 423031

SEQ ID NO: 465125 - RNA, 64 nt, Homo Sapiens; identical to SEQ ID NO: 423032

SEQ ID NO: 465126 - RNA, 64 nt, Homo Sapiens; identical to SEQ ID NO: 423040

SEQ ID NO: 465127 - RNA, 64 nt, Homo Sapiens; identical to SEQ ID NO: 423041

SEQ ID NO: 465128 - RNA, 64 nt, Homo Sapiens; identical to SEQ ID NO: 423075

SEQ ID NO: 465129 - RNA, 64 nt, Homo Sapiens; identical to SEQ ID NO: 423076

SEQ ID NO: 465130 - RNA, 64 nt, Homo Sapiens; identical to SEQ ID NO: 423095

SEQ ID NO: 465131 - RNA, 64 nt, Homo Sapiens; identical to SEQ ID NO: 423096

SEQ ID NO: 465132 - RNA, 64 nt, Homo Sapiens; identical to SEQ ID NO: 423115

SEQ ID NO: 465133 - RNA, 64 nt, Homo Sapiens; identical to SEQ ID NO: 423116

SEQ ID NO: 465134 - RNA, 64 nt, Homo Sapiens; identical to SEQ ID NO: 423117

SEQ ID NO: 465135 - RNA, 64 nt, Homo Sapiens; identical to SEQ ID NO: 423118

SEQ ID NO: 465136 - RNA, 64 nt, Homo Sapiens; identical to SEQ ID NO: 423119

SEQ ID NO: 465137 - RNA, 64 nt, Homo Sapiens; identical to SEQ ID NO: 423138

SEQ ID NO: 465138 - RNA, 64 nt, Homo Sapiens; identical to SEQ ID NO: 423139

SEQ ID NO: 465139 - RNA, 64 nt, Homo Sapiens; identical to SEQ ID NO: 423160

SEQ ID NO: 465140 - RNA, 64 nt, Homo Sapiens; identical to SEQ ID NO: 423161

SEQ ID NO: 465141 - RNA, 64 nt, Homo Sapiens; identical to SEQ ID NO: 423187

SEQ ID NO: 465142 - RNA, 64 nt, Homo Sapiens; identical to SEQ ID NO: 423188

SEQ ID NO: 465143 - RNA, 64 nt, Homo Sapiens
guccaauacuaauccaauccaauacuaauaauacuauugguacaauccaauacuaauaauacua

SEQ ID NO: 465144 - RNA, 64 nt, Homo Sapiens
uaauacuauugguacaauccaauacuaauaauacuauugguacaauccaauacuaauaauacua

SEQ ID NO: 465145 - RNA, 64 nt, Homo Sapiens
gcaccucuaucucgcagguaauggaguaguuuguuauugguagucuacuccaggccaggcagug

SEQ ID NO: 465146 - RNA, 64 nt, Homo Sapiens
uugauuuggaauaauuaauagcuacuggacauuauauugguacuaaagagaaagaauacuugac

SEQ ID NO: 465147 - RNA, 64 nt, Homo Sapiens
acuuuuuugccucuuaugauucuguuuuguccaauauugguaguaaaaucgauaaugucaguua

SEQ ID NO: 465148 - RNA, 64 nt, Homo Sapiens
gcacugguuaucuucuggauuaucaaaagaucuuuauugguagagcagaaguuaaaacccuuug

SEQ ID NO: 465149 - RNA, 64 nt, Homo Sapiens
guugccauggggaagaaggaugauguggaaaccauauugguaaaguuguuaaucccucguuaug

SEQ ID NO: 465150 - RNA, 64 nt, Homo Sapiens
ugucguuggauaccuguauucuugacaguuagaauauugguagggacuuuguuaaaauucacuu

SEQ ID NO: 465151 - RNA, 64 nt, Homo Sapiens
gguuguaugugugaugcuauauuuaauauuauuauauugguaauaggaugucuguuaaguaauc

SEQ ID NO: 465152 - RNA, 64 nt, Homo Sapiens
uauauuguuaguaauugcauauuguuggucaaaguauugguacuuguuauaaaccauugugacu

SEQ ID NO: 465153 - RNA, 64 nt, Homo Sapiens
uugacaaaguauguauuugcuggugucguguaaauauugguauuuuaaaauaaaaacuguuaca

SEQ ID NO: 465154 - RNA, 64 nt, Homo Sapiens
aucucaguccagaaccaauauuaucguaauuaauuauugguauauaaugaaaacgguauuaauu

SEQ ID NO: 465155 - RNA, 64 nt, Homo Sapiens
cuuuucugugaauauuagguuuucuaaucauuguuauugguaaugaguacauucuaacccuaca

SEQ ID NO: 465156 - RNA, 64 nt, Homo Sapiens
acccuguggaaacacacauuguaccauacugaguuauugguaugaacaauccuaauuauaucua

SEQ ID NO: 465157 - RNA, 64 nt, Homo Sapiens
uaucuaagaaaacaagaaaacaaaggcagcagacuauugguacacauuauaguccaaagugcuu

SEQ ID NO: 465158 - RNA, 64 nt, Homo Sapiens
aaaaaaaaagcuuuuuaaaauuucuauuguugucuauugguaauguuuuugaucagaauaaaga

SEQ ID NO: 465159 - RNA, 64 nt, Homo Sapiens; identical to SEQ ID NO: 250961

SEQ ID NO: 465160 - RNA, 64 nt, Homo Sapiens; identical to SEQ ID NO: 250962

SEQ ID NO: 465161 - RNA, 64 nt, Homo Sapiens; identical to SEQ ID NO: 250963

SEQ ID NO: 465162 - RNA, 64 nt, Homo Sapiens; identical to SEQ ID NO: 250964

SEQ ID NO: 465163 - RNA, 64 nt, Homo Sapiens; identical to SEQ ID NO: 250965

SEQ ID NO: 465164 - RNA, 64 nt, Homo Sapiens; identical to SEQ ID NO: 250966

SEQ ID NO: 465165 - RNA, 64 nt, Homo Sapiens; identical to SEQ ID NO: 250967

SEQ ID NO: 465166 - RNA, 64 nt, Homo Sapiens; identical to SEQ ID NO: 250968

SEQ ID NO: 465167 - RNA, 64 nt, Homo Sapiens; identical to SEQ ID NO: 250969

SEQ ID NO: 465168 - RNA, 64 nt, Homo Sapiens; identical to SEQ ID NO: 250970

SEQ ID NO: 465169 - RNA, 64 nt, Homo Sapiens; identical to SEQ ID NO: 250971

SEQ ID NO: 465170 - RNA, 64 nt, Homo Sapiens; identical to SEQ ID NO: 250972

SEQ ID NO: 465171 - RNA, 64 nt, Homo Sapiens; identical to SEQ ID NO: 250973

SEQ ID NO: 465172 - RNA, 64 nt, Homo Sapiens; identical to SEQ ID NO: 250974

SEQ ID NO: 465173 - RNA, 64 nt, Homo Sapiens; identical to SEQ ID NO: 250975

SEQ ID NO: 465174 - RNA, 64 nt, Homo Sapiens; identical to SEQ ID NO: 250976

SEQ ID NO: 465175 - RNA, 64 nt, Homo Sapiens; identical to SEQ ID NO: 250977

SEQ ID NO: 465176 - RNA, 64 nt, Homo Sapiens; identical to SEQ ID NO: 250978

SEQ ID NO: 465177 - RNA, 64 nt, Homo Sapiens; identical to SEQ ID NO: 250979

SEQ ID NO: 465178 - RNA, 64 nt, Homo Sapiens; identical to SEQ ID NO: 250980

SEQ ID NO: 465179 - RNA, 64 nt, Homo Sapiens; identical to SEQ ID NO: 250981

SEQ ID NO: 465180 - RNA, 64 nt, Homo Sapiens; identical to SEQ ID NO: 250982

SEQ ID NO: 465181 - RNA, 64 nt, Homo Sapiens; identical to SEQ ID NO: 250983

SEQ ID NO: 465182 - RNA, 64 nt, Homo Sapiens; identical to SEQ ID NO: 250984

SEQ ID NO: 465183 - RNA, 64 nt, Homo Sapiens; identical to SEQ ID NO: 250985

SEQ ID NO: 465184 - RNA, 64 nt, Homo Sapiens; identical to SEQ ID NO: 250986

SEQ ID NO: 465185 - RNA, 64 nt, Homo Sapiens
auagauggauggauggauggacggauggggugggggaaggaaggaaaggagggagaaaggaggg

SEQ ID NO: 465186 - RNA, 64 nt, Homo Sapiens
auggauggauggauggacggauggggugggggaaggaaggaaaggagggagaaaggagggaaua

SEQ ID NO: 465187 - RNA, 64 nt, Homo Sapiens
agacaggugggagauggagguagggcuggcuggaggaaggaaacaacaaaggaagugagguagu

SEQ ID NO: 465188 - RNA, 64 nt, Homo Sapiens
acaucugaggaaaauggaagaccuaaggcagacaggaaggaagcacaaaagacaagcauugggu

SEQ ID NO: 465189 - RNA, 64 nt, Homo Sapiens
ugaucccuccagaagucucccgggggguggggaaggaaggaacagagcaucugcuguuugagga

SEQ ID NO: 465190 - RNA, 64 nt, Homo Sapiens
aacaugaucccuccagaaguaggacgggggguggggaaggaagggggggagcaucugcuguuug

SEQ ID NO: 465191 - RNA, 64 nt, Homo Sapiens
gaacggaguuagcucccaggaguggguaagggcaggaaggaaauggccugcccacaggacaaga

SEQ ID NO: 465192 - RNA, 64 nt, Homo Sapiens
cucugucuucaacucuuugacuagcaggcaugugggaaggaaggauauuuuaaagauuucugag

SEQ ID NO: 465193 - RNA, 64 nt, Homo Sapiens
uaauacuuugaagucaugagagaaacugacuuggggaaggaauuuccuccucaaaaacugauuc

SEQ ID NO: 465194 - RNA, 64 nt, Homo Sapiens
ggaggagcagggaaaucagagagucugauuuuuaggaaggaauaucaagacuacuggucacaau

SEQ ID NO: 465195 - RNA, 64 nt, Homo Sapiens
gagagagcaggaucccuggagagaaaguuggugaggaaggaaugcugucauucaaauuggauag

SEQ ID NO: 465196 - RNA, 64 nt, Homo Sapiens
aaugcaccuucucuugcugacccuaccuuggacaggaaggaaguccugacccccucccagcccu

SEQ ID NO: 465197 - RNA, 64 nt, Homo Sapiens
agaagcagaggggccucuaccauacuugaugcagggaaggaaccccagccucuugcaguauucc

SEQ ID NO: 465198 - RNA, 64 nt, Homo Sapiens
uccuauuuugggguaucaguaaucuucagaggaaggaaggaaaaccucuuggauuuuuugaaau

SEQ ID NO: 465199 - RNA, 64 nt, Homo Sapiens
aaaauccuauuuugggguauaaauaaucuucagaggaaggaagguauuccucuuggauuuuuug

SEQ ID NO: 465200 - RNA, 64 nt, Homo Sapiens
cuaacaauuucucauacuuagugggaagaccaaaggaaggaacgugccucuuguggugaggggu

SEQ ID NO: 465201 - RNA, 64 nt, Homo Sapiens
auacacuuccacccuuuuuuacugguuuccccagggaaggaaaauucguuagaaugucugccuu

SEQ ID NO: 465202 - RNA, 64 nt, Homo Sapiens
uccucagaacaaugaaaaaagucuccauaggacaggaaggaaugcaaaacucauuuacacagug

SEQ ID NO: 465203 - RNA, 64 nt, Homo Sapiens
gcuccggaaagaugagcuuuuuauucuacuacuuggaaggaaaaggaauuccugguccaccuga

SEQ ID NO: 465204 - RNA, 64 nt, Homo Sapiens
ggguugugccaagguauugacaaauugaaaagcaggaaggaagacaguagcaaauauuuauuga

SEQ ID NO: 465205 - RNA, 64 nt, Homo Sapiens
acuuuuuaaaaaauaaaaacagggaaugcaaucaggaaggaaagaagcacauacaaaagaagac

SEQ ID NO: 465206 - RNA, 64 nt, Homo Sapiens
auuuugagaauauauugagaaaaaggaagaggaaggaaggaaaucacuuagaaagaaaagacag

SEQ ID NO: 465207 - RNA, 64 nt, Homo Sapiens
aaauauuuugagaauauauuacagaaaaggaagaggaaggaagguacacacuuagaaagaaaag

SEQ ID NO: 465208 - RNA, 64 nt, Homo Sapiens
cugggacaagcagggaacgccugggguggaggauggaaggaaagggccagucccugcauccucc

SEQ ID NO: 465209 - RNA, 64 nt, Homo Sapiens
guuuguguagaagagagagagagaggaagagaagggaaggaagugaagggaagagaggaagaac

SEQ ID NO: 465210 - RNA, 64 nt, Homo Sapiens
cagggaaggugauugcugcuaccaacuuuugguaggaaggaaaagcuuuacauuauuugcugau

SEQ ID NO: 465211 - RNA, 64 nt, Homo Sapiens
cuguugcauaucaauuguagauugugucaaucuuggaaggaaaguuuuauagaguauaugguau

SEQ ID NO: 465212 - RNA, 64 nt, Homo Sapiens
caaaaaaaaaccccacaaucuaggaugggaacaaggaaggaaagaugugaauaggcugaugggc

SEQ ID NO: 465213 - RNA, 64 nt, Homo Sapiens
ucaacauagugagacacugucucuaccaaaaaaaggaaggaagggacacauaucaaacugaaac

SEQ ID NO: 465214 - RNA, 64 nt, Homo Sapiens
caaggcugucuguccauccgaguggaccgaggaaggaaggaaggccuggaucccaggagaaagg

SEQ ID NO: 465215 - RNA, 64 nt, Homo Sapiens
aaggcaaggcugucuguccaaaggaguggaccgaggaaggaaggcaacccuggaucccaggaga

SEQ ID NO: 465216 - RNA, 64 nt, Homo Sapiens
ugaguaucccugccaccaagagagcaaugggcagggaaggaaggggucugccgaccccagcucg

SEQ ID NO: 465217 - RNA, 64 nt, Homo Sapiens
guacuuguggaaagguguguuugcguagccuuagggaaggaaggcaauugcuccuuaacagcag

SEQ ID NO: 465218 - RNA, 64 nt, Homo Sapiens
aauucuucauuuuaaaaauuuuuggccaaaggaaggaaggaacuucccaaguuucccaggcacu

SEQ ID NO: 465219 - RNA, 64 nt, Homo Sapiens
aacuaauucuucauuuuaaacacuuuuggccaaaggaaggaagguucaucccaaguuucccagg

SEQ ID NO: 465220 - RNA, 64 nt, Homo Sapiens
auccaacugaccuagugaagguucagaugcaaauggaaggaaaaaggaaacuggaaggaaaacc

SEQ ID NO: 465221 - RNA, 64 nt, Homo Sapiens
agguucagaugcaaauggaaggaaaaaggaaacuggaaggaaaaccauugcgguaaguucucca

SEQ ID NO: 465222 - RNA, 64 nt, Homo Sapiens
uuugugguuauaaacuaagagcuugauaggaguuggaaggaaacucuuacuaaaauguuaacuu

SEQ ID NO: 465223 - RNA, 64 nt, Homo Sapiens
guagcagcuguugaguaacuuucauuggagguugggaaggaagugaggagaaaguguucuuguu

SEQ ID NO: 465224 - RNA, 64 nt, Homo Sapiens
ugcuugcagggaaccgacugaguaaugaagaagaggaaggaagcccuuggaaggaacguaaaau

SEQ ID NO: 465225 - RNA, 64 nt, Homo Sapiens
cgacugaguaaugaagaagaggaaggaagcccuuggaaggaacguaaaauccauuucagccugc

SEQ ID NO: 465226 - RNA, 64 nt, Homo Sapiens
augauccuccugagacuaacuauaagaaaugaauggaaggaaauuucaaguggauaacaauauu

SEQ ID NO: 465227 - RNA, 64 nt, Homo Sapiens
aagggagggaaacagggagaaaggaaggaagaaaggaaggaaaguucagugaauucuaagaagg

SEQ ID NO: 465228 - RNA, 64 nt, Homo Sapiens
aaggaaggaaagaagggaggauucuaagaaggaaggaaggaagaccuaggaaauacuucaguga

SEQ ID NO: 465229 - RNA, 64 nt, Homo Sapiens
aagaaaggaaggaaagaagggugaauucuaagaaggaaggaagggcuaccuaggaaauacuuca

SEQ ID NO: 465230 - RNA, 64 nt, Homo Sapiens
ggagaaucucucagcacacgaccauggcugcucaggaaggaagugcuguggaaugagagagaaa

SEQ ID NO: 465231 - RNA, 64 nt, Homo Sapiens
accugaauuauaucugcaaacuugacauucaaauggaaggaaccuuuauagcuucaaagugugg

SEQ ID NO: 465232 - RNA, 64 nt, Homo Sapiens
cugagggccaugaaagccacagaggaugggcugaggaaggaaagaaaugggguuacugcuccca

SEQ ID NO: 465233 - RNA, 64 nt, Homo Sapiens
guugcauuaagcuuuuucaauaaaggaaaauuacggaaggaaaauaggcaacaccagcaaauua

SEQ ID NO: 465234 - RNA, 64 nt, Homo Sapiens
acguggaggagggacggaggagcucucagccuuaggaaggaagcuuggggaaggucuucaguug

SEQ ID NO: 465235 - RNA, 64 nt, Homo Sapiens
aagggaccccucuccaguccgggcagaaccaauuggaaggaagacucuacaggugucuucuggg

SEQ ID NO: 465236 - RNA, 64 nt, Homo Sapiens
aaaggauauaggaagagaggaaugaaagaaggcaggaaggaaaguagagaagaagaaauggaaa

SEQ ID NO: 465237 - RNA, 64 nt, Homo Sapiens
gcuggugacuaaaauaagguuauuuaugugcuauggaaggaaaugucaauguacauuuugaaca

SEQ ID NO: 465238 - RNA, 64 nt, Homo Sapiens
cuacuuucccuauucuuauggagguaaaaggaaaggaaggaaggaaaaagcagcuuucacuuac

SEQ ID NO: 465239 - RNA, 64 nt, Homo Sapiens
uuucccuauucuuauggagguaaaaggaaaggaaggaaggaaaaagcagcuuucacuuacaaag

SEQ ID NO: 465240 - RNA, 64 nt, Homo Sapiens
aucaaggaaccaagcgccucagguuagaagggaaggaaggaaaguucccacuccuuccggagua

SEQ ID NO: 465241 - RNA, 64 nt, Homo Sapiens
aaagaucaaggaaccaagcgaguaagguuagaagggaaggaaggccccuucccacuccuuccgg

SEQ ID NO: 465242 - RNA, 64 nt, Homo Sapiens
agaauauugcauggagcacagugcuuccaaaacuggaaggaauuggccuggauuaggagucuua

SEQ ID NO: 465243 - RNA, 64 nt, Homo Sapiens
ccauuuucacuaaacaauaaaaucuaaauaaauuggaaggaauaacaaccacaaaggaaagaau

SEQ ID NO: 465244 - RNA, 64 nt, Homo Sapiens
ggaaccagaugcagaagagguauaaaagauacauggaaggaaguuuauaauuugauaaggugau

SEQ ID NO: 465245 - RNA, 64 nt, Homo Sapiens
uuugguuugguuuuauucucuuggaaacucaaguggaaggaagagagaguaagguguccuuaug

SEQ ID NO: 465246 - RNA, 64 nt, Homo Sapiens
ggaccaaggucuucagaggucgugaagccacccuggaaggaacugggaggcagggauggcaagg

SEQ ID NO: 465247 - RNA, 64 nt, Homo Sapiens
gcauccgagaugcugggcggggcaggugccaccgggaaggaauguucgauuucggcaaagccug

SEQ ID NO: 465248 - RNA, 64 nt, Homo Sapiens
ggagacucugucucgaaagaaagaaagaaaaaaaggaaggaaggagaaggaaggaaggagaaga

SEQ ID NO: 465249 - RNA, 64 nt, Homo Sapiens
gaaagaaagaaagaaaaaaaggaaggaaggagaaggaaggaaggagaagaaaagguaccuguuc

SEQ ID NO: 465250 - RNA, 64 nt, Homo Sapiens
ggcuggagcuccaugcacguaguccagaugccugggaaggaacaucucccuuccagcaucugcu

SEQ ID NO: 465251 - RNA, 64 nt, Homo Sapiens
acaguucugaccuuuuuuguccaguuucuuugggggaaggaagacaaagaagguaggaacggaa

SEQ ID NO: 465252 - RNA, 64 nt, Homo Sapiens
acuuguuacugaaagagacuaaagaaagaaggaaggaaggaaaaauaauuggacaaagagagag

SEQ ID NO: 465253 - RNA, 64 nt, Homo Sapiens
aaaaacuuguuacugaaagaagagaaagaaagaaggaaggaaggauugauaauuggacaaagag

SEQ ID NO: 465254 - RNA, 64 nt, Homo Sapiens
cgguggcggucacucccucugccacuauccccagggaaggaaaggcuccgccauuugggaaagu

SEQ ID NO: 465255 - RNA, 64 nt, Homo Sapiens
auggucccaaaguacggcagcugcaaaaaguaguggaaggaaauugucuacgugucuuggaaaa

SEQ ID NO: 465256 - RNA, 64 nt, Homo Sapiens
gcugcuggagcccagucaccacggaagcaaggaaggaaggaaggggaaggaggaggaaggaagg

SEQ ID NO: 465257 - RNA, 64 nt, Homo Sapiens
aagggcugcuggagcccaguaaggacggaagcaaggaaggaaggagacggaaggaggaggaagg

SEQ ID NO: 465258 - RNA, 64 nt, Homo Sapiens
acggaagcaaggaaggaaggagacggaaggaggaggaaggaaggcggaugcaggaaggaggugc

SEQ ID NO: 465259 - RNA, 64 nt, Homo Sapiens
uuuuuuuuguuguuuguuugugagcacagacuuuggaaggaacccaguuagggaagggagccau

SEQ ID NO: 465260 - RNA, 64 nt, Homo Sapiens
ccaggcgguaggggacuggucuggcccaggcaggggaaggaagauugggaguugugcagggacu

SEQ ID NO: 465261 - RNA, 64 nt, Homo Sapiens
uaauauuauggauuuagccugggggguuugggaaggaaggaauguacuuuaauguuuuaagugu

SEQ ID NO: 465262 - RNA, 64 nt, Homo Sapiens
aauguaauauuauggauuuagugugggggguuugggaaggaagguuaauacuuuaauguuuuaa

SEQ ID NO: 465263 - RNA, 64 nt, Homo Sapiens
cacaaaucaacugaucuacuacuugggagacaguggaaggaaagauagagggaaggaaguucac

SEQ ID NO: 465264 - RNA, 64 nt, Homo Sapiens
uacuacuugggagacaguggaaggaaagauagagggaaggaaguucacucacuugaauuugaau

SEQ ID NO: 465265 - RNA, 64 nt, Homo Sapiens
ugaaaaauaaaaauuuauaauuugcccuugaauuggaaggaauggagauuagggaaggaaaacu

SEQ ID NO: 465266 - RNA, 64 nt, Homo Sapiens
aauuugcccuugaauuggaaggaauggagauuagggaaggaaaacuacucuagaggccauuuaa

SEQ ID NO: 465267 - RNA, 64 nt, Homo Sapiens
auugcccacuguucucauagcuaaaaguuaagaaggaaggaaggaaagcaggagaaaggaagga

SEQ ID NO: 465268 - RNA, 64 nt, Homo Sapiens
cccacuguucucauagcuaaaaguuaagaaggaaggaaggaaagcaggagaaaggaaggauuaa

SEQ ID NO: 465269 - RNA, 64 nt, Homo Sapiens
gagaaauuggaauguuuuaacaauaaagaaagauggaaggaagggcaaaaucuugagaaucaau

SEQ ID NO: 465270 - RNA, 64 nt, Homo Sapiens
aaaaagaaaaaauuuaaaaauaaaacaaaaaaaaggaaggaaaauaaaacaaaacaaaacaaaa

SEQ ID NO: 465271 - RNA, 64 nt, Homo Sapiens
gaggagaaaaaugugucuucauggaaggaagggaggaaggaaagaguuuacauacaggagaaug

SEQ ID NO: 465272 - RNA, 64 nt, Homo Sapiens
gaggaaggaaaggaggagaauacaggagaaugauggaaggaaggcuagguaccgugaguuuaca

SEQ ID NO: 465273 - RNA, 64 nt, Homo Sapiens
agcggggagcacugaugaggugcuggggaugacaggaaggaaggaacacugggcagaaccagag

SEQ ID NO: 465274 - RNA, 64 nt, Homo Sapiens
gggagcacugaugaggugcuggggaugacaggaaggaaggaacacugggcagaaccagagagau

SEQ ID NO: 465275 - RNA, 64 nt, Homo Sapiens
uagaggagcuauguggagcaaaggccgacagaggggaaggaauggaccugugagaggaagggaa

SEQ ID NO: 465276 - RNA, 64 nt, Homo Sapiens
gcagaaagucucauuucaggaaggagggauagaaggaaggaaggaaggaacccccccccccccg

SEQ ID NO: 465277 - RNA, 64 nt, Homo Sapiens
aaagucucauuucaggaaggagggauagaaggaaggaaggaaggaacccccccccccccgaaaa

SEQ ID NO: 465278 - RNA, 64 nt, Homo Sapiens
ucucauuucaggaaggagggauagaaggaaggaaggaaggaacccccccccccccgaaaaaaaa

SEQ ID NO: 465279 - RNA, 64 nt, Homo Sapiens
ggguuucuugggcugguugauuccccucagggauggaaggaagauguaguucccaccaguugcc

SEQ ID NO: 465280 - RNA, 64 nt, Homo Sapiens
aaccccuucccucuccaccuauuuggugggguauggaaggaacuuucuaaaaugagagauaggg

SEQ ID NO: 465281 - RNA, 64 nt, Homo Sapiens
cucucgggugggggagccaggucagagagacccgggaaggaagggccuguggggagccgagggc

SEQ ID NO: 465282 - RNA, 64 nt, Homo Sapiens
gagagggagcaggcggagcggaggaggaauaaggggaaggaagaggggugguagucagaggagg

SEQ ID NO: 465283 - RNA, 64 nt, Homo Sapiens
uuauuuuuggagccacucucggugguguggugcuggaaggaaggugaagugaauucucugagcu

SEQ ID NO: 465284 - RNA, 64 nt, Homo Sapiens
cauccuuccuugauauauauuauuuagagaucaaggaaggaagucuccgauguggagagggugu

SEQ ID NO: 465285 - RNA, 64 nt, Homo Sapiens
agagagaaagaaagaaagaaagaaagggaaagauggaaggaaggaaggaaaaagaaagagaaag

SEQ ID NO: 465286 - RNA, 64 nt, Homo Sapiens
agaaagaaagaaagaaagaaagggaaagauggaaggaaggaaggaaaaagaaagagaaagagag

SEQ ID NO: 465287 - RNA, 64 nt, Homo Sapiens
agaaagaaagaaagaaagggaaagauggaaggaaggaaggaaaaagaaagagaaagagagagag

SEQ ID NO: 465288 - RNA, 64 nt, Homo Sapiens
gggggccccagccccaggccaccugccuguggcaggaaggaaugugcaucccgccucccugggg

SEQ ID NO: 465289 - RNA, 64 nt, Homo Sapiens
augaggacagucccgucguaaggggaagaccuggggaaggaagacaaggccaacagggcagggg

SEQ ID NO: 465290 - RNA, 64 nt, Homo Sapiens
ggaggggagaggaggggaagaggaaaggaaggaaggaaggaaaaaaauggugcucagugcucca

SEQ ID NO: 465291 - RNA, 64 nt, Homo Sapiens
aaaaggaggggagaggaggguccaaggaaaggaaggaaggaagguuccaaauggugcucagugc

SEQ ID NO: 465292 - RNA, 64 nt, Homo Sapiens
aaggaaaaggaggggagagggugcuccaaggaaaggaaggaaggaagcuuccaaauggugcuca

SEQ ID NO: 465293 - RNA, 64 nt, Homo Sapiens
aaggaagggaggacccaauccaggaagaaaggaaggaaggaaagauguagcuucucaggggagg

SEQ ID NO: 465294 - RNA, 64 nt, Homo Sapiens
aaagaaggaagggaggacccgaggcaggaagaaaggaaggaaggaaaaauguagcuucucaggg

SEQ ID NO: 465295 - RNA, 64 nt, Homo Sapiens
ugucugucugugucugcauguaagagugagggagggaaggaaggaacuacaagagagucggaga

SEQ ID NO: 465296 - RNA, 64 nt, Homo Sapiens
ugucugugucugcauguaagagugagggagggaaggaaggaacuacaagagagucggagaugau

SEQ ID NO: 465297 - RNA, 64 nt, Homo Sapiens
uacucuuuuagucaggauuucggucuuuucugcgggaaggaauuaagcuauguauuagguccac

SEQ ID NO: 465298 - RNA, 64 nt, Homo Sapiens
gucacguggcucccccuagccgcacacuagugugggaaggaaaauauugagcuaggcacauuac

SEQ ID NO: 465299 - RNA, 64 nt, Homo Sapiens
auaguagcaauggauacuuugaguguuauaagguggaaggaaacucauuuuucaggaaaguuuu

SEQ ID NO: 465300 - RNA, 64 nt, Homo Sapiens
agagaaggaaagagagagaggcaacauagaagagggaaggaaagcccucugcccuacccgcuca

SEQ ID NO: 465301 - RNA, 62 nt, Homo Sapiens
agggcucuagacccgagcccgacugaguccucuccccaaauccccugcagucuggguuccca

SEQ ID NO: 465302 - RNA, 62 nt, Homo Sapiens
gguacucccugacccagggccccacuccagcauccccaaacucugggcuccaggauugucuc

SEQ ID NO: 465303 - RNA, 62 nt, Homo Sapiens
ugucccccacagcucaugcguuggaaacuuaauccccaaagcaacagcuuugagaggugaga

SEQ ID NO: 465304 - RNA, 62 nt, Homo Sapiens
uccugauaaaaggaugaguucggccuucuucuuccccaaaaucuuuauccccacccccaccu

SEQ ID NO: 465305 - RNA, 62 nt, Homo Sapiens
augugaggcauugucaccuuccgaacugccucuccccaaagagauugugcgcacacucguuu

SEQ ID NO: 465306 - RNA, 62 nt, Homo Sapiens
cuagacgugaccuggcagauauucagucccucuccccaaagagaaauguucucaauugagca

SEQ ID NO: 465307 - RNA, 62 nt, Homo Sapiens
ucuucuaagccuguguguuauaauuuaccaguuccccaaaaugccauuuuuaacgccgaacu

SEQ ID NO: 465308 - RNA, 62 nt, Homo Sapiens
aaauaaaauaaaaaauauuugucuccaccuuuuccccaaaagcaacagcaagacauauuuug

SEQ ID NO: 465309 - RNA, 62 nt, Homo Sapiens
cacacacacacacacauacauccugcuuucccuccccaaacccaucagacagguaaaugggc

SEQ ID NO: 465310 - RNA, 62 nt, Homo Sapiens
gucucucucucccuuuuaaauggugggaacccuccccaaaaccuuuccccagacacauucuc

SEQ ID NO: 465311 - RNA, 62 nt, Homo Sapiens
cauguggccuaagagcucuggggagcccacacuccccaaagcaguuagacuauggagagccg

SEQ ID NO: 465312 - RNA, 62 nt, Homo Sapiens
uuauuaaagaucauauggggaaaaugaaacccuccccaaaauacaagaaguucugggaggag

SEQ ID NO: 465313 - RNA, 62 nt, Homo Sapiens
auggcauuucucuuugaaauuuaccuuugugguccccaaaugaagcuuuuugagggcaaacu

SEQ ID NO: 465314 - RNA, 62 nt, Homo Sapiens
uguucuguaaauaauauuauggguaguuacuauccccaaaucguuuacuucuaaacccacuu

SEQ ID NO: 465315 - RNA, 62 nt, Homo Sapiens
ggguaaccuagacuucagaggccuauaauggguccccaaaaucuuugggaacuguguuuauu

SEQ ID NO: 465316 - RNA, 62 nt, Homo Sapiens
uuuaucugucuugacuuuuuuuuuuuuccgucuccccaaagcaucuggucuuuuuuuuuuuu

SEQ ID NO: 465317 - RNA, 62 nt, Homo Sapiens
acuugaagucaguuuuagauaucagcagccucuccccaaaguuucuuauuuuggcauucgau

SEQ ID NO: 465318 - RNA, 62 nt, Homo Sapiens
guugcgcaucagcaccuggggcucgccaguccuccccaaagauggcugcugcuuucugccca

SEQ ID NO: 465319 - RNA, 62 nt, Homo Sapiens
cuuaauugcuuuauuuugguuguacuuugaauuccccaaaguaauaaucguuuuuguuuucu

SEQ ID NO: 465320 - RNA, 62 nt, Homo Sapiens
gacaauuuguuguacccaugaauucuuggucuuccccaaagaagccccaguuuugacagaau

SEQ ID NO: 465321 - RNA, 62 nt, Homo Sapiens
auuauaagcauugcagucagggaggcccaggauccccaaaauucaucccuuaauguucucaa

SEQ ID NO: 465322 - RNA, 62 nt, Homo Sapiens
auccuuuauagcuguuuauuauucuccaguuguccccaaaauauauaugauccauauucaaa

SEQ ID NO: 465323 - RNA, 62 nt, Homo Sapiens
agagaauagcccgccaucccuccucucuguguuccccaaaucacuuuccacuuugcccccug

SEQ ID NO: 465324 - RNA, 62 nt, Homo Sapiens
aaggcuauuggacaucugcagggggcauuugguccccaaauugaucugucuuuccaauggcc

SEQ ID NO: 465325 - RNA, 62 nt, Homo Sapiens
ccagaauuuuuuaucuagagaccagcauguucuccccaaagaccaagauauucugccaaaau

SEQ ID NO: 465326 - RNA, 62 nt, Homo Sapiens
ccagaauuuuuugucuagagaccagcauguucuccccaaagaccagaauauucuaccuaaau

SEQ ID NO: 465327 - RNA, 62 nt, Homo Sapiens
ccaggacuuuuuaucuagagaccagcauguucuccccaaagacuggaauauucuacccaaau

SEQ ID NO: 465328 - RNA, 62 nt, Homo Sapiens
gcugcuauugaagaacuucccuacacgugauguccccaaacuuucaggaaauaucgacaggg

SEQ ID NO: 465329 - RNA, 62 nt, Homo Sapiens
gaggcucauggugggaggccuaaagcauagauuccccaaaguaggcaagaauaugccccaac

SEQ ID NO: 465330 - RNA, 62 nt, Homo Sapiens
agagacauaaucccgguccuggguauaugguauccccaaacacagucaccacacaaggcacu

SEQ ID NO: 465331 - RNA, 62 nt, Homo Sapiens
auuauauuuuuucuauaaaaucauggucacucuccccaaaaucuccuuuccacugcuauuag

SEQ ID NO: 465332 - RNA, 62 nt, Homo Sapiens
ggggaagccaauggccugucuccccacuaccauccccaaacgcuccuuggggcgugguuccu

SEQ ID NO: 465333 - RNA, 62 nt, Homo Sapiens
gaauguuuugaaaggccagaggguggccuuuuuccccaaacaguuugguuccuuuuauguuu

SEQ ID NO: 465334 - RNA, 62 nt, Homo Sapiens
uggccuugugcagacccuggacugcauccgguuccccaaagcccugcugcauucgagugucc

SEQ ID NO: 465335 - RNA, 62 nt, Homo Sapiens
ccagggccccuguucuagggguuaggguucuuuccccaaaggaacuuaaaaagacaagcgug

SEQ ID NO: 465336 - RNA, 62 nt, Homo Sapiens
ccaagccccgugcuagcagcgcuccgugcucuuccccaaauacucacggcucuaauucccca

SEQ ID NO: 465337 - RNA, 62 nt, Homo Sapiens
cgugcucuuccccaaauacucacggcucuaauuccccaaaccugaaacuucauacccuggga

SEQ ID NO: 465338 - RNA, 62 nt, Homo Sapiens
gugcuacuucaacauagagauuggacaugcucuccccaaaugagccacuuuccucuccaggu

SEQ ID NO: 465339 - RNA, 62 nt, Homo Sapiens
accucuugcacaagccuaaauuccaggaaucuuccccaaaucccagauccucugcaaucuac

SEQ ID NO: 465340 - RNA, 64 nt, Homo Sapiens; identical to SEQ ID NO: 220740

SEQ ID NO: 465341 - RNA, 64 nt, Homo Sapiens; identical to SEQ ID NO: 220741

SEQ ID NO: 465342 - RNA, 64 nt, Homo Sapiens; identical to SEQ ID NO: 220742

SEQ ID NO: 465343 - RNA, 64 nt, Homo Sapiens; identical to SEQ ID NO: 220743

SEQ ID NO: 465344 - RNA, 64 nt, Homo Sapiens; identical to SEQ ID NO: 220744

SEQ ID NO: 465345 - RNA, 64 nt, Homo Sapiens; identical to SEQ ID NO: 220745

SEQ ID NO: 465346 - RNA, 64 nt, Homo Sapiens; identical to SEQ ID NO: 220746

SEQ ID NO: 465347 - RNA, 64 nt, Homo Sapiens; identical to SEQ ID NO: 220747

SEQ ID NO: 465348 - RNA, 64 nt, Homo Sapiens; identical to SEQ ID NO: 220748

SEQ ID NO: 465349 - RNA, 64 nt, Homo Sapiens; identical to SEQ ID NO: 220749

SEQ ID NO: 465350 - RNA, 64 nt, Homo Sapiens; identical to SEQ ID NO: 220750

SEQ ID NO: 465351 - RNA, 64 nt, Homo Sapiens; identical to SEQ ID NO: 220751

SEQ ID NO: 465352 - RNA, 64 nt, Homo Sapiens; identical to SEQ ID NO: 220752

SEQ ID NO: 465353 - RNA, 64 nt, Homo Sapiens; identical to SEQ ID NO: 220753

SEQ ID NO: 465354 - RNA, 64 nt, Homo Sapiens; identical to SEQ ID NO: 220754

SEQ ID NO: 465355 - RNA, 64 nt, Homo Sapiens; identical to SEQ ID NO: 220755

SEQ ID NO: 465356 - RNA, 64 nt, Homo Sapiens; identical to SEQ ID NO: 220756

SEQ ID NO: 465357 - RNA, 64 nt, Homo Sapiens; identical to SEQ ID NO: 220757

SEQ ID NO: 465358 - RNA, 64 nt, Homo Sapiens; identical to SEQ ID NO: 220758

SEQ ID NO: 465359 - RNA, 64 nt, Homo Sapiens; identical to SEQ ID NO: 220759

SEQ ID NO: 465360 - RNA, 64 nt, Homo Sapiens; identical to SEQ ID NO: 220760

SEQ ID NO: 465361 - RNA, 64 nt, Homo Sapiens; identical to SEQ ID NO: 220761

SEQ ID NO: 465362 - RNA, 64 nt, Homo Sapiens; identical to SEQ ID NO: 220762

SEQ ID NO: 465363 - RNA, 64 nt, Homo Sapiens; identical to SEQ ID NO: 220763

SEQ ID NO: 465364 - RNA, 64 nt, Homo Sapiens; identical to SEQ ID NO: 220764

SEQ ID NO: 465365 - RNA, 64 nt, Homo Sapiens; identical to SEQ ID NO: 220765

SEQ ID NO: 465366 - RNA, 64 nt, Homo Sapiens; identical to SEQ ID NO: 220766

SEQ ID NO: 465367 - RNA, 64 nt, Homo Sapiens; identical to SEQ ID NO: 220767

SEQ ID NO: 465368 - RNA, 64 nt, Homo Sapiens; identical to SEQ ID NO: 220768

SEQ ID NO: 465369 - RNA, 64 nt, Homo Sapiens; identical to SEQ ID NO: 220769

SEQ ID NO: 465370 - RNA, 64 nt, Homo Sapiens; identical to SEQ ID NO: 220770

SEQ ID NO: 465371 - RNA, 64 nt, Homo Sapiens; identical to SEQ ID NO: 220771

SEQ ID NO: 465372 - RNA, 64 nt, Homo Sapiens; identical to SEQ ID NO: 220772

SEQ ID NO: 465373 - RNA, 64 nt, Homo Sapiens; identical to SEQ ID NO: 220773

SEQ ID NO: 465374 - RNA, 64 nt, Homo Sapiens; identical to SEQ ID NO: 220774

SEQ ID NO: 465375 - RNA, 64 nt, Homo Sapiens; identical to SEQ ID NO: 220775

SEQ ID NO: 465376 - RNA, 64 nt, Homo Sapiens; identical to SEQ ID NO: 220776

SEQ ID NO: 465377 - RNA, 64 nt, Homo Sapiens; identical to SEQ ID NO: 220777

SEQ ID NO: 465378 - RNA, 64 nt, Homo Sapiens; identical to SEQ ID NO: 220778

SEQ ID NO: 465379 - RNA, 64 nt, Homo Sapiens; identical to SEQ ID NO: 220779

SEQ ID NO: 465380 - RNA, 64 nt, Homo Sapiens; identical to SEQ ID NO: 220780

SEQ ID NO: 465381 - RNA, 64 nt, Homo Sapiens; identical to SEQ ID NO: 220781

SEQ ID NO: 465382 - RNA, 64 nt, Homo Sapiens; identical to SEQ ID NO: 220782

SEQ ID NO: 465383 - RNA, 63 nt, Homo Sapiens; identical to SEQ ID NO: 220783

SEQ ID NO: 465384 - RNA, 64 nt, Homo Sapiens; identical to SEQ ID NO: 220784

SEQ ID NO: 465385 - RNA, 64 nt, Homo Sapiens; identical to SEQ ID NO: 220785

SEQ ID NO: 465386 - RNA, 64 nt, Homo Sapiens; identical to SEQ ID NO: 220786

SEQ ID NO: 465387 - RNA, 64 nt, Homo Sapiens; identical to SEQ ID NO: 220787

SEQ ID NO: 465388 - RNA, 64 nt, Homo Sapiens; identical to SEQ ID NO: 220788

SEQ ID NO: 465389 - RNA, 64 nt, Homo Sapiens; identical to SEQ ID NO: 220789

SEQ ID NO: 465390 - RNA, 64 nt, Homo Sapiens; identical to SEQ ID NO: 220790

SEQ ID NO: 465391 - RNA, 64 nt, Homo Sapiens; identical to SEQ ID NO: 220791

SEQ ID NO: 465392 - RNA, 64 nt, Homo Sapiens; identical to SEQ ID NO: 220792

SEQ ID NO: 465393 - RNA, 64 nt, Homo Sapiens; identical to SEQ ID NO: 220793

SEQ ID NO: 465394 - RNA, 64 nt, Homo Sapiens; identical to SEQ ID NO: 220794

SEQ ID NO: 465395 - RNA, 64 nt, Homo Sapiens; identical to SEQ ID NO: 220795

SEQ ID NO: 465396 - RNA, 56 nt, Homo Sapiens; identical to SEQ ID NO: 220796

SEQ ID NO: 465397 - RNA, 64 nt, Homo Sapiens; identical to SEQ ID NO: 220797

SEQ ID NO: 465398 - RNA, 64 nt, Homo Sapiens; identical to SEQ ID NO: 220798

SEQ ID NO: 465399 - RNA, 64 nt, Homo Sapiens; identical to SEQ ID NO: 220799

SEQ ID NO: 465400 - RNA, 64 nt, Homo Sapiens; identical to SEQ ID NO: 220800

SEQ ID NO: 465401 - RNA, 64 nt, Homo Sapiens; identical to SEQ ID NO: 220801

SEQ ID NO: 465402 - RNA, 64 nt, Homo Sapiens; identical to SEQ ID NO: 220802

SEQ ID NO: 465403 - RNA, 51 nt, Homo Sapiens; identical to SEQ ID NO: 220803

SEQ ID NO: 465404 - RNA, 51 nt, Homo Sapiens; identical to SEQ ID NO: 220804

SEQ ID NO: 465405 - RNA, 51 nt, Homo Sapiens; identical to SEQ ID NO: 220805

SEQ ID NO: 465406 - RNA, 64 nt, Homo Sapiens; identical to SEQ ID NO: 220806

SEQ ID NO: 465407 - RNA, 64 nt, Homo Sapiens; identical to SEQ ID NO: 220807

SEQ ID NO: 465408 - RNA, 64 nt, Homo Sapiens; identical to SEQ ID NO: 220808

SEQ ID NO: 465409 - RNA, 64 nt, Homo Sapiens; identical to SEQ ID NO: 220809

SEQ ID NO: 465410 - RNA, 64 nt, Homo Sapiens; identical to SEQ ID NO: 220810

SEQ ID NO: 465411 - RNA, 64 nt, Homo Sapiens; identical to SEQ ID NO: 220811

SEQ ID NO: 465412 - RNA, 64 nt, Homo Sapiens; identical to SEQ ID NO: 220812

SEQ ID NO: 465413 - RNA, 64 nt, Homo Sapiens; identical to SEQ ID NO: 220813

SEQ ID NO: 465414 - RNA, 64 nt, Homo Sapiens; identical to SEQ ID NO: 220814

SEQ ID NO: 465415 - RNA, 64 nt, Homo Sapiens; identical to SEQ ID NO: 220815

SEQ ID NO: 465416 - RNA, 64 nt, Homo Sapiens
ucgggcaaauugaaaguauaugggaugagcccuaauggaggaaguggaggaauggaaauaaaau

SEQ ID NO: 465417 - RNA, 64 nt, Homo Sapiens
ggaaauaaaauugggaugagaugugaaagggggaauggaggaauauguugcacaaggguuguga

SEQ ID NO: 465418 - RNA, 64 nt, Homo Sapiens
ugaggagacaccaccuaguggagguuuguaggccauggaggaaaccacugugugcauuagcagg

SEQ ID NO: 465419 - RNA, 64 nt, Homo Sapiens
cccaguggcugacaggccaggccaugggccagagauggaggagccuugccugcuggggggccua

SEQ ID NO: 465420 - RNA, 64 nt, Homo Sapiens
ggccuagauccacacacagaggaagagcaggcacauggaggagcuugggggaugacuagaggca

SEQ ID NO: 465421 - RNA, 64 nt, Homo Sapiens
auuuaugaaggcaaaaaaauuaaauuauuuauuuauggaggauggagagaggggaauaauagaa

SEQ ID NO: 465422 - RNA, 64 nt, Homo Sapiens
aggccgcuucgcggguggagcccucugccuggccauggaggaaggaucccgcuaggcugguccc

SEQ ID NO: 465423 - RNA, 64 nt, Homo Sapiens
acuucggugacuucauccaccugucuauuugcacauggaggacuuuucaagaugucaggauacc

SEQ ID NO: 465424 - RNA, 64 nt, Homo Sapiens
gucucaccaacaagugaggauauagccuuaucucauggaggacgagcuccguauuuacucagga

SEQ ID NO: 465425 - RNA, 64 nt, Homo Sapiens
acucaggagcagucaggguacauuacauaaaacaauggaggaugccucauuuuagcaaacuagg

SEQ ID NO: 465426 - RNA, 64 nt, Homo Sapiens
ugcuggcugcugcugccucgcgcgcugggguuccauggaggaacugggccugccgccccggccu

SEQ ID NO: 465427 - RNA, 64 nt, Homo Sapiens
ccggccucaccugcugcccgcaugcuggggucccauggaggaaccaggccuggcgccccggccu

SEQ ID NO: 465428 - RNA, 64 nt, Homo Sapiens
ccugugccaggagccaaccuaggugcccaagaagauggaggaucuggccugcuggcaaugccac

SEQ ID NO: 465429 - RNA, 64 nt, Homo Sapiens
caguaccagaguuuacagagccguggggcaccccauggaggacauugagaagagagcccgcucu

SEQ ID NO: 465430 - RNA, 64 nt, Homo Sapiens
gaagaaaaugacacauugauuucaagguacaguuauggaggaaacugcaggucagcaguaaggu

SEQ ID NO: 465431 - RNA, 64 nt, Homo Sapiens
ccgcccccaugauccaguuaaucacaggaacagcauggaggaaaucucaugagaccggcucacu

SEQ ID NO: 465432 - RNA, 64 nt, Homo Sapiens
gcgagaagaaaggaagagaaggacggaauggaggauggaggacaccgggacugggcuaggaguu

SEQ ID NO: 465433 - RNA, 64 nt, Homo Sapiens
gaggacagcgagaagaaaggaggaguuggacggaauggaggaugggcgcccccgggacugggcu

SEQ ID NO: 465434 - RNA, 64 nt, Homo Sapiens
gugccugcuagaggagcucuguguucccaaggagauggaggaagaccuggggugggggugguac

SEQ ID NO: 465435 - RNA, 64 nt, Homo Sapiens
cagaggcugugaacagggagaugggggaggggggauggaggacucaagggauguaagggauaug

SEQ ID NO: 465436 - RNA, 64 nt, Homo Sapiens
acacauacacacauguauauauauauucuucauaauggaggacaauguuuugcaauauauaaau

SEQ ID NO: 465437 - RNA, 64 nt, Homo Sapiens
guucuuuauuagugccucucacaaaagauccuggauggaggaguaagaugaaauauuaugcuau

SEQ ID NO: 465438 - RNA, 64 nt, Homo Sapiens
ugccccucugagucaggagccugguggggacaagauggaggauguccacagaggcugaccugug

SEQ ID NO: 465439 - RNA, 64 nt, Homo Sapiens
ugcaagaauauucauauuauaaaugucucaucugauggaggaacgugugcauuuagagagaggg

SEQ ID NO: 465440 - RNA, 64 nt, Homo Sapiens; identical to SEQ ID NO: 285072

SEQ ID NO: 465441 - RNA, 64 nt, Homo Sapiens; identical to SEQ ID NO: 285073

SEQ ID NO: 465442 - RNA, 64 nt, Homo Sapiens; identical to SEQ ID NO: 285074

SEQ ID NO: 465443 - RNA, 64 nt, Homo Sapiens; identical to SEQ ID NO: 285075

SEQ ID NO: 465444 - RNA, 64 nt, Homo Sapiens; identical to SEQ ID NO: 285076

SEQ ID NO: 465445 - RNA, 64 nt, Homo Sapiens; identical to SEQ ID NO: 285077

SEQ ID NO: 465446 - RNA, 64 nt, Homo Sapiens; identical to SEQ ID NO: 285078

SEQ ID NO: 465447 - RNA, 64 nt, Homo Sapiens; identical to SEQ ID NO: 285079

SEQ ID NO: 465448 - RNA, 64 nt, Homo Sapiens; identical to SEQ ID NO: 285080

SEQ ID NO: 465449 - RNA, 64 nt, Homo Sapiens; identical to SEQ ID NO: 285081

SEQ ID NO: 465450 - RNA, 64 nt, Homo Sapiens; identical to SEQ ID NO: 285082

SEQ ID NO: 465451 - RNA, 64 nt, Homo Sapiens; identical to SEQ ID NO: 285083

SEQ ID NO: 465452 - RNA, 64 nt, Homo Sapiens; identical to SEQ ID NO: 285084

SEQ ID NO: 465453 - RNA, 64 nt, Homo Sapiens; identical to SEQ ID NO: 285085

SEQ ID NO: 465454 - RNA, 64 nt, Homo Sapiens; identical to SEQ ID NO: 285086

SEQ ID NO: 465455 - RNA, 64 nt, Homo Sapiens; identical to SEQ ID NO: 285087

SEQ ID NO: 465456 - RNA, 64 nt, Homo Sapiens; identical to SEQ ID NO: 285088

SEQ ID NO: 465457 - RNA, 64 nt, Homo Sapiens; identical to SEQ ID NO: 285089

SEQ ID NO: 465458 - RNA, 64 nt, Homo Sapiens; identical to SEQ ID NO: 285090

SEQ ID NO: 465459 - RNA, 64 nt, Homo Sapiens; identical to SEQ ID NO: 285091

SEQ ID NO: 465460 - RNA, 62 nt, Homo Sapiens; identical to SEQ ID NO: 285092

SEQ ID NO: 465461 - RNA, 64 nt, Homo Sapiens; identical to SEQ ID NO: 285093

SEQ ID NO: 465462 - RNA, 64 nt, Homo Sapiens; identical to SEQ ID NO: 285094

SEQ ID NO: 465463 - RNA, 64 nt, Homo Sapiens; identical to SEQ ID NO: 285095

SEQ ID NO: 465464 - RNA, 64 nt, Homo Sapiens; identical to SEQ ID NO: 285096

SEQ ID NO: 465465 - RNA, 64 nt, Homo Sapiens; identical to SEQ ID NO: 285097

SEQ ID NO: 465466 - RNA, 64 nt, Homo Sapiens; identical to SEQ ID NO: 285098

SEQ ID NO: 465467 - RNA, 64 nt, Homo Sapiens; identical to SEQ ID NO: 285099

SEQ ID NO: 465468 - RNA, 64 nt, Homo Sapiens; identical to SEQ ID NO: 285100

SEQ ID NO: 465469 - RNA, 64 nt, Homo Sapiens; identical to SEQ ID NO: 285101

SEQ ID NO: 465470 - RNA, 64 nt, Homo Sapiens; identical to SEQ ID NO: 93186

SEQ ID NO: 465471 - RNA, 64 nt, Homo Sapiens; identical to SEQ ID NO: 93187

SEQ ID NO: 465472 - RNA, 64 nt, Homo Sapiens; identical to SEQ ID NO: 93188

SEQ ID NO: 465473 - RNA, 64 nt, Homo Sapiens; identical to SEQ ID NO: 93189

SEQ ID NO: 465474 - RNA, 64 nt, Homo Sapiens; identical to SEQ ID NO: 93190

SEQ ID NO: 465475 - RNA, 64 nt, Homo Sapiens; identical to SEQ ID NO: 93191

SEQ ID NO: 465476 - RNA, 64 nt, Homo Sapiens; identical to SEQ ID NO: 93192

SEQ ID NO: 465477 - RNA, 64 nt, Homo Sapiens; identical to SEQ ID NO: 93193

SEQ ID NO: 465478 - RNA, 64 nt, Homo Sapiens; identical to SEQ ID NO: 93194

SEQ ID NO: 465479 - RNA, 64 nt, Homo Sapiens; identical to SEQ ID NO: 93195

SEQ ID NO: 465480 - RNA, 64 nt, Homo Sapiens; identical to SEQ ID NO: 93196

SEQ ID NO: 465481 - RNA, 64 nt, Homo Sapiens; identical to SEQ ID NO: 93197

SEQ ID NO: 465482 - RNA, 64 nt, Homo Sapiens; identical to SEQ ID NO: 93198

SEQ ID NO: 465483 - RNA, 64 nt, Homo Sapiens; identical to SEQ ID NO: 93199

SEQ ID NO: 465484 - RNA, 64 nt, Homo Sapiens; identical to SEQ ID NO: 209146

SEQ ID NO: 465485 - RNA, 63 nt, Homo Sapiens; identical to SEQ ID NO: 209147

SEQ ID NO: 465486 - RNA, 64 nt, Homo Sapiens; identical to SEQ ID NO: 209148

SEQ ID NO: 465487 - RNA, 64 nt, Homo Sapiens; identical to SEQ ID NO: 209149

SEQ ID NO: 465488 - RNA, 64 nt, Homo Sapiens; identical to SEQ ID NO: 380092

SEQ ID NO: 465489 - RNA, 64 nt, Homo Sapiens; identical to SEQ ID NO: 380093

SEQ ID NO: 465490 - RNA, 64 nt, Homo Sapiens; identical to SEQ ID NO: 380094

SEQ ID NO: 465491 - RNA, 64 nt, Homo Sapiens; identical to SEQ ID NO: 380095

SEQ ID NO: 465492 - RNA, 64 nt, Homo Sapiens
aguaaugggaauuuuaaauacugucuuucauggcugaaaacaaagaacagaaaauuguauuuuc

SEQ ID NO: 465493 - RNA, 64 nt, Homo Sapiens
cuuccagucuagaugaugcuuuggaggaaccaauugaaaacacaaauuuguugacacgaaaauu

SEQ ID NO: 465494 - RNA, 64 nt, Homo Sapiens
cugcagaggcuggcacagccaacagcuguagagaugaaaacagggggcucugcuggcgagacga

SEQ ID NO: 465495 - RNA, 64 nt, Homo Sapiens
ggauugacuaguuuacugguuauacuuucugaaaugaaaacauauauauuucucgccaaguuuu

SEQ ID NO: 465496 - RNA, 64 nt, Homo Sapiens
guauuaccccagggcccaacuuacuuauucugccugaaaacaauuuguaaaguaagggauaguc

SEQ ID NO: 465497 - RNA, 64 nt, Homo Sapiens
guuccauuuaaaguacauuuuggcuuuucuuaaaugaaaacacuuuugauguuuuuuugccagu

SEQ ID NO: 465498 - RNA, 64 nt, Homo Sapiens
agacagucuuaauauaaauguucaacccuuaaucugaaaacagauugcauuuuaaugggaaauu

SEQ ID NO: 465499 - RNA, 64 nt, Homo Sapiens
uacuucugauuaaugcaaggggaaauuuuuauacugaaaacaaacaaacaaacuagcagcuacu

SEQ ID NO: 465500 - RNA, 64 nt, Homo Sapiens
uauuuuauaaaauguuuucuguauggcaauaaacugaaaacauggaucaacccuucuuuugaaa

SEQ ID NO: 465501 - RNA, 64 nt, Homo Sapiens
guauuuucgacugaaaauucuugauacgaucuugugaaaacacuaauuccaaauuugggaacuu

SEQ ID NO: 465502 - RNA, 64 nt, Homo Sapiens
gcuguguuaagcuguucauguauuguuaccugcuugaaaacacuccuauuuuuuuuuccaguag

SEQ ID NO: 465503 - RNA, 64 nt, Homo Sapiens
ugcacaaauuguaaugugauacugugaaacaaauugaaaacauugccucuuugcaucacauacc

SEQ ID NO: 465504 - RNA, 64 nt, Homo Sapiens
ugacaaucuuguguauuuagaaaaauguauuacuugaaaacaugacauagaacauugaguuagc

SEQ ID NO: 465505 - RNA, 64 nt, Homo Sapiens
auucucagaucuuuauucuaacaauuacaugauuugaaaacaguacucaaugagacuggaaaua

SEQ ID NO: 465506 - RNA, 64 nt, Homo Sapiens
uuuuuaauaauagauucauaauguuacauuuaauugaaaacaaaccuuuauauccaaugaaaau

SEQ ID NO: 465507 - RNA, 64 nt, Homo Sapiens
agaauuuguauuuagaaaagguuuauauuauuagugaaaacaaaacuaaagggaaguucaaguu

SEQ ID NO: 465508 - RNA, 64 nt, Homo Sapiens
agaggugaucuuuauuuucuaaauauuucaaacuugaaaacagaguaaaaaagugauagaaaag

SEQ ID NO: 465509 - RNA, 64 nt, Homo Sapiens
ucuauacuuggaaguguuuaagguugccauugguugaaaacauaagugucucuggccaucaaag

SEQ ID NO: 465510 - RNA, 64 nt, Homo Sapiens
gauauugugaucaauuuuacacuuuauuauuuuuugaaaacaagaauauaaaaacaagguauau

SEQ ID NO: 465511 - RNA, 64 nt, Homo Sapiens
ccuggggauucugaaggcuuucaacuagaaagcuugaaaacaucugaacuugguuugaucuuac

SEQ ID NO: 465512 - RNA, 64 nt, Homo Sapiens
aaaacaauaauuuuuucaacagagguuaguaggaugaaaacagcgauaaauuguguucuguuaa

SEQ ID NO: 465513 - RNA, 64 nt, Homo Sapiens
auugacuugaaaaauuucagcauuuuaauauacuugaaaacaacggagaauuuuuucuucugag

SEQ ID NO: 465514 - RNA, 64 nt, Homo Sapiens
acauauuaaacuggaagaauuuucuuuauucaaaugaaaacauguuugaugacuggucaaaaaa

SEQ ID NO: 465515 - RNA, 64 nt, Homo Sapiens
acauagcugugagguacccuaugaguuguugacuugaaaacauggaacugcacagggcauucag

SEQ ID NO: 465516 - RNA, 64 nt, Homo Sapiens
gaggugugcaguucgcugcucccugcuuggcuuaugaaaacaccacugaacagaaauuucucca

SEQ ID NO: 465517 - RNA, 64 nt, Homo Sapiens
aagugcacugcacuucuggaauacugaaaaagaaugaaaacaauauguuagauuagguguaaga

SEQ ID NO: 465518 - RNA, 64 nt, Homo Sapiens
uagagaaauaucaguaagucauaaucaguucuuaugaaaacaaauaaauagauuucagcugaaa

SEQ ID NO: 465519 - RNA, 64 nt, Homo Sapiens
cugaagggucgucggaagaagaacuagaagcuuuugaaaacagaaugcuguuuuuauuuaggcu

SEQ ID NO: 465520 - RNA, 64 nt, Homo Sapiens
gagauuuauacuguaucaauuaaugucaucuaccugaaaacaguuaaaauuaaccuuuaccauu

SEQ ID NO: 465521 - RNA, 64 nt, Homo Sapiens
cuccguuuacacaucucuucagcuuggaaggcauugaaaacagucuucccgauucuccuguccc

SEQ ID NO: 465522 - RNA, 64 nt, Homo Sapiens
ugacaacaaagggcccccauaaggcaaguuuggcugaaaacagugcaauacuacaacaaacuuc

SEQ ID NO: 465523 - RNA, 64 nt, Homo Sapiens
uguaaacaacuauauuucaacuuaaucauccuuaugaaaacagagaccccaugagaaaagaugu

SEQ ID NO: 465524 - RNA, 64 nt, Homo Sapiens
cacucggcucccaucucuguccaaagcgaaucuuugaaaacaccgcacccuucuccacucagcu

SEQ ID NO: 465525 - RNA, 64 nt, Homo Sapiens
ucugaaugugcgguucggaacgugcggaaacauuugaaaacaaccgugugaaaggcagaacuaa

SEQ ID NO: 465526 - RNA, 64 nt, Homo Sapiens
ggaaccaugccuucauaauucucgaaaaggaaucugaaaacaauggugacagaagagaccuugu

SEQ ID NO: 465527 - RNA, 64 nt, Homo Sapiens
cuggaaguccagugaugggauaacagugaaaaauugaaaacaacaaauguugccaccuuguuug

SEQ ID NO: 465528 - RNA, 64 nt, Homo Sapiens
uuaaggcuauaguuuagccaucccaggaucaaacugaaaacaugauucagggcauauuuuuucu

SEQ ID NO: 465529 - RNA, 64 nt, Homo Sapiens
uuagaaagaagcuauugggccuauuuuuuucuacugaaaacaauuacacuaaggucuccauaua

SEQ ID NO: 465530 - RNA, 64 nt, Homo Sapiens
uuuacaggaaaguguucuccccuuggcuccagcaugaaaacacgaauccaaacccaagucaaaa

SEQ ID NO: 465531 - RNA, 64 nt, Homo Sapiens
caaaaagaagaaaacacucacgcaguaaguauguugaaaacaaauuucuuugcaugacuuuaua

SEQ ID NO: 465532 - RNA, 64 nt, Homo Sapiens
ugaagauggcauccugugaaguccuucaccucacugaaaacaucuggaaggggaucccacccca

SEQ ID NO: 465533 - RNA, 64 nt, Homo Sapiens
ugggcuaaugaagaucauauacgugaaaauuauuugaaaacauauaaagcacuauacagauucg

SEQ ID NO: 465534 - RNA, 64 nt, Homo Sapiens
uuucuuuuguaguuuuaaccuccuuaauguucucugaaaacaaggaaaaugauuuaaaguguuu

SEQ ID NO: 465535 - RNA, 64 nt, Homo Sapiens
ugaccuuugauaacgaacucaauuugaaugacugugaaaacauaaagaaaaguuuuugggauau

SEQ ID NO: 465536 - RNA, 64 nt, Homo Sapiens
uuggcagcgccauaacauucauuuaaaaaguuuaugaaaacauucauuugaaaguuccaugcag

SEQ ID NO: 465537 - RNA, 64 nt, Homo Sapiens
uuagaagguuuaacacuucacugauuaauggugcugaaaacacguuacaauuaccacauauccu

SEQ ID NO: 465538 - RNA, 64 nt, Homo Sapiens
uacaaauguuaaaauguguuguuccaaauacuaaugaaaacagaaugucucuuccugguagacc

SEQ ID NO: 465539 - RNA, 64 nt, Homo Sapiens
caaucauguguguuaacccagugcuuuccauucgugaaaacacauuugcuuuuugugauaugca

SEQ ID NO: 465540 - RNA, 64 nt, Homo Sapiens
gaggacuucagagccaggccugcagcauuuuguuugaaaacacaaucagcucugacaguuagac

SEQ ID NO: 465541 - RNA, 64 nt, Homo Sapiens
uaucaaagaucaguugacaucuccuagggaaugaugaaaacagcaggcuauuagaaaauuauuu

SEQ ID NO: 465542 - RNA, 64 nt, Homo Sapiens
ugcuaaacuugaauggagcaguacuuggaagcuuugaaaacaugaaaggcauuuaacagcagca

SEQ ID NO: 465543 - RNA, 64 nt, Homo Sapiens
guaccccuuuaaacacacaccuuugauuucagggugaaaacagauuuugggaaaggagugggau

SEQ ID NO: 465544 - RNA, 64 nt, Homo Sapiens
caaaucaaacacaacacaagagccuggauagccuugaaaacaaaggaaauccccgggaagaguu

SEQ ID NO: 465545 - RNA, 64 nt, Homo Sapiens
caaaaugaugcaaccaaaagucuuguuguuuauaugaaaacacuuuuugguugugauuuuuugu

SEQ ID NO: 465546 - RNA, 64 nt, Homo Sapiens
guaguuuaccaaagcauuuuuuguuuucuuaccuugaaaacacagaaccguuaauuccuugguu

SEQ ID NO: 465547 - RNA, 64 nt, Homo Sapiens
ugaaguaugagauguaacuauuauaaacuguugcugaaaacauaaaugucuguaacuuacaaac

SEQ ID NO: 465548 - RNA, 64 nt, Homo Sapiens
gcuguauagggauccucucucuuuuaaaagguucugaaaacaaaacaaggaacaguuugauaca

SEQ ID NO: 465549 - RNA, 64 nt, Homo Sapiens
agcauuuucaguaauuccuaaaugaccucugggcugaaaacagccacagguaccaggaagaagg

SEQ ID NO: 465550 - RNA, 64 nt, Homo Sapiens
aauacaaacaaaaaacaccucauaaauaaaguuuugaaaacauggauauucaaauuucaguguc

SEQ ID NO: 465551 - RNA, 64 nt, Homo Sapiens
uagugcaauguaagaaauauuacaaucuccacaaugaaaacaaacuaaaaacaguaguauuuau

SEQ ID NO: 465552 - RNA, 64 nt, Homo Sapiens
aaacaaaaaaacgaaagcaucagugccucaugacugaaaacaaauuucagcacaacucauucuu

SEQ ID NO: 465553 - RNA, 64 nt, Homo Sapiens
caauauuaguuuaggucggguuuuaagagcuaugugaaaacagagcugucagauuuagaaaugu

SEQ ID NO: 465554 - RNA, 64 nt, Homo Sapiens
cauaucagcaacauacguguuuuuugacagaaagugaaaacaaauuccguaaaacuguuaguau

SEQ ID NO: 465555 - RNA, 64 nt, Homo Sapiens
acuccaucucuccaaauguauuuccauaauguguugaaaacaugcuaacauuuguaugauuuuu

SEQ ID NO: 465556 - RNA, 64 nt, Homo Sapiens
aaagauuuuuuugacuauauauguuaguuuauuaugaaaacaucuucuuggcuuauguuaguuu

SEQ ID NO: 465557 - RNA, 64 nt, Homo Sapiens
guauauguuguaaauauuugucaauguaaagaacugaaaacaauaaaaaguuugucuuugagau

SEQ ID NO: 465558 - RNA, 64 nt, Homo Sapiens
aauguggcuacacaguuuuuuccacacaggacguugaaaacaguuuguacagugauagcaacuu

SEQ ID NO: 465559 - RNA, 64 nt, Homo Sapiens
aaugcaucuaugugguugaaauggcuuucugguuugaaaacaaaccuuuaaagaguuaguguua

SEQ ID NO: 465560 - RNA, 64 nt, Homo Sapiens
gaaaaccucuacaacaaucugaaaaggggauccuugaaaacacugcauucauuauuuuuaagcu

SEQ ID NO: 465561 - RNA, 64 nt, Homo Sapiens
auuagagcaaagcugaccugauugugaaaacaaaugaaaacaaacagagaguucucccuccacg

SEQ ID NO: 465562 - RNA, 64 nt, Homo Sapiens
ugaaaacaaaauuagagcaaucccuccacgauugugaaaacaaacccaagccuccagagaguuc

SEQ ID NO: 465563 - RNA, 64 nt, Homo Sapiens
caaaaguucacaucccuguuuacugccucugagcugaaaacauucugagguauuaggacgacca

SEQ ID NO: 465564 - RNA, 64 nt, Homo Sapiens
ugauggucauguugcaguuugcuuacucaggaaaugaaaacaaaggucugugagggacugcaaa

SEQ ID NO: 465565 - RNA, 64 nt, Homo Sapiens
uuugucauauucuuguauuccugccuguuuccacugaaaacauuuagugcgauuucacagucua

SEQ ID NO: 465566 - RNA, 64 nt, Homo Sapiens
acaaaugagaaaagaaaaaacauaacuaaaacauugaaaacagaguuuguuaccauccuuuaau

SEQ ID NO: 465567 - RNA, 64 nt, Homo Sapiens
uaaauauucacuaauggugccacagcaucguuuaugaaaacaacauauguacaugagucuucau

SEQ ID NO: 465568 - RNA, 64 nt, Homo Sapiens
auguaucuccuaggauggcucuguaaaugcaggaugaaaacaaucucuguuuucauuucuuuuu

SEQ ID NO: 465569 - RNA, 64 nt, Homo Sapiens
guacuguauaggaaccaacaugaacaauuuuaauugaaaacaccagucauaaacuauuaccacc

SEQ ID NO: 465570 - RNA, 64 nt, Homo Sapiens
uuuuuuuuuuuuaaacacaccuggagaggacauuugaaaacacuguucuuacccucgaacccug

SEQ ID NO: 465571 - RNA, 64 nt, Homo Sapiens
uucccaaagauuauauaauguucauaauccaccaugaaaacagcauuggccaaagguacugagg

SEQ ID NO: 465572 - RNA, 64 nt, Homo Sapiens
acaaauuuuuuuacaaguauuuacauacuguaucugaaaacagacuuuaaagucacaagauuau

SEQ ID NO: 465573 - RNA, 64 nt, Homo Sapiens
auuuguuuaguauaaauugucauagcugguuuacugaaaacaaacacauuuaaaauugguuuac

SEQ ID NO: 465574 - RNA, 64 nt, Homo Sapiens
ccccagcaccaaccucugagcccaagaccuugccugaaaacaagcagauaccgauugcuucauc

SEQ ID NO: 465575 - RNA, 64 nt, Homo Sapiens
ugccuuuuugggaaagagacaggaaagauucacuugaaaacauaaaugaacgucaagacugaag

SEQ ID NO: 465576 - RNA, 64 nt, Homo Sapiens
uugucgguucaaagaggaaagaugaauuucaaugugaaaacacguuuuguugagggcuguacuu

SEQ ID NO: 465577 - RNA, 64 nt, Homo Sapiens
ugcuacaaugaggcagcaucugaaaacacuagagugaaaacacacauaaacacagaguguagag

SEQ ID NO: 465578 - RNA, 64 nt, Homo Sapiens
agagugaaaacacaugcuaccacagaguguagagugaaaacacuucaggcuauucauucauaaa

SEQ ID NO: 465579 - RNA, 64 nt, Homo Sapiens
aauuauucagaauuacauuuuaucguuuucacauugaaaacagcaaauguugacuuaguaauuu

SEQ ID NO: 465580 - RNA, 64 nt, Homo Sapiens
agccuuccaugaggcagaaggggucgucguucucugaaaacagugacucugaaauguugggaca

SEQ ID NO: 465581 - RNA, 64 nt, Homo Sapiens
gacuauaaagauuucacaaagagcaaaaggaauaugaaaacagaacacgauuccucagaccagu

SEQ ID NO: 465582 - RNA, 64 nt, Homo Sapiens
accaugacaucucucuccaaucauuuggcaguucugaaaacaucuucuucaaaagaaagagacu

SEQ ID NO: 465583 - RNA, 64 nt, Homo Sapiens
uuugaacccuuauuuuaauuagaaauuaauauauugaaaacauguugccugaacaugacuuuaa

SEQ ID NO: 465584 - RNA, 64 nt, Homo Sapiens
aaacacugcacaugacaggagacaggagcguaugugaaaacaucaaucuugaauguuuuccuga

SEQ ID NO: 465585 - RNA, 64 nt, Homo Sapiens
aaugccuaugcauucaugucugucuccaugcaugugaaaacaggagaguguuuucauuuugugu

SEQ ID NO: 465586 - RNA, 64 nt, Homo Sapiens
agugaaaaaucuguuauccaauagcuaccauagaugaaaacaaacuuggauuuuuuucuuuguc

SEQ ID NO: 465587 - RNA, 64 nt, Homo Sapiens
uauagacaaucauaaaugaacuuccauugugauaugaaaacagcuuacagacacugaacuugaa

SEQ ID NO: 465588 - RNA, 64 nt, Homo Sapiens
uauagacaaucauaaaugaacuaccacugugguaugaaaacagcguauuuacagcaacucaauu

SEQ ID NO: 465589 - RNA, 64 nt, Homo Sapiens
cauuccauaucuacuuacacguuaccuacuaaacugaaaacauugcuguccauuguuugaggau

SEQ ID NO: 465590 - RNA, 64 nt, Homo Sapiens
agucucuauauucuuugccuuugagguaagcugcugaaaacaaauguguucugguagcccguau

SEQ ID NO: 465591 - RNA, 63 nt, Homo Sapiens
ucccuugucuagaggguggacauuggcuacaggcucuuccaucucucaugacuucauggaccc

SEQ ID NO: 465592 - RNA, 63 nt, Homo Sapiens
gaaggagggcaccccaaaggacagcgccuucuucucuuccacccaugcacggccuugggugau

SEQ ID NO: 465593 - RNA, 63 nt, Homo Sapiens
aucgggaacaaaggguuuuaucuaauaaagugucucuuccauucacguugcuaccuuacccac

SEQ ID NO: 465594 - RNA, 63 nt, Homo Sapiens
acacccagccacuguaaagagguaacuuggguccucuuccauugcaguccugaugauccuaac

SEQ ID NO: 465595 - RNA, 63 nt, Homo Sapiens
ugcugcugcuuuuuuugccaaccagcagcugaucucuuccacgggaagugaagcuggcuuagu

SEQ ID NO: 465596 - RNA, 63 nt, Homo Sapiens
guccugccccacgaaggaucuccugcuucucagcucuuccaccgucuguugucugcccucugc

SEQ ID NO: 465597 - RNA, 63 nt, Homo Sapiens
ccucagaguuuucuucuccauccuccuaccuuucucuuccacuaagagcccugcuucccugcc

SEQ ID NO: 465598 - RNA, 63 nt, Homo Sapiens
cccugcugcccaggaguugcgcaaccagggucccucuuccaugguuaccaggagcccugacau

SEQ ID NO: 465599 - RNA, 63 nt, Homo Sapiens
cauggagauccuccauccuaguuggugaauggacucuuccaggcccagcacauugaggaugua

SEQ ID NO: 465600 - RNA, 63 nt, Homo Sapiens
agcaugaguccuggagagcucuuccaggcuacacucuuccaucauguugcucuacauucaaac

SEQ ID NO: 465601 - RNA, 63 nt, Homo Sapiens
aaauuggaagcuuuuuuuaaguuuugcuuuucucucuuccacaagcacuggauaaauuguuug

SEQ ID NO: 465602 - RNA, 63 nt, Homo Sapiens
aguugagauucgcauauuugaaagaaaggauuucucuuccaacggaggaaauagacuuagacg

SEQ ID NO: 465603 - RNA, 63 nt, Homo Sapiens
ugaccucaugcaucuccaccccuaucagccugucucuuccauaucccaaaggacuccacccau

SEQ ID NO: 465604 - RNA, 63 nt, Homo Sapiens
auguccccaaaccugcaaggucuucauuaagcccucuuccauccccugauuacaccagccucg

SEQ ID NO: 465605 - RNA, 63 nt, Homo Sapiens
gacagacuggacauuucccuguuucgagccaggcucuuccaaggggccagcuggguccccgga

SEQ ID NO: 465606 - RNA, 63 nt, Homo Sapiens
ccgaggcucccgguuccaagucccaucgugcuccucuuccaaugccacacugccucugagccc

SEQ ID NO: 465607 - RNA, 63 nt, Homo Sapiens
cacggugaucuuggaguaggcgcccagcccuggcucuuccaugcucugccccuuuccuggaug

SEQ ID NO: 465608 - RNA, 63 nt, Homo Sapiens
cccugauuggugucucagcauuuauuuuccugucucuuccaccaaaagccagcuguagcuuua

SEQ ID NO: 465609 - RNA, 63 nt, Homo Sapiens
uugaagaaggcauccagaagggaauuaaagggacucuuccauuuuuccaaagaacugcacucu

SEQ ID NO: 465610 - RNA, 63 nt, Homo Sapiens
uuccaugcagcuagcagucacuggaaagaagaccucuuccaucccacuucugguuccuuucau

SEQ ID NO: 465611 - RNA, 63 nt, Homo Sapiens
cgagaaguuccugucccagaggguacagccccucucuuccaacauugagaaccaccacccgag

SEQ ID NO: 465612 - RNA, 63 nt, Homo Sapiens
gcugccucugccuuuauccuguggcaacagcuccucuuccagaguccuguuuguaaaacaacg

SEQ ID NO: 465613 - RNA, 63 nt, Homo Sapiens
caacuacuaaaacuucccgccacccugcuauuucucuuccaauuacuguucaaacauuuuugg

SEQ ID NO: 465614 - RNA, 63 nt, Homo Sapiens
guuuaguguaaacugaguaccacuuuauauuuucucuuccauagugagauguaugcaguaugu

SEQ ID NO: 465615 - RNA, 63 nt, Homo Sapiens
gugaauagugcucucuaccuguggguggccguucucuuccacuugcucgucuccccccagccc

SEQ ID NO: 465616 - RNA, 63 nt, Homo Sapiens
uucccaguaagauugugcaauuuuuauucacagcucuuccauguagacuuaccuuuccucaua

SEQ ID NO: 465617 - RNA, 63 nt, Homo Sapiens
cauccugggucagccuuuccugcuuucugccuccucuuccacaacagggcuggagacuguguc

SEQ ID NO: 465618 - RNA, 63 nt, Homo Sapiens
uggagaaggacugagccccagagcugggcuuggcucuuccagcggcuuuugcugggcucucca

SEQ ID NO: 465619 - RNA, 63 nt, Homo Sapiens
cccagccuacccuuccugcauuucucuucucagcucuuccaugauggauuccccccccuuucc

SEQ ID NO: 465620 - RNA, 63 nt, Homo Sapiens
cuuuugucucccagcaguagugagccacucagucucuuccacaggaaguuuggagccuacauu

SEQ ID NO: 465621 - RNA, 63 nt, Homo Sapiens
cacuggcaaugcagugaugacuacguucccagccucuuccaggguauauuuauugagugccaa

SEQ ID NO: 465622 - RNA, 63 nt, Homo Sapiens
cuuucuacuugaucuccagcccugucccuggaacucuuccagccaggaccuggcuggaugcuu

SEQ ID NO: 465623 - RNA, 63 nt, Homo Sapiens
agacaggugacugagagcugcaggccuccucugcucuuccaaacacguagcauuugcaccccu

SEQ ID NO: 465624 - RNA, 63 nt, Homo Sapiens
gagaacugcacagugaccacuguauuuuucacgcucuuccagggaucccugucccccgacauu

SEQ ID NO: 465625 - RNA, 63 nt, Homo Sapiens
uucugcccuuucccacaccuugccccuggcuuccucuuccaugugucuugaucccccccuccc

SEQ ID NO: 465626 - RNA, 63 nt, Homo Sapiens
uucugcccuuucccacauguugccccuggcuuccucuuccaugggagcuuggggaccccuccc

SEQ ID NO: 465627 - RNA, 63 nt, Homo Sapiens
cuuugcuguuccccagcagccauccaccugcuucucuuccagggucaucaaugccccaguuca

SEQ ID NO: 465628 - RNA, 63 nt, Homo Sapiens
gugggauuucuaagaccgacuguaugagcucgccucuuccagauagcuggcagagggcagggc

SEQ ID NO: 465629 - RNA, 63 nt, Homo Sapiens
aagaaauugaaaauacauacaugcuugucucaacucuuccacuuguaggaauuuauucuauaa

SEQ ID NO: 465630 - RNA, 63 nt, Homo Sapiens
cacagucccaugagggccccccggggcgaccuucucuuccagcgugucuucagccuccaaccu

SEQ ID NO: 465631 - RNA, 63 nt, Homo Sapiens
uugaccaggacugcaccaaggcacagaggagcgcucuuccauccaccccugcacagcagcugg

SEQ ID NO: 465632 - RNA, 63 nt, Homo Sapiens
agaggggugcccagcggagggguucagaggggacucuuccagggaggggaaggggaagcuugg

SEQ ID NO: 465633 - RNA, 63 nt, Homo Sapiens
ccuguaggggagacaaaaccgugacuucucccucucuuccaguggcuucccugccagugagga

SEQ ID NO: 465634 - RNA, 64 nt, Homo Sapiens; identical to SEQ ID NO: 279530

SEQ ID NO: 465635 - RNA, 64 nt, Homo Sapiens; identical to SEQ ID NO: 279531

SEQ ID NO: 465636 - RNA, 64 nt, Homo Sapiens; identical to SEQ ID NO: 279532

SEQ ID NO: 465637 - RNA, 64 nt, Homo Sapiens; identical to SEQ ID NO: 279533

SEQ ID NO: 465638 - RNA, 64 nt, Homo Sapiens; identical to SEQ ID NO: 279534

SEQ ID NO: 465639 - RNA, 64 nt, Homo Sapiens; identical to SEQ ID NO: 279535

SEQ ID NO: 465640 - RNA, 64 nt, Homo Sapiens; identical to SEQ ID NO: 279536

SEQ ID NO: 465641 - RNA, 64 nt, Homo Sapiens; identical to SEQ ID NO: 279537

SEQ ID NO: 465642 - RNA, 64 nt, Homo Sapiens; identical to SEQ ID NO: 279538

SEQ ID NO: 465643 - RNA, 64 nt, Homo Sapiens; identical to SEQ ID NO: 279539

SEQ ID NO: 465644 - RNA, 64 nt, Homo Sapiens; identical to SEQ ID NO: 279540

SEQ ID NO: 465645 - RNA, 64 nt, Homo Sapiens; identical to SEQ ID NO: 279541

SEQ ID NO: 465646 - RNA, 64 nt, Homo Sapiens; identical to SEQ ID NO: 279542

SEQ ID NO: 465647 - RNA, 64 nt, Homo Sapiens; identical to SEQ ID NO: 279543

SEQ ID NO: 465648 - RNA, 64 nt, Homo Sapiens; identical to SEQ ID NO: 279544

SEQ ID NO: 465649 - RNA, 64 nt, Homo Sapiens; identical to SEQ ID NO: 392288

SEQ ID NO: 465650 - RNA, 64 nt, Homo Sapiens; identical to SEQ ID NO: 392289

SEQ ID NO: 465651 - RNA, 64 nt, Homo Sapiens; identical to SEQ ID NO: 392290

SEQ ID NO: 465652 - RNA, 64 nt, Homo Sapiens; identical to SEQ ID NO: 392291

SEQ ID NO: 465653 - RNA, 64 nt, Homo Sapiens; identical to SEQ ID NO: 392292

SEQ ID NO: 465654 - RNA, 64 nt, Homo Sapiens; identical to SEQ ID NO: 392293

SEQ ID NO: 465655 - RNA, 64 nt, Homo Sapiens
cuaucucuauauacacauuucaugcuuccgcggaggagucuauauuuacaaccuccuuucccuc

SEQ ID NO: 465656 - RNA, 64 nt, Homo Sapiens
uuacaaccuccuuucccucccuaagagucuccauggagucuauuccccgggaaucuacugcuuc

SEQ ID NO: 465657 - RNA, 64 nt, Homo Sapiens
auccaaaggccuuaacuuauuuuaagaggccgagggagucuaugaaaaucuccccuuuuuuacu

SEQ ID NO: 465658 - RNA, 64 nt, Homo Sapiens
ccuccugucugaugacaggacagacugguggugaggagucuaagugggcucaguuugaugucag

SEQ ID NO: 465659 - RNA, 61 nt, Homo Sapiens
auuuuuuugagacaggguguaugcuagagcaccaauguauaaauuugguaaccuaugaaag

SEQ ID NO: 465660 - RNA, 61 nt, Homo Sapiens
uccgugaggccuguugcauuauaguuguuacccaauguauuggauccacauccagacuaac

SEQ ID NO: 465661 - RNA, 64 nt, Homo Sapiens
uaaaaagaccuccagauaggcagacagacagauggaccaccaaccuggacagacagccaaagcu

SEQ ID NO: 465662 - RNA, 64 nt, Homo Sapiens
agccaacagcuugauagaccagugcagccagagagaccaccaaacagagcccccaaaagacaga

SEQ ID NO: 465663 - RNA, 64 nt, Homo Sapiens
ggccaaggaccccugaugcagacucuggaaucccuggcccaaaggccugucugggcccaucugg

SEQ ID NO: 465664 - RNA, 64 nt, Homo Sapiens
cucugaggacacuuagaauaugaggaagaggguguggcccaacccucacuucaccuggggaggg

SEQ ID NO: 465665 - RNA, 64 nt, Homo Sapiens
uccagggucugguggggagggcucaggcugaggauggcccaaagaggggaggggcuguuugcug

SEQ ID NO: 465666 - RNA, 64 nt, Homo Sapiens
uuuuauuuaaaugugcuaccccccaccuuuccuguggcccaaccccuugcuguggagauccauu

SEQ ID NO: 465667 - RNA, 64 nt, Homo Sapiens
cgucccaaaguaggccucgcgauguggcccaaaguggcccaaagggccccaagcugccuuccuc

SEQ ID NO: 465668 - RNA, 64 nt, Homo Sapiens
uggcccaaagcgucccaaagugccuuccucgauguggcccaaagggcgccucccggccccaagc

SEQ ID NO: 465669 - RNA, 64 nt, Homo Sapiens
gcucguguaucuaaguugaaaccguuuuccucgguggcccaauaagcaagaugcuuacuaccac

SEQ ID NO: 465670 - RNA, 64 nt, Homo Sapiens
ccagaccguuaacacauuaaugagcaacugugccuggcccaaaaaagugcugggauuacaggcc

SEQ ID NO: 465671 - RNA, 64 nt, Homo Sapiens
gggaaauucucauuuuggucgacuccaacccuaauggcccaacagaauaggggaggguuaauaa

SEQ ID NO: 465672 - RNA, 64 nt, Homo Sapiens
aucucuguugccaguuaaagguagcaucucaugauggcccaacauauguucauagagcuagaaa

SEQ ID NO: 465673 - RNA, 64 nt, Homo Sapiens
uuuuccucuguuuuggucucuugggcaacauuuuuggcccaaguuugggcaacauuuggcccaa

SEQ ID NO: 465674 - RNA, 64 nt, Homo Sapiens
gggcaacauuuuuggcccaaguuugggcaacauuuggcccaaguuugggcauuuuggcaguagc

SEQ ID NO: 465675 - RNA, 64 nt, Homo Sapiens
acccugaucucucagccccaaacacccacccaauuggcccaacacugucugccccucggggugu

SEQ ID NO: 465676 - RNA, 64 nt, Homo Sapiens
ccuaggacauucccuuguagcccccagaauugucuggcccaaauugaauagaagcagaaaaaca

SEQ ID NO: 465677 - RNA, 64 nt, Homo Sapiens
cacggcugaccucauacaucaagccaauaccguguggcccaagacccccaccauaaaucacauc

SEQ ID NO: 465678 - RNA, 64 nt, Homo Sapiens
cauaaaucacaucauuagcaugaaccacccagaguggcccaagacucccagaucagcuaccagg

SEQ ID NO: 465679 - RNA, 64 nt, Homo Sapiens
agcaaucacuugugccugggaguucuagacuagccugggcgagacuucaucucuacaaaaaaag

SEQ ID NO: 465680 - RNA, 64 nt, Homo Sapiens
gcagugagccaagauugugccaccacacuccagccugggcgacagaaugagacccugucucaaa

SEQ ID NO: 465681 - RNA, 64 nt, Homo Sapiens
cuccccugcugagaucgcgccacugcacuccagccugggcgacagagcaagacuccaucucaaa

SEQ ID NO: 465682 - RNA, 64 nt, Homo Sapiens
gccgugagccaagaucgcaccacugcacuccagccugggcgacaaagugagacucugucuccaa

SEQ ID NO: 465683 - RNA, 64 nt, Homo Sapiens
ugggcuggggagagccuguggcgagcugggcgagcugggcgagcgcucaccuguggugagcugg

SEQ ID NO: 465684 - RNA, 64 nt, Homo Sapiens
ugggcgagcugggcuggggagugagcugggcgagcugggcgagcgugccuccugcucaccugug

SEQ ID NO: 465685 - RNA, 64 nt, Homo Sapiens
ugggcgagcugggcgagcugucaccuguggugagcugggcgagcgagugcucugugccuccugc

SEQ ID NO: 465686 - RNA, 64 nt, Homo Sapiens
gcaguaagcugagaucacgccacugcauuccagccugggcgacagagcaagacuccaucucaaa

SEQ ID NO: 465687 - RNA, 64 nt, Homo Sapiens
guagugaggcgagauugugccauugcacuccaaccugggcgacagagugagacuccaucucaaa

SEQ ID NO: 465688 - RNA, 64 nt, Homo Sapiens
uggggaauggggucccggccgggaggcuuggccucugggcgaccucguccuguuuuuuuuguuu

SEQ ID NO: 465689 - RNA, 64 nt, Homo Sapiens
ggcucacgguggcuccgagcaugagguccgccuccugggcgagacccagcaguggacagcaugg

SEQ ID NO: 465690 - RNA, 64 nt, Homo Sapiens
agguuaggacuugaagagggaagguauuuaauaacugggcgaggaugggugugguggcucacac

SEQ ID NO: 465691 - RNA, 64 nt, Homo Sapiens
gcagugagccaagaucgugccacugcacuccagccugggcgacagagcaagacuccgucucaaa

SEQ ID NO: 465692 - RNA, 64 nt, Homo Sapiens
gagugagacuccaucucaaacacugcacuccagccugggcgacagcagugagccgagaucgugc

SEQ ID NO: 465693 - RNA, 64 nt, Homo Sapiens
gagcgagacuccaucuuuaacaccgcacuccagccugggcgacagcagugaacugagauugcgc

SEQ ID NO: 465694 - RNA, 64 nt, Homo Sapiens
ccuggggacauugugguugugcccccagggaacacugggcgaugaggcucacccagcgugaacu

SEQ ID NO: 465695 - RNA, 64 nt, Homo Sapiens
gcggggagcuugcucuuccccucugacugcaggccugggcgacuauggugucacccccgucacc

SEQ ID NO: 465696 - RNA, 64 nt, Homo Sapiens
acccuuaugacuccccccuugcaacccuggugugcugggcgaaauggaaggucuugcgcaggcu

SEQ ID NO: 465697 - RNA, 64 nt, Homo Sapiens
gagcaagacucugucucaaucacggcacuccagccugggcgacagcagugaacugagacugcgc

SEQ ID NO: 465698 - RNA, 64 nt, Homo Sapiens
cgcccgaucacagacgagcaucacagacgagcggucaccagaaucagucaucggacucacccga

SEQ ID NO: 465699 - RNA, 64 nt, Homo Sapiens
cgcccgaucacagacgagcaucacagacgagcggucaccagacucagucaucggacucacccga

SEQ ID NO: 465700 - RNA, 64 nt, Homo Sapiens
acaucuuaacucauguugaguuugugcuguggugucaccagaauuccagauaaacacacagccu

SEQ ID NO: 465701 - RNA, 64 nt, Homo Sapiens
ucaauauuaagucuuuuaccuaaaggcccagccgucaccagacaacagaauaaucaaucugccu

SEQ ID NO: 465702 - RNA, 64 nt, Homo Sapiens
ucggaggagcaguguguggcggcugggcagcccuucaccagagugacucugcucaggccuguga

SEQ ID NO: 465703 - RNA, 64 nt, Homo Sapiens
cucaggcaggcuggcuuaguugcuccgucuucgcucaccagacacauguucccacagaggugcc

SEQ ID NO: 465704 - RNA, 64 nt, Homo Sapiens
acacacaggggagacgccccucaguccuccucauucaccagaggagcggggcuuuagccggaag

SEQ ID NO: 465705 - RNA, 64 nt, Homo Sapiens
acacacacaggggagaagccucagaccuccucagucaccagagggggagggcuuuagccggaag

SEQ ID NO: 465706 - RNA, 64 nt, Homo Sapiens
cuauugcuucaacagugcuuacacuugagcugagucaccagaccggaggugaugagaucgggcc

SEQ ID NO: 465707 - RNA, 64 nt, Homo Sapiens
gcaugugguguggcaccugugccucccucuccucucaccagaugcucuacauccuacugcuuug

SEQ ID NO: 465708 - RNA, 64 nt, Homo Sapiens; identical to SEQ ID NO: 214864

SEQ ID NO: 465709 - RNA, 64 nt, Homo Sapiens; identical to SEQ ID NO: 214865

SEQ ID NO: 465710 - RNA, 64 nt, Homo Sapiens; identical to SEQ ID NO: 214866

SEQ ID NO: 465711 - RNA, 64 nt, Homo Sapiens; identical to SEQ ID NO: 214867

SEQ ID NO: 465712 - RNA, 64 nt, Homo Sapiens; identical to SEQ ID NO: 214868

SEQ ID NO: 465713 - RNA, 64 nt, Homo Sapiens; identical to SEQ ID NO: 214869

SEQ ID NO: 465714 - RNA, 64 nt, Homo Sapiens; identical to SEQ ID NO: 214870

SEQ ID NO: 465715 - RNA, 64 nt, Homo Sapiens; identical to SEQ ID NO: 214871

SEQ ID NO: 465716 - RNA, 64 nt, Homo Sapiens; identical to SEQ ID NO: 214872

SEQ ID NO: 465717 - RNA, 64 nt, Homo Sapiens; identical to SEQ ID NO: 214873

SEQ ID NO: 465718 - RNA, 64 nt, Homo Sapiens; identical to SEQ ID NO: 214874

SEQ ID NO: 465719 - RNA, 64 nt, Homo Sapiens; identical to SEQ ID NO: 214875

SEQ ID NO: 465720 - RNA, 64 nt, Homo Sapiens; identical to SEQ ID NO: 214876

SEQ ID NO: 465721 - RNA, 64 nt, Homo Sapiens; identical to SEQ ID NO: 214877

SEQ ID NO: 465722 - RNA, 64 nt, Homo Sapiens; identical to SEQ ID NO: 214878

SEQ ID NO: 465723 - RNA, 64 nt, Homo Sapiens; identical to SEQ ID NO: 214879

SEQ ID NO: 465724 - RNA, 64 nt, Homo Sapiens; identical to SEQ ID NO: 214880

SEQ ID NO: 465725 - RNA, 64 nt, Homo Sapiens; identical to SEQ ID NO: 214881

SEQ ID NO: 465726 - RNA, 64 nt, Homo Sapiens; identical to SEQ ID NO: 214882

SEQ ID NO: 465727 - RNA, 64 nt, Homo Sapiens; identical to SEQ ID NO: 214883

SEQ ID NO: 465728 - RNA, 64 nt, Homo Sapiens; identical to SEQ ID NO: 214884

SEQ ID NO: 465729 - RNA, 64 nt, Homo Sapiens; identical to SEQ ID NO: 214885

SEQ ID NO: 465730 - RNA, 64 nt, Homo Sapiens; identical to SEQ ID NO: 214886

SEQ ID NO: 465731 - RNA, 64 nt, Homo Sapiens; identical to SEQ ID NO: 214887

SEQ ID NO: 465732 - RNA, 64 nt, Homo Sapiens; identical to SEQ ID NO: 214888

SEQ ID NO: 465733 - RNA, 64 nt, Homo Sapiens; identical to SEQ ID NO: 214889

SEQ ID NO: 465734 - RNA, 64 nt, Homo Sapiens; identical to SEQ ID NO: 214890

SEQ ID NO: 465735 - RNA, 64 nt, Homo Sapiens; identical to SEQ ID NO: 214891

SEQ ID NO: 465736 - RNA, 64 nt, Homo Sapiens; identical to SEQ ID NO: 214892

SEQ ID NO: 465737 - RNA, 64 nt, Homo Sapiens; identical to SEQ ID NO: 214893

SEQ ID NO: 465738 - RNA, 64 nt, Homo Sapiens; identical to SEQ ID NO: 214894

SEQ ID NO: 465739 - RNA, 64 nt, Homo Sapiens; identical to SEQ ID NO: 214895

SEQ ID NO: 465740 - RNA, 64 nt, Homo Sapiens; identical to SEQ ID NO: 214896

SEQ ID NO: 465741 - RNA, 64 nt, Homo Sapiens; identical to SEQ ID NO: 214897

SEQ ID NO: 465742 - RNA, 64 nt, Homo Sapiens; identical to SEQ ID NO: 106415

SEQ ID NO: 465743 - RNA, 64 nt, Homo Sapiens; identical to SEQ ID NO: 106416

SEQ ID NO: 465744 - RNA, 64 nt, Homo Sapiens; identical to SEQ ID NO: 106417

SEQ ID NO: 465745 - RNA, 64 nt, Homo Sapiens; identical to SEQ ID NO: 106418

SEQ ID NO: 465746 - RNA, 64 nt, Homo Sapiens; identical to SEQ ID NO: 106419

SEQ ID NO: 465747 - RNA, 64 nt, Homo Sapiens; identical to SEQ ID NO: 106420

SEQ ID NO: 465748 - RNA, 64 nt, Homo Sapiens; identical to SEQ ID NO: 106421

SEQ ID NO: 465749 - RNA, 64 nt, Homo Sapiens; identical to SEQ ID NO: 106422

SEQ ID NO: 465750 - RNA, 64 nt, Homo Sapiens; identical to SEQ ID NO: 106423

SEQ ID NO: 465751 - RNA, 64 nt, Homo Sapiens; identical to SEQ ID NO: 106424

SEQ ID NO: 465752 - RNA, 64 nt, Homo Sapiens; identical to SEQ ID NO: 106425

SEQ ID NO: 465753 - RNA, 64 nt, Homo Sapiens; identical to SEQ ID NO: 106426

SEQ ID NO: 465754 - RNA, 64 nt, Homo Sapiens; identical to SEQ ID NO: 106427

SEQ ID NO: 465755 - RNA, 64 nt, Homo Sapiens; identical to SEQ ID NO: 106428

SEQ ID NO: 465756 - RNA, 64 nt, Homo Sapiens; identical to SEQ ID NO: 106429

SEQ ID NO: 465757 - RNA, 64 nt, Homo Sapiens; identical to SEQ ID NO: 106430

SEQ ID NO: 465758 - RNA, 64 nt, Homo Sapiens; identical to SEQ ID NO: 106431

SEQ ID NO: 465759 - RNA, 64 nt, Homo Sapiens; identical to SEQ ID NO: 106432

SEQ ID NO: 465760 - RNA, 64 nt, Homo Sapiens; identical to SEQ ID NO: 106433

SEQ ID NO: 465761 - RNA, 64 nt, Homo Sapiens; identical to SEQ ID NO: 106434

SEQ ID NO: 465762 - RNA, 64 nt, Homo Sapiens; identical to SEQ ID NO: 106435

SEQ ID NO: 465763 - RNA, 64 nt, Homo Sapiens; identical to SEQ ID NO: 106436

SEQ ID NO: 465764 - RNA, 64 nt, Homo Sapiens; identical to SEQ ID NO: 106437

SEQ ID NO: 465765 - RNA, 64 nt, Homo Sapiens; identical to SEQ ID NO: 106438

SEQ ID NO: 465766 - RNA, 64 nt, Homo Sapiens; identical to SEQ ID NO: 106439

SEQ ID NO: 465767 - RNA, 64 nt, Homo Sapiens; identical to SEQ ID NO: 106440

SEQ ID NO: 465768 - RNA, 64 nt, Homo Sapiens; identical to SEQ ID NO: 106441

SEQ ID NO: 465769 - RNA, 64 nt, Homo Sapiens; identical to SEQ ID NO: 106442

SEQ ID NO: 465770 - RNA, 64 nt, Homo Sapiens; identical to SEQ ID NO: 106443

SEQ ID NO: 465771 - RNA, 64 nt, Homo Sapiens; identical to SEQ ID NO: 106444

SEQ ID NO: 465772 - RNA, 64 nt, Homo Sapiens; identical to SEQ ID NO: 106445

SEQ ID NO: 465773 - RNA, 64 nt, Homo Sapiens; identical to SEQ ID NO: 106446

SEQ ID NO: 465774 - RNA, 64 nt, Homo Sapiens; identical to SEQ ID NO: 106447

SEQ ID NO: 465775 - RNA, 64 nt, Homo Sapiens; identical to SEQ ID NO: 106448

SEQ ID NO: 465776 - RNA, 64 nt, Homo Sapiens; identical to SEQ ID NO: 111894

SEQ ID NO: 465777 - RNA, 64 nt, Homo Sapiens; identical to SEQ ID NO: 111895

SEQ ID NO: 465778 - RNA, 64 nt, Homo Sapiens; identical to SEQ ID NO: 111896

SEQ ID NO: 465779 - RNA, 64 nt, Homo Sapiens; identical to SEQ ID NO: 111897

SEQ ID NO: 465780 - RNA, 64 nt, Homo Sapiens; identical to SEQ ID NO: 111898

SEQ ID NO: 465781 - RNA, 64 nt, Homo Sapiens; identical to SEQ ID NO: 111899

SEQ ID NO: 465782 - RNA, 64 nt, Homo Sapiens; identical to SEQ ID NO: 111900

SEQ ID NO: 465783 - RNA, 64 nt, Homo Sapiens; identical to SEQ ID NO: 111901

SEQ ID NO: 465784 - RNA, 64 nt, Homo Sapiens; identical to SEQ ID NO: 111902

SEQ ID NO: 465785 - RNA, 64 nt, Homo Sapiens; identical to SEQ ID NO: 111903

SEQ ID NO: 465786 - RNA, 64 nt, Homo Sapiens; identical to SEQ ID NO: 111904

SEQ ID NO: 465787 - RNA, 64 nt, Homo Sapiens; identical to SEQ ID NO: 111905

SEQ ID NO: 465788 - RNA, 64 nt, Homo Sapiens; identical to SEQ ID NO: 111906

SEQ ID NO: 465789 - RNA, 64 nt, Homo Sapiens; identical to SEQ ID NO: 111907

SEQ ID NO: 465790 - RNA, 64 nt, Homo Sapiens; identical to SEQ ID NO: 111908

SEQ ID NO: 465791 - RNA, 64 nt, Homo Sapiens; identical to SEQ ID NO: 111909

SEQ ID NO: 465792 - RNA, 64 nt, Homo Sapiens; identical to SEQ ID NO: 111910

SEQ ID NO: 465793 - RNA, 64 nt, Homo Sapiens; identical to SEQ ID NO: 111911

SEQ ID NO: 465794 - RNA, 64 nt, Homo Sapiens; identical to SEQ ID NO: 111912

SEQ ID NO: 465795 - RNA, 64 nt, Homo Sapiens; identical to SEQ ID NO: 111913

SEQ ID NO: 465796 - RNA, 64 nt, Homo Sapiens; identical to SEQ ID NO: 111914

SEQ ID NO: 465797 - RNA, 64 nt, Homo Sapiens; identical to SEQ ID NO: 111915

SEQ ID NO: 465798 - RNA, 64 nt, Homo Sapiens; identical to SEQ ID NO: 111916

SEQ ID NO: 465799 - RNA, 64 nt, Homo Sapiens; identical to SEQ ID NO: 111917

SEQ ID NO: 465800 - RNA, 64 nt, Homo Sapiens; identical to SEQ ID NO: 111918

SEQ ID NO: 465801 - RNA, 64 nt, Homo Sapiens; identical to SEQ ID NO: 111919

SEQ ID NO: 465802 - RNA, 64 nt, Homo Sapiens; identical to SEQ ID NO: 111920

SEQ ID NO: 465803 - RNA, 64 nt, Homo Sapiens; identical to SEQ ID NO: 111921

SEQ ID NO: 465804 - RNA, 64 nt, Homo Sapiens; identical to SEQ ID NO: 111922

SEQ ID NO: 465805 - RNA, 64 nt, Homo Sapiens; identical to SEQ ID NO: 111923

SEQ ID NO: 465806 - RNA, 64 nt, Homo Sapiens; identical to SEQ ID NO: 111924

SEQ ID NO: 465807 - RNA, 64 nt, Homo Sapiens; identical to SEQ ID NO: 111925

SEQ ID NO: 465808 - RNA, 64 nt, Homo Sapiens; identical to SEQ ID NO: 111926

SEQ ID NO: 465809 - RNA, 64 nt, Homo Sapiens; identical to SEQ ID NO: 111927

SEQ ID NO: 465810 - RNA, 62 nt, Homo Sapiens
gcaggaaaagugcaacuuaaagcaguaccuucauucaugaagcuacuuuuuaauuugaugua

SEQ ID NO: 465811 - RNA, 62 nt, Homo Sapiens
ccaaaugaaaauuucaaagucaauaccagcagauucaugaaaguaaauuuaguccuauaauu

SEQ ID NO: 465812 - RNA, 62 nt, Homo Sapiens
cuguuacugagaauaaugaaaaaauagcccuuauucaugauggugaauaaggcaaaagccag

SEQ ID NO: 465813 - RNA, 62 nt, Homo Sapiens
uguuuuugaaugcaggcaguaauuguggcuuaauucaugacuuuuggacuucuucuccugac

SEQ ID NO: 465814 - RNA, 62 nt, Homo Sapiens
agucacuuaucaccaaggggauggcccaggccauucaugagggauccaccuuugugcuccaa

SEQ ID NO: 465815 - RNA, 62 nt, Homo Sapiens
aguagugguaaauauuccagaauccauaugaaauucaugaguuuauuuaugucuaaaacacu

SEQ ID NO: 465816 - RNA, 62 nt, Homo Sapiens
auaaauuugaccuaaaauauuuucucaaacuaauucaugaaacagcaacuuuuaccaauacc

SEQ ID NO: 465817 - RNA, 62 nt, Homo Sapiens
auucuaagccucuggagagacuguaaugauccauucaugagcugguaugaaaucagugggaa

SEQ ID NO: 465818 - RNA, 62 nt, Homo Sapiens
cagaauguauuuuguuguauuaugcaggaaucauucaugagaagucuaggcguuguggugaa

SEQ ID NO: 465819 - RNA, 62 nt, Homo Sapiens
gaaagcagaacaauggagauaaaaaggucaugauucaugauuaaaugcugacuacuguagaa

SEQ ID NO: 465820 - RNA, 62 nt, Homo Sapiens
uugaggaagauuggguaaugcugauguguuccauucaugaaacuguauuugauacauaaucc

SEQ ID NO: 465821 - RNA, 62 nt, Homo Sapiens
uccauauuuuaaggaaggagcuaaaaauggaaauucaugaaacauaaaugguaucaagaacu

SEQ ID NO: 465822 - RNA, 62 nt, Homo Sapiens
aucuuucuauaaccaugccauucacuuaaauaauucaugaagggaaugguuuaauuuaaagg

SEQ ID NO: 465823 - RNA, 62 nt, Homo Sapiens
uuauaagaaaaacacauaaaccauuaucauuuauucaugagccaaagccauuaagaagauaa

SEQ ID NO: 465824 - RNA, 62 nt, Homo Sapiens
ccuuggccaugagguuuguugaaaccaaauagauucaugaaauguucagguuugcaugguau

SEQ ID NO: 465825 - RNA, 62 nt, Homo Sapiens
ggccugauaucacucauccuagaacggugauuauucaugacagaggggagcgagacgaaagg

SEQ ID NO: 465826 - RNA, 62 nt, Homo Sapiens
ggaaagccuucagaucugccucacaccuucaaauucaugaaaggacacaaacacacauaaga

SEQ ID NO: 465827 - RNA, 62 nt, Homo Sapiens
ggaaagccuucagaucugccaagaaccuucgaauucaugaaaggacacaaacacacguaaga

SEQ ID NO: 465828 - RNA, 62 nt, Homo Sapiens
aauaaaauuacugcuuuccauggcaaaaagcaauucaugauacucuguugcacauguuuaau

SEQ ID NO: 465829 - RNA, 62 nt, Homo Sapiens
cggagugguaguuauccuucuuugauuauuucauucaugaaggaauuugagagaaauaguaa

SEQ ID NO: 465830 - RNA, 62 nt, Homo Sapiens
aaguaaguuacucuuuuccuuuaaucuguaagauucaugaaauucggggccagggaaacagu

SEQ ID NO: 465831 - RNA, 62 nt, Homo Sapiens
ggacaagggugucuccuucauuacuuaaagauauucaugagggugggucacuacagauguug

SEQ ID NO: 465832 - RNA, 64 nt, Homo Sapiens
gacugcuuguuuugcacaagcgaugagggcauucuuucuacauacuacaguuuuuauuagacua

SEQ ID NO: 465833 - RNA, 64 nt, Homo Sapiens
uuuuauuagacuacgaugaguucucuggcauuuuuuucuacaguggaagugggaagagaggugg

SEQ ID NO: 465834 - RNA, 64 nt, Homo Sapiens
cucuuuccucuucucaugcuggcuucuucccaaauuucuacagcuucuccugggaauaauugug

SEQ ID NO: 465835 - RNA, 64 nt, Homo Sapiens
guuaaaauugcagaaguagcgacuaguagcaucuuuucuacaacucaccuuaguggugaaagga

SEQ ID NO: 465836 - RNA, 64 nt, Homo Sapiens
auuguuugcuaauuuuuaaauuuacauaucaauguuucuacaguaagaugcagcauuuuagaaa

SEQ ID NO: 465837 - RNA, 64 nt, Homo Sapiens
gaagacuaaacucaugcuuauuuaguguaucugguuucuacauguuuuuuuuuuuuuuuuacag

SEQ ID NO: 465838 - RNA, 64 nt, Homo Sapiens
gccagaauauacuauaaaaauggaucucaacuaauuucuacauuuucaaaagguuuguaagauu

SEQ ID NO: 465839 - RNA, 64 nt, Homo Sapiens
aacauaaacuucaaaagguuuauuuucuuuuacuuuucuacauaucauuuuugccaguuauuuu

SEQ ID NO: 465840 - RNA, 64 nt, Homo Sapiens
uugcaugagggauuuuuuuaaggaaagaaaauuuuuucuacaauauuuuucacugccagcuuca

SEQ ID NO: 465841 - RNA, 64 nt, Homo Sapiens
aacccuagauauaaaauuguuccagagauguugguuucuacagcuccuuuucuuuccuucccuc

SEQ ID NO: 465842 - RNA, 64 nt, Homo Sapiens
cuaagauguucugccuuaucauaccauguauaauuuucuacaacagcuaauauucccaguaaag

SEQ ID NO: 465843 - RNA, 64 nt, Homo Sapiens
ccauauuuuuaaagaaauguguuuuacucuuuucuuucuacagaacugucacuuuacaacuuag

SEQ ID NO: 465844 - RNA, 64 nt, Homo Sapiens
augacauaaugauuugcuauuccuuugcuucaucuuucuacaguucuuuauccuuggaguuuaa

SEQ ID NO: 465845 - RNA, 64 nt, Homo Sapiens
guucuacagcaagaauauucauacccagaaguuauuucuacauuauuuuuauuuuuacuguuuu

SEQ ID NO: 465846 - RNA, 64 nt, Homo Sapiens
aguacaggaaauauuccucuuuuaaucucuaaaauuucuacagucagaacaaaucauagggguu

SEQ ID NO: 465847 - RNA, 64 nt, Homo Sapiens
auguuuuauccauuccauaaaacuguaaugaccuuuucuacaacgguuuuuuaugugcuaaccu

SEQ ID NO: 465848 - RNA, 64 nt, Homo Sapiens
caagucgugaggaaauggguaugcaaggcugagauuucuacagcaauaaaggagacacacacug

SEQ ID NO: 465849 - RNA, 64 nt, Homo Sapiens
uuuagguuuuaugaguagacaguguucauuugauuuucuacagaaauaauauaaauuauucuuu

SEQ ID NO: 465850 - RNA, 64 nt, Homo Sapiens
accuguaguucguuuuaagucauguucacaggaauuucuacaauaauaaacccaucaucuccau

SEQ ID NO: 465851 - RNA, 64 nt, Homo Sapiens
aguuugguuuacucuucucccaugagauuuugucuuucuacauuaacuaguaagacauaaagau

SEQ ID NO: 465852 - RNA, 64 nt, Homo Sapiens
uaaaaugaagaaccaaaacugugaaggauuugauuuucuacauuuuggaagacacaaaucaaau

SEQ ID NO: 465853 - RNA, 64 nt, Homo Sapiens
uaaaugucauagugcaaauauuugaaaauugcaauuucuacaaaugcuaacuuuuaaaaauguu

SEQ ID NO: 465854 - RNA, 64 nt, Homo Sapiens
ugcauauaguuuuccaagaguuaaaagggaaauauuucuacaugguuauaaugaaugcuucuau

SEQ ID NO: 465855 - RNA, 64 nt, Homo Sapiens
uguguucugugacucaauugacuuuuucggugucuuucuacaacaguugaauguugaggcuuua

SEQ ID NO: 465856 - RNA, 64 nt, Homo Sapiens
gcuuacauugaaaacagauauuacagcuuauuuuuuucuacauaauugugaccaauacauuugu

SEQ ID NO: 465857 - RNA, 64 nt, Homo Sapiens
aaaagcaagauauaagagauucauuugcuuaacauuucuacauaauauuuauggucuggucagu

SEQ ID NO: 465858 - RNA, 64 nt, Homo Sapiens
uaugcuuacaaaagcaauuuauuacuaaugggaauuucuacauaaucauaugaauuguauauca

SEQ ID NO: 465859 - RNA, 64 nt, Homo Sapiens
gcaaaccauuuuucuuucauagauuacacuuguguuucuacacaaaaaaaaucuuugguaccaa

SEQ ID NO: 465860 - RNA, 64 nt, Homo Sapiens
uuauuaugcucaggauugcagugucuuacauucauuucuacacugaccugugaggacaggaaug

SEQ ID NO: 465861 - RNA, 64 nt, Homo Sapiens
uuuucuauuuuucuugagguaaauuuaauaauuauuucuacaaacuaaaaggcuuagauuuuua

SEQ ID NO: 465862 - RNA, 64 nt, Homo Sapiens
auuucuauuguuuaacauaauccuuuaucauggcuuucuacagucauuaacuaauuuuagguuu

SEQ ID NO: 465863 - RNA, 64 nt, Homo Sapiens
gucaagacuagccaaaggacucuacauaaaauuauuucuacaauuauucuuccagguuuugcac

SEQ ID NO: 465864 - RNA, 64 nt, Homo Sapiens
gacacuauucauuaagaacauaccacucauguucuuucuacacuuguaagcuguaauuuuuuau

SEQ ID NO: 465865 - RNA, 64 nt, Homo Sapiens
aaaugcuacccaggcagugcuaaucaaaauagguuuucuacaccagcacuuuauucauacaaaa

SEQ ID NO: 465866 - RNA, 64 nt, Homo Sapiens
gaagauuuucuucuuauuuaaaugagccuuuuucuuucuacacugccugcugcuauuucacggc

SEQ ID NO: 465867 - RNA, 64 nt, Homo Sapiens
agcuuuaaguguucagauuaauucuuaucaaaaauuucuacauuuuguauauaccugcacugau

SEQ ID NO: 465868 - RNA, 64 nt, Homo Sapiens
cauacuuaaauauagugauguauauguaaauauauuucuacacauauguacauauguuugugug

SEQ ID NO: 465869 - RNA, 64 nt, Homo Sapiens
aaauaccauuggugucuuuaguauuuguuaauauuuucuacacuuuaauugaguaacuacuaug

SEQ ID NO: 465870 - RNA, 64 nt, Homo Sapiens
cauggagacagauuuuaauuuaaaaaccaggaaauuucuacaaucuucucacugaguuuuuguu

SEQ ID NO: 465871 - RNA, 64 nt, Homo Sapiens
uggcagaucagguuugucuggaccuucugcugcuuuucuacaauguucauauuuuuaaagggaa

SEQ ID NO: 465872 - RNA, 64 nt, Homo Sapiens
acaaugaucugucuggugcaggagaaggcaaaaguuucuacaagucuacaugaccuugcugaua

SEQ ID NO: 465873 - RNA, 64 nt, Homo Sapiens
uuagggcucuaucggaaaugcuuccauuuugccuuuucuacaguuaggccaauuuugaaauaua

SEQ ID NO: 465874 - RNA, 64 nt, Homo Sapiens
gacgggaacacgguguagcaggaagauacucaucuuucuacauacucauauuucuacauaggug

SEQ ID NO: 465875 - RNA, 64 nt, Homo Sapiens
ggugggaagauacucaucuuggagcauacucauauuucuacauaagaugggauuuuaccugaau

SEQ ID NO: 465876 - RNA, 64 nt, Homo Sapiens
uuaaaugaauauuuugauaauaauauuguuuuucuuucuacaaagcacuagagaaugcacagau

SEQ ID NO: 465877 - RNA, 64 nt, Homo Sapiens
uucuuguuuauugaguuuguagguaaaauguauuuuucuacauuauugcuuauugcuuaguaaa

SEQ ID NO: 465878 - RNA, 64 nt, Homo Sapiens
uguuaggaaacuugugagcagagagcuuucuguuuuucuacauuauugaacaucaucaauauug

SEQ ID NO: 465879 - RNA, 64 nt, Homo Sapiens
ucaggaauucaagaacagcuuuauucucuaacaauuucuacagauggcuucaaacacgaaaugu

SEQ ID NO: 465880 - RNA, 64 nt, Homo Sapiens
ucuuugcuuuuaacagacacccuaaaagucuucuuuucuacauaguugaagacagcaacaucuu

SEQ ID NO: 465881 - RNA, 64 nt, Homo Sapiens
cacuuuguggcagggguacuuuuaaacauaaauguuucuacaaaaguagguugaguucauugua

SEQ ID NO: 465882 - RNA, 64 nt, Homo Sapiens
uacaguucccaaagucaguuuuggaaaaacaaaauuucuacaauccaagguuacuuucuuguuu

SEQ ID NO: 465883 - RNA, 64 nt, Homo Sapiens
uacaguucccaaagacacaguuggauaaagaaaauuucuacaauccaagguuacuuucuuguuc

SEQ ID NO: 465884 - RNA, 64 nt, Homo Sapiens
aggagugaggcagccucacugugugcccucagggauacgagauucucuguugugaguugugggu

SEQ ID NO: 465885 - RNA, 64 nt, Homo Sapiens
uuuuuucagggugaggugcuguguuucuuauuucauacgagauaaaacagagagaaguucucuc

SEQ ID NO: 465886 - RNA, 64 nt, Homo Sapiens
aacugcauggaagcgguggucagaagguuguuuuauacgagaacaggcagaaagugcccauugu

SEQ ID NO: 465887 - RNA, 64 nt, Homo Sapiens
auagcauuuuuguaacuugccauccgcacagaaaauacgagaaaaucugcauguuugauuauag

SEQ ID NO: 465888 - RNA, 64 nt, Homo Sapiens
cauggauaaacugugaaccaaaauauggugcaacauacgagacaugaauauaguccaaccauca

SEQ ID NO: 465889 - RNA, 64 nt, Homo Sapiens
uauaaaucuagcuuucuuuaugauguuucugauaauacgagaauugaaaacuuuaccuucucuu

SEQ ID NO: 465890 - RNA, 64 nt, Homo Sapiens
guagucacauuaauagaagaagucuauuucugagauacgagagguuaauuuugguaauuauuaa

SEQ ID NO: 465891 - RNA, 64 nt, Homo Sapiens
agaggucucccaaacgcccuuuggagguuaaggcauacgagagcggucugggagucacacagug

SEQ ID NO: 465892 - RNA, 64 nt, Homo Sapiens
uggaaagcuauguagacaucggagagacugacugauacgagauuaggcagcucccacgacacac

SEQ ID NO: 465893 - RNA, 64 nt, Homo Sapiens
ugcaggggaaacaucaguaauuuaguaucagaaaauacgagauuauccaacuucugugcaaaau

SEQ ID NO: 465894 - RNA, 64 nt, Homo Sapiens
guccucugaacacacaugcaguuucacuccugagauacgagaacaagauguacaggaugcuuug

SEQ ID NO: 465895 - RNA, 64 nt, Homo Sapiens
acugcaaaauauuuuccuuugcaaagucuuucaaauacgagauauucugauaaaguucucuaug

SEQ ID NO: 465896 - RNA, 64 nt, Homo Sapiens
ggaagcugaagaaaaagcgccagugaagaaaucuauacgagauacuccagccaaaaaugcacaa

SEQ ID NO: 465897 - RNA, 64 nt, Homo Sapiens
gugguauauaagucuuuguauuuuugaaaaauuuauacgagaaaaaauuauauuauuauuguau

SEQ ID NO: 465898 - RNA, 64 nt, Homo Sapiens
agauucuggauucuugguguccacagccuagcugauacgagauagcccauaggacaccugguuu

SEQ ID NO: 465899 - RNA, 64 nt, Homo Sapiens
aucaaugugaacugcuuagcauggugccugguauauacgagagcuccacaaaugugagcuauaa

SEQ ID NO: 465900 - RNA, 64 nt, Homo Sapiens
uagcuacaugugaugugcacgacaugugaaagacauacgagacaacucuuugugauacacaugu

SEQ ID NO: 465901 - RNA, 64 nt, Homo Sapiens
ggggcuuuucagugaacuaaugucuugcugucugauacgagagucaagucaguggcuguuguuc

SEQ ID NO: 465902 - RNA, 64 nt, Homo Sapiens
agaaagugaaaguuuuacaauguauuuaaaagaaauacgagaaauagaugaacagagaggaaaa

SEQ ID NO: 465903 - RNA, 64 nt, Homo Sapiens
ccccacccuccuugagacuggagcuggcgucugcauacgagagacuugguugaacuugguuggu

SEQ ID NO: 465904 - RNA, 64 nt, Homo Sapiens
gaaacgcuuaagcaguugccuuuuuuaaacaucgauacgagaccucugaauuuguauuuuuucu

SEQ ID NO: 465905 - RNA, 64 nt, Homo Sapiens
uauuuuucuuccuugcauauacaugaaaggacucauacgagagagaauccguaugaauguaagg

SEQ ID NO: 465906 - RNA, 64 nt, Homo Sapiens
ucuccuuuucuacugaccaucuugauacuuauuuauacgagaggcaguugcuggacgggguagu

SEQ ID NO: 465907 - RNA, 64 nt, Homo Sapiens
aauuggugagaaacccaacaaaugccuuucauauauacgagaaccaaaugaagucagaauuugc

SEQ ID NO: 465908 - RNA, 64 nt, Homo Sapiens
aaagagagugguuuccguuuagucugacugaaaaauacgagagaucauuucaaaauccugagug

SEQ ID NO: 465909 - RNA, 64 nt, Homo Sapiens
gcccacagaggcucagcuccuucuuuucugugcaauacgagacccggccgcaccccgagucaca

SEQ ID NO: 465910 - RNA, 64 nt, Homo Sapiens
acuguagaaguggacgauuuaucaacucuguuggauacgagaacugaguauuuauauauugugc

SEQ ID NO: 465911 - RNA, 64 nt, Homo Sapiens
uucuuccccuccuacaccuaaguuagcguucaauauacgagacacaaaauaaaguuuguuugaa

SEQ ID NO: 465912 - RNA, 64 nt, Homo Sapiens; identical to SEQ ID NO: 266463

SEQ ID NO: 465913 - RNA, 64 nt, Homo Sapiens; identical to SEQ ID NO: 266464

SEQ ID NO: 465914 - RNA, 64 nt, Homo Sapiens; identical to SEQ ID NO: 266465

SEQ ID NO: 465915 - RNA, 64 nt, Homo Sapiens; identical to SEQ ID NO: 266466

SEQ ID NO: 465916 - RNA, 64 nt, Homo Sapiens; identical to SEQ ID NO: 266467

SEQ ID NO: 465917 - RNA, 64 nt, Homo Sapiens; identical to SEQ ID NO: 266468

SEQ ID NO: 465918 - RNA, 64 nt, Homo Sapiens; identical to SEQ ID NO: 266469

SEQ ID NO: 465919 - RNA, 64 nt, Homo Sapiens; identical to SEQ ID NO: 266470

SEQ ID NO: 465920 - RNA, 64 nt, Homo Sapiens; identical to SEQ ID NO: 266471

SEQ ID NO: 465921 - RNA, 64 nt, Homo Sapiens; identical to SEQ ID NO: 266472

SEQ ID NO: 465922 - RNA, 64 nt, Homo Sapiens; identical to SEQ ID NO: 266473

SEQ ID NO: 465923 - RNA, 64 nt, Homo Sapiens; identical to SEQ ID NO: 266474

SEQ ID NO: 465924 - RNA, 64 nt, Homo Sapiens; identical to SEQ ID NO: 266475

SEQ ID NO: 465925 - RNA, 64 nt, Homo Sapiens; identical to SEQ ID NO: 266476

SEQ ID NO: 465926 - RNA, 64 nt, Homo Sapiens; identical to SEQ ID NO: 266477

SEQ ID NO: 465927 - RNA, 64 nt, Homo Sapiens; identical to SEQ ID NO: 266478

SEQ ID NO: 465928 - RNA, 64 nt, Homo Sapiens; identical to SEQ ID NO: 266479

SEQ ID NO: 465929 - RNA, 64 nt, Homo Sapiens; identical to SEQ ID NO: 266480

SEQ ID NO: 465930 - RNA, 64 nt, Homo Sapiens; identical to SEQ ID NO: 266481

SEQ ID NO: 465931 - RNA, 64 nt, Homo Sapiens; identical to SEQ ID NO: 266482

SEQ ID NO: 465932 - RNA, 64 nt, Homo Sapiens; identical to SEQ ID NO: 266483

SEQ ID NO: 465933 - RNA, 64 nt, Homo Sapiens; identical to SEQ ID NO: 266484

SEQ ID NO: 465934 - RNA, 64 nt, Homo Sapiens; identical to SEQ ID NO: 266485

SEQ ID NO: 465935 - RNA, 64 nt, Homo Sapiens; identical to SEQ ID NO: 266486

SEQ ID NO: 465936 - RNA, 64 nt, Homo Sapiens; identical to SEQ ID NO: 266487

SEQ ID NO: 465937 - RNA, 64 nt, Homo Sapiens; identical to SEQ ID NO: 266488

SEQ ID NO: 465938 - RNA, 64 nt, Homo Sapiens; identical to SEQ ID NO: 266489

SEQ ID NO: 465939 - RNA, 64 nt, Homo Sapiens; identical to SEQ ID NO: 266490

SEQ ID NO: 465940 - RNA, 64 nt, Homo Sapiens; identical to SEQ ID NO: 266491

SEQ ID NO: 465941 - RNA, 64 nt, Homo Sapiens; identical to SEQ ID NO: 266492

SEQ ID NO: 465942 - RNA, 64 nt, Homo Sapiens; identical to SEQ ID NO: 266493

SEQ ID NO: 465943 - RNA, 64 nt, Homo Sapiens; identical to SEQ ID NO: 266494

SEQ ID NO: 465944 - RNA, 64 nt, Homo Sapiens; identical to SEQ ID NO: 266495

SEQ ID NO: 465945 - RNA, 64 nt, Homo Sapiens; identical to SEQ ID NO: 266496

SEQ ID NO: 465946 - RNA, 64 nt, Homo Sapiens; identical to SEQ ID NO: 266497

SEQ ID NO: 465947 - RNA, 64 nt, Homo Sapiens; identical to SEQ ID NO: 266498

SEQ ID NO: 465948 - RNA, 64 nt, Homo Sapiens; identical to SEQ ID NO: 266499

SEQ ID NO: 465949 - RNA, 64 nt, Homo Sapiens; identical to SEQ ID NO: 266500

SEQ ID NO: 465950 - RNA, 64 nt, Homo Sapiens; identical to SEQ ID NO: 266501

SEQ ID NO: 465951 - RNA, 64 nt, Homo Sapiens; identical to SEQ ID NO: 266502

SEQ ID NO: 465952 - RNA, 64 nt, Homo Sapiens; identical to SEQ ID NO: 266503

SEQ ID NO: 465953 - RNA, 64 nt, Homo Sapiens; identical to SEQ ID NO: 266504

SEQ ID NO: 465954 - RNA, 64 nt, Homo Sapiens; identical to SEQ ID NO: 266505

SEQ ID NO: 465955 - RNA, 64 nt, Homo Sapiens; identical to SEQ ID NO: 266506

SEQ ID NO: 465956 - RNA, 64 nt, Homo Sapiens; identical to SEQ ID NO: 266507

SEQ ID NO: 465957 - RNA, 64 nt, Homo Sapiens; identical to SEQ ID NO: 266508

SEQ ID NO: 465958 - RNA, 64 nt, Homo Sapiens; identical to SEQ ID NO: 266509

SEQ ID NO: 465959 - RNA, 64 nt, Homo Sapiens; identical to SEQ ID NO: 266510

SEQ ID NO: 465960 - RNA, 64 nt, Homo Sapiens; identical to SEQ ID NO: 266511

SEQ ID NO: 465961 - RNA, 64 nt, Homo Sapiens; identical to SEQ ID NO: 266512

SEQ ID NO: 465962 - RNA, 64 nt, Homo Sapiens; identical to SEQ ID NO: 266513

SEQ ID NO: 465963 - RNA, 64 nt, Homo Sapiens; identical to SEQ ID NO: 266514

SEQ ID NO: 465964 - RNA, 64 nt, Homo Sapiens; identical to SEQ ID NO: 266515

SEQ ID NO: 465965 - RNA, 64 nt, Homo Sapiens; identical to SEQ ID NO: 266516

SEQ ID NO: 465966 - RNA, 64 nt, Homo Sapiens; identical to SEQ ID NO: 266517

SEQ ID NO: 465967 - RNA, 64 nt, Homo Sapiens; identical to SEQ ID NO: 266518

SEQ ID NO: 465968 - RNA, 64 nt, Homo Sapiens; identical to SEQ ID NO: 266519

SEQ ID NO: 465969 - RNA, 64 nt, Homo Sapiens; identical to SEQ ID NO: 266520

SEQ ID NO: 465970 - RNA, 64 nt, Homo Sapiens; identical to SEQ ID NO: 266521

SEQ ID NO: 465971 - RNA, 64 nt, Homo Sapiens; identical to SEQ ID NO: 266522

SEQ ID NO: 465972 - RNA, 64 nt, Homo Sapiens; identical to SEQ ID NO: 266523

SEQ ID NO: 465973 - RNA, 64 nt, Homo Sapiens; identical to SEQ ID NO: 266524

SEQ ID NO: 465974 - RNA, 64 nt, Homo Sapiens; identical to SEQ ID NO: 266525

SEQ ID NO: 465975 - RNA, 64 nt, Homo Sapiens; identical to SEQ ID NO: 266526

SEQ ID NO: 465976 - RNA, 64 nt, Homo Sapiens; identical to SEQ ID NO: 266527

SEQ ID NO: 465977 - RNA, 64 nt, Homo Sapiens; identical to SEQ ID NO: 266528

SEQ ID NO: 465978 - RNA, 64 nt, Homo Sapiens; identical to SEQ ID NO: 266529

SEQ ID NO: 465979 - RNA, 64 nt, Homo Sapiens; identical to SEQ ID NO: 266530

SEQ ID NO: 465980 - RNA, 64 nt, Homo Sapiens; identical to SEQ ID NO: 266531

SEQ ID NO: 465981 - RNA, 64 nt, Homo Sapiens; identical to SEQ ID NO: 266532

SEQ ID NO: 465982 - RNA, 64 nt, Homo Sapiens; identical to SEQ ID NO: 266533

SEQ ID NO: 465983 - RNA, 64 nt, Homo Sapiens; identical to SEQ ID NO: 266534

SEQ ID NO: 465984 - RNA, 64 nt, Homo Sapiens; identical to SEQ ID NO: 266535

SEQ ID NO: 465985 - RNA, 64 nt, Homo Sapiens; identical to SEQ ID NO: 266536

SEQ ID NO: 465986 - RNA, 64 nt, Homo Sapiens; identical to SEQ ID NO: 266537

SEQ ID NO: 465987 - RNA, 64 nt, Homo Sapiens; identical to SEQ ID NO: 266538

SEQ ID NO: 465988 - RNA, 64 nt, Homo Sapiens; identical to SEQ ID NO: 266539

SEQ ID NO: 465989 - RNA, 64 nt, Homo Sapiens; identical to SEQ ID NO: 266540

SEQ ID NO: 465990 - RNA, 64 nt, Homo Sapiens; identical to SEQ ID NO: 266541

SEQ ID NO: 465991 - RNA, 64 nt, Homo Sapiens; identical to SEQ ID NO: 266542

SEQ ID NO: 465992 - RNA, 64 nt, Homo Sapiens; identical to SEQ ID NO: 266543

SEQ ID NO: 465993 - RNA, 64 nt, Homo Sapiens; identical to SEQ ID NO: 266544

SEQ ID NO: 465994 - RNA, 64 nt, Homo Sapiens; identical to SEQ ID NO: 266545

SEQ ID NO: 465995 - RNA, 64 nt, Homo Sapiens; identical to SEQ ID NO: 266546

SEQ ID NO: 465996 - RNA, 64 nt, Homo Sapiens; identical to SEQ ID NO: 266547

SEQ ID NO: 465997 - RNA, 64 nt, Homo Sapiens; identical to SEQ ID NO: 266548

SEQ ID NO: 465998 - RNA, 64 nt, Homo Sapiens; identical to SEQ ID NO: 266549

SEQ ID NO: 465999 - RNA, 64 nt, Homo Sapiens; identical to SEQ ID NO: 266550

SEQ ID NO: 466000 - RNA, 64 nt, Homo Sapiens; identical to SEQ ID NO: 266551

SEQ ID NO: 466001 - RNA, 64 nt, Homo Sapiens; identical to SEQ ID NO: 266552

SEQ ID NO: 466002 - RNA, 64 nt, Homo Sapiens; identical to SEQ ID NO: 266553

SEQ ID NO: 466003 - RNA, 64 nt, Homo Sapiens; identical to SEQ ID NO: 266554

SEQ ID NO: 466004 - RNA, 64 nt, Homo Sapiens; identical to SEQ ID NO: 266555

SEQ ID NO: 466005 - RNA, 64 nt, Homo Sapiens; identical to SEQ ID NO: 266556

SEQ ID NO: 466006 - RNA, 64 nt, Homo Sapiens; identical to SEQ ID NO: 266557

SEQ ID NO: 466007 - RNA, 64 nt, Homo Sapiens; identical to SEQ ID NO: 266558

SEQ ID NO: 466008 - RNA, 64 nt, Homo Sapiens; identical to SEQ ID NO: 266559

SEQ ID NO: 466009 - RNA, 64 nt, Homo Sapiens; identical to SEQ ID NO: 266560

SEQ ID NO: 466010 - RNA, 55 nt, Homo Sapiens; identical to SEQ ID NO: 266561

SEQ ID NO: 466011 - RNA, 64 nt, Homo Sapiens; identical to SEQ ID NO: 266562

SEQ ID NO: 466012 - RNA, 64 nt, Homo Sapiens; identical to SEQ ID NO: 266563

SEQ ID NO: 466013 - RNA, 64 nt, Homo Sapiens; identical to SEQ ID NO: 266564

SEQ ID NO: 466014 - RNA, 64 nt, Homo Sapiens; identical to SEQ ID NO: 266565

SEQ ID NO: 466015 - RNA, 64 nt, Homo Sapiens; identical to SEQ ID NO: 266566

SEQ ID NO: 466016 - RNA, 64 nt, Homo Sapiens; identical to SEQ ID NO: 266567

SEQ ID NO: 466017 - RNA, 64 nt, Homo Sapiens; identical to SEQ ID NO: 266568

SEQ ID NO: 466018 - RNA, 64 nt, Homo Sapiens; identical to SEQ ID NO: 266569

SEQ ID NO: 466019 - RNA, 64 nt, Homo Sapiens; identical to SEQ ID NO: 266570

SEQ ID NO: 466020 - RNA, 64 nt, Homo Sapiens; identical to SEQ ID NO: 266571

SEQ ID NO: 466021 - RNA, 64 nt, Homo Sapiens; identical to SEQ ID NO: 266572

SEQ ID NO: 466022 - RNA, 64 nt, Homo Sapiens; identical to SEQ ID NO: 266573

SEQ ID NO: 466023 - RNA, 64 nt, Homo Sapiens; identical to SEQ ID NO: 266574

SEQ ID NO: 466024 - RNA, 64 nt, Homo Sapiens; identical to SEQ ID NO: 266575

SEQ ID NO: 466025 - RNA, 60 nt, Homo Sapiens; identical to SEQ ID NO: 266576

SEQ ID NO: 466026 - RNA, 64 nt, Homo Sapiens; identical to SEQ ID NO: 266577

SEQ ID NO: 466027 - RNA, 64 nt, Homo Sapiens; identical to SEQ ID NO: 266578

SEQ ID NO: 466028 - RNA, 64 nt, Homo Sapiens; identical to SEQ ID NO: 266579

SEQ ID NO: 466029 - RNA, 64 nt, Homo Sapiens; identical to SEQ ID NO: 266580

SEQ ID NO: 466030 - RNA, 64 nt, Homo Sapiens; identical to SEQ ID NO: 266581

SEQ ID NO: 466031 - RNA, 64 nt, Homo Sapiens; identical to SEQ ID NO: 266582

SEQ ID NO: 466032 - RNA, 64 nt, Homo Sapiens; identical to SEQ ID NO: 266583

SEQ ID NO: 466033 - RNA, 64 nt, Homo Sapiens; identical to SEQ ID NO: 266584

SEQ ID NO: 466034 - RNA, 64 nt, Homo Sapiens; identical to SEQ ID NO: 266585

SEQ ID NO: 466035 - RNA, 64 nt, Homo Sapiens; identical to SEQ ID NO: 266586

SEQ ID NO: 466036 - RNA, 64 nt, Homo Sapiens; identical to SEQ ID NO: 266587

SEQ ID NO: 466037 - RNA, 64 nt, Homo Sapiens; identical to SEQ ID NO: 266588

SEQ ID NO: 466038 - RNA, 64 nt, Homo Sapiens; identical to SEQ ID NO: 266589

SEQ ID NO: 466039 - RNA, 64 nt, Homo Sapiens; identical to SEQ ID NO: 266590

SEQ ID NO: 466040 - RNA, 54 nt, Homo Sapiens; identical to SEQ ID NO: 266591

SEQ ID NO: 466041 - RNA, 64 nt, Homo Sapiens; identical to SEQ ID NO: 266592

SEQ ID NO: 466042 - RNA, 64 nt, Homo Sapiens; identical to SEQ ID NO: 266593

SEQ ID NO: 466043 - RNA, 64 nt, Homo Sapiens; identical to SEQ ID NO: 266594

SEQ ID NO: 466044 - RNA, 64 nt, Homo Sapiens; identical to SEQ ID NO: 266595

SEQ ID NO: 466045 - RNA, 64 nt, Homo Sapiens; identical to SEQ ID NO: 266596

SEQ ID NO: 466046 - RNA, 64 nt, Homo Sapiens; identical to SEQ ID NO: 266597

SEQ ID NO: 466047 - RNA, 64 nt, Homo Sapiens; identical to SEQ ID NO: 266598

SEQ ID NO: 466048 - RNA, 64 nt, Homo Sapiens; identical to SEQ ID NO: 266599

SEQ ID NO: 466049 - RNA, 64 nt, Homo Sapiens; identical to SEQ ID NO: 266600

SEQ ID NO: 466050 - RNA, 64 nt, Homo Sapiens; identical to SEQ ID NO: 266601

SEQ ID NO: 466051 - RNA, 64 nt, Homo Sapiens; identical to SEQ ID NO: 266602

SEQ ID NO: 466052 - RNA, 64 nt, Homo Sapiens; identical to SEQ ID NO: 266603

SEQ ID NO: 466053 - RNA, 64 nt, Homo Sapiens; identical to SEQ ID NO: 266604

SEQ ID NO: 466054 - RNA, 64 nt, Homo Sapiens; identical to SEQ ID NO: 266605

SEQ ID NO: 466055 - RNA, 64 nt, Homo Sapiens; identical to SEQ ID NO: 266606

SEQ ID NO: 466056 - RNA, 64 nt, Homo Sapiens; identical to SEQ ID NO: 266607

SEQ ID NO: 466057 - RNA, 64 nt, Homo Sapiens; identical to SEQ ID NO: 266608

SEQ ID NO: 466058 - RNA, 64 nt, Homo Sapiens; identical to SEQ ID NO: 266609

SEQ ID NO: 466059 - RNA, 64 nt, Homo Sapiens; identical to SEQ ID NO: 266610

SEQ ID NO: 466060 - RNA, 64 nt, Homo Sapiens; identical to SEQ ID NO: 266611

SEQ ID NO: 466061 - RNA, 64 nt, Homo Sapiens; identical to SEQ ID NO: 266612

SEQ ID NO: 466062 - RNA, 64 nt, Homo Sapiens; identical to SEQ ID NO: 266613

SEQ ID NO: 466063 - RNA, 64 nt, Homo Sapiens; identical to SEQ ID NO: 266614

SEQ ID NO: 466064 - RNA, 64 nt, Homo Sapiens; identical to SEQ ID NO: 266615

SEQ ID NO: 466065 - RNA, 64 nt, Homo Sapiens; identical to SEQ ID NO: 266616

SEQ ID NO: 466066 - RNA, 64 nt, Homo Sapiens; identical to SEQ ID NO: 266617

SEQ ID NO: 466067 - RNA, 64 nt, Homo Sapiens; identical to SEQ ID NO: 266618

SEQ ID NO: 466068 - RNA, 64 nt, Homo Sapiens; identical to SEQ ID NO: 266619

SEQ ID NO: 466069 - RNA, 64 nt, Homo Sapiens; identical to SEQ ID NO: 266620

SEQ ID NO: 466070 - RNA, 64 nt, Homo Sapiens; identical to SEQ ID NO: 266621

SEQ ID NO: 466071 - RNA, 64 nt, Homo Sapiens; identical to SEQ ID NO: 266622

SEQ ID NO: 466072 - RNA, 64 nt, Homo Sapiens; identical to SEQ ID NO: 266623

SEQ ID NO: 466073 - RNA, 64 nt, Homo Sapiens; identical to SEQ ID NO: 266624

SEQ ID NO: 466074 - RNA, 64 nt, Homo Sapiens; identical to SEQ ID NO: 266625

SEQ ID NO: 466075 - RNA, 64 nt, Homo Sapiens; identical to SEQ ID NO: 266626

SEQ ID NO: 466076 - RNA, 64 nt, Homo Sapiens; identical to SEQ ID NO: 266627

SEQ ID NO: 466077 - RNA, 64 nt, Homo Sapiens; identical to SEQ ID NO: 266628

SEQ ID NO: 466078 - RNA, 64 nt, Homo Sapiens; identical to SEQ ID NO: 266629

SEQ ID NO: 466079 - RNA, 64 nt, Homo Sapiens; identical to SEQ ID NO: 266630

SEQ ID NO: 466080 - RNA, 64 nt, Homo Sapiens; identical to SEQ ID NO: 266631

SEQ ID NO: 466081 - RNA, 64 nt, Homo Sapiens; identical to SEQ ID NO: 266632

SEQ ID NO: 466082 - RNA, 65 nt, Homo Sapiens
ugaacauugcucuucauuuuggccuguacuucucccucagggacguagaacaauggaaugucagu

SEQ ID NO: 466083 - RNA, 65 nt, Homo Sapiens
acuuuuucuuuaaaauucaauuaagguacuucucccucagggacguagaacaauggaaugucagu

SEQ ID NO: 466084 - RNA, 65 nt, Homo Sapiens
aaaauauuagccacagaccaccuacaucacaauaacucagggagcuuauagaagugaagauuccu

SEQ ID NO: 466085 - RNA, 65 nt, Homo Sapiens
cuguguaggaucucguuuguuuaaaguccagcaugcucagggaccggucuuaucagacgcccguc

SEQ ID NO: 466086 - RNA, 65 nt, Homo Sapiens
uagguuuucucagaggcucagccugccauccaccccucagggagccucagggguuggucugagag

SEQ ID NO: 466087 - RNA, 65 nt, Homo Sapiens
uccagagacucaugcccaugcgaggcugggcuacccucagggagacaggccccugugcuccaggc

SEQ ID NO: 466088 - RNA, 65 nt, Homo Sapiens
ggauuguccaguuacuuuaguguuacuguaguggucucagggaaauagaaguugucuguggguga

SEQ ID NO: 466089 - RNA, 65 nt, Homo Sapiens
cccacgccuuuguuguuugagugccucccacccuucucagggacccagggcaggaggagggggcc

SEQ ID NO: 466090 - RNA, 65 nt, Homo Sapiens
ucagaccuagugcucccuucuggggaagggccccacucagggaucucuaaugaguggucggaccg

SEQ ID NO: 466091 - RNA, 65 nt, Homo Sapiens
agaggccgaugcauaaagucagccuguucaaagugcucagggacuuagcaaaaugagaagaugug

SEQ ID NO: 466092 - RNA, 65 nt, Homo Sapiens
aauacuguacuguguagugugucuccguaugucaucucagggagcuuaaaaugggcuugauuuaa

SEQ ID NO: 466093 - RNA, 65 nt, Homo Sapiens
gucuuuccucggccgagucaggcuuccuggugagccucagggagugcauggucucagaugccauc

SEQ ID NO: 466094 - RNA, 65 nt, Homo Sapiens
ugcuccucuccagaguuuccggucaccuccguguucucagggagugcguggucuuggaugccauc

SEQ ID NO: 466095 - RNA, 65 nt, Homo Sapiens
cagucuccuuuugucugguguguuccaugcagucacucagggaccuaaggguagggguauaaguc

SEQ ID NO: 466096 - RNA, 65 nt, Homo Sapiens
cagacuuacagaguggguagccuuuucugcagucacucagggaccgugagcaggucagcaggaac

SEQ ID NO: 466097 - RNA, 65 nt, Homo Sapiens
gucuuuuauaaacucaauggggugguuucucaggucucagggaagagaaaagagagaucuacuuu

SEQ ID NO: 466098 - RNA, 65 nt, Homo Sapiens
gcaauuguucuuaaagagccgcucuuugccugccacucagggagugcuuugggaagagcugcuga

SEQ ID NO: 466099 - RNA, 65 nt, Homo Sapiens
agcuggccacccuggccucagcucccucaggacgccucagggaucucgcugcgcgguccuauacg

SEQ ID NO: 466100 - RNA, 65 nt, Homo Sapiens
gccaauugauccucuacuuuccuucuuuagucccucucagggacgccuccauccccggcuccccu

SEQ ID NO: 466101 - RNA, 65 nt, Homo Sapiens
ccuaugcugcuggccuaaaagcauuucuaaggagucucagggaugugggcugggccugagauucu

SEQ ID NO: 466102 - RNA, 65 nt, Homo Sapiens
aggaagcuaaagugacgagucagugugacaucaaacucagggaagacuaaaaucugaguuuugcc

SEQ ID NO: 466103 - RNA, 65 nt, Homo Sapiens
aaggaugacucagcacugccgcucaacagacaugacucagggauggcuuaguacugccccucagc

SEQ ID NO: 466104 - RNA, 65 nt, Homo Sapiens
aaggaugacucagcacugccgcucaacagggaugacucagggauggcuuaguacugccccucaac

SEQ ID NO: 466105 - RNA, 65 nt, Homo Sapiens; identical to SEQ ID NO: 466103

SEQ ID NO: 466106 - RNA, 65 nt, Homo Sapiens; identical to SEQ ID NO: 466103

SEQ ID NO: 466107 - RNA, 65 nt, Homo Sapiens
cagccccucagccauccagggcuacccacugcuuacucagggaccaggcagcccccauggcagua

SEQ ID NO: 466108 - RNA, 65 nt, Homo Sapiens
uccucccccuacuucuccccaagggccaagaacugcucagggacauuaaaggucaaaaguccagc

SEQ ID NO: 466109 - RNA, 65 nt, Homo Sapiens
acauaaggagcgugggauccgauggaaagguggagcucagggaaaauggggguccuugccucucg

SEQ ID NO: 466110 - RNA, 65 nt, Homo Sapiens
gacucagaggggagggaagggcucaucagcacccgcucagggagccugucccuuuauguucccaa

SEQ ID NO: 466111 - RNA, 65 nt, Homo Sapiens
gcacccccaggcuucaaaccaccuggaaugcacagcucagggaagcugguggaugccuagaggcu

SEQ ID NO: 466112 - RNA, 65 nt, Homo Sapiens
ugaaggacagggaacucuccauuauuggggcaggacucagggaggacacuuggggccaugugucu

SEQ ID NO: 466113 - RNA, 65 nt, Homo Sapiens
ggcccaucugucagcagcgucuucuagguccccagcucagggagccauccccagcuccaguuuuc

SEQ ID NO: 466114 - RNA, 65 nt, Homo Sapiens
cacaucuuucuucuuaguuuacagugaaauauuaucucagggauauuuuuuuuuuuuuuuugaga

SEQ ID NO: 466115 - RNA, 65 nt, Homo Sapiens
ugggauuacaggcgugagccaccgcgcccggccaucucagggauauuuaaacaaaggaagaggaa

SEQ ID NO: 466116 - RNA, 65 nt, Homo Sapiens
caauaccauaaucaugauaacauauauuauguacacucagggaaccauauuugguaaguuuugua

SEQ ID NO: 466117 - RNA, 65 nt, Homo Sapiens
gcagaccucuccucucucuucaccacuccacugugcucagggaagagcucuccaaagaguguguc

SEQ ID NO: 466118 - RNA, 65 nt, Homo Sapiens
gagaaccacaauagaaaaagacagaacaacagagucucagggaaaucagacacccagaguuggag

SEQ ID NO: 466119 - RNA, 65 nt, Homo Sapiens
gggagacaaugaccuggaggggagagaaacagagacucagggagaagagagacagagacccaaag

SEQ ID NO: 466120 - RNA, 65 nt, Homo Sapiens
aauuacauccucccauggaggaugagagacugaggcucagggagggcaaggaauaggcccaagau

SEQ ID NO: 466121 - RNA, 65 nt, Homo Sapiens
cauggugguauggcugaacaaggagcggcagacaacucagggagaaacucaggagugcaguacca

SEQ ID NO: 466122 - RNA, 65 nt, Homo Sapiens
gaggcccuugggagcaggugucuugggcguuugaacucagggaggagccaaucagaucaacucug

SEQ ID NO: 466123 - RNA, 65 nt, Homo Sapiens
ggcacacuggccuccagaaggggucuccucugcagcucagggacucacugcccccuccacuggag

SEQ ID NO: 466124 - RNA, 65 nt, Homo Sapiens
aggugggaauugaguucaaagcuugguagcauaagcucagggauacuccaaacauuguaagaauu

SEQ ID NO: 466125 - RNA, 65 nt, Homo Sapiens
ccuccaggggucuucagaccacccacgaaaagggucucagggacuaaauaauuuuuaaucugcag

SEQ ID NO: 466126 - RNA, 64 nt, Homo Sapiens
uucuguaggacacugaggcucuuguuugacaugguguguggauggggacuugccccaagacuga

SEQ ID NO: 466127 - RNA, 64 nt, Homo Sapiens
auccaaguugcgugagauaagaugcaaagggcucuguguggaugaggaacgcaccuuagaggag

SEQ ID NO: 466128 - RNA, 64 nt, Homo Sapiens
gcacucuuuccaccucucuccaggacaguggagguguguggaagucugguaggggagaaagcag

SEQ ID NO: 466129 - RNA, 64 nt, Homo Sapiens
ugacucacccugaggagucuacccaaaggaguguuguguggacauugugucuuguugaaaagaa

SEQ ID NO: 466130 - RNA, 64 nt, Homo Sapiens
ggaguuugcaggaaggugagggugagcagagauguguguggacaucucugaccauccaucgcug

SEQ ID NO: 466131 - RNA, 64 nt, Homo Sapiens
ggcuggacuaaggugugauuaauucuuuguuuuuuguguggaacagcucaccuugucagacagc

SEQ ID NO: 466132 - RNA, 64 nt, Homo Sapiens
uuuccuccacuaaaucugcauugggauggggguauguguggauuguugaagaaaaucuggggga

SEQ ID NO: 466133 - RNA, 64 nt, Homo Sapiens
gcaugcaucaggugaucccgaugaccucguggccuguguggagaauggcuguugggagagagug

SEQ ID NO: 466134 - RNA, 64 nt, Homo Sapiens
acagggaauugauagcugcuaccacaugcagacauguguggagaugcuuccaaagucauuuccc

SEQ ID NO: 466135 - RNA, 64 nt, Homo Sapiens
ucuguucccagaccuguccccacaacaaggacccuguguggagccagguguucuccuucuuugu

SEQ ID NO: 466136 - RNA, 64 nt, Homo Sapiens
gaacaaccacuugaaauuauauacauacaauucuuguguggaauuuaacuccaugacugaauag

SEQ ID NO: 466137 - RNA, 64 nt, Homo Sapiens
ugcagugcuucacuggaaauuuagcagacugguguguguggaucggacauggccuugguaaagg

SEQ ID NO: 466138 - RNA, 64 nt, Homo Sapiens
ccuagcccuccauucucgacuuauuugaauucacuguguggagccuucccucacugaagagccc

SEQ ID NO: 466139 - RNA, 64 nt, Homo Sapiens
auuaaugguauaugcuccuugagugaccuuuauauguguggaaguuuucucucaauuauccuag

SEQ ID NO: 466140 - RNA, 64 nt, Homo Sapiens
uucacggacaaguuccaguaggaugugcagcaucuguguggauuccuccuuguaggggauaagg

SEQ ID NO: 466141 - RNA, 64 nt, Homo Sapiens
uguagagauucuguagugaagaggucugacaccauguguggaggaggaggaacgaucagucaag

SEQ ID NO: 466142 - RNA, 64 nt, Homo Sapiens
aagucaggcugaacauucagucuccagagacagcuguguggagcaaaucagaguucaugcccaa

SEQ ID NO: 466143 - RNA, 64 nt, Homo Sapiens
cguguaaaugcgaagaguucgaacagcuucucuauguguggauuaaugguguuggggggucuug

SEQ ID NO: 466144 - RNA, 64 nt, Homo Sapiens
gccaccaaucuagggacagggggguuagcgucuauguguggaagggugccagguuugugggaug

SEQ ID NO: 466145 - RNA, 64 nt, Homo Sapiens
cuuggaaucagcuacaaauccuaaagaugggguguguguggauguguguguguguguguguaca

SEQ ID NO: 466146 - RNA, 64 nt, Homo Sapiens
guucuagagcuggggguucuugggccaugcuccguguguggauaaggaaagaaauacuguuucu

SEQ ID NO: 466147 - RNA, 64 nt, Homo Sapiens
cagcacggaacauguagguuccccagcgggggcauguguggaggggcagggaagagaaagggca

SEQ ID NO: 466148 - RNA, 64 nt, Homo Sapiens
ccuucuucuuccuagcuuucaaguggaggccugcuguguggaucagucuauuauagaaggaaag

SEQ ID NO: 466149 - RNA, 64 nt, Homo Sapiens
gugucuuagguuggcauucaggucacaugaaagguguguggaaaguggccagcauucugccugc

SEQ ID NO: 466150 - RNA, 64 nt, Homo Sapiens
uguagguacccgcaucagcccuuguuccuaaggauguguggagcccaggcuguacucuuugaca

SEQ ID NO: 466151 - RNA, 64 nt, Homo Sapiens
ugagggaguggcaagcaccacagauuaccacguauguguggaagacauucguacucuuaucuuu

SEQ ID NO: 466152 - RNA, 64 nt, Homo Sapiens
auucucuuaauuagcuucauuauucuugucuuuguguguggauuaccuaaacucuccuuccaga

SEQ ID NO: 466153 - RNA, 64 nt, Homo Sapiens
ugagcucgcccgaguuguccuugagucugaaguuuguguggaagucugauuauguuuugccaua

SEQ ID NO: 466154 - RNA, 64 nt, Homo Sapiens
acaguuauucaggguucauuucagcccuaacuucuguguggauccgugguguuauguggucauu

SEQ ID NO: 466155 - RNA, 64 nt, Homo Sapiens
uggcuguuacgacaucccugucuuuuuuggcagauguguggaguugcucgccuugaugacuugc

SEQ ID NO: 466156 - RNA, 64 nt, Homo Sapiens
ucagugugugugugguuucuccugaaugggucccuguguggaucucuguguccucacucuuguc

SEQ ID NO: 466157 - RNA, 64 nt, Homo Sapiens
acuggaaggacucguguagguauguagagcauuauguguggacucaaaaaugguuuguuuuuaa

SEQ ID NO: 466158 - RNA, 64 nt, Homo Sapiens
ggcaagcuccuaauaaacaggaggagaagucaaguguguggacaaagaaaagccucaacugaca

SEQ ID NO: 466159 - RNA, 64 nt, Homo Sapiens
uccaggcaacaaaauaauuucuaaaauggauauauguguggauuaaugacaggcaguaaauacc

SEQ ID NO: 466160 - RNA, 64 nt, Homo Sapiens
uucuuuauuuuuaaaugaaaauuaagacaccuuuuguguggacauguuuuugucuuuaauguca

SEQ ID NO: 466161 - RNA, 64 nt, Homo Sapiens
uaacauuugggggaucuuuccaccuuuucacaguuguguggauaugggagaaaucucaauuagc

SEQ ID NO: 466162 - RNA, 64 nt, Homo Sapiens
acaguguauaacacguaguuugaagagcacaguauguguggaaguauucuagaucauuuuuuau

SEQ ID NO: 466163 - RNA, 64 nt, Homo Sapiens
uucaaacauacagaaacacacccauuccugugauagcauacaaaauacaauauacaaacauaug

SEQ ID NO: 466164 - RNA, 64 nt, Homo Sapiens
uacacacaaaaauguguguagugguauaccaaauagcauacaugugaggaguguguauguaccu

SEQ ID NO: 466165 - RNA, 64 nt, Homo Sapiens
uuuuauaggcuuauggguuauuuuauuacuaguuagcauacacaaaauauaacacaguuuguac

SEQ ID NO: 466166 - RNA, 64 nt, Homo Sapiens
acugaagcaugugaaacagugcaucugguguuucagcauacauacgaaaaguaaagauguauag

SEQ ID NO: 466167 - RNA, 64 nt, Homo Sapiens
ggacaauuuaaauuguggguaaauauuuaaaacuccugaacaauguuucugauggucuucuauc

SEQ ID NO: 466168 - RNA, 64 nt, Homo Sapiens
aggcucaucagucuauccuucugccuccauauauccugaacaucaaacuaucccaggaaaacca

SEQ ID NO: 466169 - RNA, 64 nt, Homo Sapiens
ucugggcacaagcuaguuuuuauguugauacguuccugaacauauuaucuuguuggacaucuuu

SEQ ID NO: 466170 - RNA, 64 nt, Homo Sapiens
caaaucaccaaauuucugauuuauguuuuuaucuccugaacaauauuuucucacucauauuccu

SEQ ID NO: 466171 - RNA, 64 nt, Homo Sapiens
cacagcuuccggcccgaggcuacuacccaagcccccugaacaaaccaauguguacacgacuacu

SEQ ID NO: 466172 - RNA, 64 nt, Homo Sapiens
aauaacuugaucccugaugaauggaauucaagacccugaacaagagaaugaaaaguacacaccc

SEQ ID NO: 466173 - RNA, 64 nt, Homo Sapiens
uuuaagguuuuacuuuucuguguaaagugaucucccugaacauuuauugcaagacaaaguugaa

SEQ ID NO: 466174 - RNA, 64 nt, Homo Sapiens
aaaaacaaaaagaaaaaaaaaccagugaggcugcccugaacaaaaauaaaauguuauuauguca

SEQ ID NO: 466175 - RNA, 64 nt, Homo Sapiens; identical to SEQ ID NO: 97088

SEQ ID NO: 466176 - RNA, 64 nt, Homo Sapiens; identical to SEQ ID NO: 97089

SEQ ID NO: 466177 - RNA, 64 nt, Homo Sapiens; identical to SEQ ID NO: 97090

SEQ ID NO: 466178 - RNA, 52 nt, Homo Sapiens; identical to SEQ ID NO: 97091

SEQ ID NO: 466179 - RNA, 64 nt, Homo Sapiens; identical to SEQ ID NO: 97092

SEQ ID NO: 466180 - RNA, 64 nt, Homo Sapiens; identical to SEQ ID NO: 97093

SEQ ID NO: 466181 - RNA, 64 nt, Homo Sapiens; identical to SEQ ID NO: 97094

SEQ ID NO: 466182 - RNA, 64 nt, Homo Sapiens; identical to SEQ ID NO: 97095

SEQ ID NO: 466183 - RNA, 64 nt, Homo Sapiens; identical to SEQ ID NO: 97096

SEQ ID NO: 466184 - RNA, 64 nt, Homo Sapiens; identical to SEQ ID NO: 97097

SEQ ID NO: 466185 - RNA, 64 nt, Homo Sapiens; identical to SEQ ID NO: 97098

SEQ ID NO: 466186 - RNA, 64 nt, Homo Sapiens; identical to SEQ ID NO: 97099

SEQ ID NO: 466187 - RNA, 64 nt, Homo Sapiens; identical to SEQ ID NO: 97100

SEQ ID NO: 466188 - RNA, 64 nt, Homo Sapiens; identical to SEQ ID NO: 97101

SEQ ID NO: 466189 - RNA, 64 nt, Homo Sapiens; identical to SEQ ID NO: 97102

SEQ ID NO: 466190 - RNA, 64 nt, Homo Sapiens; identical to SEQ ID NO: 97103

SEQ ID NO: 466191 - RNA, 64 nt, Homo Sapiens; identical to SEQ ID NO: 97104

SEQ ID NO: 466192 - RNA, 64 nt, Homo Sapiens; identical to SEQ ID NO: 97105

SEQ ID NO: 466193 - RNA, 64 nt, Homo Sapiens; identical to SEQ ID NO: 97106

SEQ ID NO: 466194 - RNA, 64 nt, Homo Sapiens; identical to SEQ ID NO: 97107

SEQ ID NO: 466195 - RNA, 64 nt, Homo Sapiens; identical to SEQ ID NO: 97108

SEQ ID NO: 466196 - RNA, 64 nt, Homo Sapiens; identical to SEQ ID NO: 97109

SEQ ID NO: 466197 - RNA, 64 nt, Homo Sapiens; identical to SEQ ID NO: 97110

SEQ ID NO: 466198 - RNA, 64 nt, Homo Sapiens; identical to SEQ ID NO: 97111

SEQ ID NO: 466199 - RNA, 64 nt, Homo Sapiens; identical to SEQ ID NO: 97112

SEQ ID NO: 466200 - RNA, 64 nt, Homo Sapiens; identical to SEQ ID NO: 97113

SEQ ID NO: 466201 - RNA, 64 nt, Homo Sapiens; identical to SEQ ID NO: 97114

SEQ ID NO: 466202 - RNA, 64 nt, Homo Sapiens; identical to SEQ ID NO: 97115

SEQ ID NO: 466203 - RNA, 64 nt, Homo Sapiens; identical to SEQ ID NO: 97116

SEQ ID NO: 466204 - RNA, 64 nt, Homo Sapiens; identical to SEQ ID NO: 97117

SEQ ID NO: 466205 - RNA, 64 nt, Homo Sapiens; identical to SEQ ID NO: 97118

SEQ ID NO: 466206 - RNA, 64 nt, Homo Sapiens; identical to SEQ ID NO: 97119

SEQ ID NO: 466207 - RNA, 64 nt, Homo Sapiens; identical to SEQ ID NO: 97120

SEQ ID NO: 466208 - RNA, 64 nt, Homo Sapiens; identical to SEQ ID NO: 97121

SEQ ID NO: 466209 - RNA, 64 nt, Homo Sapiens; identical to SEQ ID NO: 97122

SEQ ID NO: 466210 - RNA, 64 nt, Homo Sapiens; identical to SEQ ID NO: 97123

SEQ ID NO: 466211 - RNA, 64 nt, Homo Sapiens; identical to SEQ ID NO: 97124

SEQ ID NO: 466212 - RNA, 64 nt, Homo Sapiens; identical to SEQ ID NO: 97125

SEQ ID NO: 466213 - RNA, 64 nt, Homo Sapiens; identical to SEQ ID NO: 97126

SEQ ID NO: 466214 - RNA, 64 nt, Homo Sapiens; identical to SEQ ID NO: 97127

SEQ ID NO: 466215 - RNA, 64 nt, Homo Sapiens; identical to SEQ ID NO: 97128

SEQ ID NO: 466216 - RNA, 64 nt, Homo Sapiens; identical to SEQ ID NO: 97129

SEQ ID NO: 466217 - RNA, 64 nt, Homo Sapiens; identical to SEQ ID NO: 97130

SEQ ID NO: 466218 - RNA, 64 nt, Homo Sapiens; identical to SEQ ID NO: 97131

SEQ ID NO: 466219 - RNA, 64 nt, Homo Sapiens; identical to SEQ ID NO: 97132

SEQ ID NO: 466220 - RNA, 64 nt, Homo Sapiens; identical to SEQ ID NO: 97133

SEQ ID NO: 466221 - RNA, 65 nt, Homo Sapiens; identical to SEQ ID NO: 46699

SEQ ID NO: 466222 - RNA, 65 nt, Homo Sapiens; identical to SEQ ID NO: 46700

SEQ ID NO: 466223 - RNA, 65 nt, Homo Sapiens; identical to SEQ ID NO: 46729

SEQ ID NO: 466224 - RNA, 65 nt, Homo Sapiens; identical to SEQ ID NO: 46730

SEQ ID NO: 466225 - RNA, 65 nt, Homo Sapiens; identical to SEQ ID NO: 46736

SEQ ID NO: 466226 - RNA, 65 nt, Homo Sapiens; identical to SEQ ID NO: 46737

SEQ ID NO: 466227 - RNA, 65 nt, Homo Sapiens; identical to SEQ ID NO: 46784

SEQ ID NO: 466228 - RNA, 65 nt, Homo Sapiens; identical to SEQ ID NO: 46785

SEQ ID NO: 466229 - RNA, 65 nt, Homo Sapiens; identical to SEQ ID NO: 46787

SEQ ID NO: 466230 - RNA, 65 nt, Homo Sapiens; identical to SEQ ID NO: 46788

SEQ ID NO: 466231 - RNA, 65 nt, Homo Sapiens; identical to SEQ ID NO: 46800

SEQ ID NO: 466232 - RNA, 65 nt, Homo Sapiens; identical to SEQ ID NO: 46801

SEQ ID NO: 466233 - RNA, 65 nt, Homo Sapiens; identical to SEQ ID NO: 46823

SEQ ID NO: 466234 - RNA, 65 nt, Homo Sapiens; identical to SEQ ID NO: 46824

SEQ ID NO: 466235 - RNA, 65 nt, Homo Sapiens; identical to SEQ ID NO: 46864

SEQ ID NO: 466236 - RNA, 65 nt, Homo Sapiens; identical to SEQ ID NO: 46865

SEQ ID NO: 466237 - RNA, 64 nt, Homo Sapiens
cacuccuuguccuccaugcuguggcuguaucagcucccuacaaguucguuuacaccuggcagca

SEQ ID NO: 466238 - RNA, 64 nt, Homo Sapiens
cacauuaccuucuaauuauaguuugaaaauagauucccuacacauacauacauauguaugcaca

SEQ ID NO: 466239 - RNA, 64 nt, Homo Sapiens
uaauguggguaaaucugaguuuaauucaacugcuucccuacauagacuagagggcuaaggauuc

SEQ ID NO: 466240 - RNA, 64 nt, Homo Sapiens
uuuuuaaaaucaaccauguuagcugggauuagacucccuacaguccuucaauggaaaaguaaca

SEQ ID NO: 466241 - RNA, 64 nt, Homo Sapiens
ugaagacuuaucagggcccuaaggacuagaggucucccuacaaaagaaugagaauucagguucu

SEQ ID NO: 466242 - RNA, 64 nt, Homo Sapiens
gucacccucaggaucucuccaaguuuucuuuuuuucccuacaggcccagaaauagauguuuuuu

SEQ ID NO: 466243 - RNA, 64 nt, Homo Sapiens
agaaugcaucccgcauccaggcgcggucccccacucccuacaucagcgguggcuucuugaugcu

SEQ ID NO: 466244 - RNA, 64 nt, Homo Sapiens
agaacgcaucccucaucugggcgccgucccccacucccuacaucucagugcaagucuugaugcu

SEQ ID NO: 466245 - RNA, 64 nt, Homo Sapiens
uuuagaaauaguuuuaacuagcuuaguuuucugguuuccaaaacuaaaauagauuaaauccuac

SEQ ID NO: 466246 - RNA, 64 nt, Homo Sapiens
ucugaccacuaucuauaaauacauuggacauugguuuccaaaucucccuuucuucuucaguucc

SEQ ID NO: 466247 - RNA, 64 nt, Homo Sapiens
auaucccuaaaauuuuuagaaaucucucaaaaucuuuccaaauguucugguaucuuugaaaaau

SEQ ID NO: 466248 - RNA, 64 nt, Homo Sapiens
uacagaaacacaaaauggacuaagacaccacccuuuuccaaaaucucuccuugugauggcuccc

SEQ ID NO: 466249 - RNA, 64 nt, Homo Sapiens
agccuguucucuccucucuccaaagugcuggaauuuuccaaaacagagacgcauggcccgaagu

SEQ ID NO: 466250 - RNA, 64 nt, Homo Sapiens
agugcauguauaaauaauggaaaaguuuuuauuuuuuccaaacucauuuuuuucuuuuuuuaaa

SEQ ID NO: 466251 - RNA, 64 nt, Homo Sapiens
uguaccauguuuuauaaaccaaguaucuaacucauuuccaaacaucaguguguuuagacuuuuc

SEQ ID NO: 466252 - RNA, 64 nt, Homo Sapiens
ugaaauauaggugugaacagcuugcaaauaugcauuuccaaacuugaauacuuuuguauugcug

SEQ ID NO: 466253 - RNA, 64 nt, Homo Sapiens
gcccuaugcugugcuccauaaauuagugugacaguuuccaaauuaaaauuaacuuuuuuguggc

SEQ ID NO: 466254 - RNA, 64 nt, Homo Sapiens
aaaacaaauauacauuuucucuuguguucagcucuuuccaaauugaucuuuuaaaaucaugauc

SEQ ID NO: 466255 - RNA, 64 nt, Homo Sapiens
aacauuuuuuaagaaaacauguaagaggcugacuuuuccaaauaguauagauacaaaaccuugu

SEQ ID NO: 466256 - RNA, 64 nt, Homo Sapiens
cucaguuaaacugugaagcuaauucacuuaaguuuuuccaaaacgauauuucaaacaucagcug

SEQ ID NO: 466257 - RNA, 64 nt, Homo Sapiens
uguguguguguagguauuaaagauguguuguugguuuccaaaaaggaacacuggaaaauaaauu

SEQ ID NO: 466258 - RNA, 64 nt, Homo Sapiens
ugugauguuaacuauuauuaauaaauuuuaacauuuuccaaaauaaucaaaugugauucaugag

SEQ ID NO: 466259 - RNA, 64 nt, Homo Sapiens
ugagggagaaaaagaaaacauacauuaugaagccuuuccaaaauuaggugcuugguaaucacgu

SEQ ID NO: 466260 - RNA, 64 nt, Homo Sapiens
aauacauggaaauagcuugcuauuuuuauauacauuuccaaaauauuaagauaacuuucuguaa

SEQ ID NO: 466261 - RNA, 64 nt, Homo Sapiens
uugaagagaucuucucuggucagacuuggaagaauuuccaaaacugaaguuagccccaagacuu

SEQ ID NO: 466262 - RNA, 64 nt, Homo Sapiens
gcaacacuguucucuucuucucuacuaaauucuauuuccaaaauugguaauagagccagaagga

SEQ ID NO: 466263 - RNA, 64 nt, Homo Sapiens
cauaaugcuuaaagccauauggaguuggaaauuauuuccaaagcauauuuauuccauuguuuua

SEQ ID NO: 466264 - RNA, 64 nt, Homo Sapiens
uuuauuuuccuccauucauguacuuuuccuuauauuuccaaaacuguuacugagaaugggucaa

SEQ ID NO: 466265 - RNA, 64 nt, Homo Sapiens
uaauaaacuuuaauauaaagccuguacaguagauuuuccaaaugcuuaauccaauggguuuuuc

SEQ ID NO: 466266 - RNA, 64 nt, Homo Sapiens
gugauagucuuuugcuuuugggaaucaggaauauuuuccaaagacccacccugggcccugggcu

SEQ ID NO: 466267 - RNA, 64 nt, Homo Sapiens
uuuaugcuuugcuucccuuaagucaggcugcaaauuuccaaacuguuuuucuuuucuauugcau

SEQ ID NO: 466268 - RNA, 64 nt, Homo Sapiens
ucaauucuugacuucugugcaaacuaggcggagguuuccaaauccauuuccauacaucuucuga

SEQ ID NO: 466269 - RNA, 64 nt, Homo Sapiens
auuuucccuggucugaagcuuggaaagacugaucuuuccaaaaucuuggaaaggagcucacucu

SEQ ID NO: 466270 - RNA, 64 nt, Homo Sapiens
gcuuuuaugagauacauuucuuuggucugcaguuuuuccaaaggacaugaaggaggguuuuggu

SEQ ID NO: 466271 - RNA, 64 nt, Homo Sapiens
gcugucagcaauuuuuuccucccauuguugcugauuuccaaauccaugugacauauuucccuuu

SEQ ID NO: 466272 - RNA, 64 nt, Homo Sapiens
gcucauuuuauucuaggucucccaccagggcaaauuuccaaauagacaugcugggaaucuucac

SEQ ID NO: 466273 - RNA, 64 nt, Homo Sapiens
aggauacuuuuuuaagggguugagaauugaagauuuuccaaaagcguucaugaauuuagagcau

SEQ ID NO: 466274 - RNA, 64 nt, Homo Sapiens
uuucuuuuguuaagcagcacuuauguagacugcauuuccaaauguguugagcacucagagugua

SEQ ID NO: 466275 - RNA, 64 nt, Homo Sapiens
gggaaaacugucuaguucccuucugugucuaaauuuuccaaaacguugauuugcauaauacagu

SEQ ID NO: 466276 - RNA, 64 nt, Homo Sapiens
gcauuguagcuugcuuaacggagcacuucuccuuuuuccaaaggucuacauucuaggguguggg

SEQ ID NO: 466277 - RNA, 64 nt, Homo Sapiens
aaaaaguagaaaauugaguuacaauuugauuuuuuuuccaaagaugucuguuaaaucuguugug

SEQ ID NO: 466278 - RNA, 64 nt, Homo Sapiens
aggaaaaguuauaagguacagguugaguaucccuuuuccaaaaaugcuugggacaagaaguauu

SEQ ID NO: 466279 - RNA, 64 nt, Homo Sapiens
ucuguucaccaugaaaaggcugccaaaacaguaauuuccaaacuuacuaagauaaucugcuuug

SEQ ID NO: 466280 - RNA, 64 nt, Homo Sapiens
ggaagcccauacauaacaguagcaaguucauaaguuuccaaaaacaauuugcagaagcucacau

SEQ ID NO: 466281 - RNA, 64 nt, Homo Sapiens
gugccaucaaauauguucuuaauaaggacaccucuuuccaaacagcuuuuuuuuuuuuuuuuuu

SEQ ID NO: 466282 - RNA, 64 nt, Homo Sapiens
gcagcuccacuggguccccuugaugcuggccacguuuccaaacggauuccuccguguugugaug

SEQ ID NO: 466283 - RNA, 64 nt, Homo Sapiens
ucucacucaggaagggaggcccaaagccaccucauuuccaaacauguuacagacaagcuuauuu

SEQ ID NO: 466284 - RNA, 64 nt, Homo Sapiens
caccucauuuccaaacaucuuacagacaagcuuauuuccaaagcgucuuuguggaaaccacugu

SEQ ID NO: 466285 - RNA, 64 nt, Homo Sapiens
ggaucccagcccacaagugaucagcagaguugcauuuccaaagaaaaaggcuaugagaugagcu

SEQ ID NO: 466286 - RNA, 64 nt, Homo Sapiens
uuuuaacaaaaugaaaugauguguuaaguuuuuauuuccaaaguguuuaguuuauuggcugaug

SEQ ID NO: 466287 - RNA, 64 nt, Homo Sapiens
augucugcacaacaagaccuauuaaauaguaugguuuccaaaauuaacaccuacugauauucac

SEQ ID NO: 466288 - RNA, 64 nt, Homo Sapiens
caacuaagaaaauacucauaauaaaauaacaauguuuccaaaugguuuguggcaauuaauugcc

SEQ ID NO: 466289 - RNA, 64 nt, Homo Sapiens
auacccauaaauugugacuaugaaugcauuauauuuuccaaacuauccuaugugauuccugcuc

SEQ ID NO: 466290 - RNA, 64 nt, Homo Sapiens
auugcaaaauaauggccaguaaaaucagucaauauuuccaaauagagucuugguagauaagaaa

SEQ ID NO: 466291 - RNA, 64 nt, Homo Sapiens
caaugaaggaaaccaaaauaaaaccaaaacaaaauuuccaaaaauggcuauuucuauguuuuau

SEQ ID NO: 466292 - RNA, 64 nt, Homo Sapiens
gagccuuaaaaauuguaaagaugguaauacacacuuuccaaaauucauguugcagaccauguuu

SEQ ID NO: 466293 - RNA, 64 nt, Homo Sapiens
cuaauuaaggcgagugcuccagagucgggucugcuuuccaaaguauaggacauuugaagaacug

SEQ ID NO: 466294 - RNA, 64 nt, Homo Sapiens
cuguuuugucucuacuguguacucugaucguaucuuuccaaagugcagacucuugugaaguuuu

SEQ ID NO: 466295 - RNA, 64 nt, Homo Sapiens
gcuugcaacgcuuacguguugaucccaguguccuuuuccaaaugagugcuguagcuuuagaagu

SEQ ID NO: 466296 - RNA, 64 nt, Homo Sapiens
gaaaguaucgugaccauguggcccaccagcagccuuuccaaaggggaacuccagagacauuuca

SEQ ID NO: 466297 - RNA, 64 nt, Homo Sapiens
auuguucagaagauuuuuacaaauuaaaaacugauuuccaaauauguucaacauuuacuucuau

SEQ ID NO: 466298 - RNA, 64 nt, Homo Sapiens
gguaugcauuggauauagcaggaaagaaagcacauuuccaaacagcagggaguaagcuuacauu

SEQ ID NO: 466299 - RNA, 64 nt, Homo Sapiens
uaacuaaaaccccuaggucauuuguagauauauauuuccaaauauucuaaaaaagauacuguau

SEQ ID NO: 466300 - RNA, 64 nt, Homo Sapiens
gcuuuuuaaacugauguauagcuuuaacauuuuguuuccaaagcugaagauccccauucuuucu

SEQ ID NO: 466301 - RNA, 64 nt, Homo Sapiens
gugugaaguccacuuauguagacaaaacuuauaauuuccaaacuguugucuaguauacagugau

SEQ ID NO: 466302 - RNA, 64 nt, Homo Sapiens
cccugggcuuuccugaauugccaagccuggugccuuuccaaaggacuagcagggccuguggugg

SEQ ID NO: 466303 - RNA, 64 nt, Homo Sapiens
uuuccacaucaccucugggauauuucagcuguuguuuccaaauggcaaaucaucaacuaaaagc

SEQ ID NO: 466304 - RNA, 64 nt, Homo Sapiens
auucucauuccucuccucccagaguuuauuccucuuuccaaaacgaaagaaagguaaagagucu

SEQ ID NO: 466305 - RNA, 64 nt, Homo Sapiens
gcaugucacaugccacaaccaaguagaaaaauuguuuccaaaguuucaugccuuuuuuuuuuuu

SEQ ID NO: 466306 - RNA, 64 nt, Homo Sapiens
guccauuucauuaggaacuuugagauacauaugauuuccaaauaacccuaaugauuaaaccccg

SEQ ID NO: 466307 - RNA, 64 nt, Homo Sapiens
gaagacagacccucagacacagaugacuaggcuuuuuccaaaagcauauaucaugaucuaaugc

SEQ ID NO: 466308 - RNA, 64 nt, Homo Sapiens
uuguuagauuuuaaauguauuuaaugauacuaucuuuccaaacuauguaguguuuuaagauaau

SEQ ID NO: 466309 - RNA, 64 nt, Homo Sapiens
aaaaaugugauagauaaaagugauaagcaaacuauuuccaaacuaauaaaguagaauucuauau

SEQ ID NO: 466310 - RNA, 64 nt, Homo Sapiens
ccaggcaugaugcugagugacacucuuguguauauuuccaaauuuuuguacagucgcugcacau

SEQ ID NO: 466311 - RNA, 64 nt, Homo Sapiens
gucgcugcacauauuugaaaucauauauuaagacuuuccaaagaugaggucccugguuuuucau

SEQ ID NO: 466312 - RNA, 64 nt, Homo Sapiens
ggagaagggcacauuuaucuaggggcauuucagguuuccaaagaaaggaauguaugccugggaa

SEQ ID NO: 466313 - RNA, 64 nt, Homo Sapiens
cuguuagaauguauuaggucaugggcuaacauuauuuccaaaauugauuggcugguugccaaga

SEQ ID NO: 466314 - RNA, 64 nt, Homo Sapiens
uuagggaagauuccaauuaagcuuuaacacuaauuuuccaaagguguguggguuaaaaaaagaa

SEQ ID NO: 466315 - RNA, 64 nt, Homo Sapiens
ggaccauccugucuuaugguaaaagaucuugguuuuuccaaacuggcaccuauuuggaacuuag

SEQ ID NO: 466316 - RNA, 64 nt, Homo Sapiens
gcucaaaacacuacauccacauguagaguccuuuuuuccaaagaaugaauugucuaauuaauuu

SEQ ID NO: 466317 - RNA, 64 nt, Homo Sapiens
uuuguggguccgacaguaauuaauuuaaaaaaaauuuccaaauacaauuaagugggaacauuuu

SEQ ID NO: 466318 - RNA, 64 nt, Homo Sapiens
aacuucgggccccaagccauccucccaccuuggcuuuccaaaguguugggauuacaagcgugag

SEQ ID NO: 466319 - RNA, 64 nt, Homo Sapiens
acaacccccuuugguuagagaagggaaagugacuuuuccaaagcugcacagcuagacagucaua

SEQ ID NO: 466320 - RNA, 64 nt, Homo Sapiens
aaaaagcauaucaaauauuuuggguacuaggcaguuuccaaaguagcaugguaguauuacuugu

SEQ ID NO: 466321 - RNA, 64 nt, Homo Sapiens
cguuuuucaacuucaguuucauucacuaccauuguuuccaaauuaucaaucucugcuaguaauu

SEQ ID NO: 466322 - RNA, 64 nt, Homo Sapiens
uuauuaccuccccuaauccuugcauuucaguuucuuuccaaaacuguccaacucuccuccaggu

SEQ ID NO: 466323 - RNA, 64 nt, Homo Sapiens
aacuaaagccuggauuugauggugcugaaaccacuuuccaaauacagagccagcucaucuucca

SEQ ID NO: 466324 - RNA, 64 nt, Homo Sapiens
agcuacacaaaugcuucugacuccagugcccuucuuuccaaaaccuaauguagaaaaggcccgc

SEQ ID NO: 466325 - RNA, 64 nt, Homo Sapiens
uaaagacagcccauuuuuguucuuuuucuuuuuuuuuccaaaaauugguugaguuuugguuuuu

SEQ ID NO: 466326 - RNA, 64 nt, Homo Sapiens
gugugauuuucauacagguuauuuuuacgaucuguuuccaaaucccuuucaugucuuuccacuu

SEQ ID NO: 466327 - RNA, 64 nt, Homo Sapiens
gaguggccuagagcacucucaccccaagcggccuuuuccaaaugcccaaggaugccuuagcaug

SEQ ID NO: 466328 - RNA, 64 nt, Homo Sapiens
ucuuuugacauuuuggaaauaaucauaacuugucuuuccaaaauaaccauuuucuugauggaac

SEQ ID NO: 466329 - RNA, 64 nt, Homo Sapiens
uugcuuguagaaaguagacuugcucuuugucagauuuccaaacaaccuugccagccuuggcugu

SEQ ID NO: 466330 - RNA, 64 nt, Homo Sapiens
aaacuccugagcacuagcaauccacccaccucuguuuccaaaaaaaaaaaaaaaaugaaagguc

SEQ ID NO: 466331 - RNA, 64 nt, Homo Sapiens
cauucaggagauucuuccaucugggcaaccugguuuuccaaauaucauuugaccuaagugaaug

SEQ ID NO: 466332 - RNA, 64 nt, Homo Sapiens
acaugccacugucaccaaaacaaacaacuaccacuuuccaaauuucauucagaaccauuuuagu

SEQ ID NO: 466333 - RNA, 64 nt, Homo Sapiens
ucuggcuucuuuuucaagguaucagggcaaacaauuuccaaacuuuucauuuuguacagaagga

SEQ ID NO: 466334 - RNA, 64 nt, Homo Sapiens
acuuuuaaacuugggaaauaagcaccuguauuuuuuuccaaaacuguuuuuaaagcuguauacg

SEQ ID NO: 466335 - RNA, 64 nt, Homo Sapiens
guuagugcaucaguaaauguguuauuuugucauuuuuccaaagagaguguuguagguuuucccu

SEQ ID NO: 466336 - RNA, 64 nt, Homo Sapiens
ggcccuauuucauagaggcuggcccuauuagugauuuccaaaaacaauauggaagugccuuuug

SEQ ID NO: 466337 - RNA, 64 nt, Homo Sapiens
caagccugguagaauuggcuuuucuagcagaaccuuuccaaaaguuuuauauugagauucauaa

SEQ ID NO: 466338 - RNA, 64 nt, Homo Sapiens
uacuauuauguggaauuuaacuuuucagagaaaauuuccaaaguccucuaccuuauuuggcuuu

SEQ ID NO: 466339 - RNA, 64 nt, Homo Sapiens
aaaaugaggauccuguuggugauccucauuccaguuuccaaagcgagaggagccuucugagcag

SEQ ID NO: 466340 - RNA, 64 nt, Homo Sapiens
aaaaaaacuacuaaauuaaagccuuauugauuuuuuuccaaaaauauauauuuucaguuuuuuu

SEQ ID NO: 466341 - RNA, 64 nt, Homo Sapiens
aaucaccagaaggagacaccuugaccaaucauuuuuuccaaaucuuuccucaaguuugucucuc

SEQ ID NO: 466342 - RNA, 64 nt, Homo Sapiens
ccagauguuccacaggaccccaccaagaaggucauuuccaaacccauccuggaagggcccagga

SEQ ID NO: 466343 - RNA, 64 nt, Homo Sapiens
ucuucuggcugcuggccggagacagcucuugcccuuuccaaagucacuguccacugccuugcaa

SEQ ID NO: 466344 - RNA, 64 nt, Homo Sapiens
cuucaugguuaggagucuucgaaugauauguauuuuuccaaaugaaaaugguucugugaaaagu

SEQ ID NO: 466345 - RNA, 64 nt, Homo Sapiens
guuacuuuaaaaaucuguuaaucacguaaaauuuuuuccaaagggugaacuagugccuuugggu

SEQ ID NO: 466346 - RNA, 64 nt, Homo Sapiens
caacuaaagguauugaagguacuaauuaauuagauuuccaaaauuuucuacagagaguuaauua

SEQ ID NO: 466347 - RNA, 64 nt, Homo Sapiens
ccaguggaguuggguagaaugaccaaauaauuauuuuccaaacugggauacuuuuuagagugaa

SEQ ID NO: 466348 - RNA, 64 nt, Homo Sapiens
aagaggacagugauagaugcgcaucggauuuauuuuuccaaaucacccuuguccaaggcuuuau

SEQ ID NO: 466349 - RNA, 64 nt, Homo Sapiens
gugauauugacauuuauggagcccagagcuccgauuuccaaagaccagagggagcaucauaaga

SEQ ID NO: 466350 - RNA, 64 nt, Homo Sapiens
gaugauauucucuugaguauauaaugccagguauuuuccaaaauggcuugucaaguuuugcaaa

SEQ ID NO: 466351 - RNA, 64 nt, Homo Sapiens
guuaaaacuuguaaaaaaaauaucugcuucuguuuuuccaaaaguucaagaaauuauuuuauca

SEQ ID NO: 466352 - RNA, 64 nt, Homo Sapiens
guauuuauccucacugcuuugcagcauuuuugccuuuccaaaaauagugccucugaaaguugau

SEQ ID NO: 466353 - RNA, 64 nt, Homo Sapiens
ugacaagcuguguugaaauaauuaugauugauuuuuuccaaagaauucaguauaaggaaacgua

SEQ ID NO: 466354 - RNA, 64 nt, Homo Sapiens
ucccuuaaagucuuauuugcacccuuacaaaaucuuuccaaaggucacucuuaugaauggaugu

SEQ ID NO: 466355 - RNA, 64 nt, Homo Sapiens
uagucuuucaaacuguuccucagaggccuaggauuuuccaaaaguaccuuaggaaccuuguagg

SEQ ID NO: 466356 - RNA, 64 nt, Homo Sapiens
uuuaacauaggugguucugugauaacaucaguguuuuccaaaucaaaggaacgcuuuaaaaaau

SEQ ID NO: 466357 - RNA, 64 nt, Homo Sapiens
ucuucauaaaguucugcguuuggcaucuucacucuuuccaaaauguaucuguacaucagaaaug

SEQ ID NO: 466358 - RNA, 64 nt, Homo Sapiens
guugugcuuugagucagugcaauaaacuagacuuuuuccaaaccuggccgaguguggugccuga

SEQ ID NO: 466359 - RNA, 64 nt, Homo Sapiens
ggaggacuacacacauuauggaaagaccucauucuuuccaaaggaauuuauagguguagcuuga

SEQ ID NO: 466360 - RNA, 64 nt, Homo Sapiens
uuuaggaauguuuaguguaaaaucuuuuucucucuuuccaaaaacauuucaagugaauuauuuu

SEQ ID NO: 466361 - RNA, 64 nt, Homo Sapiens
gcagcuugaaauguugguccuguuuuuaauuuucuuuccaaaagaauaauuaaccaucuaccuc

SEQ ID NO: 466362 - RNA, 64 nt, Homo Sapiens
agccuuauuaaaauauaaauaauaguaaauuuacuuuccaaaaacaugggagcaacugaguagc

SEQ ID NO: 466363 - RNA, 64 nt, Homo Sapiens
gcagcagugucucuuucagugacacacacacacguuuccaaagugauagguuuaaacacacaga

SEQ ID NO: 466364 - RNA, 64 nt, Homo Sapiens
cuaugauucuuucugcauuuucgguuaacuaucauuuccaaagacuugucauucaguaauauua

SEQ ID NO: 466365 - RNA, 64 nt, Homo Sapiens
ugucaugaaaucauuccagauaccucuuuucuucuuuccaaaugguuuucacauguguuugaaa

SEQ ID NO: 466366 - RNA, 64 nt, Homo Sapiens
gagcccggggcucugcagcaucauccugccagaguuuccaaaugggacguggucuccagcuucu

SEQ ID NO: 466367 - RNA, 64 nt, Homo Sapiens
aggucacauucugaggucugcaucaaaacccguguuuccaaauacucaucuuaacuaauuauau

SEQ ID NO: 466368 - RNA, 64 nt, Homo Sapiens
auaaguuauggguuuuuauguuuuguuuuguguuuuuccaaaacuugaacuugcaggcaagccu

SEQ ID NO: 466369 - RNA, 64 nt, Homo Sapiens
acauuuuaaggaugucacuauggcacuguugucauuuccaaauuccuagaaaaguuuguuuuac

SEQ ID NO: 466370 - RNA, 64 nt, Homo Sapiens
uucaaagccaauagccuuguuacucuguggaugauuuccaaacaugcuuuguggcuuaguaaac

SEQ ID NO: 466371 - RNA, 64 nt, Homo Sapiens
ucucaguuaucaagaccucaucauuagaggaagcuuuccaaaguccugccagcccuucccaguc

SEQ ID NO: 466372 - RNA, 64 nt, Homo Sapiens
gaaaaucccucccauguagacauguugcacauuuuuuccaaauuuauacauggaacugcaguag

SEQ ID NO: 466373 - RNA, 64 nt, Homo Sapiens
auuguuaaaguugucacuuguguaacugacugcuuuuccaaaacugguacuuaugugaacuguu

SEQ ID NO: 466374 - RNA, 64 nt, Homo Sapiens
gugaaaaauguuaaaacagaguuguugcuuaucuuuuccaaaaaaauuuauauuuuuaaagcaa

SEQ ID NO: 466375 - RNA, 64 nt, Homo Sapiens
uaauauuguaaaguucaauuagacauucuggagguuuccaaaaagcuacaauuaggucuuuguc

SEQ ID NO: 466376 - RNA, 64 nt, Homo Sapiens
cguaaacacuugacuauaaaaacugccccccuccuuuccaaauaagugcauuuauugccucuau

SEQ ID NO: 466377 - RNA, 64 nt, Homo Sapiens
gagaugucuuaaccuauucccaaaugccuucuguuuuccaaaggaguggucaagcccuugccca

SEQ ID NO: 466378 - RNA, 64 nt, Homo Sapiens
ccaaauauggccacgcuccccagccugagcgugcuuuccaaaacuccccuccccguccacaggg

SEQ ID NO: 466379 - RNA, 64 nt, Homo Sapiens
uccacugcugcucccgggucacuugguccauccauuuccaaaccgcccccacccaguccugcac

SEQ ID NO: 466380 - RNA, 64 nt, Homo Sapiens
acucauagugagcuuauucuuauuuuggauugauuuuccaaaaccacagcuucagcagcaacaa

SEQ ID NO: 466381 - RNA, 64 nt, Homo Sapiens
uuguuguguuuuaagacuuguauauaaacugcuuuuuccaaacucuguauaacuuuuaaauggc

SEQ ID NO: 466382 - RNA, 64 nt, Homo Sapiens
uucgggacgcggcggcugcaguuucacccccgaauuuccaaacggaguuucgcucucguugccg

SEQ ID NO: 466383 - RNA, 64 nt, Homo Sapiens
ugcaauagguucucuuugggaccuaaugacucauuuuccaaaaauccgcuucuacuuuugguac

SEQ ID NO: 466384 - RNA, 64 nt, Homo Sapiens; identical to SEQ ID NO: 349054

SEQ ID NO: 466385 - RNA, 64 nt, Homo Sapiens; identical to SEQ ID NO: 349055

SEQ ID NO: 466386 - RNA, 64 nt, Homo Sapiens; identical to SEQ ID NO: 349056

SEQ ID NO: 466387 - RNA, 64 nt, Homo Sapiens; identical to SEQ ID NO: 349057

SEQ ID NO: 466388 - RNA, 64 nt, Homo Sapiens; identical to SEQ ID NO: 349058

SEQ ID NO: 466389 - RNA, 64 nt, Homo Sapiens; identical to SEQ ID NO: 349059

SEQ ID NO: 466390 - RNA, 64 nt, Homo Sapiens; identical to SEQ ID NO: 349060

SEQ ID NO: 466391 - RNA, 64 nt, Homo Sapiens; identical to SEQ ID NO: 349061

SEQ ID NO: 466392 - RNA, 64 nt, Homo Sapiens; identical to SEQ ID NO: 349062

SEQ ID NO: 466393 - RNA, 64 nt, Homo Sapiens; identical to SEQ ID NO: 349063

SEQ ID NO: 466394 - RNA, 64 nt, Homo Sapiens; identical to SEQ ID NO: 349064

SEQ ID NO: 466395 - RNA, 64 nt, Homo Sapiens; identical to SEQ ID NO: 349065

SEQ ID NO: 466396 - RNA, 64 nt, Homo Sapiens; identical to SEQ ID NO: 349066

SEQ ID NO: 466397 - RNA, 64 nt, Homo Sapiens; identical to SEQ ID NO: 349067

SEQ ID NO: 466398 - RNA, 64 nt, Homo Sapiens; identical to SEQ ID NO: 349068

SEQ ID NO: 466399 - RNA, 64 nt, Homo Sapiens; identical to SEQ ID NO: 349069

SEQ ID NO: 466400 - RNA, 64 nt, Homo Sapiens
ggaaucuagugucuuucuaacuuuaauugaaaacgaaguguaacaaucgcucagagaugagauc

SEQ ID NO: 466401 - RNA, 64 nt, Homo Sapiens
ugcagaaaagugggaacauguaauugaagcaugugaaguguaccagaguuuguuuuaaaauuuu

SEQ ID NO: 466402 - RNA, 64 nt, Homo Sapiens
cauggauguguguugcaggguggagaaguggggagaaguguauaguaguacacggggggaagag

SEQ ID NO: 466403 - RNA, 64 nt, Homo Sapiens
ugccacucacuuuuuguugguucugaaucuuccugaaguguacugacauuugggcugcacagag

SEQ ID NO: 466404 - RNA, 64 nt, Homo Sapiens; identical to SEQ ID NO: 114045

SEQ ID NO: 466405 - RNA, 64 nt, Homo Sapiens; identical to SEQ ID NO: 114046

SEQ ID NO: 466406 - RNA, 64 nt, Homo Sapiens; identical to SEQ ID NO: 114047

SEQ ID NO: 466407 - RNA, 64 nt, Homo Sapiens; identical to SEQ ID NO: 114048

SEQ ID NO: 466408 - RNA, 64 nt, Homo Sapiens; identical to SEQ ID NO: 114049

SEQ ID NO: 466409 - RNA, 64 nt, Homo Sapiens; identical to SEQ ID NO: 114050

SEQ ID NO: 466410 - RNA, 64 nt, Homo Sapiens; identical to SEQ ID NO: 114051

SEQ ID NO: 466411 - RNA, 64 nt, Homo Sapiens; identical to SEQ ID NO: 114052

SEQ ID NO: 466412 - RNA, 64 nt, Homo Sapiens; identical to SEQ ID NO: 114053

SEQ ID NO: 466413 - RNA, 64 nt, Homo Sapiens; identical to SEQ ID NO: 114054

SEQ ID NO: 466414 - RNA, 64 nt, Homo Sapiens; identical to SEQ ID NO: 114055

SEQ ID NO: 466415 - RNA, 64 nt, Homo Sapiens; identical to SEQ ID NO: 114056

SEQ ID NO: 466416 - RNA, 64 nt, Homo Sapiens; identical to SEQ ID NO: 114057

SEQ ID NO: 466417 - RNA, 64 nt, Homo Sapiens
ugauuugcuauuuugccuagagcuuuguccuucuagaucugauuggcuguaaguaucucuacug

SEQ ID NO: 466418 - RNA, 64 nt, Homo Sapiens
gauuagagggggauuuuugaugggagaaagcuggagaucugaacccagcccauuugcacacuau

SEQ ID NO: 466419 - RNA, 64 nt, Homo Sapiens
aguaaaacggcaccucuggcacuuuugcagcaucagaucugagggggcugcugaaaucgcagag

SEQ ID NO: 466420 - RNA, 64 nt, Homo Sapiens
ccagaaaugacccuuccuccggcuaaccaggugaagaucugagcaauaucuuuauuagaccugg

SEQ ID NO: 466421 - RNA, 64 nt, Homo Sapiens
uaggguucuuccaugggcuuacugacaguugcccagaucugaaggggaaagggucuugagaaag

SEQ ID NO: 466422 - RNA, 64 nt, Homo Sapiens
accucuacguuauuuugcugcuaugugcauuuccagaucugauuuucugcuaacuugugugcua

SEQ ID NO: 466423 - RNA, 64 nt, Homo Sapiens
accagaauagcuuuaaaaagacaaaaaggaucguagaucugauuuuuaaaugguugguugcucu

SEQ ID NO: 466424 - RNA, 64 nt, Homo Sapiens
uagaucugauuuuuaaaugguugguugcucugacagaucugaacacuuugcuucaugacuauuu

SEQ ID NO: 466425 - RNA, 64 nt, Homo Sapiens
agauuaaaaaaaaaucucaagugguuucagaggcagaucugagaaguugcauagcugcuuugca

SEQ ID NO: 466426 - RNA, 64 nt, Homo Sapiens
aagcugucaguucucacccccucugcguucuccuagaucugagcgguugaaugauagcauuuca

SEQ ID NO: 466427 - RNA, 64 nt, Homo Sapiens
uaaaugagaagccaagcucuuugaaucugcaacaagaucugaaaacugagaaauaagauugacu

SEQ ID NO: 466428 - RNA, 64 nt, Homo Sapiens
cacgucaaguugaaauuaggccuauaugaauaugagaucugaaguauguuuggaucauuaaaua

SEQ ID NO: 466429 - RNA, 64 nt, Homo Sapiens
gauuucuuuguauacuuguauuaguauuucuguaagaucugagaaguggaauuuguagggucau

SEQ ID NO: 466430 - RNA, 64 nt, Homo Sapiens
uauucaccaguggauuuacccuuagaguauuuuuagaucugagcugaugacuugugagagaaaa

SEQ ID NO: 466431 - RNA, 64 nt, Homo Sapiens
uuaggcaauggucuauauaagcaaaaggagauagagaucugaaauaauuuuccgaauaauucag

SEQ ID NO: 466432 - RNA, 64 nt, Homo Sapiens
cauuauuucaaauugcuugucaaaauggcccaaaagaucugaauucacauuaaguuccccuugc

SEQ ID NO: 466433 - RNA, 64 nt, Homo Sapiens
ccuguaaggauucauggauaaaaugaacaggaauagaucugaauaaagcaaaucugcauaaaug

SEQ ID NO: 466434 - RNA, 64 nt, Homo Sapiens
acuuaaaauucuugagcacguuaauauguuuuuaagaucugauuaucuuugagagaucuucugu

SEQ ID NO: 466435 - RNA, 51 nt, Homo Sapiens
cuaaaccuguggagaagugagagaucugaauuuggagaggacauggggaag

SEQ ID NO: 466436 - RNA, 64 nt, Homo Sapiens
acagauaaucuuuaaguacagacccaggaauaucagaucugaaguggcaccaucuuuucugucu

SEQ ID NO: 466437 - RNA, 64 nt, Homo Sapiens
ccucaugcuguucuugugauggugaguucucaugagaucugauggguguuuuuuuuuguuuugu

SEQ ID NO: 466438 - RNA, 64 nt, Homo Sapiens
gggauuacaggcgugagccacugcuccuggcccaagaucugaugguuuuguaagggaauuuucc

SEQ ID NO: 466439 - RNA, 64 nt, Homo Sapiens
uaacuaucuaucuugccucguaugacagugaaagagaucugaccaaugauaacagugaggaaau

SEQ ID NO: 466440 - RNA, 63 nt, Homo Sapiens
uagaaagacugcgugagucuacuggcuggaugaagaucugauuugauuagguuacggaaauga

SEQ ID NO: 466441 - RNA, 64 nt, Homo Sapiens
gagcacaguaauuaugaccuuuuuguuuuggcuacaacuugauugaaacaaguucaaaauuuaa

SEQ ID NO: 466442 - RNA, 64 nt, Homo Sapiens
uaaaugauggguuuguugguauuuaaaaugaauacaacuugaauguaauuaaagugcuguuuuu

SEQ ID NO: 466443 - RNA, 64 nt, Homo Sapiens
ucuccugcucuguccauuuccuaugaacuaaugacaacuugagaaggcugggaggauuguguau

SEQ ID NO: 466444 - RNA, 64 nt, Homo Sapiens
guauuucacuuuuucuguuauuuucaauuuauuacaacuugacagcuccaagcucuuauuacua

SEQ ID NO: 466445 - RNA, 64 nt, Homo Sapiens
gguggcaauauggugucgaucuguauguaagcaacaacuugaaaugucugguucuugguauuua

SEQ ID NO: 466446 - RNA, 64 nt, Homo Sapiens
uuuaaaaacugcuauuccuugaguuuggacugaucaacuugagagcuaaaaaaaaaaacgggug

SEQ ID NO: 466447 - RNA, 64 nt, Homo Sapiens
auuugggggacauuuucauaugguaugugccuuucaacuugauaugaaugaacugcuggggcag

SEQ ID NO: 466448 - RNA, 64 nt, Homo Sapiens
gaacugcuggggcagugguaucacaugcuaacgacaacuugaaucuaaaagcacaacuaaaauu

SEQ ID NO: 466449 - RNA, 64 nt, Homo Sapiens
auucuaaaucacuuuaauuuagaagauaggugagcaacuugagugaucccaaaccaaacuaaca

SEQ ID NO: 466450 - RNA, 64 nt, Homo Sapiens
ggauauagcaacaucuuuugauaauugugcuuuacaacuugaaugcugauucaaggcauuauuu

SEQ ID NO: 466451 - RNA, 64 nt, Homo Sapiens
uggagguaauacauacauaguaucaauauuguuucaacuugauguccucuaagcuaucauccag

SEQ ID NO: 466452 - RNA, 64 nt, Homo Sapiens
uuuugacuuaguguccugucccccuuggacguuccaacuugacuuaguguccagugccccuugg

SEQ ID NO: 466453 - RNA, 64 nt, Homo Sapiens
ccccaagcuucccucggagaagugagaggcucucccuggcuagauccucaucucaauagcaccu

SEQ ID NO: 466454 - RNA, 64 nt, Homo Sapiens
aggcaaucaccugaggucaggaguucaagaccagccuggcuaacaugugaaacuaauaauaaua

SEQ ID NO: 466455 - RNA, 64 nt, Homo Sapiens
acagugaaacguguuuuuacgagaucgagaccauccuggcuaaccggguggaucacgaggucag

SEQ ID NO: 466456 - RNA, 64 nt, Homo Sapiens
auggugaaacccugucucuagagaucgagaccauccuggcuaacggggcggaucgugaagucag

SEQ ID NO: 466457 - RNA, 64 nt, Homo Sapiens
uuuuacuuuuuuuuuuuuuuugugagccaccacaccuggcuaaucgaguagggaggaccacagg

SEQ ID NO: 466458 - RNA, 64 nt, Homo Sapiens
acccaaacauaugcacauucaucagagaccaggcccuggcuaagucuaggguaugggaaaucca

SEQ ID NO: 466459 - RNA, 64 nt, Homo Sapiens
caaguagccaggacuauaggcaccugccaccaugccuggcuaauuuuuguauuuuuuuucuuuc

SEQ ID NO: 466460 - RNA, 64 nt, Homo Sapiens
caaguagcuaggacuacaggagcacaccaccacaccuggcuaauuuuuguauuuuuuguggaga

SEQ ID NO: 466461 - RNA, 64 nt, Homo Sapiens
agagcuccaccguauuagcuccauuagcuuggagccuggcuagcaacacucacugucaguuagg

SEQ ID NO: 466462 - RNA, 64 nt, Homo Sapiens
cugaguaacuggaacuacaggugugcacuccucgccuggcuaauuuuuuauuuuuuguacaggc

SEQ ID NO: 466463 - RNA, 64 nt, Homo Sapiens
ugaguagcuaggacuacagaugcucgccaccacaccuggcuaauuuuuuuuuuuugagacugag

SEQ ID NO: 466464 - RNA, 64 nt, Homo Sapiens
ugaguagcugggauuacaggcgugugccaccaugccuggcuaacuuuuguauuuuuaguagaga

SEQ ID NO: 466465 - RNA, 64 nt, Homo Sapiens
ugauggcagagccagagcuuucacuuaaaugucaccuggcuaacugagacuuaagggaacugaa

SEQ ID NO: 466466 - RNA, 64 nt, Homo Sapiens
uuuuguauuuuuauuauagacacacacuaccacgccuggcuaaucgaguagcugggauuacagg

SEQ ID NO: 466467 - RNA, 64 nt, Homo Sapiens
gacccaggaagggcagcuccagccagaggaccuuccuggcuaugcaggugcacagcucuuaggc

SEQ ID NO: 466468 - RNA, 64 nt, Homo Sapiens
guccagcugcuaagaucccuucaucugcacaagcccuggcuagauaugugugaauguguggcau

SEQ ID NO: 466469 - RNA, 64 nt, Homo Sapiens
uuuuguuuuucguagagaugugccugccacuaugccuggcuaaucaaguagcuaggauuacaag

SEQ ID NO: 466470 - RNA, 64 nt, Homo Sapiens
uuuguauuuuuaguagagaccauaguccagcacgccuggcuaaucgaguaguugggauuagagg

SEQ ID NO: 466471 - RNA, 64 nt, Homo Sapiens
ggaaagcccugcuuugcuccaggcuccaagaucuccuggcuaagucagcaagugagaaaaugug

SEQ ID NO: 466472 - RNA, 64 nt, Homo Sapiens
gcugauuuuuuccaaagucuaaagacugagcucaccuggcuagauuguuguguguuuuguugaa

SEQ ID NO: 466473 - RNA, 64 nt, Homo Sapiens
gggaagauacagaaccaucccagacaaagggcucccuggcuacugcgugccaggcaacaguggg

SEQ ID NO: 466474 - RNA, 64 nt, Homo Sapiens
auggugaaaccccaucucuagagaucaaaaccauccuggcuaaccagguagaucaugaggucag

SEQ ID NO: 466475 - RNA, 64 nt, Homo Sapiens
ugggaugggcugggaucuucucugugaauccaccccuggcuacccccacccuggcuaccccaac

SEQ ID NO: 466476 - RNA, 64 nt, Homo Sapiens
ucuucucugugaauccaccccuggcuacccccacccuggcuaccccaacggcaucccaaggcca

SEQ ID NO: 466477 - RNA, 64 nt, Homo Sapiens
cacccccaccauuccuacacccucgggagcggccccuggcuauggggcuccacugggccccugg

SEQ ID NO: 466478 - RNA, 64 nt, Homo Sapiens
gcuacacuggucuucccuacauccugcacugccaccuggcuauaagcccagcagcccuucguga

SEQ ID NO: 466479 - RNA, 64 nt, Homo Sapiens
cgaguagcugggauuaccggcacccaccaccacgccuggcuaauuuuucaauuuucuuuuucag

SEQ ID NO: 466480 - RNA, 64 nt, Homo Sapiens
gcaguuuugccucaggugcugaacauuucucagcccuggcuaaaagggagcagcacagggagag

SEQ ID NO: 466481 - RNA, 64 nt, Homo Sapiens
aggccgacagcuacauccucgauuagcaagcccaccuggcuaccagcuuaagguagaggugcag

SEQ ID NO: 466482 - RNA, 64 nt, Homo Sapiens
auagaggggcucugggagacauuagcuugagcaaccuggcuaaguccuguugggaaagaauaaa

SEQ ID NO: 466483 - RNA, 64 nt, Homo Sapiens
gcuucgggugugugugucugggauggaaaacgggccuggcuagaaaugagagaaugguacuuag

SEQ ID NO: 466484 - RNA, 64 nt, Homo Sapiens
acggugaaacccugucucuacaggacgagaccauccuggcuaacaggcgggcggaucacaaagu

SEQ ID NO: 466485 - RNA, 64 nt, Homo Sapiens
uuuuguauuuuauguagagacaugcaccaccaugccuggcuaaucagguaacugggacuacagg

SEQ ID NO: 466486 - RNA, 64 nt, Homo Sapiens
uuuuguauuuuuaguacagaugugcaccaccacgccuggcuaaaccaguagcugggauuacagg

SEQ ID NO: 466487 - RNA, 64 nt, Homo Sapiens
caaguaggugggacuccaggcaugcaccaccaugccuggcuaauuuuugcauuuuuaguagaga

SEQ ID NO: 466488 - RNA, 64 nt, Homo Sapiens
caagcagcugggacuacagguaccugccaccacgccuggcuaauuuuguuuuuguauuuuuagu

SEQ ID NO: 466489 - RNA, 64 nt, Homo Sapiens
ccuugacgacaagaccaccaacguguccuuguacccuggcuacaacuucagguaacuccaaggc

SEQ ID NO: 466490 - RNA, 64 nt, Homo Sapiens
ggcagaucaccugaggucgggaguuggagacccgccuggcuaacaaggcgaaauccugucugua

SEQ ID NO: 466491 - RNA, 64 nt, Homo Sapiens
ccagauagcugggccacaggcgugugccaccacaccuggcuaacuuuuuuuuuuuuuuuuuuuu

SEQ ID NO: 466492 - RNA, 64 nt, Homo Sapiens
ccaguagcugggacuacaggcgccugccaacaugccuggcuaauuuuuuuuuuuuguauuuuua

SEQ ID NO: 466493 - RNA, 64 nt, Homo Sapiens
cuuccucccuucagucaguguccccaggguccagccuggcuagaguuagaaggcagaccuagcc

SEQ ID NO: 466494 - RNA, 64 nt, Homo Sapiens
cgggcggaucacgaggucaggagaucgagaccauccuggcuaacguggugaaaccccaucucua

SEQ ID NO: 466495 - RNA, 64 nt, Homo Sapiens
ggaggagcugguaucacaggcgucccccaccacgccuggcuaaauuuuguauuuuuaggugguc

SEQ ID NO: 466496 - RNA, 64 nt, Homo Sapiens
caaguagcugggauuacaggcauguacuaccaugccuggcuaauuuucuuguaguuuuaguagg

SEQ ID NO: 466497 - RNA, 64 nt, Homo Sapiens
auggugaaaccccaucucuaaaguucaagagcacccuggcuaacaguggaucaccuaaggucag

SEQ ID NO: 466498 - RNA, 64 nt, Homo Sapiens
acggugaaaccccaucucuagagaucgagaccguccuggcuaaccgggcccaugacaaggucag

SEQ ID NO: 466499 - RNA, 64 nt, Homo Sapiens
auggcgaauccucguuuugaguauuugagaacagccuggcuaacggcagaucaccugagaucaa

SEQ ID NO: 466500 - RNA, 64 nt, Homo Sapiens
acggugaaaccccaucucuagagaucgagaaaauccuggcuaaccaagagcaucacgaggucag

SEQ ID NO: 466501 - RNA, 64 nt, Homo Sapiens
agugaaacccugucuccacugagaucgcgaccauccuggcuaaccgggcggaucaugaggucag

SEQ ID NO: 466502 - RNA, 64 nt, Homo Sapiens
acagugaaaccccaugucuggaaauugagaccauccuggcuaaucagguagaucacaaggucag

SEQ ID NO: 466503 - RNA, 64 nt, Homo Sapiens
cuaggacaucaccuugcuguucuuccuuucggagccuggcuaguaguuaggagggacagacagc

SEQ ID NO: 466504 - RNA, 64 nt, Homo Sapiens
cagugugugguuaguaggaaaggacccgccaugcccuggcuagagucuacugugccucaggaua

SEQ ID NO: 466505 - RNA, 64 nt, Homo Sapiens
uaugaaccagccccacagccccaggccccugucaccuggcuaugcccacucaucccacccgucu

SEQ ID NO: 466506 - RNA, 64 nt, Homo Sapiens
caaguagcugggauuacaggcaugcaccaccaugccuggcuaauuuuguauuuuuaguagagau

SEQ ID NO: 466507 - RNA, 64 nt, Homo Sapiens
aaaugagcugggugugaugauacaugccuguaauccuggcuacuugggaggcugaggcaugaga

SEQ ID NO: 466508 - RNA, 64 nt, Homo Sapiens
gugggcggaucacgaggucaggagauugagaccuccuggcuaacacggugaaaccccgucuuua

SEQ ID NO: 466509 - RNA, 64 nt, Homo Sapiens
uuuuguguuuuuaguagagacaugcaccaccacaccuggcuaaucgaguagcugggauuacagg

SEQ ID NO: 466510 - RNA, 64 nt, Homo Sapiens
uuuuguauuuuuaguagagacgugcaccaccacaccuggcuaaucgaguagcugagauuauagg

SEQ ID NO: 466511 - RNA, 64 nt, Homo Sapiens
cagggcugggaggaccccagugcccuccucagaagaagcacaugggcuccugcagcccuguccu

SEQ ID NO: 466512 - RNA, 64 nt, Homo Sapiens
cccuuggugcuuuagugcaagaagccuaggcucagaagcacagcagcgccaucuuuccguuuca

SEQ ID NO: 466513 - RNA, 64 nt, Homo Sapiens
auguugaaaauccuggguguugauguuucuuacagaagcacaauccugcaggguaguaacccag

SEQ ID NO: 466514 - RNA, 64 nt, Homo Sapiens
gccauguuggagagcaaaacguccucugggagcugaagcacacggagugcuuuguggcuuuggg

SEQ ID NO: 466515 - RNA, 64 nt, Homo Sapiens
uuugcccuuugcgagacauuaaagucaauucacagaagcacaauaucacagccuagaguuaagu

SEQ ID NO: 466516 - RNA, 59 nt, Homo Sapiens; identical to SEQ ID NO: 214912

SEQ ID NO: 466517 - RNA, 64 nt, Homo Sapiens
agcugggaaggccgcaagaggcauagagggagaggaagcacacugcagggcugcuguggcccag

SEQ ID NO: 466518 - RNA, 64 nt, Homo Sapiens
ugagacggagaccccgguggcaguggaaaaaucagaagcacaaaggaaaacucuuggccucugc

SEQ ID NO: 466519 - RNA, 64 nt, Homo Sapiens
aaugugccuuaaaaaucaagacacuaguucagaggaagcacauaauguccagaucuauggcgaa

SEQ ID NO: 466520 - RNA, 64 nt, Homo Sapiens
cggcagaccucuuagagucccucugugucaaggugaagcacauaggaggcugcagcgcccggug

SEQ ID NO: 466521 - RNA, 64 nt, Homo Sapiens
accgggggagagggacacuccuggagaauugacugaagcacagcaggguuugagagcccgcgug

SEQ ID NO: 466522 - RNA, 64 nt, Homo Sapiens
cacgcagaccugcagcgggcaaagagcucccgaggaagcacagcuugggucagguucuugccuu

SEQ ID NO: 466523 - RNA, 64 nt, Homo Sapiens
aagcaagaaagagggucccagggcugcaaaacuggaagcacagccucggggauggggagggaaa

SEQ ID NO: 466524 - RNA, 64 nt, Homo Sapiens
ucaaccagaagagugcgcugcaggugcacaugaagaagcacacgggggagcggcccuacaagug

SEQ ID NO: 466525 - RNA, 64 nt, Homo Sapiens
aaucuguguucagguccaggguuacauaauugcagaagcacaagccauacaucgcagguaggaa

SEQ ID NO: 466526 - RNA, 64 nt, Homo Sapiens
cuggcugaacucugggagugugucccagcugagggaagcacaaguagcaaagcucauuggucug

SEQ ID NO: 466527 - RNA, 64 nt, Homo Sapiens
agggucauuagcuuugggaauagaaggcuacacagaagcacacuguuuuugaacuugacaacag

SEQ ID NO: 466528 - RNA, 64 nt, Homo Sapiens; identical to SEQ ID NO: 71314

SEQ ID NO: 466529 - RNA, 64 nt, Homo Sapiens; identical to SEQ ID NO: 71315

SEQ ID NO: 466530 - RNA, 64 nt, Homo Sapiens; identical to SEQ ID NO: 71316

SEQ ID NO: 466531 - RNA, 64 nt, Homo Sapiens; identical to SEQ ID NO: 71317

SEQ ID NO: 466532 - RNA, 64 nt, Homo Sapiens
caccccuucccacggcgugucccacggccagacacaugcacacacaucacacccucaaacaccc

SEQ ID NO: 466533 - RNA, 64 nt, Homo Sapiens
guguaugcguaugcauacacaccacacacacacacaugcacaagucaugugcgaacagcccucc

SEQ ID NO: 466534 - RNA, 64 nt, Homo Sapiens
agucggccaagauguacuucucugugugcacacccaugcacacucaugcacacagauacauagg

SEQ ID NO: 466535 - RNA, 64 nt, Homo Sapiens
gauguacuucucugugugcacacccaugcacacucaugcacacagauacauaggucuguauggc

SEQ ID NO: 466536 - RNA, 64 nt, Homo Sapiens
aaucauuuugacugcauacaaacuaugucucugacaugcacauacacugcuuuauaaugaaaau

SEQ ID NO: 466537 - RNA, 64 nt, Homo Sapiens
uacacguccacaccacucaccacacauacauacacaugcacacacacacacaugcaauucuacc

SEQ ID NO: 466538 - RNA, 64 nt, Homo Sapiens
uuugcaggaguuccuuucccuccgaacgcugcuccaugcacaggaaaagggcauuuuguacaau

SEQ ID NO: 466539 - RNA, 64 nt, Homo Sapiens
aaaaaaaaauauguguacacauaugaacgcacaacaugcacauucauccucacauguggcacgu

SEQ ID NO: 466540 - RNA, 64 nt, Homo Sapiens
cacagccucaaucuuguauucaugcacaugaaaacaugcacaaccuuuagaaguuaaauacaug

SEQ ID NO: 466541 - RNA, 64 nt, Homo Sapiens
aaaacaugcacaaccacagcaaguuaaauacaugcaugcacauggugaugaaaaagggcuuuag

SEQ ID NO: 466542 - RNA, 64 nt, Homo Sapiens
gugcucccugaaggcacacguacgcacacacgcacaugcacagauaugccgccugggcacacag

SEQ ID NO: 466543 - RNA, 64 nt, Homo Sapiens
acacacgcagacaugcuguccggacacacacacgcaugcacagauaugcuguccggacacacac

SEQ ID NO: 466544 - RNA, 64 nt, Homo Sapiens
ggacacacacaugugcacagauaugcugucuggacaugcacacacgugcagauaugcuguccgg

SEQ ID NO: 466545 - RNA, 64 nt, Homo Sapiens
agauaugcugccugggcacacacuuccggacacacaugcacacacaggugcagauaugcugccu

SEQ ID NO: 466546 - RNA, 64 nt, Homo Sapiens
uuauuguaauaccucacagacguuguaccauauccaugcacauuuaguugccugccuguggcug

SEQ ID NO: 466547 - RNA, 64 nt, Homo Sapiens
uuuuaacacucuacauuucccuuguuuuuuaacucaugcacaugugcucuuuguacaguuuuaa

SEQ ID NO: 466548 - RNA, 64 nt, Homo Sapiens
aggaaagcagccccuccucacacauacaugugcacaugcacacacaugcaugcacacacaugca

SEQ ID NO: 466549 - RNA, 64 nt, Homo Sapiens
uccucacacauacaugugcacaugcacacacaugcaugcacacacaugcacacauacacgcaca

SEQ ID NO: 466550 - RNA, 64 nt, Homo Sapiens
uacaugugcacaugcacacacaugcaugcacacacaugcacacauacacgcacaugcacacaua

SEQ ID NO: 466551 - RNA, 64 nt, Homo Sapiens
cacaugcaugcacacacaugcacacauacacgcacaugcacacauacacaugcaugcacacaua

SEQ ID NO: 466552 - RNA, 64 nt, Homo Sapiens
ugcacacauacacgcacaugcacacauacacaugcaugcacacauacacaggcauacaugcaug

SEQ ID NO: 466553 - RNA, 64 nt, Homo Sapiens
uacacaugcaugcacacauacacaggcauacaugcaugcacacacacaugcacgcacacacaca

SEQ ID NO: 466554 - RNA, 64 nt, Homo Sapiens
uacaugcaugcacacacacaugcacgcacacacacaugcacacauacacgugcacacauacaca

SEQ ID NO: 466555 - RNA, 64 nt, Homo Sapiens
cacauacacgugcacacauacacaggcacacaugcaugcacacauacacaugcacacacacaug

SEQ ID NO: 466556 - RNA, 64 nt, Homo Sapiens
cacauacacaggcacacaugcaugcacacauacacaugcacacacacaugcacacauauaugca

SEQ ID NO: 466557 - RNA, 64 nt, Homo Sapiens
cacacaugcaugcacacauacacaugcacacacacaugcacacauauaugcacaggcacacaca

SEQ ID NO: 466558 - RNA, 64 nt, Homo Sapiens
auguacgcacacacacaugcacugcacacauauccaugcacacaaacacauauauacacaugca

SEQ ID NO: 466559 - RNA, 64 nt, Homo Sapiens
cacacauauccaugcacacaaacacauauauacacaugcacauacacagauuuuucugcuggcc

SEQ ID NO: 466560 - RNA, 64 nt, Homo Sapiens
ggcuuauuuauauauauguguguguauauaaauacaugcacacacuugcauacauauauauuuu

SEQ ID NO: 466561 - RNA, 64 nt, Homo Sapiens
uagcaacugaacaaaagcucagguuuguccuggucaugcacaugccuuaagccaguuccgucuu

SEQ ID NO: 466562 - RNA, 64 nt, Homo Sapiens
uuguccuguguccuuagugaugugugugugucuccaugcacaugcacgccgggauuccucugcu

SEQ ID NO: 466563 - RNA, 64 nt, Homo Sapiens
cugccauuugaauuagaagaaaauaauuuauaugcaugcacaggaagauauugguggccggugg

SEQ ID NO: 466564 - RNA, 64 nt, Homo Sapiens
ccucugccagccaccuaagcccugcguacauucacaugcacacauggaagaauguuuaucggcu

SEQ ID NO: 466565 - RNA, 64 nt, Homo Sapiens
uaugagagacagagcuccaggcaugucccauccccaugcacaugugguaacacacaccuguauc

SEQ ID NO: 466566 - RNA, 64 nt, Homo Sapiens
acccuucauacacacacgcacgcacgcacacaaacaugcacacacgcaugcacacacacaaagc

SEQ ID NO: 466567 - RNA, 64 nt, Homo Sapiens
cacacgcacgcacgcacacaaacaugcacacacgcaugcacacacacaaagccuuaagcagaag

SEQ ID NO: 466568 - RNA, 64 nt, Homo Sapiens
cacacucacacacaugcauacacaaauacacacucaugcacacaaucuuacucccucguacaug

SEQ ID NO: 466569 - RNA, 64 nt, Homo Sapiens
uacacacucaugcacacacacuuacucccucguacaugcacaaaccccuucaccuuugagugau

SEQ ID NO: 466570 - RNA, 64 nt, Homo Sapiens
acccaccacaaacgugcaagcuccugcacacaugcaugcacacaaacguguacacaagugugag

SEQ ID NO: 466571 - RNA, 64 nt, Homo Sapiens
cacagcagagagacguaugagcuucuacugcacacaugcacacacacacgcacacguacauuca

SEQ ID NO: 466572 - RNA, 64 nt, Homo Sapiens
ggacacaccccaaacacgcacaggcuccuacacacaugcacacacguguacaccacaaacgagc

SEQ ID NO: 466573 - RNA, 64 nt, Homo Sapiens
acacgucucccacacgugagcucccacacguacacaugcacauguacgcaccacaaacacaugc

SEQ ID NO: 466574 - RNA, 64 nt, Homo Sapiens
cacaugcgcaggcuccugcaggcgugaauacacacaugcacacacauauacacacaugugccac

SEQ ID NO: 466575 - RNA, 64 nt, Homo Sapiens
uggguauggaccaggggcuuguugagagcugagccaugcacacaggugcagacaccccccaacu

SEQ ID NO: 466576 - RNA, 64 nt, Homo Sapiens
gccaugcacacaggugcagacaccccccaacucccaugcacacggcuaguccaggcgccuccac

SEQ ID NO: 466577 - RNA, 64 nt, Homo Sapiens
gcuccuucaguuguuuuuauaaugggcguuuucacaugcacauauguguaugcauguauacgcc

SEQ ID NO: 466578 - RNA, 64 nt, Homo Sapiens
cacauauguguaugcauguauacgcccauacagacaugcacacacagacuccuacuccauuagc

SEQ ID NO: 466579 - RNA, 64 nt, Homo Sapiens
ggggaaagcaaucauugguguguauguguaugugcaugcacacacgugcauauacacauuugug

SEQ ID NO: 466580 - RNA, 64 nt, Homo Sapiens
acuuagguucuggugaagggagacaaucagugcacaugcacacaccccacacgcauacacacau

SEQ ID NO: 466581 - RNA, 64 nt, Homo Sapiens
augcacacaccccacacgcauacacacaugaacacaugcacaugugcacacacaaguaagaugg

SEQ ID NO: 466582 - RNA, 56 nt, Homo Sapiens
uugggaagauugccuuguagagguagcaugcacaggaugguaaauuggauuggugg

SEQ ID NO: 466583 - RNA, 64 nt, Homo Sapiens
ggagcacgcguggcuccuggaggacuuggagaugcaugcacauuuaggguguuuucccuagaau

SEQ ID NO: 466584 - RNA, 64 nt, Homo Sapiens
ccucgcacuuccagccuuggcacacacacgcgugcaugcacacugagcacacugcacacaugca

SEQ ID NO: 466585 - RNA, 64 nt, Homo Sapiens
cacacgcgugcaugcacacugagcacacugcacacaugcacacaacagcacacacaagugcaca

SEQ ID NO: 466586 - RNA, 64 nt, Homo Sapiens
ggugcacagaccacacagcauaggccacacagcacaugcacacaacaugcacacacaaagugca

SEQ ID NO: 466587 - RNA, 64 nt, Homo Sapiens
caaagugcauaggccacacaacacagcacuaacacaugcacacauacacaagugcacagaccac

SEQ ID NO: 466588 - RNA, 64 nt, Homo Sapiens
cguguagcucacacacaguagcacagaucacacacaugcacacagcacgcuuacauguacacgu

SEQ ID NO: 466589 - RNA, 64 nt, Homo Sapiens
acacauacgugcauacacauacaccuguauagaccaugcacaguagcacacaugugcacugacc

SEQ ID NO: 466590 - RNA, 64 nt, Homo Sapiens
gaccacauagcacacaugugugcacgcuugcacacaugcacacauccgcauacaggcguacaca

SEQ ID NO: 466591 - RNA, 64 nt, Homo Sapiens
ccacuucuugacacauucucucggggauggacuccaugcacaguaugcaguucuguggugcugc

SEQ ID NO: 466592 - RNA, 64 nt, Homo Sapiens
ucccggccccuccucagcaggugcccagcggccgcaugcacaccaccgccacuacugcagcuca

SEQ ID NO: 466593 - RNA, 64 nt, Homo Sapiens; identical to SEQ ID NO: 415214

SEQ ID NO: 466594 - RNA, 64 nt, Homo Sapiens; identical to SEQ ID NO: 415215

SEQ ID NO: 466595 - RNA, 64 nt, Homo Sapiens; identical to SEQ ID NO: 415216

SEQ ID NO: 466596 - RNA, 64 nt, Homo Sapiens; identical to SEQ ID NO: 415217

SEQ ID NO: 466597 - RNA, 64 nt, Homo Sapiens; identical to SEQ ID NO: 415218

SEQ ID NO: 466598 - RNA, 64 nt, Homo Sapiens; identical to SEQ ID NO: 415219

SEQ ID NO: 466599 - RNA, 64 nt, Homo Sapiens; identical to SEQ ID NO: 415220

SEQ ID NO: 466600 - RNA, 64 nt, Homo Sapiens; identical to SEQ ID NO: 415221

SEQ ID NO: 466601 - RNA, 55 nt, Homo Sapiens; identical to SEQ ID NO: 415222

SEQ ID NO: 466602 - RNA, 64 nt, Homo Sapiens; identical to SEQ ID NO: 415223

SEQ ID NO: 466603 - RNA, 64 nt, Homo Sapiens; identical to SEQ ID NO: 415224

SEQ ID NO: 466604 - RNA, 64 nt, Homo Sapiens; identical to SEQ ID NO: 415225

SEQ ID NO: 466605 - RNA, 64 nt, Homo Sapiens; identical to SEQ ID NO: 415226

SEQ ID NO: 466606 - RNA, 64 nt, Homo Sapiens; identical to SEQ ID NO: 415227

SEQ ID NO: 466607 - RNA, 64 nt, Homo Sapiens; identical to SEQ ID NO: 415228

SEQ ID NO: 466608 - RNA, 50 nt, Homo Sapiens; identical to SEQ ID NO: 415229

SEQ ID NO: 466609 - RNA, 64 nt, Homo Sapiens; identical to SEQ ID NO: 415230

SEQ ID NO: 466610 - RNA, 64 nt, Homo Sapiens; identical to SEQ ID NO: 415231

SEQ ID NO: 466611 - RNA, 64 nt, Homo Sapiens; identical to SEQ ID NO: 415232

SEQ ID NO: 466612 - RNA, 64 nt, Homo Sapiens; identical to SEQ ID NO: 415233

SEQ ID NO: 466613 - RNA, 64 nt, Homo Sapiens; identical to SEQ ID NO: 415234

SEQ ID NO: 466614 - RNA, 64 nt, Homo Sapiens; identical to SEQ ID NO: 415235

SEQ ID NO: 466615 - RNA, 64 nt, Homo Sapiens; identical to SEQ ID NO: 415236

SEQ ID NO: 466616 - RNA, 64 nt, Homo Sapiens; identical to SEQ ID NO: 415237

SEQ ID NO: 466617 - RNA, 64 nt, Homo Sapiens; identical to SEQ ID NO: 415238

SEQ ID NO: 466618 - RNA, 64 nt, Homo Sapiens; identical to SEQ ID NO: 415239

SEQ ID NO: 466619 - RNA, 64 nt, Homo Sapiens; identical to SEQ ID NO: 415240

SEQ ID NO: 466620 - RNA, 64 nt, Homo Sapiens; identical to SEQ ID NO: 415241

SEQ ID NO: 466621 - RNA, 64 nt, Homo Sapiens; identical to SEQ ID NO: 415242

SEQ ID NO: 466622 - RNA, 64 nt, Homo Sapiens; identical to SEQ ID NO: 415243

SEQ ID NO: 466623 - RNA, 64 nt, Homo Sapiens; identical to SEQ ID NO: 415244

SEQ ID NO: 466624 - RNA, 64 nt, Homo Sapiens; identical to SEQ ID NO: 415245

SEQ ID NO: 466625 - RNA, 64 nt, Homo Sapiens; identical to SEQ ID NO: 415246

SEQ ID NO: 466626 - RNA, 64 nt, Homo Sapiens; identical to SEQ ID NO: 415247

SEQ ID NO: 466627 - RNA, 64 nt, Homo Sapiens; identical to SEQ ID NO: 415248

SEQ ID NO: 466628 - RNA, 64 nt, Homo Sapiens; identical to SEQ ID NO: 415249

SEQ ID NO: 466629 - RNA, 64 nt, Homo Sapiens; identical to SEQ ID NO: 415250

SEQ ID NO: 466630 - RNA, 64 nt, Homo Sapiens; identical to SEQ ID NO: 415251

SEQ ID NO: 466631 - RNA, 64 nt, Homo Sapiens; identical to SEQ ID NO: 415252

SEQ ID NO: 466632 - RNA, 64 nt, Homo Sapiens; identical to SEQ ID NO: 415253

SEQ ID NO: 466633 - RNA, 64 nt, Homo Sapiens; identical to SEQ ID NO: 415254

SEQ ID NO: 466634 - RNA, 64 nt, Homo Sapiens; identical to SEQ ID NO: 415255

SEQ ID NO: 466635 - RNA, 64 nt, Homo Sapiens; identical to SEQ ID NO: 415256

SEQ ID NO: 466636 - RNA, 64 nt, Homo Sapiens
auaucccacucaagguugaagaagaaaugaagaagcaugaaaguaauaaugugggauuacuaga

SEQ ID NO: 466637 - RNA, 64 nt, Homo Sapiens
uuucucuuaguuguaagaaagaaaaagacgucuugcaugaaaauaguacguugcgggaagaaau

SEQ ID NO: 466638 - RNA, 64 nt, Homo Sapiens
gucacuucuguaauagugcacgaaauuuaucugugcaugaaaggcucuuccauacugguagaug

SEQ ID NO: 466639 - RNA, 64 nt, Homo Sapiens
ugcuccacauuuaaaggacacaguucaauaugaugcaugaaaaaguuauuuccucugcaggaua

SEQ ID NO: 466640 - RNA, 64 nt, Homo Sapiens
agauggagaaacagguacuggacuuuucccuccugcaugaaacaagcaaacaauggacaaaaua

SEQ ID NO: 466641 - RNA, 64 nt, Homo Sapiens
guaaaauguacaaugucuagcauccaguagagaggcaugaaaagcaggaaaauacauugcauaa

SEQ ID NO: 466642 - RNA, 64 nt, Homo Sapiens
uuucauauauuugugacaauuuuugaguaauauugcaugaaaaugucccuauguuacauccauu

SEQ ID NO: 466643 - RNA, 64 nt, Homo Sapiens
auucgcuuucuccuguuuuuuuuuuaaaaaaaaagcaugaaaaaggaagagaaaaaguuugaua

SEQ ID NO: 466644 - RNA, 64 nt, Homo Sapiens
gcuggguguuuuuuuccauuacuuuuaaugaucuucguugcaaguuauaguuguggauaaaggg

SEQ ID NO: 466645 - RNA, 64 nt, Homo Sapiens
gcuccaagucuggcugugucuucggucugugaucucguugcacuccaagugugaacugggguca

SEQ ID NO: 466646 - RNA, 64 nt, Homo Sapiens
auauaguguuugcugcaaggccuguggaauuaauucguugcauauagagguaucaacugcugca

SEQ ID NO: 466647 - RNA, 64 nt, Homo Sapiens
cccuggucucucuaggaggaguggacugaauggaucguugcagagaagacucacccagaccugg

SEQ ID NO: 466648 - RNA, 64 nt, Homo Sapiens
aaugcuuuauuuuugaacaauucauagcaagaauucguugcaaaacauuuugugugcauauugu

SEQ ID NO: 466649 - RNA, 64 nt, Homo Sapiens
gaauuaaaagagaaggaaaaugcaaaagcugaccucguugcaugaaaauaaaaccccaccuugu

SEQ ID NO: 466650 - RNA, 64 nt, Homo Sapiens
gaccuuuuaaaagaugugcagagcagcuuagcauucguugcagcugagccuaauuuuuucuugc

SEQ ID NO: 466651 - RNA, 64 nt, Homo Sapiens
cacugcaauaucuucguuaguugagcugguaacaucguugcaacauuguauuguuagauguuug

SEQ ID NO: 466652 - RNA, 64 nt, Homo Sapiens
ugauaauaacgaaguguuucuucacauaagcaaaucguugcaaguugaacaagagaaugccaug

SEQ ID NO: 466653 - RNA, 64 nt, Homo Sapiens
acugcccaucagugacagacaugcacgcguauguucguugcagcaaucauuguuauaaagacac

SEQ ID NO: 466654 - RNA, 64 nt, Homo Sapiens
uuagucuccucaagugaaaaacaggaguaauguuucguugcacuuugaaagaucugcuucaagg

SEQ ID NO: 466655 - RNA, 64 nt, Homo Sapiens
uuaauuagucaccaugagguguuuggaaacacagucguugcagagcaccucagaaugugaccuu

SEQ ID NO: 466656 - RNA, 64 nt, Homo Sapiens
cuguauuuuccaccuuuuguccaaguccuuuaacucguugcaguccacuuuccaccaacuuuuu

SEQ ID NO: 466657 - RNA, 64 nt, Homo Sapiens
uuacaguaucuucaaaaauacuagugauauggcaucguugcauuugaaggcauauuuccaauaa

SEQ ID NO: 466658 - RNA, 64 nt, Homo Sapiens
acgagcuuguuucccugaacauuucuccugccccucguugcaaauuggagaggaauagcagaac

SEQ ID NO: 466659 - RNA, 64 nt, Homo Sapiens
cacacgcuaaauguauucuuacauagugcuuguaucguugcauuuguuuuaauuuguggaaaag

SEQ ID NO: 466660 - RNA, 64 nt, Homo Sapiens
gcuagacacgaaauucccaugcugcgggugauguucguugcacugcucgcgguccucccaggga

SEQ ID NO: 466661 - RNA, 64 nt, Homo Sapiens
gagcagucuuaguaccagaaacaguguugcacuuucguugcaugugcugugugaccccaagggg

SEQ ID NO: 466662 - RNA, 64 nt, Homo Sapiens
auccgccccugguggguggcgaggaaguacggagucguugcauaacacaccauggauuucagag

SEQ ID NO: 466663 - RNA, 64 nt, Homo Sapiens
auagcugaaccuguucaaaauguuaauaaagguuucguugcaugguagcauacuugguguuuug

SEQ ID NO: 466664 - RNA, 64 nt, Homo Sapiens
acuguguagcaggccuaccagaaacuuuugagggucguugcaagcuggaaaugugcauuuugca

SEQ ID NO: 466665 - RNA, 64 nt, Homo Sapiens
ggacucuuggcgugugggaaccguguggcagggaucguugcacucaccaaguggggucggcuga

SEQ ID NO: 466666 - RNA, 64 nt, Homo Sapiens
cucacccgggccccgggcaggggcgcgcuccacuucguugcacgcggguccggcgcacaguucc

SEQ ID NO: 466667 - RNA, 64 nt, Homo Sapiens
ugcagagggccccaugccagacagcccuuggggcucguugcacuuuaagaaauaggaucugugg

SEQ ID NO: 466668 - RNA, 62 nt, Homo Sapiens
gcugcguuuauugacaugcuaaguuagagcacucucguugcaacuuucucacagggauaaua

SEQ ID NO: 466669 - RNA, 64 nt, Homo Sapiens
agggcaaacuaggugaauaaauaaugcugaggacucguugcagggucugcauuauacuccugca

SEQ ID NO: 466670 - RNA, 64 nt, Homo Sapiens
uuccagccuggauccccucacacugaacccuucuucguugcaccauccugcuucugacauugaa

SEQ ID NO: 466671 - RNA, 64 nt, Homo Sapiens
gcuguuugaaauguuuaauauuuauuugguguguucguugcacauggacugcuauucuagagcu

SEQ ID NO: 466672 - RNA, 64 nt, Homo Sapiens
ugaugguucuguggacauaugguuagggcuuuuuucguugcauguguguguguguaugugugug

SEQ ID NO: 466673 - RNA, 64 nt, Homo Sapiens
cccaccucagaguguaaucggaauacacaauucaucguugcacccuccgcugagaauccuggag

SEQ ID NO: 466674 - RNA, 64 nt, Homo Sapiens
ugcgcuucccccuucaggaagggugugugccaccucguugcacuggaucccaguggcugcuugg

SEQ ID NO: 466675 - RNA, 64 nt, Homo Sapiens
uuugcaucuaggaguuaguugcagcacuucugggucguugcaauucacugggguuucccauguu

SEQ ID NO: 466676 - RNA, 64 nt, Homo Sapiens; identical to SEQ ID NO: 161467

SEQ ID NO: 466677 - RNA, 64 nt, Homo Sapiens; identical to SEQ ID NO: 161468

SEQ ID NO: 466678 - RNA, 64 nt, Homo Sapiens; identical to SEQ ID NO: 161469

SEQ ID NO: 466679 - RNA, 64 nt, Homo Sapiens; identical to SEQ ID NO: 161470

SEQ ID NO: 466680 - RNA, 64 nt, Homo Sapiens; identical to SEQ ID NO: 161471

SEQ ID NO: 466681 - RNA, 64 nt, Homo Sapiens; identical to SEQ ID NO: 161472

SEQ ID NO: 466682 - RNA, 64 nt, Homo Sapiens; identical to SEQ ID NO: 161473

SEQ ID NO: 466683 - RNA, 64 nt, Homo Sapiens; identical to SEQ ID NO: 161474

SEQ ID NO: 466684 - RNA, 64 nt, Homo Sapiens; identical to SEQ ID NO: 161475

SEQ ID NO: 466685 - RNA, 64 nt, Homo Sapiens; identical to SEQ ID NO: 161476

SEQ ID NO: 466686 - RNA, 64 nt, Homo Sapiens; identical to SEQ ID NO: 161477

SEQ ID NO: 466687 - RNA, 64 nt, Homo Sapiens; identical to SEQ ID NO: 161478

SEQ ID NO: 466688 - RNA, 64 nt, Homo Sapiens; identical to SEQ ID NO: 161479

SEQ ID NO: 466689 - RNA, 64 nt, Homo Sapiens; identical to SEQ ID NO: 161480

SEQ ID NO: 466690 - RNA, 64 nt, Homo Sapiens; identical to SEQ ID NO: 161481

SEQ ID NO: 466691 - RNA, 64 nt, Homo Sapiens; identical to SEQ ID NO: 161482

SEQ ID NO: 466692 - RNA, 64 nt, Homo Sapiens; identical to SEQ ID NO: 161483

SEQ ID NO: 466693 - RNA, 64 nt, Homo Sapiens; identical to SEQ ID NO: 161484

SEQ ID NO: 466694 - RNA, 64 nt, Homo Sapiens; identical to SEQ ID NO: 161485

SEQ ID NO: 466695 - RNA, 64 nt, Homo Sapiens; identical to SEQ ID NO: 161486

SEQ ID NO: 466696 - RNA, 64 nt, Homo Sapiens; identical to SEQ ID NO: 161487

SEQ ID NO: 466697 - RNA, 64 nt, Homo Sapiens; identical to SEQ ID NO: 161488

SEQ ID NO: 466698 - RNA, 64 nt, Homo Sapiens; identical to SEQ ID NO: 161489

SEQ ID NO: 466699 - RNA, 64 nt, Homo Sapiens; identical to SEQ ID NO: 161490

SEQ ID NO: 466700 - RNA, 64 nt, Homo Sapiens; identical to SEQ ID NO: 161491

SEQ ID NO: 466701 - RNA, 64 nt, Homo Sapiens; identical to SEQ ID NO: 161492

SEQ ID NO: 466702 - RNA, 64 nt, Homo Sapiens; identical to SEQ ID NO: 161493

SEQ ID NO: 466703 - RNA, 64 nt, Homo Sapiens; identical to SEQ ID NO: 161494

SEQ ID NO: 466704 - RNA, 64 nt, Homo Sapiens; identical to SEQ ID NO: 161495

SEQ ID NO: 466705 - RNA, 64 nt, Homo Sapiens; identical to SEQ ID NO: 161496

SEQ ID NO: 466706 - RNA, 64 nt, Homo Sapiens; identical to SEQ ID NO: 161497

SEQ ID NO: 466707 - RNA, 64 nt, Homo Sapiens; identical to SEQ ID NO: 87425

SEQ ID NO: 466708 - RNA, 64 nt, Homo Sapiens; identical to SEQ ID NO: 87426

SEQ ID NO: 466709 - RNA, 64 nt, Homo Sapiens; identical to SEQ ID NO: 87427

SEQ ID NO: 466710 - RNA, 64 nt, Homo Sapiens; identical to SEQ ID NO: 87428

SEQ ID NO: 466711 - RNA, 64 nt, Homo Sapiens; identical to SEQ ID NO: 87429

SEQ ID NO: 466712 - RNA, 64 nt, Homo Sapiens; identical to SEQ ID NO: 87430

SEQ ID NO: 466713 - RNA, 60 nt, Homo Sapiens
aggggugggccugugaaucaauccugggcaaucagacacccucuccuuaaaaacuggccc

SEQ ID NO: 466714 - RNA, 60 nt, Homo Sapiens
cuggagggacuuuuaaucagugaagaugcaaucagacaaguguuuuggaaagagcacccu

SEQ ID NO: 466715 - RNA, 60 nt, Homo Sapiens
aucucuacccuccuaguaagacagaguugaaucagacaugucaggcucugugcuuggaau

SEQ ID NO: 466716 - RNA, 60 nt, Homo Sapiens
uaccgaacacccucuauuuguuauguauucaucagacacaucauuuguguauucauucau

SEQ ID NO: 466717 - RNA, 64 nt, Homo Sapiens; identical to SEQ ID NO: 141176

SEQ ID NO: 466718 - RNA, 64 nt, Homo Sapiens; identical to SEQ ID NO: 141177

SEQ ID NO: 466719 - RNA, 64 nt, Homo Sapiens; identical to SEQ ID NO: 141178

SEQ ID NO: 466720 - RNA, 64 nt, Homo Sapiens; identical to SEQ ID NO: 141179

SEQ ID NO: 466721 - RNA, 64 nt, Homo Sapiens; identical to SEQ ID NO: 141180

SEQ ID NO: 466722 - RNA, 64 nt, Homo Sapiens; identical to SEQ ID NO: 141181

SEQ ID NO: 466723 - RNA, 64 nt, Homo Sapiens; identical to SEQ ID NO: 141182

SEQ ID NO: 466724 - RNA, 64 nt, Homo Sapiens; identical to SEQ ID NO: 141183

SEQ ID NO: 466725 - RNA, 64 nt, Homo Sapiens; identical to SEQ ID NO: 141184

SEQ ID NO: 466726 - RNA, 64 nt, Homo Sapiens; identical to SEQ ID NO: 141185

SEQ ID NO: 466727 - RNA, 64 nt, Homo Sapiens; identical to SEQ ID NO: 141186

SEQ ID NO: 466728 - RNA, 64 nt, Homo Sapiens; identical to SEQ ID NO: 141187

SEQ ID NO: 466729 - RNA, 64 nt, Homo Sapiens; identical to SEQ ID NO: 141188

SEQ ID NO: 466730 - RNA, 64 nt, Homo Sapiens; identical to SEQ ID NO: 141189

SEQ ID NO: 466731 - RNA, 64 nt, Homo Sapiens; identical to SEQ ID NO: 141190

SEQ ID NO: 466732 - RNA, 64 nt, Homo Sapiens; identical to SEQ ID NO: 141191

SEQ ID NO: 466733 - RNA, 64 nt, Homo Sapiens; identical to SEQ ID NO: 141192

SEQ ID NO: 466734 - RNA, 64 nt, Homo Sapiens; identical to SEQ ID NO: 141193

SEQ ID NO: 466735 - RNA, 64 nt, Homo Sapiens; identical to SEQ ID NO: 141194

SEQ ID NO: 466736 - RNA, 64 nt, Homo Sapiens; identical to SEQ ID NO: 141195

SEQ ID NO: 466737 - RNA, 64 nt, Homo Sapiens; identical to SEQ ID NO: 141196

SEQ ID NO: 466738 - RNA, 64 nt, Homo Sapiens; identical to SEQ ID NO: 141197

SEQ ID NO: 466739 - RNA, 64 nt, Homo Sapiens; identical to SEQ ID NO: 141198

SEQ ID NO: 466740 - RNA, 64 nt, Homo Sapiens; identical to SEQ ID NO: 141199

SEQ ID NO: 466741 - RNA, 64 nt, Homo Sapiens; identical to SEQ ID NO: 141200

SEQ ID NO: 466742 - RNA, 64 nt, Homo Sapiens; identical to SEQ ID NO: 141201

SEQ ID NO: 466743 - RNA, 64 nt, Homo Sapiens; identical to SEQ ID NO: 141202

SEQ ID NO: 466744 - RNA, 64 nt, Homo Sapiens; identical to SEQ ID NO: 141203

SEQ ID NO: 466745 - RNA, 64 nt, Homo Sapiens; identical to SEQ ID NO: 141204

SEQ ID NO: 466746 - RNA, 64 nt, Homo Sapiens; identical to SEQ ID NO: 141205

SEQ ID NO: 466747 - RNA, 64 nt, Homo Sapiens; identical to SEQ ID NO: 141206

SEQ ID NO: 466748 - RNA, 64 nt, Homo Sapiens; identical to SEQ ID NO: 141207

SEQ ID NO: 466749 - RNA, 64 nt, Homo Sapiens; identical to SEQ ID NO: 141208

SEQ ID NO: 466750 - RNA, 64 nt, Homo Sapiens; identical to SEQ ID NO: 141209

SEQ ID NO: 466751 - RNA, 64 nt, Homo Sapiens; identical to SEQ ID NO: 141210

SEQ ID NO: 466752 - RNA, 64 nt, Homo Sapiens; identical to SEQ ID NO: 141211

SEQ ID NO: 466753 - RNA, 64 nt, Homo Sapiens; identical to SEQ ID NO: 141212

SEQ ID NO: 466754 - RNA, 64 nt, Homo Sapiens; identical to SEQ ID NO: 141213

SEQ ID NO: 466755 - RNA, 64 nt, Homo Sapiens; identical to SEQ ID NO: 141214

SEQ ID NO: 466756 - RNA, 64 nt, Homo Sapiens; identical to SEQ ID NO: 141215

SEQ ID NO: 466757 - RNA, 64 nt, Homo Sapiens; identical to SEQ ID NO: 141216

SEQ ID NO: 466758 - RNA, 64 nt, Homo Sapiens; identical to SEQ ID NO: 141217

SEQ ID NO: 466759 - RNA, 64 nt, Homo Sapiens; identical to SEQ ID NO: 141218

SEQ ID NO: 466760 - RNA, 64 nt, Homo Sapiens; identical to SEQ ID NO: 141219

SEQ ID NO: 466761 - RNA, 64 nt, Homo Sapiens; identical to SEQ ID NO: 141220

SEQ ID NO: 466762 - RNA, 64 nt, Homo Sapiens; identical to SEQ ID NO: 141221

SEQ ID NO: 466763 - RNA, 64 nt, Homo Sapiens
aucagagggguucauuauacggcagagggcaaagagagaccaagcuuaacugcaguuucaauga

SEQ ID NO: 466764 - RNA, 64 nt, Homo Sapiens
uaccaucuuuaucuacacuuagcggugugcagggagagaccaagcuccuuguugggcagacacc

SEQ ID NO: 466765 - RNA, 64 nt, Homo Sapiens
ucuuuuuaaaaucuaacucuuuggaagccucugaagagaccauguauagcgggugggguuguau

SEQ ID NO: 466766 - RNA, 64 nt, Homo Sapiens
acagguggacaaagggauccccagccagagagagagagaccagccaacagcuugauagaccagu

SEQ ID NO: 466767 - RNA, 64 nt, Homo Sapiens
accagccaacagcuugauagaccagugcagccagagagaccaccaaacagagcccccaaaagac

SEQ ID NO: 466768 - RNA, 64 nt, Homo Sapiens
cuuguauauuucaguggaaauacaaaaccacuucagagaccaggguaucuccucuggaaggauc

SEQ ID NO: 466769 - RNA, 64 nt, Homo Sapiens
ucuuagaggaggaaauauccuuuguccuguucagagagaccagggcccuaccauuaggcauacu

SEQ ID NO: 466770 - RNA, 64 nt, Homo Sapiens
aagguucugccaggccucgauuaucccacccuacagagaccagccugguuuaauguugcuucac

SEQ ID NO: 466771 - RNA, 64 nt, Homo Sapiens
aagguucugccaggccccaauuaucccauccuucagagaccagccugauuuacuguugcuucau

SEQ ID NO: 466772 - RNA, 64 nt, Homo Sapiens
aucuucaagagaaguauucuagagagagagagagagagaccagcugugugugugugugagagag

SEQ ID NO: 466773 - RNA, 64 nt, Homo Sapiens
uuuauuuggguaggaggaaggagaaauagagaaaagagaccauguccaggugauggggcaugcu

SEQ ID NO: 466774 - RNA, 64 nt, Homo Sapiens
ggauacaaggaagggccuuucucggggccggagaagagaccaagagaccaggcccgggcagcag

SEQ ID NO: 466775 - RNA, 64 nt, Homo Sapiens
ggaagggccuuucucggggccggagaagagaccaagagaccaggcccgggcagcagccuaccgg

SEQ ID NO: 466776 - RNA, 64 nt, Homo Sapiens
gaauuuucuaccuaaggaccagaauuuuuuaucuagagaccagcauguucuccccaaagaccaa

SEQ ID NO: 466777 - RNA, 64 nt, Homo Sapiens
gaauuuucuaccuaaggaccagaauuuuuugucuagagaccagcauguucuccccaaagaccag

SEQ ID NO: 466778 - RNA, 64 nt, Homo Sapiens
ggauuuucuaccuaaagaccaggacuuuuuaucuagagaccagcauguucuccccaaagacugg

SEQ ID NO: 466779 - RNA, 64 nt, Homo Sapiens
ucuacccaaaugucaggaccaggauuuucuacccagagaccaagguguucuucccaaagaccaa

SEQ ID NO: 466780 - RNA, 64 nt, Homo Sapiens
ucuacccauaugucaggaccaggauuuucuacccagagaccaagguuaucuuccuaaagaccaa

SEQ ID NO: 466781 - RNA, 64 nt, Homo Sapiens
uaagauucauuccucauucuaccacuucugaugaagagaccaauugaauauagagaccaaguuu

SEQ ID NO: 466782 - RNA, 64 nt, Homo Sapiens
uuuaccacuucugaugaagagacuucgugaauauagagaccaaggucugcuuaaaaaacugucu

SEQ ID NO: 466783 - RNA, 64 nt, Homo Sapiens; identical to SEQ ID NO: 433201

SEQ ID NO: 466784 - RNA, 64 nt, Homo Sapiens; identical to SEQ ID NO: 433202

SEQ ID NO: 466785 - RNA, 64 nt, Homo Sapiens
acuauggauauaaauguaggcaaaaugaaagauuaugacuaauauucagauuccauuuucaaua

SEQ ID NO: 466786 - RNA, 64 nt, Homo Sapiens
cugagaauaauugaugcugauuaaggugcaaaucaugacuaaagacuuuucuuucuucuuuugc

SEQ ID NO: 466787 - RNA, 64 nt, Homo Sapiens
uuucugaggcuucaggaguagccaucaaaugauaaugacuaaaagccagccagguuguuucuca

SEQ ID NO: 466788 - RNA, 64 nt, Homo Sapiens
cacagguggcagaauuuuucguuucacccgcuucaugacuaaauccucauaccaacuugacuau

SEQ ID NO: 466789 - RNA, 64 nt, Homo Sapiens
cagguauuccaggucacugacaugaauuugaagauauaucuaucuguauggauauauaucuaua

SEQ ID NO: 466790 - RNA, 64 nt, Homo Sapiens
caugaauuugaagauauaucuaucuguauggauauauaucuauauguauauagauauauaaaua

SEQ ID NO: 466791 - RNA, 64 nt, Homo Sapiens
aauaaucuauuaacaugaucagaaacauagcaauuauaucuacaaagcaaugggcuaaggucca

SEQ ID NO: 466792 - RNA, 64 nt, Homo Sapiens
ugugggaaccauucugaaguuuagaaaaugcaacuauaucuauaugaauauuaauguuucuugu

SEQ ID NO: 466793 - RNA, 64 nt, Homo Sapiens
ucuauauaaucuuacauuuauauaucuaucuaucuauaucuacaauuauaucuauauaucuaca

SEQ ID NO: 466794 - RNA, 64 nt, Homo Sapiens
uaucuauaucuacaucuauaucuauauaucuacauauaucuaucagugauauugugacauuaua

SEQ ID NO: 466795 - RNA, 64 nt, Homo Sapiens
uauaucuaucuaucuauaucugacauuauaucuauauaucuacaaaugccuuauagugauauug

SEQ ID NO: 466796 - RNA, 64 nt, Homo Sapiens
uaucuacauauaucuaucuaugauauugugacauuauaucuauagaagaaggaaugccuuauag

SEQ ID NO: 466797 - RNA, 64 nt, Homo Sapiens
cguuuucccuccuuuaauauaucauauauaugccuauaucuaaauccaagaacuguuacauaua

SEQ ID NO: 466798 - RNA, 64 nt, Homo Sapiens
ucuguauuggaguaauguguugaaaaauccuuguuauaucuauuauagcugaccaaguuugcug

SEQ ID NO: 466799 - RNA, 64 nt, Homo Sapiens
guagucaauuaguacaguaguuaauguugggauuuauaucuauagccuaaaucuaaucagguug

SEQ ID NO: 466800 - RNA, 64 nt, Homo Sapiens
uuauacaaaauaauuuaacucagaaaaguagaauuauaucuaauucaucaauuuuuauacauau

SEQ ID NO: 466801 - RNA, 64 nt, Homo Sapiens
agucucuugaugagcauuggcaccaggcccagccuauaucuaggcugggauuacaggugugagc

SEQ ID NO: 466802 - RNA, 64 nt, Homo Sapiens
aguuucuuuauuuuauuuuacuuaaaccugccuuuauaucuaggcucugaacuggucuuacccc

SEQ ID NO: 466803 - RNA, 64 nt, Homo Sapiens
cuugaaucugcuuuauguacauaaucaaaauaucuauaucuauaucuauaucuauaucuauaua

SEQ ID NO: 466804 - RNA, 64 nt, Homo Sapiens
ucugcuuuauguacauaaucaaaauaucuauaucuauaucuauaucuauaucuauauauuuuua

SEQ ID NO: 466805 - RNA, 64 nt, Homo Sapiens
uuauguacauaaucaaaauaucuauaucuauaucuauaucuauaucuauauauuuuuaaucauc

SEQ ID NO: 466806 - RNA, 64 nt, Homo Sapiens
acauaaucaaaauaucuauaucuauaucuauaucuauaucuauauauuuuuaaucaucuacaug

SEQ ID NO: 466807 - RNA, 64 nt, Homo Sapiens
uauauguacuguuuuguuucgauauauauaucuauauaucuauaauuaugaaaaauuuuuaaaa

SEQ ID NO: 466808 - RNA, 64 nt, Homo Sapiens
uaucuauauauauguacuguuuuuaaaagauauauauaucuauagaacuucaauuaugaaaaau

SEQ ID NO: 466809 - RNA, 64 nt, Homo Sapiens
ucacuagaacgucauugugugaaaggaacauaauuauaucuaggguuuaaaaaacuuuacuucu

SEQ ID NO: 466810 - RNA, 64 nt, Homo Sapiens
aauauuugagauauaauggcuucaaaugcuuuuuuauaucuaaaaacuguguauguacuuuaau

SEQ ID NO: 466811 - RNA, 64 nt, Homo Sapiens
gaucuguaucuacaucuauaucuguaugugcaucuauaucuaugccuauaucuauaucuauauc

SEQ ID NO: 466812 - RNA, 64 nt, Homo Sapiens
caucuauaucuguaugugcaucuauaucuaugccuauaucuauaucuauaucauauugauuuug

SEQ ID NO: 466813 - RNA, 64 nt, Homo Sapiens
uaucuguaugugcaucuauaucuaugccuauaucuauaucuauaucauauugauuuugucucuc

SEQ ID NO: 466814 - RNA, 64 nt, Homo Sapiens
cagguucuaaacucuauauauacauauauauauauauaucuauauaucuauauacguaaucauc

SEQ ID NO: 466815 - RNA, 64 nt, Homo Sapiens
aaacucuauauauacauauauauauauauaucuauauaucuauauacguaaucaucuaguucug

SEQ ID NO: 466816 - RNA, 64 nt, Homo Sapiens
cuuagauauagugcauugucguauguuaaauaacuauaucuauauuuaguuucuccuacaaugg

SEQ ID NO: 466817 - RNA, 64 nt, Homo Sapiens
ucaugcuguuucugaaacagcugaaacuucacuuuauaucuaaaugaccugcacuuucauugua

SEQ ID NO: 466818 - RNA, 64 nt, Homo Sapiens
cuggucauauacugauguauaugguuaucuggguuauaucuauuuuuauguaaacucuauuuug

SEQ ID NO: 466819 - RNA, 64 nt, Homo Sapiens
uucucaccuuugauuuuaaaucccaguaccuaguuauaucuaaccuaucaaaggcaagauauca

SEQ ID NO: 466820 - RNA, 64 nt, Homo Sapiens
ucauauuucuguggaggguucaauauauauuauauauaucuauaauauguauaauauauaucua

SEQ ID NO: 466821 - RNA, 64 nt, Homo Sapiens
auauauauuauauauaucuaauauauguauaauauauaucuacaugcgugguauacauguguac

SEQ ID NO: 466822 - RNA, 64 nt, Homo Sapiens
aaaaaaaaugaaguccagucuauaaaucuauaucuauaucuauuaaaacuauuuuauauauaaa

SEQ ID NO: 466823 - RNA, 64 nt, Homo Sapiens
ucuauuaaaaaaaaugaaguuauaaauauaaaucuauaucuauauuguaaaaaacuauuuuaua

SEQ ID NO: 466824 - RNA, 64 nt, Homo Sapiens
uaacccagucuuaggcugguauucccuuuuuauauauaucuauauuacuuuucaccucuuuuuc

SEQ ID NO: 466825 - RNA, 64 nt, Homo Sapiens
auacaguuuucaaucguucaaguuuuggaugguuuauaucuaauguguguuucauuuuuuugga

SEQ ID NO: 466826 - RNA, 64 nt, Homo Sapiens
uaucuauacagcggaaccaccuacacacaaauuauauaucuaucaagaauacauauauauauau

SEQ ID NO: 466827 - RNA, 64 nt, Homo Sapiens
cacaaauuauauaucuaucuagaauacauauauauauaucuacaugcaaaaaaauacguaauaa

SEQ ID NO: 466828 - RNA, 64 nt, Homo Sapiens
agcgucugcuugcguugugucuguuuuauguuuuuauaucuacaucuauauaucuauaauuuua

SEQ ID NO: 466829 - RNA, 64 nt, Homo Sapiens
uugugucuguuuuauguuuuuauaucuacaucuauauaucuauaauuuuauuaaaaaaaagaaa

SEQ ID NO: 466830 - RNA, 64 nt, Homo Sapiens
aagggaauagccauauaaauucauguucuaucaguauaucuagagauacucugugguguucugu

SEQ ID NO: 466831 - RNA, 64 nt, Homo Sapiens
accaaaacagcuaaaucccauuuugguuaaccuuuauaucuagauaacagagaaaaaccuuuga

SEQ ID NO: 466832 - RNA, 64 nt, Homo Sapiens; identical to SEQ ID NO: 142221

SEQ ID NO: 466833 - RNA, 64 nt, Homo Sapiens; identical to SEQ ID NO: 142222

SEQ ID NO: 466834 - RNA, 64 nt, Homo Sapiens; identical to SEQ ID NO: 142223

SEQ ID NO: 466835 - RNA, 64 nt, Homo Sapiens; identical to SEQ ID NO: 142224

SEQ ID NO: 466836 - RNA, 64 nt, Homo Sapiens; identical to SEQ ID NO: 142225

SEQ ID NO: 466837 - RNA, 64 nt, Homo Sapiens; identical to SEQ ID NO: 142226

SEQ ID NO: 466838 - RNA, 64 nt, Homo Sapiens; identical to SEQ ID NO: 142227

SEQ ID NO: 466839 - RNA, 64 nt, Homo Sapiens; identical to SEQ ID NO: 142228

SEQ ID NO: 466840 - RNA, 64 nt, Homo Sapiens; identical to SEQ ID NO: 142229

SEQ ID NO: 466841 - RNA, 64 nt, Homo Sapiens; identical to SEQ ID NO: 142230

SEQ ID NO: 466842 - RNA, 64 nt, Homo Sapiens; identical to SEQ ID NO: 142231

SEQ ID NO: 466843 - RNA, 64 nt, Homo Sapiens; identical to SEQ ID NO: 142232

SEQ ID NO: 466844 - RNA, 64 nt, Homo Sapiens; identical to SEQ ID NO: 142233

SEQ ID NO: 466845 - RNA, 64 nt, Homo Sapiens; identical to SEQ ID NO: 142234

SEQ ID NO: 466846 - RNA, 64 nt, Homo Sapiens; identical to SEQ ID NO: 142235

SEQ ID NO: 466847 - RNA, 64 nt, Homo Sapiens; identical to SEQ ID NO: 142236

SEQ ID NO: 466848 - RNA, 64 nt, Homo Sapiens; identical to SEQ ID NO: 142237

SEQ ID NO: 466849 - RNA, 64 nt, Homo Sapiens; identical to SEQ ID NO: 142238

SEQ ID NO: 466850 - RNA, 64 nt, Homo Sapiens; identical to SEQ ID NO: 142239

SEQ ID NO: 466851 - RNA, 64 nt, Homo Sapiens; identical to SEQ ID NO: 142240

SEQ ID NO: 466852 - RNA, 64 nt, Homo Sapiens; identical to SEQ ID NO: 142241

SEQ ID NO: 466853 - RNA, 64 nt, Homo Sapiens; identical to SEQ ID NO: 142242

SEQ ID NO: 466854 - RNA, 64 nt, Homo Sapiens; identical to SEQ ID NO: 142243

SEQ ID NO: 466855 - RNA, 64 nt, Homo Sapiens; identical to SEQ ID NO: 142244

SEQ ID NO: 466856 - RNA, 64 nt, Homo Sapiens; identical to SEQ ID NO: 142245

SEQ ID NO: 466857 - RNA, 64 nt, Homo Sapiens; identical to SEQ ID NO: 142246

SEQ ID NO: 466858 - RNA, 64 nt, Homo Sapiens; identical to SEQ ID NO: 142247

SEQ ID NO: 466859 - RNA, 64 nt, Homo Sapiens; identical to SEQ ID NO: 142248

SEQ ID NO: 466860 - RNA, 64 nt, Homo Sapiens; identical to SEQ ID NO: 142249

SEQ ID NO: 466861 - RNA, 64 nt, Homo Sapiens; identical to SEQ ID NO: 142250

SEQ ID NO: 466862 - RNA, 64 nt, Homo Sapiens; identical to SEQ ID NO: 142251

SEQ ID NO: 466863 - RNA, 64 nt, Homo Sapiens; identical to SEQ ID NO: 142252

SEQ ID NO: 466864 - RNA, 64 nt, Homo Sapiens; identical to SEQ ID NO: 142253

SEQ ID NO: 466865 - RNA, 64 nt, Homo Sapiens; identical to SEQ ID NO: 142254

SEQ ID NO: 466866 - RNA, 64 nt, Homo Sapiens; identical to SEQ ID NO: 142255

SEQ ID NO: 466867 - RNA, 64 nt, Homo Sapiens; identical to SEQ ID NO: 142256

SEQ ID NO: 466868 - RNA, 64 nt, Homo Sapiens; identical to SEQ ID NO: 142257

SEQ ID NO: 466869 - RNA, 64 nt, Homo Sapiens; identical to SEQ ID NO: 142258

SEQ ID NO: 466870 - RNA, 64 nt, Homo Sapiens; identical to SEQ ID NO: 142259

SEQ ID NO: 466871 - RNA, 64 nt, Homo Sapiens; identical to SEQ ID NO: 142260

SEQ ID NO: 466872 - RNA, 64 nt, Homo Sapiens; identical to SEQ ID NO: 142261

SEQ ID NO: 466873 - RNA, 64 nt, Homo Sapiens; identical to SEQ ID NO: 142262

SEQ ID NO: 466874 - RNA, 64 nt, Homo Sapiens; identical to SEQ ID NO: 142263

SEQ ID NO: 466875 - RNA, 64 nt, Homo Sapiens; identical to SEQ ID NO: 142264

SEQ ID NO: 466876 - RNA, 64 nt, Homo Sapiens; identical to SEQ ID NO: 142265

SEQ ID NO: 466877 - RNA, 64 nt, Homo Sapiens; identical to SEQ ID NO: 142266

SEQ ID NO: 466878 - RNA, 64 nt, Homo Sapiens; identical to SEQ ID NO: 142267

SEQ ID NO: 466879 - RNA, 64 nt, Homo Sapiens; identical to SEQ ID NO: 142268

SEQ ID NO: 466880 - RNA, 64 nt, Homo Sapiens
cagccccaggcugcugaggagcagaggccagaccagggccgaucuggguguccugacccucagc

SEQ ID NO: 466881 - RNA, 64 nt, Homo Sapiens
uccgguccuuccugggcaaaucuaagccuuggccagggccgaaguuuaggccccugucuuguuc

SEQ ID NO: 466882 - RNA, 64 nt, Homo Sapiens
ccccauguucugcaagacuacuugguauucuuguagggccgacacuaaauaaaagccaaaccuu

SEQ ID NO: 466883 - RNA, 64 nt, Homo Sapiens
gcuggugaagcuguuaaggcuuucuguggcaaacagggccgaggagaaaccugcgguuucagcu

SEQ ID NO: 466884 - RNA, 64 nt, Homo Sapiens
uuaucuacuuaaacaacuuuaaaauccuuaauucagggccgacagccagaaaggggaugaaaaa

SEQ ID NO: 466885 - RNA, 64 nt, Homo Sapiens
ugcuagcuucgacagugagaggaguuaggauggcagggccgagcaagcagagagacugccaccu

SEQ ID NO: 466886 - RNA, 64 nt, Homo Sapiens
uuuaaagaacuucaacauagaauaguucuucaggagggccgacccaaaguaggcagaauaagaa

SEQ ID NO: 466887 - RNA, 64 nt, Homo Sapiens
acuugcucaucugaggaguucaaaggcccuuuuuagggccgaccagcuuugcacguuucgaucc

SEQ ID NO: 466888 - RNA, 64 nt, Homo Sapiens
ugcgauccgagucgcggucuccggggugccugggagggccgaaccacuggugagggcgugggga

SEQ ID NO: 466889 - RNA, 64 nt, Homo Sapiens
aggagcgaacuggugagcccagcgcccugggaagagggccgagggcggggcgguggugccggga

SEQ ID NO: 466890 - RNA, 64 nt, Homo Sapiens
gucuguccuucaggccccacagugcagcuucuccagggccgacagcugagggcugcucccugca

SEQ ID NO: 466891 - RNA, 64 nt, Homo Sapiens
gcuggucugcaugcuggaaguccaccuuagugccagggccgaggucccugcccuaccccuuaac

SEQ ID NO: 466892 - RNA, 64 nt, Homo Sapiens
uaaaaaaccaucaccucccagcauacucuguacuagggccgaaggauggaauccagcuucaaga

SEQ ID NO: 466893 - RNA, 64 nt, Homo Sapiens
uaauuaaacuuagguaagaauugggagaaaauuaagggccgauuacagagcuaucauuaugcac

SEQ ID NO: 466894 - RNA, 64 nt, Homo Sapiens
guuuggacccacauagcugcggcugcucggcaggagggccgagauccaugcugcaggccacuac

SEQ ID NO: 466895 - RNA, 64 nt, Homo Sapiens
agggacggggaagccgagcuccagagcaacgaccagggccgaggaggugccuggagugcccacc

SEQ ID NO: 466896 - RNA, 64 nt, Homo Sapiens
uuccucccgucccagacuucguggcgcugcugacagggccgaggucgcaggcgguggcacgagc

SEQ ID NO: 466897 - RNA, 64 nt, Homo Sapiens
acccaugccaagggaauccaggcugcaguugcugagggccgaccgggugacagagccaaaugag

SEQ ID NO: 466898 - RNA, 64 nt, Homo Sapiens
cggcuagcuucacgccacccccugccgguaguuuagggccgagacugcaccugccggcgacacu

SEQ ID NO: 466899 - RNA, 64 nt, Homo Sapiens
ggcuuggccugauggugggcggggccccgcccacagggccgaccccaauacaccagcgacucaa

SEQ ID NO: 466900 - RNA, 64 nt, Homo Sapiens
ugcagcgggccaggcaggcugggugggagggaggagggccgagacaggagcagcccacccagca

SEQ ID NO: 466901 - RNA, 64 nt, Homo Sapiens
ccuaagucaagugggugaacgcagugcccuugggagggccgaggcacccgguggcagcuggcag

SEQ ID NO: 466902 - RNA, 51 nt, Homo Sapiens
acagcaaugcaaguaaguggaagggccgagcgcguccagcccuaccuauag

SEQ ID NO: 466903 - RNA, 64 nt, Homo Sapiens
gaauuuugagcacuagccgucuagccccuucuucagggccgagaaccaaaguauaaaacaaaau

SEQ ID NO: 466904 - RNA, 64 nt, Homo Sapiens
auuggagauguacacauacauacccuauaccaagagggccgaaacucuucaccuugauguaugu

SEQ ID NO: 466905 - RNA, 64 nt, Homo Sapiens
ggagagggugaccauggggauccacagagagggaagggccgaggugagccuucugcaggggaug

SEQ ID NO: 466906 - RNA, 64 nt, Homo Sapiens
uuacauuuggagaacccguaucucagagaucuguagggccgaggucacaaacccccugacauag

SEQ ID NO: 466907 - RNA, 64 nt, Homo Sapiens
ucaggacagugucccucccugggaaugugacaugagggccgacuggggccaggcucaggggcag

SEQ ID NO: 466908 - RNA, 64 nt, Homo Sapiens
cagccaggguuugugugucaucguacuggaguagagggccgacucuucccaugaaggugagcac

SEQ ID NO: 466909 - RNA, 64 nt, Homo Sapiens
cucccgagccuagauccuggcucggaccacugcaagggccgaggcagggccagaccagagcauc

SEQ ID NO: 466910 - RNA, 64 nt, Homo Sapiens
ccuccgccccugcaccagucacaugcacuggacgagggccgaaacuccugucugcuaucgagcc

SEQ ID NO: 466911 - RNA, 64 nt, Homo Sapiens
aguugagaaauggacauucuucaccagguacgcaagggccgaauccaguuccuaggcaacuugu

SEQ ID NO: 466912 - RNA, 64 nt, Homo Sapiens
ugggcuucaguaaguccccgggacaaaguggaggagggccgaggaaggaaaaccugaagacuga

SEQ ID NO: 466913 - RNA, 64 nt, Homo Sapiens
agaugacuauaaaauguucaacauauuucacaacagggccgaagcucugaauugaacuggaauc

SEQ ID NO: 466914 - RNA, 64 nt, Homo Sapiens
cuguguuggcaugcgcaguacugaggguaucaggagggccgacgaacgccacguuugugaagag

SEQ ID NO: 466915 - RNA, 64 nt, Homo Sapiens
agaggagccuuuuuaaaacagcucuguggaugccagggccgaccgccuucgggcgucugugugc

SEQ ID NO: 466916 - RNA, 64 nt, Homo Sapiens
uagugugcugagcaaaaagaacuguguauuagacagggccgaacacccaagccugucuaagguu

SEQ ID NO: 466917 - RNA, 64 nt, Homo Sapiens
gcauuuccugguuacucuauuuuguucauucaugagggccgacuccccuccugggguuguaagu

SEQ ID NO: 466918 - RNA, 64 nt, Homo Sapiens
ggaaagugggggaacgacacacacuucaccugcaagggccgacaacgcaggggacaccgugccg

SEQ ID NO: 466919 - RNA, 64 nt, Homo Sapiens
ucuggugaugugguucccaggucacuuggcaaaaagggccgaggcacaucaggguggggugggg

SEQ ID NO: 466920 - RNA, 64 nt, Homo Sapiens
ugggcaguccaggccgagaguuccgcucugacgcagggccgaggaccuucuggaagacuuggcc

SEQ ID NO: 466921 - RNA, 64 nt, Homo Sapiens
agcccaagggcaucauccucagcagcaucgaggaagggccgaggaaugugaagccagaucucgg

SEQ ID NO: 466922 - RNA, 64 nt, Homo Sapiens
acugguuuggggacuggaggagaaaccuggcugcagggccgaggcccaccacuguccacugacc

SEQ ID NO: 466923 - RNA, 64 nt, Homo Sapiens
ggaguggaagaagagggagagguggagcaaagugagggccgagugagagcgugcuccagccugg

SEQ ID NO: 466924 - RNA, 64 nt, Homo Sapiens
uucuaguuuaguaaaagaugugcaaaggccagagagggccgaaaaugaagcuuucuugcuacac

SEQ ID NO: 466925 - RNA, 64 nt, Homo Sapiens
gcugacuaguguggccucacggauugguguagggagggccgaacgacaacuaggagcccagcug

SEQ ID NO: 466926 - RNA, 64 nt, Homo Sapiens
aguuacagcccuccuucuuuuuuguuuucuguugagggccgacugcugcucugccuuccuucua

SEQ ID NO: 466927 - RNA, 64 nt, Homo Sapiens
aggacuaggacccauaugggaauuauuaccucucagggccgagaggacagaauggauauaaucu

SEQ ID NO: 466928 - RNA, 64 nt, Homo Sapiens
guagacaggcagcuucugugcuggucagugagaaagggccgaggauccagauggguucagcagu

SEQ ID NO: 466929 - RNA, 64 nt, Homo Sapiens
uggaccuggaacuguagggccaggggauugucucagggccgacguuccaccuggggcuucccuc

SEQ ID NO: 466930 - RNA, 64 nt, Homo Sapiens
gaauccugaccccuugagagagagugaucuggcgagggccgaugaaggggcugggccuggucuu

SEQ ID NO: 466931 - RNA, 64 nt, Homo Sapiens
cuuuguugcuuccguucauggaagcgcacaggauagggccgacgcugugccggucguggggaaa

SEQ ID NO: 466932 - RNA, 64 nt, Homo Sapiens
gacaccugaggaugcggcugcacacacucagccaagggccgagucucaccugcggugggguguc

SEQ ID NO: 466933 - RNA, 64 nt, Homo Sapiens
uagagcggccggccugacucggccgagaggccggagggccgaguaggcuggucuggcuuagcug

SEQ ID NO: 466934 - RNA, 64 nt, Homo Sapiens
ugggaccagaccuggccaaggucagccagcggggagggccgaggucugagcucucguccugccg

SEQ ID NO: 466935 - RNA, 64 nt, Homo Sapiens
ccucugagcgcccugcugccacccagugacuggcagggccgagccagcauuccaccccaccuuu

SEQ ID NO: 466936 - RNA, 64 nt, Homo Sapiens
gggaggugguguacauaggauggccacugaccucagggccgaagcuuaccccaucacccgacuc

SEQ ID NO: 466937 - RNA, 64 nt, Homo Sapiens
cagaaagaaaauagauucucgcaccuaguaaagcagggccgagaagguccagcaugucuggcuu

SEQ ID NO: 466938 - RNA, 64 nt, Homo Sapiens
gcuuuccccaccccacccuccacccucagcuccgagggccgagggggaccacaugccugggucu

SEQ ID NO: 466939 - RNA, 64 nt, Homo Sapiens
cugaccuuuagcucccuccuccacccauggugccagggccgaaguuccucaccccuccucugac

SEQ ID NO: 466940 - RNA, 64 nt, Homo Sapiens
gagaccaggugagcacagccuggagccugugcccagggccgacaggcgcgacacccagcaaggc

SEQ ID NO: 466941 - RNA, 64 nt, Homo Sapiens
cuucggguacaacccugagcaggucgggggacacagggccgaggcaggccuucggggccccuuu

SEQ ID NO: 466942 - RNA, 64 nt, Homo Sapiens
ccccguguccccccaggugcuggaggcagacucgagggccgaauuguuucuaguuaggccacgc

SEQ ID NO: 466943 - RNA, 64 nt, Homo Sapiens
cugucuuaaaaaacacaaaaaaagacuuggccuuagggccgagugcgguggcucacgccuauaa

SEQ ID NO: 466944 - RNA, 64 nt, Homo Sapiens
gcuauaggagucaccuggagccucggucucucccagggccgauccugucugcagucacaucuuu

SEQ ID NO: 466945 - RNA, 64 nt, Homo Sapiens
aggcuccaggaggccuccagggccgggccggggaagggccgagcuuguuuuucucuuugggccg

SEQ ID NO: 466946 - RNA, 64 nt, Homo Sapiens
caggcaucuuggcccccagccucccaaagccguaagggccgaccgcccccaugugguugcgaca

SEQ ID NO: 466947 - RNA, 64 nt, Homo Sapiens
gggcaaguggguggagucuggcagcugcccacagagggccgagggucacccgucggccgccgcc

SEQ ID NO: 466948 - RNA, 64 nt, Homo Sapiens
ggccccagacagacuaaagcugcccuccuggugcagggccgaggggacacaaggaccuaccugg

SEQ ID NO: 466949 - RNA, 64 nt, Homo Sapiens
ggacacgccuggggcagcgugucugugcucagugagggccgaugaagaaagugcguuuucuguu

SEQ ID NO: 466950 - RNA, 64 nt, Homo Sapiens
acuaaaauaagaucauguuuuaauugugagaaacagggccgagcacaguggcucacgccuguaa

SEQ ID NO: 466951 - RNA, 64 nt, Homo Sapiens
auuuccaccgcggaggccccgcgcgccggugccgagggccgaggagcgcccggguccgggcagg

SEQ ID NO: 466952 - RNA, 64 nt, Homo Sapiens
cacauauggaauuuugcaaagauuuaaucugccaagggccgacuaagagaaguuguaaaguaug

SEQ ID NO: 466953 - RNA, 64 nt, Homo Sapiens
cguccaccgagcacucagauggaugcugaucaccagggccgagggggcucccagaaggacccca

SEQ ID NO: 466954 - RNA, 64 nt, Homo Sapiens
aagggcaagaagaggaggcuccaggguuggggcgagggccgaccuguccacccuucccuggaau

SEQ ID NO: 466955 - RNA, 64 nt, Homo Sapiens
cugggccccgggagccgugcuccuuggaacgcaaagggccgaggagcaucugguuuucauggca

SEQ ID NO: 466956 - RNA, 56 nt, Homo Sapiens
agccagcugcauugcuuagagaaugcagggccgaguagaucuucuugaguugguga

SEQ ID NO: 466957 - RNA, 64 nt, Homo Sapiens
ccaaaaaugugugaaauggaaaguugauggcagcagggccgacgaugucaccuggugccucgcg

SEQ ID NO: 466958 - RNA, 64 nt, Homo Sapiens
gggcagucgugguugggaacaugacaguucauucagggccgaugaccaggccccccugucaccc

SEQ ID NO: 466959 - RNA, 64 nt, Homo Sapiens
ucuccgucccccaucccuggggaggcucccaccaucucgccacuggacagaagcguccccuuug

SEQ ID NO: 466960 - RNA, 64 nt, Homo Sapiens
cgcgcgaagaagcuugggagucguggcgggggucucucgccaccccuuuccggagagccucccc

SEQ ID NO: 466961 - RNA, 64 nt, Homo Sapiens
ucccugccauugggcccuccaccuguggcucacaucucgccagccccacagagcauccucaggc

SEQ ID NO: 466962 - RNA, 64 nt, Homo Sapiens
accucugggccaaugcauuuccaaaggaugccuuucucgccauaugccuccccuggcccccagc

SEQ ID NO: 466963 - RNA, 64 nt, Homo Sapiens
agcuagcugcuuaggaguaccaggcuuuguaagaucucgccaacaggaagcugcguuagccgau

SEQ ID NO: 466964 - RNA, 64 nt, Homo Sapiens
guccccagccggcucgccagugcugcgcccacacucucgccagaggcccugccccaggccccgc

SEQ ID NO: 466965 - RNA, 64 nt, Homo Sapiens
aauucuugucuuugaguguucaugccuaaaaagaucucgccaaugaaacagaagggcgccaagc

SEQ ID NO: 466966 - RNA, 64 nt, Homo Sapiens
cuggaguguaguggcacaauacggagucuugcccucucgccaggucuuuuuuuuuuuuuuugag

SEQ ID NO: 466967 - RNA, 64 nt, Homo Sapiens
uuuuuauacuuucugaaaugacgaaauauauauuucucgccaaguggcagugacuguagaaaau

SEQ ID NO: 466968 - RNA, 58 nt, Homo Sapiens
ugagagguugcgcaacguucgagggcuaucucgccaccuccgcggggagcgggccuag

SEQ ID NO: 466969 - RNA, 64 nt, Homo Sapiens
ggcuucgugcaggagggcacggugggugagccauucucgccauucucaugucagacugaaagga

SEQ ID NO: 466970 - RNA, 64 nt, Homo Sapiens
ucaguuggcuuugugaagugucuuagguguucacucucgccagcccaguuucuuccggcgcagc

SEQ ID NO: 466971 - RNA, 64 nt, Homo Sapiens
acuacccaggacucuugcuaggccuucugcuguuucucgccaacggccugcuggggcuuuccau

SEQ ID NO: 466972 - RNA, 64 nt, Homo Sapiens
cccuuuaaauaccugucuuauucuaauguagcuaucucgccauuguuuuuuaaaaaaauaaaua

SEQ ID NO: 466973 - RNA, 64 nt, Homo Sapiens
uggcuuguaugaccuguucaggggucacaugaggucucgccaguuuccuggguccucuucagag

SEQ ID NO: 466974 - RNA, 64 nt, Homo Sapiens
cccccgcagcaucuacugaaaauacuacucaaauucucgccaaccguccucacacaguauugcu

SEQ ID NO: 466975 - RNA, 64 nt, Homo Sapiens
uuucuuauggaaagguccuguggggagcccauccucucgccaagccaucacaggcucugcauac

SEQ ID NO: 466976 - RNA, 64 nt, Homo Sapiens
aggcuuccaguucagccucaguuauuuuagacaaucucgccaucuuuaauuucuuagcuuccug

SEQ ID NO: 466977 - RNA, 64 nt, Homo Sapiens
uucugucuccagcuucccgaguaccagugacacgucucgccaagcaggacagugcuugauacag

SEQ ID NO: 466978 - RNA, 64 nt, Homo Sapiens
uggcagaucguggacccucuauggauguccucacucucgccauccagugggccugcuggugggc

SEQ ID NO: 466979 - RNA, 64 nt, Homo Sapiens
aaaaaaaaaaaaaaaaaaaauaacaguacuauuuucucgccacccuacgggguaagauuugccu

SEQ ID NO: 466980 - RNA, 64 nt, Homo Sapiens
uuucccccaaguuacauuccgccgaguccugcccucucgccacauuguggcaugcccaugggcu

SEQ ID NO: 466981 - RNA, 64 nt, Homo Sapiens
agcagaaacuaaagcagcaaaugcaggaaggcugucucgccauccucaagacucagcagcucuc

SEQ ID NO: 466982 - RNA, 64 nt, Homo Sapiens
gcccacccccauggcucgggucgugggggacaagucucgccagccccgcccagcccgggccacc

SEQ ID NO: 466983 - RNA, 64 nt, Homo Sapiens
uuugugacuccuguggacuccacugcgccugggaucucgccaaccccucucucauuugggguga

SEQ ID NO: 466984 - RNA, 64 nt, Homo Sapiens
uaaaaauguuaggcucuaaauggacgaaaaauucucucgccaucuuaauaacaaaauaaacuac

SEQ ID NO: 466985 - RNA, 64 nt, Homo Sapiens
auguaaggaugagggaagcgaagcaagaggaaccucucgccaugaucagacauacagcugccua

SEQ ID NO: 466986 - RNA, 64 nt, Homo Sapiens
gucaaagagaaacuuugaagacuuagaauauaagucucgccauccaagguuuuauuuucuucug

SEQ ID NO: 466987 - RNA, 64 nt, Homo Sapiens
ucagccgcagccuuuaaagauacauaauucuucaucucgccaaugggagacagcagccuuaauc

SEQ ID NO: 466988 - RNA, 64 nt, Homo Sapiens
cugggcuuuggcaccaaguaccugaaagagaacuucucgccauggauccagcagcacgguggau

SEQ ID NO: 466989 - RNA, 64 nt, Homo Sapiens
guagauucaucaaacuagagaccccagcuccccuucucgccaucuucuuucucaaguugaccgu

SEQ ID NO: 466990 - RNA, 64 nt, Homo Sapiens
uuaucuauuuauuuauuugaugacugucucucuuucucgccauuagcaguauugaauuauuuau

SEQ ID NO: 466991 - RNA, 64 nt, Homo Sapiens
gaaaccacgcccacaccaauagucaccaaugauaucucgccaaacuacagaagaggcaagacac

SEQ ID NO: 466992 - RNA, 64 nt, Homo Sapiens
cuucuuuacuuuaacauauuuuaauucauguuugucucgccaugugaaugaucagaacugacau

SEQ ID NO: 466993 - RNA, 64 nt, Homo Sapiens
cuagcacuuugaauucgagcaggucagcgucuucucucgccacgacgguccccauuccaccccc

SEQ ID NO: 466994 - RNA, 64 nt, Homo Sapiens
uacuggggaagccgguccguacguaggccuugcaucucgccaccuccacuucuguccucaagaa

SEQ ID NO: 466995 - RNA, 64 nt, Homo Sapiens
ggcaccuccuauccugcugcaguccccaagacaaucucgccaaaucccgguggucuccccaaga

SEQ ID NO: 466996 - RNA, 64 nt, Homo Sapiens
ugcguuucucuuguuuuuuuccccgaaucaucgcucucgccaugcagugaaccaaccaaaccaa

SEQ ID NO: 466997 - RNA, 64 nt, Homo Sapiens
agaacagauuuaaugacuuuauggauccgacuacucucgccaacuacagaugcacgauuuggcc

SEQ ID NO: 466998 - RNA, 64 nt, Homo Sapiens
gcacuccagcuugggcaauagcagugagccaagaucucgccacugaaccugggaggcggagguu

SEQ ID NO: 466999 - RNA, 64 nt, Homo Sapiens
ucacccagacagcucccucugccugaaccuuccaucucgccaccccuccuuccuugaccagcag

SEQ ID NO: 467000 - RNA, 63 nt, Homo Sapiens
aggcagggacaggacgggcagggguggcggcugucucgccaucccgcagaggaggggcgauga

SEQ ID NO: 467001 - RNA, 64 nt, Homo Sapiens
cuuuagcuguagucaugaauuuccagcuccccuuucucgccauuaauagaaacuuccaaggcuc

SEQ ID NO: 467002 - RNA, 64 nt, Homo Sapiens
cgccucagacucggggugagggaggcgggcagccucucgccagccuucccguccuucaguucaa

SEQ ID NO: 467003 - RNA, 64 nt, Homo Sapiens
cgggcagauggcagaagggaccccuuggacuuuuucucgccaucccuccccccagcgcaggggc

SEQ ID NO: 467004 - RNA, 64 nt, Homo Sapiens
caccgagcccuagcuggccggccaccuccuuuccucucgccaccuuccaccccugcgcugugcu

SEQ ID NO: 467005 - RNA, 64 nt, Homo Sapiens
ccaggccugacccugguaccgaagcuguggacguucucgccacacucaaccccaugagcuucca

SEQ ID NO: 467006 - RNA, 64 nt, Homo Sapiens
uccugugccaaugucccaccgcaccucaugccugucucgccaccgcugcccgccucagggaugg

SEQ ID NO: 467007 - RNA, 64 nt, Homo Sapiens
ccgccaaccgcgagagacccggggcgggcuccccucucgccaacagcugagcaccuggggccuc

SEQ ID NO: 467008 - RNA, 64 nt, Homo Sapiens
gacugucaauguuucauucagauaauugcuugauucucgccagaaaucagaucuacagcuccug

SEQ ID NO: 467009 - RNA, 64 nt, Homo Sapiens
gaaaaucugaggccacacagcuagcagcacacaaucucgccagggguaaccuaauggccacugg

SEQ ID NO: 467010 - RNA, 64 nt, Homo Sapiens
cugguaauuccaggugcugcgcuuggcagaggggucucgccaaagcgcaugugugugcaugugu

SEQ ID NO: 467011 - RNA, 64 nt, Homo Sapiens
guuagugauccaagagaggaauuuggcaauaaguucucgccaagcaaggcccagcuccuugaca

SEQ ID NO: 467012 - RNA, 64 nt, Homo Sapiens
agacuccuaggcccuugggggguucagccuccugucucgccagaucccuggcugcagccuccgg

SEQ ID NO: 467013 - RNA, 64 nt, Homo Sapiens
cugggugcuuuacugucucuaucuggaagugcucucucgccacucccccgagaggacaacaggc

SEQ ID NO: 467014 - RNA, 64 nt, Homo Sapiens
agauguuuuugugccauaugcuggauauccagguucucgccaggccccgauacaugaauaacaa

SEQ ID NO: 467015 - RNA, 64 nt, Homo Sapiens
accauggcuggcccaucugagagcaucuccccacucucgccaaccuaucggggcauagcccagg

SEQ ID NO: 467016 - RNA, 64 nt, Homo Sapiens
ccccauauuuaugugacuagaagcgcaacagacuucucgccauagucgagcucucccgcugggg

SEQ ID NO: 467017 - RNA, 64 nt, Homo Sapiens
gauggccacuuccagagcuugcccauugccugucucucgccaauuccguuuauccaaaaaggua

SEQ ID NO: 467018 - RNA, 58 nt, Homo Sapiens
ucccuaaugagauuccacccguggggguucucgccaaucuucagucccccaguccuga

SEQ ID NO: 467019 - RNA, 64 nt, Homo Sapiens
cacuccugcagugugcgucccccugcggcuggccucucgccagcaacaggaccucgguucaugu

SEQ ID NO: 467020 - RNA, 64 nt, Homo Sapiens
ucaggaggaugcugugcacacugugugugaugaaucucgccagaaaggcuccugaggucccagg

SEQ ID NO: 467021 - RNA, 64 nt, Homo Sapiens
cuccugcauuucuguucaguccaaucucggccccucucgccacccaccucucugcccugaacac

SEQ ID NO: 467022 - RNA, 64 nt, Homo Sapiens
gaacccgggaggcagagcuugcagugagccgagaucucgccacugcacuccagccugggcaaca

SEQ ID NO: 467023 - RNA, 64 nt, Homo Sapiens
ccucucugaguauuuagcuaucucucucucucucucucgccauaucucucucucucucucucuc

SEQ ID NO: 467024 - RNA, 64 nt, Homo Sapiens; identical to SEQ ID NO: 51723

SEQ ID NO: 467025 - RNA, 64 nt, Homo Sapiens; identical to SEQ ID NO: 51724

SEQ ID NO: 467026 - RNA, 64 nt, Homo Sapiens; identical to SEQ ID NO: 51725

SEQ ID NO: 467027 - RNA, 64 nt, Homo Sapiens; identical to SEQ ID NO: 51726

SEQ ID NO: 467028 - RNA, 64 nt, Homo Sapiens; identical to SEQ ID NO: 51727

SEQ ID NO: 467029 - RNA, 64 nt, Homo Sapiens; identical to SEQ ID NO: 51728

SEQ ID NO: 467030 - RNA, 64 nt, Homo Sapiens; identical to SEQ ID NO: 51729

SEQ ID NO: 467031 - RNA, 64 nt, Homo Sapiens; identical to SEQ ID NO: 51730

SEQ ID NO: 467032 - RNA, 64 nt, Homo Sapiens; identical to SEQ ID NO: 51731

SEQ ID NO: 467033 - RNA, 64 nt, Homo Sapiens; identical to SEQ ID NO: 51732

SEQ ID NO: 467034 - RNA, 64 nt, Homo Sapiens; identical to SEQ ID NO: 51733

SEQ ID NO: 467035 - RNA, 64 nt, Homo Sapiens; identical to SEQ ID NO: 51734

SEQ ID NO: 467036 - RNA, 64 nt, Homo Sapiens; identical to SEQ ID NO: 51735

SEQ ID NO: 467037 - RNA, 64 nt, Homo Sapiens; identical to SEQ ID NO: 51736

SEQ ID NO: 467038 - RNA, 64 nt, Homo Sapiens; identical to SEQ ID NO: 51737

SEQ ID NO: 467039 - RNA, 64 nt, Homo Sapiens; identical to SEQ ID NO: 51738

SEQ ID NO: 467040 - RNA, 64 nt, Homo Sapiens; identical to SEQ ID NO: 51739

SEQ ID NO: 467041 - RNA, 64 nt, Homo Sapiens; identical to SEQ ID NO: 51740

SEQ ID NO: 467042 - RNA, 64 nt, Homo Sapiens; identical to SEQ ID NO: 51741

SEQ ID NO: 467043 - RNA, 64 nt, Homo Sapiens; identical to SEQ ID NO: 51742

SEQ ID NO: 467044 - RNA, 64 nt, Homo Sapiens; identical to SEQ ID NO: 51743

SEQ ID NO: 467045 - RNA, 64 nt, Homo Sapiens; identical to SEQ ID NO: 51744

SEQ ID NO: 467046 - RNA, 64 nt, Homo Sapiens; identical to SEQ ID NO: 51745

SEQ ID NO: 467047 - RNA, 64 nt, Homo Sapiens; identical to SEQ ID NO: 51746

SEQ ID NO: 467048 - RNA, 64 nt, Homo Sapiens; identical to SEQ ID NO: 51747

SEQ ID NO: 467049 - RNA, 64 nt, Homo Sapiens; identical to SEQ ID NO: 51748

SEQ ID NO: 467050 - RNA, 64 nt, Homo Sapiens; identical to SEQ ID NO: 236779

SEQ ID NO: 467051 - RNA, 64 nt, Homo Sapiens; identical to SEQ ID NO: 236780

SEQ ID NO: 467052 - RNA, 64 nt, Homo Sapiens; identical to SEQ ID NO: 236781

SEQ ID NO: 467053 - RNA, 64 nt, Homo Sapiens; identical to SEQ ID NO: 236782

SEQ ID NO: 467054 - RNA, 64 nt, Homo Sapiens; identical to SEQ ID NO: 236783

SEQ ID NO: 467055 - RNA, 64 nt, Homo Sapiens; identical to SEQ ID NO: 236784

SEQ ID NO: 467056 - RNA, 64 nt, Homo Sapiens; identical to SEQ ID NO: 236785

SEQ ID NO: 467057 - RNA, 64 nt, Homo Sapiens; identical to SEQ ID NO: 236786

SEQ ID NO: 467058 - RNA, 64 nt, Homo Sapiens; identical to SEQ ID NO: 236787

SEQ ID NO: 467059 - RNA, 64 nt, Homo Sapiens; identical to SEQ ID NO: 236788

SEQ ID NO: 467060 - RNA, 64 nt, Homo Sapiens; identical to SEQ ID NO: 236789

SEQ ID NO: 467061 - RNA, 64 nt, Homo Sapiens; identical to SEQ ID NO: 236790

SEQ ID NO: 467062 - RNA, 64 nt, Homo Sapiens; identical to SEQ ID NO: 223465

SEQ ID NO: 467063 - RNA, 64 nt, Homo Sapiens; identical to SEQ ID NO: 223466

SEQ ID NO: 467064 - RNA, 64 nt, Homo Sapiens; identical to SEQ ID NO: 223467

SEQ ID NO: 467065 - RNA, 64 nt, Homo Sapiens; identical to SEQ ID NO: 223468

SEQ ID NO: 467066 - RNA, 64 nt, Homo Sapiens; identical to SEQ ID NO: 223469

SEQ ID NO: 467067 - RNA, 64 nt, Homo Sapiens; identical to SEQ ID NO: 223470

SEQ ID NO: 467068 - RNA, 64 nt, Homo Sapiens; identical to SEQ ID NO: 223471

SEQ ID NO: 467069 - RNA, 64 nt, Homo Sapiens; identical to SEQ ID NO: 223472

SEQ ID NO: 467070 - RNA, 64 nt, Homo Sapiens; identical to SEQ ID NO: 223473

SEQ ID NO: 467071 - RNA, 64 nt, Homo Sapiens; identical to SEQ ID NO: 223474

SEQ ID NO: 467072 - RNA, 64 nt, Homo Sapiens; identical to SEQ ID NO: 223475

SEQ ID NO: 467073 - RNA, 64 nt, Homo Sapiens; identical to SEQ ID NO: 223476

SEQ ID NO: 467074 - RNA, 64 nt, Homo Sapiens; identical to SEQ ID NO: 223477

SEQ ID NO: 467075 - RNA, 64 nt, Homo Sapiens; identical to SEQ ID NO: 223478

SEQ ID NO: 467076 - RNA, 64 nt, Homo Sapiens; identical to SEQ ID NO: 223479

SEQ ID NO: 467077 - RNA, 64 nt, Homo Sapiens; identical to SEQ ID NO: 223480

SEQ ID NO: 467078 - RNA, 64 nt, Homo Sapiens; identical to SEQ ID NO: 223481

SEQ ID NO: 467079 - RNA, 64 nt, Homo Sapiens; identical to SEQ ID NO: 223482

SEQ ID NO: 467080 - RNA, 64 nt, Homo Sapiens; identical to SEQ ID NO: 223483

SEQ ID NO: 467081 - RNA, 64 nt, Homo Sapiens; identical to SEQ ID NO: 223484

SEQ ID NO: 467082 - RNA, 64 nt, Homo Sapiens; identical to SEQ ID NO: 223485

SEQ ID NO: 467083 - RNA, 64 nt, Homo Sapiens; identical to SEQ ID NO: 223486

SEQ ID NO: 467084 - RNA, 64 nt, Homo Sapiens; identical to SEQ ID NO: 223487

SEQ ID NO: 467085 - RNA, 64 nt, Homo Sapiens; identical to SEQ ID NO: 223488

SEQ ID NO: 467086 - RNA, 64 nt, Homo Sapiens; identical to SEQ ID NO: 223489

SEQ ID NO: 467087 - RNA, 64 nt, Homo Sapiens; identical to SEQ ID NO: 223490

SEQ ID NO: 467088 - RNA, 64 nt, Homo Sapiens; identical to SEQ ID NO: 223491

SEQ ID NO: 467089 - RNA, 64 nt, Homo Sapiens; identical to SEQ ID NO: 223492

SEQ ID NO: 467090 - RNA, 64 nt, Homo Sapiens; identical to SEQ ID NO: 223493

SEQ ID NO: 467091 - RNA, 64 nt, Homo Sapiens; identical to SEQ ID NO: 223494

SEQ ID NO: 467092 - RNA, 64 nt, Homo Sapiens; identical to SEQ ID NO: 223495

SEQ ID NO: 467093 - RNA, 64 nt, Homo Sapiens; identical to SEQ ID NO: 223496

SEQ ID NO: 467094 - RNA, 64 nt, Homo Sapiens; identical to SEQ ID NO: 223497

SEQ ID NO: 467095 - RNA, 64 nt, Homo Sapiens; identical to SEQ ID NO: 223498

SEQ ID NO: 467096 - RNA, 64 nt, Homo Sapiens; identical to SEQ ID NO: 223499

SEQ ID NO: 467097 - RNA, 64 nt, Homo Sapiens; identical to SEQ ID NO: 223500

SEQ ID NO: 467098 - RNA, 64 nt, Homo Sapiens; identical to SEQ ID NO: 223501

SEQ ID NO: 467099 - RNA, 64 nt, Homo Sapiens; identical to SEQ ID NO: 223502

SEQ ID NO: 467100 - RNA, 64 nt, Homo Sapiens; identical to SEQ ID NO: 223503

SEQ ID NO: 467101 - RNA, 64 nt, Homo Sapiens; identical to SEQ ID NO: 223504

SEQ ID NO: 467102 - RNA, 64 nt, Homo Sapiens; identical to SEQ ID NO: 223505

SEQ ID NO: 467103 - RNA, 64 nt, Homo Sapiens; identical to SEQ ID NO: 223506

SEQ ID NO: 467104 - RNA, 64 nt, Homo Sapiens; identical to SEQ ID NO: 223507

SEQ ID NO: 467105 - RNA, 64 nt, Homo Sapiens; identical to SEQ ID NO: 223508

SEQ ID NO: 467106 - RNA, 64 nt, Homo Sapiens; identical to SEQ ID NO: 223509

SEQ ID NO: 467107 - RNA, 64 nt, Homo Sapiens; identical to SEQ ID NO: 223510

SEQ ID NO: 467108 - RNA, 64 nt, Homo Sapiens; identical to SEQ ID NO: 223511

SEQ ID NO: 467109 - RNA, 64 nt, Homo Sapiens; identical to SEQ ID NO: 223512

SEQ ID NO: 467110 - RNA, 64 nt, Homo Sapiens; identical to SEQ ID NO: 223513

SEQ ID NO: 467111 - RNA, 64 nt, Homo Sapiens; identical to SEQ ID NO: 223514

SEQ ID NO: 467112 - RNA, 64 nt, Homo Sapiens; identical to SEQ ID NO: 223515

SEQ ID NO: 467113 - RNA, 64 nt, Homo Sapiens; identical to SEQ ID NO: 223516

SEQ ID NO: 467114 - RNA, 64 nt, Homo Sapiens; identical to SEQ ID NO: 223517

SEQ ID NO: 467115 - RNA, 64 nt, Homo Sapiens; identical to SEQ ID NO: 223518

SEQ ID NO: 467116 - RNA, 64 nt, Homo Sapiens; identical to SEQ ID NO: 223519

SEQ ID NO: 467117 - RNA, 64 nt, Homo Sapiens; identical to SEQ ID NO: 223520

SEQ ID NO: 467118 - RNA, 64 nt, Homo Sapiens; identical to SEQ ID NO: 223521

SEQ ID NO: 467119 - RNA, 64 nt, Homo Sapiens; identical to SEQ ID NO: 223522

SEQ ID NO: 467120 - RNA, 64 nt, Homo Sapiens; identical to SEQ ID NO: 223523

SEQ ID NO: 467121 - RNA, 64 nt, Homo Sapiens; identical to SEQ ID NO: 223524

SEQ ID NO: 467122 - RNA, 64 nt, Homo Sapiens; identical to SEQ ID NO: 223525

SEQ ID NO: 467123 - RNA, 64 nt, Homo Sapiens; identical to SEQ ID NO: 223526

SEQ ID NO: 467124 - RNA, 64 nt, Homo Sapiens; identical to SEQ ID NO: 223527

SEQ ID NO: 467125 - RNA, 64 nt, Homo Sapiens; identical to SEQ ID NO: 223528

SEQ ID NO: 467126 - RNA, 64 nt, Homo Sapiens; identical to SEQ ID NO: 223529

SEQ ID NO: 467127 - RNA, 64 nt, Homo Sapiens; identical to SEQ ID NO: 223530

SEQ ID NO: 467128 - RNA, 64 nt, Homo Sapiens; identical to SEQ ID NO: 223531

SEQ ID NO: 467129 - RNA, 64 nt, Homo Sapiens; identical to SEQ ID NO: 223532

SEQ ID NO: 467130 - RNA, 64 nt, Homo Sapiens; identical to SEQ ID NO: 223533

SEQ ID NO: 467131 - RNA, 64 nt, Homo Sapiens; identical to SEQ ID NO: 223534

SEQ ID NO: 467132 - RNA, 64 nt, Homo Sapiens; identical to SEQ ID NO: 223535

SEQ ID NO: 467133 - RNA, 64 nt, Homo Sapiens; identical to SEQ ID NO: 223536

SEQ ID NO: 467134 - RNA, 64 nt, Homo Sapiens; identical to SEQ ID NO: 223537

SEQ ID NO: 467135 - RNA, 64 nt, Homo Sapiens; identical to SEQ ID NO: 223538

SEQ ID NO: 467136 - RNA, 64 nt, Homo Sapiens; identical to SEQ ID NO: 223539

SEQ ID NO: 467137 - RNA, 64 nt, Homo Sapiens; identical to SEQ ID NO: 223540

SEQ ID NO: 467138 - RNA, 64 nt, Homo Sapiens; identical to SEQ ID NO: 223541

SEQ ID NO: 467139 - RNA, 64 nt, Homo Sapiens; identical to SEQ ID NO: 223542

SEQ ID NO: 467140 - RNA, 64 nt, Homo Sapiens; identical to SEQ ID NO: 223543

SEQ ID NO: 467141 - RNA, 64 nt, Homo Sapiens; identical to SEQ ID NO: 223544

SEQ ID NO: 467142 - RNA, 64 nt, Homo Sapiens; identical to SEQ ID NO: 223545

SEQ ID NO: 467143 - RNA, 64 nt, Homo Sapiens; identical to SEQ ID NO: 223546

SEQ ID NO: 467144 - RNA, 64 nt, Homo Sapiens; identical to SEQ ID NO: 223547

SEQ ID NO: 467145 - RNA, 64 nt, Homo Sapiens; identical to SEQ ID NO: 223548

SEQ ID NO: 467146 - RNA, 64 nt, Homo Sapiens; identical to SEQ ID NO: 223549

SEQ ID NO: 467147 - RNA, 64 nt, Homo Sapiens; identical to SEQ ID NO: 223550

SEQ ID NO: 467148 - RNA, 64 nt, Homo Sapiens; identical to SEQ ID NO: 223551

SEQ ID NO: 467149 - RNA, 64 nt, Homo Sapiens; identical to SEQ ID NO: 223552

SEQ ID NO: 467150 - RNA, 64 nt, Homo Sapiens; identical to SEQ ID NO: 223553

SEQ ID NO: 467151 - RNA, 64 nt, Homo Sapiens; identical to SEQ ID NO: 223554

SEQ ID NO: 467152 - RNA, 64 nt, Homo Sapiens; identical to SEQ ID NO: 223555

SEQ ID NO: 467153 - RNA, 64 nt, Homo Sapiens; identical to SEQ ID NO: 223556

SEQ ID NO: 467154 - RNA, 64 nt, Homo Sapiens; identical to SEQ ID NO: 223557

SEQ ID NO: 467155 - RNA, 64 nt, Homo Sapiens; identical to SEQ ID NO: 223558

SEQ ID NO: 467156 - RNA, 64 nt, Homo Sapiens; identical to SEQ ID NO: 223559

SEQ ID NO: 467157 - RNA, 64 nt, Homo Sapiens; identical to SEQ ID NO: 223560

SEQ ID NO: 467158 - RNA, 64 nt, Homo Sapiens; identical to SEQ ID NO: 223561

SEQ ID NO: 467159 - RNA, 64 nt, Homo Sapiens; identical to SEQ ID NO: 223562

SEQ ID NO: 467160 - RNA, 64 nt, Homo Sapiens; identical to SEQ ID NO: 223563

SEQ ID NO: 467161 - RNA, 64 nt, Homo Sapiens; identical to SEQ ID NO: 223564

SEQ ID NO: 467162 - RNA, 64 nt, Homo Sapiens; identical to SEQ ID NO: 223565

SEQ ID NO: 467163 - RNA, 64 nt, Homo Sapiens; identical to SEQ ID NO: 223566

SEQ ID NO: 467164 - RNA, 64 nt, Homo Sapiens; identical to SEQ ID NO: 223567

SEQ ID NO: 467165 - RNA, 64 nt, Homo Sapiens; identical to SEQ ID NO: 223568

SEQ ID NO: 467166 - RNA, 64 nt, Homo Sapiens; identical to SEQ ID NO: 223569

SEQ ID NO: 467167 - RNA, 64 nt, Homo Sapiens; identical to SEQ ID NO: 223570

SEQ ID NO: 467168 - RNA, 64 nt, Homo Sapiens; identical to SEQ ID NO: 223571

SEQ ID NO: 467169 - RNA, 64 nt, Homo Sapiens
ucacacagcuaguuagcggcagaaaucaggugacuugcccaaggucguuuuacaguugcccaag

SEQ ID NO: 467170 - RNA, 64 nt, Homo Sapiens
gaaaucaggugacuugcccaccuucguuuuacaguugcccaagauuagagaucacccgaccaac

SEQ ID NO: 467171 - RNA, 64 nt, Homo Sapiens
uuuuauuuuuuuguacagauggggucuugcuauguugcccaagcuggucuuaaacuccuggccu

SEQ ID NO: 467172 - RNA, 64 nt, Homo Sapiens
uuaauaucaacucucacuccugaauucaguugcuuugcccaagauaggaguucucugaugcaga

SEQ ID NO: 467173 - RNA, 64 nt, Homo Sapiens
ugucuacagaaaaugcuggcugagcugaacacauuugcccaauuccaggugugcacagaaaacc

SEQ ID NO: 467174 - RNA, 64 nt, Homo Sapiens
uuuagagaucugagcugucucuuaaaggggacaguugcccaaaauguuccuugcuauguguucu

SEQ ID NO: 467175 - RNA, 64 nt, Homo Sapiens
uuuuuuuuuuuucccgagaccaaguuucacucuguugcccaagguagagugcaguggcgugauc

SEQ ID NO: 467176 - RNA, 64 nt, Homo Sapiens
ugcaaaacgucuauauuuuuagaaagagcucucccugagucaguccaguauauucaguaguuga

SEQ ID NO: 467177 - RNA, 64 nt, Homo Sapiens
agaaucacuugaacgugggaagcuacacuggaggcugagucagguaguacaugccuguaauccc

SEQ ID NO: 467178 - RNA, 64 nt, Homo Sapiens
agagauaaaagucagguuaauacuaucuuaaacacugagucagaaaaucauuacuguauagaag

SEQ ID NO: 467179 - RNA, 64 nt, Homo Sapiens
guaaaaugaaccauuuacaguucgguuuuggacucugagucaaaggauuuuccuuuaaaugcuu

SEQ ID NO: 467180 - RNA, 64 nt, Homo Sapiens
cgcuaucacacaccuccaagaucaagauccuguucugagucagaugaugaugacagcagugaaa

SEQ ID NO: 467181 - RNA, 64 nt, Homo Sapiens
aaaaggaagaauuaugcugguaguaaaugggacucugagucaaauucagaacgagaugucacua

SEQ ID NO: 467182 - RNA, 64 nt, Homo Sapiens
gucuacauaggcaaaguuuuccauuuuugucagucugagucaucaaaaagagucuuaauuuucu

SEQ ID NO: 467183 - RNA, 64 nt, Homo Sapiens
uagaagcugaucugauugguccaacaguuugaugcugagucaugcguguugaaucccacuucag

SEQ ID NO: 467184 - RNA, 64 nt, Homo Sapiens
agagcuaccccaggugaaacugagagggcauggccugagucagauauuuuguuuuccccucuaa

SEQ ID NO: 467185 - RNA, 64 nt, Homo Sapiens
gacucgccugcccacuacguuccuucgguucuuacugagucacaguguucugcucaccacaccg

SEQ ID NO: 467186 - RNA, 64 nt, Homo Sapiens
ccucuguccccuggccuagccucucuguccuucccugagucacagagagcaagccaagacaucc

SEQ ID NO: 467187 - RNA, 64 nt, Homo Sapiens
aaccucccuagggcucccaacugaccucaggccucugagucacugaaugucaccaggagaggug

SEQ ID NO: 467188 - RNA, 64 nt, Homo Sapiens
gcucuacagagagcaauuaacauaaggcauuuaucugagucauuuuaguuacauuauuaaaagu

SEQ ID NO: 467189 - RNA, 64 nt, Homo Sapiens
gauuaacaaugcuauacuauaaggaauuaauauacugagucaaaccggugacauuuauucacca

SEQ ID NO: 467190 - RNA, 64 nt, Homo Sapiens
cauggguaagacucaagguagauuuaaauguuaucugagucaaaaaaauuguaguccaaagugu

SEQ ID NO: 467191 - RNA, 64 nt, Homo Sapiens
ccucugucuaaccagccccaacaugcacagcuuccugagucaccggccaccccucuucucuccc

SEQ ID NO: 467192 - RNA, 64 nt, Homo Sapiens
aauucucuuacauccuucccuuuaaacccuaaaucugagucagucuuccuauuucucaauaguc

SEQ ID NO: 467193 - RNA, 64 nt, Homo Sapiens
aauucucuaaaaauccuuccuuuaagcccuaaaucugagucagucuuccuauuucucaauaguc

SEQ ID NO: 467194 - RNA, 64 nt, Homo Sapiens
cugcauaggaauuuagaaccuaggcucuauuuaacugagucacaauguucccaaguaggcauuc

SEQ ID NO: 467195 - RNA, 64 nt, Homo Sapiens
ucagaaaugcccuacaucuuaugaaguuuucccacugagucacacugcugcuguggauaucucc

SEQ ID NO: 467196 - RNA, 64 nt, Homo Sapiens
aggaauguuaaagucaguggugcggccgcauucccugagucacccagugcuugaguuuggggaa

SEQ ID NO: 467197 - RNA, 64 nt, Homo Sapiens
aucucccugccgccucaaugucagaccccagcggcugagucauggggauggaggagaagaauuu

SEQ ID NO: 467198 - RNA, 64 nt, Homo Sapiens
gcugucagugcagccauuugcugggaaccagugccugagucacacuggccuggguucuagaucu

SEQ ID NO: 467199 - RNA, 64 nt, Homo Sapiens
gcugucuaggccucggugcucugggaaccagcaccugagucacacuggccuggguucuagaccu

SEQ ID NO: 467200 - RNA, 64 nt, Homo Sapiens
acacucuacuuccuuugcagccuuagucacacaacugagucaucucaaguacucuuuaaggaca

SEQ ID NO: 467201 - RNA, 64 nt, Homo Sapiens
aaguacucuuuaaggacacacagcccaggcuguucugagucagaauaggccccuacagguauau

SEQ ID NO: 467202 - RNA, 64 nt, Homo Sapiens
uucccaguaaagauaccaugagcuaauaaguggcacagcuaauaaguaauuugccuaaggucac

SEQ ID NO: 467203 - RNA, 64 nt, Homo Sapiens
aguggcacagcuaauauuccauuugccuaaggucacagcuaauacaggccagauaagugaagua

SEQ ID NO: 467204 - RNA, 64 nt, Homo Sapiens
cagcucuuuagauucccuguaucuguguauguacacagcuaacaccuugaccuuuucucagaua

SEQ ID NO: 467205 - RNA, 64 nt, Homo Sapiens
uauuuuuuaaaaugcauugcgccauuuuuaauuuacagcuaaaaucugccaaggguacauuaug

SEQ ID NO: 467206 - RNA, 64 nt, Homo Sapiens
uauucucuagaaugagcacaaaacaaaucgaauaacagcuaaacaaaucgaauaacagcuaaac

SEQ ID NO: 467207 - RNA, 64 nt, Homo Sapiens
aaacaaaucgaauaacagcuaaacaaaucgaauaacagcuaaacgaaucgaauaacagcuuuug

SEQ ID NO: 467208 - RNA, 64 nt, Homo Sapiens
aaugcuuuaugccaaacauguuuauuuuuaucacacagcuaaagucuguaguuaaguugcugcu

SEQ ID NO: 467209 - RNA, 64 nt, Homo Sapiens
guacaaggcaggaaaagggauggaauugauggugacagcuaagucugucuuuuuucuuaggaaa

SEQ ID NO: 467210 - RNA, 64 nt, Homo Sapiens
aauauugcuaauaccaaaaaugaaagaggccaucacagcuaauccuauggucaccaaaaggauu

SEQ ID NO: 467211 - RNA, 64 nt, Homo Sapiens
ucaaguugguaaagaacauacuacaaaaaacccuacagcuaacauuauccuugauguuuccaac

SEQ ID NO: 467212 - RNA, 64 nt, Homo Sapiens
aggcaggacaugcugaagccaaagccaauaacacacagcuaacacacagcucccauaaccgcug

SEQ ID NO: 467213 - RNA, 64 nt, Homo Sapiens
gaaggcaaugccauccucaaacacugcaggcaucacagcuaacaauugugaagucgucuuaacu

SEQ ID NO: 467214 - RNA, 64 nt, Homo Sapiens
ccugugagugcaucucuucuuuccuuuagucuucacagcuaacucuggagagcuucaaaacuag

SEQ ID NO: 467215 - RNA, 64 nt, Homo Sapiens
ugggaugaguugccccgggcugcaaauuaagaguacagcuaagugcggggguggcgguggaggg

SEQ ID NO: 467216 - RNA, 64 nt, Homo Sapiens
aguacuaacugauuuagaggacuauagauucaugacagcuaauuaaucuucagugauuccuuuu

SEQ ID NO: 467217 - RNA, 64 nt, Homo Sapiens
uaucagaaugaaagcaagguuauugacuggauugacagcuaaagacagacuuaacaacaaccgg

SEQ ID NO: 467218 - RNA, 64 nt, Homo Sapiens; identical to SEQ ID NO: 182508

SEQ ID NO: 467219 - RNA, 64 nt, Homo Sapiens; identical to SEQ ID NO: 182509

SEQ ID NO: 467220 - RNA, 64 nt, Homo Sapiens; identical to SEQ ID NO: 182510

SEQ ID NO: 467221 - RNA, 64 nt, Homo Sapiens; identical to SEQ ID NO: 182511

SEQ ID NO: 467222 - RNA, 64 nt, Homo Sapiens; identical to SEQ ID NO: 182512

SEQ ID NO: 467223 - RNA, 64 nt, Homo Sapiens; identical to SEQ ID NO: 182513

SEQ ID NO: 467224 - RNA, 64 nt, Homo Sapiens; identical to SEQ ID NO: 182514

SEQ ID NO: 467225 - RNA, 64 nt, Homo Sapiens; identical to SEQ ID NO: 182515

SEQ ID NO: 467226 - RNA, 64 nt, Homo Sapiens; identical to SEQ ID NO: 182516

SEQ ID NO: 467227 - RNA, 64 nt, Homo Sapiens; identical to SEQ ID NO: 182517

SEQ ID NO: 467228 - RNA, 64 nt, Homo Sapiens; identical to SEQ ID NO: 182518

SEQ ID NO: 467229 - RNA, 64 nt, Homo Sapiens; identical to SEQ ID NO: 182519

SEQ ID NO: 467230 - RNA, 64 nt, Homo Sapiens; identical to SEQ ID NO: 182520

SEQ ID NO: 467231 - RNA, 64 nt, Homo Sapiens; identical to SEQ ID NO: 182521

SEQ ID NO: 467232 - RNA, 64 nt, Homo Sapiens; identical to SEQ ID NO: 182522

SEQ ID NO: 467233 - RNA, 64 nt, Homo Sapiens; identical to SEQ ID NO: 182523

SEQ ID NO: 467234 - RNA, 64 nt, Homo Sapiens; identical to SEQ ID NO: 182524

SEQ ID NO: 467235 - RNA, 64 nt, Homo Sapiens; identical to SEQ ID NO: 182525

SEQ ID NO: 467236 - RNA, 64 nt, Homo Sapiens; identical to SEQ ID NO: 182526

SEQ ID NO: 467237 - RNA, 64 nt, Homo Sapiens; identical to SEQ ID NO: 182527

SEQ ID NO: 467238 - RNA, 64 nt, Homo Sapiens; identical to SEQ ID NO: 182528

SEQ ID NO: 467239 - RNA, 64 nt, Homo Sapiens; identical to SEQ ID NO: 182529

SEQ ID NO: 467240 - RNA, 64 nt, Homo Sapiens; identical to SEQ ID NO: 182530

SEQ ID NO: 467241 - RNA, 64 nt, Homo Sapiens; identical to SEQ ID NO: 182531

SEQ ID NO: 467242 - RNA, 64 nt, Homo Sapiens; identical to SEQ ID NO: 182532

SEQ ID NO: 467243 - RNA, 64 nt, Homo Sapiens; identical to SEQ ID NO: 182533

SEQ ID NO: 467244 - RNA, 64 nt, Homo Sapiens; identical to SEQ ID NO: 182534

SEQ ID NO: 467245 - RNA, 64 nt, Homo Sapiens; identical to SEQ ID NO: 182535

SEQ ID NO: 467246 - RNA, 64 nt, Homo Sapiens; identical to SEQ ID NO: 298158

SEQ ID NO: 467247 - RNA, 64 nt, Homo Sapiens; identical to SEQ ID NO: 298159

SEQ ID NO: 467248 - RNA, 64 nt, Homo Sapiens; identical to SEQ ID NO: 298160

SEQ ID NO: 467249 - RNA, 64 nt, Homo Sapiens; identical to SEQ ID NO: 298161

SEQ ID NO: 467250 - RNA, 64 nt, Homo Sapiens; identical to SEQ ID NO: 298162

SEQ ID NO: 467251 - RNA, 64 nt, Homo Sapiens; identical to SEQ ID NO: 298163

SEQ ID NO: 467252 - RNA, 64 nt, Homo Sapiens; identical to SEQ ID NO: 298164

SEQ ID NO: 467253 - RNA, 64 nt, Homo Sapiens; identical to SEQ ID NO: 298165

SEQ ID NO: 467254 - RNA, 64 nt, Homo Sapiens; identical to SEQ ID NO: 298166

SEQ ID NO: 467255 - RNA, 64 nt, Homo Sapiens; identical to SEQ ID NO: 298167

SEQ ID NO: 467256 - RNA, 64 nt, Homo Sapiens; identical to SEQ ID NO: 298168

SEQ ID NO: 467257 - RNA, 64 nt, Homo Sapiens; identical to SEQ ID NO: 298169

SEQ ID NO: 467258 - RNA, 64 nt, Homo Sapiens; identical to SEQ ID NO: 298170

SEQ ID NO: 467259 - RNA, 64 nt, Homo Sapiens; identical to SEQ ID NO: 298171

SEQ ID NO: 467260 - RNA, 64 nt, Homo Sapiens; identical to SEQ ID NO: 298172

SEQ ID NO: 467261 - RNA, 64 nt, Homo Sapiens; identical to SEQ ID NO: 298173

SEQ ID NO: 467262 - RNA, 64 nt, Homo Sapiens; identical to SEQ ID NO: 298174

SEQ ID NO: 467263 - RNA, 64 nt, Homo Sapiens; identical to SEQ ID NO: 298175

SEQ ID NO: 467264 - RNA, 64 nt, Homo Sapiens; identical to SEQ ID NO: 298176

SEQ ID NO: 467265 - RNA, 64 nt, Homo Sapiens; identical to SEQ ID NO: 298177

SEQ ID NO: 467266 - RNA, 64 nt, Homo Sapiens; identical to SEQ ID NO: 298178

SEQ ID NO: 467267 - RNA, 64 nt, Homo Sapiens; identical to SEQ ID NO: 298179

SEQ ID NO: 467268 - RNA, 64 nt, Homo Sapiens; identical to SEQ ID NO: 298180

SEQ ID NO: 467269 - RNA, 64 nt, Homo Sapiens; identical to SEQ ID NO: 298181

SEQ ID NO: 467270 - RNA, 64 nt, Homo Sapiens; identical to SEQ ID NO: 298182

SEQ ID NO: 467271 - RNA, 64 nt, Homo Sapiens; identical to SEQ ID NO: 298183

SEQ ID NO: 467272 - RNA, 64 nt, Homo Sapiens; identical to SEQ ID NO: 298184

SEQ ID NO: 467273 - RNA, 64 nt, Homo Sapiens; identical to SEQ ID NO: 298185

SEQ ID NO: 467274 - RNA, 64 nt, Homo Sapiens; identical to SEQ ID NO: 298186

SEQ ID NO: 467275 - RNA, 64 nt, Homo Sapiens; identical to SEQ ID NO: 298187

SEQ ID NO: 467276 - RNA, 64 nt, Homo Sapiens; identical to SEQ ID NO: 298188

SEQ ID NO: 467277 - RNA, 64 nt, Homo Sapiens; identical to SEQ ID NO: 298189

SEQ ID NO: 467278 - RNA, 64 nt, Homo Sapiens; identical to SEQ ID NO: 298190

SEQ ID NO: 467279 - RNA, 64 nt, Homo Sapiens; identical to SEQ ID NO: 298191

SEQ ID NO: 467280 - RNA, 64 nt, Homo Sapiens; identical to SEQ ID NO: 298192

SEQ ID NO: 467281 - RNA, 64 nt, Homo Sapiens; identical to SEQ ID NO: 298193

SEQ ID NO: 467282 - RNA, 64 nt, Homo Sapiens; identical to SEQ ID NO: 298194

SEQ ID NO: 467283 - RNA, 64 nt, Homo Sapiens; identical to SEQ ID NO: 298195

SEQ ID NO: 467284 - RNA, 64 nt, Homo Sapiens; identical to SEQ ID NO: 298196

SEQ ID NO: 467285 - RNA, 64 nt, Homo Sapiens; identical to SEQ ID NO: 298197

SEQ ID NO: 467286 - RNA, 64 nt, Homo Sapiens; identical to SEQ ID NO: 298198

SEQ ID NO: 467287 - RNA, 64 nt, Homo Sapiens; identical to SEQ ID NO: 298199

SEQ ID NO: 467288 - RNA, 64 nt, Homo Sapiens; identical to SEQ ID NO: 298200

SEQ ID NO: 467289 - RNA, 64 nt, Homo Sapiens; identical to SEQ ID NO: 298201

SEQ ID NO: 467290 - RNA, 64 nt, Homo Sapiens; identical to SEQ ID NO: 298202

SEQ ID NO: 467291 - RNA, 64 nt, Homo Sapiens; identical to SEQ ID NO: 298203

SEQ ID NO: 467292 - RNA, 64 nt, Homo Sapiens; identical to SEQ ID NO: 298204

SEQ ID NO: 467293 - RNA, 64 nt, Homo Sapiens; identical to SEQ ID NO: 298205

SEQ ID NO: 467294 - RNA, 64 nt, Homo Sapiens; identical to SEQ ID NO: 298206

SEQ ID NO: 467295 - RNA, 64 nt, Homo Sapiens; identical to SEQ ID NO: 298207

SEQ ID NO: 467296 - RNA, 64 nt, Homo Sapiens; identical to SEQ ID NO: 298208

SEQ ID NO: 467297 - RNA, 64 nt, Homo Sapiens; identical to SEQ ID NO: 298209

SEQ ID NO: 467298 - RNA, 64 nt, Homo Sapiens; identical to SEQ ID NO: 298210

SEQ ID NO: 467299 - RNA, 64 nt, Homo Sapiens; identical to SEQ ID NO: 298211

SEQ ID NO: 467300 - RNA, 64 nt, Homo Sapiens; identical to SEQ ID NO: 298212

SEQ ID NO: 467301 - RNA, 64 nt, Homo Sapiens; identical to SEQ ID NO: 298213

SEQ ID NO: 467302 - RNA, 64 nt, Homo Sapiens; identical to SEQ ID NO: 298214

SEQ ID NO: 467303 - RNA, 64 nt, Homo Sapiens; identical to SEQ ID NO: 298215

SEQ ID NO: 467304 - RNA, 64 nt, Homo Sapiens; identical to SEQ ID NO: 298216

SEQ ID NO: 467305 - RNA, 64 nt, Homo Sapiens; identical to SEQ ID NO: 298217

SEQ ID NO: 467306 - RNA, 64 nt, Homo Sapiens; identical to SEQ ID NO: 298218

SEQ ID NO: 467307 - RNA, 64 nt, Homo Sapiens; identical to SEQ ID NO: 298219

SEQ ID NO: 467308 - RNA, 64 nt, Homo Sapiens; identical to SEQ ID NO: 298220

SEQ ID NO: 467309 - RNA, 64 nt, Homo Sapiens; identical to SEQ ID NO: 298221

SEQ ID NO: 467310 - RNA, 64 nt, Homo Sapiens; identical to SEQ ID NO: 298222

SEQ ID NO: 467311 - RNA, 64 nt, Homo Sapiens; identical to SEQ ID NO: 298223

SEQ ID NO: 467312 - RNA, 64 nt, Homo Sapiens; identical to SEQ ID NO: 298224

SEQ ID NO: 467313 - RNA, 64 nt, Homo Sapiens; identical to SEQ ID NO: 298225

SEQ ID NO: 467314 - RNA, 64 nt, Homo Sapiens; identical to SEQ ID NO: 298226

SEQ ID NO: 467315 - RNA, 64 nt, Homo Sapiens; identical to SEQ ID NO: 298227

SEQ ID NO: 467316 - RNA, 64 nt, Homo Sapiens; identical to SEQ ID NO: 298228

SEQ ID NO: 467317 - RNA, 64 nt, Homo Sapiens; identical to SEQ ID NO: 298229

SEQ ID NO: 467318 - RNA, 56 nt, Homo Sapiens; identical to SEQ ID NO: 298230

SEQ ID NO: 467319 - RNA, 64 nt, Homo Sapiens; identical to SEQ ID NO: 298231

SEQ ID NO: 467320 - RNA, 64 nt, Homo Sapiens; identical to SEQ ID NO: 298232

SEQ ID NO: 467321 - RNA, 64 nt, Homo Sapiens; identical to SEQ ID NO: 298233

SEQ ID NO: 467322 - RNA, 64 nt, Homo Sapiens; identical to SEQ ID NO: 298234

SEQ ID NO: 467323 - RNA, 64 nt, Homo Sapiens; identical to SEQ ID NO: 298235

SEQ ID NO: 467324 - RNA, 64 nt, Homo Sapiens; identical to SEQ ID NO: 298236

SEQ ID NO: 467325 - RNA, 64 nt, Homo Sapiens; identical to SEQ ID NO: 298237

SEQ ID NO: 467326 - RNA, 64 nt, Homo Sapiens; identical to SEQ ID NO: 298238

SEQ ID NO: 467327 - RNA, 63 nt, Homo Sapiens; identical to SEQ ID NO: 298239

SEQ ID NO: 467328 - RNA, 64 nt, Homo Sapiens; identical to SEQ ID NO: 298240

SEQ ID NO: 467329 - RNA, 64 nt, Homo Sapiens; identical to SEQ ID NO: 298241

SEQ ID NO: 467330 - RNA, 64 nt, Homo Sapiens; identical to SEQ ID NO: 298242

SEQ ID NO: 467331 - RNA, 64 nt, Homo Sapiens; identical to SEQ ID NO: 298243

SEQ ID NO: 467332 - RNA, 64 nt, Homo Sapiens; identical to SEQ ID NO: 298244

SEQ ID NO: 467333 - RNA, 64 nt, Homo Sapiens; identical to SEQ ID NO: 298245

SEQ ID NO: 467334 - RNA, 64 nt, Homo Sapiens; identical to SEQ ID NO: 298246

SEQ ID NO: 467335 - RNA, 64 nt, Homo Sapiens; identical to SEQ ID NO: 298247

SEQ ID NO: 467336 - RNA, 64 nt, Homo Sapiens; identical to SEQ ID NO: 298248

SEQ ID NO: 467337 - RNA, 64 nt, Homo Sapiens; identical to SEQ ID NO: 298249

SEQ ID NO: 467338 - RNA, 64 nt, Homo Sapiens; identical to SEQ ID NO: 182508

SEQ ID NO: 467339 - RNA, 64 nt, Homo Sapiens; identical to SEQ ID NO: 182509

SEQ ID NO: 467340 - RNA, 64 nt, Homo Sapiens; identical to SEQ ID NO: 182510

SEQ ID NO: 467341 - RNA, 64 nt, Homo Sapiens; identical to SEQ ID NO: 182511

SEQ ID NO: 467342 - RNA, 64 nt, Homo Sapiens; identical to SEQ ID NO: 182512

SEQ ID NO: 467343 - RNA, 64 nt, Homo Sapiens; identical to SEQ ID NO: 182513

SEQ ID NO: 467344 - RNA, 64 nt, Homo Sapiens; identical to SEQ ID NO: 182514

SEQ ID NO: 467345 - RNA, 64 nt, Homo Sapiens; identical to SEQ ID NO: 182515

SEQ ID NO: 467346 - RNA, 64 nt, Homo Sapiens; identical to SEQ ID NO: 182516

SEQ ID NO: 467347 - RNA, 64 nt, Homo Sapiens; identical to SEQ ID NO: 182517

SEQ ID NO: 467348 - RNA, 64 nt, Homo Sapiens; identical to SEQ ID NO: 182518

SEQ ID NO: 467349 - RNA, 64 nt, Homo Sapiens; identical to SEQ ID NO: 182519

SEQ ID NO: 467350 - RNA, 64 nt, Homo Sapiens; identical to SEQ ID NO: 182520

SEQ ID NO: 467351 - RNA, 64 nt, Homo Sapiens; identical to SEQ ID NO: 182521

SEQ ID NO: 467352 - RNA, 64 nt, Homo Sapiens; identical to SEQ ID NO: 182522

SEQ ID NO: 467353 - RNA, 64 nt, Homo Sapiens; identical to SEQ ID NO: 182523

SEQ ID NO: 467354 - RNA, 64 nt, Homo Sapiens; identical to SEQ ID NO: 182524

SEQ ID NO: 467355 - RNA, 64 nt, Homo Sapiens; identical to SEQ ID NO: 182525

SEQ ID NO: 467356 - RNA, 64 nt, Homo Sapiens; identical to SEQ ID NO: 182526

SEQ ID NO: 467357 - RNA, 64 nt, Homo Sapiens; identical to SEQ ID NO: 182527

SEQ ID NO: 467358 - RNA, 64 nt, Homo Sapiens; identical to SEQ ID NO: 182528

SEQ ID NO: 467359 - RNA, 64 nt, Homo Sapiens; identical to SEQ ID NO: 182529

SEQ ID NO: 467360 - RNA, 64 nt, Homo Sapiens; identical to SEQ ID NO: 182530

SEQ ID NO: 467361 - RNA, 64 nt, Homo Sapiens; identical to SEQ ID NO: 182531

SEQ ID NO: 467362 - RNA, 64 nt, Homo Sapiens; identical to SEQ ID NO: 182532

SEQ ID NO: 467363 - RNA, 64 nt, Homo Sapiens; identical to SEQ ID NO: 182533

SEQ ID NO: 467364 - RNA, 64 nt, Homo Sapiens; identical to SEQ ID NO: 182534

SEQ ID NO: 467365 - RNA, 64 nt, Homo Sapiens; identical to SEQ ID NO: 182535

SEQ ID NO: 467366 - RNA, 64 nt, Homo Sapiens; identical to SEQ ID NO: 298158

SEQ ID NO: 467367 - RNA, 64 nt, Homo Sapiens; identical to SEQ ID NO: 298159

SEQ ID NO: 467368 - RNA, 64 nt, Homo Sapiens; identical to SEQ ID NO: 298160

SEQ ID NO: 467369 - RNA, 64 nt, Homo Sapiens; identical to SEQ ID NO: 298161

SEQ ID NO: 467370 - RNA, 64 nt, Homo Sapiens; identical to SEQ ID NO: 298162

SEQ ID NO: 467371 - RNA, 64 nt, Homo Sapiens; identical to SEQ ID NO: 298163

SEQ ID NO: 467372 - RNA, 64 nt, Homo Sapiens; identical to SEQ ID NO: 298164

SEQ ID NO: 467373 - RNA, 64 nt, Homo Sapiens; identical to SEQ ID NO: 298165

SEQ ID NO: 467374 - RNA, 64 nt, Homo Sapiens; identical to SEQ ID NO: 298166

SEQ ID NO: 467375 - RNA, 64 nt, Homo Sapiens; identical to SEQ ID NO: 298167

SEQ ID NO: 467376 - RNA, 64 nt, Homo Sapiens; identical to SEQ ID NO: 298168

SEQ ID NO: 467377 - RNA, 64 nt, Homo Sapiens; identical to SEQ ID NO: 298169

SEQ ID NO: 467378 - RNA, 64 nt, Homo Sapiens; identical to SEQ ID NO: 298170

SEQ ID NO: 467379 - RNA, 64 nt, Homo Sapiens; identical to SEQ ID NO: 298171

SEQ ID NO: 467380 - RNA, 64 nt, Homo Sapiens; identical to SEQ ID NO: 298172

SEQ ID NO: 467381 - RNA, 64 nt, Homo Sapiens; identical to SEQ ID NO: 298173

SEQ ID NO: 467382 - RNA, 64 nt, Homo Sapiens; identical to SEQ ID NO: 298174

SEQ ID NO: 467383 - RNA, 64 nt, Homo Sapiens; identical to SEQ ID NO: 298175

SEQ ID NO: 467384 - RNA, 64 nt, Homo Sapiens; identical to SEQ ID NO: 298176

SEQ ID NO: 467385 - RNA, 64 nt, Homo Sapiens; identical to SEQ ID NO: 298177

SEQ ID NO: 467386 - RNA, 64 nt, Homo Sapiens; identical to SEQ ID NO: 298178

SEQ ID NO: 467387 - RNA, 64 nt, Homo Sapiens; identical to SEQ ID NO: 298179

SEQ ID NO: 467388 - RNA, 64 nt, Homo Sapiens; identical to SEQ ID NO: 298180

SEQ ID NO: 467389 - RNA, 64 nt, Homo Sapiens; identical to SEQ ID NO: 298181

SEQ ID NO: 467390 - RNA, 64 nt, Homo Sapiens; identical to SEQ ID NO: 298182

SEQ ID NO: 467391 - RNA, 64 nt, Homo Sapiens; identical to SEQ ID NO: 298183

SEQ ID NO: 467392 - RNA, 64 nt, Homo Sapiens; identical to SEQ ID NO: 298184

SEQ ID NO: 467393 - RNA, 64 nt, Homo Sapiens; identical to SEQ ID NO: 298185

SEQ ID NO: 467394 - RNA, 64 nt, Homo Sapiens; identical to SEQ ID NO: 298186

SEQ ID NO: 467395 - RNA, 64 nt, Homo Sapiens; identical to SEQ ID NO: 298187

SEQ ID NO: 467396 - RNA, 64 nt, Homo Sapiens; identical to SEQ ID NO: 298188

SEQ ID NO: 467397 - RNA, 64 nt, Homo Sapiens; identical to SEQ ID NO: 298189

SEQ ID NO: 467398 - RNA, 64 nt, Homo Sapiens; identical to SEQ ID NO: 298190

SEQ ID NO: 467399 - RNA, 64 nt, Homo Sapiens; identical to SEQ ID NO: 298191

SEQ ID NO: 467400 - RNA, 64 nt, Homo Sapiens; identical to SEQ ID NO: 298192

SEQ ID NO: 467401 - RNA, 64 nt, Homo Sapiens; identical to SEQ ID NO: 298193

SEQ ID NO: 467402 - RNA, 64 nt, Homo Sapiens; identical to SEQ ID NO: 298194

SEQ ID NO: 467403 - RNA, 64 nt, Homo Sapiens; identical to SEQ ID NO: 298195

SEQ ID NO: 467404 - RNA, 64 nt, Homo Sapiens; identical to SEQ ID NO: 298196

SEQ ID NO: 467405 - RNA, 64 nt, Homo Sapiens; identical to SEQ ID NO: 298197

SEQ ID NO: 467406 - RNA, 64 nt, Homo Sapiens; identical to SEQ ID NO: 298198

SEQ ID NO: 467407 - RNA, 64 nt, Homo Sapiens; identical to SEQ ID NO: 298199

SEQ ID NO: 467408 - RNA, 64 nt, Homo Sapiens; identical to SEQ ID NO: 298200

SEQ ID NO: 467409 - RNA, 64 nt, Homo Sapiens; identical to SEQ ID NO: 298201

SEQ ID NO: 467410 - RNA, 64 nt, Homo Sapiens; identical to SEQ ID NO: 298202

SEQ ID NO: 467411 - RNA, 64 nt, Homo Sapiens; identical to SEQ ID NO: 298203

SEQ ID NO: 467412 - RNA, 64 nt, Homo Sapiens; identical to SEQ ID NO: 298204

SEQ ID NO: 467413 - RNA, 64 nt, Homo Sapiens; identical to SEQ ID NO: 298205

SEQ ID NO: 467414 - RNA, 64 nt, Homo Sapiens; identical to SEQ ID NO: 298206

SEQ ID NO: 467415 - RNA, 64 nt, Homo Sapiens; identical to SEQ ID NO: 298207

SEQ ID NO: 467416 - RNA, 64 nt, Homo Sapiens; identical to SEQ ID NO: 298208

SEQ ID NO: 467417 - RNA, 64 nt, Homo Sapiens; identical to SEQ ID NO: 298209

SEQ ID NO: 467418 - RNA, 64 nt, Homo Sapiens; identical to SEQ ID NO: 298210

SEQ ID NO: 467419 - RNA, 64 nt, Homo Sapiens; identical to SEQ ID NO: 298211

SEQ ID NO: 467420 - RNA, 64 nt, Homo Sapiens; identical to SEQ ID NO: 298212

SEQ ID NO: 467421 - RNA, 64 nt, Homo Sapiens; identical to SEQ ID NO: 298213

SEQ ID NO: 467422 - RNA, 64 nt, Homo Sapiens; identical to SEQ ID NO: 298214

SEQ ID NO: 467423 - RNA, 64 nt, Homo Sapiens; identical to SEQ ID NO: 298215

SEQ ID NO: 467424 - RNA, 64 nt, Homo Sapiens; identical to SEQ ID NO: 298216

SEQ ID NO: 467425 - RNA, 64 nt, Homo Sapiens; identical to SEQ ID NO: 298217

SEQ ID NO: 467426 - RNA, 64 nt, Homo Sapiens; identical to SEQ ID NO: 298218

SEQ ID NO: 467427 - RNA, 64 nt, Homo Sapiens; identical to SEQ ID NO: 298219

SEQ ID NO: 467428 - RNA, 64 nt, Homo Sapiens; identical to SEQ ID NO: 298220

SEQ ID NO: 467429 - RNA, 64 nt, Homo Sapiens; identical to SEQ ID NO: 298221

SEQ ID NO: 467430 - RNA, 64 nt, Homo Sapiens; identical to SEQ ID NO: 298222

SEQ ID NO: 467431 - RNA, 64 nt, Homo Sapiens; identical to SEQ ID NO: 298223

SEQ ID NO: 467432 - RNA, 64 nt, Homo Sapiens; identical to SEQ ID NO: 298224

SEQ ID NO: 467433 - RNA, 64 nt, Homo Sapiens; identical to SEQ ID NO: 298225

SEQ ID NO: 467434 - RNA, 64 nt, Homo Sapiens; identical to SEQ ID NO: 298226

SEQ ID NO: 467435 - RNA, 64 nt, Homo Sapiens; identical to SEQ ID NO: 298227

SEQ ID NO: 467436 - RNA, 64 nt, Homo Sapiens; identical to SEQ ID NO: 298228

SEQ ID NO: 467437 - RNA, 64 nt, Homo Sapiens; identical to SEQ ID NO: 298229

SEQ ID NO: 467438 - RNA, 56 nt, Homo Sapiens; identical to SEQ ID NO: 298230

SEQ ID NO: 467439 - RNA, 64 nt, Homo Sapiens; identical to SEQ ID NO: 298231

SEQ ID NO: 467440 - RNA, 64 nt, Homo Sapiens; identical to SEQ ID NO: 298232

SEQ ID NO: 467441 - RNA, 64 nt, Homo Sapiens; identical to SEQ ID NO: 298233

SEQ ID NO: 467442 - RNA, 64 nt, Homo Sapiens; identical to SEQ ID NO: 298234

SEQ ID NO: 467443 - RNA, 64 nt, Homo Sapiens; identical to SEQ ID NO: 298235

SEQ ID NO: 467444 - RNA, 64 nt, Homo Sapiens; identical to SEQ ID NO: 298236

SEQ ID NO: 467445 - RNA, 64 nt, Homo Sapiens; identical to SEQ ID NO: 298237

SEQ ID NO: 467446 - RNA, 64 nt, Homo Sapiens; identical to SEQ ID NO: 298238

SEQ ID NO: 467447 - RNA, 63 nt, Homo Sapiens; identical to SEQ ID NO: 298239

SEQ ID NO: 467448 - RNA, 64 nt, Homo Sapiens; identical to SEQ ID NO: 298240

SEQ ID NO: 467449 - RNA, 64 nt, Homo Sapiens; identical to SEQ ID NO: 298241

SEQ ID NO: 467450 - RNA, 64 nt, Homo Sapiens; identical to SEQ ID NO: 298242

SEQ ID NO: 467451 - RNA, 64 nt, Homo Sapiens; identical to SEQ ID NO: 298243

SEQ ID NO: 467452 - RNA, 64 nt, Homo Sapiens; identical to SEQ ID NO: 298244

SEQ ID NO: 467453 - RNA, 64 nt, Homo Sapiens; identical to SEQ ID NO: 298245

SEQ ID NO: 467454 - RNA, 64 nt, Homo Sapiens; identical to SEQ ID NO: 298246

SEQ ID NO: 467455 - RNA, 64 nt, Homo Sapiens; identical to SEQ ID NO: 298247

SEQ ID NO: 467456 - RNA, 64 nt, Homo Sapiens; identical to SEQ ID NO: 298248

SEQ ID NO: 467457 - RNA, 64 nt, Homo Sapiens; identical to SEQ ID NO: 298249

SEQ ID NO: 467458 - RNA, 64 nt, Homo Sapiens; identical to SEQ ID NO: 182508

SEQ ID NO: 467459 - RNA, 64 nt, Homo Sapiens; identical to SEQ ID NO: 182509

SEQ ID NO: 467460 - RNA, 64 nt, Homo Sapiens; identical to SEQ ID NO: 182510

SEQ ID NO: 467461 - RNA, 64 nt, Homo Sapiens; identical to SEQ ID NO: 182511

SEQ ID NO: 467462 - RNA, 64 nt, Homo Sapiens; identical to SEQ ID NO: 182512

SEQ ID NO: 467463 - RNA, 64 nt, Homo Sapiens; identical to SEQ ID NO: 182513

SEQ ID NO: 467464 - RNA, 64 nt, Homo Sapiens; identical to SEQ ID NO: 182514

SEQ ID NO: 467465 - RNA, 64 nt, Homo Sapiens; identical to SEQ ID NO: 182515

SEQ ID NO: 467466 - RNA, 64 nt, Homo Sapiens; identical to SEQ ID NO: 182516

SEQ ID NO: 467467 - RNA, 64 nt, Homo Sapiens; identical to SEQ ID NO: 182517

SEQ ID NO: 467468 - RNA, 64 nt, Homo Sapiens; identical to SEQ ID NO: 182518

SEQ ID NO: 467469 - RNA, 64 nt, Homo Sapiens; identical to SEQ ID NO: 182519

SEQ ID NO: 467470 - RNA, 64 nt, Homo Sapiens; identical to SEQ ID NO: 182520

SEQ ID NO: 467471 - RNA, 64 nt, Homo Sapiens; identical to SEQ ID NO: 182521

SEQ ID NO: 467472 - RNA, 64 nt, Homo Sapiens; identical to SEQ ID NO: 182522

SEQ ID NO: 467473 - RNA, 64 nt, Homo Sapiens; identical to SEQ ID NO: 182523

SEQ ID NO: 467474 - RNA, 64 nt, Homo Sapiens; identical to SEQ ID NO: 182524

SEQ ID NO: 467475 - RNA, 64 nt, Homo Sapiens; identical to SEQ ID NO: 182525

SEQ ID NO: 467476 - RNA, 64 nt, Homo Sapiens; identical to SEQ ID NO: 182526

SEQ ID NO: 467477 - RNA, 64 nt, Homo Sapiens; identical to SEQ ID NO: 182527

SEQ ID NO: 467478 - RNA, 64 nt, Homo Sapiens; identical to SEQ ID NO: 182528

SEQ ID NO: 467479 - RNA, 64 nt, Homo Sapiens; identical to SEQ ID NO: 182529

SEQ ID NO: 467480 - RNA, 64 nt, Homo Sapiens; identical to SEQ ID NO: 182530

SEQ ID NO: 467481 - RNA, 64 nt, Homo Sapiens; identical to SEQ ID NO: 182531

SEQ ID NO: 467482 - RNA, 64 nt, Homo Sapiens; identical to SEQ ID NO: 182532

SEQ ID NO: 467483 - RNA, 64 nt, Homo Sapiens; identical to SEQ ID NO: 182533

SEQ ID NO: 467484 - RNA, 64 nt, Homo Sapiens; identical to SEQ ID NO: 182534

SEQ ID NO: 467485 - RNA, 64 nt, Homo Sapiens; identical to SEQ ID NO: 182535

SEQ ID NO: 467486 - RNA, 64 nt, Homo Sapiens; identical to SEQ ID NO: 298158

SEQ ID NO: 467487 - RNA, 64 nt, Homo Sapiens; identical to SEQ ID NO: 298159

SEQ ID NO: 467488 - RNA, 64 nt, Homo Sapiens; identical to SEQ ID NO: 298160

SEQ ID NO: 467489 - RNA, 64 nt, Homo Sapiens; identical to SEQ ID NO: 298161

SEQ ID NO: 467490 - RNA, 64 nt, Homo Sapiens; identical to SEQ ID NO: 298162

SEQ ID NO: 467491 - RNA, 64 nt, Homo Sapiens; identical to SEQ ID NO: 298163

SEQ ID NO: 467492 - RNA, 64 nt, Homo Sapiens; identical to SEQ ID NO: 298164

SEQ ID NO: 467493 - RNA, 64 nt, Homo Sapiens; identical to SEQ ID NO: 298165

SEQ ID NO: 467494 - RNA, 64 nt, Homo Sapiens; identical to SEQ ID NO: 298166

SEQ ID NO: 467495 - RNA, 64 nt, Homo Sapiens; identical to SEQ ID NO: 298167

SEQ ID NO: 467496 - RNA, 64 nt, Homo Sapiens; identical to SEQ ID NO: 298168

SEQ ID NO: 467497 - RNA, 64 nt, Homo Sapiens; identical to SEQ ID NO: 298169

SEQ ID NO: 467498 - RNA, 64 nt, Homo Sapiens; identical to SEQ ID NO: 298170

SEQ ID NO: 467499 - RNA, 64 nt, Homo Sapiens; identical to SEQ ID NO: 298171

SEQ ID NO: 467500 - RNA, 64 nt, Homo Sapiens; identical to SEQ ID NO: 298172

SEQ ID NO: 467501 - RNA, 64 nt, Homo Sapiens; identical to SEQ ID NO: 298173

SEQ ID NO: 467502 - RNA, 64 nt, Homo Sapiens; identical to SEQ ID NO: 298174

SEQ ID NO: 467503 - RNA, 64 nt, Homo Sapiens; identical to SEQ ID NO: 298175

SEQ ID NO: 467504 - RNA, 64 nt, Homo Sapiens; identical to SEQ ID NO: 298176

SEQ ID NO: 467505 - RNA, 64 nt, Homo Sapiens; identical to SEQ ID NO: 298177

SEQ ID NO: 467506 - RNA, 64 nt, Homo Sapiens; identical to SEQ ID NO: 298178

SEQ ID NO: 467507 - RNA, 64 nt, Homo Sapiens; identical to SEQ ID NO: 298179

SEQ ID NO: 467508 - RNA, 64 nt, Homo Sapiens; identical to SEQ ID NO: 298180

SEQ ID NO: 467509 - RNA, 64 nt, Homo Sapiens; identical to SEQ ID NO: 298181

SEQ ID NO: 467510 - RNA, 64 nt, Homo Sapiens; identical to SEQ ID NO: 298182

SEQ ID NO: 467511 - RNA, 64 nt, Homo Sapiens; identical to SEQ ID NO: 298183

SEQ ID NO: 467512 - RNA, 64 nt, Homo Sapiens; identical to SEQ ID NO: 298184

SEQ ID NO: 467513 - RNA, 64 nt, Homo Sapiens; identical to SEQ ID NO: 298185

SEQ ID NO: 467514 - RNA, 64 nt, Homo Sapiens; identical to SEQ ID NO: 298186

SEQ ID NO: 467515 - RNA, 64 nt, Homo Sapiens; identical to SEQ ID NO: 298187

SEQ ID NO: 467516 - RNA, 64 nt, Homo Sapiens; identical to SEQ ID NO: 298188

SEQ ID NO: 467517 - RNA, 64 nt, Homo Sapiens; identical to SEQ ID NO: 298189

SEQ ID NO: 467518 - RNA, 64 nt, Homo Sapiens; identical to SEQ ID NO: 298190

SEQ ID NO: 467519 - RNA, 64 nt, Homo Sapiens; identical to SEQ ID NO: 298191

SEQ ID NO: 467520 - RNA, 64 nt, Homo Sapiens; identical to SEQ ID NO: 298192

SEQ ID NO: 467521 - RNA, 64 nt, Homo Sapiens; identical to SEQ ID NO: 298193

SEQ ID NO: 467522 - RNA, 64 nt, Homo Sapiens; identical to SEQ ID NO: 298194

SEQ ID NO: 467523 - RNA, 64 nt, Homo Sapiens; identical to SEQ ID NO: 298195

SEQ ID NO: 467524 - RNA, 64 nt, Homo Sapiens; identical to SEQ ID NO: 298196

SEQ ID NO: 467525 - RNA, 64 nt, Homo Sapiens; identical to SEQ ID NO: 298197

SEQ ID NO: 467526 - RNA, 64 nt, Homo Sapiens; identical to SEQ ID NO: 298198

SEQ ID NO: 467527 - RNA, 64 nt, Homo Sapiens; identical to SEQ ID NO: 298199

SEQ ID NO: 467528 - RNA, 64 nt, Homo Sapiens; identical to SEQ ID NO: 298200

SEQ ID NO: 467529 - RNA, 64 nt, Homo Sapiens; identical to SEQ ID NO: 298201

SEQ ID NO: 467530 - RNA, 64 nt, Homo Sapiens; identical to SEQ ID NO: 298202

SEQ ID NO: 467531 - RNA, 64 nt, Homo Sapiens; identical to SEQ ID NO: 298203

SEQ ID NO: 467532 - RNA, 64 nt, Homo Sapiens; identical to SEQ ID NO: 298204

SEQ ID NO: 467533 - RNA, 64 nt, Homo Sapiens; identical to SEQ ID NO: 298205

SEQ ID NO: 467534 - RNA, 64 nt, Homo Sapiens; identical to SEQ ID NO: 298206

SEQ ID NO: 467535 - RNA, 64 nt, Homo Sapiens; identical to SEQ ID NO: 298207

SEQ ID NO: 467536 - RNA, 64 nt, Homo Sapiens; identical to SEQ ID NO: 298208

SEQ ID NO: 467537 - RNA, 64 nt, Homo Sapiens; identical to SEQ ID NO: 298209

SEQ ID NO: 467538 - RNA, 64 nt, Homo Sapiens; identical to SEQ ID NO: 298210

SEQ ID NO: 467539 - RNA, 64 nt, Homo Sapiens; identical to SEQ ID NO: 298211

SEQ ID NO: 467540 - RNA, 64 nt, Homo Sapiens; identical to SEQ ID NO: 298212

SEQ ID NO: 467541 - RNA, 64 nt, Homo Sapiens; identical to SEQ ID NO: 298213

SEQ ID NO: 467542 - RNA, 64 nt, Homo Sapiens; identical to SEQ ID NO: 298214

SEQ ID NO: 467543 - RNA, 64 nt, Homo Sapiens; identical to SEQ ID NO: 298215

SEQ ID NO: 467544 - RNA, 64 nt, Homo Sapiens; identical to SEQ ID NO: 298216

SEQ ID NO: 467545 - RNA, 64 nt, Homo Sapiens; identical to SEQ ID NO: 298217

SEQ ID NO: 467546 - RNA, 64 nt, Homo Sapiens; identical to SEQ ID NO: 298218

SEQ ID NO: 467547 - RNA, 64 nt, Homo Sapiens; identical to SEQ ID NO: 298219

SEQ ID NO: 467548 - RNA, 64 nt, Homo Sapiens; identical to SEQ ID NO: 298220

SEQ ID NO: 467549 - RNA, 64 nt, Homo Sapiens; identical to SEQ ID NO: 298221

SEQ ID NO: 467550 - RNA, 64 nt, Homo Sapiens; identical to SEQ ID NO: 298222

SEQ ID NO: 467551 - RNA, 64 nt, Homo Sapiens; identical to SEQ ID NO: 298223

SEQ ID NO: 467552 - RNA, 64 nt, Homo Sapiens; identical to SEQ ID NO: 298224

SEQ ID NO: 467553 - RNA, 64 nt, Homo Sapiens; identical to SEQ ID NO: 298225

SEQ ID NO: 467554 - RNA, 64 nt, Homo Sapiens; identical to SEQ ID NO: 298226

SEQ ID NO: 467555 - RNA, 64 nt, Homo Sapiens; identical to SEQ ID NO: 298227

SEQ ID NO: 467556 - RNA, 64 nt, Homo Sapiens; identical to SEQ ID NO: 298228

SEQ ID NO: 467557 - RNA, 64 nt, Homo Sapiens; identical to SEQ ID NO: 298229

SEQ ID NO: 467558 - RNA, 56 nt, Homo Sapiens; identical to SEQ ID NO: 298230

SEQ ID NO: 467559 - RNA, 64 nt, Homo Sapiens; identical to SEQ ID NO: 298231

SEQ ID NO: 467560 - RNA, 64 nt, Homo Sapiens; identical to SEQ ID NO: 298232

SEQ ID NO: 467561 - RNA, 64 nt, Homo Sapiens; identical to SEQ ID NO: 298233

SEQ ID NO: 467562 - RNA, 64 nt, Homo Sapiens; identical to SEQ ID NO: 298234

SEQ ID NO: 467563 - RNA, 64 nt, Homo Sapiens; identical to SEQ ID NO: 298235

SEQ ID NO: 467564 - RNA, 64 nt, Homo Sapiens; identical to SEQ ID NO: 298236

SEQ ID NO: 467565 - RNA, 64 nt, Homo Sapiens; identical to SEQ ID NO: 298237

SEQ ID NO: 467566 - RNA, 64 nt, Homo Sapiens; identical to SEQ ID NO: 298238

SEQ ID NO: 467567 - RNA, 63 nt, Homo Sapiens; identical to SEQ ID NO: 298239

SEQ ID NO: 467568 - RNA, 64 nt, Homo Sapiens; identical to SEQ ID NO: 298240

SEQ ID NO: 467569 - RNA, 64 nt, Homo Sapiens; identical to SEQ ID NO: 298241

SEQ ID NO: 467570 - RNA, 64 nt, Homo Sapiens; identical to SEQ ID NO: 298242

SEQ ID NO: 467571 - RNA, 64 nt, Homo Sapiens; identical to SEQ ID NO: 298243

SEQ ID NO: 467572 - RNA, 64 nt, Homo Sapiens; identical to SEQ ID NO: 298244

SEQ ID NO: 467573 - RNA, 64 nt, Homo Sapiens; identical to SEQ ID NO: 298245

SEQ ID NO: 467574 - RNA, 64 nt, Homo Sapiens; identical to SEQ ID NO: 298246

SEQ ID NO: 467575 - RNA, 64 nt, Homo Sapiens; identical to SEQ ID NO: 298247

SEQ ID NO: 467576 - RNA, 64 nt, Homo Sapiens; identical to SEQ ID NO: 298248

SEQ ID NO: 467577 - RNA, 64 nt, Homo Sapiens; identical to SEQ ID NO: 298249

SEQ ID NO: 467578 - RNA, 64 nt, Homo Sapiens; identical to SEQ ID NO: 133489

SEQ ID NO: 467579 - RNA, 64 nt, Homo Sapiens; identical to SEQ ID NO: 133490

SEQ ID NO: 467580 - RNA, 64 nt, Homo Sapiens; identical to SEQ ID NO: 133491

SEQ ID NO: 467581 - RNA, 64 nt, Homo Sapiens; identical to SEQ ID NO: 133492

SEQ ID NO: 467582 - RNA, 64 nt, Homo Sapiens; identical to SEQ ID NO: 133493

SEQ ID NO: 467583 - RNA, 64 nt, Homo Sapiens; identical to SEQ ID NO: 133494

SEQ ID NO: 467584 - RNA, 64 nt, Homo Sapiens; identical to SEQ ID NO: 133495

SEQ ID NO: 467585 - RNA, 64 nt, Homo Sapiens; identical to SEQ ID NO: 133496

SEQ ID NO: 467586 - RNA, 64 nt, Homo Sapiens; identical to SEQ ID NO: 133497

SEQ ID NO: 467587 - RNA, 64 nt, Homo Sapiens; identical to SEQ ID NO: 133498

SEQ ID NO: 467588 - RNA, 64 nt, Homo Sapiens; identical to SEQ ID NO: 133499

SEQ ID NO: 467589 - RNA, 64 nt, Homo Sapiens; identical to SEQ ID NO: 133500

SEQ ID NO: 467590 - RNA, 64 nt, Homo Sapiens; identical to SEQ ID NO: 133501

SEQ ID NO: 467591 - RNA, 64 nt, Homo Sapiens; identical to SEQ ID NO: 133502

SEQ ID NO: 467592 - RNA, 64 nt, Homo Sapiens; identical to SEQ ID NO: 133503

SEQ ID NO: 467593 - RNA, 64 nt, Homo Sapiens; identical to SEQ ID NO: 133504

SEQ ID NO: 467594 - RNA, 64 nt, Homo Sapiens; identical to SEQ ID NO: 133505

SEQ ID NO: 467595 - RNA, 64 nt, Homo Sapiens; identical to SEQ ID NO: 133506

SEQ ID NO: 467596 - RNA, 64 nt, Homo Sapiens; identical to SEQ ID NO: 133507

SEQ ID NO: 467597 - RNA, 64 nt, Homo Sapiens; identical to SEQ ID NO: 133508

SEQ ID NO: 467598 - RNA, 64 nt, Homo Sapiens; identical to SEQ ID NO: 133509

SEQ ID NO: 467599 - RNA, 64 nt, Homo Sapiens; identical to SEQ ID NO: 133510

SEQ ID NO: 467600 - RNA, 64 nt, Homo Sapiens; identical to SEQ ID NO: 439495

SEQ ID NO: 467601 - RNA, 64 nt, Homo Sapiens; identical to SEQ ID NO: 439496

SEQ ID NO: 467602 - RNA, 64 nt, Homo Sapiens; identical to SEQ ID NO: 439497

SEQ ID NO: 467603 - RNA, 64 nt, Homo Sapiens; identical to SEQ ID NO: 439498

SEQ ID NO: 467604 - RNA, 64 nt, Homo Sapiens; identical to SEQ ID NO: 439499

SEQ ID NO: 467605 - RNA, 64 nt, Homo Sapiens; identical to SEQ ID NO: 439500

SEQ ID NO: 467606 - RNA, 64 nt, Homo Sapiens; identical to SEQ ID NO: 439501

SEQ ID NO: 467607 - RNA, 64 nt, Homo Sapiens; identical to SEQ ID NO: 439502

SEQ ID NO: 467608 - RNA, 64 nt, Homo Sapiens; identical to SEQ ID NO: 439503

SEQ ID NO: 467609 - RNA, 64 nt, Homo Sapiens; identical to SEQ ID NO: 439504

SEQ ID NO: 467610 - RNA, 64 nt, Homo Sapiens; identical to SEQ ID NO: 439505

SEQ ID NO: 467611 - RNA, 64 nt, Homo Sapiens; identical to SEQ ID NO: 439506

SEQ ID NO: 467612 - RNA, 64 nt, Homo Sapiens; identical to SEQ ID NO: 439507

SEQ ID NO: 467613 - RNA, 64 nt, Homo Sapiens; identical to SEQ ID NO: 439508

SEQ ID NO: 467614 - RNA, 64 nt, Homo Sapiens; identical to SEQ ID NO: 439509

SEQ ID NO: 467615 - RNA, 64 nt, Homo Sapiens; identical to SEQ ID NO: 439510

SEQ ID NO: 467616 - RNA, 64 nt, Homo Sapiens; identical to SEQ ID NO: 439511

SEQ ID NO: 467617 - RNA, 64 nt, Homo Sapiens; identical to SEQ ID NO: 439512

SEQ ID NO: 467618 - RNA, 64 nt, Homo Sapiens; identical to SEQ ID NO: 439513

SEQ ID NO: 467619 - RNA, 64 nt, Homo Sapiens; identical to SEQ ID NO: 439514

SEQ ID NO: 467620 - RNA, 64 nt, Homo Sapiens; identical to SEQ ID NO: 439515

SEQ ID NO: 467621 - RNA, 64 nt, Homo Sapiens; identical to SEQ ID NO: 439516

SEQ ID NO: 467622 - RNA, 64 nt, Homo Sapiens; identical to SEQ ID NO: 439517

SEQ ID NO: 467623 - RNA, 64 nt, Homo Sapiens; identical to SEQ ID NO: 439518

SEQ ID NO: 467624 - RNA, 64 nt, Homo Sapiens; identical to SEQ ID NO: 439519

SEQ ID NO: 467625 - RNA, 64 nt, Homo Sapiens; identical to SEQ ID NO: 439520

SEQ ID NO: 467626 - RNA, 64 nt, Homo Sapiens; identical to SEQ ID NO: 439521

SEQ ID NO: 467627 - RNA, 64 nt, Homo Sapiens; identical to SEQ ID NO: 439522

SEQ ID NO: 467628 - RNA, 64 nt, Homo Sapiens; identical to SEQ ID NO: 439523

SEQ ID NO: 467629 - RNA, 56 nt, Homo Sapiens; identical to SEQ ID NO: 439524

SEQ ID NO: 467630 - RNA, 64 nt, Homo Sapiens; identical to SEQ ID NO: 439525

SEQ ID NO: 467631 - RNA, 64 nt, Homo Sapiens; identical to SEQ ID NO: 439526

SEQ ID NO: 467632 - RNA, 64 nt, Homo Sapiens; identical to SEQ ID NO: 439527

SEQ ID NO: 467633 - RNA, 64 nt, Homo Sapiens; identical to SEQ ID NO: 439528

SEQ ID NO: 467634 - RNA, 64 nt, Homo Sapiens; identical to SEQ ID NO: 439529

SEQ ID NO: 467635 - RNA, 64 nt, Homo Sapiens; identical to SEQ ID NO: 439530

SEQ ID NO: 467636 - RNA, 64 nt, Homo Sapiens; identical to SEQ ID NO: 439531

SEQ ID NO: 467637 - RNA, 64 nt, Homo Sapiens
uguauguuaccuuuuccaccucucauuguuuuccccagaacauuguagauggggguuggcagag

SEQ ID NO: 467638 - RNA, 64 nt, Homo Sapiens
cuggcgaugugggcauccugggguucuuagggucccagaacaagccccaggcaagcuggaacuu

SEQ ID NO: 467639 - RNA, 64 nt, Homo Sapiens
ucagggucaacucccaggccucagaugcaggggcccagaacaccugcucucaccugagccccag

SEQ ID NO: 467640 - RNA, 64 nt, Homo Sapiens
caccugcucucaccugaaccccaggugaaggggcccagaacaccugcucucaccugagccccag

SEQ ID NO: 467641 - RNA, 64 nt, Homo Sapiens
aauauccuaaaauacagaacacagcuugaccucuccagaacacucaaugagggcgaaugacauu

SEQ ID NO: 467642 - RNA, 64 nt, Homo Sapiens
uacugaaaagcugaaauuuaaacuagaacacaucccagaacaauagcuagcaucuaauuugcac

SEQ ID NO: 467643 - RNA, 64 nt, Homo Sapiens
uggaaguguggaaaggagguccaaaaccuggcacccagaacaguuccugguucucagucccacc

SEQ ID NO: 467644 - RNA, 64 nt, Homo Sapiens
ggaucggcuuccuuacccaggguuccuuugaaagccagaacaauuugccuguuuucggaucugu

SEQ ID NO: 467645 - RNA, 64 nt, Homo Sapiens
uaguguagaugaaaaugugguucacccacucccuccagaacauuuagcuucccuucccuccccc

SEQ ID NO: 467646 - RNA, 64 nt, Homo Sapiens
cugccccucaaggaaggguggaagucguggccuuccagaacaguacagacucccacugucucca

SEQ ID NO: 467647 - RNA, 64 nt, Homo Sapiens
aucaucagcaggagaugagacuaugaauuggcauccagaacaggagauuuagagcaaaaucuaa

SEQ ID NO: 467648 - RNA, 64 nt, Homo Sapiens
uggcuggagagcugaucagccaggcacagaaucuccagaacaaccuagagagugaaugcuaauu

SEQ ID NO: 467649 - RNA, 64 nt, Homo Sapiens
agcuggagggucagccaccaagcugggagcugagccagaacaggagugaugucucugcccuucc

SEQ ID NO: 467650 - RNA, 64 nt, Homo Sapiens
ccaugcuuggagcauuggguaucugaugucugcaccagaacaagagaaccucugacgguggaga

SEQ ID NO: 467651 - RNA, 64 nt, Homo Sapiens
uuguuuacauaaguuccuauagaaagaaugcauuccagaacaaaacccaaauauaaccauuuaa

SEQ ID NO: 467652 - RNA, 64 nt, Homo Sapiens
ucauuauguuuccuaacuguuccagcagcugauuccagaacaaauuuaaccacuugccucuuuc

SEQ ID NO: 467653 - RNA, 64 nt, Homo Sapiens
cauggcacauuuguuuaauauuauacuugaaggcccagaacacucuguuucuccuugguuaaaa

SEQ ID NO: 467654 - RNA, 64 nt, Homo Sapiens
acaaaaguuuuaaaucguagggcuaaaauuuuggccagaacauuuuuucagaaugccaaaugaa

SEQ ID NO: 467655 - RNA, 64 nt, Homo Sapiens
agccccucugggcagcaggacaccaacuaccagaccagaacacggccuaaaggaggaaaagucc

SEQ ID NO: 467656 - RNA, 64 nt, Homo Sapiens
aggccacaggcuggcacuacacacacugcagaacccagaacagaacauuccccaaucaauacac

SEQ ID NO: 467657 - RNA, 64 nt, Homo Sapiens
uucugugugccuccuuucaggggaccccaaaaaaccagaacaaguaaggacucgguucuguguu

SEQ ID NO: 467658 - RNA, 64 nt, Homo Sapiens
caguguggacaacugcccauuacgcaaaaaagaaccagaacacaacacuacuugcacuggaucu

SEQ ID NO: 467659 - RNA, 64 nt, Homo Sapiens
uaggagggugucuuuggaccgaacguggauagugccagaacacuuaauggccucaacaccuucu

SEQ ID NO: 467660 - RNA, 64 nt, Homo Sapiens
ggaaagggaagcacaugaucaugggaaugauagcccagaacaaaaagaaaucuugucuuaccac

SEQ ID NO: 467661 - RNA, 64 nt, Homo Sapiens
cauuuacaugucauuugacugucucacuuuuuacccagaacaguaacaacccacaccgucuucc

SEQ ID NO: 467662 - RNA, 64 nt, Homo Sapiens
ugggaacauugaaguuuauuuggauaucaaggucccagaacaaggaagucacuuuucaguggau

SEQ ID NO: 467663 - RNA, 64 nt, Homo Sapiens
guuacauaaaccagagaugauaaaacagauacuuccagaacauagugugcuucaaaacauuaau

SEQ ID NO: 467664 - RNA, 64 nt, Homo Sapiens
agguaggaugugacaaaugggaagugucaaccauccagaacacaaacuuuccucccucaauagu

SEQ ID NO: 467665 - RNA, 64 nt, Homo Sapiens
aaguccugaaaauccaaaaccugccuugaaagauccagaacaaaggaaucgaaaguucuagaaa

SEQ ID NO: 467666 - RNA, 63 nt, Homo Sapiens
guucucacaaggucaugggaucucaugugaacagugugugaucaaguguguccaccccuucgg

SEQ ID NO: 467667 - RNA, 63 nt, Homo Sapiens
ggugaugguggaugaugugucaugaaugaggaggugugugagcagggaacucagugugacacc

SEQ ID NO: 467668 - RNA, 63 nt, Homo Sapiens
ccaugcccacccuccccacgcugcagugggcuugugugugaugugcagucccgaagccacacc

SEQ ID NO: 467669 - RNA, 63 nt, Homo Sapiens
ccuuuaugcuugagguuccaaccuggagccacagugugugagaggaggaggagagggagaauu

SEQ ID NO: 467670 - RNA, 63 nt, Homo Sapiens
cuuuagcaaaaaaaacccaugccaacacugugggugugugacugaccuuuguacagcccagag

SEQ ID NO: 467671 - RNA, 63 nt, Homo Sapiens
gacggugucuuguucugucaugugugugugugugugugugagacuccagauuaucuauuugug

SEQ ID NO: 467672 - RNA, 63 nt, Homo Sapiens
gaaaaaucuguagagaagaguuuauauguguaugugugugacaucuguguguguaugugugug

SEQ ID NO: 467673 - RNA, 63 nt, Homo Sapiens
uuuuuuuuaaauuuauguugugaguguaugugugugugugauuuuucuauauaugggucugug

SEQ ID NO: 467674 - RNA, 63 nt, Homo Sapiens
gucgguggguuaacugugugugggucugcucuggugugugaagcccuucucccugcaugccug

SEQ ID NO: 467675 - RNA, 63 nt, Homo Sapiens
ggugggcaggccaguggcagcuccuguguguaugugugugaguucacgggagagcagucucgu

SEQ ID NO: 467676 - RNA, 63 nt, Homo Sapiens
aaaugugacuccauauuuauccauugcugcccugugugugaacgugaaguuuccauuuuucau

SEQ ID NO: 467677 - RNA, 63 nt, Homo Sapiens
uugggcagugugccauccugucuaagaaacucagugugugaugguacacaugccugggccaag

SEQ ID NO: 467678 - RNA, 63 nt, Homo Sapiens
aaccuuucaugucgugaaaggcagagggugacugugugugaugugcagaguccuuggacagga

SEQ ID NO: 467679 - RNA, 63 nt, Homo Sapiens
ccuugcuugcccaugguguguguguccagaggugugugugaggcugccagaacaagugcuggg

SEQ ID NO: 467680 - RNA, 63 nt, Homo Sapiens
agacuuaacagauacaugcugguucuccuugcugugugugacacagcagacagaggcacuauu

SEQ ID NO: 467681 - RNA, 63 nt, Homo Sapiens
gaaaugacaagggcaagagugagauaggaaacugugugugaaaggaaagcccuugcaguauuu

SEQ ID NO: 467682 - RNA, 63 nt, Homo Sapiens
uuuuucuagacugucucuguggaauauauuugugugugugauauaugcaugugugugauggua

SEQ ID NO: 467683 - RNA, 63 nt, Homo Sapiens
uguggaauauauuugugugugugauauaugcaugugugugaugguauguauggauuuaaucua

SEQ ID NO: 467684 - RNA, 63 nt, Homo Sapiens
cagagggagcugugguaaggucuauuaauuacugugugugagcuggggucuguucuugaaucc

SEQ ID NO: 467685 - RNA, 63 nt, Homo Sapiens
gguuguacguuuugcacauucacauguauggacgugugugaauacaaugccuacagcugucuu

SEQ ID NO: 467686 - RNA, 63 nt, Homo Sapiens
cagauggacauuggauggcuguuggauggggucgugugugauuaaagauagauuugugccugu

SEQ ID NO: 467687 - RNA, 63 nt, Homo Sapiens
gucuacuggauuucuuuacuuuggggggugagcgugugugacauuucucuauguuucucuaag

SEQ ID NO: 467688 - RNA, 63 nt, Homo Sapiens
guguguguuuccguuuaacuuguggugaaggaagugugugacucagcuuggcugggaagugcu

SEQ ID NO: 467689 - RNA, 63 nt, Homo Sapiens
gcuuaacagaacauggaaaguucccacuaaguugugugugaggaaauccucaucuuguauuuu

SEQ ID NO: 467690 - RNA, 63 nt, Homo Sapiens
uguguuugugugugugugugugugugugugugugugugugaguggaguugaggugucagagaa

SEQ ID NO: 467691 - RNA, 63 nt, Homo Sapiens
ccauucgaccuauaagaagccuuaauuugcacagugugugacuuacagaaacugcaugaaaaa

SEQ ID NO: 467692 - RNA, 63 nt, Homo Sapiens
uucugaaagacaauauuaaaucugugugugagugugugugaacgcggccccgccuuguucuga

SEQ ID NO: 467693 - RNA, 63 nt, Homo Sapiens
gugugugaacuucugaaagacuuguucugaucugugugugagugcuccccucggcggccccgc

SEQ ID NO: 467694 - RNA, 63 nt, Homo Sapiens
aaagggcacggaaguggcugucuuguguagucugugugugaucuaugcguagcuucugugugc

SEQ ID NO: 467695 - RNA, 63 nt, Homo Sapiens
uguaaaucaggucaaaccucauggagauauauagugugugaugcccaucaagggaaugcauag

SEQ ID NO: 467696 - RNA, 63 nt, Homo Sapiens
uugugugccuguagguacugugucugcgugugugugugugaucugugugugagagagagaucu

SEQ ID NO: 467697 - RNA, 63 nt, Homo Sapiens
gagagaucuugucugcguguugugugucugugugugugugagacugugaaaguuugggagcug

SEQ ID NO: 467698 - RNA, 63 nt, Homo Sapiens
uugagcaaaaagugacuucuuuccccgagguccgugugugacuuggcucauuagaucuguccc

SEQ ID NO: 467699 - RNA, 63 nt, Homo Sapiens
gugugcaugugugcaugacccauuuuccuucgugugugugauuugcuguggcucuauuugcaa

SEQ ID NO: 467700 - RNA, 63 nt, Homo Sapiens
guugugugugugugugugugugaaugugugcaugugugugaauacuggcaaaaggugugugug

SEQ ID NO: 467701 - RNA, 63 nt, Homo Sapiens
gugugcaugugugugaauguuggcaaaaggugugugugugaauaugugauuuuuguugggcac

SEQ ID NO: 467702 - RNA, 63 nt, Homo Sapiens
gucaucuacaauuaaaaaaaacaggggaauuaugugugugaaucaauuaaugcugauuugggu

SEQ ID NO: 467703 - RNA, 63 nt, Homo Sapiens
gaggcgugugugugugucuuugugugugagcgugugugugagugcaugugugugagugaggcg

SEQ ID NO: 467704 - RNA, 63 nt, Homo Sapiens
gugugugugagugaggcguggugagugaggcgugugugugagcaaaugugugugagcaugugu

SEQ ID NO: 467705 - RNA, 63 nt, Homo Sapiens
gaggcgugugugugagcgugugugugugagcaugugugugaguccuggggucaagaaggaaaa

SEQ ID NO: 467706 - RNA, 63 nt, Homo Sapiens
augugugugagugaggcgugcaagaaggaaaaugugugugagcuggggguccaggccuggggu

SEQ ID NO: 467707 - RNA, 63 nt, Homo Sapiens
gccuuccaggagguggcuuucagaugaccaggagugugugaauugggcagggugggugaggug

SEQ ID NO: 467708 - RNA, 63 nt, Homo Sapiens
ggggugcagcuuagaggacccuuagauugaagugugugugaugcgaggcucagaaacuccugg

SEQ ID NO: 467709 - RNA, 63 nt, Homo Sapiens
gagagcccucccacugccagugugugugugugugugugugagaugugugugugugugugugug

SEQ ID NO: 467710 - RNA, 63 nt, Homo Sapiens
gagcauguaugucugcaggugucugacacgcaagugugugagugugagugugagagauggggc

SEQ ID NO: 467711 - RNA, 63 nt, Homo Sapiens
cuguccaaacauuucauccguguguauguguaugugugugagugugugaagccgccaguucau

SEQ ID NO: 467712 - RNA, 63 nt, Homo Sapiens
acauuucauccguguguauguguaugugugugagugugugaagccgccaguucaucuuuuuau

SEQ ID NO: 467713 - RNA, 63 nt, Homo Sapiens
agccagaaacgcugaauccacaccagagaggaugugugugagguugcacaaaccugaaucccc

SEQ ID NO: 467714 - RNA, 63 nt, Homo Sapiens
cagcaagggcccuguguggguugaggcuguuuggugugugacccucagcugcugaauuuuucc

SEQ ID NO: 467715 - RNA, 63 nt, Homo Sapiens
cagugaagucucaacagcagugggguagauggugugugugaaauucuuguauauuaaaggucu

SEQ ID NO: 467716 - RNA, 63 nt, Homo Sapiens
uuccauguguuugcugagguguucaucagagcagugugugaaaaagugagugcucgucacugg

SEQ ID NO: 467717 - RNA, 63 nt, Homo Sapiens
acgugugugugugugcacauuaugugugcuugagugugugaacaaccuucaaaacaagacaug

SEQ ID NO: 467718 - RNA, 63 nt, Homo Sapiens
cacuguguacuggagccugcugacuguaugugugugugugaacuguguguguguucaagugcg

SEQ ID NO: 467719 - RNA, 63 nt, Homo Sapiens
uauacuauauaugcccacacgugugauguauaugugugugaugacuauauguguguauauagu

SEQ ID NO: 467720 - RNA, 63 nt, Homo Sapiens
uauaugugugugauguauacauguguguauauagugugugaugauacauaucacauauacuau

SEQ ID NO: 467721 - RNA, 63 nt, Homo Sapiens
agcaguagugggggcaaaagccguggaaguacugugugugaauucuccuaaugauguauugug

SEQ ID NO: 467722 - RNA, 63 nt, Homo Sapiens
uuuacaaagagcaauuuugagauacuuggaaaugugugugacuaacaagcaggacugcgacuu

SEQ ID NO: 467723 - RNA, 63 nt, Homo Sapiens
aggagacaggauggguuuaaagcaggauggugugugugugaacgggcaugagcagaggugagc

SEQ ID NO: 467724 - RNA, 63 nt, Homo Sapiens
ugcacagaggguguggugccagcuugagugggagugugugagugugagcaggcgggcgagugc

SEQ ID NO: 467725 - RNA, 64 nt, Homo Sapiens; identical to SEQ ID NO: 115592

SEQ ID NO: 467726 - RNA, 64 nt, Homo Sapiens; identical to SEQ ID NO: 115593

SEQ ID NO: 467727 - RNA, 64 nt, Homo Sapiens; identical to SEQ ID NO: 115594

SEQ ID NO: 467728 - RNA, 64 nt, Homo Sapiens; identical to SEQ ID NO: 115595

SEQ ID NO: 467729 - RNA, 64 nt, Homo Sapiens; identical to SEQ ID NO: 115596

SEQ ID NO: 467730 - RNA, 64 nt, Homo Sapiens; identical to SEQ ID NO: 115597

SEQ ID NO: 467731 - RNA, 64 nt, Homo Sapiens; identical to SEQ ID NO: 115598

SEQ ID NO: 467732 - RNA, 64 nt, Homo Sapiens; identical to SEQ ID NO: 115599

SEQ ID NO: 467733 - RNA, 64 nt, Homo Sapiens; identical to SEQ ID NO: 115600

SEQ ID NO: 467734 - RNA, 64 nt, Homo Sapiens; identical to SEQ ID NO: 115601

SEQ ID NO: 467735 - RNA, 64 nt, Homo Sapiens; identical to SEQ ID NO: 115602

SEQ ID NO: 467736 - RNA, 64 nt, Homo Sapiens; identical to SEQ ID NO: 115603

SEQ ID NO: 467737 - RNA, 64 nt, Homo Sapiens; identical to SEQ ID NO: 115604

SEQ ID NO: 467738 - RNA, 64 nt, Homo Sapiens; identical to SEQ ID NO: 115605

SEQ ID NO: 467739 - RNA, 64 nt, Homo Sapiens; identical to SEQ ID NO: 115606

SEQ ID NO: 467740 - RNA, 64 nt, Homo Sapiens; identical to SEQ ID NO: 115607

SEQ ID NO: 467741 - RNA, 64 nt, Homo Sapiens; identical to SEQ ID NO: 115608

SEQ ID NO: 467742 - RNA, 64 nt, Homo Sapiens; identical to SEQ ID NO: 115609

SEQ ID NO: 467743 - RNA, 64 nt, Homo Sapiens; identical to SEQ ID NO: 115610

SEQ ID NO: 467744 - RNA, 64 nt, Homo Sapiens; identical to SEQ ID NO: 115611

SEQ ID NO: 467745 - RNA, 64 nt, Homo Sapiens; identical to SEQ ID NO: 115612

SEQ ID NO: 467746 - RNA, 64 nt, Homo Sapiens; identical to SEQ ID NO: 115613

SEQ ID NO: 467747 - RNA, 64 nt, Homo Sapiens; identical to SEQ ID NO: 115614

SEQ ID NO: 467748 - RNA, 64 nt, Homo Sapiens; identical to SEQ ID NO: 115615

SEQ ID NO: 467749 - RNA, 52 nt, Homo Sapiens; identical to SEQ ID NO: 115616

SEQ ID NO: 467750 - RNA, 64 nt, Homo Sapiens; identical to SEQ ID NO: 115617

SEQ ID NO: 467751 - RNA, 64 nt, Homo Sapiens; identical to SEQ ID NO: 115618

SEQ ID NO: 467752 - RNA, 64 nt, Homo Sapiens; identical to SEQ ID NO: 115619

SEQ ID NO: 467753 - RNA, 64 nt, Homo Sapiens; identical to SEQ ID NO: 115620

SEQ ID NO: 467754 - RNA, 64 nt, Homo Sapiens; identical to SEQ ID NO: 115621

SEQ ID NO: 467755 - RNA, 64 nt, Homo Sapiens; identical to SEQ ID NO: 115622

SEQ ID NO: 467756 - RNA, 64 nt, Homo Sapiens; identical to SEQ ID NO: 115623

SEQ ID NO: 467757 - RNA, 64 nt, Homo Sapiens; identical to SEQ ID NO: 115624

SEQ ID NO: 467758 - RNA, 64 nt, Homo Sapiens; identical to SEQ ID NO: 115625

SEQ ID NO: 467759 - RNA, 64 nt, Homo Sapiens; identical to SEQ ID NO: 115626

SEQ ID NO: 467760 - RNA, 64 nt, Homo Sapiens; identical to SEQ ID NO: 115627

SEQ ID NO: 467761 - RNA, 64 nt, Homo Sapiens; identical to SEQ ID NO: 115628

SEQ ID NO: 467762 - RNA, 64 nt, Homo Sapiens; identical to SEQ ID NO: 115629

SEQ ID NO: 467763 - RNA, 64 nt, Homo Sapiens; identical to SEQ ID NO: 115630

SEQ ID NO: 467764 - RNA, 64 nt, Homo Sapiens; identical to SEQ ID NO: 115631

SEQ ID NO: 467765 - RNA, 64 nt, Homo Sapiens; identical to SEQ ID NO: 115632

SEQ ID NO: 467766 - RNA, 64 nt, Homo Sapiens; identical to SEQ ID NO: 115633

SEQ ID NO: 467767 - RNA, 64 nt, Homo Sapiens; identical to SEQ ID NO: 115634

SEQ ID NO: 467768 - RNA, 64 nt, Homo Sapiens; identical to SEQ ID NO: 115635

SEQ ID NO: 467769 - RNA, 64 nt, Homo Sapiens; identical to SEQ ID NO: 115636

SEQ ID NO: 467770 - RNA, 64 nt, Homo Sapiens; identical to SEQ ID NO: 115637

SEQ ID NO: 467771 - RNA, 64 nt, Homo Sapiens; identical to SEQ ID NO: 115636

SEQ ID NO: 467772 - RNA, 64 nt, Homo Sapiens; identical to SEQ ID NO: 115639

SEQ ID NO: 467773 - RNA, 64 nt, Homo Sapiens; identical to SEQ ID NO: 115640

SEQ ID NO: 467774 - RNA, 64 nt, Homo Sapiens; identical to SEQ ID NO: 115641

SEQ ID NO: 467775 - RNA, 64 nt, Homo Sapiens; identical to SEQ ID NO: 115642

SEQ ID NO: 467776 - RNA, 64 nt, Homo Sapiens; identical to SEQ ID NO: 115643

SEQ ID NO: 467777 - RNA, 64 nt, Homo Sapiens; identical to SEQ ID NO: 115644

SEQ ID NO: 467778 - RNA, 64 nt, Homo Sapiens; identical to SEQ ID NO: 115645

SEQ ID NO: 467779 - RNA, 64 nt, Homo Sapiens; identical to SEQ ID NO: 115646

SEQ ID NO: 467780 - RNA, 64 nt, Homo Sapiens; identical to SEQ ID NO: 115647

SEQ ID NO: 467781 - RNA, 64 nt, Homo Sapiens; identical to SEQ ID NO: 115648

SEQ ID NO: 467782 - RNA, 64 nt, Homo Sapiens; identical to SEQ ID NO: 115649

SEQ ID NO: 467783 - RNA, 64 nt, Homo Sapiens; identical to SEQ ID NO: 115650

SEQ ID NO: 467784 - RNA, 64 nt, Homo Sapiens; identical to SEQ ID NO: 115651

SEQ ID NO: 467785 - RNA, 64 nt, Homo Sapiens; identical to SEQ ID NO: 115652

SEQ ID NO: 467786 - RNA, 64 nt, Homo Sapiens; identical to SEQ ID NO: 115653

SEQ ID NO: 467787 - RNA, 64 nt, Homo Sapiens; identical to SEQ ID NO: 115654

SEQ ID NO: 467788 - RNA, 64 nt, Homo Sapiens; identical to SEQ ID NO: 115655

SEQ ID NO: 467789 - RNA, 64 nt, Homo Sapiens; identical to SEQ ID NO: 115656

SEQ ID NO: 467790 - RNA, 64 nt, Homo Sapiens; identical to SEQ ID NO: 115657

SEQ ID NO: 467791 - RNA, 64 nt, Homo Sapiens; identical to SEQ ID NO: 115658

SEQ ID NO: 467792 - RNA, 64 nt, Homo Sapiens; identical to SEQ ID NO: 115659

SEQ ID NO: 467793 - RNA, 64 nt, Homo Sapiens; identical to SEQ ID NO: 72506

SEQ ID NO: 467794 - RNA, 64 nt, Homo Sapiens; identical to SEQ ID NO: 72507

SEQ ID NO: 467795 - RNA, 64 nt, Homo Sapiens; identical to SEQ ID NO: 72508

SEQ ID NO: 467796 - RNA, 64 nt, Homo Sapiens; identical to SEQ ID NO: 72509

SEQ ID NO: 467797 - RNA, 64 nt, Homo Sapiens; identical to SEQ ID NO: 72510

SEQ ID NO: 467798 - RNA, 64 nt, Homo Sapiens; identical to SEQ ID NO: 72511

SEQ ID NO: 467799 - RNA, 64 nt, Homo Sapiens; identical to SEQ ID NO: 72512

SEQ ID NO: 467800 - RNA, 64 nt, Homo Sapiens; identical to SEQ ID NO: 72513

SEQ ID NO: 467801 - RNA, 64 nt, Homo Sapiens; identical to SEQ ID NO: 72514

SEQ ID NO: 467802 - RNA, 64 nt, Homo Sapiens; identical to SEQ ID NO: 72515

SEQ ID NO: 467803 - RNA, 64 nt, Homo Sapiens; identical to SEQ ID NO: 72516

SEQ ID NO: 467804 - RNA, 64 nt, Homo Sapiens; identical to SEQ ID NO: 72517

SEQ ID NO: 467805 - RNA, 64 nt, Homo Sapiens; identical to SEQ ID NO: 72518

SEQ ID NO: 467806 - RNA, 64 nt, Homo Sapiens; identical to SEQ ID NO: 72519

SEQ ID NO: 467807 - RNA, 64 nt, Homo Sapiens; identical to SEQ ID NO: 72520

SEQ ID NO: 467808 - RNA, 64 nt, Homo Sapiens; identical to SEQ ID NO: 72521

SEQ ID NO: 467809 - RNA, 64 nt, Homo Sapiens; identical to SEQ ID NO: 72522

SEQ ID NO: 467810 - RNA, 64 nt, Homo Sapiens; identical to SEQ ID NO: 72523

SEQ ID NO: 467811 - RNA, 64 nt, Homo Sapiens; identical to SEQ ID NO: 72524

SEQ ID NO: 467812 - RNA, 64 nt, Homo Sapiens; identical to SEQ ID NO: 72525

SEQ ID NO: 467813 - RNA, 64 nt, Homo Sapiens; identical to SEQ ID NO: 72526

SEQ ID NO: 467814 - RNA, 64 nt, Homo Sapiens; identical to SEQ ID NO: 72527

SEQ ID NO: 467815 - RNA, 64 nt, Homo Sapiens; identical to SEQ ID NO: 72528

SEQ ID NO: 467816 - RNA, 64 nt, Homo Sapiens; identical to SEQ ID NO: 72529

SEQ ID NO: 467817 - RNA, 64 nt, Homo Sapiens; identical to SEQ ID NO: 72530

SEQ ID NO: 467818 - RNA, 64 nt, Homo Sapiens; identical to SEQ ID NO: 72531

SEQ ID NO: 467819 - RNA, 64 nt, Homo Sapiens; identical to SEQ ID NO: 72532

SEQ ID NO: 467820 - RNA, 64 nt, Homo Sapiens; identical to SEQ ID NO: 72533

SEQ ID NO: 467821 - RNA, 64 nt, Homo Sapiens; identical to SEQ ID NO: 72534

SEQ ID NO: 467822 - RNA, 64 nt, Homo Sapiens; identical to SEQ ID NO: 72535

SEQ ID NO: 467823 - RNA, 64 nt, Homo Sapiens; identical to SEQ ID NO: 72536

SEQ ID NO: 467824 - RNA, 64 nt, Homo Sapiens; identical to SEQ ID NO: 72537

SEQ ID NO: 467825 - RNA, 64 nt, Homo Sapiens; identical to SEQ ID NO: 72538

SEQ ID NO: 467826 - RNA, 64 nt, Homo Sapiens; identical to SEQ ID NO: 72539

SEQ ID NO: 467827 - RNA, 64 nt, Homo Sapiens; identical to SEQ ID NO: 72540

SEQ ID NO: 467828 - RNA, 64 nt, Homo Sapiens; identical to SEQ ID NO: 72541

SEQ ID NO: 467829 - RNA, 64 nt, Homo Sapiens; identical to SEQ ID NO: 72542

SEQ ID NO: 467830 - RNA, 64 nt, Homo Sapiens; identical to SEQ ID NO: 72543

SEQ ID NO: 467831 - RNA, 64 nt, Homo Sapiens; identical to SEQ ID NO: 72544

SEQ ID NO: 467832 - RNA, 64 nt, Homo Sapiens; identical to SEQ ID NO: 72545

SEQ ID NO: 467833 - RNA, 64 nt, Homo Sapiens; identical to SEQ ID NO: 72546

SEQ ID NO: 467834 - RNA, 64 nt, Homo Sapiens; identical to SEQ ID NO: 72547

SEQ ID NO: 467835 - RNA, 64 nt, Homo Sapiens; identical to SEQ ID NO: 72548

SEQ ID NO: 467836 - RNA, 64 nt, Homo Sapiens; identical to SEQ ID NO: 72549

SEQ ID NO: 467837 - RNA, 64 nt, Homo Sapiens; identical to SEQ ID NO: 72550

SEQ ID NO: 467838 - RNA, 64 nt, Homo Sapiens; identical to SEQ ID NO: 72551

SEQ ID NO: 467839 - RNA, 64 nt, Homo Sapiens; identical to SEQ ID NO: 72552

SEQ ID NO: 467840 - RNA, 64 nt, Homo Sapiens; identical to SEQ ID NO: 72553

SEQ ID NO: 467841 - RNA, 64 nt, Homo Sapiens; identical to SEQ ID NO: 72554

SEQ ID NO: 467842 - RNA, 64 nt, Homo Sapiens; identical to SEQ ID NO: 72555

SEQ ID NO: 467843 - RNA, 64 nt, Homo Sapiens; identical to SEQ ID NO: 72556

SEQ ID NO: 467844 - RNA, 64 nt, Homo Sapiens; identical to SEQ ID NO: 72557

SEQ ID NO: 467845 - RNA, 64 nt, Homo Sapiens; identical to SEQ ID NO: 72558

SEQ ID NO: 467846 - RNA, 64 nt, Homo Sapiens; identical to SEQ ID NO: 72559

SEQ ID NO: 467847 - RNA, 64 nt, Homo Sapiens; identical to SEQ ID NO: 72560

SEQ ID NO: 467848 - RNA, 64 nt, Homo Sapiens; identical to SEQ ID NO: 72561

SEQ ID NO: 467849 - RNA, 64 nt, Homo Sapiens; identical to SEQ ID NO: 72562

SEQ ID NO: 467850 - RNA, 64 nt, Homo Sapiens; identical to SEQ ID NO: 72563

SEQ ID NO: 467851 - RNA, 64 nt, Homo Sapiens; identical to SEQ ID NO: 72564

SEQ ID NO: 467852 - RNA, 64 nt, Homo Sapiens; identical to SEQ ID NO: 72565

SEQ ID NO: 467853 - RNA, 64 nt, Homo Sapiens; identical to SEQ ID NO: 72566

SEQ ID NO: 467854 - RNA, 64 nt, Homo Sapiens; identical to SEQ ID NO: 72567

SEQ ID NO: 467855 - RNA, 64 nt, Homo Sapiens; identical to SEQ ID NO: 72568

SEQ ID NO: 467856 - RNA, 64 nt, Homo Sapiens; identical to SEQ ID NO: 72569

SEQ ID NO: 467857 - RNA, 64 nt, Homo Sapiens; identical to SEQ ID NO: 72570

SEQ ID NO: 467858 - RNA, 64 nt, Homo Sapiens; identical to SEQ ID NO: 72571

SEQ ID NO: 467859 - RNA, 64 nt, Homo Sapiens; identical to SEQ ID NO: 72572

SEQ ID NO: 467860 - RNA, 64 nt, Homo Sapiens; identical to SEQ ID NO: 72573

SEQ ID NO: 467861 - RNA, 64 nt, Homo Sapiens; identical to SEQ ID NO: 72574

SEQ ID NO: 467862 - RNA, 64 nt, Homo Sapiens; identical to SEQ ID NO: 72575

SEQ ID NO: 467863 - RNA, 64 nt, Homo Sapiens; identical to SEQ ID NO: 72576

SEQ ID NO: 467864 - RNA, 64 nt, Homo Sapiens; identical to SEQ ID NO: 72577

SEQ ID NO: 467865 - RNA, 64 nt, Homo Sapiens; identical to SEQ ID NO: 72578

SEQ ID NO: 467866 - RNA, 64 nt, Homo Sapiens; identical to SEQ ID NO: 72579

SEQ ID NO: 467867 - RNA, 64 nt, Homo Sapiens; identical to SEQ ID NO: 72580

SEQ ID NO: 467868 - RNA, 64 nt, Homo Sapiens; identical to SEQ ID NO: 72581

SEQ ID NO: 467869 - RNA, 64 nt, Homo Sapiens; identical to SEQ ID NO: 72582

SEQ ID NO: 467870 - RNA, 64 nt, Homo Sapiens; identical to SEQ ID NO: 72583

SEQ ID NO: 467871 - RNA, 64 nt, Homo Sapiens; identical to SEQ ID NO: 72584

SEQ ID NO: 467872 - RNA, 64 nt, Homo Sapiens; identical to SEQ ID NO: 72585

SEQ ID NO: 467873 - RNA, 64 nt, Homo Sapiens; identical to SEQ ID NO: 72586

SEQ ID NO: 467874 - RNA, 64 nt, Homo Sapiens; identical to SEQ ID NO: 72587

SEQ ID NO: 467875 - RNA, 64 nt, Homo Sapiens; identical to SEQ ID NO: 72588

SEQ ID NO: 467876 - RNA, 64 nt, Homo Sapiens; identical to SEQ ID NO: 72589

SEQ ID NO: 467877 - RNA, 64 nt, Homo Sapiens; identical to SEQ ID NO: 72590

SEQ ID NO: 467878 - RNA, 64 nt, Homo Sapiens; identical to SEQ ID NO: 72591

SEQ ID NO: 467879 - RNA, 64 nt, Homo Sapiens; identical to SEQ ID NO: 72592

SEQ ID NO: 467880 - RNA, 64 nt, Homo Sapiens; identical to SEQ ID NO: 72593

SEQ ID NO: 467881 - RNA, 64 nt, Homo Sapiens; identical to SEQ ID NO: 72594

SEQ ID NO: 467882 - RNA, 64 nt, Homo Sapiens; identical to SEQ ID NO: 72595

SEQ ID NO: 467883 - RNA, 64 nt, Homo Sapiens; identical to SEQ ID NO: 72596

SEQ ID NO: 467884 - RNA, 64 nt, Homo Sapiens; identical to SEQ ID NO: 72597

SEQ ID NO: 467885 - RNA, 64 nt, Homo Sapiens; identical to SEQ ID NO: 72598

SEQ ID NO: 467886 - RNA, 64 nt, Homo Sapiens; identical to SEQ ID NO: 72599

SEQ ID NO: 467887 - RNA, 64 nt, Homo Sapiens; identical to SEQ ID NO: 72600

SEQ ID NO: 467888 - RNA, 64 nt, Homo Sapiens; identical to SEQ ID NO: 72601

SEQ ID NO: 467889 - RNA, 64 nt, Homo Sapiens
gguaaauucucuauuuuuuguaauguguucggugauuucagaaagcuagaaaguguaugugugg

SEQ ID NO: 467890 - RNA, 64 nt, Homo Sapiens
uuaaaacaucccuaacugaucgaauauaucaguaauuucagaaucagaugcauccuuucauaag

SEQ ID NO: 467891 - RNA, 64 nt, Homo Sapiens
uauuugauuaguuuacaaucuuuaauaaacuuuuauuucagagauaacuuccacuuaauuuaaa

SEQ ID NO: 467892 - RNA, 64 nt, Homo Sapiens
acaauauuugauguauaacuuacaccagauuuugauuucagaaaauauucuguauuacauacug

SEQ ID NO: 467893 - RNA, 64 nt, Homo Sapiens
auauuaccauguaaauauguauaaugaaaaucauauuucagaaaucaugaugcuguuacugaga

SEQ ID NO: 467894 - RNA, 64 nt, Homo Sapiens
ucuagagcaauucaguccuggaaaauuucuacuaauuucagaccgccaaaaagagaaaagaaaa

SEQ ID NO: 467895 - RNA, 64 nt, Homo Sapiens
guaccuuuauaaauucaguugcaucuguggcaaaauuucagacuauuuuugcgucuuuccucau

SEQ ID NO: 467896 - RNA, 64 nt, Homo Sapiens
agugcaguggaaggaagccacacacuggucagucauuucagaggcagcagaugcccagggagac

SEQ ID NO: 467897 - RNA, 64 nt, Homo Sapiens
ccauuauauuaaaauauuugaauauaugaauaacauuucagauaaauacuaugacaguacuaaa

SEQ ID NO: 467898 - RNA, 64 nt, Homo Sapiens
uaaauaaaagauuguaaaauuaacauuuaagcauauuucagauggguuaaagugaauguuuuug

SEQ ID NO: 467899 - RNA, 64 nt, Homo Sapiens
cgcuguauuaaaauagaaccaggaaaggcucaggauuucagacauuucaucagccuuuucacuu

SEQ ID NO: 467900 - RNA, 64 nt, Homo Sapiens
agguucuugguggugucucccauuccccuggcuaauuucagacagcuguggucaagggauuuua

SEQ ID NO: 467901 - RNA, 64 nt, Homo Sapiens
ugaguuuagugaucugaacagaaauaccaaaauuauuucagaaauguacaacuuuuuaccuagu

SEQ ID NO: 467902 - RNA, 64 nt, Homo Sapiens
aaaacccacaaaaguacaauuuaccagccuccguauuucagacugaauggggguggggggggcg

SEQ ID NO: 467903 - RNA, 64 nt, Homo Sapiens
cagcaucccccaacucccacaaugccucucuggcauuucagagccagaugcuuccagaguucuu

SEQ ID NO: 467904 - RNA, 64 nt, Homo Sapiens
guccuuaggccauucuccuugguuugauaauuaaauuucagaaugauuugguuugguuugguuu

SEQ ID NO: 467905 - RNA, 64 nt, Homo Sapiens
uugagaacaauuucauaauaauagacuacugagaauuucagaaagcaugugaaaaugggauacu

SEQ ID NO: 467906 - RNA, 64 nt, Homo Sapiens
aaagggaugacaaaagcaugaccacugggaaaauauuucagaugugugugcaaaauacugagua

SEQ ID NO: 467907 - RNA, 64 nt, Homo Sapiens
uuugcuuuacugcaugaaugaaacugaugguucaauuucagaaguaaugauuaacaguuaugug

SEQ ID NO: 467908 - RNA, 64 nt, Homo Sapiens
acaugaauugugucucaacagaaacuaaaugaacauuucagaauaaauuauugcuguauguaaa

SEQ ID NO: 467909 - RNA, 64 nt, Homo Sapiens
ugugcuccugcucccagcagcccucucuuagaauauuucagauggaugagcuucugacucuuuc

SEQ ID NO: 467910 - RNA, 64 nt, Homo Sapiens
cuaacuaaaauggccaaaguuccaacuuccuuaaauuucagaccugacuguaauggccucaaga

SEQ ID NO: 467911 - RNA, 64 nt, Homo Sapiens
uauucuaaguauuuuaccagcaaguguuuagauaauuucagauaucucuuauuugacagaauag

SEQ ID NO: 467912 - RNA, 64 nt, Homo Sapiens
guguuagaagaauucuauguaauuuaaagaaacaauuucagaaauuacccuuaucuuuguuucu

SEQ ID NO: 467913 - RNA, 64 nt, Homo Sapiens
cccauagcaauucagugauuuuaauuuuuuggauauuucagaaaauuuuucccccugcuucagg

SEQ ID NO: 467914 - RNA, 61 nt, Homo Sapiens
auguaguuuacaagaauaaaugcaggaauuuauuucagaaaauuuccuccaaacaaaauaa

SEQ ID NO: 467915 - RNA, 64 nt, Homo Sapiens
gcaagccuuugucuuacucuuucagucaggaccuauuucagacuguugaugacauugacauuuc

SEQ ID NO: 467916 - RNA, 64 nt, Homo Sapiens
uuuagauguugaacccugagagaacuaagaugauauuucagaagaguuggcugccuucucugga

SEQ ID NO: 467917 - RNA, 64 nt, Homo Sapiens
uucccauaauuuagaaaaggaugucgacuugcuaauuucagaaauaauuauucauuuuuaaaaa

SEQ ID NO: 467918 - RNA, 64 nt, Homo Sapiens
aaagauaucuuagauaaacuauuuugaaguucagauuucagaugaggcaacauuuucuugagau

SEQ ID NO: 467919 - RNA, 64 nt, Homo Sapiens
ugcaggguuaucuucucacagggcuggaaugcaaauuucagaggcuucuuuugaagauucccca

SEQ ID NO: 467920 - RNA, 64 nt, Homo Sapiens
ucacuccuguauauuuugguuuacuuacuccucuauuucagaaauugaaaaagauccccaagga

SEQ ID NO: 467921 - RNA, 64 nt, Homo Sapiens
aaagaugaaacuauuguaucucacaaaaaaucuuauuucagaauggaaauauuuuugagaaaag

SEQ ID NO: 467922 - RNA, 64 nt, Homo Sapiens
guagaauacuaaaaggaaaaugucauguuaagcaauuucagaacauuaacugaacuauuuucaa

SEQ ID NO: 467923 - RNA, 64 nt, Homo Sapiens
caauaaggaauuucgauuauuugcuguuagaauaauuucagaccuugguuuuguuuuuucuuuu

SEQ ID NO: 467924 - RNA, 64 nt, Homo Sapiens
cccauucuaaacaagggcauucuuaaaaaugaagauuucagagaaucauaauuaccuagaugcc

SEQ ID NO: 467925 - RNA, 64 nt, Homo Sapiens
cuaagaaaucaggcaagugcauuguuauggauacauuucagaauauuaaacaacguguaugcaa

SEQ ID NO: 467926 - RNA, 64 nt, Homo Sapiens
acacagggcaagacacauacaaauuucaaacauuauuucagagaaaaaacaaaucauccaaauu

SEQ ID NO: 467927 - RNA, 64 nt, Homo Sapiens
uuauuuggaggaaaccgcuauaauguaaaaucagauuucagaaggaaaaugcagcaaggacuga

SEQ ID NO: 467928 - RNA, 64 nt, Homo Sapiens
gaaggaaaaugcagcaaggacugacuguaguccuauuucagaccccugggcacuagugucaacu

SEQ ID NO: 467929 - RNA, 64 nt, Homo Sapiens
uguguuuuagaaauuugcacuuaauggaauuugcauuucagagauguguuaguguugugcuuug

SEQ ID NO: 467930 - RNA, 64 nt, Homo Sapiens
uuuuuuuuuggacagcuucaaggagauguuagcaauuucagauauacuagccaguuuagguaug

SEQ ID NO: 467931 - RNA, 64 nt, Homo Sapiens
aaauaaaauuaaaauuggaggguugguuagauugauuucagauggauacuaacaguuugagggg

SEQ ID NO: 467932 - RNA, 64 nt, Homo Sapiens
uaaugcugcaguuuaagagaacuuguauugugucauuucagauuguaggcugagaguuguaaau

SEQ ID NO: 467933 - RNA, 64 nt, Homo Sapiens
cuuauuguuuucucuguauuucagaaacagacuuauuucagaggugggaagacuauugacuauu

SEQ ID NO: 467934 - RNA, 64 nt, Homo Sapiens
cagacuuauuucagaggcuugaagacuauugacuauuucagaaauucucuuauaguuuggaugg

SEQ ID NO: 467935 - RNA, 64 nt, Homo Sapiens
auuaagcgaaagugguaucauccuagguaagcuuauuucagaacaagucuaauauuucagauuc

SEQ ID NO: 467936 - RNA, 64 nt, Homo Sapiens
auccuagguaagcuuauuucagaacaagucuaauauuucagauucuuucuuuucgacuuuauac

SEQ ID NO: 467937 - RNA, 64 nt, Homo Sapiens
gguggaguuuuucuauauuuaaaaauacauauauauuucagaggauuuuuauuuugcuuuuugg

SEQ ID NO: 467938 - RNA, 64 nt, Homo Sapiens
uauauuucagaggauuuuuauuuugcuuuuuggcauuucagacuuugaucaguguuaagugcac

SEQ ID NO: 467939 - RNA, 64 nt, Homo Sapiens
uaugcaaaacgucaaaaucugauacgugcauguuauuucagaauuuauucucaauuuaucaaug

SEQ ID NO: 467940 - RNA, 64 nt, Homo Sapiens
uagcucagcccaucucuaauuugguuuuauuauuauuucagaacgauacucgaaugucagguuu

SEQ ID NO: 467941 - RNA, 64 nt, Homo Sapiens
agucuaaucaaugccaaguacuaagcauaaccaaauuucagaaccaauaaacagaauuuuuuga

SEQ ID NO: 467942 - RNA, 64 nt, Homo Sapiens
uuagauuuuuguaugaggaauuggauuuugggguauuucagauugugucagcacucaaaaaguu

SEQ ID NO: 467943 - RNA, 64 nt, Homo Sapiens
aaauccgagacccagaacacuucuggucccaagcauuucagauaagggauaucaaucuguacua

SEQ ID NO: 467944 - RNA, 64 nt, Homo Sapiens
uggauacaguauuuacacccugcagacccuaaagauuucagauucaguuagcaaaccuugauga

SEQ ID NO: 467945 - RNA, 64 nt, Homo Sapiens
uuucaucuuggaccucagugcauaggucaaauggauuucagagguuuaaacuucccugugauuc

SEQ ID NO: 467946 - RNA, 64 nt, Homo Sapiens
gagcagucuagucaaaucauauaaauuguucuaaauuucagaauugaacauugaaguauuaacu

SEQ ID NO: 467947 - RNA, 64 nt, Homo Sapiens
cguuuuaaguguuaacauccuuugaaugcguuggauuucagagaauaaacauuuuguaaaaauc

SEQ ID NO: 467948 - RNA, 64 nt, Homo Sapiens
uuggcuuucuuccauuguuguuuuuguagcauuuauuucagaaauguguauuuccauaauccag

SEQ ID NO: 467949 - RNA, 64 nt, Homo Sapiens
gcagacaagaauauccauauaagauuuguuaaccauuucagagaguuuggcaauuuuuaaaaga

SEQ ID NO: 467950 - RNA, 64 nt, Homo Sapiens
cagauacuaagcuuguauaugauuauggugggugauuucagauauauaagcagauaagcacaga

SEQ ID NO: 467951 - RNA, 64 nt, Homo Sapiens
auagacaauuagcuguuugaagugaguauuaaauauuucagaagugugaauuucauguauuuga

SEQ ID NO: 467952 - RNA, 64 nt, Homo Sapiens
cgcaauuuuaucgaagauuaaaaauugcgaaacuauuucagaauaauaucaaaguuaacuuuua

SEQ ID NO: 467953 - RNA, 64 nt, Homo Sapiens
cgcacuucggcagccaacucgaauucgcaggaucauuucagaccgcgcgggcgagcaggccugu

SEQ ID NO: 467954 - RNA, 64 nt, Homo Sapiens
uuucuuuuugucacugucuagaauuuuguauuuuauuucagacuauaccuuggaguuuuguaua

SEQ ID NO: 467955 - RNA, 64 nt, Homo Sapiens
gguauacauauccuccuauaccgcacauaaauagauuucagagcccccauacaaugggcagugu

SEQ ID NO: 467956 - RNA, 64 nt, Homo Sapiens
gaaaucacagagagguaaaauggaggccagugccauuucagaggggaggcucaggaaggcuucu

SEQ ID NO: 467957 - RNA, 64 nt, Homo Sapiens
gacccuagaugugcucguacucccucggccugggauuucagagcuggaaauauagaaaauaucu

SEQ ID NO: 467958 - RNA, 64 nt, Homo Sapiens
ccacgcagccuggugauggcaggccuggguuuggauuucagaauccuagcuccgggcuccacuc

SEQ ID NO: 467959 - RNA, 64 nt, Homo Sapiens
uguaaaauguuaucugcccuuuggcugcauuggaauuucagagaaggcugcagaggccuggguu

SEQ ID NO: 467960 - RNA, 64 nt, Homo Sapiens
cgagguaguagacaggaugcccaguuaaguuugaauuucagauagaaaauaauuuuagaauaaa

SEQ ID NO: 467961 - RNA, 64 nt, Homo Sapiens
aggagccaggaaaugugcuucuacuuugccaguuauuucagacagcacuaccaagaggaggugg

SEQ ID NO: 467962 - RNA, 64 nt, Homo Sapiens
agaauagugcuauauaucagguaugugaccauuuauuucagaaggcugaacauaagagguuucu

SEQ ID NO: 467963 - RNA, 64 nt, Homo Sapiens
auauaaacaaauggaaggauucugcagaacugugauuucagacccagagagaaaacauguccac

SEQ ID NO: 467964 - RNA, 64 nt, Homo Sapiens
ccaauucuucucauuugucaauaugucaagcugaauuucagaagauguggaugauauuuguuca

SEQ ID NO: 467965 - RNA, 64 nt, Homo Sapiens
uaaagcuggcaaucaggagauaauccuguuuuacauuucagaccgaguuguucggaaccucaau

SEQ ID NO: 467966 - RNA, 64 nt, Homo Sapiens
aaauagaaaaaacaauguuaguuuaauuugauuuauuucagagaggugugaacgaauuuugcaa

SEQ ID NO: 467967 - RNA, 64 nt, Homo Sapiens
uuauuuuuguuuuuguuggauagcuuuuaauuacauuucagagagguguaauuuuggguagaug

SEQ ID NO: 467968 - RNA, 64 nt, Homo Sapiens
gauuuauaugacuggugauacuggcuuuacagaaauuucagagaacuaauuuuuaaaaucuuua

SEQ ID NO: 467969 - RNA, 64 nt, Homo Sapiens
gacauaaguuacuagaaaguguaaagcuuucuguauuucagagaagcauuuaugagaauuauaa

SEQ ID NO: 467970 - RNA, 64 nt, Homo Sapiens
gguuuuaacuuaucccagcuugacagacucuuccauuucagacuucgcaccaaacuuccugugg

SEQ ID NO: 467971 - RNA, 64 nt, Homo Sapiens
uuggaaugggcuuauuuaaccuggauuguaauaaauuucagauuuuuauaccucauucaucaug

SEQ ID NO: 467972 - RNA, 64 nt, Homo Sapiens
aucaaacaaaucuauauuuaugcaagaagaugacauuucagaaauuauuacauaccaauggcuu

SEQ ID NO: 467973 - RNA, 64 nt, Homo Sapiens
caaaaggccgggcgcggugggcaacagcaccugaauuucagaaacucuuugucuaagagcugug

SEQ ID NO: 467974 - RNA, 64 nt, Homo Sapiens
guuccuggaaauuccaauguucaacauuuaaaagauuucagaaggugcauguaaauauauacuc

SEQ ID NO: 467975 - RNA, 64 nt, Homo Sapiens
ggccuuuuggaauguggcccagagaauuucuaccauuucagagacuagccuuaaucagguccuc

SEQ ID NO: 467976 - RNA, 64 nt, Homo Sapiens
cccagagcaaaauaauuuuauaauuuauccugaaauuucagauuugcuuuuucaccagauuugc

SEQ ID NO: 467977 - RNA, 64 nt, Homo Sapiens
uaugaugcuuuucuucucagagagagcuaucaccauuucagaacccuccucucauuuguggcuu

SEQ ID NO: 467978 - RNA, 64 nt, Homo Sapiens
aaauuaacccuuuucuccugccuaauuguguuugauuucagacaccuguaaguuauuuauuagc

SEQ ID NO: 467979 - RNA, 64 nt, Homo Sapiens
auaaacaucauguauaggcagucugcaucuucagauuucagagauuaaaugaguauucaguuuu

SEQ ID NO: 467980 - RNA, 64 nt, Homo Sapiens
ucaucgcugagcaaauggagcuugcuauguuuuaauuucagaaaauuuccucauauacguagug

SEQ ID NO: 467981 - RNA, 64 nt, Homo Sapiens
ugguaauauaaucuaaaucaagauuaccaaaauaauuucagagguugaugugguaaccuuuaag

SEQ ID NO: 467982 - RNA, 64 nt, Homo Sapiens
auuuaauaacugggucaccaguguuucuugagccauuucagauguauguaaaacacaaaauaug

SEQ ID NO: 467983 - RNA, 64 nt, Homo Sapiens
uaucaagagacacuccccccggaggaaucaccccauuucagaguccccacccaguucuucauuu

SEQ ID NO: 467984 - RNA, 64 nt, Homo Sapiens
gagaaggcuggagaaggacacgcccagugcagguauuucagaagugcaccuuccccaaaggaac

SEQ ID NO: 467985 - RNA, 64 nt, Homo Sapiens
ggcaguuuugauuauaugugaaauacaaauguuuauuucagaaguguauucccauuuuuaaaau

SEQ ID NO: 467986 - RNA, 64 nt, Homo Sapiens
aucuucauauugauuauuaguuagcauugauuuaauuucagaacuuuauaaacacagccuuucu

SEQ ID NO: 467987 - RNA, 64 nt, Homo Sapiens
uacagauaaaugauucaaaauauaauugugugauauuucagaaauuuuuucucuagaguagagg

SEQ ID NO: 467988 - RNA, 64 nt, Homo Sapiens
gccuuucauuuugcuuuaaugaucaguaguuugcauuucagaaacuguugcugauuuuauucuu

SEQ ID NO: 467989 - RNA, 64 nt, Homo Sapiens
uuuaaauauuaagcaugacaccucuugucuuccuauuucagaaggaaauuugcagcuuccaaug

SEQ ID NO: 467990 - RNA, 64 nt, Homo Sapiens
aaaauguacuguauacuuuuuuagauugucucauauuucagaaugaccacaacugcauguugga

SEQ ID NO: 467991 - RNA, 64 nt, Homo Sapiens
augaacacccuugugauagaacaguuauuagcacauuucagaaauggaaaggaaggcaaucgac

SEQ ID NO: 467992 - RNA, 64 nt, Homo Sapiens; identical to SEQ ID NO: 276789

SEQ ID NO: 467993 - RNA, 64 nt, Homo Sapiens; identical to SEQ ID NO: 276790

SEQ ID NO: 467994 - RNA, 64 nt, Homo Sapiens; identical to SEQ ID NO: 276791

SEQ ID NO: 467995 - RNA, 64 nt, Homo Sapiens; identical to SEQ ID NO: 276792

SEQ ID NO: 467996 - RNA, 64 nt, Homo Sapiens; identical to SEQ ID NO: 276793

SEQ ID NO: 467997 - RNA, 64 nt, Homo Sapiens; identical to SEQ ID NO: 276794

SEQ ID NO: 467998 - RNA, 64 nt, Homo Sapiens; identical to SEQ ID NO: 276795

SEQ ID NO: 467999 - RNA, 64 nt, Homo Sapiens; identical to SEQ ID NO: 276796

SEQ ID NO: 468000 - RNA, 64 nt, Homo Sapiens; identical to SEQ ID NO: 276797

SEQ ID NO: 468001 - RNA, 64 nt, Homo Sapiens; identical to SEQ ID NO: 276798

SEQ ID NO: 468002 - RNA, 64 nt, Homo Sapiens; identical to SEQ ID NO: 276799

SEQ ID NO: 468003 - RNA, 64 nt, Homo Sapiens; identical to SEQ ID NO: 276800

SEQ ID NO: 468004 - RNA, 64 nt, Homo Sapiens; identical to SEQ ID NO: 276801

SEQ ID NO: 468005 - RNA, 64 nt, Homo Sapiens; identical to SEQ ID NO: 276802

SEQ ID NO: 468006 - RNA, 64 nt, Homo Sapiens; identical to SEQ ID NO: 276803

SEQ ID NO: 468007 - RNA, 64 nt, Homo Sapiens; identical to SEQ ID NO: 276804

SEQ ID NO: 468008 - RNA, 64 nt, Homo Sapiens; identical to SEQ ID NO: 276805

SEQ ID NO: 468009 - RNA, 64 nt, Homo Sapiens; identical to SEQ ID NO: 276806

SEQ ID NO: 468010 - RNA, 64 nt, Homo Sapiens; identical to SEQ ID NO: 276807

SEQ ID NO: 468011 - RNA, 64 nt, Homo Sapiens; identical to SEQ ID NO: 276808

SEQ ID NO: 468012 - RNA, 64 nt, Homo Sapiens; identical to SEQ ID NO: 276809

SEQ ID NO: 468013 - RNA, 64 nt, Homo Sapiens; identical to SEQ ID NO: 276810

SEQ ID NO: 468014 - RNA, 64 nt, Homo Sapiens; identical to SEQ ID NO: 276811

SEQ ID NO: 468015 - RNA, 64 nt, Homo Sapiens; identical to SEQ ID NO: 276812

SEQ ID NO: 468016 - RNA, 64 nt, Homo Sapiens; identical to SEQ ID NO: 276813

SEQ ID NO: 468017 - RNA, 64 nt, Homo Sapiens; identical to SEQ ID NO: 276814

SEQ ID NO: 468018 - RNA, 64 nt, Homo Sapiens; identical to SEQ ID NO: 276815

SEQ ID NO: 468019 - RNA, 64 nt, Homo Sapiens; identical to SEQ ID NO: 276816

SEQ ID NO: 468020 - RNA, 64 nt, Homo Sapiens; identical to SEQ ID NO: 276817

SEQ ID NO: 468021 - RNA, 64 nt, Homo Sapiens; identical to SEQ ID NO: 276818

SEQ ID NO: 468022 - RNA, 64 nt, Homo Sapiens; identical to SEQ ID NO: 276819

SEQ ID NO: 468023 - RNA, 64 nt, Homo Sapiens; identical to SEQ ID NO: 276820

SEQ ID NO: 468024 - RNA, 64 nt, Homo Sapiens; identical to SEQ ID NO: 276821

SEQ ID NO: 468025 - RNA, 64 nt, Homo Sapiens; identical to SEQ ID NO: 276822

SEQ ID NO: 468026 - RNA, 64 nt, Homo Sapiens; identical to SEQ ID NO: 276823

SEQ ID NO: 468027 - RNA, 64 nt, Homo Sapiens; identical to SEQ ID NO: 276824

SEQ ID NO: 468028 - RNA, 64 nt, Homo Sapiens; identical to SEQ ID NO: 276825

SEQ ID NO: 468029 - RNA, 64 nt, Homo Sapiens; identical to SEQ ID NO: 276826

SEQ ID NO: 468030 - RNA, 64 nt, Homo Sapiens; identical to SEQ ID NO: 276827

SEQ ID NO: 468031 - RNA, 64 nt, Homo Sapiens; identical to SEQ ID NO: 276828

SEQ ID NO: 468032 - RNA, 64 nt, Homo Sapiens; identical to SEQ ID NO: 276829

SEQ ID NO: 468033 - RNA, 64 nt, Homo Sapiens; identical to SEQ ID NO: 276830

SEQ ID NO: 468034 - RNA, 64 nt, Homo Sapiens; identical to SEQ ID NO: 276831

SEQ ID NO: 468035 - RNA, 64 nt, Homo Sapiens; identical to SEQ ID NO: 276832

SEQ ID NO: 468036 - RNA, 64 nt, Homo Sapiens; identical to SEQ ID NO: 276833

SEQ ID NO: 468037 - RNA, 64 nt, Homo Sapiens; identical to SEQ ID NO: 276834

SEQ ID NO: 468038 - RNA, 64 nt, Homo Sapiens; identical to SEQ ID NO: 276835

SEQ ID NO: 468039 - RNA, 64 nt, Homo Sapiens; identical to SEQ ID NO: 276836

SEQ ID NO: 468040 - RNA, 64 nt, Homo Sapiens; identical to SEQ ID NO: 276837

SEQ ID NO: 468041 - RNA, 64 nt, Homo Sapiens; identical to SEQ ID NO: 276838

SEQ ID NO: 468042 - RNA, 64 nt, Homo Sapiens; identical to SEQ ID NO: 276839

SEQ ID NO: 468043 - RNA, 64 nt, Homo Sapiens; identical to SEQ ID NO: 276840

SEQ ID NO: 468044 - RNA, 64 nt, Homo Sapiens; identical to SEQ ID NO: 276841

SEQ ID NO: 468045 - RNA, 64 nt, Homo Sapiens; identical to SEQ ID NO: 276842

SEQ ID NO: 468046 - RNA, 64 nt, Homo Sapiens; identical to SEQ ID NO: 276843

SEQ ID NO: 468047 - RNA, 64 nt, Homo Sapiens; identical to SEQ ID NO: 276844

SEQ ID NO: 468048 - RNA, 64 nt, Homo Sapiens; identical to SEQ ID NO: 276845

SEQ ID NO: 468049 - RNA, 64 nt, Homo Sapiens; identical to SEQ ID NO: 276846

SEQ ID NO: 468050 - RNA, 64 nt, Homo Sapiens; identical to SEQ ID NO: 276847

SEQ ID NO: 468051 - RNA, 64 nt, Homo Sapiens; identical to SEQ ID NO: 276848

SEQ ID NO: 468052 - RNA, 64 nt, Homo Sapiens; identical to SEQ ID NO: 276849

SEQ ID NO: 468053 - RNA, 64 nt, Homo Sapiens; identical to SEQ ID NO: 276850

SEQ ID NO: 468054 - RNA, 64 nt, Homo Sapiens; identical to SEQ ID NO: 276851

SEQ ID NO: 468055 - RNA, 64 nt, Homo Sapiens; identical to SEQ ID NO: 276852

SEQ ID NO: 468056 - RNA, 64 nt, Homo Sapiens; identical to SEQ ID NO: 276853

SEQ ID NO: 468057 - RNA, 64 nt, Homo Sapiens; identical to SEQ ID NO: 276854

SEQ ID NO: 468058 - RNA, 64 nt, Homo Sapiens; identical to SEQ ID NO: 276855

SEQ ID NO: 468059 - RNA, 64 nt, Homo Sapiens; identical to SEQ ID NO: 276856

SEQ ID NO: 468060 - RNA, 64 nt, Homo Sapiens; identical to SEQ ID NO: 276857

SEQ ID NO: 468061 - RNA, 64 nt, Homo Sapiens; identical to SEQ ID NO: 297128

SEQ ID NO: 468062 - RNA, 64 nt, Homo Sapiens; identical to SEQ ID NO: 297129

SEQ ID NO: 468063 - RNA, 64 nt, Homo Sapiens; identical to SEQ ID NO: 297130

SEQ ID NO: 468064 - RNA, 64 nt, Homo Sapiens; identical to SEQ ID NO: 297131

SEQ ID NO: 468065 - RNA, 64 nt, Homo Sapiens; identical to SEQ ID NO: 297132

SEQ ID NO: 468066 - RNA, 64 nt, Homo Sapiens; identical to SEQ ID NO: 297133

SEQ ID NO: 468067 - RNA, 64 nt, Homo Sapiens; identical to SEQ ID NO: 297134

SEQ ID NO: 468068 - RNA, 64 nt, Homo Sapiens; identical to SEQ ID NO: 297135

SEQ ID NO: 468069 - RNA, 64 nt, Homo Sapiens; identical to SEQ ID NO: 297136

SEQ ID NO: 468070 - RNA, 64 nt, Homo Sapiens; identical to SEQ ID NO: 297137

SEQ ID NO: 468071 - RNA, 64 nt, Homo Sapiens; identical to SEQ ID NO: 297138

SEQ ID NO: 468072 - RNA, 64 nt, Homo Sapiens; identical to SEQ ID NO: 297139

SEQ ID NO: 468073 - RNA, 64 nt, Homo Sapiens; identical to SEQ ID NO: 297140

SEQ ID NO: 468074 - RNA, 64 nt, Homo Sapiens; identical to SEQ ID NO: 297141

SEQ ID NO: 468075 - RNA, 64 nt, Homo Sapiens; identical to SEQ ID NO: 297142

SEQ ID NO: 468076 - RNA, 64 nt, Homo Sapiens; identical to SEQ ID NO: 297143

SEQ ID NO: 468077 - RNA, 64 nt, Homo Sapiens; identical to SEQ ID NO: 297144

SEQ ID NO: 468078 - RNA, 62 nt, Homo Sapiens; identical to SEQ ID NO: 297145

SEQ ID NO: 468079 - RNA, 64 nt, Homo Sapiens; identical to SEQ ID NO: 248259

SEQ ID NO: 468080 - RNA, 64 nt, Homo Sapiens; identical to SEQ ID NO: 248260

SEQ ID NO: 468081 - RNA, 64 nt, Homo Sapiens; identical to SEQ ID NO: 248261

SEQ ID NO: 468082 - RNA, 64 nt, Homo Sapiens; identical to SEQ ID NO: 248262

SEQ ID NO: 468083 - RNA, 64 nt, Homo Sapiens; identical to SEQ ID NO: 248263

SEQ ID NO: 468084 - RNA, 64 nt, Homo Sapiens; identical to SEQ ID NO: 248264

SEQ ID NO: 468085 - RNA, 64 nt, Homo Sapiens; identical to SEQ ID NO: 248265

SEQ ID NO: 468086 - RNA, 64 nt, Homo Sapiens; identical to SEQ ID NO: 248266

SEQ ID NO: 468087 - RNA, 64 nt, Homo Sapiens; identical to SEQ ID NO: 248267

SEQ ID NO: 468088 - RNA, 64 nt, Homo Sapiens; identical to SEQ ID NO: 248268

SEQ ID NO: 468089 - RNA, 64 nt, Homo Sapiens; identical to SEQ ID NO: 248269

SEQ ID NO: 468090 - RNA, 64 nt, Homo Sapiens; identical to SEQ ID NO: 248270

SEQ ID NO: 468091 - RNA, 64 nt, Homo Sapiens; identical to SEQ ID NO: 248271

SEQ ID NO: 468092 - RNA, 64 nt, Homo Sapiens; identical to SEQ ID NO: 248272

SEQ ID NO: 468093 - RNA, 64 nt, Homo Sapiens; identical to SEQ ID NO: 248273

SEQ ID NO: 468094 - RNA, 64 nt, Homo Sapiens; identical to SEQ ID NO: 248274

SEQ ID NO: 468095 - RNA, 64 nt, Homo Sapiens; identical to SEQ ID NO: 248275

SEQ ID NO: 468096 - RNA, 64 nt, Homo Sapiens; identical to SEQ ID NO: 248276

SEQ ID NO: 468097 - RNA, 64 nt, Homo Sapiens; identical to SEQ ID NO: 248277

SEQ ID NO: 468098 - RNA, 64 nt, Homo Sapiens; identical to SEQ ID NO: 248278

SEQ ID NO: 468099 - RNA, 64 nt, Homo Sapiens; identical to SEQ ID NO: 248279

SEQ ID NO: 468100 - RNA, 64 nt, Homo Sapiens; identical to SEQ ID NO: 248280

SEQ ID NO: 468101 - RNA, 64 nt, Homo Sapiens; identical to SEQ ID NO: 248281

SEQ ID NO: 468102 - RNA, 64 nt, Homo Sapiens; identical to SEQ ID NO: 248282

SEQ ID NO: 468103 - RNA, 64 nt, Homo Sapiens; identical to SEQ ID NO: 248283

SEQ ID NO: 468104 - RNA, 64 nt, Homo Sapiens; identical to SEQ ID NO: 248284

SEQ ID NO: 468105 - RNA, 64 nt, Homo Sapiens; identical to SEQ ID NO: 248285

SEQ ID NO: 468106 - RNA, 64 nt, Homo Sapiens; identical to SEQ ID NO: 248286

SEQ ID NO: 468107 - RNA, 64 nt, Homo Sapiens; identical to SEQ ID NO: 248287

SEQ ID NO: 468108 - RNA, 64 nt, Homo Sapiens; identical to SEQ ID NO: 248288

SEQ ID NO: 468109 - RNA, 64 nt, Homo Sapiens; identical to SEQ ID NO: 248289

SEQ ID NO: 468110 - RNA, 64 nt, Homo Sapiens; identical to SEQ ID NO: 248290

SEQ ID NO: 468111 - RNA, 54 nt, Homo Sapiens; identical to SEQ ID NO: 248291

SEQ ID NO: 468112 - RNA, 64 nt, Homo Sapiens; identical to SEQ ID NO: 248292

SEQ ID NO: 468113 - RNA, 64 nt, Homo Sapiens; identical to SEQ ID NO: 248293

SEQ ID NO: 468114 - RNA, 64 nt, Homo Sapiens; identical to SEQ ID NO: 248294

SEQ ID NO: 468115 - RNA, 64 nt, Homo Sapiens; identical to SEQ ID NO: 248295

SEQ ID NO: 468116 - RNA, 64 nt, Homo Sapiens; identical to SEQ ID NO: 248296

SEQ ID NO: 468117 - RNA, 64 nt, Homo Sapiens; identical to SEQ ID NO: 248297

SEQ ID NO: 468118 - RNA, 64 nt, Homo Sapiens; identical to SEQ ID NO: 248298

SEQ ID NO: 468119 - RNA, 64 nt, Homo Sapiens; identical to SEQ ID NO: 248299

SEQ ID NO: 468120 - RNA, 64 nt, Homo Sapiens
aauuaucuuacuuucuucugccucuucugaauccacaccccaucaggcucaaagaaaaguaauc

SEQ ID NO: 468121 - RNA, 64 nt, Homo Sapiens
ccaauuuuaguuucauuacuuuuuacaacuuuuaacaccccacauaugauuuagaugaagaaaa

SEQ ID NO: 468122 - RNA, 64 nt, Homo Sapiens
ggaaaaccagagcacacaguuuugucaccauggaacaccccaaaugccauucuucagcgugucu

SEQ ID NO: 468123 - RNA, 64 nt, Homo Sapiens
cucuauggccuggcuagagcugcaaaaaagggacacaccccacuucgguaaaagaaaauaggga

SEQ ID NO: 468124 - RNA, 64 nt, Homo Sapiens
aacuggcccaaggcagcgaggcuucuacagucccacaccccauagccgccugggcuggggcuua

SEQ ID NO: 468125 - RNA, 64 nt, Homo Sapiens
aacaagggucagguagaagagaaaggcuuccccuacaccccagccuccugcuguccccugaagc

SEQ ID NO: 468126 - RNA, 64 nt, Homo Sapiens
cucagagcuaacauccacacccagaugucugaccacaccccaauccggucagagauggaccugg

SEQ ID NO: 468127 - RNA, 64 nt, Homo Sapiens
ucccuccuccauggggcacaugugcuugggggagacaccccaccuccugugaagaguugagugc

SEQ ID NO: 468128 - RNA, 64 nt, Homo Sapiens
ucuuuguuaccccaggggcuacaggccauggcagacaccccaugccagggaggcccagguacac

SEQ ID NO: 468129 - RNA, 64 nt, Homo Sapiens
gugcgugugcgugugaugugcucgagacguguggacaccccagcaugcaugccgccggcacaug

SEQ ID NO: 468130 - RNA, 64 nt, Homo Sapiens
cagggacggaaugccuggucucacucuggaagggacaccccagcgcagccucagaucaucucug

SEQ ID NO: 468131 - RNA, 64 nt, Homo Sapiens
augacccaacgauguccacagaguuuugggguucacaccccaaacuucuggcacaccuuguaca

SEQ ID NO: 468132 - RNA, 64 nt, Homo Sapiens
cucugacuugcuguguugucggugagccccugccacaccccagcgccacaccccagaggugaca

SEQ ID NO: 468133 - RNA, 64 nt, Homo Sapiens
ggugacaggugagccccugcuccgggaagaagccacaccccagaccaggggccucuggugcggu

SEQ ID NO: 468134 - RNA, 64 nt, Homo Sapiens
cacaggagcacggauucccugugaauggaucccaacaccccaacacuggaucccacacaaauca

SEQ ID NO: 468135 - RNA, 64 nt, Homo Sapiens
ccuuaauccccaucccccaaauucaagauuauccacaccccagcucugcuacccuaaccacaag

SEQ ID NO: 468136 - RNA, 64 nt, Homo Sapiens
agcacccucuccagaugcagcuccagaugagaguacaccccaacguacaccccaacagcacccu

SEQ ID NO: 468137 - RNA, 64 nt, Homo Sapiens
agcacccucuccagaugagacuccagaugagaguacaccccaacguacaccccaacagcacccu

SEQ ID NO: 468138 - RNA, 64 nt, Homo Sapiens
agcacccucuccagaugagacuccagaugagaguacaccccaacagugcccccaacagcacccu

SEQ ID NO: 468139 - RNA, 64 nt, Homo Sapiens
agcacccucuccagaugggagccuucccaggaguacaccccaaccccgcuccucuauggccccu

SEQ ID NO: 468140 - RNA, 64 nt, Homo Sapiens
cagaggcagagggcacaggaaagaagccgggccaagcucggaauuaaugugccacaaguguugu

SEQ ID NO: 468141 - RNA, 64 nt, Homo Sapiens
gagccacguugacuucagguggucuucuaccagcagcucggaauaguugcacugaaucuauacu

SEQ ID NO: 468142 - RNA, 64 nt, Homo Sapiens
uccauacuuuuaaccuccuaaagcuaaaaacaauagcucggaaaccauucuuucuaguuacuuu

SEQ ID NO: 468143 - RNA, 64 nt, Homo Sapiens
ggagagaaaggaauguuuuugauggugguuucaaagcucggacaguaacuaucuugagcccauu

SEQ ID NO: 468144 - RNA, 64 nt, Homo Sapiens
aagauccugagaacuuggaauuccuuguaacuggagcucggagcugcaccgagggcaaccagga

SEQ ID NO: 468145 - RNA, 64 nt, Homo Sapiens
gucuaacgccaguuccugccuguugccucuugugagcucggacugcugaugccccggugcugcu

SEQ ID NO: 468146 - RNA, 64 nt, Homo Sapiens
cugcaguuauugaccucccggcuccccugggcucagcucggacgaggcuucuuucuccucgccc

SEQ ID NO: 468147 - RNA, 64 nt, Homo Sapiens
gaaaggccacccuaaccucuguguucaggugaacagcucggagaagcugcagcugcaggagugc

SEQ ID NO: 468148 - RNA, 64 nt, Homo Sapiens
gucauauacaccuccagggaccaaaaacaaaagcagcucggagucuguguugccugauuggaaa

SEQ ID NO: 468149 - RNA, 64 nt, Homo Sapiens
agaggccaccuucuuaggugugggcagcccuggaagcucggagggcuguugcuucagccuggcc

SEQ ID NO: 468150 - RNA, 64 nt, Homo Sapiens
cacaggcccguccucggaagagccuugagagugcagcucggacccaccggcggcccccguagca

SEQ ID NO: 468151 - RNA, 64 nt, Homo Sapiens
cauaaugaaugcuauugaaaagguuaacagauacagcucggaguugugagcacucuacugcaag

SEQ ID NO: 468152 - RNA, 64 nt, Homo Sapiens
gguuugaauacuauggcucaagguuuucauaugcagcucggauggacauuuuucuucuaagaug

SEQ ID NO: 468153 - RNA, 64 nt, Homo Sapiens
ccaguuccucaggaaccccuucgccuugcgagcaagcucggaaucuccgccuccacggaacguc

SEQ ID NO: 468154 - RNA, 64 nt, Homo Sapiens
acaggcguccuccaccaugcucagccucccaaguagcucggacuguucacgccauucuccugcc

SEQ ID NO: 468155 - RNA, 64 nt, Homo Sapiens
cuggguccucccacccucucuccucccaccccacagcucggacugcucugggagggcccugagg

SEQ ID NO: 468156 - RNA, 64 nt, Homo Sapiens
gccagcggcucgcaucccccucaucuccagcugcagcucggaugguggauuuucagugccaaca

SEQ ID NO: 468157 - RNA, 64 nt, Homo Sapiens
acacgugaggggggggugggugagagagacaggcagcucggauucaacuaccuuagauaauauu

SEQ ID NO: 468158 - RNA, 64 nt, Homo Sapiens
uccuaggacagagacucagccgcacagcauacccagcucggacccuucccgcagugucugcguc

SEQ ID NO: 468159 - RNA, 64 nt, Homo Sapiens
gacaagcacauggcaaucucaaugaagaauugaaagcucggaugugaagcguuuccagcaggag

SEQ ID NO: 468160 - RNA, 64 nt, Homo Sapiens
gucugcuuccacguccucucccaggaacauucuuagcucggacucuugaagaaucucuuuagau

SEQ ID NO: 468161 - RNA, 64 nt, Homo Sapiens
auacugcugaguucuggucucgagcaggugccccagcucggacugauggagacaguaacacugg

SEQ ID NO: 468162 - RNA, 64 nt, Homo Sapiens
cauacucggggggccucagcaccaaagaccagggagcucggauccaggaggauuucaagaaagc

SEQ ID NO: 468163 - RNA, 64 nt, Homo Sapiens
gggcugccugcaaugcagggagggcccaagucggagcucggaggggguccagugggaacugaag

SEQ ID NO: 468164 - RNA, 64 nt, Homo Sapiens
uuacuguguaaauaaacuuugacuguccacuucuagcucggaacagucugacaggaagacugga

SEQ ID NO: 468165 - RNA, 52 nt, Homo Sapiens
cuccuaccucagccuccugagaagcucggacuacaggcacgagccaccaugc

SEQ ID NO: 468166 - RNA, 64 nt, Homo Sapiens
cagugacuuggggccaaggggucaucggggccucagcucggaggccagcugagaauguauggag

SEQ ID NO: 468167 - RNA, 64 nt, Homo Sapiens
ccgauggucagggagagggcuagagcucacacccagcucggaauagaucuucccugaugacauu

SEQ ID NO: 468168 - RNA, 64 nt, Homo Sapiens
cugagccugaagagccccaaggggcucggacuccagcucggagucaccaucucugccuucgaug

SEQ ID NO: 468169 - RNA, 64 nt, Homo Sapiens
ccaggcugagcccggcgcagcugcgggcccaggcagcucggacacaggcuugccccuggucagc

SEQ ID NO: 468170 - RNA, 64 nt, Homo Sapiens
ggagggaagagugaucuaugucucuucccccagcagcucggaccacucccagccccccaucccc

SEQ ID NO: 468171 - RNA, 64 nt, Homo Sapiens
caucucuccaaaagccaccaguuugccagcagcgagcucggaugccgcacacuuggacuugaga

SEQ ID NO: 468172 - RNA, 64 nt, Homo Sapiens
gcugguccuggagagcugcccgcggcggcccaggagcucggacugccacuggcuaccccuacug

SEQ ID NO: 468173 - RNA, 55 nt, Homo Sapiens
gcaccgugguucuggaguagccuccagcucggaggacuuguguucagggguccug

SEQ ID NO: 468174 - RNA, 64 nt, Homo Sapiens
aaggcuugagcgccccccauggcugggagcccgaagcucggagccagggcucgcgagggcagca

SEQ ID NO: 468175 - RNA, 64 nt, Homo Sapiens
gucucagccuccccuggguugucccuggaaccccagcucggaggucugggaagaggugacgcgu

SEQ ID NO: 468176 - RNA, 64 nt, Homo Sapiens
ccucaccacugaggccacgacaaagcacagcuccagcucggacagcacccucagugccagccag

SEQ ID NO: 468177 - RNA, 64 nt, Homo Sapiens
cuugaccuugggggaauauuucacauccauccagagcucggaaucuacagcguccagccauuuc

SEQ ID NO: 468178 - RNA, 64 nt, Homo Sapiens
uggcacuccuggacaaccuggaccacacaggagaagcucggacuagcagcugugccagaggcug

SEQ ID NO: 468179 - RNA, 64 nt, Homo Sapiens
aaggccucuguaucaccccaaaguccauagccugagcucggaggguuucuccuccugggaguca

SEQ ID NO: 468180 - RNA, 64 nt, Homo Sapiens
ugccguggagggugcccggcgggacgguucacaaagcucggacccccucaaagcagacgugaga

SEQ ID NO: 468181 - RNA, 64 nt, Homo Sapiens
cugugggcuccucaaagcugcacacacaccccucagcucggagggcccuggcuggagcugucau

SEQ ID NO: 468182 - RNA, 64 nt, Homo Sapiens
cuggaucgugaggacgcugcgggccagcggcuucagcucggaggcggacguccccacucugggu

SEQ ID NO: 468183 - RNA, 64 nt, Homo Sapiens
caaucccaggaaaauaugcgaugccuccaauuccagcucggagucuguaaguugcaugccaaca

SEQ ID NO: 468184 - RNA, 64 nt, Homo Sapiens
cuuggccagcacugcuggauccagcauuuggccaagcucggagggaagguugucuccucugggg

SEQ ID NO: 468185 - RNA, 64 nt, Homo Sapiens
gcugccuccuuacuccuggcccucuacaugaagaagcucggauacuggguaaacacuugcgaga

SEQ ID NO: 468186 - RNA, 64 nt, Homo Sapiens
gacacaaccguccccggccccugccccgcccccaagcucggaucacaugaaggagacagcagca

SEQ ID NO: 468187 - RNA, 64 nt, Homo Sapiens
acucaugacuaauaccucauuauuucagcugucugcaccuaauuccccacuugcacggcagugu

SEQ ID NO: 468188 - RNA, 64 nt, Homo Sapiens
gugaaagcaauggcagccuuccuuauuugauuaugcaccuaagaauaaaugguauuugggcaug

SEQ ID NO: 468189 - RNA, 62 nt, Homo Sapiens
cuacuccagucuucucucacuggccucuggagagcccugauuuggggccugggcugggggcc

SEQ ID NO: 468190 - RNA, 62 nt, Homo Sapiens
uccgagaaaugaccccguccucagcucaccagagcccugaccacacucaccacccaggaugc

SEQ ID NO: 468191 - RNA, 62 nt, Homo Sapiens
agaaagggaagacuuggggcgcucugacugugagcccugagaguuuccuggucauuucugca

SEQ ID NO: 468192 - RNA, 62 nt, Homo Sapiens
caggagaggaaccucaacucaguccauuucauagcccugauaggggaagugggaguugacag

SEQ ID NO: 468193 - RNA, 62 nt, Homo Sapiens
ucacagauauccuauggagauuuaaggaugaaagcccugaguuguucuuggguucuuggauc

SEQ ID NO: 468194 - RNA, 62 nt, Homo Sapiens
ccaucuacaucuccuucaccccuauggugcucagcccugagauccugcacaagguggagugu

SEQ ID NO: 468195 - RNA, 62 nt, Homo Sapiens
cuccuaugaugagagauacauguugccucaccagcccugaggcuccgccccagcccucagcc

SEQ ID NO: 468196 - RNA, 62 nt, Homo Sapiens
gugagcacgcugaaggcuuagcgcgaugugacagcccugaaccccaucuccggggaagacgu

SEQ ID NO: 468197 - RNA, 62 nt, Homo Sapiens
agaugcuuuuccacuuuggaauucccccagggagcccugaggggaugcccaauggcuccacc

SEQ ID NO: 468198 - RNA, 62 nt, Homo Sapiens
uuguaccacuuacauuuuaggcuggggcaagcagcccugaccuaagggagaaugaguuggac

SEQ ID NO: 468199 - RNA, 62 nt, Homo Sapiens
guuacaucauaacaacuucugaaacacacaccagcccugaguucugggcucauuugaagccu

SEQ ID NO: 468200 - RNA, 62 nt, Homo Sapiens
ucagcugcaggaaggacaucccccugcccagcagcccugagcggcuggggccacagcuccua

SEQ ID NO: 468201 - RNA, 62 nt, Homo Sapiens
gccagcgcgaggaccagggcgagccccagcuuagcccugagcucggcugcagcagagggcag

SEQ ID NO: 468202 - RNA, 62 nt, Homo Sapiens
gggcacaugaaacgaccuggaacuugcuucacagcccugaggaagguggacuuacauaagca

SEQ ID NO: 468203 - RNA, 62 nt, Homo Sapiens
acuaggccagugguuuucaaacugcuuggcagagcccugaaguuuccuagggguugccucag

SEQ ID NO: 468204 - RNA, 62 nt, Homo Sapiens
cugccagcagcugccugggaaggccguguuucagcccugaugggccaagggaaggcuaucag

SEQ ID NO: 468205 - RNA, 62 nt, Homo Sapiens
uugugcugacagcaaagauccacuuuggcaggagcccugacccagcuaggagguagucugga

SEQ ID NO: 468206 - RNA, 62 nt, Homo Sapiens
cauuaggcugcaacucugauauuuggacaacuagcccugauggccaccugccaucuccaagc

SEQ ID NO: 468207 - RNA, 62 nt, Homo Sapiens
uccauggguugacuuaugcuugaaagaauugcagcccugaggauuacaugagaagauuucca

SEQ ID NO: 468208 - RNA, 62 nt, Homo Sapiens
cucagcuaccuaagaaaaacgaaggugagauaagcccugaguauucuucaaaagcauucuga

SEQ ID NO: 468209 - RNA, 62 nt, Homo Sapiens
guguauauucauauauuuuguccaguaccuuaagcccugauuuagcaauuuauacaauauca

SEQ ID NO: 468210 - RNA, 62 nt, Homo Sapiens
accguggagcgcuggcaagggcguccuggcccagcccugagcgcgcggcccuuccccugucg

SEQ ID NO: 468211 - RNA, 62 nt, Homo Sapiens
accucacccggccccaucuguugccccgguccagcccugauggcgcgcgccuggucugucug

SEQ ID NO: 468212 - RNA, 62 nt, Homo Sapiens
cugccugcuuugugcaggguccuccggggcucagcccugaguuggcaucaccugcgcagggc

SEQ ID NO: 468213 - RNA, 62 nt, Homo Sapiens
uggcaucaccugcgcagggcccucuggggcucagcccugagcuagugucaccugcacagggc

SEQ ID NO: 468214 - RNA, 62 nt, Homo Sapiens
uagugucaccugcacagggcccucugaggcucagcccugagcuggcgucaccugugcagggc

SEQ ID NO: 468215 - RNA, 62 nt, Homo Sapiens
uggcgucaccugugcagggcccucuggggcucagcccugagcuggccucaccuggguucccc

SEQ ID NO: 468216 - RNA, 64 nt, Homo Sapiens
uaugaagucccuccugauuuugugugugugugucuguguuuaagcaagcguucgguugguauag

SEQ ID NO: 468217 - RNA, 64 nt, Homo Sapiens
uucucugugaaggcuguucauaguugcuauagccuguguuuaguuuugugauuucaucaauccc

SEQ ID NO: 468218 - RNA, 64 nt, Homo Sapiens
cuccucuuuaucauguuuuuucccuuguagcaguuguguuuaaugucauuaaaaagaaauaaaa

SEQ ID NO: 468219 - RNA, 64 nt, Homo Sapiens
ugccugccagugcucuccagcugucuugucucuguguguuuauugugugugagguucucgagaa

SEQ ID NO: 468220 - RNA, 64 nt, Homo Sapiens
uacacucgugcuuuuccuuagcucaguccaacacuguguuuacauguguucuuuacaaaggcua

SEQ ID NO: 468221 - RNA, 64 nt, Homo Sapiens
uaaguguuugaacaacuauaugcacuuacgguuguguguuuaaaaugucucucucacccccuag

SEQ ID NO: 468222 - RNA, 64 nt, Homo Sapiens
cacacacaugcacacaaauggacuucucugaagcuguguuuagugaaaugagcucaaguacaug

SEQ ID NO: 468223 - RNA, 64 nt, Homo Sapiens
gggaauguuuaauugagaaauagaacucauuccuuguguuuaaaaauucaucuuuaugaagauu

SEQ ID NO: 468224 - RNA, 64 nt, Homo Sapiens
gcacagcuacuucacaccuuuuuauuguuuauuuuguguuuaauacuugacuauaucuuauaau

SEQ ID NO: 468225 - RNA, 64 nt, Homo Sapiens
aauaagcauuuucccacacaaugaacauuugaacuguguuuaugaaaauuuucugguuugcacc

SEQ ID NO: 468226 - RNA, 64 nt, Homo Sapiens
uguggaccauaaauaacacggcccaauaacucuuuguguuuauggaguguuguuuucuuagaau

SEQ ID NO: 468227 - RNA, 64 nt, Homo Sapiens
acugcaacuauugcaccucuaauguauuuuuuuguguguuuaccccagauuuuuaguccaaaaa

SEQ ID NO: 468228 - RNA, 64 nt, Homo Sapiens
uuauccacucaugcuucucccacuguuaugauccuguguuuagaacagagguguugcagcguau

SEQ ID NO: 468229 - RNA, 64 nt, Homo Sapiens
aaucaacugguaauucugaaaucuauaucuacuuuguguuuaaaccagauuagccaccauuagc

SEQ ID NO: 468230 - RNA, 64 nt, Homo Sapiens
uguuacuuguuuucaaacuuguagaauaccgugcuguguuuaaaagaaaaaaguuucaguugug

SEQ ID NO: 468231 - RNA, 64 nt, Homo Sapiens
uuuguugguaguauaugauuaaagggaacaugcuuguguuuauuugguggaggauaauaugauu

SEQ ID NO: 468232 - RNA, 64 nt, Homo Sapiens
guuuuacaggaacguggagcauuaggaagaaaaauguguuuaaacaacaaaacugcuaaugucu

SEQ ID NO: 468233 - RNA, 64 nt, Homo Sapiens
aaaacaauucaggaccaaauuuuuucucaguguguguguuuauuccuuauagguguaaaugaga

SEQ ID NO: 468234 - RNA, 64 nt, Homo Sapiens
ugaugauagcauauguguucagguuuauagcuguuguguuuaaaaauugaaaaaaguggaaaac

SEQ ID NO: 468235 - RNA, 64 nt, Homo Sapiens
aauaucugacuauaaaauauuuuuuugaguuuuuuguguuuaugagauuaugcuaauuuuaugg

SEQ ID NO: 468236 - RNA, 64 nt, Homo Sapiens
cugcuauagagaacauucuuccaagauaaauauguguguuuacacauaugucugcaugcaugug

SEQ ID NO: 468237 - RNA, 64 nt, Homo Sapiens
ggcugcguggcguuccauugagugucugucaucauguguuuagccgaguggauggauagucugc

SEQ ID NO: 468238 - RNA, 64 nt, Homo Sapiens
uagcccuuggggaacacagguaguuccuuuucacuguguuuaauuugggaaaauccagauccac

SEQ ID NO: 468239 - RNA, 64 nt, Homo Sapiens
ccaaacucuuccccaccucggagcugaacugggcuguguuuacccguguguguuuaagacucuu

SEQ ID NO: 468240 - RNA, 64 nt, Homo Sapiens
acucuugagcugaacugggccgcgcgcaagcguguguguuuaagugugagugugugugugugcg

SEQ ID NO: 468241 - RNA, 64 nt, Homo Sapiens
uuuauaugauugaaugaguuagucaauguaaauuuguguuuauuuuuaaauuguauaguugaug

SEQ ID NO: 468242 - RNA, 64 nt, Homo Sapiens
gauaauccuuuccaugugaagagcauggaauucauguguuuaaaccacagagagagagcugcaa

SEQ ID NO: 468243 - RNA, 64 nt, Homo Sapiens
cucuuugcucauggaauagcuacucucacagcuuuguguuuauuaaucuaguguccauauuuaa

SEQ ID NO: 468244 - RNA, 64 nt, Homo Sapiens
cgcagggcaggucacagauauaaaccugcuuggcuguguuuauccuuugugucuuugaucuaau

SEQ ID NO: 468245 - RNA, 64 nt, Homo Sapiens
gaacuuaguugaauauaaaaaucuagauuaaaaguguguuuaccauacuguauaauuccauuua

SEQ ID NO: 468246 - RNA, 64 nt, Homo Sapiens
uucaacaaagcuguuuuaauaaaaaaaggaaaaauguguuuacuauaucggcuuagaaacaugc

SEQ ID NO: 468247 - RNA, 64 nt, Homo Sapiens
auaucggcuuagaaacaugcaaaaaaaggaaaaauguguuuacuuucaacaaagcuguuuuaau

SEQ ID NO: 468248 - RNA, 64 nt, Homo Sapiens
auacuguauaauuccauuuaaucuagauuaaaaguguguuuaccgaacuuaguugaauauaaaa

SEQ ID NO: 468249 - RNA, 64 nt, Homo Sapiens
uuacccuugaaauguuuucacacagcuuuauucuuguguuuacaacaucacuaaguaauagacc

SEQ ID NO: 468250 - RNA, 64 nt, Homo Sapiens
auacacauuuuaaaucccuccucagcucaacugcuguguuuaaaagcguacuauagaaaaugca

SEQ ID NO: 468251 - RNA, 64 nt, Homo Sapiens
ugacaauguuaugagauucauuacuaucuuaagauguguuuauccucagcuuauaggaaucucu

SEQ ID NO: 468252 - RNA, 64 nt, Homo Sapiens
uugaagauaguaauuagguuucuaagcuguauacuguguuuauugguggcagugacaccaaaga

SEQ ID NO: 468253 - RNA, 64 nt, Homo Sapiens
aaaacccagauaaagguucaugcaaacuuuauuuuguguuuaggaacuacugaggaucagagua

SEQ ID NO: 468254 - RNA, 64 nt, Homo Sapiens
gcugccugcuuuuuauggccugugagcuaggaauuguguuuauaauuuuaaauguuuuuuuuua

SEQ ID NO: 468255 - RNA, 64 nt, Homo Sapiens
aaucuccacaugaaggccccuccccugggaucacuguguuuaagagagagugguuccugcuguu

SEQ ID NO: 468256 - RNA, 64 nt, Homo Sapiens
gaugacuccaggaagacagcuggaguacugcauuuguguuuaggguuuguaugacccuuccgag

SEQ ID NO: 468257 - RNA, 64 nt, Homo Sapiens
ugcagagccaaaauagcaaaacaaacauauuaaguguguuuacuaaacauauuguguguuuacu

SEQ ID NO: 468258 - RNA, 64 nt, Homo Sapiens
acaaacauauuaaguguguuuacuaaacauauuguguguuuacuaacacacuuaauguuuauau

SEQ ID NO: 468259 - RNA, 64 nt, Homo Sapiens
uguuguuaugaugaguaugccccaccuguuuacuuguguuuauucaguagggaauaaacugugu

SEQ ID NO: 468260 - RNA, 64 nt, Homo Sapiens
cuucuuaaaauguaucuuguagaaaaagaaaugcuguguuuaauaaaaaaaaagagagagagag

SEQ ID NO: 468261 - RNA, 64 nt, Homo Sapiens
ccuccgucuuuccccuccccuggcauggacaccuuguguuuaggaucaucucugcagguuuccu

SEQ ID NO: 468262 - RNA, 64 nt, Homo Sapiens
ggugaaauuccagaugagucagucucuugggaaguguguuuagaaggguucaggacuuugugag

SEQ ID NO: 468263 - RNA, 64 nt, Homo Sapiens
uggaauguuuaaggauauacgugaguuuugacaguguguuuaugcuccaauuccagcauaucca

SEQ ID NO: 468264 - RNA, 64 nt, Homo Sapiens
acucaaccguugguuggaaagccguugcacagacuguguuuauggaacauagccaaaaguaugu

SEQ ID NO: 468265 - RNA, 64 nt, Homo Sapiens
uacgugagagagugugaguggaugugaggcugaguguguuuaaguaauaaagagaacaggguaa

SEQ ID NO: 468266 - RNA, 64 nt, Homo Sapiens
gaaagccgaaaacaguauuaugccaacacaaaacuguguuuacuagaaaccacgcccacaccaa

SEQ ID NO: 468267 - RNA, 64 nt, Homo Sapiens
ucugagcacuuaggugaagggacaagcagguuuauguguuuaaacagaaagaagggaaaaggua

SEQ ID NO: 468268 - RNA, 64 nt, Homo Sapiens
gcuuauuuuaaaaauauuuuuuaucuauuuacuguguguuuaagcaagcaacagugcacugauc

SEQ ID NO: 468269 - RNA, 64 nt, Homo Sapiens
uuuuaauuauagaaauuccauuacgaaauaguucuguguuuauugcacacuaagauguauuuuc

SEQ ID NO: 468270 - RNA, 64 nt, Homo Sapiens
agacauggcaugcuaagaaguuuuuguguauauauguguuuauuuucacaugauuuuguucuag

SEQ ID NO: 468271 - RNA, 64 nt, Homo Sapiens
ucgcccccuccagcucuccucagggcuccagguguguguuuauccugggaguucagguucucuc

SEQ ID NO: 468272 - RNA, 64 nt, Homo Sapiens
uugcuugcuuugacucaugccucuggucaauauguguguuuacuaauggaaguguccuccuguu

SEQ ID NO: 468273 - RNA, 64 nt, Homo Sapiens
guuuauuuauuuugaggcaguucuuuguuauuguuguguuuacuuuauuauuguuuguuguuau

SEQ ID NO: 468274 - RNA, 64 nt, Homo Sapiens
guuauuauuguuuguuguuauucacucccacuuauguguuuauuagagauuaaagaaaaauaug

SEQ ID NO: 468275 - RNA, 64 nt, Homo Sapiens
agcaucaaauauuuaaugcccucagugggaaauuuguguuuaaacucaauggaaucuaauauuu

SEQ ID NO: 468276 - RNA, 64 nt, Homo Sapiens
auuugcaaugaaauauucauagauauugaaagcuuguguuuacaugaaauauguuuauuaucaa

SEQ ID NO: 468277 - RNA, 64 nt, Homo Sapiens
aaaauguaaauacugauuugacuggucuuuaagauguguuuaacugugaggcuauuuaacgaau

SEQ ID NO: 468278 - RNA, 64 nt, Homo Sapiens
gucauccaguauuaaguucuuagucauugauuuuuguguuuaaaaaaaaauaggaaagagggaa

SEQ ID NO: 468279 - RNA, 64 nt, Homo Sapiens
aaguuacccaguacccauguaagaaaucaauaaauguguuuaaccacuguguuugguuacuguc

SEQ ID NO: 468280 - RNA, 64 nt, Homo Sapiens
gaguuaauuucauuuuucugaccagcucaauaaauguguuuaaccauuguguuugguuauuguu

SEQ ID NO: 468281 - RNA, 64 nt, Homo Sapiens
cauucauucauuuauucagcuucuuguuucucuguguguuuacugugcccaacagccuggcauc

SEQ ID NO: 468282 - RNA, 64 nt, Homo Sapiens
ccuggauugaauugggcccuuggaagagcagccuuguguuuagagaggccucggcaucuugaga

SEQ ID NO: 468283 - RNA, 64 nt, Homo Sapiens
uaaguuucuuuuaaaaauaugacauagccagugauguguuuaauuauauaacuguucuuacuga

SEQ ID NO: 468284 - RNA, 64 nt, Homo Sapiens
ccaaaucaaaugguaauuuaaauaaaaucuauucuguguuuauguagggugguauaaaaaagag

SEQ ID NO: 468285 - RNA, 64 nt, Homo Sapiens
guuuugauuuugauuaacauugacaggauuacuguguguuuaauuuuuuaaaaacugaacacug

SEQ ID NO: 468286 - RNA, 64 nt, Homo Sapiens
cucccaagugcacucauccaggucagugcucagauguguuuaaggagacccuauauucagggaa

SEQ ID NO: 468287 - RNA, 64 nt, Homo Sapiens
caguaguuuggauguacaauuuggagguguguucuguguuuacaauuuaguucacaagcauaau

SEQ ID NO: 468288 - RNA, 64 nt, Homo Sapiens
auacuugauuugaaguccuuaccacuuuuaauaauguguuuaaggaugguaucgaaaaccagaa

SEQ ID NO: 468289 - RNA, 64 nt, Homo Sapiens
uuucaguagcugcaguauauuuguauauacacuuuguguuuauuucuugaacaucuuucccugu

SEQ ID NO: 468290 - RNA, 64 nt, Homo Sapiens
ucucaagagguuggaaucaaauaauccucaugcuuguguuuaugauacggauuuguuucugucc

SEQ ID NO: 468291 - RNA, 64 nt, Homo Sapiens
cuugaugaaaagcuuuguuuaauuguuuagauuuuguguuuauuguuaaaaugcaugauugcag

SEQ ID NO: 468292 - RNA, 64 nt, Homo Sapiens
caaacugaaaagcugagaccgaaaauugccuuucuguguuuauuaguacauuuuuugaaaugcu

SEQ ID NO: 468293 - RNA, 64 nt, Homo Sapiens
guucuucauuagauguuuauuuagaaccugguucuguguuuaauauauaguuuaaaguaacaaa

SEQ ID NO: 468294 - RNA, 64 nt, Homo Sapiens
auuuguaucaguaucauuugaucugccauggacauguguuuaaaguggcuuucuggcccuucuu

SEQ ID NO: 468295 - RNA, 64 nt, Homo Sapiens; identical to SEQ ID NO: 468293

SEQ ID NO: 468296 - RNA, 64 nt, Homo Sapiens; identical to SEQ ID NO: 468294

SEQ ID NO: 468297 - RNA, 64 nt, Homo Sapiens; identical to SEQ ID NO: 382152

SEQ ID NO: 468298 - RNA, 64 nt, Homo Sapiens; identical to SEQ ID NO: 382153

SEQ ID NO: 468299 - RNA, 64 nt, Homo Sapiens; identical to SEQ ID NO: 382154

SEQ ID NO: 468300 - RNA, 64 nt, Homo Sapiens; identical to SEQ ID NO: 382155

SEQ ID NO: 468301 - RNA, 64 nt, Homo Sapiens; identical to SEQ ID NO: 382156

SEQ ID NO: 468302 - RNA, 64 nt, Homo Sapiens; identical to SEQ ID NO: 382157

SEQ ID NO: 468303 - RNA, 64 nt, Homo Sapiens; identical to SEQ ID NO: 382158

SEQ ID NO: 468304 - RNA, 64 nt, Homo Sapiens; identical to SEQ ID NO: 382159

SEQ ID NO: 468305 - RNA, 64 nt, Homo Sapiens; identical to SEQ ID NO: 382160

SEQ ID NO: 468306 - RNA, 64 nt, Homo Sapiens; identical to SEQ ID NO: 382161

SEQ ID NO: 468307 - RNA, 64 nt, Homo Sapiens; identical to SEQ ID NO: 382162

SEQ ID NO: 468308 - RNA, 64 nt, Homo Sapiens; identical to SEQ ID NO: 382163

SEQ ID NO: 468309 - RNA, 64 nt, Homo Sapiens; identical to SEQ ID NO: 382164

SEQ ID NO: 468310 - RNA, 64 nt, Homo Sapiens; identical to SEQ ID NO: 382165

SEQ ID NO: 468311 - RNA, 64 nt, Homo Sapiens; identical to SEQ ID NO: 382166

SEQ ID NO: 468312 - RNA, 64 nt, Homo Sapiens; identical to SEQ ID NO: 382167

SEQ ID NO: 468313 - RNA, 64 nt, Homo Sapiens; identical to SEQ ID NO: 382168

SEQ ID NO: 468314 - RNA, 64 nt, Homo Sapiens; identical to SEQ ID NO: 382169

SEQ ID NO: 468315 - RNA, 64 nt, Homo Sapiens; identical to SEQ ID NO: 382170

SEQ ID NO: 468316 - RNA, 64 nt, Homo Sapiens; identical to SEQ ID NO: 382171

SEQ ID NO: 468317 - RNA, 64 nt, Homo Sapiens; identical to SEQ ID NO: 382172

SEQ ID NO: 468318 - RNA, 64 nt, Homo Sapiens; identical to SEQ ID NO: 382173

SEQ ID NO: 468319 - RNA, 64 nt, Homo Sapiens; identical to SEQ ID NO: 382174

SEQ ID NO: 468320 - RNA, 64 nt, Homo Sapiens; identical to SEQ ID NO: 382175

SEQ ID NO: 468321 - RNA, 64 nt, Homo Sapiens; identical to SEQ ID NO: 382176

SEQ ID NO: 468322 - RNA, 64 nt, Homo Sapiens; identical to SEQ ID NO: 382177

SEQ ID NO: 468323 - RNA, 64 nt, Homo Sapiens; identical to SEQ ID NO: 382178

SEQ ID NO: 468324 - RNA, 64 nt, Homo Sapiens; identical to SEQ ID NO: 382179

SEQ ID NO: 468325 - RNA, 64 nt, Homo Sapiens; identical to SEQ ID NO: 382180

SEQ ID NO: 468326 - RNA, 64 nt, Homo Sapiens; identical to SEQ ID NO: 382181

SEQ ID NO: 468327 - RNA, 64 nt, Homo Sapiens; identical to SEQ ID NO: 382182

SEQ ID NO: 468328 - RNA, 64 nt, Homo Sapiens; identical to SEQ ID NO: 382183

SEQ ID NO: 468329 - RNA, 64 nt, Homo Sapiens; identical to SEQ ID NO: 382184

SEQ ID NO: 468330 - RNA, 64 nt, Homo Sapiens; identical to SEQ ID NO: 382185

SEQ ID NO: 468331 - RNA, 64 nt, Homo Sapiens; identical to SEQ ID NO: 382186

SEQ ID NO: 468332 - RNA, 64 nt, Homo Sapiens; identical to SEQ ID NO: 382187

SEQ ID NO: 468333 - RNA, 64 nt, Homo Sapiens; identical to SEQ ID NO: 382188

SEQ ID NO: 468334 - RNA, 64 nt, Homo Sapiens; identical to SEQ ID NO: 382189

SEQ ID NO: 468335 - RNA, 64 nt, Homo Sapiens; identical to SEQ ID NO: 382190

SEQ ID NO: 468336 - RNA, 64 nt, Homo Sapiens; identical to SEQ ID NO: 382191

SEQ ID NO: 468337 - RNA, 64 nt, Homo Sapiens; identical to SEQ ID NO: 382192

SEQ ID NO: 468338 - RNA, 64 nt, Homo Sapiens; identical to SEQ ID NO: 87431

SEQ ID NO: 468339 - RNA, 64 nt, Homo Sapiens; identical to SEQ ID NO: 87432

SEQ ID NO: 468340 - RNA, 64 nt, Homo Sapiens; identical to SEQ ID NO: 87433

SEQ ID NO: 468341 - RNA, 64 nt, Homo Sapiens; identical to SEQ ID NO: 87434

SEQ ID NO: 468342 - RNA, 64 nt, Homo Sapiens; identical to SEQ ID NO: 87435

SEQ ID NO: 468343 - RNA, 64 nt, Homo Sapiens; identical to SEQ ID NO: 87436

SEQ ID NO: 468344 - RNA, 64 nt, Homo Sapiens; identical to SEQ ID NO: 87437

SEQ ID NO: 468345 - RNA, 64 nt, Homo Sapiens; identical to SEQ ID NO: 87438

SEQ ID NO: 468346 - RNA, 64 nt, Homo Sapiens; identical to SEQ ID NO: 87439

SEQ ID NO: 468347 - RNA, 64 nt, Homo Sapiens; identical to SEQ ID NO: 87440

SEQ ID NO: 468348 - RNA, 64 nt, Homo Sapiens; identical to SEQ ID NO: 87441

SEQ ID NO: 468349 - RNA, 64 nt, Homo Sapiens; identical to SEQ ID NO: 87442

SEQ ID NO: 468350 - RNA, 64 nt, Homo Sapiens; identical to SEQ ID NO: 87443

SEQ ID NO: 468351 - RNA, 64 nt, Homo Sapiens; identical to SEQ ID NO: 87444

SEQ ID NO: 468352 - RNA, 64 nt, Homo Sapiens; identical to SEQ ID NO: 87445

SEQ ID NO: 468353 - RNA, 64 nt, Homo Sapiens; identical to SEQ ID NO: 87446

SEQ ID NO: 468354 - RNA, 64 nt, Homo Sapiens; identical to SEQ ID NO: 87447

SEQ ID NO: 468355 - RNA, 64 nt, Homo Sapiens; identical to SEQ ID NO: 87448

SEQ ID NO: 468356 - RNA, 64 nt, Homo Sapiens; identical to SEQ ID NO: 87449

SEQ ID NO: 468357 - RNA, 64 nt, Homo Sapiens; identical to SEQ ID NO: 87450

SEQ ID NO: 468358 - RNA, 64 nt, Homo Sapiens; identical to SEQ ID NO: 87451

SEQ ID NO: 468359 - RNA, 64 nt, Homo Sapiens; identical to SEQ ID NO: 87452

SEQ ID NO: 468360 - RNA, 64 nt, Homo Sapiens; identical to SEQ ID NO: 87453

SEQ ID NO: 468361 - RNA, 64 nt, Homo Sapiens; identical to SEQ ID NO: 87454

SEQ ID NO: 468362 - RNA, 64 nt, Homo Sapiens; identical to SEQ ID NO: 87455

SEQ ID NO: 468363 - RNA, 64 nt, Homo Sapiens; identical to SEQ ID NO: 87456

SEQ ID NO: 468364 - RNA, 64 nt, Homo Sapiens; identical to SEQ ID NO: 87457

SEQ ID NO: 468365 - RNA, 64 nt, Homo Sapiens; identical to SEQ ID NO: 87458

SEQ ID NO: 468366 - RNA, 64 nt, Homo Sapiens; identical to SEQ ID NO: 87459

SEQ ID NO: 468367 - RNA, 64 nt, Homo Sapiens; identical to SEQ ID NO: 87460

SEQ ID NO: 468368 - RNA, 64 nt, Homo Sapiens; identical to SEQ ID NO: 87461

SEQ ID NO: 468369 - RNA, 64 nt, Homo Sapiens; identical to SEQ ID NO: 87462
